United States Patent 12,043,843 (MATERIALS AND METHODS FOR TREATMENT OF HEMOGLOBINOPATHIES) - sequence listing, part 3

SEQ ID NO: 66826 - DNA, 20 bp, Artificial Sequence
  chemically synthesized
aaaaagctagagaagattaa

SEQ ID NO: 66827 - DNA, 20 bp, Artificial Sequence
  chemically synthesized
agattaaggagaatattttc

SEQ ID NO: 66828 - DNA, 20 bp, Artificial Sequence
  chemically synthesized
ttccaagaaacttaaataaa

SEQ ID NO: 66829 - DNA, 20 bp, Artificial Sequence
  chemically synthesized
aaaagcctagaacaatgcca

SEQ ID NO: 66830 - DNA, 20 bp, Artificial Sequence
  chemically synthesized
aaatgaccttatttacacct

SEQ ID NO: 66831 - DNA, 20 bp, Artificial Sequence
  chemically synthesized
gaaagacaaaaaaaaaactt

SEQ ID NO: 66832 - DNA, 20 bp, Artificial Sequence
  chemically synthesized
tagctttttctgtgattttt

SEQ ID NO: 66833 - DNA, 20 bp, Artificial Sequence
  chemically synthesized
cacacacacgtttgtgcacc

SEQ ID NO: 66834 - DNA, 20 bp, Artificial Sequence
  chemically synthesized
cacgtttgtgcaccaaagaa

SEQ ID NO: 66835 - DNA, 20 bp, Artificial Sequence
  chemically synthesized
tgcaccaaagaataagaaag

SEQ ID NO: 66836 - DNA, 20 bp, Artificial Sequence
  chemically synthesized
gtatttccattattgggaag

SEQ ID NO: 66837 - DNA, 20 bp, Artificial Sequence
  chemically synthesized
tgattttagcagtggggagc

SEQ ID NO: 66838 - DNA, 20 bp, Artificial Sequence
  chemically synthesized
aaggaaaggtccaaaaaagg

SEQ ID NO: 66839 - DNA, 20 bp, Artificial Sequence
  chemically synthesized
aaactgatatggtgttctag

SEQ ID NO: 66840 - DNA, 20 bp, Artificial Sequence
  chemically synthesized
gtgctaagtgattgataagg

SEQ ID NO: 66841 - DNA, 20 bp, Artificial Sequence
  chemically synthesized
gcaaaattttgatttcgggg

SEQ ID NO: 66842 - DNA, 20 bp, Artificial Sequence
  chemically synthesized
ctgcaagaaccaataggaaa

SEQ ID NO: 66843 - DNA, 20 bp, Artificial Sequence
  chemically synthesized
ctacatgggaggctgaggca

SEQ ID NO: 66844 - DNA, 20 bp, Artificial Sequence
  chemically synthesized
aatacgtaaaacaaaaacaa

SEQ ID NO: 66845 - DNA, 20 bp, Artificial Sequence
  chemically synthesized
tgtttattgtaacaattctc

SEQ ID NO: 66846 - DNA, 20 bp, Artificial Sequence
  chemically synthesized
aaaactttttcatcatccaa

SEQ ID NO: 66847 - DNA, 20 bp, Artificial Sequence
  chemically synthesized
ttcatttgtatatcttcttt

SEQ ID NO: 66848 - DNA, 20 bp, Artificial Sequence
  chemically synthesized
catactttttgtgtcatatc

SEQ ID NO: 66849 - DNA, 20 bp, Artificial Sequence
  chemically synthesized
tggcttttaatccttatttg

SEQ ID NO: 66850 - DNA, 20 bp, Artificial Sequence
  chemically synthesized
atatgaagttgtatataaaa

SEQ ID NO: 66851 - DNA, 20 bp, Artificial Sequence
  chemically synthesized
aaaaggacacagatcaaaca

SEQ ID NO: 66852 - DNA, 20 bp, Artificial Sequence
  chemically synthesized
atcaaacaacagaaaacagt

SEQ ID NO: 66853 - DNA, 20 bp, Artificial Sequence
  chemically synthesized
ccttgatcttatacttggta

SEQ ID NO: 66854 - DNA, 20 bp, Artificial Sequence
  chemically synthesized
agaaaaattgtttatatgtt

SEQ ID NO: 66855 - DNA, 20 bp, Artificial Sequence
  chemically synthesized
aaacaaatttcaggtggaat

SEQ ID NO: 66856 - DNA, 20 bp, Artificial Sequence
  chemically synthesized
ttgtatatggaatagcttct

SEQ ID NO: 66857 - DNA, 20 bp, Artificial Sequence
  chemically synthesized
taagatgcgggggaagtata

SEQ ID NO: 66858 - DNA, 20 bp, Artificial Sequence
  chemically synthesized
ctaatctatggatagcaggt

SEQ ID NO: 66859 - DNA, 20 bp, Artificial Sequence
  chemically synthesized
aaagagtgaactggtaagtt

SEQ ID NO: 66860 - DNA, 20 bp, Artificial Sequence
  chemically synthesized
atggaaaatactttattcta

SEQ ID NO: 66861 - DNA, 20 bp, Artificial Sequence
  chemically synthesized
ggcttacctgtgcccttgtt

SEQ ID NO: 66862 - DNA, 20 bp, Artificial Sequence
  chemically synthesized
acttgatgtgcaataactga

SEQ ID NO: 66863 - DNA, 20 bp, Artificial Sequence
  chemically synthesized
ttgtctatagtatcaaaatc

SEQ ID NO: 66864 - DNA, 20 bp, Artificial Sequence
  chemically synthesized
agctttaacattttgtagat

SEQ ID NO: 66865 - DNA, 20 bp, Artificial Sequence
  chemically synthesized
aacagttttatatatttccc

SEQ ID NO: 66866 - DNA, 20 bp, Artificial Sequence
  chemically synthesized
acatttggttctgggaatat

SEQ ID NO: 66867 - DNA, 20 bp, Artificial Sequence
  chemically synthesized
ctctgatggatataaagatg

SEQ ID NO: 66868 - DNA, 20 bp, Artificial Sequence
  chemically synthesized
gaatacaagtgtggaaaata

SEQ ID NO: 66869 - DNA, 20 bp, Artificial Sequence
  chemically synthesized
caggaggaaactgtttggct

SEQ ID NO: 66870 - DNA, 20 bp, Artificial Sequence
  chemically synthesized
tatttttaatgagttcaata

SEQ ID NO: 66871 - DNA, 20 bp, Artificial Sequence
  chemically synthesized
tttaatgagttcaatactag

SEQ ID NO: 66872 - DNA, 20 bp, Artificial Sequence
  chemically synthesized
tacttgaaaatactgtttta

SEQ ID NO: 66873 - DNA, 20 bp, Artificial Sequence
  chemically synthesized
tagaagaaaataactaaaaa

SEQ ID NO: 66874 - DNA, 20 bp, Artificial Sequence
  chemically synthesized
caaaaaggtagggaggacca

SEQ ID NO: 66875 - DNA, 20 bp, Artificial Sequence
  chemically synthesized
tagggaggaccagaagaatt

SEQ ID NO: 66876 - DNA, 20 bp, Artificial Sequence
  chemically synthesized
tttattcatttataaatgaa

SEQ ID NO: 66877 - DNA, 20 bp, Artificial Sequence
  chemically synthesized
aatccacggaacaaatatat

SEQ ID NO: 66878 - DNA, 20 bp, Artificial Sequence
  chemically synthesized
tttgtctacatgttacaaat

SEQ ID NO: 66879 - DNA, 20 bp, Artificial Sequence
  chemically synthesized
tacatgttacaaatgtagaa

SEQ ID NO: 66880 - DNA, 20 bp, Artificial Sequence
  chemically synthesized
agtcaaagagttaataagtg

SEQ ID NO: 66881 - DNA, 20 bp, Artificial Sequence
  chemically synthesized
gatcctaaaagcagaagaga

SEQ ID NO: 66882 - DNA, 20 bp, Artificial Sequence
  chemically synthesized
ctgtgacaacaaacatctca

SEQ ID NO: 66883 - DNA, 20 bp, Artificial Sequence
  chemically synthesized
tttcaaagcgctcagggata

SEQ ID NO: 66884 - DNA, 20 bp, Artificial Sequence
  chemically synthesized
gataaaagaaaactgatatt

SEQ ID NO: 66885 - DNA, 20 bp, Artificial Sequence
  chemically synthesized
tcccagacaaacaaaagttg

SEQ ID NO: 66886 - DNA, 20 bp, Artificial Sequence
  chemically synthesized
aaagggagttatgcaatctg

SEQ ID NO: 66887 - DNA, 20 bp, Artificial Sequence
  chemically synthesized
aaaaaagacattaacatgca

SEQ ID NO: 66888 - DNA, 20 bp, Artificial Sequence
  chemically synthesized
aattaagtacatagacaaac

SEQ ID NO: 66889 - DNA, 20 bp, Artificial Sequence
  chemically synthesized
gggtggagtggagttaaagt

SEQ ID NO: 66890 - DNA, 20 bp, Artificial Sequence
  chemically synthesized
cagttccccaattaaaagta

SEQ ID NO: 66891 - DNA, 20 bp, Artificial Sequence
  chemically synthesized
taatagaatggtaaatggat

SEQ ID NO: 66892 - DNA, 20 bp, Artificial Sequence
  chemically synthesized
atccaactttatgcgatctt

SEQ ID NO: 66893 - DNA, 20 bp, Artificial Sequence
  chemically synthesized
aaaattccatgaactggaaa

SEQ ID NO: 66894 - DNA, 20 bp, Artificial Sequence
  chemically synthesized
gactacaaatttaaaaactg

SEQ ID NO: 66895 - DNA, 20 bp, Artificial Sequence
  chemically synthesized
tttgtacaaatttttcagaa

SEQ ID NO: 66896 - DNA, 20 bp, Artificial Sequence
  chemically synthesized
ctgaccacagtggaataaaa

SEQ ID NO: 66897 - DNA, 20 bp, Artificial Sequence
  chemically synthesized
aatgaataacaagaagatca

SEQ ID NO: 66898 - DNA, 20 bp, Artificial Sequence
  chemically synthesized
caagaagatcatcagaaaat

SEQ ID NO: 66899 - DNA, 20 bp, Artificial Sequence
  chemically synthesized
tcctcctgctctttgctccg

SEQ ID NO: 66900 - DNA, 20 bp, Artificial Sequence
  chemically synthesized
ggtcctcaaactgaccagcc

SEQ ID NO: 66901 - DNA, 20 bp, Artificial Sequence
  chemically synthesized
tcgacagtggttccaaatag

SEQ ID NO: 66902 - DNA, 20 bp, Artificial Sequence
  chemically synthesized
ccaggagcttgctacaagtg

SEQ ID NO: 66903 - DNA, 20 bp, Artificial Sequence
  chemically synthesized
cccatctgtgcaggacccca

SEQ ID NO: 66904 - DNA, 20 bp, Artificial Sequence
  chemically synthesized
gacaagccttacaggttagt

SEQ ID NO: 66905 - DNA, 20 bp, Artificial Sequence
  chemically synthesized
cctaggcatagttagtgcgg

SEQ ID NO: 66906 - DNA, 20 bp, Artificial Sequence
  chemically synthesized
cctctcatttcctttccatc

SEQ ID NO: 66907 - DNA, 20 bp, Artificial Sequence
  chemically synthesized
catcgtagaaatctatcctc

SEQ ID NO: 66908 - DNA, 20 bp, Artificial Sequence
  chemically synthesized
ctcagaagtcagacctgtcc

SEQ ID NO: 66909 - DNA, 20 bp, Artificial Sequence
  chemically synthesized
attccagacaccagaccaac

SEQ ID NO: 66910 - DNA, 20 bp, Artificial Sequence
  chemically synthesized
aatcccgctcgaagcagccc

SEQ ID NO: 66911 - DNA, 20 bp, Artificial Sequence
  chemically synthesized
tgaataaccaatgagtcact

SEQ ID NO: 66912 - DNA, 20 bp, Artificial Sequence
  chemically synthesized
aaacacctatatccaaaaaa

SEQ ID NO: 66913 - DNA, 20 bp, Artificial Sequence
  chemically synthesized
aatgcaaaattaatagaagg

SEQ ID NO: 66914 - DNA, 20 bp, Artificial Sequence
  chemically synthesized
aattaatagaaggggagaaa

SEQ ID NO: 66915 - DNA, 20 bp, Artificial Sequence
  chemically synthesized
gagaaataagaaagatcaga

SEQ ID NO: 66916 - DNA, 20 bp, Artificial Sequence
  chemically synthesized
tgaaattgagaccaaaaaat

SEQ ID NO: 66917 - DNA, 20 bp, Artificial Sequence
  chemically synthesized
aaacaaaatcaacaaaactt

SEQ ID NO: 66918 - DNA, 20 bp, Artificial Sequence
  chemically synthesized
gaaaaaagagtcaaataaaa

SEQ ID NO: 66919 - DNA, 20 bp, Artificial Sequence
  chemically synthesized
attccaacaaattggaaaat

SEQ ID NO: 66920 - DNA, 20 bp, Artificial Sequence
  chemically synthesized
gcctagcaagactgaagcat

SEQ ID NO: 66921 - DNA, 20 bp, Artificial Sequence
  chemically synthesized
caagactgaagcatgtagaa

SEQ ID NO: 66922 - DNA, 20 bp, Artificial Sequence
  chemically synthesized
gtaatataaagtttcctatt

SEQ ID NO: 66923 - DNA, 20 bp, Artificial Sequence
  chemically synthesized
gtgctaacattatgctgaac

SEQ ID NO: 66924 - DNA, 20 bp, Artificial Sequence
  chemically synthesized
ctctaaggactgaaataagg

SEQ ID NO: 66925 - DNA, 20 bp, Artificial Sequence
  chemically synthesized
taatattggaagtcttggaa

SEQ ID NO: 66926 - DNA, 20 bp, Artificial Sequence
  chemically synthesized
ttggaaagagaaattcagga

SEQ ID NO: 66927 - DNA, 20 bp, Artificial Sequence
  chemically synthesized
aaagagaaattcaggaagag

SEQ ID NO: 66928 - DNA, 20 bp, Artificial Sequence
  chemically synthesized
tagatgacatgatcttatac

SEQ ID NO: 66929 - DNA, 20 bp, Artificial Sequence
  chemically synthesized
caagaagtaaaagatctcta

SEQ ID NO: 66930 - DNA, 20 bp, Artificial Sequence
  chemically synthesized
aaaattataaaactctggtg

SEQ ID NO: 66931 - DNA, 20 bp, Artificial Sequence
  chemically synthesized
tattccatgctcatgaacta

SEQ ID NO: 66932 - DNA, 20 bp, Artificial Sequence
  chemically synthesized
tcaaaataccaatggcattc

SEQ ID NO: 66933 - DNA, 20 bp, Artificial Sequence
  chemically synthesized
taccaatggcattcacagaa

SEQ ID NO: 66934 - DNA, 20 bp, Artificial Sequence
  chemically synthesized
atactcaggaggctgaggca

SEQ ID NO: 66935 - DNA, 20 bp, Artificial Sequence
  chemically synthesized
aaaggtacaaacagtctttt

SEQ ID NO: 66936 - DNA, 20 bp, Artificial Sequence
  chemically synthesized
ctgaaattatgaaactactg

SEQ ID NO: 66937 - DNA, 20 bp, Artificial Sequence
  chemically synthesized
tgtttgaagctctgcacagc

SEQ ID NO: 66938 - DNA, 20 bp, Artificial Sequence
  chemically synthesized
ataaagtgaagagacaaccc

SEQ ID NO: 66939 - DNA, 20 bp, Artificial Sequence
  chemically synthesized
aagagacaacccaaagaatg

SEQ ID NO: 66940 - DNA, 20 bp, Artificial Sequence
  chemically synthesized
attttacaaggaattgataa

SEQ ID NO: 66941 - DNA, 20 bp, Artificial Sequence
  chemically synthesized
gaattgataaccagaatatg

SEQ ID NO: 66942 - DNA, 20 bp, Artificial Sequence
  chemically synthesized
caagaaactcaagcaactca

SEQ ID NO: 66943 - DNA, 20 bp, Artificial Sequence
  chemically synthesized
ctcctaggtatataccctta

SEQ ID NO: 66944 - DNA, 20 bp, Artificial Sequence
  chemically synthesized
tcgtcaacagataaatggat

SEQ ID NO: 66945 - DNA, 20 bp, Artificial Sequence
  chemically synthesized
gaatattattcaaccataaa

SEQ ID NO: 66946 - DNA, 20 bp, Artificial Sequence
  chemically synthesized
ttaagtgaaataagccaagc

SEQ ID NO: 66947 - DNA, 20 bp, Artificial Sequence
  chemically synthesized
gtgaaataagccaagcacag

SEQ ID NO: 66948 - DNA, 20 bp, Artificial Sequence
  chemically synthesized
tagttaccggcggcgggagg

SEQ ID NO: 66949 - DNA, 20 bp, Artificial Sequence
  chemically synthesized
ggcgggagggaagaaaggaa

SEQ ID NO: 66950 - DNA, 20 bp, Artificial Sequence
  chemically synthesized
ctacttgggaggcttgggca

SEQ ID NO: 66951 - DNA, 20 bp, Artificial Sequence
  chemically synthesized
ctactatggaggctgaggcg

SEQ ID NO: 66952 - DNA, 20 bp, Artificial Sequence
  chemically synthesized
gagagactctgtctcaaaaa

SEQ ID NO: 66953 - DNA, 20 bp, Artificial Sequence
  chemically synthesized
cctgtgtacttggaacagag

SEQ ID NO: 66954 - DNA, 20 bp, Artificial Sequence
  chemically synthesized
accagcacatgtgaatagtt

SEQ ID NO: 66955 - DNA, 20 bp, Artificial Sequence
  chemically synthesized
aaatcagtataagagaagag

SEQ ID NO: 66956 - DNA, 20 bp, Artificial Sequence
  chemically synthesized
taaattgtttcttagtgaca

SEQ ID NO: 66957 - DNA, 20 bp, Artificial Sequence
  chemically synthesized
aagtgtctcttagctacatt

SEQ ID NO: 66958 - DNA, 20 bp, Artificial Sequence
  chemically synthesized
ttagctacattcaagaaagc

SEQ ID NO: 66959 - DNA, 20 bp, Artificial Sequence
  chemically synthesized
aaccagctgtaaaatgtcaa

SEQ ID NO: 66960 - DNA, 20 bp, Artificial Sequence
  chemically synthesized
gtcatatgcataagtcttgc

SEQ ID NO: 66961 - DNA, 20 bp, Artificial Sequence
  chemically synthesized
tataatttttttcatttcat

SEQ ID NO: 66962 - DNA, 20 bp, Artificial Sequence
  chemically synthesized
aatataatgactgttttttg

SEQ ID NO: 66963 - DNA, 20 bp, Artificial Sequence
  chemically synthesized
gaaggaaggaaagtaacaag

SEQ ID NO: 66964 - DNA, 20 bp, Artificial Sequence
  chemically synthesized
gaaagtaacaaggaagaaag

SEQ ID NO: 66965 - DNA, 20 bp, Artificial Sequence
  chemically synthesized
cagctttacatttgtaggac

SEQ ID NO: 66966 - DNA, 20 bp, Artificial Sequence
  chemically synthesized
tccattataatttgtcacta

SEQ ID NO: 66967 - DNA, 20 bp, Artificial Sequence
  chemically synthesized
acttcaataaaataaaatgg

SEQ ID NO: 66968 - DNA, 20 bp, Artificial Sequence
  chemically synthesized
tttttcttttctgaataaaa

SEQ ID NO: 66969 - DNA, 20 bp, Artificial Sequence
  chemically synthesized
ttatttaaataggaattggc

SEQ ID NO: 66970 - DNA, 20 bp, Artificial Sequence
  chemically synthesized
atgtttgcattaaatgggct

SEQ ID NO: 66971 - DNA, 20 bp, Artificial Sequence
  chemically synthesized
tgggctttagaattttgcaa

SEQ ID NO: 66972 - DNA, 20 bp, Artificial Sequence
  chemically synthesized
gaattttgcaaatagaaatg

SEQ ID NO: 66973 - DNA, 20 bp, Artificial Sequence
  chemically synthesized
tgcatttagcctgtgggaaa

SEQ ID NO: 66974 - DNA, 20 bp, Artificial Sequence
  chemically synthesized
ctgtgggaaaagagaaaaag

SEQ ID NO: 66975 - DNA, 20 bp, Artificial Sequence
  chemically synthesized
gaaaggagatttctgcaagt

SEQ ID NO: 66976 - DNA, 20 bp, Artificial Sequence
  chemically synthesized
caataaattcatcccgtgtt

SEQ ID NO: 66977 - DNA, 20 bp, Artificial Sequence
  chemically synthesized
tgctgttacacagagtgcag

SEQ ID NO: 66978 - DNA, 20 bp, Artificial Sequence
  chemically synthesized
atgaagctggaatccttgga

SEQ ID NO: 66979 - DNA, 20 bp, Artificial Sequence
  chemically synthesized
taattgtgattatctttgga

SEQ ID NO: 66980 - DNA, 20 bp, Artificial Sequence
  chemically synthesized
gaagaaaaaatttgccccta

SEQ ID NO: 66981 - DNA, 20 bp, Artificial Sequence
  chemically synthesized
actttattgaagtgtctagg

SEQ ID NO: 66982 - DNA, 20 bp, Artificial Sequence
  chemically synthesized
tgattcaaaatatgtaattt

SEQ ID NO: 66983 - DNA, 20 bp, Artificial Sequence
  chemically synthesized
agcataagagcccaggtttt

SEQ ID NO: 66984 - DNA, 20 bp, Artificial Sequence
  chemically synthesized
gttctacatttgacttcttc

SEQ ID NO: 66985 - DNA, 20 bp, Artificial Sequence
  chemically synthesized
atataattccctttaacttt

SEQ ID NO: 66986 - DNA, 20 bp, Artificial Sequence
  chemically synthesized
ttacattattctgaatataa

SEQ ID NO: 66987 - DNA, 20 bp, Artificial Sequence
  chemically synthesized
tgcttgtctaaaatgttctt

SEQ ID NO: 66988 - DNA, 20 bp, Artificial Sequence
  chemically synthesized
ttttttgtccacaggtctgg

SEQ ID NO: 66989 - DNA, 20 bp, Artificial Sequence
  chemically synthesized
agactcaatataatgagttt

SEQ ID NO: 66990 - DNA, 20 bp, Artificial Sequence
  chemically synthesized
tataatgagtttggagaaaa

SEQ ID NO: 66991 - DNA, 20 bp, Artificial Sequence
  chemically synthesized
agaggaacagtaacactgac

SEQ ID NO: 66992 - DNA, 20 bp, Artificial Sequence
  chemically synthesized
cactagtagggatcccaggc

SEQ ID NO: 66993 - DNA, 20 bp, Artificial Sequence
  chemically synthesized
ccctggttgagttattcttc

SEQ ID NO: 66994 - DNA, 20 bp, Artificial Sequence
  chemically synthesized
atgttaactgtgttcttgtc

SEQ ID NO: 66995 - DNA, 20 bp, Artificial Sequence
  chemically synthesized
aatattaaaaatactatact

SEQ ID NO: 66996 - DNA, 20 bp, Artificial Sequence
  chemically synthesized
gggcaggcaagggaaagaag

SEQ ID NO: 66997 - DNA, 20 bp, Artificial Sequence
  chemically synthesized
acataggatgtggagttcag

SEQ ID NO: 66998 - DNA, 20 bp, Artificial Sequence
  chemically synthesized
attgtctaaaattagtggca

SEQ ID NO: 66999 - DNA, 20 bp, Artificial Sequence
  chemically synthesized
ttgcactcataccatattga

SEQ ID NO: 67000 - DNA, 20 bp, Artificial Sequence
  chemically synthesized
cagaggtaactacctaacca

SEQ ID NO: 67001 - DNA, 20 bp, Artificial Sequence
  chemically synthesized
attttgaggttagcaaaaaa

SEQ ID NO: 67002 - DNA, 20 bp, Artificial Sequence
  chemically synthesized
tgatatgagccatgatgatc

SEQ ID NO: 67003 - DNA, 20 bp, Artificial Sequence
  chemically synthesized
gcctccttctggggcaaacg

SEQ ID NO: 67004 - DNA, 20 bp, Artificial Sequence
  chemically synthesized
actgatgattgaattttctg

SEQ ID NO: 67005 - DNA, 20 bp, Artificial Sequence
  chemically synthesized
tttgtgtgctcatcccccag

SEQ ID NO: 67006 - DNA, 20 bp, Artificial Sequence
  chemically synthesized
gggatttcctagttgatagc

SEQ ID NO: 67007 - DNA, 20 bp, Artificial Sequence
  chemically synthesized
ccttccttctttttctttca

SEQ ID NO: 67008 - DNA, 20 bp, Artificial Sequence
  chemically synthesized
atttcctctgtgaaggagca

SEQ ID NO: 67009 - DNA, 20 bp, Artificial Sequence
  chemically synthesized
tatcttgggtcatttcattc

SEQ ID NO: 67010 - DNA, 20 bp, Artificial Sequence
  chemically synthesized
tcttatattaataagaaaaa

SEQ ID NO: 67011 - DNA, 20 bp, Artificial Sequence
  chemically synthesized
atacggttttgtatggattg

SEQ ID NO: 67012 - DNA, 20 bp, Artificial Sequence
  chemically synthesized
aaatggaataagagaaggag

SEQ ID NO: 67013 - DNA, 20 bp, Artificial Sequence
  chemically synthesized
tatcagctgtgatggcttgg

SEQ ID NO: 67014 - DNA, 20 bp, Artificial Sequence
  chemically synthesized
tactgaatactaagagcctg

SEQ ID NO: 67015 - DNA, 20 bp, Artificial Sequence
  chemically synthesized
tgcagacctgagggctaggc

SEQ ID NO: 67016 - DNA, 20 bp, Artificial Sequence
  chemically synthesized
ggcaccatggggtggatagg

SEQ ID NO: 67017 - DNA, 20 bp, Artificial Sequence
  chemically synthesized
aaggaggctttgaactgggg

SEQ ID NO: 67018 - DNA, 20 bp, Artificial Sequence
  chemically synthesized
cggagttttgggtccacgga

SEQ ID NO: 67019 - DNA, 20 bp, Artificial Sequence
  chemically synthesized
aaaggaatataaacaagggc

SEQ ID NO: 67020 - DNA, 20 bp, Artificial Sequence
  chemically synthesized
ttagaatgaataatatgtaa

SEQ ID NO: 67021 - DNA, 20 bp, Artificial Sequence
  chemically synthesized
ttttataaagatcctcttga

SEQ ID NO: 67022 - DNA, 20 bp, Artificial Sequence
  chemically synthesized
gtccataaattaatttcgag

SEQ ID NO: 67023 - DNA, 20 bp, Artificial Sequence
  chemically synthesized
gaaattcaaaattatctgaa

SEQ ID NO: 67024 - DNA, 20 bp, Artificial Sequence
  chemically synthesized
gttttttagttattttcttc

SEQ ID NO: 67025 - DNA, 20 bp, Artificial Sequence
  chemically synthesized
gtaccgttttgacaaattga

SEQ ID NO: 67026 - DNA, 20 bp, Artificial Sequence
  chemically synthesized
cctattctcagggaaatata

SEQ ID NO: 67027 - DNA, 20 bp, Artificial Sequence
  chemically synthesized
taagagtgaaagagtgcata

SEQ ID NO: 67028 - DNA, 20 bp, Artificial Sequence
  chemically synthesized
catctggagcaggcaaccac

SEQ ID NO: 67029 - DNA, 20 bp, Artificial Sequence
  chemically synthesized
gtgaatgttatggaacgttt

SEQ ID NO: 67030 - DNA, 20 bp, Artificial Sequence
  chemically synthesized
ttgggtcatctatggcagtg

SEQ ID NO: 67031 - DNA, 20 bp, Artificial Sequence
  chemically synthesized
agaacatgccaatgtcaatg

SEQ ID NO: 67032 - DNA, 20 bp, Artificial Sequence
  chemically synthesized
ttttcatacacaatcattta

SEQ ID NO: 67033 - DNA, 20 bp, Artificial Sequence
  chemically synthesized
atgaaaaagtcctacaactc

SEQ ID NO: 67034 - DNA, 20 bp, Artificial Sequence
  chemically synthesized
ttggcacataaaatgcaaac

SEQ ID NO: 67035 - DNA, 20 bp, Artificial Sequence
  chemically synthesized
tgtctatactttaagagaaa

SEQ ID NO: 67036 - DNA, 20 bp, Artificial Sequence
  chemically synthesized
aaatattttgacagttcttc

SEQ ID NO: 67037 - DNA, 20 bp, Artificial Sequence
  chemically synthesized
caactttaagtgaaatgatg

SEQ ID NO: 67038 - DNA, 20 bp, Artificial Sequence
  chemically synthesized
tgggtaaaataagccagaca

SEQ ID NO: 67039 - DNA, 20 bp, Artificial Sequence
  chemically synthesized
aataaaaatggaaagaaatt

SEQ ID NO: 67040 - DNA, 20 bp, Artificial Sequence
  chemically synthesized
tattggttcttgcagttgca

SEQ ID NO: 67041 - DNA, 20 bp, Artificial Sequence
  chemically synthesized
attaactaagacctcagtta

SEQ ID NO: 67042 - DNA, 20 bp, Artificial Sequence
  chemically synthesized
cagttttagctaagtgcttc

SEQ ID NO: 67043 - DNA, 20 bp, Artificial Sequence
  chemically synthesized
ttaaggagacagtagaacat

SEQ ID NO: 67044 - DNA, 20 bp, Artificial Sequence
  chemically synthesized
aaatttcacattagaatgtc

SEQ ID NO: 67045 - DNA, 20 bp, Artificial Sequence
  chemically synthesized
acattgtgtagagtagaaaa

SEQ ID NO: 67046 - DNA, 20 bp, Artificial Sequence
  chemically synthesized
aaaaagcccagtgactgact

SEQ ID NO: 67047 - DNA, 20 bp, Artificial Sequence
  chemically synthesized
cattaaagtatttttttttt

SEQ ID NO: 67048 - DNA, 20 bp, Artificial Sequence
  chemically synthesized
attgtatttattctattccc

SEQ ID NO: 67049 - DNA, 20 bp, Artificial Sequence
  chemically synthesized
attatttctacagatgtaaa

SEQ ID NO: 67050 - DNA, 20 bp, Artificial Sequence
  chemically synthesized
tccaatgctgcctatcaagg

SEQ ID NO: 67051 - DNA, 20 bp, Artificial Sequence
  chemically synthesized
tatcaaggtaaaactagata

SEQ ID NO: 67052 - DNA, 20 bp, Artificial Sequence
  chemically synthesized
tatttctcaaaaatatagga

SEQ ID NO: 67053 - DNA, 20 bp, Artificial Sequence
  chemically synthesized
gagttccagaccagcttgac

SEQ ID NO: 67054 - DNA, 20 bp, Artificial Sequence
  chemically synthesized
caaccagtaccagccactgc

SEQ ID NO: 67055 - DNA, 20 bp, Artificial Sequence
  chemically synthesized
gaagatctaccaagcaaatg

SEQ ID NO: 67056 - DNA, 20 bp, Artificial Sequence
  chemically synthesized
tttgcaatcttagtctctga

SEQ ID NO: 67057 - DNA, 20 bp, Artificial Sequence
  chemically synthesized
tcaggattaagaaactcact

SEQ ID NO: 67058 - DNA, 20 bp, Artificial Sequence
  chemically synthesized
caacgagaataaagatacaa

SEQ ID NO: 67059 - DNA, 20 bp, Artificial Sequence
  chemically synthesized
gtgaaggagattgagacaca

SEQ ID NO: 67060 - DNA, 20 bp, Artificial Sequence
  chemically synthesized
aatttaatgttttcacatta

SEQ ID NO: 67061 - DNA, 20 bp, Artificial Sequence
  chemically synthesized
gaatgaagataagggggaaa

SEQ ID NO: 67062 - DNA, 20 bp, Artificial Sequence
  chemically synthesized
gtttgtttttttgtttttcc

SEQ ID NO: 67063 - DNA, 20 bp, Artificial Sequence
  chemically synthesized
tatttaaacatattctaaga

SEQ ID NO: 67064 - DNA, 20 bp, Artificial Sequence
  chemically synthesized
accatgatattcatggaatt

SEQ ID NO: 67065 - DNA, 20 bp, Artificial Sequence
  chemically synthesized
gcttttttcacctatagtag

SEQ ID NO: 67066 - DNA, 20 bp, Artificial Sequence
  chemically synthesized
aacttagtaaaaaaaaatag

SEQ ID NO: 67067 - DNA, 20 bp, Artificial Sequence
  chemically synthesized
gtttttaaatctggggactc

SEQ ID NO: 67068 - DNA, 20 bp, Artificial Sequence
  chemically synthesized
caagtaccatgttactactt

SEQ ID NO: 67069 - DNA, 20 bp, Artificial Sequence
  chemically synthesized
gctatccaacacaactttct

SEQ ID NO: 67070 - DNA, 20 bp, Artificial Sequence
  chemically synthesized
atctgctcggccatgtggta

SEQ ID NO: 67071 - DNA, 20 bp, Artificial Sequence
  chemically synthesized
tgcaagggaaatgcccttta

SEQ ID NO: 67072 - DNA, 20 bp, Artificial Sequence
  chemically synthesized
tatcatgagaacagcatgtg

SEQ ID NO: 67073 - DNA, 20 bp, Artificial Sequence
  chemically synthesized
tcaagaagaaatttgggtgg

SEQ ID NO: 67074 - DNA, 20 bp, Artificial Sequence
  chemically synthesized
gtatttttttacagcagtgt

SEQ ID NO: 67075 - DNA, 20 bp, Artificial Sequence
  chemically synthesized
agtaaactatcgcaaggacg

SEQ ID NO: 67076 - DNA, 20 bp, Artificial Sequence
  chemically synthesized
cacattgtgcacatgtaccc

SEQ ID NO: 67077 - DNA, 20 bp, Artificial Sequence
  chemically synthesized
caaaagcagtccctggtacc

SEQ ID NO: 67078 - DNA, 20 bp, Artificial Sequence
  chemically synthesized
attagcagatcatttttact

SEQ ID NO: 67079 - DNA, 20 bp, Artificial Sequence
  chemically synthesized
ctgttgttgcctaattcatg

SEQ ID NO: 67080 - DNA, 20 bp, Artificial Sequence
  chemically synthesized
ctggctactatgtagctttt

SEQ ID NO: 67081 - DNA, 20 bp, Artificial Sequence
  chemically synthesized
cttccagatagaggcctttg

SEQ ID NO: 67082 - DNA, 20 bp, Artificial Sequence
  chemically synthesized
ttccctatgagtggctggtg

SEQ ID NO: 67083 - DNA, 20 bp, Artificial Sequence
  chemically synthesized
gctaacttctcttttcatta

SEQ ID NO: 67084 - DNA, 20 bp, Artificial Sequence
  chemically synthesized
ctaatagaatataggaagat

SEQ ID NO: 67085 - DNA, 20 bp, Artificial Sequence
  chemically synthesized
agttttctactttgaaactt

SEQ ID NO: 67086 - DNA, 20 bp, Artificial Sequence
  chemically synthesized
cacgggggaaaggtgcttgc

SEQ ID NO: 67087 - DNA, 20 bp, Artificial Sequence
  chemically synthesized
gatggggggtgtaataaaga

SEQ ID NO: 67088 - DNA, 20 bp, Artificial Sequence
  chemically synthesized
gggccagcatggacaggaag

SEQ ID NO: 67089 - DNA, 20 bp, Artificial Sequence
  chemically synthesized
tctaagtaaatgaaataccc

SEQ ID NO: 67090 - DNA, 20 bp, Artificial Sequence
  chemically synthesized
ctaaaacttactgacttaaa

SEQ ID NO: 67091 - DNA, 20 bp, Artificial Sequence
  chemically synthesized
tatccttagaagccataagc

SEQ ID NO: 67092 - DNA, 20 bp, Artificial Sequence
  chemically synthesized
caatttcttcctaccctttt

SEQ ID NO: 67093 - DNA, 20 bp, Artificial Sequence
  chemically synthesized
tatcatgtttcaattttaaa

SEQ ID NO: 67094 - DNA, 20 bp, Artificial Sequence
  chemically synthesized
atcacacaaacctttgttga

SEQ ID NO: 67095 - DNA, 20 bp, Artificial Sequence
  chemically synthesized
ttaggtatctttatcttcct

SEQ ID NO: 67096 - DNA, 20 bp, Artificial Sequence
  chemically synthesized
taccaagtttgaatggttta

SEQ ID NO: 67097 - DNA, 20 bp, Artificial Sequence
  chemically synthesized
tggtgaaaccctgtctctac

SEQ ID NO: 67098 - DNA, 20 bp, Artificial Sequence
  chemically synthesized
aaataaatgaagatttaaag

SEQ ID NO: 67099 - DNA, 20 bp, Artificial Sequence
  chemically synthesized
agatgctccacctgtattta

SEQ ID NO: 67100 - DNA, 20 bp, Artificial Sequence
  chemically synthesized
cttttctgatgccctctgat

SEQ ID NO: 67101 - DNA, 20 bp, Artificial Sequence
  chemically synthesized
tctttataattctatagaac

SEQ ID NO: 67102 - DNA, 20 bp, Artificial Sequence
  chemically synthesized
gtaaacactgaatgaaagaa

SEQ ID NO: 67103 - DNA, 20 bp, Artificial Sequence
  chemically synthesized
tacaaataaatttatatttt

SEQ ID NO: 67104 - DNA, 20 bp, Artificial Sequence
  chemically synthesized
tatgcagtgtgagagatcac

SEQ ID NO: 67105 - DNA, 20 bp, Artificial Sequence
  chemically synthesized
aatttatgaggataaataat

SEQ ID NO: 67106 - DNA, 20 bp, Artificial Sequence
  chemically synthesized
atagagaagtaacttatcct

SEQ ID NO: 67107 - DNA, 20 bp, Artificial Sequence
  chemically synthesized
gaatacctgagaggaaaaaa

SEQ ID NO: 67108 - DNA, 20 bp, Artificial Sequence
  chemically synthesized
ttggtatgatgataatatat

SEQ ID NO: 67109 - DNA, 20 bp, Artificial Sequence
  chemically synthesized
tgctcctggctacatcccag

SEQ ID NO: 67110 - DNA, 20 bp, Artificial Sequence
  chemically synthesized
aattactttcataatgcgca

SEQ ID NO: 67111 - DNA, 20 bp, Artificial Sequence
  chemically synthesized
aacaacattttgttagactt

SEQ ID NO: 67112 - DNA, 20 bp, Artificial Sequence
  chemically synthesized
tatggtgttttctagataca

SEQ ID NO: 67113 - DNA, 20 bp, Artificial Sequence
  chemically synthesized
ggttcagccttgggaggacc

SEQ ID NO: 67114 - DNA, 20 bp, Artificial Sequence
  chemically synthesized
ttcaagactaatgaatagct

SEQ ID NO: 67115 - DNA, 20 bp, Artificial Sequence
  chemically synthesized
atgaattttgggtaaataat

SEQ ID NO: 67116 - DNA, 20 bp, Artificial Sequence
  chemically synthesized
caaagctaactgaaggatat

SEQ ID NO: 67117 - DNA, 20 bp, Artificial Sequence
  chemically synthesized
cagaaatacaaataatcatc

SEQ ID NO: 67118 - DNA, 20 bp, Artificial Sequence
  chemically synthesized
ggagaatatcatcaccgtaa

SEQ ID NO: 67119 - DNA, 20 bp, Artificial Sequence
  chemically synthesized
tgagattgttctggttcatg

SEQ ID NO: 67120 - DNA, 20 bp, Artificial Sequence
  chemically synthesized
aaggaatgttaactgactga

SEQ ID NO: 67121 - DNA, 20 bp, Artificial Sequence
  chemically synthesized
aattttgttgatcttttcaa

SEQ ID NO: 67122 - DNA, 20 bp, Artificial Sequence
  chemically synthesized
tagaaatgaagaaaagcatg

SEQ ID NO: 67123 - DNA, 20 bp, Artificial Sequence
  chemically synthesized
acactagaaaatctagggag

SEQ ID NO: 67124 - DNA, 20 bp, Artificial Sequence
  chemically synthesized
tccagcctggacaacaagag

SEQ ID NO: 67125 - DNA, 20 bp, Artificial Sequence
  chemically synthesized
tgcttctcatatcaaattca

SEQ ID NO: 67126 - DNA, 20 bp, Artificial Sequence
  chemically synthesized
gaggagaaaccatctcgccg

SEQ ID NO: 67127 - DNA, 20 bp, Artificial Sequence
  chemically synthesized
aagacattcatgaggacagc

SEQ ID NO: 67128 - DNA, 20 bp, Artificial Sequence
  chemically synthesized
taatgtaaaatacagcatag

SEQ ID NO: 67129 - DNA, 20 bp, Artificial Sequence
  chemically synthesized
gtcaatatgtgtacacatat

SEQ ID NO: 67130 - DNA, 20 bp, Artificial Sequence
  chemically synthesized
aaagcaagaattaaacaaaa

SEQ ID NO: 67131 - DNA, 20 bp, Artificial Sequence
  chemically synthesized
gaacagcaaataaaagaaac

SEQ ID NO: 67132 - DNA, 20 bp, Artificial Sequence
  chemically synthesized
ccatagaaaagaaggggaaa

SEQ ID NO: 67133 - DNA, 20 bp, Artificial Sequence
  chemically synthesized
catcagtacaaattgctact

SEQ ID NO: 67134 - DNA, 20 bp, Artificial Sequence
  chemically synthesized
acttacaggacagaatggat

SEQ ID NO: 67135 - DNA, 20 bp, Artificial Sequence
  chemically synthesized
tatcttctccttatttggat

SEQ ID NO: 67136 - DNA, 20 bp, Artificial Sequence
  chemically synthesized
gttttgggaaacaagagata

SEQ ID NO: 67137 - DNA, 20 bp, Artificial Sequence
  chemically synthesized
aattaactcctcaggtgagg

SEQ ID NO: 67138 - DNA, 20 bp, Artificial Sequence
  chemically synthesized
ctgctattaaaagatgtaat

SEQ ID NO: 67139 - DNA, 20 bp, Artificial Sequence
  chemically synthesized
taaaataaaataaaataaaa

SEQ ID NO: 67140 - DNA, 20 bp, Artificial Sequence
  chemically synthesized
tttatattcattcctctgta

SEQ ID NO: 67141 - DNA, 20 bp, Artificial Sequence
  chemically synthesized
ctttaaaatattttaaatgt

SEQ ID NO: 67142 - DNA, 20 bp, Artificial Sequence
  chemically synthesized
atcagcattcaaagttcctg

SEQ ID NO: 67143 - DNA, 20 bp, Artificial Sequence
  chemically synthesized
atgaaataaaaatgctccaa

SEQ ID NO: 67144 - DNA, 20 bp, Artificial Sequence
  chemically synthesized
caacgccatagtgagaaaag

SEQ ID NO: 67145 - DNA, 20 bp, Artificial Sequence
  chemically synthesized
actatgtataatgacttaag

SEQ ID NO: 67146 - DNA, 20 bp, Artificial Sequence
  chemically synthesized
tcaattcaaaatgttgtgat

SEQ ID NO: 67147 - DNA, 20 bp, Artificial Sequence
  chemically synthesized
ttttctgcccaaatcttaga

SEQ ID NO: 67148 - DNA, 20 bp, Artificial Sequence
  chemically synthesized
gtaaaatgatttatagcctc

SEQ ID NO: 67149 - DNA, 20 bp, Artificial Sequence
  chemically synthesized
caccagtaatctgagggtag

SEQ ID NO: 67150 - DNA, 20 bp, Artificial Sequence
  chemically synthesized
tttctgtcactttatactaa

SEQ ID NO: 67151 - DNA, 20 bp, Artificial Sequence
  chemically synthesized
ttggtaaattcttcctataa

SEQ ID NO: 67152 - DNA, 20 bp, Artificial Sequence
  chemically synthesized
acaatagtataacccctttg

SEQ ID NO: 67153 - DNA, 20 bp, Artificial Sequence
  chemically synthesized
cttatgacagcaataatcat

SEQ ID NO: 67154 - DNA, 20 bp, Artificial Sequence
  chemically synthesized
gctatctaatgactaaaatg

SEQ ID NO: 67155 - DNA, 20 bp, Artificial Sequence
  chemically synthesized
agattaagtacattagtagg

SEQ ID NO: 67156 - DNA, 20 bp, Artificial Sequence
  chemically synthesized
tttccactaaaggtgaatgt

SEQ ID NO: 67157 - DNA, 20 bp, Artificial Sequence
  chemically synthesized
agaaagggtattatatcttc

SEQ ID NO: 67158 - DNA, 20 bp, Artificial Sequence
  chemically synthesized
aaacttcagtgatttttgct

SEQ ID NO: 67159 - DNA, 20 bp, Artificial Sequence
  chemically synthesized
agaataaaatcactaccact

SEQ ID NO: 67160 - DNA, 20 bp, Artificial Sequence
  chemically synthesized
atcactaccactaaaaacaa

SEQ ID NO: 67161 - DNA, 20 bp, Artificial Sequence
  chemically synthesized
gtagcagatgaagtacagat

SEQ ID NO: 67162 - DNA, 20 bp, Artificial Sequence
  chemically synthesized
ccattgacctccctttctgt

SEQ ID NO: 67163 - DNA, 20 bp, Artificial Sequence
  chemically synthesized
tcctcgctgaagtgggttgc

SEQ ID NO: 67164 - DNA, 20 bp, Artificial Sequence
  chemically synthesized
caacttctgttccctcatcc

SEQ ID NO: 67165 - DNA, 20 bp, Artificial Sequence
  chemically synthesized
acagtcagagcccagatatc

SEQ ID NO: 67166 - DNA, 20 bp, Artificial Sequence
  chemically synthesized
acaaactagggaagtaaggg

SEQ ID NO: 67167 - DNA, 20 bp, Artificial Sequence
  chemically synthesized
tagtgacaaacagtttgagg

SEQ ID NO: 67168 - DNA, 20 bp, Artificial Sequence
  chemically synthesized
gtcatgtcctttaatggccc

SEQ ID NO: 67169 - DNA, 20 bp, Artificial Sequence
  chemically synthesized
tatccttaggtacatacatc

SEQ ID NO: 67170 - DNA, 20 bp, Artificial Sequence
  chemically synthesized
atggattagagacttaaatg

SEQ ID NO: 67171 - DNA, 20 bp, Artificial Sequence
  chemically synthesized
aaacaactttacaagaaaaa

SEQ ID NO: 67172 - DNA, 20 bp, Artificial Sequence
  chemically synthesized
acaagaaaaaaaaaacccat

SEQ ID NO: 67173 - DNA, 20 bp, Artificial Sequence
  chemically synthesized
ccatggcacacttttaccta

SEQ ID NO: 67174 - DNA, 20 bp, Artificial Sequence
  chemically synthesized
aagagaaggcataaataatc

SEQ ID NO: 67175 - DNA, 20 bp, Artificial Sequence
  chemically synthesized
gaaatttgctttgacttaaa

SEQ ID NO: 67176 - DNA, 20 bp, Artificial Sequence
  chemically synthesized
gctttgacttaaaaaaaaca

SEQ ID NO: 67177 - DNA, 20 bp, Artificial Sequence
  chemically synthesized
aacatggtctgtagtccact

SEQ ID NO: 67178 - DNA, 20 bp, Artificial Sequence
  chemically synthesized
gaaccttttcccatctcttc

SEQ ID NO: 67179 - DNA, 20 bp, Artificial Sequence
  chemically synthesized
tctttgccgaaatggattgc

SEQ ID NO: 67180 - DNA, 20 bp, Artificial Sequence
  chemically synthesized
ctgcctccagatagatgttt

SEQ ID NO: 67181 - DNA, 20 bp, Artificial Sequence
  chemically synthesized
tagaggcactccttaggccc

SEQ ID NO: 67182 - DNA, 20 bp, Artificial Sequence
  chemically synthesized
taatttctcaatagtgcagt

SEQ ID NO: 67183 - DNA, 20 bp, Artificial Sequence
  chemically synthesized
ataagatgtgcgtgtacatg

SEQ ID NO: 67184 - DNA, 20 bp, Artificial Sequence
  chemically synthesized
gaaagtaggaagggcatgtg

SEQ ID NO: 67185 - DNA, 20 bp, Artificial Sequence
  chemically synthesized
attgtagttaccgtggaaag

SEQ ID NO: 67186 - DNA, 20 bp, Artificial Sequence
  chemically synthesized
gaacctttccccatctcttc

SEQ ID NO: 67187 - DNA, 20 bp, Artificial Sequence
  chemically synthesized
tagttcttttatttgctcat

SEQ ID NO: 67188 - DNA, 20 bp, Artificial Sequence
  chemically synthesized
cataaacacatccctcaaca

SEQ ID NO: 67189 - DNA, 20 bp, Artificial Sequence
  chemically synthesized
tctttgccgaaatggattgc

SEQ ID NO: 67190 - DNA, 20 bp, Artificial Sequence
  chemically synthesized
aaccctgtatgctgtaggct

SEQ ID NO: 67191 - DNA, 20 bp, Artificial Sequence
  chemically synthesized
ctgcctccagatagatgttt

SEQ ID NO: 67192 - DNA, 20 bp, Artificial Sequence
  chemically synthesized
cagaggcactccttaggccc

SEQ ID NO: 67193 - DNA, 20 bp, Artificial Sequence
  chemically synthesized
ataagacatgtatttgcatg

SEQ ID NO: 67194 - DNA, 20 bp, Artificial Sequence
  chemically synthesized
aacaacttccccatttatcc

SEQ ID NO: 67195 - DNA, 20 bp, Artificial Sequence
  chemically synthesized
attgattaaatcctaactga

SEQ ID NO: 67196 - DNA, 20 bp, Artificial Sequence
  chemically synthesized
aagttaaataagtcagagaa

SEQ ID NO: 67197 - DNA, 20 bp, Artificial Sequence
  chemically synthesized
ttcaaagctctgaagcagaa

SEQ ID NO: 67198 - DNA, 20 bp, Artificial Sequence
  chemically synthesized
acccaagtgagaaggaacca

SEQ ID NO: 67199 - DNA, 20 bp, Artificial Sequence
  chemically synthesized
aaactaactctggtaatatg

SEQ ID NO: 67200 - DNA, 20 bp, Artificial Sequence
  chemically synthesized
aaggtgaagtccaattttaa

SEQ ID NO: 67201 - DNA, 20 bp, Artificial Sequence
  chemically synthesized
ttaaagagatagcataaata

SEQ ID NO: 67202 - DNA, 20 bp, Artificial Sequence
  chemically synthesized
tagcataaataaaaaacatt

SEQ ID NO: 67203 - DNA, 20 bp, Artificial Sequence
  chemically synthesized
aagagaaatctaaaagtttg

SEQ ID NO: 67204 - DNA, 20 bp, Artificial Sequence
  chemically synthesized
tatccagggaaataatcaag

SEQ ID NO: 67205 - DNA, 20 bp, Artificial Sequence
  chemically synthesized
ctaccaggtaacctatgaaa

SEQ ID NO: 67206 - DNA, 20 bp, Artificial Sequence
  chemically synthesized
ctatcttcagccttcttaaa

SEQ ID NO: 67207 - DNA, 20 bp, Artificial Sequence
  chemically synthesized
aaatacacagtgtttttcag

SEQ ID NO: 67208 - DNA, 20 bp, Artificial Sequence
  chemically synthesized
aataaaccctggaagcacat

SEQ ID NO: 67209 - DNA, 20 bp, Artificial Sequence
  chemically synthesized
gcagctattcttatgtcaga

SEQ ID NO: 67210 - DNA, 20 bp, Artificial Sequence
  chemically synthesized
tactggagatcccaaattta

SEQ ID NO: 67211 - DNA, 20 bp, Artificial Sequence
  chemically synthesized
ataggccatatgatatgcca

SEQ ID NO: 67212 - DNA, 20 bp, Artificial Sequence
  chemically synthesized
tcaactacaaaaggaacctt

SEQ ID NO: 67213 - DNA, 20 bp, Artificial Sequence
  chemically synthesized
atttaaaaatcatttgcttt

SEQ ID NO: 67214 - DNA, 20 bp, Artificial Sequence
  chemically synthesized
gagaggacacaaacaaatgg

SEQ ID NO: 67215 - DNA, 20 bp, Artificial Sequence
  chemically synthesized
acttttttcaaagaattaga

SEQ ID NO: 67216 - DNA, 20 bp, Artificial Sequence
  chemically synthesized
tactacaaggctacagtaac

SEQ ID NO: 67217 - DNA, 20 bp, Artificial Sequence
  chemically synthesized
aaacagcatggtactggtac

SEQ ID NO: 67218 - DNA, 20 bp, Artificial Sequence
  chemically synthesized
tatttaataaatggtgctgg

SEQ ID NO: 67219 - DNA, 20 bp, Artificial Sequence
  chemically synthesized
aaactggctagcaatatgca

SEQ ID NO: 67220 - DNA, 20 bp, Artificial Sequence
  chemically synthesized
aaagacttaaatgtgcaacc

SEQ ID NO: 67221 - DNA, 20 bp, Artificial Sequence
  chemically synthesized
catgggcaaaaattcacgac

SEQ ID NO: 67222 - DNA, 20 bp, Artificial Sequence
  chemically synthesized
acttcaacaaatttacaaga

SEQ ID NO: 67223 - DNA, 20 bp, Artificial Sequence
  chemically synthesized
gtcattagagaaatgcaaat

SEQ ID NO: 67224 - DNA, 20 bp, Artificial Sequence
  chemically synthesized
acaatagtgacacaacctat

SEQ ID NO: 67225 - DNA, 20 bp, Artificial Sequence
  chemically synthesized
ccacaagaaactagagaaac

SEQ ID NO: 67226 - DNA, 20 bp, Artificial Sequence
  chemically synthesized
gaaacaaaaacaaacagaac

SEQ ID NO: 67227 - DNA, 20 bp, Artificial Sequence
  chemically synthesized
agaggagaactaaatgaaat

SEQ ID NO: 67228 - DNA, 20 bp, Artificial Sequence
  chemically synthesized
tggttctttgaaaagataaa

SEQ ID NO: 67229 - DNA, 20 bp, Artificial Sequence
  chemically synthesized
caaataaactcaattagaaa

SEQ ID NO: 67230 - DNA, 20 bp, Artificial Sequence
  chemically synthesized
acctttacatgcataaacta

SEQ ID NO: 67231 - DNA, 20 bp, Artificial Sequence
  chemically synthesized
agccagtatcaccttaatac

SEQ ID NO: 67232 - DNA, 20 bp, Artificial Sequence
  chemically synthesized
aaagaacataaccaaaaaaa

SEQ ID NO: 67233 - DNA, 20 bp, Artificial Sequence
  chemically synthesized
aatagcatccgacagcatat

SEQ ID NO: 67234 - DNA, 20 bp, Artificial Sequence
  chemically synthesized
attcaacatcactttatgac

SEQ ID NO: 67235 - DNA, 20 bp, Artificial Sequence
  chemically synthesized
aagttaaaagcattctgtct

SEQ ID NO: 67236 - DNA, 20 bp, Artificial Sequence
  chemically synthesized
atgatatgattgtgtatgta

SEQ ID NO: 67237 - DNA, 20 bp, Artificial Sequence
  chemically synthesized
gaaaactctaaagactcctc

SEQ ID NO: 67238 - DNA, 20 bp, Artificial Sequence
  chemically synthesized
ccccttttacaatagctgca

SEQ ID NO: 67239 - DNA, 20 bp, Artificial Sequence
  chemically synthesized
tttacaatagctgcaaaaaa

SEQ ID NO: 67240 - DNA, 20 bp, Artificial Sequence
  chemically synthesized
aatagctgcaaaaaacaaaa

SEQ ID NO: 67241 - DNA, 20 bp, Artificial Sequence
  chemically synthesized
ctgcaaaaaacaaaacaaaa

SEQ ID NO: 67242 - DNA, 20 bp, Artificial Sequence
  chemically synthesized
aaaacaaaacaaaacaaaac

SEQ ID NO: 67243 - DNA, 20 bp, Artificial Sequence
  chemically synthesized
aggtgaaagacatctacaag

SEQ ID NO: 67244 - DNA, 20 bp, Artificial Sequence
  chemically synthesized
gacatctacaaggaaaacta

SEQ ID NO: 67245 - DNA, 20 bp, Artificial Sequence
  chemically synthesized
ttagtcttcacagaactaga

SEQ ID NO: 67246 - DNA, 20 bp, Artificial Sequence
  chemically synthesized
tacaataaggccatagtcac

SEQ ID NO: 67247 - DNA, 20 bp, Artificial Sequence
  chemically synthesized
tgatctttgacaaagcaaac

SEQ ID NO: 67248 - DNA, 20 bp, Artificial Sequence
  chemically synthesized
attctagaaaataacatcgg

SEQ ID NO: 67249 - DNA, 20 bp, Artificial Sequence
  chemically synthesized
gaacacaaatgcaaatacat

SEQ ID NO: 67250 - DNA, 20 bp, Artificial Sequence
  chemically synthesized
atgatcagggaaatgcaaat

SEQ ID NO: 67251 - DNA, 20 bp, Artificial Sequence
  chemically synthesized
agatatctacttactctagt

SEQ ID NO: 67252 - DNA, 20 bp, Artificial Sequence
  chemically synthesized
aaaatagtacaaccattatg

SEQ ID NO: 67253 - DNA, 20 bp, Artificial Sequence
  chemically synthesized
tgaagatttctcagtaaact

SEQ ID NO: 67254 - DNA, 20 bp, Artificial Sequence
  chemically synthesized
tgaaagccctgaagcagaac

SEQ ID NO: 67255 - DNA, 20 bp, Artificial Sequence
  chemically synthesized
aagacacaagacctgaaggt

SEQ ID NO: 67256 - DNA, 20 bp, Artificial Sequence
  chemically synthesized
aagtcttcatcacactctcc

SEQ ID NO: 67257 - DNA, 20 bp, Artificial Sequence
  chemically synthesized
ttatctccaaatcaatttca

SEQ ID NO: 67258 - DNA, 20 bp, Artificial Sequence
  chemically synthesized
ccttctttccccggtgcagt

SEQ ID NO: 67259 - DNA, 20 bp, Artificial Sequence
  chemically synthesized
catgttgagtagaagtttcc

SEQ ID NO: 67260 - DNA, 20 bp, Artificial Sequence
  chemically synthesized
ttccgaaaacaacttgatga

SEQ ID NO: 67261 - DNA, 20 bp, Artificial Sequence
  chemically synthesized
gaaaaaacaaacaaacaaac

SEQ ID NO: 67262 - DNA, 20 bp, Artificial Sequence
  chemically synthesized
ttaaaggtggtgacagtgac

SEQ ID NO: 67263 - DNA, 20 bp, Artificial Sequence
  chemically synthesized
ggaaaagaaaataaagctgt

SEQ ID NO: 67264 - DNA, 20 bp, Artificial Sequence
  chemically synthesized
cttaaggagtgcattgtaaa

SEQ ID NO: 67265 - DNA, 20 bp, Artificial Sequence
  chemically synthesized
cttagtttctctagggagac

SEQ ID NO: 67266 - DNA, 20 bp, Artificial Sequence
  chemically synthesized
tgataaaaaaaaaaaaaaaa

SEQ ID NO: 67267 - DNA, 20 bp, Artificial Sequence
  chemically synthesized
taaccattggctaacacaga

SEQ ID NO: 67268 - DNA, 20 bp, Artificial Sequence
  chemically synthesized
agcgaaactccatctcaaac

SEQ ID NO: 67269 - DNA, 20 bp, Artificial Sequence
  chemically synthesized
actccatctcaaacaaaaac

SEQ ID NO: 67270 - DNA, 20 bp, Artificial Sequence
  chemically synthesized
ttggagaacaggtttctccc

SEQ ID NO: 67271 - DNA, 20 bp, Artificial Sequence
  chemically synthesized
taagttctatgcaggattct

SEQ ID NO: 67272 - DNA, 20 bp, Artificial Sequence
  chemically synthesized
acatgatgggcactgaaggt

SEQ ID NO: 67273 - DNA, 20 bp, Artificial Sequence
  chemically synthesized
aacttgagtctgtcaactta

SEQ ID NO: 67274 - DNA, 20 bp, Artificial Sequence
  chemically synthesized
atgaactaagaacatagaaa

SEQ ID NO: 67275 - DNA, 20 bp, Artificial Sequence
  chemically synthesized
tcttatgtctagaaattttg

SEQ ID NO: 67276 - DNA, 20 bp, Artificial Sequence
  chemically synthesized
tgtatttctctggagaaggt

SEQ ID NO: 67277 - DNA, 20 bp, Artificial Sequence
  chemically synthesized
atccatcatgaggaaatatg

SEQ ID NO: 67278 - DNA, 20 bp, Artificial Sequence
  chemically synthesized
tacaaatatgtgattatcat

SEQ ID NO: 67279 - DNA, 20 bp, Artificial Sequence
  chemically synthesized
tgagactttaaaaaaaaaaa

SEQ ID NO: 67280 - DNA, 20 bp, Artificial Sequence
  chemically synthesized
aaaaaaaaaaaaaaacaaaa

SEQ ID NO: 67281 - DNA, 20 bp, Artificial Sequence
  chemically synthesized
cagaacttaaagcatattaa

SEQ ID NO: 67282 - DNA, 20 bp, Artificial Sequence
  chemically synthesized
tagttataaattccagtgta

SEQ ID NO: 67283 - DNA, 20 bp, Artificial Sequence
  chemically synthesized
caagagcaaatctcagccta

SEQ ID NO: 67284 - DNA, 20 bp, Artificial Sequence
  chemically synthesized
aattgctaagaatacagcac

SEQ ID NO: 67285 - DNA, 20 bp, Artificial Sequence
  chemically synthesized
aggtgctatggagaaaaaaa

SEQ ID NO: 67286 - DNA, 20 bp, Artificial Sequence
  chemically synthesized
tacatcatagagttgtaaga

SEQ ID NO: 67287 - DNA, 20 bp, Artificial Sequence
  chemically synthesized
aaggcaaggggtcagcctct

SEQ ID NO: 67288 - DNA, 20 bp, Artificial Sequence
  chemically synthesized
tctgaaaacatcctttcacg

SEQ ID NO: 67289 - DNA, 20 bp, Artificial Sequence
  chemically synthesized
ttaaacactgccactcaacc

SEQ ID NO: 67290 - DNA, 20 bp, Artificial Sequence
  chemically synthesized
ttcattcacaaatgaataca

SEQ ID NO: 67291 - DNA, 20 bp, Artificial Sequence
  chemically synthesized
tgtaatgggtcctgggcctg

SEQ ID NO: 67292 - DNA, 20 bp, Artificial Sequence
  chemically synthesized
aaatgtaacaggaactaagg

SEQ ID NO: 67293 - DNA, 20 bp, Artificial Sequence
  chemically synthesized
gcttgaatcataaataagaa

SEQ ID NO: 67294 - DNA, 20 bp, Artificial Sequence
  chemically synthesized
aagatttttttaaaaattaa

SEQ ID NO: 67295 - DNA, 20 bp, Artificial Sequence
  chemically synthesized
agtttgtgttttgctgtgga

SEQ ID NO: 67296 - DNA, 20 bp, Artificial Sequence
  chemically synthesized
cttctgagtattggtgtgag

SEQ ID NO: 67297 - DNA, 20 bp, Artificial Sequence
  chemically synthesized
actttatagatgatgatcct

SEQ ID NO: 67298 - DNA, 20 bp, Artificial Sequence
  chemically synthesized
atggagttagcgtgaggatg

SEQ ID NO: 67299 - DNA, 20 bp, Artificial Sequence
  chemically synthesized
tatgatggggtagcagacaa

SEQ ID NO: 67300 - DNA, 20 bp, Artificial Sequence
  chemically synthesized
taactgaagacagcagcaat

SEQ ID NO: 67301 - DNA, 20 bp, Artificial Sequence
  chemically synthesized
taattttttagtcacttagg

SEQ ID NO: 67302 - DNA, 20 bp, Artificial Sequence
  chemically synthesized
gaacaatcttatgagcctgt

SEQ ID NO: 67303 - DNA, 20 bp, Artificial Sequence
  chemically synthesized
acagagtgagaccctttctc

SEQ ID NO: 67304 - DNA, 20 bp, Artificial Sequence
  chemically synthesized
tctcaaaaacaaactaatta

SEQ ID NO: 67305 - DNA, 20 bp, Artificial Sequence
  chemically synthesized
gttgtgtttgctgtgtttgc

SEQ ID NO: 67306 - DNA, 20 bp, Artificial Sequence
  chemically synthesized
aaataattttatttatatta

SEQ ID NO: 67307 - DNA, 20 bp, Artificial Sequence
  chemically synthesized
atacagatgtatataaacta

SEQ ID NO: 67308 - DNA, 20 bp, Artificial Sequence
  chemically synthesized
atatcacttcttcacttaga

SEQ ID NO: 67309 - DNA, 20 bp, Artificial Sequence
  chemically synthesized
taggaaataataatggacca

SEQ ID NO: 67310 - DNA, 20 bp, Artificial Sequence
  chemically synthesized
acccatataaataacgtaga

SEQ ID NO: 67311 - DNA, 20 bp, Artificial Sequence
  chemically synthesized
acatacttattttttgtggt

SEQ ID NO: 67312 - DNA, 20 bp, Artificial Sequence
  chemically synthesized
aggatgcagtaatagattta

SEQ ID NO: 67313 - DNA, 20 bp, Artificial Sequence
  chemically synthesized
atgaataatgatcaatcgag

SEQ ID NO: 67314 - DNA, 20 bp, Artificial Sequence
  chemically synthesized
tgagtggattgatgtggaag

SEQ ID NO: 67315 - DNA, 20 bp, Artificial Sequence
  chemically synthesized
aaagacaaatgtgcaacatc

SEQ ID NO: 67316 - DNA, 20 bp, Artificial Sequence
  chemically synthesized
actcagaggtggataagaga

SEQ ID NO: 67317 - DNA, 20 bp, Artificial Sequence
  chemically synthesized
actccaagatagatttagat

SEQ ID NO: 67318 - DNA, 20 bp, Artificial Sequence
  chemically synthesized
atgatgaggagacatggaaa

SEQ ID NO: 67319 - DNA, 20 bp, Artificial Sequence
  chemically synthesized
atcccatatttacaaaaaat

SEQ ID NO: 67320 - DNA, 20 bp, Artificial Sequence
  chemically synthesized
gttatgaatataattaaaat

SEQ ID NO: 67321 - DNA, 20 bp, Artificial Sequence
  chemically synthesized
tgtcttcttataacaatcaa

SEQ ID NO: 67322 - DNA, 20 bp, Artificial Sequence
  chemically synthesized
atacatttgccatttttaca

SEQ ID NO: 67323 - DNA, 20 bp, Artificial Sequence
  chemically synthesized
ccaaacaacaaaggcaacca

SEQ ID NO: 67324 - DNA, 20 bp, Artificial Sequence
  chemically synthesized
actctgtatgccaactttgg

SEQ ID NO: 67325 - DNA, 20 bp, Artificial Sequence
  chemically synthesized
caagtttttgcattaattat

SEQ ID NO: 67326 - DNA, 20 bp, Artificial Sequence
  chemically synthesized
cagcagacaatgggaagaag

SEQ ID NO: 67327 - DNA, 20 bp, Artificial Sequence
  chemically synthesized
aggaaaaaaaagtgtggata

SEQ ID NO: 67328 - DNA, 20 bp, Artificial Sequence
  chemically synthesized
aattatgggcaaaatggaca

SEQ ID NO: 67329 - DNA, 20 bp, Artificial Sequence
  chemically synthesized
gcaatgaaacagtcataggc

SEQ ID NO: 67330 - DNA, 20 bp, Artificial Sequence
  chemically synthesized
catcaggccattttttacct

SEQ ID NO: 67331 - DNA, 20 bp, Artificial Sequence
  chemically synthesized
ctataaaaaataaaataaaa

SEQ ID NO: 67332 - DNA, 20 bp, Artificial Sequence
  chemically synthesized
ttttgtagcaggtttattgg

SEQ ID NO: 67333 - DNA, 20 bp, Artificial Sequence
  chemically synthesized
ttgcaccttttttattttat

SEQ ID NO: 67334 - DNA, 20 bp, Artificial Sequence
  chemically synthesized
actatgttcatatggatact

SEQ ID NO: 67335 - DNA, 20 bp, Artificial Sequence
  chemically synthesized
ttaaactatagtcgtgtttt

SEQ ID NO: 67336 - DNA, 20 bp, Artificial Sequence
  chemically synthesized
gcggatgcacagggttttat

SEQ ID NO: 67337 - DNA, 20 bp, Artificial Sequence
  chemically synthesized
ttaacatctgcagtctctag

SEQ ID NO: 67338 - DNA, 20 bp, Artificial Sequence
  chemically synthesized
aggcaggagaattgctttaa

SEQ ID NO: 67339 - DNA, 20 bp, Artificial Sequence
  chemically synthesized
aagttgatctgtatttacaa

SEQ ID NO: 67340 - DNA, 20 bp, Artificial Sequence
  chemically synthesized
tgtgagacaaaaagtgagta

SEQ ID NO: 67341 - DNA, 20 bp, Artificial Sequence
  chemically synthesized
gaccagctgggccaacatgg

SEQ ID NO: 67342 - DNA, 20 bp, Artificial Sequence
  chemically synthesized
agagaaaagaaaagtgagta

SEQ ID NO: 67343 - DNA, 20 bp, Artificial Sequence
  chemically synthesized
aaacacaggtttatctaacc

SEQ ID NO: 67344 - DNA, 20 bp, Artificial Sequence
  chemically synthesized
atttattctttctattgatt

SEQ ID NO: 67345 - DNA, 20 bp, Artificial Sequence
  chemically synthesized
tgtataaagatatctgcatt

SEQ ID NO: 67346 - DNA, 20 bp, Artificial Sequence
  chemically synthesized
tctaccctaaactcttatct

SEQ ID NO: 67347 - DNA, 20 bp, Artificial Sequence
  chemically synthesized
cctgtttatacttaggggaa

SEQ ID NO: 67348 - DNA, 20 bp, Artificial Sequence
  chemically synthesized
atattcaggtaagattttgc

SEQ ID NO: 67349 - DNA, 20 bp, Artificial Sequence
  chemically synthesized
agttctctttgtactcacag

SEQ ID NO: 67350 - DNA, 20 bp, Artificial Sequence
  chemically synthesized
tctttgtactcacagtaaaa

SEQ ID NO: 67351 - DNA, 20 bp, Artificial Sequence
  chemically synthesized
ttaaggttgaaggtatgcag

SEQ ID NO: 67352 - DNA, 20 bp, Artificial Sequence
  chemically synthesized
aagattttgtgtcaactaaa

SEQ ID NO: 67353 - DNA, 20 bp, Artificial Sequence
  chemically synthesized
cgtaaattgcaggttattga

SEQ ID NO: 67354 - DNA, 20 bp, Artificial Sequence
  chemically synthesized
tctttctcactaagcatgag

SEQ ID NO: 67355 - DNA, 20 bp, Artificial Sequence
  chemically synthesized
ttttaatacaaggacataca

SEQ ID NO: 67356 - DNA, 20 bp, Artificial Sequence
  chemically synthesized
atttttatgtcttcccaata

SEQ ID NO: 67357 - DNA, 20 bp, Artificial Sequence
  chemically synthesized
acagagcgagactccatctc

SEQ ID NO: 67358 - DNA, 20 bp, Artificial Sequence
  chemically synthesized
gcgagactccatctcaaaaa

SEQ ID NO: 67359 - DNA, 20 bp, Artificial Sequence
  chemically synthesized
actccatctcaaaaacaaaa

SEQ ID NO: 67360 - DNA, 20 bp, Artificial Sequence
  chemically synthesized
acaaaacaaaacaaagcaaa

SEQ ID NO: 67361 - DNA, 20 bp, Artificial Sequence
  chemically synthesized
gttaaatcatttctttaact

SEQ ID NO: 67362 - DNA, 20 bp, Artificial Sequence
  chemically synthesized
tcagccgagatcaaggcact

SEQ ID NO: 67363 - DNA, 20 bp, Artificial Sequence
  chemically synthesized
tacaacatgaataaacctta

SEQ ID NO: 67364 - DNA, 20 bp, Artificial Sequence
  chemically synthesized
atatattaccactataaaaa

SEQ ID NO: 67365 - DNA, 20 bp, Artificial Sequence
  chemically synthesized
aaatttattgtgaaaggttt

SEQ ID NO: 67366 - DNA, 20 bp, Artificial Sequence
  chemically synthesized
actaacataagcactcatga

SEQ ID NO: 67367 - DNA, 20 bp, Artificial Sequence
  chemically synthesized
tattttttggactgctattt

SEQ ID NO: 67368 - DNA, 20 bp, Artificial Sequence
  chemically synthesized
ttcagtgaatgacacccaag

SEQ ID NO: 67369 - DNA, 20 bp, Artificial Sequence
  chemically synthesized
aaataatattgaagtaattt

SEQ ID NO: 67370 - DNA, 20 bp, Artificial Sequence
  chemically synthesized
tgtatatagcaagacaaaca

SEQ ID NO: 67371 - DNA, 20 bp, Artificial Sequence
  chemically synthesized
gaaaatacgtacactaaaaa

SEQ ID NO: 67372 - DNA, 20 bp, Artificial Sequence
  chemically synthesized
aatttagagagtctctactg

SEQ ID NO: 67373 - DNA, 20 bp, Artificial Sequence
  chemically synthesized
gacattgtatcattttgaaa

SEQ ID NO: 67374 - DNA, 20 bp, Artificial Sequence
  chemically synthesized
atctggagtctatgaggaac

SEQ ID NO: 67375 - DNA, 20 bp, Artificial Sequence
  chemically synthesized
ctaaaacaaatttacaagaa

SEQ ID NO: 67376 - DNA, 20 bp, Artificial Sequence
  chemically synthesized
gtcattagaaaaatgcaaat

SEQ ID NO: 67377 - DNA, 20 bp, Artificial Sequence
  chemically synthesized
tcaatgatagagtggataaa

SEQ ID NO: 67378 - DNA, 20 bp, Artificial Sequence
  chemically synthesized
atcaaactaacacaggaaca

SEQ ID NO: 67379 - DNA, 20 bp, Artificial Sequence
  chemically synthesized
ataattcatctttatatggc

SEQ ID NO: 67380 - DNA, 20 bp, Artificial Sequence
  chemically synthesized
agttaagcattcttaatcta

SEQ ID NO: 67381 - DNA, 20 bp, Artificial Sequence
  chemically synthesized
atagacatagtgttttgtta

SEQ ID NO: 67382 - DNA, 20 bp, Artificial Sequence
  chemically synthesized
gatcatctcaatagactgag

SEQ ID NO: 67383 - DNA, 20 bp, Artificial Sequence
  chemically synthesized
attcaacatcccttcatgat

SEQ ID NO: 67384 - DNA, 20 bp, Artificial Sequence
  chemically synthesized
aagaataaaagccacgtatg

SEQ ID NO: 67385 - DNA, 20 bp, Artificial Sequence
  chemically synthesized
acgtatgaaaaacccataac

SEQ ID NO: 67386 - DNA, 20 bp, Artificial Sequence
  chemically synthesized
aagctggaactattctcctc

SEQ ID NO: 67387 - DNA, 20 bp, Artificial Sequence
  chemically synthesized
ttgttctttttattgaaatt

SEQ ID NO: 67388 - DNA, 20 bp, Artificial Sequence
  chemically synthesized
acaggtgaaaagaacaaaca

SEQ ID NO: 67389 - DNA, 20 bp, Artificial Sequence
  chemically synthesized
aatatatcttgcaaatcatg

SEQ ID NO: 67390 - DNA, 20 bp, Artificial Sequence
  chemically synthesized
ttaccataagggaatgaata

SEQ ID NO: 67391 - DNA, 20 bp, Artificial Sequence
  chemically synthesized
ttccatcaaatgtatcactg

SEQ ID NO: 67392 - DNA, 20 bp, Artificial Sequence
  chemically synthesized
cttttagtacacagtcacac

SEQ ID NO: 67393 - DNA, 20 bp, Artificial Sequence
  chemically synthesized
tgaagagcaaacatactctt

SEQ ID NO: 67394 - DNA, 20 bp, Artificial Sequence
  chemically synthesized
aattacaggcaggatggata

SEQ ID NO: 67395 - DNA, 20 bp, Artificial Sequence
  chemically synthesized
tttgcaacaacagtgataac

SEQ ID NO: 67396 - DNA, 20 bp, Artificial Sequence
  chemically synthesized
gtcctcaggtgattccagtg

SEQ ID NO: 67397 - DNA, 20 bp, Artificial Sequence
  chemically synthesized
tcgaaagatccttcatgctt

SEQ ID NO: 67398 - DNA, 20 bp, Artificial Sequence
  chemically synthesized
tgtttgtgagcttttcctta

SEQ ID NO: 67399 - DNA, 20 bp, Artificial Sequence
  chemically synthesized
gtctttagagaaattggcca

SEQ ID NO: 67400 - DNA, 20 bp, Artificial Sequence
  chemically synthesized
tcaacaggatccataatgct

SEQ ID NO: 67401 - DNA, 20 bp, Artificial Sequence
  chemically synthesized
tttttgtctactcttcagag

SEQ ID NO: 67402 - DNA, 20 bp, Artificial Sequence
  chemically synthesized
taagccctttctggataaac

SEQ ID NO: 67403 - DNA, 20 bp, Artificial Sequence
  chemically synthesized
aatccaagggtcccagatta

SEQ ID NO: 67404 - DNA, 20 bp, Artificial Sequence
  chemically synthesized
tacctctaggcagacctctg

SEQ ID NO: 67405 - DNA, 20 bp, Artificial Sequence
  chemically synthesized
gtgaggaaaatttgaaattc

SEQ ID NO: 67406 - DNA, 20 bp, Artificial Sequence
  chemically synthesized
attatttaagctaataattg

SEQ ID NO: 67407 - DNA, 20 bp, Artificial Sequence
  chemically synthesized
ttctagcagagccagaataa

SEQ ID NO: 67408 - DNA, 20 bp, Artificial Sequence
  chemically synthesized
tagcccaatcaagtgacatt

SEQ ID NO: 67409 - DNA, 20 bp, Artificial Sequence
  chemically synthesized
caggggattatggatgccaa

SEQ ID NO: 67410 - DNA, 20 bp, Artificial Sequence
  chemically synthesized
cctgaggagaaacaaacaaa

SEQ ID NO: 67411 - DNA, 20 bp, Artificial Sequence
  chemically synthesized
aaattatttcacacatactt

SEQ ID NO: 67412 - DNA, 20 bp, Artificial Sequence
  chemically synthesized
ggtgtgataggcataatttt

SEQ ID NO: 67413 - DNA, 20 bp, Artificial Sequence
  chemically synthesized
agcctgcaaacaaacaaaca

SEQ ID NO: 67414 - DNA, 20 bp, Artificial Sequence
  chemically synthesized
caaacaaacaaacaaaaaac

SEQ ID NO: 67415 - DNA, 20 bp, Artificial Sequence
  chemically synthesized
aacaaacaaaaaacaaaaac

SEQ ID NO: 67416 - DNA, 20 bp, Artificial Sequence
  chemically synthesized
gtaatttatgtataacaata

SEQ ID NO: 67417 - DNA, 20 bp, Artificial Sequence
  chemically synthesized
gcatcacccagactttagca

SEQ ID NO: 67418 - DNA, 20 bp, Artificial Sequence
  chemically synthesized
ggctctaactcattgtagta

SEQ ID NO: 67419 - DNA, 20 bp, Artificial Sequence
  chemically synthesized
ataggtggatgtaagataga

SEQ ID NO: 67420 - DNA, 20 bp, Artificial Sequence
  chemically synthesized
tcatgtaagcacccatcaca

SEQ ID NO: 67421 - DNA, 20 bp, Artificial Sequence
  chemically synthesized
ccatattttctttgcaaaaa

SEQ ID NO: 67422 - DNA, 20 bp, Artificial Sequence
  chemically synthesized
gcggcttcctccaatcagtt

SEQ ID NO: 67423 - DNA, 20 bp, Artificial Sequence
  chemically synthesized
tttagattgaactgaaacat

SEQ ID NO: 67424 - DNA, 20 bp, Artificial Sequence
  chemically synthesized
atctgttgtttcttgacttt

SEQ ID NO: 67425 - DNA, 20 bp, Artificial Sequence
  chemically synthesized
aggatttaggctataaaatc

SEQ ID NO: 67426 - DNA, 20 bp, Artificial Sequence
  chemically synthesized
ttacaatgggttttgaatag

SEQ ID NO: 67427 - DNA, 20 bp, Artificial Sequence
  chemically synthesized
tcaactgaaactaggctgaa

SEQ ID NO: 67428 - DNA, 20 bp, Artificial Sequence
  chemically synthesized
tccttgtcactgagtctcag

SEQ ID NO: 67429 - DNA, 20 bp, Artificial Sequence
  chemically synthesized
ttgaagtcacttgcctgatg

SEQ ID NO: 67430 - DNA, 20 bp, Artificial Sequence
  chemically synthesized
atattaaatttccccatcaa

SEQ ID NO: 67431 - DNA, 20 bp, Artificial Sequence
  chemically synthesized
gtttggttttatgaatgatt

SEQ ID NO: 67432 - DNA, 20 bp, Artificial Sequence
  chemically synthesized
tgaatgattgaaaacaggac

SEQ ID NO: 67433 - DNA, 20 bp, Artificial Sequence
  chemically synthesized
gacatggcgtgacaaggata

SEQ ID NO: 67434 - DNA, 20 bp, Artificial Sequence
  chemically synthesized
attctgtaaaatgatcgggg

SEQ ID NO: 67435 - DNA, 20 bp, Artificial Sequence
  chemically synthesized
aatatgtggaacctgctttc

SEQ ID NO: 67436 - DNA, 20 bp, Artificial Sequence
  chemically synthesized
aatccaatcactgtgacata

SEQ ID NO: 67437 - DNA, 20 bp, Artificial Sequence
  chemically synthesized
aagagggttgcagatggcaa

SEQ ID NO: 67438 - DNA, 20 bp, Artificial Sequence
  chemically synthesized
atgagcttcctccaagcctg

SEQ ID NO: 67439 - DNA, 20 bp, Artificial Sequence
  chemically synthesized
atataaatgcaagtttaaca

SEQ ID NO: 67440 - DNA, 20 bp, Artificial Sequence
  chemically synthesized
actgagacctcaatacaaaa

SEQ ID NO: 67441 - DNA, 20 bp, Artificial Sequence
  chemically synthesized
gaccgtatacagacctagag

SEQ ID NO: 67442 - DNA, 20 bp, Artificial Sequence
  chemically synthesized
gcatgactggcatttgataa

SEQ ID NO: 67443 - DNA, 20 bp, Artificial Sequence
  chemically synthesized
tgaaaaaaagagaaaaatag

SEQ ID NO: 67444 - DNA, 20 bp, Artificial Sequence
  chemically synthesized
atattcaacctccaacagag

SEQ ID NO: 67445 - DNA, 20 bp, Artificial Sequence
  chemically synthesized
tgcaggaaccaaggcaaaaa

SEQ ID NO: 67446 - DNA, 20 bp, Artificial Sequence
  chemically synthesized
taaagactccctgacatctc

SEQ ID NO: 67447 - DNA, 20 bp, Artificial Sequence
  chemically synthesized
agaattagtttctcattaat

SEQ ID NO: 67448 - DNA, 20 bp, Artificial Sequence
  chemically synthesized
aagcactcagttttcaatat

SEQ ID NO: 67449 - DNA, 20 bp, Artificial Sequence
  chemically synthesized
ttaacaatgaatacctataa

SEQ ID NO: 67450 - DNA, 20 bp, Artificial Sequence
  chemically synthesized
aaagtcaaacacaggctcct

SEQ ID NO: 67451 - DNA, 20 bp, Artificial Sequence
  chemically synthesized
tacttctctgaaacaataac

SEQ ID NO: 67452 - DNA, 20 bp, Artificial Sequence
  chemically synthesized
aaaaaattatccactcttta

SEQ ID NO: 67453 - DNA, 20 bp, Artificial Sequence
  chemically synthesized
aacccatttatctatagcat

SEQ ID NO: 67454 - DNA, 20 bp, Artificial Sequence
  chemically synthesized
ctatgagaaatgtgttcagt

SEQ ID NO: 67455 - DNA, 20 bp, Artificial Sequence
  chemically synthesized
aataatattgataataattt

SEQ ID NO: 67456 - DNA, 20 bp, Artificial Sequence
  chemically synthesized
tgtgcaaaatagcagagttg

SEQ ID NO: 67457 - DNA, 20 bp, Artificial Sequence
  chemically synthesized
ggatgtataaataacacaga

SEQ ID NO: 67458 - DNA, 20 bp, Artificial Sequence
  chemically synthesized
agagactcagccactcacag

SEQ ID NO: 67459 - DNA, 20 bp, Artificial Sequence
  chemically synthesized
gctctgggaggatatccaca

SEQ ID NO: 67460 - DNA, 20 bp, Artificial Sequence
  chemically synthesized
atgcatccttgctaacactg

SEQ ID NO: 67461 - DNA, 20 bp, Artificial Sequence
  chemically synthesized
gattttatattaatactttc

SEQ ID NO: 67462 - DNA, 20 bp, Artificial Sequence
  chemically synthesized
gctgagggtcctgttagaag

SEQ ID NO: 67463 - DNA, 20 bp, Artificial Sequence
  chemically synthesized
acagaaaggacatccacacc

SEQ ID NO: 67464 - DNA, 20 bp, Artificial Sequence
  chemically synthesized
catcaaagaccaaaggtaga

SEQ ID NO: 67465 - DNA, 20 bp, Artificial Sequence
  chemically synthesized
ataaaaccacaaagatgggg

SEQ ID NO: 67466 - DNA, 20 bp, Artificial Sequence
  chemically synthesized
gatggggaaaaacagagcag

SEQ ID NO: 67467 - DNA, 20 bp, Artificial Sequence
  chemically synthesized
gaacccatggcaaaaaagtt

SEQ ID NO: 67468 - DNA, 20 bp, Artificial Sequence
  chemically synthesized
ttaaaggacctgatggagct

SEQ ID NO: 67469 - DNA, 20 bp, Artificial Sequence
  chemically synthesized
ggcagaatggaaccaagttg

SEQ ID NO: 67470 - DNA, 20 bp, Artificial Sequence
  chemically synthesized
caaccggtaccagccactgc

SEQ ID NO: 67471 - DNA, 20 bp, Artificial Sequence
  chemically synthesized
gaagatctaccaagaaaatg

SEQ ID NO: 67472 - DNA, 20 bp, Artificial Sequence
  chemically synthesized
gttgcaatcctcatctctga

SEQ ID NO: 67473 - DNA, 20 bp, Artificial Sequence
  chemically synthesized
tcaggattaagaaactcact

SEQ ID NO: 67474 - DNA, 20 bp, Artificial Sequence
  chemically synthesized
tgaaggaaatagagacacaa

SEQ ID NO: 67475 - DNA, 20 bp, Artificial Sequence
  chemically synthesized
taattaatagcttaccaacc

SEQ ID NO: 67476 - DNA, 20 bp, Artificial Sequence
  chemically synthesized
ccctgatggacatcgatgca

SEQ ID NO: 67477 - DNA, 20 bp, Artificial Sequence
  chemically synthesized
atataaacagaaccaaagac

SEQ ID NO: 67478 - DNA, 20 bp, Artificial Sequence
  chemically synthesized
attcaacaacccttcatgct

SEQ ID NO: 67479 - DNA, 20 bp, Artificial Sequence
  chemically synthesized
caatatcatactgaatggac

SEQ ID NO: 67480 - DNA, 20 bp, Artificial Sequence
  chemically synthesized
aaactggaagcattcccttt

SEQ ID NO: 67481 - DNA, 20 bp, Artificial Sequence
  chemically synthesized
atgacacgattgtatatcta

SEQ ID NO: 67482 - DNA, 20 bp, Artificial Sequence
  chemically synthesized
actttcttcacagaattgga

SEQ ID NO: 67483 - DNA, 20 bp, Artificial Sequence
  chemically synthesized
tactacaaggctacagtaac

SEQ ID NO: 67484 - DNA, 20 bp, Artificial Sequence
  chemically synthesized
aaacagcatggtactggtac

SEQ ID NO: 67485 - DNA, 20 bp, Artificial Sequence
  chemically synthesized
tctttgacaaacctgacaaa

SEQ ID NO: 67486 - DNA, 20 bp, Artificial Sequence
  chemically synthesized
tatttaataaatggtgctgg

SEQ ID NO: 67487 - DNA, 20 bp, Artificial Sequence
  chemically synthesized
acagacttaaatgttagact

SEQ ID NO: 67488 - DNA, 20 bp, Artificial Sequence
  chemically synthesized
aatgttagactgaaaaccat

SEQ ID NO: 67489 - DNA, 20 bp, Artificial Sequence
  chemically synthesized
aaaccataaaaactctggaa

SEQ ID NO: 67490 - DNA, 20 bp, Artificial Sequence
  chemically synthesized
atgggcaaggacttcatgtc

SEQ ID NO: 67491 - DNA, 20 bp, Artificial Sequence
  chemically synthesized
ctcaaacaaatttacaagaa

SEQ ID NO: 67492 - DNA, 20 bp, Artificial Sequence
  chemically synthesized
gccatcagagaaatacaaat

SEQ ID NO: 67493 - DNA, 20 bp, Artificial Sequence
  chemically synthesized
acaatgatagactggattaa

SEQ ID NO: 67494 - DNA, 20 bp, Artificial Sequence
  chemically synthesized
cagcaaactatcgcaaggac

SEQ ID NO: 67495 - DNA, 20 bp, Artificial Sequence
  chemically synthesized
cacgttgtgcaaatgtaccc

SEQ ID NO: 67496 - DNA, 20 bp, Artificial Sequence
  chemically synthesized
gggtatagactaacagaaag

SEQ ID NO: 67497 - DNA, 20 bp, Artificial Sequence
  chemically synthesized
gggattggggcatgaaggtt

SEQ ID NO: 67498 - DNA, 20 bp, Artificial Sequence
  chemically synthesized
aaagagaccctgagtgtctt

SEQ ID NO: 67499 - DNA, 20 bp, Artificial Sequence
  chemically synthesized
attttcatgaggattctatt

SEQ ID NO: 67500 - DNA, 20 bp, Artificial Sequence
  chemically synthesized
gaccaccaatcttgacttca

SEQ ID NO: 67501 - DNA, 20 bp, Artificial Sequence
  chemically synthesized
ggcaaataagggacactcaa

SEQ ID NO: 67502 - DNA, 20 bp, Artificial Sequence
  chemically synthesized
actggtgtttgccagctgtg

SEQ ID NO: 67503 - DNA, 20 bp, Artificial Sequence
  chemically synthesized
cacaaagcatattgatacac

SEQ ID NO: 67504 - DNA, 20 bp, Artificial Sequence
  chemically synthesized
ctagctctgacaaagaaaat

SEQ ID NO: 67505 - DNA, 20 bp, Artificial Sequence
  chemically synthesized
ttactcaaaatattatgctt

SEQ ID NO: 67506 - DNA, 20 bp, Artificial Sequence
  chemically synthesized
tgctttaaaactgaaggaag

SEQ ID NO: 67507 - DNA, 20 bp, Artificial Sequence
  chemically synthesized
ttacatctattatacctcag

SEQ ID NO: 67508 - DNA, 20 bp, Artificial Sequence
  chemically synthesized
tcacattaggttaatttttt

SEQ ID NO: 67509 - DNA, 20 bp, Artificial Sequence
  chemically synthesized
tagagacattgatgaaactg

SEQ ID NO: 67510 - DNA, 20 bp, Artificial Sequence
  chemically synthesized
tactgatattaaaaatagag

SEQ ID NO: 67511 - DNA, 20 bp, Artificial Sequence
  chemically synthesized
gagctctggcacattttaca

SEQ ID NO: 67512 - DNA, 20 bp, Artificial Sequence
  chemically synthesized
acagaacacccccaaatggc

SEQ ID NO: 67513 - DNA, 20 bp, Artificial Sequence
  chemically synthesized
ccaaaacaatcttgagaaag

SEQ ID NO: 67514 - DNA, 20 bp, Artificial Sequence
  chemically synthesized
tcctcaacaaatagtgttgg

SEQ ID NO: 67515 - DNA, 20 bp, Artificial Sequence
  chemically synthesized
aaatgtaagacctgaaatca

SEQ ID NO: 67516 - DNA, 20 bp, Artificial Sequence
  chemically synthesized
ggccaggtactcctctgaga

SEQ ID NO: 67517 - DNA, 20 bp, Artificial Sequence
  chemically synthesized
agggtcctgtctgttagaag

SEQ ID NO: 67518 - DNA, 20 bp, Artificial Sequence
  chemically synthesized
acagaaaggacatccacacc

SEQ ID NO: 67519 - DNA, 20 bp, Artificial Sequence
  chemically synthesized
tacaaccacaaagttgggga

SEQ ID NO: 67520 - DNA, 20 bp, Artificial Sequence
  chemically synthesized
ttggggaaaaaacagagcag

SEQ ID NO: 67521 - DNA, 20 bp, Artificial Sequence
  chemically synthesized
aaaccaaaggcaaagaagat

SEQ ID NO: 67522 - DNA, 20 bp, Artificial Sequence
  chemically synthesized
gggagaatcgaaccaagttg

SEQ ID NO: 67523 - DNA, 20 bp, Artificial Sequence
  chemically synthesized
gaagatctaccaagcaaatg

SEQ ID NO: 67524 - DNA, 20 bp, Artificial Sequence
  chemically synthesized
gttgcaatcctagtctctga

SEQ ID NO: 67525 - DNA, 20 bp, Artificial Sequence
  chemically synthesized
tcaggattaagaaactcact

SEQ ID NO: 67526 - DNA, 20 bp, Artificial Sequence
  chemically synthesized
ctgaaggaaacagagacaca

SEQ ID NO: 67527 - DNA, 20 bp, Artificial Sequence
  chemically synthesized
tggttttttgaaaggatcaa

SEQ ID NO: 67528 - DNA, 20 bp, Artificial Sequence
  chemically synthesized
atataaacagaaccaaagac

SEQ ID NO: 67529 - DNA, 20 bp, Artificial Sequence
  chemically synthesized
attcaacaacccttcatgct

SEQ ID NO: 67530 - DNA, 20 bp, Artificial Sequence
  chemically synthesized
caatatcatactgaatgggc

SEQ ID NO: 67531 - DNA, 20 bp, Artificial Sequence
  chemically synthesized
acgacatgattgtatatcta

SEQ ID NO: 67532 - DNA, 20 bp, Artificial Sequence
  chemically synthesized
ttcagcaaagcctcaggata

SEQ ID NO: 67533 - DNA, 20 bp, Artificial Sequence
  chemically synthesized
gattttcttcacagaattgg

SEQ ID NO: 67534 - DNA, 20 bp, Artificial Sequence
  chemically synthesized
tactacaaggctacagtaac

SEQ ID NO: 67535 - DNA, 20 bp, Artificial Sequence
  chemically synthesized
aaacagcatgttactggtac

SEQ ID NO: 67536 - DNA, 20 bp, Artificial Sequence
  chemically synthesized
ctacaactatctgatctttg

SEQ ID NO: 67537 - DNA, 20 bp, Artificial Sequence
  chemically synthesized
tgatctttgaaaaacctgag

SEQ ID NO: 67538 - DNA, 20 bp, Artificial Sequence
  chemically synthesized
aaagacttaaacattagacc

SEQ ID NO: 67539 - DNA, 20 bp, Artificial Sequence
  chemically synthesized
aacattagacctaaaaccat

SEQ ID NO: 67540 - DNA, 20 bp, Artificial Sequence
  chemically synthesized
aaaccataaaaaccctagaa

SEQ ID NO: 67541 - DNA, 20 bp, Artificial Sequence
  chemically synthesized
atgggcaaggacttcatgtc

SEQ ID NO: 67542 - DNA, 20 bp, Artificial Sequence
  chemically synthesized
ctcaaacaaatttacaagaa

SEQ ID NO: 67543 - DNA, 20 bp, Artificial Sequence
  chemically synthesized
tgaacagacacttctcaaaa

SEQ ID NO: 67544 - DNA, 20 bp, Artificial Sequence
  chemically synthesized
gccatcagagaaatgcaaat

SEQ ID NO: 67545 - DNA, 20 bp, Artificial Sequence
  chemically synthesized
agtaaactatcgcaaggaca

SEQ ID NO: 67546 - DNA, 20 bp, Artificial Sequence
  chemically synthesized
attcagtcaataattcctca

SEQ ID NO: 67547 - DNA, 20 bp, Artificial Sequence
  chemically synthesized
caccagaatcatgaaccaaa

SEQ ID NO: 67548 - DNA, 20 bp, Artificial Sequence
  chemically synthesized
tcaaaatatgcaaaatacac

SEQ ID NO: 67549 - DNA, 20 bp, Artificial Sequence
  chemically synthesized
taaaaatctgaaaaagctaa

SEQ ID NO: 67550 - DNA, 20 bp, Artificial Sequence
  chemically synthesized
tccccctggtggctacattg

SEQ ID NO: 67551 - DNA, 20 bp, Artificial Sequence
  chemically synthesized
ctggatagaggttccttaaa

SEQ ID NO: 67552 - DNA, 20 bp, Artificial Sequence
  chemically synthesized
caaacaatattacatgcaat

SEQ ID NO: 67553 - DNA, 20 bp, Artificial Sequence
  chemically synthesized
aggactattttgtgatatga

SEQ ID NO: 67554 - DNA, 20 bp, Artificial Sequence
  chemically synthesized
ccggaaaatcttatagttct

SEQ ID NO: 67555 - DNA, 20 bp, Artificial Sequence
  chemically synthesized
tactacatccgacctctctg

SEQ ID NO: 67556 - DNA, 20 bp, Artificial Sequence
  chemically synthesized
gcagcagatgtctgtgtagc

SEQ ID NO: 67557 - DNA, 20 bp, Artificial Sequence
  chemically synthesized
ccagagccagagaaagaaca

SEQ ID NO: 67558 - DNA, 20 bp, Artificial Sequence
  chemically synthesized
cctctccttactctcatcag

SEQ ID NO: 67559 - DNA, 20 bp, Artificial Sequence
  chemically synthesized
aaatcctcctctatcctact

SEQ ID NO: 67560 - DNA, 20 bp, Artificial Sequence
  chemically synthesized
cgcaagtgtttactggttgg

SEQ ID NO: 67561 - DNA, 20 bp, Artificial Sequence
  chemically synthesized
agcaataaatatagaagaat

SEQ ID NO: 67562 - DNA, 20 bp, Artificial Sequence
  chemically synthesized
agatgggtttggaaaggtgc

SEQ ID NO: 67563 - DNA, 20 bp, Artificial Sequence
  chemically synthesized
ataggagctactgaagtact

SEQ ID NO: 67564 - DNA, 20 bp, Artificial Sequence
  chemically synthesized
ttagctaagtgggttttaaa

SEQ ID NO: 67565 - DNA, 20 bp, Artificial Sequence
  chemically synthesized
ttgccattgaaagtaatggt

SEQ ID NO: 67566 - DNA, 20 bp, Artificial Sequence
  chemically synthesized
taaaccttttttacttcatt

SEQ ID NO: 67567 - DNA, 20 bp, Artificial Sequence
  chemically synthesized
tgatatggagaagtctaaca

SEQ ID NO: 67568 - DNA, 20 bp, Artificial Sequence
  chemically synthesized
gaaataattgaaatacagag

SEQ ID NO: 67569 - DNA, 20 bp, Artificial Sequence
  chemically synthesized
cagtaaatgagtcctggggc

SEQ ID NO: 67570 - DNA, 20 bp, Artificial Sequence
  chemically synthesized
tgtctggagttgtggcttta

SEQ ID NO: 67571 - DNA, 20 bp, Artificial Sequence
  chemically synthesized
aaggtcatcatcaatgtaac

SEQ ID NO: 67572 - DNA, 20 bp, Artificial Sequence
  chemically synthesized
aaactaaaatgaaactaaat

SEQ ID NO: 67573 - DNA, 20 bp, Artificial Sequence
  chemically synthesized
cccgattcaaaaataaaaag

SEQ ID NO: 67574 - DNA, 20 bp, Artificial Sequence
  chemically synthesized
gtacaggtaataacatattt

SEQ ID NO: 67575 - DNA, 20 bp, Artificial Sequence
  chemically synthesized
acagagcaagactccttctc

SEQ ID NO: 67576 - DNA, 20 bp, Artificial Sequence
  chemically synthesized
gtattttcacataccagaat

SEQ ID NO: 67577 - DNA, 20 bp, Artificial Sequence
  chemically synthesized
aatttaatttgccttttata

SEQ ID NO: 67578 - DNA, 20 bp, Artificial Sequence
  chemically synthesized
ataaatatttgtatcaaaag

SEQ ID NO: 67579 - DNA, 20 bp, Artificial Sequence
  chemically synthesized
atcaggaaaagatagcaaca

SEQ ID NO: 67580 - DNA, 20 bp, Artificial Sequence
  chemically synthesized
taagagttatagattcacag

SEQ ID NO: 67581 - DNA, 20 bp, Artificial Sequence
  chemically synthesized
aacaacaacaacaaaccaaa

SEQ ID NO: 67582 - DNA, 20 bp, Artificial Sequence
  chemically synthesized
tgaaattgatactgtatttg

SEQ ID NO: 67583 - DNA, 20 bp, Artificial Sequence
  chemically synthesized
gccatatggaaggattgtcc

SEQ ID NO: 67584 - DNA, 20 bp, Artificial Sequence
  chemically synthesized
atgacgtgattgcatatcta

SEQ ID NO: 67585 - DNA, 20 bp, Artificial Sequence
  chemically synthesized
actttcttcacagaattgga

SEQ ID NO: 67586 - DNA, 20 bp, Artificial Sequence
  chemically synthesized
tactacaaggctacagtaac

SEQ ID NO: 67587 - DNA, 20 bp, Artificial Sequence
  chemically synthesized
aaacagcatagtactggtac

SEQ ID NO: 67588 - DNA, 20 bp, Artificial Sequence
  chemically synthesized
agagatatagaccaatggaa

SEQ ID NO: 67589 - DNA, 20 bp, Artificial Sequence
  chemically synthesized
tgatctttgacaaacctgag

SEQ ID NO: 67590 - DNA, 20 bp, Artificial Sequence
  chemically synthesized
tgtttaataaatggtgctgg

SEQ ID NO: 67591 - DNA, 20 bp, Artificial Sequence
  chemically synthesized
aaagacttaaatgttagacc

SEQ ID NO: 67592 - DNA, 20 bp, Artificial Sequence
  chemically synthesized
aatgttagacctaaaaccat

SEQ ID NO: 67593 - DNA, 20 bp, Artificial Sequence
  chemically synthesized
aaaccataaaaactctagaa

SEQ ID NO: 67594 - DNA, 20 bp, Artificial Sequence
  chemically synthesized
atgggcatggacttcatgtc

SEQ ID NO: 67595 - DNA, 20 bp, Artificial Sequence
  chemically synthesized
aaacaaatttacaagagaaa

SEQ ID NO: 67596 - DNA, 20 bp, Artificial Sequence
  chemically synthesized
gccatcagagaaatgcaaat

SEQ ID NO: 67597 - DNA, 20 bp, Artificial Sequence
  chemically synthesized
caccttgtgcacatgtaccc

SEQ ID NO: 67598 - DNA, 20 bp, Artificial Sequence
  chemically synthesized
tcctaaattggtggcagatg

SEQ ID NO: 67599 - DNA, 20 bp, Artificial Sequence
  chemically synthesized
aattggtggcagatggaaaa

SEQ ID NO: 67600 - DNA, 20 bp, Artificial Sequence
  chemically synthesized
tggcagatggaaaacaaaac

SEQ ID NO: 67601 - DNA, 20 bp, Artificial Sequence
  chemically synthesized
gtattaacatctttatcttt

SEQ ID NO: 67602 - DNA, 20 bp, Artificial Sequence
  chemically synthesized
aagaaagaaaaaaaaaggaa

SEQ ID NO: 67603 - DNA, 20 bp, Artificial Sequence
  chemically synthesized
gatctccttgaaagagatct

SEQ ID NO: 67604 - DNA, 20 bp, Artificial Sequence
  chemically synthesized
aacccaagataatatgatgg

SEQ ID NO: 67605 - DNA, 20 bp, Artificial Sequence
  chemically synthesized
agagagtgagcaagaagagg

SEQ ID NO: 67606 - DNA, 20 bp, Artificial Sequence
  chemically synthesized
gaagagggaaaactgcctta

SEQ ID NO: 67607 - DNA, 20 bp, Artificial Sequence
  chemically synthesized
ataaaaccatcagatctcat

SEQ ID NO: 67608 - DNA, 20 bp, Artificial Sequence
  chemically synthesized
ccagatctgtcttccccatc

SEQ ID NO: 67609 - DNA, 20 bp, Artificial Sequence
  chemically synthesized
ccaatgacttcctttatcca

SEQ ID NO: 67610 - DNA, 20 bp, Artificial Sequence
  chemically synthesized
ctgcaggaggttgatgtgaa

SEQ ID NO: 67611 - DNA, 20 bp, Artificial Sequence
  chemically synthesized
ctaacgtcccctgatgaagc

SEQ ID NO: 67612 - DNA, 20 bp, Artificial Sequence
  chemically synthesized
gtaacattttagatagaggg

SEQ ID NO: 67613 - DNA, 20 bp, Artificial Sequence
  chemically synthesized
ggctcagagttgtcacaaag

SEQ ID NO: 67614 - DNA, 20 bp, Artificial Sequence
  chemically synthesized
ttgaatcagtggagcatagt

SEQ ID NO: 67615 - DNA, 20 bp, Artificial Sequence
  chemically synthesized
taggttataatatgtgctta

SEQ ID NO: 67616 - DNA, 20 bp, Artificial Sequence
  chemically synthesized
acttccttcagtataacatg

SEQ ID NO: 67617 - DNA, 20 bp, Artificial Sequence
  chemically synthesized
gagcctcagtttcctaattt

SEQ ID NO: 67618 - DNA, 20 bp, Artificial Sequence
  chemically synthesized
aaaatgctctttttagatta

SEQ ID NO: 67619 - DNA, 20 bp, Artificial Sequence
  chemically synthesized
attgttcaatatcacacaac

SEQ ID NO: 67620 - DNA, 20 bp, Artificial Sequence
  chemically synthesized
agcaggtggggcatgcttcc

SEQ ID NO: 67621 - DNA, 20 bp, Artificial Sequence
  chemically synthesized
accaggtccagcatcacagt

SEQ ID NO: 67622 - DNA, 20 bp, Artificial Sequence
  chemically synthesized
attttcattcttcctggaat

SEQ ID NO: 67623 - DNA, 20 bp, Artificial Sequence
  chemically synthesized
agtgtgtggctatcttaggg

SEQ ID NO: 67624 - DNA, 20 bp, Artificial Sequence
  chemically synthesized
ccaccctataatgttttttt

SEQ ID NO: 67625 - DNA, 20 bp, Artificial Sequence
  chemically synthesized
ttattactacttcacaagga

SEQ ID NO: 67626 - DNA, 20 bp, Artificial Sequence
  chemically synthesized
atatttattgctttcttggc

SEQ ID NO: 67627 - DNA, 20 bp, Artificial Sequence
  chemically synthesized
gaacataaatttatattggc

SEQ ID NO: 67628 - DNA, 20 bp, Artificial Sequence
  chemically synthesized
tatatatatttttttgcatg

SEQ ID NO: 67629 - DNA, 20 bp, Artificial Sequence
  chemically synthesized
cagagctagacctcatttct

SEQ ID NO: 67630 - DNA, 20 bp, Artificial Sequence
  chemically synthesized
acaaagaaacaacaacaaaa

SEQ ID NO: 67631 - DNA, 20 bp, Artificial Sequence
  chemically synthesized
cctacaacaagtagccttta

SEQ ID NO: 67632 - DNA, 20 bp, Artificial Sequence
  chemically synthesized
tgtacatttctcttttcttt

SEQ ID NO: 67633 - DNA, 20 bp, Artificial Sequence
  chemically synthesized
agttgtgtggggatgagctc

SEQ ID NO: 67634 - DNA, 20 bp, Artificial Sequence
  chemically synthesized
caaaacggggcatacagatc

SEQ ID NO: 67635 - DNA, 20 bp, Artificial Sequence
  chemically synthesized
atctatcacacataagatag

SEQ ID NO: 67636 - DNA, 20 bp, Artificial Sequence
  chemically synthesized
agagagttaataccttggaa

SEQ ID NO: 67637 - DNA, 20 bp, Artificial Sequence
  chemically synthesized
tccaagcaatagatttattt

SEQ ID NO: 67638 - DNA, 20 bp, Artificial Sequence
  chemically synthesized
tctacatcttacaaacacat

SEQ ID NO: 67639 - DNA, 20 bp, Artificial Sequence
  chemically synthesized
ccgattttcattttcattgt

SEQ ID NO: 67640 - DNA, 20 bp, Artificial Sequence
  chemically synthesized
gagcaatgtcaattaaaaaa

SEQ ID NO: 67641 - DNA, 20 bp, Artificial Sequence
  chemically synthesized
cagttttgttgatcctttca

SEQ ID NO: 67642 - DNA, 20 bp, Artificial Sequence
  chemically synthesized
ctatttggccatcttggctc

SEQ ID NO: 67643 - DNA, 20 bp, Artificial Sequence
  chemically synthesized
aatattttctgcacagcaaa

SEQ ID NO: 67644 - DNA, 20 bp, Artificial Sequence
  chemically synthesized
atcatcaggaaaatgcaaat

SEQ ID NO: 67645 - DNA, 20 bp, Artificial Sequence
  chemically synthesized
aagttaacatagccattata

SEQ ID NO: 67646 - DNA, 20 bp, Artificial Sequence
  chemically synthesized
cttcatgttatttccactct

SEQ ID NO: 67647 - DNA, 20 bp, Artificial Sequence
  chemically synthesized
gaatgtgtggagagtaattc

SEQ ID NO: 67648 - DNA, 20 bp, Artificial Sequence
  chemically synthesized
ctcaaattatctgctcttgg

SEQ ID NO: 67649 - DNA, 20 bp, Artificial Sequence
  chemically synthesized
ctttctttctatgttgatag

SEQ ID NO: 67650 - DNA, 20 bp, Artificial Sequence
  chemically synthesized
tctagtcccagaaggaggct

SEQ ID NO: 67651 - DNA, 20 bp, Artificial Sequence
  chemically synthesized
caaattttgctcttgacaga

SEQ ID NO: 67652 - DNA, 20 bp, Artificial Sequence
  chemically synthesized
tcacaggatgcatgtgagaa

SEQ ID NO: 67653 - DNA, 20 bp, Artificial Sequence
  chemically synthesized
ccacttaaagatgagtggac

SEQ ID NO: 67654 - DNA, 20 bp, Artificial Sequence
  chemically synthesized
aaaccaaactgtttaattcc

SEQ ID NO: 67655 - DNA, 20 bp, Artificial Sequence
  chemically synthesized
caaatctgaatggcagagga

SEQ ID NO: 67656 - DNA, 20 bp, Artificial Sequence
  chemically synthesized
ggtcataaagaccttgctga

SEQ ID NO: 67657 - DNA, 20 bp, Artificial Sequence
  chemically synthesized
ccagttcacaatgaaataac

SEQ ID NO: 67658 - DNA, 20 bp, Artificial Sequence
  chemically synthesized
caccaagtccaggcagggac

SEQ ID NO: 67659 - DNA, 20 bp, Artificial Sequence
  chemically synthesized
tgtatcaatatgctttgtga

SEQ ID NO: 67660 - DNA, 20 bp, Artificial Sequence
  chemically synthesized
tatttactaaaatcatttaa

SEQ ID NO: 67661 - DNA, 20 bp, Artificial Sequence
  chemically synthesized
ttctttctgcattcacactc

SEQ ID NO: 67662 - DNA, 20 bp, Artificial Sequence
  chemically synthesized
caccatagcttgaagtaaaa

SEQ ID NO: 67663 - DNA, 20 bp, Artificial Sequence
  chemically synthesized
agcttgaagtaaaaaaaaac

SEQ ID NO: 67664 - DNA, 20 bp, Artificial Sequence
  chemically synthesized
aaaaaaaaacaaaaaccaaa

SEQ ID NO: 67665 - DNA, 20 bp, Artificial Sequence
  chemically synthesized
tactgctgcatcatgacttg

SEQ ID NO: 67666 - DNA, 20 bp, Artificial Sequence
  chemically synthesized
cagactaatcattctgttcg

SEQ ID NO: 67667 - DNA, 20 bp, Artificial Sequence
  chemically synthesized
gacacttccagcaatagaaa

SEQ ID NO: 67668 - DNA, 20 bp, Artificial Sequence
  chemically synthesized
caattttgttgatctttttg

SEQ ID NO: 67669 - DNA, 20 bp, Artificial Sequence
  chemically synthesized
atttgaaatgacacaccact

SEQ ID NO: 67670 - DNA, 20 bp, Artificial Sequence
  chemically synthesized
tcacacacagccaagttgag

SEQ ID NO: 67671 - DNA, 20 bp, Artificial Sequence
  chemically synthesized
tctttcttttaaaattaatt

SEQ ID NO: 67672 - DNA, 20 bp, Artificial Sequence
  chemically synthesized
atgtgagttaaattacctga

SEQ ID NO: 67673 - DNA, 20 bp, Artificial Sequence
  chemically synthesized
tccaacaagaccattgcaaa

SEQ ID NO: 67674 - DNA, 20 bp, Artificial Sequence
  chemically synthesized
aatcatataacccagaaaat

SEQ ID NO: 67675 - DNA, 20 bp, Artificial Sequence
  chemically synthesized
cagatataaagattatatgg

SEQ ID NO: 67676 - DNA, 20 bp, Artificial Sequence
  chemically synthesized
atcaaggagaattttttttt

SEQ ID NO: 67677 - DNA, 20 bp, Artificial Sequence
  chemically synthesized
atataattgataaattaaaa

SEQ ID NO: 67678 - DNA, 20 bp, Artificial Sequence
  chemically synthesized
gtcttgtctgttttcatatt

SEQ ID NO: 67679 - DNA, 20 bp, Artificial Sequence
  chemically synthesized
tttcagaggggataaaaatc

SEQ ID NO: 67680 - DNA, 20 bp, Artificial Sequence
  chemically synthesized
gcatttcatagtccttactg

SEQ ID NO: 67681 - DNA, 20 bp, Artificial Sequence
  chemically synthesized
gctgcatcccctggaaaaga

SEQ ID NO: 67682 - DNA, 20 bp, Artificial Sequence
  chemically synthesized
tgaggacacaagaattttca

SEQ ID NO: 67683 - DNA, 20 bp, Artificial Sequence
  chemically synthesized
ccatctttttaacttaggat

SEQ ID NO: 67684 - DNA, 20 bp, Artificial Sequence
  chemically synthesized
tactacatttatagtaagaa

SEQ ID NO: 67685 - DNA, 20 bp, Artificial Sequence
  chemically synthesized
catttatagtaagaagaaaa

SEQ ID NO: 67686 - DNA, 20 bp, Artificial Sequence
  chemically synthesized
atagtaagaagaaaacaaaa

SEQ ID NO: 67687 - DNA, 20 bp, Artificial Sequence
  chemically synthesized
tctagtggcagaaggaatat

SEQ ID NO: 67688 - DNA, 20 bp, Artificial Sequence
  chemically synthesized
cagtcactctcacagaatgt

SEQ ID NO: 67689 - DNA, 20 bp, Artificial Sequence
  chemically synthesized
aattataatgaatttgtctc

SEQ ID NO: 67690 - DNA, 20 bp, Artificial Sequence
  chemically synthesized
catagagagtccaacttaag

SEQ ID NO: 67691 - DNA, 20 bp, Artificial Sequence
  chemically synthesized
gtcctgttttcaatcattca

SEQ ID NO: 67692 - DNA, 20 bp, Artificial Sequence
  chemically synthesized
ccaaaaatattgttccctat

SEQ ID NO: 67693 - DNA, 20 bp, Artificial Sequence
  chemically synthesized
aatcttctctaactaatatt

SEQ ID NO: 67694 - DNA, 20 bp, Artificial Sequence
  chemically synthesized
ctcagacatgtttttctatt

SEQ ID NO: 67695 - DNA, 20 bp, Artificial Sequence
  chemically synthesized
agcaaattaatacaggaaca

SEQ ID NO: 67696 - DNA, 20 bp, Artificial Sequence
  chemically synthesized
tgatcttcaacaaacctggt

SEQ ID NO: 67697 - DNA, 20 bp, Artificial Sequence
  chemically synthesized
atgcattaaagacttaagtg

SEQ ID NO: 67698 - DNA, 20 bp, Artificial Sequence
  chemically synthesized
aaagacttaagtgtaaaacc

SEQ ID NO: 67699 - DNA, 20 bp, Artificial Sequence
  chemically synthesized
agtgtaaaacccaaaactat

SEQ ID NO: 67700 - DNA, 20 bp, Artificial Sequence
  chemically synthesized
aaactataaaaactttagaa

SEQ ID NO: 67701 - DNA, 20 bp, Artificial Sequence
  chemically synthesized
gatttcatgatgaaaatgtc

SEQ ID NO: 67702 - DNA, 20 bp, Artificial Sequence
  chemically synthesized
atcattagagaaatgcaaat

SEQ ID NO: 67703 - DNA, 20 bp, Artificial Sequence
  chemically synthesized
agtaaactaatgcaggaaca

SEQ ID NO: 67704 - DNA, 20 bp, Artificial Sequence
  chemically synthesized
cattaaaaaaaaataatggc

SEQ ID NO: 67705 - DNA, 20 bp, Artificial Sequence
  chemically synthesized
gcagagtgagtcatcaagtt

SEQ ID NO: 67706 - DNA, 20 bp, Artificial Sequence
  chemically synthesized
tttaaatgttaatcttgcct

SEQ ID NO: 67707 - DNA, 20 bp, Artificial Sequence
  chemically synthesized
ttgcctaaaaacaccctcac

SEQ ID NO: 67708 - DNA, 20 bp, Artificial Sequence
  chemically synthesized
gcaagacttaccaagagaca

SEQ ID NO: 67709 - DNA, 20 bp, Artificial Sequence
  chemically synthesized
gcaaatgttaactctgaaat

SEQ ID NO: 67710 - DNA, 20 bp, Artificial Sequence
  chemically synthesized
atataggaagaacgacacag

SEQ ID NO: 67711 - DNA, 20 bp, Artificial Sequence
  chemically synthesized
ctattctcctactacttggt

SEQ ID NO: 67712 - DNA, 20 bp, Artificial Sequence
  chemically synthesized
tagtctagagctgtgctgtc

SEQ ID NO: 67713 - DNA, 20 bp, Artificial Sequence
  chemically synthesized
aaattatttcacacatactt

SEQ ID NO: 67714 - DNA, 20 bp, Artificial Sequence
  chemically synthesized
taacacgtcacaatgcaaat

SEQ ID NO: 67715 - DNA, 20 bp, Artificial Sequence
  chemically synthesized
agcaaactatcgcaaggaca

SEQ ID NO: 67716 - DNA, 20 bp, Artificial Sequence
  chemically synthesized
cacattgtgcacatgtaccc

SEQ ID NO: 67717 - DNA, 20 bp, Artificial Sequence
  chemically synthesized
atacattattttggattaac

SEQ ID NO: 67718 - DNA, 20 bp, Artificial Sequence
  chemically synthesized
accaaagtaacaggaaagac

SEQ ID NO: 67719 - DNA, 20 bp, Artificial Sequence
  chemically synthesized
cagagaatatttcttcattc

SEQ ID NO: 67720 - DNA, 20 bp, Artificial Sequence
  chemically synthesized
gctgctccacctttatccag

SEQ ID NO: 67721 - DNA, 20 bp, Artificial Sequence
  chemically synthesized
ttctgctcataaatataata

SEQ ID NO: 67722 - DNA, 20 bp, Artificial Sequence
  chemically synthesized
tttttatttttaaaattttt

SEQ ID NO: 67723 - DNA, 20 bp, Artificial Sequence
  chemically synthesized
tactgaggccattttatgaa

SEQ ID NO: 67724 - DNA, 20 bp, Artificial Sequence
  chemically synthesized
tcttggatcgtggcaaccaa

SEQ ID NO: 67725 - DNA, 20 bp, Artificial Sequence
  chemically synthesized
agagagaggtaagaaggaca

SEQ ID NO: 67726 - DNA, 20 bp, Artificial Sequence
  chemically synthesized
gtgatgcacgctatagtgca

SEQ ID NO: 67727 - DNA, 20 bp, Artificial Sequence
  chemically synthesized
caatttccaaaaaaaatgag

SEQ ID NO: 67728 - DNA, 20 bp, Artificial Sequence
  chemically synthesized
agaaaaactgcattaactga

SEQ ID NO: 67729 - DNA, 20 bp, Artificial Sequence
  chemically synthesized
gtattttttctaattaggga

SEQ ID NO: 67730 - DNA, 20 bp, Artificial Sequence
  chemically synthesized
aaccctgtcatctacagcat

SEQ ID NO: 67731 - DNA, 20 bp, Artificial Sequence
  chemically synthesized
cagaacatataatctctatg

SEQ ID NO: 67732 - DNA, 20 bp, Artificial Sequence
  chemically synthesized
cccaaaaaaatcttagaagg

SEQ ID NO: 67733 - DNA, 20 bp, Artificial Sequence
  chemically synthesized
atccacaaatttcaaaaggg

SEQ ID NO: 67734 - DNA, 20 bp, Artificial Sequence
  chemically synthesized
cagcttcctttaaattctct

SEQ ID NO: 67735 - DNA, 20 bp, Artificial Sequence
  chemically synthesized
ttttctacaaagtcagcatg

SEQ ID NO: 67736 - DNA, 20 bp, Artificial Sequence
  chemically synthesized
tggaactactctccattcag

SEQ ID NO: 67737 - DNA, 20 bp, Artificial Sequence
  chemically synthesized
tgctactgataacaactagt

SEQ ID NO: 67738 - DNA, 20 bp, Artificial Sequence
  chemically synthesized
gatctctacaaggagaacta

SEQ ID NO: 67739 - DNA, 20 bp, Artificial Sequence
  chemically synthesized
gtcattcttcacagtattag

SEQ ID NO: 67740 - DNA, 20 bp, Artificial Sequence
  chemically synthesized
ttgactaaggaaacacaata

SEQ ID NO: 67741 - DNA, 20 bp, Artificial Sequence
  chemically synthesized
tgatcttcaacaacactgac

SEQ ID NO: 67742 - DNA, 20 bp, Artificial Sequence
  chemically synthesized
aaatcaactgaaaatgaatt

SEQ ID NO: 67743 - DNA, 20 bp, Artificial Sequence
  chemically synthesized
agcaaactatcacaaggaca

SEQ ID NO: 67744 - DNA, 20 bp, Artificial Sequence
  chemically synthesized
ctaatgagagaaatgcaaat

SEQ ID NO: 67745 - DNA, 20 bp, Artificial Sequence
  chemically synthesized
tagctatttttaaaaagcca

SEQ ID NO: 67746 - DNA, 20 bp, Artificial Sequence
  chemically synthesized
aaattagttcaaccactgca

SEQ ID NO: 67747 - DNA, 20 bp, Artificial Sequence
  chemically synthesized
tactgggtatatatccatag

SEQ ID NO: 67748 - DNA, 20 bp, Artificial Sequence
  chemically synthesized
gcatgcaatatatccatgta

SEQ ID NO: 67749 - DNA, 20 bp, Artificial Sequence
  chemically synthesized
aatgttgaaaatttaaaaga

SEQ ID NO: 67750 - DNA, 20 bp, Artificial Sequence
  chemically synthesized
aaaagaaaaaacaaataaat

SEQ ID NO: 67751 - DNA, 20 bp, Artificial Sequence
  chemically synthesized
tgctcatggattagcttcag

SEQ ID NO: 67752 - DNA, 20 bp, Artificial Sequence
  chemically synthesized
tggcttttgttagaattcca

SEQ ID NO: 67753 - DNA, 20 bp, Artificial Sequence
  chemically synthesized
aaaacattaacattctattt

SEQ ID NO: 67754 - DNA, 20 bp, Artificial Sequence
  chemically synthesized
aacaaagaaaagttttctaa

SEQ ID NO: 67755 - DNA, 20 bp, Artificial Sequence
  chemically synthesized
cagtttcacaagaaggtagt

SEQ ID NO: 67756 - DNA, 20 bp, Artificial Sequence
  chemically synthesized
ttttcttatatcctgatcct

SEQ ID NO: 67757 - DNA, 20 bp, Artificial Sequence
  chemically synthesized
aatactattgaatatggaga

SEQ ID NO: 67758 - DNA, 20 bp, Artificial Sequence
  chemically synthesized
atggaactctactataatct

SEQ ID NO: 67759 - DNA, 20 bp, Artificial Sequence
  chemically synthesized
gaataaaagaaatccaaatt

SEQ ID NO: 67760 - DNA, 20 bp, Artificial Sequence
  chemically synthesized
aactgtagaactagactttt

SEQ ID NO: 67761 - DNA, 20 bp, Artificial Sequence
  chemically synthesized
aattttgtattacaccaaat

SEQ ID NO: 67762 - DNA, 20 bp, Artificial Sequence
  chemically synthesized
ttttctgtatgtccttgtat

SEQ ID NO: 67763 - DNA, 20 bp, Artificial Sequence
  chemically synthesized
ttttcatactgaatcaattg

SEQ ID NO: 67764 - DNA, 20 bp, Artificial Sequence
  chemically synthesized
ttggctaaggcccttcaaat

SEQ ID NO: 67765 - DNA, 20 bp, Artificial Sequence
  chemically synthesized
ttctttcaacgtaatctcca

SEQ ID NO: 67766 - DNA, 20 bp, Artificial Sequence
  chemically synthesized
tggtgtatttagacatcaac

SEQ ID NO: 67767 - DNA, 20 bp, Artificial Sequence
  chemically synthesized
atataagttccataagtggt

SEQ ID NO: 67768 - DNA, 20 bp, Artificial Sequence
  chemically synthesized
gccaaagtactaagaaggaa

SEQ ID NO: 67769 - DNA, 20 bp, Artificial Sequence
  chemically synthesized
aaaggtctacaatttggcta

SEQ ID NO: 67770 - DNA, 20 bp, Artificial Sequence
  chemically synthesized
atgctcagaaaccgcaaaga

SEQ ID NO: 67771 - DNA, 20 bp, Artificial Sequence
  chemically synthesized
taattaccacacagttttaa

SEQ ID NO: 67772 - DNA, 20 bp, Artificial Sequence
  chemically synthesized
ccaaacgcagctcaggtttt

SEQ ID NO: 67773 - DNA, 20 bp, Artificial Sequence
  chemically synthesized
catgtttgtccctaatgtgc

SEQ ID NO: 67774 - DNA, 20 bp, Artificial Sequence
  chemically synthesized
gaagattgtgagagaaaaaa

SEQ ID NO: 67775 - DNA, 20 bp, Artificial Sequence
  chemically synthesized
aaaaatatcttctccacctg

SEQ ID NO: 67776 - DNA, 20 bp, Artificial Sequence
  chemically synthesized
ttgcctccatcaagatgtca

SEQ ID NO: 67777 - DNA, 20 bp, Artificial Sequence
  chemically synthesized
atagttttgataattaatgc

SEQ ID NO: 67778 - DNA, 20 bp, Artificial Sequence
  chemically synthesized
ttgataagaaaatacttact

SEQ ID NO: 67779 - DNA, 20 bp, Artificial Sequence
  chemically synthesized
catttggatgcaggaaaaat

SEQ ID NO: 67780 - DNA, 20 bp, Artificial Sequence
  chemically synthesized
aaaggatgtctgtaagagta

SEQ ID NO: 67781 - DNA, 20 bp, Artificial Sequence
  chemically synthesized
gaccaataaggaacagaaaa

SEQ ID NO: 67782 - DNA, 20 bp, Artificial Sequence
  chemically synthesized
ggtaggttaagtaatttatc

SEQ ID NO: 67783 - DNA, 20 bp, Artificial Sequence
  chemically synthesized
gttacaataacggaagagat

SEQ ID NO: 67784 - DNA, 20 bp, Artificial Sequence
  chemically synthesized
tgatagaaaatgagaagaga

SEQ ID NO: 67785 - DNA, 20 bp, Artificial Sequence
  chemically synthesized
aaatagttaggaataatgta

SEQ ID NO: 67786 - DNA, 20 bp, Artificial Sequence
  chemically synthesized
tttttactgcttaaacataa

SEQ ID NO: 67787 - DNA, 20 bp, Artificial Sequence
  chemically synthesized
tgcaccaatcagtgccctgt

SEQ ID NO: 67788 - DNA, 20 bp, Artificial Sequence
  chemically synthesized
tcctcacggtgactaacgca

SEQ ID NO: 67789 - DNA, 20 bp, Artificial Sequence
  chemically synthesized
tattgatagtcacaatgaca

SEQ ID NO: 67790 - DNA, 20 bp, Artificial Sequence
  chemically synthesized
agctatacttaactcacttg

SEQ ID NO: 67791 - DNA, 20 bp, Artificial Sequence
  chemically synthesized
aaaggaagtcaaaagatgtg

SEQ ID NO: 67792 - DNA, 20 bp, Artificial Sequence
  chemically synthesized
gatttaagcctttttggtca

SEQ ID NO: 67793 - DNA, 20 bp, Artificial Sequence
  chemically synthesized
tgcctcacgaaacagaatac

SEQ ID NO: 67794 - DNA, 20 bp, Artificial Sequence
  chemically synthesized
aatacaaaaacaaacaaaca

SEQ ID NO: 67795 - DNA, 20 bp, Artificial Sequence
  chemically synthesized
tgtctattgtcaatttatgg

SEQ ID NO: 67796 - DNA, 20 bp, Artificial Sequence
  chemically synthesized
caatcattcttgctgcaggt

SEQ ID NO: 67797 - DNA, 20 bp, Artificial Sequence
  chemically synthesized
ccccattttactacagttaa

SEQ ID NO: 67798 - DNA, 20 bp, Artificial Sequence
  chemically synthesized
atggttaactttgtgaagtt

SEQ ID NO: 67799 - DNA, 20 bp, Artificial Sequence
  chemically synthesized
tcctcacgctaactccataa

SEQ ID NO: 67800 - DNA, 20 bp, Artificial Sequence
  chemically synthesized
agacagtgttttttccacag

SEQ ID NO: 67801 - DNA, 20 bp, Artificial Sequence
  chemically synthesized
aattataagcagacacttga

SEQ ID NO: 67802 - DNA, 20 bp, Artificial Sequence
  chemically synthesized
tttatcataatactgtaaca

SEQ ID NO: 67803 - DNA, 20 bp, Artificial Sequence
  chemically synthesized
ttagcatccagcaggtgctt

SEQ ID NO: 67804 - DNA, 20 bp, Artificial Sequence
  chemically synthesized
ggagaagctgaccacctgac

SEQ ID NO: 67805 - DNA, 20 bp, Artificial Sequence
  chemically synthesized
gatatggaagaggaaggcat

SEQ ID NO: 67806 - DNA, 20 bp, Artificial Sequence
  chemically synthesized
aaggcatgaaaacaggaaaa

SEQ ID NO: 67807 - DNA, 20 bp, Artificial Sequence
  chemically synthesized
tgaaggactacaagaggatg

SEQ ID NO: 67808 - DNA, 20 bp, Artificial Sequence
  chemically synthesized
gacataatgcttgtgggaga

SEQ ID NO: 67809 - DNA, 20 bp, Artificial Sequence
  chemically synthesized
aagatttagtgatgctatgt

SEQ ID NO: 67810 - DNA, 20 bp, Artificial Sequence
  chemically synthesized
aatcacaaattaattagaaa

SEQ ID NO: 67811 - DNA, 20 bp, Artificial Sequence
  chemically synthesized
ttcaattctacacatggagg

SEQ ID NO: 67812 - DNA, 20 bp, Artificial Sequence
  chemically synthesized
gagcgagactctgtctaaag

SEQ ID NO: 67813 - DNA, 20 bp, Artificial Sequence
  chemically synthesized
gactctgtctaaagaaaaac

SEQ ID NO: 67814 - DNA, 20 bp, Artificial Sequence
  chemically synthesized
caaacaaacaaacaaacaaa

SEQ ID NO: 67815 - DNA, 20 bp, Artificial Sequence
  chemically synthesized
gtttcctatatcatttataa

SEQ ID NO: 67816 - DNA, 20 bp, Artificial Sequence
  chemically synthesized
ctttccactatcaagtccat

SEQ ID NO: 67817 - DNA, 20 bp, Artificial Sequence
  chemically synthesized
gtaggctgagatttgctctt

SEQ ID NO: 67818 - DNA, 20 bp, Artificial Sequence
  chemically synthesized
tcagtcaggtaaaagtaaag

SEQ ID NO: 67819 - DNA, 20 bp, Artificial Sequence
  chemically synthesized
catcagtgttatgtgaggtt

SEQ ID NO: 67820 - DNA, 20 bp, Artificial Sequence
  chemically synthesized
cacacacatatatatatata

SEQ ID NO: 67821 - DNA, 20 bp, Artificial Sequence
  chemically synthesized
ttgcccatctctgttgatta

SEQ ID NO: 67822 - DNA, 20 bp, Artificial Sequence
  chemically synthesized
catctctgttgattagaaaa

SEQ ID NO: 67823 - DNA, 20 bp, Artificial Sequence
  chemically synthesized
aataagcccctaagctccca

SEQ ID NO: 67824 - DNA, 20 bp, Artificial Sequence
  chemically synthesized
catcctcacccttagtgaca

SEQ ID NO: 67825 - DNA, 20 bp, Artificial Sequence
  chemically synthesized
aggcaatgcaatttaattaa

SEQ ID NO: 67826 - DNA, 20 bp, Artificial Sequence
  chemically synthesized
ctgaacttaaaataaaagtt

SEQ ID NO: 67827 - DNA, 20 bp, Artificial Sequence
  chemically synthesized
atttcttagataataccatg

SEQ ID NO: 67828 - DNA, 20 bp, Artificial Sequence
  chemically synthesized
atctgtagcaaattccccct

SEQ ID NO: 67829 - DNA, 20 bp, Artificial Sequence
  chemically synthesized
tgtatattatttgatgcaat

SEQ ID NO: 67830 - DNA, 20 bp, Artificial Sequence
  chemically synthesized
cttcctttggagatgctatt

SEQ ID NO: 67831 - DNA, 20 bp, Artificial Sequence
  chemically synthesized
agacttctagtgagcataac

SEQ ID NO: 67832 - DNA, 20 bp, Artificial Sequence
  chemically synthesized
aattagacaattgcttaaag

SEQ ID NO: 67833 - DNA, 20 bp, Artificial Sequence
  chemically synthesized
ggtacatgtcacttttcatt

SEQ ID NO: 67834 - DNA, 20 bp, Artificial Sequence
  chemically synthesized
tgtcacttttcattaaaaac

SEQ ID NO: 67835 - DNA, 20 bp, Artificial Sequence
  chemically synthesized
cttttcattaaaaacaaaaa

SEQ ID NO: 67836 - DNA, 20 bp, Artificial Sequence
  chemically synthesized
cattaaaaacaaaaacaaaa

SEQ ID NO: 67837 - DNA, 20 bp, Artificial Sequence
  chemically synthesized
aaaacaaaaacaaaacaaaa

SEQ ID NO: 67838 - DNA, 20 bp, Artificial Sequence
  chemically synthesized
actaataaaggcttaaattc

SEQ ID NO: 67839 - DNA, 20 bp, Artificial Sequence
  chemically synthesized
tttagctcccacagatgaat

SEQ ID NO: 67840 - DNA, 20 bp, Artificial Sequence
  chemically synthesized
tctcagcatttgtttttctg

SEQ ID NO: 67841 - DNA, 20 bp, Artificial Sequence
  chemically synthesized
ttgttggattgggttaattc

SEQ ID NO: 67842 - DNA, 20 bp, Artificial Sequence
  chemically synthesized
tctctctttttcttctcccc

SEQ ID NO: 67843 - DNA, 20 bp, Artificial Sequence
  chemically synthesized
ggcaataagggctttttaag

SEQ ID NO: 67844 - DNA, 20 bp, Artificial Sequence
  chemically synthesized
atacatgggaaagaatgctt

SEQ ID NO: 67845 - DNA, 20 bp, Artificial Sequence
  chemically synthesized
gataaatggggaagttgttt

SEQ ID NO: 67846 - DNA, 20 bp, Artificial Sequence
  chemically synthesized
tcatggatcgagttcagaga

SEQ ID NO: 67847 - DNA, 20 bp, Artificial Sequence
  chemically synthesized
gttcagagaaaaaacaaaag

SEQ ID NO: 67848 - DNA, 20 bp, Artificial Sequence
  chemically synthesized
cccaaagaaaaaataaagaa

SEQ ID NO: 67849 - DNA, 20 bp, Artificial Sequence
  chemically synthesized
gtgtgtggactattagtcaa

SEQ ID NO: 67850 - DNA, 20 bp, Artificial Sequence
  chemically synthesized
cgagcatagaagagctacac

SEQ ID NO: 67851 - DNA, 20 bp, Artificial Sequence
  chemically synthesized
gaacttaagagataatggcc

SEQ ID NO: 67852 - DNA, 20 bp, Artificial Sequence
  chemically synthesized
aaaaatcctggacctatgcc

SEQ ID NO: 67853 - DNA, 20 bp, Artificial Sequence
  chemically synthesized
gagctacagacaagaaggtg

SEQ ID NO: 67854 - DNA, 20 bp, Artificial Sequence
  chemically synthesized
tatcttctatggtgggagaa

SEQ ID NO: 67855 - DNA, 20 bp, Artificial Sequence
  chemically synthesized
cctatttttgttattcgttt

SEQ ID NO: 67856 - DNA, 20 bp, Artificial Sequence
  chemically synthesized
tttgtcctttttttttttag

SEQ ID NO: 67857 - DNA, 20 bp, Artificial Sequence
  chemically synthesized
atcatggatcactttcagag

SEQ ID NO: 67858 - DNA, 20 bp, Artificial Sequence
  chemically synthesized
gatcactttcagagaaaaac

SEQ ID NO: 67859 - DNA, 20 bp, Artificial Sequence
  chemically synthesized
aaaaacaaactaaccaaaag

SEQ ID NO: 67860 - DNA, 20 bp, Artificial Sequence
  chemically synthesized
ccaaaagcaaaacagaacca

SEQ ID NO: 67861 - DNA, 20 bp, Artificial Sequence
  chemically synthesized
tgtgtggactattagtcaat

SEQ ID NO: 67862 - DNA, 20 bp, Artificial Sequence
  chemically synthesized
tgagcatagaagagctacgc

SEQ ID NO: 67863 - DNA, 20 bp, Artificial Sequence
  chemically synthesized
aaaaatcctggacctatgcc

SEQ ID NO: 67864 - DNA, 20 bp, Artificial Sequence
  chemically synthesized
gagctagagacaagaaggta

SEQ ID NO: 67865 - DNA, 20 bp, Artificial Sequence
  chemically synthesized
aagggaagaataaattagag

SEQ ID NO: 67866 - DNA, 20 bp, Artificial Sequence
  chemically synthesized
ttccctcatttttgttgttt

SEQ ID NO: 67867 - DNA, 20 bp, Artificial Sequence
  chemically synthesized
cagccttcagaaatgtgaga

SEQ ID NO: 67868 - DNA, 20 bp, Artificial Sequence
  chemically synthesized
cagtagaagcaataatcatg

SEQ ID NO: 67869 - DNA, 20 bp, Artificial Sequence
  chemically synthesized
actttccccatgttcctaag

SEQ ID NO: 67870 - DNA, 20 bp, Artificial Sequence
  chemically synthesized
actgactactaaatggatta

SEQ ID NO: 67871 - DNA, 20 bp, Artificial Sequence
  chemically synthesized
tggattaaaaaacacagtaa

SEQ ID NO: 67872 - DNA, 20 bp, Artificial Sequence
  chemically synthesized
aaagaaagaaagaaagaaaa

SEQ ID NO: 67873 - DNA, 20 bp, Artificial Sequence
  chemically synthesized
aatgtagtctcaagagaatt

SEQ ID NO: 67874 - DNA, 20 bp, Artificial Sequence
  chemically synthesized
aaactcgaatgtccatcttg

SEQ ID NO: 67875 - DNA, 20 bp, Artificial Sequence
  chemically synthesized
cttaccatttgatagctctg

SEQ ID NO: 67876 - DNA, 20 bp, Artificial Sequence
  chemically synthesized
aattattagcaatcaatatt

SEQ ID NO: 67877 - DNA, 20 bp, Artificial Sequence
  chemically synthesized
gcagtgattgcacagaactg

SEQ ID NO: 67878 - DNA, 20 bp, Artificial Sequence
  chemically synthesized
gtatgtagcaccctcaaacc

SEQ ID NO: 67879 - DNA, 20 bp, Artificial Sequence
  chemically synthesized
ttctccagtttcattaatcc

SEQ ID NO: 67880 - DNA, 20 bp, Artificial Sequence
  chemically synthesized
tttcacattcacctttagtg

SEQ ID NO: 67881 - DNA, 20 bp, Artificial Sequence
  chemically synthesized
tctagatgttagtaacatca

SEQ ID NO: 67882 - DNA, 20 bp, Artificial Sequence
  chemically synthesized
gcatcaaagtatcagccata

SEQ ID NO: 67883 - DNA, 20 bp, Artificial Sequence
  chemically synthesized
atgtattgataagataatat

SEQ ID NO: 67884 - DNA, 20 bp, Artificial Sequence
  chemically synthesized
gggtatttcacttgttatac

SEQ ID NO: 67885 - DNA, 20 bp, Artificial Sequence
  chemically synthesized
tttgaattcagaaaagagtg

SEQ ID NO: 67886 - DNA, 20 bp, Artificial Sequence
  chemically synthesized
tttatattgagtcaacttgt

SEQ ID NO: 67887 - DNA, 20 bp, Artificial Sequence
  chemically synthesized
tacattccactatattagcc

SEQ ID NO: 67888 - DNA, 20 bp, Artificial Sequence
  chemically synthesized
gctatatacacatacaaaat

SEQ ID NO: 67889 - DNA, 20 bp, Artificial Sequence
  chemically synthesized
gaaagaaaatatttattcaa

SEQ ID NO: 67890 - DNA, 20 bp, Artificial Sequence
  chemically synthesized
gaccttatgatcttgatagg

SEQ ID NO: 67891 - DNA, 20 bp, Artificial Sequence
  chemically synthesized
cccaaatttaaaatgaaagt

SEQ ID NO: 67892 - DNA, 20 bp, Artificial Sequence
  chemically synthesized
gctgcttttgaaacaaatga

SEQ ID NO: 67893 - DNA, 20 bp, Artificial Sequence
  chemically synthesized
agactagggccattctgata

SEQ ID NO: 67894 - DNA, 20 bp, Artificial Sequence
  chemically synthesized
atagttcatcatttaaaaaa

SEQ ID NO: 67895 - DNA, 20 bp, Artificial Sequence
  chemically synthesized
agaaaacaaaatagaaaaag

SEQ ID NO: 67896 - DNA, 20 bp, Artificial Sequence
  chemically synthesized
gggatgtgaaacagggtctt

SEQ ID NO: 67897 - DNA, 20 bp, Artificial Sequence
  chemically synthesized
tcttgaaaactgtctaaatc

SEQ ID NO: 67898 - DNA, 20 bp, Artificial Sequence
  chemically synthesized
ttgaatcaaggaaatgattt

SEQ ID NO: 67899 - DNA, 20 bp, Artificial Sequence
  chemically synthesized
gttttttatctcttgtttcc

SEQ ID NO: 67900 - DNA, 20 bp, Artificial Sequence
  chemically synthesized
gcatgcatgagcaaattaag

SEQ ID NO: 67901 - DNA, 20 bp, Artificial Sequence
  chemically synthesized
caaagctgaattatggtaga

SEQ ID NO: 67902 - DNA, 20 bp, Artificial Sequence
  chemically synthesized
ttgtgtaataagaaaattgg

SEQ ID NO: 67903 - DNA, 20 bp, Artificial Sequence
  chemically synthesized
atacattaagtaacttaaaa

SEQ ID NO: 67904 - DNA, 20 bp, Artificial Sequence
  chemically synthesized
catctggattctgcctaata

SEQ ID NO: 67905 - DNA, 20 bp, Artificial Sequence
  chemically synthesized
atgtgggaggtcagtgcatt

SEQ ID NO: 67906 - DNA, 20 bp, Artificial Sequence
  chemically synthesized
agaggtctacttgaagaagg

SEQ ID NO: 67907 - DNA, 20 bp, Artificial Sequence
  chemically synthesized
taaagaattaaactaagacc

SEQ ID NO: 67908 - DNA, 20 bp, Artificial Sequence
  chemically synthesized
aactaaaaaatttccacaca

SEQ ID NO: 67909 - DNA, 20 bp, Artificial Sequence
  chemically synthesized
aaaaatttccacacaaaaaa

SEQ ID NO: 67910 - DNA, 20 bp, Artificial Sequence
  chemically synthesized
attgatgaacctggaggatg

SEQ ID NO: 67911 - DNA, 20 bp, Artificial Sequence
  chemically synthesized
ttcacaaggtatacatatat

SEQ ID NO: 67912 - DNA, 20 bp, Artificial Sequence
  chemically synthesized
aatagacatcacatgaatta

SEQ ID NO: 67913 - DNA, 20 bp, Artificial Sequence
  chemically synthesized
tttgactgtttactcttttc

SEQ ID NO: 67914 - DNA, 20 bp, Artificial Sequence
  chemically synthesized
agtggaataaatagaaatcc

SEQ ID NO: 67915 - DNA, 20 bp, Artificial Sequence
  chemically synthesized
ttaaatttagcttggaaata

SEQ ID NO: 67916 - DNA, 20 bp, Artificial Sequence
  chemically synthesized
aaggtaaaattcagtcacga

SEQ ID NO: 67917 - DNA, 20 bp, Artificial Sequence
  chemically synthesized
ctcatcgctactaaaaatat

SEQ ID NO: 67918 - DNA, 20 bp, Artificial Sequence
  chemically synthesized
tggctggtactcctctaaga

SEQ ID NO: 67919 - DNA, 20 bp, Artificial Sequence
  chemically synthesized
ccaccgctgttgatacccag

SEQ ID NO: 67920 - DNA, 20 bp, Artificial Sequence
  chemically synthesized
agggtcctgactgttagaag

SEQ ID NO: 67921 - DNA, 20 bp, Artificial Sequence
  chemically synthesized
acagaaaggacatccacacc

SEQ ID NO: 67922 - DNA, 20 bp, Artificial Sequence
  chemically synthesized
catcaaagaccaaaggtaga

SEQ ID NO: 67923 - DNA, 20 bp, Artificial Sequence
  chemically synthesized
atggggaaaaagcagagcag

SEQ ID NO: 67924 - DNA, 20 bp, Artificial Sequence
  chemically synthesized
gaacaaacggcaaagaagta

SEQ ID NO: 67925 - DNA, 20 bp, Artificial Sequence
  chemically synthesized
ttaaaggacctgatggagct

SEQ ID NO: 67926 - DNA, 20 bp, Artificial Sequence
  chemically synthesized
gggagaatggaaccaagttg

SEQ ID NO: 67927 - DNA, 20 bp, Artificial Sequence
  chemically synthesized
caactagtatcagccactgc

SEQ ID NO: 67928 - DNA, 20 bp, Artificial Sequence
  chemically synthesized
gaatatctaccaagcaaatg

SEQ ID NO: 67929 - DNA, 20 bp, Artificial Sequence
  chemically synthesized
gttgcaatcctagtctctga

SEQ ID NO: 67930 - DNA, 20 bp, Artificial Sequence
  chemically synthesized
tacaggagcacccagattca

SEQ ID NO: 67931 - DNA, 20 bp, Artificial Sequence
  chemically synthesized
gcaccacaccacacctattc

SEQ ID NO: 67932 - DNA, 20 bp, Artificial Sequence
  chemically synthesized
tcaggattaagaaactcact

SEQ ID NO: 67933 - DNA, 20 bp, Artificial Sequence
  chemically synthesized
acaccctaacatcacaatta

SEQ ID NO: 67934 - DNA, 20 bp, Artificial Sequence
  chemically synthesized
tgaaggacatagagacacaa

SEQ ID NO: 67935 - DNA, 20 bp, Artificial Sequence
  chemically synthesized
attcaacaacgcttcatgct

SEQ ID NO: 67936 - DNA, 20 bp, Artificial Sequence
  chemically synthesized
caatatcatactgagtggac

SEQ ID NO: 67937 - DNA, 20 bp, Artificial Sequence
  chemically synthesized
aaactggaagcattcccttt

SEQ ID NO: 67938 - DNA, 20 bp, Artificial Sequence
  chemically synthesized
atgacatgattgtatatcta

SEQ ID NO: 67939 - DNA, 20 bp, Artificial Sequence
  chemically synthesized
actttcttcacagaactgga

SEQ ID NO: 67940 - DNA, 20 bp, Artificial Sequence
  chemically synthesized
tactacaatgctacggtaac

SEQ ID NO: 67941 - DNA, 20 bp, Artificial Sequence
  chemically synthesized
aaacagcatggtactggtac

SEQ ID NO: 67942 - DNA, 20 bp, Artificial Sequence
  chemically synthesized
tatttaataaatggtgctgg

SEQ ID NO: 67943 - DNA, 20 bp, Artificial Sequence
  chemically synthesized
aaagacttacatgttagacc

SEQ ID NO: 67944 - DNA, 20 bp, Artificial Sequence
  chemically synthesized
catgttagacctaaaaccat

SEQ ID NO: 67945 - DNA, 20 bp, Artificial Sequence
  chemically synthesized
aaaccataaaaaccctagaa

SEQ ID NO: 67946 - DNA, 20 bp, Artificial Sequence
  chemically synthesized
atgggcaaggacttcatgtc

SEQ ID NO: 67947 - DNA, 20 bp, Artificial Sequence
  chemically synthesized
actcaaacaaatttacaaga

SEQ ID NO: 67948 - DNA, 20 bp, Artificial Sequence
  chemically synthesized
agaagacatttatgtaatca

SEQ ID NO: 67949 - DNA, 20 bp, Artificial Sequence
  chemically synthesized
gccatcagagaaatgcaaat

SEQ ID NO: 67950 - DNA, 20 bp, Artificial Sequence
  chemically synthesized
catgttgtgcacatgtaccc

SEQ ID NO: 67951 - DNA, 20 bp, Artificial Sequence
  chemically synthesized
ataaaaaaaagttatcctat

SEQ ID NO: 67952 - DNA, 20 bp, Artificial Sequence
  chemically synthesized
ttaaagataacaagaggtct

SEQ ID NO: 67953 - DNA, 20 bp, Artificial Sequence
  chemically synthesized
ctgagatcctgtctctgagg

SEQ ID NO: 67954 - DNA, 20 bp, Artificial Sequence
  chemically synthesized
gaaaaacaaacaaacaagca

SEQ ID NO: 67955 - DNA, 20 bp, Artificial Sequence
  chemically synthesized
ctaccttattaattttttca

SEQ ID NO: 67956 - DNA, 20 bp, Artificial Sequence
  chemically synthesized
ggccagcatcatcctgatac

SEQ ID NO: 67957 - DNA, 20 bp, Artificial Sequence
  chemically synthesized
gacacacaacaacaaaaaaa

SEQ ID NO: 67958 - DNA, 20 bp, Artificial Sequence
  chemically synthesized
ttcatcatatatacagcact

SEQ ID NO: 67959 - DNA, 20 bp, Artificial Sequence
  chemically synthesized
aattcaacttcacttcatgt

SEQ ID NO: 67960 - DNA, 20 bp, Artificial Sequence
  chemically synthesized
ccaacatcatacagaatggg

SEQ ID NO: 67961 - DNA, 20 bp, Artificial Sequence
  chemically synthesized
aacctggaagcattcttctt

SEQ ID NO: 67962 - DNA, 20 bp, Artificial Sequence
  chemically synthesized
atccctgttttctgtatcta

SEQ ID NO: 67963 - DNA, 20 bp, Artificial Sequence
  chemically synthesized
gatctctacaatgagattta

SEQ ID NO: 67964 - DNA, 20 bp, Artificial Sequence
  chemically synthesized
gagctgatagaaacaaatgg

SEQ ID NO: 67965 - DNA, 20 bp, Artificial Sequence
  chemically synthesized
taccacagggctacagtaac

SEQ ID NO: 67966 - DNA, 20 bp, Artificial Sequence
  chemically synthesized
tgatctttgacaaagctgat

SEQ ID NO: 67967 - DNA, 20 bp, Artificial Sequence
  chemically synthesized
atggattagagacttaaatg

SEQ ID NO: 67968 - DNA, 20 bp, Artificial Sequence
  chemically synthesized
cttaaatgaatctacaagaa

SEQ ID NO: 67969 - DNA, 20 bp, Artificial Sequence
  chemically synthesized
tggcaattccctaaagacct

SEQ ID NO: 67970 - DNA, 20 bp, Artificial Sequence
  chemically synthesized
aacaaactaatgtaagaaca

SEQ ID NO: 67971 - DNA, 20 bp, Artificial Sequence
  chemically synthesized
aagtaggaactaaatgatga

SEQ ID NO: 67972 - DNA, 20 bp, Artificial Sequence
  chemically synthesized
tgttcctatatagtaaatat

SEQ ID NO: 67973 - DNA, 20 bp, Artificial Sequence
  chemically synthesized
aggaactcaagtcctatctt

SEQ ID NO: 67974 - DNA, 20 bp, Artificial Sequence
  chemically synthesized
acatgcaggctgctataaga

SEQ ID NO: 67975 - DNA, 20 bp, Artificial Sequence
  chemically synthesized
tgtacttaaaatattaaaat

SEQ ID NO: 67976 - DNA, 20 bp, Artificial Sequence
  chemically synthesized
attatatacctaagaaatga

SEQ ID NO: 67977 - DNA, 20 bp, Artificial Sequence
  chemically synthesized
gatcatggtgatattaataa

SEQ ID NO: 67978 - DNA, 20 bp, Artificial Sequence
  chemically synthesized
taataaataaataaaataaa

SEQ ID NO: 67979 - DNA, 20 bp, Artificial Sequence
  chemically synthesized
taaaataaataaaacagaaa

SEQ ID NO: 67980 - DNA, 20 bp, Artificial Sequence
  chemically synthesized
gacgagtttctataaaaaaa

SEQ ID NO: 67981 - DNA, 20 bp, Artificial Sequence
  chemically synthesized
cattacttttttattgctgc

SEQ ID NO: 67982 - DNA, 20 bp, Artificial Sequence
  chemically synthesized
ttttaaaaagttgatttcat

SEQ ID NO: 67983 - DNA, 20 bp, Artificial Sequence
  chemically synthesized
agggaacatattaaagccaa

SEQ ID NO: 67984 - DNA, 20 bp, Artificial Sequence
  chemically synthesized
tcaaatgctataaatcttat

SEQ ID NO: 67985 - DNA, 20 bp, Artificial Sequence
  chemically synthesized
aattatgttctaagaacagc

SEQ ID NO: 67986 - DNA, 20 bp, Artificial Sequence
  chemically synthesized
tgaaaagacagaaaaaaaaa

SEQ ID NO: 67987 - DNA, 20 bp, Artificial Sequence
  chemically synthesized
acagtgctcagaggggatac

SEQ ID NO: 67988 - DNA, 20 bp, Artificial Sequence
  chemically synthesized
taacacaacatgatgtcttg

SEQ ID NO: 67989 - DNA, 20 bp, Artificial Sequence
  chemically synthesized
tcttcatttatttaccttat

SEQ ID NO: 67990 - DNA, 20 bp, Artificial Sequence
  chemically synthesized
tgctctttcatcctaccttt

SEQ ID NO: 67991 - DNA, 20 bp, Artificial Sequence
  chemically synthesized
atttttcatattcttgagca

SEQ ID NO: 67992 - DNA, 20 bp, Artificial Sequence
  chemically synthesized
tgagaaggagtcagggcaag

SEQ ID NO: 67993 - DNA, 20 bp, Artificial Sequence
  chemically synthesized
ttacattattagagctttaa

SEQ ID NO: 67994 - DNA, 20 bp, Artificial Sequence
  chemically synthesized
gaactgcaggttctaagaaa

SEQ ID NO: 67995 - DNA, 20 bp, Artificial Sequence
  chemically synthesized
ctacgtcatctggaggggga

SEQ ID NO: 67996 - DNA, 20 bp, Artificial Sequence
  chemically synthesized
gtctaagcaacgtatttttt

SEQ ID NO: 67997 - DNA, 20 bp, Artificial Sequence
  chemically synthesized
tttgagcatttcctttgctg

SEQ ID NO: 67998 - DNA, 20 bp, Artificial Sequence
  chemically synthesized
ctgtaaaacaaagctggatt

SEQ ID NO: 67999 - DNA, 20 bp, Artificial Sequence
  chemically synthesized
ggttttcaagtttcaaagta

SEQ ID NO: 68000 - DNA, 20 bp, Artificial Sequence
  chemically synthesized
gaaaggaaggaaatcaggta

SEQ ID NO: 68001 - DNA, 20 bp, Artificial Sequence
  chemically synthesized
ttttatttttagatatcaac

SEQ ID NO: 68002 - DNA, 20 bp, Artificial Sequence
  chemically synthesized
ctggtatagctatcagaagt

SEQ ID NO: 68003 - DNA, 20 bp, Artificial Sequence
  chemically synthesized
tgaaaccccgtctctactaa

SEQ ID NO: 68004 - DNA, 20 bp, Artificial Sequence
  chemically synthesized
gtttgaaataatggccgtga

SEQ ID NO: 68005 - DNA, 20 bp, Artificial Sequence
  chemically synthesized
atggagacatcacaggtgtt

SEQ ID NO: 68006 - DNA, 20 bp, Artificial Sequence
  chemically synthesized
gcgtcactgagaaacgttac

SEQ ID NO: 68007 - DNA, 20 bp, Artificial Sequence
  chemically synthesized
cacggttattataataagga

SEQ ID NO: 68008 - DNA, 20 bp, Artificial Sequence
  chemically synthesized
catttaaatatgatttttta

SEQ ID NO: 68009 - DNA, 20 bp, Artificial Sequence
  chemically synthesized
agaaaaggataccaatgaga

SEQ ID NO: 68010 - DNA, 20 bp, Artificial Sequence
  chemically synthesized
ctgcaaagagcattttctgg

SEQ ID NO: 68011 - DNA, 20 bp, Artificial Sequence
  chemically synthesized
tgcaccaatcagcactctgc

SEQ ID NO: 68012 - DNA, 20 bp, Artificial Sequence
  chemically synthesized
ctagaatcaattttaataaa

SEQ ID NO: 68013 - DNA, 20 bp, Artificial Sequence
  chemically synthesized
tggtaagttaagagaatgaa

SEQ ID NO: 68014 - DNA, 20 bp, Artificial Sequence
  chemically synthesized
agccacagagaacatatttg

SEQ ID NO: 68015 - DNA, 20 bp, Artificial Sequence
  chemically synthesized
acttttaaaattctacaata

SEQ ID NO: 68016 - DNA, 20 bp, Artificial Sequence
  chemically synthesized
gtcattaagaaactgcacat

SEQ ID NO: 68017 - DNA, 20 bp, Artificial Sequence
  chemically synthesized
agacagtttacagtttctta

SEQ ID NO: 68018 - DNA, 20 bp, Artificial Sequence
  chemically synthesized
acctatgagcctgtaaaatc

SEQ ID NO: 68019 - DNA, 20 bp, Artificial Sequence
  chemically synthesized
ctaaagatcccacacgagta

SEQ ID NO: 68020 - DNA, 20 bp, Artificial Sequence
  chemically synthesized
ggtatttcttcatagcagtt

SEQ ID NO: 68021 - DNA, 20 bp, Artificial Sequence
  chemically synthesized
cttataatcatggcagagag

SEQ ID NO: 68022 - DNA, 20 bp, Artificial Sequence
  chemically synthesized
caaaatacataaaatgtaag

SEQ ID NO: 68023 - DNA, 20 bp, Artificial Sequence
  chemically synthesized
atgtaagcaaaacacaacaa

SEQ ID NO: 68024 - DNA, 20 bp, Artificial Sequence
  chemically synthesized
cttgaaatccatagaaattt

SEQ ID NO: 68025 - DNA, 20 bp, Artificial Sequence
  chemically synthesized
aagactgtagacttctataa

SEQ ID NO: 68026 - DNA, 20 bp, Artificial Sequence
  chemically synthesized
atcagaaatcattatttact

SEQ ID NO: 68027 - DNA, 20 bp, Artificial Sequence
  chemically synthesized
gttttagagtccccagattt

SEQ ID NO: 68028 - DNA, 20 bp, Artificial Sequence
  chemically synthesized
aaaattcgtcctcttaagct

SEQ ID NO: 68029 - DNA, 20 bp, Artificial Sequence
  chemically synthesized
taaactgagttatgctcaat

SEQ ID NO: 68030 - DNA, 20 bp, Artificial Sequence
  chemically synthesized
tgaatttatattctagtagt

SEQ ID NO: 68031 - DNA, 20 bp, Artificial Sequence
  chemically synthesized
tactggtgatggggcaaaaa

SEQ ID NO: 68032 - DNA, 20 bp, Artificial Sequence
  chemically synthesized
acatatgacaatgttttagg

SEQ ID NO: 68033 - DNA, 20 bp, Artificial Sequence
  chemically synthesized
caatgttttaggaaaaacaa

SEQ ID NO: 68034 - DNA, 20 bp, Artificial Sequence
  chemically synthesized
aaaaaaacaaacaaatattt

SEQ ID NO: 68035 - DNA, 20 bp, Artificial Sequence
  chemically synthesized
gtgagatatatattaaatag

SEQ ID NO: 68036 - DNA, 20 bp, Artificial Sequence
  chemically synthesized
cagaatatttagcacttagc

SEQ ID NO: 68037 - DNA, 20 bp, Artificial Sequence
  chemically synthesized
taagcccctgtgccacctca

SEQ ID NO: 68038 - DNA, 20 bp, Artificial Sequence
  chemically synthesized
agactcctgttttataatgt

SEQ ID NO: 68039 - DNA, 20 bp, Artificial Sequence
  chemically synthesized
caattttgttgatcttttca

SEQ ID NO: 68040 - DNA, 20 bp, Artificial Sequence
  chemically synthesized
attcaacaatgcttcatact

SEQ ID NO: 68041 - DNA, 20 bp, Artificial Sequence
  chemically synthesized
caatatcatactgaatggac

SEQ ID NO: 68042 - DNA, 20 bp, Artificial Sequence
  chemically synthesized
aaactggaagcattcccttt

SEQ ID NO: 68043 - DNA, 20 bp, Artificial Sequence
  chemically synthesized
atgacgtgattgtatatcta

SEQ ID NO: 68044 - DNA, 20 bp, Artificial Sequence
  chemically synthesized
gacctcttcaaggagaacaa

SEQ ID NO: 68045 - DNA, 20 bp, Artificial Sequence
  chemically synthesized
actttcttcacagaattgga

SEQ ID NO: 68046 - DNA, 20 bp, Artificial Sequence
  chemically synthesized
atactacaaggtacagtaac

SEQ ID NO: 68047 - DNA, 20 bp, Artificial Sequence
  chemically synthesized
aaacaacatggtactggtac

SEQ ID NO: 68048 - DNA, 20 bp, Artificial Sequence
  chemically synthesized
tgatctttgacaaacctgac

SEQ ID NO: 68049 - DNA, 20 bp, Artificial Sequence
  chemically synthesized
tatttaataaatgatgctgg

SEQ ID NO: 68050 - DNA, 20 bp, Artificial Sequence
  chemically synthesized
aaagacttacatgttagacc

SEQ ID NO: 68051 - DNA, 20 bp, Artificial Sequence
  chemically synthesized
catgttagacctaaaaccat

SEQ ID NO: 68052 - DNA, 20 bp, Artificial Sequence
  chemically synthesized
aaaccataaaaaccttagaa

SEQ ID NO: 68053 - DNA, 20 bp, Artificial Sequence
  chemically synthesized
atgggcaaggacttcatgtc

SEQ ID NO: 68054 - DNA, 20 bp, Artificial Sequence
  chemically synthesized
ctcaaacaaatttacaagaa

SEQ ID NO: 68055 - DNA, 20 bp, Artificial Sequence
  chemically synthesized
agaagacatttatgcagcca

SEQ ID NO: 68056 - DNA, 20 bp, Artificial Sequence
  chemically synthesized
gccatcagagaaatgcaaat

SEQ ID NO: 68057 - DNA, 20 bp, Artificial Sequence
  chemically synthesized
agcaaagtatcgcaaggacg

SEQ ID NO: 68058 - DNA, 20 bp, Artificial Sequence
  chemically synthesized
ccaggctggcatatagattt

SEQ ID NO: 68059 - DNA, 20 bp, Artificial Sequence
  chemically synthesized
tactctcctttcccagagaa

SEQ ID NO: 68060 - DNA, 20 bp, Artificial Sequence
  chemically synthesized
agagaagaaaacattggaaa

SEQ ID NO: 68061 - DNA, 20 bp, Artificial Sequence
  chemically synthesized
cttgcccatcgctttggagg

SEQ ID NO: 68062 - DNA, 20 bp, Artificial Sequence
  chemically synthesized
cacctaaagaaagacaaaaa

SEQ ID NO: 68063 - DNA, 20 bp, Artificial Sequence
  chemically synthesized
tattgggaagggagaataca

SEQ ID NO: 68064 - DNA, 20 bp, Artificial Sequence
  chemically synthesized
gagttttggaagcacttagc

SEQ ID NO: 68065 - DNA, 20 bp, Artificial Sequence
  chemically synthesized
gtgttctagacagaattagc

SEQ ID NO: 68066 - DNA, 20 bp, Artificial Sequence
  chemically synthesized
agacagaattagcaaaaaca

SEQ ID NO: 68067 - DNA, 20 bp, Artificial Sequence
  chemically synthesized
agagagagactccatctcaa

SEQ ID NO: 68068 - DNA, 20 bp, Artificial Sequence
  chemically synthesized
tcaaaaaaaccaaaaatacg

SEQ ID NO: 68069 - DNA, 20 bp, Artificial Sequence
  chemically synthesized
aaaccaaaaatacgtaaaac

SEQ ID NO: 68070 - DNA, 20 bp, Artificial Sequence
  chemically synthesized
cgtaaaacaaaaacaaaaag

SEQ ID NO: 68071 - DNA, 20 bp, Artificial Sequence
  chemically synthesized
acaaaaagaaaaacaaaaaa

SEQ ID NO: 68072 - DNA, 20 bp, Artificial Sequence
  chemically synthesized
ctatcaccatgatctcatgc

SEQ ID NO: 68073 - DNA, 20 bp, Artificial Sequence
  chemically synthesized
tctcatctaacagtgttggc

SEQ ID NO: 68074 - DNA, 20 bp, Artificial Sequence
  chemically synthesized
cacttaaagttgccatttcc

SEQ ID NO: 68075 - DNA, 20 bp, Artificial Sequence
  chemically synthesized
ttgaatatgaagttgtatat

SEQ ID NO: 68076 - DNA, 20 bp, Artificial Sequence
  chemically synthesized
aggacacagatcaaacaaca

SEQ ID NO: 68077 - DNA, 20 bp, Artificial Sequence
  chemically synthesized
ttgatcatggtaggagtcat

SEQ ID NO: 68078 - DNA, 20 bp, Artificial Sequence
  chemically synthesized
acattttgtagatgaagaaa

SEQ ID NO: 68079 - DNA, 20 bp, Artificial Sequence
  chemically synthesized
acattgttttgtcaatttgt

SEQ ID NO: 68080 - DNA, 20 bp, Artificial Sequence
  chemically synthesized
taggtacatcaattttacat

SEQ ID NO: 68081 - DNA, 20 bp, Artificial Sequence
  chemically synthesized
agttcaatactagaaagaaa

SEQ ID NO: 68082 - DNA, 20 bp, Artificial Sequence
  chemically synthesized
gttttagaagaaaataacta

SEQ ID NO: 68083 - DNA, 20 bp, Artificial Sequence
  chemically synthesized
gttcaatgtagtgaagtcat

SEQ ID NO: 68084 - DNA, 20 bp, Artificial Sequence
  chemically synthesized
tattcttatggtatacatga

SEQ ID NO: 68085 - DNA, 20 bp, Artificial Sequence
  chemically synthesized
tttatcaagttcacacaatg

SEQ ID NO: 68086 - DNA, 20 bp, Artificial Sequence
  chemically synthesized
taagtggcagaatcacaact

SEQ ID NO: 68087 - DNA, 20 bp, Artificial Sequence
  chemically synthesized
caaaaccagacaatccaact

SEQ ID NO: 68088 - DNA, 20 bp, Artificial Sequence
  chemically synthesized
caaagcgctcagggataaaa

SEQ ID NO: 68089 - DNA, 20 bp, Artificial Sequence
  chemically synthesized
ttcaagaatattttataggg

SEQ ID NO: 68090 - DNA, 20 bp, Artificial Sequence
  chemically synthesized
aaagacattaacatgcaaaa

SEQ ID NO: 68091 - DNA, 20 bp, Artificial Sequence
  chemically synthesized
gaactccagtatgaaaccca

SEQ ID NO: 68092 - DNA, 20 bp, Artificial Sequence
  chemically synthesized
acccaaaaaacaaatctttc

SEQ ID NO: 68093 - DNA, 20 bp, Artificial Sequence
  chemically synthesized
ataaaatagactacaaattt

SEQ ID NO: 68094 - DNA, 20 bp, Artificial Sequence
  chemically synthesized
aaagttcccaagtatataag

SEQ ID NO: 68095 - DNA, 20 bp, Artificial Sequence
  chemically synthesized
attttctgaccacagtggaa

SEQ ID NO: 68096 - DNA, 20 bp, Artificial Sequence
  chemically synthesized
ctttacctacccaaatctta

SEQ ID NO: 68097 - DNA, 20 bp, Artificial Sequence
  chemically synthesized
acatgttttatccgtggacc

SEQ ID NO: 68098 - DNA, 20 bp, Artificial Sequence
  chemically synthesized
agcctgtgctctcaagaact

SEQ ID NO: 68099 - DNA, 20 bp, Artificial Sequence
  chemically synthesized
tcttcaactcacacctgacc

SEQ ID NO: 68100 - DNA, 20 bp, Artificial Sequence
  chemically synthesized
gatctaaataatttttgtcg

SEQ ID NO: 68101 - DNA, 20 bp, Artificial Sequence
  chemically synthesized
aggctctttcatcaaatatg

SEQ ID NO: 68102 - DNA, 20 bp, Artificial Sequence
  chemically synthesized
aatctgctcctgacattaaa

SEQ ID NO: 68103 - DNA, 20 bp, Artificial Sequence
  chemically synthesized
tgcgccccttaccatcccat

SEQ ID NO: 68104 - DNA, 20 bp, Artificial Sequence
  chemically synthesized
ttcccccattttacctgtcc

SEQ ID NO: 68105 - DNA, 20 bp, Artificial Sequence
  chemically synthesized
tatctcggcataattctcat

SEQ ID NO: 68106 - DNA, 20 bp, Artificial Sequence
  chemically synthesized
ccaaacctcaatcccttcta

SEQ ID NO: 68107 - DNA, 20 bp, Artificial Sequence
  chemically synthesized
ttcaggctcttagtattcag

SEQ ID NO: 68108 - DNA, 20 bp, Artificial Sequence
  chemically synthesized
gaacggactaaatgtctttt

SEQ ID NO: 68109 - DNA, 20 bp, Artificial Sequence
  chemically synthesized
caacttagaatgtgccccaa

SEQ ID NO: 68110 - DNA, 20 bp, Artificial Sequence
  chemically synthesized
atttggtttttcaatccata

SEQ ID NO: 68111 - DNA, 20 bp, Artificial Sequence
  chemically synthesized
ctttacctacccaaatctta

SEQ ID NO: 68112 - DNA, 20 bp, Artificial Sequence
  chemically synthesized
agaaattaagaaggaaattt

SEQ ID NO: 68113 - DNA, 20 bp, Artificial Sequence
  chemically synthesized
aaaatggaaatacaacatac

SEQ ID NO: 68114 - DNA, 20 bp, Artificial Sequence
  chemically synthesized
aaaaaatacagaaaatcatt

SEQ ID NO: 68115 - DNA, 20 bp, Artificial Sequence
  chemically synthesized
ggaaaggtaaacaaaatcaa

SEQ ID NO: 68116 - DNA, 20 bp, Artificial Sequence
  chemically synthesized
gactgaagcatgtagaaaca

SEQ ID NO: 68117 - DNA, 20 bp, Artificial Sequence
  chemically synthesized
cctcaaacaaacaaacaaat

SEQ ID NO: 68118 - DNA, 20 bp, Artificial Sequence
  chemically synthesized
ggaacatacctcaaaataat

SEQ ID NO: 68119 - DNA, 20 bp, Artificial Sequence
  chemically synthesized
gacatgatcttatacttaga

SEQ ID NO: 68120 - DNA, 20 bp, Artificial Sequence
  chemically synthesized
cttatacttagaaaaaacct

SEQ ID NO: 68121 - DNA, 20 bp, Artificial Sequence
  chemically synthesized
aaaacttcactaaatactat

SEQ ID NO: 68122 - DNA, 20 bp, Artificial Sequence
  chemically synthesized
caatctgcaaaaaaaatcaa

SEQ ID NO: 68123 - DNA, 20 bp, Artificial Sequence
  chemically synthesized
gatctctataagaaaaatta

SEQ ID NO: 68124 - DNA, 20 bp, Artificial Sequence
  chemically synthesized
aatggcattcacagaaatag

SEQ ID NO: 68125 - DNA, 20 bp, Artificial Sequence
  chemically synthesized
gcaatcctgagcaaaaagaa

SEQ ID NO: 68126 - DNA, 20 bp, Artificial Sequence
  chemically synthesized
ttttcaagaaacagtgctag

SEQ ID NO: 68127 - DNA, 20 bp, Artificial Sequence
  chemically synthesized
aaattatgaaactactggaa

SEQ ID NO: 68128 - DNA, 20 bp, Artificial Sequence
  chemically synthesized
acttcaaaagcacaaataac

SEQ ID NO: 68129 - DNA, 20 bp, Artificial Sequence
  chemically synthesized
tcactaatcaccagataaat

SEQ ID NO: 68130 - DNA, 20 bp, Artificial Sequence
  chemically synthesized
ttagttaaaatagcttataa

SEQ ID NO: 68131 - DNA, 20 bp, Artificial Sequence
  chemically synthesized
ttctaactcgtgtggaagtt

SEQ ID NO: 68132 - DNA, 20 bp, Artificial Sequence
  chemically synthesized
aggaatgagaaatcaagcaa

SEQ ID NO: 68133 - DNA, 20 bp, Artificial Sequence
  chemically synthesized
ttaatttactaaaagataaa

SEQ ID NO: 68134 - DNA, 20 bp, Artificial Sequence
  chemically synthesized
tcttttctgaataaaaagag

SEQ ID NO: 68135 - DNA, 20 bp, Artificial Sequence
  chemically synthesized
cttcaggtatctggtaagag

SEQ ID NO: 68136 - DNA, 20 bp, Artificial Sequence
  chemically synthesized
acttatggatgggagtgtca

SEQ ID NO: 68137 - DNA, 20 bp, Artificial Sequence
  chemically synthesized
gattcatgagcttactgaga

SEQ ID NO: 68138 - DNA, 20 bp, Artificial Sequence
  chemically synthesized
aattataactctgaacattt

SEQ ID NO: 68139 - DNA, 20 bp, Artificial Sequence
  chemically synthesized
tgcctgtgaatgccccacct

SEQ ID NO: 68140 - DNA, 20 bp, Artificial Sequence
  chemically synthesized
atgaatccatcttttccttt

SEQ ID NO: 68141 - DNA, 20 bp, Artificial Sequence
  chemically synthesized
ttttgcagtagtaaccatat

SEQ ID NO: 68142 - DNA, 20 bp, Artificial Sequence
  chemically synthesized
cagtagtaaccatatcaaaa

SEQ ID NO: 68143 - DNA, 20 bp, Artificial Sequence
  chemically synthesized
aaccatatcaaaacaaaaca

SEQ ID NO: 68144 - DNA, 20 bp, Artificial Sequence
  chemically synthesized
gaaacatccagggactcaat

SEQ ID NO: 68145 - DNA, 20 bp, Artificial Sequence
  chemically synthesized
tattaattcatcattttatc

SEQ ID NO: 68146 - DNA, 20 bp, Artificial Sequence
  chemically synthesized
cggctagtcaattgttcttg

SEQ ID NO: 68147 - DNA, 20 bp, Artificial Sequence
  chemically synthesized
gaaaaaaatgatctatgacc

SEQ ID NO: 68148 - DNA, 20 bp, Artificial Sequence
  chemically synthesized
aatactctccaatggcacat

SEQ ID NO: 68149 - DNA, 20 bp, Artificial Sequence
  chemically synthesized
agttaccttaaactacatta

SEQ ID NO: 68150 - DNA, 20 bp, Artificial Sequence
  chemically synthesized
aaatacaataaatgcaactc

SEQ ID NO: 68151 - DNA, 20 bp, Artificial Sequence
  chemically synthesized
aatgcaactcccctgctttg

SEQ ID NO: 68152 - DNA, 20 bp, Artificial Sequence
  chemically synthesized
cccctgctttggttagattt

SEQ ID NO: 68153 - DNA, 20 bp, Artificial Sequence
  chemically synthesized
tcatgagaattattcactgt

SEQ ID NO: 68154 - DNA, 20 bp, Artificial Sequence
  chemically synthesized
gtgccagatttactattatg

SEQ ID NO: 68155 - DNA, 20 bp, Artificial Sequence
  chemically synthesized
agtatagtatttttaatatt

SEQ ID NO: 68156 - DNA, 20 bp, Artificial Sequence
  chemically synthesized
ctgaaaatgtatttaaattt

SEQ ID NO: 68157 - DNA, 20 bp, Artificial Sequence
  chemically synthesized
tttattgtctcttgatattc

SEQ ID NO: 68158 - DNA, 20 bp, Artificial Sequence
  chemically synthesized
acacagttaacatgtacttc

SEQ ID NO: 68159 - DNA, 20 bp, Artificial Sequence
  chemically synthesized
caagaaaatgagagtcaaca

SEQ ID NO: 68160 - DNA, 20 bp, Artificial Sequence
  chemically synthesized
cttgttttcattgagtccct

SEQ ID NO: 68161 - DNA, 20 bp, Artificial Sequence
  chemically synthesized
tcacgtagaattcacaatcc

SEQ ID NO: 68162 - DNA, 20 bp, Artificial Sequence
  chemically synthesized
ctaaaaccagctattgtgct

SEQ ID NO: 68163 - DNA, 20 bp, Artificial Sequence
  chemically synthesized
caaacccagcatctcaaata

SEQ ID NO: 68164 - DNA, 20 bp, Artificial Sequence
  chemically synthesized
agcatctcaaataatatgtt

SEQ ID NO: 68165 - DNA, 20 bp, Artificial Sequence
  chemically synthesized
ctcaaataatatgttttttg

SEQ ID NO: 68166 - DNA, 20 bp, Artificial Sequence
  chemically synthesized
agcatgtaggcattaattaa

SEQ ID NO: 68167 - DNA, 20 bp, Artificial Sequence
  chemically synthesized
tggtctttgcaccatagaca

SEQ ID NO: 68168 - DNA, 20 bp, Artificial Sequence
  chemically synthesized
atgtgagcaatgcaggtatt

SEQ ID NO: 68169 - DNA, 20 bp, Artificial Sequence
  chemically synthesized
agtgaaggccacaaacaaac

SEQ ID NO: 68170 - DNA, 20 bp, Artificial Sequence
  chemically synthesized
tgacttgaacatttgctgct

SEQ ID NO: 68171 - DNA, 20 bp, Artificial Sequence
  chemically synthesized
ttgaagcaagcaggaatcaa

SEQ ID NO: 68172 - DNA, 20 bp, Artificial Sequence
  chemically synthesized
aagggctcatggagactgcg

SEQ ID NO: 68173 - DNA, 20 bp, Artificial Sequence
  chemically synthesized
ggaatcccaatccagcactg

SEQ ID NO: 68174 - DNA, 20 bp, Artificial Sequence
  chemically synthesized
ggtctcctgatgcaaacaaa

SEQ ID NO: 68175 - DNA, 20 bp, Artificial Sequence
  chemically synthesized
agtcagtgttactgttcctc

SEQ ID NO: 68176 - DNA, 20 bp, Artificial Sequence
  chemically synthesized
gttactgttcctcttctgct

SEQ ID NO: 68177 - DNA, 20 bp, Artificial Sequence
  chemically synthesized
aaactcattatattgagtct

SEQ ID NO: 68178 - DNA, 20 bp, Artificial Sequence
  chemically synthesized
ctaaaatcatccatcttatt

SEQ ID NO: 68179 - DNA, 20 bp, Artificial Sequence
  chemically synthesized
tcacagttttgaaaggaaaa

SEQ ID NO: 68180 - DNA, 20 bp, Artificial Sequence
  chemically synthesized
atggattcatggagatacat

SEQ ID NO: 68181 - DNA, 20 bp, Artificial Sequence
  chemically synthesized
accagcaaaatcacctggac

SEQ ID NO: 68182 - DNA, 20 bp, Artificial Sequence
  chemically synthesized
acctgtggacaaaaaaaaaa

SEQ ID NO: 68183 - DNA, 20 bp, Artificial Sequence
  chemically synthesized
tctgaccagtacattggtgt

SEQ ID NO: 68184 - DNA, 20 bp, Artificial Sequence
  chemically synthesized
tattcagaataatgtaaaga

SEQ ID NO: 68185 - DNA, 20 bp, Artificial Sequence
  chemically synthesized
aaatctgagccaaagctcct

SEQ ID NO: 68186 - DNA, 20 bp, Artificial Sequence
  chemically synthesized
gctgaaactcttgaaatgtt

SEQ ID NO: 68187 - DNA, 20 bp, Artificial Sequence
  chemically synthesized
atcatttagccagaatagag

SEQ ID NO: 68188 - DNA, 20 bp, Artificial Sequence
  chemically synthesized
gccagaatagagtccagttt

SEQ ID NO: 68189 - DNA, 20 bp, Artificial Sequence
  chemically synthesized
ttcttaatgaaatataggtg

SEQ ID NO: 68190 - DNA, 20 bp, Artificial Sequence
  chemically synthesized
taaaaataaaaaagctaaag

SEQ ID NO: 68191 - DNA, 20 bp, Artificial Sequence
  chemically synthesized
tagtcacttttcaatttcac

SEQ ID NO: 68192 - DNA, 20 bp, Artificial Sequence
  chemically synthesized
tttctgaaaaacctgggctc

SEQ ID NO: 68193 - DNA, 20 bp, Artificial Sequence
  chemically synthesized
ttttaagctatacattagag

SEQ ID NO: 68194 - DNA, 20 bp, Artificial Sequence
  chemically synthesized
tttcctagacacttcaataa

SEQ ID NO: 68195 - DNA, 20 bp, Artificial Sequence
  chemically synthesized
agctcatgaatcagctaacc

SEQ ID NO: 68196 - DNA, 20 bp, Artificial Sequence
  chemically synthesized
agctgttctttgaaagaaaa

SEQ ID NO: 68197 - DNA, 20 bp, Artificial Sequence
  chemically synthesized
agagaaaagaggaaatggat

SEQ ID NO: 68198 - DNA, 20 bp, Artificial Sequence
  chemically synthesized
actagtaggtcaattaaata

SEQ ID NO: 68199 - DNA, 20 bp, Artificial Sequence
  chemically synthesized
caattaaatactttgatttc

SEQ ID NO: 68200 - DNA, 20 bp, Artificial Sequence
  chemically synthesized
atttccacagatttgatccc

SEQ ID NO: 68201 - DNA, 20 bp, Artificial Sequence
  chemically synthesized
cacagatttgatccccaatg

SEQ ID NO: 68202 - DNA, 20 bp, Artificial Sequence
  chemically synthesized
gacactcccatccataagtc

SEQ ID NO: 68203 - DNA, 20 bp, Artificial Sequence
  chemically synthesized
agttcctggttagttggata

SEQ ID NO: 68204 - DNA, 20 bp, Artificial Sequence
  chemically synthesized
ctcctcaattattattgaga

SEQ ID NO: 68205 - DNA, 20 bp, Artificial Sequence
  chemically synthesized
actcaccaatttttcttctc

SEQ ID NO: 68206 - DNA, 20 bp, Artificial Sequence
  chemically synthesized
aatttttcttctccaaggat

SEQ ID NO: 68207 - DNA, 20 bp, Artificial Sequence
  chemically synthesized
agctaatgtcataaatttta

SEQ ID NO: 68208 - DNA, 20 bp, Artificial Sequence
  chemically synthesized
aggagttatgagcatgaaat

SEQ ID NO: 68209 - DNA, 20 bp, Artificial Sequence
  chemically synthesized
ctaaagcccatttaatgcaa

SEQ ID NO: 68210 - DNA, 20 bp, Artificial Sequence
  chemically synthesized
tggtgacattttcactgagg

SEQ ID NO: 68211 - DNA, 20 bp, Artificial Sequence
  chemically synthesized
ttcttcccattttattttat

SEQ ID NO: 68212 - DNA, 20 bp, Artificial Sequence
  chemically synthesized
acctttaaattattagtaaa

SEQ ID NO: 68213 - DNA, 20 bp, Artificial Sequence
  chemically synthesized
attctccttgacattttaca

SEQ ID NO: 68214 - DNA, 20 bp, Artificial Sequence
  chemically synthesized
tgacattttacagctggttt

SEQ ID NO: 68215 - DNA, 20 bp, Artificial Sequence
  chemically synthesized
tagctaagagacacttgata

SEQ ID NO: 68216 - DNA, 20 bp, Artificial Sequence
  chemically synthesized
taatggtggagaatatttat

SEQ ID NO: 68217 - DNA, 20 bp, Artificial Sequence
  chemically synthesized
tactgttgcatgttgaatga

SEQ ID NO: 68218 - DNA, 20 bp, Artificial Sequence
  chemically synthesized
caatttagactagtatacca

SEQ ID NO: 68219 - DNA, 20 bp, Artificial Sequence
  chemically synthesized
ggtttcttcctcttctctta

SEQ ID NO: 68220 - DNA, 20 bp, Artificial Sequence
  chemically synthesized
tcctataacaatatttccag

SEQ ID NO: 68221 - DNA, 20 bp, Artificial Sequence
  chemically synthesized
acagcatgtactgcccaaat

SEQ ID NO: 68222 - DNA, 20 bp, Artificial Sequence
  chemically synthesized
catatgcatcaataactatc

SEQ ID NO: 68223 - DNA, 20 bp, Artificial Sequence
  chemically synthesized
ttgtatttttttagtagaga

SEQ ID NO: 68224 - DNA, 20 bp, Artificial Sequence
  chemically synthesized
cctccgcccccaccaggttc

SEQ ID NO: 68225 - DNA, 20 bp, Artificial Sequence
  chemically synthesized
tgcccaagcctcccaagtag

SEQ ID NO: 68226 - DNA, 20 bp, Artificial Sequence
  chemically synthesized
ttttgtatttttagtagaga

SEQ ID NO: 68227 - DNA, 20 bp, Artificial Sequence
  chemically synthesized
tgccttggcctcccaaagtg

SEQ ID NO: 68228 - DNA, 20 bp, Artificial Sequence
  chemically synthesized
gagggagagagagagagtgg

SEQ ID NO: 68229 - DNA, 20 bp, Artificial Sequence
  chemically synthesized
gagagagagtgggagggttt

SEQ ID NO: 68230 - DNA, 20 bp, Artificial Sequence
  chemically synthesized
gagagtgggagggttttttt

SEQ ID NO: 68231 - DNA, 20 bp, Artificial Sequence
  chemically synthesized
actctctgtcttcataagat

SEQ ID NO: 68232 - DNA, 20 bp, Artificial Sequence
  chemically synthesized
aacatgtgatatttttcttt

SEQ ID NO: 68233 - DNA, 20 bp, Artificial Sequence
  chemically synthesized
gtgatatttttctttctgtg

SEQ ID NO: 68234 - DNA, 20 bp, Artificial Sequence
  chemically synthesized
tggcttatttcacttaacgt

SEQ ID NO: 68235 - DNA, 20 bp, Artificial Sequence
  chemically synthesized
tatctgttgacgaatacatc

SEQ ID NO: 68236 - DNA, 20 bp, Artificial Sequence
  chemically synthesized
catcagttgatttcaaatct

SEQ ID NO: 68237 - DNA, 20 bp, Artificial Sequence
  chemically synthesized
tactcccaccaacagtgtaa

SEQ ID NO: 68238 - DNA, 20 bp, Artificial Sequence
  chemically synthesized
cacaagcatctgttatttcc

SEQ ID NO: 68239 - DNA, 20 bp, Artificial Sequence
  chemically synthesized
aaggtgagatgatatcacat

SEQ ID NO: 68240 - DNA, 20 bp, Artificial Sequence
  chemically synthesized
gagatgatatcacattgtgg

SEQ ID NO: 68241 - DNA, 20 bp, Artificial Sequence
  chemically synthesized
cattgtggttttgatttatc

SEQ ID NO: 68242 - DNA, 20 bp, Artificial Sequence
  chemically synthesized
aaatacctctgggccatttg

SEQ ID NO: 68243 - DNA, 20 bp, Artificial Sequence
  chemically synthesized
tatttatttattttctgttg

SEQ ID NO: 68244 - DNA, 20 bp, Artificial Sequence
  chemically synthesized
tttattttctgttgagttgc

SEQ ID NO: 68245 - DNA, 20 bp, Artificial Sequence
  chemically synthesized
tatcaattccttgtaaaata

SEQ ID NO: 68246 - DNA, 20 bp, Artificial Sequence
  chemically synthesized
ttattattttctttgctgtg

SEQ ID NO: 68247 - DNA, 20 bp, Artificial Sequence
  chemically synthesized
aaacaatcccaattgtctat

SEQ ID NO: 68248 - DNA, 20 bp, Artificial Sequence
  chemically synthesized
tctatttttgttttggttat

SEQ ID NO: 68249 - DNA, 20 bp, Artificial Sequence
  chemically synthesized
ccaaatcaatgaatgccctg

SEQ ID NO: 68250 - DNA, 20 bp, Artificial Sequence
  chemically synthesized
aatgccctggagggtttccc

SEQ ID NO: 68251 - DNA, 20 bp, Artificial Sequence
  chemically synthesized
tttccccactgttttcttcc

SEQ ID NO: 68252 - DNA, 20 bp, Artificial Sequence
  chemically synthesized
gtagtttcataatttcaggt

SEQ ID NO: 68253 - DNA, 20 bp, Artificial Sequence
  chemically synthesized
ggattcaagtctttaatcca

SEQ ID NO: 68254 - DNA, 20 bp, Artificial Sequence
  chemically synthesized
caagtctttaatccatcttg

SEQ ID NO: 68255 - DNA, 20 bp, Artificial Sequence
  chemically synthesized
gtatatagtgagagataggg

SEQ ID NO: 68256 - DNA, 20 bp, Artificial Sequence
  chemically synthesized
tactcttttgcaaatggata

SEQ ID NO: 68257 - DNA, 20 bp, Artificial Sequence
  chemically synthesized
tggatatccagttttcctag

SEQ ID NO: 68258 - DNA, 20 bp, Artificial Sequence
  chemically synthesized
ctagcactgtttcttgaaaa

SEQ ID NO: 68259 - DNA, 20 bp, Artificial Sequence
  chemically synthesized
aacttctgcctcccaggttc

SEQ ID NO: 68260 - DNA, 20 bp, Artificial Sequence
  chemically synthesized
tgcctcagcctcctgagtat

SEQ ID NO: 68261 - DNA, 20 bp, Artificial Sequence
  chemically synthesized
cacctcagcctcacaaagtg

SEQ ID NO: 68262 - DNA, 20 bp, Artificial Sequence
  chemically synthesized
gatgacttggttgttaagtg

SEQ ID NO: 68263 - DNA, 20 bp, Artificial Sequence
  chemically synthesized
tctgtctttatgcagtactg

SEQ ID NO: 68264 - DNA, 20 bp, Artificial Sequence
  chemically synthesized
gtactgtgctgtttggctac

SEQ ID NO: 68265 - DNA, 20 bp, Artificial Sequence
  chemically synthesized
tttggctactgtagctttgt

SEQ ID NO: 68266 - DNA, 20 bp, Artificial Sequence
  chemically synthesized
attttgaagtcatatagtgt

SEQ ID NO: 68267 - DNA, 20 bp, Artificial Sequence
  chemically synthesized
aagtcatatagtgtgatagc

SEQ ID NO: 68268 - DNA, 20 bp, Artificial Sequence
  chemically synthesized
tttggttttgttctttttgc

SEQ ID NO: 68269 - DNA, 20 bp, Artificial Sequence
  chemically synthesized
gttttgttctttttgctcag

SEQ ID NO: 68270 - DNA, 20 bp, Artificial Sequence
  chemically synthesized
tttgtggttccatataaata

SEQ ID NO: 68271 - DNA, 20 bp, Artificial Sequence
  chemically synthesized
tggttccatataaatattag

SEQ ID NO: 68272 - DNA, 20 bp, Artificial Sequence
  chemically synthesized
gaaattgcactgaatctgta

SEQ ID NO: 68273 - DNA, 20 bp, Artificial Sequence
  chemically synthesized
ccctcttctatttctttcac

SEQ ID NO: 68274 - DNA, 20 bp, Artificial Sequence
  chemically synthesized
agagatcttttacttcttgg

SEQ ID NO: 68275 - DNA, 20 bp, Artificial Sequence
  chemically synthesized
tatttttattgctattgtaa

SEQ ID NO: 68276 - DNA, 20 bp, Artificial Sequence
  chemically synthesized
tttattgctattgtaaataa

SEQ ID NO: 68277 - DNA, 20 bp, Artificial Sequence
  chemically synthesized
tattgtaaataagattgttt

SEQ ID NO: 68278 - DNA, 20 bp, Artificial Sequence
  chemically synthesized
attgttttattgattttttt

SEQ ID NO: 68279 - DNA, 20 bp, Artificial Sequence
  chemically synthesized
actttttatatatgaaatgc

SEQ ID NO: 68280 - DNA, 20 bp, Artificial Sequence
  chemically synthesized
tatttcatatcctgtaactt

SEQ ID NO: 68281 - DNA, 20 bp, Artificial Sequence
  chemically synthesized
taactttattgattttttta

SEQ ID NO: 68282 - DNA, 20 bp, Artificial Sequence
  chemically synthesized
atcgttttaatagtatttag

SEQ ID NO: 68283 - DNA, 20 bp, Artificial Sequence
  chemically synthesized
aatagtatttagtgaagttt

SEQ ID NO: 68284 - DNA, 20 bp, Artificial Sequence
  chemically synthesized
gtccttagaggaaaggcctt

SEQ ID NO: 68285 - DNA, 20 bp, Artificial Sequence
  chemically synthesized
tgttcagcataatgttagca

SEQ ID NO: 68286 - DNA, 20 bp, Artificial Sequence
  chemically synthesized
ttagcacttggtttgtccta

SEQ ID NO: 68287 - DNA, 20 bp, Artificial Sequence
  chemically synthesized
catttgttgttgtgtcctgg

SEQ ID NO: 68288 - DNA, 20 bp, Artificial Sequence
  chemically synthesized
ctggtttgggtatattagag

SEQ ID NO: 68289 - DNA, 20 bp, Artificial Sequence
  chemically synthesized
agtaatgcttgcctcataga

SEQ ID NO: 68290 - DNA, 20 bp, Artificial Sequence
  chemically synthesized
tttagaagtaggcccttctt

SEQ ID NO: 68291 - DNA, 20 bp, Artificial Sequence
  chemically synthesized
ggcccttcttttcagttttt

SEQ ID NO: 68292 - DNA, 20 bp, Artificial Sequence
  chemically synthesized
cttcttttcagtttttattt

SEQ ID NO: 68293 - DNA, 20 bp, Artificial Sequence
  chemically synthesized
ttttcagtttttatttgttt

SEQ ID NO: 68294 - DNA, 20 bp, Artificial Sequence
  chemically synthesized
tgtttgtttgaggaatttga

SEQ ID NO: 68295 - DNA, 20 bp, Artificial Sequence
  chemically synthesized
attagtattagttctacttg

SEQ ID NO: 68296 - DNA, 20 bp, Artificial Sequence
  chemically synthesized
gtttggtagcccatcgagtc

SEQ ID NO: 68297 - DNA, 20 bp, Artificial Sequence
  chemically synthesized
gttattcattattgttctat

SEQ ID NO: 68298 - DNA, 20 bp, Artificial Sequence
  chemically synthesized
attattgttctattgaggtt

SEQ ID NO: 68299 - DNA, 20 bp, Artificial Sequence
  chemically synthesized
tattgaggttttctgtttct

SEQ ID NO: 68300 - DNA, 20 bp, Artificial Sequence
  chemically synthesized
ccaggaatttatccatttat

SEQ ID NO: 68301 - DNA, 20 bp, Artificial Sequence
  chemically synthesized
tttatttgactcttttttct

SEQ ID NO: 68302 - DNA, 20 bp, Artificial Sequence
  chemically synthesized
actcttttttcttaaagttt

SEQ ID NO: 68303 - DNA, 20 bp, Artificial Sequence
  chemically synthesized
ttttcttaaagttttgttga

SEQ ID NO: 68304 - DNA, 20 bp, Artificial Sequence
  chemically synthesized
gtttacctttccaagaaagc

SEQ ID NO: 68305 - DNA, 20 bp, Artificial Sequence
  chemically synthesized
acctttccaagaaagcaact

SEQ ID NO: 68306 - DNA, 20 bp, Artificial Sequence
  chemically synthesized
agaaagcaactgtttgtttt

SEQ ID NO: 68307 - DNA, 20 bp, Artificial Sequence
  chemically synthesized
tattttttggtctcaatttc

SEQ ID NO: 68308 - DNA, 20 bp, Artificial Sequence
  chemically synthesized
ccccttctattaattttgca

SEQ ID NO: 68309 - DNA, 20 bp, Artificial Sequence
  chemically synthesized
taattttgcatttggtttgt

SEQ ID NO: 68310 - DNA, 20 bp, Artificial Sequence
  chemically synthesized
tttcctatttccttgaggta

SEQ ID NO: 68311 - DNA, 20 bp, Artificial Sequence
  chemically synthesized
ttccttgaggtacattgttt

SEQ ID NO: 68312 - DNA, 20 bp, Artificial Sequence
  chemically synthesized
ctttctacttttttggatat

SEQ ID NO: 68313 - DNA, 20 bp, Artificial Sequence
  chemically synthesized
gctatgaacttccctctaag

SEQ ID NO: 68314 - DNA, 20 bp, Artificial Sequence
  chemically synthesized
tactgcttttgccatatcct

SEQ ID NO: 68315 - DNA, 20 bp, Artificial Sequence
  chemically synthesized
tatgttgtatttccattttc

SEQ ID NO: 68316 - DNA, 20 bp, Artificial Sequence
  chemically synthesized
ttccattttcacttgtttca

SEQ ID NO: 68317 - DNA, 20 bp, Artificial Sequence
  chemically synthesized
ctttagtgactcattggtta

SEQ ID NO: 68318 - DNA, 20 bp, Artificial Sequence
  chemically synthesized
ccctgtgaggagactaccaa

SEQ ID NO: 68319 - DNA, 20 bp, Artificial Sequence
  chemically synthesized
aacaggctttgtgtgagcaa

SEQ ID NO: 68320 - DNA, 20 bp, Artificial Sequence
  chemically synthesized
gcaaagggagataggagtgg

SEQ ID NO: 68321 - DNA, 20 bp, Artificial Sequence
  chemically synthesized
gataggagtggggctgtttt

SEQ ID NO: 68322 - DNA, 20 bp, Artificial Sequence
  chemically synthesized
ggtcacaaggtgctcagtag

SEQ ID NO: 68323 - DNA, 20 bp, Artificial Sequence
  chemically synthesized
ctgcaggtcacaggggacat

SEQ ID NO: 68324 - DNA, 20 bp, Artificial Sequence
  chemically synthesized
ggtcacaggggacatgatgg

SEQ ID NO: 68325 - DNA, 20 bp, Artificial Sequence
  chemically synthesized
taatgggcgatatttctcag

SEQ ID NO: 68326 - DNA, 20 bp, Artificial Sequence
  chemically synthesized
atttctcagggctgcttcga

SEQ ID NO: 68327 - DNA, 20 bp, Artificial Sequence
  chemically synthesized
ggcgtgggaacctagagtgg

SEQ ID NO: 68328 - DNA, 20 bp, Artificial Sequence
  chemically synthesized
gtgggagagattaagctgaa

SEQ ID NO: 68329 - DNA, 20 bp, Artificial Sequence
  chemically synthesized
attattggtgatggcctgga

SEQ ID NO: 68330 - DNA, 20 bp, Artificial Sequence
  chemically synthesized
atggcctggatacggttttg

SEQ ID NO: 68331 - DNA, 20 bp, Artificial Sequence
  chemically synthesized
gaagtgggaggacctaggac

SEQ ID NO: 68332 - DNA, 20 bp, Artificial Sequence
  chemically synthesized
atctgattaaagagtgccta

SEQ ID NO: 68333 - DNA, 20 bp, Artificial Sequence
  chemically synthesized
attcaacatagtcctgccag

SEQ ID NO: 68334 - DNA, 20 bp, Artificial Sequence
  chemically synthesized
ttacttcaagagttaagagt

SEQ ID NO: 68335 - DNA, 20 bp, Artificial Sequence
  chemically synthesized
caccaggagatatcagctgt

SEQ ID NO: 68336 - DNA, 20 bp, Artificial Sequence
  chemically synthesized
gacagaagatagcagggatg

SEQ ID NO: 68337 - DNA, 20 bp, Artificial Sequence
  chemically synthesized
agtcctttttaagttggtgg

SEQ ID NO: 68338 - DNA, 20 bp, Artificial Sequence
  chemically synthesized
tggtggctgagcttggtgag

SEQ ID NO: 68339 - DNA, 20 bp, Artificial Sequence
  chemically synthesized
cggaggaccgtaagggatat

SEQ ID NO: 68340 - DNA, 20 bp, Artificial Sequence
  chemically synthesized
tgaatactaagagcctgaaa

SEQ ID NO: 68341 - DNA, 20 bp, Artificial Sequence
  chemically synthesized
aagagcctgaaaaactgctt

SEQ ID NO: 68342 - DNA, 20 bp, Artificial Sequence
  chemically synthesized
tcctgggtgggggcaaatcc

SEQ ID NO: 68343 - DNA, 20 bp, Artificial Sequence
  chemically synthesized
tgagaagttatttctttgag

SEQ ID NO: 68344 - DNA, 20 bp, Artificial Sequence
  chemically synthesized
gaggttcgaagaggcaggct

SEQ ID NO: 68345 - DNA, 20 bp, Artificial Sequence
  chemically synthesized
tatcaggaataatgtgggag

SEQ ID NO: 68346 - DNA, 20 bp, Artificial Sequence
  chemically synthesized
gcatcaggtatgaggaagaa

SEQ ID NO: 68347 - DNA, 20 bp, Artificial Sequence
  chemically synthesized
aatgtgaagagtgagctaag

SEQ ID NO: 68348 - DNA, 20 bp, Artificial Sequence
  chemically synthesized
aagagtgagctaagcatagt

SEQ ID NO: 68349 - DNA, 20 bp, Artificial Sequence
  chemically synthesized
tgcctaggaaggaaaggagt

SEQ ID NO: 68350 - DNA, 20 bp, Artificial Sequence
  chemically synthesized
aaggagttgttgttttgtag

SEQ ID NO: 68351 - DNA, 20 bp, Artificial Sequence
  chemically synthesized
tgttgttttgtagaagggat

SEQ ID NO: 68352 - DNA, 20 bp, Artificial Sequence
  chemically synthesized
tgtagaagggattgaggttt

SEQ ID NO: 68353 - DNA, 20 bp, Artificial Sequence
  chemically synthesized
acaatcagcagggagagcac

SEQ ID NO: 68354 - DNA, 20 bp, Artificial Sequence
  chemically synthesized
gtaacacatgaggatgaaat

SEQ ID NO: 68355 - DNA, 20 bp, Artificial Sequence
  chemically synthesized
gcaaaggaatagtaaagaaa

SEQ ID NO: 68356 - DNA, 20 bp, Artificial Sequence
  chemically synthesized
tattgaggataggagagtat

SEQ ID NO: 68357 - DNA, 20 bp, Artificial Sequence
  chemically synthesized
aaacaatttggttgataaga

SEQ ID NO: 68358 - DNA, 20 bp, Artificial Sequence
  chemically synthesized
gcagattctgaactaacctg

SEQ ID NO: 68359 - DNA, 20 bp, Artificial Sequence
  chemically synthesized
gaactaacctgtaaggcttg

SEQ ID NO: 68360 - DNA, 20 bp, Artificial Sequence
  chemically synthesized
taaaatgggggaatggtaag

SEQ ID NO: 68361 - DNA, 20 bp, Artificial Sequence
  chemically synthesized
gggaatggtaaggagagttt

SEQ ID NO: 68362 - DNA, 20 bp, Artificial Sequence
  chemically synthesized
gctgtaacaggcaagtaata

SEQ ID NO: 68363 - DNA, 20 bp, Artificial Sequence
  chemically synthesized
actggcattgagcggggtaa

SEQ ID NO: 68364 - DNA, 20 bp, Artificial Sequence
  chemically synthesized
attgagcggggtaagagtga

SEQ ID NO: 68365 - DNA, 20 bp, Artificial Sequence
  chemically synthesized
aagtagaggtgtcttatact

SEQ ID NO: 68366 - DNA, 20 bp, Artificial Sequence
  chemically synthesized
atacaaggggaggatgtgaa

SEQ ID NO: 68367 - DNA, 20 bp, Artificial Sequence
  chemically synthesized
aggtggggataatgaaaaag

SEQ ID NO: 68368 - DNA, 20 bp, Artificial Sequence
  chemically synthesized
accagagttggggaatttta

SEQ ID NO: 68369 - DNA, 20 bp, Artificial Sequence
  chemically synthesized
tgtggagtgggtagcctcca

SEQ ID NO: 68370 - DNA, 20 bp, Artificial Sequence
  chemically synthesized
tcggtgtctgtgatggtcta

SEQ ID NO: 68371 - DNA, 20 bp, Artificial Sequence
  chemically synthesized
gctgccaggtgagttgaaca

SEQ ID NO: 68372 - DNA, 20 bp, Artificial Sequence
  chemically synthesized
ggggtcctgcacagatggga

SEQ ID NO: 68373 - DNA, 20 bp, Artificial Sequence
  chemically synthesized
gggcattccttggcctggtg

SEQ ID NO: 68374 - DNA, 20 bp, Artificial Sequence
  chemically synthesized
ccggaggaacgcctggccac

SEQ ID NO: 68375 - DNA, 20 bp, Artificial Sequence
  chemically synthesized
ttgtgtgctggagatgtggc

SEQ ID NO: 68376 - DNA, 20 bp, Artificial Sequence
  chemically synthesized
aggttaattgagtcctgttg

SEQ ID NO: 68377 - DNA, 20 bp, Artificial Sequence
  chemically synthesized
gaggtccagaatttaatttt

SEQ ID NO: 68378 - DNA, 20 bp, Artificial Sequence
  chemically synthesized
gagttttatttaatgtcagg

SEQ ID NO: 68379 - DNA, 20 bp, Artificial Sequence
  chemically synthesized
cgaacgagccatgaactggg

SEQ ID NO: 68380 - DNA, 20 bp, Artificial Sequence
  chemically synthesized
ttgatgaaagagcctaaacg

SEQ ID NO: 68381 - DNA, 20 bp, Artificial Sequence
  chemically synthesized
gcattaaccttgactacgcc

SEQ ID NO: 68382 - DNA, 20 bp, Artificial Sequence
  chemically synthesized
tgtgaggaggggaggtgata

SEQ ID NO: 68383 - DNA, 20 bp, Artificial Sequence
  chemically synthesized
ggtggaggagctgaggctga

SEQ ID NO: 68384 - DNA, 20 bp, Artificial Sequence
  chemically synthesized
tcagatgggtctgtagaaaa

SEQ ID NO: 68385 - DNA, 20 bp, Artificial Sequence
  chemically synthesized
ggaagattagaaagactcag

SEQ ID NO: 68386 - DNA, 20 bp, Artificial Sequence
  chemically synthesized
gacaggcgggagggaaagaa

SEQ ID NO: 68387 - DNA, 20 bp, Artificial Sequence
  chemically synthesized
cctggacgtcaggcacctca

SEQ ID NO: 68388 - DNA, 20 bp, Artificial Sequence
  chemically synthesized
tcaggcacctcagactgttt

SEQ ID NO: 68389 - DNA, 20 bp, Artificial Sequence
  chemically synthesized
ctggctatttggaaccactg

SEQ ID NO: 68390 - DNA, 20 bp, Artificial Sequence
  chemically synthesized
tgcagaagaaaataaggcat

SEQ ID NO: 68391 - DNA, 20 bp, Artificial Sequence
  chemically synthesized
ttaggtcaggtgtgagttga

SEQ ID NO: 68392 - DNA, 20 bp, Artificial Sequence
  chemically synthesized
agaggtcggggtgcagaaat

SEQ ID NO: 68393 - DNA, 20 bp, Artificial Sequence
  chemically synthesized
agaggttggggcacagaaat

SEQ ID NO: 68394 - DNA, 20 bp, Artificial Sequence
  chemically synthesized
acttacccccctccagaaaa

SEQ ID NO: 68395 - DNA, 20 bp, Artificial Sequence
  chemically synthesized
gtggtctgacacctctgaaa

SEQ ID NO: 68396 - DNA, 20 bp, Artificial Sequence
  chemically synthesized
taatcagagaggtgtccctg

SEQ ID NO: 68397 - DNA, 20 bp, Artificial Sequence
  chemically synthesized
tcccagtccgtgactggcac

SEQ ID NO: 68398 - DNA, 20 bp, Artificial Sequence
  chemically synthesized
ggagaaattgaagtgtggtg

SEQ ID NO: 68399 - DNA, 20 bp, Artificial Sequence
  chemically synthesized
acagtaaaaagaggccactt

SEQ ID NO: 68400 - DNA, 20 bp, Artificial Sequence
  chemically synthesized
taccggatttgaaattggtg

SEQ ID NO: 68401 - DNA, 20 bp, Artificial Sequence
  chemically synthesized
gtgaaatgtttcttgggctg

SEQ ID NO: 68402 - DNA, 20 bp, Artificial Sequence
  chemically synthesized
ggagcaaagagcaggaggac

SEQ ID NO: 68403 - DNA, 20 bp, Artificial Sequence
  chemically synthesized
ccatatgaagagactaccaa

SEQ ID NO: 68404 - DNA, 20 bp, Artificial Sequence
  chemically synthesized
aggctttgtgtaagcaacaa

SEQ ID NO: 68405 - DNA, 20 bp, Artificial Sequence
  chemically synthesized
gcaaagggagataggagtgg

SEQ ID NO: 68406 - DNA, 20 bp, Artificial Sequence
  chemically synthesized
gataggagtggggctgtttt

SEQ ID NO: 68407 - DNA, 20 bp, Artificial Sequence
  chemically synthesized
ggtcacaaggtgctcagtag

SEQ ID NO: 68408 - DNA, 20 bp, Artificial Sequence
  chemically synthesized
atgcaggtcacaggggacat

SEQ ID NO: 68409 - DNA, 20 bp, Artificial Sequence
  chemically synthesized
ggtcacaggggacatgatgg

SEQ ID NO: 68410 - DNA, 20 bp, Artificial Sequence
  chemically synthesized
aggcctgacattcaggagca

SEQ ID NO: 68411 - DNA, 20 bp, Artificial Sequence
  chemically synthesized
ctgacattcaggagcatact

SEQ ID NO: 68412 - DNA, 20 bp, Artificial Sequence
  chemically synthesized
gagcatactgtttgatttcc

SEQ ID NO: 68413 - DNA, 20 bp, Artificial Sequence
  chemically synthesized
tgatcttcttgttattcatt

SEQ ID NO: 68414 - DNA, 20 bp, Artificial Sequence
  chemically synthesized
atttaggaaaatgttgtaca

SEQ ID NO: 68415 - DNA, 20 bp, Artificial Sequence
  chemically synthesized
cattaactgtgttgttcatt

SEQ ID NO: 68416 - DNA, 20 bp, Artificial Sequence
  chemically synthesized
tctgttcattactgagactg

SEQ ID NO: 68417 - DNA, 20 bp, Artificial Sequence
  chemically synthesized
gtctcgccctttaggactat

SEQ ID NO: 68418 - DNA, 20 bp, Artificial Sequence
  chemically synthesized
tgaccctccttatcttttct

SEQ ID NO: 68419 - DNA, 20 bp, Artificial Sequence
  chemically synthesized
ttaaatttgtagtctatttt

SEQ ID NO: 68420 - DNA, 20 bp, Artificial Sequence
  chemically synthesized
gtacaattactactgctctt

SEQ ID NO: 68421 - DNA, 20 bp, Artificial Sequence
  chemically synthesized
tgtgtgcctttataggtgaa

SEQ ID NO: 68422 - DNA, 20 bp, Artificial Sequence
  chemically synthesized
gaagatcgcataaagttgga

SEQ ID NO: 68423 - DNA, 20 bp, Artificial Sequence
  chemically synthesized
cactcagtgtagttactaag

SEQ ID NO: 68424 - DNA, 20 bp, Artificial Sequence
  chemically synthesized
tttttttttttttttttttt

SEQ ID NO: 68425 - DNA, 20 bp, Artificial Sequence
  chemically synthesized
cttttttttccttcatggtt

SEQ ID NO: 68426 - DNA, 20 bp, Artificial Sequence
  chemically synthesized
tttatttttagtaaatctat

SEQ ID NO: 68427 - DNA, 20 bp, Artificial Sequence
  chemically synthesized
tttttgtgctgtggttacca

SEQ ID NO: 68428 - DNA, 20 bp, Artificial Sequence
  chemically synthesized
taaaaggttgctatagctat

SEQ ID NO: 68429 - DNA, 20 bp, Artificial Sequence
  chemically synthesized
ctatagctattactgttttt

SEQ ID NO: 68430 - DNA, 20 bp, Artificial Sequence
  chemically synthesized
gctattactgtttttgaaag

SEQ ID NO: 68431 - DNA, 20 bp, Artificial Sequence
  chemically synthesized
gtttttgaaagatttgtttt

SEQ ID NO: 68432 - DNA, 20 bp, Artificial Sequence
  chemically synthesized
ggtttcatactggagttctg

SEQ ID NO: 68433 - DNA, 20 bp, Artificial Sequence
  chemically synthesized
aaatacagtaatggggtatt

SEQ ID NO: 68434 - DNA, 20 bp, Artificial Sequence
  chemically synthesized
ctatgtacttaattttacca

SEQ ID NO: 68435 - DNA, 20 bp, Artificial Sequence
  chemically synthesized
ccagtgggtttcatactttg

SEQ ID NO: 68436 - DNA, 20 bp, Artificial Sequence
  chemically synthesized
catgttaatgtcttttttct

SEQ ID NO: 68437 - DNA, 20 bp, Artificial Sequence
  chemically synthesized
tgttggtgaattctctcaac

SEQ ID NO: 68438 - DNA, 20 bp, Artificial Sequence
  chemically synthesized
tgtctgggaaagactttata

SEQ ID NO: 68439 - DNA, 20 bp, Artificial Sequence
  chemically synthesized
tatattgcttatatttgaat

SEQ ID NO: 68440 - DNA, 20 bp, Artificial Sequence
  chemically synthesized
cctataaaatattcttgaat

SEQ ID NO: 68441 - DNA, 20 bp, Artificial Sequence
  chemically synthesized
atcagttttcttttatccct

SEQ ID NO: 68442 - DNA, 20 bp, Artificial Sequence
  chemically synthesized
attcgactctctcttggact

SEQ ID NO: 68443 - DNA, 20 bp, Artificial Sequence
  chemically synthesized
ggactgtgtgatttctattg

SEQ ID NO: 68444 - DNA, 20 bp, Artificial Sequence
  chemically synthesized
ctattgagatgtttgttgtc

SEQ ID NO: 68445 - DNA, 20 bp, Artificial Sequence
  chemically synthesized
ttggagctcctttatatgct

SEQ ID NO: 68446 - DNA, 20 bp, Artificial Sequence
  chemically synthesized
tgctatttgtttctcatctc

SEQ ID NO: 68447 - DNA, 20 bp, Artificial Sequence
  chemically synthesized
atagtaagtgaagtgaagtt

SEQ ID NO: 68448 - DNA, 20 bp, Artificial Sequence
  chemically synthesized
tcatgaatctcaaaggagaa

SEQ ID NO: 68449 - DNA, 20 bp, Artificial Sequence
  chemically synthesized
aaggagaaaatggtttacag

SEQ ID NO: 68450 - DNA, 20 bp, Artificial Sequence
  chemically synthesized
tacagaattgcttggtgttc

SEQ ID NO: 68451 - DNA, 20 bp, Artificial Sequence
  chemically synthesized
taatatggtgggctaaagaa

SEQ ID NO: 68452 - DNA, 20 bp, Artificial Sequence
  chemically synthesized
gctaaagaatcaggttttta

SEQ ID NO: 68453 - DNA, 20 bp, Artificial Sequence
  chemically synthesized
tcaggtttttagttggattg

SEQ ID NO: 68454 - DNA, 20 bp, Artificial Sequence
  chemically synthesized
ttggattgtctggttttgag

SEQ ID NO: 68455 - DNA, 20 bp, Artificial Sequence
  chemically synthesized
ggcatgatgacttgacttct

SEQ ID NO: 68456 - DNA, 20 bp, Artificial Sequence
  chemically synthesized
atgacttgacttctctatgt

SEQ ID NO: 68457 - DNA, 20 bp, Artificial Sequence
  chemically synthesized
atttcttcatatatttgttc

SEQ ID NO: 68458 - DNA, 20 bp, Artificial Sequence
  chemically synthesized
tgactttaatttttatgtac

SEQ ID NO: 68459 - DNA, 20 bp, Artificial Sequence
  chemically synthesized
ctgtgtattcacgtattgta

SEQ ID NO: 68460 - DNA, 20 bp, Artificial Sequence
  chemically synthesized
attttactaggaactttgct

SEQ ID NO: 68461 - DNA, 20 bp, Artificial Sequence
  chemically synthesized
taatcttcaagatcataaaa

SEQ ID NO: 68462 - DNA, 20 bp, Artificial Sequence
  chemically synthesized
aattactaatagcaagatag

SEQ ID NO: 68463 - DNA, 20 bp, Artificial Sequence
  chemically synthesized
aggacttggctcttgggtgt

SEQ ID NO: 68464 - DNA, 20 bp, Artificial Sequence
  chemically synthesized
taaagttacaaaaattatct

SEQ ID NO: 68465 - DNA, 20 bp, Artificial Sequence
  chemically synthesized
accaataattattgttaagg

SEQ ID NO: 68466 - DNA, 20 bp, Artificial Sequence
  chemically synthesized
gaatttttttttaaatccca

SEQ ID NO: 68467 - DNA, 20 bp, Artificial Sequence
  chemically synthesized
actacattgaacactttcaa

SEQ ID NO: 68468 - DNA, 20 bp, Artificial Sequence
  chemically synthesized
ctgataatcactcaagactg

SEQ ID NO: 68469 - DNA, 20 bp, Artificial Sequence
  chemically synthesized
gggctctgcaatccctgtct

SEQ ID NO: 68470 - DNA, 20 bp, Artificial Sequence
  chemically synthesized
tcttctggtcctccctacct

SEQ ID NO: 68471 - DNA, 20 bp, Artificial Sequence
  chemically synthesized
tccctacctttttgtttgtc

SEQ ID NO: 68472 - DNA, 20 bp, Artificial Sequence
  chemically synthesized
tcagaagcttgtctactacc

SEQ ID NO: 68473 - DNA, 20 bp, Artificial Sequence
  chemically synthesized
aagactattgcaggagtagg

SEQ ID NO: 68474 - DNA, 20 bp, Artificial Sequence
  chemically synthesized
gcaggagtaggccttgcttt

SEQ ID NO: 68475 - DNA, 20 bp, Artificial Sequence
  chemically synthesized
aaacagtattttcaagtagt

SEQ ID NO: 68476 - DNA, 20 bp, Artificial Sequence
  chemically synthesized
attgaactcattaaaaataa

SEQ ID NO: 68477 - DNA, 20 bp, Artificial Sequence
  chemically synthesized
aaaatagctttctaaagcca

SEQ ID NO: 68478 - DNA, 20 bp, Artificial Sequence
  chemically synthesized
cctgaccagttaaaagttat

SEQ ID NO: 68479 - DNA, 20 bp, Artificial Sequence
  chemically synthesized
gcttcatggtgcatattcaa

SEQ ID NO: 68480 - DNA, 20 bp, Artificial Sequence
  chemically synthesized
ttttgttattattatcattc

SEQ ID NO: 68481 - DNA, 20 bp, Artificial Sequence
  chemically synthesized
aaatgtgcaaatcttagctg

SEQ ID NO: 68482 - DNA, 20 bp, Artificial Sequence
  chemically synthesized
tccatcagaggtaagcaggg

SEQ ID NO: 68483 - DNA, 20 bp, Artificial Sequence
  chemically synthesized
acaatatgtactcttttgtg

SEQ ID NO: 68484 - DNA, 20 bp, Artificial Sequence
  chemically synthesized
atgtcactgaattgagtatt

SEQ ID NO: 68485 - DNA, 20 bp, Artificial Sequence
  chemically synthesized
attctcagggaaatatataa

SEQ ID NO: 68486 - DNA, 20 bp, Artificial Sequence
  chemically synthesized
aacaacgctgttgcgaattt

SEQ ID NO: 68487 - DNA, 20 bp, Artificial Sequence
  chemically synthesized
atcgttaatgccaaagagga

SEQ ID NO: 68488 - DNA, 20 bp, Artificial Sequence
  chemically synthesized
ttgtaggtgtgaatgttatg

SEQ ID NO: 68489 - DNA, 20 bp, Artificial Sequence
  chemically synthesized
gcacatggagactggaatat

SEQ ID NO: 68490 - DNA, 20 bp, Artificial Sequence
  chemically synthesized
gttaaaataagcatagagat

SEQ ID NO: 68491 - DNA, 20 bp, Artificial Sequence
  chemically synthesized
ctgaagaaactgctaacttg

SEQ ID NO: 68492 - DNA, 20 bp, Artificial Sequence
  chemically synthesized
catttaattgacgtgtaatc

SEQ ID NO: 68493 - DNA, 20 bp, Artificial Sequence
  chemically synthesized
taatcttgggattatattaa

SEQ ID NO: 68494 - DNA, 20 bp, Artificial Sequence
  chemically synthesized
attttaaagtaatatttata

SEQ ID NO: 68495 - DNA, 20 bp, Artificial Sequence
  chemically synthesized
ttaatatattagaacacaag

SEQ ID NO: 68496 - DNA, 20 bp, Artificial Sequence
  chemically synthesized
ctctttctccacctgctatc

SEQ ID NO: 68497 - DNA, 20 bp, Artificial Sequence
  chemically synthesized
tgtgatggtggggctagggt

SEQ ID NO: 68498 - DNA, 20 bp, Artificial Sequence
  chemically synthesized
ttagagatatttatctggga

SEQ ID NO: 68499 - DNA, 20 bp, Artificial Sequence
  chemically synthesized
aatatttccaaataaaaatg

SEQ ID NO: 68500 - DNA, 20 bp, Artificial Sequence
  chemically synthesized
atgccctgatttttaccagt

SEQ ID NO: 68501 - DNA, 20 bp, Artificial Sequence
  chemically synthesized
ttttaccagttaccgatttt

SEQ ID NO: 68502 - DNA, 20 bp, Artificial Sequence
  chemically synthesized
gcagagctgagatgagcata

SEQ ID NO: 68503 - DNA, 20 bp, Artificial Sequence
  chemically synthesized
aatccatgcatactatttgt

SEQ ID NO: 68504 - DNA, 20 bp, Artificial Sequence
  chemically synthesized
tagttactacctccctgtat

SEQ ID NO: 68505 - DNA, 20 bp, Artificial Sequence
  chemically synthesized
gactggaggacatagagaca

SEQ ID NO: 68506 - DNA, 20 bp, Artificial Sequence
  chemically synthesized
ttataatttaaatataagac

SEQ ID NO: 68507 - DNA, 20 bp, Artificial Sequence
  chemically synthesized
aagacaggtaataatagtgt

SEQ ID NO: 68508 - DNA, 20 bp, Artificial Sequence
  chemically synthesized
gtaataatagtgttagagat

SEQ ID NO: 68509 - DNA, 20 bp, Artificial Sequence
  chemically synthesized
gattcttgattccacctgaa

SEQ ID NO: 68510 - DNA, 20 bp, Artificial Sequence
  chemically synthesized
ggttggtctccaagcatgat

SEQ ID NO: 68511 - DNA, 20 bp, Artificial Sequence
  chemically synthesized
taaatatggatctaattcta

SEQ ID NO: 68512 - DNA, 20 bp, Artificial Sequence
  chemically synthesized
tctaattctagactgttttc

SEQ ID NO: 68513 - DNA, 20 bp, Artificial Sequence
  chemically synthesized
tgcacatactgccgttctta

SEQ ID NO: 68514 - DNA, 20 bp, Artificial Sequence
  chemically synthesized
taactttgtattctttcaaa

SEQ ID NO: 68515 - DNA, 20 bp, Artificial Sequence
  chemically synthesized
catgggtaaatcttcatgaa

SEQ ID NO: 68516 - DNA, 20 bp, Artificial Sequence
  chemically synthesized
ttcatgaactttgattttac

SEQ ID NO: 68517 - DNA, 20 bp, Artificial Sequence
  chemically synthesized
aacaaaaaataaatacataa

SEQ ID NO: 68518 - DNA, 20 bp, Artificial Sequence
  chemically synthesized
ctttgcaaattatgtatttc

SEQ ID NO: 68519 - DNA, 20 bp, Artificial Sequence
  chemically synthesized
gtatatattaaaaatatata

SEQ ID NO: 68520 - DNA, 20 bp, Artificial Sequence
  chemically synthesized
gtccttatttaatgtcatga

SEQ ID NO: 68521 - DNA, 20 bp, Artificial Sequence
  chemically synthesized
taaaacagatcctcaaataa

SEQ ID NO: 68522 - DNA, 20 bp, Artificial Sequence
  chemically synthesized
atggatatcattatatgtca

SEQ ID NO: 68523 - DNA, 20 bp, Artificial Sequence
  chemically synthesized
tcattatatgtcacttggct

SEQ ID NO: 68524 - DNA, 20 bp, Artificial Sequence
  chemically synthesized
tatgtcacttggcttaaagt

SEQ ID NO: 68525 - DNA, 20 bp, Artificial Sequence
  chemically synthesized
tatatgaattatctaaaata

SEQ ID NO: 68526 - DNA, 20 bp, Artificial Sequence
  chemically synthesized
actgatttagagaaacatat

SEQ ID NO: 68527 - DNA, 20 bp, Artificial Sequence
  chemically synthesized
ctgcctaacaagtatagcat

SEQ ID NO: 68528 - DNA, 20 bp, Artificial Sequence
  chemically synthesized
catttctgcttggatgatga

SEQ ID NO: 68529 - DNA, 20 bp, Artificial Sequence
  chemically synthesized
acttaaaaatggttaatatg

SEQ ID NO: 68530 - DNA, 20 bp, Artificial Sequence
  chemically synthesized
taaaacaagacaaattttta

SEQ ID NO: 68531 - DNA, 20 bp, Artificial Sequence
  chemically synthesized
gttgaattgaatttattatg

SEQ ID NO: 68532 - DNA, 20 bp, Artificial Sequence
  chemically synthesized
tatacagttctattatcatt

SEQ ID NO: 68533 - DNA, 20 bp, Artificial Sequence
  chemically synthesized
ttatcattttgggttttatt

SEQ ID NO: 68534 - DNA, 20 bp, Artificial Sequence
  chemically synthesized
gttttattttttgtttttct

SEQ ID NO: 68535 - DNA, 20 bp, Artificial Sequence
  chemically synthesized
ttttttgtttttctttttgt

SEQ ID NO: 68536 - DNA, 20 bp, Artificial Sequence
  chemically synthesized
ttgtttttgttttacgtatt

SEQ ID NO: 68537 - DNA, 20 bp, Artificial Sequence
  chemically synthesized
tgcctcagcctcccatgtag

SEQ ID NO: 68538 - DNA, 20 bp, Artificial Sequence
  chemically synthesized
cttgcagttgcataaaacat

SEQ ID NO: 68539 - DNA, 20 bp, Artificial Sequence
  chemically synthesized
atgtaaataaagaaatacac

SEQ ID NO: 68540 - DNA, 20 bp, Artificial Sequence
  chemically synthesized
ttctccccccgaaatcaaaa

SEQ ID NO: 68541 - DNA, 20 bp, Artificial Sequence
  chemically synthesized
ccccccgaaatcaaaatttt

SEQ ID NO: 68542 - DNA, 20 bp, Artificial Sequence
  chemically synthesized
atcacttagcaccctgtacc

SEQ ID NO: 68543 - DNA, 20 bp, Artificial Sequence
  chemically synthesized
agcaccctgtaccttttgtt

SEQ ID NO: 68544 - DNA, 20 bp, Artificial Sequence
  chemically synthesized
aattctgtctagaacaccat

SEQ ID NO: 68545 - DNA, 20 bp, Artificial Sequence
  chemically synthesized
acaccatatcagttttagct

SEQ ID NO: 68546 - DNA, 20 bp, Artificial Sequence
  chemically synthesized
agctaagtgcttccaaaact

SEQ ID NO: 68547 - DNA, 20 bp, Artificial Sequence
  chemically synthesized
tccaaaactccctgctttaa

SEQ ID NO: 68548 - DNA, 20 bp, Artificial Sequence
  chemically synthesized
aactccctgctttaaaattg

SEQ ID NO: 68549 - DNA, 20 bp, Artificial Sequence
  chemically synthesized
tttccctttcccttcctgct

SEQ ID NO: 68550 - DNA, 20 bp, Artificial Sequence
  chemically synthesized
cagaatctgagtgctcaact

SEQ ID NO: 68551 - DNA, 20 bp, Artificial Sequence
  chemically synthesized
tgctcaactgaaagtttatt

SEQ ID NO: 68552 - DNA, 20 bp, Artificial Sequence
  chemically synthesized
ctgtgtagctatatatgtat

SEQ ID NO: 68553 - DNA, 20 bp, Artificial Sequence
  chemically synthesized
gagtagaaaaaaaaactata

SEQ ID NO: 68554 - DNA, 20 bp, Artificial Sequence
  chemically synthesized
gtactagcagaaacaaatta

SEQ ID NO: 68555 - DNA, 20 bp, Artificial Sequence
  chemically synthesized
caaattaattagatttttta

SEQ ID NO: 68556 - DNA, 20 bp, Artificial Sequence
  chemically synthesized
ctaagcataagccaagcatg

SEQ ID NO: 68557 - DNA, 20 bp, Artificial Sequence
  chemically synthesized
gccaagcatgagtagatttc

SEQ ID NO: 68558 - DNA, 20 bp, Artificial Sequence
  chemically synthesized
tcaagtgtttaagatagtac

SEQ ID NO: 68559 - DNA, 20 bp, Artificial Sequence
  chemically synthesized
agatagtacctcagatttct

SEQ ID NO: 68560 - DNA, 20 bp, Artificial Sequence
  chemically synthesized
aacattctcatggcattgtt

SEQ ID NO: 68561 - DNA, 20 bp, Artificial Sequence
  chemically synthesized
tgttctaggcttttaagaag

SEQ ID NO: 68562 - DNA, 20 bp, Artificial Sequence
  chemically synthesized
taaaaatttgtattgatgtg

SEQ ID NO: 68563 - DNA, 20 bp, Artificial Sequence
  chemically synthesized
atcatagataattacttttg

SEQ ID NO: 68564 - DNA, 20 bp, Artificial Sequence
  chemically synthesized
gggattacattcttttttat

SEQ ID NO: 68565 - DNA, 20 bp, Artificial Sequence
  chemically synthesized
aaatattctccttaatcttc

SEQ ID NO: 68566 - DNA, 20 bp, Artificial Sequence
  chemically synthesized
atcttctctagctttttaaa

SEQ ID NO: 68567 - DNA, 20 bp, Artificial Sequence
  chemically synthesized
caatcattttacttcttcag

SEQ ID NO: 68568 - DNA, 20 bp, Artificial Sequence
  chemically synthesized
cactatagggggaaatgtgt

SEQ ID NO: 68569 - DNA, 20 bp, Artificial Sequence
  chemically synthesized
ttaatttaatattggttatt

SEQ ID NO: 68570 - DNA, 20 bp, Artificial Sequence
  chemically synthesized
ggtgttgacaaaaataatat

SEQ ID NO: 68571 - DNA, 20 bp, Artificial Sequence
  chemically synthesized
ctctacgtaggaaaagtcaa

SEQ ID NO: 68572 - DNA, 20 bp, Artificial Sequence
  chemically synthesized
cctaaaatatatttctcttt

SEQ ID NO: 68573 - DNA, 20 bp, Artificial Sequence
  chemically synthesized
gatagacaccatcattttaa

SEQ ID NO: 68574 - DNA, 20 bp, Artificial Sequence
  chemically synthesized
accatcattttaagtgtgtt

SEQ ID NO: 68575 - DNA, 20 bp, Artificial Sequence
  chemically synthesized
taagtgtgtttgaggatttc

SEQ ID NO: 68576 - DNA, 20 bp, Artificial Sequence
  chemically synthesized
gcaaaatcactcgatcttta

SEQ ID NO: 68577 - DNA, 20 bp, Artificial Sequence
  chemically synthesized
ggtcttcaccccataaatga

SEQ ID NO: 68578 - DNA, 20 bp, Artificial Sequence
  chemically synthesized
aggatgtgaatgtggtgagg

SEQ ID NO: 68579 - DNA, 20 bp, Artificial Sequence
  chemically synthesized
ctcacagtaggaatgaggaa

SEQ ID NO: 68580 - DNA, 20 bp, Artificial Sequence
  chemically synthesized
aatgccattgccaggagaat

SEQ ID NO: 68581 - DNA, 20 bp, Artificial Sequence
  chemically synthesized
ggtatgcaagccttccagcc

SEQ ID NO: 68582 - DNA, 20 bp, Artificial Sequence
  chemically synthesized
accacacatcctgggaatta

SEQ ID NO: 68583 - DNA, 20 bp, Artificial Sequence
  chemically synthesized
cgaaagaaaggagccgtatg

SEQ ID NO: 68584 - DNA, 20 bp, Artificial Sequence
  chemically synthesized
ttagtgaaagactacaaagt

SEQ ID NO: 68585 - DNA, 20 bp, Artificial Sequence
  chemically synthesized
cttaggctgaatgaggtctc

SEQ ID NO: 68586 - DNA, 20 bp, Artificial Sequence
  chemically synthesized
gctgaatgaggtctcatcag

SEQ ID NO: 68587 - DNA, 20 bp, Artificial Sequence
  chemically synthesized
catcagatttgttttctttc

SEQ ID NO: 68588 - DNA, 20 bp, Artificial Sequence
  chemically synthesized
attagtagatattatttaat

SEQ ID NO: 68589 - DNA, 20 bp, Artificial Sequence
  chemically synthesized
agcctcttaccctaggccct

SEQ ID NO: 68590 - DNA, 20 bp, Artificial Sequence
  chemically synthesized
aagtaaggcaggataaatct

SEQ ID NO: 68591 - DNA, 20 bp, Artificial Sequence
  chemically synthesized
agagttatgaaatttagttg

SEQ ID NO: 68592 - DNA, 20 bp, Artificial Sequence
  chemically synthesized
gagggaattaagtctgacaa

SEQ ID NO: 68593 - DNA, 20 bp, Artificial Sequence
  chemically synthesized
agcatgtatgccttcttcca

SEQ ID NO: 68594 - DNA, 20 bp, Artificial Sequence
  chemically synthesized
atttgcaatggcagacggag

SEQ ID NO: 68595 - DNA, 20 bp, Artificial Sequence
  chemically synthesized
cacaaggtcaggagttccag

SEQ ID NO: 68596 - DNA, 20 bp, Artificial Sequence
  chemically synthesized
tcaagaggctgaggcaggag

SEQ ID NO: 68597 - DNA, 20 bp, Artificial Sequence
  chemically synthesized
atcgcttgaacctgggaggc

SEQ ID NO: 68598 - DNA, 20 bp, Artificial Sequence
  chemically synthesized
aggtggtaaagaataaaata

SEQ ID NO: 68599 - DNA, 20 bp, Artificial Sequence
  chemically synthesized
ttgtttctttccacttcagt

SEQ ID NO: 68600 - DNA, 20 bp, Artificial Sequence
  chemically synthesized
tacacattgtatatatatat

SEQ ID NO: 68601 - DNA, 20 bp, Artificial Sequence
  chemically synthesized
agggtacatgtgcacaacat

SEQ ID NO: 68602 - DNA, 20 bp, Artificial Sequence
  chemically synthesized
cacctatgagtgagaatatg

SEQ ID NO: 68603 - DNA, 20 bp, Artificial Sequence
  chemically synthesized
atgagtgagaatatgtggtg

SEQ ID NO: 68604 - DNA, 20 bp, Artificial Sequence
  chemically synthesized
tgcgatactttgctcagaat

SEQ ID NO: 68605 - DNA, 20 bp, Artificial Sequence
  chemically synthesized
ctttgctcagaatgatggtt

SEQ ID NO: 68606 - DNA, 20 bp, Artificial Sequence
  chemically synthesized
gtgcatgtgtctttatagca

SEQ ID NO: 68607 - DNA, 20 bp, Artificial Sequence
  chemically synthesized
ctgacttccacaatggttga

SEQ ID NO: 68608 - DNA, 20 bp, Artificial Sequence
  chemically synthesized
tccacatcctctccagcacc

SEQ ID NO: 68609 - DNA, 20 bp, Artificial Sequence
  chemically synthesized
ggtgtgagatgatatctcat

SEQ ID NO: 68610 - DNA, 20 bp, Artificial Sequence
  chemically synthesized
gagatgatatctcattgtgg

SEQ ID NO: 68611 - DNA, 20 bp, Artificial Sequence
  chemically synthesized
gtgatgatgagcattttttc

SEQ ID NO: 68612 - DNA, 20 bp, Artificial Sequence
  chemically synthesized
cttcacccccttgttgatgc

SEQ ID NO: 68613 - DNA, 20 bp, Artificial Sequence
  chemically synthesized
acccccttgttgatgcagtt

SEQ ID NO: 68614 - DNA, 20 bp, Artificial Sequence
  chemically synthesized
tgtttgtttttttcttgtaa

SEQ ID NO: 68615 - DNA, 20 bp, Artificial Sequence
  chemically synthesized
gtaaatttgtttgagttcat

SEQ ID NO: 68616 - DNA, 20 bp, Artificial Sequence
  chemically synthesized
tattagccctttgtcagatg

SEQ ID NO: 68617 - DNA, 20 bp, Artificial Sequence
  chemically synthesized
ggttgcctgttcactctgat

SEQ ID NO: 68618 - DNA, 20 bp, Artificial Sequence
  chemically synthesized
cttttgctgtgcagaagctc

SEQ ID NO: 68619 - DNA, 20 bp, Artificial Sequence
  chemically synthesized
tccattttgtcttttgttgc

SEQ ID NO: 68620 - DNA, 20 bp, Artificial Sequence
  chemically synthesized
tcttttgttgccattgcttt

SEQ ID NO: 68621 - DNA, 20 bp, Artificial Sequence
  chemically synthesized
catgcctatgtcctgaatgg

SEQ ID NO: 68622 - DNA, 20 bp, Artificial Sequence
  chemically synthesized
tatgtcctgaatggtattgc

SEQ ID NO: 68623 - DNA, 20 bp, Artificial Sequence
  chemically synthesized
gtattgcttaggttttcttc

SEQ ID NO: 68624 - DNA, 20 bp, Artificial Sequence
  chemically synthesized
aggttttcttctaaggtttt

SEQ ID NO: 68625 - DNA, 20 bp, Artificial Sequence
  chemically synthesized
tataaggtgtaaggaaggga

SEQ ID NO: 68626 - DNA, 20 bp, Artificial Sequence
  chemically synthesized
gtgtaaggaagggatccagt

SEQ ID NO: 68627 - DNA, 20 bp, Artificial Sequence
  chemically synthesized
cagctttctacatatggcta

SEQ ID NO: 68628 - DNA, 20 bp, Artificial Sequence
  chemically synthesized
taaatagggaatcctttccc

SEQ ID NO: 68629 - DNA, 20 bp, Artificial Sequence
  chemically synthesized
tagggaatcctttccccatt

SEQ ID NO: 68630 - DNA, 20 bp, Artificial Sequence
  chemically synthesized
ttccccattgcttgtttttg

SEQ ID NO: 68631 - DNA, 20 bp, Artificial Sequence
  chemically synthesized
tctgctccattggtctacat

SEQ ID NO: 68632 - DNA, 20 bp, Artificial Sequence
  chemically synthesized
ctgttttggtaccagtacca

SEQ ID NO: 68633 - DNA, 20 bp, Artificial Sequence
  chemically synthesized
ttggttactgtaccttgtag

SEQ ID NO: 68634 - DNA, 20 bp, Artificial Sequence
  chemically synthesized
aagtcaggtagcatgatgcc

SEQ ID NO: 68635 - DNA, 20 bp, Artificial Sequence
  chemically synthesized
gatgcctctagctttgttct

SEQ ID NO: 68636 - DNA, 20 bp, Artificial Sequence
  chemically synthesized
tctagctttgttcttttggc

SEQ ID NO: 68637 - DNA, 20 bp, Artificial Sequence
  chemically synthesized
tggttccatatgaactttaa

SEQ ID NO: 68638 - DNA, 20 bp, Artificial Sequence
  chemically synthesized
attctgtgaagaaagtcatt

SEQ ID NO: 68639 - DNA, 20 bp, Artificial Sequence
  chemically synthesized
cagtaaggccattttcacga

SEQ ID NO: 68640 - DNA, 20 bp, Artificial Sequence
  chemically synthesized
tgagcatggaatgttcttcc

SEQ ID NO: 68641 - DNA, 20 bp, Artificial Sequence
  chemically synthesized
tcctcttttatttcgttgag

SEQ ID NO: 68642 - DNA, 20 bp, Artificial Sequence
  chemically synthesized
gtccttcacatcccttgtaa

SEQ ID NO: 68643 - DNA, 20 bp, Artificial Sequence
  chemically synthesized
aattgtgaatgggagttcac

SEQ ID NO: 68644 - DNA, 20 bp, Artificial Sequence
  chemically synthesized
agttcactcatgatttggct

SEQ ID NO: 68645 - DNA, 20 bp, Artificial Sequence
  chemically synthesized
tgtctgttattggtgtatag

SEQ ID NO: 68646 - DNA, 20 bp, Artificial Sequence
  chemically synthesized
ttattggtgtataggaatgc

SEQ ID NO: 68647 - DNA, 20 bp, Artificial Sequence
  chemically synthesized
gaatgcttgtgatttttgca

SEQ ID NO: 68648 - DNA, 20 bp, Artificial Sequence
  chemically synthesized
gtatgctgagacttttctga

SEQ ID NO: 68649 - DNA, 20 bp, Artificial Sequence
  chemically synthesized
agacttttctgaagttgctt

SEQ ID NO: 68650 - DNA, 20 bp, Artificial Sequence
  chemically synthesized
tgaagttgcttatcagctta

SEQ ID NO: 68651 - DNA, 20 bp, Artificial Sequence
  chemically synthesized
gagattttgggctgagacga

SEQ ID NO: 68652 - DNA, 20 bp, Artificial Sequence
  chemically synthesized
gccctttatttctttctctt

SEQ ID NO: 68653 - DNA, 20 bp, Artificial Sequence
  chemically synthesized
agagggcatccctgtcttgt

SEQ ID NO: 68654 - DNA, 20 bp, Artificial Sequence
  chemically synthesized
cttgtgccagttttcaaagg

SEQ ID NO: 68655 - DNA, 20 bp, Artificial Sequence
  chemically synthesized
cagttttcaaagggaatgct

SEQ ID NO: 68656 - DNA, 20 bp, Artificial Sequence
  chemically synthesized
cattcagtatgatattggct

SEQ ID NO: 68657 - DNA, 20 bp, Artificial Sequence
  chemically synthesized
ccatcgatacctaatttatt

SEQ ID NO: 68658 - DNA, 20 bp, Artificial Sequence
  chemically synthesized
tgcatctattgagataatca

SEQ ID NO: 68659 - DNA, 20 bp, Artificial Sequence
  chemically synthesized
catgtggtttgtgtctttgg

SEQ ID NO: 68660 - DNA, 20 bp, Artificial Sequence
  chemically synthesized
gtctttggttctgtttatat

SEQ ID NO: 68661 - DNA, 20 bp, Artificial Sequence
  chemically synthesized
ggttctgtttatatgctgga

SEQ ID NO: 68662 - DNA, 20 bp, Artificial Sequence
  chemically synthesized
tttatatgctggattatgtt

SEQ ID NO: 68663 - DNA, 20 bp, Artificial Sequence
  chemically synthesized
agcccacttgatcatggtgg

SEQ ID NO: 68664 - DNA, 20 bp, Artificial Sequence
  chemically synthesized
gataagctttttgatgtgct

SEQ ID NO: 68665 - DNA, 20 bp, Artificial Sequence
  chemically synthesized
ctttttgatgtgctcctgga

SEQ ID NO: 68666 - DNA, 20 bp, Artificial Sequence
  chemically synthesized
ttggtttgccagtattttac

SEQ ID NO: 68667 - DNA, 20 bp, Artificial Sequence
  chemically synthesized
ctttttttgttgtgtgtctg

SEQ ID NO: 68668 - DNA, 20 bp, Artificial Sequence
  chemically synthesized
ggcctcataaaatgagttag

SEQ ID NO: 68669 - DNA, 20 bp, Artificial Sequence
  chemically synthesized
gggaggattccctctttttc

SEQ ID NO: 68670 - DNA, 20 bp, Artificial Sequence
  chemically synthesized
cctctttttctattgattgg

SEQ ID NO: 68671 - DNA, 20 bp, Artificial Sequence
  chemically synthesized
tcctggactttttttggttg

SEQ ID NO: 68672 - DNA, 20 bp, Artificial Sequence
  chemically synthesized
atactttacagacaagcaat

SEQ ID NO: 68673 - DNA, 20 bp, Artificial Sequence
  chemically synthesized
aatggaaaacaaaaaaaagg

SEQ ID NO: 68674 - DNA, 20 bp, Artificial Sequence
  chemically synthesized
atgcacccaatacagcagca

SEQ ID NO: 68675 - DNA, 20 bp, Artificial Sequence
  chemically synthesized
cagtgcaatcaaactagaac

SEQ ID NO: 68676 - DNA, 20 bp, Artificial Sequence
  chemically synthesized
taagatcagagcagaagtga

SEQ ID NO: 68677 - DNA, 20 bp, Artificial Sequence
  chemically synthesized
aaaaatcaatgaatccagga

SEQ ID NO: 68678 - DNA, 20 bp, Artificial Sequence
  chemically synthesized
ctgaaattgagacaataatt

SEQ ID NO: 68679 - DNA, 20 bp, Artificial Sequence
  chemically synthesized
caccacagcagcaagtaatt

SEQ ID NO: 68680 - DNA, 20 bp, Artificial Sequence
  chemically synthesized
tctaaaaaatgtggatagaa

SEQ ID NO: 68681 - DNA, 20 bp, Artificial Sequence
  chemically synthesized
agtttaatattgagtggaaa

SEQ ID NO: 68682 - DNA, 20 bp, Artificial Sequence
  chemically synthesized
gggtaggtgacatatacaga

SEQ ID NO: 68683 - DNA, 20 bp, Artificial Sequence
  chemically synthesized
ataataatatgtgaatgaca

SEQ ID NO: 68684 - DNA, 20 bp, Artificial Sequence
  chemically synthesized
aagtaaaagctggctaaagt

SEQ ID NO: 68685 - DNA, 20 bp, Artificial Sequence
  chemically synthesized
cttgttttttgaggtggcac

SEQ ID NO: 68686 - DNA, 20 bp, Artificial Sequence
  chemically synthesized
gaaatgactgctcccccatc

SEQ ID NO: 68687 - DNA, 20 bp, Artificial Sequence
  chemically synthesized
gcatagtctgctacctttac

SEQ ID NO: 68688 - DNA, 20 bp, Artificial Sequence
  chemically synthesized
tctcaaattttatatgatgg

SEQ ID NO: 68689 - DNA, 20 bp, Artificial Sequence
  chemically synthesized
ttgggtcccattttttgagt

SEQ ID NO: 68690 - DNA, 20 bp, Artificial Sequence
  chemically synthesized
cacacagctgagcaatttac

SEQ ID NO: 68691 - DNA, 20 bp, Artificial Sequence
  chemically synthesized
ctactttatttacataaact

SEQ ID NO: 68692 - DNA, 20 bp, Artificial Sequence
  chemically synthesized
gaatattttaagtaaactgt

SEQ ID NO: 68693 - DNA, 20 bp, Artificial Sequence
  chemically synthesized
gaagtgagggttacagtgac

SEQ ID NO: 68694 - DNA, 20 bp, Artificial Sequence
  chemically synthesized
tgaagataagggggaaagaa

SEQ ID NO: 68695 - DNA, 20 bp, Artificial Sequence
  chemically synthesized
tggtgatcttttgtgatacc

SEQ ID NO: 68696 - DNA, 20 bp, Artificial Sequence
  chemically synthesized
gatacctatggtttttaaat

SEQ ID NO: 68697 - DNA, 20 bp, Artificial Sequence
  chemically synthesized
cctatggtttttaaatattt

SEQ ID NO: 68698 - DNA, 20 bp, Artificial Sequence
  chemically synthesized
ttttaaatatttgtttgttt

SEQ ID NO: 68699 - DNA, 20 bp, Artificial Sequence
  chemically synthesized
tttaatttaaactttagttc

SEQ ID NO: 68700 - DNA, 20 bp, Artificial Sequence
  chemically synthesized
caaaattattgtcaactgga

SEQ ID NO: 68701 - DNA, 20 bp, Artificial Sequence
  chemically synthesized
taagtttaactttcaggact

SEQ ID NO: 68702 - DNA, 20 bp, Artificial Sequence
  chemically synthesized
caggcttattatccatcaaa

SEQ ID NO: 68703 - DNA, 20 bp, Artificial Sequence
  chemically synthesized
tatccatcaaactgagattg

SEQ ID NO: 68704 - DNA, 20 bp, Artificial Sequence
  chemically synthesized
cagacacatgaattttgaaa

SEQ ID NO: 68705 - DNA, 20 bp, Artificial Sequence
  chemically synthesized
agagttaaaaattttggagt

SEQ ID NO: 68706 - DNA, 20 bp, Artificial Sequence
  chemically synthesized
taaaattttttattactgag

SEQ ID NO: 68707 - DNA, 20 bp, Artificial Sequence
  chemically synthesized
caaaaatcaaggaaaatgtt

SEQ ID NO: 68708 - DNA, 20 bp, Artificial Sequence
  chemically synthesized
attaagttatcggaagaatg

SEQ ID NO: 68709 - DNA, 20 bp, Artificial Sequence
  chemically synthesized
tcggaagaatgagctgcttc

SEQ ID NO: 68710 - DNA, 20 bp, Artificial Sequence
  chemically synthesized
tttttctggtgttattttct

SEQ ID NO: 68711 - DNA, 20 bp, Artificial Sequence
  chemically synthesized
caagttttcattgagcataa

SEQ ID NO: 68712 - DNA, 20 bp, Artificial Sequence
  chemically synthesized
gaggagacaaaataaatgca

SEQ ID NO: 68713 - DNA, 20 bp, Artificial Sequence
  chemically synthesized
tttaaagcatgtcttgggcc

SEQ ID NO: 68714 - DNA, 20 bp, Artificial Sequence
  chemically synthesized
catgtcttgggcccaaggtt

SEQ ID NO: 68715 - DNA, 20 bp, Artificial Sequence
  chemically synthesized
catggaaggagatgacacag

SEQ ID NO: 68716 - DNA, 20 bp, Artificial Sequence
  chemically synthesized
ggtcttttgtccctgtcata

SEQ ID NO: 68717 - DNA, 20 bp, Artificial Sequence
  chemically synthesized
ccctttaatttttaaggttc

SEQ ID NO: 68718 - DNA, 20 bp, Artificial Sequence
  chemically synthesized
ttttaaggttctattgcttt

SEQ ID NO: 68719 - DNA, 20 bp, Artificial Sequence
  chemically synthesized
tgatattcatggaattaaaa

SEQ ID NO: 68720 - DNA, 20 bp, Artificial Sequence
  chemically synthesized
aactggcttcacactgataa

SEQ ID NO: 68721 - DNA, 20 bp, Artificial Sequence
  chemically synthesized
taagccagatttatggagag

SEQ ID NO: 68722 - DNA, 20 bp, Artificial Sequence
  chemically synthesized
aagtggagccttccatatat

SEQ ID NO: 68723 - DNA, 20 bp, Artificial Sequence
  chemically synthesized
atatttttcaaagaatccct

SEQ ID NO: 68724 - DNA, 20 bp, Artificial Sequence
  chemically synthesized
gtaaaacttccctataaata

SEQ ID NO: 68725 - DNA, 20 bp, Artificial Sequence
  chemically synthesized
agctgaccctgactggatga

SEQ ID NO: 68726 - DNA, 20 bp, Artificial Sequence
  chemically synthesized
agaattatcacatgcatttc

SEQ ID NO: 68727 - DNA, 20 bp, Artificial Sequence
  chemically synthesized
accatagtgagggtaaattg

SEQ ID NO: 68728 - DNA, 20 bp, Artificial Sequence
  chemically synthesized
gggtaaattggatggcttca

SEQ ID NO: 68729 - DNA, 20 bp, Artificial Sequence
  chemically synthesized
actctgctgataacttatta

SEQ ID NO: 68730 - DNA, 20 bp, Artificial Sequence
  chemically synthesized
tgaagaatttttttttgagc

SEQ ID NO: 68731 - DNA, 20 bp, Artificial Sequence
  chemically synthesized
gagcaaatgttttcagtaaa

SEQ ID NO: 68732 - DNA, 20 bp, Artificial Sequence
  chemically synthesized
agatgaaataatagttattg

SEQ ID NO: 68733 - DNA, 20 bp, Artificial Sequence
  chemically synthesized
ttattgatatgtttaattta

SEQ ID NO: 68734 - DNA, 20 bp, Artificial Sequence
  chemically synthesized
gatatgtttaatttaatatg

SEQ ID NO: 68735 - DNA, 20 bp, Artificial Sequence
  chemically synthesized
aagtctacagtctttgagcc

SEQ ID NO: 68736 - DNA, 20 bp, Artificial Sequence
  chemically synthesized
cccttaataatcatatatct

SEQ ID NO: 68737 - DNA, 20 bp, Artificial Sequence
  chemically synthesized
taagtattatgtagaataaa

SEQ ID NO: 68738 - DNA, 20 bp, Artificial Sequence
  chemically synthesized
agaaattgccatcactttag

SEQ ID NO: 68739 - DNA, 20 bp, Artificial Sequence
  chemically synthesized
cagattgtgctgttaaaaga

SEQ ID NO: 68740 - DNA, 20 bp, Artificial Sequence
  chemically synthesized
agactcagtttttaaatttc

SEQ ID NO: 68741 - DNA, 20 bp, Artificial Sequence
  chemically synthesized
tggatttcaaggaaatggat

SEQ ID NO: 68742 - DNA, 20 bp, Artificial Sequence
  chemically synthesized
ttaaccaaaatagcagtaaa

SEQ ID NO: 68743 - DNA, 20 bp, Artificial Sequence
  chemically synthesized
gcagtaaaaatggctttggc

SEQ ID NO: 68744 - DNA, 20 bp, Artificial Sequence
  chemically synthesized
agtatctgtaaattaaggat

SEQ ID NO: 68745 - DNA, 20 bp, Artificial Sequence
  chemically synthesized
tctgtaaattaaggatgttg

SEQ ID NO: 68746 - DNA, 20 bp, Artificial Sequence
  chemically synthesized
aattaaggatgttggattgc

SEQ ID NO: 68747 - DNA, 20 bp, Artificial Sequence
  chemically synthesized
gcttgagattttagctctaa

SEQ ID NO: 68748 - DNA, 20 bp, Artificial Sequence
  chemically synthesized
taaattagtgtcctggatgc

SEQ ID NO: 68749 - DNA, 20 bp, Artificial Sequence
  chemically synthesized
taatttggcataattggaca

SEQ ID NO: 68750 - DNA, 20 bp, Artificial Sequence
  chemically synthesized
gaaatattaatttatttctt

SEQ ID NO: 68751 - DNA, 20 bp, Artificial Sequence
  chemically synthesized
ccttgtttgtaggctgtaga

SEQ ID NO: 68752 - DNA, 20 bp, Artificial Sequence
  chemically synthesized
gtgggctgcatgcatcccaa

SEQ ID NO: 68753 - DNA, 20 bp, Artificial Sequence
  chemically synthesized
cacaactttcttaaaacatt

SEQ ID NO: 68754 - DNA, 20 bp, Artificial Sequence
  chemically synthesized
atgagattttatgggacatt

SEQ ID NO: 68755 - DNA, 20 bp, Artificial Sequence
  chemically synthesized
atgtgtggcccagggaagcc

SEQ ID NO: 68756 - DNA, 20 bp, Artificial Sequence
  chemically synthesized
aagattggacatccctgctg

SEQ ID NO: 68757 - DNA, 20 bp, Artificial Sequence
  chemically synthesized
aatcaatatttgcagagtct

SEQ ID NO: 68758 - DNA, 20 bp, Artificial Sequence
  chemically synthesized
gcagagtcttgtagcttttt

SEQ ID NO: 68759 - DNA, 20 bp, Artificial Sequence
  chemically synthesized
tttcccctgccacattgaag

SEQ ID NO: 68760 - DNA, 20 bp, Artificial Sequence
  chemically synthesized
tagccactcttctttccagg

SEQ ID NO: 68761 - DNA, 20 bp, Artificial Sequence
  chemically synthesized
gaattactaatatattatct

SEQ ID NO: 68762 - DNA, 20 bp, Artificial Sequence
  chemically synthesized
tacaccaggacctgccttaa

SEQ ID NO: 68763 - DNA, 20 bp, Artificial Sequence
  chemically synthesized
acttgtatagaagccaatac

SEQ ID NO: 68764 - DNA, 20 bp, Artificial Sequence
  chemically synthesized
gactgcttgtattaaagaaa

SEQ ID NO: 68765 - DNA, 20 bp, Artificial Sequence
  chemically synthesized
taaagaaacaaagtttaatt

SEQ ID NO: 68766 - DNA, 20 bp, Artificial Sequence
  chemically synthesized
tttaattcatcgttttgttg

SEQ ID NO: 68767 - DNA, 20 bp, Artificial Sequence
  chemically synthesized
ttcatcgttttgttgttgtg

SEQ ID NO: 68768 - DNA, 20 bp, Artificial Sequence
  chemically synthesized
attttatgtattttgttgaa

SEQ ID NO: 68769 - DNA, 20 bp, Artificial Sequence
  chemically synthesized
caagagtaatgcatgcctga

SEQ ID NO: 68770 - DNA, 20 bp, Artificial Sequence
  chemically synthesized
tgaagatggggcctggtggg

SEQ ID NO: 68771 - DNA, 20 bp, Artificial Sequence
  chemically synthesized
ataggagcagagttatcata

SEQ ID NO: 68772 - DNA, 20 bp, Artificial Sequence
  chemically synthesized
ggtgagttctcatgagatat

SEQ ID NO: 68773 - DNA, 20 bp, Artificial Sequence
  chemically synthesized
agccatgtgaagacacatgc

SEQ ID NO: 68774 - DNA, 20 bp, Artificial Sequence
  chemically synthesized
tgctcctgtttttctctctg

SEQ ID NO: 68775 - DNA, 20 bp, Artificial Sequence
  chemically synthesized
tttttctctctgccatgatt

SEQ ID NO: 68776 - DNA, 20 bp, Artificial Sequence
  chemically synthesized
tagaagctgagcagacgttg

SEQ ID NO: 68777 - DNA, 20 bp, Artificial Sequence
  chemically synthesized
tattatttaagttatgtgac

SEQ ID NO: 68778 - DNA, 20 bp, Artificial Sequence
  chemically synthesized
aggtgttcaagatgtgtcct

SEQ ID NO: 68779 - DNA, 20 bp, Artificial Sequence
  chemically synthesized
ttaaaagggaagcagagcat

SEQ ID NO: 68780 - DNA, 20 bp, Artificial Sequence
  chemically synthesized
cctggtggcctaggagtact

SEQ ID NO: 68781 - DNA, 20 bp, Artificial Sequence
  chemically synthesized
agtactgaatgattttgtgg

SEQ ID NO: 68782 - DNA, 20 bp, Artificial Sequence
  chemically synthesized
ttcaggaccctgctgccttg

SEQ ID NO: 68783 - DNA, 20 bp, Artificial Sequence
  chemically synthesized
ggcccaagaacagctaaggc

SEQ ID NO: 68784 - DNA, 20 bp, Artificial Sequence
  chemically synthesized
gggtgcaagacataagcctt

SEQ ID NO: 68785 - DNA, 20 bp, Artificial Sequence
  chemically synthesized
gtgtgcaaaggtcaaaaagt

SEQ ID NO: 68786 - DNA, 20 bp, Artificial Sequence
  chemically synthesized
ttgaggcttgtaagcctcca

SEQ ID NO: 68787 - DNA, 20 bp, Artificial Sequence
  chemically synthesized
cccagaatggtagatccact

SEQ ID NO: 68788 - DNA, 20 bp, Artificial Sequence
  chemically synthesized
gatatgagacatggggtcaa

SEQ ID NO: 68789 - DNA, 20 bp, Artificial Sequence
  chemically synthesized
gagtgttaaggtgtgtattt

SEQ ID NO: 68790 - DNA, 20 bp, Artificial Sequence
  chemically synthesized
ctgggtaatttataaagaaa

SEQ ID NO: 68791 - DNA, 20 bp, Artificial Sequence
  chemically synthesized
agcatgtgaaaaacctaccc

SEQ ID NO: 68792 - DNA, 20 bp, Artificial Sequence
  chemically synthesized
tgtgttccttccatgacagg

SEQ ID NO: 68793 - DNA, 20 bp, Artificial Sequence
  chemically synthesized
aaggtgtaatgactgccctg

SEQ ID NO: 68794 - DNA, 20 bp, Artificial Sequence
  chemically synthesized
ttatgtcttggaagtaacta

SEQ ID NO: 68795 - DNA, 20 bp, Artificial Sequence
  chemically synthesized
cttggaagtaactaacttgt

SEQ ID NO: 68796 - DNA, 20 bp, Artificial Sequence
  chemically synthesized
tttgtaggactgttgggaag

SEQ ID NO: 68797 - DNA, 20 bp, Artificial Sequence
  chemically synthesized
ttttgtgatgtgagaagaac

SEQ ID NO: 68798 - DNA, 20 bp, Artificial Sequence
  chemically synthesized
aggggccagaggtggaagga

SEQ ID NO: 68799 - DNA, 20 bp, Artificial Sequence
  chemically synthesized
catggtggcagagttctcat

SEQ ID NO: 68800 - DNA, 20 bp, Artificial Sequence
  chemically synthesized
tagtgagttctcaagaggct

SEQ ID NO: 68801 - DNA, 20 bp, Artificial Sequence
  chemically synthesized
aaagtgtgtagcacctccta

SEQ ID NO: 68802 - DNA, 20 bp, Artificial Sequence
  chemically synthesized
ggccatgtgaagatacttgc

SEQ ID NO: 68803 - DNA, 20 bp, Artificial Sequence
  chemically synthesized
tgctcctgctttgtcttctg

SEQ ID NO: 68804 - DNA, 20 bp, Artificial Sequence
  chemically synthesized
ctttgtcttctgccatgatt

SEQ ID NO: 68805 - DNA, 20 bp, Artificial Sequence
  chemically synthesized
tagaagctgagcagatgctg

SEQ ID NO: 68806 - DNA, 20 bp, Artificial Sequence
  chemically synthesized
tcctttgatactcaatgtga

SEQ ID NO: 68807 - DNA, 20 bp, Artificial Sequence
  chemically synthesized
gtctattattgaatatctat

SEQ ID NO: 68808 - DNA, 20 bp, Artificial Sequence
  chemically synthesized
atatgaaagactataggaat

SEQ ID NO: 68809 - DNA, 20 bp, Artificial Sequence
  chemically synthesized
taaagctctttatgtctttt

SEQ ID NO: 68810 - DNA, 20 bp, Artificial Sequence
  chemically synthesized
attctatcctatggatgttc

SEQ ID NO: 68811 - DNA, 20 bp, Artificial Sequence
  chemically synthesized
atttgggtaaatacatagga

SEQ ID NO: 68812 - DNA, 20 bp, Artificial Sequence
  chemically synthesized
ttgttgggtcacatgaaaag

SEQ ID NO: 68813 - DNA, 20 bp, Artificial Sequence
  chemically synthesized
ctgttgctccacttcgttgc

SEQ ID NO: 68814 - DNA, 20 bp, Artificial Sequence
  chemically synthesized
gtgtgtagtggttggtatct

SEQ ID NO: 68815 - DNA, 20 bp, Artificial Sequence
  chemically synthesized
ggtatcttcttgttttaatg

SEQ ID NO: 68816 - DNA, 20 bp, Artificial Sequence
  chemically synthesized
gtgttactgagtatattttc

SEQ ID NO: 68817 - DNA, 20 bp, Artificial Sequence
  chemically synthesized
gatcttttgcccactttgca

SEQ ID NO: 68818 - DNA, 20 bp, Artificial Sequence
  chemically synthesized
ttttgcccactttgcaattg

SEQ ID NO: 68819 - DNA, 20 bp, Artificial Sequence
  chemically synthesized
gcccactttgcaattggatt

SEQ ID NO: 68820 - DNA, 20 bp, Artificial Sequence
  chemically synthesized
tacaagtcctttatcagata

SEQ ID NO: 68821 - DNA, 20 bp, Artificial Sequence
  chemically synthesized
tgttttgcaaatatgttctc

SEQ ID NO: 68822 - DNA, 20 bp, Artificial Sequence
  chemically synthesized
ttgcaaatatgttctctgtg

SEQ ID NO: 68823 - DNA, 20 bp, Artificial Sequence
  chemically synthesized
cactctctcctgaactccag

SEQ ID NO: 68824 - DNA, 20 bp, Artificial Sequence
  chemically synthesized
cttcatctcatctctcatat

SEQ ID NO: 68825 - DNA, 20 bp, Artificial Sequence
  chemically synthesized
tattatgcacctcttttatt

SEQ ID NO: 68826 - DNA, 20 bp, Artificial Sequence
  chemically synthesized
ctgaataagctgtgctccaa

SEQ ID NO: 68827 - DNA, 20 bp, Artificial Sequence
  chemically synthesized
aaataagttttctttattaa

SEQ ID NO: 68828 - DNA, 20 bp, Artificial Sequence
  chemically synthesized
tgttcaaaggatggtgtgtc

SEQ ID NO: 68829 - DNA, 20 bp, Artificial Sequence
  chemically synthesized
tttgttacttcagatgtgtc

SEQ ID NO: 68830 - DNA, 20 bp, Artificial Sequence
  chemically synthesized
catgctgggttcgtggtctt

SEQ ID NO: 68831 - DNA, 20 bp, Artificial Sequence
  chemically synthesized
gatccaaagagtgagcagca

SEQ ID NO: 68832 - DNA, 20 bp, Artificial Sequence
  chemically synthesized
tattgtgaagaataaaagaa

SEQ ID NO: 68833 - DNA, 20 bp, Artificial Sequence
  chemically synthesized
atctgaccccacccacatcc

SEQ ID NO: 68834 - DNA, 20 bp, Artificial Sequence
  chemically synthesized
gattggtccattttacagag

SEQ ID NO: 68835 - DNA, 20 bp, Artificial Sequence
  chemically synthesized
attttacagagagctggttg

SEQ ID NO: 68836 - DNA, 20 bp, Artificial Sequence
  chemically synthesized
gttggtccgttttggcagag

SEQ ID NO: 68837 - DNA, 20 bp, Artificial Sequence
  chemically synthesized
accttgagctagacacagag

SEQ ID NO: 68838 - DNA, 20 bp, Artificial Sequence
  chemically synthesized
caaaagttctccaagtcccc

SEQ ID NO: 68839 - DNA, 20 bp, Artificial Sequence
  chemically synthesized
tagattagctagacacagag

SEQ ID NO: 68840 - DNA, 20 bp, Artificial Sequence
  chemically synthesized
tttacaaaccttgagttaga

SEQ ID NO: 68841 - DNA, 20 bp, Artificial Sequence
  chemically synthesized
accttgagttagacacagat

SEQ ID NO: 68842 - DNA, 20 bp, Artificial Sequence
  chemically synthesized
gagaactttcatgtctagct

SEQ ID NO: 68843 - DNA, 20 bp, Artificial Sequence
  chemically synthesized
caaatgtccaacaatgatag

SEQ ID NO: 68844 - DNA, 20 bp, Artificial Sequence
  chemically synthesized
taattttaaaaagagtatag

SEQ ID NO: 68845 - DNA, 20 bp, Artificial Sequence
  chemically synthesized
ctattagtcctttctcttga

SEQ ID NO: 68846 - DNA, 20 bp, Artificial Sequence
  chemically synthesized
tgtattcttttgcataatct

SEQ ID NO: 68847 - DNA, 20 bp, Artificial Sequence
  chemically synthesized
tttcccagtgtctggatcat

SEQ ID NO: 68848 - DNA, 20 bp, Artificial Sequence
  chemically synthesized
tttttagccctacccctcac

SEQ ID NO: 68849 - DNA, 20 bp, Artificial Sequence
  chemically synthesized
gaatgctttataagtaattt

SEQ ID NO: 68850 - DNA, 20 bp, Artificial Sequence
  chemically synthesized
cagaaaatgctctttgcaga

SEQ ID NO: 68851 - DNA, 20 bp, Artificial Sequence
  chemically synthesized
ggtatccttttctgtagaca

SEQ ID NO: 68852 - DNA, 20 bp, Artificial Sequence
  chemically synthesized
ttttctgtagacatatagat

SEQ ID NO: 68853 - DNA, 20 bp, Artificial Sequence
  chemically synthesized
atagatttcagattatcctg

SEQ ID NO: 68854 - DNA, 20 bp, Artificial Sequence
  chemically synthesized
acagtgtctctgtgtacatc

SEQ ID NO: 68855 - DNA, 20 bp, Artificial Sequence
  chemically synthesized
ctgtgtacatctatagcttt

SEQ ID NO: 68856 - DNA, 20 bp, Artificial Sequence
  chemically synthesized
atgaacacatattcagtctg

SEQ ID NO: 68857 - DNA, 20 bp, Artificial Sequence
  chemically synthesized
gaaaaatacataaataaaag

SEQ ID NO: 68858 - DNA, 20 bp, Artificial Sequence
  chemically synthesized
taaattgacacaaaattagc

SEQ ID NO: 68859 - DNA, 20 bp, Artificial Sequence
  chemically synthesized
ccagcatctcaaaagctaaa

SEQ ID NO: 68860 - DNA, 20 bp, Artificial Sequence
  chemically synthesized
catctcaaaagctaaacacc

SEQ ID NO: 68861 - DNA, 20 bp, Artificial Sequence
  chemically synthesized
agaaaccacacttttactgg

SEQ ID NO: 68862 - DNA, 20 bp, Artificial Sequence
  chemically synthesized
ggctaggttggcattaattt

SEQ ID NO: 68863 - DNA, 20 bp, Artificial Sequence
  chemically synthesized
tcaagtagaacatctcttaa

SEQ ID NO: 68864 - DNA, 20 bp, Artificial Sequence
  chemically synthesized
tctcttaagtctgtttaaca

SEQ ID NO: 68865 - DNA, 20 bp, Artificial Sequence
  chemically synthesized
gtcacatcggcagtggcggc

SEQ ID NO: 68866 - DNA, 20 bp, Artificial Sequence
  chemically synthesized
ggcatgcaagggatctaggt

SEQ ID NO: 68867 - DNA, 20 bp, Artificial Sequence
  chemically synthesized
tgcctaatgctctgaggtgg

SEQ ID NO: 68868 - DNA, 20 bp, Artificial Sequence
  chemically synthesized
gtgtacagtgaacatctgcc

SEQ ID NO: 68869 - DNA, 20 bp, Artificial Sequence
  chemically synthesized
gtcctctcacttctaagaat

SEQ ID NO: 68870 - DNA, 20 bp, Artificial Sequence
  chemically synthesized
actgatttctcccactggac

SEQ ID NO: 68871 - DNA, 20 bp, Artificial Sequence
  chemically synthesized
gcaattgaatggactagact

SEQ ID NO: 68872 - DNA, 20 bp, Artificial Sequence
  chemically synthesized
caccttgttctcggcaatat

SEQ ID NO: 68873 - DNA, 20 bp, Artificial Sequence
  chemically synthesized
aaaaaaaaggcaaaagagaa

SEQ ID NO: 68874 - DNA, 20 bp, Artificial Sequence
  chemically synthesized
tgtttccctaacatcactgt

SEQ ID NO: 68875 - DNA, 20 bp, Artificial Sequence
  chemically synthesized
catcactgtggctgttttcg

SEQ ID NO: 68876 - DNA, 20 bp, Artificial Sequence
  chemically synthesized
gccttacaaaggaatctgat

SEQ ID NO: 68877 - DNA, 20 bp, Artificial Sequence
  chemically synthesized
ctgcaggctaccacatcaac

SEQ ID NO: 68878 - DNA, 20 bp, Artificial Sequence
  chemically synthesized
tgttgcctaattcatggaaa

SEQ ID NO: 68879 - DNA, 20 bp, Artificial Sequence
  chemically synthesized
gaaaacaagtttccttagaa

SEQ ID NO: 68880 - DNA, 20 bp, Artificial Sequence
  chemically synthesized
atgtctccacctggctacta

SEQ ID NO: 68881 - DNA, 20 bp, Artificial Sequence
  chemically synthesized
atgtagcttttcaaaacaga

SEQ ID NO: 68882 - DNA, 20 bp, Artificial Sequence
  chemically synthesized
attgccttttcttcctcagg

SEQ ID NO: 68883 - DNA, 20 bp, Artificial Sequence
  chemically synthesized
gtttagttatttttttaagt

SEQ ID NO: 68884 - DNA, 20 bp, Artificial Sequence
  chemically synthesized
ctaaactactaatgttctaa

SEQ ID NO: 68885 - DNA, 20 bp, Artificial Sequence
  chemically synthesized
tataaagcccagtaatcata

SEQ ID NO: 68886 - DNA, 20 bp, Artificial Sequence
  chemically synthesized
atcatataaagtttactttc

SEQ ID NO: 68887 - DNA, 20 bp, Artificial Sequence
  chemically synthesized
tggctttttttttttttttt

SEQ ID NO: 68888 - DNA, 20 bp, Artificial Sequence
  chemically synthesized
tcctccctttggctgaattg

SEQ ID NO: 68889 - DNA, 20 bp, Artificial Sequence
  chemically synthesized
ttatatagctctaaaataag

SEQ ID NO: 68890 - DNA, 20 bp, Artificial Sequence
  chemically synthesized
actcttaggtattttttatt

SEQ ID NO: 68891 - DNA, 20 bp, Artificial Sequence
  chemically synthesized
taataaatataaattcattc

SEQ ID NO: 68892 - DNA, 20 bp, Artificial Sequence
  chemically synthesized
ttgtcagttgttgaagaatt

SEQ ID NO: 68893 - DNA, 20 bp, Artificial Sequence
  chemically synthesized
tctccggcgtatgggagggt

SEQ ID NO: 68894 - DNA, 20 bp, Artificial Sequence
  chemically synthesized
tcactttcaaagcattagaa

SEQ ID NO: 68895 - DNA, 20 bp, Artificial Sequence
  chemically synthesized
tgagacattcacatgacctc

SEQ ID NO: 68896 - DNA, 20 bp, Artificial Sequence
  chemically synthesized
aactggggcataggaatctt

SEQ ID NO: 68897 - DNA, 20 bp, Artificial Sequence
  chemically synthesized
caccacgcctggatactttc

SEQ ID NO: 68898 - DNA, 20 bp, Artificial Sequence
  chemically synthesized
ttgtgtttttttagtagaga

SEQ ID NO: 68899 - DNA, 20 bp, Artificial Sequence
  chemically synthesized
tccgcccgcctcggcagcta

SEQ ID NO: 68900 - DNA, 20 bp, Artificial Sequence
  chemically synthesized
ttcccctctagaacctacct

SEQ ID NO: 68901 - DNA, 20 bp, Artificial Sequence
  chemically synthesized
cagaaacaatttcctcactt

SEQ ID NO: 68902 - DNA, 20 bp, Artificial Sequence
  chemically synthesized
ttagaaaccaaagcctgtat

SEQ ID NO: 68903 - DNA, 20 bp, Artificial Sequence
  chemically synthesized
aattacaggaagacaaatct

SEQ ID NO: 68904 - DNA, 20 bp, Artificial Sequence
  chemically synthesized
atctaaaaataaaaataaat

SEQ ID NO: 68905 - DNA, 20 bp, Artificial Sequence
  chemically synthesized
tagatacctaatagaatata

SEQ ID NO: 68906 - DNA, 20 bp, Artificial Sequence
  chemically synthesized
ttattttcttgttatccatg

SEQ ID NO: 68907 - DNA, 20 bp, Artificial Sequence
  chemically synthesized
ttatccatgcatagttttgt

SEQ ID NO: 68908 - DNA, 20 bp, Artificial Sequence
  chemically synthesized
ttccttctttggaaagctgc

SEQ ID NO: 68909 - DNA, 20 bp, Artificial Sequence
  chemically synthesized
cactagcttacttagaaaag

SEQ ID NO: 68910 - DNA, 20 bp, Artificial Sequence
  chemically synthesized
agcaaaagatctagagcaaa

SEQ ID NO: 68911 - DNA, 20 bp, Artificial Sequence
  chemically synthesized
cacatataaaatctaaaaaa

SEQ ID NO: 68912 - DNA, 20 bp, Artificial Sequence
  chemically synthesized
tttgtgtcctctttatgaac

SEQ ID NO: 68913 - DNA, 20 bp, Artificial Sequence
  chemically synthesized
gtattttatagaacatcgcc

SEQ ID NO: 68914 - DNA, 20 bp, Artificial Sequence
  chemically synthesized
ctcagagaatgaaagaaact

SEQ ID NO: 68915 - DNA, 20 bp, Artificial Sequence
  chemically synthesized
ctactttgaaacttgaaaac

SEQ ID NO: 68916 - DNA, 20 bp, Artificial Sequence
  chemically synthesized
ttgaaaacctaggtttttaa

SEQ ID NO: 68917 - DNA, 20 bp, Artificial Sequence
  chemically synthesized
aacctaggtttttaatccag

SEQ ID NO: 68918 - DNA, 20 bp, Artificial Sequence
  chemically synthesized
gtccaggctgacacaatgga

SEQ ID NO: 68919 - DNA, 20 bp, Artificial Sequence
  chemically synthesized
ctgacacaatggaacttgtt

SEQ ID NO: 68920 - DNA, 20 bp, Artificial Sequence
  chemically synthesized
taattttttcttttttatgg

SEQ ID NO: 68921 - DNA, 20 bp, Artificial Sequence
  chemically synthesized
ttcttttttatggcactgat

SEQ ID NO: 68922 - DNA, 20 bp, Artificial Sequence
  chemically synthesized
tgatttttgtttattattgt

SEQ ID NO: 68923 - DNA, 20 bp, Artificial Sequence
  chemically synthesized
gggtcttgacactgtagatg

SEQ ID NO: 68924 - DNA, 20 bp, Artificial Sequence
  chemically synthesized
gaacgtgggccacgggggaa

SEQ ID NO: 68925 - DNA, 20 bp, Artificial Sequence
  chemically synthesized
tcaggatggaggaataacgt

SEQ ID NO: 68926 - DNA, 20 bp, Artificial Sequence
  chemically synthesized
gaagtaaaacataggctggt

SEQ ID NO: 68927 - DNA, 20 bp, Artificial Sequence
  chemically synthesized
attgcccaaaagcaccatgg

SEQ ID NO: 68928 - DNA, 20 bp, Artificial Sequence
  chemically synthesized
ggaagaattcgtgctggtgc

SEQ ID NO: 68929 - DNA, 20 bp, Artificial Sequence
  chemically synthesized
tgagagtattttttcaaagg

SEQ ID NO: 68930 - DNA, 20 bp, Artificial Sequence
  chemically synthesized
taaaaaaaacagctgagaaa

SEQ ID NO: 68931 - DNA, 20 bp, Artificial Sequence
  chemically synthesized
ataagcaaaaacaaataagg

SEQ ID NO: 68932 - DNA, 20 bp, Artificial Sequence
  chemically synthesized
gagattagtaaaaggagaag

SEQ ID NO: 68933 - DNA, 20 bp, Artificial Sequence
  chemically synthesized
aggctagttttaaaaaaata

SEQ ID NO: 68934 - DNA, 20 bp, Artificial Sequence
  chemically synthesized
ttcgaagtgaagagtaatct

SEQ ID NO: 68935 - DNA, 20 bp, Artificial Sequence
  chemically synthesized
atactatttaatgaagatac

SEQ ID NO: 68936 - DNA, 20 bp, Artificial Sequence
  chemically synthesized
ttatgcatgagaccttgggt

SEQ ID NO: 68937 - DNA, 20 bp, Artificial Sequence
  chemically synthesized
gtgcctttgtgatgtagaga

SEQ ID NO: 68938 - DNA, 20 bp, Artificial Sequence
  chemically synthesized
ctgagcctttgatagcagct

SEQ ID NO: 68939 - DNA, 20 bp, Artificial Sequence
  chemically synthesized
ctttatttattcagttaatg

SEQ ID NO: 68940 - DNA, 20 bp, Artificial Sequence
  chemically synthesized
ttattcaatgtattggccaa

SEQ ID NO: 68941 - DNA, 20 bp, Artificial Sequence
  chemically synthesized
acaaagccaggctcaaacaa

SEQ ID NO: 68942 - DNA, 20 bp, Artificial Sequence
  chemically synthesized
gcctcatggtagcagaatca

SEQ ID NO: 68943 - DNA, 20 bp, Artificial Sequence
  chemically synthesized
atcaattggcttcttcttta

SEQ ID NO: 68944 - DNA, 20 bp, Artificial Sequence
  chemically synthesized
gcttcttctttacattgttt

SEQ ID NO: 68945 - DNA, 20 bp, Artificial Sequence
  chemically synthesized
ttccagacctgagaatcatc

SEQ ID NO: 68946 - DNA, 20 bp, Artificial Sequence
  chemically synthesized
atgttcaaaagtccatactt

SEQ ID NO: 68947 - DNA, 20 bp, Artificial Sequence
  chemically synthesized
tcaaaagtccatactttcat

SEQ ID NO: 68948 - DNA, 20 bp, Artificial Sequence
  chemically synthesized
cttcgagatgttaaagtaac

SEQ ID NO: 68949 - DNA, 20 bp, Artificial Sequence
  chemically synthesized
ctgccctttatgtcctactt

SEQ ID NO: 68950 - DNA, 20 bp, Artificial Sequence
  chemically synthesized
acgtcttctagcagtctaac

SEQ ID NO: 68951 - DNA, 20 bp, Artificial Sequence
  chemically synthesized
ttaatacttttttctccata

SEQ ID NO: 68952 - DNA, 20 bp, Artificial Sequence
  chemically synthesized
ttttttctccatagaatgct

SEQ ID NO: 68953 - DNA, 20 bp, Artificial Sequence
  chemically synthesized
ccatagaatgcttgaagttt

SEQ ID NO: 68954 - DNA, 20 bp, Artificial Sequence
  chemically synthesized
gaagtttcttcgtttcttgc

SEQ ID NO: 68955 - DNA, 20 bp, Artificial Sequence
  chemically synthesized
aactcaacaatcacttttca

SEQ ID NO: 68956 - DNA, 20 bp, Artificial Sequence
  chemically synthesized
atatatctattattttggta

SEQ ID NO: 68957 - DNA, 20 bp, Artificial Sequence
  chemically synthesized
tttgaaactaacatttgcac

SEQ ID NO: 68958 - DNA, 20 bp, Artificial Sequence
  chemically synthesized
gctatttaatatattcatct

SEQ ID NO: 68959 - DNA, 20 bp, Artificial Sequence
  chemically synthesized
aagaatgatgccaataaagt

SEQ ID NO: 68960 - DNA, 20 bp, Artificial Sequence
  chemically synthesized
cacttttacacattgcccgt

SEQ ID NO: 68961 - DNA, 20 bp, Artificial Sequence
  chemically synthesized
cccgtcttggtttataatat

SEQ ID NO: 68962 - DNA, 20 bp, Artificial Sequence
  chemically synthesized
aatattattactagctaata

SEQ ID NO: 68963 - DNA, 20 bp, Artificial Sequence
  chemically synthesized
actagctaatatcatgattt

SEQ ID NO: 68964 - DNA, 20 bp, Artificial Sequence
  chemically synthesized
tattatctccagggaaacca

SEQ ID NO: 68965 - DNA, 20 bp, Artificial Sequence
  chemically synthesized
caccattaacttttgagtta

SEQ ID NO: 68966 - DNA, 20 bp, Artificial Sequence
  chemically synthesized
ttaaaatgattacttcctca

SEQ ID NO: 68967 - DNA, 20 bp, Artificial Sequence
  chemically synthesized
ttttctaatactgctcccca

SEQ ID NO: 68968 - DNA, 20 bp, Artificial Sequence
  chemically synthesized
acttactctcatcacagtat

SEQ ID NO: 68969 - DNA, 20 bp, Artificial Sequence
  chemically synthesized
ttattatacactgaatttcc

SEQ ID NO: 68970 - DNA, 20 bp, Artificial Sequence
  chemically synthesized
ttagattcattagaggctgt

SEQ ID NO: 68971 - DNA, 20 bp, Artificial Sequence
  chemically synthesized
tgtagaagattaggaaccat

SEQ ID NO: 68972 - DNA, 20 bp, Artificial Sequence
  chemically synthesized
accaattgagtcatcatata

SEQ ID NO: 68973 - DNA, 20 bp, Artificial Sequence
  chemically synthesized
gtcatcatataccaagtttg

SEQ ID NO: 68974 - DNA, 20 bp, Artificial Sequence
  chemically synthesized
atacaacactccaatttcaa

SEQ ID NO: 68975 - DNA, 20 bp, Artificial Sequence
  chemically synthesized
tcagacatatcgtcaaggat

SEQ ID NO: 68976 - DNA, 20 bp, Artificial Sequence
  chemically synthesized
aaggatctgggattgatcac

SEQ ID NO: 68977 - DNA, 20 bp, Artificial Sequence
  chemically synthesized
ttaaaagtatctactttcag

SEQ ID NO: 68978 - DNA, 20 bp, Artificial Sequence
  chemically synthesized
cactttgggaggccgaggca

SEQ ID NO: 68979 - DNA, 20 bp, Artificial Sequence
  chemically synthesized
ttgggagactgaggcaggag

SEQ ID NO: 68980 - DNA, 20 bp, Artificial Sequence
  chemically synthesized
aaaaaaaaatctattttcat

SEQ ID NO: 68981 - DNA, 20 bp, Artificial Sequence
  chemically synthesized
ggtttcttcagactgactac

SEQ ID NO: 68982 - DNA, 20 bp, Artificial Sequence
  chemically synthesized
caaaggcttcagactagcta

SEQ ID NO: 68983 - DNA, 20 bp, Artificial Sequence
  chemically synthesized
gcttaaaaatctactttcat

SEQ ID NO: 68984 - DNA, 20 bp, Artificial Sequence
  chemically synthesized
ccatagagactatcagcctt

SEQ ID NO: 68985 - DNA, 20 bp, Artificial Sequence
  chemically synthesized
accagagcaaaatacatgtt

SEQ ID NO: 68986 - DNA, 20 bp, Artificial Sequence
  chemically synthesized
atgttggaggattttttaaa

SEQ ID NO: 68987 - DNA, 20 bp, Artificial Sequence
  chemically synthesized
tgaaaggtaggatgaaagag

SEQ ID NO: 68988 - DNA, 20 bp, Artificial Sequence
  chemically synthesized
gttttgataaggtaaataaa

SEQ ID NO: 68989 - DNA, 20 bp, Artificial Sequence
  chemically synthesized
ccacctgtatttaaaaaaca

SEQ ID NO: 68990 - DNA, 20 bp, Artificial Sequence
  chemically synthesized
atttaaaaaacaaaaagatt

SEQ ID NO: 68991 - DNA, 20 bp, Artificial Sequence
  chemically synthesized
atttgagtctggagaaataa

SEQ ID NO: 68992 - DNA, 20 bp, Artificial Sequence
  chemically synthesized
tgttgacttggaaagcaaat

SEQ ID NO: 68993 - DNA, 20 bp, Artificial Sequence
  chemically synthesized
caggagtcttttctgatgcc

SEQ ID NO: 68994 - DNA, 20 bp, Artificial Sequence
  chemically synthesized
acctacatatgcagaaatct

SEQ ID NO: 68995 - DNA, 20 bp, Artificial Sequence
  chemically synthesized
tcttttcagaataattccct

SEQ ID NO: 68996 - DNA, 20 bp, Artificial Sequence
  chemically synthesized
gaataattccctgtgtgatt

SEQ ID NO: 68997 - DNA, 20 bp, Artificial Sequence
  chemically synthesized
aaagacatagagaaagtata

SEQ ID NO: 68998 - DNA, 20 bp, Artificial Sequence
  chemically synthesized
aaagtatattgtgtttaaaa

SEQ ID NO: 68999 - DNA, 20 bp, Artificial Sequence
  chemically synthesized
attcctatttgccaaggcag

SEQ ID NO: 69000 - DNA, 20 bp, Artificial Sequence
  chemically synthesized
ttcagtgatgcataaggcag

SEQ ID NO: 69001 - DNA, 20 bp, Artificial Sequence
  chemically synthesized
taagacttgtccaaagaact

SEQ ID NO: 69002 - DNA, 20 bp, Artificial Sequence
  chemically synthesized
tgtccaaagaactgactgtt

SEQ ID NO: 69003 - DNA, 20 bp, Artificial Sequence
  chemically synthesized
ctatttaccacaaacctgaa

SEQ ID NO: 69004 - DNA, 20 bp, Artificial Sequence
  chemically synthesized
acctgaagtaggcttaaatt

SEQ ID NO: 69005 - DNA, 20 bp, Artificial Sequence
  chemically synthesized
attatataagcataaaatgt

SEQ ID NO: 69006 - DNA, 20 bp, Artificial Sequence
  chemically synthesized
catatttcattatatatttt

SEQ ID NO: 69007 - DNA, 20 bp, Artificial Sequence
  chemically synthesized
tgtagccatctaaccatttg

SEQ ID NO: 69008 - DNA, 20 bp, Artificial Sequence
  chemically synthesized
taaccatttgagaagttttt

SEQ ID NO: 69009 - DNA, 20 bp, Artificial Sequence
  chemically synthesized
gtttttataagatttatagc

SEQ ID NO: 69010 - DNA, 20 bp, Artificial Sequence
  chemically synthesized
catctcatgcaagatagtgt

SEQ ID NO: 69011 - DNA, 20 bp, Artificial Sequence
  chemically synthesized
caagatagtgtatttgtttt

SEQ ID NO: 69012 - DNA, 20 bp, Artificial Sequence
  chemically synthesized
cttttcttcagaaaatgtga

SEQ ID NO: 69013 - DNA, 20 bp, Artificial Sequence
  chemically synthesized
atatgttatgggatacaatg

SEQ ID NO: 69014 - DNA, 20 bp, Artificial Sequence
  chemically synthesized
ctatggaaccatctttctat

SEQ ID NO: 69015 - DNA, 20 bp, Artificial Sequence
  chemically synthesized
tttaagataaaggaaattgt

SEQ ID NO: 69016 - DNA, 20 bp, Artificial Sequence
  chemically synthesized
atttttctccagggggttac

SEQ ID NO: 69017 - DNA, 20 bp, Artificial Sequence
  chemically synthesized
tcaccacacagtggaataag

SEQ ID NO: 69018 - DNA, 20 bp, Artificial Sequence
  chemically synthesized
acattaccataattatttat

SEQ ID NO: 69019 - DNA, 20 bp, Artificial Sequence
  chemically synthesized
agtccaggatgactagcagt

SEQ ID NO: 69020 - DNA, 20 bp, Artificial Sequence
  chemically synthesized
tgtgtgaacagtaatgctag

SEQ ID NO: 69021 - DNA, 20 bp, Artificial Sequence
  chemically synthesized
ctagccttgattttaccatg

SEQ ID NO: 69022 - DNA, 20 bp, Artificial Sequence
  chemically synthesized
ccttgattttaccatggcaa

SEQ ID NO: 69023 - DNA, 20 bp, Artificial Sequence
  chemically synthesized
aagatactgtatcttaggag

SEQ ID NO: 69024 - DNA, 20 bp, Artificial Sequence
  chemically synthesized
caaaagagtagacatcccca

SEQ ID NO: 69025 - DNA, 20 bp, Artificial Sequence
  chemically synthesized
atcagtgactaacatgacca

SEQ ID NO: 69026 - DNA, 20 bp, Artificial Sequence
  chemically synthesized
tgccaggaggttgcctttgc

SEQ ID NO: 69027 - DNA, 20 bp, Artificial Sequence
  chemically synthesized
cctttgctgtggctttcgac

SEQ ID NO: 69028 - DNA, 20 bp, Artificial Sequence
  chemically synthesized
tatttatgtaaataaaatgt

SEQ ID NO: 69029 - DNA, 20 bp, Artificial Sequence
  chemically synthesized
tagatctaaaattgtaattt

SEQ ID NO: 69030 - DNA, 20 bp, Artificial Sequence
  chemically synthesized
attcctagaatttctaaatc

SEQ ID NO: 69031 - DNA, 20 bp, Artificial Sequence
  chemically synthesized
tagaattctctagaggtgac

SEQ ID NO: 69032 - DNA, 20 bp, Artificial Sequence
  chemically synthesized
tcaatccttcataccctttg

SEQ ID NO: 69033 - DNA, 20 bp, Artificial Sequence
  chemically synthesized
taccctttgtatcgtttttt

SEQ ID NO: 69034 - DNA, 20 bp, Artificial Sequence
  chemically synthesized
gtgaagaaaaaaattataat

SEQ ID NO: 69035 - DNA, 20 bp, Artificial Sequence
  chemically synthesized
taatatttactgggaactta

SEQ ID NO: 69036 - DNA, 20 bp, Artificial Sequence
  chemically synthesized
tcactataagaaatttataa

SEQ ID NO: 69037 - DNA, 20 bp, Artificial Sequence
  chemically synthesized
attgaagggcatgaaataat

SEQ ID NO: 69038 - DNA, 20 bp, Artificial Sequence
  chemically synthesized
tgatcttctggtcagtgaga

SEQ ID NO: 69039 - DNA, 20 bp, Artificial Sequence
  chemically synthesized
agtgagaactggtttcaaat

SEQ ID NO: 69040 - DNA, 20 bp, Artificial Sequence
  chemically synthesized
taataattctagttgtgaga

SEQ ID NO: 69041 - DNA, 20 bp, Artificial Sequence
  chemically synthesized
agagtggagagtaaaggcaa

SEQ ID NO: 69042 - DNA, 20 bp, Artificial Sequence
  chemically synthesized
aaatctgagtgaaccattca

SEQ ID NO: 69043 - DNA, 20 bp, Artificial Sequence
  chemically synthesized
tttactatcttttcaactcg

SEQ ID NO: 69044 - DNA, 20 bp, Artificial Sequence
  chemically synthesized
agcaatgaagttctttttag

SEQ ID NO: 69045 - DNA, 20 bp, Artificial Sequence
  chemically synthesized
cagagagcaccatcttttca

SEQ ID NO: 69046 - DNA, 20 bp, Artificial Sequence
  chemically synthesized
catcttttcatgttgctttc

SEQ ID NO: 69047 - DNA, 20 bp, Artificial Sequence
  chemically synthesized
caggaagttaagacagtcta

SEQ ID NO: 69048 - DNA, 20 bp, Artificial Sequence
  chemically synthesized
gtctacctagatttagaagc

SEQ ID NO: 69049 - DNA, 20 bp, Artificial Sequence
  chemically synthesized
gaaatggtctgacttttttc

SEQ ID NO: 69050 - DNA, 20 bp, Artificial Sequence
  chemically synthesized
ggtctgacttttttccattg

SEQ ID NO: 69051 - DNA, 20 bp, Artificial Sequence
  chemically synthesized
tccattgtttagtttctaaa

SEQ ID NO: 69052 - DNA, 20 bp, Artificial Sequence
  chemically synthesized
cctgatataattcattttta

SEQ ID NO: 69053 - DNA, 20 bp, Artificial Sequence
  chemically synthesized
gtatacattgaattatactg

SEQ ID NO: 69054 - DNA, 20 bp, Artificial Sequence
  chemically synthesized
atgtctgactttattcaata

SEQ ID NO: 69055 - DNA, 20 bp, Artificial Sequence
  chemically synthesized
tcatactagtgtatgactgt

SEQ ID NO: 69056 - DNA, 20 bp, Artificial Sequence
  chemically synthesized
tgatagatatttgagtacct

SEQ ID NO: 69057 - DNA, 20 bp, Artificial Sequence
  chemically synthesized
tataatataaattgctgcta

SEQ ID NO: 69058 - DNA, 20 bp, Artificial Sequence
  chemically synthesized
aactttaaaatacactgcca

SEQ ID NO: 69059 - DNA, 20 bp, Artificial Sequence
  chemically synthesized
tggtcaacctataatatcat

SEQ ID NO: 69060 - DNA, 20 bp, Artificial Sequence
  chemically synthesized
cttatagcagcctgcatgtg

SEQ ID NO: 69061 - DNA, 20 bp, Artificial Sequence
  chemically synthesized
gttgaagaaattgcactcca

SEQ ID NO: 69062 - DNA, 20 bp, Artificial Sequence
  chemically synthesized
gccaagtctgacctaatgcc

SEQ ID NO: 69063 - DNA, 20 bp, Artificial Sequence
  chemically synthesized
ttctcccacttgctctgcag

SEQ ID NO: 69064 - DNA, 20 bp, Artificial Sequence
  chemically synthesized
tccttcactaacaaagcaaa

SEQ ID NO: 69065 - DNA, 20 bp, Artificial Sequence
  chemically synthesized
atctcgttagtaccttttga

SEQ ID NO: 69066 - DNA, 20 bp, Artificial Sequence
  chemically synthesized
agataggacttgagttcctc

SEQ ID NO: 69067 - DNA, 20 bp, Artificial Sequence
  chemically synthesized
cacagccgaggccggaggga

SEQ ID NO: 69068 - DNA, 20 bp, Artificial Sequence
  chemically synthesized
tttgagctcaggagttggag

SEQ ID NO: 69069 - DNA, 20 bp, Artificial Sequence
  chemically synthesized
gatatcttgagccaaggagg

SEQ ID NO: 69070 - DNA, 20 bp, Artificial Sequence
  chemically synthesized
gagggggagattgcagtgag

SEQ ID NO: 69071 - DNA, 20 bp, Artificial Sequence
  chemically synthesized
ttttttacctccaacatata

SEQ ID NO: 69072 - DNA, 20 bp, Artificial Sequence
  chemically synthesized
ttactatataggaacacaat

SEQ ID NO: 69073 - DNA, 20 bp, Artificial Sequence
  chemically synthesized
ttttgttagacttaaaaaca

SEQ ID NO: 69074 - DNA, 20 bp, Artificial Sequence
  chemically synthesized
aagaactgctaaagactcac

SEQ ID NO: 69075 - DNA, 20 bp, Artificial Sequence
  chemically synthesized
tacatagctaaacacatgtc

SEQ ID NO: 69076 - DNA, 20 bp, Artificial Sequence
  chemically synthesized
cacatgtcatgggtttgtcg

SEQ ID NO: 69077 - DNA, 20 bp, Artificial Sequence
  chemically synthesized
cttttgttcccgttatgtgt

SEQ ID NO: 69078 - DNA, 20 bp, Artificial Sequence
  chemically synthesized
gtaagtgataatatgtagta

SEQ ID NO: 69079 - DNA, 20 bp, Artificial Sequence
  chemically synthesized
atttggttttctgttcttac

SEQ ID NO: 69080 - DNA, 20 bp, Artificial Sequence
  chemically synthesized
ataccactaatgggccttca

SEQ ID NO: 69081 - DNA, 20 bp, Artificial Sequence
  chemically synthesized
ttgattctatgtctttgcta

SEQ ID NO: 69082 - DNA, 20 bp, Artificial Sequence
  chemically synthesized
tgcatgtgtctttgtgatag

SEQ ID NO: 69083 - DNA, 20 bp, Artificial Sequence
  chemically synthesized
ctttaggtatatactcaata

SEQ ID NO: 69084 - DNA, 20 bp, Artificial Sequence
  chemically synthesized
attgttgggttaaatggtat

SEQ ID NO: 69085 - DNA, 20 bp, Artificial Sequence
  chemically synthesized
atgtgagatagtatctcatt

SEQ ID NO: 69086 - DNA, 20 bp, Artificial Sequence
  chemically synthesized
gagatagtatctcattttgg

SEQ ID NO: 69087 - DNA, 20 bp, Artificial Sequence
  chemically synthesized
ttctctaatgatcagtgaca

SEQ ID NO: 69088 - DNA, 20 bp, Artificial Sequence
  chemically synthesized
agtgacactgagcttttttc

SEQ ID NO: 69089 - DNA, 20 bp, Artificial Sequence
  chemically synthesized
cctttacccattttttgtgg

SEQ ID NO: 69090 - DNA, 20 bp, Artificial Sequence
  chemically synthesized
tacccattttttgtggcatt

SEQ ID NO: 69091 - DNA, 20 bp, Artificial Sequence
  chemically synthesized
ggcattgtttgttttgttct

SEQ ID NO: 69092 - DNA, 20 bp, Artificial Sequence
  chemically synthesized
gtagattcatttaagttcct

SEQ ID NO: 69093 - DNA, 20 bp, Artificial Sequence
  chemically synthesized
tattaggcctttgttggatg

SEQ ID NO: 69094 - DNA, 20 bp, Artificial Sequence
  chemically synthesized
aaattttctcccattctata

SEQ ID NO: 69095 - DNA, 20 bp, Artificial Sequence
  chemically synthesized
tataggttgtttactcagtt

SEQ ID NO: 69096 - DNA, 20 bp, Artificial Sequence
  chemically synthesized
attagatcctatttgtcaat

SEQ ID NO: 69097 - DNA, 20 bp, Artificial Sequence
  chemically synthesized
ctttgtcatgaaatctttgc

SEQ ID NO: 69098 - DNA, 20 bp, Artificial Sequence
  chemically synthesized
gtccggaatggtattgccta

SEQ ID NO: 69099 - DNA, 20 bp, Artificial Sequence
  chemically synthesized
aggttgctttcaagcatttt

SEQ ID NO: 69100 - DNA, 20 bp, Artificial Sequence
  chemically synthesized
ctttcaagcatttttatagt

SEQ ID NO: 69101 - DNA, 20 bp, Artificial Sequence
  chemically synthesized
atttaagtctctaatccatc

SEQ ID NO: 69102 - DNA, 20 bp, Artificial Sequence
  chemically synthesized
gtatatgatatagaacgggg

SEQ ID NO: 69103 - DNA, 20 bp, Artificial Sequence
  chemically synthesized
tgaatagggtgtcttttcct

SEQ ID NO: 69104 - DNA, 20 bp, Artificial Sequence
  chemically synthesized
tagggtgtcttttcctcatt

SEQ ID NO: 69105 - DNA, 20 bp, Artificial Sequence
  chemically synthesized
tttcctcattgcttgttttt

SEQ ID NO: 69106 - DNA, 20 bp, Artificial Sequence
  chemically synthesized
tcttttctgtaacagtacca

SEQ ID NO: 69107 - DNA, 20 bp, Artificial Sequence
  chemically synthesized
tggttactgtagccctgtgg

SEQ ID NO: 69108 - DNA, 20 bp, Artificial Sequence
  chemically synthesized
aagttaggcaatgtattatc

SEQ ID NO: 69109 - DNA, 20 bp, Artificial Sequence
  chemically synthesized
tctaagttctacggtacctg

SEQ ID NO: 69110 - DNA, 20 bp, Artificial Sequence
  chemically synthesized
tcaattcccacctgtgagta

SEQ ID NO: 69111 - DNA, 20 bp, Artificial Sequence
  chemically synthesized
gttctgtgaagaatgtcatt

SEQ ID NO: 69112 - DNA, 20 bp, Artificial Sequence
  chemically synthesized
gtcattggtagtttgatagg

SEQ ID NO: 69113 - DNA, 20 bp, Artificial Sequence
  chemically synthesized
cagtatggacattttaacaa

SEQ ID NO: 69114 - DNA, 20 bp, Artificial Sequence
  chemically synthesized
tctttttatccatgagcatg

SEQ ID NO: 69115 - DNA, 20 bp, Artificial Sequence
  chemically synthesized
tgagcatggaaagtttttcc

SEQ ID NO: 69116 - DNA, 20 bp, Artificial Sequence
  chemically synthesized
tttccatttgtttctatcag

SEQ ID NO: 69117 - DNA, 20 bp, Artificial Sequence
  chemically synthesized
tcagctctgatttctttgag

SEQ ID NO: 69118 - DNA, 20 bp, Artificial Sequence
  chemically synthesized
tctcattgtagagatctttc

SEQ ID NO: 69119 - DNA, 20 bp, Artificial Sequence
  chemically synthesized
tctttttgtggcaacggtaa

SEQ ID NO: 69120 - DNA, 20 bp, Artificial Sequence
  chemically synthesized
aacggtaaatgggattgact

SEQ ID NO: 69121 - DNA, 20 bp, Artificial Sequence
  chemically synthesized
attgacttcctgatttggct

SEQ ID NO: 69122 - DNA, 20 bp, Artificial Sequence
  chemically synthesized
ttgttgatgtatgggaatgc

SEQ ID NO: 69123 - DNA, 20 bp, Artificial Sequence
  chemically synthesized
gaatgctagtgatttttgta

SEQ ID NO: 69124 - DNA, 20 bp, Artificial Sequence
  chemically synthesized
ttgctgaagttatcagctga

SEQ ID NO: 69125 - DNA, 20 bp, Artificial Sequence
  chemically synthesized
gagcttttgggccttgacta

SEQ ID NO: 69126 - DNA, 20 bp, Artificial Sequence
  chemically synthesized
gccctttattcccttctctt

SEQ ID NO: 69127 - DNA, 20 bp, Artificial Sequence
  chemically synthesized
agagggcatccttgtcttgt

SEQ ID NO: 69128 - DNA, 20 bp, Artificial Sequence
  chemically synthesized
cttgtgccagttttcaagaa

SEQ ID NO: 69129 - DNA, 20 bp, Artificial Sequence
  chemically synthesized
agttttcaagaagaatgctt

SEQ ID NO: 69130 - DNA, 20 bp, Artificial Sequence
  chemically synthesized
cattctgtatgatgttggct

SEQ ID NO: 69131 - DNA, 20 bp, Artificial Sequence
  chemically synthesized
tgaggtcatgtccttaaata

SEQ ID NO: 69132 - DNA, 20 bp, Artificial Sequence
  chemically synthesized
cttaaatagctagtttgttg

SEQ ID NO: 69133 - DNA, 20 bp, Artificial Sequence
  chemically synthesized
tgcacatattgaaatgatca

SEQ ID NO: 69134 - DNA, 20 bp, Artificial Sequence
  chemically synthesized
tattgaaatgatcatgtggt

SEQ ID NO: 69135 - DNA, 20 bp, Artificial Sequence
  chemically synthesized
atttgtatatgctgaaccaa

SEQ ID NO: 69136 - DNA, 20 bp, Artificial Sequence
  chemically synthesized
gcttctcagggataaagcct

SEQ ID NO: 69137 - DNA, 20 bp, Artificial Sequence
  chemically synthesized
gataaagcctacttgattga

SEQ ID NO: 69138 - DNA, 20 bp, Artificial Sequence
  chemically synthesized
agcctacttgattgaggtgg

SEQ ID NO: 69139 - DNA, 20 bp, Artificial Sequence
  chemically synthesized
gattagctttgtgatgtgtt

SEQ ID NO: 69140 - DNA, 20 bp, Artificial Sequence
  chemically synthesized
ctttgtgatgtgttgctgga

SEQ ID NO: 69141 - DNA, 20 bp, Artificial Sequence
  chemically synthesized
aatgttcaaggatattggcc

SEQ ID NO: 69142 - DNA, 20 bp, Artificial Sequence
  chemically synthesized
tttttgttgttgtgtgtcta

SEQ ID NO: 69143 - DNA, 20 bp, Artificial Sequence
  chemically synthesized
cctccccctcaattttttgg

SEQ ID NO: 69144 - DNA, 20 bp, Artificial Sequence
  chemically synthesized
tggttgtgaatcatattgtc

SEQ ID NO: 69145 - DNA, 20 bp, Artificial Sequence
  chemically synthesized
atcatattgtccagggcttt

SEQ ID NO: 69146 - DNA, 20 bp, Artificial Sequence
  chemically synthesized
catcatggatctcttcagga

SEQ ID NO: 69147 - DNA, 20 bp, Artificial Sequence
  chemically synthesized
tcagaccacagaggaataaa

SEQ ID NO: 69148 - DNA, 20 bp, Artificial Sequence
  chemically synthesized
atataccggaatctctggga

SEQ ID NO: 69149 - DNA, 20 bp, Artificial Sequence
  chemically synthesized
taaaacacaaaataccattc

SEQ ID NO: 69150 - DNA, 20 bp, Artificial Sequence
  chemically synthesized
aaagattaatgagtccaaga

SEQ ID NO: 69151 - DNA, 20 bp, Artificial Sequence
  chemically synthesized
agccccttctgtgatgcctc

SEQ ID NO: 69152 - DNA, 20 bp, Artificial Sequence
  chemically synthesized
cttctatgttcttaatatct

SEQ ID NO: 69153 - DNA, 20 bp, Artificial Sequence
  chemically synthesized
tatgttcttaatatctgtgt

SEQ ID NO: 69154 - DNA, 20 bp, Artificial Sequence
  chemically synthesized
ttcttaatatctgtgtgttt

SEQ ID NO: 69155 - DNA, 20 bp, Artificial Sequence
  chemically synthesized
taatatctgtgtgtttgttt

SEQ ID NO: 69156 - DNA, 20 bp, Artificial Sequence
  chemically synthesized
tgtgtgtttgtttgtttgtt

SEQ ID NO: 69157 - DNA, 20 bp, Artificial Sequence
  chemically synthesized
tgtttgtttgtttgtttttt

SEQ ID NO: 69158 - DNA, 20 bp, Artificial Sequence
  chemically synthesized
tgtttgtttgttttttgctt

SEQ ID NO: 69159 - DNA, 20 bp, Artificial Sequence
  chemically synthesized
tgtttgttttttgcttgttt

SEQ ID NO: 69160 - DNA, 20 bp, Artificial Sequence
  chemically synthesized
tacagatgcaagccactgtg

SEQ ID NO: 69161 - DNA, 20 bp, Artificial Sequence
  chemically synthesized
ctttttattttaattggtca

SEQ ID NO: 69162 - DNA, 20 bp, Artificial Sequence
  chemically synthesized
gacttaatgggagactttcc

SEQ ID NO: 69163 - DNA, 20 bp, Artificial Sequence
  chemically synthesized
tgggagactttcccctagct

SEQ ID NO: 69164 - DNA, 20 bp, Artificial Sequence
  chemically synthesized
tccagaaattcaactttatt

SEQ ID NO: 69165 - DNA, 20 bp, Artificial Sequence
  chemically synthesized
aactttattctaggcttggc

SEQ ID NO: 69166 - DNA, 20 bp, Artificial Sequence
  chemically synthesized
gcttggctcctgtttagtat

SEQ ID NO: 69167 - DNA, 20 bp, Artificial Sequence
  chemically synthesized
tcctgtttagtattgctgct

SEQ ID NO: 69168 - DNA, 20 bp, Artificial Sequence
  chemically synthesized
tggctctacggatgtgtgag

SEQ ID NO: 69169 - DNA, 20 bp, Artificial Sequence
  chemically synthesized
cttttttttattattatact

SEQ ID NO: 69170 - DNA, 20 bp, Artificial Sequence
  chemically synthesized
agggtacatgtgcacaacat

SEQ ID NO: 69171 - DNA, 20 bp, Artificial Sequence
  chemically synthesized
cacctatgagtgagaacatg

SEQ ID NO: 69172 - DNA, 20 bp, Artificial Sequence
  chemically synthesized
atgagtgagaacatgcggtg

SEQ ID NO: 69173 - DNA, 20 bp, Artificial Sequence
  chemically synthesized
gtttggtttattctccttgt

SEQ ID NO: 69174 - DNA, 20 bp, Artificial Sequence
  chemically synthesized
tgtgatagtttgctgagaat

SEQ ID NO: 69175 - DNA, 20 bp, Artificial Sequence
  chemically synthesized
gtttgctgagaatgatagtt

SEQ ID NO: 69176 - DNA, 20 bp, Artificial Sequence
  chemically synthesized
gtgcatgtgtctttatagca

SEQ ID NO: 69177 - DNA, 20 bp, Artificial Sequence
  chemically synthesized
ggtcaaatggtatttctagt

SEQ ID NO: 69178 - DNA, 20 bp, Artificial Sequence
  chemically synthesized
ctgacttccgcaatggttga

SEQ ID NO: 69179 - DNA, 20 bp, Artificial Sequence
  chemically synthesized
accaacagtgtaaaagttgt

SEQ ID NO: 69180 - DNA, 20 bp, Artificial Sequence
  chemically synthesized
tccacatcctctccagcacc

SEQ ID NO: 69181 - DNA, 20 bp, Artificial Sequence
  chemically synthesized
ggtgtgagatggtatctcat

SEQ ID NO: 69182 - DNA, 20 bp, Artificial Sequence
  chemically synthesized
gagatggtatctcattgtgg

SEQ ID NO: 69183 - DNA, 20 bp, Artificial Sequence
  chemically synthesized
gtgatgatgagcattttttc

SEQ ID NO: 69184 - DNA, 20 bp, Artificial Sequence
  chemically synthesized
tgagcattttttcatgtgtt

SEQ ID NO: 69185 - DNA, 20 bp, Artificial Sequence
  chemically synthesized
ctttgcccactttttgatgg

SEQ ID NO: 69186 - DNA, 20 bp, Artificial Sequence
  chemically synthesized
gcccactttttgatggggtt

SEQ ID NO: 69187 - DNA, 20 bp, Artificial Sequence
  chemically synthesized
ttgtttgttttttcttgtaa

SEQ ID NO: 69188 - DNA, 20 bp, Artificial Sequence
  chemically synthesized
gtaaatttgtttgagttcat

SEQ ID NO: 69189 - DNA, 20 bp, Artificial Sequence
  chemically synthesized
tattagccctttgtcagatg

SEQ ID NO: 69190 - DNA, 20 bp, Artificial Sequence
  chemically synthesized
ggttgcctgttcactctgat

SEQ ID NO: 69191 - DNA, 20 bp, Artificial Sequence
  chemically synthesized
ctttagctgtgcagaagctc

SEQ ID NO: 69192 - DNA, 20 bp, Artificial Sequence
  chemically synthesized
agctctttagtttaattaga

SEQ ID NO: 69193 - DNA, 20 bp, Artificial Sequence
  chemically synthesized
tccattttgtcttttgttgc

SEQ ID NO: 69194 - DNA, 20 bp, Artificial Sequence
  chemically synthesized
tcttttgttgccattgcttt

SEQ ID NO: 69195 - DNA, 20 bp, Artificial Sequence
  chemically synthesized
tatgtcctgaatggtattgc

SEQ ID NO: 69196 - DNA, 20 bp, Artificial Sequence
  chemically synthesized
gtattgcctaggtttttttc

SEQ ID NO: 69197 - DNA, 20 bp, Artificial Sequence
  chemically synthesized
aggtttttttctagggtttt

SEQ ID NO: 69198 - DNA, 20 bp, Artificial Sequence
  chemically synthesized
tataaggtgtaaggaaggga

SEQ ID NO: 69199 - DNA, 20 bp, Artificial Sequence
  chemically synthesized
gtgtaaggaagggatccagt

SEQ ID NO: 69200 - DNA, 20 bp, Artificial Sequence
  chemically synthesized
cagctttctacatatggcta

SEQ ID NO: 69201 - DNA, 20 bp, Artificial Sequence
  chemically synthesized
taaatagggaatcctttccc

SEQ ID NO: 69202 - DNA, 20 bp, Artificial Sequence
  chemically synthesized
tagggaatcctttccccatt

SEQ ID NO: 69203 - DNA, 20 bp, Artificial Sequence
  chemically synthesized
ttccccattgcttgtttctc

SEQ ID NO: 69204 - DNA, 20 bp, Artificial Sequence
  chemically synthesized
tctgttccattggtctagat

SEQ ID NO: 69205 - DNA, 20 bp, Artificial Sequence
  chemically synthesized
ctgttttggtaccagtacca

SEQ ID NO: 69206 - DNA, 20 bp, Artificial Sequence
  chemically synthesized
tggttaccgtagcattgtag

SEQ ID NO: 69207 - DNA, 20 bp, Artificial Sequence
  chemically synthesized
aagtcaggtagcgtgatgcc

SEQ ID NO: 69208 - DNA, 20 bp, Artificial Sequence
  chemically synthesized
gatgcctccagctttgttct

SEQ ID NO: 69209 - DNA, 20 bp, Artificial Sequence
  chemically synthesized
tccagctttgttcttttggc

SEQ ID NO: 69210 - DNA, 20 bp, Artificial Sequence
  chemically synthesized
tggttccatatgaactttaa

SEQ ID NO: 69211 - DNA, 20 bp, Artificial Sequence
  chemically synthesized
gttctgtgaagaaagtcatt

SEQ ID NO: 69212 - DNA, 20 bp, Artificial Sequence
  chemically synthesized
cagtatgaccattttcacga

SEQ ID NO: 69213 - DNA, 20 bp, Artificial Sequence
  chemically synthesized
tgagcatggaatgttcttcc

SEQ ID NO: 69214 - DNA, 20 bp, Artificial Sequence
  chemically synthesized
cctcttttatttcattgagc

SEQ ID NO: 69215 - DNA, 20 bp, Artificial Sequence
  chemically synthesized
gtccttcacatcccttgtaa

SEQ ID NO: 69216 - DNA, 20 bp, Artificial Sequence
  chemically synthesized
aattgtgaatgggagttcac

SEQ ID NO: 69217 - DNA, 20 bp, Artificial Sequence
  chemically synthesized
agttcactcatgatttggct

SEQ ID NO: 69218 - DNA, 20 bp, Artificial Sequence
  chemically synthesized
ttattggtgcataggaatac

SEQ ID NO: 69219 - DNA, 20 bp, Artificial Sequence
  chemically synthesized
gaatacttgtgatttttgca

SEQ ID NO: 69220 - DNA, 20 bp, Artificial Sequence
  chemically synthesized
atatcctgagactttgctga

SEQ ID NO: 69221 - DNA, 20 bp, Artificial Sequence
  chemically synthesized
agactttgctgaagttgctt

SEQ ID NO: 69222 - DNA, 20 bp, Artificial Sequence
  chemically synthesized
tgaagttgcttatcagctta

SEQ ID NO: 69223 - DNA, 20 bp, Artificial Sequence
  chemically synthesized
gagattttgggctgagacaa

SEQ ID NO: 69224 - DNA, 20 bp, Artificial Sequence
  chemically synthesized
gccctttatttccttctcct

SEQ ID NO: 69225 - DNA, 20 bp, Artificial Sequence
  chemically synthesized
agagggcatccctgccttgt

SEQ ID NO: 69226 - DNA, 20 bp, Artificial Sequence
  chemically synthesized
cttgtgccagttttcaaagg

SEQ ID NO: 69227 - DNA, 20 bp, Artificial Sequence
  chemically synthesized
cagttttcaaagggaatgct

SEQ ID NO: 69228 - DNA, 20 bp, Artificial Sequence
  chemically synthesized
cactcagtatgatattggct

SEQ ID NO: 69229 - DNA, 20 bp, Artificial Sequence
  chemically synthesized
ccatcaatacctaatttatt

SEQ ID NO: 69230 - DNA, 20 bp, Artificial Sequence
  chemically synthesized
tgcatctattgagataatca

SEQ ID NO: 69231 - DNA, 20 bp, Artificial Sequence
  chemically synthesized
catatggtttgtgtctttgg

SEQ ID NO: 69232 - DNA, 20 bp, Artificial Sequence
  chemically synthesized
gtctttggttctgtttatat

SEQ ID NO: 69233 - DNA, 20 bp, Artificial Sequence
  chemically synthesized
ggttctgtttatatgctgga

SEQ ID NO: 69234 - DNA, 20 bp, Artificial Sequence
  chemically synthesized
tttatatgctggattatgtt

SEQ ID NO: 69235 - DNA, 20 bp, Artificial Sequence
  chemically synthesized
agcccacttgatcatggtgg

SEQ ID NO: 69236 - DNA, 20 bp, Artificial Sequence
  chemically synthesized
tcagtttgccagtattttat

SEQ ID NO: 69237 - DNA, 20 bp, Artificial Sequence
  chemically synthesized
ctttttttgttgtgtctctg

SEQ ID NO: 69238 - DNA, 20 bp, Artificial Sequence
  chemically synthesized
ggcctcataaaatgagttag

SEQ ID NO: 69239 - DNA, 20 bp, Artificial Sequence
  chemically synthesized
gggaggattccctctttttc

SEQ ID NO: 69240 - DNA, 20 bp, Artificial Sequence
  chemically synthesized
cctctttttctattgattgg

SEQ ID NO: 69241 - DNA, 20 bp, Artificial Sequence
  chemically synthesized
attcagagatacaacttctt

SEQ ID NO: 69242 - DNA, 20 bp, Artificial Sequence
  chemically synthesized
cgaggaatttatccatttct

SEQ ID NO: 69243 - DNA, 20 bp, Artificial Sequence
  chemically synthesized
tatccatttcttctagattt

SEQ ID NO: 69244 - DNA, 20 bp, Artificial Sequence
  chemically synthesized
tttctagtttatttgcgtag

SEQ ID NO: 69245 - DNA, 20 bp, Artificial Sequence
  chemically synthesized
tgtttatagtattctctgac

SEQ ID NO: 69246 - DNA, 20 bp, Artificial Sequence
  chemically synthesized
tgtcattttttattgcgtct

SEQ ID NO: 69247 - DNA, 20 bp, Artificial Sequence
  chemically synthesized
tttgttgatcttttcaaaaa

SEQ ID NO: 69248 - DNA, 20 bp, Artificial Sequence
  chemically synthesized
atcttttcaaaaaaacagct

SEQ ID NO: 69249 - DNA, 20 bp, Artificial Sequence
  chemically synthesized
aaaaaaacagcttctggatt

SEQ ID NO: 69250 - DNA, 20 bp, Artificial Sequence
  chemically synthesized
tggattcattgatttttttg

SEQ ID NO: 69251 - DNA, 20 bp, Artificial Sequence
  chemically synthesized
ttagttatttcttgtcttct

SEQ ID NO: 69252 - DNA, 20 bp, Artificial Sequence
  chemically synthesized
tgtcttctgttagcttttga

SEQ ID NO: 69253 - DNA, 20 bp, Artificial Sequence
  chemically synthesized
tagcttttgaatgtgtttgc

SEQ ID NO: 69254 - DNA, 20 bp, Artificial Sequence
  chemically synthesized
aatgtgtttgctcctgcttc

SEQ ID NO: 69255 - DNA, 20 bp, Artificial Sequence
  chemically synthesized
gggtgtcaattttagatctt

SEQ ID NO: 69256 - DNA, 20 bp, Artificial Sequence
  chemically synthesized
gctataaatttccctctaca

SEQ ID NO: 69257 - DNA, 20 bp, Artificial Sequence
  chemically synthesized
acactgctttgaatgtgtct

SEQ ID NO: 69258 - DNA, 20 bp, Artificial Sequence
  chemically synthesized
tgtgttgtgtctttgttctc

SEQ ID NO: 69259 - DNA, 20 bp, Artificial Sequence
  chemically synthesized
agtcattcaggagcaggctg

SEQ ID NO: 69260 - DNA, 20 bp, Artificial Sequence
  chemically synthesized
gttcagtttccatgtagctg

SEQ ID NO: 69261 - DNA, 20 bp, Artificial Sequence
  chemically synthesized
atgtagctgagtggttttga

SEQ ID NO: 69262 - DNA, 20 bp, Artificial Sequence
  chemically synthesized
tgagtttcttaatcctgagt

SEQ ID NO: 69263 - DNA, 20 bp, Artificial Sequence
  chemically synthesized
tttcttaatcctgagttcta

SEQ ID NO: 69264 - DNA, 20 bp, Artificial Sequence
  chemically synthesized
gattgcactgtggtctgaga

SEQ ID NO: 69265 - DNA, 20 bp, Artificial Sequence
  chemically synthesized
tggtctgagagacagtttgt

SEQ ID NO: 69266 - DNA, 20 bp, Artificial Sequence
  chemically synthesized
gttcttttacatttgctgag

SEQ ID NO: 69267 - DNA, 20 bp, Artificial Sequence
  chemically synthesized
gctttacttccaactatgtg

SEQ ID NO: 69268 - DNA, 20 bp, Artificial Sequence
  chemically synthesized
gctgaaaagaatgtatattc

SEQ ID NO: 69269 - DNA, 20 bp, Artificial Sequence
  chemically synthesized
gttctgtagatgtctattag

SEQ ID NO: 69270 - DNA, 20 bp, Artificial Sequence
  chemically synthesized
ctctttgtaggtcactcagg

SEQ ID NO: 69271 - DNA, 20 bp, Artificial Sequence
  chemically synthesized
ctttgtctcttttgatcttt

SEQ ID NO: 69272 - DNA, 20 bp, Artificial Sequence
  chemically synthesized
ttgatctttgttggtttaaa

SEQ ID NO: 69273 - DNA, 20 bp, Artificial Sequence
  chemically synthesized
aaaatctgttttatcagaga

SEQ ID NO: 69274 - DNA, 20 bp, Artificial Sequence
  chemically synthesized
ggattgcaacccctgccttt

SEQ ID NO: 69275 - DNA, 20 bp, Artificial Sequence
  chemically synthesized
cctgcctttttttgttttcc

SEQ ID NO: 69276 - DNA, 20 bp, Artificial Sequence
  chemically synthesized
tgtgtgtctctgcacgtgag

SEQ ID NO: 69277 - DNA, 20 bp, Artificial Sequence
  chemically synthesized
ctggttattttgctcgttga

SEQ ID NO: 69278 - DNA, 20 bp, Artificial Sequence
  chemically synthesized
ttgatggtctttacaatttg

SEQ ID NO: 69279 - DNA, 20 bp, Artificial Sequence
  chemically synthesized
ctgatactagttgttccttt

SEQ ID NO: 69280 - DNA, 20 bp, Artificial Sequence
  chemically synthesized
tagttgttcctttccatgtt

SEQ ID NO: 69281 - DNA, 20 bp, Artificial Sequence
  chemically synthesized
tggtgacaaaatctctcagc

SEQ ID NO: 69282 - DNA, 20 bp, Artificial Sequence
  chemically synthesized
ctcagcatttgcttgtctgt

SEQ ID NO: 69283 - DNA, 20 bp, Artificial Sequence
  chemically synthesized
ttttatttctccttcactta

SEQ ID NO: 69284 - DNA, 20 bp, Artificial Sequence
  chemically synthesized
tttctccttcacttatgaag

SEQ ID NO: 69285 - DNA, 20 bp, Artificial Sequence
  chemically synthesized
aatattggcccccactttct

SEQ ID NO: 69286 - DNA, 20 bp, Artificial Sequence
  chemically synthesized
ccccactttcttctggcttg

SEQ ID NO: 69287 - DNA, 20 bp, Artificial Sequence
  chemically synthesized
atagatcagctgttagtctg

SEQ ID NO: 69288 - DNA, 20 bp, Artificial Sequence
  chemically synthesized
ctgacagttatgtgtcttgg

SEQ ID NO: 69289 - DNA, 20 bp, Artificial Sequence
  chemically synthesized
tgtatttcctgaatgtgaat

SEQ ID NO: 69290 - DNA, 20 bp, Artificial Sequence
  chemically synthesized
tgtgaatttgggcttgcctt

SEQ ID NO: 69291 - DNA, 20 bp, Artificial Sequence
  chemically synthesized
ctcctggataatatcctgca

SEQ ID NO: 69292 - DNA, 20 bp, Artificial Sequence
  chemically synthesized
tttcagctacaccaattaga

SEQ ID NO: 69293 - DNA, 20 bp, Artificial Sequence
  chemically synthesized
cacatagtcccatatttctt

SEQ ID NO: 69294 - DNA, 20 bp, Artificial Sequence
  chemically synthesized
ccatatttcttggaggcttt

SEQ ID NO: 69295 - DNA, 20 bp, Artificial Sequence
  chemically synthesized
ttttttctctaaacttctct

SEQ ID NO: 69296 - DNA, 20 bp, Artificial Sequence
  chemically synthesized
cagttgatctcatcggttac

SEQ ID NO: 69297 - DNA, 20 bp, Artificial Sequence
  chemically synthesized
ttgtcacgtagttctcctgc

SEQ ID NO: 69298 - DNA, 20 bp, Artificial Sequence
  chemically synthesized
ccattcatctaatttttttt

SEQ ID NO: 69299 - DNA, 20 bp, Artificial Sequence
  chemically synthesized
ttcaaagttttttacttctt

SEQ ID NO: 69300 - DNA, 20 bp, Artificial Sequence
  chemically synthesized
cgtttgttcgaacttcctcc

SEQ ID NO: 69301 - DNA, 20 bp, Artificial Sequence
  chemically synthesized
aacttcctcctttagcttgg

SEQ ID NO: 69302 - DNA, 20 bp, Artificial Sequence
  chemically synthesized
ctcgtcaaagtcattctctg

SEQ ID NO: 69303 - DNA, 20 bp, Artificial Sequence
  chemically synthesized
gcactctcatttttagagtg

SEQ ID NO: 69304 - DNA, 20 bp, Artificial Sequence
  chemically synthesized
tagagtgtccagtttttctg

SEQ ID NO: 69305 - DNA, 20 bp, Artificial Sequence
  chemically synthesized
ctctgctttttccccatctt

SEQ ID NO: 69306 - DNA, 20 bp, Artificial Sequence
  chemically synthesized
ttgatgatggcgatgtacag

SEQ ID NO: 69307 - DNA, 20 bp, Artificial Sequence
  chemically synthesized
gtttttggtgtggatgtcct

SEQ ID NO: 69308 - DNA, 20 bp, Artificial Sequence
  chemically synthesized
tgtggatgtcctttctgttt

SEQ ID NO: 69309 - DNA, 20 bp, Artificial Sequence
  chemically synthesized
accctcagctgcaggtctgt

SEQ ID NO: 69310 - DNA, 20 bp, Artificial Sequence
  chemically synthesized
tactggaggtccactccaga

SEQ ID NO: 69311 - DNA, 20 bp, Artificial Sequence
  chemically synthesized
tgctgcctgatcattcctct

SEQ ID NO: 69312 - DNA, 20 bp, Artificial Sequence
  chemically synthesized
ctgcagaggttcttgttgtc

SEQ ID NO: 69313 - DNA, 20 bp, Artificial Sequence
  chemically synthesized
tgtggtgggctccacccagt

SEQ ID NO: 69314 - DNA, 20 bp, Artificial Sequence
  chemically synthesized
ccacccagttcgagcttcca

SEQ ID NO: 69315 - DNA, 20 bp, Artificial Sequence
  chemically synthesized
cagttcgagcttccaggcgg

SEQ ID NO: 69316 - DNA, 20 bp, Artificial Sequence
  chemically synthesized
ccccagcctcactgccacct

SEQ ID NO: 69317 - DNA, 20 bp, Artificial Sequence
  chemically synthesized
atctcctggtgtgccatttg

SEQ ID NO: 69318 - DNA, 20 bp, Artificial Sequence
  chemically synthesized
gcagtattagggcgggagtg

SEQ ID NO: 69319 - DNA, 20 bp, Artificial Sequence
  chemically synthesized
aaagggaattccctgacccc

SEQ ID NO: 69320 - DNA, 20 bp, Artificial Sequence
  chemically synthesized
ccgggtgaggtgatgcctcg

SEQ ID NO: 69321 - DNA, 20 bp, Artificial Sequence
  chemically synthesized
aacctctgcctcccaggatc

SEQ ID NO: 69322 - DNA, 20 bp, Artificial Sequence
  chemically synthesized
tgcctcagcctcccaaattg

SEQ ID NO: 69323 - DNA, 20 bp, Artificial Sequence
  chemically synthesized
atgcctgccaccacgccagg

SEQ ID NO: 69324 - DNA, 20 bp, Artificial Sequence
  chemically synthesized
ttttatatttttagtagcga

SEQ ID NO: 69325 - DNA, 20 bp, Artificial Sequence
  chemically synthesized
ccagcctagaataacttctt

SEQ ID NO: 69326 - DNA, 20 bp, Artificial Sequence
  chemically synthesized
actgaatttatttctccctt

SEQ ID NO: 69327 - DNA, 20 bp, Artificial Sequence
  chemically synthesized
attaaataacagtgttatct

SEQ ID NO: 69328 - DNA, 20 bp, Artificial Sequence
  chemically synthesized
atgtcttcccatatttttat

SEQ ID NO: 69329 - DNA, 20 bp, Artificial Sequence
  chemically synthesized
accttcacacctaattgtgt

SEQ ID NO: 69330 - DNA, 20 bp, Artificial Sequence
  chemically synthesized
aaaaagtatagttgttcaat

SEQ ID NO: 69331 - DNA, 20 bp, Artificial Sequence
  chemically synthesized
agtatagttgttcaattact

SEQ ID NO: 69332 - DNA, 20 bp, Artificial Sequence
  chemically synthesized
tatcacattattatatttta

SEQ ID NO: 69333 - DNA, 20 bp, Artificial Sequence
  chemically synthesized
attattatattttagtgaga

SEQ ID NO: 69334 - DNA, 20 bp, Artificial Sequence
  chemically synthesized
tattttagtgagatttagtt

SEQ ID NO: 69335 - DNA, 20 bp, Artificial Sequence
  chemically synthesized
acatgagtggtattaattta

SEQ ID NO: 69336 - DNA, 20 bp, Artificial Sequence
  chemically synthesized
aaaatatatatatatataat

SEQ ID NO: 69337 - DNA, 20 bp, Artificial Sequence
  chemically synthesized
taaagtgctaaaatttattg

SEQ ID NO: 69338 - DNA, 20 bp, Artificial Sequence
  chemically synthesized
caagatgcatttttttattt

SEQ ID NO: 69339 - DNA, 20 bp, Artificial Sequence
  chemically synthesized
tatatttaaggtgtacaaca

SEQ ID NO: 69340 - DNA, 20 bp, Artificial Sequence
  chemically synthesized
taatatatgtataccttgtg

SEQ ID NO: 69341 - DNA, 20 bp, Artificial Sequence
  chemically synthesized
agttacctttttcttgtggt

SEQ ID NO: 69342 - DNA, 20 bp, Artificial Sequence
  chemically synthesized
gctactcgggaggctgaggc

SEQ ID NO: 69343 - DNA, 20 bp, Artificial Sequence
  chemically synthesized
tcgggaggctgaggcaggag

SEQ ID NO: 69344 - DNA, 20 bp, Artificial Sequence
  chemically synthesized
aaattttataccctttgagt

SEQ ID NO: 69345 - DNA, 20 bp, Artificial Sequence
  chemically synthesized
ataccctttgagtaatagtt

SEQ ID NO: 69346 - DNA, 20 bp, Artificial Sequence
  chemically synthesized
ctggaaaccatacctctact

SEQ ID NO: 69347 - DNA, 20 bp, Artificial Sequence
  chemically synthesized
tttccatgagagtgactttt

SEQ ID NO: 69348 - DNA, 20 bp, Artificial Sequence
  chemically synthesized
gtagtatttgtctttttgtg

SEQ ID NO: 69349 - DNA, 20 bp, Artificial Sequence
  chemically synthesized
tttgtgtcaggcttattttt

SEQ ID NO: 69350 - DNA, 20 bp, Artificial Sequence
  chemically synthesized
catcaattctgccataaatg

SEQ ID NO: 69351 - DNA, 20 bp, Artificial Sequence
  chemically synthesized
ttattttcctatttttaatt

SEQ ID NO: 69352 - DNA, 20 bp, Artificial Sequence
  chemically synthesized
tttgtttgttattgaatcat

SEQ ID NO: 69353 - DNA, 20 bp, Artificial Sequence
  chemically synthesized
accaaaatatttaagaaata

SEQ ID NO: 69354 - DNA, 20 bp, Artificial Sequence
  chemically synthesized
tggttcacctttcatttgtt

SEQ ID NO: 69355 - DNA, 20 bp, Artificial Sequence
  chemically synthesized
cacctttcatttgttcattg

SEQ ID NO: 69356 - DNA, 20 bp, Artificial Sequence
  chemically synthesized
tgttttttgtgtggaaattt

SEQ ID NO: 69357 - DNA, 20 bp, Artificial Sequence
  chemically synthesized
tttatttttccttttgttgc

SEQ ID NO: 69358 - DNA, 20 bp, Artificial Sequence
  chemically synthesized
tgaatattagaattttcttc

SEQ ID NO: 69359 - DNA, 20 bp, Artificial Sequence
  chemically synthesized
ttgatttctttaaaaatttt

SEQ ID NO: 69360 - DNA, 20 bp, Artificial Sequence
  chemically synthesized
aaatttttatggttttaggt

SEQ ID NO: 69361 - DNA, 20 bp, Artificial Sequence
  chemically synthesized
tttaacccattcaaatttat

SEQ ID NO: 69362 - DNA, 20 bp, Artificial Sequence
  chemically synthesized
gtttatggtgtaagacaagg

SEQ ID NO: 69363 - DNA, 20 bp, Artificial Sequence
  chemically synthesized
gtctgatttcatttcatttt

SEQ ID NO: 69364 - DNA, 20 bp, Artificial Sequence
  chemically synthesized
acccttctatcatcacttat

SEQ ID NO: 69365 - DNA, 20 bp, Artificial Sequence
  chemically synthesized
cacttattactgattatatg

SEQ ID NO: 69366 - DNA, 20 bp, Artificial Sequence
  chemically synthesized
ttgatttcagaatcttgcca

SEQ ID NO: 69367 - DNA, 20 bp, Artificial Sequence
  chemically synthesized
tagttccgggagactagcac

SEQ ID NO: 69368 - DNA, 20 bp, Artificial Sequence
  chemically synthesized
caggacagtcaaaccatgac

SEQ ID NO: 69369 - DNA, 20 bp, Artificial Sequence
  chemically synthesized
ggctgttgccaatgtgcatt

SEQ ID NO: 69370 - DNA, 20 bp, Artificial Sequence
  chemically synthesized
tgcagcctcaccttctttca

SEQ ID NO: 69371 - DNA, 20 bp, Artificial Sequence
  chemically synthesized
taagatatagtgtattttcc

SEQ ID NO: 69372 - DNA, 20 bp, Artificial Sequence
  chemically synthesized
tgaactagctcttcatttct

SEQ ID NO: 69373 - DNA, 20 bp, Artificial Sequence
  chemically synthesized
tacatcattgcaatgaaaat

SEQ ID NO: 69374 - DNA, 20 bp, Artificial Sequence
  chemically synthesized
caaggcccttcataatatcc

SEQ ID NO: 69375 - DNA, 20 bp, Artificial Sequence
  chemically synthesized
agaaattggacagcaagaaa

SEQ ID NO: 69376 - DNA, 20 bp, Artificial Sequence
  chemically synthesized
gaggaagataagaggtatga

SEQ ID NO: 69377 - DNA, 20 bp, Artificial Sequence
  chemically synthesized
gaacatgattagcaaaaggg

SEQ ID NO: 69378 - DNA, 20 bp, Artificial Sequence
  chemically synthesized
aaaataaaagcagaatggta

SEQ ID NO: 69379 - DNA, 20 bp, Artificial Sequence
  chemically synthesized
atcattattgccctgaaaga

SEQ ID NO: 69380 - DNA, 20 bp, Artificial Sequence
  chemically synthesized
aaattacaaatgcaaaatta

SEQ ID NO: 69381 - DNA, 20 bp, Artificial Sequence
  chemically synthesized
ctttaacccataaatatgta

SEQ ID NO: 69382 - DNA, 20 bp, Artificial Sequence
  chemically synthesized
aaataaaagaaaataaagta

SEQ ID NO: 69383 - DNA, 20 bp, Artificial Sequence
  chemically synthesized
aatgtactaggcagactgtg

SEQ ID NO: 69384 - DNA, 20 bp, Artificial Sequence
  chemically synthesized
ccacactgatgcaatcattc

SEQ ID NO: 69385 - DNA, 20 bp, Artificial Sequence
  chemically synthesized
tgaagttctcaggatccacg

SEQ ID NO: 69386 - DNA, 20 bp, Artificial Sequence
  chemically synthesized
gtcttctctgtctccacatg

SEQ ID NO: 69387 - DNA, 20 bp, Artificial Sequence
  chemically synthesized
ggagtcagatgcaccatggt

SEQ ID NO: 69388 - DNA, 20 bp, Artificial Sequence
  chemically synthesized
ctgccctccctgctcctggg

SEQ ID NO: 69389 - DNA, 20 bp, Artificial Sequence
  chemically synthesized
ctgtccttggctcttctggc

SEQ ID NO: 69390 - DNA, 20 bp, Artificial Sequence
  chemically synthesized
atttacgtaatatttggaat

SEQ ID NO: 69391 - DNA, 20 bp, Artificial Sequence
  chemically synthesized
agcttggtaagcatattgaa

SEQ ID NO: 69392 - DNA, 20 bp, Artificial Sequence
  chemically synthesized
agttgatgcactaaaagtgg

SEQ ID NO: 69393 - DNA, 20 bp, Artificial Sequence
  chemically synthesized
aagagttttgtctaccataa

SEQ ID NO: 69394 - DNA, 20 bp, Artificial Sequence
  chemically synthesized
ctaagcatatcttctcctta

SEQ ID NO: 69395 - DNA, 20 bp, Artificial Sequence
  chemically synthesized
atatatatgcattcatttgt

SEQ ID NO: 69396 - DNA, 20 bp, Artificial Sequence
  chemically synthesized
ctctgtgcattagttactta

SEQ ID NO: 69397 - DNA, 20 bp, Artificial Sequence
  chemically synthesized
gaggttaactggggacatct

SEQ ID NO: 69398 - DNA, 20 bp, Artificial Sequence
  chemically synthesized
ggaaaaggtcttctacttgg

SEQ ID NO: 69399 - DNA, 20 bp, Artificial Sequence
  chemically synthesized
cctctagtccactaagaata

SEQ ID NO: 69400 - DNA, 20 bp, Artificial Sequence
  chemically synthesized
actgcgttttaaaatcattt

SEQ ID NO: 69401 - DNA, 20 bp, Artificial Sequence
  chemically synthesized
agttcctatttctctttata

SEQ ID NO: 69402 - DNA, 20 bp, Artificial Sequence
  chemically synthesized
cctatttctctttatatttt

SEQ ID NO: 69403 - DNA, 20 bp, Artificial Sequence
  chemically synthesized
aaaatttactcttctttctc

SEQ ID NO: 69404 - DNA, 20 bp, Artificial Sequence
  chemically synthesized
aaaacttttgaagtgcagag

SEQ ID NO: 69405 - DNA, 20 bp, Artificial Sequence
  chemically synthesized
gcccctacctggaaacccat

SEQ ID NO: 69406 - DNA, 20 bp, Artificial Sequence
  chemically synthesized
aagtgttatacttttacttt

SEQ ID NO: 69407 - DNA, 20 bp, Artificial Sequence
  chemically synthesized
tcagctctaacactctgaaa

SEQ ID NO: 69408 - DNA, 20 bp, Artificial Sequence
  chemically synthesized
atttacaaatttcttatttc

SEQ ID NO: 69409 - DNA, 20 bp, Artificial Sequence
  chemically synthesized
ttccattgctttattctctt

SEQ ID NO: 69410 - DNA, 20 bp, Artificial Sequence
  chemically synthesized
gtacttgtgaaaaaatctca

SEQ ID NO: 69411 - DNA, 20 bp, Artificial Sequence
  chemically synthesized
attattctcacacacgcaga

SEQ ID NO: 69412 - DNA, 20 bp, Artificial Sequence
  chemically synthesized
ggttaaaaaattatgcctat

SEQ ID NO: 69413 - DNA, 20 bp, Artificial Sequence
  chemically synthesized
ggcacacgtgtatccctgag

SEQ ID NO: 69414 - DNA, 20 bp, Artificial Sequence
  chemically synthesized
atattttaaatgttaaaaca

SEQ ID NO: 69415 - DNA, 20 bp, Artificial Sequence
  chemically synthesized
catgcagatttgacttggct

SEQ ID NO: 69416 - DNA, 20 bp, Artificial Sequence
  chemically synthesized
atttgacttggctgttagat

SEQ ID NO: 69417 - DNA, 20 bp, Artificial Sequence
  chemically synthesized
taaatttaaacctgcattag

SEQ ID NO: 69418 - DNA, 20 bp, Artificial Sequence
  chemically synthesized
taaacctgcattagcattgt

SEQ ID NO: 69419 - DNA, 20 bp, Artificial Sequence
  chemically synthesized
ttagcattgttttagattta

SEQ ID NO: 69420 - DNA, 20 bp, Artificial Sequence
  chemically synthesized
gatttagacagttttcaaga

SEQ ID NO: 69421 - DNA, 20 bp, Artificial Sequence
  chemically synthesized
tgtgaaataaagtgttctgc

SEQ ID NO: 69422 - DNA, 20 bp, Artificial Sequence
  chemically synthesized
aagaccaaaattgtcaaagc

SEQ ID NO: 69423 - DNA, 20 bp, Artificial Sequence
  chemically synthesized
tcaaagcaagagctttgaaa

SEQ ID NO: 69424 - DNA, 20 bp, Artificial Sequence
  chemically synthesized
tacaacttcttatgctcaga

SEQ ID NO: 69425 - DNA, 20 bp, Artificial Sequence
  chemically synthesized
aaatagttttcctttttcta

SEQ ID NO: 69426 - DNA, 20 bp, Artificial Sequence
  chemically synthesized
actgctgcagataccatcat

SEQ ID NO: 69427 - DNA, 20 bp, Artificial Sequence
  chemically synthesized
catcctggcttcaaggcagg

SEQ ID NO: 69428 - DNA, 20 bp, Artificial Sequence
  chemically synthesized
agcccaggcataccaggcaa

SEQ ID NO: 69429 - DNA, 20 bp, Artificial Sequence
  chemically synthesized
aatttggttatggtcagagc

SEQ ID NO: 69430 - DNA, 20 bp, Artificial Sequence
  chemically synthesized
caaagttcctgaaaaactat

SEQ ID NO: 69431 - DNA, 20 bp, Artificial Sequence
  chemically synthesized
ttactgacatcttcactatt

SEQ ID NO: 69432 - DNA, 20 bp, Artificial Sequence
  chemically synthesized
tgacatcttcactattgtga

SEQ ID NO: 69433 - DNA, 20 bp, Artificial Sequence
  chemically synthesized
tattaatctttcttaagtcc

SEQ ID NO: 69434 - DNA, 20 bp, Artificial Sequence
  chemically synthesized
atgacactcatctatgggag

SEQ ID NO: 69435 - DNA, 20 bp, Artificial Sequence
  chemically synthesized
tatgggagtgtggttttatc

SEQ ID NO: 69436 - DNA, 20 bp, Artificial Sequence
  chemically synthesized
gagtatttttatacatgctc

SEQ ID NO: 69437 - DNA, 20 bp, Artificial Sequence
  chemically synthesized
aacaaaccgcacacacacaa

SEQ ID NO: 69438 - DNA, 20 bp, Artificial Sequence
  chemically synthesized
acaaaatagtttggaaatag

SEQ ID NO: 69439 - DNA, 20 bp, Artificial Sequence
  chemically synthesized
ttaatatttcctccactggg

SEQ ID NO: 69440 - DNA, 20 bp, Artificial Sequence
  chemically synthesized
ggctcagattttcattcaga

SEQ ID NO: 69441 - DNA, 20 bp, Artificial Sequence
  chemically synthesized
ggtacagtcttcagataaat

SEQ ID NO: 69442 - DNA, 20 bp, Artificial Sequence
  chemically synthesized
catctctttagaggtagaat

SEQ ID NO: 69443 - DNA, 20 bp, Artificial Sequence
  chemically synthesized
tgctctgaagctcaagagat

SEQ ID NO: 69444 - DNA, 20 bp, Artificial Sequence
  chemically synthesized
atggatgatttaggagacta

SEQ ID NO: 69445 - DNA, 20 bp, Artificial Sequence
  chemically synthesized
tttcattcagacatactgaa

SEQ ID NO: 69446 - DNA, 20 bp, Artificial Sequence
  chemically synthesized
gaattaattccattcctata

SEQ ID NO: 69447 - DNA, 20 bp, Artificial Sequence
  chemically synthesized
catatcactgggtcttgatg

SEQ ID NO: 69448 - DNA, 20 bp, Artificial Sequence
  chemically synthesized
ttctcatgaattctctggta

SEQ ID NO: 69449 - DNA, 20 bp, Artificial Sequence
  chemically synthesized
ttgacttttggagaaaggaa

SEQ ID NO: 69450 - DNA, 20 bp, Artificial Sequence
  chemically synthesized
cttttggagaaaggaatgta

SEQ ID NO: 69451 - DNA, 20 bp, Artificial Sequence
  chemically synthesized
ccccaaaatgccctgagtag

SEQ ID NO: 69452 - DNA, 20 bp, Artificial Sequence
  chemically synthesized
aggaaaacacatggatataa

SEQ ID NO: 69453 - DNA, 20 bp, Artificial Sequence
  chemically synthesized
actttcaaacacaaggaaac

SEQ ID NO: 69454 - DNA, 20 bp, Artificial Sequence
  chemically synthesized
aaacacaaggaaacaacaga

SEQ ID NO: 69455 - DNA, 20 bp, Artificial Sequence
  chemically synthesized
gattctgtttaggtattcaa

SEQ ID NO: 69456 - DNA, 20 bp, Artificial Sequence
  chemically synthesized
attaatcaacatgcatataa

SEQ ID NO: 69457 - DNA, 20 bp, Artificial Sequence
  chemically synthesized
cagaaaggaaataactgttc

SEQ ID NO: 69458 - DNA, 20 bp, Artificial Sequence
  chemically synthesized
taactgttcggttgtttact

SEQ ID NO: 69459 - DNA, 20 bp, Artificial Sequence
  chemically synthesized
tactcattcgttcattcatt

SEQ ID NO: 69460 - DNA, 20 bp, Artificial Sequence
  chemically synthesized
agaaggtagagaataggcag

SEQ ID NO: 69461 - DNA, 20 bp, Artificial Sequence
  chemically synthesized
atataaaaaatggtgtgggg

SEQ ID NO: 69462 - DNA, 20 bp, Artificial Sequence
  chemically synthesized
atggtgtgggggagggtttg

SEQ ID NO: 69463 - DNA, 20 bp, Artificial Sequence
  chemically synthesized
agattttttgggtagtatag

SEQ ID NO: 69464 - DNA, 20 bp, Artificial Sequence
  chemically synthesized
attattttctcagtaattgt

SEQ ID NO: 69465 - DNA, 20 bp, Artificial Sequence
  chemically synthesized
attaatgccttgtacggttc

SEQ ID NO: 69466 - DNA, 20 bp, Artificial Sequence
  chemically synthesized
tggttaacagagaaataaag

SEQ ID NO: 69467 - DNA, 20 bp, Artificial Sequence
  chemically synthesized
tatatacaaattaattccaa

SEQ ID NO: 69468 - DNA, 20 bp, Artificial Sequence
  chemically synthesized
tatacaaattaattactata

SEQ ID NO: 69469 - DNA, 20 bp, Artificial Sequence
  chemically synthesized
cagattaatagatacaaatt

SEQ ID NO: 69470 - DNA, 20 bp, Artificial Sequence
  chemically synthesized
tccaattattccttattgta

SEQ ID NO: 69471 - DNA, 20 bp, Artificial Sequence
  chemically synthesized
catacccatgtggagagaca

SEQ ID NO: 69472 - DNA, 20 bp, Artificial Sequence
  chemically synthesized
atattaaataatttaaaata

SEQ ID NO: 69473 - DNA, 20 bp, Artificial Sequence
  chemically synthesized
gtaggtaaaagaaccaaaat

SEQ ID NO: 69474 - DNA, 20 bp, Artificial Sequence
  chemically synthesized
tgaagttctcaggatccacg

SEQ ID NO: 69475 - DNA, 20 bp, Artificial Sequence
  chemically synthesized
gtcttctctgtctacacatg

SEQ ID NO: 69476 - DNA, 20 bp, Artificial Sequence
  chemically synthesized
ggagtcagatgcaccatggt

SEQ ID NO: 69477 - DNA, 20 bp, Artificial Sequence
  chemically synthesized
ctccctgctccagtgagcag

SEQ ID NO: 69478 - DNA, 20 bp, Artificial Sequence
  chemically synthesized
gcaggttggtttaagataag

SEQ ID NO: 69479 - DNA, 20 bp, Artificial Sequence
  chemically synthesized
tttaagataagcagggtttc

SEQ ID NO: 69480 - DNA, 20 bp, Artificial Sequence
  chemically synthesized
cactattcccttaacttgcc

SEQ ID NO: 69481 - DNA, 20 bp, Artificial Sequence
  chemically synthesized
cccaccgcatctctttcagc

SEQ ID NO: 69482 - DNA, 20 bp, Artificial Sequence
  chemically synthesized
gttgtttctaaaaatatcct

SEQ ID NO: 69483 - DNA, 20 bp, Artificial Sequence
  chemically synthesized
tcctagtttcatttttgcag

SEQ ID NO: 69484 - DNA, 20 bp, Artificial Sequence
  chemically synthesized
taatatagtggaatgtatct

SEQ ID NO: 69485 - DNA, 20 bp, Artificial Sequence
  chemically synthesized
tgtatcttagagtttaactt

SEQ ID NO: 69486 - DNA, 20 bp, Artificial Sequence
  chemically synthesized
aagaaaacttatctaaaagc

SEQ ID NO: 69487 - DNA, 20 bp, Artificial Sequence
  chemically synthesized
ataaagttcttctttgcctc

SEQ ID NO: 69488 - DNA, 20 bp, Artificial Sequence
  chemically synthesized
ggaatggacaaatctattgc

SEQ ID NO: 69489 - DNA, 20 bp, Artificial Sequence
  chemically synthesized
aatctattgctgcagtttaa

SEQ ID NO: 69490 - DNA, 20 bp, Artificial Sequence
  chemically synthesized
tattgctgcagtttaaactt

SEQ ID NO: 69491 - DNA, 20 bp, Artificial Sequence
  chemically synthesized
aagaatatttaaaaaatgaa

SEQ ID NO: 69492 - DNA, 20 bp, Artificial Sequence
  chemically synthesized
atattatatacaaatatttt

SEQ ID NO: 69493 - DNA, 20 bp, Artificial Sequence
  chemically synthesized
agaaagaatgcaaagtgaaa

SEQ ID NO: 69494 - DNA, 20 bp, Artificial Sequence
  chemically synthesized
aagtagatttaccatattca

SEQ ID NO: 69495 - DNA, 20 bp, Artificial Sequence
  chemically synthesized
gacccaggaatgaagatccc

SEQ ID NO: 69496 - DNA, 20 bp, Artificial Sequence
  chemically synthesized
cccatgagcatatccaaaag

SEQ ID NO: 69497 - DNA, 20 bp, Artificial Sequence
  chemically synthesized
taatagtatccacaaatgct

SEQ ID NO: 69498 - DNA, 20 bp, Artificial Sequence
  chemically synthesized
gtatccaaagacatgtatag

SEQ ID NO: 69499 - DNA, 20 bp, Artificial Sequence
  chemically synthesized
cctcaaaccggtagccactt

SEQ ID NO: 69500 - DNA, 20 bp, Artificial Sequence
  chemically synthesized
cagaaatgaaaagaatcaac

SEQ ID NO: 69501 - DNA, 20 bp, Artificial Sequence
  chemically synthesized
aaatgcattttacagcattt

SEQ ID NO: 69502 - DNA, 20 bp, Artificial Sequence
  chemically synthesized
tagaaagatggatgatgtgc

SEQ ID NO: 69503 - DNA, 20 bp, Artificial Sequence
  chemically synthesized
taattcaagaaaggtggtgg

SEQ ID NO: 69504 - DNA, 20 bp, Artificial Sequence
  chemically synthesized
tcaagaaaggtggtggcatg

SEQ ID NO: 69505 - DNA, 20 bp, Artificial Sequence
  chemically synthesized
atggtttgatttgtgtcttt

SEQ ID NO: 69506 - DNA, 20 bp, Artificial Sequence
  chemically synthesized
agaaaatgggagacaaatag

SEQ ID NO: 69507 - DNA, 20 bp, Artificial Sequence
  chemically synthesized
acaagaatagggccacattt

SEQ ID NO: 69508 - DNA, 20 bp, Artificial Sequence
  chemically synthesized
tatctccttaaaatcttaga

SEQ ID NO: 69509 - DNA, 20 bp, Artificial Sequence
  chemically synthesized
atgtgtttgtgagggaggaa

SEQ ID NO: 69510 - DNA, 20 bp, Artificial Sequence
  chemically synthesized
ttccaattcatatataagaa

SEQ ID NO: 69511 - DNA, 20 bp, Artificial Sequence
  chemically synthesized
ttgtctgttaattccaaaga

SEQ ID NO: 69512 - DNA, 20 bp, Artificial Sequence
  chemically synthesized
ctttaattctgttctacctg

SEQ ID NO: 69513 - DNA, 20 bp, Artificial Sequence
  chemically synthesized
acacattgggagatctggtt

SEQ ID NO: 69514 - DNA, 20 bp, Artificial Sequence
  chemically synthesized
ctggttacatgtttattcta

SEQ ID NO: 69515 - DNA, 20 bp, Artificial Sequence
  chemically synthesized
attctatatggattgcattg

SEQ ID NO: 69516 - DNA, 20 bp, Artificial Sequence
  chemically synthesized
ttttcttttctcttctgaga

SEQ ID NO: 69517 - DNA, 20 bp, Artificial Sequence
  chemically synthesized
caggcatgcaccacacgccc

SEQ ID NO: 69518 - DNA, 20 bp, Artificial Sequence
  chemically synthesized
ttttgtatttttagtagaga

SEQ ID NO: 69519 - DNA, 20 bp, Artificial Sequence
  chemically synthesized
tgccttggcctcccaaagtg

SEQ ID NO: 69520 - DNA, 20 bp, Artificial Sequence
  chemically synthesized
acctgactgggcagtaagag

SEQ ID NO: 69521 - DNA, 20 bp, Artificial Sequence
  chemically synthesized
aaattgaagcagaatcgaac

SEQ ID NO: 69522 - DNA, 20 bp, Artificial Sequence
  chemically synthesized
actgttgattagaggtaggg

SEQ ID NO: 69523 - DNA, 20 bp, Artificial Sequence
  chemically synthesized
atggaaaacactggaagaga

SEQ ID NO: 69524 - DNA, 20 bp, Artificial Sequence
  chemically synthesized
ctatataaataagcccagta

SEQ ID NO: 69525 - DNA, 20 bp, Artificial Sequence
  chemically synthesized
cccagtacattgtttgatat

SEQ ID NO: 69526 - DNA, 20 bp, Artificial Sequence
  chemically synthesized
ttagaaatcagagttgggaa

SEQ ID NO: 69527 - DNA, 20 bp, Artificial Sequence
  chemically synthesized
ggattatacaggctgtattt

SEQ ID NO: 69528 - DNA, 20 bp, Artificial Sequence
  chemically synthesized
gacatagtccccaaaatccc

SEQ ID NO: 69529 - DNA, 20 bp, Artificial Sequence
  chemically synthesized
ccgatgattttagaactcag

SEQ ID NO: 69530 - DNA, 20 bp, Artificial Sequence
  chemically synthesized
agaatggaagtcaacttgct

SEQ ID NO: 69531 - DNA, 20 bp, Artificial Sequence
  chemically synthesized
gagcaggtaggagataaggt

SEQ ID NO: 69532 - DNA, 20 bp, Artificial Sequence
  chemically synthesized
ttgggaggctgaggcaggag

SEQ ID NO: 69533 - DNA, 20 bp, Artificial Sequence
  chemically synthesized
aacctgaaaaaataaattat

SEQ ID NO: 69534 - DNA, 20 bp, Artificial Sequence
  chemically synthesized
caattctaatctcagttcac

SEQ ID NO: 69535 - DNA, 20 bp, Artificial Sequence
  chemically synthesized
agttcactgctgtttgaatt

SEQ ID NO: 69536 - DNA, 20 bp, Artificial Sequence
  chemically synthesized
tattcatttactggacacat

SEQ ID NO: 69537 - DNA, 20 bp, Artificial Sequence
  chemically synthesized
ttctgtcaattaccattcat

SEQ ID NO: 69538 - DNA, 20 bp, Artificial Sequence
  chemically synthesized
atttgaggaactgacatttc

SEQ ID NO: 69539 - DNA, 20 bp, Artificial Sequence
  chemically synthesized
ctggctgagggaaagcataa

SEQ ID NO: 69540 - DNA, 20 bp, Artificial Sequence
  chemically synthesized
ctacagcagacagtcttttt

SEQ ID NO: 69541 - DNA, 20 bp, Artificial Sequence
  chemically synthesized
cttctaggcctaatggcgga

SEQ ID NO: 69542 - DNA, 20 bp, Artificial Sequence
  chemically synthesized
gttttctgatgttactaaca

SEQ ID NO: 69543 - DNA, 20 bp, Artificial Sequence
  chemically synthesized
ttctaggttgagtaactgat

SEQ ID NO: 69544 - DNA, 20 bp, Artificial Sequence
  chemically synthesized
gatgtgaataaatgcatgac

SEQ ID NO: 69545 - DNA, 20 bp, Artificial Sequence
  chemically synthesized
cattttagaaccaaaggttc

SEQ ID NO: 69546 - DNA, 20 bp, Artificial Sequence
  chemically synthesized
tctccaaatactagggaaat

SEQ ID NO: 69547 - DNA, 20 bp, Artificial Sequence
  chemically synthesized
agtggtaggaatatacaatg

SEQ ID NO: 69548 - DNA, 20 bp, Artificial Sequence
  chemically synthesized
gaaagagcccataattgtag

SEQ ID NO: 69549 - DNA, 20 bp, Artificial Sequence
  chemically synthesized
attgtagcagagtttataga

SEQ ID NO: 69550 - DNA, 20 bp, Artificial Sequence
  chemically synthesized
cccagttaaaattaaaaaaa

SEQ ID NO: 69551 - DNA, 20 bp, Artificial Sequence
  chemically synthesized
aaatgcagaaatccaaattc

SEQ ID NO: 69552 - DNA, 20 bp, Artificial Sequence
  chemically synthesized
tgtgttcttatgtgtgcatg

SEQ ID NO: 69553 - DNA, 20 bp, Artificial Sequence
  chemically synthesized
atctgtatgtgtatatcaga

SEQ ID NO: 69554 - DNA, 20 bp, Artificial Sequence
  chemically synthesized
cagagaatgtttacattgct

SEQ ID NO: 69555 - DNA, 20 bp, Artificial Sequence
  chemically synthesized
cacaagcattcatgctacat

SEQ ID NO: 69556 - DNA, 20 bp, Artificial Sequence
  chemically synthesized
ttcctgtaagatgtgtactt

SEQ ID NO: 69557 - DNA, 20 bp, Artificial Sequence
  chemically synthesized
gggcaagggatagcacaagt

SEQ ID NO: 69558 - DNA, 20 bp, Artificial Sequence
  chemically synthesized
cacaagtgtgagattttaaa

SEQ ID NO: 69559 - DNA, 20 bp, Artificial Sequence
  chemically synthesized
agtgtgagattttaaagtgt

SEQ ID NO: 69560 - DNA, 20 bp, Artificial Sequence
  chemically synthesized
acacagtaattattcaaaga

SEQ ID NO: 69561 - DNA, 20 bp, Artificial Sequence
  chemically synthesized
tatgctacaagacagcagtt

SEQ ID NO: 69562 - DNA, 20 bp, Artificial Sequence
  chemically synthesized
acatgagcaactggtattta

SEQ ID NO: 69563 - DNA, 20 bp, Artificial Sequence
  chemically synthesized
tagaggaaatactttgagaa

SEQ ID NO: 69564 - DNA, 20 bp, Artificial Sequence
  chemically synthesized
aatactttgagaaagaggtt

SEQ ID NO: 69565 - DNA, 20 bp, Artificial Sequence
  chemically synthesized
tcttctaaaacctctttctt

SEQ ID NO: 69566 - DNA, 20 bp, Artificial Sequence
  chemically synthesized
aaacctctttctttgaggtt

SEQ ID NO: 69567 - DNA, 20 bp, Artificial Sequence
  chemically synthesized
ttcctaagggtcttgggtac

SEQ ID NO: 69568 - DNA, 20 bp, Artificial Sequence
  chemically synthesized
gtcttgggtacaggagtttg

SEQ ID NO: 69569 - DNA, 20 bp, Artificial Sequence
  chemically synthesized
ttcattgccagatccaaaca

SEQ ID NO: 69570 - DNA, 20 bp, Artificial Sequence
  chemically synthesized
tccttcttttcattcacaga

SEQ ID NO: 69571 - DNA, 20 bp, Artificial Sequence
  chemically synthesized
tttagctgtcatctctgact

SEQ ID NO: 69572 - DNA, 20 bp, Artificial Sequence
  chemically synthesized
atctctgactctctgtttca

SEQ ID NO: 69573 - DNA, 20 bp, Artificial Sequence
  chemically synthesized
cactgccacaatggtctctt

SEQ ID NO: 69574 - DNA, 20 bp, Artificial Sequence
  chemically synthesized
tcgattttttttcttaactt

SEQ ID NO: 69575 - DNA, 20 bp, Artificial Sequence
  chemically synthesized
tatacatgtgaatcaatttt

SEQ ID NO: 69576 - DNA, 20 bp, Artificial Sequence
  chemically synthesized
ctctcatatgcaagaaactt

SEQ ID NO: 69577 - DNA, 20 bp, Artificial Sequence
  chemically synthesized
tacttcatctggtctctgca

SEQ ID NO: 69578 - DNA, 20 bp, Artificial Sequence
  chemically synthesized
tctatcaacttgacttaacg

SEQ ID NO: 69579 - DNA, 20 bp, Artificial Sequence
  chemically synthesized
taaatctcagccttttaatc

SEQ ID NO: 69580 - DNA, 20 bp, Artificial Sequence
  chemically synthesized
tgctcacataaacaaaaatc

SEQ ID NO: 69581 - DNA, 20 bp, Artificial Sequence
  chemically synthesized
caaaaatcagtggttttcaa

SEQ ID NO: 69582 - DNA, 20 bp, Artificial Sequence
  chemically synthesized
tagaaacagagagctgaaca

SEQ ID NO: 69583 - DNA, 20 bp, Artificial Sequence
  chemically synthesized
tatgataaatctatcatatg

SEQ ID NO: 69584 - DNA, 20 bp, Artificial Sequence
  chemically synthesized
acagcttaatggaattataa

SEQ ID NO: 69585 - DNA, 20 bp, Artificial Sequence
  chemically synthesized
gaagacgttaagagaaagtt

SEQ ID NO: 69586 - DNA, 20 bp, Artificial Sequence
  chemically synthesized
gagaaagttcaaggtttggc

SEQ ID NO: 69587 - DNA, 20 bp, Artificial Sequence
  chemically synthesized
attataaataataaaaaata

SEQ ID NO: 69588 - DNA, 20 bp, Artificial Sequence
  chemically synthesized
gtcaccaaatgagctatatc

SEQ ID NO: 69589 - DNA, 20 bp, Artificial Sequence
  chemically synthesized
aaaacattgtcttattctag

SEQ ID NO: 69590 - DNA, 20 bp, Artificial Sequence
  chemically synthesized
cacgagttctctcttttctt

SEQ ID NO: 69591 - DNA, 20 bp, Artificial Sequence
  chemically synthesized
acctcccccatctaaaggag

SEQ ID NO: 69592 - DNA, 20 bp, Artificial Sequence
  chemically synthesized
acacttacatcctttttcac

SEQ ID NO: 69593 - DNA, 20 bp, Artificial Sequence
  chemically synthesized
ctcaccattatgggctagat

SEQ ID NO: 69594 - DNA, 20 bp, Artificial Sequence
  chemically synthesized
caactcactaccccaacata

SEQ ID NO: 69595 - DNA, 20 bp, Artificial Sequence
  chemically synthesized
tcactaccccaacatattgt

SEQ ID NO: 69596 - DNA, 20 bp, Artificial Sequence
  chemically synthesized
agggaaacaatcctcttttt

SEQ ID NO: 69597 - DNA, 20 bp, Artificial Sequence
  chemically synthesized
tgttccctcatccaaaaaca

SEQ ID NO: 69598 - DNA, 20 bp, Artificial Sequence
  chemically synthesized
ccctcatccaaaaacactca

SEQ ID NO: 69599 - DNA, 20 bp, Artificial Sequence
  chemically synthesized
tggccagaattttttataag

SEQ ID NO: 69600 - DNA, 20 bp, Artificial Sequence
  chemically synthesized
ataacacaagagaaagccac

SEQ ID NO: 69601 - DNA, 20 bp, Artificial Sequence
  chemically synthesized
ggaagttctcagggtccacg

SEQ ID NO: 69602 - DNA, 20 bp, Artificial Sequence
  chemically synthesized
ttgaggtcatccgtgagcat

SEQ ID NO: 69603 - DNA, 20 bp, Artificial Sequence
  chemically synthesized
tctgcctttctgcaccttgt

SEQ ID NO: 69604 - DNA, 20 bp, Artificial Sequence
  chemically synthesized
ctccagccttctcaccttaa

SEQ ID NO: 69605 - DNA, 20 bp, Artificial Sequence
  chemically synthesized
tgcactacagtgtcagatct

SEQ ID NO: 69606 - DNA, 20 bp, Artificial Sequence
  chemically synthesized
agccagaagcatgcctgcat

SEQ ID NO: 69607 - DNA, 20 bp, Artificial Sequence
  chemically synthesized
gcctgcattgctgcttcatg

SEQ ID NO: 69608 - DNA, 20 bp, Artificial Sequence
  chemically synthesized
gtgggttgtgactccagggg

SEQ ID NO: 69609 - DNA, 20 bp, Artificial Sequence
  chemically synthesized
caggggtggggtttgggcaa

SEQ ID NO: 69610 - DNA, 20 bp, Artificial Sequence
  chemically synthesized
aagttttgcaagatggacat

SEQ ID NO: 69611 - DNA, 20 bp, Artificial Sequence
  chemically synthesized
tctcaggggaactttgctgt

SEQ ID NO: 69612 - DNA, 20 bp, Artificial Sequence
  chemically synthesized
actacccccaccatccagtg

SEQ ID NO: 69613 - DNA, 20 bp, Artificial Sequence
  chemically synthesized
cgtgttatcctgttattcat

SEQ ID NO: 69614 - DNA, 20 bp, Artificial Sequence
  chemically synthesized
tggaagaagccacagccttt

SEQ ID NO: 69615 - DNA, 20 bp, Artificial Sequence
  chemically synthesized
tacattgaatacacaatttc

SEQ ID NO: 69616 - DNA, 20 bp, Artificial Sequence
  chemically synthesized
tttttttttttgagatggag

SEQ ID NO: 69617 - DNA, 20 bp, Artificial Sequence
  chemically synthesized
ttttgtatttttagtagaga

SEQ ID NO: 69618 - DNA, 20 bp, Artificial Sequence
  chemically synthesized
cacctcagcctcccaaagtg

SEQ ID NO: 69619 - DNA, 20 bp, Artificial Sequence
  chemically synthesized
ctagggaagtaaggggaaaa

SEQ ID NO: 69620 - DNA, 20 bp, Artificial Sequence
  chemically synthesized
gggaaaactgggttttatta

SEQ ID NO: 69621 - DNA, 20 bp, Artificial Sequence
  chemically synthesized
cagtgtacttatctgaacaa

SEQ ID NO: 69622 - DNA, 20 bp, Artificial Sequence
  chemically synthesized
ctctgttcaagcaagaggat

SEQ ID NO: 69623 - DNA, 20 bp, Artificial Sequence
  chemically synthesized
ttaggtcatttgtgtctggc

SEQ ID NO: 69624 - DNA, 20 bp, Artificial Sequence
  chemically synthesized
gcttgatctatagtctaatg

SEQ ID NO: 69625 - DNA, 20 bp, Artificial Sequence
  chemically synthesized
cttccaccggcagagagaag

SEQ ID NO: 69626 - DNA, 20 bp, Artificial Sequence
  chemically synthesized
aacagtttattttatattct

SEQ ID NO: 69627 - DNA, 20 bp, Artificial Sequence
  chemically synthesized
catacttagaggttcaggat

SEQ ID NO: 69628 - DNA, 20 bp, Artificial Sequence
  chemically synthesized
agataaatccttacaagaaa

SEQ ID NO: 69629 - DNA, 20 bp, Artificial Sequence
  chemically synthesized
gatatagttgagaggcagtt

SEQ ID NO: 69630 - DNA, 20 bp, Artificial Sequence
  chemically synthesized
gttttacttaggaacatggg

SEQ ID NO: 69631 - DNA, 20 bp, Artificial Sequence
  chemically synthesized
ggggaaagtttgtagtgaca

SEQ ID NO: 69632 - DNA, 20 bp, Artificial Sequence
  chemically synthesized
acaaacagtttgaggcaaaa

SEQ ID NO: 69633 - DNA, 20 bp, Artificial Sequence
  chemically synthesized
tgcagtcactttcctggaag

SEQ ID NO: 69634 - DNA, 20 bp, Artificial Sequence
  chemically synthesized
tcctggaagtattgattctt

SEQ ID NO: 69635 - DNA, 20 bp, Artificial Sequence
  chemically synthesized
tgtggctgttccccatttcc

SEQ ID NO: 69636 - DNA, 20 bp, Artificial Sequence
  chemically synthesized
tccccatttccaattgtttt

SEQ ID NO: 69637 - DNA, 20 bp, Artificial Sequence
  chemically synthesized
ttccaattgttttccatgat

SEQ ID NO: 69638 - DNA, 20 bp, Artificial Sequence
  chemically synthesized
cattaattcaacaaatacat

SEQ ID NO: 69639 - DNA, 20 bp, Artificial Sequence
  chemically synthesized
tagattccatatgtcatcca

SEQ ID NO: 69640 - DNA, 20 bp, Artificial Sequence
  chemically synthesized
aatcttacatgaactagaca

SEQ ID NO: 69641 - DNA, 20 bp, Artificial Sequence
  chemically synthesized
actaaaagaaatgaattaat

SEQ ID NO: 69642 - DNA, 20 bp, Artificial Sequence
  chemically synthesized
gacaaaagcaagcaatgggg

SEQ ID NO: 69643 - DNA, 20 bp, Artificial Sequence
  chemically synthesized
cttatccaaaattaactcca

SEQ ID NO: 69644 - DNA, 20 bp, Artificial Sequence
  chemically synthesized
attcatgatataaacacggg

SEQ ID NO: 69645 - DNA, 20 bp, Artificial Sequence
  chemically synthesized
agacaatctacagaatggga

SEQ ID NO: 69646 - DNA, 20 bp, Artificial Sequence
  chemically synthesized
gaaggcataaataatccaaa

SEQ ID NO: 69647 - DNA, 20 bp, Artificial Sequence
  chemically synthesized
gctctgcctatgcagtagtc

SEQ ID NO: 69648 - DNA, 20 bp, Artificial Sequence
  chemically synthesized
tttctttactctctcaagaa

SEQ ID NO: 69649 - DNA, 20 bp, Artificial Sequence
  chemically synthesized
tcaaagttagagagaagggc

SEQ ID NO: 69650 - DNA, 20 bp, Artificial Sequence
  chemically synthesized
actgaaacataggggacgag

SEQ ID NO: 69651 - DNA, 20 bp, Artificial Sequence
  chemically synthesized
gtctgtagtccactcaaaac

SEQ ID NO: 69652 - DNA, 20 bp, Artificial Sequence
  chemically synthesized
taacaaaatacaaaagactg

SEQ ID NO: 69653 - DNA, 20 bp, Artificial Sequence
  chemically synthesized
agactgggtggcttcaacaa

SEQ ID NO: 69654 - DNA, 20 bp, Artificial Sequence
  chemically synthesized
ctcgtggtcagggttctctt

SEQ ID NO: 69655 - DNA, 20 bp, Artificial Sequence
  chemically synthesized
cctcaccgggaggaaagaga

SEQ ID NO: 69656 - DNA, 20 bp, Artificial Sequence
  chemically synthesized
gaaagagaaatggcttgtct

SEQ ID NO: 69657 - DNA, 20 bp, Artificial Sequence
  chemically synthesized
agataaggtcagttgggagt

SEQ ID NO: 69658 - DNA, 20 bp, Artificial Sequence
  chemically synthesized
attttgatctcacagtgctg

SEQ ID NO: 69659 - DNA, 20 bp, Artificial Sequence
  chemically synthesized
catgctgacttgtgagcctc

SEQ ID NO: 69660 - DNA, 20 bp, Artificial Sequence
  chemically synthesized
caatctgcacacttgagggc

SEQ ID NO: 69661 - DNA, 20 bp, Artificial Sequence
  chemically synthesized
ctgactaaaccttgaattcc

SEQ ID NO: 69662 - DNA, 20 bp, Artificial Sequence
  chemically synthesized
tttcccatctcttccaaaac

SEQ ID NO: 69663 - DNA, 20 bp, Artificial Sequence
  chemically synthesized
ctatagaggtctttcttccc

SEQ ID NO: 69664 - DNA, 20 bp, Artificial Sequence
  chemically synthesized
ctcccgtgtacaagtgtctt

SEQ ID NO: 69665 - DNA, 20 bp, Artificial Sequence
  chemically synthesized
catgtgtgatctctcagcag

SEQ ID NO: 69666 - DNA, 20 bp, Artificial Sequence
  chemically synthesized
cagaatagatttattatttg

SEQ ID NO: 69667 - DNA, 20 bp, Artificial Sequence
  chemically synthesized
aggggtgaattctttgccga

SEQ ID NO: 69668 - DNA, 20 bp, Artificial Sequence
  chemically synthesized
ggcctccagataactacaca

SEQ ID NO: 69669 - DNA, 20 bp, Artificial Sequence
  chemically synthesized
atgttaacttccctcaaagc

SEQ ID NO: 69670 - DNA, 20 bp, Artificial Sequence
  chemically synthesized
ttcaaaatctactccagccc

SEQ ID NO: 69671 - DNA, 20 bp, Artificial Sequence
  chemically synthesized
cccatctggaattaaaggat

SEQ ID NO: 69672 - DNA, 20 bp, Artificial Sequence
  chemically synthesized
ataggaatagccttagcaat

SEQ ID NO: 69673 - DNA, 20 bp, Artificial Sequence
  chemically synthesized
tacttgtcctgcctccagat

SEQ ID NO: 69674 - DNA, 20 bp, Artificial Sequence
  chemically synthesized
ctcaaagtcaaaattgtcca

SEQ ID NO: 69675 - DNA, 20 bp, Artificial Sequence
  chemically synthesized
tctcagcccagttagtcctc

SEQ ID NO: 69676 - DNA, 20 bp, Artificial Sequence
  chemically synthesized
tgaagttctcaggatccaca

SEQ ID NO: 69677 - DNA, 20 bp, Artificial Sequence
  chemically synthesized
aggtgcccttgagatcatcc

SEQ ID NO: 69678 - DNA, 20 bp, Artificial Sequence
  chemically synthesized
gggtagacaaccaggagcct

SEQ ID NO: 69679 - DNA, 20 bp, Artificial Sequence
  chemically synthesized
gagcctgtgagattgacaag

SEQ ID NO: 69680 - DNA, 20 bp, Artificial Sequence
  chemically synthesized
gtcaccagagcctaccttcc

SEQ ID NO: 69681 - DNA, 20 bp, Artificial Sequence
  chemically synthesized
ttccacattcaccttgcccc

SEQ ID NO: 69682 - DNA, 20 bp, Artificial Sequence
  chemically synthesized
tgacccatggcgtctggact

SEQ ID NO: 69683 - DNA, 20 bp, Artificial Sequence
  chemically synthesized
gagtgtgtggaactgctgaa

SEQ ID NO: 69684 - DNA, 20 bp, Artificial Sequence
  chemically synthesized
ggatactctaagactattgg

SEQ ID NO: 69685 - DNA, 20 bp, Artificial Sequence
  chemically synthesized
aaggctggccaacccatggg

SEQ ID NO: 69686 - DNA, 20 bp, Artificial Sequence
  chemically synthesized
atgggtggagtttagccagg

SEQ ID NO: 69687 - DNA, 20 bp, Artificial Sequence
  chemically synthesized
tttttatagcctttgccttg

SEQ ID NO: 69688 - DNA, 20 bp, Artificial Sequence
  chemically synthesized
ccttgttccgattcagtcat

SEQ ID NO: 69689 - DNA, 20 bp, Artificial Sequence
  chemically synthesized
ctaatttattcttcccttta

SEQ ID NO: 69690 - DNA, 20 bp, Artificial Sequence
  chemically synthesized
ataccaggacttcttttgtc

SEQ ID NO: 69691 - DNA, 20 bp, Artificial Sequence
  chemically synthesized
tctctagctccagtgaggcc

SEQ ID NO: 69692 - DNA, 20 bp, Artificial Sequence
  chemically synthesized
gtaccaatttttgaaaagtt

SEQ ID NO: 69693 - DNA, 20 bp, Artificial Sequence
  chemically synthesized
aaaagttcagggattgtgaa

SEQ ID NO: 69694 - DNA, 20 bp, Artificial Sequence
  chemically synthesized
aatgtgttttaggcataggt

SEQ ID NO: 69695 - DNA, 20 bp, Artificial Sequence
  chemically synthesized
cttagtctctttcagttagc

SEQ ID NO: 69696 - DNA, 20 bp, Artificial Sequence
  chemically synthesized
gaaaacaatttctataaagc

SEQ ID NO: 69697 - DNA, 20 bp, Artificial Sequence
  chemically synthesized
agccacagtttcagcgcagt

SEQ ID NO: 69698 - DNA, 20 bp, Artificial Sequence
  chemically synthesized
gtgttacataatataagacc

SEQ ID NO: 69699 - DNA, 20 bp, Artificial Sequence
  chemically synthesized
acctatttgaaataaatcat

SEQ ID NO: 69700 - DNA, 20 bp, Artificial Sequence
  chemically synthesized
ctgtttcatcttagaaaaat

SEQ ID NO: 69701 - DNA, 20 bp, Artificial Sequence
  chemically synthesized
gtgtgtgctggctgatgacc

SEQ ID NO: 69702 - DNA, 20 bp, Artificial Sequence
  chemically synthesized
gaatgttctttggcaggtac

SEQ ID NO: 69703 - DNA, 20 bp, Artificial Sequence
  chemically synthesized
aacaactctaaagaggcaag

SEQ ID NO: 69704 - DNA, 20 bp, Artificial Sequence
  chemically synthesized
tcgaatattagtgtacttta

SEQ ID NO: 69705 - DNA, 20 bp, Artificial Sequence
  chemically synthesized
cagctttatttctaacacag

SEQ ID NO: 69706 - DNA, 20 bp, Artificial Sequence
  chemically synthesized
acagggtaggaagtatttat

SEQ ID NO: 69707 - DNA, 20 bp, Artificial Sequence
  chemically synthesized
tatttatggtggttttttgg

SEQ ID NO: 69708 - DNA, 20 bp, Artificial Sequence
  chemically synthesized
atggtggttttttggttctg

SEQ ID NO: 69709 - DNA, 20 bp, Artificial Sequence
  chemically synthesized
ttggttctgttttgcttttg

SEQ ID NO: 69710 - DNA, 20 bp, Artificial Sequence
  chemically synthesized
ttctgttttgcttttggtta

SEQ ID NO: 69711 - DNA, 20 bp, Artificial Sequence
  chemically synthesized
tttgcttttggttagtttgt

SEQ ID NO: 69712 - DNA, 20 bp, Artificial Sequence
  chemically synthesized
gatccatgatctctaacctt

SEQ ID NO: 69713 - DNA, 20 bp, Artificial Sequence
  chemically synthesized
aatgccagaagctctggaat

SEQ ID NO: 69714 - DNA, 20 bp, Artificial Sequence
  chemically synthesized
gaggcaagctgtatcttcaa

SEQ ID NO: 69715 - DNA, 20 bp, Artificial Sequence
  chemically synthesized
gtttatcccctaagctatca

SEQ ID NO: 69716 - DNA, 20 bp, Artificial Sequence
  chemically synthesized
tcatccttcatgatcctgtg

SEQ ID NO: 69717 - DNA, 20 bp, Artificial Sequence
  chemically synthesized
ggcagcataaataatctacc

SEQ ID NO: 69718 - DNA, 20 bp, Artificial Sequence
  chemically synthesized
attccttcaattttttataa

SEQ ID NO: 69719 - DNA, 20 bp, Artificial Sequence
  chemically synthesized
tggcatttgaagtgggtcct

SEQ ID NO: 69720 - DNA, 20 bp, Artificial Sequence
  chemically synthesized
atttgatggagccaggcaga

SEQ ID NO: 69721 - DNA, 20 bp, Artificial Sequence
  chemically synthesized
tcaaagttagacagaagggc

SEQ ID NO: 69722 - DNA, 20 bp, Artificial Sequence
  chemically synthesized
tctgaaacacagaggacaag

SEQ ID NO: 69723 - DNA, 20 bp, Artificial Sequence
  chemically synthesized
atttgtaaacctgagataaa

SEQ ID NO: 69724 - DNA, 20 bp, Artificial Sequence
  chemically synthesized
gtttctaatccactgaacac

SEQ ID NO: 69725 - DNA, 20 bp, Artificial Sequence
  chemically synthesized
tagactgggtgacttcaaca

SEQ ID NO: 69726 - DNA, 20 bp, Artificial Sequence
  chemically synthesized
ggaagagaaatggctaatct

SEQ ID NO: 69727 - DNA, 20 bp, Artificial Sequence
  chemically synthesized
gctctcatgagctcctctaa

SEQ ID NO: 69728 - DNA, 20 bp, Artificial Sequence
  chemically synthesized
aaatggagccaattgggagt

SEQ ID NO: 69729 - DNA, 20 bp, Artificial Sequence
  chemically synthesized
accatcacattaaactaaac

SEQ ID NO: 69730 - DNA, 20 bp, Artificial Sequence
  chemically synthesized
tgacacgctgatgctgactt

SEQ ID NO: 69731 - DNA, 20 bp, Artificial Sequence
  chemically synthesized
acctaagtccccacctccct

SEQ ID NO: 69732 - DNA, 20 bp, Artificial Sequence
  chemically synthesized
cagtctgtagacttaagggt

SEQ ID NO: 69733 - DNA, 20 bp, Artificial Sequence
  chemically synthesized
tagttaccgtggaaagaaaa

SEQ ID NO: 69734 - DNA, 20 bp, Artificial Sequence
  chemically synthesized
ctgcctaaaccttgacttcc

SEQ ID NO: 69735 - DNA, 20 bp, Artificial Sequence
  chemically synthesized
ttccccatctcttccaaaac

SEQ ID NO: 69736 - DNA, 20 bp, Artificial Sequence
  chemically synthesized
ctatagaggtctttcttcca

SEQ ID NO: 69737 - DNA, 20 bp, Artificial Sequence
  chemically synthesized
cacttgcagaactcccatgt

SEQ ID NO: 69738 - DNA, 20 bp, Artificial Sequence
  chemically synthesized
catgtgtgatctcttagcag

SEQ ID NO: 69739 - DNA, 20 bp, Artificial Sequence
  chemically synthesized
cttagcagaatagatttatt

SEQ ID NO: 69740 - DNA, 20 bp, Artificial Sequence
  chemically synthesized
gcagaatagatttattattt

SEQ ID NO: 69741 - DNA, 20 bp, Artificial Sequence
  chemically synthesized
aggggtgaattctttgccga

SEQ ID NO: 69742 - DNA, 20 bp, Artificial Sequence
  chemically synthesized
ggcctccagataactacaca

SEQ ID NO: 69743 - DNA, 20 bp, Artificial Sequence
  chemically synthesized
atgttaacttccctcaaagc

SEQ ID NO: 69744 - DNA, 20 bp, Artificial Sequence
  chemically synthesized
acttccctcaaagcctgaga

SEQ ID NO: 69745 - DNA, 20 bp, Artificial Sequence
  chemically synthesized
ttcaaaatctactccagccc

SEQ ID NO: 69746 - DNA, 20 bp, Artificial Sequence
  chemically synthesized
cccatctggaattaaaggat

SEQ ID NO: 69747 - DNA, 20 bp, Artificial Sequence
  chemically synthesized
ataggaatagccttagcaat

SEQ ID NO: 69748 - DNA, 20 bp, Artificial Sequence
  chemically synthesized
tacttgtcctgcctccagat

SEQ ID NO: 69749 - DNA, 20 bp, Artificial Sequence
  chemically synthesized
ctcaaagtcaaagttgtcca

SEQ ID NO: 69750 - DNA, 20 bp, Artificial Sequence
  chemically synthesized
tctcagcccagttagtcctc

SEQ ID NO: 69751 - DNA, 20 bp, Artificial Sequence
  chemically synthesized
tgaagttctcaggatccaca

SEQ ID NO: 69752 - DNA, 20 bp, Artificial Sequence
  chemically synthesized
aggtgcccttgagatcatcc

SEQ ID NO: 69753 - DNA, 20 bp, Artificial Sequence
  chemically synthesized
gggtagacaaccaggagcct

SEQ ID NO: 69754 - DNA, 20 bp, Artificial Sequence
  chemically synthesized
gagcctgtgagattgacaag

SEQ ID NO: 69755 - DNA, 20 bp, Artificial Sequence
  chemically synthesized
gtcaccagagcctaccttcc

SEQ ID NO: 69756 - DNA, 20 bp, Artificial Sequence
  chemically synthesized
ttccacattcaccttgcccc

SEQ ID NO: 69757 - DNA, 20 bp, Artificial Sequence
  chemically synthesized
tgacccatggcgtctggact

SEQ ID NO: 69758 - DNA, 20 bp, Artificial Sequence
  chemically synthesized
gagtgtgtggaactgctgaa

SEQ ID NO: 69759 - DNA, 20 bp, Artificial Sequence
  chemically synthesized
ggatactctaagactattgg

SEQ ID NO: 69760 - DNA, 20 bp, Artificial Sequence
  chemically synthesized
aaggctggccaacccatggg

SEQ ID NO: 69761 - DNA, 20 bp, Artificial Sequence
  chemically synthesized
atgggtggagtttagccagg

SEQ ID NO: 69762 - DNA, 20 bp, Artificial Sequence
  chemically synthesized
aggggcccccaagaggatac

SEQ ID NO: 69763 - DNA, 20 bp, Artificial Sequence
  chemically synthesized
tttttatagcctttgccttg

SEQ ID NO: 69764 - DNA, 20 bp, Artificial Sequence
  chemically synthesized
ctaatttattcttcccttta

SEQ ID NO: 69765 - DNA, 20 bp, Artificial Sequence
  chemically synthesized
ataccaggacttcttttgtc

SEQ ID NO: 69766 - DNA, 20 bp, Artificial Sequence
  chemically synthesized
tctgtagctccagtgaggcc

SEQ ID NO: 69767 - DNA, 20 bp, Artificial Sequence
  chemically synthesized
gtaccaatttttgaaaagtt

SEQ ID NO: 69768 - DNA, 20 bp, Artificial Sequence
  chemically synthesized
aaaagttcagggattgtgaa

SEQ ID NO: 69769 - DNA, 20 bp, Artificial Sequence
  chemically synthesized
aatgtgttttaggcataggt

SEQ ID NO: 69770 - DNA, 20 bp, Artificial Sequence
  chemically synthesized
cttagtctcatttagtaagc

SEQ ID NO: 69771 - DNA, 20 bp, Artificial Sequence
  chemically synthesized
ttatctttgaatatactctc

SEQ ID NO: 69772 - DNA, 20 bp, Artificial Sequence
  chemically synthesized
agtgaaaaatcctataaagc

SEQ ID NO: 69773 - DNA, 20 bp, Artificial Sequence
  chemically synthesized
agcaacagtttcagtgcagg

SEQ ID NO: 69774 - DNA, 20 bp, Artificial Sequence
  chemically synthesized
acctatttgaaataaatcac

SEQ ID NO: 69775 - DNA, 20 bp, Artificial Sequence
  chemically synthesized
gtatgtgctggctgatgacc

SEQ ID NO: 69776 - DNA, 20 bp, Artificial Sequence
  chemically synthesized
gaatgctctttaccagatac

SEQ ID NO: 69777 - DNA, 20 bp, Artificial Sequence
  chemically synthesized
aacaactcttaagaggcagg

SEQ ID NO: 69778 - DNA, 20 bp, Artificial Sequence
  chemically synthesized
tgtgacagctgggatgtcac

SEQ ID NO: 69779 - DNA, 20 bp, Artificial Sequence
  chemically synthesized
catctttatctgtaactcag

SEQ ID NO: 69780 - DNA, 20 bp, Artificial Sequence
  chemically synthesized
aacatggcaggaagtattca

SEQ ID NO: 69781 - DNA, 20 bp, Artificial Sequence
  chemically synthesized
tttttttctttattttttct

SEQ ID NO: 69782 - DNA, 20 bp, Artificial Sequence
  chemically synthesized
tttgggatttttattttttg

SEQ ID NO: 69783 - DNA, 20 bp, Artificial Sequence
  chemically synthesized
gatttttattttttggtagg

SEQ ID NO: 69784 - DNA, 20 bp, Artificial Sequence
  chemically synthesized
ttattttttggtaggtttgg

SEQ ID NO: 69785 - DNA, 20 bp, Artificial Sequence
  chemically synthesized
tttggtaggtttggttttgc

SEQ ID NO: 69786 - DNA, 20 bp, Artificial Sequence
  chemically synthesized
tgaactcgatccatgacctt

SEQ ID NO: 69787 - DNA, 20 bp, Artificial Sequence
  chemically synthesized
gacgtcagaaactctggaaa

SEQ ID NO: 69788 - DNA, 20 bp, Artificial Sequence
  chemically synthesized
tcagacttcataatcctgtg

SEQ ID NO: 69789 - DNA, 20 bp, Artificial Sequence
  chemically synthesized
gttgaataagaaaggaaaga

SEQ ID NO: 69790 - DNA, 20 bp, Artificial Sequence
  chemically synthesized
ctcaatctaaggatgggtga

SEQ ID NO: 69791 - DNA, 20 bp, Artificial Sequence
  chemically synthesized
gatttttattggtatgctgg

SEQ ID NO: 69792 - DNA, 20 bp, Artificial Sequence
  chemically synthesized
ttcctcagcctcccaagtag

SEQ ID NO: 69793 - DNA, 20 bp, Artificial Sequence
  chemically synthesized
atttttgtatttttgtagag

SEQ ID NO: 69794 - DNA, 20 bp, Artificial Sequence
  chemically synthesized
tgccttggcctcccaaaatt

SEQ ID NO: 69795 - DNA, 20 bp, Artificial Sequence
  chemically synthesized
taaggaatatctaggatccc

SEQ ID NO: 69796 - DNA, 20 bp, Artificial Sequence
  chemically synthesized
gtataaacccttatttcctc

SEQ ID NO: 69797 - DNA, 20 bp, Artificial Sequence
  chemically synthesized
cttttgaggcaatatctttt

SEQ ID NO: 69798 - DNA, 20 bp, Artificial Sequence
  chemically synthesized
ggcaatatcttttaagagtt

SEQ ID NO: 69799 - DNA, 20 bp, Artificial Sequence
  chemically synthesized
ttatccataactgtcttatt

SEQ ID NO: 69800 - DNA, 20 bp, Artificial Sequence
  chemically synthesized
ttcctcgatttttcctatat

SEQ ID NO: 69801 - DNA, 20 bp, Artificial Sequence
  chemically synthesized
tcctatatcattgcttctga

SEQ ID NO: 69802 - DNA, 20 bp, Artificial Sequence
  chemically synthesized
gattaaatcctaactgataa

SEQ ID NO: 69803 - DNA, 20 bp, Artificial Sequence
  chemically synthesized
ttctttacacaagcaatttc

SEQ ID NO: 69804 - DNA, 20 bp, Artificial Sequence
  chemically synthesized
cagagaataaaactttcctc

SEQ ID NO: 69805 - DNA, 20 bp, Artificial Sequence
  chemically synthesized
catgggaaggcattgccaaa

SEQ ID NO: 69806 - DNA, 20 bp, Artificial Sequence
  chemically synthesized
aagtggagaatagcaggtgg

SEQ ID NO: 69807 - DNA, 20 bp, Artificial Sequence
  chemically synthesized
ctaagcaacctgtactattg

SEQ ID NO: 69808 - DNA, 20 bp, Artificial Sequence
  chemically synthesized
ggattactattctaagaatg

SEQ ID NO: 69809 - DNA, 20 bp, Artificial Sequence
  chemically synthesized
aagaatgacctgtttatcac

SEQ ID NO: 69810 - DNA, 20 bp, Artificial Sequence
  chemically synthesized
tgacctgtttatcacaactg

SEQ ID NO: 69811 - DNA, 20 bp, Artificial Sequence
  chemically synthesized
tgtgtgtgtattcattatga

SEQ ID NO: 69812 - DNA, 20 bp, Artificial Sequence
  chemically synthesized
cccacccctcaacatcacgt

SEQ ID NO: 69813 - DNA, 20 bp, Artificial Sequence
  chemically synthesized
tccttgatatcaaagggcag

SEQ ID NO: 69814 - DNA, 20 bp, Artificial Sequence
  chemically synthesized
gaaaaagagagagagagaaa

SEQ ID NO: 69815 - DNA, 20 bp, Artificial Sequence
  chemically synthesized
aagagagagagagaaaaaaa

SEQ ID NO: 69816 - DNA, 20 bp, Artificial Sequence
  chemically synthesized
cgcacacaccctctgaaaga

SEQ ID NO: 69817 - DNA, 20 bp, Artificial Sequence
  chemically synthesized
ctgaagatctagaccacagg

SEQ ID NO: 69818 - DNA, 20 bp, Artificial Sequence
  chemically synthesized
agggaagtaggacagcccta

SEQ ID NO: 69819 - DNA, 20 bp, Artificial Sequence
  chemically synthesized
ttgctcactgactgcatgga

SEQ ID NO: 69820 - DNA, 20 bp, Artificial Sequence
  chemically synthesized
gggagctgggcaagtcacgt

SEQ ID NO: 69821 - DNA, 20 bp, Artificial Sequence
  chemically synthesized
gctgggcaagtcacgtgact

SEQ ID NO: 69822 - DNA, 20 bp, Artificial Sequence
  chemically synthesized
caccacctgactgcctctgc

SEQ ID NO: 69823 - DNA, 20 bp, Artificial Sequence
  chemically synthesized
catccaaaccaagaagaaat

SEQ ID NO: 69824 - DNA, 20 bp, Artificial Sequence
  chemically synthesized
gaatccaagcagaagaaatt

SEQ ID NO: 69825 - DNA, 20 bp, Artificial Sequence
  chemically synthesized
agaaattcagagcttgaaga

SEQ ID NO: 69826 - DNA, 20 bp, Artificial Sequence
  chemically synthesized
gaacaaagcctccaagaaat

SEQ ID NO: 69827 - DNA, 20 bp, Artificial Sequence
  chemically synthesized
ctgagaaagaagagaaatct

SEQ ID NO: 69828 - DNA, 20 bp, Artificial Sequence
  chemically synthesized
taacctatgaaagaaaacct

SEQ ID NO: 69829 - DNA, 20 bp, Artificial Sequence
  chemically synthesized
agaaaacctatcagattaac

SEQ ID NO: 69830 - DNA, 20 bp, Artificial Sequence
  chemically synthesized
gaattttatatccagtgaaa

SEQ ID NO: 69831 - DNA, 20 bp, Artificial Sequence
  chemically synthesized
tcacaaatgaagaaaataca

SEQ ID NO: 69832 - DNA, 20 bp, Artificial Sequence
  chemically synthesized
aagacagtctacaaagaaac

SEQ ID NO: 69833 - DNA, 20 bp, Artificial Sequence
  chemically synthesized
aagatggaaatttaaaaatc

SEQ ID NO: 69834 - DNA, 20 bp, Artificial Sequence
  chemically synthesized
aagagaggaagtcaaattgt

SEQ ID NO: 69835 - DNA, 20 bp, Artificial Sequence
  chemically synthesized
attgtctctgtttgcagatg

SEQ ID NO: 69836 - DNA, 20 bp, Artificial Sequence
  chemically synthesized
cccaaaatcttaagctgata

SEQ ID NO: 69837 - DNA, 20 bp, Artificial Sequence
  chemically synthesized
ccatactgcccaaagtaatt

SEQ ID NO: 69838 - DNA, 20 bp, Artificial Sequence
  chemically synthesized
ttatacaaaaattaactcaa

SEQ ID NO: 69839 - DNA, 20 bp, Artificial Sequence
  chemically synthesized
tatgggatctaattaaacta

SEQ ID NO: 69840 - DNA, 20 bp, Artificial Sequence
  chemically synthesized
agtggacaaaggatatgaac

SEQ ID NO: 69841 - DNA, 20 bp, Artificial Sequence
  chemically synthesized
aaccattgtggaagacagtg

SEQ ID NO: 69842 - DNA, 20 bp, Artificial Sequence
  chemically synthesized
caaggatctagaaccagaaa

SEQ ID NO: 69843 - DNA, 20 bp, Artificial Sequence
  chemically synthesized
ctataaagacacgtgcacac

SEQ ID NO: 69844 - DNA, 20 bp, Artificial Sequence
  chemically synthesized
ataaaactgatagaccatta

SEQ ID NO: 69845 - DNA, 20 bp, Artificial Sequence
  chemically synthesized
tactgataccacagaaatac

SEQ ID NO: 69846 - DNA, 20 bp, Artificial Sequence
  chemically synthesized
ttcctggaaagatacagggc

SEQ ID NO: 69847 - DNA, 20 bp, Artificial Sequence
  chemically synthesized
aacaaaaaagtccaggacca

SEQ ID NO: 69848 - DNA, 20 bp, Artificial Sequence
  chemically synthesized
atatcaaaacccatgatcaa

SEQ ID NO: 69849 - DNA, 20 bp, Artificial Sequence
  chemically synthesized
tttcatgcgagggatgcacg

SEQ ID NO: 69850 - DNA, 20 bp, Artificial Sequence
  chemically synthesized
gagaattggaaacaaaaatc

SEQ ID NO: 69851 - DNA, 20 bp, Artificial Sequence
  chemically synthesized
tatgactaaaactcagcaaa

SEQ ID NO: 69852 - DNA, 20 bp, Artificial Sequence
  chemically synthesized
taaagagaaagtcaaactgt

SEQ ID NO: 69853 - DNA, 20 bp, Artificial Sequence
  chemically synthesized
actgtcactgtttgctgatg

SEQ ID NO: 69854 - DNA, 20 bp, Artificial Sequence
  chemically synthesized
gaactgataaaataattcag

SEQ ID NO: 69855 - DNA, 20 bp, Artificial Sequence
  chemically synthesized
aaaattaacgtacaccaatg

SEQ ID NO: 69856 - DNA, 20 bp, Artificial Sequence
  chemically synthesized
tcggaaaaacccttctacac

SEQ ID NO: 69857 - DNA, 20 bp, Artificial Sequence
  chemically synthesized
cttctacacattggcttagg

SEQ ID NO: 69858 - DNA, 20 bp, Artificial Sequence
  chemically synthesized
tctgggactaaattaaacta

SEQ ID NO: 69859 - DNA, 20 bp, Artificial Sequence
  chemically synthesized
caggctctaaaatgaacaca

SEQ ID NO: 69860 - DNA, 20 bp, Artificial Sequence
  chemically synthesized
aaccattatggaaaacagta

SEQ ID NO: 69861 - DNA, 20 bp, Artificial Sequence
  chemically synthesized
atccaatggacacattacac

SEQ ID NO: 69862 - DNA, 20 bp, Artificial Sequence
  chemically synthesized
gaagcactattcacaatagt

SEQ ID NO: 69863 - DNA, 20 bp, Artificial Sequence
  chemically synthesized
taagtgtctatcaacagatg

SEQ ID NO: 69864 - DNA, 20 bp, Artificial Sequence
  chemically synthesized
gatacagaaagtcaaatatc

SEQ ID NO: 69865 - DNA, 20 bp, Artificial Sequence
  chemically synthesized
aaagtgtgagtgtgtatggg

SEQ ID NO: 69866 - DNA, 20 bp, Artificial Sequence
  chemically synthesized
ggtacaaacacagttggata

SEQ ID NO: 69867 - DNA, 20 bp, Artificial Sequence
  chemically synthesized
tggatagaaggattaagcca

SEQ ID NO: 69868 - DNA, 20 bp, Artificial Sequence
  chemically synthesized
tatttcaaaatggctagaaa

SEQ ID NO: 69869 - DNA, 20 bp, Artificial Sequence
  chemically synthesized
tatttagtgccatgaataat

SEQ ID NO: 69870 - DNA, 20 bp, Artificial Sequence
  chemically synthesized
ccatgaataatccctgttta

SEQ ID NO: 69871 - DNA, 20 bp, Artificial Sequence
  chemically synthesized
tgagagtcaccaggtcagtg

SEQ ID NO: 69872 - DNA, 20 bp, Artificial Sequence
  chemically synthesized
cctgttatcttcaccagtct

SEQ ID NO: 69873 - DNA, 20 bp, Artificial Sequence
  chemically synthesized
ccacagactcactgctcctc

SEQ ID NO: 69874 - DNA, 20 bp, Artificial Sequence
  chemically synthesized
gaatccattttgtgcacata

SEQ ID NO: 69875 - DNA, 20 bp, Artificial Sequence
  chemically synthesized
tcctgagtcacttaacatcc

SEQ ID NO: 69876 - DNA, 20 bp, Artificial Sequence
  chemically synthesized
tcacttaacatcctaatgct

SEQ ID NO: 69877 - DNA, 20 bp, Artificial Sequence
  chemically synthesized
tagtattgcaatagcatagt

SEQ ID NO: 69878 - DNA, 20 bp, Artificial Sequence
  chemically synthesized
ctcccttctacttccagaga

SEQ ID NO: 69879 - DNA, 20 bp, Artificial Sequence
  chemically synthesized
tttcatgcaagtcacgaagc

SEQ ID NO: 69880 - DNA, 20 bp, Artificial Sequence
  chemically synthesized
aagtcacgaagccctagctt

SEQ ID NO: 69881 - DNA, 20 bp, Artificial Sequence
  chemically synthesized
tgcacaatgatatcatgtgt

SEQ ID NO: 69882 - DNA, 20 bp, Artificial Sequence
  chemically synthesized
gcctatatcttggatatcta

SEQ ID NO: 69883 - DNA, 20 bp, Artificial Sequence
  chemically synthesized
tatcttggatatctatgaag

SEQ ID NO: 69884 - DNA, 20 bp, Artificial Sequence
  chemically synthesized
tggatatctatgaagttttg

SEQ ID NO: 69885 - DNA, 20 bp, Artificial Sequence
  chemically synthesized
atctatgaagttttgttttg

SEQ ID NO: 69886 - DNA, 20 bp, Artificial Sequence
  chemically synthesized
gaagttttgttttgttttgt

SEQ ID NO: 69887 - DNA, 20 bp, Artificial Sequence
  chemically synthesized
aaaagtgacatgtaccacaa

SEQ ID NO: 69888 - DNA, 20 bp, Artificial Sequence
  chemically synthesized
taaccattttcccaccccga

SEQ ID NO: 69889 - DNA, 20 bp, Artificial Sequence
  chemically synthesized
aaggaagctcttggttcttc

SEQ ID NO: 69890 - DNA, 20 bp, Artificial Sequence
  chemically synthesized
ggagaagataaaattgcaat

SEQ ID NO: 69891 - DNA, 20 bp, Artificial Sequence
  chemically synthesized
aaaatgtactttattaaaca

SEQ ID NO: 69892 - DNA, 20 bp, Artificial Sequence
  chemically synthesized
gggcaatggcgacagcagac

SEQ ID NO: 69893 - DNA, 20 bp, Artificial Sequence
  chemically synthesized
aacacacaggcatgttgagt

SEQ ID NO: 69894 - DNA, 20 bp, Artificial Sequence
  chemically synthesized
aaaacaaacaaacaaacaaa

SEQ ID NO: 69895 - DNA, 20 bp, Artificial Sequence
  chemically synthesized
accctgacctcaaactgttc

SEQ ID NO: 69896 - DNA, 20 bp, Artificial Sequence
  chemically synthesized
tgcccacccaaaaaattcag

SEQ ID NO: 69897 - DNA, 20 bp, Artificial Sequence
  chemically synthesized
tattattgggttccctctct

SEQ ID NO: 69898 - DNA, 20 bp, Artificial Sequence
  chemically synthesized
gtgctgcaagagttctcagc

SEQ ID NO: 69899 - DNA, 20 bp, Artificial Sequence
  chemically synthesized
gataaacacatcaagttctg

SEQ ID NO: 69900 - DNA, 20 bp, Artificial Sequence
  chemically synthesized
tgtcactagttctgaatcat

SEQ ID NO: 69901 - DNA, 20 bp, Artificial Sequence
  chemically synthesized
gttctaacatcaagctcgac

SEQ ID NO: 69902 - DNA, 20 bp, Artificial Sequence
  chemically synthesized
gatctttgttggtctttcca

SEQ ID NO: 69903 - DNA, 20 bp, Artificial Sequence
  chemically synthesized
ttggtctttccaataagatt

SEQ ID NO: 69904 - DNA, 20 bp, Artificial Sequence
  chemically synthesized
tgaagttctcaggatccaca

SEQ ID NO: 69905 - DNA, 20 bp, Artificial Sequence
  chemically synthesized
gcttgtcacagtgcagctca

SEQ ID NO: 69906 - DNA, 20 bp, Artificial Sequence
  chemically synthesized
gctcactcagcttagcaaag

SEQ ID NO: 69907 - DNA, 20 bp, Artificial Sequence
  chemically synthesized
aaaggcgggcttgaggttgt

SEQ ID NO: 69908 - DNA, 20 bp, Artificial Sequence
  chemically synthesized
caggatggcagagggagacg

SEQ ID NO: 69909 - DNA, 20 bp, Artificial Sequence
  chemically synthesized
cattcccatgcattgagaac

SEQ ID NO: 69910 - DNA, 20 bp, Artificial Sequence
  chemically synthesized
agaaccaatgcttacctgcc

SEQ ID NO: 69911 - DNA, 20 bp, Artificial Sequence
  chemically synthesized
tgcaccatgatgccaggcct

SEQ ID NO: 69912 - DNA, 20 bp, Artificial Sequence
  chemically synthesized
tgccaggcctgagagcttgc

SEQ ID NO: 69913 - DNA, 20 bp, Artificial Sequence
  chemically synthesized
tcagcagtgatggatggaca

SEQ ID NO: 69914 - DNA, 20 bp, Artificial Sequence
  chemically synthesized
gcaaatctcaaaataggaaa

SEQ ID NO: 69915 - DNA, 20 bp, Artificial Sequence
  chemically synthesized
tgtaaacaaaacttctgtac

SEQ ID NO: 69916 - DNA, 20 bp, Artificial Sequence
  chemically synthesized
tcccaaagtacagtaccttg

SEQ ID NO: 69917 - DNA, 20 bp, Artificial Sequence
  chemically synthesized
tccctagagaggacagacag

SEQ ID NO: 69918 - DNA, 20 bp, Artificial Sequence
  chemically synthesized
cagacagaaaagattacatc

SEQ ID NO: 69919 - DNA, 20 bp, Artificial Sequence
  chemically synthesized
agtattgcctggggctctct

SEQ ID NO: 69920 - DNA, 20 bp, Artificial Sequence
  chemically synthesized
tcttcttgcttgcctgtctg

SEQ ID NO: 69921 - DNA, 20 bp, Artificial Sequence
  chemically synthesized
ggtagagctgaaactggaag

SEQ ID NO: 69922 - DNA, 20 bp, Artificial Sequence
  chemically synthesized
aactatcaatgtgacagaag

SEQ ID NO: 69923 - DNA, 20 bp, Artificial Sequence
  chemically synthesized
gccccagcccagttcctcct

SEQ ID NO: 69924 - DNA, 20 bp, Artificial Sequence
  chemically synthesized
aaccttcgcctcctgggttc

SEQ ID NO: 69925 - DNA, 20 bp, Artificial Sequence
  chemically synthesized
tttttttatttttagtagag

SEQ ID NO: 69926 - DNA, 20 bp, Artificial Sequence
  chemically synthesized
ttagtagagacgggatttca

SEQ ID NO: 69927 - DNA, 20 bp, Artificial Sequence
  chemically synthesized
tctcccaagtcaagtgcctt

SEQ ID NO: 69928 - DNA, 20 bp, Artificial Sequence
  chemically synthesized
gcctttggggattccatatt

SEQ ID NO: 69929 - DNA, 20 bp, Artificial Sequence
  chemically synthesized
ccatattccaagtttactaa

SEQ ID NO: 69930 - DNA, 20 bp, Artificial Sequence
  chemically synthesized
ttgttatttattatattttc

SEQ ID NO: 69931 - DNA, 20 bp, Artificial Sequence
  chemically synthesized
gtggcaagtaagaatgtctc

SEQ ID NO: 69932 - DNA, 20 bp, Artificial Sequence
  chemically synthesized
atgtctcccttgcttttctc

SEQ ID NO: 69933 - DNA, 20 bp, Artificial Sequence
  chemically synthesized
aaactttttttgtgtcacag

SEQ ID NO: 69934 - DNA, 20 bp, Artificial Sequence
  chemically synthesized
agactgtaagtgctaaaaaa

SEQ ID NO: 69935 - DNA, 20 bp, Artificial Sequence
  chemically synthesized
aaataatatacataggagtg

SEQ ID NO: 69936 - DNA, 20 bp, Artificial Sequence
  chemically synthesized
tgtggtatagtatttattat

SEQ ID NO: 69937 - DNA, 20 bp, Artificial Sequence
  chemically synthesized
tctttatgaaagcattagat

SEQ ID NO: 69938 - DNA, 20 bp, Artificial Sequence
  chemically synthesized
tcaggaggccaaggcaggag

SEQ ID NO: 69939 - DNA, 20 bp, Artificial Sequence
  chemically synthesized
tggtgtagtatgaaaatatc

SEQ ID NO: 69940 - DNA, 20 bp, Artificial Sequence
  chemically synthesized
ataggtactgatgatgtcat

SEQ ID NO: 69941 - DNA, 20 bp, Artificial Sequence
  chemically synthesized
cagttacatgtaagtaaaaa

SEQ ID NO: 69942 - DNA, 20 bp, Artificial Sequence
  chemically synthesized
ccccctagtgttctgtggac

SEQ ID NO: 69943 - DNA, 20 bp, Artificial Sequence
  chemically synthesized
tagcctaggaagacaagatc

SEQ ID NO: 69944 - DNA, 20 bp, Artificial Sequence
  chemically synthesized
gactagacaaaaagcagctc

SEQ ID NO: 69945 - DNA, 20 bp, Artificial Sequence
  chemically synthesized
caaaaagcagctcagctgct

SEQ ID NO: 69946 - DNA, 20 bp, Artificial Sequence
  chemically synthesized
tgcttgtagcttgaaccaag

SEQ ID NO: 69947 - DNA, 20 bp, Artificial Sequence
  chemically synthesized
taaccaattaagatacagct

SEQ ID NO: 69948 - DNA, 20 bp, Artificial Sequence
  chemically synthesized
ggaccaggtatctcaaggcc

SEQ ID NO: 69949 - DNA, 20 bp, Artificial Sequence
  chemically synthesized
caaggccaagagtttggaga

SEQ ID NO: 69950 - DNA, 20 bp, Artificial Sequence
  chemically synthesized
agtatggacaccagtcttct

SEQ ID NO: 69951 - DNA, 20 bp, Artificial Sequence
  chemically synthesized
ttactgcctatggttccaga

SEQ ID NO: 69952 - DNA, 20 bp, Artificial Sequence
  chemically synthesized
atccagggatctgacccatt

SEQ ID NO: 69953 - DNA, 20 bp, Artificial Sequence
  chemically synthesized
tatggctaaaggtggtaggg

SEQ ID NO: 69954 - DNA, 20 bp, Artificial Sequence
  chemically synthesized
aggttatagcattgaaaggc

SEQ ID NO: 69955 - DNA, 20 bp, Artificial Sequence
  chemically synthesized
ccaggtttgtgtctcagtaa

SEQ ID NO: 69956 - DNA, 20 bp, Artificial Sequence
  chemically synthesized
taggctgcgggcagtctcat

SEQ ID NO: 69957 - DNA, 20 bp, Artificial Sequence
  chemically synthesized
gggcagtctcattattgctt

SEQ ID NO: 69958 - DNA, 20 bp, Artificial Sequence
  chemically synthesized
atgcttgttggttcaagata

SEQ ID NO: 69959 - DNA, 20 bp, Artificial Sequence
  chemically synthesized
tgctcatttttaagcatttt

SEQ ID NO: 69960 - DNA, 20 bp, Artificial Sequence
  chemically synthesized
tcatatgagataccatgaaa

SEQ ID NO: 69961 - DNA, 20 bp, Artificial Sequence
  chemically synthesized
agataccatgaaaaatggat

SEQ ID NO: 69962 - DNA, 20 bp, Artificial Sequence
  chemically synthesized
tggccatccaggatagatca

SEQ ID NO: 69963 - DNA, 20 bp, Artificial Sequence
  chemically synthesized
aaagaaacacccaaattcga

SEQ ID NO: 69964 - DNA, 20 bp, Artificial Sequence
  chemically synthesized
ttcgatgaagattaattcct

SEQ ID NO: 69965 - DNA, 20 bp, Artificial Sequence
  chemically synthesized
gaagattaattcctgcctgt

SEQ ID NO: 69966 - DNA, 20 bp, Artificial Sequence
  chemically synthesized
attaattcctgcctgtttgg

SEQ ID NO: 69967 - DNA, 20 bp, Artificial Sequence
  chemically synthesized
tgtaatttcttaagttctat

SEQ ID NO: 69968 - DNA, 20 bp, Artificial Sequence
  chemically synthesized
ctttctggctaatttatgac

SEQ ID NO: 69969 - DNA, 20 bp, Artificial Sequence
  chemically synthesized
tagtatgaaaaattatataa

SEQ ID NO: 69970 - DNA, 20 bp, Artificial Sequence
  chemically synthesized
agtaggcccttcacttcact

SEQ ID NO: 69971 - DNA, 20 bp, Artificial Sequence
  chemically synthesized
taaaataggaaaaatataaa

SEQ ID NO: 69972 - DNA, 20 bp, Artificial Sequence
  chemically synthesized
taaaccactgataggaaaag

SEQ ID NO: 69973 - DNA, 20 bp, Artificial Sequence
  chemically synthesized
actgataggaaaagagctgc

SEQ ID NO: 69974 - DNA, 20 bp, Artificial Sequence
  chemically synthesized
ctgcttaggattctaaatta

SEQ ID NO: 69975 - DNA, 20 bp, Artificial Sequence
  chemically synthesized
attagccagattttaaatta

SEQ ID NO: 69976 - DNA, 20 bp, Artificial Sequence
  chemically synthesized
gaacaaaaatagatgtaagc

SEQ ID NO: 69977 - DNA, 20 bp, Artificial Sequence
  chemically synthesized
agatgtaagcaaatgattct

SEQ ID NO: 69978 - DNA, 20 bp, Artificial Sequence
  chemically synthesized
atgattctactagattttgt

SEQ ID NO: 69979 - DNA, 20 bp, Artificial Sequence
  chemically synthesized
accataacaagtgttcaaac

SEQ ID NO: 69980 - DNA, 20 bp, Artificial Sequence
  chemically synthesized
aagtgttcaaactgttgctt

SEQ ID NO: 69981 - DNA, 20 bp, Artificial Sequence
  chemically synthesized
ggggtacatgtacaggatgt

SEQ ID NO: 69982 - DNA, 20 bp, Artificial Sequence
  chemically synthesized
catagataaatgaatgtcaa

SEQ ID NO: 69983 - DNA, 20 bp, Artificial Sequence
  chemically synthesized
atgatctcatcactcaggta

SEQ ID NO: 69984 - DNA, 20 bp, Artificial Sequence
  chemically synthesized
gtattacgcttagcatccat

SEQ ID NO: 69985 - DNA, 20 bp, Artificial Sequence
  chemically synthesized
ctctgataggccccagtatg

SEQ ID NO: 69986 - DNA, 20 bp, Artificial Sequence
  chemically synthesized
gagtccatgtgttctcatca

SEQ ID NO: 69987 - DNA, 20 bp, Artificial Sequence
  chemically synthesized
ctcatcatttagcttctaac

SEQ ID NO: 69988 - DNA, 20 bp, Artificial Sequence
  chemically synthesized
tacctctgcctcatctctca

SEQ ID NO: 69989 - DNA, 20 bp, Artificial Sequence
  chemically synthesized
atctctcacgaagtttgcag

SEQ ID NO: 69990 - DNA, 20 bp, Artificial Sequence
  chemically synthesized
tatcccattttccgctgaaa

SEQ ID NO: 69991 - DNA, 20 bp, Artificial Sequence
  chemically synthesized
ctgaaatatagctttacttt

SEQ ID NO: 69992 - DNA, 20 bp, Artificial Sequence
  chemically synthesized
aaagatgccttcatttattt

SEQ ID NO: 69993 - DNA, 20 bp, Artificial Sequence
  chemically synthesized
attaaaattctaagaaattc

SEQ ID NO: 69994 - DNA, 20 bp, Artificial Sequence
  chemically synthesized
atactctgaagtagttcaga

SEQ ID NO: 69995 - DNA, 20 bp, Artificial Sequence
  chemically synthesized
aaatgagactattttaagtg

SEQ ID NO: 69996 - DNA, 20 bp, Artificial Sequence
  chemically synthesized
gtctagaaattttgaaaaac

SEQ ID NO: 69997 - DNA, 20 bp, Artificial Sequence
  chemically synthesized
gaaaaacctctgattatatg

SEQ ID NO: 69998 - DNA, 20 bp, Artificial Sequence
  chemically synthesized
tatgcatgctatcttcagta

SEQ ID NO: 69999 - DNA, 20 bp, Artificial Sequence
  chemically synthesized
agtattgaaactataacata

SEQ ID NO: 70000 - DNA, 20 bp, Artificial Sequence
  chemically synthesized
tctctggagaaggttaaaac

SEQ ID NO: 70001 - DNA, 20 bp, Artificial Sequence
  chemically synthesized
actgaggattggcaagtgag

SEQ ID NO: 70002 - DNA, 20 bp, Artificial Sequence
  chemically synthesized
aatatggaaaaccaggcccc

SEQ ID NO: 70003 - DNA, 20 bp, Artificial Sequence
  chemically synthesized
tcactaagggtgaggatgct

SEQ ID NO: 70004 - DNA, 20 bp, Artificial Sequence
  chemically synthesized
ctgaatgatttttccctccc

SEQ ID NO: 70005 - DNA, 20 bp, Artificial Sequence
  chemically synthesized
atcaataattctagccccac

SEQ ID NO: 70006 - DNA, 20 bp, Artificial Sequence
  chemically synthesized
gaaagtaaacttccacaacc

SEQ ID NO: 70007 - DNA, 20 bp, Artificial Sequence
  chemically synthesized
tattgtattttcttcttctt

SEQ ID NO: 70008 - DNA, 20 bp, Artificial Sequence
  chemically synthesized
tcttcttcttgctggtttag

SEQ ID NO: 70009 - DNA, 20 bp, Artificial Sequence
  chemically synthesized
ctggtttagtcatgttttct

SEQ ID NO: 70010 - DNA, 20 bp, Artificial Sequence
  chemically synthesized
gtcatgttttctgggagctt

SEQ ID NO: 70011 - DNA, 20 bp, Artificial Sequence
  chemically synthesized
gagcttaggggcttatttta

SEQ ID NO: 70012 - DNA, 20 bp, Artificial Sequence
  chemically synthesized
taggggcttattttattttg

SEQ ID NO: 70013 - DNA, 20 bp, Artificial Sequence
  chemically synthesized
tgctattgccttctcagtcc

SEQ ID NO: 70014 - DNA, 20 bp, Artificial Sequence
  chemically synthesized
ttgccttctcagtccccacg

SEQ ID NO: 70015 - DNA, 20 bp, Artificial Sequence
  chemically synthesized
acatagaaaaggctataggt

SEQ ID NO: 70016 - DNA, 20 bp, Artificial Sequence
  chemically synthesized
ggttagtgtttgagagtcct

SEQ ID NO: 70017 - DNA, 20 bp, Artificial Sequence
  chemically synthesized
atgcccgataaatatgttat

SEQ ID NO: 70018 - DNA, 20 bp, Artificial Sequence
  chemically synthesized
ttatgtgtgtttatgtatat

SEQ ID NO: 70019 - DNA, 20 bp, Artificial Sequence
  chemically synthesized
tgtgtgtgtgtgtgtgtgtg

SEQ ID NO: 70020 - DNA, 20 bp, Artificial Sequence
  chemically synthesized
tgtgtgttgtgtttacaaat

SEQ ID NO: 70021 - DNA, 20 bp, Artificial Sequence
  chemically synthesized
aatattctcattgaatagaa

SEQ ID NO: 70022 - DNA, 20 bp, Artificial Sequence
  chemically synthesized
aatagaagtatgcttatcat

SEQ ID NO: 70023 - DNA, 20 bp, Artificial Sequence
  chemically synthesized
tctgttgccttatagcctag

SEQ ID NO: 70024 - DNA, 20 bp, Artificial Sequence
  chemically synthesized
catatctgacacctatgaaa

SEQ ID NO: 70025 - DNA, 20 bp, Artificial Sequence
  chemically synthesized
cattaggctacctgccttgg

SEQ ID NO: 70026 - DNA, 20 bp, Artificial Sequence
  chemically synthesized
acctgactgatgaaacaatt

SEQ ID NO: 70027 - DNA, 20 bp, Artificial Sequence
  chemically synthesized
aattccagtgtaaaaaacac

SEQ ID NO: 70028 - DNA, 20 bp, Artificial Sequence
  chemically synthesized
agccttttattttggtcaga

SEQ ID NO: 70029 - DNA, 20 bp, Artificial Sequence
  chemically synthesized
ggagggctaactagctctat

SEQ ID NO: 70030 - DNA, 20 bp, Artificial Sequence
  chemically synthesized
tagcacttccagctctactc

SEQ ID NO: 70031 - DNA, 20 bp, Artificial Sequence
  chemically synthesized
ccttttaattatagttgtat

SEQ ID NO: 70032 - DNA, 20 bp, Artificial Sequence
  chemically synthesized
acagaatagaggaataaagt

SEQ ID NO: 70033 - DNA, 20 bp, Artificial Sequence
  chemically synthesized
ttcatggacttgatagtgga

SEQ ID NO: 70034 - DNA, 20 bp, Artificial Sequence
  chemically synthesized
atgaaacatgttatatacca

SEQ ID NO: 70035 - DNA, 20 bp, Artificial Sequence
  chemically synthesized
aaactgaaatgaaggccaga

SEQ ID NO: 70036 - DNA, 20 bp, Artificial Sequence
  chemically synthesized
aggaacccatttatatgaaa

SEQ ID NO: 70037 - DNA, 20 bp, Artificial Sequence
  chemically synthesized
gtaaataccctaaagatgta

SEQ ID NO: 70038 - DNA, 20 bp, Artificial Sequence
  chemically synthesized
atcaataaggccaatgtagg

SEQ ID NO: 70039 - DNA, 20 bp, Artificial Sequence
  chemically synthesized
acaactattgtagagaattg

SEQ ID NO: 70040 - DNA, 20 bp, Artificial Sequence
  chemically synthesized
attgtagagaattgtaagga

SEQ ID NO: 70041 - DNA, 20 bp, Artificial Sequence
  chemically synthesized
gtggggcagtggtagaagca

SEQ ID NO: 70042 - DNA, 20 bp, Artificial Sequence
  chemically synthesized
catcctttcacgaaaaacca

SEQ ID NO: 70043 - DNA, 20 bp, Artificial Sequence
  chemically synthesized
gctgtgagtatatgtcagag

SEQ ID NO: 70044 - DNA, 20 bp, Artificial Sequence
  chemically synthesized
ctttgggttgaattttgtca

SEQ ID NO: 70045 - DNA, 20 bp, Artificial Sequence
  chemically synthesized
atcacagtctctacctcaga

SEQ ID NO: 70046 - DNA, 20 bp, Artificial Sequence
  chemically synthesized
tggaaatgagaaaccatctc

SEQ ID NO: 70047 - DNA, 20 bp, Artificial Sequence
  chemically synthesized
gtatttcttggatgctgacc

SEQ ID NO: 70048 - DNA, 20 bp, Artificial Sequence
  chemically synthesized
ccctctagctgaaggaagtt

SEQ ID NO: 70049 - DNA, 20 bp, Artificial Sequence
  chemically synthesized
ctgttcggtcagggaatttg

SEQ ID NO: 70050 - DNA, 20 bp, Artificial Sequence
  chemically synthesized
cggtcagggaatttgatggg

SEQ ID NO: 70051 - DNA, 20 bp, Artificial Sequence
  chemically synthesized
cagggaatttgatgggtttt

SEQ ID NO: 70052 - DNA, 20 bp, Artificial Sequence
  chemically synthesized
gaatttgatgggttttgttt

SEQ ID NO: 70053 - DNA, 20 bp, Artificial Sequence
  chemically synthesized
ttgatgggttttgtttgttt

SEQ ID NO: 70054 - DNA, 20 bp, Artificial Sequence
  chemically synthesized
tgggttttgtttgtttgttt

SEQ ID NO: 70055 - DNA, 20 bp, Artificial Sequence
  chemically synthesized
ttttgtttgtttgtttgttt

SEQ ID NO: 70056 - DNA, 20 bp, Artificial Sequence
  chemically synthesized
ttgtttgtttgtttgtttgt

SEQ ID NO: 70057 - DNA, 20 bp, Artificial Sequence
  chemically synthesized
aaactccacctccccggttc

SEQ ID NO: 70058 - DNA, 20 bp, Artificial Sequence
  chemically synthesized
ctgcctcagcctcccaagta

SEQ ID NO: 70059 - DNA, 20 bp, Artificial Sequence
  chemically synthesized
tttatatttttaagcagaga

SEQ ID NO: 70060 - DNA, 20 bp, Artificial Sequence
  chemically synthesized
caccttggcgtcccaaactg

SEQ ID NO: 70061 - DNA, 20 bp, Artificial Sequence
  chemically synthesized
ccaccgcacctcaaggaatt

SEQ ID NO: 70062 - DNA, 20 bp, Artificial Sequence
  chemically synthesized
gaggcgtgcctccatccctg

SEQ ID NO: 70063 - DNA, 20 bp, Artificial Sequence
  chemically synthesized
gaaggatagaattcaattta

SEQ ID NO: 70064 - DNA, 20 bp, Artificial Sequence
  chemically synthesized
atagcccctttgtcaaaaat

SEQ ID NO: 70065 - DNA, 20 bp, Artificial Sequence
  chemically synthesized
tagttatttagccacatatt

SEQ ID NO: 70066 - DNA, 20 bp, Artificial Sequence
  chemically synthesized
catccatggaattttttccc

SEQ ID NO: 70067 - DNA, 20 bp, Artificial Sequence
  chemically synthesized
ctgttttttttctaattaat

SEQ ID NO: 70068 - DNA, 20 bp, Artificial Sequence
  chemically synthesized
atctgtataaatactcttca

SEQ ID NO: 70069 - DNA, 20 bp, Artificial Sequence
  chemically synthesized
ttcaggttgatttcctttct

SEQ ID NO: 70070 - DNA, 20 bp, Artificial Sequence
  chemically synthesized
ttgatttcctttcttaatgt

SEQ ID NO: 70071 - DNA, 20 bp, Artificial Sequence
  chemically synthesized
acatacacttgaaccaaaaa

SEQ ID NO: 70072 - DNA, 20 bp, Artificial Sequence
  chemically synthesized
cactgtgaactcctacagaa

SEQ ID NO: 70073 - DNA, 20 bp, Artificial Sequence
  chemically synthesized
ccttctctatccccttgacc

SEQ ID NO: 70074 - DNA, 20 bp, Artificial Sequence
  chemically synthesized
caagcattatgtctgtctgt

SEQ ID NO: 70075 - DNA, 20 bp, Artificial Sequence
  chemically synthesized
cccttttagctctcctggag

SEQ ID NO: 70076 - DNA, 20 bp, Artificial Sequence
  chemically synthesized
ctgagatgtatccttaagat

SEQ ID NO: 70077 - DNA, 20 bp, Artificial Sequence
  chemically synthesized
gggtgccttaaaatggcaaa

SEQ ID NO: 70078 - DNA, 20 bp, Artificial Sequence
  chemically synthesized
gccttaaaatggcaaacaag

SEQ ID NO: 70079 - DNA, 20 bp, Artificial Sequence
  chemically synthesized
aaacaaggtttgttttcttt

SEQ ID NO: 70080 - DNA, 20 bp, Artificial Sequence
  chemically synthesized
catgccttcctcttccatat

SEQ ID NO: 70081 - DNA, 20 bp, Artificial Sequence
  chemically synthesized
tatacacatgtattaataaa

SEQ ID NO: 70082 - DNA, 20 bp, Artificial Sequence
  chemically synthesized
gtattaataaagcctgattc

SEQ ID NO: 70083 - DNA, 20 bp, Artificial Sequence
  chemically synthesized
aggccacctgcaagataaat

SEQ ID NO: 70084 - DNA, 20 bp, Artificial Sequence
  chemically synthesized
ggcatccattttctttatga

SEQ ID NO: 70085 - DNA, 20 bp, Artificial Sequence
  chemically synthesized
ctttatgatgccgtttgagg

SEQ ID NO: 70086 - DNA, 20 bp, Artificial Sequence
  chemically synthesized
ggtggagttttagtcaggtg

SEQ ID NO: 70087 - DNA, 20 bp, Artificial Sequence
  chemically synthesized
ctcatcatgactcagcattg

SEQ ID NO: 70088 - DNA, 20 bp, Artificial Sequence
  chemically synthesized
gcattgctgtgcttgagcca

SEQ ID NO: 70089 - DNA, 20 bp, Artificial Sequence
  chemically synthesized
tgctgtgcttgagccagaag

SEQ ID NO: 70090 - DNA, 20 bp, Artificial Sequence
  chemically synthesized
aggggcctggccagaactgc

SEQ ID NO: 70091 - DNA, 20 bp, Artificial Sequence
  chemically synthesized
aacaggaactaaggaaaaac

SEQ ID NO: 70092 - DNA, 20 bp, Artificial Sequence
  chemically synthesized
gctggaagggatagagggag

SEQ ID NO: 70093 - DNA, 20 bp, Artificial Sequence
  chemically synthesized
agtatagtaatcattcagca

SEQ ID NO: 70094 - DNA, 20 bp, Artificial Sequence
  chemically synthesized
tggatgctaaacactatttt

SEQ ID NO: 70095 - DNA, 20 bp, Artificial Sequence
  chemically synthesized
tgcctcagccaccctaatag

SEQ ID NO: 70096 - DNA, 20 bp, Artificial Sequence
  chemically synthesized
cacctcagcctcccaaagtg

SEQ ID NO: 70097 - DNA, 20 bp, Artificial Sequence
  chemically synthesized
tacaggtgtgagacaccatg

SEQ ID NO: 70098 - DNA, 20 bp, Artificial Sequence
  chemically synthesized
atttatgggatgggggaaaa

SEQ ID NO: 70099 - DNA, 20 bp, Artificial Sequence
  chemically synthesized
gaaaagaatgtttctctcac

SEQ ID NO: 70100 - DNA, 20 bp, Artificial Sequence
  chemically synthesized
ttttagagagtggagaatgg

SEQ ID NO: 70101 - DNA, 20 bp, Artificial Sequence
  chemically synthesized
ttaggcagccatgttgccat

SEQ ID NO: 70102 - DNA, 20 bp, Artificial Sequence
  chemically synthesized
ttcttagatgatcttgagca

SEQ ID NO: 70103 - DNA, 20 bp, Artificial Sequence
  chemically synthesized
tagctaatagaattatgagg

SEQ ID NO: 70104 - DNA, 20 bp, Artificial Sequence
  chemically synthesized
aatagaattatgaggatgag

SEQ ID NO: 70105 - DNA, 20 bp, Artificial Sequence
  chemically synthesized
ggacacagtatatattcagt

SEQ ID NO: 70106 - DNA, 20 bp, Artificial Sequence
  chemically synthesized
tcttgactgttaatgttggc

SEQ ID NO: 70107 - DNA, 20 bp, Artificial Sequence
  chemically synthesized
ctgttaatgttggcagcaga

SEQ ID NO: 70108 - DNA, 20 bp, Artificial Sequence
  chemically synthesized
cactgggcaatacaagacct

SEQ ID NO: 70109 - DNA, 20 bp, Artificial Sequence
  chemically synthesized
gcaatacaagacctctgagc

SEQ ID NO: 70110 - DNA, 20 bp, Artificial Sequence
  chemically synthesized
gaaagacaatgtgaagcccc

SEQ ID NO: 70111 - DNA, 20 bp, Artificial Sequence
  chemically synthesized
aagtagttagcatatggaga

SEQ ID NO: 70112 - DNA, 20 bp, Artificial Sequence
  chemically synthesized
aaagggagatgcagagaatc

SEQ ID NO: 70113 - DNA, 20 bp, Artificial Sequence
  chemically synthesized
caccacagcactattcctag

SEQ ID NO: 70114 - DNA, 20 bp, Artificial Sequence
  chemically synthesized
cttaaactagacaaacatat

SEQ ID NO: 70115 - DNA, 20 bp, Artificial Sequence
  chemically synthesized
acactccctttaaccaaagt

SEQ ID NO: 70116 - DNA, 20 bp, Artificial Sequence
  chemically synthesized
aatttgggcaggcatgggcc

SEQ ID NO: 70117 - DNA, 20 bp, Artificial Sequence
  chemically synthesized
ggccttcagttttctcaagt

SEQ ID NO: 70118 - DNA, 20 bp, Artificial Sequence
  chemically synthesized
agaaaatctctttattctga

SEQ ID NO: 70119 - DNA, 20 bp, Artificial Sequence
  chemically synthesized
gaggaagtatggtctgcaac

SEQ ID NO: 70120 - DNA, 20 bp, Artificial Sequence
  chemically synthesized
atttctcgcatccacaatat

SEQ ID NO: 70121 - DNA, 20 bp, Artificial Sequence
  chemically synthesized
cgcatccacaatatctgagt

SEQ ID NO: 70122 - DNA, 20 bp, Artificial Sequence
  chemically synthesized
ccttactacttggtggttct

SEQ ID NO: 70123 - DNA, 20 bp, Artificial Sequence
  chemically synthesized
ttggacaaattatttcatgt

SEQ ID NO: 70124 - DNA, 20 bp, Artificial Sequence
  chemically synthesized
taattactaattgtctactt

SEQ ID NO: 70125 - DNA, 20 bp, Artificial Sequence
  chemically synthesized
ctaattgtctacttattagc

SEQ ID NO: 70126 - DNA, 20 bp, Artificial Sequence
  chemically synthesized
aacctccacctcctgggttc

SEQ ID NO: 70127 - DNA, 20 bp, Artificial Sequence
  chemically synthesized
tgcctcagcctcctgagtag

SEQ ID NO: 70128 - DNA, 20 bp, Artificial Sequence
  chemically synthesized
agacgcgtgccaccacacct

SEQ ID NO: 70129 - DNA, 20 bp, Artificial Sequence
  chemically synthesized
tttgtattttttagtagaga

SEQ ID NO: 70130 - DNA, 20 bp, Artificial Sequence
  chemically synthesized
tgccttggcctcccaaagtg

SEQ ID NO: 70131 - DNA, 20 bp, Artificial Sequence
  chemically synthesized
gcctcatatgataaacttaa

SEQ ID NO: 70132 - DNA, 20 bp, Artificial Sequence
  chemically synthesized
tcacagaattaccatatgta

SEQ ID NO: 70133 - DNA, 20 bp, Artificial Sequence
  chemically synthesized
aaaatggcacctgacatata

SEQ ID NO: 70134 - DNA, 20 bp, Artificial Sequence
  chemically synthesized
ctatttcctcgtgtctctca

SEQ ID NO: 70135 - DNA, 20 bp, Artificial Sequence
  chemically synthesized
ggtttctagtcccttcacca

SEQ ID NO: 70136 - DNA, 20 bp, Artificial Sequence
  chemically synthesized
tgtttccctctcaactcctg

SEQ ID NO: 70137 - DNA, 20 bp, Artificial Sequence
  chemically synthesized
aatttctcatgttcagaacc

SEQ ID NO: 70138 - DNA, 20 bp, Artificial Sequence
  chemically synthesized
atgttcagaaccttgggctt

SEQ ID NO: 70139 - DNA, 20 bp, Artificial Sequence
  chemically synthesized
gcttccatgtttccagtgaa

SEQ ID NO: 70140 - DNA, 20 bp, Artificial Sequence
  chemically synthesized
gttagacaatttcatctgtg

SEQ ID NO: 70141 - DNA, 20 bp, Artificial Sequence
  chemically synthesized
atttcatctgtgccctgctt

SEQ ID NO: 70142 - DNA, 20 bp, Artificial Sequence
  chemically synthesized
agcttaatctttaatgaaag

SEQ ID NO: 70143 - DNA, 20 bp, Artificial Sequence
  chemically synthesized
gcaaagtcaccgtgagggtc

SEQ ID NO: 70144 - DNA, 20 bp, Artificial Sequence
  chemically synthesized
ggctgtctcctttatccaca

SEQ ID NO: 70145 - DNA, 20 bp, Artificial Sequence
  chemically synthesized
ctttatccacagaatgattc

SEQ ID NO: 70146 - DNA, 20 bp, Artificial Sequence
  chemically synthesized
tgacatgtccgaccttaggc

SEQ ID NO: 70147 - DNA, 20 bp, Artificial Sequence
  chemically synthesized
tggcaaaataaagataataa

SEQ ID NO: 70148 - DNA, 20 bp, Artificial Sequence
  chemically synthesized
aggatggaaaacaatagcaa

SEQ ID NO: 70149 - DNA, 20 bp, Artificial Sequence
  chemically synthesized
aaaaggtctcaacaaatagt

SEQ ID NO: 70150 - DNA, 20 bp, Artificial Sequence
  chemically synthesized
ctcttattatattcttctta

SEQ ID NO: 70151 - DNA, 20 bp, Artificial Sequence
  chemically synthesized
gggcaggccactaacgaaga

SEQ ID NO: 70152 - DNA, 20 bp, Artificial Sequence
  chemically synthesized
accatttccagatagaagtg

SEQ ID NO: 70153 - DNA, 20 bp, Artificial Sequence
  chemically synthesized
tcttccctactcttatccaa

SEQ ID NO: 70154 - DNA, 20 bp, Artificial Sequence
  chemically synthesized
ctactcttatccaatggggc

SEQ ID NO: 70155 - DNA, 20 bp, Artificial Sequence
  chemically synthesized
taagccagtcttcacaaagc

SEQ ID NO: 70156 - DNA, 20 bp, Artificial Sequence
  chemically synthesized
cctgaatgggcaggaagcat

SEQ ID NO: 70157 - DNA, 20 bp, Artificial Sequence
  chemically synthesized
tcattcagagctctttcata

SEQ ID NO: 70158 - DNA, 20 bp, Artificial Sequence
  chemically synthesized
tctttcataccctgcttccc

SEQ ID NO: 70159 - DNA, 20 bp, Artificial Sequence
  chemically synthesized
tctcaacatttctgttgata

SEQ ID NO: 70160 - DNA, 20 bp, Artificial Sequence
  chemically synthesized
atagactttctcagagctat

SEQ ID NO: 70161 - DNA, 20 bp, Artificial Sequence
  chemically synthesized
ctcagggtagaaatccccta

SEQ ID NO: 70162 - DNA, 20 bp, Artificial Sequence
  chemically synthesized
gatttattcaatgatgggtt

SEQ ID NO: 70163 - DNA, 20 bp, Artificial Sequence
  chemically synthesized
tttctatatggtgaggagct

SEQ ID NO: 70164 - DNA, 20 bp, Artificial Sequence
  chemically synthesized
agctcacagattttccaagc

SEQ ID NO: 70165 - DNA, 20 bp, Artificial Sequence
  chemically synthesized
ccaagcccttgcttttgcta

SEQ ID NO: 70166 - DNA, 20 bp, Artificial Sequence
  chemically synthesized
cttgcttttgctagacagct

SEQ ID NO: 70167 - DNA, 20 bp, Artificial Sequence
  chemically synthesized
atcctgggttacataatata

SEQ ID NO: 70168 - DNA, 20 bp, Artificial Sequence
  chemically synthesized
ctaacagtcaaccagagagc

SEQ ID NO: 70169 - DNA, 20 bp, Artificial Sequence
  chemically synthesized
agtggaatgcaaagagtaaa

SEQ ID NO: 70170 - DNA, 20 bp, Artificial Sequence
  chemically synthesized
aggcctttggaagcagagac

SEQ ID NO: 70171 - DNA, 20 bp, Artificial Sequence
  chemically synthesized
tctcaattctactatttgct

SEQ ID NO: 70172 - DNA, 20 bp, Artificial Sequence
  chemically synthesized
ttctactatttgctagtagt

SEQ ID NO: 70173 - DNA, 20 bp, Artificial Sequence
  chemically synthesized
atgtttgtgtgtgtgagagt

SEQ ID NO: 70174 - DNA, 20 bp, Artificial Sequence
  chemically synthesized
tatgcttgagcaagttgaga

SEQ ID NO: 70175 - DNA, 20 bp, Artificial Sequence
  chemically synthesized
aaagaatccaagagtattaa

SEQ ID NO: 70176 - DNA, 20 bp, Artificial Sequence
  chemically synthesized
atgggcataaagtacagaac

SEQ ID NO: 70177 - DNA, 20 bp, Artificial Sequence
  chemically synthesized
ctagttttcacctgcagcaa

SEQ ID NO: 70178 - DNA, 20 bp, Artificial Sequence
  chemically synthesized
agtagttagcatttataagt

SEQ ID NO: 70179 - DNA, 20 bp, Artificial Sequence
  chemically synthesized
gcctgttaaaactcctgtaa

SEQ ID NO: 70180 - DNA, 20 bp, Artificial Sequence
  chemically synthesized
cactttggaaggctgaggtg

SEQ ID NO: 70181 - DNA, 20 bp, Artificial Sequence
  chemically synthesized
ttggaaggctgaggtgggca

SEQ ID NO: 70182 - DNA, 20 bp, Artificial Sequence
  chemically synthesized
tcaggatgttgaggtgggag

SEQ ID NO: 70183 - DNA, 20 bp, Artificial Sequence
  chemically synthesized
gaagtgcaagttgcagtgag

SEQ ID NO: 70184 - DNA, 20 bp, Artificial Sequence
  chemically synthesized
tcagtatgacatggaaatga

SEQ ID NO: 70185 - DNA, 20 bp, Artificial Sequence
  chemically synthesized
atgacatggaaatgatcagg

SEQ ID NO: 70186 - DNA, 20 bp, Artificial Sequence
  chemically synthesized
atggaacccaaaatattcta

SEQ ID NO: 70187 - DNA, 20 bp, Artificial Sequence
  chemically synthesized
ataaccctcctcccaggtcc

SEQ ID NO: 70188 - DNA, 20 bp, Artificial Sequence
  chemically synthesized
tttcaatcttgttctgttat

SEQ ID NO: 70189 - DNA, 20 bp, Artificial Sequence
  chemically synthesized
tgttctgttattcctgtttc

SEQ ID NO: 70190 - DNA, 20 bp, Artificial Sequence
  chemically synthesized
gcttagtagaaaaagtacat

SEQ ID NO: 70191 - DNA, 20 bp, Artificial Sequence
  chemically synthesized
atcaatgtctatatgggtcg

SEQ ID NO: 70192 - DNA, 20 bp, Artificial Sequence
  chemically synthesized
tatatgggtcgttgtgtttg

SEQ ID NO: 70193 - DNA, 20 bp, Artificial Sequence
  chemically synthesized
aaaagttatcatcttgaggc

SEQ ID NO: 70194 - DNA, 20 bp, Artificial Sequence
  chemically synthesized
atcaaggaagcgcattgcgg

SEQ ID NO: 70195 - DNA, 20 bp, Artificial Sequence
  chemically synthesized
aagcgcattgcggagcagtt

SEQ ID NO: 70196 - DNA, 20 bp, Artificial Sequence
  chemically synthesized
gcattgcggagcagtttttt

SEQ ID NO: 70197 - DNA, 20 bp, Artificial Sequence
  chemically synthesized
tgcggagcagttttttgttt

SEQ ID NO: 70198 - DNA, 20 bp, Artificial Sequence
  chemically synthesized
tttgtttgtttgtttttgta

SEQ ID NO: 70199 - DNA, 20 bp, Artificial Sequence
  chemically synthesized
ttgtattctgtttcgtgagg

SEQ ID NO: 70200 - DNA, 20 bp, Artificial Sequence
  chemically synthesized
tacagacatgagccaccact

SEQ ID NO: 70201 - DNA, 20 bp, Artificial Sequence
  chemically synthesized
gggtgactgtagggttgaga

SEQ ID NO: 70202 - DNA, 20 bp, Artificial Sequence
  chemically synthesized
ttgagagggagattagaatt

SEQ ID NO: 70203 - DNA, 20 bp, Artificial Sequence
  chemically synthesized
attcaatgttttatgaccaa

SEQ ID NO: 70204 - DNA, 20 bp, Artificial Sequence
  chemically synthesized
caaaaaggcttaaatcaggc

SEQ ID NO: 70205 - DNA, 20 bp, Artificial Sequence
  chemically synthesized
gcagttcaaggccctgtagt

SEQ ID NO: 70206 - DNA, 20 bp, Artificial Sequence
  chemically synthesized
agttctcaaagaaatgagac

SEQ ID NO: 70207 - DNA, 20 bp, Artificial Sequence
  chemically synthesized
aatgagacccttgtttacct

SEQ ID NO: 70208 - DNA, 20 bp, Artificial Sequence
  chemically synthesized
tgtttacctttaagattaga

SEQ ID NO: 70209 - DNA, 20 bp, Artificial Sequence
  chemically synthesized
ttaagattagagaaggcttg

SEQ ID NO: 70210 - DNA, 20 bp, Artificial Sequence
  chemically synthesized
tgaccaagttcagctctcct

SEQ ID NO: 70211 - DNA, 20 bp, Artificial Sequence
  chemically synthesized
atctcagatgtagggaaaag

SEQ ID NO: 70212 - DNA, 20 bp, Artificial Sequence
  chemically synthesized
agcatgagttgtgggtcaga

SEQ ID NO: 70213 - DNA, 20 bp, Artificial Sequence
  chemically synthesized
acatcagaatataacctagg

SEQ ID NO: 70214 - DNA, 20 bp, Artificial Sequence
  chemically synthesized
agtgctcagggctgtgtgtg

SEQ ID NO: 70215 - DNA, 20 bp, Artificial Sequence
  chemically synthesized
ctcagggctgtgtgtgtatg

SEQ ID NO: 70216 - DNA, 20 bp, Artificial Sequence
  chemically synthesized
cactaccctgcaagactctt

SEQ ID NO: 70217 - DNA, 20 bp, Artificial Sequence
  chemically synthesized
ccctgcaagactcttagctg

SEQ ID NO: 70218 - DNA, 20 bp, Artificial Sequence
  chemically synthesized
gctgcttagcttaattgtga

SEQ ID NO: 70219 - DNA, 20 bp, Artificial Sequence
  chemically synthesized
atatataaaattagacaagc

SEQ ID NO: 70220 - DNA, 20 bp, Artificial Sequence
  chemically synthesized
aaaattagacaagccatagt

SEQ ID NO: 70221 - DNA, 20 bp, Artificial Sequence
  chemically synthesized
aaggcaatttaattatcttt

SEQ ID NO: 70222 - DNA, 20 bp, Artificial Sequence
  chemically synthesized
actatgaagcaggtatttat

SEQ ID NO: 70223 - DNA, 20 bp, Artificial Sequence
  chemically synthesized
agttttccaagtgagttaag

SEQ ID NO: 70224 - DNA, 20 bp, Artificial Sequence
  chemically synthesized
gtgatgtcttactaactagc

SEQ ID NO: 70225 - DNA, 20 bp, Artificial Sequence
  chemically synthesized
aaagggctccttaacaactt

SEQ ID NO: 70226 - DNA, 20 bp, Artificial Sequence
  chemically synthesized
ttccctctagtggtcataac

SEQ ID NO: 70227 - DNA, 20 bp, Artificial Sequence
  chemically synthesized
aagagaaacattttgactgt

SEQ ID NO: 70228 - DNA, 20 bp, Artificial Sequence
  chemically synthesized
gaaacattttgactgtagtt

SEQ ID NO: 70229 - DNA, 20 bp, Artificial Sequence
  chemically synthesized
aatcagagaaggaggcatcc

SEQ ID NO: 70230 - DNA, 20 bp, Artificial Sequence
  chemically synthesized
tgctatagcagagtgaacca

SEQ ID NO: 70231 - DNA, 20 bp, Artificial Sequence
  chemically synthesized
gatattttccacaaagagta

SEQ ID NO: 70232 - DNA, 20 bp, Artificial Sequence
  chemically synthesized
gaaaggcaagtcatattaac

SEQ ID NO: 70233 - DNA, 20 bp, Artificial Sequence
  chemically synthesized
aaggacatggccatcagtac

SEQ ID NO: 70234 - DNA, 20 bp, Artificial Sequence
  chemically synthesized
aagaggaagaataatttgtc

SEQ ID NO: 70235 - DNA, 20 bp, Artificial Sequence
  chemically synthesized
gagccaacatagagaggaac

SEQ ID NO: 70236 - DNA, 20 bp, Artificial Sequence
  chemically synthesized
caaagaggcatcaaagatag

SEQ ID NO: 70237 - DNA, 20 bp, Artificial Sequence
  chemically synthesized
atgtttgtaaggatgaaata

SEQ ID NO: 70238 - DNA, 20 bp, Artificial Sequence
  chemically synthesized
tgtattcatggggtacaaca

SEQ ID NO: 70239 - DNA, 20 bp, Artificial Sequence
  chemically synthesized
catatgtgtcaggatgcagt

SEQ ID NO: 70240 - DNA, 20 bp, Artificial Sequence
  chemically synthesized
taatagatttagaaaacatt

SEQ ID NO: 70241 - DNA, 20 bp, Artificial Sequence
  chemically synthesized
tcacttttggaggtcaggaa

SEQ ID NO: 70242 - DNA, 20 bp, Artificial Sequence
  chemically synthesized
atagcagaatgtaggccttg

SEQ ID NO: 70243 - DNA, 20 bp, Artificial Sequence
  chemically synthesized
gacttgtgccattaatttta

SEQ ID NO: 70244 - DNA, 20 bp, Artificial Sequence
  chemically synthesized
taagcagtttcatatgaaac

SEQ ID NO: 70245 - DNA, 20 bp, Artificial Sequence
  chemically synthesized
ccaggagtccaggtgccttc

SEQ ID NO: 70246 - DNA, 20 bp, Artificial Sequence
  chemically synthesized
ttggaaattgttgagaagta

SEQ ID NO: 70247 - DNA, 20 bp, Artificial Sequence
  chemically synthesized
tatattgatttagtgactca

SEQ ID NO: 70248 - DNA, 20 bp, Artificial Sequence
  chemically synthesized
gtgtccggaattggtgggtt

SEQ ID NO: 70249 - DNA, 20 bp, Artificial Sequence
  chemically synthesized
gttcttaaaggctgcgtgtg

SEQ ID NO: 70250 - DNA, 20 bp, Artificial Sequence
  chemically synthesized
tgtgtggagtttgttcgttc

SEQ ID NO: 70251 - DNA, 20 bp, Artificial Sequence
  chemically synthesized
ttctgatgtttggatgtgtt

SEQ ID NO: 70252 - DNA, 20 bp, Artificial Sequence
  chemically synthesized
cccggtgggttcgtggtctc

SEQ ID NO: 70253 - DNA, 20 bp, Artificial Sequence
  chemically synthesized
gacccaaacagtgagcagca

SEQ ID NO: 70254 - DNA, 20 bp, Artificial Sequence
  chemically synthesized
tattgcaaagagcgaaagaa

SEQ ID NO: 70255 - DNA, 20 bp, Artificial Sequence
  chemically synthesized
tgccactgctggctcgggca

SEQ ID NO: 70256 - DNA, 20 bp, Artificial Sequence
  chemically synthesized
atctggccccacccacatcc

SEQ ID NO: 70257 - DNA, 20 bp, Artificial Sequence
  chemically synthesized
ctgattggtagagcccagtg

SEQ ID NO: 70258 - DNA, 20 bp, Artificial Sequence
  chemically synthesized
agtggtctgttttgacaggg

SEQ ID NO: 70259 - DNA, 20 bp, Artificial Sequence
  chemically synthesized
caaaggttctccacgtcccc

SEQ ID NO: 70260 - DNA, 20 bp, Artificial Sequence
  chemically synthesized
cagagtagctagatacagag

SEQ ID NO: 70261 - DNA, 20 bp, Artificial Sequence
  chemically synthesized
accctgagctagacacaggg

SEQ ID NO: 70262 - DNA, 20 bp, Artificial Sequence
  chemically synthesized
tagacacagggtgctgattg

SEQ ID NO: 70263 - DNA, 20 bp, Artificial Sequence
  chemically synthesized
cagagtagctagatacagag

SEQ ID NO: 70264 - DNA, 20 bp, Artificial Sequence
  chemically synthesized
accctgagctagacacaggg

SEQ ID NO: 70265 - DNA, 20 bp, Artificial Sequence
  chemically synthesized
tagacacagggtgctgattg

SEQ ID NO: 70266 - DNA, 20 bp, Artificial Sequence
  chemically synthesized
accttgagctagatacagac

SEQ ID NO: 70267 - DNA, 20 bp, Artificial Sequence
  chemically synthesized
accagagtagctagatagag

SEQ ID NO: 70268 - DNA, 20 bp, Artificial Sequence
  chemically synthesized
accctgagctagacacaggg

SEQ ID NO: 70269 - DNA, 20 bp, Artificial Sequence
  chemically synthesized
tagacacagggtgctgattg

SEQ ID NO: 70270 - DNA, 20 bp, Artificial Sequence
  chemically synthesized
ccagcaaactcaggagccta

SEQ ID NO: 70271 - DNA, 20 bp, Artificial Sequence
  chemically synthesized
aattagcattatcccacacc

SEQ ID NO: 70272 - DNA, 20 bp, Artificial Sequence
  chemically synthesized
aatcaaaggcatactgaacc

SEQ ID NO: 70273 - DNA, 20 bp, Artificial Sequence
  chemically synthesized
atactgaaccatatgtttta

SEQ ID NO: 70274 - DNA, 20 bp, Artificial Sequence
  chemically synthesized
gctgtaatacttcatggaat

SEQ ID NO: 70275 - DNA, 20 bp, Artificial Sequence
  chemically synthesized
cttatttcagagcaaataac

SEQ ID NO: 70276 - DNA, 20 bp, Artificial Sequence
  chemically synthesized
caaataacttaggctttaaa

SEQ ID NO: 70277 - DNA, 20 bp, Artificial Sequence
  chemically synthesized
cctcatgaattattattgta

SEQ ID NO: 70278 - DNA, 20 bp, Artificial Sequence
  chemically synthesized
attactttagggccctgtgc

SEQ ID NO: 70279 - DNA, 20 bp, Artificial Sequence
  chemically synthesized
acttttatactatcctagtg

SEQ ID NO: 70280 - DNA, 20 bp, Artificial Sequence
  chemically synthesized
agtgtgtagattgaggatgt

SEQ ID NO: 70281 - DNA, 20 bp, Artificial Sequence
  chemically synthesized
aatagatgagatgacattgt

SEQ ID NO: 70282 - DNA, 20 bp, Artificial Sequence
  chemically synthesized
tatgtaccaattgatggaca

SEQ ID NO: 70283 - DNA, 20 bp, Artificial Sequence
  chemically synthesized
agttagtctggaagtattta

SEQ ID NO: 70284 - DNA, 20 bp, Artificial Sequence
  chemically synthesized
ttagaaggctttggagagga

SEQ ID NO: 70285 - DNA, 20 bp, Artificial Sequence
  chemically synthesized
gtaatgcaacatttgagact

SEQ ID NO: 70286 - DNA, 20 bp, Artificial Sequence
  chemically synthesized
taagtttgtgggaaacttag

SEQ ID NO: 70287 - DNA, 20 bp, Artificial Sequence
  chemically synthesized
tgtgggaaacttagaactgt

SEQ ID NO: 70288 - DNA, 20 bp, Artificial Sequence
  chemically synthesized
taactatttaaaatgctatg

SEQ ID NO: 70289 - DNA, 20 bp, Artificial Sequence
  chemically synthesized
aaaatgctatgaaatgattt

SEQ ID NO: 70290 - DNA, 20 bp, Artificial Sequence
  chemically synthesized
tgattttgcagatttttctg

SEQ ID NO: 70291 - DNA, 20 bp, Artificial Sequence
  chemically synthesized
tctgttcctttgttgtataa

SEQ ID NO: 70292 - DNA, 20 bp, Artificial Sequence
  chemically synthesized
atctctttgtaacttaccac

SEQ ID NO: 70293 - DNA, 20 bp, Artificial Sequence
  chemically synthesized
cttattttctttatgtaaac

SEQ ID NO: 70294 - DNA, 20 bp, Artificial Sequence
  chemically synthesized
tatctcttctcattttctat

SEQ ID NO: 70295 - DNA, 20 bp, Artificial Sequence
  chemically synthesized
ctcattttctatcaaggatt

SEQ ID NO: 70296 - DNA, 20 bp, Artificial Sequence
  chemically synthesized
aatgcattttaacactccaa

SEQ ID NO: 70297 - DNA, 20 bp, Artificial Sequence
  chemically synthesized
ttttaacactccaagataga

SEQ ID NO: 70298 - DNA, 20 bp, Artificial Sequence
  chemically synthesized
cattgctgtctaaatgtatt

SEQ ID NO: 70299 - DNA, 20 bp, Artificial Sequence
  chemically synthesized
catttcaacctacacaaatt

SEQ ID NO: 70300 - DNA, 20 bp, Artificial Sequence
  chemically synthesized
tatccctaattaggctacac

SEQ ID NO: 70301 - DNA, 20 bp, Artificial Sequence
  chemically synthesized
cagctgtttaaattaggaat

SEQ ID NO: 70302 - DNA, 20 bp, Artificial Sequence
  chemically synthesized
ccagataattgtatatctga

SEQ ID NO: 70303 - DNA, 20 bp, Artificial Sequence
  chemically synthesized
cattgccaatgcatgcagaa

SEQ ID NO: 70304 - DNA, 20 bp, Artificial Sequence
  chemically synthesized
gcatgcagaaagaagcttaa

SEQ ID NO: 70305 - DNA, 20 bp, Artificial Sequence
  chemically synthesized
caacagacagaaatgtaaag

SEQ ID NO: 70306 - DNA, 20 bp, Artificial Sequence
  chemically synthesized
tgtctcatttataccacata

SEQ ID NO: 70307 - DNA, 20 bp, Artificial Sequence
  chemically synthesized
tattgtgtttctatggccga

SEQ ID NO: 70308 - DNA, 20 bp, Artificial Sequence
  chemically synthesized
tcagcttaggttctacattg

SEQ ID NO: 70309 - DNA, 20 bp, Artificial Sequence
  chemically synthesized
cactagcaacttgaatacat

SEQ ID NO: 70310 - DNA, 20 bp, Artificial Sequence
  chemically synthesized
atactgaactcatgtgagga

SEQ ID NO: 70311 - DNA, 20 bp, Artificial Sequence
  chemically synthesized
tgaggatccagtttctatat

SEQ ID NO: 70312 - DNA, 20 bp, Artificial Sequence
  chemically synthesized
tatagagtaaaatactaact

SEQ ID NO: 70313 - DNA, 20 bp, Artificial Sequence
  chemically synthesized
actaacttcaggtttagtac

SEQ ID NO: 70314 - DNA, 20 bp, Artificial Sequence
  chemically synthesized
tccatattataatttacatt

SEQ ID NO: 70315 - DNA, 20 bp, Artificial Sequence
  chemically synthesized
ataaagggaacggcgtggga

SEQ ID NO: 70316 - DNA, 20 bp, Artificial Sequence
  chemically synthesized
atataggcatgttaatatac

SEQ ID NO: 70317 - DNA, 20 bp, Artificial Sequence
  chemically synthesized
atctcaggaatggccatgtt

SEQ ID NO: 70318 - DNA, 20 bp, Artificial Sequence
  chemically synthesized
atcattaggaggccagggtg

SEQ ID NO: 70319 - DNA, 20 bp, Artificial Sequence
  chemically synthesized
ttaggaggccagggtgggag

SEQ ID NO: 70320 - DNA, 20 bp, Artificial Sequence
  chemically synthesized
gtactcaaaaagctgaggaa

SEQ ID NO: 70321 - DNA, 20 bp, Artificial Sequence
  chemically synthesized
tcaaaaagctgaggaagaag

SEQ ID NO: 70322 - DNA, 20 bp, Artificial Sequence
  chemically synthesized
ggaagaaggattgcttgagc

SEQ ID NO: 70323 - DNA, 20 bp, Artificial Sequence
  chemically synthesized
ataaataaataaataaataa

SEQ ID NO: 70324 - DNA, 20 bp, Artificial Sequence
  chemically synthesized
aggactgcattaataaattt

SEQ ID NO: 70325 - DNA, 20 bp, Artificial Sequence
  chemically synthesized
tcctcagagcagatctctaa

SEQ ID NO: 70326 - DNA, 20 bp, Artificial Sequence
  chemically synthesized
agagagcttatagacacaac

SEQ ID NO: 70327 - DNA, 20 bp, Artificial Sequence
  chemically synthesized
gagacttgtctggaagctgc

SEQ ID NO: 70328 - DNA, 20 bp, Artificial Sequence
  chemically synthesized
gctgcacttgtttgaaagga

SEQ ID NO: 70329 - DNA, 20 bp, Artificial Sequence
  chemically synthesized
ggatgctgacttaataattg

SEQ ID NO: 70330 - DNA, 20 bp, Artificial Sequence
  chemically synthesized
atacatttacttaagaaaat

SEQ ID NO: 70331 - DNA, 20 bp, Artificial Sequence
  chemically synthesized
ttttaaaatttatccttttt

SEQ ID NO: 70332 - DNA, 20 bp, Artificial Sequence
  chemically synthesized
gatttttgactattgataca

SEQ ID NO: 70333 - DNA, 20 bp, Artificial Sequence
  chemically synthesized
tcttatttataattagatac

SEQ ID NO: 70334 - DNA, 20 bp, Artificial Sequence
  chemically synthesized
ttattttcagcacatcgccc

SEQ ID NO: 70335 - DNA, 20 bp, Artificial Sequence
  chemically synthesized
gcctgaaaattttaataccg

SEQ ID NO: 70336 - DNA, 20 bp, Artificial Sequence
  chemically synthesized
ctttcagtggtcaatagaga

SEQ ID NO: 70337 - DNA, 20 bp, Artificial Sequence
  chemically synthesized
agagatgcagctttcctaaa

SEQ ID NO: 70338 - DNA, 20 bp, Artificial Sequence
  chemically synthesized
caacaaaggcaaccagaaaa

SEQ ID NO: 70339 - DNA, 20 bp, Artificial Sequence
  chemically synthesized
tccttcaggagtagtcattt

SEQ ID NO: 70340 - DNA, 20 bp, Artificial Sequence
  chemically synthesized
tttggagaaatactgcatta

SEQ ID NO: 70341 - DNA, 20 bp, Artificial Sequence
  chemically synthesized
gaaatactgcattatttagc

SEQ ID NO: 70342 - DNA, 20 bp, Artificial Sequence
  chemically synthesized
tccagatgtaaaataaatat

SEQ ID NO: 70343 - DNA, 20 bp, Artificial Sequence
  chemically synthesized
gagaggaatgaatgcaactt

SEQ ID NO: 70344 - DNA, 20 bp, Artificial Sequence
  chemically synthesized
gaatgaatgcaacttttgag

SEQ ID NO: 70345 - DNA, 20 bp, Artificial Sequence
  chemically synthesized
aagacttacaaacactttga

SEQ ID NO: 70346 - DNA, 20 bp, Artificial Sequence
  chemically synthesized
aaaatataacattacctttg

SEQ ID NO: 70347 - DNA, 20 bp, Artificial Sequence
  chemically synthesized
tttcatgaagtgaaaaagtc

SEQ ID NO: 70348 - DNA, 20 bp, Artificial Sequence
  chemically synthesized
gaaagaagaaaaagtattaa

SEQ ID NO: 70349 - DNA, 20 bp, Artificial Sequence
  chemically synthesized
aggaaaacggggctgggata

SEQ ID NO: 70350 - DNA, 20 bp, Artificial Sequence
  chemically synthesized
cttccacgagatgataagaa

SEQ ID NO: 70351 - DNA, 20 bp, Artificial Sequence
  chemically synthesized
agggaaattacatttcatga

SEQ ID NO: 70352 - DNA, 20 bp, Artificial Sequence
  chemically synthesized
ttcctaaagttctagatatt

SEQ ID NO: 70353 - DNA, 20 bp, Artificial Sequence
  chemically synthesized
tatttgctgtttagcctcac

SEQ ID NO: 70354 - DNA, 20 bp, Artificial Sequence
  chemically synthesized
tgctgtttagcctcacacaa

SEQ ID NO: 70355 - DNA, 20 bp, Artificial Sequence
  chemically synthesized
gcaagatccttttcagagta

SEQ ID NO: 70356 - DNA, 20 bp, Artificial Sequence
  chemically synthesized
gatgaactgtatttgaccca

SEQ ID NO: 70357 - DNA, 20 bp, Artificial Sequence
  chemically synthesized
gaaatcatagttactcttct

SEQ ID NO: 70358 - DNA, 20 bp, Artificial Sequence
  chemically synthesized
cttttggattgttatatctc

SEQ ID NO: 70359 - DNA, 20 bp, Artificial Sequence
  chemically synthesized
tataaaaatttctcgctcac

SEQ ID NO: 70360 - DNA, 20 bp, Artificial Sequence
  chemically synthesized
gcccagaaatcctagagatc

SEQ ID NO: 70361 - DNA, 20 bp, Artificial Sequence
  chemically synthesized
ctgcccagaaaataggcgaa

SEQ ID NO: 70362 - DNA, 20 bp, Artificial Sequence
  chemically synthesized
ggcgaataatgcttctttga

SEQ ID NO: 70363 - DNA, 20 bp, Artificial Sequence
  chemically synthesized
tggtcttgatgctataaatg

SEQ ID NO: 70364 - DNA, 20 bp, Artificial Sequence
  chemically synthesized
taatggggaccacatgaggt

SEQ ID NO: 70365 - DNA, 20 bp, Artificial Sequence
  chemically synthesized
atatgggagacacaagtgtt

SEQ ID NO: 70366 - DNA, 20 bp, Artificial Sequence
  chemically synthesized
gagacacaagtgttgagaga

SEQ ID NO: 70367 - DNA, 20 bp, Artificial Sequence
  chemically synthesized
cgcaatgcccatcactgtct

SEQ ID NO: 70368 - DNA, 20 bp, Artificial Sequence
  chemically synthesized
gattagtatataagaaaaga

SEQ ID NO: 70369 - DNA, 20 bp, Artificial Sequence
  chemically synthesized
aagtctgaataattggatat

SEQ ID NO: 70370 - DNA, 20 bp, Artificial Sequence
  chemically synthesized
taaacgtgatatcagcacag

SEQ ID NO: 70371 - DNA, 20 bp, Artificial Sequence
  chemically synthesized
taggccaaaacaagcaagat

SEQ ID NO: 70372 - DNA, 20 bp, Artificial Sequence
  chemically synthesized
acaatggccagtgaatgaat

SEQ ID NO: 70373 - DNA, 20 bp, Artificial Sequence
  chemically synthesized
cactgttgttataccacatg

SEQ ID NO: 70374 - DNA, 20 bp, Artificial Sequence
  chemically synthesized
ggggtgatgacctccaaaga

SEQ ID NO: 70375 - DNA, 20 bp, Artificial Sequence
  chemically synthesized
cctcaaaacttaaatatttt

SEQ ID NO: 70376 - DNA, 20 bp, Artificial Sequence
  chemically synthesized
aactaatgggacagctgtat

SEQ ID NO: 70377 - DNA, 20 bp, Artificial Sequence
  chemically synthesized
ttaggattaaccactgagga

SEQ ID NO: 70378 - DNA, 20 bp, Artificial Sequence
  chemically synthesized
gactgtgaggctgcagggag

SEQ ID NO: 70379 - DNA, 20 bp, Artificial Sequence
  chemically synthesized
aagaaaataactcatctatt

SEQ ID NO: 70380 - DNA, 20 bp, Artificial Sequence
  chemically synthesized
ttccctatgctgcaaaaagt

SEQ ID NO: 70381 - DNA, 20 bp, Artificial Sequence
  chemically synthesized
agcctaatacttgttagagt

SEQ ID NO: 70382 - DNA, 20 bp, Artificial Sequence
  chemically synthesized
ataattacacttttacaaag

SEQ ID NO: 70383 - DNA, 20 bp, Artificial Sequence
  chemically synthesized
tgataccaagaaattttgta

SEQ ID NO: 70384 - DNA, 20 bp, Artificial Sequence
  chemically synthesized
aaagagaactacaagggaaa

SEQ ID NO: 70385 - DNA, 20 bp, Artificial Sequence
  chemically synthesized
actcagtttctcccaaattc

SEQ ID NO: 70386 - DNA, 20 bp, Artificial Sequence
  chemically synthesized
ctatagaaacaataataatt

SEQ ID NO: 70387 - DNA, 20 bp, Artificial Sequence
  chemically synthesized
ccactgaattatgacctgca

SEQ ID NO: 70388 - DNA, 20 bp, Artificial Sequence
  chemically synthesized
ccaatgttgccttataagag

SEQ ID NO: 70389 - DNA, 20 bp, Artificial Sequence
  chemically synthesized
gatggaggaagccggaggag

SEQ ID NO: 70390 - DNA, 20 bp, Artificial Sequence
  chemically synthesized
tgattattcttaaactatag

SEQ ID NO: 70391 - DNA, 20 bp, Artificial Sequence
  chemically synthesized
tcgtgttttcaaaacctgag

SEQ ID NO: 70392 - DNA, 20 bp, Artificial Sequence
  chemically synthesized
gtttgggacatgcggatgca

SEQ ID NO: 70393 - DNA, 20 bp, Artificial Sequence
  chemically synthesized
ccagggagaatagttgccct

SEQ ID NO: 70394 - DNA, 20 bp, Artificial Sequence
  chemically synthesized
cccctttctgagtgcctttg

SEQ ID NO: 70395 - DNA, 20 bp, Artificial Sequence
  chemically synthesized
gcaactatcccagagtcctc

SEQ ID NO: 70396 - DNA, 20 bp, Artificial Sequence
  chemically synthesized
ggtaacatagatccatcatc

SEQ ID NO: 70397 - DNA, 20 bp, Artificial Sequence
  chemically synthesized
ttcaacttgccatgctgaca

SEQ ID NO: 70398 - DNA, 20 bp, Artificial Sequence
  chemically synthesized
cgtgttaaaaaagaacagtc

SEQ ID NO: 70399 - DNA, 20 bp, Artificial Sequence
  chemically synthesized
agacaaaatatctgaaaaat

SEQ ID NO: 70400 - DNA, 20 bp, Artificial Sequence
  chemically synthesized
ctgaggtggatcacgaggtc

SEQ ID NO: 70401 - DNA, 20 bp, Artificial Sequence
  chemically synthesized
tcgggaggctgaggcaggag

SEQ ID NO: 70402 - DNA, 20 bp, Artificial Sequence
  chemically synthesized
gcagaggtcgtcgcagtgag

SEQ ID NO: 70403 - DNA, 20 bp, Artificial Sequence
  chemically synthesized
gtctcaaaaaaaaaaaaaaa

SEQ ID NO: 70404 - DNA, 20 bp, Artificial Sequence
  chemically synthesized
tacaaaaaaacaatgaaaag

SEQ ID NO: 70405 - DNA, 20 bp, Artificial Sequence
  chemically synthesized
aattaatataaacatagagg

SEQ ID NO: 70406 - DNA, 20 bp, Artificial Sequence
  chemically synthesized
aatataaacatagaggtgtt

SEQ ID NO: 70407 - DNA, 20 bp, Artificial Sequence
  chemically synthesized
tgtcataaaggaattcaaac

SEQ ID NO: 70408 - DNA, 20 bp, Artificial Sequence
  chemically synthesized
catcaaatggaaatggttaa

SEQ ID NO: 70409 - DNA, 20 bp, Artificial Sequence
  chemically synthesized
ttgcttcccgtatttgaatc

SEQ ID NO: 70410 - DNA, 20 bp, Artificial Sequence
  chemically synthesized
ttggcttttcttacctgagc

SEQ ID NO: 70411 - DNA, 20 bp, Artificial Sequence
  chemically synthesized
ctgagccacagttttctctt

SEQ ID NO: 70412 - DNA, 20 bp, Artificial Sequence
  chemically synthesized
ctgagcatgacctgaatatt

SEQ ID NO: 70413 - DNA, 20 bp, Artificial Sequence
  chemically synthesized
accaccaaaccttttcgtct

SEQ ID NO: 70414 - DNA, 20 bp, Artificial Sequence
  chemically synthesized
agacatttatttattctttc

SEQ ID NO: 70415 - DNA, 20 bp, Artificial Sequence
  chemically synthesized
gctatctcattcatatatat

SEQ ID NO: 70416 - DNA, 20 bp, Artificial Sequence
  chemically synthesized
accaatatcaacagtccttt

SEQ ID NO: 70417 - DNA, 20 bp, Artificial Sequence
  chemically synthesized
tatcatgtaattattcctaa

SEQ ID NO: 70418 - DNA, 20 bp, Artificial Sequence
  chemically synthesized
attctgaaatctcttttttc

SEQ ID NO: 70419 - DNA, 20 bp, Artificial Sequence
  chemically synthesized
ttttttcattggattatgtg

SEQ ID NO: 70420 - DNA, 20 bp, Artificial Sequence
  chemically synthesized
aaacatgtcaaattcagtct

SEQ ID NO: 70421 - DNA, 20 bp, Artificial Sequence
  chemically synthesized
aagttactctatttactatc

SEQ ID NO: 70422 - DNA, 20 bp, Artificial Sequence
  chemically synthesized
atatcctctcatatattcag

SEQ ID NO: 70423 - DNA, 20 bp, Artificial Sequence
  chemically synthesized
tcaggtaagattttgccaaa

SEQ ID NO: 70424 - DNA, 20 bp, Artificial Sequence
  chemically synthesized
agaattcattttgcagaacc

SEQ ID NO: 70425 - DNA, 20 bp, Artificial Sequence
  chemically synthesized
tagacttgtagctaagaagt

SEQ ID NO: 70426 - DNA, 20 bp, Artificial Sequence
  chemically synthesized
cacagtaaaacaaaacttct

SEQ ID NO: 70427 - DNA, 20 bp, Artificial Sequence
  chemically synthesized
ttttaagtgagtgacatttt

SEQ ID NO: 70428 - DNA, 20 bp, Artificial Sequence
  chemically synthesized
gacattttcagtgcttaaaa

SEQ ID NO: 70429 - DNA, 20 bp, Artificial Sequence
  chemically synthesized
gctattcttgtgatcaagcc

SEQ ID NO: 70430 - DNA, 20 bp, Artificial Sequence
  chemically synthesized
tagacctttacaacctctac

SEQ ID NO: 70431 - DNA, 20 bp, Artificial Sequence
  chemically synthesized
aacctctacatctgtttgta

SEQ ID NO: 70432 - DNA, 20 bp, Artificial Sequence
  chemically synthesized
caatgctatctccttttctt

SEQ ID NO: 70433 - DNA, 20 bp, Artificial Sequence
  chemically synthesized
atccataacaacatcaagaa

SEQ ID NO: 70434 - DNA, 20 bp, Artificial Sequence
  chemically synthesized
catcaagaagaaagattttt

SEQ ID NO: 70435 - DNA, 20 bp, Artificial Sequence
  chemically synthesized
agggagtgcagtggtgagat

SEQ ID NO: 70436 - DNA, 20 bp, Artificial Sequence
  chemically synthesized
gatcatagtttactgcagcc

SEQ ID NO: 70437 - DNA, 20 bp, Artificial Sequence
  chemically synthesized
tttactgcagcctcaagctt

SEQ ID NO: 70438 - DNA, 20 bp, Artificial Sequence
  chemically synthesized
agcctcaagcttttaggctt

SEQ ID NO: 70439 - DNA, 20 bp, Artificial Sequence
  chemically synthesized
ccacatgagaagagacattt

SEQ ID NO: 70440 - DNA, 20 bp, Artificial Sequence
  chemically synthesized
tgcaagtgagtctcaaggta

SEQ ID NO: 70441 - DNA, 20 bp, Artificial Sequence
  chemically synthesized
caatgaaaagactactttga

SEQ ID NO: 70442 - DNA, 20 bp, Artificial Sequence
  chemically synthesized
ggttgaaggtatgcagtaaa

SEQ ID NO: 70443 - DNA, 20 bp, Artificial Sequence
  chemically synthesized
atgcagtaaaacttgttttc

SEQ ID NO: 70444 - DNA, 20 bp, Artificial Sequence
  chemically synthesized
gcactttgggcccctgctga

SEQ ID NO: 70445 - DNA, 20 bp, Artificial Sequence
  chemically synthesized
ccctctcttatacctcgtca

SEQ ID NO: 70446 - DNA, 20 bp, Artificial Sequence
  chemically synthesized
tgatgctggtcatcactgaa

SEQ ID NO: 70447 - DNA, 20 bp, Artificial Sequence
  chemically synthesized
ttattgaaaaaactataact

SEQ ID NO: 70448 - DNA, 20 bp, Artificial Sequence
  chemically synthesized
ctaagcatgagaaaaactaa

SEQ ID NO: 70449 - DNA, 20 bp, Artificial Sequence
  chemically synthesized
caaagaagccatatattttt

SEQ ID NO: 70450 - DNA, 20 bp, Artificial Sequence
  chemically synthesized
agaggagtctttgggggata

SEQ ID NO: 70451 - DNA, 20 bp, Artificial Sequence
  chemically synthesized
ctttgggggataaccagatt

SEQ ID NO: 70452 - DNA, 20 bp, Artificial Sequence
  chemically synthesized
ggataaccagattttaagat

SEQ ID NO: 70453 - DNA, 20 bp, Artificial Sequence
  chemically synthesized
ttgtgtttatactcagtatc

SEQ ID NO: 70454 - DNA, 20 bp, Artificial Sequence
  chemically synthesized
ttgtactcaatagcatataa

SEQ ID NO: 70455 - DNA, 20 bp, Artificial Sequence
  chemically synthesized
cagcatgcattgggtaaata

SEQ ID NO: 70456 - DNA, 20 bp, Artificial Sequence
  chemically synthesized
gggtaaataatcggttttac

SEQ ID NO: 70457 - DNA, 20 bp, Artificial Sequence
  chemically synthesized
ttacaattgattcagtatga

SEQ ID NO: 70458 - DNA, 20 bp, Artificial Sequence
  chemically synthesized
acctatttttttaagcattc

SEQ ID NO: 70459 - DNA, 20 bp, Artificial Sequence
  chemically synthesized
aatggcgtgaacccgggagg

SEQ ID NO: 70460 - DNA, 20 bp, Artificial Sequence
  chemically synthesized
ttactcagtgaagtccagag

SEQ ID NO: 70461 - DNA, 20 bp, Artificial Sequence
  chemically synthesized
gccacatatttttaggtctg

SEQ ID NO: 70462 - DNA, 20 bp, Artificial Sequence
  chemically synthesized
ctgaaaacttcctttctcca

SEQ ID NO: 70463 - DNA, 20 bp, Artificial Sequence
  chemically synthesized
gtcatacgcaaaagaacatt

SEQ ID NO: 70464 - DNA, 20 bp, Artificial Sequence
  chemically synthesized
gcaaattcatagagacaaaa

SEQ ID NO: 70465 - DNA, 20 bp, Artificial Sequence
  chemically synthesized
ttaccagagtgtaggaagaa

SEQ ID NO: 70466 - DNA, 20 bp, Artificial Sequence
  chemically synthesized
aagaacatggattggggagt

SEQ ID NO: 70467 - DNA, 20 bp, Artificial Sequence
  chemically synthesized
gagtaactgattaatcaata

SEQ ID NO: 70468 - DNA, 20 bp, Artificial Sequence
  chemically synthesized
caaaattttagaaatagtgg

SEQ ID NO: 70469 - DNA, 20 bp, Artificial Sequence
  chemically synthesized
aattcattaaatttattgtg

SEQ ID NO: 70470 - DNA, 20 bp, Artificial Sequence
  chemically synthesized
attgtgaaaggtttaaaaac

SEQ ID NO: 70471 - DNA, 20 bp, Artificial Sequence
  chemically synthesized
tatgtctaagataaaatatt

SEQ ID NO: 70472 - DNA, 20 bp, Artificial Sequence
  chemically synthesized
ttatatcttaaagaccattt

SEQ ID NO: 70473 - DNA, 20 bp, Artificial Sequence
  chemically synthesized
acttgagagaaagaatcaag

SEQ ID NO: 70474 - DNA, 20 bp, Artificial Sequence
  chemically synthesized
atatggtcctcctcaaatat

SEQ ID NO: 70475 - DNA, 20 bp, Artificial Sequence
  chemically synthesized
tagttaatccatcttcctat

SEQ ID NO: 70476 - DNA, 20 bp, Artificial Sequence
  chemically synthesized
atcttcctatttatgtttgt

SEQ ID NO: 70477 - DNA, 20 bp, Artificial Sequence
  chemically synthesized
catataattgatatattatc

SEQ ID NO: 70478 - DNA, 20 bp, Artificial Sequence
  chemically synthesized
ccaagaaaaacccggatcta

SEQ ID NO: 70479 - DNA, 20 bp, Artificial Sequence
  chemically synthesized
tttctcctaggatagtgagc

SEQ ID NO: 70480 - DNA, 20 bp, Artificial Sequence
  chemically synthesized
tctgaccttctttgggtgtc

SEQ ID NO: 70481 - DNA, 20 bp, Artificial Sequence
  chemically synthesized
cttctttgggtgtcatctgc

SEQ ID NO: 70482 - DNA, 20 bp, Artificial Sequence
  chemically synthesized
tttgggtgtcatctgcttca

SEQ ID NO: 70483 - DNA, 20 bp, Artificial Sequence
  chemically synthesized
gcaaaaagaaatacatactg

SEQ ID NO: 70484 - DNA, 20 bp, Artificial Sequence
  chemically synthesized
catactgaaatgatttgaat

SEQ ID NO: 70485 - DNA, 20 bp, Artificial Sequence
  chemically synthesized
ttttaattattaagctaata

SEQ ID NO: 70486 - DNA, 20 bp, Artificial Sequence
  chemically synthesized
tgtttttaaaagtctagttc

SEQ ID NO: 70487 - DNA, 20 bp, Artificial Sequence
  chemically synthesized
cagtttgaaatacttccttc

SEQ ID NO: 70488 - DNA, 20 bp, Artificial Sequence
  chemically synthesized
ttcaattgctttcttaaatc

SEQ ID NO: 70489 - DNA, 20 bp, Artificial Sequence
  chemically synthesized
tcccacaactttaaaaatta

SEQ ID NO: 70490 - DNA, 20 bp, Artificial Sequence
  chemically synthesized
aagaacatgtcagaaattga

SEQ ID NO: 70491 - DNA, 20 bp, Artificial Sequence
  chemically synthesized
cctttccaactctttctttc

SEQ ID NO: 70492 - DNA, 20 bp, Artificial Sequence
  chemically synthesized
tttaaaacatcaatgaatta

SEQ ID NO: 70493 - DNA, 20 bp, Artificial Sequence
  chemically synthesized
tgaattatgcagcttctttc

SEQ ID NO: 70494 - DNA, 20 bp, Artificial Sequence
  chemically synthesized
tcttgtctgtattttcacca

SEQ ID NO: 70495 - DNA, 20 bp, Artificial Sequence
  chemically synthesized
ctctccattcagtgtcttct

SEQ ID NO: 70496 - DNA, 20 bp, Artificial Sequence
  chemically synthesized
ttcagtgtcttctttctgct

SEQ ID NO: 70497 - DNA, 20 bp, Artificial Sequence
  chemically synthesized
gctttatgattaatcacagc

SEQ ID NO: 70498 - DNA, 20 bp, Artificial Sequence
  chemically synthesized
atcacagcacttgttttaaa

SEQ ID NO: 70499 - DNA, 20 bp, Artificial Sequence
  chemically synthesized
tatttgaagactttaagaag

SEQ ID NO: 70500 - DNA, 20 bp, Artificial Sequence
  chemically synthesized
tatttgctctcttatatcat

SEQ ID NO: 70501 - DNA, 20 bp, Artificial Sequence
  chemically synthesized
ccttaaaaaattaaccaaag

SEQ ID NO: 70502 - DNA, 20 bp, Artificial Sequence
  chemically synthesized
aaggaatgattaaatattag

SEQ ID NO: 70503 - DNA, 20 bp, Artificial Sequence
  chemically synthesized
cacgaaaataggcacatgag

SEQ ID NO: 70504 - DNA, 20 bp, Artificial Sequence
  chemically synthesized
taaataaacctgaagtcagc

SEQ ID NO: 70505 - DNA, 20 bp, Artificial Sequence
  chemically synthesized
aataataaaataatgtatat

SEQ ID NO: 70506 - DNA, 20 bp, Artificial Sequence
  chemically synthesized
atatgatcaaataaatccta

SEQ ID NO: 70507 - DNA, 20 bp, Artificial Sequence
  chemically synthesized
ctgcaacaaattgagatcac

SEQ ID NO: 70508 - DNA, 20 bp, Artificial Sequence
  chemically synthesized
gaatatacaaaaaggaaaat

SEQ ID NO: 70509 - DNA, 20 bp, Artificial Sequence
  chemically synthesized
tcatctattggacatatcag

SEQ ID NO: 70510 - DNA, 20 bp, Artificial Sequence
  chemically synthesized
aatgggatctaattaaatta

SEQ ID NO: 70511 - DNA, 20 bp, Artificial Sequence
  chemically synthesized
cacttctctaaagaagacat

SEQ ID NO: 70512 - DNA, 20 bp, Artificial Sequence
  chemically synthesized
gttgcagagagaaaggaatg

SEQ ID NO: 70513 - DNA, 20 bp, Artificial Sequence
  chemically synthesized
aatctattataaaaatacag

SEQ ID NO: 70514 - DNA, 20 bp, Artificial Sequence
  chemically synthesized
ctatacagccataaaaagga

SEQ ID NO: 70515 - DNA, 20 bp, Artificial Sequence
  chemically synthesized
gaaaatctaccctgaaatag

SEQ ID NO: 70516 - DNA, 20 bp, Artificial Sequence
  chemically synthesized
taccctgaaatagagtagtt

SEQ ID NO: 70517 - DNA, 20 bp, Artificial Sequence
  chemically synthesized
aattgcacatttttccttct

SEQ ID NO: 70518 - DNA, 20 bp, Artificial Sequence
  chemically synthesized
gttatgaataaccatatttt

SEQ ID NO: 70519 - DNA, 20 bp, Artificial Sequence
  chemically synthesized
gattattagggtatttatct

SEQ ID NO: 70520 - DNA, 20 bp, Artificial Sequence
  chemically synthesized
tatagatatatctccctcga

SEQ ID NO: 70521 - DNA, 20 bp, Artificial Sequence
  chemically synthesized
ttcattgtattattgttcca

SEQ ID NO: 70522 - DNA, 20 bp, Artificial Sequence
  chemically synthesized
gtgcccagaaaataggcgaa

SEQ ID NO: 70523 - DNA, 20 bp, Artificial Sequence
  chemically synthesized
ggcgaacaatgcttctttgg

SEQ ID NO: 70524 - DNA, 20 bp, Artificial Sequence
  chemically synthesized
acaatgcttctttggatctg

SEQ ID NO: 70525 - DNA, 20 bp, Artificial Sequence
  chemically synthesized
taatgtgcaccacatgtggt

SEQ ID NO: 70526 - DNA, 20 bp, Artificial Sequence
  chemically synthesized
atatgggagacacacatgtt

SEQ ID NO: 70527 - DNA, 20 bp, Artificial Sequence
  chemically synthesized
gagacacacatgttgagagc

SEQ ID NO: 70528 - DNA, 20 bp, Artificial Sequence
  chemically synthesized
tttctggaggcaataccttt

SEQ ID NO: 70529 - DNA, 20 bp, Artificial Sequence
  chemically synthesized
caaccagaatagctgggtat

SEQ ID NO: 70530 - DNA, 20 bp, Artificial Sequence
  chemically synthesized
tgaatgtaatatcagcacag

SEQ ID NO: 70531 - DNA, 20 bp, Artificial Sequence
  chemically synthesized
agccacagttctatcttcac

SEQ ID NO: 70532 - DNA, 20 bp, Artificial Sequence
  chemically synthesized
taggccattgacaggagaat

SEQ ID NO: 70533 - DNA, 20 bp, Artificial Sequence
  chemically synthesized
aggccccatggataacctct

SEQ ID NO: 70534 - DNA, 20 bp, Artificial Sequence
  chemically synthesized
tgggttcgtgaagactgtgg

SEQ ID NO: 70535 - DNA, 20 bp, Artificial Sequence
  chemically synthesized
ggtcatgcttgatgaggtag

SEQ ID NO: 70536 - DNA, 20 bp, Artificial Sequence
  chemically synthesized
ttgtgtgttcacaagtggca

SEQ ID NO: 70537 - DNA, 20 bp, Artificial Sequence
  chemically synthesized
tacactgaaatccctgcctt

SEQ ID NO: 70538 - DNA, 20 bp, Artificial Sequence
  chemically synthesized
atgcatcatgcccctctgtg

SEQ ID NO: 70539 - DNA, 20 bp, Artificial Sequence
  chemically synthesized
tctgtggtgtgcttgctgca

SEQ ID NO: 70540 - DNA, 20 bp, Artificial Sequence
  chemically synthesized
ataattgtacatagttaacc

SEQ ID NO: 70541 - DNA, 20 bp, Artificial Sequence
  chemically synthesized
tgtacatagttaacctgctg

SEQ ID NO: 70542 - DNA, 20 bp, Artificial Sequence
  chemically synthesized
gcatatttggatacatttaa

SEQ ID NO: 70543 - DNA, 20 bp, Artificial Sequence
  chemically synthesized
atttaaacttgatttttatt

SEQ ID NO: 70544 - DNA, 20 bp, Artificial Sequence
  chemically synthesized
tcacaatcatgatatagaca

SEQ ID NO: 70545 - DNA, 20 bp, Artificial Sequence
  chemically synthesized
tgttttgttagaaaactttt

SEQ ID NO: 70546 - DNA, 20 bp, Artificial Sequence
  chemically synthesized
tgttagaaaacttttctttg

SEQ ID NO: 70547 - DNA, 20 bp, Artificial Sequence
  chemically synthesized
ttagttttgaaatagaatgt

SEQ ID NO: 70548 - DNA, 20 bp, Artificial Sequence
  chemically synthesized
catttagtctaaaaatattc

SEQ ID NO: 70549 - DNA, 20 bp, Artificial Sequence
  chemically synthesized
atgtgttgagatgaaaaagt

SEQ ID NO: 70550 - DNA, 20 bp, Artificial Sequence
  chemically synthesized
ctattcaagaggccaaatta

SEQ ID NO: 70551 - DNA, 20 bp, Artificial Sequence
  chemically synthesized
gtatgtggaaatcacttccc

SEQ ID NO: 70552 - DNA, 20 bp, Artificial Sequence
  chemically synthesized
ggtcacatgtgtctttgtcc

SEQ ID NO: 70553 - DNA, 20 bp, Artificial Sequence
  chemically synthesized
tatattttgtcttaaaataa

SEQ ID NO: 70554 - DNA, 20 bp, Artificial Sequence
  chemically synthesized
tcataccaggttcaggatag

SEQ ID NO: 70555 - DNA, 20 bp, Artificial Sequence
  chemically synthesized
ggatagacttgtttttattt

SEQ ID NO: 70556 - DNA, 20 bp, Artificial Sequence
  chemically synthesized
tagatacagtgggtacttgt

SEQ ID NO: 70557 - DNA, 20 bp, Artificial Sequence
  chemically synthesized
cagtggtgagcatactatcc

SEQ ID NO: 70558 - DNA, 20 bp, Artificial Sequence
  chemically synthesized
catctctccctgccccttgt

SEQ ID NO: 70559 - DNA, 20 bp, Artificial Sequence
  chemically synthesized
gtttcaagtggctattgttc

SEQ ID NO: 70560 - DNA, 20 bp, Artificial Sequence
  chemically synthesized
tgtttatatccacgtgtact

SEQ ID NO: 70561 - DNA, 20 bp, Artificial Sequence
  chemically synthesized
atatccacgtgtactcaatg

SEQ ID NO: 70562 - DNA, 20 bp, Artificial Sequence
  chemically synthesized
tataaatgagaatatatggt

SEQ ID NO: 70563 - DNA, 20 bp, Artificial Sequence
  chemically synthesized
gcttttgtgttcttgcgtta

SEQ ID NO: 70564 - DNA, 20 bp, Artificial Sequence
  chemically synthesized
gtgttcttgcgttaatttgc

SEQ ID NO: 70565 - DNA, 20 bp, Artificial Sequence
  chemically synthesized
cacccatgttgctgaaaagg

SEQ ID NO: 70566 - DNA, 20 bp, Artificial Sequence
  chemically synthesized
tagtggtggtgtatatgtac

SEQ ID NO: 70567 - DNA, 20 bp, Artificial Sequence
  chemically synthesized
tgtgtctagttggtctaatg

SEQ ID NO: 70568 - DNA, 20 bp, Artificial Sequence
  chemically synthesized
ctatggatatatacccagta

SEQ ID NO: 70569 - DNA, 20 bp, Artificial Sequence
  chemically synthesized
attgctgtgtcaaattgtag

SEQ ID NO: 70570 - DNA, 20 bp, Artificial Sequence
  chemically synthesized
agttctttgaagactctcca

SEQ ID NO: 70571 - DNA, 20 bp, Artificial Sequence
  chemically synthesized
ttctccatagcctcatgaga

SEQ ID NO: 70572 - DNA, 20 bp, Artificial Sequence
  chemically synthesized
agcctcatgagaatctgttt

SEQ ID NO: 70573 - DNA, 20 bp, Artificial Sequence
  chemically synthesized
tggtatgagatagtatctct

SEQ ID NO: 70574 - DNA, 20 bp, Artificial Sequence
  chemically synthesized
tgagatagtatctcttgtgg

SEQ ID NO: 70575 - DNA, 20 bp, Artificial Sequence
  chemically synthesized
tctcttgagaagagtctgtt

SEQ ID NO: 70576 - DNA, 20 bp, Artificial Sequence
  chemically synthesized
ttttgcccatttttaaatgg

SEQ ID NO: 70577 - DNA, 20 bp, Artificial Sequence
  chemically synthesized
gcccatttttaaatggaatt

SEQ ID NO: 70578 - DNA, 20 bp, Artificial Sequence
  chemically synthesized
tttaaatggaattgtttgct

SEQ ID NO: 70579 - DNA, 20 bp, Artificial Sequence
  chemically synthesized
gctgatatgttcgaattcct

SEQ ID NO: 70580 - DNA, 20 bp, Artificial Sequence
  chemically synthesized
tattagaccttttccagatg

SEQ ID NO: 70581 - DNA, 20 bp, Artificial Sequence
  chemically synthesized
ttccagatgcacagtttgtg

SEQ ID NO: 70582 - DNA, 20 bp, Artificial Sequence
  chemically synthesized
gtgaatagtttctcctatcc

SEQ ID NO: 70583 - DNA, 20 bp, Artificial Sequence
  chemically synthesized
tttctcctatcctgtagatt

SEQ ID NO: 70584 - DNA, 20 bp, Artificial Sequence
  chemically synthesized
gattgtcagtttactctgtt

SEQ ID NO: 70585 - DNA, 20 bp, Artificial Sequence
  chemically synthesized
agggtacatgtgcgcaacgt

SEQ ID NO: 70586 - DNA, 20 bp, Artificial Sequence
  chemically synthesized
ataagtgagaacatgtggta

SEQ ID NO: 70587 - DNA, 20 bp, Artificial Sequence
  chemically synthesized
atttggttttttgtccttgt

SEQ ID NO: 70588 - DNA, 20 bp, Artificial Sequence
  chemically synthesized
tgtgatagtttgctgagaat

SEQ ID NO: 70589 - DNA, 20 bp, Artificial Sequence
  chemically synthesized
gtttgctgagaatgatggtt

SEQ ID NO: 70590 - DNA, 20 bp, Artificial Sequence
  chemically synthesized
tattgtgaatagtgaagctc

SEQ ID NO: 70591 - DNA, 20 bp, Artificial Sequence
  chemically synthesized
tgaatttttctttgcattgc

SEQ ID NO: 70592 - DNA, 20 bp, Artificial Sequence
  chemically synthesized
tttgcattgcaattgctttt

SEQ ID NO: 70593 - DNA, 20 bp, Artificial Sequence
  chemically synthesized
aaaatgcactgccagtgcag

SEQ ID NO: 70594 - DNA, 20 bp, Artificial Sequence
  chemically synthesized
taagatttgagatcttacat

SEQ ID NO: 70595 - DNA, 20 bp, Artificial Sequence
  chemically synthesized
taagttttgaattcattttc

SEQ ID NO: 70596 - DNA, 20 bp, Artificial Sequence
  chemically synthesized
taaatggtgtaaggtaaggg

SEQ ID NO: 70597 - DNA, 20 bp, Artificial Sequence
  chemically synthesized
tggctagccacgtattccag

SEQ ID NO: 70598 - DNA, 20 bp, Artificial Sequence
  chemically synthesized
tggataggtagtccttttcc

SEQ ID NO: 70599 - DNA, 20 bp, Artificial Sequence
  chemically synthesized
taggtagtccttttcccgct

SEQ ID NO: 70600 - DNA, 20 bp, Artificial Sequence
  chemically synthesized
agatcagatggttgtaacta

SEQ ID NO: 70601 - DNA, 20 bp, Artificial Sequence
  chemically synthesized
gtaactatgtagctttattt

SEQ ID NO: 70602 - DNA, 20 bp, Artificial Sequence
  chemically synthesized
ctttatttttgagttttcta

SEQ ID NO: 70603 - DNA, 20 bp, Artificial Sequence
  chemically synthesized
ctatttttgtaacaatatca

SEQ ID NO: 70604 - DNA, 20 bp, Artificial Sequence
  chemically synthesized
ggggtactgtggccttataa

SEQ ID NO: 70605 - DNA, 20 bp, Artificial Sequence
  chemically synthesized
tctttctttttttatttttt

SEQ ID NO: 70606 - DNA, 20 bp, Artificial Sequence
  chemically synthesized
tgcctcagccttccgagtag

SEQ ID NO: 70607 - DNA, 20 bp, Artificial Sequence
  chemically synthesized
ttttgtatttttagtagaga

SEQ ID NO: 70608 - DNA, 20 bp, Artificial Sequence
  chemically synthesized
gtgagccaccgtgcctggcc

SEQ ID NO: 70609 - DNA, 20 bp, Artificial Sequence
  chemically synthesized
tagtttcaagtcaggtggtg

SEQ ID NO: 70610 - DNA, 20 bp, Artificial Sequence
  chemically synthesized
ggtgcttccaattttgttct

SEQ ID NO: 70611 - DNA, 20 bp, Artificial Sequence
  chemically synthesized
tccaattttgttctttctgc

SEQ ID NO: 70612 - DNA, 20 bp, Artificial Sequence
  chemically synthesized
attttgttctttctgcttaa

SEQ ID NO: 70613 - DNA, 20 bp, Artificial Sequence
  chemically synthesized
tggttccatatgaattttaa

SEQ ID NO: 70614 - DNA, 20 bp, Artificial Sequence
  chemically synthesized
gaaattgcaatgaatgtcta

SEQ ID NO: 70615 - DNA, 20 bp, Artificial Sequence
  chemically synthesized
agtatggccatttaaattca

SEQ ID NO: 70616 - DNA, 20 bp, Artificial Sequence
  chemically synthesized
tcttccaatccatgagcctg

SEQ ID NO: 70617 - DNA, 20 bp, Artificial Sequence
  chemically synthesized
agcttttatttatttatttg

SEQ ID NO: 70618 - DNA, 20 bp, Artificial Sequence
  chemically synthesized
tatttatttatttgtgttgt

SEQ ID NO: 70619 - DNA, 20 bp, Artificial Sequence
  chemically synthesized
ttgtttctgatttctttcag

SEQ ID NO: 70620 - DNA, 20 bp, Artificial Sequence
  chemically synthesized
cctcgaaaactgcaacaaga

SEQ ID NO: 70621 - DNA, 20 bp, Artificial Sequence
  chemically synthesized
actctatacttagaaaatcc

SEQ ID NO: 70622 - DNA, 20 bp, Artificial Sequence
  chemically synthesized
gaactgataaacaattttag

SEQ ID NO: 70623 - DNA, 20 bp, Artificial Sequence
  chemically synthesized
aacgaaacaagtaaacaaat

SEQ ID NO: 70624 - DNA, 20 bp, Artificial Sequence
  chemically synthesized
aaatgtacattggtaatggg

SEQ ID NO: 70625 - DNA, 20 bp, Artificial Sequence
  chemically synthesized
ttgaacaacaatacatgaaa

SEQ ID NO: 70626 - DNA, 20 bp, Artificial Sequence
  chemically synthesized
agtacttataatcaagtagt

SEQ ID NO: 70627 - DNA, 20 bp, Artificial Sequence
  chemically synthesized
cacgtgtcaaattgtgttgg

SEQ ID NO: 70628 - DNA, 20 bp, Artificial Sequence
  chemically synthesized
gttgttatcagtagcattag

SEQ ID NO: 70629 - DNA, 20 bp, Artificial Sequence
  chemically synthesized
ttagaaaggcttgaatagaa

SEQ ID NO: 70630 - DNA, 20 bp, Artificial Sequence
  chemically synthesized
ctatgacttagaatagaact

SEQ ID NO: 70631 - DNA, 20 bp, Artificial Sequence
  chemically synthesized
agaactgagtgattgaaggt

SEQ ID NO: 70632 - DNA, 20 bp, Artificial Sequence
  chemically synthesized
aagtaatgccacctgaattt

SEQ ID NO: 70633 - DNA, 20 bp, Artificial Sequence
  chemically synthesized
ttcactaatcaacagttatt

SEQ ID NO: 70634 - DNA, 20 bp, Artificial Sequence
  chemically synthesized
attggtcattgtacattaat

SEQ ID NO: 70635 - DNA, 20 bp, Artificial Sequence
  chemically synthesized
ttgtagaaaagatgaagaga

SEQ ID NO: 70636 - DNA, 20 bp, Artificial Sequence
  chemically synthesized
gaagagaatcagtttcaatg

SEQ ID NO: 70637 - DNA, 20 bp, Artificial Sequence
  chemically synthesized
ctcatatcattttcttttct

SEQ ID NO: 70638 - DNA, 20 bp, Artificial Sequence
  chemically synthesized
aaggctgaataaggatatta

SEQ ID NO: 70639 - DNA, 20 bp, Artificial Sequence
  chemically synthesized
aatatgacagaagagtgata

SEQ ID NO: 70640 - DNA, 20 bp, Artificial Sequence
  chemically synthesized
gacagaagagtgatagctgg

SEQ ID NO: 70641 - DNA, 20 bp, Artificial Sequence
  chemically synthesized
ctggtttggtttaatgaagt

SEQ ID NO: 70642 - DNA, 20 bp, Artificial Sequence
  chemically synthesized
atatttcagagcactaataa

SEQ ID NO: 70643 - DNA, 20 bp, Artificial Sequence
  chemically synthesized
tctcaatgaaataaaatgct

SEQ ID NO: 70644 - DNA, 20 bp, Artificial Sequence
  chemically synthesized
acagagaattcaacgtctaa

SEQ ID NO: 70645 - DNA, 20 bp, Artificial Sequence
  chemically synthesized
taaacatatttcccaataat

SEQ ID NO: 70646 - DNA, 20 bp, Artificial Sequence
  chemically synthesized
ttctttcatcttggaaacaa

SEQ ID NO: 70647 - DNA, 20 bp, Artificial Sequence
  chemically synthesized
tgccagtgatgctgctccat

SEQ ID NO: 70648 - DNA, 20 bp, Artificial Sequence
  chemically synthesized
catgtggcaggtaattaaac

SEQ ID NO: 70649 - DNA, 20 bp, Artificial Sequence
  chemically synthesized
ggatataatatcgcagtaac

SEQ ID NO: 70650 - DNA, 20 bp, Artificial Sequence
  chemically synthesized
cacagcaacttgtgatgtcc

SEQ ID NO: 70651 - DNA, 20 bp, Artificial Sequence
  chemically synthesized
tacaaagatgggaaacaaag

SEQ ID NO: 70652 - DNA, 20 bp, Artificial Sequence
  chemically synthesized
caagatgggaattatccgaa

SEQ ID NO: 70653 - DNA, 20 bp, Artificial Sequence
  chemically synthesized
ctttggtagataactgactt

SEQ ID NO: 70654 - DNA, 20 bp, Artificial Sequence
  chemically synthesized
agataactgacttttaggat

SEQ ID NO: 70655 - DNA, 20 bp, Artificial Sequence
  chemically synthesized
cttgaacattatactctgag

SEQ ID NO: 70656 - DNA, 20 bp, Artificial Sequence
  chemically synthesized
ttgaaatttgtggatgaaaa

SEQ ID NO: 70657 - DNA, 20 bp, Artificial Sequence
  chemically synthesized
cacaattaaatcagtctaaa

SEQ ID NO: 70658 - DNA, 20 bp, Artificial Sequence
  chemically synthesized
ttgttggtcttcctaatata

SEQ ID NO: 70659 - DNA, 20 bp, Artificial Sequence
  chemically synthesized
tacttttttacgagctgaca

SEQ ID NO: 70660 - DNA, 20 bp, Artificial Sequence
  chemically synthesized
cgagctgacaagaagcttgt

SEQ ID NO: 70661 - DNA, 20 bp, Artificial Sequence
  chemically synthesized
gcttgtctaggtttttcctt

SEQ ID NO: 70662 - DNA, 20 bp, Artificial Sequence
  chemically synthesized
tttaaaagtaaatttaaaat

SEQ ID NO: 70663 - DNA, 20 bp, Artificial Sequence
  chemically synthesized
acaaatgtgcacactgaggc

SEQ ID NO: 70664 - DNA, 20 bp, Artificial Sequence
  chemically synthesized
actgaggcaaaagtttttca

SEQ ID NO: 70665 - DNA, 20 bp, Artificial Sequence
  chemically synthesized
ctctttgctaagaaagaact

SEQ ID NO: 70666 - DNA, 20 bp, Artificial Sequence
  chemically synthesized
tccaggctttcatttttcat

SEQ ID NO: 70667 - DNA, 20 bp, Artificial Sequence
  chemically synthesized
ggcttcatttttatgtctgt

SEQ ID NO: 70668 - DNA, 20 bp, Artificial Sequence
  chemically synthesized
ctgtgtctgattctccagat

SEQ ID NO: 70669 - DNA, 20 bp, Artificial Sequence
  chemically synthesized
tccgagtttaactactaaac

SEQ ID NO: 70670 - DNA, 20 bp, Artificial Sequence
  chemically synthesized
ggcggataatgccatattgt

SEQ ID NO: 70671 - DNA, 20 bp, Artificial Sequence
  chemically synthesized
ataatgccatattgtatttg

SEQ ID NO: 70672 - DNA, 20 bp, Artificial Sequence
  chemically synthesized
atgtgggagatacaggtatt

SEQ ID NO: 70673 - DNA, 20 bp, Artificial Sequence
  chemically synthesized
gaggatgatcagacagtcta

SEQ ID NO: 70674 - DNA, 20 bp, Artificial Sequence
  chemically synthesized
tatgtcagcacaagccagtc

SEQ ID NO: 70675 - DNA, 20 bp, Artificial Sequence
  chemically synthesized
cagaaagcacgtgtgataac

SEQ ID NO: 70676 - DNA, 20 bp, Artificial Sequence
  chemically synthesized
tgagaatggaagcatatctc

SEQ ID NO: 70677 - DNA, 20 bp, Artificial Sequence
  chemically synthesized
tatgccattgccaggaggga

SEQ ID NO: 70678 - DNA, 20 bp, Artificial Sequence
  chemically synthesized
agcccacactgctaatctcc

SEQ ID NO: 70679 - DNA, 20 bp, Artificial Sequence
  chemically synthesized
tgggctcatgaagactgtgg

SEQ ID NO: 70680 - DNA, 20 bp, Artificial Sequence
  chemically synthesized
tagtgtatccaccggtaaag

SEQ ID NO: 70681 - DNA, 20 bp, Artificial Sequence
  chemically synthesized
aaaccaggagcctccaatct

SEQ ID NO: 70682 - DNA, 20 bp, Artificial Sequence
  chemically synthesized
cctccaatcttcctgcttgg

SEQ ID NO: 70683 - DNA, 20 bp, Artificial Sequence
  chemically synthesized
gaagaatagcatgtacagac

SEQ ID NO: 70684 - DNA, 20 bp, Artificial Sequence
  chemically synthesized
gaaaaaatactgagttaatg

SEQ ID NO: 70685 - DNA, 20 bp, Artificial Sequence
  chemically synthesized
tatacataaatggataataa

SEQ ID NO: 70686 - DNA, 20 bp, Artificial Sequence
  chemically synthesized
ctggcttagttgtcttcttg

SEQ ID NO: 70687 - DNA, 20 bp, Artificial Sequence
  chemically synthesized
tgtgattactgaccatttgg

SEQ ID NO: 70688 - DNA, 20 bp, Artificial Sequence
  chemically synthesized
gattgttgtaattttacatt

SEQ ID NO: 70689 - DNA, 20 bp, Artificial Sequence
  chemically synthesized
catttcacgattatgatgaa

SEQ ID NO: 70690 - DNA, 20 bp, Artificial Sequence
  chemically synthesized
aagacagttttttcagttaa

SEQ ID NO: 70691 - DNA, 20 bp, Artificial Sequence
  chemically synthesized
tttttttggaaattgaatgt

SEQ ID NO: 70692 - DNA, 20 bp, Artificial Sequence
  chemically synthesized
catcaccatcactaccaatg

SEQ ID NO: 70693 - DNA, 20 bp, Artificial Sequence
  chemically synthesized
tttgtcactctaacagttac

SEQ ID NO: 70694 - DNA, 20 bp, Artificial Sequence
  chemically synthesized
ctagacgcagctaacaagca

SEQ ID NO: 70695 - DNA, 20 bp, Artificial Sequence
  chemically synthesized
gggcttgttaggcatgcagc

SEQ ID NO: 70696 - DNA, 20 bp, Artificial Sequence
  chemically synthesized
cttccaacattctgaatcaa

SEQ ID NO: 70697 - DNA, 20 bp, Artificial Sequence
  chemically synthesized
ttcgcttttttcaggtcctc

SEQ ID NO: 70698 - DNA, 20 bp, Artificial Sequence
  chemically synthesized
ctttcgagatagaaaccttt

SEQ ID NO: 70699 - DNA, 20 bp, Artificial Sequence
  chemically synthesized
accttttaatgcttccatcc

SEQ ID NO: 70700 - DNA, 20 bp, Artificial Sequence
  chemically synthesized
tcttcatacaattatctttt

SEQ ID NO: 70701 - DNA, 20 bp, Artificial Sequence
  chemically synthesized
ttatgtttctttcaccattt

SEQ ID NO: 70702 - DNA, 20 bp, Artificial Sequence
  chemically synthesized
ttcccataattaaatactta

SEQ ID NO: 70703 - DNA, 20 bp, Artificial Sequence
  chemically synthesized
tttctgtccttcttacctct

SEQ ID NO: 70704 - DNA, 20 bp, Artificial Sequence
  chemically synthesized
ttctgtaacaggtaaaatta

SEQ ID NO: 70705 - DNA, 20 bp, Artificial Sequence
  chemically synthesized
ctaaggatgccagccatcac

SEQ ID NO: 70706 - DNA, 20 bp, Artificial Sequence
  chemically synthesized
atgccagccatcactactgt

SEQ ID NO: 70707 - DNA, 20 bp, Artificial Sequence
  chemically synthesized
agaggggtatgggagaaaga

SEQ ID NO: 70708 - DNA, 20 bp, Artificial Sequence
  chemically synthesized
gaggcaagtctttagcacct

SEQ ID NO: 70709 - DNA, 20 bp, Artificial Sequence
  chemically synthesized
tctgtatcagctcctgtgag

SEQ ID NO: 70710 - DNA, 20 bp, Artificial Sequence
  chemically synthesized
gagtcaggattactaactta

SEQ ID NO: 70711 - DNA, 20 bp, Artificial Sequence
  chemically synthesized
ttctaccttcgaaagatcct

SEQ ID NO: 70712 - DNA, 20 bp, Artificial Sequence
  chemically synthesized
agatccttcatgcttaaaaa

SEQ ID NO: 70713 - DNA, 20 bp, Artificial Sequence
  chemically synthesized
aggtataggaggaagagaat

SEQ ID NO: 70714 - DNA, 20 bp, Artificial Sequence
  chemically synthesized
acattaaaattttttttaat

SEQ ID NO: 70715 - DNA, 20 bp, Artificial Sequence
  chemically synthesized
taaaaagaaagccataaaat

SEQ ID NO: 70716 - DNA, 20 bp, Artificial Sequence
  chemically synthesized
aaaaattgtgtaaggatcaa

SEQ ID NO: 70717 - DNA, 20 bp, Artificial Sequence
  chemically synthesized
cagagcacaagtacttttta

SEQ ID NO: 70718 - DNA, 20 bp, Artificial Sequence
  chemically synthesized
aagtactttttaaaatgttt

SEQ ID NO: 70719 - DNA, 20 bp, Artificial Sequence
  chemically synthesized
aaacacttgaaaccaaaaaa

SEQ ID NO: 70720 - DNA, 20 bp, Artificial Sequence
  chemically synthesized
ttatatttatgagcagaaaa

SEQ ID NO: 70721 - DNA, 20 bp, Artificial Sequence
  chemically synthesized
agtcatatctccctccatct

SEQ ID NO: 70722 - DNA, 20 bp, Artificial Sequence
  chemically synthesized
aaatgaaaggtaaatcatgt

SEQ ID NO: 70723 - DNA, 20 bp, Artificial Sequence
  chemically synthesized
tttacccagaggcaggcgtg

SEQ ID NO: 70724 - DNA, 20 bp, Artificial Sequence
  chemically synthesized
atgtggcaaaattccattca

SEQ ID NO: 70725 - DNA, 20 bp, Artificial Sequence
  chemically synthesized
attatactagaagcacaaga

SEQ ID NO: 70726 - DNA, 20 bp, Artificial Sequence
  chemically synthesized
cagctctcaactcagaacat

SEQ ID NO: 70727 - DNA, 20 bp, Artificial Sequence
  chemically synthesized
caactcagaacataaatgtt

SEQ ID NO: 70728 - DNA, 20 bp, Artificial Sequence
  chemically synthesized
tggggtcctgacttgatgtg

SEQ ID NO: 70729 - DNA, 20 bp, Artificial Sequence
  chemically synthesized
gcacatgccacacaactgca

SEQ ID NO: 70730 - DNA, 20 bp, Artificial Sequence
  chemically synthesized
agaagctctcaatatggcct

SEQ ID NO: 70731 - DNA, 20 bp, Artificial Sequence
  chemically synthesized
tatggcctatgagtttataa

SEQ ID NO: 70732 - DNA, 20 bp, Artificial Sequence
  chemically synthesized
agaaaaatcatagatctaag

SEQ ID NO: 70733 - DNA, 20 bp, Artificial Sequence
  chemically synthesized
agatctaagccctgcttcat

SEQ ID NO: 70734 - DNA, 20 bp, Artificial Sequence
  chemically synthesized
gatgatatatttctagatga

SEQ ID NO: 70735 - DNA, 20 bp, Artificial Sequence
  chemically synthesized
aacaagtgaaagaggaaaaa

SEQ ID NO: 70736 - DNA, 20 bp, Artificial Sequence
  chemically synthesized
acacagacacacatgcatgt

SEQ ID NO: 70737 - DNA, 20 bp, Artificial Sequence
  chemically synthesized
catgtgtgtgtttcaagggg

SEQ ID NO: 70738 - DNA, 20 bp, Artificial Sequence
  chemically synthesized
tagcagagtgcagaagctca

SEQ ID NO: 70739 - DNA, 20 bp, Artificial Sequence
  chemically synthesized
acagttgggactacccaact

SEQ ID NO: 70740 - DNA, 20 bp, Artificial Sequence
  chemically synthesized
tatattatcatctgccatca

SEQ ID NO: 70741 - DNA, 20 bp, Artificial Sequence
  chemically synthesized
atgatttcattttcaatcca

SEQ ID NO: 70742 - DNA, 20 bp, Artificial Sequence
  chemically synthesized
gcccttttctaagcctttca

SEQ ID NO: 70743 - DNA, 20 bp, Artificial Sequence
  chemically synthesized
ttctggataaacaaaaactg

SEQ ID NO: 70744 - DNA, 20 bp, Artificial Sequence
  chemically synthesized
cattatgcatacatattcct

SEQ ID NO: 70745 - DNA, 20 bp, Artificial Sequence
  chemically synthesized
aaggaggtgagtgataacaa

SEQ ID NO: 70746 - DNA, 20 bp, Artificial Sequence
  chemically synthesized
acttatgccaatccaagggt

SEQ ID NO: 70747 - DNA, 20 bp, Artificial Sequence
  chemically synthesized
gacctctggaaaaccttctt

SEQ ID NO: 70748 - DNA, 20 bp, Artificial Sequence
  chemically synthesized
cctctcatgaggcctcattt

SEQ ID NO: 70749 - DNA, 20 bp, Artificial Sequence
  chemically synthesized
gcatgtggaaatcacctccc

SEQ ID NO: 70750 - DNA, 20 bp, Artificial Sequence
  chemically synthesized
gggccccacaactgatgtcc

SEQ ID NO: 70751 - DNA, 20 bp, Artificial Sequence
  chemically synthesized
ctgatgtcctcgggattttc

SEQ ID NO: 70752 - DNA, 20 bp, Artificial Sequence
  chemically synthesized
ctgatgtaagatagggatac

SEQ ID NO: 70753 - DNA, 20 bp, Artificial Sequence
  chemically synthesized
aaggaggctcagcatcataa

SEQ ID NO: 70754 - DNA, 20 bp, Artificial Sequence
  chemically synthesized
atatgtacctctacgggtcc

SEQ ID NO: 70755 - DNA, 20 bp, Artificial Sequence
  chemically synthesized
ctagagcttatgaattccaa

SEQ ID NO: 70756 - DNA, 20 bp, Artificial Sequence
  chemically synthesized
aatggatctgttaatagtca

SEQ ID NO: 70757 - DNA, 20 bp, Artificial Sequence
  chemically synthesized
agtcatgcagattcatgaca

SEQ ID NO: 70758 - DNA, 20 bp, Artificial Sequence
  chemically synthesized
aaactccacctcccaggttc

SEQ ID NO: 70759 - DNA, 20 bp, Artificial Sequence
  chemically synthesized
ttttgtatttttagtagaca

SEQ ID NO: 70760 - DNA, 20 bp, Artificial Sequence
  chemically synthesized
ctccttggcctcccaaagtg

SEQ ID NO: 70761 - DNA, 20 bp, Artificial Sequence
  chemically synthesized
gtcactgcgcccggctgaca

SEQ ID NO: 70762 - DNA, 20 bp, Artificial Sequence
  chemically synthesized
aacaaggaaggtaacaaata

SEQ ID NO: 70763 - DNA, 20 bp, Artificial Sequence
  chemically synthesized
tagtgtttgtataagtgggg

SEQ ID NO: 70764 - DNA, 20 bp, Artificial Sequence
  chemically synthesized
aagagaatctgtggtagcct

SEQ ID NO: 70765 - DNA, 20 bp, Artificial Sequence
  chemically synthesized
attattattattattatact

SEQ ID NO: 70766 - DNA, 20 bp, Artificial Sequence
  chemically synthesized
agggtacatgtgcacaatgt

SEQ ID NO: 70767 - DNA, 20 bp, Artificial Sequence
  chemically synthesized
cacctatgagtgagaacatg

SEQ ID NO: 70768 - DNA, 20 bp, Artificial Sequence
  chemically synthesized
atgagtgagaacatgcagtg

SEQ ID NO: 70769 - DNA, 20 bp, Artificial Sequence
  chemically synthesized
gcttggttttttgtccttgc

SEQ ID NO: 70770 - DNA, 20 bp, Artificial Sequence
  chemically synthesized
tgcgatagtttgctgagaat

SEQ ID NO: 70771 - DNA, 20 bp, Artificial Sequence
  chemically synthesized
gtttgctgagaatgatggtt

SEQ ID NO: 70772 - DNA, 20 bp, Artificial Sequence
  chemically synthesized
gtgcatgtgtctttatagca

SEQ ID NO: 70773 - DNA, 20 bp, Artificial Sequence
  chemically synthesized
ctgacttccacaatggttga

SEQ ID NO: 70774 - DNA, 20 bp, Artificial Sequence
  chemically synthesized
cctgttgttccctgactttt

SEQ ID NO: 70775 - DNA, 20 bp, Artificial Sequence
  chemically synthesized
ggtgtgagatggtatctctt

SEQ ID NO: 70776 - DNA, 20 bp, Artificial Sequence
  chemically synthesized
gagatggtatctctttgtgg

SEQ ID NO: 70777 - DNA, 20 bp, Artificial Sequence
  chemically synthesized
tttgatttgcattgtgacgt

SEQ ID NO: 70778 - DNA, 20 bp, Artificial Sequence
  chemically synthesized
taaaggtgatgtctgcacag

SEQ ID NO: 70779 - DNA, 20 bp, Artificial Sequence
  chemically synthesized
cagaaagcatgggagaggac

SEQ ID NO: 70780 - DNA, 20 bp, Artificial Sequence
  chemically synthesized
gtaggggaatccagagaggg

SEQ ID NO: 70781 - DNA, 20 bp, Artificial Sequence
  chemically synthesized
tgagaatggaggtgtatctc

SEQ ID NO: 70782 - DNA, 20 bp, Artificial Sequence
  chemically synthesized
ggactccacgatagagaggg

SEQ ID NO: 70783 - DNA, 20 bp, Artificial Sequence
  chemically synthesized
aatcatatatgagatagttc

SEQ ID NO: 70784 - DNA, 20 bp, Artificial Sequence
  chemically synthesized
ggtacaaattcttcaaaatc

SEQ ID NO: 70785 - DNA, 20 bp, Artificial Sequence
  chemically synthesized
gactcaagctaaccagatgc

SEQ ID NO: 70786 - DNA, 20 bp, Artificial Sequence
  chemically synthesized
ctagactatacgacttcatc

SEQ ID NO: 70787 - DNA, 20 bp, Artificial Sequence
  chemically synthesized
tcatcctcagtttcgactcc

SEQ ID NO: 70788 - DNA, 20 bp, Artificial Sequence
  chemically synthesized
ttctaccaccctttcagaca

SEQ ID NO: 70789 - DNA, 20 bp, Artificial Sequence
  chemically synthesized
attttaaaaacctttctacc

SEQ ID NO: 70790 - DNA, 20 bp, Artificial Sequence
  chemically synthesized
actgtgaatatgatacaata

SEQ ID NO: 70791 - DNA, 20 bp, Artificial Sequence
  chemically synthesized
attccatgagcccctaaaag

SEQ ID NO: 70792 - DNA, 20 bp, Artificial Sequence
  chemically synthesized
gaaaggttcatgggtcagtt

SEQ ID NO: 70793 - DNA, 20 bp, Artificial Sequence
  chemically synthesized
ttgggaaactgaggcaggag

SEQ ID NO: 70794 - DNA, 20 bp, Artificial Sequence
  chemically synthesized
aggcacaggttgcagggagc

SEQ ID NO: 70795 - DNA, 20 bp, Artificial Sequence
  chemically synthesized
aatgtgatataataaactaa

SEQ ID NO: 70796 - DNA, 20 bp, Artificial Sequence
  chemically synthesized
actattatccatattttatt

SEQ ID NO: 70797 - DNA, 20 bp, Artificial Sequence
  chemically synthesized
ctataataaactaatattta

SEQ ID NO: 70798 - DNA, 20 bp, Artificial Sequence
  chemically synthesized
catggttcaacttatttagg

SEQ ID NO: 70799 - DNA, 20 bp, Artificial Sequence
  chemically synthesized
gctgtacgtcatccctatcc

SEQ ID NO: 70800 - DNA, 20 bp, Artificial Sequence
  chemically synthesized
aaaacttagcacaaaatttt

SEQ ID NO: 70801 - DNA, 20 bp, Artificial Sequence
  chemically synthesized
tactcccactccaacactaa

SEQ ID NO: 70802 - DNA, 20 bp, Artificial Sequence
  chemically synthesized
aatggccctggaagcaatga

SEQ ID NO: 70803 - DNA, 20 bp, Artificial Sequence
  chemically synthesized
agcaatgacagagtttgaca

SEQ ID NO: 70804 - DNA, 20 bp, Artificial Sequence
  chemically synthesized
tttataaaattttaattact

SEQ ID NO: 70805 - DNA, 20 bp, Artificial Sequence
  chemically synthesized
tgatcactaactgactggta

SEQ ID NO: 70806 - DNA, 20 bp, Artificial Sequence
  chemically synthesized
aagcacccatcacataaaac

SEQ ID NO: 70807 - DNA, 20 bp, Artificial Sequence
  chemically synthesized
atgtggtggaagagaatcca

SEQ ID NO: 70808 - DNA, 20 bp, Artificial Sequence
  chemically synthesized
tgctgagtcctggtgtagaa

SEQ ID NO: 70809 - DNA, 20 bp, Artificial Sequence
  chemically synthesized
ttgcaaaaagaaaacagaat

SEQ ID NO: 70810 - DNA, 20 bp, Artificial Sequence
  chemically synthesized
tatctaactacctttgcctt

SEQ ID NO: 70811 - DNA, 20 bp, Artificial Sequence
  chemically synthesized
ataagctcactcaacttaga

SEQ ID NO: 70812 - DNA, 20 bp, Artificial Sequence
  chemically synthesized
tccctcacacttaatctttt

SEQ ID NO: 70813 - DNA, 20 bp, Artificial Sequence
  chemically synthesized
taatcttttcttggtttcaa

SEQ ID NO: 70814 - DNA, 20 bp, Artificial Sequence
  chemically synthesized
cttttcttggtttcaaataa

SEQ ID NO: 70815 - DNA, 20 bp, Artificial Sequence
  chemically synthesized
ctgataagttctttcaaaca

SEQ ID NO: 70816 - DNA, 20 bp, Artificial Sequence
  chemically synthesized
taagttctttcaaacagtaa

SEQ ID NO: 70817 - DNA, 20 bp, Artificial Sequence
  chemically synthesized
tcttgcccaagaatcagagt

SEQ ID NO: 70818 - DNA, 20 bp, Artificial Sequence
  chemically synthesized
tgcttctggagcaatataaa

SEQ ID NO: 70819 - DNA, 20 bp, Artificial Sequence
  chemically synthesized
ggtggaggtattctttaatc

SEQ ID NO: 70820 - DNA, 20 bp, Artificial Sequence
  chemically synthesized
tcctggaacttagcccaact

SEQ ID NO: 70821 - DNA, 20 bp, Artificial Sequence
  chemically synthesized
agcagaatagtagtaggaaa

SEQ ID NO: 70822 - DNA, 20 bp, Artificial Sequence
  chemically synthesized
attaaaagtcagtctctgga

SEQ ID NO: 70823 - DNA, 20 bp, Artificial Sequence
  chemically synthesized
gtactaagttaaaatttagg

SEQ ID NO: 70824 - DNA, 20 bp, Artificial Sequence
  chemically synthesized
taagttaaaatttaggtctg

SEQ ID NO: 70825 - DNA, 20 bp, Artificial Sequence
  chemically synthesized
tctggattgatttaggggag

SEQ ID NO: 70826 - DNA, 20 bp, Artificial Sequence
  chemically synthesized
aggtagtaagaccctgagat

SEQ ID NO: 70827 - DNA, 20 bp, Artificial Sequence
  chemically synthesized
tcagccaacactcaaagtca

SEQ ID NO: 70828 - DNA, 20 bp, Artificial Sequence
  chemically synthesized
tcatgtcacagcagcataat

SEQ ID NO: 70829 - DNA, 20 bp, Artificial Sequence
  chemically synthesized
aataaaagccttctttgatg

SEQ ID NO: 70830 - DNA, 20 bp, Artificial Sequence
  chemically synthesized
gaaggcaacattcaagtata

SEQ ID NO: 70831 - DNA, 20 bp, Artificial Sequence
  chemically synthesized
gtataataagcttatatcgc

SEQ ID NO: 70832 - DNA, 20 bp, Artificial Sequence
  chemically synthesized
gattcaggaaggtctctatc

SEQ ID NO: 70833 - DNA, 20 bp, Artificial Sequence
  chemically synthesized
ggtctctatcctaggatttt

SEQ ID NO: 70834 - DNA, 20 bp, Artificial Sequence
  chemically synthesized
agtaagtctgtgctgacaat

SEQ ID NO: 70835 - DNA, 20 bp, Artificial Sequence
  chemically synthesized
ttcttttttttttttttctg

SEQ ID NO: 70836 - DNA, 20 bp, Artificial Sequence
  chemically synthesized
tttttttttttttctgtgta

SEQ ID NO: 70837 - DNA, 20 bp, Artificial Sequence
  chemically synthesized
attctattatctgtcagcct

SEQ ID NO: 70838 - DNA, 20 bp, Artificial Sequence
  chemically synthesized
ctggattccacaattatctc

SEQ ID NO: 70839 - DNA, 20 bp, Artificial Sequence
  chemically synthesized
tatttgtcaaacattattct

SEQ ID NO: 70840 - DNA, 20 bp, Artificial Sequence
  chemically synthesized
tattctagatgtttttgtga

SEQ ID NO: 70841 - DNA, 20 bp, Artificial Sequence
  chemically synthesized
ttttgtgagggtgtttttag

SEQ ID NO: 70842 - DNA, 20 bp, Artificial Sequence
  chemically synthesized
agatggtccttcctattgca

SEQ ID NO: 70843 - DNA, 20 bp, Artificial Sequence
  chemically synthesized
tctagacctttttttctgcc

SEQ ID NO: 70844 - DNA, 20 bp, Artificial Sequence
  chemically synthesized
acttcctgggtctgaagcct

SEQ ID NO: 70845 - DNA, 20 bp, Artificial Sequence
  chemically synthesized
tgcaagtacaccatcaatcc

SEQ ID NO: 70846 - DNA, 20 bp, Artificial Sequence
  chemically synthesized
gactaaactaccaggctctc

SEQ ID NO: 70847 - DNA, 20 bp, Artificial Sequence
  chemically synthesized
taggttggtgcaacagtaat

SEQ ID NO: 70848 - DNA, 20 bp, Artificial Sequence
  chemically synthesized
gaggtacatgtgcaggatgt

SEQ ID NO: 70849 - DNA, 20 bp, Artificial Sequence
  chemically synthesized
catacgtaaatgtgtgcaat

SEQ ID NO: 70850 - DNA, 20 bp, Artificial Sequence
  chemically synthesized
ccagtgtgtgttcttcccct

SEQ ID NO: 70851 - DNA, 20 bp, Artificial Sequence
  chemically synthesized
cacttctaagtgagaacatg

SEQ ID NO: 70852 - DNA, 20 bp, Artificial Sequence
  chemically synthesized
ctaagtgagaacatgtggtg

SEQ ID NO: 70853 - DNA, 20 bp, Artificial Sequence
  chemically synthesized
gtttggttttctgttcctgc

SEQ ID NO: 70854 - DNA, 20 bp, Artificial Sequence
  chemically synthesized
tgcattagtttactgaagat

SEQ ID NO: 70855 - DNA, 20 bp, Artificial Sequence
  chemically synthesized
tttatggttagatagtattt

SEQ ID NO: 70856 - DNA, 20 bp, Artificial Sequence
  chemically synthesized
ctatcattgatggccatttg

SEQ ID NO: 70857 - DNA, 20 bp, Artificial Sequence
  chemically synthesized
gtgcatgtatcttagtaata

SEQ ID NO: 70858 - DNA, 20 bp, Artificial Sequence
  chemically synthesized
ctttaggtatatacccagta

SEQ ID NO: 70859 - DNA, 20 bp, Artificial Sequence
  chemically synthesized
ctgtcttccacaatggttga

SEQ ID NO: 70860 - DNA, 20 bp, Artificial Sequence
  chemically synthesized
tctgcaaccttgctagcatc

SEQ ID NO: 70861 - DNA, 20 bp, Artificial Sequence
  chemically synthesized
ggtgtcagatggtatttcat

SEQ ID NO: 70862 - DNA, 20 bp, Artificial Sequence
  chemically synthesized
cagatggtatttcattgtgg

SEQ ID NO: 70863 - DNA, 20 bp, Artificial Sequence
  chemically synthesized
gtgacattgagacttttttc

SEQ ID NO: 70864 - DNA, 20 bp, Artificial Sequence
  chemically synthesized
ctttgcccactttttaatgg

SEQ ID NO: 70865 - DNA, 20 bp, Artificial Sequence
  chemically synthesized
actttttaatggggttgttt

SEQ ID NO: 70866 - DNA, 20 bp, Artificial Sequence
  chemically synthesized
gtaaatatgtctaagttcct

SEQ ID NO: 70867 - DNA, 20 bp, Artificial Sequence
  chemically synthesized
tattagacctttgtcagatg

SEQ ID NO: 70868 - DNA, 20 bp, Artificial Sequence
  chemically synthesized
ggttgcctgttcgctctgat

SEQ ID NO: 70869 - DNA, 20 bp, Artificial Sequence
  chemically synthesized
gctctgatgatagtttattt

SEQ ID NO: 70870 - DNA, 20 bp, Artificial Sequence
  chemically synthesized
tgcctcagcctcctgagtag

SEQ ID NO: 70871 - DNA, 20 bp, Artificial Sequence
  chemically synthesized
ttttgtatttttagtagaga

SEQ ID NO: 70872 - DNA, 20 bp, Artificial Sequence
  chemically synthesized
caccttggcctcccaaagtg

SEQ ID NO: 70873 - DNA, 20 bp, Artificial Sequence
  chemically synthesized
gagccaccatgcccgatctc

SEQ ID NO: 70874 - DNA, 20 bp, Artificial Sequence
  chemically synthesized
tttaattagatctcatttga

SEQ ID NO: 70875 - DNA, 20 bp, Artificial Sequence
  chemically synthesized
attagatctcatttgacagt

SEQ ID NO: 70876 - DNA, 20 bp, Artificial Sequence
  chemically synthesized
acagtgtttgcttttgttgc

SEQ ID NO: 70877 - DNA, 20 bp, Artificial Sequence
  chemically synthesized
tatgtccggaatggtattgc

SEQ ID NO: 70878 - DNA, 20 bp, Artificial Sequence
  chemically synthesized
gtattgcctaggttttcttc

SEQ ID NO: 70879 - DNA, 20 bp, Artificial Sequence
  chemically synthesized
aggttttcttctaaagtttt

SEQ ID NO: 70880 - DNA, 20 bp, Artificial Sequence
  chemically synthesized
cttctaaagtttttatagtt

SEQ ID NO: 70881 - DNA, 20 bp, Artificial Sequence
  chemically synthesized
tataagatgtaaggaagggg

SEQ ID NO: 70882 - DNA, 20 bp, Artificial Sequence
  chemically synthesized
tagggaatcccttccccatt

SEQ ID NO: 70883 - DNA, 20 bp, Artificial Sequence
  chemically synthesized
ttccccattacttgttttta

SEQ ID NO: 70884 - DNA, 20 bp, Artificial Sequence
  chemically synthesized
ttttaccaggtttgttgaag

SEQ ID NO: 70885 - DNA, 20 bp, Artificial Sequence
  chemically synthesized
accaggtttgttgaagatca

SEQ ID NO: 70886 - DNA, 20 bp, Artificial Sequence
  chemically synthesized
tctgttccattagtcagtgt

SEQ ID NO: 70887 - DNA, 20 bp, Artificial Sequence
  chemically synthesized
tctgtttggtatcagtacca

SEQ ID NO: 70888 - DNA, 20 bp, Artificial Sequence
  chemically synthesized
atttgaagttgggtaaatcc

SEQ ID NO: 70889 - DNA, 20 bp, Artificial Sequence
  chemically synthesized
gtgactaatcactgtcatct

SEQ ID NO: 70890 - DNA, 20 bp, Artificial Sequence
  chemically synthesized
ccataaaataaattttgtct

SEQ ID NO: 70891 - DNA, 20 bp, Artificial Sequence
  chemically synthesized
ttaataacaatgactgtgtc

SEQ ID NO: 70892 - DNA, 20 bp, Artificial Sequence
  chemically synthesized
atttaggctataaaatcaaa

SEQ ID NO: 70893 - DNA, 20 bp, Artificial Sequence
  chemically synthesized
catattttttcagtgtgtct

SEQ ID NO: 70894 - DNA, 20 bp, Artificial Sequence
  chemically synthesized
ccacgtcttcttaatcattt

SEQ ID NO: 70895 - DNA, 20 bp, Artificial Sequence
  chemically synthesized
tcttcttaatcatttctaag

SEQ ID NO: 70896 - DNA, 20 bp, Artificial Sequence
  chemically synthesized
aagaaaggatggtatttggc

SEQ ID NO: 70897 - DNA, 20 bp, Artificial Sequence
  chemically synthesized
taatgtatattcttttacac

SEQ ID NO: 70898 - DNA, 20 bp, Artificial Sequence
  chemically synthesized
gaatgatgaaaagctgaatt

SEQ ID NO: 70899 - DNA, 20 bp, Artificial Sequence
  chemically synthesized
ctgctgtaagaaggtggttc

SEQ ID NO: 70900 - DNA, 20 bp, Artificial Sequence
  chemically synthesized
tatgaatacaaattcatgtg

SEQ ID NO: 70901 - DNA, 20 bp, Artificial Sequence
  chemically synthesized
cctaggagatagtgttataa

SEQ ID NO: 70902 - DNA, 20 bp, Artificial Sequence
  chemically synthesized
catatttaaacttgtgtcac

SEQ ID NO: 70903 - DNA, 20 bp, Artificial Sequence
  chemically synthesized
tgtgtcacgagggtttgttg

SEQ ID NO: 70904 - DNA, 20 bp, Artificial Sequence
  chemically synthesized
ataagtgagaacacgtggta

SEQ ID NO: 70905 - DNA, 20 bp, Artificial Sequence
  chemically synthesized
ctgttcctgtattaatttgc

SEQ ID NO: 70906 - DNA, 20 bp, Artificial Sequence
  chemically synthesized
tttatgataatactaacata

SEQ ID NO: 70907 - DNA, 20 bp, Artificial Sequence
  chemically synthesized
atactaacatactgtgttta

SEQ ID NO: 70908 - DNA, 20 bp, Artificial Sequence
  chemically synthesized
tgtttatgttgattgttaca

SEQ ID NO: 70909 - DNA, 20 bp, Artificial Sequence
  chemically synthesized
tgaatagaaaaacatgtctg

SEQ ID NO: 70910 - DNA, 20 bp, Artificial Sequence
  chemically synthesized
ccatgtagccttctgtataa

SEQ ID NO: 70911 - DNA, 20 bp, Artificial Sequence
  chemically synthesized
tacagcatcttctcagtgaa

SEQ ID NO: 70912 - DNA, 20 bp, Artificial Sequence
  chemically synthesized
tcttctacctaacagtattt

SEQ ID NO: 70913 - DNA, 20 bp, Artificial Sequence
  chemically synthesized
cagttttaaatattagttag

SEQ ID NO: 70914 - DNA, 20 bp, Artificial Sequence
  chemically synthesized
acaaaacaaattacaagaag

SEQ ID NO: 70915 - DNA, 20 bp, Artificial Sequence
  chemically synthesized
attaggctgtggaatcaaaa

SEQ ID NO: 70916 - DNA, 20 bp, Artificial Sequence
  chemically synthesized
gtctcaggaaaacatggaat

SEQ ID NO: 70917 - DNA, 20 bp, Artificial Sequence
  chemically synthesized
aaaacatggaatcagagatt

SEQ ID NO: 70918 - DNA, 20 bp, Artificial Sequence
  chemically synthesized
aatttactctaaatatttat

SEQ ID NO: 70919 - DNA, 20 bp, Artificial Sequence
  chemically synthesized
aaagttcttctactgcggtt

SEQ ID NO: 70920 - DNA, 20 bp, Artificial Sequence
  chemically synthesized
ttggagatacaatgcaaaat

SEQ ID NO: 70921 - DNA, 20 bp, Artificial Sequence
  chemically synthesized
gtagagcataattaagggac

SEQ ID NO: 70922 - DNA, 20 bp, Artificial Sequence
  chemically synthesized
gcataattaagggacacatg

SEQ ID NO: 70923 - DNA, 20 bp, Artificial Sequence
  chemically synthesized
ggacacatgtttggttttat

SEQ ID NO: 70924 - DNA, 20 bp, Artificial Sequence
  chemically synthesized
aaggataaaaaacatgataa

SEQ ID NO: 70925 - DNA, 20 bp, Artificial Sequence
  chemically synthesized
ttaatgaaacagaatataaa

SEQ ID NO: 70926 - DNA, 20 bp, Artificial Sequence
  chemically synthesized
aacagaatataaataaggat

SEQ ID NO: 70927 - DNA, 20 bp, Artificial Sequence
  chemically synthesized
tctatgagcaatacctgaga

SEQ ID NO: 70928 - DNA, 20 bp, Artificial Sequence
  chemically synthesized
aagcaagtgcatactgaagc

SEQ ID NO: 70929 - DNA, 20 bp, Artificial Sequence
  chemically synthesized
agtgcatactgaagctggag

SEQ ID NO: 70930 - DNA, 20 bp, Artificial Sequence
  chemically synthesized
tcactgaagtattatttttg

SEQ ID NO: 70931 - DNA, 20 bp, Artificial Sequence
  chemically synthesized
gtctacgtcctctcatttat

SEQ ID NO: 70932 - DNA, 20 bp, Artificial Sequence
  chemically synthesized
tcttctcacatttttttgtt

SEQ ID NO: 70933 - DNA, 20 bp, Artificial Sequence
  chemically synthesized
tactgccttggggaataaat

SEQ ID NO: 70934 - DNA, 20 bp, Artificial Sequence
  chemically synthesized
ttggggaataaatatgagtt

SEQ ID NO: 70935 - DNA, 20 bp, Artificial Sequence
  chemically synthesized
gtaattaggtcactgatcaa

SEQ ID NO: 70936 - DNA, 20 bp, Artificial Sequence
  chemically synthesized
tgaccaaatttataggttcc

SEQ ID NO: 70937 - DNA, 20 bp, Artificial Sequence
  chemically synthesized
gaaattcataagagttggaa

SEQ ID NO: 70938 - DNA, 20 bp, Artificial Sequence
  chemically synthesized
caactaataattttatattt

SEQ ID NO: 70939 - DNA, 20 bp, Artificial Sequence
  chemically synthesized
gttatcacaataatttagtg

SEQ ID NO: 70940 - DNA, 20 bp, Artificial Sequence
  chemically synthesized
gtggaaagcttagagaaata

SEQ ID NO: 70941 - DNA, 20 bp, Artificial Sequence
  chemically synthesized
aactacatttagctaaagag

SEQ ID NO: 70942 - DNA, 20 bp, Artificial Sequence
  chemically synthesized
tttgctctcctgctaaatat

SEQ ID NO: 70943 - DNA, 20 bp, Artificial Sequence
  chemically synthesized
acattctgtgagagtgactg

SEQ ID NO: 70944 - DNA, 20 bp, Artificial Sequence
  chemically synthesized
ggtgaagaatggcattctga

SEQ ID NO: 70945 - DNA, 20 bp, Artificial Sequence
  chemically synthesized
tggtcttgacactatatgtt

SEQ ID NO: 70946 - DNA, 20 bp, Artificial Sequence
  chemically synthesized
tgaggtgaacaatatgtgga

SEQ ID NO: 70947 - DNA, 20 bp, Artificial Sequence
  chemically synthesized
tgaaggtggtatcagcacag

SEQ ID NO: 70948 - DNA, 20 bp, Artificial Sequence
  chemically synthesized
atacagaaaaaaatagaggg

SEQ ID NO: 70949 - DNA, 20 bp, Artificial Sequence
  chemically synthesized
gaaagaagtacatgggctca

SEQ ID NO: 70950 - DNA, 20 bp, Artificial Sequence
  chemically synthesized
aaaaatacggaaatccagtg

SEQ ID NO: 70951 - DNA, 20 bp, Artificial Sequence
  chemically synthesized
agctgccgctggacgacatc

SEQ ID NO: 70952 - DNA, 20 bp, Artificial Sequence
  chemically synthesized
tttatatagaagaaatgtct

SEQ ID NO: 70953 - DNA, 20 bp, Artificial Sequence
  chemically synthesized
gataataatgacatcaatat

SEQ ID NO: 70954 - DNA, 20 bp, Artificial Sequence
  chemically synthesized
ataatgacatcaatataagt

SEQ ID NO: 70955 - DNA, 20 bp, Artificial Sequence
  chemically synthesized
tacctacgtaatcaaattct

SEQ ID NO: 70956 - DNA, 20 bp, Artificial Sequence
  chemically synthesized
aatcaaattcttggagtttc

SEQ ID NO: 70957 - DNA, 20 bp, Artificial Sequence
  chemically synthesized
taaactgttacccttaacta

SEQ ID NO: 70958 - DNA, 20 bp, Artificial Sequence
  chemically synthesized
cgtattctatggggcattca

SEQ ID NO: 70959 - DNA, 20 bp, Artificial Sequence
  chemically synthesized
accactgtagctaaggagca

SEQ ID NO: 70960 - DNA, 20 bp, Artificial Sequence
  chemically synthesized
tgagaaagagacacttggcc

SEQ ID NO: 70961 - DNA, 20 bp, Artificial Sequence
  chemically synthesized
tagtgatggggaacagacat

SEQ ID NO: 70962 - DNA, 20 bp, Artificial Sequence
  chemically synthesized
ttagactttggggctggaat

SEQ ID NO: 70963 - DNA, 20 bp, Artificial Sequence
  chemically synthesized
acttataatagtgtatctcc

SEQ ID NO: 70964 - DNA, 20 bp, Artificial Sequence
  chemically synthesized
ctccttcagtttaaacatct

SEQ ID NO: 70965 - DNA, 20 bp, Artificial Sequence
  chemically synthesized
tatatttaaacatccatctt

SEQ ID NO: 70966 - DNA, 20 bp, Artificial Sequence
  chemically synthesized
ccttccctttatccccagcc

SEQ ID NO: 70967 - DNA, 20 bp, Artificial Sequence
  chemically synthesized
atactgagtgagagctattt

SEQ ID NO: 70968 - DNA, 20 bp, Artificial Sequence
  chemically synthesized
tgctgtcttttactgaagag

SEQ ID NO: 70969 - DNA, 20 bp, Artificial Sequence
  chemically synthesized
agaagagattagtcctttga

SEQ ID NO: 70970 - DNA, 20 bp, Artificial Sequence
  chemically synthesized
attccttctgccactagact

SEQ ID NO: 70971 - DNA, 20 bp, Artificial Sequence
  chemically synthesized
gggcttcttgcatatagaca

SEQ ID NO: 70972 - DNA, 20 bp, Artificial Sequence
  chemically synthesized
tgcatatagacatggtgttt

SEQ ID NO: 70973 - DNA, 20 bp, Artificial Sequence
  chemically synthesized
aattttaaacaaatataaat

SEQ ID NO: 70974 - DNA, 20 bp, Artificial Sequence
  chemically synthesized
cataaaacagtactacttga

SEQ ID NO: 70975 - DNA, 20 bp, Artificial Sequence
  chemically synthesized
tattgtatacaagatagtat

SEQ ID NO: 70976 - DNA, 20 bp, Artificial Sequence
  chemically synthesized
cttacagaccaccacggaat

SEQ ID NO: 70977 - DNA, 20 bp, Artificial Sequence
  chemically synthesized
agaccaccacggaatttttg

SEQ ID NO: 70978 - DNA, 20 bp, Artificial Sequence
  chemically synthesized
accacggaatttttgttttg

SEQ ID NO: 70979 - DNA, 20 bp, Artificial Sequence
  chemically synthesized
gaaaatagtgtggtgatata

SEQ ID NO: 70980 - DNA, 20 bp, Artificial Sequence
  chemically synthesized
gatgcatttttgaagtagtg

SEQ ID NO: 70981 - DNA, 20 bp, Artificial Sequence
  chemically synthesized
ggagtgagggaaaaatcaaa

SEQ ID NO: 70982 - DNA, 20 bp, Artificial Sequence
  chemically synthesized
aaaaatcaaatgaggtttcc

SEQ ID NO: 70983 - DNA, 20 bp, Artificial Sequence
  chemically synthesized
aaatgaggtttcccctagat

SEQ ID NO: 70984 - DNA, 20 bp, Artificial Sequence
  chemically synthesized
tgaattagagcaaatgcatc

SEQ ID NO: 70985 - DNA, 20 bp, Artificial Sequence
  chemically synthesized
atgccagaacaacttcttga

SEQ ID NO: 70986 - DNA, 20 bp, Artificial Sequence
  chemically synthesized
tagagatgagatctaactgt

SEQ ID NO: 70987 - DNA, 20 bp, Artificial Sequence
  chemically synthesized
gttactagacgcaaagataa

SEQ ID NO: 70988 - DNA, 20 bp, Artificial Sequence
  chemically synthesized
tgtcaacactcttacttctc

SEQ ID NO: 70989 - DNA, 20 bp, Artificial Sequence
  chemically synthesized
aagctaaccaaactgtaagg

SEQ ID NO: 70990 - DNA, 20 bp, Artificial Sequence
  chemically synthesized
gccaataataacctgcaact

SEQ ID NO: 70991 - DNA, 20 bp, Artificial Sequence
  chemically synthesized
tgatctatggaatcactcta

SEQ ID NO: 70992 - DNA, 20 bp, Artificial Sequence
  chemically synthesized
gtcctcagctagtcgtggct

SEQ ID NO: 70993 - DNA, 20 bp, Artificial Sequence
  chemically synthesized
aaagactgaggatagaagca

SEQ ID NO: 70994 - DNA, 20 bp, Artificial Sequence
  chemically synthesized
catttacagccataattttt

SEQ ID NO: 70995 - DNA, 20 bp, Artificial Sequence
  chemically synthesized
acagccataatttttctctg

SEQ ID NO: 70996 - DNA, 20 bp, Artificial Sequence
  chemically synthesized
agttggttggtagcacttgg

SEQ ID NO: 70997 - DNA, 20 bp, Artificial Sequence
  chemically synthesized
cttctccgtatctttctctg

SEQ ID NO: 70998 - DNA, 20 bp, Artificial Sequence
  chemically synthesized
ccatactcccaggtaccata

SEQ ID NO: 70999 - DNA, 20 bp, Artificial Sequence
  chemically synthesized
ggaacacttaattagtcccc

SEQ ID NO: 71000 - DNA, 20 bp, Artificial Sequence
  chemically synthesized
acttcaacagtcaaatcttt

SEQ ID NO: 71001 - DNA, 20 bp, Artificial Sequence
  chemically synthesized
acctgaatttctactatatt

SEQ ID NO: 71002 - DNA, 20 bp, Artificial Sequence
  chemically synthesized
aatttctactatatttcctg

SEQ ID NO: 71003 - DNA, 20 bp, Artificial Sequence
  chemically synthesized
cctgcttggtttagatcaga

SEQ ID NO: 71004 - DNA, 20 bp, Artificial Sequence
  chemically synthesized
tatcactaactattcccttc

SEQ ID NO: 71005 - DNA, 20 bp, Artificial Sequence
  chemically synthesized
cttcttgagtttagcctacc

SEQ ID NO: 71006 - DNA, 20 bp, Artificial Sequence
  chemically synthesized
cagcaggcatactcatcaca

SEQ ID NO: 71007 - DNA, 20 bp, Artificial Sequence
  chemically synthesized
tttgtgatggcaattattat

SEQ ID NO: 71008 - DNA, 20 bp, Artificial Sequence
  chemically synthesized
atcaggaatggtctctgggg

SEQ ID NO: 71009 - DNA, 20 bp, Artificial Sequence
  chemically synthesized
tcctaccagccaggctcatg

SEQ ID NO: 71010 - DNA, 20 bp, Artificial Sequence
  chemically synthesized
aactgaagaatggaagggaa

SEQ ID NO: 71011 - DNA, 20 bp, Artificial Sequence
  chemically synthesized
aaaaaaaacagagagatcga

SEQ ID NO: 71012 - DNA, 20 bp, Artificial Sequence
  chemically synthesized
actccctgacatctctaaaa

SEQ ID NO: 71013 - DNA, 20 bp, Artificial Sequence
  chemically synthesized
tcaaatataaaaaagtgaag

SEQ ID NO: 71014 - DNA, 20 bp, Artificial Sequence
  chemically synthesized
gtagtaatttctctccacct

SEQ ID NO: 71015 - DNA, 20 bp, Artificial Sequence
  chemically synthesized
ctgactgattctttaatctc

SEQ ID NO: 71016 - DNA, 20 bp, Artificial Sequence
  chemically synthesized
actaataaaccaattcaaaa

SEQ ID NO: 71017 - DNA, 20 bp, Artificial Sequence
  chemically synthesized
aattcaaaattaagcttgga

SEQ ID NO: 71018 - DNA, 20 bp, Artificial Sequence
  chemically synthesized
gtgtgcctctggatcagggg

SEQ ID NO: 71019 - DNA, 20 bp, Artificial Sequence
  chemically synthesized
tgtgtgactttagcacctgg

SEQ ID NO: 71020 - DNA, 20 bp, Artificial Sequence
  chemically synthesized
ctactcttccatcttctttt

SEQ ID NO: 71021 - DNA, 20 bp, Artificial Sequence
  chemically synthesized
tttcttctagccgccctggc

SEQ ID NO: 71022 - DNA, 20 bp, Artificial Sequence
  chemically synthesized
ctttgcatccttcaatccaa

SEQ ID NO: 71023 - DNA, 20 bp, Artificial Sequence
  chemically synthesized
aaaaaaaggatggagatact

SEQ ID NO: 71024 - DNA, 20 bp, Artificial Sequence
  chemically synthesized
tgaggtgtctgcatagagcc

SEQ ID NO: 71025 - DNA, 20 bp, Artificial Sequence
  chemically synthesized
agagccatcagtttatgcgg

SEQ ID NO: 71026 - DNA, 20 bp, Artificial Sequence
  chemically synthesized
cagagtttgagactttgaga

SEQ ID NO: 71027 - DNA, 20 bp, Artificial Sequence
  chemically synthesized
aatggctgcagggatgaggc

SEQ ID NO: 71028 - DNA, 20 bp, Artificial Sequence
  chemically synthesized
tgcagggatgaggcaaaggt

SEQ ID NO: 71029 - DNA, 20 bp, Artificial Sequence
  chemically synthesized
gagtgaatcaagtgaaagca

SEQ ID NO: 71030 - DNA, 20 bp, Artificial Sequence
  chemically synthesized
gacaagacaaacagctattt

SEQ ID NO: 71031 - DNA, 20 bp, Artificial Sequence
  chemically synthesized
aacaattatttgttccatac

SEQ ID NO: 71032 - DNA, 20 bp, Artificial Sequence
  chemically synthesized
tttgttccatacatttgttt

SEQ ID NO: 71033 - DNA, 20 bp, Artificial Sequence
  chemically synthesized
tccctatctggtattcctac

SEQ ID NO: 71034 - DNA, 20 bp, Artificial Sequence
  chemically synthesized
ttttttttaatttatcaatt

SEQ ID NO: 71035 - DNA, 20 bp, Artificial Sequence
  chemically synthesized
gtagtaatataacacaatta

SEQ ID NO: 71036 - DNA, 20 bp, Artificial Sequence
  chemically synthesized
ttctgtattatcttttccct

SEQ ID NO: 71037 - DNA, 20 bp, Artificial Sequence
  chemically synthesized
gtgaggtgatagatatatta

SEQ ID NO: 71038 - DNA, 20 bp, Artificial Sequence
  chemically synthesized
ggtgatagatatattaatta

SEQ ID NO: 71039 - DNA, 20 bp, Artificial Sequence
  chemically synthesized
tgtacaatttttatttgcca

SEQ ID NO: 71040 - DNA, 20 bp, Artificial Sequence
  chemically synthesized
gtctgaacctctcactggca

SEQ ID NO: 71041 - DNA, 20 bp, Artificial Sequence
  chemically synthesized
ttctcactttttgaggacag

SEQ ID NO: 71042 - DNA, 20 bp, Artificial Sequence
  chemically synthesized
cagacatatcacattttatc

SEQ ID NO: 71043 - DNA, 20 bp, Artificial Sequence
  chemically synthesized
tatctgctgattagagaaac

SEQ ID NO: 71044 - DNA, 20 bp, Artificial Sequence
  chemically synthesized
catcatcttatatctgttcc

SEQ ID NO: 71045 - DNA, 20 bp, Artificial Sequence
  chemically synthesized
acaggttatgtaaccaaatc

SEQ ID NO: 71046 - DNA, 20 bp, Artificial Sequence
  chemically synthesized
tctcacttttgtcaaatccc

SEQ ID NO: 71047 - DNA, 20 bp, Artificial Sequence
  chemically synthesized
tgtcaaatcccatcagattc

SEQ ID NO: 71048 - DNA, 20 bp, Artificial Sequence
  chemically synthesized
ccaagtaggtgatatgcaac

SEQ ID NO: 71049 - DNA, 20 bp, Artificial Sequence
  chemically synthesized
tattatcaattagtgccttc

SEQ ID NO: 71050 - DNA, 20 bp, Artificial Sequence
  chemically synthesized
ttatcatcaaatccacattt

SEQ ID NO: 71051 - DNA, 20 bp, Artificial Sequence
  chemically synthesized
gctgggcaacttagagttct

SEQ ID NO: 71052 - DNA, 20 bp, Artificial Sequence
  chemically synthesized
tctaactacccaaaagtctc

SEQ ID NO: 71053 - DNA, 20 bp, Artificial Sequence
  chemically synthesized
catatatttcttacttgtgt

SEQ ID NO: 71054 - DNA, 20 bp, Artificial Sequence
  chemically synthesized
tttttccatataatctttat

SEQ ID NO: 71055 - DNA, 20 bp, Artificial Sequence
  chemically synthesized
ctttatatctgcttttccaa

SEQ ID NO: 71056 - DNA, 20 bp, Artificial Sequence
  chemically synthesized
agcaccatgaaaagtgacct

SEQ ID NO: 71057 - DNA, 20 bp, Artificial Sequence
  chemically synthesized
attacagcactattcaaata

SEQ ID NO: 71058 - DNA, 20 bp, Artificial Sequence
  chemically synthesized
tatagtgatttcttctttca

SEQ ID NO: 71059 - DNA, 20 bp, Artificial Sequence
  chemically synthesized
ttgtttttattttctgggtt

SEQ ID NO: 71060 - DNA, 20 bp, Artificial Sequence
  chemically synthesized
atgatttacaatgaattcaa

SEQ ID NO: 71061 - DNA, 20 bp, Artificial Sequence
  chemically synthesized
tcaaggagcaacttttatac

SEQ ID NO: 71062 - DNA, 20 bp, Artificial Sequence
  chemically synthesized
acttttatacaactgattac

SEQ ID NO: 71063 - DNA, 20 bp, Artificial Sequence
  chemically synthesized
ctggcaatggggctcaataa

SEQ ID NO: 71064 - DNA, 20 bp, Artificial Sequence
  chemically synthesized
caataagtctgcttccacct

SEQ ID NO: 71065 - DNA, 20 bp, Artificial Sequence
  chemically synthesized
ctgcttccaccttccagctt

SEQ ID NO: 71066 - DNA, 20 bp, Artificial Sequence
  chemically synthesized
tgttctgtggttagatcaca

SEQ ID NO: 71067 - DNA, 20 bp, Artificial Sequence
  chemically synthesized
acagggagattggccatgga

SEQ ID NO: 71068 - DNA, 20 bp, Artificial Sequence
  chemically synthesized
ttctgtcatggagtcaggtg

SEQ ID NO: 71069 - DNA, 20 bp, Artificial Sequence
  chemically synthesized
gagtcaggtgtcttgcttgc

SEQ ID NO: 71070 - DNA, 20 bp, Artificial Sequence
  chemically synthesized
tcttgcttgccatggcttat

SEQ ID NO: 71071 - DNA, 20 bp, Artificial Sequence
  chemically synthesized
cctgaccaacacccaggtaa

SEQ ID NO: 71072 - DNA, 20 bp, Artificial Sequence
  chemically synthesized
gccaatagttgttcgcctac

SEQ ID NO: 71073 - DNA, 20 bp, Artificial Sequence
  chemically synthesized
tgtcgatcccatgtactctc

SEQ ID NO: 71074 - DNA, 20 bp, Artificial Sequence
  chemically synthesized
ttcaaccgtctctatccagt

SEQ ID NO: 71075 - DNA, 20 bp, Artificial Sequence
  chemically synthesized
catcatctttttctcctaca

SEQ ID NO: 71076 - DNA, 20 bp, Artificial Sequence
  chemically synthesized
atcctggtcttctatgtcac

SEQ ID NO: 71077 - DNA, 20 bp, Artificial Sequence
  chemically synthesized
agtttgtctgacatttattc

SEQ ID NO: 71078 - DNA, 20 bp, Artificial Sequence
  chemically synthesized
tatctatagcattaaaacta

SEQ ID NO: 71079 - DNA, 20 bp, Artificial Sequence
  chemically synthesized
agcagattcagagtggcata

SEQ ID NO: 71080 - DNA, 20 bp, Artificial Sequence
  chemically synthesized
tgcctcactctagagcatga

SEQ ID NO: 71081 - DNA, 20 bp, Artificial Sequence
  chemically synthesized
attttaccctgcctgtctat

SEQ ID NO: 71082 - DNA, 20 bp, Artificial Sequence
  chemically synthesized
atatctcagtgctcaactga

SEQ ID NO: 71083 - DNA, 20 bp, Artificial Sequence
  chemically synthesized
ttctcaggtaatttaactca

SEQ ID NO: 71084 - DNA, 20 bp, Artificial Sequence
  chemically synthesized
caggtaatttaactcacatt

SEQ ID NO: 71085 - DNA, 20 bp, Artificial Sequence
  chemically synthesized
aatttaactcacattgtttg

SEQ ID NO: 71086 - DNA, 20 bp, Artificial Sequence
  chemically synthesized
tagtgtgtgtatgtatctgt

SEQ ID NO: 71087 - DNA, 20 bp, Artificial Sequence
  chemically synthesized
tatatatataattcttgggt

SEQ ID NO: 71088 - DNA, 20 bp, Artificial Sequence
  chemically synthesized
tcaatgcccattgctctcca

SEQ ID NO: 71089 - DNA, 20 bp, Artificial Sequence
  chemically synthesized
atacataggaataaggcatt

SEQ ID NO: 71090 - DNA, 20 bp, Artificial Sequence
  chemically synthesized
cttgcatatatggagctggc

SEQ ID NO: 71091 - DNA, 20 bp, Artificial Sequence
  chemically synthesized
tcataaagtggtatgagagg

SEQ ID NO: 71092 - DNA, 20 bp, Artificial Sequence
  chemically synthesized
ccttttctggctccaaatac

SEQ ID NO: 71093 - DNA, 20 bp, Artificial Sequence
  chemically synthesized
agagtctaggcatgagaaga

SEQ ID NO: 71094 - DNA, 20 bp, Artificial Sequence
  chemically synthesized
cagtatccatgactcaaatg

SEQ ID NO: 71095 - DNA, 20 bp, Artificial Sequence
  chemically synthesized
tgaccaaaatacagggtatg

SEQ ID NO: 71096 - DNA, 20 bp, Artificial Sequence
  chemically synthesized
tactcttcatcacagaaagg

SEQ ID NO: 71097 - DNA, 20 bp, Artificial Sequence
  chemically synthesized
cacagaaaggtggggatttt

SEQ ID NO: 71098 - DNA, 20 bp, Artificial Sequence
  chemically synthesized
aaataaaataataccttcac

SEQ ID NO: 71099 - DNA, 20 bp, Artificial Sequence
  chemically synthesized
caggctagtaaatgatcttt

SEQ ID NO: 71100 - DNA, 20 bp, Artificial Sequence
  chemically synthesized
gatctttatctgattagacc

SEQ ID NO: 71101 - DNA, 20 bp, Artificial Sequence
  chemically synthesized
tatctgattagaccaaaaga

SEQ ID NO: 71102 - DNA, 20 bp, Artificial Sequence
  chemically synthesized
tgattagaccaaaagatttt

SEQ ID NO: 71103 - DNA, 20 bp, Artificial Sequence
  chemically synthesized
tgaaatttgcctttctcttt

SEQ ID NO: 71104 - DNA, 20 bp, Artificial Sequence
  chemically synthesized
taatcctgttctttcttccc

SEQ ID NO: 71105 - DNA, 20 bp, Artificial Sequence
  chemically synthesized
gacacatttgactgacaacc

SEQ ID NO: 71106 - DNA, 20 bp, Artificial Sequence
  chemically synthesized
agctgctgagacaaaagaca

SEQ ID NO: 71107 - DNA, 20 bp, Artificial Sequence
  chemically synthesized
cagacctgagagaactctga

SEQ ID NO: 71108 - DNA, 20 bp, Artificial Sequence
  chemically synthesized
tcactgtgtgaagtctgtgc

SEQ ID NO: 71109 - DNA, 20 bp, Artificial Sequence
  chemically synthesized
tcacatcaccaagtgcagca

SEQ ID NO: 71110 - DNA, 20 bp, Artificial Sequence
  chemically synthesized
cccacctccatcgggctcaa

SEQ ID NO: 71111 - DNA, 20 bp, Artificial Sequence
  chemically synthesized
agaatttcagaaagcataga

SEQ ID NO: 71112 - DNA, 20 bp, Artificial Sequence
  chemically synthesized
gaaagcatagagaaagtttg

SEQ ID NO: 71113 - DNA, 20 bp, Artificial Sequence
  chemically synthesized
cattattatagtcaagacga

SEQ ID NO: 71114 - DNA, 20 bp, Artificial Sequence
  chemically synthesized
aaacatctccagccttgaag

SEQ ID NO: 71115 - DNA, 20 bp, Artificial Sequence
  chemically synthesized
taagtttcataaggaaactg

SEQ ID NO: 71116 - DNA, 20 bp, Artificial Sequence
  chemically synthesized
aacattcaaagagcaacacc

SEQ ID NO: 71117 - DNA, 20 bp, Artificial Sequence
  chemically synthesized
aaagatgtcctcatggccta

SEQ ID NO: 71118 - DNA, 20 bp, Artificial Sequence
  chemically synthesized
agttcaagtgaaacactagc

SEQ ID NO: 71119 - DNA, 20 bp, Artificial Sequence
  chemically synthesized
ccacaaatcatctgtaaaag

SEQ ID NO: 71120 - DNA, 20 bp, Artificial Sequence
  chemically synthesized
aggatcaatgtaatgccctg

SEQ ID NO: 71121 - DNA, 20 bp, Artificial Sequence
  chemically synthesized
actttgacaagttgagagaa

SEQ ID NO: 71122 - DNA, 20 bp, Artificial Sequence
  chemically synthesized
atgaatgcacaagactcagt

SEQ ID NO: 71123 - DNA, 20 bp, Artificial Sequence
  chemically synthesized
gaatgaaatgaagcaagaag

SEQ ID NO: 71124 - DNA, 20 bp, Artificial Sequence
  chemically synthesized
tgtgaaaagaccaaatctat

SEQ ID NO: 71125 - DNA, 20 bp, Artificial Sequence
  chemically synthesized
caactacaaggcacataatt

SEQ ID NO: 71126 - DNA, 20 bp, Artificial Sequence
  chemically synthesized
gaatttcatatccagccaaa

SEQ ID NO: 71127 - DNA, 20 bp, Artificial Sequence
  chemically synthesized
tttacagacaagcaaatgct

SEQ ID NO: 71128 - DNA, 20 bp, Artificial Sequence
  chemically synthesized
caatcctcatctctgataaa

SEQ ID NO: 71129 - DNA, 20 bp, Artificial Sequence
  chemically synthesized
cagtgcaatcaaactagaac

SEQ ID NO: 71130 - DNA, 20 bp, Artificial Sequence
  chemically synthesized
aaaaatcaatgaatccagaa

SEQ ID NO: 71131 - DNA, 20 bp, Artificial Sequence
  chemically synthesized
ctgaaattgaggcaataatt

SEQ ID NO: 71132 - DNA, 20 bp, Artificial Sequence
  chemically synthesized
gcaaatccagcagcacatcc

SEQ ID NO: 71133 - DNA, 20 bp, Artificial Sequence
  chemically synthesized
agcttatccaccatgatcaa

SEQ ID NO: 71134 - DNA, 20 bp, Artificial Sequence
  chemically synthesized
cagaaccaaagacaaaaacc

SEQ ID NO: 71135 - DNA, 20 bp, Artificial Sequence
  chemically synthesized
aaaagaggaagtcaaattgt

SEQ ID NO: 71136 - DNA, 20 bp, Artificial Sequence
  chemically synthesized
attgtccctgtttgcagatg

SEQ ID NO: 71137 - DNA, 20 bp, Artificial Sequence
  chemically synthesized
atgagggaactcccattcac

SEQ ID NO: 71138 - DNA, 20 bp, Artificial Sequence
  chemically synthesized
ccatacagcccaaggtaatt

SEQ ID NO: 71139 - DNA, 20 bp, Artificial Sequence
  chemically synthesized
gacaaaaaaaacaaatgggg

SEQ ID NO: 71140 - DNA, 20 bp, Artificial Sequence
  chemically synthesized
ttatacaaaaattaattcaa

SEQ ID NO: 71141 - DNA, 20 bp, Artificial Sequence
  chemically synthesized
aatgggatctaattaaacta

SEQ ID NO: 71142 - DNA, 20 bp, Artificial Sequence
  chemically synthesized
aaccattgtggaagtcagtg

SEQ ID NO: 71143 - DNA, 20 bp, Artificial Sequence
  chemically synthesized
ccattactgggtacatactc

SEQ ID NO: 71144 - DNA, 20 bp, Artificial Sequence
  chemically synthesized
ctataaagacacatgcacat

SEQ ID NO: 71145 - DNA, 20 bp, Artificial Sequence
  chemically synthesized
caaatgtccaacaatgatag

SEQ ID NO: 71146 - DNA, 20 bp, Artificial Sequence
  chemically synthesized
ttttcttttctacccctatg

SEQ ID NO: 71147 - DNA, 20 bp, Artificial Sequence
  chemically synthesized
gagaggagtgggccgtaggg

SEQ ID NO: 71148 - DNA, 20 bp, Artificial Sequence
  chemically synthesized
tttctgaaactaattttctt

SEQ ID NO: 71149 - DNA, 20 bp, Artificial Sequence
  chemically synthesized
gaaactaattttctttgcag

SEQ ID NO: 71150 - DNA, 20 bp, Artificial Sequence
  chemically synthesized
tgttggatccaatatcttga

SEQ ID NO: 71151 - DNA, 20 bp, Artificial Sequence
  chemically synthesized
ataggaatgagcagtagacg

SEQ ID NO: 71152 - DNA, 20 bp, Artificial Sequence
  chemically synthesized
gcagtagacggttggcttat

SEQ ID NO: 71153 - DNA, 20 bp, Artificial Sequence
  chemically synthesized
actccctaaaatctttagaa

SEQ ID NO: 71154 - DNA, 20 bp, Artificial Sequence
  chemically synthesized
tctctggtgtagttccagac

SEQ ID NO: 71155 - DNA, 20 bp, Artificial Sequence
  chemically synthesized
ggtgtagttccagactctgg

SEQ ID NO: 71156 - DNA, 20 bp, Artificial Sequence
  chemically synthesized
gctctcttcgggctgcataa

SEQ ID NO: 71157 - DNA, 20 bp, Artificial Sequence
  chemically synthesized
acagaaagaaaaacttacca

SEQ ID NO: 71158 - DNA, 20 bp, Artificial Sequence
  chemically synthesized
aacttaccaaatagattagt

SEQ ID NO: 71159 - DNA, 20 bp, Artificial Sequence
  chemically synthesized
gcaaactttgacatgaggca

SEQ ID NO: 71160 - DNA, 20 bp, Artificial Sequence
  chemically synthesized
ccttataaaccaaagtcaga

SEQ ID NO: 71161 - DNA, 20 bp, Artificial Sequence
  chemically synthesized
ccatgctgagctatcagcac

SEQ ID NO: 71162 - DNA, 20 bp, Artificial Sequence
  chemically synthesized
atagagagtgatagtggatc

SEQ ID NO: 71163 - DNA, 20 bp, Artificial Sequence
  chemically synthesized
ggatgggagtagataaggaa

SEQ ID NO: 71164 - DNA, 20 bp, Artificial Sequence
  chemically synthesized
acccagatgaaaatggtgct

SEQ ID NO: 71165 - DNA, 20 bp, Artificial Sequence
  chemically synthesized
tgtagatcagatgatcagtc

SEQ ID NO: 71166 - DNA, 20 bp, Artificial Sequence
  chemically synthesized
tgagccttataatgagaatg

SEQ ID NO: 71167 - DNA, 20 bp, Artificial Sequence
  chemically synthesized
aagtcttctggtggcagagt

SEQ ID NO: 71168 - DNA, 20 bp, Artificial Sequence
  chemically synthesized
caacccagctgtcttccccc

SEQ ID NO: 71169 - DNA, 20 bp, Artificial Sequence
  chemically synthesized
tgtcttcccccatctgattg

SEQ ID NO: 71170 - DNA, 20 bp, Artificial Sequence
  chemically synthesized
atgttcttcaccacctggtt

SEQ ID NO: 71171 - DNA, 20 bp, Artificial Sequence
  chemically synthesized
ccttggtggcctcactcttc

SEQ ID NO: 71172 - DNA, 20 bp, Artificial Sequence
  chemically synthesized
gtgcccaagagtaacaacca

SEQ ID NO: 71173 - DNA, 20 bp, Artificial Sequence
  chemically synthesized
accaggtggcttcactgaat

SEQ ID NO: 71174 - DNA, 20 bp, Artificial Sequence
  chemically synthesized
tgaatccctgcttttgtaaa

SEQ ID NO: 71175 - DNA, 20 bp, Artificial Sequence
  chemically synthesized
attgctggaagtgtcccgcc

SEQ ID NO: 71176 - DNA, 20 bp, Artificial Sequence
  chemically synthesized
aagaaataatagaagttagg

SEQ ID NO: 71177 - DNA, 20 bp, Artificial Sequence
  chemically synthesized
agtggcattcctccatgaga

SEQ ID NO: 71178 - DNA, 20 bp, Artificial Sequence
  chemically synthesized
ccctgagtgtcttcaaaact

SEQ ID NO: 71179 - DNA, 20 bp, Artificial Sequence
  chemically synthesized
aactcaaagttttacgaaca

SEQ ID NO: 71180 - DNA, 20 bp, Artificial Sequence
  chemically synthesized
tttcatcaatacaggatctc

SEQ ID NO: 71181 - DNA, 20 bp, Artificial Sequence
  chemically synthesized
cacaccggtgagtggacaga

SEQ ID NO: 71182 - DNA, 20 bp, Artificial Sequence
  chemically synthesized
tgatgcagcagtattggaat

SEQ ID NO: 71183 - DNA, 20 bp, Artificial Sequence
  chemically synthesized
gtattggaattacagttttt

SEQ ID NO: 71184 - DNA, 20 bp, Artificial Sequence
  chemically synthesized
gaattacagttttttttggt

SEQ ID NO: 71185 - DNA, 20 bp, Artificial Sequence
  chemically synthesized
tattaaaccaagcacagata

SEQ ID NO: 71186 - DNA, 20 bp, Artificial Sequence
  chemically synthesized
gcagaaagaagatatattga

SEQ ID NO: 71187 - DNA, 20 bp, Artificial Sequence
  chemically synthesized
gatttttctcatagatacta

SEQ ID NO: 71188 - DNA, 20 bp, Artificial Sequence
  chemically synthesized
aacaactctgccatttggcc

SEQ ID NO: 71189 - DNA, 20 bp, Artificial Sequence
  chemically synthesized
tctgccatttggccatttgc

SEQ ID NO: 71190 - DNA, 20 bp, Artificial Sequence
  chemically synthesized
gcgggaaagtagcattttca

SEQ ID NO: 71191 - DNA, 20 bp, Artificial Sequence
  chemically synthesized
acccatttctgtaaaggagg

SEQ ID NO: 71192 - DNA, 20 bp, Artificial Sequence
  chemically synthesized
agaatgcctgggctggagaa

SEQ ID NO: 71193 - DNA, 20 bp, Artificial Sequence
  chemically synthesized
gggcttcacaacagtgtagt

SEQ ID NO: 71194 - DNA, 20 bp, Artificial Sequence
  chemically synthesized
attctccatggttgcaataa

SEQ ID NO: 71195 - DNA, 20 bp, Artificial Sequence
  chemically synthesized
atggttgcaataaggtcgat

SEQ ID NO: 71196 - DNA, 20 bp, Artificial Sequence
  chemically synthesized
aaaagctcatctagctatga

SEQ ID NO: 71197 - DNA, 20 bp, Artificial Sequence
  chemically synthesized
acaaagtttgacatagttag

SEQ ID NO: 71198 - DNA, 20 bp, Artificial Sequence
  chemically synthesized
aggtcatggtaaggctatga

SEQ ID NO: 71199 - DNA, 20 bp, Artificial Sequence
  chemically synthesized
gatatgagagctgcacatct

SEQ ID NO: 71200 - DNA, 20 bp, Artificial Sequence
  chemically synthesized
gactataaattcaactacat

SEQ ID NO: 71201 - DNA, 20 bp, Artificial Sequence
  chemically synthesized
ctacatgccagctttaagca

SEQ ID NO: 71202 - DNA, 20 bp, Artificial Sequence
  chemically synthesized
cacagtgctttgaagagagt

SEQ ID NO: 71203 - DNA, 20 bp, Artificial Sequence
  chemically synthesized
tcatgtgcatctctgaatat

SEQ ID NO: 71204 - DNA, 20 bp, Artificial Sequence
  chemically synthesized
cactctaaggcagccctcta

SEQ ID NO: 71205 - DNA, 20 bp, Artificial Sequence
  chemically synthesized
caaagtgaatgatcaaagtc

SEQ ID NO: 71206 - DNA, 20 bp, Artificial Sequence
  chemically synthesized
acaggactttgttacctttc

SEQ ID NO: 71207 - DNA, 20 bp, Artificial Sequence
  chemically synthesized
attggtgaatttccatttaa

SEQ ID NO: 71208 - DNA, 20 bp, Artificial Sequence
  chemically synthesized
ccatttaatatagttttatt

SEQ ID NO: 71209 - DNA, 20 bp, Artificial Sequence
  chemically synthesized
agtaaataatttttaatcat

SEQ ID NO: 71210 - DNA, 20 bp, Artificial Sequence
  chemically synthesized
tgaagtaacagaaggctaca

SEQ ID NO: 71211 - DNA, 20 bp, Artificial Sequence
  chemically synthesized
tacaaggggatttctcaagt

SEQ ID NO: 71212 - DNA, 20 bp, Artificial Sequence
  chemically synthesized
aaaaccaaatgtgtcaataa

SEQ ID NO: 71213 - DNA, 20 bp, Artificial Sequence
  chemically synthesized
taataaccttgaattcaagt

SEQ ID NO: 71214 - DNA, 20 bp, Artificial Sequence
  chemically synthesized
ttagagtgtagggctggcaa

SEQ ID NO: 71215 - DNA, 20 bp, Artificial Sequence
  chemically synthesized
cagtgttattagaataccac

SEQ ID NO: 71216 - DNA, 20 bp, Artificial Sequence
  chemically synthesized
aggatatggctgtactacct

SEQ ID NO: 71217 - DNA, 20 bp, Artificial Sequence
  chemically synthesized
attatcgagatgcacatgac

SEQ ID NO: 71218 - DNA, 20 bp, Artificial Sequence
  chemically synthesized
gaggccctaatgagaaacat

SEQ ID NO: 71219 - DNA, 20 bp, Artificial Sequence
  chemically synthesized
taattatttaaaaaatagat

SEQ ID NO: 71220 - DNA, 20 bp, Artificial Sequence
  chemically synthesized
cacattgtctagcacattat

SEQ ID NO: 71221 - DNA, 20 bp, Artificial Sequence
  chemically synthesized
attatagatgcttagtatgt

SEQ ID NO: 71222 - DNA, 20 bp, Artificial Sequence
  chemically synthesized
gtgctggcttgatgacagga

SEQ ID NO: 71223 - DNA, 20 bp, Artificial Sequence
  chemically synthesized
gctaaccattcttagaggaa

SEQ ID NO: 71224 - DNA, 20 bp, Artificial Sequence
  chemically synthesized
atggagcagccaggtaatca

SEQ ID NO: 71225 - DNA, 20 bp, Artificial Sequence
  chemically synthesized
aatggaagagttgctgaggg

SEQ ID NO: 71226 - DNA, 20 bp, Artificial Sequence
  chemically synthesized
acaggaggctgaggtaggag

SEQ ID NO: 71227 - DNA, 20 bp, Artificial Sequence
  chemically synthesized
aaggaaatcagggtattcac

SEQ ID NO: 71228 - DNA, 20 bp, Artificial Sequence
  chemically synthesized
aaaaattaaaatttgggaaa

SEQ ID NO: 71229 - DNA, 20 bp, Artificial Sequence
  chemically synthesized
tctgtgcaatgcaggactgg

SEQ ID NO: 71230 - DNA, 20 bp, Artificial Sequence
  chemically synthesized
aaggtttaggcaggggtgct

SEQ ID NO: 71231 - DNA, 20 bp, Artificial Sequence
  chemically synthesized
gattcatgagacaacaggca

SEQ ID NO: 71232 - DNA, 20 bp, Artificial Sequence
  chemically synthesized
gtctcctaacattcccctcc

SEQ ID NO: 71233 - DNA, 20 bp, Artificial Sequence
  chemically synthesized
attcccctcccaaagtttga

SEQ ID NO: 71234 - DNA, 20 bp, Artificial Sequence
  chemically synthesized
tgcaaagccacttagtgaca

SEQ ID NO: 71235 - DNA, 20 bp, Artificial Sequence
  chemically synthesized
tggaataaaatcattttgaa

SEQ ID NO: 71236 - DNA, 20 bp, Artificial Sequence
  chemically synthesized
ccagaccctaagagagggtt

SEQ ID NO: 71237 - DNA, 20 bp, Artificial Sequence
  chemically synthesized
tgatgatatgctaaacaagg

SEQ ID NO: 71238 - DNA, 20 bp, Artificial Sequence
  chemically synthesized
attcatgcctccccttttca

SEQ ID NO: 71239 - DNA, 20 bp, Artificial Sequence
  chemically synthesized
gaggtcactctcatcacaat

SEQ ID NO: 71240 - DNA, 20 bp, Artificial Sequence
  chemically synthesized
ctcatcacaatcttggtttg

SEQ ID NO: 71241 - DNA, 20 bp, Artificial Sequence
  chemically synthesized
tcttggtttggtgggtttca

SEQ ID NO: 71242 - DNA, 20 bp, Artificial Sequence
  chemically synthesized
cagccagcttctttactgca

SEQ ID NO: 71243 - DNA, 20 bp, Artificial Sequence
  chemically synthesized
tctgacaaaaggaacaaaaa

SEQ ID NO: 71244 - DNA, 20 bp, Artificial Sequence
  chemically synthesized
aaaaatgtattttttttcac

SEQ ID NO: 71245 - DNA, 20 bp, Artificial Sequence
  chemically synthesized
ctatatctatttttatgtcc

SEQ ID NO: 71246 - DNA, 20 bp, Artificial Sequence
  chemically synthesized
gcattttcctatccttactc

SEQ ID NO: 71247 - DNA, 20 bp, Artificial Sequence
  chemically synthesized
gtgaggaatcagacattctt

SEQ ID NO: 71248 - DNA, 20 bp, Artificial Sequence
  chemically synthesized
tcttacaccccacaactaac

SEQ ID NO: 71249 - DNA, 20 bp, Artificial Sequence
  chemically synthesized
gctcactcagaactctcttt

SEQ ID NO: 71250 - DNA, 20 bp, Artificial Sequence
  chemically synthesized
ctttgttttttcctctgcca

SEQ ID NO: 71251 - DNA, 20 bp, Artificial Sequence
  chemically synthesized
aaaatcctgttaagtgttct

SEQ ID NO: 71252 - DNA, 20 bp, Artificial Sequence
  chemically synthesized
tctgtaggcttcttgaaacc

SEQ ID NO: 71253 - DNA, 20 bp, Artificial Sequence
  chemically synthesized
gcttcttgaaacctattgtt

SEQ ID NO: 71254 - DNA, 20 bp, Artificial Sequence
  chemically synthesized
ttcttcatacagtcttatgc

SEQ ID NO: 71255 - DNA, 20 bp, Artificial Sequence
  chemically synthesized
tgcagtagttttgggaatta

SEQ ID NO: 71256 - DNA, 20 bp, Artificial Sequence
  chemically synthesized
tagttttgggaattaaacag

SEQ ID NO: 71257 - DNA, 20 bp, Artificial Sequence
  chemically synthesized
tagcaaagcaatttatcttt

SEQ ID NO: 71258 - DNA, 20 bp, Artificial Sequence
  chemically synthesized
cccacatggttgaattattt

SEQ ID NO: 71259 - DNA, 20 bp, Artificial Sequence
  chemically synthesized
gatattctaacataaagact

SEQ ID NO: 71260 - DNA, 20 bp, Artificial Sequence
  chemically synthesized
gtgagaaagcagagcatagt

SEQ ID NO: 71261 - DNA, 20 bp, Artificial Sequence
  chemically synthesized
aagcagagcatagtagaggt

SEQ ID NO: 71262 - DNA, 20 bp, Artificial Sequence
  chemically synthesized
tatctgtcaagagcaaaatt

SEQ ID NO: 71263 - DNA, 20 bp, Artificial Sequence
  chemically synthesized
acattgagttactcaaaata

SEQ ID NO: 71264 - DNA, 20 bp, Artificial Sequence
  chemically synthesized
aacctcagcataggccttct

SEQ ID NO: 71265 - DNA, 20 bp, Artificial Sequence
  chemically synthesized
taggccttctgaaagcttac

SEQ ID NO: 71266 - DNA, 20 bp, Artificial Sequence
  chemically synthesized
tggaatttacaccattctta

SEQ ID NO: 71267 - DNA, 20 bp, Artificial Sequence
  chemically synthesized
ccattcttatgtggattaag

SEQ ID NO: 71268 - DNA, 20 bp, Artificial Sequence
  chemically synthesized
aggaactttttctttccgga

SEQ ID NO: 71269 - DNA, 20 bp, Artificial Sequence
  chemically synthesized
tttccggatcatgcttacag

SEQ ID NO: 71270 - DNA, 20 bp, Artificial Sequence
  chemically synthesized
agccaactagatgtggacaa

SEQ ID NO: 71271 - DNA, 20 bp, Artificial Sequence
  chemically synthesized
acacatataacctgagtccc

SEQ ID NO: 71272 - DNA, 20 bp, Artificial Sequence
  chemically synthesized
tggggtagtagaaacaaagt

SEQ ID NO: 71273 - DNA, 20 bp, Artificial Sequence
  chemically synthesized
tgatgccacactaaaatcag

SEQ ID NO: 71274 - DNA, 20 bp, Artificial Sequence
  chemically synthesized
ttgttaaaagtgatgacctc

SEQ ID NO: 71275 - DNA, 20 bp, Artificial Sequence
  chemically synthesized
aagaaagggaagacattttc

SEQ ID NO: 71276 - DNA, 20 bp, Artificial Sequence
  chemically synthesized
caaggaaaggcagtggggaa

SEQ ID NO: 71277 - DNA, 20 bp, Artificial Sequence
  chemically synthesized
acaaacctctcctgccatct

SEQ ID NO: 71278 - DNA, 20 bp, Artificial Sequence
  chemically synthesized
tggtttgtacagcatgtgca

SEQ ID NO: 71279 - DNA, 20 bp, Artificial Sequence
  chemically synthesized
ttatagtaaatcctaaagtt

SEQ ID NO: 71280 - DNA, 20 bp, Artificial Sequence
  chemically synthesized
aatcctaaagttgaaggttt

SEQ ID NO: 71281 - DNA, 20 bp, Artificial Sequence
  chemically synthesized
gtatcttttatgctgactgt

SEQ ID NO: 71282 - DNA, 20 bp, Artificial Sequence
  chemically synthesized
ttctccctttctcactcttt

SEQ ID NO: 71283 - DNA, 20 bp, Artificial Sequence
  chemically synthesized
acatttatttaacaagcggt

SEQ ID NO: 71284 - DNA, 20 bp, Artificial Sequence
  chemically synthesized
ttaacaagcggtcattgttt

SEQ ID NO: 71285 - DNA, 20 bp, Artificial Sequence
  chemically synthesized
caagcggtcattgtttagtt

SEQ ID NO: 71286 - DNA, 20 bp, Artificial Sequence
  chemically synthesized
agttgtttgtttatctaatg

SEQ ID NO: 71287 - DNA, 20 bp, Artificial Sequence
  chemically synthesized
gcatatattctctgttccta

SEQ ID NO: 71288 - DNA, 20 bp, Artificial Sequence
  chemically synthesized
acttcaggaaaaagacttac

SEQ ID NO: 71289 - DNA, 20 bp, Artificial Sequence
  chemically synthesized
gattggggctacccaaaggg

SEQ ID NO: 71290 - DNA, 20 bp, Artificial Sequence
  chemically synthesized
gataatttgagtgataaaaa

SEQ ID NO: 71291 - DNA, 20 bp, Artificial Sequence
  chemically synthesized
accaccatggatattgaagt

SEQ ID NO: 71292 - DNA, 20 bp, Artificial Sequence
  chemically synthesized
catggatattgaagtaaggg

SEQ ID NO: 71293 - DNA, 20 bp, Artificial Sequence
  chemically synthesized
agaaagtccatagcacattc

SEQ ID NO: 71294 - DNA, 20 bp, Artificial Sequence
  chemically synthesized
cattatatccaaagggttac

SEQ ID NO: 71295 - DNA, 20 bp, Artificial Sequence
  chemically synthesized
aattaggaaacagaaatttg

SEQ ID NO: 71296 - DNA, 20 bp, Artificial Sequence
  chemically synthesized
aaatttgacttgcttcagat

SEQ ID NO: 71297 - DNA, 20 bp, Artificial Sequence
  chemically synthesized
aaatattttatctgaaacaa

SEQ ID NO: 71298 - DNA, 20 bp, Artificial Sequence
  chemically synthesized
ggatatatgtgtacatagtg

SEQ ID NO: 71299 - DNA, 20 bp, Artificial Sequence
  chemically synthesized
caacaccttccatagatacc

SEQ ID NO: 71300 - DNA, 20 bp, Artificial Sequence
  chemically synthesized
ctaacatctactgtcataac

SEQ ID NO: 71301 - DNA, 20 bp, Artificial Sequence
  chemically synthesized
atctactgtcataacaaatg

SEQ ID NO: 71302 - DNA, 20 bp, Artificial Sequence
  chemically synthesized
cttatttatcctatacagct

SEQ ID NO: 71303 - DNA, 20 bp, Artificial Sequence
  chemically synthesized
tttctttcttccccttttta

SEQ ID NO: 71304 - DNA, 20 bp, Artificial Sequence
  chemically synthesized
catttgaccttatttttctt

SEQ ID NO: 71305 - DNA, 20 bp, Artificial Sequence
  chemically synthesized
ataagtaatatcatgccttt

SEQ ID NO: 71306 - DNA, 20 bp, Artificial Sequence
  chemically synthesized
tgcctttatttgtttctgtg

SEQ ID NO: 71307 - DNA, 20 bp, Artificial Sequence
  chemically synthesized
ttcacttagcaaaatgtact

SEQ ID NO: 71308 - DNA, 20 bp, Artificial Sequence
  chemically synthesized
tcatctatatatagatacca

SEQ ID NO: 71309 - DNA, 20 bp, Artificial Sequence
  chemically synthesized
ctatatatagataccactta

SEQ ID NO: 71310 - DNA, 20 bp, Artificial Sequence
  chemically synthesized
gtgcagatagctctagaaaa

SEQ ID NO: 71311 - DNA, 20 bp, Artificial Sequence
  chemically synthesized
catacaataactctattttt

SEQ ID NO: 71312 - DNA, 20 bp, Artificial Sequence
  chemically synthesized
tagttgtttgagaaacttcc

SEQ ID NO: 71313 - DNA, 20 bp, Artificial Sequence
  chemically synthesized
caacaggtgtgagtgatact

SEQ ID NO: 71314 - DNA, 20 bp, Artificial Sequence
  chemically synthesized
ggtgtgagtgatacttgtgg

SEQ ID NO: 71315 - DNA, 20 bp, Artificial Sequence
  chemically synthesized
ggttttgatttgcattttcc

SEQ ID NO: 71316 - DNA, 20 bp, Artificial Sequence
  chemically synthesized
tattatattttttcatattt

SEQ ID NO: 71317 - DNA, 20 bp, Artificial Sequence
  chemically synthesized
ttctcccaaactgttccttt

SEQ ID NO: 71318 - DNA, 20 bp, Artificial Sequence
  chemically synthesized
cccaaactgttccttttgat

SEQ ID NO: 71319 - DNA, 20 bp, Artificial Sequence
  chemically synthesized
tctttgctgtgcagaaaata

SEQ ID NO: 71320 - DNA, 20 bp, Artificial Sequence
  chemically synthesized
atttagtttgatgttgctcc

SEQ ID NO: 71321 - DNA, 20 bp, Artificial Sequence
  chemically synthesized
atgttgctccacttgtttat

SEQ ID NO: 71322 - DNA, 20 bp, Artificial Sequence
  chemically synthesized
caacttgatggcagcacacg

SEQ ID NO: 71323 - DNA, 20 bp, Artificial Sequence
  chemically synthesized
taagccataagtcaactcaa

SEQ ID NO: 71324 - DNA, 20 bp, Artificial Sequence
  chemically synthesized
ggaagaacatgtatagagat

SEQ ID NO: 71325 - DNA, 20 bp, Artificial Sequence
  chemically synthesized
cggcaattttttagatattg

SEQ ID NO: 71326 - DNA, 20 bp, Artificial Sequence
  chemically synthesized
tttcactggaagtctatatt

SEQ ID NO: 71327 - DNA, 20 bp, Artificial Sequence
  chemically synthesized
ttttctttcacaaataaagt

SEQ ID NO: 71328 - DNA, 20 bp, Artificial Sequence
  chemically synthesized
gcgtgaacaacacagaagac

SEQ ID NO: 71329 - DNA, 20 bp, Artificial Sequence
  chemically synthesized
gggccactcccacccgaata

SEQ ID NO: 71330 - DNA, 20 bp, Artificial Sequence
  chemically synthesized
ccgaatactgtgcttttctg

SEQ ID NO: 71331 - DNA, 20 bp, Artificial Sequence
  chemically synthesized
ggcttaggaaatggcgcacc

SEQ ID NO: 71332 - DNA, 20 bp, Artificial Sequence
  chemically synthesized
gtcctacgcccacggagtct

SEQ ID NO: 71333 - DNA, 20 bp, Artificial Sequence
  chemically synthesized
ggaggggcagccgccattgc

SEQ ID NO: 71334 - DNA, 20 bp, Artificial Sequence
  chemically synthesized
gggcagccgccattgcccag

SEQ ID NO: 71335 - DNA, 20 bp, Artificial Sequence
  chemically synthesized
agacttaaatgtccctgtct

SEQ ID NO: 71336 - DNA, 20 bp, Artificial Sequence
  chemically synthesized
ctagaataaccaatacagag

SEQ ID NO: 71337 - DNA, 20 bp, Artificial Sequence
  chemically synthesized
aaatgaaatgaagcgagaag

SEQ ID NO: 71338 - DNA, 20 bp, Artificial Sequence
  chemically synthesized
tgtgaaaagatcaaatctag

SEQ ID NO: 71339 - DNA, 20 bp, Artificial Sequence
  chemically synthesized
tctagcaaggcaggccaaca

SEQ ID NO: 71340 - DNA, 20 bp, Artificial Sequence
  chemically synthesized
caactccaagacacataatt

SEQ ID NO: 71341 - DNA, 20 bp, Artificial Sequence
  chemically synthesized
gaatttaatatccagccaaa

SEQ ID NO: 71342 - DNA, 20 bp, Artificial Sequence
  chemically synthesized
tttacagacaagcaaatgct

SEQ ID NO: 71343 - DNA, 20 bp, Artificial Sequence
  chemically synthesized
caatcctagtctctgataaa

SEQ ID NO: 71344 - DNA, 20 bp, Artificial Sequence
  chemically synthesized
atgcacccaatacaggagca

SEQ ID NO: 71345 - DNA, 20 bp, Artificial Sequence
  chemically synthesized
cagtgcaatcaaactagaac

SEQ ID NO: 71346 - DNA, 20 bp, Artificial Sequence
  chemically synthesized
aaaaattaatgaatctggga

SEQ ID NO: 71347 - DNA, 20 bp, Artificial Sequence
  chemically synthesized
ctgaaattgtggcaataatc

SEQ ID NO: 71348 - DNA, 20 bp, Artificial Sequence
  chemically synthesized
ccaaaaagagtccaggacca

SEQ ID NO: 71349 - DNA, 20 bp, Artificial Sequence
  chemically synthesized
ccgaatccagcagcacatca

SEQ ID NO: 71350 - DNA, 20 bp, Artificial Sequence
  chemically synthesized
cagaaccaaagacaaaaacc

SEQ ID NO: 71351 - DNA, 20 bp, Artificial Sequence
  chemically synthesized
aaaagaggaagtcaaattgt

SEQ ID NO: 71352 - DNA, 20 bp, Artificial Sequence
  chemically synthesized
attgtccctgtttgcagacg

SEQ ID NO: 71353 - DNA, 20 bp, Artificial Sequence
  chemically synthesized
atgagggaactcccattcac

SEQ ID NO: 71354 - DNA, 20 bp, Artificial Sequence
  chemically synthesized
caaacaaatggaagaacatt

SEQ ID NO: 71355 - DNA, 20 bp, Artificial Sequence
  chemically synthesized
ccataatgcccaaggtaatt

SEQ ID NO: 71356 - DNA, 20 bp, Artificial Sequence
  chemically synthesized
tgccatccccatcaagctac

SEQ ID NO: 71357 - DNA, 20 bp, Artificial Sequence
  chemically synthesized
gagaaaaacaagaaatgggg

SEQ ID NO: 71358 - DNA, 20 bp, Artificial Sequence
  chemically synthesized
ttatacaaaaattaattcaa

SEQ ID NO: 71359 - DNA, 20 bp, Artificial Sequence
  chemically synthesized
aatgggatctaatgaaacta

SEQ ID NO: 71360 - DNA, 20 bp, Artificial Sequence
  chemically synthesized
aaccattgtggaagtcagtg

SEQ ID NO: 71361 - DNA, 20 bp, Artificial Sequence
  chemically synthesized
ctataaagacacatgcacac

SEQ ID NO: 71362 - DNA, 20 bp, Artificial Sequence
  chemically synthesized
caaatgtccaacaatgatag

SEQ ID NO: 71363 - DNA, 20 bp, Artificial Sequence
  chemically synthesized
aaaaaaataaaaaataaagt

SEQ ID NO: 71364 - DNA, 20 bp, Artificial Sequence
  chemically synthesized
taaagttccagtttattttt

SEQ ID NO: 71365 - DNA, 20 bp, Artificial Sequence
  chemically synthesized
agtttattttttcaggtttc

SEQ ID NO: 71366 - DNA, 20 bp, Artificial Sequence
  chemically synthesized
tgcaatgtgtctttttctat

SEQ ID NO: 71367 - DNA, 20 bp, Artificial Sequence
  chemically synthesized
gtctttttctatgtctgctt

SEQ ID NO: 71368 - DNA, 20 bp, Artificial Sequence
  chemically synthesized
ttttaagattggcatacatt

SEQ ID NO: 71369 - DNA, 20 bp, Artificial Sequence
  chemically synthesized
tttgtaagatatgcatttag

SEQ ID NO: 71370 - DNA, 20 bp, Artificial Sequence
  chemically synthesized
gttagctaaagatatgaatt

SEQ ID NO: 71371 - DNA, 20 bp, Artificial Sequence
  chemically synthesized
tcagtcaataattcctcaaa

SEQ ID NO: 71372 - DNA, 20 bp, Artificial Sequence
  chemically synthesized
caaaaaacgtttaatccatt

SEQ ID NO: 71373 - DNA, 20 bp, Artificial Sequence
  chemically synthesized
ttctaatttcacatatggtg

SEQ ID NO: 71374 - DNA, 20 bp, Artificial Sequence
  chemically synthesized
gcttgatactttcccatgag

SEQ ID NO: 71375 - DNA, 20 bp, Artificial Sequence
  chemically synthesized
tttcccatgagtctggcttt

SEQ ID NO: 71376 - DNA, 20 bp, Artificial Sequence
  chemically synthesized
cttgcatgcacttgctcttt

SEQ ID NO: 71377 - DNA, 20 bp, Artificial Sequence
  chemically synthesized
tgctctttgtctgctttctg

SEQ ID NO: 71378 - DNA, 20 bp, Artificial Sequence
  chemically synthesized
aacttggagtggggagaaga

SEQ ID NO: 71379 - DNA, 20 bp, Artificial Sequence
  chemically synthesized
tcccaaaaggggtctctctg

SEQ ID NO: 71380 - DNA, 20 bp, Artificial Sequence
  chemically synthesized
aggtaggatgttacgaaaga

SEQ ID NO: 71381 - DNA, 20 bp, Artificial Sequence
  chemically synthesized
gacattgagaaccctgtgag

SEQ ID NO: 71382 - DNA, 20 bp, Artificial Sequence
  chemically synthesized
tgagtaaggattttatttag

SEQ ID NO: 71383 - DNA, 20 bp, Artificial Sequence
  chemically synthesized
aggtctgtttctggtcagag

SEQ ID NO: 71384 - DNA, 20 bp, Artificial Sequence
  chemically synthesized
ttctggtcagagtggggatt

SEQ ID NO: 71385 - DNA, 20 bp, Artificial Sequence
  chemically synthesized
ggggatttaaggcttggtca

SEQ ID NO: 71386 - DNA, 20 bp, Artificial Sequence
  chemically synthesized
ttaagactaaaggccacaca

SEQ ID NO: 71387 - DNA, 20 bp, Artificial Sequence
  chemically synthesized
ggccacacacatagatttgt

SEQ ID NO: 71388 - DNA, 20 bp, Artificial Sequence
  chemically synthesized
acctatctctctccatcaat

SEQ ID NO: 71389 - DNA, 20 bp, Artificial Sequence
  chemically synthesized
ctccatcaattttagttttt

SEQ ID NO: 71390 - DNA, 20 bp, Artificial Sequence
  chemically synthesized
aaaggaagaatgaactggtt

SEQ ID NO: 71391 - DNA, 20 bp, Artificial Sequence
  chemically synthesized
cacagcatgtgtacagacct

SEQ ID NO: 71392 - DNA, 20 bp, Artificial Sequence
  chemically synthesized
ttatactggccccttgaaag

SEQ ID NO: 71393 - DNA, 20 bp, Artificial Sequence
  chemically synthesized
ctctctctctgtcgctcgct

SEQ ID NO: 71394 - DNA, 20 bp, Artificial Sequence
  chemically synthesized
tgacacttttcacttttagt

SEQ ID NO: 71395 - DNA, 20 bp, Artificial Sequence
  chemically synthesized
ttttcacttttagtaatgga

SEQ ID NO: 71396 - DNA, 20 bp, Artificial Sequence
  chemically synthesized
attcacttcacctaatattc

SEQ ID NO: 71397 - DNA, 20 bp, Artificial Sequence
  chemically synthesized
catcatcctcctcttggcct

SEQ ID NO: 71398 - DNA, 20 bp, Artificial Sequence
  chemically synthesized
atctaacatctttactcaat

SEQ ID NO: 71399 - DNA, 20 bp, Artificial Sequence
  chemically synthesized
tctatcttcaagttcttgat

SEQ ID NO: 71400 - DNA, 20 bp, Artificial Sequence
  chemically synthesized
acgtcaatgaaaattgatga

SEQ ID NO: 71401 - DNA, 20 bp, Artificial Sequence
  chemically synthesized
aaaaatgctgagttctttca

SEQ ID NO: 71402 - DNA, 20 bp, Artificial Sequence
  chemically synthesized
atttggttttcaaataaatc

SEQ ID NO: 71403 - DNA, 20 bp, Artificial Sequence
  chemically synthesized
tataaagctattatacagat

SEQ ID NO: 71404 - DNA, 20 bp, Artificial Sequence
  chemically synthesized
gtaggttatccactaaacag

SEQ ID NO: 71405 - DNA, 20 bp, Artificial Sequence
  chemically synthesized
gctccatacaccaaaataac

SEQ ID NO: 71406 - DNA, 20 bp, Artificial Sequence
  chemically synthesized
ttaacaatgtactctggaaa

SEQ ID NO: 71407 - DNA, 20 bp, Artificial Sequence
  chemically synthesized
cccaaccatcaaaatgtgta

SEQ ID NO: 71408 - DNA, 20 bp, Artificial Sequence
  chemically synthesized
gtcttgcccctgcctacctc

SEQ ID NO: 71409 - DNA, 20 bp, Artificial Sequence
  chemically synthesized
acttttcctcacctccatgc

SEQ ID NO: 71410 - DNA, 20 bp, Artificial Sequence
  chemically synthesized
ttctataaagccctatctgt

SEQ ID NO: 71411 - DNA, 20 bp, Artificial Sequence
  chemically synthesized
ctcttacattgcgctaagat

SEQ ID NO: 71412 - DNA, 20 bp, Artificial Sequence
  chemically synthesized
aaatcatgttcttaataaat

SEQ ID NO: 71413 - DNA, 20 bp, Artificial Sequence
  chemically synthesized
taaacttcatgggtctctgt

SEQ ID NO: 71414 - DNA, 20 bp, Artificial Sequence
  chemically synthesized
cctggttttagatctgtatg

SEQ ID NO: 71415 - DNA, 20 bp, Artificial Sequence
  chemically synthesized
cctatttaaaggatgtaata

SEQ ID NO: 71416 - DNA, 20 bp, Artificial Sequence
  chemically synthesized
gccagtctccaagagtgtgt

SEQ ID NO: 71417 - DNA, 20 bp, Artificial Sequence
  chemically synthesized
ttgtggtggagaggttgtgt

SEQ ID NO: 71418 - DNA, 20 bp, Artificial Sequence
  chemically synthesized
tgctaccagaaaagaaggaa

SEQ ID NO: 71419 - DNA, 20 bp, Artificial Sequence
  chemically synthesized
gtgcattcaaagatgaagta

SEQ ID NO: 71420 - DNA, 20 bp, Artificial Sequence
  chemically synthesized
cctgagacactgacctggac

SEQ ID NO: 71421 - DNA, 20 bp, Artificial Sequence
  chemically synthesized
gacctggacatttgtttggg

SEQ ID NO: 71422 - DNA, 20 bp, Artificial Sequence
  chemically synthesized
tttggggtaggattgaatat

SEQ ID NO: 71423 - DNA, 20 bp, Artificial Sequence
  chemically synthesized
gtgagagaatcttgaagtag

SEQ ID NO: 71424 - DNA, 20 bp, Artificial Sequence
  chemically synthesized
tcttgaagtagtggtgattg

SEQ ID NO: 71425 - DNA, 20 bp, Artificial Sequence
  chemically synthesized
atgctaaaaagttagggctc

SEQ ID NO: 71426 - DNA, 20 bp, Artificial Sequence
  chemically synthesized
gagacaggggtggagataaa

SEQ ID NO: 71427 - DNA, 20 bp, Artificial Sequence
  chemically synthesized
ataaagaaagtttcctgccc

SEQ ID NO: 71428 - DNA, 20 bp, Artificial Sequence
  chemically synthesized
gattcccagccctggggacc

SEQ ID NO: 71429 - DNA, 20 bp, Artificial Sequence
  chemically synthesized
tcttcctttggaacctactc

SEQ ID NO: 71430 - DNA, 20 bp, Artificial Sequence
  chemically synthesized
gtctcactactgtcttgtgc

SEQ ID NO: 71431 - DNA, 20 bp, Artificial Sequence
  chemically synthesized
gacatggtctcagttacaat

SEQ ID NO: 71432 - DNA, 20 bp, Artificial Sequence
  chemically synthesized
acaattaaggcttttccccc

SEQ ID NO: 71433 - DNA, 20 bp, Artificial Sequence
  chemically synthesized
tgtttgaatgtccttagcca

SEQ ID NO: 71434 - DNA, 20 bp, Artificial Sequence
  chemically synthesized
cattccctgcactaagccta

SEQ ID NO: 71435 - DNA, 20 bp, Artificial Sequence
  chemically synthesized
gcctaatgggattttttttt

SEQ ID NO: 71436 - DNA, 20 bp, Artificial Sequence
  chemically synthesized
ttttctttgttttcttttgt

SEQ ID NO: 71437 - DNA, 20 bp, Artificial Sequence
  chemically synthesized
gttttcttttgttgttgttt

SEQ ID NO: 71438 - DNA, 20 bp, Artificial Sequence
  chemically synthesized
tttgttgttgtttctttgtt

SEQ ID NO: 71439 - DNA, 20 bp, Artificial Sequence
  chemically synthesized
atagctcactgtaaactcaa

SEQ ID NO: 71440 - DNA, 20 bp, Artificial Sequence
  chemically synthesized
caccttattcttccaagttg

SEQ ID NO: 71441 - DNA, 20 bp, Artificial Sequence
  chemically synthesized
ccatatacagcagtctgggc

SEQ ID NO: 71442 - DNA, 20 bp, Artificial Sequence
  chemically synthesized
tagaaaagaccccatcctca

SEQ ID NO: 71443 - DNA, 20 bp, Artificial Sequence
  chemically synthesized
ctctatcctactaaaaacag

SEQ ID NO: 71444 - DNA, 20 bp, Artificial Sequence
  chemically synthesized
aaaaacaggcatgtttacag

SEQ ID NO: 71445 - DNA, 20 bp, Artificial Sequence
  chemically synthesized
gaataatctggttcaagtcc

SEQ ID NO: 71446 - DNA, 20 bp, Artificial Sequence
  chemically synthesized
ctgctctgagtggactcctc

SEQ ID NO: 71447 - DNA, 20 bp, Artificial Sequence
  chemically synthesized
tcttgctaggagaaatcccc

SEQ ID NO: 71448 - DNA, 20 bp, Artificial Sequence
  chemically synthesized
tcattgtctctgtatagaca

SEQ ID NO: 71449 - DNA, 20 bp, Artificial Sequence
  chemically synthesized
gtactttatttattcaccca

SEQ ID NO: 71450 - DNA, 20 bp, Artificial Sequence
  chemically synthesized
taggttggtgaaaaattaat

SEQ ID NO: 71451 - DNA, 20 bp, Artificial Sequence
  chemically synthesized
aatatctaatatttttgtat

SEQ ID NO: 71452 - DNA, 20 bp, Artificial Sequence
  chemically synthesized
atgctacagaaggaagtcag

SEQ ID NO: 71453 - DNA, 20 bp, Artificial Sequence
  chemically synthesized
ctaagtcttaaaggatccgc

SEQ ID NO: 71454 - DNA, 20 bp, Artificial Sequence
  chemically synthesized
ttactggttggaaaaacagg

SEQ ID NO: 71455 - DNA, 20 bp, Artificial Sequence
  chemically synthesized
ggtgtgttgactgggaaaag

SEQ ID NO: 71456 - DNA, 20 bp, Artificial Sequence
  chemically synthesized
gggctaaagatggtgttaca

SEQ ID NO: 71457 - DNA, 20 bp, Artificial Sequence
  chemically synthesized
agacaaaggttcatatctta

SEQ ID NO: 71458 - DNA, 20 bp, Artificial Sequence
  chemically synthesized
tcgctcactaccaggccttg

SEQ ID NO: 71459 - DNA, 20 bp, Artificial Sequence
  chemically synthesized
tcactaccaggccttgggat

SEQ ID NO: 71460 - DNA, 20 bp, Artificial Sequence
  chemically synthesized
gggatgattgtttacctttt

SEQ ID NO: 71461 - DNA, 20 bp, Artificial Sequence
  chemically synthesized
ctccttgtgaagtagtaata

SEQ ID NO: 71462 - DNA, 20 bp, Artificial Sequence
  chemically synthesized
ttcatagttacatgaaatat

SEQ ID NO: 71463 - DNA, 20 bp, Artificial Sequence
  chemically synthesized
atgaaatattcatgattatg

SEQ ID NO: 71464 - DNA, 20 bp, Artificial Sequence
  chemically synthesized
actatcaccacagatctttt

SEQ ID NO: 71465 - DNA, 20 bp, Artificial Sequence
  chemically synthesized
ctgaagtactgaaaacagtg

SEQ ID NO: 71466 - DNA, 20 bp, Artificial Sequence
  chemically synthesized
tggaccaagggaaggaggag

SEQ ID NO: 71467 - DNA, 20 bp, Artificial Sequence
  chemically synthesized
tggctacagagatgaagatg

SEQ ID NO: 71468 - DNA, 20 bp, Artificial Sequence
  chemically synthesized
gaagatgaatagattacagg

SEQ ID NO: 71469 - DNA, 20 bp, Artificial Sequence
  chemically synthesized
tgggctcaatattagacgtg

SEQ ID NO: 71470 - DNA, 20 bp, Artificial Sequence
  chemically synthesized
tgtaacggagttatctggac

SEQ ID NO: 71471 - DNA, 20 bp, Artificial Sequence
  chemically synthesized
aaaaaaatcaataaaagcag

SEQ ID NO: 71472 - DNA, 20 bp, Artificial Sequence
  chemically synthesized
tcactggtgaatttaaggag

SEQ ID NO: 71473 - DNA, 20 bp, Artificial Sequence
  chemically synthesized
aggagcattgctttagctaa

SEQ ID NO: 71474 - DNA, 20 bp, Artificial Sequence
  chemically synthesized
acaagtataataaaattcaa

SEQ ID NO: 71475 - DNA, 20 bp, Artificial Sequence
  chemically synthesized
agcatttagctgctacttca

SEQ ID NO: 71476 - DNA, 20 bp, Artificial Sequence
  chemically synthesized
ggatttgccaccattcccca

SEQ ID NO: 71477 - DNA, 20 bp, Artificial Sequence
  chemically synthesized
tttaaacttgtcaagctgct

SEQ ID NO: 71478 - DNA, 20 bp, Artificial Sequence
  chemically synthesized
cttgttcttcctccttcctt

SEQ ID NO: 71479 - DNA, 20 bp, Artificial Sequence
  chemically synthesized
aagatagccacacacttgcc

SEQ ID NO: 71480 - DNA, 20 bp, Artificial Sequence
  chemically synthesized
gccacacacttgccctctga

SEQ ID NO: 71481 - DNA, 20 bp, Artificial Sequence
  chemically synthesized
ttgcattgcagtatgtatgt

SEQ ID NO: 71482 - DNA, 20 bp, Artificial Sequence
  chemically synthesized
tgtgtttatttttgtctctg

SEQ ID NO: 71483 - DNA, 20 bp, Artificial Sequence
  chemically synthesized
atattgaaataattattgaa

SEQ ID NO: 71484 - DNA, 20 bp, Artificial Sequence
  chemically synthesized
aatttattcaaataatattt

SEQ ID NO: 71485 - DNA, 20 bp, Artificial Sequence
  chemically synthesized
aaaattaaaaaagagacagt

SEQ ID NO: 71486 - DNA, 20 bp, Artificial Sequence
  chemically synthesized
attagtagaagttaactaga

SEQ ID NO: 71487 - DNA, 20 bp, Artificial Sequence
  chemically synthesized
gggaaagctatttcaggaaa

SEQ ID NO: 71488 - DNA, 20 bp, Artificial Sequence
  chemically synthesized
tccaggaagaatgaaaatac

SEQ ID NO: 71489 - DNA, 20 bp, Artificial Sequence
  chemically synthesized
catactagataaactggaag

SEQ ID NO: 71490 - DNA, 20 bp, Artificial Sequence
  chemically synthesized
ccttttttacttcattaaaa

SEQ ID NO: 71491 - DNA, 20 bp, Artificial Sequence
  chemically synthesized
taaacagaaaccctaggact

SEQ ID NO: 71492 - DNA, 20 bp, Artificial Sequence
  chemically synthesized
aaccctaggacttggtgatt

SEQ ID NO: 71493 - DNA, 20 bp, Artificial Sequence
  chemically synthesized
aaagaaagttcaataaagta

SEQ ID NO: 71494 - DNA, 20 bp, Artificial Sequence
  chemically synthesized
aaaggtgatgatgaccatgg

SEQ ID NO: 71495 - DNA, 20 bp, Artificial Sequence
  chemically synthesized
catgctgctatccaacatta

SEQ ID NO: 71496 - DNA, 20 bp, Artificial Sequence
  chemically synthesized
ttagccccatattctatctc

SEQ ID NO: 71497 - DNA, 20 bp, Artificial Sequence
  chemically synthesized
tattctatctcaccagcttt

SEQ ID NO: 71498 - DNA, 20 bp, Artificial Sequence
  chemically synthesized
tggattggaaggcatcaaac

SEQ ID NO: 71499 - DNA, 20 bp, Artificial Sequence
  chemically synthesized
acatggttgccatctcaggc

SEQ ID NO: 71500 - DNA, 20 bp, Artificial Sequence
  chemically synthesized
gcccaccactatggggatct

SEQ ID NO: 71501 - DNA, 20 bp, Artificial Sequence
  chemically synthesized
atccctattgtcctcctcct

SEQ ID NO: 71502 - DNA, 20 bp, Artificial Sequence
  chemically synthesized
aatctgtatggactgatggt

SEQ ID NO: 71503 - DNA, 20 bp, Artificial Sequence
  chemically synthesized
tgatggggctgtccctggtg

SEQ ID NO: 71504 - DNA, 20 bp, Artificial Sequence
  chemically synthesized
tgtctacctttttgtgcctc

SEQ ID NO: 71505 - DNA, 20 bp, Artificial Sequence
  chemically synthesized
ttgagtatatagcatgctct

SEQ ID NO: 71506 - DNA, 20 bp, Artificial Sequence
  chemically synthesized
ggcaaatttatgtctggagt

SEQ ID NO: 71507 - DNA, 20 bp, Artificial Sequence
  chemically synthesized
gctttaaaaaactgaacttc

SEQ ID NO: 71508 - DNA, 20 bp, Artificial Sequence
  chemically synthesized
aaaaaactgaacttctcttg

SEQ ID NO: 71509 - DNA, 20 bp, Artificial Sequence
  chemically synthesized
ctccttccatggttccttgg

SEQ ID NO: 71510 - DNA, 20 bp, Artificial Sequence
  chemically synthesized
cttccatcttatctacctgg

SEQ ID NO: 71511 - DNA, 20 bp, Artificial Sequence
  chemically synthesized
ctcctgcattcttcctcaac

SEQ ID NO: 71512 - DNA, 20 bp, Artificial Sequence
  chemically synthesized
ctatccttgactcctctcat

SEQ ID NO: 71513 - DNA, 20 bp, Artificial Sequence
  chemically synthesized
tacagtcagtatttacttgt

SEQ ID NO: 71514 - DNA, 20 bp, Artificial Sequence
  chemically synthesized
aacaatgacatgtaacgtga

SEQ ID NO: 71515 - DNA, 20 bp, Artificial Sequence
  chemically synthesized
aatgcaatccttgcaggggt

SEQ ID NO: 71516 - DNA, 20 bp, Artificial Sequence
  chemically synthesized
tgcaggggtctcagctttga

SEQ ID NO: 71517 - DNA, 20 bp, Artificial Sequence
  chemically synthesized
ggtaaagcaccaaatgctcc

SEQ ID NO: 71518 - DNA, 20 bp, Artificial Sequence
  chemically synthesized
acatttgtcacacagtaatg

SEQ ID NO: 71519 - DNA, 20 bp, Artificial Sequence
  chemically synthesized
attaccatgaggccaggcac

SEQ ID NO: 71520 - DNA, 20 bp, Artificial Sequence
  chemically synthesized
cactttgggagaccaaggtg

SEQ ID NO: 71521 - DNA, 20 bp, Artificial Sequence
  chemically synthesized
tgggaggattgctgaaggcc

SEQ ID NO: 71522 - DNA, 20 bp, Artificial Sequence
  chemically synthesized
tttgagaccaacttcaggca

SEQ ID NO: 71523 - DNA, 20 bp, Artificial Sequence
  chemically synthesized
caagaagattacttgagtcc

SEQ ID NO: 71524 - DNA, 20 bp, Artificial Sequence
  chemically synthesized
ctgggaggctgaggtgggaa

SEQ ID NO: 71525 - DNA, 20 bp, Artificial Sequence
  chemically synthesized
gcctgggtgaccaagtgaga

SEQ ID NO: 71526 - DNA, 20 bp, Artificial Sequence
  chemically synthesized
caaactctaaaaatatgtat

SEQ ID NO: 71527 - DNA, 20 bp, Artificial Sequence
  chemically synthesized
aaaatatgtatgtatgtttg

SEQ ID NO: 71528 - DNA, 20 bp, Artificial Sequence
  chemically synthesized
atgtttgtgcggtttcttgt

SEQ ID NO: 71529 - DNA, 20 bp, Artificial Sequence
  chemically synthesized
gtgtatgtttgtgtggtatc

SEQ ID NO: 71530 - DNA, 20 bp, Artificial Sequence
  chemically synthesized
gtgtgggtgttatcagactc

SEQ ID NO: 71531 - DNA, 20 bp, Artificial Sequence
  chemically synthesized
tgggagcccctctggaaccc

SEQ ID NO: 71532 - DNA, 20 bp, Artificial Sequence
  chemically synthesized
tagaatggggtacaaaaaat

SEQ ID NO: 71533 - DNA, 20 bp, Artificial Sequence
  chemically synthesized
ggggtacaaaaaatttagga

SEQ ID NO: 71534 - DNA, 20 bp, Artificial Sequence
  chemically synthesized
caaaaaatttaggatttgga

SEQ ID NO: 71535 - DNA, 20 bp, Artificial Sequence
  chemically synthesized
aatggcgtgaacccaggagg

SEQ ID NO: 71536 - DNA, 20 bp, Artificial Sequence
  chemically synthesized
aattaaaaatttaggatgta

SEQ ID NO: 71537 - DNA, 20 bp, Artificial Sequence
  chemically synthesized
tgtttgtggcaaaatttttt

SEQ ID NO: 71538 - DNA, 20 bp, Artificial Sequence
  chemically synthesized
ctattattaaaatgacattt

SEQ ID NO: 71539 - DNA, 20 bp, Artificial Sequence
  chemically synthesized
atatataatcttattttcta

SEQ ID NO: 71540 - DNA, 20 bp, Artificial Sequence
  chemically synthesized
aaattttctgaagaagacat

SEQ ID NO: 71541 - DNA, 20 bp, Artificial Sequence
  chemically synthesized
caatgactataaaaagttat

SEQ ID NO: 71542 - DNA, 20 bp, Artificial Sequence
  chemically synthesized
attatgatcatgataaatgc

SEQ ID NO: 71543 - DNA, 20 bp, Artificial Sequence
  chemically synthesized
tagggaggtattattatttt

SEQ ID NO: 71544 - DNA, 20 bp, Artificial Sequence
  chemically synthesized
tgaaattcaatatcaagcgc

SEQ ID NO: 71545 - DNA, 20 bp, Artificial Sequence
  chemically synthesized
actcctctccaaacaggacc

SEQ ID NO: 71546 - DNA, 20 bp, Artificial Sequence
  chemically synthesized
caggaccactcgtttcaggg

SEQ ID NO: 71547 - DNA, 20 bp, Artificial Sequence
  chemically synthesized
atactgaaggaagtcccatc

SEQ ID NO: 71548 - DNA, 20 bp, Artificial Sequence
  chemically synthesized
tattaaatactttttaatag

SEQ ID NO: 71549 - DNA, 20 bp, Artificial Sequence
  chemically synthesized
atagacttgattttaagagt

SEQ ID NO: 71550 - DNA, 20 bp, Artificial Sequence
  chemically synthesized
gtaccttctattttgcatat

SEQ ID NO: 71551 - DNA, 20 bp, Artificial Sequence
  chemically synthesized
aaccttatgagatggatact

SEQ ID NO: 71552 - DNA, 20 bp, Artificial Sequence
  chemically synthesized
atatcttgcccaatattata

SEQ ID NO: 71553 - DNA, 20 bp, Artificial Sequence
  chemically synthesized
aagtttgacagttctgactg

SEQ ID NO: 71554 - DNA, 20 bp, Artificial Sequence
  chemically synthesized
acagttctgactgtggtgct

SEQ ID NO: 71555 - DNA, 20 bp, Artificial Sequence
  chemically synthesized
ttgtagttttaactatgctc

SEQ ID NO: 71556 - DNA, 20 bp, Artificial Sequence
  chemically synthesized
atattcctgctaatgacagt

SEQ ID NO: 71557 - DNA, 20 bp, Artificial Sequence
  chemically synthesized
taattgaagttcacagaatt

SEQ ID NO: 71558 - DNA, 20 bp, Artificial Sequence
  chemically synthesized
gaagttcacagaattttatg

SEQ ID NO: 71559 - DNA, 20 bp, Artificial Sequence
  chemically synthesized
tgacaactctgagcctttgt

SEQ ID NO: 71560 - DNA, 20 bp, Artificial Sequence
  chemically synthesized
atagtgcagacattagtaag

SEQ ID NO: 71561 - DNA, 20 bp, Artificial Sequence
  chemically synthesized
atatttgtatcacctgggaa

SEQ ID NO: 71562 - DNA, 20 bp, Artificial Sequence
  chemically synthesized
gtatcacctgggaagcctgt

SEQ ID NO: 71563 - DNA, 20 bp, Artificial Sequence
  chemically synthesized
tttttgcttcatcaggggac

SEQ ID NO: 71564 - DNA, 20 bp, Artificial Sequence
  chemically synthesized
catcaacctcctgcagaaga

SEQ ID NO: 71565 - DNA, 20 bp, Artificial Sequence
  chemically synthesized
agacaatgctttctgaaaga

SEQ ID NO: 71566 - DNA, 20 bp, Artificial Sequence
  chemically synthesized
agacagagtttgtgtcttat

SEQ ID NO: 71567 - DNA, 20 bp, Artificial Sequence
  chemically synthesized
ttgcattcaaatatctgacc

SEQ ID NO: 71568 - DNA, 20 bp, Artificial Sequence
  chemically synthesized
aaagaaaagaaagacaaaaa

SEQ ID NO: 71569 - DNA, 20 bp, Artificial Sequence
  chemically synthesized
ttaagataactgggcatctc

SEQ ID NO: 71570 - DNA, 20 bp, Artificial Sequence
  chemically synthesized
atcaagtctgcgtccatcta

SEQ ID NO: 71571 - DNA, 20 bp, Artificial Sequence
  chemically synthesized
ccaaagacccaaggaagaga

SEQ ID NO: 71572 - DNA, 20 bp, Artificial Sequence
  chemically synthesized
ccagtaagttgctgaaggtc

SEQ ID NO: 71573 - DNA, 20 bp, Artificial Sequence
  chemically synthesized
tatgcagggttatggaatag

SEQ ID NO: 71574 - DNA, 20 bp, Artificial Sequence
  chemically synthesized
ctgttctatcatatctcccg

SEQ ID NO: 71575 - DNA, 20 bp, Artificial Sequence
  chemically synthesized
tcagcaattgctccaattga

SEQ ID NO: 71576 - DNA, 20 bp, Artificial Sequence
  chemically synthesized
atgaagcttctaacatttca

SEQ ID NO: 71577 - DNA, 20 bp, Artificial Sequence
  chemically synthesized
tttcaacatagtaaaaaagc

SEQ ID NO: 71578 - DNA, 20 bp, Artificial Sequence
  chemically synthesized
agtaaaaaagctaaggttta

SEQ ID NO: 71579 - DNA, 20 bp, Artificial Sequence
  chemically synthesized
aactttgccaaagccatatg

SEQ ID NO: 71580 - DNA, 20 bp, Artificial Sequence
  chemically synthesized
caaaaacctgtgcaagagct

SEQ ID NO: 71581 - DNA, 20 bp, Artificial Sequence
  chemically synthesized
ggcttcccactccaaatacc

SEQ ID NO: 71582 - DNA, 20 bp, Artificial Sequence
  chemically synthesized
ataccttacgcttcattgtt

SEQ ID NO: 71583 - DNA, 20 bp, Artificial Sequence
  chemically synthesized
ataaaatgtgtctattgagt

SEQ ID NO: 71584 - DNA, 20 bp, Artificial Sequence
  chemically synthesized
caatttttcagatgaagaaa

SEQ ID NO: 71585 - DNA, 20 bp, Artificial Sequence
  chemically synthesized
agagtgaagagctattgaag

SEQ ID NO: 71586 - DNA, 20 bp, Artificial Sequence
  chemically synthesized
taaagagaaagtcaaattgt

SEQ ID NO: 71587 - DNA, 20 bp, Artificial Sequence
  chemically synthesized
attgtccctgtttgcagatg

SEQ ID NO: 71588 - DNA, 20 bp, Artificial Sequence
  chemically synthesized
gtgagtgaactcccattcac

SEQ ID NO: 71589 - DNA, 20 bp, Artificial Sequence
  chemically synthesized
ccatactgcccaaggtaatt

SEQ ID NO: 71590 - DNA, 20 bp, Artificial Sequence
  chemically synthesized
aaagctggaggcatcacact

SEQ ID NO: 71591 - DNA, 20 bp, Artificial Sequence
  chemically synthesized
gagaaaaacaagaaatgggg

SEQ ID NO: 71592 - DNA, 20 bp, Artificial Sequence
  chemically synthesized
caagaaatggggaaaggatt

SEQ ID NO: 71593 - DNA, 20 bp, Artificial Sequence
  chemically synthesized
ttatacaaaaattaactcaa

SEQ ID NO: 71594 - DNA, 20 bp, Artificial Sequence
  chemically synthesized
aaacattgtggaagtcagtg

SEQ ID NO: 71595 - DNA, 20 bp, Artificial Sequence
  chemically synthesized
ccattactgggtatacaccc

SEQ ID NO: 71596 - DNA, 20 bp, Artificial Sequence
  chemically synthesized
ctataaagacacatgcacac

SEQ ID NO: 71597 - DNA, 20 bp, Artificial Sequence
  chemically synthesized
caaatgtccaacaatgatag

SEQ ID NO: 71598 - DNA, 20 bp, Artificial Sequence
  chemically synthesized
caaagatactgactctatat

SEQ ID NO: 71599 - DNA, 20 bp, Artificial Sequence
  chemically synthesized
gatactgactctatatcttt

SEQ ID NO: 71600 - DNA, 20 bp, Artificial Sequence
  chemically synthesized
ctctactcctagagactctg

SEQ ID NO: 71601 - DNA, 20 bp, Artificial Sequence
  chemically synthesized
agtggcagggacttgctgaa

SEQ ID NO: 71602 - DNA, 20 bp, Artificial Sequence
  chemically synthesized
atcccacctgaggctcagag

SEQ ID NO: 71603 - DNA, 20 bp, Artificial Sequence
  chemically synthesized
cacaagcccatgatccctga

SEQ ID NO: 71604 - DNA, 20 bp, Artificial Sequence
  chemically synthesized
tgtcgggggagggaccaggt

SEQ ID NO: 71605 - DNA, 20 bp, Artificial Sequence
  chemically synthesized
ggagattattggatcatggg

SEQ ID NO: 71606 - DNA, 20 bp, Artificial Sequence
  chemically synthesized
tgcagttctcgtgatactga

SEQ ID NO: 71607 - DNA, 20 bp, Artificial Sequence
  chemically synthesized
agtgagttttcatgagatct

SEQ ID NO: 71608 - DNA, 20 bp, Artificial Sequence
  chemically synthesized
gagatctgatggttttataa

SEQ ID NO: 71609 - DNA, 20 bp, Artificial Sequence
  chemically synthesized
cctgccaccaagtaagatgt

SEQ ID NO: 71610 - DNA, 20 bp, Artificial Sequence
  chemically synthesized
cttctccttctgccataatt

SEQ ID NO: 71611 - DNA, 20 bp, Artificial Sequence
  chemically synthesized
cctaagacagtagtcacctc

SEQ ID NO: 71612 - DNA, 20 bp, Artificial Sequence
  chemically synthesized
agcacatcatgaattcttga

SEQ ID NO: 71613 - DNA, 20 bp, Artificial Sequence
  chemically synthesized
attatcttgggttactcaca

SEQ ID NO: 71614 - DNA, 20 bp, Artificial Sequence
  chemically synthesized
ttactcacaaaatgcttatg

SEQ ID NO: 71615 - DNA, 20 bp, Artificial Sequence
  chemically synthesized
taagtgggaaattcttgtct

SEQ ID NO: 71616 - DNA, 20 bp, Artificial Sequence
  chemically synthesized
aaaagttggaaataagctga

SEQ ID NO: 71617 - DNA, 20 bp, Artificial Sequence
  chemically synthesized
tacgtaaagttataccgaac

SEQ ID NO: 71618 - DNA, 20 bp, Artificial Sequence
  chemically synthesized
tgtcccacattctacttttt

SEQ ID NO: 71619 - DNA, 20 bp, Artificial Sequence
  chemically synthesized
aacaaatcctaaactcagga

SEQ ID NO: 71620 - DNA, 20 bp, Artificial Sequence
  chemically synthesized
tcctaaactcaggagaatga

SEQ ID NO: 71621 - DNA, 20 bp, Artificial Sequence
  chemically synthesized
gaaggcagaggaggagagac

SEQ ID NO: 71622 - DNA, 20 bp, Artificial Sequence
  chemically synthesized
actctagtttcaagtatcag

SEQ ID NO: 71623 - DNA, 20 bp, Artificial Sequence
  chemically synthesized
agtttcaagtatcagtcaag

SEQ ID NO: 71624 - DNA, 20 bp, Artificial Sequence
  chemically synthesized
gatacagggtgcagtgggat

SEQ ID NO: 71625 - DNA, 20 bp, Artificial Sequence
  chemically synthesized
ctctgcctgtctgtggtctc

SEQ ID NO: 71626 - DNA, 20 bp, Artificial Sequence
  chemically synthesized
ttttttttttttgcatcctt

SEQ ID NO: 71627 - DNA, 20 bp, Artificial Sequence
  chemically synthesized
cttaaaacacaatcattctc

SEQ ID NO: 71628 - DNA, 20 bp, Artificial Sequence
  chemically synthesized
acacaatcattctcctgagt

SEQ ID NO: 71629 - DNA, 20 bp, Artificial Sequence
  chemically synthesized
atcattctcctgagtttagg

SEQ ID NO: 71630 - DNA, 20 bp, Artificial Sequence
  chemically synthesized
gatttgtttgacaagagcat

SEQ ID NO: 71631 - DNA, 20 bp, Artificial Sequence
  chemically synthesized
acctttgtgcacattagtat

SEQ ID NO: 71632 - DNA, 20 bp, Artificial Sequence
  chemically synthesized
attctcaggagtcaatcaca

SEQ ID NO: 71633 - DNA, 20 bp, Artificial Sequence
  chemically synthesized
caagaattcatgatgtgctc

SEQ ID NO: 71634 - DNA, 20 bp, Artificial Sequence
  chemically synthesized
ttcatgatgtgctctggtgt

SEQ ID NO: 71635 - DNA, 20 bp, Artificial Sequence
  chemically synthesized
gatgtgctctggtgtttttg

SEQ ID NO: 71636 - DNA, 20 bp, Artificial Sequence
  chemically synthesized
ccatctgccaccaatttagg

SEQ ID NO: 71637 - DNA, 20 bp, Artificial Sequence
  chemically synthesized
actgtcttaggaaaaatgct

SEQ ID NO: 71638 - DNA, 20 bp, Artificial Sequence
  chemically synthesized
atggggttgggagtcctgaa

SEQ ID NO: 71639 - DNA, 20 bp, Artificial Sequence
  chemically synthesized
ctgaatgctgcttcagaagg

SEQ ID NO: 71640 - DNA, 20 bp, Artificial Sequence
  chemically synthesized
ctgcttcagaaggcagggct

SEQ ID NO: 71641 - DNA, 20 bp, Artificial Sequence
  chemically synthesized
ctgggtaatttattaacaaa

SEQ ID NO: 71642 - DNA, 20 bp, Artificial Sequence
  chemically synthesized
ctggtccctcccccgacata

SEQ ID NO: 71643 - DNA, 20 bp, Artificial Sequence
  chemically synthesized
cccccgacatatagggatta

SEQ ID NO: 71644 - DNA, 20 bp, Artificial Sequence
  chemically synthesized
gccaagccatatcagggatc

SEQ ID NO: 71645 - DNA, 20 bp, Artificial Sequence
  chemically synthesized
acttattttttgttatactt

SEQ ID NO: 71646 - DNA, 20 bp, Artificial Sequence
  chemically synthesized
cacctatgagtgagaacatg

SEQ ID NO: 71647 - DNA, 20 bp, Artificial Sequence
  chemically synthesized
atgagtgagaacatgtggtg

SEQ ID NO: 71648 - DNA, 20 bp, Artificial Sequence
  chemically synthesized
gtttggctttttgtccttgt

SEQ ID NO: 71649 - DNA, 20 bp, Artificial Sequence
  chemically synthesized
tgtgatagtttgctgagaat

SEQ ID NO: 71650 - DNA, 20 bp, Artificial Sequence
  chemically synthesized
gtttgctgagaatgatggtt

SEQ ID NO: 71651 - DNA, 20 bp, Artificial Sequence
  chemically synthesized
gtgcatgtgtctttatagca

SEQ ID NO: 71652 - DNA, 20 bp, Artificial Sequence
  chemically synthesized
aatcaccacactgacttcca

SEQ ID NO: 71653 - DNA, 20 bp, Artificial Sequence
  chemically synthesized
ctgacttccacaatgtttga

SEQ ID NO: 71654 - DNA, 20 bp, Artificial Sequence
  chemically synthesized
tccacatcctctccagcacc

SEQ ID NO: 71655 - DNA, 20 bp, Artificial Sequence
  chemically synthesized
cctgttgtttcctgactttt

SEQ ID NO: 71656 - DNA, 20 bp, Artificial Sequence
  chemically synthesized
ggtgtgagatggtatctcat

SEQ ID NO: 71657 - DNA, 20 bp, Artificial Sequence
  chemically synthesized
gagatggtatctcattgtgg

SEQ ID NO: 71658 - DNA, 20 bp, Artificial Sequence
  chemically synthesized
atcctttgcccactttttga

SEQ ID NO: 71659 - DNA, 20 bp, Artificial Sequence
  chemically synthesized
gggttttttttctcttgtaa

SEQ ID NO: 71660 - DNA, 20 bp, Artificial Sequence
  chemically synthesized
gtaaatttgtttgagttcat

SEQ ID NO: 71661 - DNA, 20 bp, Artificial Sequence
  chemically synthesized
tattagccctttgtcagatg

SEQ ID NO: 71662 - DNA, 20 bp, Artificial Sequence
  chemically synthesized
ggttgcctgttcactctgat

SEQ ID NO: 71663 - DNA, 20 bp, Artificial Sequence
  chemically synthesized
cttttgctgtgcagaagatc

SEQ ID NO: 71664 - DNA, 20 bp, Artificial Sequence
  chemically synthesized
attagatcccattagtgaat

SEQ ID NO: 71665 - DNA, 20 bp, Artificial Sequence
  chemically synthesized
tgaattttggcttttgttgc

SEQ ID NO: 71666 - DNA, 20 bp, Artificial Sequence
  chemically synthesized
gcttttgttgccattgcttt

SEQ ID NO: 71667 - DNA, 20 bp, Artificial Sequence
  chemically synthesized
catgcctatgtcctgaatgg

SEQ ID NO: 71668 - DNA, 20 bp, Artificial Sequence
  chemically synthesized
tatgtcctgaatggtattgc

SEQ ID NO: 71669 - DNA, 20 bp, Artificial Sequence
  chemically synthesized
gtattgcttaggttttcttc

SEQ ID NO: 71670 - DNA, 20 bp, Artificial Sequence
  chemically synthesized
aggttttcttctagagtttt

SEQ ID NO: 71671 - DNA, 20 bp, Artificial Sequence
  chemically synthesized
tataaggtgtaaggaaggga

SEQ ID NO: 71672 - DNA, 20 bp, Artificial Sequence
  chemically synthesized
gtgtaaggaagggatccagt

SEQ ID NO: 71673 - DNA, 20 bp, Artificial Sequence
  chemically synthesized
cagcttcctacatttggcta

SEQ ID NO: 71674 - DNA, 20 bp, Artificial Sequence
  chemically synthesized
cagggaatcctttccccatt

SEQ ID NO: 71675 - DNA, 20 bp, Artificial Sequence
  chemically synthesized
ttccccatttcttgtttttc

SEQ ID NO: 71676 - DNA, 20 bp, Artificial Sequence
  chemically synthesized
gacagcattatttctgaggg

SEQ ID NO: 71677 - DNA, 20 bp, Artificial Sequence
  chemically synthesized
tttgttccattggtctatat

SEQ ID NO: 71678 - DNA, 20 bp, Artificial Sequence
  chemically synthesized
ctgttttggtaccagtacta

SEQ ID NO: 71679 - DNA, 20 bp, Artificial Sequence
  chemically synthesized
tggttactgtagccttgtag

SEQ ID NO: 71680 - DNA, 20 bp, Artificial Sequence
  chemically synthesized
aaatcaggtagtgtgatgcc

SEQ ID NO: 71681 - DNA, 20 bp, Artificial Sequence
  chemically synthesized
gatgcctccagctttgttct

SEQ ID NO: 71682 - DNA, 20 bp, Artificial Sequence
  chemically synthesized
tccagctttgttcttttggc

SEQ ID NO: 71683 - DNA, 20 bp, Artificial Sequence
  chemically synthesized
tggttccatatgaactttaa

SEQ ID NO: 71684 - DNA, 20 bp, Artificial Sequence
  chemically synthesized
attctgtgaagaaagtcatt

SEQ ID NO: 71685 - DNA, 20 bp, Artificial Sequence
  chemically synthesized
cagtatggccattttcacga

SEQ ID NO: 71686 - DNA, 20 bp, Artificial Sequence
  chemically synthesized
tgagcatggaatgttcttcc

SEQ ID NO: 71687 - DNA, 20 bp, Artificial Sequence
  chemically synthesized
tgtatcttatttccttgagc

SEQ ID NO: 71688 - DNA, 20 bp, Artificial Sequence
  chemically synthesized
gtccttcacatcccttgtaa

SEQ ID NO: 71689 - DNA, 20 bp, Artificial Sequence
  chemically synthesized
attgtgaatgggagttcact

SEQ ID NO: 71690 - DNA, 20 bp, Artificial Sequence
  chemically synthesized
tgtctgttattggtgtataa

SEQ ID NO: 71691 - DNA, 20 bp, Artificial Sequence
  chemically synthesized
ttattggtgtataagaatgc

SEQ ID NO: 71692 - DNA, 20 bp, Artificial Sequence
  chemically synthesized
gaatgcttgtgatttttgca

SEQ ID NO: 71693 - DNA, 20 bp, Artificial Sequence
  chemically synthesized
gtatcctgagactttgctga

SEQ ID NO: 71694 - DNA, 20 bp, Artificial Sequence
  chemically synthesized
agactttgctgaagttgctt

SEQ ID NO: 71695 - DNA, 20 bp, Artificial Sequence
  chemically synthesized
tgaagttgcttatcagctta

SEQ ID NO: 71696 - DNA, 20 bp, Artificial Sequence
  chemically synthesized
gggattttgggctgagacaa

SEQ ID NO: 71697 - DNA, 20 bp, Artificial Sequence
  chemically synthesized
gccttttatttccttctcct

SEQ ID NO: 71698 - DNA, 20 bp, Artificial Sequence
  chemically synthesized
aacttcaatagctcttcact

SEQ ID NO: 71699 - DNA, 20 bp, Artificial Sequence
  chemically synthesized
actctatgattgtgcaaagt

SEQ ID NO: 71700 - DNA, 20 bp, Artificial Sequence
  chemically synthesized
gtgcaaagtatctgattaat

SEQ ID NO: 71701 - DNA, 20 bp, Artificial Sequence
  chemically synthesized
tgagacaattctacctactc

SEQ ID NO: 71702 - DNA, 20 bp, Artificial Sequence
  chemically synthesized
atgttgcagtgagctctaag

SEQ ID NO: 71703 - DNA, 20 bp, Artificial Sequence
  chemically synthesized
gggaagccatgagctcttgc

SEQ ID NO: 71704 - DNA, 20 bp, Artificial Sequence
  chemically synthesized
gtttttggacaatccttcca

SEQ ID NO: 71705 - DNA, 20 bp, Artificial Sequence
  chemically synthesized
gttactgaatctttctaaac

SEQ ID NO: 71706 - DNA, 20 bp, Artificial Sequence
  chemically synthesized
cttagcttttttactatgtt

SEQ ID NO: 71707 - DNA, 20 bp, Artificial Sequence
  chemically synthesized
gccctgcctcttttcgagag

SEQ ID NO: 71708 - DNA, 20 bp, Artificial Sequence
  chemically synthesized
cctcttttcgagagaaatga

SEQ ID NO: 71709 - DNA, 20 bp, Artificial Sequence
  chemically synthesized
ggaaagcactctgaaatgtt

SEQ ID NO: 71710 - DNA, 20 bp, Artificial Sequence
  chemically synthesized
ttcatcaattggagcaattg

SEQ ID NO: 71711 - DNA, 20 bp, Artificial Sequence
  chemically synthesized
aattggagcaattgctgaga

SEQ ID NO: 71712 - DNA, 20 bp, Artificial Sequence
  chemically synthesized
gatagaacagcagccctaac

SEQ ID NO: 71713 - DNA, 20 bp, Artificial Sequence
  chemically synthesized
cttactggtcctttcttctc

SEQ ID NO: 71714 - DNA, 20 bp, Artificial Sequence
  chemically synthesized
cagacttgatgaatgtcaaa

SEQ ID NO: 71715 - DNA, 20 bp, Artificial Sequence
  chemically synthesized
acttcataagaaaatttatt

SEQ ID NO: 71716 - DNA, 20 bp, Artificial Sequence
  chemically synthesized
tgagcaagtatgtaaagatc

SEQ ID NO: 71717 - DNA, 20 bp, Artificial Sequence
  chemically synthesized
cgtcccctgatgaagcaaaa

SEQ ID NO: 71718 - DNA, 20 bp, Artificial Sequence
  chemically synthesized
ccaggtgatacaaatattta

SEQ ID NO: 71719 - DNA, 20 bp, Artificial Sequence
  chemically synthesized
acttcaattacatgagccat

SEQ ID NO: 71720 - DNA, 20 bp, Artificial Sequence
  chemically synthesized
acaaatacagtatcaatttc

SEQ ID NO: 71721 - DNA, 20 bp, Artificial Sequence
  chemically synthesized
tatcaatttcaaaggcttag

SEQ ID NO: 71722 - DNA, 20 bp, Artificial Sequence
  chemically synthesized
attaaataacgggatagttg

SEQ ID NO: 71723 - DNA, 20 bp, Artificial Sequence
  chemically synthesized
agatttttgcctgcaggaat

SEQ ID NO: 71724 - DNA, 20 bp, Artificial Sequence
  chemically synthesized
cttgtgctgaggaatgggcc

SEQ ID NO: 71725 - DNA, 20 bp, Artificial Sequence
  chemically synthesized
ctgtcattagcaggaatatg

SEQ ID NO: 71726 - DNA, 20 bp, Artificial Sequence
  chemically synthesized
gcaggaatatgtacagcttt

SEQ ID NO: 71727 - DNA, 20 bp, Artificial Sequence
  chemically synthesized
atgtacagctttggctgatt

SEQ ID NO: 71728 - DNA, 20 bp, Artificial Sequence
  chemically synthesized
ttggctgattttatgttttt

SEQ ID NO: 71729 - DNA, 20 bp, Artificial Sequence
  chemically synthesized
aataatacctaggttataat

SEQ ID NO: 71730 - DNA, 20 bp, Artificial Sequence
  chemically synthesized
aaggtactcagtaccttcta

SEQ ID NO: 71731 - DNA, 20 bp, Artificial Sequence
  chemically synthesized
ttaatacaataattttatgt

SEQ ID NO: 71732 - DNA, 20 bp, Artificial Sequence
  chemically synthesized
catggccctgaaacgagtgg

SEQ ID NO: 71733 - DNA, 20 bp, Artificial Sequence
  chemically synthesized
tttggagaggagtccagcat

SEQ ID NO: 71734 - DNA, 20 bp, Artificial Sequence
  chemically synthesized
taatggtttaagaaaatcag

SEQ ID NO: 71735 - DNA, 20 bp, Artificial Sequence
  chemically synthesized
atttcagttctgacttacat

SEQ ID NO: 71736 - DNA, 20 bp, Artificial Sequence
  chemically synthesized
ttaatgatttaactaaggaa

SEQ ID NO: 71737 - DNA, 20 bp, Artificial Sequence
  chemically synthesized
agttgctttcctctgtgagc

SEQ ID NO: 71738 - DNA, 20 bp, Artificial Sequence
  chemically synthesized
taataatacctccctacttc

SEQ ID NO: 71739 - DNA, 20 bp, Artificial Sequence
  chemically synthesized
agccctctctaccgtgagtt

SEQ ID NO: 71740 - DNA, 20 bp, Artificial Sequence
  chemically synthesized
agtcattgtaaaatgctctt

SEQ ID NO: 71741 - DNA, 20 bp, Artificial Sequence
  chemically synthesized
tagagaaatctatatagaaa

SEQ ID NO: 71742 - DNA, 20 bp, Artificial Sequence
  chemically synthesized
aaaataagattatatataac

SEQ ID NO: 71743 - DNA, 20 bp, Artificial Sequence
  chemically synthesized
aatatttatagccttttaca

SEQ ID NO: 71744 - DNA, 20 bp, Artificial Sequence
  chemically synthesized
agtgattgttctgtacctaa

SEQ ID NO: 71745 - DNA, 20 bp, Artificial Sequence
  chemically synthesized
tttttatttaatattttgcc

SEQ ID NO: 71746 - DNA, 20 bp, Artificial Sequence
  chemically synthesized
aataatagtgtatcaaatga

SEQ ID NO: 71747 - DNA, 20 bp, Artificial Sequence
  chemically synthesized
tagtgtatcaaatgaatatg

SEQ ID NO: 71748 - DNA, 20 bp, Artificial Sequence
  chemically synthesized
atttttattctagacatttt

SEQ ID NO: 71749 - DNA, 20 bp, Artificial Sequence
  chemically synthesized
tattgatcactgacctagga

SEQ ID NO: 71750 - DNA, 20 bp, Artificial Sequence
  chemically synthesized
aggaaaaaaattttgccaca

SEQ ID NO: 71751 - DNA, 20 bp, Artificial Sequence
  chemically synthesized
ttaatttatcatttatttag

SEQ ID NO: 71752 - DNA, 20 bp, Artificial Sequence
  chemically synthesized
ttttcaagtcttttgatgta

SEQ ID NO: 71753 - DNA, 20 bp, Artificial Sequence
  chemically synthesized
tttataaaaggcaaattaaa

SEQ ID NO: 71754 - DNA, 20 bp, Artificial Sequence
  chemically synthesized
atttatttatttttcttttt

SEQ ID NO: 71755 - DNA, 20 bp, Artificial Sequence
  chemically synthesized
cgcctcggcctcccagagtg

SEQ ID NO: 71756 - DNA, 20 bp, Artificial Sequence
  chemically synthesized
agccaccgcgcccagccaga

SEQ ID NO: 71757 - DNA, 20 bp, Artificial Sequence
  chemically synthesized
tgttaactctattcttcaat

SEQ ID NO: 71758 - DNA, 20 bp, Artificial Sequence
  chemically synthesized
attttaaatttgagtaaggt

SEQ ID NO: 71759 - DNA, 20 bp, Artificial Sequence
  chemically synthesized
cctactatgtggatgtaaat

SEQ ID NO: 71760 - DNA, 20 bp, Artificial Sequence
  chemically synthesized
attaaagtttagaatggaac

SEQ ID NO: 71761 - DNA, 20 bp, Artificial Sequence
  chemically synthesized
caaacatacatacatatttt

SEQ ID NO: 71762 - DNA, 20 bp, Artificial Sequence
  chemically synthesized
gagtttggttcttttttaaa

SEQ ID NO: 71763 - DNA, 20 bp, Artificial Sequence
  chemically synthesized
ttttaaatttcgctttgtaa

SEQ ID NO: 71764 - DNA, 20 bp, Artificial Sequence
  chemically synthesized
aaatttcgctttgtaatttt

SEQ ID NO: 71765 - DNA, 20 bp, Artificial Sequence
  chemically synthesized
acttggtcacccaggcagta

SEQ ID NO: 71766 - DNA, 20 bp, Artificial Sequence
  chemically synthesized
caccttggtctcccaaagtg

SEQ ID NO: 71767 - DNA, 20 bp, Artificial Sequence
  chemically synthesized
gccagcagaaaggtgtcttc

SEQ ID NO: 71768 - DNA, 20 bp, Artificial Sequence
  chemically synthesized
atgcctaattcctccaggga

SEQ ID NO: 71769 - DNA, 20 bp, Artificial Sequence
  chemically synthesized
aaggaaaccgatggagcatt

SEQ ID NO: 71770 - DNA, 20 bp, Artificial Sequence
  chemically synthesized
tttcaaagctgagacccctg

SEQ ID NO: 71771 - DNA, 20 bp, Artificial Sequence
  chemically synthesized
gacaggctgatcagccaatg

SEQ ID NO: 71772 - DNA, 20 bp, Artificial Sequence
  chemically synthesized
agtttatttcctcctgagca

SEQ ID NO: 71773 - DNA, 20 bp, Artificial Sequence
  chemically synthesized
gcaatgggattgtgacttca

SEQ ID NO: 71774 - DNA, 20 bp, Artificial Sequence
  chemically synthesized
tgtgacttcaatatgtttgt

SEQ ID NO: 71775 - DNA, 20 bp, Artificial Sequence
  chemically synthesized
tttgtgtgagtttccttggc

SEQ ID NO: 71776 - DNA, 20 bp, Artificial Sequence
  chemically synthesized
acctacaagtaaatactgac

SEQ ID NO: 71777 - DNA, 20 bp, Artificial Sequence
  chemically synthesized
accttagaaatttggggggg

SEQ ID NO: 71778 - DNA, 20 bp, Artificial Sequence
  chemically synthesized
gaggaagaatgcaggagttc

SEQ ID NO: 71779 - DNA, 20 bp, Artificial Sequence
  chemically synthesized
ctctggtatttattgttctt

SEQ ID NO: 71780 - DNA, 20 bp, Artificial Sequence
  chemically synthesized
attgttctttttagttttta

SEQ ID NO: 71781 - DNA, 20 bp, Artificial Sequence
  chemically synthesized
tagtttttatttagtttcat

SEQ ID NO: 71782 - DNA, 20 bp, Artificial Sequence
  chemically synthesized
ttcaataaagttgccttctg

SEQ ID NO: 71783 - DNA, 20 bp, Artificial Sequence
  chemically synthesized
taaaatctaagcaagagaag

SEQ ID NO: 71784 - DNA, 20 bp, Artificial Sequence
  chemically synthesized
ccttcttataggcctctagg

SEQ ID NO: 71785 - DNA, 20 bp, Artificial Sequence
  chemically synthesized
ctccttggtcttaatgctgt

SEQ ID NO: 71786 - DNA, 20 bp, Artificial Sequence
  chemically synthesized
gaagatgaatagcaggtggg

SEQ ID NO: 71787 - DNA, 20 bp, Artificial Sequence
  chemically synthesized
aaactaccaccatcagtcca

SEQ ID NO: 71788 - DNA, 20 bp, Artificial Sequence
  chemically synthesized
aaaagagtggatgcagaaca

SEQ ID NO: 71789 - DNA, 20 bp, Artificial Sequence
  chemically synthesized
agaaaaaggggatgaaaatc

SEQ ID NO: 71790 - DNA, 20 bp, Artificial Sequence
  chemically synthesized
aatattggactgacattcct

SEQ ID NO: 71791 - DNA, 20 bp, Artificial Sequence
  chemically synthesized
atatttctggttattaattc

SEQ ID NO: 71792 - DNA, 20 bp, Artificial Sequence
  chemically synthesized
tctttgataacctcgccctc

SEQ ID NO: 71793 - DNA, 20 bp, Artificial Sequence
  chemically synthesized
cttcttaatgtcatccacta

SEQ ID NO: 71794 - DNA, 20 bp, Artificial Sequence
  chemically synthesized
ccagaacttgtctttctctc

SEQ ID NO: 71795 - DNA, 20 bp, Artificial Sequence
  chemically synthesized
tcagtggctcaagtcaaatg

SEQ ID NO: 71796 - DNA, 20 bp, Artificial Sequence
  chemically synthesized
atcaaccaatcaccaagtcc

SEQ ID NO: 71797 - DNA, 20 bp, Artificial Sequence
  chemically synthesized
caatcaccaagtcctagggt

SEQ ID NO: 71798 - DNA, 20 bp, Artificial Sequence
  chemically synthesized
ctgtttactgaatacctcaa

SEQ ID NO: 71799 - DNA, 20 bp, Artificial Sequence
  chemically synthesized
caagagagacgtatacataa

SEQ ID NO: 71800 - DNA, 20 bp, Artificial Sequence
  chemically synthesized
caagtttttaatgaagtaaa

SEQ ID NO: 71801 - DNA, 20 bp, Artificial Sequence
  chemically synthesized
taatgacactaaacaattct

SEQ ID NO: 71802 - DNA, 20 bp, Artificial Sequence
  chemically synthesized
caattcttccagtttatcta

SEQ ID NO: 71803 - DNA, 20 bp, Artificial Sequence
  chemically synthesized
ataaaaacattttttcctga

SEQ ID NO: 71804 - DNA, 20 bp, Artificial Sequence
  chemically synthesized
cttctactaatataacccac

SEQ ID NO: 71805 - DNA, 20 bp, Artificial Sequence
  chemically synthesized
agaaggccttcttaaattcc

SEQ ID NO: 71806 - DNA, 20 bp, Artificial Sequence
  chemically synthesized
gccttcttaaattccccaag

SEQ ID NO: 71807 - DNA, 20 bp, Artificial Sequence
  chemically synthesized
tgcagcattgtcaatttctg

SEQ ID NO: 71808 - DNA, 20 bp, Artificial Sequence
  chemically synthesized
tttaattttaatattagctc

SEQ ID NO: 71809 - DNA, 20 bp, Artificial Sequence
  chemically synthesized
tatttcaataattattcatt

SEQ ID NO: 71810 - DNA, 20 bp, Artificial Sequence
  chemically synthesized
taggttggtgcaaaagtaat

SEQ ID NO: 71811 - DNA, 20 bp, Artificial Sequence
  chemically synthesized
tgaaagttcctgaagcagag

SEQ ID NO: 71812 - DNA, 20 bp, Artificial Sequence
  chemically synthesized
ctgaagcagagagcagcttg

SEQ ID NO: 71813 - DNA, 20 bp, Artificial Sequence
  chemically synthesized
ctttgaattttattatactt

SEQ ID NO: 71814 - DNA, 20 bp, Artificial Sequence
  chemically synthesized
gcagaggtgctgcatggata

SEQ ID NO: 71815 - DNA, 20 bp, Artificial Sequence
  chemically synthesized
tcttttccatttctttactt

SEQ ID NO: 71816 - DNA, 20 bp, Artificial Sequence
  chemically synthesized
ctactcaaccaaccacccta

SEQ ID NO: 71817 - DNA, 20 bp, Artificial Sequence
  chemically synthesized
caatggagagtcttaatcat

SEQ ID NO: 71818 - DNA, 20 bp, Artificial Sequence
  chemically synthesized
gtcttaatcatacctgcttt

SEQ ID NO: 71819 - DNA, 20 bp, Artificial Sequence
  chemically synthesized
gccaagatctgctggttctc

SEQ ID NO: 71820 - DNA, 20 bp, Artificial Sequence
  chemically synthesized
ggttctcttctgatttttgt

SEQ ID NO: 71821 - DNA, 20 bp, Artificial Sequence
  chemically synthesized
ttgctcaaatatttatgtta

SEQ ID NO: 71822 - DNA, 20 bp, Artificial Sequence
  chemically synthesized
aactccgttacatatcaggc

SEQ ID NO: 71823 - DNA, 20 bp, Artificial Sequence
  chemically synthesized
tgagtttctgccttctcact

SEQ ID NO: 71824 - DNA, 20 bp, Artificial Sequence
  chemically synthesized
cccagcatccatcttttcac

SEQ ID NO: 71825 - DNA, 20 bp, Artificial Sequence
  chemically synthesized
ctgtagccaatgtccttgtt

SEQ ID NO: 71826 - DNA, 20 bp, Artificial Sequence
  chemically synthesized
cttgttcttagcttttccac

SEQ ID NO: 71827 - DNA, 20 bp, Artificial Sequence
  chemically synthesized
tccatcctctactgcagcca

SEQ ID NO: 71828 - DNA, 20 bp, Artificial Sequence
  chemically synthesized
actaactctatgaatcactg

SEQ ID NO: 71829 - DNA, 20 bp, Artificial Sequence
  chemically synthesized
gtccaatttattgaggccat

SEQ ID NO: 71830 - DNA, 20 bp, Artificial Sequence
  chemically synthesized
tacatgatttagatgctgtg

SEQ ID NO: 71831 - DNA, 20 bp, Artificial Sequence
  chemically synthesized
accatctttagcccggtcct

SEQ ID NO: 71832 - DNA, 20 bp, Artificial Sequence
  chemically synthesized
caattccctacacatacttt

SEQ ID NO: 71833 - DNA, 20 bp, Artificial Sequence
  chemically synthesized
tgtttttattcttctatatt

SEQ ID NO: 71834 - DNA, 20 bp, Artificial Sequence
  chemically synthesized
gctttcttggcaaaaaccac

SEQ ID NO: 71835 - DNA, 20 bp, Artificial Sequence
  chemically synthesized
ccatataagtacacatatgt

SEQ ID NO: 71836 - DNA, 20 bp, Artificial Sequence
  chemically synthesized
gtttaaataacatataagtg

SEQ ID NO: 71837 - DNA, 20 bp, Artificial Sequence
  chemically synthesized
tatatattctttatatactt

SEQ ID NO: 71838 - DNA, 20 bp, Artificial Sequence
  chemically synthesized
ttatacgtattctttattat

SEQ ID NO: 71839 - DNA, 20 bp, Artificial Sequence
  chemically synthesized
acctaataattcatttttta

SEQ ID NO: 71840 - DNA, 20 bp, Artificial Sequence
  chemically synthesized
aataaagtactcacctctta

SEQ ID NO: 71841 - DNA, 20 bp, Artificial Sequence
  chemically synthesized
atacagagacaatgacaggg

SEQ ID NO: 71842 - DNA, 20 bp, Artificial Sequence
  chemically synthesized
agtatacttcctcttgggaa

SEQ ID NO: 71843 - DNA, 20 bp, Artificial Sequence
  chemically synthesized
cctcttgggaagaaagcttt

SEQ ID NO: 71844 - DNA, 20 bp, Artificial Sequence
  chemically synthesized
aattaaaatattcaaggcag

SEQ ID NO: 71845 - DNA, 20 bp, Artificial Sequence
  chemically synthesized
cacaggagaaaattcctgaa

SEQ ID NO: 71846 - DNA, 20 bp, Artificial Sequence
  chemically synthesized
tcacctgtgtctaaatattc

SEQ ID NO: 71847 - DNA, 20 bp, Artificial Sequence
  chemically synthesized
tgaactacattggtggagga

SEQ ID NO: 71848 - DNA, 20 bp, Artificial Sequence
  chemically synthesized
acctaaacacaaggacttga

SEQ ID NO: 71849 - DNA, 20 bp, Artificial Sequence
  chemically synthesized
tcaaactcatctgtaaacat

SEQ ID NO: 71850 - DNA, 20 bp, Artificial Sequence
  chemically synthesized
cctgtttttagtaggataga

SEQ ID NO: 71851 - DNA, 20 bp, Artificial Sequence
  chemically synthesized
atactggggaagttacaagg

SEQ ID NO: 71852 - DNA, 20 bp, Artificial Sequence
  chemically synthesized
ggggaagttacaaggtgttg

SEQ ID NO: 71853 - DNA, 20 bp, Artificial Sequence
  chemically synthesized
gtgttgtttggattaaaata

SEQ ID NO: 71854 - DNA, 20 bp, Artificial Sequence
  chemically synthesized
aatttgttgaataagtgaat

SEQ ID NO: 71855 - DNA, 20 bp, Artificial Sequence
  chemically synthesized
aggaaagagtatagagacca

SEQ ID NO: 71856 - DNA, 20 bp, Artificial Sequence
  chemically synthesized
tcttttccagcaagagaagg

SEQ ID NO: 71857 - DNA, 20 bp, Artificial Sequence
  chemically synthesized
atagactctgagaatatcag

SEQ ID NO: 71858 - DNA, 20 bp, Artificial Sequence
  chemically synthesized
agaagagattctgtgagaac

SEQ ID NO: 71859 - DNA, 20 bp, Artificial Sequence
  chemically synthesized
caacttggaagaataaggtg

SEQ ID NO: 71860 - DNA, 20 bp, Artificial Sequence
  chemically synthesized
ttggaagaataaggtgggag

SEQ ID NO: 71861 - DNA, 20 bp, Artificial Sequence
  chemically synthesized
aggtgggaggattgcttgaa

SEQ ID NO: 71862 - DNA, 20 bp, Artificial Sequence
  chemically synthesized
gaggattgcttgaatccggt

SEQ ID NO: 71863 - DNA, 20 bp, Artificial Sequence
  chemically synthesized
cggtttgagtttacagtgag

SEQ ID NO: 71864 - DNA, 20 bp, Artificial Sequence
  chemically synthesized
acaaagaaaaaaaaatccca

SEQ ID NO: 71865 - DNA, 20 bp, Artificial Sequence
  chemically synthesized
agaccatgtctttttgggct

SEQ ID NO: 71866 - DNA, 20 bp, Artificial Sequence
  chemically synthesized
acaaggctgtggctgtcaca

SEQ ID NO: 71867 - DNA, 20 bp, Artificial Sequence
  chemically synthesized
aactttttagcattcagtcc

SEQ ID NO: 71868 - DNA, 20 bp, Artificial Sequence
  chemically synthesized
aacaaaagtactactgcctt

SEQ ID NO: 71869 - DNA, 20 bp, Artificial Sequence
  chemically synthesized
ttatccactagtaatggacc

SEQ ID NO: 71870 - DNA, 20 bp, Artificial Sequence
  chemically synthesized
aggtcggatgtagtatatga

SEQ ID NO: 71871 - DNA, 20 bp, Artificial Sequence
  chemically synthesized
attatccatgtgatgttcac

SEQ ID NO: 71872 - DNA, 20 bp, Artificial Sequence
  chemically synthesized
gcaccacaatcaccactact

SEQ ID NO: 71873 - DNA, 20 bp, Artificial Sequence
  chemically synthesized
caaatgtccaggtcagtgtc

SEQ ID NO: 71874 - DNA, 20 bp, Artificial Sequence
  chemically synthesized
acatcctttaaatagggcat

SEQ ID NO: 71875 - DNA, 20 bp, Artificial Sequence
  chemically synthesized
aaaaccaggacagagaccca

SEQ ID NO: 71876 - DNA, 20 bp, Artificial Sequence
  chemically synthesized
attgtagttatgaggaaggt

SEQ ID NO: 71877 - DNA, 20 bp, Artificial Sequence
  chemically synthesized
aaggagctgagcatcttcat

SEQ ID NO: 71878 - DNA, 20 bp, Artificial Sequence
  chemically synthesized
aaatcctgcatttattaaga

SEQ ID NO: 71879 - DNA, 20 bp, Artificial Sequence
  chemically synthesized
aattaagaatcaaccacaga

SEQ ID NO: 71880 - DNA, 20 bp, Artificial Sequence
  chemically synthesized
agggcatggaggtgaggaaa

SEQ ID NO: 71881 - DNA, 20 bp, Artificial Sequence
  chemically synthesized
gaggtgaggaaaagttgttt

SEQ ID NO: 71882 - DNA, 20 bp, Artificial Sequence
  chemically synthesized
gtttatgtgttttgagaact

SEQ ID NO: 71883 - DNA, 20 bp, Artificial Sequence
  chemically synthesized
aggcaggggcaagaccctga

SEQ ID NO: 71884 - DNA, 20 bp, Artificial Sequence
  chemically synthesized
catggtacacattttgatgg

SEQ ID NO: 71885 - DNA, 20 bp, Artificial Sequence
  chemically synthesized
acattgttaacaatatgcag

SEQ ID NO: 71886 - DNA, 20 bp, Artificial Sequence
  chemically synthesized
ctggatgcagatatgtaatt

SEQ ID NO: 71887 - DNA, 20 bp, Artificial Sequence
  chemically synthesized
ctttttacgtagataaacaa

SEQ ID NO: 71888 - DNA, 20 bp, Artificial Sequence
  chemically synthesized
accatttagagatctctaat

SEQ ID NO: 71889 - DNA, 20 bp, Artificial Sequence
  chemically synthesized
ttttaaactaacatctgtat

SEQ ID NO: 71890 - DNA, 20 bp, Artificial Sequence
  chemically synthesized
ctgaattatataattgaagg

SEQ ID NO: 71891 - DNA, 20 bp, Artificial Sequence
  chemically synthesized
tgaaggaccagtttccaagc

SEQ ID NO: 71892 - DNA, 20 bp, Artificial Sequence
  chemically synthesized
caaatgaaagaactcagcat

SEQ ID NO: 71893 - DNA, 20 bp, Artificial Sequence
  chemically synthesized
ctttattgctctaaatgacc

SEQ ID NO: 71894 - DNA, 20 bp, Artificial Sequence
  chemically synthesized
ttgctctaaatgacctttag

SEQ ID NO: 71895 - DNA, 20 bp, Artificial Sequence
  chemically synthesized
tgatcaagaacttgaagata

SEQ ID NO: 71896 - DNA, 20 bp, Artificial Sequence
  chemically synthesized
agctcacattgagtaaagat

SEQ ID NO: 71897 - DNA, 20 bp, Artificial Sequence
  chemically synthesized
aaagatgttagattgttcaa

SEQ ID NO: 71898 - DNA, 20 bp, Artificial Sequence
  chemically synthesized
gcccaggctaggaaggcaga

SEQ ID NO: 71899 - DNA, 20 bp, Artificial Sequence
  chemically synthesized
tacctatttgttaatgtgca

SEQ ID NO: 71900 - DNA, 20 bp, Artificial Sequence
  chemically synthesized
atggttttcattgcatgtaa

SEQ ID NO: 71901 - DNA, 20 bp, Artificial Sequence
  chemically synthesized
gggtatggtggggtggaaag

SEQ ID NO: 71902 - DNA, 20 bp, Artificial Sequence
  chemically synthesized
ctggctttcaaggggccagt

SEQ ID NO: 71903 - DNA, 20 bp, Artificial Sequence
  chemically synthesized
tacctagccagcccactgag

SEQ ID NO: 71904 - DNA, 20 bp, Artificial Sequence
  chemically synthesized
tgagccaggcttggtgaagt

SEQ ID NO: 71905 - DNA, 20 bp, Artificial Sequence
  chemically synthesized
cccaaggtctgtacacatgc

SEQ ID NO: 71906 - DNA, 20 bp, Artificial Sequence
  chemically synthesized
ggggagcattcagcccaagg

SEQ ID NO: 71907 - DNA, 20 bp, Artificial Sequence
  chemically synthesized
atccccagggcacaagaaaa

SEQ ID NO: 71908 - DNA, 20 bp, Artificial Sequence
  chemically synthesized
actaaaattgatggagagag

SEQ ID NO: 71909 - DNA, 20 bp, Artificial Sequence
  chemically synthesized
gatggagagagataggtttt

SEQ ID NO: 71910 - DNA, 20 bp, Artificial Sequence
  chemically synthesized
agataggttttcttagcttt

SEQ ID NO: 71911 - DNA, 20 bp, Artificial Sequence
  chemically synthesized
actggagagacccacagaag

SEQ ID NO: 71912 - DNA, 20 bp, Artificial Sequence
  chemically synthesized
gtgtgtgcacagagagtctg

SEQ ID NO: 71913 - DNA, 20 bp, Artificial Sequence
  chemically synthesized
cttcagtcattatgaaaggg

SEQ ID NO: 71914 - DNA, 20 bp, Artificial Sequence
  chemically synthesized
ctccccactccaagttgggc

SEQ ID NO: 71915 - DNA, 20 bp, Artificial Sequence
  chemically synthesized
gttttagtgtattttgcata

SEQ ID NO: 71916 - DNA, 20 bp, Artificial Sequence
  chemically synthesized
taacagagtacctgagtctg

SEQ ID NO: 71917 - DNA, 20 bp, Artificial Sequence
  chemically synthesized
ggtagcttattttttttttt

SEQ ID NO: 71918 - DNA, 20 bp, Artificial Sequence
  chemically synthesized
cttattttttttttttaaag

SEQ ID NO: 71919 - DNA, 20 bp, Artificial Sequence
  chemically synthesized
tttttaaagttttgtttggt

SEQ ID NO: 71920 - DNA, 20 bp, Artificial Sequence
  chemically synthesized
aattctaaaaggaaacaaaa

SEQ ID NO: 71921 - DNA, 20 bp, Artificial Sequence
  chemically synthesized
aaggaaacaaaaaatggatt

SEQ ID NO: 71922 - DNA, 20 bp, Artificial Sequence
  chemically synthesized
tttttgaggaattattgact

SEQ ID NO: 71923 - DNA, 20 bp, Artificial Sequence
  chemically synthesized
tttattattattattatact

SEQ ID NO: 71924 - DNA, 20 bp, Artificial Sequence
  chemically synthesized
catctatgagtgagaatatg

SEQ ID NO: 71925 - DNA, 20 bp, Artificial Sequence
  chemically synthesized
atgagtgagaatatgtggtg

SEQ ID NO: 71926 - DNA, 20 bp, Artificial Sequence
  chemically synthesized
gtttggttttttgtccttgc

SEQ ID NO: 71927 - DNA, 20 bp, Artificial Sequence
  chemically synthesized
ttgcgatagtttactgagaa

SEQ ID NO: 71928 - DNA, 20 bp, Artificial Sequence
  chemically synthesized
gtgcatgtgtctttatagca

SEQ ID NO: 71929 - DNA, 20 bp, Artificial Sequence
  chemically synthesized
ctgacttccacaatggttga

SEQ ID NO: 71930 - DNA, 20 bp, Artificial Sequence
  chemically synthesized
tccacatcctctccagcacc

SEQ ID NO: 71931 - DNA, 20 bp, Artificial Sequence
  chemically synthesized
cctgttgtttcctgactttt

SEQ ID NO: 71932 - DNA, 20 bp, Artificial Sequence
  chemically synthesized
ggtatgagatggtatctcat

SEQ ID NO: 71933 - DNA, 20 bp, Artificial Sequence
  chemically synthesized
gagatggtatctcattgtgg

SEQ ID NO: 71934 - DNA, 20 bp, Artificial Sequence
  chemically synthesized
catgtgtcttttggttgcat

SEQ ID NO: 71935 - DNA, 20 bp, Artificial Sequence
  chemically synthesized
ctttgcccacttgttgatgg

SEQ ID NO: 71936 - DNA, 20 bp, Artificial Sequence
  chemically synthesized
gcccacttgttgatggggct

SEQ ID NO: 71937 - DNA, 20 bp, Artificial Sequence
  chemically synthesized
tgtttgtttttttcttgtaa

SEQ ID NO: 71938 - DNA, 20 bp, Artificial Sequence
  chemically synthesized
gtaaatttgtttgagttcat

SEQ ID NO: 71939 - DNA, 20 bp, Artificial Sequence
  chemically synthesized
ggttgcctgttcactctgat

SEQ ID NO: 71940 - DNA, 20 bp, Artificial Sequence
  chemically synthesized
ctttagctgtgcagaagctc

SEQ ID NO: 71941 - DNA, 20 bp, Artificial Sequence
  chemically synthesized
attagatcccattagtgaat

SEQ ID NO: 71942 - DNA, 20 bp, Artificial Sequence
  chemically synthesized
tgaattttggcttttgttgc

SEQ ID NO: 71943 - DNA, 20 bp, Artificial Sequence
  chemically synthesized
gcttttgttgccatcgcttt

SEQ ID NO: 71944 - DNA, 20 bp, Artificial Sequence
  chemically synthesized
tatgtcctgaatggtaatgc

SEQ ID NO: 71945 - DNA, 20 bp, Artificial Sequence
  chemically synthesized
gtaatgcctgcgttttcttc

SEQ ID NO: 71946 - DNA, 20 bp, Artificial Sequence
  chemically synthesized
gcgttttcttctagggtttt

SEQ ID NO: 71947 - DNA, 20 bp, Artificial Sequence
  chemically synthesized
ggtttttatggttttaggtc

SEQ ID NO: 71948 - DNA, 20 bp, Artificial Sequence
  chemically synthesized
tataaggtgtaaggaaggga

SEQ ID NO: 71949 - DNA, 20 bp, Artificial Sequence
  chemically synthesized
tagggaatcctttccccatt

SEQ ID NO: 71950 - DNA, 20 bp, Artificial Sequence
  chemically synthesized
ttccccatttcttgtttttc

SEQ ID NO: 71951 - DNA, 20 bp, Artificial Sequence
  chemically synthesized
tctgttccattgatctatat

SEQ ID NO: 71952 - DNA, 20 bp, Artificial Sequence
  chemically synthesized
gtgttttggtaccagtaaca

SEQ ID NO: 71953 - DNA, 20 bp, Artificial Sequence
  chemically synthesized
tggttactgtagccttgtag

SEQ ID NO: 71954 - DNA, 20 bp, Artificial Sequence
  chemically synthesized
aagtgaggtagcctgatgcc

SEQ ID NO: 71955 - DNA, 20 bp, Artificial Sequence
  chemically synthesized
gatgcctccagctttgttct

SEQ ID NO: 71956 - DNA, 20 bp, Artificial Sequence
  chemically synthesized
tccagctttgttcttttggc

SEQ ID NO: 71957 - DNA, 20 bp, Artificial Sequence
  chemically synthesized
tggttccatatgaactttaa

SEQ ID NO: 71958 - DNA, 20 bp, Artificial Sequence
  chemically synthesized
attctgtgaagaaaatcatt

SEQ ID NO: 71959 - DNA, 20 bp, Artificial Sequence
  chemically synthesized
cattatggccattttgatga

SEQ ID NO: 71960 - DNA, 20 bp, Artificial Sequence
  chemically synthesized
taagcatggaatgttcttcc

SEQ ID NO: 71961 - DNA, 20 bp, Artificial Sequence
  chemically synthesized
cttcttttatttcattgagc

SEQ ID NO: 71962 - DNA, 20 bp, Artificial Sequence
  chemically synthesized
gtccttcacatcccttgtaa

SEQ ID NO: 71963 - DNA, 20 bp, Artificial Sequence
  chemically synthesized
aattgtgaatgggagttccc

SEQ ID NO: 71964 - DNA, 20 bp, Artificial Sequence
  chemically synthesized
agttccctcatgatttggct

SEQ ID NO: 71965 - DNA, 20 bp, Artificial Sequence
  chemically synthesized
tgtctgttattggtgtataa

SEQ ID NO: 71966 - DNA, 20 bp, Artificial Sequence
  chemically synthesized
ttattggtgtataagaatgc

SEQ ID NO: 71967 - DNA, 20 bp, Artificial Sequence
  chemically synthesized
aatgcttgtgatttttgcac

SEQ ID NO: 71968 - DNA, 20 bp, Artificial Sequence
  chemically synthesized
tgcacattggttttgtatcc

SEQ ID NO: 71969 - DNA, 20 bp, Artificial Sequence
  chemically synthesized
gtatcctgaggctttgctga

SEQ ID NO: 71970 - DNA, 20 bp, Artificial Sequence
  chemically synthesized
aggctttgctgaagttgctt

SEQ ID NO: 71971 - DNA, 20 bp, Artificial Sequence
  chemically synthesized
tgaagttgcttatcagctta

SEQ ID NO: 71972 - DNA, 20 bp, Artificial Sequence
  chemically synthesized
gagattttgggctgagacaa

SEQ ID NO: 71973 - DNA, 20 bp, Artificial Sequence
  chemically synthesized
agagggcatccctgtcttgt

SEQ ID NO: 71974 - DNA, 20 bp, Artificial Sequence
  chemically synthesized
cttgtgccagtttacaaagg

SEQ ID NO: 71975 - DNA, 20 bp, Artificial Sequence
  chemically synthesized
cagtttacaaagggaatgct

SEQ ID NO: 71976 - DNA, 20 bp, Artificial Sequence
  chemically synthesized
cattcagtatgatattggct

SEQ ID NO: 71977 - DNA, 20 bp, Artificial Sequence
  chemically synthesized
ccatcaatacctaatttatt

SEQ ID NO: 71978 - DNA, 20 bp, Artificial Sequence
  chemically synthesized
tgcatctattgagataatca

SEQ ID NO: 71979 - DNA, 20 bp, Artificial Sequence
  chemically synthesized
catgtggtttttgtctttgg

SEQ ID NO: 71980 - DNA, 20 bp, Artificial Sequence
  chemically synthesized
gtctttggttctgtttatat

SEQ ID NO: 71981 - DNA, 20 bp, Artificial Sequence
  chemically synthesized
tttatatgctggattacatt

SEQ ID NO: 71982 - DNA, 20 bp, Artificial Sequence
  chemically synthesized
agtccacttgatcatcgtgg

SEQ ID NO: 71983 - DNA, 20 bp, Artificial Sequence
  chemically synthesized
gataagctttttgatgtgct

SEQ ID NO: 71984 - DNA, 20 bp, Artificial Sequence
  chemically synthesized
ctttttgatgtgctgctgga

SEQ ID NO: 71985 - DNA, 20 bp, Artificial Sequence
  chemically synthesized
tcggtttgccagtattttat

SEQ ID NO: 71986 - DNA, 20 bp, Artificial Sequence
  chemically synthesized
cttttttggttgtgtctctt

SEQ ID NO: 71987 - DNA, 20 bp, Artificial Sequence
  chemically synthesized
ggcctcataaaatgagttag

SEQ ID NO: 71988 - DNA, 20 bp, Artificial Sequence
  chemically synthesized
gggaggattccttctttttc

SEQ ID NO: 71989 - DNA, 20 bp, Artificial Sequence
  chemically synthesized
cttctttttctgttgattgg

SEQ ID NO: 71990 - DNA, 20 bp, Artificial Sequence
  chemically synthesized
actctttttggttggtaagc

SEQ ID NO: 71991 - DNA, 20 bp, Artificial Sequence
  chemically synthesized
gatcctgttattggtctatt

SEQ ID NO: 71992 - DNA, 20 bp, Artificial Sequence
  chemically synthesized
attcagagattcaacttctt

SEQ ID NO: 71993 - DNA, 20 bp, Artificial Sequence
  chemically synthesized
ccaggaatttatccatttct

SEQ ID NO: 71994 - DNA, 20 bp, Artificial Sequence
  chemically synthesized
tatccatttcttctagattt

SEQ ID NO: 71995 - DNA, 20 bp, Artificial Sequence
  chemically synthesized
tttctagtttatttgcgtag

SEQ ID NO: 71996 - DNA, 20 bp, Artificial Sequence
  chemically synthesized
tgtttgtagtattctctgat

SEQ ID NO: 71997 - DNA, 20 bp, Artificial Sequence
  chemically synthesized
atcatttttttattgtgtct

SEQ ID NO: 71998 - DNA, 20 bp, Artificial Sequence
  chemically synthesized
attagtcttgctagcggtct

SEQ ID NO: 71999 - DNA, 20 bp, Artificial Sequence
  chemically synthesized
atcctttcaaaaaaccagct

SEQ ID NO: 72000 - DNA, 20 bp, Artificial Sequence
  chemically synthesized
ccagattcattaattttttg

SEQ ID NO: 72001 - DNA, 20 bp, Artificial Sequence
  chemically synthesized
ttttgaagggttttttgtgt

SEQ ID NO: 72002 - DNA, 20 bp, Artificial Sequence
  chemically synthesized
ctctgtttccttcagttctg

SEQ ID NO: 72003 - DNA, 20 bp, Artificial Sequence
  chemically synthesized
ttagttatttcttgacttct

SEQ ID NO: 72004 - DNA, 20 bp, Artificial Sequence
  chemically synthesized
tgacttctgctagcttttga

SEQ ID NO: 72005 - DNA, 20 bp, Artificial Sequence
  chemically synthesized
tagcttttgaatgtgtttgc

SEQ ID NO: 72006 - DNA, 20 bp, Artificial Sequence
  chemically synthesized
gggtgtcaattttggatctt

SEQ ID NO: 72007 - DNA, 20 bp, Artificial Sequence
  chemically synthesized
tctttcttgctttctcttgt

SEQ ID NO: 72008 - DNA, 20 bp, Artificial Sequence
  chemically synthesized
gctataaatttccccctaca

SEQ ID NO: 72009 - DNA, 20 bp, Artificial Sequence
  chemically synthesized
acactgattcgaatgtgtcc

SEQ ID NO: 72010 - DNA, 20 bp, Artificial Sequence
  chemically synthesized
tatgttgtgtctttgttctc

SEQ ID NO: 72011 - DNA, 20 bp, Artificial Sequence
  chemically synthesized
agtcattcaggagcaggttg

SEQ ID NO: 72012 - DNA, 20 bp, Artificial Sequence
  chemically synthesized
gttcagtttccatgtagttg

SEQ ID NO: 72013 - DNA, 20 bp, Artificial Sequence
  chemically synthesized
atgtagttgagtggttttga

SEQ ID NO: 72014 - DNA, 20 bp, Artificial Sequence
  chemically synthesized
tgagtttcttaatcctgagt

SEQ ID NO: 72015 - DNA, 20 bp, Artificial Sequence
  chemically synthesized
tttcttaatcctgagttcta

SEQ ID NO: 72016 - DNA, 20 bp, Artificial Sequence
  chemically synthesized
gattgcactgtggtctgaga

SEQ ID NO: 72017 - DNA, 20 bp, Artificial Sequence
  chemically synthesized
gttcttttatatttgctgag

SEQ ID NO: 72018 - DNA, 20 bp, Artificial Sequence
  chemically synthesized
ctgaaaaaaaatgtatattc

SEQ ID NO: 72019 - DNA, 20 bp, Artificial Sequence
  chemically synthesized
gttctgtagatgtctattag

SEQ ID NO: 72020 - DNA, 20 bp, Artificial Sequence
  chemically synthesized
ctctttgtaggtctctaagg

SEQ ID NO: 72021 - DNA, 20 bp, Artificial Sequence
  chemically synthesized
ctttgtctcttttgatcttt

SEQ ID NO: 72022 - DNA, 20 bp, Artificial Sequence
  chemically synthesized
ttgatctttgttggtttaaa

SEQ ID NO: 72023 - DNA, 20 bp, Artificial Sequence
  chemically synthesized
aaagcctgttttatcagaga

SEQ ID NO: 72024 - DNA, 20 bp, Artificial Sequence
  chemically synthesized
ggattgcaacccctgccttt

SEQ ID NO: 72025 - DNA, 20 bp, Artificial Sequence
  chemically synthesized
cctgcctttttttgttttcc

SEQ ID NO: 72026 - DNA, 20 bp, Artificial Sequence
  chemically synthesized
tgtgtgtgtgtgcacatgag

SEQ ID NO: 72027 - DNA, 20 bp, Artificial Sequence
  chemically synthesized
ttattttgctcgttagttga

SEQ ID NO: 72028 - DNA, 20 bp, Artificial Sequence
  chemically synthesized
ttgatggtcttcacattttg

SEQ ID NO: 72029 - DNA, 20 bp, Artificial Sequence
  chemically synthesized
ctggtaccggttgtgccttt

SEQ ID NO: 72030 - DNA, 20 bp, Artificial Sequence
  chemically synthesized
cggttgtgcctttccatgtt

SEQ ID NO: 72031 - DNA, 20 bp, Artificial Sequence
  chemically synthesized
tgatgacaaaatctctcagc

SEQ ID NO: 72032 - DNA, 20 bp, Artificial Sequence
  chemically synthesized
ttttatttctccttcactta

SEQ ID NO: 72033 - DNA, 20 bp, Artificial Sequence
  chemically synthesized
tttctccttcacttatgaag

SEQ ID NO: 72034 - DNA, 20 bp, Artificial Sequence
  chemically synthesized
aatattggcccccactctct

SEQ ID NO: 72035 - DNA, 20 bp, Artificial Sequence
  chemically synthesized
ccccactctcttctggcttg

SEQ ID NO: 72036 - DNA, 20 bp, Artificial Sequence
  chemically synthesized
agagagctgctgttagtctg

SEQ ID NO: 72037 - DNA, 20 bp, Artificial Sequence
  chemically synthesized
ggagttgctcttctcgagga

SEQ ID NO: 72038 - DNA, 20 bp, Artificial Sequence
  chemically synthesized
tctgaatgttggcctgcctt

SEQ ID NO: 72039 - DNA, 20 bp, Artificial Sequence
  chemically synthesized
ctcctggataatatcctgca

SEQ ID NO: 72040 - DNA, 20 bp, Artificial Sequence
  chemically synthesized
gcagagtgttttccaacttg

SEQ ID NO: 72041 - DNA, 20 bp, Artificial Sequence
  chemically synthesized
tttcaggtacaccaatcaga

SEQ ID NO: 72042 - DNA, 20 bp, Artificial Sequence
  chemically synthesized
cacatagtcccatatttctt

SEQ ID NO: 72043 - DNA, 20 bp, Artificial Sequence
  chemically synthesized
ttttttctctaaacttccct

SEQ ID NO: 72044 - DNA, 20 bp, Artificial Sequence
  chemically synthesized
cagttgatcgcatcagctcc

SEQ ID NO: 72045 - DNA, 20 bp, Artificial Sequence
  chemically synthesized
tcttcacgtcattctcgagc

SEQ ID NO: 72046 - DNA, 20 bp, Artificial Sequence
  chemically synthesized
cattcatctaaatttttttt

SEQ ID NO: 72047 - DNA, 20 bp, Artificial Sequence
  chemically synthesized
aagtttttatcttctttgcc

SEQ ID NO: 72048 - DNA, 20 bp, Artificial Sequence
  chemically synthesized
aatttcctcctgtagctcgg

SEQ ID NO: 72049 - DNA, 20 bp, Artificial Sequence
  chemically synthesized
ctcgtcaaagtcattctcca

SEQ ID NO: 72050 - DNA, 20 bp, Artificial Sequence
  chemically synthesized
ttgttccgttgctggtgagg

SEQ ID NO: 72051 - DNA, 20 bp, Artificial Sequence
  chemically synthesized
cctttggaggaggaaaggtg

SEQ ID NO: 72052 - DNA, 20 bp, Artificial Sequence
  chemically synthesized
aggaaaggtgctctgctttt

SEQ ID NO: 72053 - DNA, 20 bp, Artificial Sequence
  chemically synthesized
gtgctctgctttttagagtt

SEQ ID NO: 72054 - DNA, 20 bp, Artificial Sequence
  chemically synthesized
tagagtttccagtttttctg

SEQ ID NO: 72055 - DNA, 20 bp, Artificial Sequence
  chemically synthesized
ttgatgatagtgatgtaccg

SEQ ID NO: 72056 - DNA, 20 bp, Artificial Sequence
  chemically synthesized
gtttttggtgtggatgtcct

SEQ ID NO: 72057 - DNA, 20 bp, Artificial Sequence
  chemically synthesized
tgtggatgtcctttctgttt

SEQ ID NO: 72058 - DNA, 20 bp, Artificial Sequence
  chemically synthesized
accctcagctgcaggtctgt

SEQ ID NO: 72059 - DNA, 20 bp, Artificial Sequence
  chemically synthesized
tgctagaggtccactccaga

SEQ ID NO: 72060 - DNA, 20 bp, Artificial Sequence
  chemically synthesized
agcagcggtgtctgcagaac

SEQ ID NO: 72061 - DNA, 20 bp, Artificial Sequence
  chemically synthesized
tgctgtctgatcgttcctct

SEQ ID NO: 72062 - DNA, 20 bp, Artificial Sequence
  chemically synthesized
tgcagaggttactgctgtct

SEQ ID NO: 72063 - DNA, 20 bp, Artificial Sequence
  chemically synthesized
ttgagctgtggtggggtcca

SEQ ID NO: 72064 - DNA, 20 bp, Artificial Sequence
  chemically synthesized
tgtggtggggtccacccagt

SEQ ID NO: 72065 - DNA, 20 bp, Artificial Sequence
  chemically synthesized
ccacccagtttgagcttcct

SEQ ID NO: 72066 - DNA, 20 bp, Artificial Sequence
  chemically synthesized
cagtttgagcttcctggctg

SEQ ID NO: 72067 - DNA, 20 bp, Artificial Sequence
  chemically synthesized
ccccagcctcgctgccacct

SEQ ID NO: 72068 - DNA, 20 bp, Artificial Sequence
  chemically synthesized
aaagggaactccatgacccc

SEQ ID NO: 72069 - DNA, 20 bp, Artificial Sequence
  chemically synthesized
ccaagtgaggcaatgcctca

SEQ ID NO: 72070 - DNA, 20 bp, Artificial Sequence
  chemically synthesized
atctctatacatgttcttcc

SEQ ID NO: 72071 - DNA, 20 bp, Artificial Sequence
  chemically synthesized
tacatgttcttccaggagtt

SEQ ID NO: 72072 - DNA, 20 bp, Artificial Sequence
  chemically synthesized
taatctattttgagttgact

SEQ ID NO: 72073 - DNA, 20 bp, Artificial Sequence
  chemically synthesized
tattcttttgcatttggata

SEQ ID NO: 72074 - DNA, 20 bp, Artificial Sequence
  chemically synthesized
taccatacttttttggttac

SEQ ID NO: 72075 - DNA, 20 bp, Artificial Sequence
  chemically synthesized
agaacgtgtgctgccatcaa

SEQ ID NO: 72076 - DNA, 20 bp, Artificial Sequence
  chemically synthesized
atcaagttggtttttctttc

SEQ ID NO: 72077 - DNA, 20 bp, Artificial Sequence
  chemically synthesized
agttggtttttctttctcaa

SEQ ID NO: 72078 - DNA, 20 bp, Artificial Sequence
  chemically synthesized
ttggccatttgggggtgttc

SEQ ID NO: 72079 - DNA, 20 bp, Artificial Sequence
  chemically synthesized
tggtttcatacaaattttca

SEQ ID NO: 72080 - DNA, 20 bp, Artificial Sequence
  chemically synthesized
agaaaacaatcatcaaaagg

SEQ ID NO: 72081 - DNA, 20 bp, Artificial Sequence
  chemically synthesized
agccattatagaaaacgtat

SEQ ID NO: 72082 - DNA, 20 bp, Artificial Sequence
  chemically synthesized
cttgcagctgtataggataa

SEQ ID NO: 72083 - DNA, 20 bp, Artificial Sequence
  chemically synthesized
ttgtattgatggataggtta

SEQ ID NO: 72084 - DNA, 20 bp, Artificial Sequence
  chemically synthesized
attgatggataggttaattt

SEQ ID NO: 72085 - DNA, 20 bp, Artificial Sequence
  chemically synthesized
atatatcctatattttttga

SEQ ID NO: 72086 - DNA, 20 bp, Artificial Sequence
  chemically synthesized
tatattttttgaacaagctt

SEQ ID NO: 72087 - DNA, 20 bp, Artificial Sequence
  chemically synthesized
tgtttcagataaaatatttt

SEQ ID NO: 72088 - DNA, 20 bp, Artificial Sequence
  chemically synthesized
ttatctgaagcaagtcaaat

SEQ ID NO: 72089 - DNA, 20 bp, Artificial Sequence
  chemically synthesized
aagtcaaatttctgtttcct

SEQ ID NO: 72090 - DNA, 20 bp, Artificial Sequence
  chemically synthesized
ccctttggatataatgagat

SEQ ID NO: 72091 - DNA, 20 bp, Artificial Sequence
  chemically synthesized
tatatctccggcctacaact

SEQ ID NO: 72092 - DNA, 20 bp, Artificial Sequence
  chemically synthesized
cggcctacaactcagggttt

SEQ ID NO: 72093 - DNA, 20 bp, Artificial Sequence
  chemically synthesized
gtttcatcaatgtctctatt

SEQ ID NO: 72094 - DNA, 20 bp, Artificial Sequence
  chemically synthesized
tgttcaatttttttgaactt

SEQ ID NO: 72095 - DNA, 20 bp, Artificial Sequence
  chemically synthesized
atttttttgaacttctgtgt

SEQ ID NO: 72096 - DNA, 20 bp, Artificial Sequence
  chemically synthesized
agatccggggaaaggtgctg

SEQ ID NO: 72097 - DNA, 20 bp, Artificial Sequence
  chemically synthesized
tcagaacccgcatttgtcac

SEQ ID NO: 72098 - DNA, 20 bp, Artificial Sequence
  chemically synthesized
tatttcctttccgttaaaat

SEQ ID NO: 72099 - DNA, 20 bp, Artificial Sequence
  chemically synthesized
taaacaaacaactaaacaat

SEQ ID NO: 72100 - DNA, 20 bp, Artificial Sequence
  chemically synthesized
cataccaacaaatgatcctc

SEQ ID NO: 72101 - DNA, 20 bp, Artificial Sequence
  chemically synthesized
tgacctgacaacccagctat

SEQ ID NO: 72102 - DNA, 20 bp, Artificial Sequence
  chemically synthesized
aaacattcaaaccttcaact

SEQ ID NO: 72103 - DNA, 20 bp, Artificial Sequence
  chemically synthesized
aatgataataataaatacat

SEQ ID NO: 72104 - DNA, 20 bp, Artificial Sequence
  chemically synthesized
tctatatgcatttctataga

SEQ ID NO: 72105 - DNA, 20 bp, Artificial Sequence
  chemically synthesized
acaaaccataagatggcagg

SEQ ID NO: 72106 - DNA, 20 bp, Artificial Sequence
  chemically synthesized
tctcctggggccatgcagag

SEQ ID NO: 72107 - DNA, 20 bp, Artificial Sequence
  chemically synthesized
aggtttgaagatcttgttga

SEQ ID NO: 72108 - DNA, 20 bp, Artificial Sequence
  chemically synthesized
tttaacaactgttgacttat

SEQ ID NO: 72109 - DNA, 20 bp, Artificial Sequence
  chemically synthesized
acaaaaatgcagacaagcag

SEQ ID NO: 72110 - DNA, 20 bp, Artificial Sequence
  chemically synthesized
aaagttgcagagaaatgtat

SEQ ID NO: 72111 - DNA, 20 bp, Artificial Sequence
  chemically synthesized
ttttttaaatgtctcaaatt

SEQ ID NO: 72112 - DNA, 20 bp, Artificial Sequence
  chemically synthesized
ccagaaaaaatatataaaaa

SEQ ID NO: 72113 - DNA, 20 bp, Artificial Sequence
  chemically synthesized
tatataaaaagtctgtttca

SEQ ID NO: 72114 - DNA, 20 bp, Artificial Sequence
  chemically synthesized
taatatttgttaagccgtga

SEQ ID NO: 72115 - DNA, 20 bp, Artificial Sequence
  chemically synthesized
atcctttctgtatgtctaac

SEQ ID NO: 72116 - DNA, 20 bp, Artificial Sequence
  chemically synthesized
aggtggcccaaccaccctat

SEQ ID NO: 72117 - DNA, 20 bp, Artificial Sequence
  chemically synthesized
cccaaccaccctatcacaga

SEQ ID NO: 72118 - DNA, 20 bp, Artificial Sequence
  chemically synthesized
ctagttggctgacacacaat

SEQ ID NO: 72119 - DNA, 20 bp, Artificial Sequence
  chemically synthesized
gaaagaaaaagttcctgaac

SEQ ID NO: 72120 - DNA, 20 bp, Artificial Sequence
  chemically synthesized
ggaaaaaaagaaaagccatc

SEQ ID NO: 72121 - DNA, 20 bp, Artificial Sequence
  chemically synthesized
agctttcagaaggcctatgc

SEQ ID NO: 72122 - DNA, 20 bp, Artificial Sequence
  chemically synthesized
tcagaaggcctatgctgagg

SEQ ID NO: 72123 - DNA, 20 bp, Artificial Sequence
  chemically synthesized
tatgctgaggttttgcttcc

SEQ ID NO: 72124 - DNA, 20 bp, Artificial Sequence
  chemically synthesized
gcataatattttgagtaact

SEQ ID NO: 72125 - DNA, 20 bp, Artificial Sequence
  chemically synthesized
aaactgaaacctctactatg

SEQ ID NO: 72126 - DNA, 20 bp, Artificial Sequence
  chemically synthesized
atcttgtgtaacttcaagta

SEQ ID NO: 72127 - DNA, 20 bp, Artificial Sequence
  chemically synthesized
ttcaagtattacgattgtga

SEQ ID NO: 72128 - DNA, 20 bp, Artificial Sequence
  chemically synthesized
cgattgtgagagagcttttt

SEQ ID NO: 72129 - DNA, 20 bp, Artificial Sequence
  chemically synthesized
cattttcacaaaattttcaa

SEQ ID NO: 72130 - DNA, 20 bp, Artificial Sequence
  chemically synthesized
gatgattatagtaataatag

SEQ ID NO: 72131 - DNA, 20 bp, Artificial Sequence
  chemically synthesized
gaccaaaacacagaaagata

SEQ ID NO: 72132 - DNA, 20 bp, Artificial Sequence
  chemically synthesized
acgcagccaataagtggaag

SEQ ID NO: 72133 - DNA, 20 bp, Artificial Sequence
  chemically synthesized
gaaggtgggattgtaaacca

SEQ ID NO: 72134 - DNA, 20 bp, Artificial Sequence
  chemically synthesized
gtatgaagaagcatgaaaca

SEQ ID NO: 72135 - DNA, 20 bp, Artificial Sequence
  chemically synthesized
agaagcctacagaacactta

SEQ ID NO: 72136 - DNA, 20 bp, Artificial Sequence
  chemically synthesized
cataggagcaaagaaccaag

SEQ ID NO: 72137 - DNA, 20 bp, Artificial Sequence
  chemically synthesized
gaagtgaaactttgaagaat

SEQ ID NO: 72138 - DNA, 20 bp, Artificial Sequence
  chemically synthesized
aggaaaatgcatagccttgg

SEQ ID NO: 72139 - DNA, 20 bp, Artificial Sequence
  chemically synthesized
cataaagaccttgctgaaaa

SEQ ID NO: 72140 - DNA, 20 bp, Artificial Sequence
  chemically synthesized
gctggctgaaacccaccaaa

SEQ ID NO: 72141 - DNA, 20 bp, Artificial Sequence
  chemically synthesized
tactctcccaccagcactat

SEQ ID NO: 72142 - DNA, 20 bp, Artificial Sequence
  chemically synthesized
ggaggcatgaataatccacc

SEQ ID NO: 72143 - DNA, 20 bp, Artificial Sequence
  chemically synthesized
ctcctttactttcttaatta

SEQ ID NO: 72144 - DNA, 20 bp, Artificial Sequence
  chemically synthesized
aacttgctttcacttttctg

SEQ ID NO: 72145 - DNA, 20 bp, Artificial Sequence
  chemically synthesized
ccaagaaccctctcttaggg

SEQ ID NO: 72146 - DNA, 20 bp, Artificial Sequence
  chemically synthesized
ggattgtgactcctttctgg

SEQ ID NO: 72147 - DNA, 20 bp, Artificial Sequence
  chemically synthesized
acttcaaaaatctcctttca

SEQ ID NO: 72148 - DNA, 20 bp, Artificial Sequence
  chemically synthesized
actaaaactctgtgtcacta

SEQ ID NO: 72149 - DNA, 20 bp, Artificial Sequence
  chemically synthesized
ggtggcatgtgtatgtgtgg

SEQ ID NO: 72150 - DNA, 20 bp, Artificial Sequence
  chemically synthesized
gtcctgcattgcacagagac

SEQ ID NO: 72151 - DNA, 20 bp, Artificial Sequence
  chemically synthesized
cattgcacagagacccgtgc

SEQ ID NO: 72152 - DNA, 20 bp, Artificial Sequence
  chemically synthesized
ctttgaatctcaagtgaata

SEQ ID NO: 72153 - DNA, 20 bp, Artificial Sequence
  chemically synthesized
ctttctctatttctttctca

SEQ ID NO: 72154 - DNA, 20 bp, Artificial Sequence
  chemically synthesized
aacctccgcctcccaggttc

SEQ ID NO: 72155 - DNA, 20 bp, Artificial Sequence
  chemically synthesized
ttttgtatttttattagaga

SEQ ID NO: 72156 - DNA, 20 bp, Artificial Sequence
  chemically synthesized
tgcctcagccacccaaagtg

SEQ ID NO: 72157 - DNA, 20 bp, Artificial Sequence
  chemically synthesized
aaccttcccttgagctcctt

SEQ ID NO: 72158 - DNA, 20 bp, Artificial Sequence
  chemically synthesized
gctccttttcagattcttcc

SEQ ID NO: 72159 - DNA, 20 bp, Artificial Sequence
  chemically synthesized
ctttgtcttctatactttcc

SEQ ID NO: 72160 - DNA, 20 bp, Artificial Sequence
  chemically synthesized
actttcctactgattttcct

SEQ ID NO: 72161 - DNA, 20 bp, Artificial Sequence
  chemically synthesized
ctcatccttaacttcctact

SEQ ID NO: 72162 - DNA, 20 bp, Artificial Sequence
  chemically synthesized
cttgctctatcctcttcaca

SEQ ID NO: 72163 - DNA, 20 bp, Artificial Sequence
  chemically synthesized
ccattaacagcccccaaaca

SEQ ID NO: 72164 - DNA, 20 bp, Artificial Sequence
  chemically synthesized
tagccagcacctagcagttc

SEQ ID NO: 72165 - DNA, 20 bp, Artificial Sequence
  chemically synthesized
tgtgggtaatggaggtgatg

SEQ ID NO: 72166 - DNA, 20 bp, Artificial Sequence
  chemically synthesized
ggattataatatctgccctc

SEQ ID NO: 72167 - DNA, 20 bp, Artificial Sequence
  chemically synthesized
ttacaggacaatttaaatgt

SEQ ID NO: 72168 - DNA, 20 bp, Artificial Sequence
  chemically synthesized
tttgggttgaataaaatcag

SEQ ID NO: 72169 - DNA, 20 bp, Artificial Sequence
  chemically synthesized
ggaggtgtgttaagacagta

SEQ ID NO: 72170 - DNA, 20 bp, Artificial Sequence
  chemically synthesized
cgatgtcatgtgcatctcga

SEQ ID NO: 72171 - DNA, 20 bp, Artificial Sequence
  chemically synthesized
gataatgtttttgtgtatca

SEQ ID NO: 72172 - DNA, 20 bp, Artificial Sequence
  chemically synthesized
catctaaatgcatctctcca

SEQ ID NO: 72173 - DNA, 20 bp, Artificial Sequence
  chemically synthesized
tctccacagcgatttctaca

SEQ ID NO: 72174 - DNA, 20 bp, Artificial Sequence
  chemically synthesized
catgccgggaccagccatgc

SEQ ID NO: 72175 - DNA, 20 bp, Artificial Sequence
  chemically synthesized
catcagtgtatgctctatac

SEQ ID NO: 72176 - DNA, 20 bp, Artificial Sequence
  chemically synthesized
accagcccttctggttcact

SEQ ID NO: 72177 - DNA, 20 bp, Artificial Sequence
  chemically synthesized
tgaattcaaggttattacaa

SEQ ID NO: 72178 - DNA, 20 bp, Artificial Sequence
  chemically synthesized
caagcatgattattgacaca

SEQ ID NO: 72179 - DNA, 20 bp, Artificial Sequence
  chemically synthesized
attgagtgtcccttatttgc

SEQ ID NO: 72180 - DNA, 20 bp, Artificial Sequence
  chemically synthesized
cttcatttttttccctctct

SEQ ID NO: 72181 - DNA, 20 bp, Artificial Sequence
  chemically synthesized
tgtatccaccatagaagcta

SEQ ID NO: 72182 - DNA, 20 bp, Artificial Sequence
  chemically synthesized
aggtaacaaagtcctgtgag

SEQ ID NO: 72183 - DNA, 20 bp, Artificial Sequence
  chemically synthesized
tgtcatatgctggatgggca

SEQ ID NO: 72184 - DNA, 20 bp, Artificial Sequence
  chemically synthesized
gagagacacataaatacctc

SEQ ID NO: 72185 - DNA, 20 bp, Artificial Sequence
  chemically synthesized
acacataaatacctctcacg

SEQ ID NO: 72186 - DNA, 20 bp, Artificial Sequence
  chemically synthesized
ctcctactctcttcaaagca

SEQ ID NO: 72187 - DNA, 20 bp, Artificial Sequence
  chemically synthesized
atcatagccttaccatgacc

SEQ ID NO: 72188 - DNA, 20 bp, Artificial Sequence
  chemically synthesized
catgacctcctgtttctgca

SEQ ID NO: 72189 - DNA, 20 bp, Artificial Sequence
  chemically synthesized
tccatatcaccccaaattcc

SEQ ID NO: 72190 - DNA, 20 bp, Artificial Sequence
  chemically synthesized
attccaatggttttgtgaag

SEQ ID NO: 72191 - DNA, 20 bp, Artificial Sequence
  chemically synthesized
tcaaactttgtcatagctag

SEQ ID NO: 72192 - DNA, 20 bp, Artificial Sequence
  chemically synthesized
ctagatgagctttttgaact

SEQ ID NO: 72193 - DNA, 20 bp, Artificial Sequence
  chemically synthesized
aaaatattttgcccttaggt

SEQ ID NO: 72194 - DNA, 20 bp, Artificial Sequence
  chemically synthesized
ggcattcttccattcctaac

SEQ ID NO: 72195 - DNA, 20 bp, Artificial Sequence
  chemically synthesized
atgtcatgctgagtgggggc

SEQ ID NO: 72196 - DNA, 20 bp, Artificial Sequence
  chemically synthesized
gggaacataattgctatggt

SEQ ID NO: 72197 - DNA, 20 bp, Artificial Sequence
  chemically synthesized
tggatgtattgcatatggtc

SEQ ID NO: 72198 - DNA, 20 bp, Artificial Sequence
  chemically synthesized
tcctcatgaaaatgctactt

SEQ ID NO: 72199 - DNA, 20 bp, Artificial Sequence
  chemically synthesized
ttgttctttttctgtgtcac

SEQ ID NO: 72200 - DNA, 20 bp, Artificial Sequence
  chemically synthesized
cacactcaaaaacttggtat

SEQ ID NO: 72201 - DNA, 20 bp, Artificial Sequence
  chemically synthesized
tcaaaaacttggtatctgtg

SEQ ID NO: 72202 - DNA, 20 bp, Artificial Sequence
  chemically synthesized
tggagctgagtggtggtgat

SEQ ID NO: 72203 - DNA, 20 bp, Artificial Sequence
  chemically synthesized
tgagtggtggtgatgtgtgt

SEQ ID NO: 72204 - DNA, 20 bp, Artificial Sequence
  chemically synthesized
tgtgtttatgattgtgtgtg

SEQ ID NO: 72205 - DNA, 20 bp, Artificial Sequence
  chemically synthesized
tgtatgtgtgtcaagaggtt

SEQ ID NO: 72206 - DNA, 20 bp, Artificial Sequence
  chemically synthesized
ggcttaaaggaacaattaat

SEQ ID NO: 72207 - DNA, 20 bp, Artificial Sequence
  chemically synthesized
taggatcatgtactcaacac

SEQ ID NO: 72208 - DNA, 20 bp, Artificial Sequence
  chemically synthesized
tgagatcctgtattgatgaa

SEQ ID NO: 72209 - DNA, 20 bp, Artificial Sequence
  chemically synthesized
atcattctgttcgtaaaact

SEQ ID NO: 72210 - DNA, 20 bp, Artificial Sequence
  chemically synthesized
ctcagggtctctttcttccc

SEQ ID NO: 72211 - DNA, 20 bp, Artificial Sequence
  chemically synthesized
catttccttgggctcctttt

SEQ ID NO: 72212 - DNA, 20 bp, Artificial Sequence
  chemically synthesized
gaaaacttaatttacaaaag

SEQ ID NO: 72213 - DNA, 20 bp, Artificial Sequence
  chemically synthesized
gacttctgttatttcttatc

SEQ ID NO: 72214 - DNA, 20 bp, Artificial Sequence
  chemically synthesized
atatctaacaatgttatcta

SEQ ID NO: 72215 - DNA, 20 bp, Artificial Sequence
  chemically synthesized
tgattcatagtatccagtag

SEQ ID NO: 72216 - DNA, 20 bp, Artificial Sequence
  chemically synthesized
aaattcctgaccatcttcgt

SEQ ID NO: 72217 - DNA, 20 bp, Artificial Sequence
  chemically synthesized
cgtagttgattatggctctg

SEQ ID NO: 72218 - DNA, 20 bp, Artificial Sequence
  chemically synthesized
tccagcaccattttcatctg

SEQ ID NO: 72219 - DNA, 20 bp, Artificial Sequence
  chemically synthesized
accaacaagctctctctgac

SEQ ID NO: 72220 - DNA, 20 bp, Artificial Sequence
  chemically synthesized
ctctctctgactttggttta

SEQ ID NO: 72221 - DNA, 20 bp, Artificial Sequence
  chemically synthesized
taaagcattgtgcctcatgt

SEQ ID NO: 72222 - DNA, 20 bp, Artificial Sequence
  chemically synthesized
gcattgtgcctcatgtcaaa

SEQ ID NO: 72223 - DNA, 20 bp, Artificial Sequence
  chemically synthesized
atctgacactaatctatttg

SEQ ID NO: 72224 - DNA, 20 bp, Artificial Sequence
  chemically synthesized
cacatagaggcaaagaggaa

SEQ ID NO: 72225 - DNA, 20 bp, Artificial Sequence
  chemically synthesized
gagatatcattctgtattcc

SEQ ID NO: 72226 - DNA, 20 bp, Artificial Sequence
  chemically synthesized
tgtattcccgtggattttca

SEQ ID NO: 72227 - DNA, 20 bp, Artificial Sequence
  chemically synthesized
tagggaatgaaaaaggagat

SEQ ID NO: 72228 - DNA, 20 bp, Artificial Sequence
  chemically synthesized
cctcttctaggaatttgcaa

SEQ ID NO: 72229 - DNA, 20 bp, Artificial Sequence
  chemically synthesized
attattcagaagccaagttc

SEQ ID NO: 72230 - DNA, 20 bp, Artificial Sequence
  chemically synthesized
ttttagggagtctttgggat

SEQ ID NO: 72231 - DNA, 20 bp, Artificial Sequence
  chemically synthesized
gaagccaagctgcaaagaaa

SEQ ID NO: 72232 - DNA, 20 bp, Artificial Sequence
  chemically synthesized
cttctttattctcccagcct

SEQ ID NO: 72233 - DNA, 20 bp, Artificial Sequence
  chemically synthesized
aactttggaacaggagtcgc

SEQ ID NO: 72234 - DNA, 20 bp, Artificial Sequence
  chemically synthesized
aattagccacatctccagaa

SEQ ID NO: 72235 - DNA, 20 bp, Artificial Sequence
  chemically synthesized
agggaggatggcctttttgc

SEQ ID NO: 72236 - DNA, 20 bp, Artificial Sequence
  chemically synthesized
ctttcttttattattatact

SEQ ID NO: 72237 - DNA, 20 bp, Artificial Sequence
  chemically synthesized
agggtacatttgcacaacgt

SEQ ID NO: 72238 - DNA, 20 bp, Artificial Sequence
  chemically synthesized
cacctatgagtgagaacatg

SEQ ID NO: 72239 - DNA, 20 bp, Artificial Sequence
  chemically synthesized
atgagtgagaacatgcagtg

SEQ ID NO: 72240 - DNA, 20 bp, Artificial Sequence
  chemically synthesized
tgtttggtttttgtccttgc

SEQ ID NO: 72241 - DNA, 20 bp, Artificial Sequence
  chemically synthesized
tgcgatagtttgctgagaat

SEQ ID NO: 72242 - DNA, 20 bp, Artificial Sequence
  chemically synthesized
gtttgctgagaatgatggtt

SEQ ID NO: 72243 - DNA, 20 bp, Artificial Sequence
  chemically synthesized
tattccatggtgtatatgtg

SEQ ID NO: 72244 - DNA, 20 bp, Artificial Sequence
  chemically synthesized
gtgcatgtgtctttatagca

SEQ ID NO: 72245 - DNA, 20 bp, Artificial Sequence
  chemically synthesized
ctgacttccacaatggttga

SEQ ID NO: 72246 - DNA, 20 bp, Artificial Sequence
  chemically synthesized
ttcacatcctctccagcacc

SEQ ID NO: 72247 - DNA, 20 bp, Artificial Sequence
  chemically synthesized
ggtgtgagatggtatctcac

SEQ ID NO: 72248 - DNA, 20 bp, Artificial Sequence
  chemically synthesized
gagatggtatctcactgtgg

SEQ ID NO: 72249 - DNA, 20 bp, Artificial Sequence
  chemically synthesized
ctttgcccactttttgatgg

SEQ ID NO: 72250 - DNA, 20 bp, Artificial Sequence
  chemically synthesized
gggttgtttttttcttgtaa

SEQ ID NO: 72251 - DNA, 20 bp, Artificial Sequence
  chemically synthesized
gtaaatttgtttgagttcat

SEQ ID NO: 72252 - DNA, 20 bp, Artificial Sequence
  chemically synthesized
tattagccctttgtcggatg

SEQ ID NO: 72253 - DNA, 20 bp, Artificial Sequence
  chemically synthesized
tgttgcctgttcactctgat

SEQ ID NO: 72254 - DNA, 20 bp, Artificial Sequence
  chemically synthesized
cttttgctgtgcagaagctc

SEQ ID NO: 72255 - DNA, 20 bp, Artificial Sequence
  chemically synthesized
attagatcccatttgtccat

SEQ ID NO: 72256 - DNA, 20 bp, Artificial Sequence
  chemically synthesized
tccattttggcttttgttgc

SEQ ID NO: 72257 - DNA, 20 bp, Artificial Sequence
  chemically synthesized
gcttttgttgccattgcttt

SEQ ID NO: 72258 - DNA, 20 bp, Artificial Sequence
  chemically synthesized
tatgtcctgaatggtattgc

SEQ ID NO: 72259 - DNA, 20 bp, Artificial Sequence
  chemically synthesized
gtattgcctaggttttcttc

SEQ ID NO: 72260 - DNA, 20 bp, Artificial Sequence
  chemically synthesized
aggttttcttccagagtttt

SEQ ID NO: 72261 - DNA, 20 bp, Artificial Sequence
  chemically synthesized
tataaggtgtaagaaaggga

SEQ ID NO: 72262 - DNA, 20 bp, Artificial Sequence
  chemically synthesized
gtgtaagaaagggatccagt

SEQ ID NO: 72263 - DNA, 20 bp, Artificial Sequence
  chemically synthesized
cagctttctgcgtatggtta

SEQ ID NO: 72264 - DNA, 20 bp, Artificial Sequence
  chemically synthesized
aaatagggaatcctttcccc

SEQ ID NO: 72265 - DNA, 20 bp, Artificial Sequence
  chemically synthesized
ttccccatttgttttttttg

SEQ ID NO: 72266 - DNA, 20 bp, Artificial Sequence
  chemically synthesized
tctgttccattggtctatat

SEQ ID NO: 72267 - DNA, 20 bp, Artificial Sequence
  chemically synthesized
ctgttttggtaccagtacca

SEQ ID NO: 72268 - DNA, 20 bp, Artificial Sequence
  chemically synthesized
tggttactgtagccttgtag

SEQ ID NO: 72269 - DNA, 20 bp, Artificial Sequence
  chemically synthesized
aagtcaggtagcgtgatgcc

SEQ ID NO: 72270 - DNA, 20 bp, Artificial Sequence
  chemically synthesized
gatgcctccagctttgttct

SEQ ID NO: 72271 - DNA, 20 bp, Artificial Sequence
  chemically synthesized
tccagctttgttcttttggc

SEQ ID NO: 72272 - DNA, 20 bp, Artificial Sequence
  chemically synthesized
tggttccatatgaactttaa

SEQ ID NO: 72273 - DNA, 20 bp, Artificial Sequence
  chemically synthesized
attctgtgaagaaagtcatt

SEQ ID NO: 72274 - DNA, 20 bp, Artificial Sequence
  chemically synthesized
ctgtatggccattttcatga

SEQ ID NO: 72275 - DNA, 20 bp, Artificial Sequence
  chemically synthesized
tgagcatggaatgttcttcc

SEQ ID NO: 72276 - DNA, 20 bp, Artificial Sequence
  chemically synthesized
cttcttttatttcattcagc

SEQ ID NO: 72277 - DNA, 20 bp, Artificial Sequence
  chemically synthesized
gtccttcacctctcttgtaa

SEQ ID NO: 72278 - DNA, 20 bp, Artificial Sequence
  chemically synthesized
aattgtgaatgggagttccc

SEQ ID NO: 72279 - DNA, 20 bp, Artificial Sequence
  chemically synthesized
agttccctcatgatttggct

SEQ ID NO: 72280 - DNA, 20 bp, Artificial Sequence
  chemically synthesized
tgtctgttattggtgtataa

SEQ ID NO: 72281 - DNA, 20 bp, Artificial Sequence
  chemically synthesized
ttattggtgtataagaatgc

SEQ ID NO: 72282 - DNA, 20 bp, Artificial Sequence
  chemically synthesized
gaatgcttgtgatttttgca

SEQ ID NO: 72283 - DNA, 20 bp, Artificial Sequence
  chemically synthesized
agactttgctgaagttgcct

SEQ ID NO: 72284 - DNA, 20 bp, Artificial Sequence
  chemically synthesized
gacattttgggctgagacag

SEQ ID NO: 72285 - DNA, 20 bp, Artificial Sequence
  chemically synthesized
agagggcatccctgtcttgt

SEQ ID NO: 72286 - DNA, 20 bp, Artificial Sequence
  chemically synthesized
cttgtgccagttttcaaagg

SEQ ID NO: 72287 - DNA, 20 bp, Artificial Sequence
  chemically synthesized
cagttttcaaagggaatgct

SEQ ID NO: 72288 - DNA, 20 bp, Artificial Sequence
  chemically synthesized
cattcagtatgatattggct

SEQ ID NO: 72289 - DNA, 20 bp, Artificial Sequence
  chemically synthesized
ccatcaatacctaatttatt

SEQ ID NO: 72290 - DNA, 20 bp, Artificial Sequence
  chemically synthesized
tgcatctattgagataatca

SEQ ID NO: 72291 - DNA, 20 bp, Artificial Sequence
  chemically synthesized
catgtggtttttgtctttgg

SEQ ID NO: 72292 - DNA, 20 bp, Artificial Sequence
  chemically synthesized
gtctttggttctgtttatat

SEQ ID NO: 72293 - DNA, 20 bp, Artificial Sequence
  chemically synthesized
tttatatgctggattacatt

SEQ ID NO: 72294 - DNA, 20 bp, Artificial Sequence
  chemically synthesized
agcccacttgatcatggtgg

SEQ ID NO: 72295 - DNA, 20 bp, Artificial Sequence
  chemically synthesized
gataagcttttggatgtgct

SEQ ID NO: 72296 - DNA, 20 bp, Artificial Sequence
  chemically synthesized
gcttttggatgtgctgctgg

SEQ ID NO: 72297 - DNA, 20 bp, Artificial Sequence
  chemically synthesized
ttgctttgccagtattttat

SEQ ID NO: 72298 - DNA, 20 bp, Artificial Sequence
  chemically synthesized
ctttttttgttgtgtctctg

SEQ ID NO: 72299 - DNA, 20 bp, Artificial Sequence
  chemically synthesized
ggcctcataaaatgagttag

SEQ ID NO: 72300 - DNA, 20 bp, Artificial Sequence
  chemically synthesized
gggaggattccctcttttac

SEQ ID NO: 72301 - DNA, 20 bp, Artificial Sequence
  chemically synthesized
cctcttttactattgattcg

SEQ ID NO: 72302 - DNA, 20 bp, Artificial Sequence
  chemically synthesized
tgtgactccatctggtcctg

SEQ ID NO: 72303 - DNA, 20 bp, Artificial Sequence
  chemically synthesized
gatcctgttattggtctatt

SEQ ID NO: 72304 - DNA, 20 bp, Artificial Sequence
  chemically synthesized
attcagagattcaacttctt

SEQ ID NO: 72305 - DNA, 20 bp, Artificial Sequence
  chemically synthesized
caaggaatttatccatttct

SEQ ID NO: 72306 - DNA, 20 bp, Artificial Sequence
  chemically synthesized
tatccatttcttctagattt

SEQ ID NO: 72307 - DNA, 20 bp, Artificial Sequence
  chemically synthesized
tttctagtttatttgtgtag

SEQ ID NO: 72308 - DNA, 20 bp, Artificial Sequence
  chemically synthesized
tgtttatagtattctctgat

SEQ ID NO: 72309 - DNA, 20 bp, Artificial Sequence
  chemically synthesized
tatcattttttattgcatct

SEQ ID NO: 72310 - DNA, 20 bp, Artificial Sequence
  chemically synthesized
tttgttgatctttttgaaaa

SEQ ID NO: 72311 - DNA, 20 bp, Artificial Sequence
  chemically synthesized
atctttttgaaaaaccagct

SEQ ID NO: 72312 - DNA, 20 bp, Artificial Sequence
  chemically synthesized
gaaaaaccagcttctggatt

SEQ ID NO: 72313 - DNA, 20 bp, Artificial Sequence
  chemically synthesized
ctggattcattgattttttg

SEQ ID NO: 72314 - DNA, 20 bp, Artificial Sequence
  chemically synthesized
ctctatttccttcagttctg

SEQ ID NO: 72315 - DNA, 20 bp, Artificial Sequence
  chemically synthesized
tgccttctgctagcatttga

SEQ ID NO: 72316 - DNA, 20 bp, Artificial Sequence
  chemically synthesized
tagcatttgaatgtgtttgc

SEQ ID NO: 72317 - DNA, 20 bp, Artificial Sequence
  chemically synthesized
gggtgtcaattttagatctt

SEQ ID NO: 72318 - DNA, 20 bp, Artificial Sequence
  chemically synthesized
tctttcctgctttctcttct

SEQ ID NO: 72319 - DNA, 20 bp, Artificial Sequence
  chemically synthesized
gctataaatttccctctaca

SEQ ID NO: 72320 - DNA, 20 bp, Artificial Sequence
  chemically synthesized
acactgctttgaatgtgtcc

SEQ ID NO: 72321 - DNA, 20 bp, Artificial Sequence
  chemically synthesized
agtcattcaggagcaatttg

SEQ ID NO: 72322 - DNA, 20 bp, Artificial Sequence
  chemically synthesized
gttcggtttccatgtagttg

SEQ ID NO: 72323 - DNA, 20 bp, Artificial Sequence
  chemically synthesized
atgtagttgagcggttttga

SEQ ID NO: 72324 - DNA, 20 bp, Artificial Sequence
  chemically synthesized
tgagtttcttaatcctgagt

SEQ ID NO: 72325 - DNA, 20 bp, Artificial Sequence
  chemically synthesized
tttcttaatcctgagttcta

SEQ ID NO: 72326 - DNA, 20 bp, Artificial Sequence
  chemically synthesized
gattgcactgtggtctgaga

SEQ ID NO: 72327 - DNA, 20 bp, Artificial Sequence
  chemically synthesized
gttcttttacatttgctgag

SEQ ID NO: 72328 - DNA, 20 bp, Artificial Sequence
  chemically synthesized
gctgaaaagaatgtatattc

SEQ ID NO: 72329 - DNA, 20 bp, Artificial Sequence
  chemically synthesized
gttctgtagatgtctattag

SEQ ID NO: 72330 - DNA, 20 bp, Artificial Sequence
  chemically synthesized
ctctttgtaggtctctaagg

SEQ ID NO: 72331 - DNA, 20 bp, Artificial Sequence
  chemically synthesized
tgttcctgtattgggtgcat

SEQ ID NO: 72332 - DNA, 20 bp, Artificial Sequence
  chemically synthesized
ctttgtctcttttgatcttt

SEQ ID NO: 72333 - DNA, 20 bp, Artificial Sequence
  chemically synthesized
ttgatctttgttggtttaaa

SEQ ID NO: 72334 - DNA, 20 bp, Artificial Sequence
  chemically synthesized
aaagcctgttttatcagaga

SEQ ID NO: 72335 - DNA, 20 bp, Artificial Sequence
  chemically synthesized
ggattgcaacccctgccttt

SEQ ID NO: 72336 - DNA, 20 bp, Artificial Sequence
  chemically synthesized
tgtgtgtgtgtgcacatgag

SEQ ID NO: 72337 - DNA, 20 bp, Artificial Sequence
  chemically synthesized
ttattttgctcattagttga

SEQ ID NO: 72338 - DNA, 20 bp, Artificial Sequence
  chemically synthesized
tcaatggtctttacaatttg

SEQ ID NO: 72339 - DNA, 20 bp, Artificial Sequence
  chemically synthesized
cggttgtgcctttccatatt

SEQ ID NO: 72340 - DNA, 20 bp, Artificial Sequence
  chemically synthesized
tgatgacaaaatctctcagc

SEQ ID NO: 72341 - DNA, 20 bp, Artificial Sequence
  chemically synthesized
ttttatttctccttcactta

SEQ ID NO: 72342 - DNA, 20 bp, Artificial Sequence
  chemically synthesized
tttctccttcacttatgaag

SEQ ID NO: 72343 - DNA, 20 bp, Artificial Sequence
  chemically synthesized
aatattggcccccactctct

SEQ ID NO: 72344 - DNA, 20 bp, Artificial Sequence
  chemically synthesized
ccccactctcttctggcttg

SEQ ID NO: 72345 - DNA, 20 bp, Artificial Sequence
  chemically synthesized
agagatctgctgttattctg

SEQ ID NO: 72346 - DNA, 20 bp, Artificial Sequence
  chemically synthesized
tttgaatgttgacctgcctt

SEQ ID NO: 72347 - DNA, 20 bp, Artificial Sequence
  chemically synthesized
ctcctggataatatcctgca

SEQ ID NO: 72348 - DNA, 20 bp, Artificial Sequence
  chemically synthesized
tttcaggtacaccaatcaga

SEQ ID NO: 72349 - DNA, 20 bp, Artificial Sequence
  chemically synthesized
cacatagtcccatatttctt

SEQ ID NO: 72350 - DNA, 20 bp, Artificial Sequence
  chemically synthesized
ttttttctctaaacttctct

SEQ ID NO: 72351 - DNA, 20 bp, Artificial Sequence
  chemically synthesized
tcatcatgtagttctcatgc

SEQ ID NO: 72352 - DNA, 20 bp, Artificial Sequence
  chemically synthesized
ccattagtctaatttatttt

SEQ ID NO: 72353 - DNA, 20 bp, Artificial Sequence
  chemically synthesized
ttaacttttttgccatgggt

SEQ ID NO: 72354 - DNA, 20 bp, Artificial Sequence
  chemically synthesized
agcttcctcctttagctcgg

SEQ ID NO: 72355 - DNA, 20 bp, Artificial Sequence
  chemically synthesized
cttgtcaaagtcattctctg

SEQ ID NO: 72356 - DNA, 20 bp, Artificial Sequence
  chemically synthesized
cctttggaggaggagaggca

SEQ ID NO: 72357 - DNA, 20 bp, Artificial Sequence
  chemically synthesized
aggagaggcactctgatttt

SEQ ID NO: 72358 - DNA, 20 bp, Artificial Sequence
  chemically synthesized
gcactctgatttttagagtt

SEQ ID NO: 72359 - DNA, 20 bp, Artificial Sequence
  chemically synthesized
tagagtttccagtttttctg

SEQ ID NO: 72360 - DNA, 20 bp, Artificial Sequence
  chemically synthesized
gctctgtttttccccatctt

SEQ ID NO: 72361 - DNA, 20 bp, Artificial Sequence
  chemically synthesized
ttgatgatggtgacgtacag

SEQ ID NO: 72362 - DNA, 20 bp, Artificial Sequence
  chemically synthesized
gtttttggtgtggatgtcct

SEQ ID NO: 72363 - DNA, 20 bp, Artificial Sequence
  chemically synthesized
tgtggatgtcctttctgttt

SEQ ID NO: 72364 - DNA, 20 bp, Artificial Sequence
  chemically synthesized
gttttccttctaacaggacc

SEQ ID NO: 72365 - DNA, 20 bp, Artificial Sequence
  chemically synthesized
taacaggaccctcagcttgc

SEQ ID NO: 72366 - DNA, 20 bp, Artificial Sequence
  chemically synthesized
ggtaattgttagaaatttcc

SEQ ID NO: 72367 - DNA, 20 bp, Artificial Sequence
  chemically synthesized
actgaaaacataacttttac

SEQ ID NO: 72368 - DNA, 20 bp, Artificial Sequence
  chemically synthesized
ggcataggagaagcaggtgc

SEQ ID NO: 72369 - DNA, 20 bp, Artificial Sequence
  chemically synthesized
ccttgtcagcatactggtca

SEQ ID NO: 72370 - DNA, 20 bp, Artificial Sequence
  chemically synthesized
ccagtttcatcatcacttca

SEQ ID NO: 72371 - DNA, 20 bp, Artificial Sequence
  chemically synthesized
tactgtttgtaccaaagcac

SEQ ID NO: 72372 - DNA, 20 bp, Artificial Sequence
  chemically synthesized
accacagtttccttatgaaa

SEQ ID NO: 72373 - DNA, 20 bp, Artificial Sequence
  chemically synthesized
aaacttagcttcaaggctgg

SEQ ID NO: 72374 - DNA, 20 bp, Artificial Sequence
  chemically synthesized
ttaaactcttcaaactttct

SEQ ID NO: 72375 - DNA, 20 bp, Artificial Sequence
  chemically synthesized
ggcaggcactgtcatagtcc

SEQ ID NO: 72376 - DNA, 20 bp, Artificial Sequence
  chemically synthesized
gcttcctgctgcacttggtg

SEQ ID NO: 72377 - DNA, 20 bp, Artificial Sequence
  chemically synthesized
caagtcaggaaattggtcca

SEQ ID NO: 72378 - DNA, 20 bp, Artificial Sequence
  chemically synthesized
gtgttagcaaggatgcatcc

SEQ ID NO: 72379 - DNA, 20 bp, Artificial Sequence
  chemically synthesized
gcacagacttcacacagtga

SEQ ID NO: 72380 - DNA, 20 bp, Artificial Sequence
  chemically synthesized
cgtcaaggtctcttgaatgc

SEQ ID NO: 72381 - DNA, 20 bp, Artificial Sequence
  chemically synthesized
aaggtctcttgaatgccttt

SEQ ID NO: 72382 - DNA, 20 bp, Artificial Sequence
  chemically synthesized
gttctctcaggtctggtacc

SEQ ID NO: 72383 - DNA, 20 bp, Artificial Sequence
  chemically synthesized
gtctggtaccctctgcttct

SEQ ID NO: 72384 - DNA, 20 bp, Artificial Sequence
  chemically synthesized
agttctggacatattcttca

SEQ ID NO: 72385 - DNA, 20 bp, Artificial Sequence
  chemically synthesized
aactgtttgtcttttgtctc

SEQ ID NO: 72386 - DNA, 20 bp, Artificial Sequence
  chemically synthesized
cttttgtctcagcagctttc

SEQ ID NO: 72387 - DNA, 20 bp, Artificial Sequence
  chemically synthesized
agctttccctggcttctgga

SEQ ID NO: 72388 - DNA, 20 bp, Artificial Sequence
  chemically synthesized
atcgggagcccagagctctg

SEQ ID NO: 72389 - DNA, 20 bp, Artificial Sequence
  chemically synthesized
ctttatactagcctgctatg

SEQ ID NO: 72390 - DNA, 20 bp, Artificial Sequence
  chemically synthesized
ggacctagagggtgagtcaa

SEQ ID NO: 72391 - DNA, 20 bp, Artificial Sequence
  chemically synthesized
tcaagaaagattttctttga

SEQ ID NO: 72392 - DNA, 20 bp, Artificial Sequence
  chemically synthesized
aaagcccaagggaagaaaga

SEQ ID NO: 72393 - DNA, 20 bp, Artificial Sequence
  chemically synthesized
ttgtgaaggtattattttat

SEQ ID NO: 72394 - DNA, 20 bp, Artificial Sequence
  chemically synthesized
cccactctccacatatgacc

SEQ ID NO: 72395 - DNA, 20 bp, Artificial Sequence
  chemically synthesized
ctctccacatatgaccaact

SEQ ID NO: 72396 - DNA, 20 bp, Artificial Sequence
  chemically synthesized
atctgaattagaaattatat

SEQ ID NO: 72397 - DNA, 20 bp, Artificial Sequence
  chemically synthesized
attatttgataaatgttaac

SEQ ID NO: 72398 - DNA, 20 bp, Artificial Sequence
  chemically synthesized
catcattttgaattgaggga

SEQ ID NO: 72399 - DNA, 20 bp, Artificial Sequence
  chemically synthesized
tgaagaaagtaattgaggga

SEQ ID NO: 72400 - DNA, 20 bp, Artificial Sequence
  chemically synthesized
aaataatgttctaagtagca

SEQ ID NO: 72401 - DNA, 20 bp, Artificial Sequence
  chemically synthesized
ttctaagtagcagagggatt

SEQ ID NO: 72402 - DNA, 20 bp, Artificial Sequence
  chemically synthesized
ctgatttccactgaaatgct

SEQ ID NO: 72403 - DNA, 20 bp, Artificial Sequence
  chemically synthesized
tttccactgaaatgctcagg

SEQ ID NO: 72404 - DNA, 20 bp, Artificial Sequence
  chemically synthesized
aacgaagtatgccactctga

SEQ ID NO: 72405 - DNA, 20 bp, Artificial Sequence
  chemically synthesized
agtatgccactctgaatctg

SEQ ID NO: 72406 - DNA, 20 bp, Artificial Sequence
  chemically synthesized
tgatgtgaacgacatgagga

SEQ ID NO: 72407 - DNA, 20 bp, Artificial Sequence
  chemically synthesized
tgaaggtgatgtcagcacag

SEQ ID NO: 72408 - DNA, 20 bp, Artificial Sequence
  chemically synthesized
cagacttattgagccccatt

SEQ ID NO: 72409 - DNA, 20 bp, Artificial Sequence
  chemically synthesized
tgtataaagaagatattatt

SEQ ID NO: 72410 - DNA, 20 bp, Artificial Sequence
  chemically synthesized
ttatttagggtttactctat

SEQ ID NO: 72411 - DNA, 20 bp, Artificial Sequence
  chemically synthesized
tggtattatagggtggatgt

SEQ ID NO: 72412 - DNA, 20 bp, Artificial Sequence
  chemically synthesized
cactattggaaaagcagata

SEQ ID NO: 72413 - DNA, 20 bp, Artificial Sequence
  chemically synthesized
tacaataaaatagtaaattt

SEQ ID NO: 72414 - DNA, 20 bp, Artificial Sequence
  chemically synthesized
cgtaagagtgacttacctgt

SEQ ID NO: 72415 - DNA, 20 bp, Artificial Sequence
  chemically synthesized
gcacatagaactctaagttg

SEQ ID NO: 72416 - DNA, 20 bp, Artificial Sequence
  chemically synthesized
tataaccctagttattgata

SEQ ID NO: 72417 - DNA, 20 bp, Artificial Sequence
  chemically synthesized
ttgaagaataaacagtaaaa

SEQ ID NO: 72418 - DNA, 20 bp, Artificial Sequence
  chemically synthesized
agtaaaatgtggatttgatg

SEQ ID NO: 72419 - DNA, 20 bp, Artificial Sequence
  chemically synthesized
ttttaaaactatggaatctg

SEQ ID NO: 72420 - DNA, 20 bp, Artificial Sequence
  chemically synthesized
ctctgtgactcattagaatt

SEQ ID NO: 72421 - DNA, 20 bp, Artificial Sequence
  chemically synthesized
taggcccaccttctcttatg

SEQ ID NO: 72422 - DNA, 20 bp, Artificial Sequence
  chemically synthesized
gcatattgatgtaaatttat

SEQ ID NO: 72423 - DNA, 20 bp, Artificial Sequence
  chemically synthesized
tgtccatgaaaagaatgcat

SEQ ID NO: 72424 - DNA, 20 bp, Artificial Sequence
  chemically synthesized
tcattttcagaagaatttgt

SEQ ID NO: 72425 - DNA, 20 bp, Artificial Sequence
  chemically synthesized
cttgggaaagtaatttaatc

SEQ ID NO: 72426 - DNA, 20 bp, Artificial Sequence
  chemically synthesized
acataacctgtaaagactac

SEQ ID NO: 72427 - DNA, 20 bp, Artificial Sequence
  chemically synthesized
tcttgacacaaagtaagggg

SEQ ID NO: 72428 - DNA, 20 bp, Artificial Sequence
  chemically synthesized
agtggataatttttttattt

SEQ ID NO: 72429 - DNA, 20 bp, Artificial Sequence
  chemically synthesized
ttttatttttgtgtttttgt

SEQ ID NO: 72430 - DNA, 20 bp, Artificial Sequence
  chemically synthesized
ctttctctagtgagtacatg

SEQ ID NO: 72431 - DNA, 20 bp, Artificial Sequence
  chemically synthesized
tattcacccagaggtgtgtc

SEQ ID NO: 72432 - DNA, 20 bp, Artificial Sequence
  chemically synthesized
gaacagatataagatgatga

SEQ ID NO: 72433 - DNA, 20 bp, Artificial Sequence
  chemically synthesized
atgatggggtttttaggagc

SEQ ID NO: 72434 - DNA, 20 bp, Artificial Sequence
  chemically synthesized
tttaaataaagatattaaac

SEQ ID NO: 72435 - DNA, 20 bp, Artificial Sequence
  chemically synthesized
gggtgggaaagggaaaggag

SEQ ID NO: 72436 - DNA, 20 bp, Artificial Sequence
  chemically synthesized
agtgagaggttcagacaata

SEQ ID NO: 72437 - DNA, 20 bp, Artificial Sequence
  chemically synthesized
tcagacaatactcagcttat

SEQ ID NO: 72438 - DNA, 20 bp, Artificial Sequence
  chemically synthesized
ttgtacataggtatataact

SEQ ID NO: 72439 - DNA, 20 bp, Artificial Sequence
  chemically synthesized
tattataggtattcattgtt

SEQ ID NO: 72440 - DNA, 20 bp, Artificial Sequence
  chemically synthesized
tggtagtaaaaatatgtgag

SEQ ID NO: 72441 - DNA, 20 bp, Artificial Sequence
  chemically synthesized
ttgggaagaatccttaaaat

SEQ ID NO: 72442 - DNA, 20 bp, Artificial Sequence
  chemically synthesized
ttaaaatagctgtttgtctt

SEQ ID NO: 72443 - DNA, 20 bp, Artificial Sequence
  chemically synthesized
ctgttttcatattgaaaact

SEQ ID NO: 72444 - DNA, 20 bp, Artificial Sequence
  chemically synthesized
attgaaaactgagtgctttc

SEQ ID NO: 72445 - DNA, 20 bp, Artificial Sequence
  chemically synthesized
tgctttcacttgattcactc

SEQ ID NO: 72446 - DNA, 20 bp, Artificial Sequence
  chemically synthesized
tgtggtatatgagatgatct

SEQ ID NO: 72447 - DNA, 20 bp, Artificial Sequence
  chemically synthesized
gtctctgtcatagaatagac

SEQ ID NO: 72448 - DNA, 20 bp, Artificial Sequence
  chemically synthesized
atatattctctcaccttccc

SEQ ID NO: 72449 - DNA, 20 bp, Artificial Sequence
  chemically synthesized
atggttaatattgagtgcaa

SEQ ID NO: 72450 - DNA, 20 bp, Artificial Sequence
  chemically synthesized
taatattgagtgcaaacttg

SEQ ID NO: 72451 - DNA, 20 bp, Artificial Sequence
  chemically synthesized
tgctgtaagggtgttgccaa

SEQ ID NO: 72452 - DNA, 20 bp, Artificial Sequence
  chemically synthesized
acacataacccaagctccgt

SEQ ID NO: 72453 - DNA, 20 bp, Artificial Sequence
  chemically synthesized
ccgtccaagcttaattttga

SEQ ID NO: 72454 - DNA, 20 bp, Artificial Sequence
  chemically synthesized
ctagaaagtatttgaacctc

SEQ ID NO: 72455 - DNA, 20 bp, Artificial Sequence
  chemically synthesized
cctcctcaagaatttggaag

SEQ ID NO: 72456 - DNA, 20 bp, Artificial Sequence
  chemically synthesized
cagggttagaatggaagcca

SEQ ID NO: 72457 - DNA, 20 bp, Artificial Sequence
  chemically synthesized
gcctgagtcaacacccatgc

SEQ ID NO: 72458 - DNA, 20 bp, Artificial Sequence
  chemically synthesized
atgctctggtttgttcgtag

SEQ ID NO: 72459 - DNA, 20 bp, Artificial Sequence
  chemically synthesized
agaggtaactctcaaagaaa

SEQ ID NO: 72460 - DNA, 20 bp, Artificial Sequence
  chemically synthesized
tacttttctcttgctaagaa

SEQ ID NO: 72461 - DNA, 20 bp, Artificial Sequence
  chemically synthesized
taagaaatcagcttcgatct

SEQ ID NO: 72462 - DNA, 20 bp, Artificial Sequence
  chemically synthesized
cctgcaatgagatcttacag

SEQ ID NO: 72463 - DNA, 20 bp, Artificial Sequence
  chemically synthesized
tctcacatctttagccgtat

SEQ ID NO: 72464 - DNA, 20 bp, Artificial Sequence
  chemically synthesized
agctcctccccagagaccat

SEQ ID NO: 72465 - DNA, 20 bp, Artificial Sequence
  chemically synthesized
tgccctcagccttgtgggta

SEQ ID NO: 72466 - DNA, 20 bp, Artificial Sequence
  chemically synthesized
ctcaagatctctgtctctgt

SEQ ID NO: 72467 - DNA, 20 bp, Artificial Sequence
  chemically synthesized
tctctgtcctggcttttact

SEQ ID NO: 72468 - DNA, 20 bp, Artificial Sequence
  chemically synthesized
gttgaatattttgtctacat

SEQ ID NO: 72469 - DNA, 20 bp, Artificial Sequence
  chemically synthesized
tgccatcacaaagtgatgtg

SEQ ID NO: 72470 - DNA, 20 bp, Artificial Sequence
  chemically synthesized
tgactctagtctatctagct

SEQ ID NO: 72471 - DNA, 20 bp, Artificial Sequence
  chemically synthesized
gtctatctagctctctgctt

SEQ ID NO: 72472 - DNA, 20 bp, Artificial Sequence
  chemically synthesized
tacataggccaagaagatat

SEQ ID NO: 72473 - DNA, 20 bp, Artificial Sequence
  chemically synthesized
tttctcttgagataaactgg

SEQ ID NO: 72474 - DNA, 20 bp, Artificial Sequence
  chemically synthesized
tggggctatgaagacaggct

SEQ ID NO: 72475 - DNA, 20 bp, Artificial Sequence
  chemically synthesized
ccacacataaaggtcctacc

SEQ ID NO: 72476 - DNA, 20 bp, Artificial Sequence
  chemically synthesized
acataaaggtcctaccagtg

SEQ ID NO: 72477 - DNA, 20 bp, Artificial Sequence
  chemically synthesized
cagtaacttatttgaaaaaa

SEQ ID NO: 72478 - DNA, 20 bp, Artificial Sequence
  chemically synthesized
tgaaaaaagaaagattattt

SEQ ID NO: 72479 - DNA, 20 bp, Artificial Sequence
  chemically synthesized
tctttattaataaccacagt

SEQ ID NO: 72480 - DNA, 20 bp, Artificial Sequence
  chemically synthesized
agtgaaggatctcaatagtc

SEQ ID NO: 72481 - DNA, 20 bp, Artificial Sequence
  chemically synthesized
tccacagctttggatgtgtg

SEQ ID NO: 72482 - DNA, 20 bp, Artificial Sequence
  chemically synthesized
ttctgtactcagtgatgtga

SEQ ID NO: 72483 - DNA, 20 bp, Artificial Sequence
  chemically synthesized
aaattatggctgtaaatgtt

SEQ ID NO: 72484 - DNA, 20 bp, Artificial Sequence
  chemically synthesized
gctgtaaatgttagaagttt

SEQ ID NO: 72485 - DNA, 20 bp, Artificial Sequence
  chemically synthesized
ggtgttccattatagaatct

SEQ ID NO: 72486 - DNA, 20 bp, Artificial Sequence
  chemically synthesized
ccttccctatattttttttc

SEQ ID NO: 72487 - DNA, 20 bp, Artificial Sequence
  chemically synthesized
aattttcacaaaacaaagta

SEQ ID NO: 72488 - DNA, 20 bp, Artificial Sequence
  chemically synthesized
gcaaaatacaatcattgcct

SEQ ID NO: 72489 - DNA, 20 bp, Artificial Sequence
  chemically synthesized
aatcattgccttacagtttg

SEQ ID NO: 72490 - DNA, 20 bp, Artificial Sequence
  chemically synthesized
agtttggttagctttccctg

SEQ ID NO: 72491 - DNA, 20 bp, Artificial Sequence
  chemically synthesized
tcacaaagttgagatacagt

SEQ ID NO: 72492 - DNA, 20 bp, Artificial Sequence
  chemically synthesized
acagtgaaagattaggttaa

SEQ ID NO: 72493 - DNA, 20 bp, Artificial Sequence
  chemically synthesized
cacagaaggggaggagctaa

SEQ ID NO: 72494 - DNA, 20 bp, Artificial Sequence
  chemically synthesized
atgttcagtaggcactgaat

SEQ ID NO: 72495 - DNA, 20 bp, Artificial Sequence
  chemically synthesized
gacagaatatggatgctgaa

SEQ ID NO: 72496 - DNA, 20 bp, Artificial Sequence
  chemically synthesized
ctatgggtggaaggtaagag

SEQ ID NO: 72497 - DNA, 20 bp, Artificial Sequence
  chemically synthesized
cagctatatttactaatgac

SEQ ID NO: 72498 - DNA, 20 bp, Artificial Sequence
  chemically synthesized
tcagacttccattttgagta

SEQ ID NO: 72499 - DNA, 20 bp, Artificial Sequence
  chemically synthesized
agaaatctaggggaaacctc

SEQ ID NO: 72500 - DNA, 20 bp, Artificial Sequence
  chemically synthesized
tacttcaaaaatgcatctgt

SEQ ID NO: 72501 - DNA, 20 bp, Artificial Sequence
  chemically synthesized
aaaaatgcatctgtctctgt

SEQ ID NO: 72502 - DNA, 20 bp, Artificial Sequence
  chemically synthesized
ttttctctttttttcatttc

SEQ ID NO: 72503 - DNA, 20 bp, Artificial Sequence
  chemically synthesized
aaggtcaccatgactcttca

SEQ ID NO: 72504 - DNA, 20 bp, Artificial Sequence
  chemically synthesized
ctcttcatatggatttttaa

SEQ ID NO: 72505 - DNA, 20 bp, Artificial Sequence
  chemically synthesized
aactcatctcttttcttgtc

SEQ ID NO: 72506 - DNA, 20 bp, Artificial Sequence
  chemically synthesized
tatcaccacactattttcca

SEQ ID NO: 72507 - DNA, 20 bp, Artificial Sequence
  chemically synthesized
ggtctgtaaggccctatgac

SEQ ID NO: 72508 - DNA, 20 bp, Artificial Sequence
  chemically synthesized
ccctatgacacttgattact

SEQ ID NO: 72509 - DNA, 20 bp, Artificial Sequence
  chemically synthesized
gacatcatctattgtccctc

SEQ ID NO: 72510 - DNA, 20 bp, Artificial Sequence
  chemically synthesized
ttcttatcaaatgccagtca

SEQ ID NO: 72511 - DNA, 20 bp, Artificial Sequence
  chemically synthesized
catgctgattttccctctgg

SEQ ID NO: 72512 - DNA, 20 bp, Artificial Sequence
  chemically synthesized
tcctctaggtctgtatacgg

SEQ ID NO: 72513 - DNA, 20 bp, Artificial Sequence
  chemically synthesized
aattaatctacatcaagtag

SEQ ID NO: 72514 - DNA, 20 bp, Artificial Sequence
  chemically synthesized
tatgttaaacttgcatttat

SEQ ID NO: 72515 - DNA, 20 bp, Artificial Sequence
  chemically synthesized
atttatttttcaacttaatt

SEQ ID NO: 72516 - DNA, 20 bp, Artificial Sequence
  chemically synthesized
ttcaacttaatttatggttt

SEQ ID NO: 72517 - DNA, 20 bp, Artificial Sequence
  chemically synthesized
cttattaccatttaattcca

SEQ ID NO: 72518 - DNA, 20 bp, Artificial Sequence
  chemically synthesized
caaatattaggtgaactaag

SEQ ID NO: 72519 - DNA, 20 bp, Artificial Sequence
  chemically synthesized
ctcttcagtaaaagacagca

SEQ ID NO: 72520 - DNA, 20 bp, Artificial Sequence
  chemically synthesized
tctcactcagtattggggag

SEQ ID NO: 72521 - DNA, 20 bp, Artificial Sequence
  chemically synthesized
gggaaggaaaccaggaagat

SEQ ID NO: 72522 - DNA, 20 bp, Artificial Sequence
  chemically synthesized
gagaacttgaaatgagagag

SEQ ID NO: 72523 - DNA, 20 bp, Artificial Sequence
  chemically synthesized
cttgtaaataagaaacagta

SEQ ID NO: 72524 - DNA, 20 bp, Artificial Sequence
  chemically synthesized
cacaagtagtgagtagtact

SEQ ID NO: 72525 - DNA, 20 bp, Artificial Sequence
  chemically synthesized
cttagctacagtggtagtgg

SEQ ID NO: 72526 - DNA, 20 bp, Artificial Sequence
  chemically synthesized
agtctttacatgcaggaaaa

SEQ ID NO: 72527 - DNA, 20 bp, Artificial Sequence
  chemically synthesized
tcactactgtgaaggcaatt

SEQ ID NO: 72528 - DNA, 20 bp, Artificial Sequence
  chemically synthesized
tagaccagaaaaaaattagt

SEQ ID NO: 72529 - DNA, 20 bp, Artificial Sequence
  chemically synthesized
aaatctgcatagttaagggt

SEQ ID NO: 72530 - DNA, 20 bp, Artificial Sequence
  chemically synthesized
aagggtaacagtttagaagt

SEQ ID NO: 72531 - DNA, 20 bp, Artificial Sequence
  chemically synthesized
cataattttttttctgaaga

SEQ ID NO: 72532 - DNA, 20 bp, Artificial Sequence
  chemically synthesized
aaacagttgaaactccaaga

SEQ ID NO: 72533 - DNA, 20 bp, Artificial Sequence
  chemically synthesized
gctcccatcccttcctattg

SEQ ID NO: 72534 - DNA, 20 bp, Artificial Sequence
  chemically synthesized
ccttcctattgactggtttt

SEQ ID NO: 72535 - DNA, 20 bp, Artificial Sequence
  chemically synthesized
aggcttggaggaagctcatc

SEQ ID NO: 72536 - DNA, 20 bp, Artificial Sequence
  chemically synthesized
agtcctctggctggatcaca

SEQ ID NO: 72537 - DNA, 20 bp, Artificial Sequence
  chemically synthesized
acagggagattggaagtgcg

SEQ ID NO: 72538 - DNA, 20 bp, Artificial Sequence
  chemically synthesized
ttcctttctcgagtctggca

SEQ ID NO: 72539 - DNA, 20 bp, Artificial Sequence
  chemically synthesized
ttctgcttgccatggcctat

SEQ ID NO: 72540 - DNA, 20 bp, Artificial Sequence
  chemically synthesized
acttactaatactcgagtag

SEQ ID NO: 72541 - DNA, 20 bp, Artificial Sequence
  chemically synthesized
ttgggctgggagttctgatg

SEQ ID NO: 72542 - DNA, 20 bp, Artificial Sequence
  chemically synthesized
cttcaaccgactgtacccag

SEQ ID NO: 72543 - DNA, 20 bp, Artificial Sequence
  chemically synthesized
cttgtagtctttatatttgt

SEQ ID NO: 72544 - DNA, 20 bp, Artificial Sequence
  chemically synthesized
ctttatatttgtgctggatt

SEQ ID NO: 72545 - DNA, 20 bp, Artificial Sequence
  chemically synthesized
gtctcccatatctgctgtgt

SEQ ID NO: 72546 - DNA, 20 bp, Artificial Sequence
  chemically synthesized
tgtcctggttttttatgtca

SEQ ID NO: 72547 - DNA, 20 bp, Artificial Sequence
  chemically synthesized
tggttttttatgtcacagtg

SEQ ID NO: 72548 - DNA, 20 bp, Artificial Sequence
  chemically synthesized
tgtcacagtgattggattgt

SEQ ID NO: 72549 - DNA, 20 bp, Artificial Sequence
  chemically synthesized
tgattggattgtctctgatt

SEQ ID NO: 72550 - DNA, 20 bp, Artificial Sequence
  chemically synthesized
aacatatagtgtcaagacca

SEQ ID NO: 72551 - DNA, 20 bp, Artificial Sequence
  chemically synthesized
tggtaaaataggtgttaaaa

SEQ ID NO: 72552 - DNA, 20 bp, Artificial Sequence
  chemically synthesized
ataggtgttaaaatacagct

SEQ ID NO: 72553 - DNA, 20 bp, Artificial Sequence
  chemically synthesized
agcccaactctttagctaaa

SEQ ID NO: 72554 - DNA, 20 bp, Artificial Sequence
  chemically synthesized
cctgtaaacggaatatttct

SEQ ID NO: 72555 - DNA, 20 bp, Artificial Sequence
  chemically synthesized
atgtctataatgtaactaac

SEQ ID NO: 72556 - DNA, 20 bp, Artificial Sequence
  chemically synthesized
ttggttcgagtgaaatggaa

SEQ ID NO: 72557 - DNA, 20 bp, Artificial Sequence
  chemically synthesized
tcgagtgaaatggaatagag

SEQ ID NO: 72558 - DNA, 20 bp, Artificial Sequence
  chemically synthesized
gtctgaaggaacaaaaaaaa

SEQ ID NO: 72559 - DNA, 20 bp, Artificial Sequence
  chemically synthesized
ggtttctgcatttttttgaa

SEQ ID NO: 72560 - DNA, 20 bp, Artificial Sequence
  chemically synthesized
tctgcatttttttgaagaat

SEQ ID NO: 72561 - DNA, 20 bp, Artificial Sequence
  chemically synthesized
gattgctttctgtacataca

SEQ ID NO: 72562 - DNA, 20 bp, Artificial Sequence
  chemically synthesized
aatacaacaatgtcattctc

SEQ ID NO: 72563 - DNA, 20 bp, Artificial Sequence
  chemically synthesized
agaggggactatatagaaga

SEQ ID NO: 72564 - DNA, 20 bp, Artificial Sequence
  chemically synthesized
gaagatattgtttatgtctt

SEQ ID NO: 72565 - DNA, 20 bp, Artificial Sequence
  chemically synthesized
gaatgttggctgctcattgt

SEQ ID NO: 72566 - DNA, 20 bp, Artificial Sequence
  chemically synthesized
tggctgctcattgttcatgt

SEQ ID NO: 72567 - DNA, 20 bp, Artificial Sequence
  chemically synthesized
cttgccttctgaagctaagc

SEQ ID NO: 72568 - DNA, 20 bp, Artificial Sequence
  chemically synthesized
aagctccagcttcagtatgc

SEQ ID NO: 72569 - DNA, 20 bp, Artificial Sequence
  chemically synthesized
ttacctccttcccctgtcca

SEQ ID NO: 72570 - DNA, 20 bp, Artificial Sequence
  chemically synthesized
aactgcaatccttatttata

SEQ ID NO: 72571 - DNA, 20 bp, Artificial Sequence
  chemically synthesized
agaactgaacatataaaaaa

SEQ ID NO: 72572 - DNA, 20 bp, Artificial Sequence
  chemically synthesized
atataaaaaaatcagcttta

SEQ ID NO: 72573 - DNA, 20 bp, Artificial Sequence
  chemically synthesized
gtgagtgcatatatgtgatg

SEQ ID NO: 72574 - DNA, 20 bp, Artificial Sequence
  chemically synthesized
tatgtgatggtaggtttttg

SEQ ID NO: 72575 - DNA, 20 bp, Artificial Sequence
  chemically synthesized
tattgtggggtagatattat

SEQ ID NO: 72576 - DNA, 20 bp, Artificial Sequence
  chemically synthesized
aacatttttaattggtatag

SEQ ID NO: 72577 - DNA, 20 bp, Artificial Sequence
  chemically synthesized
cactacagtagactatcctt

SEQ ID NO: 72578 - DNA, 20 bp, Artificial Sequence
  chemically synthesized
actttttgccttgtattccg

SEQ ID NO: 72579 - DNA, 20 bp, Artificial Sequence
  chemically synthesized
cattgcaaaaaaaaaaagag

SEQ ID NO: 72580 - DNA, 20 bp, Artificial Sequence
  chemically synthesized
gttgtagaattactaaaatg

SEQ ID NO: 72581 - DNA, 20 bp, Artificial Sequence
  chemically synthesized
atgcttagaattgttaatga

SEQ ID NO: 72582 - DNA, 20 bp, Artificial Sequence
  chemically synthesized
aataaaaagaatcttcaaat

SEQ ID NO: 72583 - DNA, 20 bp, Artificial Sequence
  chemically synthesized
gaatcttcaaatctctgatt

SEQ ID NO: 72584 - DNA, 20 bp, Artificial Sequence
  chemically synthesized
tgagactcagtgacaaggag

SEQ ID NO: 72585 - DNA, 20 bp, Artificial Sequence
  chemically synthesized
gaggacagtttgaatctttt

SEQ ID NO: 72586 - DNA, 20 bp, Artificial Sequence
  chemically synthesized
aataaactcctcttcttgta

SEQ ID NO: 72587 - DNA, 20 bp, Artificial Sequence
  chemically synthesized
ttgtaatttgttttgttcag

SEQ ID NO: 72588 - DNA, 20 bp, Artificial Sequence
  chemically synthesized
tttgttcagcctagtttcag

SEQ ID NO: 72589 - DNA, 20 bp, Artificial Sequence
  chemically synthesized
aggaaagttgaccatttggt

SEQ ID NO: 72590 - DNA, 20 bp, Artificial Sequence
  chemically synthesized
atgatttatgaagttatttc

SEQ ID NO: 72591 - DNA, 20 bp, Artificial Sequence
  chemically synthesized
catggtggaaatccactcag

SEQ ID NO: 72592 - DNA, 20 bp, Artificial Sequence
  chemically synthesized
ggaaaagtaacaaaagggta

SEQ ID NO: 72593 - DNA, 20 bp, Artificial Sequence
  chemically synthesized
gtacaacaaaccctcgtgac

SEQ ID NO: 72594 - DNA, 20 bp, Artificial Sequence
  chemically synthesized
acagcaggtgaagcctgtaa

SEQ ID NO: 72595 - DNA, 20 bp, Artificial Sequence
  chemically synthesized
taataatatacttgtgtagt

SEQ ID NO: 72596 - DNA, 20 bp, Artificial Sequence
  chemically synthesized
gtagactaagccaatcttag

SEQ ID NO: 72597 - DNA, 20 bp, Artificial Sequence
  chemically synthesized
gaaaaaatatgtatggtcta

SEQ ID NO: 72598 - DNA, 20 bp, Artificial Sequence
  chemically synthesized
ctgggttccttcaccagaga

SEQ ID NO: 72599 - DNA, 20 bp, Artificial Sequence
  chemically synthesized
tgatatatttaaagatactt

SEQ ID NO: 72600 - DNA, 20 bp, Artificial Sequence
  chemically synthesized
agtattaaattgggcagcaa

SEQ ID NO: 72601 - DNA, 20 bp, Artificial Sequence
  chemically synthesized
tgggcagcaaggatgattag

SEQ ID NO: 72602 - DNA, 20 bp, Artificial Sequence
  chemically synthesized
tgtccaattaaagaatgtaa

SEQ ID NO: 72603 - DNA, 20 bp, Artificial Sequence
  chemically synthesized
attaaagaatgtaaatctgt

SEQ ID NO: 72604 - DNA, 20 bp, Artificial Sequence
  chemically synthesized
atttattttatgggaaattt

SEQ ID NO: 72605 - DNA, 20 bp, Artificial Sequence
  chemically synthesized
gaaatttaggagtttatgtc

SEQ ID NO: 72606 - DNA, 20 bp, Artificial Sequence
  chemically synthesized
gccaccaaactgacagatga

SEQ ID NO: 72607 - DNA, 20 bp, Artificial Sequence
  chemically synthesized
tctccagaaaaatagaatca

SEQ ID NO: 72608 - DNA, 20 bp, Artificial Sequence
  chemically synthesized
ggtaaaaacaagtaatgggg

SEQ ID NO: 72609 - DNA, 20 bp, Artificial Sequence
  chemically synthesized
attccggacatagacacagg

SEQ ID NO: 72610 - DNA, 20 bp, Artificial Sequence
  chemically synthesized
tcaggaggctgaggcaggag

SEQ ID NO: 72611 - DNA, 20 bp, Artificial Sequence
  chemically synthesized
aagaaaaatacaattaaata

SEQ ID NO: 72612 - DNA, 20 bp, Artificial Sequence
  chemically synthesized
catctgacaccagtcagaat

SEQ ID NO: 72613 - DNA, 20 bp, Artificial Sequence
  chemically synthesized
aagacagtgtggcaattcct

SEQ ID NO: 72614 - DNA, 20 bp, Artificial Sequence
  chemically synthesized
gaaaaaatagctaatgcatg

SEQ ID NO: 72615 - DNA, 20 bp, Artificial Sequence
  chemically synthesized
ctaatataaggaaatagcag

SEQ ID NO: 72616 - DNA, 20 bp, Artificial Sequence
  chemically synthesized
ttgaaaactcaagagagcct

SEQ ID NO: 72617 - DNA, 20 bp, Artificial Sequence
  chemically synthesized
gtctgaaggcctgggaaaca

SEQ ID NO: 72618 - DNA, 20 bp, Artificial Sequence
  chemically synthesized
tacttgcaacccaaaagcca

SEQ ID NO: 72619 - DNA, 20 bp, Artificial Sequence
  chemically synthesized
gccatcaggcttcagaccca

SEQ ID NO: 72620 - DNA, 20 bp, Artificial Sequence
  chemically synthesized
gcttcagacccaggaagttt

SEQ ID NO: 72621 - DNA, 20 bp, Artificial Sequence
  chemically synthesized
tctaaaggcagaaaaaaagg

SEQ ID NO: 72622 - DNA, 20 bp, Artificial Sequence
  chemically synthesized
gcagaaaaaaaggtctagat

SEQ ID NO: 72623 - DNA, 20 bp, Artificial Sequence
  chemically synthesized
catcaataaggaataattct

SEQ ID NO: 72624 - DNA, 20 bp, Artificial Sequence
  chemically synthesized
ggtcagactttttgttctat

SEQ ID NO: 72625 - DNA, 20 bp, Artificial Sequence
  chemically synthesized
tttgttctattcaggttttc

SEQ ID NO: 72626 - DNA, 20 bp, Artificial Sequence
  chemically synthesized
accatctgctctacttggtc

SEQ ID NO: 72627 - DNA, 20 bp, Artificial Sequence
  chemically synthesized
cctcacaaaaacatctagaa

SEQ ID NO: 72628 - DNA, 20 bp, Artificial Sequence
  chemically synthesized
cttcctgaatcgttagcgat

SEQ ID NO: 72629 - DNA, 20 bp, Artificial Sequence
  chemically synthesized
attctaataaatattgtgtt

SEQ ID NO: 72630 - DNA, 20 bp, Artificial Sequence
  chemically synthesized
tcaggaaacactgcatcaaa

SEQ ID NO: 72631 - DNA, 20 bp, Artificial Sequence
  chemically synthesized
agatggaggtccttcccaat

SEQ ID NO: 72632 - DNA, 20 bp, Artificial Sequence
  chemically synthesized
cctacttcctcccagtgccc

SEQ ID NO: 72633 - DNA, 20 bp, Artificial Sequence
  chemically synthesized
aatagttgttcccattctct

SEQ ID NO: 72634 - DNA, 20 bp, Artificial Sequence
  chemically synthesized
caccaacagtgtcacttcac

SEQ ID NO: 72635 - DNA, 20 bp, Artificial Sequence
  chemically synthesized
tatatctgttctaagataag

SEQ ID NO: 72636 - DNA, 20 bp, Artificial Sequence
  chemically synthesized
tagagtcatatttatggggc

SEQ ID NO: 72637 - DNA, 20 bp, Artificial Sequence
  chemically synthesized
ttccagagactgacttttaa

SEQ ID NO: 72638 - DNA, 20 bp, Artificial Sequence
  chemically synthesized
atcatgatttcctactacta

SEQ ID NO: 72639 - DNA, 20 bp, Artificial Sequence
  chemically synthesized
ggctaagttccaggataaat

SEQ ID NO: 72640 - DNA, 20 bp, Artificial Sequence
  chemically synthesized
tatttctctgacagactatg

SEQ ID NO: 72641 - DNA, 20 bp, Artificial Sequence
  chemically synthesized
tacaaattgtcagacaaagc

SEQ ID NO: 72642 - DNA, 20 bp, Artificial Sequence
  chemically synthesized
acttaaataaaattttttaa

SEQ ID NO: 72643 - DNA, 20 bp, Artificial Sequence
  chemically synthesized
tattgctccagaagcagtaa

SEQ ID NO: 72644 - DNA, 20 bp, Artificial Sequence
  chemically synthesized
gacttaccaagagacagaaa

SEQ ID NO: 72645 - DNA, 20 bp, Artificial Sequence
  chemically synthesized
caagagacagaaaacaagct

SEQ ID NO: 72646 - DNA, 20 bp, Artificial Sequence
  chemically synthesized
caatcttatttgaaaccaag

SEQ ID NO: 72647 - DNA, 20 bp, Artificial Sequence
  chemically synthesized
accaagaaaagattaagtgt

SEQ ID NO: 72648 - DNA, 20 bp, Artificial Sequence
  chemically synthesized
agattaagtgtgagggatta

SEQ ID NO: 72649 - DNA, 20 bp, Artificial Sequence
  chemically synthesized
ttaagctttgtctaagttga

SEQ ID NO: 72650 - DNA, 20 bp, Artificial Sequence
  chemically synthesized
agggttaaggaataacaaaa

SEQ ID NO: 72651 - DNA, 20 bp, Artificial Sequence
  chemically synthesized
tgtgctggatgaagctacaa

SEQ ID NO: 72652 - DNA, 20 bp, Artificial Sequence
  chemically synthesized
ttctttttgcaaagaaaata

SEQ ID NO: 72653 - DNA, 20 bp, Artificial Sequence
  chemically synthesized
agcccacttccttctccaaa

SEQ ID NO: 72654 - DNA, 20 bp, Artificial Sequence
  chemically synthesized
ggaaaataaagactaatctt

SEQ ID NO: 72655 - DNA, 20 bp, Artificial Sequence
  chemically synthesized
agaggcaagatatctgtatc

SEQ ID NO: 72656 - DNA, 20 bp, Artificial Sequence
  chemically synthesized
gttaactctgaaataaaaac

SEQ ID NO: 72657 - DNA, 20 bp, Artificial Sequence
  chemically synthesized
aaacagtagttttatgtgat

SEQ ID NO: 72658 - DNA, 20 bp, Artificial Sequence
  chemically synthesized
tcttgatgcagttctctagg

SEQ ID NO: 72659 - DNA, 20 bp, Artificial Sequence
  chemically synthesized
tactttgtagctcccacatt

SEQ ID NO: 72660 - DNA, 20 bp, Artificial Sequence
  chemically synthesized
aagtcactgttcttacctaa

SEQ ID NO: 72661 - DNA, 20 bp, Artificial Sequence
  chemically synthesized
atcaatatgtcaaactctgt

SEQ ID NO: 72662 - DNA, 20 bp, Artificial Sequence
  chemically synthesized
gtgttggagtgggagtagaa

SEQ ID NO: 72663 - DNA, 20 bp, Artificial Sequence
  chemically synthesized
taaacagtaaaaattttgtg

SEQ ID NO: 72664 - DNA, 20 bp, Artificial Sequence
  chemically synthesized
ggtgatgcaaaagagacatc

SEQ ID NO: 72665 - DNA, 20 bp, Artificial Sequence
  chemically synthesized
catgcattagagtgaaaaat

SEQ ID NO: 72666 - DNA, 20 bp, Artificial Sequence
  chemically synthesized
tgtcagccactgatgctata

SEQ ID NO: 72667 - DNA, 20 bp, Artificial Sequence
  chemically synthesized
tttacataaaccctgtaaat

SEQ ID NO: 72668 - DNA, 20 bp, Artificial Sequence
  chemically synthesized
ggataatagtaatactttgc

SEQ ID NO: 72669 - DNA, 20 bp, Artificial Sequence
  chemically synthesized
acataaattactgcaacttg

SEQ ID NO: 72670 - DNA, 20 bp, Artificial Sequence
  chemically synthesized
cttgagctgcttcaaacatt

SEQ ID NO: 72671 - DNA, 20 bp, Artificial Sequence
  chemically synthesized
ttctataggtctgcactctc

SEQ ID NO: 72672 - DNA, 20 bp, Artificial Sequence
  chemically synthesized
ctcataggcttaactgagtt

SEQ ID NO: 72673 - DNA, 20 bp, Artificial Sequence
  chemically synthesized
tccaaaggctctggggaaga

SEQ ID NO: 72674 - DNA, 20 bp, Artificial Sequence
  chemically synthesized
agaattcgcttccacgttca

SEQ ID NO: 72675 - DNA, 20 bp, Artificial Sequence
  chemically synthesized
cattcagattgtagtcagag

SEQ ID NO: 72676 - DNA, 20 bp, Artificial Sequence
  chemically synthesized
ggttcaagcaattctcctgc

SEQ ID NO: 72677 - DNA, 20 bp, Artificial Sequence
  chemically synthesized
cgccttggcctcccaaagtg

SEQ ID NO: 72678 - DNA, 20 bp, Artificial Sequence
  chemically synthesized
cctcccaaagtgctgggatt

SEQ ID NO: 72679 - DNA, 20 bp, Artificial Sequence
  chemically synthesized
attgcacccggctgtcagag

SEQ ID NO: 72680 - DNA, 20 bp, Artificial Sequence
  chemically synthesized
ctactgctgaactctgaagt

SEQ ID NO: 72681 - DNA, 20 bp, Artificial Sequence
  chemically synthesized
tgctgaactctgaagtccct

SEQ ID NO: 72682 - DNA, 20 bp, Artificial Sequence
  chemically synthesized
actctgaagtccctgtttgt

SEQ ID NO: 72683 - DNA, 20 bp, Artificial Sequence
  chemically synthesized
aagtccctgtttgtttttgt

SEQ ID NO: 72684 - DNA, 20 bp, Artificial Sequence
  chemically synthesized
tgtttgtttttgtttttgtt

SEQ ID NO: 72685 - DNA, 20 bp, Artificial Sequence
  chemically synthesized
tgtttttgtttttgtttttt

SEQ ID NO: 72686 - DNA, 20 bp, Artificial Sequence
  chemically synthesized
tttgtttttgttttttgttt

SEQ ID NO: 72687 - DNA, 20 bp, Artificial Sequence
  chemically synthesized
aggatgcccgttctgtacct

SEQ ID NO: 72688 - DNA, 20 bp, Artificial Sequence
  chemically synthesized
tttctcaaattttgaatatg

SEQ ID NO: 72689 - DNA, 20 bp, Artificial Sequence
  chemically synthesized
ctcctactacttggtgaaaa

SEQ ID NO: 72690 - DNA, 20 bp, Artificial Sequence
  chemically synthesized
gataggaaatcttgtggtag

SEQ ID NO: 72691 - DNA, 20 bp, Artificial Sequence
  chemically synthesized
ctttcttttccaatatatgt

SEQ ID NO: 72692 - DNA, 20 bp, Artificial Sequence
  chemically synthesized
gtccaaaacagtagcatctg

SEQ ID NO: 72693 - DNA, 20 bp, Artificial Sequence
  chemically synthesized
aattttctgtaagtgtaaac

SEQ ID NO: 72694 - DNA, 20 bp, Artificial Sequence
  chemically synthesized
aatcgtgggaactatctcat

SEQ ID NO: 72695 - DNA, 20 bp, Artificial Sequence
  chemically synthesized
tatctcatatatgattttta

SEQ ID NO: 72696 - DNA, 20 bp, Artificial Sequence
  chemically synthesized
aatgataatatttttgatat

SEQ ID NO: 72697 - DNA, 20 bp, Artificial Sequence
  chemically synthesized
cacatagtgctggtctagag

SEQ ID NO: 72698 - DNA, 20 bp, Artificial Sequence
  chemically synthesized
agtgctggtctagagagctg

SEQ ID NO: 72699 - DNA, 20 bp, Artificial Sequence
  chemically synthesized
ctggtctagagagctgtttt

SEQ ID NO: 72700 - DNA, 20 bp, Artificial Sequence
  chemically synthesized
tctagagagctgttttgttt

SEQ ID NO: 72701 - DNA, 20 bp, Artificial Sequence
  chemically synthesized
ctgctgccccttttctcctc

SEQ ID NO: 72702 - DNA, 20 bp, Artificial Sequence
  chemically synthesized
tcactggctttccaggtctg

SEQ ID NO: 72703 - DNA, 20 bp, Artificial Sequence
  chemically synthesized
acaggaaaatgagccatgga

SEQ ID NO: 72704 - DNA, 20 bp, Artificial Sequence
  chemically synthesized
tgttgctcatcatggcccat

SEQ ID NO: 72705 - DNA, 20 bp, Artificial Sequence
  chemically synthesized
tagatctgggggttcaaatg

SEQ ID NO: 72706 - DNA, 20 bp, Artificial Sequence
  chemically synthesized
tgcccataatcatcaccctc

SEQ ID NO: 72707 - DNA, 20 bp, Artificial Sequence
  chemically synthesized
tgtcaatcccatgtcctctc

SEQ ID NO: 72708 - DNA, 20 bp, Artificial Sequence
  chemically synthesized
ctatagtcctggtctcatca

SEQ ID NO: 72709 - DNA, 20 bp, Artificial Sequence
  chemically synthesized
atcaactggtttcttggact

SEQ ID NO: 72710 - DNA, 20 bp, Artificial Sequence
  chemically synthesized
atttctcacattagctgtgt

SEQ ID NO: 72711 - DNA, 20 bp, Artificial Sequence
  chemically synthesized
gtgttctggtttttaatgtc

SEQ ID NO: 72712 - DNA, 20 bp, Artificial Sequence
  chemically synthesized
ggctaccaccctttcagaca

SEQ ID NO: 72713 - DNA, 20 bp, Artificial Sequence
  chemically synthesized
aaccattgtggaagtcagtg

SEQ ID NO: 72714 - DNA, 20 bp, Artificial Sequence
  chemically synthesized
ccattactgggtatataccc

SEQ ID NO: 72715 - DNA, 20 bp, Artificial Sequence
  chemically synthesized
ctataaagacacatgcacac

SEQ ID NO: 72716 - DNA, 20 bp, Artificial Sequence
  chemically synthesized
taataataaaaatacattat

SEQ ID NO: 72717 - DNA, 20 bp, Artificial Sequence
  chemically synthesized
aacaaaaaccaacaggctac

SEQ ID NO: 72718 - DNA, 20 bp, Artificial Sequence
  chemically synthesized
tctttgtgttcaattttctc

SEQ ID NO: 72719 - DNA, 20 bp, Artificial Sequence
  chemically synthesized
ttctggctctgctagaattc

SEQ ID NO: 72720 - DNA, 20 bp, Artificial Sequence
  chemically synthesized
tctgctagaattctcttgat

SEQ ID NO: 72721 - DNA, 20 bp, Artificial Sequence
  chemically synthesized
aacactatatttgttacctt

SEQ ID NO: 72722 - DNA, 20 bp, Artificial Sequence
  chemically synthesized
accttccttgtttttcaatt

SEQ ID NO: 72723 - DNA, 20 bp, Artificial Sequence
  chemically synthesized
gaaattttcccctgccccaa

SEQ ID NO: 72724 - DNA, 20 bp, Artificial Sequence
  chemically synthesized
tggtgacgcgctactgtagt

SEQ ID NO: 72725 - DNA, 20 bp, Artificial Sequence
  chemically synthesized
aatcacttgaacctgggagg

SEQ ID NO: 72726 - DNA, 20 bp, Artificial Sequence
  chemically synthesized
gaggtggagtttgcagtgag

SEQ ID NO: 72727 - DNA, 20 bp, Artificial Sequence
  chemically synthesized
ggtatccctatcttacatca

SEQ ID NO: 72728 - DNA, 20 bp, Artificial Sequence
  chemically synthesized
agaaagatgaaactcagggg

SEQ ID NO: 72729 - DNA, 20 bp, Artificial Sequence
  chemically synthesized
gggaggtgatttccacatgc

SEQ ID NO: 72730 - DNA, 20 bp, Artificial Sequence
  chemically synthesized
gtgccaggaacttgaatatg

SEQ ID NO: 72731 - DNA, 20 bp, Artificial Sequence
  chemically synthesized
cactcaaggaaagcatataa

SEQ ID NO: 72732 - DNA, 20 bp, Artificial Sequence
  chemically synthesized
tgaggtgggatatcctacag

SEQ ID NO: 72733 - DNA, 20 bp, Artificial Sequence
  chemically synthesized
aagagtatttaaggaactgt

SEQ ID NO: 72734 - DNA, 20 bp, Artificial Sequence
  chemically synthesized
tttaaggaactgtgatagat

SEQ ID NO: 72735 - DNA, 20 bp, Artificial Sequence
  chemically synthesized
aggttttctaatctgggacc

SEQ ID NO: 72736 - DNA, 20 bp, Artificial Sequence
  chemically synthesized
tcttactcatttttctatgt

SEQ ID NO: 72737 - DNA, 20 bp, Artificial Sequence
  chemically synthesized
catttttctatgtagatgtt

SEQ ID NO: 72738 - DNA, 20 bp, Artificial Sequence
  chemically synthesized
agaatatttcttcattccaa

SEQ ID NO: 72739 - DNA, 20 bp, Artificial Sequence
  chemically synthesized
aatgacatgactatctttac

SEQ ID NO: 72740 - DNA, 20 bp, Artificial Sequence
  chemically synthesized
ctggtgcttttgtcatttta

SEQ ID NO: 72741 - DNA, 20 bp, Artificial Sequence
  chemically synthesized
caaatgatcatctttggtca

SEQ ID NO: 72742 - DNA, 20 bp, Artificial Sequence
  chemically synthesized
ttcaacttagttgaaatcaa

SEQ ID NO: 72743 - DNA, 20 bp, Artificial Sequence
  chemically synthesized
ttagttgaaatcaactcagt

SEQ ID NO: 72744 - DNA, 20 bp, Artificial Sequence
  chemically synthesized
tcagtttttgtttatccaga

SEQ ID NO: 72745 - DNA, 20 bp, Artificial Sequence
  chemically synthesized
ttatccagaaagggcttatt

SEQ ID NO: 72746 - DNA, 20 bp, Artificial Sequence
  chemically synthesized
tattgataactttcctgttc

SEQ ID NO: 72747 - DNA, 20 bp, Artificial Sequence
  chemically synthesized
tgttcagaggattttttgtt

SEQ ID NO: 72748 - DNA, 20 bp, Artificial Sequence
  chemically synthesized
aaaaattctgaatcgagttg

SEQ ID NO: 72749 - DNA, 20 bp, Artificial Sequence
  chemically synthesized
attaagatctaagaaagcaa

SEQ ID NO: 72750 - DNA, 20 bp, Artificial Sequence
  chemically synthesized
aaatggaggactcacttttt

SEQ ID NO: 72751 - DNA, 20 bp, Artificial Sequence
  chemically synthesized
gagttctgaacctaaacagg

SEQ ID NO: 72752 - DNA, 20 bp, Artificial Sequence
  chemically synthesized
acacacatgcatgtgtgtct

SEQ ID NO: 72753 - DNA, 20 bp, Artificial Sequence
  chemically synthesized
acatgcatgtgtgtctgtgt

SEQ ID NO: 72754 - DNA, 20 bp, Artificial Sequence
  chemically synthesized
atcatattttttcctctttc

SEQ ID NO: 72755 - DNA, 20 bp, Artificial Sequence
  chemically synthesized
cttgtttatgtagactgtat

SEQ ID NO: 72756 - DNA, 20 bp, Artificial Sequence
  chemically synthesized
agaatgaagctagaatgaag

SEQ ID NO: 72757 - DNA, 20 bp, Artificial Sequence
  chemically synthesized
gaatgaagcagggcttagat

SEQ ID NO: 72758 - DNA, 20 bp, Artificial Sequence
  chemically synthesized
gcttagatctatgatttttc

SEQ ID NO: 72759 - DNA, 20 bp, Artificial Sequence
  chemically synthesized
ataaactcataggccatatt

SEQ ID NO: 72760 - DNA, 20 bp, Artificial Sequence
  chemically synthesized
gagagcttcttaagagcaga

SEQ ID NO: 72761 - DNA, 20 bp, Artificial Sequence
  chemically synthesized
tggtgaatggagctcctaca

SEQ ID NO: 72762 - DNA, 20 bp, Artificial Sequence
  chemically synthesized
ttatccagaaaaactagttc

SEQ ID NO: 72763 - DNA, 20 bp, Artificial Sequence
  chemically synthesized
ccttgggagcatgcatacag

SEQ ID NO: 72764 - DNA, 20 bp, Artificial Sequence
  chemically synthesized
tatggcttcatctctggtga

SEQ ID NO: 72765 - DNA, 20 bp, Artificial Sequence
  chemically synthesized
tgacactgcttatagtgggc

SEQ ID NO: 72766 - DNA, 20 bp, Artificial Sequence
  chemically synthesized
cctgcctctgggtaaatatc

SEQ ID NO: 72767 - DNA, 20 bp, Artificial Sequence
  chemically synthesized
caacggcttcccagtgttgg

SEQ ID NO: 72768 - DNA, 20 bp, Artificial Sequence
  chemically synthesized
cagtgttgggcaggcttctt

SEQ ID NO: 72769 - DNA, 20 bp, Artificial Sequence
  chemically synthesized
ttttattcccaaaatctcag

SEQ ID NO: 72770 - DNA, 20 bp, Artificial Sequence
  chemically synthesized
cctgtcttacttttaatgac

SEQ ID NO: 72771 - DNA, 20 bp, Artificial Sequence
  chemically synthesized
tataataaaaaactttcttt

SEQ ID NO: 72772 - DNA, 20 bp, Artificial Sequence
  chemically synthesized
aaactttcttttttggtttc

SEQ ID NO: 72773 - DNA, 20 bp, Artificial Sequence
  chemically synthesized
gccaatttctctaaagacgt

SEQ ID NO: 72774 - DNA, 20 bp, Artificial Sequence
  chemically synthesized
aagtacttgtgctctggaaa

SEQ ID NO: 72775 - DNA, 20 bp, Artificial Sequence
  chemically synthesized
acaattttttttaaaggaat

SEQ ID NO: 72776 - DNA, 20 bp, Artificial Sequence
  chemically synthesized
tttaaaggaatcccagattt

SEQ ID NO: 72777 - DNA, 20 bp, Artificial Sequence
  chemically synthesized
aattttaatgtgactttctt

SEQ ID NO: 72778 - DNA, 20 bp, Artificial Sequence
  chemically synthesized
acatcctcttattcctcaat

SEQ ID NO: 72779 - DNA, 20 bp, Artificial Sequence
  chemically synthesized
cagtcttctatatgaattca

SEQ ID NO: 72780 - DNA, 20 bp, Artificial Sequence
  chemically synthesized
aattcaatgtgatttaattt

SEQ ID NO: 72781 - DNA, 20 bp, Artificial Sequence
  chemically synthesized
ttttagggattccctagtgt

SEQ ID NO: 72782 - DNA, 20 bp, Artificial Sequence
  chemically synthesized
acatttccttatacaatatg

SEQ ID NO: 72783 - DNA, 20 bp, Artificial Sequence
  chemically synthesized
cttatacaatatgaaatgct

SEQ ID NO: 72784 - DNA, 20 bp, Artificial Sequence
  chemically synthesized
atgaaatgctttgtgatttc

SEQ ID NO: 72785 - DNA, 20 bp, Artificial Sequence
  chemically synthesized
tgctttgtgatttcttctga

SEQ ID NO: 72786 - DNA, 20 bp, Artificial Sequence
  chemically synthesized
taggtgctaaagacttgcct

SEQ ID NO: 72787 - DNA, 20 bp, Artificial Sequence
  chemically synthesized
agactgcagcagagctggta

SEQ ID NO: 72788 - DNA, 20 bp, Artificial Sequence
  chemically synthesized
cagaactgcaacagttcctc

SEQ ID NO: 72789 - DNA, 20 bp, Artificial Sequence
  chemically synthesized
tcaactggatggaagcatta

SEQ ID NO: 72790 - DNA, 20 bp, Artificial Sequence
  chemically synthesized
aaaaggtttctatctcgaaa

SEQ ID NO: 72791 - DNA, 20 bp, Artificial Sequence
  chemically synthesized
cgaaagatggattaggtatg

SEQ ID NO: 72792 - DNA, 20 bp, Artificial Sequence
  chemically synthesized
ttatagcagtgatgcccaga

SEQ ID NO: 72793 - DNA, 20 bp, Artificial Sequence
  chemically synthesized
tgaggacctgaaaaaagcga

SEQ ID NO: 72794 - DNA, 20 bp, Artificial Sequence
  chemically synthesized
ggctgcatgcctaacaagcc

SEQ ID NO: 72795 - DNA, 20 bp, Artificial Sequence
  chemically synthesized
cacagcaagaagacaactaa

SEQ ID NO: 72796 - DNA, 20 bp, Artificial Sequence
  chemically synthesized
catttatgtatatttatgtt

SEQ ID NO: 72797 - DNA, 20 bp, Artificial Sequence
  chemically synthesized
cagttaatcatctccaagca

SEQ ID NO: 72798 - DNA, 20 bp, Artificial Sequence
  chemically synthesized
aagcaggaagattggaggct

SEQ ID NO: 72799 - DNA, 20 bp, Artificial Sequence
  chemically synthesized
agattggaggctcctggttt

SEQ ID NO: 72800 - DNA, 20 bp, Artificial Sequence
  chemically synthesized
ctgcagccccttttttgctg

SEQ ID NO: 72801 - DNA, 20 bp, Artificial Sequence
  chemically synthesized
tggatctccatccccttctt

SEQ ID NO: 72802 - DNA, 20 bp, Artificial Sequence
  chemically synthesized
catcctatgggtgaatcaca

SEQ ID NO: 72803 - DNA, 20 bp, Artificial Sequence
  chemically synthesized
acagggagattagcagtgtg

SEQ ID NO: 72804 - DNA, 20 bp, Artificial Sequence
  chemically synthesized
agcagtgtgggctgcttcct

SEQ ID NO: 72805 - DNA, 20 bp, Artificial Sequence
  chemically synthesized
ggttccctcctggcaatggc

SEQ ID NO: 72806 - DNA, 20 bp, Artificial Sequence
  chemically synthesized
ccctcctggcaatggcatat

SEQ ID NO: 72807 - DNA, 20 bp, Artificial Sequence
  chemically synthesized
gccatccgcaatcctttgag

SEQ ID NO: 72808 - DNA, 20 bp, Artificial Sequence
  chemically synthesized
agtcatagcgttaggagtgg

SEQ ID NO: 72809 - DNA, 20 bp, Artificial Sequence
  chemically synthesized
taggagtgggagtgtttcta

SEQ ID NO: 72810 - DNA, 20 bp, Artificial Sequence
  chemically synthesized
tgcaaatctcatgttatcac

SEQ ID NO: 72811 - DNA, 20 bp, Artificial Sequence
  chemically synthesized
ctccaccaagaaatcatgag

SEQ ID NO: 72812 - DNA, 20 bp, Artificial Sequence
  chemically synthesized
attcttaatactgtcatagg

SEQ ID NO: 72813 - DNA, 20 bp, Artificial Sequence
  chemically synthesized
ttatcttctatgttacagtg

SEQ ID NO: 72814 - DNA, 20 bp, Artificial Sequence
  chemically synthesized
tgatgggtttgacattcatt

SEQ ID NO: 72815 - DNA, 20 bp, Artificial Sequence
  chemically synthesized
tatccgccttttatctaaac

SEQ ID NO: 72816 - DNA, 20 bp, Artificial Sequence
  chemically synthesized
cagtgtgcacatttgtgcat

SEQ ID NO: 72817 - DNA, 20 bp, Artificial Sequence
  chemically synthesized
acatttgtgcatacatgttt

SEQ ID NO: 72818 - DNA, 20 bp, Artificial Sequence
  chemically synthesized
agttagggtactctctaggg

SEQ ID NO: 72819 - DNA, 20 bp, Artificial Sequence
  chemically synthesized
cacttacagagtatttcaat

SEQ ID NO: 72820 - DNA, 20 bp, Artificial Sequence
  chemically synthesized
aatacattccttgcaggatg

SEQ ID NO: 72821 - DNA, 20 bp, Artificial Sequence
  chemically synthesized
tcttagaaggaaaaacctag

SEQ ID NO: 72822 - DNA, 20 bp, Artificial Sequence
  chemically synthesized
agctcgtaaaaaagtaaaaa

SEQ ID NO: 72823 - DNA, 20 bp, Artificial Sequence
  chemically synthesized
taaaaagtgagtttttaaga

SEQ ID NO: 72824 - DNA, 20 bp, Artificial Sequence
  chemically synthesized
taagagtatgtttgctcttc

SEQ ID NO: 72825 - DNA, 20 bp, Artificial Sequence
  chemically synthesized
tcagagggaaaaattagaaa

SEQ ID NO: 72826 - DNA, 20 bp, Artificial Sequence
  chemically synthesized
agaccaacaatgttgagaga

SEQ ID NO: 72827 - DNA, 20 bp, Artificial Sequence
  chemically synthesized
gactaaaaaattgtggtggg

SEQ ID NO: 72828 - DNA, 20 bp, Artificial Sequence
  chemically synthesized
tttttgtgtgactgtgtact

SEQ ID NO: 72829 - DNA, 20 bp, Artificial Sequence
  chemically synthesized
tgtactaaaagcttctttta

SEQ ID NO: 72830 - DNA, 20 bp, Artificial Sequence
  chemically synthesized
tagactgatttaattgtgaa

SEQ ID NO: 72831 - DNA, 20 bp, Artificial Sequence
  chemically synthesized
ctcatttcggataattccca

SEQ ID NO: 72832 - DNA, 20 bp, Artificial Sequence
  chemically synthesized
tgtagctgaggaaagcctgc

SEQ ID NO: 72833 - DNA, 20 bp, Artificial Sequence
  chemically synthesized
ctaaattttgaggataggct

SEQ ID NO: 72834 - DNA, 20 bp, Artificial Sequence
  chemically synthesized
atacatttgatggaaggact

SEQ ID NO: 72835 - DNA, 20 bp, Artificial Sequence
  chemically synthesized
ccaaggccaggacttcaagc

SEQ ID NO: 72836 - DNA, 20 bp, Artificial Sequence
  chemically synthesized
gccacatgtgtgagaaataa

SEQ ID NO: 72837 - DNA, 20 bp, Artificial Sequence
  chemically synthesized
ctcactgaataggtataagg

SEQ ID NO: 72838 - DNA, 20 bp, Artificial Sequence
  chemically synthesized
tgcttactttggataagcag

SEQ ID NO: 72839 - DNA, 20 bp, Artificial Sequence
  chemically synthesized
gaagcccaaattattgggaa

SEQ ID NO: 72840 - DNA, 20 bp, Artificial Sequence
  chemically synthesized
attaatgacgttgtccttaa

SEQ ID NO: 72841 - DNA, 20 bp, Artificial Sequence
  chemically synthesized
tctgttcttggtgccttcat

SEQ ID NO: 72842 - DNA, 20 bp, Artificial Sequence
  chemically synthesized
tttaaagaaaatatttttca

SEQ ID NO: 72843 - DNA, 20 bp, Artificial Sequence
  chemically synthesized
gtcatatttttaataaggag

SEQ ID NO: 72844 - DNA, 20 bp, Artificial Sequence
  chemically synthesized
ccttcccactttaccacatg

SEQ ID NO: 72845 - DNA, 20 bp, Artificial Sequence
  chemically synthesized
tgtgcaaagcacttcattga

SEQ ID NO: 72846 - DNA, 20 bp, Artificial Sequence
  chemically synthesized
atgaccaatcaataaataac

SEQ ID NO: 72847 - DNA, 20 bp, Artificial Sequence
  chemically synthesized
agaaattcaggtggcattac

SEQ ID NO: 72848 - DNA, 20 bp, Artificial Sequence
  chemically synthesized
cctgttctcccccttttcca

SEQ ID NO: 72849 - DNA, 20 bp, Artificial Sequence
  chemically synthesized
agtaactttaaacaataact

SEQ ID NO: 72850 - DNA, 20 bp, Artificial Sequence
  chemically synthesized
ttataagtactcatcatacc

SEQ ID NO: 72851 - DNA, 20 bp, Artificial Sequence
  chemically synthesized
attcccttatggtaatgtca

SEQ ID NO: 72852 - DNA, 20 bp, Artificial Sequence
  chemically synthesized
tggtaatgtcaaaatgtttt

SEQ ID NO: 72853 - DNA, 20 bp, Artificial Sequence
  chemically synthesized
tgatcagaacctgctactac

SEQ ID NO: 72854 - DNA, 20 bp, Artificial Sequence
  chemically synthesized
tactacagattcattttctc

SEQ ID NO: 72855 - DNA, 20 bp, Artificial Sequence
  chemically synthesized
tgtacattttacaaacttta

SEQ ID NO: 72856 - DNA, 20 bp, Artificial Sequence
  chemically synthesized
ttacaaactttaatttgttt

SEQ ID NO: 72857 - DNA, 20 bp, Artificial Sequence
  chemically synthesized
aactttaatttgtttacttg

SEQ ID NO: 72858 - DNA, 20 bp, Artificial Sequence
  chemically synthesized
atttgtttacttgtttcgtt

SEQ ID NO: 72859 - DNA, 20 bp, Artificial Sequence
  chemically synthesized
ttgttcttttcacctgtacg

SEQ ID NO: 72860 - DNA, 20 bp, Artificial Sequence
  chemically synthesized
taatatagtagcatttaatt

SEQ ID NO: 72861 - DNA, 20 bp, Artificial Sequence
  chemically synthesized
gtaaatattttctttctagt

SEQ ID NO: 72862 - DNA, 20 bp, Artificial Sequence
  chemically synthesized
attttctttctagtgcctgc

SEQ ID NO: 72863 - DNA, 20 bp, Artificial Sequence
  chemically synthesized
tttctttgtggctgttctta

SEQ ID NO: 72864 - DNA, 20 bp, Artificial Sequence
  chemically synthesized
tgttcttaatgggattgtgt

SEQ ID NO: 72865 - DNA, 20 bp, Artificial Sequence
  chemically synthesized
ttattggtgtatggaaatgc

SEQ ID NO: 72866 - DNA, 20 bp, Artificial Sequence
  chemically synthesized
gaaatgctactgatttttgt

SEQ ID NO: 72867 - DNA, 20 bp, Artificial Sequence
  chemically synthesized
gtatcctgaaaccttgctaa

SEQ ID NO: 72868 - DNA, 20 bp, Artificial Sequence
  chemically synthesized
gcagccttttggaagaatct

SEQ ID NO: 72869 - DNA, 20 bp, Artificial Sequence
  chemically synthesized
tcatatcatcagcaaagaga

SEQ ID NO: 72870 - DNA, 20 bp, Artificial Sequence
  chemically synthesized
tcatcagcaaagagagatag

SEQ ID NO: 72871 - DNA, 20 bp, Artificial Sequence
  chemically synthesized
gccatttctttctttctctc

SEQ ID NO: 72872 - DNA, 20 bp, Artificial Sequence
  chemically synthesized
aatgggaatccttgtcttgt

SEQ ID NO: 72873 - DNA, 20 bp, Artificial Sequence
  chemically synthesized
cagttttcgaggagaatagt

SEQ ID NO: 72874 - DNA, 20 bp, Artificial Sequence
  chemically synthesized
tccagcttttgcccattcag

SEQ ID NO: 72875 - DNA, 20 bp, Artificial Sequence
  chemically synthesized
cattcagtatggttttggtt

SEQ ID NO: 72876 - DNA, 20 bp, Artificial Sequence
  chemically synthesized
ttggttatgggtttttcata

SEQ ID NO: 72877 - DNA, 20 bp, Artificial Sequence
  chemically synthesized
cctttgatgcctagtctgtt

SEQ ID NO: 72878 - DNA, 20 bp, Artificial Sequence
  chemically synthesized
agggatgttgaattttattg

SEQ ID NO: 72879 - DNA, 20 bp, Artificial Sequence
  chemically synthesized
tcagtctattgagatgatca

SEQ ID NO: 72880 - DNA, 20 bp, Artificial Sequence
  chemically synthesized
aacaacacaaataaataaat

SEQ ID NO: 72881 - DNA, 20 bp, Artificial Sequence
  chemically synthesized
aaataaaagctttccaggct

SEQ ID NO: 72882 - DNA, 20 bp, Artificial Sequence
  chemically synthesized
ttcttcacagtattagaaaa

SEQ ID NO: 72883 - DNA, 20 bp, Artificial Sequence
  chemically synthesized
tcggaaggctgaggcaggag

SEQ ID NO: 72884 - DNA, 20 bp, Artificial Sequence
  chemically synthesized
agtggaacctaattaaacta

SEQ ID NO: 72885 - DNA, 20 bp, Artificial Sequence
  chemically synthesized
caaatgtccaacaatgatag

SEQ ID NO: 72886 - DNA, 20 bp, Artificial Sequence
  chemically synthesized
agtataataataataataaa

SEQ ID NO: 72887 - DNA, 20 bp, Artificial Sequence
  chemically synthesized
ctatttttaaaaagccaaaa

SEQ ID NO: 72888 - DNA, 20 bp, Artificial Sequence
  chemically synthesized
ttagttcaaccactgcagaa

SEQ ID NO: 72889 - DNA, 20 bp, Artificial Sequence
  chemically synthesized
cacttgcatgttcactgtaa

SEQ ID NO: 72890 - DNA, 20 bp, Artificial Sequence
  chemically synthesized
tgaacctggtatgaaatggg

SEQ ID NO: 72891 - DNA, 20 bp, Artificial Sequence
  chemically synthesized
ttgaggttcctgtggatcag

SEQ ID NO: 72892 - DNA, 20 bp, Artificial Sequence
  chemically synthesized
cacatggatatactgtgtac

SEQ ID NO: 72893 - DNA, 20 bp, Artificial Sequence
  chemically synthesized
gtagaggtggcattggagta

SEQ ID NO: 72894 - DNA, 20 bp, Artificial Sequence
  chemically synthesized
cgaggacattggttgagcgt

SEQ ID NO: 72895 - DNA, 20 bp, Artificial Sequence
  chemically synthesized
ggaaagaggaaactctgggg

SEQ ID NO: 72896 - DNA, 20 bp, Artificial Sequence
  chemically synthesized
gtgccaggaacaggaataag

SEQ ID NO: 72897 - DNA, 20 bp, Artificial Sequence
  chemically synthesized
gatgcagcgaagagaagata

SEQ ID NO: 72898 - DNA, 20 bp, Artificial Sequence
  chemically synthesized
acagactttttcatctcaac

SEQ ID NO: 72899 - DNA, 20 bp, Artificial Sequence
  chemically synthesized
atctcaacacatgtttcaag

SEQ ID NO: 72900 - DNA, 20 bp, Artificial Sequence
  chemically synthesized
cacatgtttcaaggcaggct

SEQ ID NO: 72901 - DNA, 20 bp, Artificial Sequence
  chemically synthesized
gaagtttcaaatgtggtgct

SEQ ID NO: 72902 - DNA, 20 bp, Artificial Sequence
  chemically synthesized
ttcaaatgtggtgctcatgg

SEQ ID NO: 72903 - DNA, 20 bp, Artificial Sequence
  chemically synthesized
tttagactaaatgtgacgtc

SEQ ID NO: 72904 - DNA, 20 bp, Artificial Sequence
  chemically synthesized
atttttctccacagagggct

SEQ ID NO: 72905 - DNA, 20 bp, Artificial Sequence
  chemically synthesized
tatttcaaaactaaacaaag

SEQ ID NO: 72906 - DNA, 20 bp, Artificial Sequence
  chemically synthesized
aacaaaacactatgtctata

SEQ ID NO: 72907 - DNA, 20 bp, Artificial Sequence
  chemically synthesized
tgtgaaacataaaataaaaa

SEQ ID NO: 72908 - DNA, 20 bp, Artificial Sequence
  chemically synthesized
ggcatgatgcattttttaaa

SEQ ID NO: 72909 - DNA, 20 bp, Artificial Sequence
  chemically synthesized
gcattttttaaaatgtgttt

SEQ ID NO: 72910 - DNA, 20 bp, Artificial Sequence
  chemically synthesized
aaatgtgttttttagattaa

SEQ ID NO: 72911 - DNA, 20 bp, Artificial Sequence
  chemically synthesized
attattgctaaatatgaata

SEQ ID NO: 72912 - DNA, 20 bp, Artificial Sequence
  chemically synthesized
taggattgaggctgcagaaa

SEQ ID NO: 72913 - DNA, 20 bp, Artificial Sequence
  chemically synthesized
ggtagtaaaaactgataagg

SEQ ID NO: 72914 - DNA, 20 bp, Artificial Sequence
  chemically synthesized
taaggcagggatttcagtgt

SEQ ID NO: 72915 - DNA, 20 bp, Artificial Sequence
  chemically synthesized
atgcggctccttttttgctg

SEQ ID NO: 72916 - DNA, 20 bp, Artificial Sequence
  chemically synthesized
tcgatctccatccccttctt

SEQ ID NO: 72917 - DNA, 20 bp, Artificial Sequence
  chemically synthesized
acagtcttcacgaacccatg

SEQ ID NO: 72918 - DNA, 20 bp, Artificial Sequence
  chemically synthesized
acaaagaggttatccatggg

SEQ ID NO: 72919 - DNA, 20 bp, Artificial Sequence
  chemically synthesized
atccatggggcctgcttctt

SEQ ID NO: 72920 - DNA, 20 bp, Artificial Sequence
  chemically synthesized
ttctcctgtcaatggcctat

SEQ ID NO: 72921 - DNA, 20 bp, Artificial Sequence
  chemically synthesized
tgaccgtttcattatcatcc

SEQ ID NO: 72922 - DNA, 20 bp, Artificial Sequence
  chemically synthesized
tgcctccaattctgccactc

SEQ ID NO: 72923 - DNA, 20 bp, Artificial Sequence
  chemically synthesized
cacttatacccagctattct

SEQ ID NO: 72924 - DNA, 20 bp, Artificial Sequence
  chemically synthesized
atacccagctattctggttg

SEQ ID NO: 72925 - DNA, 20 bp, Artificial Sequence
  chemically synthesized
gatcagtgagactttcattc

SEQ ID NO: 72926 - DNA, 20 bp, Artificial Sequence
  chemically synthesized
cgcctattttctgggcacag

SEQ ID NO: 72927 - DNA, 20 bp, Artificial Sequence
  chemically synthesized
ttttcagaattttgtgatct

SEQ ID NO: 72928 - DNA, 20 bp, Artificial Sequence
  chemically synthesized
ggccttttgagtaattggaa

SEQ ID NO: 72929 - DNA, 20 bp, Artificial Sequence
  chemically synthesized
atctcttgtatcagtgttag

SEQ ID NO: 72930 - DNA, 20 bp, Artificial Sequence
  chemically synthesized
aatgtattcatatgtagatg

SEQ ID NO: 72931 - DNA, 20 bp, Artificial Sequence
  chemically synthesized
gaaaaatgtgcaattgcaga

SEQ ID NO: 72932 - DNA, 20 bp, Artificial Sequence
  chemically synthesized
tcaaaactactctatttcag

SEQ ID NO: 72933 - DNA, 20 bp, Artificial Sequence
  chemically synthesized
ttttttttttttttttttaa

SEQ ID NO: 72934 - DNA, 20 bp, Artificial Sequence
  chemically synthesized
agggcacatgtgcaggatgt

SEQ ID NO: 72935 - DNA, 20 bp, Artificial Sequence
  chemically synthesized
cataggtaaatgtgtgccat

SEQ ID NO: 72936 - DNA, 20 bp, Artificial Sequence
  chemically synthesized
ccatttctgtgtgagaacat

SEQ ID NO: 72937 - DNA, 20 bp, Artificial Sequence
  chemically synthesized
tctgtgtgagaacatgtgtg

SEQ ID NO: 72938 - DNA, 20 bp, Artificial Sequence
  chemically synthesized
gtttggttttctgttcctgt

SEQ ID NO: 72939 - DNA, 20 bp, Artificial Sequence
  chemically synthesized
tgtgttagtttgatgaggat

SEQ ID NO: 72940 - DNA, 20 bp, Artificial Sequence
  chemically synthesized
tattccatggtatatatgta

SEQ ID NO: 72941 - DNA, 20 bp, Artificial Sequence
  chemically synthesized
ctatcattgatggacatttg

SEQ ID NO: 72942 - DNA, 20 bp, Artificial Sequence
  chemically synthesized
aagcatgcctgtatttttat

SEQ ID NO: 72943 - DNA, 20 bp, Artificial Sequence
  chemically synthesized
atgcctgtatttttataata

SEQ ID NO: 72944 - DNA, 20 bp, Artificial Sequence
  chemically synthesized
ctttgggtatatacccagta

SEQ ID NO: 72945 - DNA, 20 bp, Artificial Sequence
  chemically synthesized
attgctgagtcaagtggtat

SEQ ID NO: 72946 - DNA, 20 bp, Artificial Sequence
  chemically synthesized
aaaggctacactctcttcca

SEQ ID NO: 72947 - DNA, 20 bp, Artificial Sequence
  chemically synthesized
tctgcaaccttgccagcaac

SEQ ID NO: 72948 - DNA, 20 bp, Artificial Sequence
  chemically synthesized
ggtgtgagatggtatcccat

SEQ ID NO: 72949 - DNA, 20 bp, Artificial Sequence
  chemically synthesized
gagatggtatcccattgtgg

SEQ ID NO: 72950 - DNA, 20 bp, Artificial Sequence
  chemically synthesized
ttttctaatgaccagtaagg

SEQ ID NO: 72951 - DNA, 20 bp, Artificial Sequence
  chemically synthesized
ggttgagctttttttttttc

SEQ ID NO: 72952 - DNA, 20 bp, Artificial Sequence
  chemically synthesized
cattccccactttttaatgg

SEQ ID NO: 72953 - DNA, 20 bp, Artificial Sequence
  chemically synthesized
gggttgtttttttcttgtaa

SEQ ID NO: 72954 - DNA, 20 bp, Artificial Sequence
  chemically synthesized
ggttgtctgttatctctgat

SEQ ID NO: 72955 - DNA, 20 bp, Artificial Sequence
  chemically synthesized
atttgtcaatttttttttgc

SEQ ID NO: 72956 - DNA, 20 bp, Artificial Sequence
  chemically synthesized
ttgcagttgcttttggtgtc

SEQ ID NO: 72957 - DNA, 20 bp, Artificial Sequence
  chemically synthesized
aaatgatacaatgtcatcta

SEQ ID NO: 72958 - DNA, 20 bp, Artificial Sequence
  chemically synthesized
gcagcaacttggaaatctca

SEQ ID NO: 72959 - DNA, 20 bp, Artificial Sequence
  chemically synthesized
gctaattttcatccttttat

SEQ ID NO: 72960 - DNA, 20 bp, Artificial Sequence
  chemically synthesized
tccttttataattgatttta

SEQ ID NO: 72961 - DNA, 20 bp, Artificial Sequence
  chemically synthesized
agtttattatgtattatctc

SEQ ID NO: 72962 - DNA, 20 bp, Artificial Sequence
  chemically synthesized
atttttagtgtacgtatttt

SEQ ID NO: 72963 - DNA, 20 bp, Artificial Sequence
  chemically synthesized
gtgtacgtattttcccagtt

SEQ ID NO: 72964 - DNA, 20 bp, Artificial Sequence
  chemically synthesized
tcttgctatatacacaattt

SEQ ID NO: 72965 - DNA, 20 bp, Artificial Sequence
  chemically synthesized
tatcaaagcccttgctgact

SEQ ID NO: 72966 - DNA, 20 bp, Artificial Sequence
  chemically synthesized
ctaatttatttgtacatatc

SEQ ID NO: 72967 - DNA, 20 bp, Artificial Sequence
  chemically synthesized
tgtacatatcctatgtttaa

SEQ ID NO: 72968 - DNA, 20 bp, Artificial Sequence
  chemically synthesized
tatcctatgtttaaaagggt

SEQ ID NO: 72969 - DNA, 20 bp, Artificial Sequence
  chemically synthesized
atccaaatttaaaacaagtg

SEQ ID NO: 72970 - DNA, 20 bp, Artificial Sequence
  chemically synthesized
tggagagtgtgggtctcaaa

SEQ ID NO: 72971 - DNA, 20 bp, Artificial Sequence
  chemically synthesized
tctcaaaaaaggcttgaggt

SEQ ID NO: 72972 - DNA, 20 bp, Artificial Sequence
  chemically synthesized
ggttatggcttgaaataagg

SEQ ID NO: 72973 - DNA, 20 bp, Artificial Sequence
  chemically synthesized
cccttcagctgagacctgaa

SEQ ID NO: 72974 - DNA, 20 bp, Artificial Sequence
  chemically synthesized
tgtgtggagacctcagctag

SEQ ID NO: 72975 - DNA, 20 bp, Artificial Sequence
  chemically synthesized
ggaaggtggctactggaaga

SEQ ID NO: 72976 - DNA, 20 bp, Artificial Sequence
  chemically synthesized
ggtggctactggaagagggt

SEQ ID NO: 72977 - DNA, 20 bp, Artificial Sequence
  chemically synthesized
atggccttattggtcatcat

SEQ ID NO: 72978 - DNA, 20 bp, Artificial Sequence
  chemically synthesized
aaagaagctgcataattcat

SEQ ID NO: 72979 - DNA, 20 bp, Artificial Sequence
  chemically synthesized
tatttaaggtctaaatataa

SEQ ID NO: 72980 - DNA, 20 bp, Artificial Sequence
  chemically synthesized
agtgccaaaagaaaggcagt

SEQ ID NO: 72981 - DNA, 20 bp, Artificial Sequence
  chemically synthesized
aatgagtcaaaataataaac

SEQ ID NO: 72982 - DNA, 20 bp, Artificial Sequence
  chemically synthesized
tagacttttaaaaacaaaat

SEQ ID NO: 72983 - DNA, 20 bp, Artificial Sequence
  chemically synthesized
taggagaaagcaggatagat

SEQ ID NO: 72984 - DNA, 20 bp, Artificial Sequence
  chemically synthesized
gtgtcattcactgaagtaga

SEQ ID NO: 72985 - DNA, 20 bp, Artificial Sequence
  chemically synthesized
gatacaaacataaataggaa

SEQ ID NO: 72986 - DNA, 20 bp, Artificial Sequence
  chemically synthesized
aacaagaatttattgaaaaa

SEQ ID NO: 72987 - DNA, 20 bp, Artificial Sequence
  chemically synthesized
gaaaaatgaagttttttcat

SEQ ID NO: 72988 - DNA, 20 bp, Artificial Sequence
  chemically synthesized
tgagtgcttatgttagttac

SEQ ID NO: 72989 - DNA, 20 bp, Artificial Sequence
  chemically synthesized
catatggaactgaaaataat

SEQ ID NO: 72990 - DNA, 20 bp, Artificial Sequence
  chemically synthesized
tggaactgaaaataatctat

SEQ ID NO: 72991 - DNA, 20 bp, Artificial Sequence
  chemically synthesized
cctagtatgtatatatatag

SEQ ID NO: 72992 - DNA, 20 bp, Artificial Sequence
  chemically synthesized
cataatttttaacctcaaac

SEQ ID NO: 72993 - DNA, 20 bp, Artificial Sequence
  chemically synthesized
ttaatgaattgaaatacatt

SEQ ID NO: 72994 - DNA, 20 bp, Artificial Sequence
  chemically synthesized
tacaccaaataaaaactcta

SEQ ID NO: 72995 - DNA, 20 bp, Artificial Sequence
  chemically synthesized
gtatgacttattgcacttag

SEQ ID NO: 72996 - DNA, 20 bp, Artificial Sequence
  chemically synthesized
ttgcacttaggatagttttt

SEQ ID NO: 72997 - DNA, 20 bp, Artificial Sequence
  chemically synthesized
catctgttgatagatacttg

SEQ ID NO: 72998 - DNA, 20 bp, Artificial Sequence
  chemically synthesized
gatgtcttcccttcaatatg

SEQ ID NO: 72999 - DNA, 20 bp, Artificial Sequence
  chemically synthesized
acttcctctcactctgaata

SEQ ID NO: 73000 - DNA, 20 bp, Artificial Sequence
  chemically synthesized
ccatggaagaagaaaatgag

SEQ ID NO: 73001 - DNA, 20 bp, Artificial Sequence
  chemically synthesized
agacaagctttctggagaaa

SEQ ID NO: 73002 - DNA, 20 bp, Artificial Sequence
  chemically synthesized
tgcaacctctgcctcctggg

SEQ ID NO: 73003 - DNA, 20 bp, Artificial Sequence
  chemically synthesized
ggttcagttttcagttaaag

SEQ ID NO: 73004 - DNA, 20 bp, Artificial Sequence
  chemically synthesized
aacaaattttttcactcaac

SEQ ID NO: 73005 - DNA, 20 bp, Artificial Sequence
  chemically synthesized
tcacggagaaagataagaac

SEQ ID NO: 73006 - DNA, 20 bp, Artificial Sequence
  chemically synthesized
gagaaagataagaactggtg

SEQ ID NO: 73007 - DNA, 20 bp, Artificial Sequence
  chemically synthesized
ttgctctggacttcactgag

SEQ ID NO: 73008 - DNA, 20 bp, Artificial Sequence
  chemically synthesized
acttcactgagtaaagtttt

SEQ ID NO: 73009 - DNA, 20 bp, Artificial Sequence
  chemically synthesized
actgagtaaagttttttttg

SEQ ID NO: 73010 - DNA, 20 bp, Artificial Sequence
  chemically synthesized
gtaaagttttttttgctttg

SEQ ID NO: 73011 - DNA, 20 bp, Artificial Sequence
  chemically synthesized
gttttttttgctttgttttg

SEQ ID NO: 73012 - DNA, 20 bp, Artificial Sequence
  chemically synthesized
ttttgtctttttagtagaga

SEQ ID NO: 73013 - DNA, 20 bp, Artificial Sequence
  chemically synthesized
cgcctcggcctcccaaagtg

SEQ ID NO: 73014 - DNA, 20 bp, Artificial Sequence
  chemically synthesized
gccaccgcgcccggcctgag

SEQ ID NO: 73015 - DNA, 20 bp, Artificial Sequence
  chemically synthesized
gaaatgagatccaatctatg

SEQ ID NO: 73016 - DNA, 20 bp, Artificial Sequence
  chemically synthesized
ttaaaaaaataggtgtaggc

SEQ ID NO: 73017 - DNA, 20 bp, Artificial Sequence
  chemically synthesized
tcatactgaatcaattgtaa

SEQ ID NO: 73018 - DNA, 20 bp, Artificial Sequence
  chemically synthesized
aaattatatgctattgagta

SEQ ID NO: 73019 - DNA, 20 bp, Artificial Sequence
  chemically synthesized
tggttatcccccaaagactc

SEQ ID NO: 73020 - DNA, 20 bp, Artificial Sequence
  chemically synthesized
taatgtgcccagtaagttcc

SEQ ID NO: 73021 - DNA, 20 bp, Artificial Sequence
  chemically synthesized
ttcaaccccgatcatttcca

SEQ ID NO: 73022 - DNA, 20 bp, Artificial Sequence
  chemically synthesized
aatagaaactgtgaaaaata

SEQ ID NO: 73023 - DNA, 20 bp, Artificial Sequence
  chemically synthesized
ttatacatctgctcctcttt

SEQ ID NO: 73024 - DNA, 20 bp, Artificial Sequence
  chemically synthesized
gcccttcaaattaaaactct

SEQ ID NO: 73025 - DNA, 20 bp, Artificial Sequence
  chemically synthesized
taaaactctgttagtttttc

SEQ ID NO: 73026 - DNA, 20 bp, Artificial Sequence
  chemically synthesized
tctgctatgaaacttcaagt

SEQ ID NO: 73027 - DNA, 20 bp, Artificial Sequence
  chemically synthesized
aatttacgtccaagaagaaa

SEQ ID NO: 73028 - DNA, 20 bp, Artificial Sequence
  chemically synthesized
gaacggttatctgggcctgt

SEQ ID NO: 73029 - DNA, 20 bp, Artificial Sequence
  chemically synthesized
actcacttttgaatatgcag

SEQ ID NO: 73030 - DNA, 20 bp, Artificial Sequence
  chemically synthesized
gctgtttccatgatggagga

SEQ ID NO: 73031 - DNA, 20 bp, Artificial Sequence
  chemically synthesized
gaggaaagagattggaggaa

SEQ ID NO: 73032 - DNA, 20 bp, Artificial Sequence
  chemically synthesized
gaatgtagatttatgggtga

SEQ ID NO: 73033 - DNA, 20 bp, Artificial Sequence
  chemically synthesized
tagatttatgggtgaagttg

SEQ ID NO: 73034 - DNA, 20 bp, Artificial Sequence
  chemically synthesized
ctaccattggtgctgaagga

SEQ ID NO: 73035 - DNA, 20 bp, Artificial Sequence
  chemically synthesized
tttggggaaatacaatttcc

SEQ ID NO: 73036 - DNA, 20 bp, Artificial Sequence
  chemically synthesized
ggaaatacaatttcctatcg

SEQ ID NO: 73037 - DNA, 20 bp, Artificial Sequence
  chemically synthesized
atcaagtcattaccaggagc

SEQ ID NO: 73038 - DNA, 20 bp, Artificial Sequence
  chemically synthesized
attaccaggagcaccagctt

SEQ ID NO: 73039 - DNA, 20 bp, Artificial Sequence
  chemically synthesized
gtttcatcttctacaacctc

SEQ ID NO: 73040 - DNA, 20 bp, Artificial Sequence
  chemically synthesized
ttcaacgtaatctccagaaa

SEQ ID NO: 73041 - DNA, 20 bp, Artificial Sequence
  chemically synthesized
catagatgtgagatggtaca

SEQ ID NO: 73042 - DNA, 20 bp, Artificial Sequence
  chemically synthesized
tacagttctttattgagaat

SEQ ID NO: 73043 - DNA, 20 bp, Artificial Sequence
  chemically synthesized
tgtaaaaatcacttaagcct

SEQ ID NO: 73044 - DNA, 20 bp, Artificial Sequence
  chemically synthesized
atctttcttcttgatgttgt

SEQ ID NO: 73045 - DNA, 20 bp, Artificial Sequence
  chemically synthesized
gttatggatttttctctgaa

SEQ ID NO: 73046 - DNA, 20 bp, Artificial Sequence
  chemically synthesized
caataaagaaaaggagatag

SEQ ID NO: 73047 - DNA, 20 bp, Artificial Sequence
  chemically synthesized
aaaggagatagcattgtttg

SEQ ID NO: 73048 - DNA, 20 bp, Artificial Sequence
  chemically synthesized
tacaatttggctacaaaacc

SEQ ID NO: 73049 - DNA, 20 bp, Artificial Sequence
  chemically synthesized
tgatcacaagaatagcattc

SEQ ID NO: 73050 - DNA, 20 bp, Artificial Sequence
  chemically synthesized
tcactcacttaaaatctttc

SEQ ID NO: 73051 - DNA, 20 bp, Artificial Sequence
  chemically synthesized
cacttaaaatctttcagaag

SEQ ID NO: 73052 - DNA, 20 bp, Artificial Sequence
  chemically synthesized
tattgctgtatgacctaaaa

SEQ ID NO: 73053 - DNA, 20 bp, Artificial Sequence
  chemically synthesized
ctgaatatatgagaggatat

SEQ ID NO: 73054 - DNA, 20 bp, Artificial Sequence
  chemically synthesized
aatctgaaagactgaatttg

SEQ ID NO: 73055 - DNA, 20 bp, Artificial Sequence
  chemically synthesized
aatttgacatgttttgagat

SEQ ID NO: 73056 - DNA, 20 bp, Artificial Sequence
  chemically synthesized
agcacataatccaatgaaaa

SEQ ID NO: 73057 - DNA, 20 bp, Artificial Sequence
  chemically synthesized
atgggactaatatgacaaca

SEQ ID NO: 73058 - DNA, 20 bp, Artificial Sequence
  chemically synthesized
ggagcatcataggaaataaa

SEQ ID NO: 73059 - DNA, 20 bp, Artificial Sequence
  chemically synthesized
acccatcaggaaagaagtct

SEQ ID NO: 73060 - DNA, 20 bp, Artificial Sequence
  chemically synthesized
aaatataaggagtagatatt

SEQ ID NO: 73061 - DNA, 20 bp, Artificial Sequence
  chemically synthesized
agatagctcagggtagggta

SEQ ID NO: 73062 - DNA, 20 bp, Artificial Sequence
  chemically synthesized
atgaataatcatcaagacga

SEQ ID NO: 73063 - DNA, 20 bp, Artificial Sequence
  chemically synthesized
gaaaaggtttggtggtggct

SEQ ID NO: 73064 - DNA, 20 bp, Artificial Sequence
  chemically synthesized
ggttgaattagagaatataa

SEQ ID NO: 73065 - DNA, 20 bp, Artificial Sequence
  chemically synthesized
aaaaaataaaggccatgggg

SEQ ID NO: 73066 - DNA, 20 bp, Artificial Sequence
  chemically synthesized
agctagaataaccccttgag

SEQ ID NO: 73067 - DNA, 20 bp, Artificial Sequence
  chemically synthesized
gtggctcaggtaagaaaagc

SEQ ID NO: 73068 - DNA, 20 bp, Artificial Sequence
  chemically synthesized
caaggattcaaatacgggaa

SEQ ID NO: 73069 - DNA, 20 bp, Artificial Sequence
  chemically synthesized
gatggacattggttgagaat

SEQ ID NO: 73070 - DNA, 20 bp, Artificial Sequence
  chemically synthesized
cattggttgagaatatgagc

SEQ ID NO: 73071 - DNA, 20 bp, Artificial Sequence
  chemically synthesized
gggttttgggttagataaac

SEQ ID NO: 73072 - DNA, 20 bp, Artificial Sequence
  chemically synthesized
tagttgcgtgatcttaggct

SEQ ID NO: 73073 - DNA, 20 bp, Artificial Sequence
  chemically synthesized
ataatatattgtctttactt

SEQ ID NO: 73074 - DNA, 20 bp, Artificial Sequence
  chemically synthesized
tcttttctctctctctcttt

SEQ ID NO: 73075 - DNA, 20 bp, Artificial Sequence
  chemically synthesized
gacctcctccaccagggttc

SEQ ID NO: 73076 - DNA, 20 bp, Artificial Sequence
  chemically synthesized
tgcctcagcctccagagtag

SEQ ID NO: 73077 - DNA, 20 bp, Artificial Sequence
  chemically synthesized
tatgatcatgtgccaccaca

SEQ ID NO: 73078 - DNA, 20 bp, Artificial Sequence
  chemically synthesized
ttttgtaattatagtagtga

SEQ ID NO: 73079 - DNA, 20 bp, Artificial Sequence
  chemically synthesized
ctcctcggcctcccaaagtg

SEQ ID NO: 73080 - DNA, 20 bp, Artificial Sequence
  chemically synthesized
aggcatgagccaccgtgccc

SEQ ID NO: 73081 - DNA, 20 bp, Artificial Sequence
  chemically synthesized
gccccaaacaatcaacacct

SEQ ID NO: 73082 - DNA, 20 bp, Artificial Sequence
  chemically synthesized
ctcctataaacttccctttt

SEQ ID NO: 73083 - DNA, 20 bp, Artificial Sequence
  chemically synthesized
tgctatcctcttacatctgt

SEQ ID NO: 73084 - DNA, 20 bp, Artificial Sequence
  chemically synthesized
ttactgagagcaaaatttgt

SEQ ID NO: 73085 - DNA, 20 bp, Artificial Sequence
  chemically synthesized
caaaatttgtcctagtttcc

SEQ ID NO: 73086 - DNA, 20 bp, Artificial Sequence
  chemically synthesized
tttttttttttgagacagag

SEQ ID NO: 73087 - DNA, 20 bp, Artificial Sequence
  chemically synthesized
cactgcgacgacctctgctc

SEQ ID NO: 73088 - DNA, 20 bp, Artificial Sequence
  chemically synthesized
tgcctcagcctcccgagtag

SEQ ID NO: 73089 - DNA, 20 bp, Artificial Sequence
  chemically synthesized
ttttgtatttttagtagaga

SEQ ID NO: 73090 - DNA, 20 bp, Artificial Sequence
  chemically synthesized
cacctcagccttccaaagtg

SEQ ID NO: 73091 - DNA, 20 bp, Artificial Sequence
  chemically synthesized
ataaaaaagtcacttaaaag

SEQ ID NO: 73092 - DNA, 20 bp, Artificial Sequence
  chemically synthesized
cagatattttgtcttcatct

SEQ ID NO: 73093 - DNA, 20 bp, Artificial Sequence
  chemically synthesized
gcaatatgtggagatgaaaa

SEQ ID NO: 73094 - DNA, 20 bp, Artificial Sequence
  chemically synthesized
gaaaaagtggattcagggga

SEQ ID NO: 73095 - DNA, 20 bp, Artificial Sequence
  chemically synthesized
cactgattgtacagggcact

SEQ ID NO: 73096 - DNA, 20 bp, Artificial Sequence
  chemically synthesized
ttctctttttgtcttctcat

SEQ ID NO: 73097 - DNA, 20 bp, Artificial Sequence
  chemically synthesized
ttttagtttatgtctttata

SEQ ID NO: 73098 - DNA, 20 bp, Artificial Sequence
  chemically synthesized
aatggtttcctgaacagttc

SEQ ID NO: 73099 - DNA, 20 bp, Artificial Sequence
  chemically synthesized
ttgcatccctcagggggcct

SEQ ID NO: 73100 - DNA, 20 bp, Artificial Sequence
  chemically synthesized
ctggaatatttgggtatgtg

SEQ ID NO: 73101 - DNA, 20 bp, Artificial Sequence
  chemically synthesized
ccacaattaaatgccagcgt

SEQ ID NO: 73102 - DNA, 20 bp, Artificial Sequence
  chemically synthesized
tatttccccagtaattacca

SEQ ID NO: 73103 - DNA, 20 bp, Artificial Sequence
  chemically synthesized
ccgcatgtcccaaacgcagc

SEQ ID NO: 73104 - DNA, 20 bp, Artificial Sequence
  chemically synthesized
tcaggttttgaaaacacgac

SEQ ID NO: 73105 - DNA, 20 bp, Artificial Sequence
  chemically synthesized
ttaagaataatcaggcctcc

SEQ ID NO: 73106 - DNA, 20 bp, Artificial Sequence
  chemically synthesized
cagtggatcaagttagttag

SEQ ID NO: 73107 - DNA, 20 bp, Artificial Sequence
  chemically synthesized
gtccatctctctccaccaat

SEQ ID NO: 73108 - DNA, 20 bp, Artificial Sequence
  chemically synthesized
attctgaaacatataattat

SEQ ID NO: 73109 - DNA, 20 bp, Artificial Sequence
  chemically synthesized
atataattattattgtttct

SEQ ID NO: 73110 - DNA, 20 bp, Artificial Sequence
  chemically synthesized
tttataaaataaaaaaggtg

SEQ ID NO: 73111 - DNA, 20 bp, Artificial Sequence
  chemically synthesized
tcaattgaatttgggagaaa

SEQ ID NO: 73112 - DNA, 20 bp, Artificial Sequence
  chemically synthesized
tgagtttcccttgtagttct

SEQ ID NO: 73113 - DNA, 20 bp, Artificial Sequence
  chemically synthesized
atttttctcaatacgagtct

SEQ ID NO: 73114 - DNA, 20 bp, Artificial Sequence
  chemically synthesized
atacgagtcttacagattca

SEQ ID NO: 73115 - DNA, 20 bp, Artificial Sequence
  chemically synthesized
tcataatgattagagggtct

SEQ ID NO: 73116 - DNA, 20 bp, Artificial Sequence
  chemically synthesized
ttgccgtattttctctctgg

SEQ ID NO: 73117 - DNA, 20 bp, Artificial Sequence
  chemically synthesized
tttccctagaactggttgtg

SEQ ID NO: 73118 - DNA, 20 bp, Artificial Sequence
  chemically synthesized
atctatgactctaacaagta

SEQ ID NO: 73119 - DNA, 20 bp, Artificial Sequence
  chemically synthesized
gtccttaaaatatttccgtt

SEQ ID NO: 73120 - DNA, 20 bp, Artificial Sequence
  chemically synthesized
ccaacatgagtctcctattt

SEQ ID NO: 73121 - DNA, 20 bp, Artificial Sequence
  chemically synthesized
agtaattacacctttctaaa

SEQ ID NO: 73122 - DNA, 20 bp, Artificial Sequence
  chemically synthesized
tttacccacttgttcaggtg

SEQ ID NO: 73123 - DNA, 20 bp, Artificial Sequence
  chemically synthesized
acaatagatgagttattttc

SEQ ID NO: 73124 - DNA, 20 bp, Artificial Sequence
  chemically synthesized
atcctaaatacagctgtccc

SEQ ID NO: 73125 - DNA, 20 bp, Artificial Sequence
  chemically synthesized
gtgttgaaaaaataaaggtt

SEQ ID NO: 73126 - DNA, 20 bp, Artificial Sequence
  chemically synthesized
aattggaattattattctga

SEQ ID NO: 73127 - DNA, 20 bp, Artificial Sequence
  chemically synthesized
tagggaaaggccttgtgagt

SEQ ID NO: 73128 - DNA, 20 bp, Artificial Sequence
  chemically synthesized
gagacaatccagaaaaatat

SEQ ID NO: 73129 - DNA, 20 bp, Artificial Sequence
  chemically synthesized
tggcctgatgatgtgctaca

SEQ ID NO: 73130 - DNA, 20 bp, Artificial Sequence
  chemically synthesized
gtgctggccccttcttgctg

SEQ ID NO: 73131 - DNA, 20 bp, Artificial Sequence
  chemically synthesized
tgtcctgctgctagaccaga

SEQ ID NO: 73132 - DNA, 20 bp, Artificial Sequence
  chemically synthesized
agagggagattgcccatgct

SEQ ID NO: 73133 - DNA, 20 bp, Artificial Sequence
  chemically synthesized
ggccattgtagaatcaggta

SEQ ID NO: 73134 - DNA, 20 bp, Artificial Sequence
  chemically synthesized
attgtagaatcaggtatctt

SEQ ID NO: 73135 - DNA, 20 bp, Artificial Sequence
  chemically synthesized
tcttgcttgttttggcctat

SEQ ID NO: 73136 - DNA, 20 bp, Artificial Sequence
  chemically synthesized
taggactgggggtactgatg

SEQ ID NO: 73137 - DNA, 20 bp, Artificial Sequence
  chemically synthesized
aaaactcgcctgtgctgata

SEQ ID NO: 73138 - DNA, 20 bp, Artificial Sequence
  chemically synthesized
gatgggactgtcattcattc

SEQ ID NO: 73139 - DNA, 20 bp, Artificial Sequence
  chemically synthesized
catttatagcatcaagacca

SEQ ID NO: 73140 - DNA, 20 bp, Artificial Sequence
  chemically synthesized
cgcctattttctgggcagag

SEQ ID NO: 73141 - DNA, 20 bp, Artificial Sequence
  chemically synthesized
atttcagaatctcaagatct

SEQ ID NO: 73142 - DNA, 20 bp, Artificial Sequence
  chemically synthesized
tcccattactgaaaaggaac

SEQ ID NO: 73143 - DNA, 20 bp, Artificial Sequence
  chemically synthesized
cacacttttttttcctcaga

SEQ ID NO: 73144 - DNA, 20 bp, Artificial Sequence
  chemically synthesized
acaatccaaaagaagagtaa

SEQ ID NO: 73145 - DNA, 20 bp, Artificial Sequence
  chemically synthesized
agtcaagataagtggactaa

SEQ ID NO: 73146 - DNA, 20 bp, Artificial Sequence
  chemically synthesized
actagttactctgaaaagga

SEQ ID NO: 73147 - DNA, 20 bp, Artificial Sequence
  chemically synthesized
gttactctgaaaaggatctt

SEQ ID NO: 73148 - DNA, 20 bp, Artificial Sequence
  chemically synthesized
agcaaatatctagaacttta

SEQ ID NO: 73149 - DNA, 20 bp, Artificial Sequence
  chemically synthesized
gtggaagccagatatcccag

SEQ ID NO: 73150 - DNA, 20 bp, Artificial Sequence
  chemically synthesized
acttaatactttttcttctt

SEQ ID NO: 73151 - DNA, 20 bp, Artificial Sequence
  chemically synthesized
ccacccatttctatttcccc

SEQ ID NO: 73152 - DNA, 20 bp, Artificial Sequence
  chemically synthesized
gagactttttcacttcatga

SEQ ID NO: 73153 - DNA, 20 bp, Artificial Sequence
  chemically synthesized
tagaaatttttcactgatgg

SEQ ID NO: 73154 - DNA, 20 bp, Artificial Sequence
  chemically synthesized
tcttccttcaatcttcttca

SEQ ID NO: 73155 - DNA, 20 bp, Artificial Sequence
  chemically synthesized
attcattcctctctgaagac

SEQ ID NO: 73156 - DNA, 20 bp, Artificial Sequence
  chemically synthesized
ttccaatttttaagttctcg

SEQ ID NO: 73157 - DNA, 20 bp, Artificial Sequence
  chemically synthesized
aatttttaagttctcgttga

SEQ ID NO: 73158 - DNA, 20 bp, Artificial Sequence
  chemically synthesized
cttgcttctaatattttctt

SEQ ID NO: 73159 - DNA, 20 bp, Artificial Sequence
  chemically synthesized
attattccattctaaattct

SEQ ID NO: 73160 - DNA, 20 bp, Artificial Sequence
  chemically synthesized
tgagcactctgaaaatattc

SEQ ID NO: 73161 - DNA, 20 bp, Artificial Sequence
  chemically synthesized
actaataaatgactactcct

SEQ ID NO: 73162 - DNA, 20 bp, Artificial Sequence
  chemically synthesized
aaggattcagttattgtgcg

SEQ ID NO: 73163 - DNA, 20 bp, Artificial Sequence
  chemically synthesized
ttctttgaaagtaggacgtg

SEQ ID NO: 73164 - DNA, 20 bp, Artificial Sequence
  chemically synthesized
tctctgtgtaaaatttattt

SEQ ID NO: 73165 - DNA, 20 bp, Artificial Sequence
  chemically synthesized
gtttttccaaagttggcata

SEQ ID NO: 73166 - DNA, 20 bp, Artificial Sequence
  chemically synthesized
gagtttattctatttagaaa

SEQ ID NO: 73167 - DNA, 20 bp, Artificial Sequence
  chemically synthesized
cgtcgttttctggttgcctt

SEQ ID NO: 73168 - DNA, 20 bp, Artificial Sequence
  chemically synthesized
attaaaattttcaggcgaat

SEQ ID NO: 73169 - DNA, 20 bp, Artificial Sequence
  chemically synthesized
tggcaaatgtatttgtcagt

SEQ ID NO: 73170 - DNA, 20 bp, Artificial Sequence
  chemically synthesized
ttgtcagtaggggattgcga

SEQ ID NO: 73171 - DNA, 20 bp, Artificial Sequence
  chemically synthesized
aggggattgcgatgctgttt

SEQ ID NO: 73172 - DNA, 20 bp, Artificial Sequence
  chemically synthesized
gggaagatcaagttgagagc

SEQ ID NO: 73173 - DNA, 20 bp, Artificial Sequence
  chemically synthesized
tcttaagtaaatgtatattt

SEQ ID NO: 73174 - DNA, 20 bp, Artificial Sequence
  chemically synthesized
tatattatattttacaactt

SEQ ID NO: 73175 - DNA, 20 bp, Artificial Sequence
  chemically synthesized
tcagtgtcctttcaaacaag

SEQ ID NO: 73176 - DNA, 20 bp, Artificial Sequence
  chemically synthesized
cctcagtctcaccctgactg

SEQ ID NO: 73177 - DNA, 20 bp, Artificial Sequence
  chemically synthesized
agttaattctctgtcatact

SEQ ID NO: 73178 - DNA, 20 bp, Artificial Sequence
  chemically synthesized
tgttacttgtctggtgtggc

SEQ ID NO: 73179 - DNA, 20 bp, Artificial Sequence
  chemically synthesized
ggctcaagcaatccttcttc

SEQ ID NO: 73180 - DNA, 20 bp, Artificial Sequence
  chemically synthesized
ctttttgagtacctaggact

SEQ ID NO: 73181 - DNA, 20 bp, Artificial Sequence
  chemically synthesized
tttatgccactgcacctagc

SEQ ID NO: 73182 - DNA, 20 bp, Artificial Sequence
  chemically synthesized
gagatatttctctcagccag

SEQ ID NO: 73183 - DNA, 20 bp, Artificial Sequence
  chemically synthesized
attcccttcatttctttatt

SEQ ID NO: 73184 - DNA, 20 bp, Artificial Sequence
  chemically synthesized
ctcccacgccgttcccttta

SEQ ID NO: 73185 - DNA, 20 bp, Artificial Sequence
  chemically synthesized
cttattcattcctcttgctg

SEQ ID NO: 73186 - DNA, 20 bp, Artificial Sequence
  chemically synthesized
atatacaagtatttctctaa

SEQ ID NO: 73187 - DNA, 20 bp, Artificial Sequence
  chemically synthesized
agaggttcacatttttatct

SEQ ID NO: 73188 - DNA, 20 bp, Artificial Sequence
  chemically synthesized
accacacaatgtagaaccta

SEQ ID NO: 73189 - DNA, 20 bp, Artificial Sequence
  chemically synthesized
tatgtggtataaatgagaca

SEQ ID NO: 73190 - DNA, 20 bp, Artificial Sequence
  chemically synthesized
gactttacatttctgtctgt

SEQ ID NO: 73191 - DNA, 20 bp, Artificial Sequence
  chemically synthesized
aagtatatgtaaaatccaca

SEQ ID NO: 73192 - DNA, 20 bp, Artificial Sequence
  chemically synthesized
cttctttctgcatgcattgg

SEQ ID NO: 73193 - DNA, 20 bp, Artificial Sequence
  chemically synthesized
aaagtgtgctgtatattcaa

SEQ ID NO: 73194 - DNA, 20 bp, Artificial Sequence
  chemically synthesized
gcctaggggtgtcaaatact

SEQ ID NO: 73195 - DNA, 20 bp, Artificial Sequence
  chemically synthesized
gtgtctgaatatctctattt

SEQ ID NO: 73196 - DNA, 20 bp, Artificial Sequence
  chemically synthesized
tatcatagtgaacatctgac

SEQ ID NO: 73197 - DNA, 20 bp, Artificial Sequence
  chemically synthesized
caaatgtttgaggaacaatt

SEQ ID NO: 73198 - DNA, 20 bp, Artificial Sequence
  chemically synthesized
actttaaaggagaaattagc

SEQ ID NO: 73199 - DNA, 20 bp, Artificial Sequence
  chemically synthesized
tcatcatgttacaataacgg

SEQ ID NO: 73200 - DNA, 20 bp, Artificial Sequence
  chemically synthesized
caacaaatacatttagacag

SEQ ID NO: 73201 - DNA, 20 bp, Artificial Sequence
  chemically synthesized
cagcaatgtttatcctggtt

SEQ ID NO: 73202 - DNA, 20 bp, Artificial Sequence
  chemically synthesized
aaaatgagaagagataaaac

SEQ ID NO: 73203 - DNA, 20 bp, Artificial Sequence
  chemically synthesized
gaaaaaaaatactccatatt

SEQ ID NO: 73204 - DNA, 20 bp, Artificial Sequence
  chemically synthesized
gctgtggtaagttacaaaga

SEQ ID NO: 73205 - DNA, 20 bp, Artificial Sequence
  chemically synthesized
tgtagaaaactgaaacagtt

SEQ ID NO: 73206 - DNA, 20 bp, Artificial Sequence
  chemically synthesized
tctgtgtgtaacttggttct

SEQ ID NO: 73207 - DNA, 20 bp, Artificial Sequence
  chemically synthesized
ctttcagaaatagcctctat

SEQ ID NO: 73208 - DNA, 20 bp, Artificial Sequence
  chemically synthesized
tttagtacatctaagaagaa

SEQ ID NO: 73209 - DNA, 20 bp, Artificial Sequence
  chemically synthesized
ttcccacagccccacttagc

SEQ ID NO: 73210 - DNA, 20 bp, Artificial Sequence
  chemically synthesized
tggattggagttctacttgg

SEQ ID NO: 73211 - DNA, 20 bp, Artificial Sequence
  chemically synthesized
aactacatggacgtaaaatg

SEQ ID NO: 73212 - DNA, 20 bp, Artificial Sequence
  chemically synthesized
atgcatggattctcttgaaa

SEQ ID NO: 73213 - DNA, 20 bp, Artificial Sequence
  chemically synthesized
tctgaaagagactaaccttc

SEQ ID NO: 73214 - DNA, 20 bp, Artificial Sequence
  chemically synthesized
tagtaatagtaataacaata

SEQ ID NO: 73215 - DNA, 20 bp, Artificial Sequence
  chemically synthesized
agtaataacaatacaatgat

SEQ ID NO: 73216 - DNA, 20 bp, Artificial Sequence
  chemically synthesized
taagacataatttggggtga

SEQ ID NO: 73217 - DNA, 20 bp, Artificial Sequence
  chemically synthesized
cataatttggggtgagaaag

SEQ ID NO: 73218 - DNA, 20 bp, Artificial Sequence
  chemically synthesized
tgcactccaggtcttatttt

SEQ ID NO: 73219 - DNA, 20 bp, Artificial Sequence
  chemically synthesized
aaacatatggttcagtatgc

SEQ ID NO: 73220 - DNA, 20 bp, Artificial Sequence
  chemically synthesized
tgtgggataatgctaattac

SEQ ID NO: 73221 - DNA, 20 bp, Artificial Sequence
  chemically synthesized
ccaaggccagagccggctcc

SEQ ID NO: 73222 - DNA, 20 bp, Artificial Sequence
  chemically synthesized
ggcaggaaccgggctgtgcg

SEQ ID NO: 73223 - DNA, 20 bp, Artificial Sequence
  chemically synthesized
cccaccggccgcgggcagtg

SEQ ID NO: 73224 - DNA, 20 bp, Artificial Sequence
  chemically synthesized
gggtgaagccggctaggctc

SEQ ID NO: 73225 - DNA, 20 bp, Artificial Sequence
  chemically synthesized
aagaacccttatgtctagat

SEQ ID NO: 73226 - DNA, 20 bp, Artificial Sequence
  chemically synthesized
ttggcactctgtatctagct

SEQ ID NO: 73227 - DNA, 20 bp, Artificial Sequence
  chemically synthesized
tcagcaccctgtgtctagct

SEQ ID NO: 73228 - DNA, 20 bp, Artificial Sequence
  chemically synthesized
gagaacctttatgtctagct

SEQ ID NO: 73229 - DNA, 20 bp, Artificial Sequence
  chemically synthesized
tcggcagtctgtatctagct

SEQ ID NO: 73230 - DNA, 20 bp, Artificial Sequence
  chemically synthesized
tcagcaccctgtgtctagct

SEQ ID NO: 73231 - DNA, 20 bp, Artificial Sequence
  chemically synthesized
gagaacctttatgtctagct

SEQ ID NO: 73232 - DNA, 20 bp, Artificial Sequence
  chemically synthesized
tcggcagtctgtatctagct

SEQ ID NO: 73233 - DNA, 20 bp, Artificial Sequence
  chemically synthesized
tcagcaccctgtgtctagct

SEQ ID NO: 73234 - DNA, 20 bp, Artificial Sequence
  chemically synthesized
gagaacctttgtgtctagct

SEQ ID NO: 73235 - DNA, 20 bp, Artificial Sequence
  chemically synthesized
cgggtccccttccacactgt

SEQ ID NO: 73236 - DNA, 20 bp, Artificial Sequence
  chemically synthesized
caataaatcttgctgctgct

SEQ ID NO: 73237 - DNA, 20 bp, Artificial Sequence
  chemically synthesized
taacgctcaccgcgaaggtc

SEQ ID NO: 73238 - DNA, 20 bp, Artificial Sequence
  chemically synthesized
gaacgttcactgtgaaggtc

SEQ ID NO: 73239 - DNA, 20 bp, Artificial Sequence
  chemically synthesized
taacactcaccacgagggtc

SEQ ID NO: 73240 - DNA, 20 bp, Artificial Sequence
  chemically synthesized
tcctctatgtggcagaaagt

SEQ ID NO: 73241 - DNA, 20 bp, Artificial Sequence
  chemically synthesized
aggcacctggactcctggcc

SEQ ID NO: 73242 - DNA, 20 bp, Artificial Sequence
  chemically synthesized
tgacgtagcaataaagaaac

SEQ ID NO: 73243 - DNA, 20 bp, Artificial Sequence
  chemically synthesized
gaaacccacgtttcatatga

SEQ ID NO: 73244 - DNA, 20 bp, Artificial Sequence
  chemically synthesized
cttaaaattaatggcacaag

SEQ ID NO: 73245 - DNA, 20 bp, Artificial Sequence
  chemically synthesized
gttgcacatttgtctttatt

SEQ ID NO: 73246 - DNA, 20 bp, Artificial Sequence
  chemically synthesized
cacatttgtctttatttgtg

SEQ ID NO: 73247 - DNA, 20 bp, Artificial Sequence
  chemically synthesized
ttgtctttatttgtggcttg

SEQ ID NO: 73248 - DNA, 20 bp, Artificial Sequence
  chemically synthesized
tccaaaattttctcattttc

SEQ ID NO: 73249 - DNA, 20 bp, Artificial Sequence
  chemically synthesized
ttctcattttcataggtttt

SEQ ID NO: 73250 - DNA, 20 bp, Artificial Sequence
  chemically synthesized
tttcctcgattgatcattat

SEQ ID NO: 73251 - DNA, 20 bp, Artificial Sequence
  chemically synthesized
atgatttgcaaggaatcatt

SEQ ID NO: 73252 - DNA, 20 bp, Artificial Sequence
  chemically synthesized
atatgacattttaactatgt

SEQ ID NO: 73253 - DNA, 20 bp, Artificial Sequence
  chemically synthesized
gaatgaagagtgtaaatttt

SEQ ID NO: 73254 - DNA, 20 bp, Artificial Sequence
  chemically synthesized
aaaaaataagtatgtgaagt

SEQ ID NO: 73255 - DNA, 20 bp, Artificial Sequence
  chemically synthesized
ttgtctagatctctatcccc

SEQ ID NO: 73256 - DNA, 20 bp, Artificial Sequence
  chemically synthesized
ttccacagtcaaaaggatat

SEQ ID NO: 73257 - DNA, 20 bp, Artificial Sequence
  chemically synthesized
tgtagtttaatgcctcagag

SEQ ID NO: 73258 - DNA, 20 bp, Artificial Sequence
  chemically synthesized
aatgcctcagagttcagctt

SEQ ID NO: 73259 - DNA, 20 bp, Artificial Sequence
  chemically synthesized
tttctcctgccttcacttgg

SEQ ID NO: 73260 - DNA, 20 bp, Artificial Sequence
  chemically synthesized
ttggacgtgcttcacgtagt

SEQ ID NO: 73261 - DNA, 20 bp, Artificial Sequence
  chemically synthesized
tcacgtagtctgtgcttatg

SEQ ID NO: 73262 - DNA, 20 bp, Artificial Sequence
  chemically synthesized
ctaatgttgttcgtcataat

SEQ ID NO: 73263 - DNA, 20 bp, Artificial Sequence
  chemically synthesized
ttcctatgcattgatctgga

SEQ ID NO: 73264 - DNA, 20 bp, Artificial Sequence
  chemically synthesized
gttcactctgctatagcaat

SEQ ID NO: 73265 - DNA, 20 bp, Artificial Sequence
  chemically synthesized
aagcatgaggatgcctcctt

SEQ ID NO: 73266 - DNA, 20 bp, Artificial Sequence
  chemically synthesized
tgttggtcacagaataacct

SEQ ID NO: 73267 - DNA, 20 bp, Artificial Sequence
  chemically synthesized
aaaacaaacaactacagtca

SEQ ID NO: 73268 - DNA, 20 bp, Artificial Sequence
  chemically synthesized
aaaatgtttctctttttatt

SEQ ID NO: 73269 - DNA, 20 bp, Artificial Sequence
  chemically synthesized
aggaagttgttaaggagccc

SEQ ID NO: 73270 - DNA, 20 bp, Artificial Sequence
  chemically synthesized
caggacatctggatactcct

SEQ ID NO: 73271 - DNA, 20 bp, Artificial Sequence
  chemically synthesized
tggatactcctcccagtttc

SEQ ID NO: 73272 - DNA, 20 bp, Artificial Sequence
  chemically synthesized
tccagaaatggcaacattac

SEQ ID NO: 73273 - DNA, 20 bp, Artificial Sequence
  chemically synthesized
tttctcagaagtatattttg

SEQ ID NO: 73274 - DNA, 20 bp, Artificial Sequence
  chemically synthesized
attcatagcagacagctaag

SEQ ID NO: 73275 - DNA, 20 bp, Artificial Sequence
  chemically synthesized
ggtagggttgcatgagccct

SEQ ID NO: 73276 - DNA, 20 bp, Artificial Sequence
  chemically synthesized
tgcatgagccctttcagttt

SEQ ID NO: 73277 - DNA, 20 bp, Artificial Sequence
  chemically synthesized
tatatacatctgtattgtta

SEQ ID NO: 73278 - DNA, 20 bp, Artificial Sequence
  chemically synthesized
cttggaaaactcaaataaat

SEQ ID NO: 73279 - DNA, 20 bp, Artificial Sequence
  chemically synthesized
acctgcttcatagttattaa

SEQ ID NO: 73280 - DNA, 20 bp, Artificial Sequence
  chemically synthesized
gattaagtgagataatgccc

SEQ ID NO: 73281 - DNA, 20 bp, Artificial Sequence
  chemically synthesized
atacacacacacacacattg

SEQ ID NO: 73282 - DNA, 20 bp, Artificial Sequence
  chemically synthesized
tcaaaagggtaaactcaaac

SEQ ID NO: 73283 - DNA, 20 bp, Artificial Sequence
  chemically synthesized
cagtagaattatactcccac

SEQ ID NO: 73284 - DNA, 20 bp, Artificial Sequence
  chemically synthesized
attatactacgctctatact

SEQ ID NO: 73285 - DNA, 20 bp, Artificial Sequence
  chemically synthesized
agatagatgatagatagaat

SEQ ID NO: 73286 - DNA, 20 bp, Artificial Sequence
  chemically synthesized
aacaatttctgacccacaac

SEQ ID NO: 73287 - DNA, 20 bp, Artificial Sequence
  chemically synthesized
cttttccctacatctgagat

SEQ ID NO: 73288 - DNA, 20 bp, Artificial Sequence
  chemically synthesized
gaacttggtcaacaaaggag

SEQ ID NO: 73289 - DNA, 20 bp, Artificial Sequence
  chemically synthesized
aaaatagacaaggacttgcc

SEQ ID NO: 73290 - DNA, 20 bp, Artificial Sequence
  chemically synthesized
ttgcctggtgcttttggtag

SEQ ID NO: 73291 - DNA, 20 bp, Artificial Sequence
  chemically synthesized
gtcctcacagttgaaaagac

SEQ ID NO: 73292 - DNA, 20 bp, Artificial Sequence
  chemically synthesized
ttgaaaagacctaagcttgt

SEQ ID NO: 73293 - DNA, 20 bp, Artificial Sequence
  chemically synthesized
ttgagaggtagaagtgggag

SEQ ID NO: 73294 - DNA, 20 bp, Artificial Sequence
  chemically synthesized
tgggaggactgcttgagctc

SEQ ID NO: 73295 - DNA, 20 bp, Artificial Sequence
  chemically synthesized
aaacaaaaaactgctccgca

SEQ ID NO: 73296 - DNA, 20 bp, Artificial Sequence
  chemically synthesized
tctcattgctgttcataatt

SEQ ID NO: 73297 - DNA, 20 bp, Artificial Sequence
  chemically synthesized
cttttattttctggacttgt

SEQ ID NO: 73298 - DNA, 20 bp, Artificial Sequence
  chemically synthesized
agtaacaatataaagttatt

SEQ ID NO: 73299 - DNA, 20 bp, Artificial Sequence
  chemically synthesized
attgaaacaggaataacaga

SEQ ID NO: 73300 - DNA, 20 bp, Artificial Sequence
  chemically synthesized
actggtgtgtggagacaaat

SEQ ID NO: 73301 - DNA, 20 bp, Artificial Sequence
  chemically synthesized
agaataagaatagccatgac

SEQ ID NO: 73302 - DNA, 20 bp, Artificial Sequence
  chemically synthesized
ctcccactcagcagctatga

SEQ ID NO: 73303 - DNA, 20 bp, Artificial Sequence
  chemically synthesized
agcaatgggcagggctctgt

SEQ ID NO: 73304 - DNA, 20 bp, Artificial Sequence
  chemically synthesized
ctctccctcccattcccgag

SEQ ID NO: 73305 - DNA, 20 bp, Artificial Sequence
  chemically synthesized
ccctcccattcccgagcagg

SEQ ID NO: 73306 - DNA, 20 bp, Artificial Sequence
  chemically synthesized
catacactagacagaaagtc

SEQ ID NO: 73307 - DNA, 20 bp, Artificial Sequence
  chemically synthesized
gtccccacccttctctgagc

SEQ ID NO: 73308 - DNA, 20 bp, Artificial Sequence
  chemically synthesized
tataagtaggagtctggagt

SEQ ID NO: 73309 - DNA, 20 bp, Artificial Sequence
  chemically synthesized
ctctcatttcaatacaaaat

SEQ ID NO: 73310 - DNA, 20 bp, Artificial Sequence
  chemically synthesized
aatttccgtttattaaatgc

SEQ ID NO: 73311 - DNA, 20 bp, Artificial Sequence
  chemically synthesized
ttcacccaggcccactgagt

SEQ ID NO: 73312 - DNA, 20 bp, Artificial Sequence
  chemically synthesized
gttcacgtgtgtaaaaagga

SEQ ID NO: 73313 - DNA, 20 bp, Artificial Sequence
  chemically synthesized
aagtcttgggcagtatagag

SEQ ID NO: 73314 - DNA, 20 bp, Artificial Sequence
  chemically synthesized
atgctggagccagaccacct

SEQ ID NO: 73315 - DNA, 20 bp, Artificial Sequence
  chemically synthesized
accacctgagtgattagtga

SEQ ID NO: 73316 - DNA, 20 bp, Artificial Sequence
  chemically synthesized
ttctcttagtagttgtatga

SEQ ID NO: 73317 - DNA, 20 bp, Artificial Sequence
  chemically synthesized
gtttcttcatctgtaaaatg

SEQ ID NO: 73318 - DNA, 20 bp, Artificial Sequence
  chemically synthesized
gtaaaatggagggtttttta

SEQ ID NO: 73319 - DNA, 20 bp, Artificial Sequence
  chemically synthesized
aatggagggttttttaatta

SEQ ID NO: 73320 - DNA, 20 bp, Artificial Sequence
  chemically synthesized
ttttgtatttttggtagaga

SEQ ID NO: 73321 - DNA, 20 bp, Artificial Sequence
  chemically synthesized
cacctcagccttccaaagtg

SEQ ID NO: 73322 - DNA, 20 bp, Artificial Sequence
  chemically synthesized
ccaaagtgctgggattataa

SEQ ID NO: 73323 - DNA, 20 bp, Artificial Sequence
  chemically synthesized
gggattataagcatgattac

SEQ ID NO: 73324 - DNA, 20 bp, Artificial Sequence
  chemically synthesized
acaggagttttaacaggctc

SEQ ID NO: 73325 - DNA, 20 bp, Artificial Sequence
  chemically synthesized
cgagtgagttaatacatgca

SEQ ID NO: 73326 - DNA, 20 bp, Artificial Sequence
  chemically synthesized
ataaatgctaactactctag

SEQ ID NO: 73327 - DNA, 20 bp, Artificial Sequence
  chemically synthesized
tagaaatgtttgctagtatt

SEQ ID NO: 73328 - DNA, 20 bp, Artificial Sequence
  chemically synthesized
aggctatcagagactgtaat

SEQ ID NO: 73329 - DNA, 20 bp, Artificial Sequence
  chemically synthesized
aattaatcatatttaatact

SEQ ID NO: 73330 - DNA, 20 bp, Artificial Sequence
  chemically synthesized
actactagcaaatagtagaa

SEQ ID NO: 73331 - DNA, 20 bp, Artificial Sequence
  chemically synthesized
gctggatgctggggatacaa

SEQ ID NO: 73332 - DNA, 20 bp, Artificial Sequence
  chemically synthesized
gtttaaatttaagctccagt

SEQ ID NO: 73333 - DNA, 20 bp, Artificial Sequence
  chemically synthesized
attttttactctttgcattc

SEQ ID NO: 73334 - DNA, 20 bp, Artificial Sequence
  chemically synthesized
acaccatgtggagaaggggt

SEQ ID NO: 73335 - DNA, 20 bp, Artificial Sequence
  chemically synthesized
atgtggagaaggggtggtgg

SEQ ID NO: 73336 - DNA, 20 bp, Artificial Sequence
  chemically synthesized
ctattatttaacaaatgcat

SEQ ID NO: 73337 - DNA, 20 bp, Artificial Sequence
  chemically synthesized
atcaagttatattatgtaac

SEQ ID NO: 73338 - DNA, 20 bp, Artificial Sequence
  chemically synthesized
atattatgtaacccaggatt

SEQ ID NO: 73339 - DNA, 20 bp, Artificial Sequence
  chemically synthesized
ttaagctgtctagcaaaagc

SEQ ID NO: 73340 - DNA, 20 bp, Artificial Sequence
  chemically synthesized
tgtgagctcctcaccatata

SEQ ID NO: 73341 - DNA, 20 bp, Artificial Sequence
  chemically synthesized
atcattgaataaatccctat

SEQ ID NO: 73342 - DNA, 20 bp, Artificial Sequence
  chemically synthesized
taccctgagcaaaaggctgg

SEQ ID NO: 73343 - DNA, 20 bp, Artificial Sequence
  chemically synthesized
tctgagaaagtctatgctgt

SEQ ID NO: 73344 - DNA, 20 bp, Artificial Sequence
  chemically synthesized
cataattcttggttgcatga

SEQ ID NO: 73345 - DNA, 20 bp, Artificial Sequence
  chemically synthesized
tctgaatgaaatggaaaccg

SEQ ID NO: 73346 - DNA, 20 bp, Artificial Sequence
  chemically synthesized
ggctccagcatgtagaaatc

SEQ ID NO: 73347 - DNA, 20 bp, Artificial Sequence
  chemically synthesized
aaatctggggctttgtgaag

SEQ ID NO: 73348 - DNA, 20 bp, Artificial Sequence
  chemically synthesized
gaacctagagcctacgctga

SEQ ID NO: 73349 - DNA, 20 bp, Artificial Sequence
  chemically synthesized
acttccagggatcctctctt

SEQ ID NO: 73350 - DNA, 20 bp, Artificial Sequence
  chemically synthesized
tctcctcacttctatctgga

SEQ ID NO: 73351 - DNA, 20 bp, Artificial Sequence
  chemically synthesized
ccctcctagcatccagagac

SEQ ID NO: 73352 - DNA, 20 bp, Artificial Sequence
  chemically synthesized
ctagcatccagagactagtg

SEQ ID NO: 73353 - DNA, 20 bp, Artificial Sequence
  chemically synthesized
gagatgatctatgtggggag

SEQ ID NO: 73354 - DNA, 20 bp, Artificial Sequence
  chemically synthesized
gatgagtaagagaggagagg

SEQ ID NO: 73355 - DNA, 20 bp, Artificial Sequence
  chemically synthesized
tatagtctaatcaattttgc

SEQ ID NO: 73356 - DNA, 20 bp, Artificial Sequence
  chemically synthesized
ggagcaggagtctctaagga

SEQ ID NO: 73357 - DNA, 20 bp, Artificial Sequence
  chemically synthesized
aggggcaagtgccttgactc

SEQ ID NO: 73358 - DNA, 20 bp, Artificial Sequence
  chemically synthesized
taacagttcaggacagagct

SEQ ID NO: 73359 - DNA, 20 bp, Artificial Sequence
  chemically synthesized
ctggttagactttttttaat

SEQ ID NO: 73360 - DNA, 20 bp, Artificial Sequence
  chemically synthesized
tagactttttttaatgaaag

SEQ ID NO: 73361 - DNA, 20 bp, Artificial Sequence
  chemically synthesized
aatgaaagcttagctttcat

SEQ ID NO: 73362 - DNA, 20 bp, Artificial Sequence
  chemically synthesized
tgagagacacgaggaaatag

SEQ ID NO: 73363 - DNA, 20 bp, Artificial Sequence
  chemically synthesized
agtatatgctagaatcaaat

SEQ ID NO: 73364 - DNA, 20 bp, Artificial Sequence
  chemically synthesized
ccgggcacggtggctcatat

SEQ ID NO: 73365 - DNA, 20 bp, Artificial Sequence
  chemically synthesized
gaggtggaggttgcagtgag

SEQ ID NO: 73366 - DNA, 20 bp, Artificial Sequence
  chemically synthesized
tccatctcaaaaaaaaaaaa

SEQ ID NO: 73367 - DNA, 20 bp, Artificial Sequence
  chemically synthesized
aagtttattatatgaattaa

SEQ ID NO: 73368 - DNA, 20 bp, Artificial Sequence
  chemically synthesized
tactcacaccaatactcaga

SEQ ID NO: 73369 - DNA, 20 bp, Artificial Sequence
  chemically synthesized
aaagacatgaaataatttgt

SEQ ID NO: 73370 - DNA, 20 bp, Artificial Sequence
  chemically synthesized
agttctgctacctctgaaga

SEQ ID NO: 73371 - DNA, 20 bp, Artificial Sequence
  chemically synthesized
agatattcctgccctgtggc

SEQ ID NO: 73372 - DNA, 20 bp, Artificial Sequence
  chemically synthesized
tgcttcttacttttacttct

SEQ ID NO: 73373 - DNA, 20 bp, Artificial Sequence
  chemically synthesized
ccataattgcatttcttcag

SEQ ID NO: 73374 - DNA, 20 bp, Artificial Sequence
  chemically synthesized
ttagaaacaacttcagaata

SEQ ID NO: 73375 - DNA, 20 bp, Artificial Sequence
  chemically synthesized
agagattttctcttgggtta

SEQ ID NO: 73376 - DNA, 20 bp, Artificial Sequence
  chemically synthesized
gctgcaactttggttaaagg

SEQ ID NO: 73377 - DNA, 20 bp, Artificial Sequence
  chemically synthesized
tcagtgcctcagaaacatac

SEQ ID NO: 73378 - DNA, 20 bp, Artificial Sequence
  chemically synthesized
cagaaacatacatatgtttg

SEQ ID NO: 73379 - DNA, 20 bp, Artificial Sequence
  chemically synthesized
catacatatgtttgtctagt

SEQ ID NO: 73380 - DNA, 20 bp, Artificial Sequence
  chemically synthesized
cacaagaaatgagaagaaac

SEQ ID NO: 73381 - DNA, 20 bp, Artificial Sequence
  chemically synthesized
ccctttgccgggtctgacaa

SEQ ID NO: 73382 - DNA, 20 bp, Artificial Sequence
  chemically synthesized
ctaactactttaaaatcatt

SEQ ID NO: 73383 - DNA, 20 bp, Artificial Sequence
  chemically synthesized
caaatgagaagttacaacat

SEQ ID NO: 73384 - DNA, 20 bp, Artificial Sequence
  chemically synthesized
ggcaacatggctgcctaaag

SEQ ID NO: 73385 - DNA, 20 bp, Artificial Sequence
  chemically synthesized
ctgtgtcttagccagttcct

SEQ ID NO: 73386 - DNA, 20 bp, Artificial Sequence
  chemically synthesized
ttcatttctcaaggtccaac

SEQ ID NO: 73387 - DNA, 20 bp, Artificial Sequence
  chemically synthesized
ttgggaggctgaggtgggtg

SEQ ID NO: 73388 - DNA, 20 bp, Artificial Sequence
  chemically synthesized
tagggtggctgaggcaggag

SEQ ID NO: 73389 - DNA, 20 bp, Artificial Sequence
  chemically synthesized
actcttgtggggaataagat

SEQ ID NO: 73390 - DNA, 20 bp, Artificial Sequence
  chemically synthesized
gatacatgttttattcttat

SEQ ID NO: 73391 - DNA, 20 bp, Artificial Sequence
  chemically synthesized
tatgattcaagcactgaaaa

SEQ ID NO: 73392 - DNA, 20 bp, Artificial Sequence
  chemically synthesized
aatagtgtttagcatccagc

SEQ ID NO: 73393 - DNA, 20 bp, Artificial Sequence
  chemically synthesized
gtgcttcaaaaccatttgct

SEQ ID NO: 73394 - DNA, 20 bp, Artificial Sequence
  chemically synthesized
atcccttccagcatcctcat

SEQ ID NO: 73395 - DNA, 20 bp, Artificial Sequence
  chemically synthesized
gcatcctcatctctgattaa

SEQ ID NO: 73396 - DNA, 20 bp, Artificial Sequence
  chemically synthesized
tcatctctgattaaataagc

SEQ ID NO: 73397 - DNA, 20 bp, Artificial Sequence
  chemically synthesized
tgagtcatgatgagtcatgc

SEQ ID NO: 73398 - DNA, 20 bp, Artificial Sequence
  chemically synthesized
tcctatctgggtccccagca

SEQ ID NO: 73399 - DNA, 20 bp, Artificial Sequence
  chemically synthesized
tgttgttatcaattgccata

SEQ ID NO: 73400 - DNA, 20 bp, Artificial Sequence
  chemically synthesized
tatacctagaagcggcagaa

SEQ ID NO: 73401 - DNA, 20 bp, Artificial Sequence
  chemically synthesized
aggctttattaatacatgtg

SEQ ID NO: 73402 - DNA, 20 bp, Artificial Sequence
  chemically synthesized
aaacaggaaaagaaaacaaa

SEQ ID NO: 73403 - DNA, 20 bp, Artificial Sequence
  chemically synthesized
aaaacaatgacagacagaca

SEQ ID NO: 73404 - DNA, 20 bp, Artificial Sequence
  chemically synthesized
caggaggtcaaggggataga

SEQ ID NO: 73405 - DNA, 20 bp, Artificial Sequence
  chemically synthesized
atagagaaggcttccagaag

SEQ ID NO: 73406 - DNA, 20 bp, Artificial Sequence
  chemically synthesized
tccagaagaatggctttgaa

SEQ ID NO: 73407 - DNA, 20 bp, Artificial Sequence
  chemically synthesized
gtaggagttcacagtggcaa

SEQ ID NO: 73408 - DNA, 20 bp, Artificial Sequence
  chemically synthesized
agatgaatgttatgtctcca

SEQ ID NO: 73409 - DNA, 20 bp, Artificial Sequence
  chemically synthesized
ttcttgaggttagcagctgt

SEQ ID NO: 73410 - DNA, 20 bp, Artificial Sequence
  chemically synthesized
aggacctcacgtatacttga

SEQ ID NO: 73411 - DNA, 20 bp, Artificial Sequence
  chemically synthesized
aatgacctcttgtcagtcta

SEQ ID NO: 73412 - DNA, 20 bp, Artificial Sequence
  chemically synthesized
aatgatgtcttgtcagccta

SEQ ID NO: 73413 - DNA, 20 bp, Artificial Sequence
  chemically synthesized
gtttcgctaagagcacagag

SEQ ID NO: 73414 - DNA, 20 bp, Artificial Sequence
  chemically synthesized
acttcctttttggttcaagt

SEQ ID NO: 73415 - DNA, 20 bp, Artificial Sequence
  chemically synthesized
gatgggtctagaaagactag

SEQ ID NO: 73416 - DNA, 20 bp, Artificial Sequence
  chemically synthesized
cattgttttaggttgagtgg

SEQ ID NO: 73417 - DNA, 20 bp, Artificial Sequence
  chemically synthesized
ttcgtatcatgaatagcaga

SEQ ID NO: 73418 - DNA, 20 bp, Artificial Sequence
  chemically synthesized
gcagatatagcttgatggcc

SEQ ID NO: 73419 - DNA, 20 bp, Artificial Sequence
  chemically synthesized
tatagcttgatggccccatg

SEQ ID NO: 73420 - DNA, 20 bp, Artificial Sequence
  chemically synthesized
ttatgtagatggtcctgagg

SEQ ID NO: 73421 - DNA, 20 bp, Artificial Sequence
  chemically synthesized
gatggtcctgaggaaaagtt

SEQ ID NO: 73422 - DNA, 20 bp, Artificial Sequence
  chemically synthesized
cctaggctataggaagtact

SEQ ID NO: 73423 - DNA, 20 bp, Artificial Sequence
  chemically synthesized
aaggcaggtgtggctctgca

SEQ ID NO: 73424 - DNA, 20 bp, Artificial Sequence
  chemically synthesized
tggctcactcctgtaatcac

SEQ ID NO: 73425 - DNA, 20 bp, Artificial Sequence
  chemically synthesized
ccaacatagtgaaacctggt

SEQ ID NO: 73426 - DNA, 20 bp, Artificial Sequence
  chemically synthesized
ttgggaggctgaggcaggag

SEQ ID NO: 73427 - DNA, 20 bp, Artificial Sequence
  chemically synthesized
aatcgcttgaaccggggagg

SEQ ID NO: 73428 - DNA, 20 bp, Artificial Sequence
  chemically synthesized
ccctgaccgaacagaattct

SEQ ID NO: 73429 - DNA, 20 bp, Artificial Sequence
  chemically synthesized
atgtgtagacaagctccaga

SEQ ID NO: 73430 - DNA, 20 bp, Artificial Sequence
  chemically synthesized
ctcatttccatatccaccca

SEQ ID NO: 73431 - DNA, 20 bp, Artificial Sequence
  chemically synthesized
caacccaaagactcactttg

SEQ ID NO: 73432 - DNA, 20 bp, Artificial Sequence
  chemically synthesized
attctctgtcagaaaatcct

SEQ ID NO: 73433 - DNA, 20 bp, Artificial Sequence
  chemically synthesized
cctgttggtttttcgtgaaa

SEQ ID NO: 73434 - DNA, 20 bp, Artificial Sequence
  chemically synthesized
ctgttgactcataacaatct

SEQ ID NO: 73435 - DNA, 20 bp, Artificial Sequence
  chemically synthesized
ctctttgttcaaagtcttct

SEQ ID NO: 73436 - DNA, 20 bp, Artificial Sequence
  chemically synthesized
aatagttgttcatgcatata

SEQ ID NO: 73437 - DNA, 20 bp, Artificial Sequence
  chemically synthesized
tatttatgtgtatgtgtgta

SEQ ID NO: 73438 - DNA, 20 bp, Artificial Sequence
  chemically synthesized
ctatgccctaaatatttaat

SEQ ID NO: 73439 - DNA, 20 bp, Artificial Sequence
  chemically synthesized
aatcacactctggccttcat

SEQ ID NO: 73440 - DNA, 20 bp, Artificial Sequence
  chemically synthesized
cctaatctcattggtatata

SEQ ID NO: 73441 - DNA, 20 bp, Artificial Sequence
  chemically synthesized
attggtatataacatgtttc

SEQ ID NO: 73442 - DNA, 20 bp, Artificial Sequence
  chemically synthesized
acaggaactttattcctcta

SEQ ID NO: 73443 - DNA, 20 bp, Artificial Sequence
  chemically synthesized
cctccgcaggcagagccttg

SEQ ID NO: 73444 - DNA, 20 bp, Artificial Sequence
  chemically synthesized
tgagttctagaattggactc

SEQ ID NO: 73445 - DNA, 20 bp, Artificial Sequence
  chemically synthesized
ggactcatttgttttgtagg

SEQ ID NO: 73446 - DNA, 20 bp, Artificial Sequence
  chemically synthesized
aaagatgaatatcgaaacca

SEQ ID NO: 73447 - DNA, 20 bp, Artificial Sequence
  chemically synthesized
ggaatttataactagagcac

SEQ ID NO: 73448 - DNA, 20 bp, Artificial Sequence
  chemically synthesized
tcatgtttatgtaagcaatt

SEQ ID NO: 73449 - DNA, 20 bp, Artificial Sequence
  chemically synthesized
attatttcataggtgtcaga

SEQ ID NO: 73450 - DNA, 20 bp, Artificial Sequence
  chemically synthesized
agagctcctttttttttttt

SEQ ID NO: 73451 - DNA, 20 bp, Artificial Sequence
  chemically synthesized
ctattcaatgagaatattct

SEQ ID NO: 73452 - DNA, 20 bp, Artificial Sequence
  chemically synthesized
tccgtctcttatagttaaat

SEQ ID NO: 73453 - DNA, 20 bp, Artificial Sequence
  chemically synthesized
atttgagcttcttttatgat

SEQ ID NO: 73454 - DNA, 20 bp, Artificial Sequence
  chemically synthesized
ttatgatcactgttttttta

SEQ ID NO: 73455 - DNA, 20 bp, Artificial Sequence
  chemically synthesized
ttctggggtacatgtgccat

SEQ ID NO: 73456 - DNA, 20 bp, Artificial Sequence
  chemically synthesized
cctccctgtgtccatggatc

SEQ ID NO: 73457 - DNA, 20 bp, Artificial Sequence
  chemically synthesized
tccatggatcactggttttt

SEQ ID NO: 73458 - DNA, 20 bp, Artificial Sequence
  chemically synthesized
ttatctggtcactttagccc

SEQ ID NO: 73459 - DNA, 20 bp, Artificial Sequence
  chemically synthesized
agctcttatctatatccaca

SEQ ID NO: 73460 - DNA, 20 bp, Artificial Sequence
  chemically synthesized
caagtctaaagaaaaaaata

SEQ ID NO: 73461 - DNA, 20 bp, Artificial Sequence
  chemically synthesized
ataatgggtttgcccatctc

SEQ ID NO: 73462 - DNA, 20 bp, Artificial Sequence
  chemically synthesized
tggtgacactagtgtctgaa

SEQ ID NO: 73463 - DNA, 20 bp, Artificial Sequence
  chemically synthesized
aaaagaggctctagcagcat

SEQ ID NO: 73464 - DNA, 20 bp, Artificial Sequence
  chemically synthesized
gcagcatagtggtttagagg

SEQ ID NO: 73465 - DNA, 20 bp, Artificial Sequence
  chemically synthesized
tcacagatgccttagcctca

SEQ ID NO: 73466 - DNA, 20 bp, Artificial Sequence
  chemically synthesized
ctcaataagcttgcggttgt

SEQ ID NO: 73467 - DNA, 20 bp, Artificial Sequence
  chemically synthesized
gtgacacaaaacagaggggg

SEQ ID NO: 73468 - DNA, 20 bp, Artificial Sequence
  chemically synthesized
tgaaggtggtctgacgagat

SEQ ID NO: 73469 - DNA, 20 bp, Artificial Sequence
  chemically synthesized
gccttgctcacttgccaatc

SEQ ID NO: 73470 - DNA, 20 bp, Artificial Sequence
  chemically synthesized
attcaggaaacatactatgt

SEQ ID NO: 73471 - DNA, 20 bp, Artificial Sequence
  chemically synthesized
tgcataggcaagaaaaagtc

SEQ ID NO: 73472 - DNA, 20 bp, Artificial Sequence
  chemically synthesized
agtccttagctttatgttgc

SEQ ID NO: 73473 - DNA, 20 bp, Artificial Sequence
  chemically synthesized
tggaatcttagcatataatc

SEQ ID NO: 73474 - DNA, 20 bp, Artificial Sequence
  chemically synthesized
gtttttcaaaatttctagac

SEQ ID NO: 73475 - DNA, 20 bp, Artificial Sequence
  chemically synthesized
cattctgaactacttcagag

SEQ ID NO: 73476 - DNA, 20 bp, Artificial Sequence
  chemically synthesized
cagcggaaaatgggatattt

SEQ ID NO: 73477 - DNA, 20 bp, Artificial Sequence
  chemically synthesized
agttttctaagttgacagac

SEQ ID NO: 73478 - DNA, 20 bp, Artificial Sequence
  chemically synthesized
taggaaagtgtggcataact

SEQ ID NO: 73479 - DNA, 20 bp, Artificial Sequence
  chemically synthesized
gtgtggcataactggctgat

SEQ ID NO: 73480 - DNA, 20 bp, Artificial Sequence
  chemically synthesized
tttttcccattaaagatccc

SEQ ID NO: 73481 - DNA, 20 bp, Artificial Sequence
  chemically synthesized
gtgctccaagttgccagaga

SEQ ID NO: 73482 - DNA, 20 bp, Artificial Sequence
  chemically synthesized
aaagttgaaaacaagaaagc

SEQ ID NO: 73483 - DNA, 20 bp, Artificial Sequence
  chemically synthesized
aattacactagaaaatagcc

SEQ ID NO: 73484 - DNA, 20 bp, Artificial Sequence
  chemically synthesized
acacaaaatctagtagaatc

SEQ ID NO: 73485 - DNA, 20 bp, Artificial Sequence
  chemically synthesized
atctatttttgttctgagaa

SEQ ID NO: 73486 - DNA, 20 bp, Artificial Sequence
  chemically synthesized
taagcagctcttttcctatc

SEQ ID NO: 73487 - DNA, 20 bp, Artificial Sequence
  chemically synthesized
tcctatcagtggtttacaag

SEQ ID NO: 73488 - DNA, 20 bp, Artificial Sequence
  chemically synthesized
catatgtcataaattagcca

SEQ ID NO: 73489 - DNA, 20 bp, Artificial Sequence
  chemically synthesized
gaaagatttaagaaaatatt

SEQ ID NO: 73490 - DNA, 20 bp, Artificial Sequence
  chemically synthesized
taagaaaatattggatgttt

SEQ ID NO: 73491 - DNA, 20 bp, Artificial Sequence
  chemically synthesized
cttgtttaaattaggcatct

SEQ ID NO: 73492 - DNA, 20 bp, Artificial Sequence
  chemically synthesized
aattaatcttcatcgaattt

SEQ ID NO: 73493 - DNA, 20 bp, Artificial Sequence
  chemically synthesized
cttaaatgtcttaagacata

SEQ ID NO: 73494 - DNA, 20 bp, Artificial Sequence
  chemically synthesized
agacaataaatgaatattct

SEQ ID NO: 73495 - DNA, 20 bp, Artificial Sequence
  chemically synthesized
aacacttatctctctgaact

SEQ ID NO: 73496 - DNA, 20 bp, Artificial Sequence
  chemically synthesized
tctcatatgataaacaaata

SEQ ID NO: 73497 - DNA, 20 bp, Artificial Sequence
  chemically synthesized
cagcctacctgacttctgag

SEQ ID NO: 73498 - DNA, 20 bp, Artificial Sequence
  chemically synthesized
tactctgaatgggaagaatg

SEQ ID NO: 73499 - DNA, 20 bp, Artificial Sequence
  chemically synthesized
aagaatgatgggattaccca

SEQ ID NO: 73500 - DNA, 20 bp, Artificial Sequence
  chemically synthesized
atgatgggattacccatagg

SEQ ID NO: 73501 - DNA, 20 bp, Artificial Sequence
  chemically synthesized
ttcttctctgagtagccaag

SEQ ID NO: 73502 - DNA, 20 bp, Artificial Sequence
  chemically synthesized
gttcaagctacaagcagctg

SEQ ID NO: 73503 - DNA, 20 bp, Artificial Sequence
  chemically synthesized
acagaacactagggggctgg

SEQ ID NO: 73504 - DNA, 20 bp, Artificial Sequence
  chemically synthesized
accataggtattgcagatct

SEQ ID NO: 73505 - DNA, 20 bp, Artificial Sequence
  chemically synthesized
ggtattgcagatctttttgt

SEQ ID NO: 73506 - DNA, 20 bp, Artificial Sequence
  chemically synthesized
gcagatctttttgtttttgt

SEQ ID NO: 73507 - DNA, 20 bp, Artificial Sequence
  chemically synthesized
gtttttgtttttgtttgaga

SEQ ID NO: 73508 - DNA, 20 bp, Artificial Sequence
  chemically synthesized
gcccaggctggagtgcagtg

SEQ ID NO: 73509 - DNA, 20 bp, Artificial Sequence
  chemically synthesized
gccttggcctcctgagtagc

SEQ ID NO: 73510 - DNA, 20 bp, Artificial Sequence
  chemically synthesized
ttttgtatttttagtagaga

SEQ ID NO: 73511 - DNA, 20 bp, Artificial Sequence
  chemically synthesized
cgccttggcctcctgaagtg

SEQ ID NO: 73512 - DNA, 20 bp, Artificial Sequence
  chemically synthesized
tgtagacccaatcctagatc

SEQ ID NO: 73513 - DNA, 20 bp, Artificial Sequence
  chemically synthesized
taaatactataccacaaatg

SEQ ID NO: 73514 - DNA, 20 bp, Artificial Sequence
  chemically synthesized
aaactggcctgtgacacaaa

SEQ ID NO: 73515 - DNA, 20 bp, Artificial Sequence
  chemically synthesized
acaaaaaaagtttaggaatt

SEQ ID NO: 73516 - DNA, 20 bp, Artificial Sequence
  chemically synthesized
gagacattcttacttgccac

SEQ ID NO: 73517 - DNA, 20 bp, Artificial Sequence
  chemically synthesized
tcgggaggctgaggcaggag

SEQ ID NO: 73518 - DNA, 20 bp, Artificial Sequence
  chemically synthesized
ggaggaactgggctggggca

SEQ ID NO: 73519 - DNA, 20 bp, Artificial Sequence
  chemically synthesized
caatgctggaatttgtggaa

SEQ ID NO: 73520 - DNA, 20 bp, Artificial Sequence
  chemically synthesized
ataatttctgtgaatttatt

SEQ ID NO: 73521 - DNA, 20 bp, Artificial Sequence
  chemically synthesized
aatgacaatggtattataag

SEQ ID NO: 73522 - DNA, 20 bp, Artificial Sequence
  chemically synthesized
atacactgtaaatcccaact

SEQ ID NO: 73523 - DNA, 20 bp, Artificial Sequence
  chemically synthesized
ataatataccctgactccta

SEQ ID NO: 73524 - DNA, 20 bp, Artificial Sequence
  chemically synthesized
gactcctagcctgattaata

SEQ ID NO: 73525 - DNA, 20 bp, Artificial Sequence
  chemically synthesized
atatatcgattcactttttt

SEQ ID NO: 73526 - DNA, 20 bp, Artificial Sequence
  chemically synthesized
ttctctgtttgatgacaaat

SEQ ID NO: 73527 - DNA, 20 bp, Artificial Sequence
  chemically synthesized
aattctggctttaaataatt

SEQ ID NO: 73528 - DNA, 20 bp, Artificial Sequence
  chemically synthesized
ctttaaataattttaggatt

SEQ ID NO: 73529 - DNA, 20 bp, Artificial Sequence
  chemically synthesized
tcatagagaaatgaaaagag

SEQ ID NO: 73530 - DNA, 20 bp, Artificial Sequence
  chemically synthesized
tcaccccaaggtactgtact

SEQ ID NO: 73531 - DNA, 20 bp, Artificial Sequence
  chemically synthesized
aaggtactgtactttgggat

SEQ ID NO: 73532 - DNA, 20 bp, Artificial Sequence
  chemically synthesized
gtggactacttgctattctg

SEQ ID NO: 73533 - DNA, 20 bp, Artificial Sequence
  chemically synthesized
agtttctagaaggaactatg

SEQ ID NO: 73534 - DNA, 20 bp, Artificial Sequence
  chemically synthesized
ccctagagaaactaaggtac

SEQ ID NO: 73535 - DNA, 20 bp, Artificial Sequence
  chemically synthesized
gagaaactaaggtacagaag

SEQ ID NO: 73536 - DNA, 20 bp, Artificial Sequence
  chemically synthesized
cttaagagagctagaactgg

SEQ ID NO: 73537 - DNA, 20 bp, Artificial Sequence
  chemically synthesized
agagctagaactgggtgaga

SEQ ID NO: 73538 - DNA, 20 bp, Artificial Sequence
  chemically synthesized
actgggtgagattctgtttt

SEQ ID NO: 73539 - DNA, 20 bp, Artificial Sequence
  chemically synthesized
ctttattttcttttccttgg

SEQ ID NO: 73540 - DNA, 20 bp, Artificial Sequence
  chemically synthesized
acctttaaggcaaatgttaa

SEQ ID NO: 73541 - DNA, 20 bp, Artificial Sequence
  chemically synthesized
ctgaaactttttttcctatt

SEQ ID NO: 73542 - DNA, 20 bp, Artificial Sequence
  chemically synthesized
ttgagatttgctcctttata

SEQ ID NO: 73543 - DNA, 20 bp, Artificial Sequence
  chemically synthesized
acagagaggcagcagcacat

SEQ ID NO: 73544 - DNA, 20 bp, Artificial Sequence
  chemically synthesized
gggtgaatattaccctagca

SEQ ID NO: 73545 - DNA, 20 bp, Artificial Sequence
  chemically synthesized
caagttgattgggaaagtcc

SEQ ID NO: 73546 - DNA, 20 bp, Artificial Sequence
  chemically synthesized
gtgtcatttcatagactcct

SEQ ID NO: 73547 - DNA, 20 bp, Artificial Sequence
  chemically synthesized
tcgttgtttacccctggacc

SEQ ID NO: 73548 - DNA, 20 bp, Artificial Sequence
  chemically synthesized
cctggacccagagatttttt

SEQ ID NO: 73549 - DNA, 20 bp, Artificial Sequence
  chemically synthesized
ggtgagttcaggtgctggtg

SEQ ID NO: 73550 - DNA, 20 bp, Artificial Sequence
  chemically synthesized
aggtgctggtgatgtgattt

SEQ ID NO: 73551 - DNA, 20 bp, Artificial Sequence
  chemically synthesized
aagatctcagaaatcatggg

SEQ ID NO: 73552 - DNA, 20 bp, Artificial Sequence
  chemically synthesized
agtgagcataaccaaaactt

SEQ ID NO: 73553 - DNA, 20 bp, Artificial Sequence
  chemically synthesized
aaggactactaacagcctga

SEQ ID NO: 73554 - DNA, 20 bp, Artificial Sequence
  chemically synthesized
ggaaatcttgccagaacttg

SEQ ID NO: 73555 - DNA, 20 bp, Artificial Sequence
  chemically synthesized
cttgtgaaagaagaatgaaa

SEQ ID NO: 73556 - DNA, 20 bp, Artificial Sequence
  chemically synthesized
tttatgtgggtcatgataat

SEQ ID NO: 73557 - DNA, 20 bp, Artificial Sequence
  chemically synthesized
catgataattgaggtttaga

SEQ ID NO: 73558 - DNA, 20 bp, Artificial Sequence
  chemically synthesized
gagatttttgcaaaaaaaat

SEQ ID NO: 73559 - DNA, 20 bp, Artificial Sequence
  chemically synthesized
catcagtattgtgaccaagt

SEQ ID NO: 73560 - DNA, 20 bp, Artificial Sequence
  chemically synthesized
agtattgtgaccaagtgaag

SEQ ID NO: 73561 - DNA, 20 bp, Artificial Sequence
  chemically synthesized
aggcttgtttccgaatttgt

SEQ ID NO: 73562 - DNA, 20 bp, Artificial Sequence
  chemically synthesized
tacatttacaaaaattagac

SEQ ID NO: 73563 - DNA, 20 bp, Artificial Sequence
  chemically synthesized
tgggtgggcacaaaccttgg

SEQ ID NO: 73564 - DNA, 20 bp, Artificial Sequence
  chemically synthesized
gtctaggaatgtaggtataa

SEQ ID NO: 73565 - DNA, 20 bp, Artificial Sequence
  chemically synthesized
gaatgtaggtataaagccgt

SEQ ID NO: 73566 - DNA, 20 bp, Artificial Sequence
  chemically synthesized
gtaggtataaagccgttttt

SEQ ID NO: 73567 - DNA, 20 bp, Artificial Sequence
  chemically synthesized
gtataaagccgtttttgttt

SEQ ID NO: 73568 - DNA, 20 bp, Artificial Sequence
  chemically synthesized
aaagccgtttttgtttgttt

SEQ ID NO: 73569 - DNA, 20 bp, Artificial Sequence
  chemically synthesized
gtttgtttgttttttcatca

SEQ ID NO: 73570 - DNA, 20 bp, Artificial Sequence
  chemically synthesized
acagctcctgggtaacgtga

SEQ ID NO: 73571 - DNA, 20 bp, Artificial Sequence
  chemically synthesized
taagtaccactgagttctct

SEQ ID NO: 73572 - DNA, 20 bp, Artificial Sequence
  chemically synthesized
cctccttctgcacatgggga

SEQ ID NO: 73573 - DNA, 20 bp, Artificial Sequence
  chemically synthesized
cttggccttgagagaaagcc

SEQ ID NO: 73574 - DNA, 20 bp, Artificial Sequence
  chemically synthesized
agagaaacataggaagaacc

SEQ ID NO: 73575 - DNA, 20 bp, Artificial Sequence
  chemically synthesized
agcttccttaagaaatgtat

SEQ ID NO: 73576 - DNA, 20 bp, Artificial Sequence
  chemically synthesized
gtggatgttatgggagaatt

SEQ ID NO: 73577 - DNA, 20 bp, Artificial Sequence
  chemically synthesized
taagtggacagagactccta

SEQ ID NO: 73578 - DNA, 20 bp, Artificial Sequence
  chemically synthesized
ctgttagtggtacctgagaa

SEQ ID NO: 73579 - DNA, 20 bp, Artificial Sequence
  chemically synthesized
cttatttacattttgaagta

SEQ ID NO: 73580 - DNA, 20 bp, Artificial Sequence
  chemically synthesized
tttgaagtagctagcttgtc

SEQ ID NO: 73581 - DNA, 20 bp, Artificial Sequence
  chemically synthesized
gcttgtcacatgttttatga

SEQ ID NO: 73582 - DNA, 20 bp, Artificial Sequence
  chemically synthesized
caatagcctgctctttccat

SEQ ID NO: 73583 - DNA, 20 bp, Artificial Sequence
  chemically synthesized
tagagttaggacctgagtgg

SEQ ID NO: 73584 - DNA, 20 bp, Artificial Sequence
  chemically synthesized
gtgggagatagaatactaat

SEQ ID NO: 73585 - DNA, 20 bp, Artificial Sequence
  chemically synthesized
aaattctaaaaccagcaagc

SEQ ID NO: 73586 - DNA, 20 bp, Artificial Sequence
  chemically synthesized
cagggcctggctacaaaaat

SEQ ID NO: 73587 - DNA, 20 bp, Artificial Sequence
  chemically synthesized
gatgttaagtgactcaggaa

SEQ ID NO: 73588 - DNA, 20 bp, Artificial Sequence
  chemically synthesized
taagattttgggaaaaagta

SEQ ID NO: 73589 - DNA, 20 bp, Artificial Sequence
  chemically synthesized
taatctgcttatgtgcacaa

SEQ ID NO: 73590 - DNA, 20 bp, Artificial Sequence
  chemically synthesized
cttatgtgcacaaaatggat

SEQ ID NO: 73591 - DNA, 20 bp, Artificial Sequence
  chemically synthesized
cagataaaataaaatatgga

SEQ ID NO: 73592 - DNA, 20 bp, Artificial Sequence
  chemically synthesized
gtgaagggtagagggatatt

SEQ ID NO: 73593 - DNA, 20 bp, Artificial Sequence
  chemically synthesized
agatttactttttaggaagt

SEQ ID NO: 73594 - DNA, 20 bp, Artificial Sequence
  chemically synthesized
aggaagtgctagattggtca

SEQ ID NO: 73595 - DNA, 20 bp, Artificial Sequence
  chemically synthesized
atgcccataaacagagtaaa

SEQ ID NO: 73596 - DNA, 20 bp, Artificial Sequence
  chemically synthesized
acttacatgcctagaacatg

SEQ ID NO: 73597 - DNA, 20 bp, Artificial Sequence
  chemically synthesized
gtctagatatttaggatatc

SEQ ID NO: 73598 - DNA, 20 bp, Artificial Sequence
  chemically synthesized
cctactcaaatatcaaacat

SEQ ID NO: 73599 - DNA, 20 bp, Artificial Sequence
  chemically synthesized
ggcttaatccttctatccaa

SEQ ID NO: 73600 - DNA, 20 bp, Artificial Sequence
  chemically synthesized
gtgatatttgactttctgta

SEQ ID NO: 73601 - DNA, 20 bp, Artificial Sequence
  chemically synthesized
atctatctctttggcatacc

SEQ ID NO: 73602 - DNA, 20 bp, Artificial Sequence
  chemically synthesized
atctctttggcataccaaga

SEQ ID NO: 73603 - DNA, 20 bp, Artificial Sequence
  chemically synthesized
ataccaagagtttgtttttg

SEQ ID NO: 73604 - DNA, 20 bp, Artificial Sequence
  chemically synthesized
agtttgtttttgttctgctt

SEQ ID NO: 73605 - DNA, 20 bp, Artificial Sequence
  chemically synthesized
catccatgttgctacaaatg

SEQ ID NO: 73606 - DNA, 20 bp, Artificial Sequence
  chemically synthesized
caaaccttaactattgtgaa

SEQ ID NO: 73607 - DNA, 20 bp, Artificial Sequence
  chemically synthesized
tgtaatgtgtccattggata

SEQ ID NO: 73608 - DNA, 20 bp, Artificial Sequence
  chemically synthesized
ttttggataaataaccacta

SEQ ID NO: 73609 - DNA, 20 bp, Artificial Sequence
  chemically synthesized
aaataaccactagtgagatt

SEQ ID NO: 73610 - DNA, 20 bp, Artificial Sequence
  chemically synthesized
attgctggattgtatgatag

SEQ ID NO: 73611 - DNA, 20 bp, Artificial Sequence
  chemically synthesized
gattgtatgatagttctgtt

SEQ ID NO: 73612 - DNA, 20 bp, Artificial Sequence
  chemically synthesized
agtttactgagaaatcttca

SEQ ID NO: 73613 - DNA, 20 bp, Artificial Sequence
  chemically synthesized
tttttgtcttttttgttaat

SEQ ID NO: 73614 - DNA, 20 bp, Artificial Sequence
  chemically synthesized
agagtaagtagatatctcat

SEQ ID NO: 73615 - DNA, 20 bp, Artificial Sequence
  chemically synthesized
aagtagatatctcattgtag

SEQ ID NO: 73616 - DNA, 20 bp, Artificial Sequence
  chemically synthesized
gtgatgttgagaattttttc

SEQ ID NO: 73617 - DNA, 20 bp, Artificial Sequence
  chemically synthesized
tgtccttagcctacttttta

SEQ ID NO: 73618 - DNA, 20 bp, Artificial Sequence
  chemically synthesized
cttagcctactttttattgg

SEQ ID NO: 73619 - DNA, 20 bp, Artificial Sequence
  chemically synthesized
tattattcttttgtcagatg

SEQ ID NO: 73620 - DNA, 20 bp, Artificial Sequence
  chemically synthesized
tttgtcagatgtatagattg

SEQ ID NO: 73621 - DNA, 20 bp, Artificial Sequence
  chemically synthesized
tttctcccactctgtgggtt

SEQ ID NO: 73622 - DNA, 20 bp, Artificial Sequence
  chemically synthesized
cttttgccatgcaaaagctc

SEQ ID NO: 73623 - DNA, 20 bp, Artificial Sequence
  chemically synthesized
aatttagtcccagatatttt

SEQ ID NO: 73624 - DNA, 20 bp, Artificial Sequence
  chemically synthesized
tttcctaagccaatgtgtag

SEQ ID NO: 73625 - DNA, 20 bp, Artificial Sequence
  chemically synthesized
atgttattttctagaattgt

SEQ ID NO: 73626 - DNA, 20 bp, Artificial Sequence
  chemically synthesized
ttctagaattgttacagttt

SEQ ID NO: 73627 - DNA, 20 bp, Artificial Sequence
  chemically synthesized
gaattgttacagtttcaggg

SEQ ID NO: 73628 - DNA, 20 bp, Artificial Sequence
  chemically synthesized
taagtccttgatccatcttg

SEQ ID NO: 73629 - DNA, 20 bp, Artificial Sequence
  chemically synthesized
tataaggtgagagatgaaga

SEQ ID NO: 73630 - DNA, 20 bp, Artificial Sequence
  chemically synthesized
tccagtttcattctcctaca

SEQ ID NO: 73631 - DNA, 20 bp, Artificial Sequence
  chemically synthesized
tagggtgccctttccccact

SEQ ID NO: 73632 - DNA, 20 bp, Artificial Sequence
  chemically synthesized
gccctttccccactttatgt

SEQ ID NO: 73633 - DNA, 20 bp, Artificial Sequence
  chemically synthesized
tttccccactttatgttttt

SEQ ID NO: 73634 - DNA, 20 bp, Artificial Sequence
  chemically synthesized
gatcagttggatgtaagtat

SEQ ID NO: 73635 - DNA, 20 bp, Artificial Sequence
  chemically synthesized
ctatttgtacaccagcatca

SEQ ID NO: 73636 - DNA, 20 bp, Artificial Sequence
  chemically synthesized
tggtgactatggccttattg

SEQ ID NO: 73637 - DNA, 20 bp, Artificial Sequence
  chemically synthesized
aaatgaggtaatgtaatgcc

SEQ ID NO: 73638 - DNA, 20 bp, Artificial Sequence
  chemically synthesized
agatttgttcttttttttag

SEQ ID NO: 73639 - DNA, 20 bp, Artificial Sequence
  chemically synthesized
ttgttcttttttttagactt

SEQ ID NO: 73640 - DNA, 20 bp, Artificial Sequence
  chemically synthesized
tttttggttccataagaatt

SEQ ID NO: 73641 - DNA, 20 bp, Artificial Sequence
  chemically synthesized
tggttccataagaattttag

SEQ ID NO: 73642 - DNA, 20 bp, Artificial Sequence
  chemically synthesized
ggaattgcaatgaatttgta

SEQ ID NO: 73643 - DNA, 20 bp, Artificial Sequence
  chemically synthesized
cattatggccattttcacaa

SEQ ID NO: 73644 - DNA, 20 bp, Artificial Sequence
  chemically synthesized
tacccatctatgagaatggc

SEQ ID NO: 73645 - DNA, 20 bp, Artificial Sequence
  chemically synthesized
tgagaatggcatgtgtttcc

SEQ ID NO: 73646 - DNA, 20 bp, Artificial Sequence
  chemically synthesized
tttccatttgtttgtgtctt

SEQ ID NO: 73647 - DNA, 20 bp, Artificial Sequence
  chemically synthesized
tcttatatgattactttcag

SEQ ID NO: 73648 - DNA, 20 bp, Artificial Sequence
  chemically synthesized
gattactttcagccgtgttt

SEQ ID NO: 73649 - DNA, 20 bp, Artificial Sequence
  chemically synthesized
ccttggttaggtatatattc

SEQ ID NO: 73650 - DNA, 20 bp, Artificial Sequence
  chemically synthesized
ttaggtatatattcctaagt

SEQ ID NO: 73651 - DNA, 20 bp, Artificial Sequence
  chemically synthesized
tatatattcctaagtttttg

SEQ ID NO: 73652 - DNA, 20 bp, Artificial Sequence
  chemically synthesized
attcctaagtttttgttttg

SEQ ID NO: 73653 - DNA, 20 bp, Artificial Sequence
  chemically synthesized
taagtttttgttttgttttg

SEQ ID NO: 73654 - DNA, 20 bp, Artificial Sequence
  chemically synthesized
tattgtaaaaggggttgagt

SEQ ID NO: 73655 - DNA, 20 bp, Artificial Sequence
  chemically synthesized
gttgagttcttgattttatt

SEQ ID NO: 73656 - DNA, 20 bp, Artificial Sequence
  chemically synthesized
gaattattttatcagttcta

SEQ ID NO: 73657 - DNA, 20 bp, Artificial Sequence
  chemically synthesized
gggggttttggaggagtctt

SEQ ID NO: 73658 - DNA, 20 bp, Artificial Sequence
  chemically synthesized
tcatatcatcagcaaacagt

SEQ ID NO: 73659 - DNA, 20 bp, Artificial Sequence
  chemically synthesized
ctttctctttaacaatttgg

SEQ ID NO: 73660 - DNA, 20 bp, Artificial Sequence
  chemically synthesized
taacaatttggatgtgcttt

SEQ ID NO: 73661 - DNA, 20 bp, Artificial Sequence
  chemically synthesized
gtgctttacttgtttctctt

SEQ ID NO: 73662 - DNA, 20 bp, Artificial Sequence
  chemically synthesized
agtgggtatccttgtctcat

SEQ ID NO: 73663 - DNA, 20 bp, Artificial Sequence
  chemically synthesized
ctcattccagttttcagaca

SEQ ID NO: 73664 - DNA, 20 bp, Artificial Sequence
  chemically synthesized
cattcaatataatgttggct

SEQ ID NO: 73665 - DNA, 20 bp, Artificial Sequence
  chemically synthesized
ttggctgtgtgtttaccata

SEQ ID NO: 73666 - DNA, 20 bp, Artificial Sequence
  chemically synthesized
attgaggtatgtcctttgta

SEQ ID NO: 73667 - DNA, 20 bp, Artificial Sequence
  chemically synthesized
tcctttgtaaaccgattttg

SEQ ID NO: 73668 - DNA, 20 bp, Artificial Sequence
  chemically synthesized
tgatgttgaattttgttgaa

SEQ ID NO: 73669 - DNA, 20 bp, Artificial Sequence
  chemically synthesized
ctgtggctattgagataatc

SEQ ID NO: 73670 - DNA, 20 bp, Artificial Sequence
  chemically synthesized
tattgagataatcacatgat

SEQ ID NO: 73671 - DNA, 20 bp, Artificial Sequence
  chemically synthesized
cgcatgaaacccacttgatc

SEQ ID NO: 73672 - DNA, 20 bp, Artificial Sequence
  chemically synthesized
tcatcagggatattgatctg

SEQ ID NO: 73673 - DNA, 20 bp, Artificial Sequence
  chemically synthesized
tttttttggttatgttcttt

SEQ ID NO: 73674 - DNA, 20 bp, Artificial Sequence
  chemically synthesized
agttttggtattaaggtgat

SEQ ID NO: 73675 - DNA, 20 bp, Artificial Sequence
  chemically synthesized
aaggtgatactggcttcata

SEQ ID NO: 73676 - DNA, 20 bp, Artificial Sequence
  chemically synthesized
ggcttcatagaatgatttag

SEQ ID NO: 73677 - DNA, 20 bp, Artificial Sequence
  chemically synthesized
tatcttgtagaatactgtca

SEQ ID NO: 73678 - DNA, 20 bp, Artificial Sequence
  chemically synthesized
ttttattatcatttcagtct

SEQ ID NO: 73679 - DNA, 20 bp, Artificial Sequence
  chemically synthesized
caggaattcgaacgtctcct

SEQ ID NO: 73680 - DNA, 20 bp, Artificial Sequence
  chemically synthesized
cgaacgtctcctttaggttt

SEQ ID NO: 73681 - DNA, 20 bp, Artificial Sequence
  chemically synthesized
gtggtatcagtaatagtatc

SEQ ID NO: 73682 - DNA, 20 bp, Artificial Sequence
  chemically synthesized
atcagtaatagtatctcctg

SEQ ID NO: 73683 - DNA, 20 bp, Artificial Sequence
  chemically synthesized
atctcctgttttgtttctaa

SEQ ID NO: 73684 - DNA, 20 bp, Artificial Sequence
  chemically synthesized
gttaatcttgctaatggtct

SEQ ID NO: 73685 - DNA, 20 bp, Artificial Sequence
  chemically synthesized
tttatttatcttttcaaaga

SEQ ID NO: 73686 - DNA, 20 bp, Artificial Sequence
  chemically synthesized
agaaccagctttttatttca

SEQ ID NO: 73687 - DNA, 20 bp, Artificial Sequence
  chemically synthesized
tagcttttgtatttttttgc

SEQ ID NO: 73688 - DNA, 20 bp, Artificial Sequence
  chemically synthesized
tagttattccctttcttttg

SEQ ID NO: 73689 - DNA, 20 bp, Artificial Sequence
  chemically synthesized
tttcttttgctgggttttgg

SEQ ID NO: 73690 - DNA, 20 bp, Artificial Sequence
  chemically synthesized
ttttgctgggttttggttct

SEQ ID NO: 73691 - DNA, 20 bp, Artificial Sequence
  chemically synthesized
tgggttttggttctgtttgt

SEQ ID NO: 73692 - DNA, 20 bp, Artificial Sequence
  chemically synthesized
gttctgtttgtttttgtttc

SEQ ID NO: 73693 - DNA, 20 bp, Artificial Sequence
  chemically synthesized
caccatctttgctgtatcct

SEQ ID NO: 73694 - DNA, 20 bp, Artificial Sequence
  chemically synthesized
gggatacatgtgcagaatgt

SEQ ID NO: 73695 - DNA, 20 bp, Artificial Sequence
  chemically synthesized
cataggtatagatgtgccat

SEQ ID NO: 73696 - DNA, 20 bp, Artificial Sequence
  chemically synthesized
cacttatgagtgagaacgtg

SEQ ID NO: 73697 - DNA, 20 bp, Artificial Sequence
  chemically synthesized
atgagtgagaacgtgtggtg

SEQ ID NO: 73698 - DNA, 20 bp, Artificial Sequence
  chemically synthesized
tttggtttctctgttcctgt

SEQ ID NO: 73699 - DNA, 20 bp, Artificial Sequence
  chemically synthesized
tgtgttagtttgctcagaat

SEQ ID NO: 73700 - DNA, 20 bp, Artificial Sequence
  chemically synthesized
gtgcacgtgtctttatagta

SEQ ID NO: 73701 - DNA, 20 bp, Artificial Sequence
  chemically synthesized
ctttgggtatatacccagta

SEQ ID NO: 73702 - DNA, 20 bp, Artificial Sequence
  chemically synthesized
tccacatcctctccagcacc

SEQ ID NO: 73703 - DNA, 20 bp, Artificial Sequence
  chemically synthesized
ggcatgagatggtatctcat

SEQ ID NO: 73704 - DNA, 20 bp, Artificial Sequence
  chemically synthesized
gagatggtatctcattgtgg

SEQ ID NO: 73705 - DNA, 20 bp, Artificial Sequence
  chemically synthesized
ttctctaatgaccagtgatg

SEQ ID NO: 73706 - DNA, 20 bp, Artificial Sequence
  chemically synthesized
gtgatgatgagcttcttttc

SEQ ID NO: 73707 - DNA, 20 bp, Artificial Sequence
  chemically synthesized
tccactttttgatggggtcg

SEQ ID NO: 73708 - DNA, 20 bp, Artificial Sequence
  chemically synthesized
gtaaatttgttgaagttctt

SEQ ID NO: 73709 - DNA, 20 bp, Artificial Sequence
  chemically synthesized
tgttagccctttgtcagatg

SEQ ID NO: 73710 - DNA, 20 bp, Artificial Sequence
  chemically synthesized
cttttgctgtgcagaagctc

SEQ ID NO: 73711 - DNA, 20 bp, Artificial Sequence
  chemically synthesized
tcaattttggcctttgttgt

SEQ ID NO: 73712 - DNA, 20 bp, Artificial Sequence
  chemically synthesized
gcctttgttgtcattgcttt

SEQ ID NO: 73713 - DNA, 20 bp, Artificial Sequence
  chemically synthesized
ggtattgcctaggttatctt

SEQ ID NO: 73714 - DNA, 20 bp, Artificial Sequence
  chemically synthesized
aggttatcttctaggatttt

SEQ ID NO: 73715 - DNA, 20 bp, Artificial Sequence
  chemically synthesized
tataaggtgtaaggaagggg

SEQ ID NO: 73716 - DNA, 20 bp, Artificial Sequence
  chemically synthesized
gtgtaaggaaggggtacagt

SEQ ID NO: 73717 - DNA, 20 bp, Artificial Sequence
  chemically synthesized
cagttttatgcatattgcta

SEQ ID NO: 73718 - DNA, 20 bp, Artificial Sequence
  chemically synthesized
taaatagggaattctttctc

SEQ ID NO: 73719 - DNA, 20 bp, Artificial Sequence
  chemically synthesized
ttctttctccattgcttttg

SEQ ID NO: 73720 - DNA, 20 bp, Artificial Sequence
  chemically synthesized
tagatgtgtggcattatttc

SEQ ID NO: 73721 - DNA, 20 bp, Artificial Sequence
  chemically synthesized
tctgttccactggtctatat

SEQ ID NO: 73722 - DNA, 20 bp, Artificial Sequence
  chemically synthesized
ctgttttggtaccagtacca

SEQ ID NO: 73723 - DNA, 20 bp, Artificial Sequence
  chemically synthesized
ttgttactgtagccttgtag

SEQ ID NO: 73724 - DNA, 20 bp, Artificial Sequence
  chemically synthesized
aagtcaggtagcatcatgcc

SEQ ID NO: 73725 - DNA, 20 bp, Artificial Sequence
  chemically synthesized
catgcctccagctttgttct

SEQ ID NO: 73726 - DNA, 20 bp, Artificial Sequence
  chemically synthesized
tccagctttgttctttttgt

SEQ ID NO: 73727 - DNA, 20 bp, Artificial Sequence
  chemically synthesized
tcttggctatatgggctctt

SEQ ID NO: 73728 - DNA, 20 bp, Artificial Sequence
  chemically synthesized
tgattccatatgacatttaa

SEQ ID NO: 73729 - DNA, 20 bp, Artificial Sequence
  chemically synthesized
attctttgaaaaaagtcagt

SEQ ID NO: 73730 - DNA, 20 bp, Artificial Sequence
  chemically synthesized
cagtatggccattttaaaga

SEQ ID NO: 73731 - DNA, 20 bp, Artificial Sequence
  chemically synthesized
tctttctatctatgagcatg

SEQ ID NO: 73732 - DNA, 20 bp, Artificial Sequence
  chemically synthesized
tgagcatggaatgtttttcc

SEQ ID NO: 73733 - DNA, 20 bp, Artificial Sequence
  chemically synthesized
tcttatttccttgagcagtg

SEQ ID NO: 73734 - DNA, 20 bp, Artificial Sequence
  chemically synthesized
aattgtgaatgggagttcac

SEQ ID NO: 73735 - DNA, 20 bp, Artificial Sequence
  chemically synthesized
agttcacccatgatttggct

SEQ ID NO: 73736 - DNA, 20 bp, Artificial Sequence
  chemically synthesized
tgtctattattggtgtatag

SEQ ID NO: 73737 - DNA, 20 bp, Artificial Sequence
  chemically synthesized
ttattggtgtataggaacgc

SEQ ID NO: 73738 - DNA, 20 bp, Artificial Sequence
  chemically synthesized
gaacgcttgtgatttctgca

SEQ ID NO: 73739 - DNA, 20 bp, Artificial Sequence
  chemically synthesized
gtatcttgagactttgctga

SEQ ID NO: 73740 - DNA, 20 bp, Artificial Sequence
  chemically synthesized
agactttgctgaagctgttt

SEQ ID NO: 73741 - DNA, 20 bp, Artificial Sequence
  chemically synthesized
tgctgaagctgtttatcagc

SEQ ID NO: 73742 - DNA, 20 bp, Artificial Sequence
  chemically synthesized
cttcctctcttcctatttga

SEQ ID NO: 73743 - DNA, 20 bp, Artificial Sequence
  chemically synthesized
atgctttatttctttctctt

SEQ ID NO: 73744 - DNA, 20 bp, Artificial Sequence
  chemically synthesized
agagggcatccttgtcttgt

SEQ ID NO: 73745 - DNA, 20 bp, Artificial Sequence
  chemically synthesized
cttgtgccggttttcaaagc

SEQ ID NO: 73746 - DNA, 20 bp, Artificial Sequence
  chemically synthesized
aaatgatttttaaatttcca

SEQ ID NO: 73747 - DNA, 20 bp, Artificial Sequence
  chemically synthesized
atttaatttccctgtatttg

SEQ ID NO: 73748 - DNA, 20 bp, Artificial Sequence
  chemically synthesized
gttttgaaggttccttttgt

SEQ ID NO: 73749 - DNA, 20 bp, Artificial Sequence
  chemically synthesized
tattctactgtggtctgaga

SEQ ID NO: 73750 - DNA, 20 bp, Artificial Sequence
  chemically synthesized
ttcaatttttaaaaatttat

SEQ ID NO: 73751 - DNA, 20 bp, Artificial Sequence
  chemically synthesized
atttttaaaaatttattgag

SEQ ID NO: 73752 - DNA, 20 bp, Artificial Sequence
  chemically synthesized
gtccatttgttctttaaatc

SEQ ID NO: 73753 - DNA, 20 bp, Artificial Sequence
  chemically synthesized
ttgctgtctagtctagtagt

SEQ ID NO: 73754 - DNA, 20 bp, Artificial Sequence
  chemically synthesized
gtaatattctcccattggac

SEQ ID NO: 73755 - DNA, 20 bp, Artificial Sequence
  chemically synthesized
ccctctttgtcttttttaac

SEQ ID NO: 73756 - DNA, 20 bp, Artificial Sequence
  chemically synthesized
ttttttaactgctgtttctt

SEQ ID NO: 73757 - DNA, 20 bp, Artificial Sequence
  chemically synthesized
ttaactgctgtttctttaaa

SEQ ID NO: 73758 - DNA, 20 bp, Artificial Sequence
  chemically synthesized
gttttgtctgacataagaat

SEQ ID NO: 73759 - DNA, 20 bp, Artificial Sequence
  chemically synthesized
acataagaatagctgctttg

SEQ ID NO: 73760 - DNA, 20 bp, Artificial Sequence
  chemically synthesized
tcattttccacccctttacc

SEQ ID NO: 73761 - DNA, 20 bp, Artificial Sequence
  chemically synthesized
atttttgttgtatatgtcct

SEQ ID NO: 73762 - DNA, 20 bp, Artificial Sequence
  chemically synthesized
ttgtatatgtcctatgggat

SEQ ID NO: 73763 - DNA, 20 bp, Artificial Sequence
  chemically synthesized
ggatttatgctttaaagagg

SEQ ID NO: 73764 - DNA, 20 bp, Artificial Sequence
  chemically synthesized
tttaaagaggttctgttttg

SEQ ID NO: 73765 - DNA, 20 bp, Artificial Sequence
  chemically synthesized
gttctgttttgatgtgcttc

SEQ ID NO: 73766 - DNA, 20 bp, Artificial Sequence
  chemically synthesized
atgtgcttccagggtttatt

SEQ ID NO: 73767 - DNA, 20 bp, Artificial Sequence
  chemically synthesized
cttttatcagttcttgtagt

SEQ ID NO: 73768 - DNA, 20 bp, Artificial Sequence
  chemically synthesized
tagtgccgaattctctcagc

SEQ ID NO: 73769 - DNA, 20 bp, Artificial Sequence
  chemically synthesized
ctgtgtattttcttcatttg

SEQ ID NO: 73770 - DNA, 20 bp, Artificial Sequence
  chemically synthesized
tattttcttcatttgtgaag

SEQ ID NO: 73771 - DNA, 20 bp, Artificial Sequence
  chemically synthesized
atataaaattcttggctgat

SEQ ID NO: 73772 - DNA, 20 bp, Artificial Sequence
  chemically synthesized
aaattcttggctgataattg

SEQ ID NO: 73773 - DNA, 20 bp, Artificial Sequence
  chemically synthesized
aagatagggccatattcact

SEQ ID NO: 73774 - DNA, 20 bp, Artificial Sequence
  chemically synthesized
ccatattcacttctagcttt

SEQ ID NO: 73775 - DNA, 20 bp, Artificial Sequence
  chemically synthesized
agaaatctgctgttaatctg

SEQ ID NO: 73776 - DNA, 20 bp, Artificial Sequence
  chemically synthesized
ttttctttcataggttacct

SEQ ID NO: 73777 - DNA, 20 bp, Artificial Sequence
  chemically synthesized
gtagtttcacctcacagctc

SEQ ID NO: 73778 - DNA, 20 bp, Artificial Sequence
  chemically synthesized
atttttgcaatgaatttccc

SEQ ID NO: 73779 - DNA, 20 bp, Artificial Sequence
  chemically synthesized
atgaatttcccaggtgttta

SEQ ID NO: 73780 - DNA, 20 bp, Artificial Sequence
  chemically synthesized
taggtctctagcaaggtggg

SEQ ID NO: 73781 - DNA, 20 bp, Artificial Sequence
  chemically synthesized
agcaaggtgggggaagtttt

SEQ ID NO: 73782 - DNA, 20 bp, Artificial Sequence
  chemically synthesized
ttccttgattatttccctgg

SEQ ID NO: 73783 - DNA, 20 bp, Artificial Sequence
  chemically synthesized
ctggataagttttccaaact

SEQ ID NO: 73784 - DNA, 20 bp, Artificial Sequence
  chemically synthesized
tttctcttctttctcaggaa

SEQ ID NO: 73785 - DNA, 20 bp, Artificial Sequence
  chemically synthesized
ctcaggaatgctgattattc

SEQ ID NO: 73786 - DNA, 20 bp, Artificial Sequence
  chemically synthesized
ggaatgctgattattcttag

SEQ ID NO: 73787 - DNA, 20 bp, Artificial Sequence
  chemically synthesized
tgctgattattcttaggttt

SEQ ID NO: 73788 - DNA, 20 bp, Artificial Sequence
  chemically synthesized
gtttgattgtttaacataat

SEQ ID NO: 73789 - DNA, 20 bp, Artificial Sequence
  chemically synthesized
aacataatcccagatttctt

SEQ ID NO: 73790 - DNA, 20 bp, Artificial Sequence
  chemically synthesized
attcttttttctttgtcttt

SEQ ID NO: 73791 - DNA, 20 bp, Artificial Sequence
  chemically synthesized
gtcttcaagctctgaatttc

SEQ ID NO: 73792 - DNA, 20 bp, Artificial Sequence
  chemically synthesized
caagctctgaatttcttctg

SEQ ID NO: 73793 - DNA, 20 bp, Artificial Sequence
  chemically synthesized
tataagtgcatccattcatc

SEQ ID NO: 73794 - DNA, 20 bp, Artificial Sequence
  chemically synthesized
tccattcatccattgtttcc

SEQ ID NO: 73795 - DNA, 20 bp, Artificial Sequence
  chemically synthesized
ccattgtttcctgaagtttt

SEQ ID NO: 73796 - DNA, 20 bp, Artificial Sequence
  chemically synthesized
atttatgctatctctttaac

SEQ ID NO: 73797 - DNA, 20 bp, Artificial Sequence
  chemically synthesized
ctcatttcttgtatcatatt

SEQ ID NO: 73798 - DNA, 20 bp, Artificial Sequence
  chemically synthesized
ttcaccttcctcggatgcct

SEQ ID NO: 73799 - DNA, 20 bp, Artificial Sequence
  chemically synthesized
cttcctcggatgcctccttg

SEQ ID NO: 73800 - DNA, 20 bp, Artificial Sequence
  chemically synthesized
gaattatttttcaggtaaat

SEQ ID NO: 73801 - DNA, 20 bp, Artificial Sequence
  chemically synthesized
aggtaaatcagggatttctt

SEQ ID NO: 73802 - DNA, 20 bp, Artificial Sequence
  chemically synthesized
gatgcattgctggtgagcta

SEQ ID NO: 73803 - DNA, 20 bp, Artificial Sequence
  chemically synthesized
ttttggggggtgttaaagaa

SEQ ID NO: 73804 - DNA, 20 bp, Artificial Sequence
  chemically synthesized
ttgtttttcatattaccaga

SEQ ID NO: 73805 - DNA, 20 bp, Artificial Sequence
  chemically synthesized
agtcccccttttcctaggcg

SEQ ID NO: 73806 - DNA, 20 bp, Artificial Sequence
  chemically synthesized
gcttcctgagagccgaactg

SEQ ID NO: 73807 - DNA, 20 bp, Artificial Sequence
  chemically synthesized
accagactccaggctggtac

SEQ ID NO: 73808 - DNA, 20 bp, Artificial Sequence
  chemically synthesized
ctactgtgggaggatggggg

SEQ ID NO: 73809 - DNA, 20 bp, Artificial Sequence
  chemically synthesized
gggggtgtagtttccaggtc

SEQ ID NO: 73810 - DNA, 20 bp, Artificial Sequence
  chemically synthesized
ctcccccgcaacagcaccga

SEQ ID NO: 73811 - DNA, 20 bp, Artificial Sequence
  chemically synthesized
agcccctagatctggccagg

SEQ ID NO: 73812 - DNA, 20 bp, Artificial Sequence
  chemically synthesized
cccctgtgaggcaaggcaga

SEQ ID NO: 73813 - DNA, 20 bp, Artificial Sequence
  chemically synthesized
taggggacccagagagccca

SEQ ID NO: 73814 - DNA, 20 bp, Artificial Sequence
  chemically synthesized
agagcccacagggcttttcc

SEQ ID NO: 73815 - DNA, 20 bp, Artificial Sequence
  chemically synthesized
ctgcttcctctacccctgta

SEQ ID NO: 73816 - DNA, 20 bp, Artificial Sequence
  chemically synthesized
tcaggttccccagtgaggat

SEQ ID NO: 73817 - DNA, 20 bp, Artificial Sequence
  chemically synthesized
cggtcccccttttccacttc

SEQ ID NO: 73818 - DNA, 20 bp, Artificial Sequence
  chemically synthesized
ttgggcactcacaatatttg

SEQ ID NO: 73819 - DNA, 20 bp, Artificial Sequence
  chemically synthesized
tcccgggtcctgcaggagca

SEQ ID NO: 73820 - DNA, 20 bp, Artificial Sequence
  chemically synthesized
tcagagggtgtgtgcgttct

SEQ ID NO: 73821 - DNA, 20 bp, Artificial Sequence
  chemically synthesized
tgtgtgcgttctctcagctt

SEQ ID NO: 73822 - DNA, 20 bp, Artificial Sequence
  chemically synthesized
ttaccccttagggagctata

SEQ ID NO: 73823 - DNA, 20 bp, Artificial Sequence
  chemically synthesized
cacacacacacatctgcatg

SEQ ID NO: 73824 - DNA, 20 bp, Artificial Sequence
  chemically synthesized
aataattgtccacaggcaat

SEQ ID NO: 73825 - DNA, 20 bp, Artificial Sequence
  chemically synthesized
gtaatccagccaatagtaca

SEQ ID NO: 73826 - DNA, 20 bp, Artificial Sequence
  chemically synthesized
agccaatagtacaggttgct

SEQ ID NO: 73827 - DNA, 20 bp, Artificial Sequence
  chemically synthesized
taccagagttaaaattctat

SEQ ID NO: 73828 - DNA, 20 bp, Artificial Sequence
  chemically synthesized
ctcactccctaccactgagg

SEQ ID NO: 73829 - DNA, 20 bp, Artificial Sequence
  chemically synthesized
ctgaggacaagtttatgtcc

SEQ ID NO: 73830 - DNA, 20 bp, Artificial Sequence
  chemically synthesized
acaagtttatgtccttaggt

SEQ ID NO: 73831 - DNA, 20 bp, Artificial Sequence
  chemically synthesized
atctaactctctggcacagc

SEQ ID NO: 73832 - DNA, 20 bp, Artificial Sequence
  chemically synthesized
aactctctggcacagcagga

SEQ ID NO: 73833 - DNA, 20 bp, Artificial Sequence
  chemically synthesized
cacagcaggagtttgttttc

SEQ ID NO: 73834 - DNA, 20 bp, Artificial Sequence
  chemically synthesized
gagtttgttttcttctgctt

SEQ ID NO: 73835 - DNA, 20 bp, Artificial Sequence
  chemically synthesized
cagagctttgaatttactat

SEQ ID NO: 73836 - DNA, 20 bp, Artificial Sequence
  chemically synthesized
atttggcaatgccttcccat

SEQ ID NO: 73837 - DNA, 20 bp, Artificial Sequence
  chemically synthesized
aataatatctgaaattattt

SEQ ID NO: 73838 - DNA, 20 bp, Artificial Sequence
  chemically synthesized
ttaattttatgtatgttcta

SEQ ID NO: 73839 - DNA, 20 bp, Artificial Sequence
  chemically synthesized
ctagattataatcttcagag

SEQ ID NO: 73840 - DNA, 20 bp, Artificial Sequence
  chemically synthesized
ttaacagatatttgctgaac

SEQ ID NO: 73841 - DNA, 20 bp, Artificial Sequence
  chemically synthesized
gtttgaaaatacatgggaaa

SEQ ID NO: 73842 - DNA, 20 bp, Artificial Sequence
  chemically synthesized
gaatgcttgaaaacacttga

SEQ ID NO: 73843 - DNA, 20 bp, Artificial Sequence
  chemically synthesized
tgaaattgcttgtgtaaaga

SEQ ID NO: 73844 - DNA, 20 bp, Artificial Sequence
  chemically synthesized
taaagaaacagttttatcag

SEQ ID NO: 73845 - DNA, 20 bp, Artificial Sequence
  chemically synthesized
tcaaaagcataagaggaaat

SEQ ID NO: 73846 - DNA, 20 bp, Artificial Sequence
  chemically synthesized
catgacttttagaacactgc

SEQ ID NO: 73847 - DNA, 20 bp, Artificial Sequence
  chemically synthesized
ggtttttggataaatgggga

SEQ ID NO: 73848 - DNA, 20 bp, Artificial Sequence
  chemically synthesized
cttagtctgaggaggagcaa

SEQ ID NO: 73849 - DNA, 20 bp, Artificial Sequence
  chemically synthesized
aggaggagcaattaagattc

SEQ ID NO: 73850 - DNA, 20 bp, Artificial Sequence
  chemically synthesized
ttgggaggctgaggaaggag

SEQ ID NO: 73851 - DNA, 20 bp, Artificial Sequence
  chemically synthesized
tctgtctcaaaaaaaaaaaa

SEQ ID NO: 73852 - DNA, 20 bp, Artificial Sequence
  chemically synthesized
aaaaaaaaaaagagagattc

SEQ ID NO: 73853 - DNA, 20 bp, Artificial Sequence
  chemically synthesized
aagagagattcaaaagattc

SEQ ID NO: 73854 - DNA, 20 bp, Artificial Sequence
  chemically synthesized
attcacttgtttaggcctta

SEQ ID NO: 73855 - DNA, 20 bp, Artificial Sequence
  chemically synthesized
aaaaatctttctcacccatc

SEQ ID NO: 73856 - DNA, 20 bp, Artificial Sequence
  chemically synthesized
caaagaacaagtgcaatatg

SEQ ID NO: 73857 - DNA, 20 bp, Artificial Sequence
  chemically synthesized
tgagcagatataagccttac

SEQ ID NO: 73858 - DNA, 20 bp, Artificial Sequence
  chemically synthesized
acacaggattatgaagtctg

SEQ ID NO: 73859 - DNA, 20 bp, Artificial Sequence
  chemically synthesized
gtagagctctcctccaataa

SEQ ID NO: 73860 - DNA, 20 bp, Artificial Sequence
  chemically synthesized
cctccaataagccagatttc

SEQ ID NO: 73861 - DNA, 20 bp, Artificial Sequence
  chemically synthesized
aacagtccctgcctcttaag

SEQ ID NO: 73862 - DNA, 20 bp, Artificial Sequence
  chemically synthesized
tacatgtcttatgtcttaga

SEQ ID NO: 73863 - DNA, 20 bp, Artificial Sequence
  chemically synthesized
cttttgctgagatgaaacag

SEQ ID NO: 73864 - DNA, 20 bp, Artificial Sequence
  chemically synthesized
cggataagtagatattgaag

SEQ ID NO: 73865 - DNA, 20 bp, Artificial Sequence
  chemically synthesized
atctattcctgcactgaaac

SEQ ID NO: 73866 - DNA, 20 bp, Artificial Sequence
  chemically synthesized
tgcactgaaactgttgcttt

SEQ ID NO: 73867 - DNA, 20 bp, Artificial Sequence
  chemically synthesized
agcacttcttatttggaaac

SEQ ID NO: 73868 - DNA, 20 bp, Artificial Sequence
  chemically synthesized
tgaacttttcaaaaattggt

SEQ ID NO: 73869 - DNA, 20 bp, Artificial Sequence
  chemically synthesized
acccttcagcagttccacac

SEQ ID NO: 73870 - DNA, 20 bp, Artificial Sequence
  chemically synthesized
ctgtgcctggcaaaagtcca

SEQ ID NO: 73871 - DNA, 20 bp, Artificial Sequence
  chemically synthesized
gcaaaagtccaggtcgcttc

SEQ ID NO: 73872 - DNA, 20 bp, Artificial Sequence
  chemically synthesized
catggacccagaggttcttt

SEQ ID NO: 73873 - DNA, 20 bp, Artificial Sequence
  chemically synthesized
aacttcaaggtgagtccagg

SEQ ID NO: 73874 - DNA, 20 bp, Artificial Sequence
  chemically synthesized
tctgagcacagcagggtgtg

SEQ ID NO: 73875 - DNA, 20 bp, Artificial Sequence
  chemically synthesized
actgggctgagacccagtgg

SEQ ID NO: 73876 - DNA, 20 bp, Artificial Sequence
  chemically synthesized
gaggaaaatgacttttcttt

SEQ ID NO: 73877 - DNA, 20 bp, Artificial Sequence
  chemically synthesized
acctttcccctatttttgtt

SEQ ID NO: 73878 - DNA, 20 bp, Artificial Sequence
  chemically synthesized
ggacacatataaaatgctgc

SEQ ID NO: 73879 - DNA, 20 bp, Artificial Sequence
  chemically synthesized
aattgaaacatttgggctgg

SEQ ID NO: 73880 - DNA, 20 bp, Artificial Sequence
  chemically synthesized
gtgtgtgtgtgtgtgcgcgc

SEQ ID NO: 73881 - DNA, 20 bp, Artificial Sequence
  chemically synthesized
gtttgtgtgtgtgtgagagc

SEQ ID NO: 73882 - DNA, 20 bp, Artificial Sequence
  chemically synthesized
gtgagagcgtgtgtttcttt

SEQ ID NO: 73883 - DNA, 20 bp, Artificial Sequence
  chemically synthesized
ttcatggtggcaagaagata

SEQ ID NO: 73884 - DNA, 20 bp, Artificial Sequence
  chemically synthesized
tttaatgggaaagcaaaatc

SEQ ID NO: 73885 - DNA, 20 bp, Artificial Sequence
  chemically synthesized
aggctttgagggaagttaac

SEQ ID NO: 73886 - DNA, 20 bp, Artificial Sequence
  chemically synthesized
tttgagggaagttaacatag

SEQ ID NO: 73887 - DNA, 20 bp, Artificial Sequence
  chemically synthesized
acataggcttgattctgggt

SEQ ID NO: 73888 - DNA, 20 bp, Artificial Sequence
  chemically synthesized
ctcctgggaaatgtgctggt

SEQ ID NO: 73889 - DNA, 20 bp, Artificial Sequence
  chemically synthesized
aaagaattcacccctgaggt

SEQ ID NO: 73890 - DNA, 20 bp, Artificial Sequence
  chemically synthesized
tgagctcactgcccatgatg

SEQ ID NO: 73891 - DNA, 20 bp, Artificial Sequence
  chemically synthesized
atgatgcagagctttcaagg

SEQ ID NO: 73892 - DNA, 20 bp, Artificial Sequence
  chemically synthesized
ttttaaatatatgagccaca

SEQ ID NO: 73893 - DNA, 20 bp, Artificial Sequence
  chemically synthesized
aaagggttttatgttgaggg

SEQ ID NO: 73894 - DNA, 20 bp, Artificial Sequence
  chemically synthesized
gtgtatttatacatggctat

SEQ ID NO: 73895 - DNA, 20 bp, Artificial Sequence
  chemically synthesized
catgtgcacactccacactt

SEQ ID NO: 73896 - DNA, 20 bp, Artificial Sequence
  chemically synthesized
cttttttgtttacgttagat

SEQ ID NO: 73897 - DNA, 20 bp, Artificial Sequence
  chemically synthesized
ggacaggactcctcagaaac

SEQ ID NO: 73898 - DNA, 20 bp, Artificial Sequence
  chemically synthesized
aagggggctgaacccccttc

SEQ ID NO: 73899 - DNA, 20 bp, Artificial Sequence
  chemically synthesized
ctcaacgaagaaaaagtgtt

SEQ ID NO: 73900 - DNA, 20 bp, Artificial Sequence
  chemically synthesized
tgttccaagctttaggaagt

SEQ ID NO: 73901 - DNA, 20 bp, Artificial Sequence
  chemically synthesized
caatactatttccaacggca

SEQ ID NO: 73902 - DNA, 20 bp, Artificial Sequence
  chemically synthesized
gttagagatcagagcaggaa

SEQ ID NO: 73903 - DNA, 20 bp, Artificial Sequence
  chemically synthesized
ttcaaggaggagacctcatt

SEQ ID NO: 73904 - DNA, 20 bp, Artificial Sequence
  chemically synthesized
tgtataacattaattgagaa

SEQ ID NO: 73905 - DNA, 20 bp, Artificial Sequence
  chemically synthesized
gttaatgcacgttaataagc

SEQ ID NO: 73906 - DNA, 20 bp, Artificial Sequence
  chemically synthesized
tgcacgttaataagcaagag

SEQ ID NO: 73907 - DNA, 20 bp, Artificial Sequence
  chemically synthesized
atgtgatggtgttatgaact

SEQ ID NO: 73908 - DNA, 20 bp, Artificial Sequence
  chemically synthesized
caattggctccatttgtggg

SEQ ID NO: 73909 - DNA, 20 bp, Artificial Sequence
  chemically synthesized
gggaggctttggaaaagtaa

SEQ ID NO: 73910 - DNA, 20 bp, Artificial Sequence
  chemically synthesized
tattttcctcatcagaagca

SEQ ID NO: 73911 - DNA, 20 bp, Artificial Sequence
  chemically synthesized
agatgaagaaagagaaaaaa

SEQ ID NO: 73912 - DNA, 20 bp, Artificial Sequence
  chemically synthesized
aaaaataagcttcggtgttc

SEQ ID NO: 73913 - DNA, 20 bp, Artificial Sequence
  chemically synthesized
ggtgttcagtggattagaaa

SEQ ID NO: 73914 - DNA, 20 bp, Artificial Sequence
  chemically synthesized
gattagaaaccatgtttatc

SEQ ID NO: 73915 - DNA, 20 bp, Artificial Sequence
  chemically synthesized
tacaaatctccacttgtcct

SEQ ID NO: 73916 - DNA, 20 bp, Artificial Sequence
  chemically synthesized
tattttttcttcaacgtact

SEQ ID NO: 73917 - DNA, 20 bp, Artificial Sequence
  chemically synthesized
caacgtactttaggcttgta

SEQ ID NO: 73918 - DNA, 20 bp, Artificial Sequence
  chemically synthesized
ttcttttttttcctcagcct

SEQ ID NO: 73919 - DNA, 20 bp, Artificial Sequence
  chemically synthesized
tcctttttttttttagtaaa

SEQ ID NO: 73920 - DNA, 20 bp, Artificial Sequence
  chemically synthesized
tagacgcaagggctactggt

SEQ ID NO: 73921 - DNA, 20 bp, Artificial Sequence
  chemically synthesized
caatagtatgctaaacaagg

SEQ ID NO: 73922 - DNA, 20 bp, Artificial Sequence
  chemically synthesized
aaggtacatgtgcaggatgt

SEQ ID NO: 73923 - DNA, 20 bp, Artificial Sequence
  chemically synthesized
atctgtatcaatgagcagat

SEQ ID NO: 73924 - DNA, 20 bp, Artificial Sequence
  chemically synthesized
ataataatttcaatcaacct

SEQ ID NO: 73925 - DNA, 20 bp, Artificial Sequence
  chemically synthesized
gggataaactaatttgaaga

SEQ ID NO: 73926 - DNA, 20 bp, Artificial Sequence
  chemically synthesized
cctccgataagccagaattc

SEQ ID NO: 73927 - DNA, 20 bp, Artificial Sequence
  chemically synthesized
aacaacccttgcctctttag

SEQ ID NO: 73928 - DNA, 20 bp, Artificial Sequence
  chemically synthesized
cgcacatcttatgtcttaga

SEQ ID NO: 73929 - DNA, 20 bp, Artificial Sequence
  chemically synthesized
atttttctaagatgaaacag

SEQ ID NO: 73930 - DNA, 20 bp, Artificial Sequence
  chemically synthesized
atctattactgcgctgaaac

SEQ ID NO: 73931 - DNA, 20 bp, Artificial Sequence
  chemically synthesized
tgaaactgtggctttataga

SEQ ID NO: 73932 - DNA, 20 bp, Artificial Sequence
  chemically synthesized
ccactgctaactgaaagaga

SEQ ID NO: 73933 - DNA, 20 bp, Artificial Sequence
  chemically synthesized
tgaacttttcaaaaattggt

SEQ ID NO: 73934 - DNA, 20 bp, Artificial Sequence
  chemically synthesized
tttcaaaaattggtacatgc

SEQ ID NO: 73935 - DNA, 20 bp, Artificial Sequence
  chemically synthesized
acccttcagcagttccacac

SEQ ID NO: 73936 - DNA, 20 bp, Artificial Sequence
  chemically synthesized
ctgtgcctggcaaaagtcca

SEQ ID NO: 73937 - DNA, 20 bp, Artificial Sequence
  chemically synthesized
gcaaaagtccaggtcgcttc

SEQ ID NO: 73938 - DNA, 20 bp, Artificial Sequence
  chemically synthesized
catggacccagaggttcttt

SEQ ID NO: 73939 - DNA, 20 bp, Artificial Sequence
  chemically synthesized
aacttcaaggtgagtccagg

SEQ ID NO: 73940 - DNA, 20 bp, Artificial Sequence
  chemically synthesized
tctgagcacagcagggtgtg

SEQ ID NO: 73941 - DNA, 20 bp, Artificial Sequence
  chemically synthesized
actgggctgagacccagtgg

SEQ ID NO: 73942 - DNA, 20 bp, Artificial Sequence
  chemically synthesized
gaggaaaatgacttttcttt

SEQ ID NO: 73943 - DNA, 20 bp, Artificial Sequence
  chemically synthesized
tttcatctttccctcatttt

SEQ ID NO: 73944 - DNA, 20 bp, Artificial Sequence
  chemically synthesized
ggacacatataaaatgctgc

SEQ ID NO: 73945 - DNA, 20 bp, Artificial Sequence
  chemically synthesized
aattgaaacatttgggctgg

SEQ ID NO: 73946 - DNA, 20 bp, Artificial Sequence
  chemically synthesized
gtgtgtgtgtgtgtgtcagc

SEQ ID NO: 73947 - DNA, 20 bp, Artificial Sequence
  chemically synthesized
ttcatggtggcaagaagata

SEQ ID NO: 73948 - DNA, 20 bp, Artificial Sequence
  chemically synthesized
tttaaattatggccagtgac

SEQ ID NO: 73949 - DNA, 20 bp, Artificial Sequence
  chemically synthesized
tttaatgggaaggcaaaatc

SEQ ID NO: 73950 - DNA, 20 bp, Artificial Sequence
  chemically synthesized
aggctttgagggaagttaac

SEQ ID NO: 73951 - DNA, 20 bp, Artificial Sequence
  chemically synthesized
tttgagggaagttaacatag

SEQ ID NO: 73952 - DNA, 20 bp, Artificial Sequence
  chemically synthesized
acataggcttgattctgggt

SEQ ID NO: 73953 - DNA, 20 bp, Artificial Sequence
  chemically synthesized
ctcctgggaaatgtgctggt

SEQ ID NO: 73954 - DNA, 20 bp, Artificial Sequence
  chemically synthesized
aaagaattcacccctgaggt

SEQ ID NO: 73955 - DNA, 20 bp, Artificial Sequence
  chemically synthesized
gataccactgagctcactgc

SEQ ID NO: 73956 - DNA, 20 bp, Artificial Sequence
  chemically synthesized
tgagctcactgcccatgatt

SEQ ID NO: 73957 - DNA, 20 bp, Artificial Sequence
  chemically synthesized
atgattcagagctttcaagg

SEQ ID NO: 73958 - DNA, 20 bp, Artificial Sequence
  chemically synthesized
ctattctgctgagagatcac

SEQ ID NO: 73959 - DNA, 20 bp, Artificial Sequence
  chemically synthesized
ttttaaatatatgagccaca

SEQ ID NO: 73960 - DNA, 20 bp, Artificial Sequence
  chemically synthesized
gtgtatgtgtatttctgcat

SEQ ID NO: 73961 - DNA, 20 bp, Artificial Sequence
  chemically synthesized
gtgtatttctgcatgcctgt

SEQ ID NO: 73962 - DNA, 20 bp, Artificial Sequence
  chemically synthesized
ggacaggacttctcagaaac

SEQ ID NO: 73963 - DNA, 20 bp, Artificial Sequence
  chemically synthesized
ggttcagtgaagacctgggg

SEQ ID NO: 73964 - DNA, 20 bp, Artificial Sequence
  chemically synthesized
cagtgaagacctgggggctg

SEQ ID NO: 73965 - DNA, 20 bp, Artificial Sequence
  chemically synthesized
cttaaggaagggaaagtgtt

SEQ ID NO: 73966 - DNA, 20 bp, Artificial Sequence
  chemically synthesized
tgttccaagctttaggaatt

SEQ ID NO: 73967 - DNA, 20 bp, Artificial Sequence
  chemically synthesized
gaatactatttctaatggca

SEQ ID NO: 73968 - DNA, 20 bp, Artificial Sequence
  chemically synthesized
taatcccatgccctcaagtg

SEQ ID NO: 73969 - DNA, 20 bp, Artificial Sequence
  chemically synthesized
aatttgtacaacattaattg

SEQ ID NO: 73970 - DNA, 20 bp, Artificial Sequence
  chemically synthesized
gttagtgcatctctataagt

SEQ ID NO: 73971 - DNA, 20 bp, Artificial Sequence
  chemically synthesized
atatgatggtgttacggacc

SEQ ID NO: 73972 - DNA, 20 bp, Artificial Sequence
  chemically synthesized
caactgaccttatctgtggg

SEQ ID NO: 73973 - DNA, 20 bp, Artificial Sequence
  chemically synthesized
gggaggcttttgaaaagtaa

SEQ ID NO: 73974 - DNA, 20 bp, Artificial Sequence
  chemically synthesized
agatgaagaaggagaaaaaa

SEQ ID NO: 73975 - DNA, 20 bp, Artificial Sequence
  chemically synthesized
agaaggagaaaaaaataagc

SEQ ID NO: 73976 - DNA, 20 bp, Artificial Sequence
  chemically synthesized
ggttttgagtggactacaga

SEQ ID NO: 73977 - DNA, 20 bp, Artificial Sequence
  chemically synthesized
gactacagaccatgtttatc

SEQ ID NO: 73978 - DNA, 20 bp, Artificial Sequence
  chemically synthesized
tgcaaagctcccctcgtccc

SEQ ID NO: 73979 - DNA, 20 bp, Artificial Sequence
  chemically synthesized
gcctgcgcccttctctctaa

SEQ ID NO: 73980 - DNA, 20 bp, Artificial Sequence
  chemically synthesized
tttctcctatttttacttca

SEQ ID NO: 73981 - DNA, 20 bp, Artificial Sequence
  chemically synthesized
cccacttcaaatgcagtcac

SEQ ID NO: 73982 - DNA, 20 bp, Artificial Sequence
  chemically synthesized
gaatatgcactttctttctt

SEQ ID NO: 73983 - DNA, 20 bp, Artificial Sequence
  chemically synthesized
cactttctttcttttttgtt

SEQ ID NO: 73984 - DNA, 20 bp, Artificial Sequence
  chemically synthesized
atttcttgatgatatgttaa

SEQ ID NO: 73985 - DNA, 20 bp, Artificial Sequence
  chemically synthesized
tgatgatatgttaaacaagt

SEQ ID NO: 73986 - DNA, 20 bp, Artificial Sequence
  chemically synthesized
ggggtacacgtacaggatat

SEQ ID NO: 73987 - DNA, 20 bp, Artificial Sequence
  chemically synthesized
tacacgtacaggatatgcag

SEQ ID NO: 73988 - DNA, 20 bp, Artificial Sequence
  chemically synthesized
ttttataggtaaaagtgtgc

SEQ ID NO: 73989 - DNA, 20 bp, Artificial Sequence
  chemically synthesized
aaaagtgtgccatggtttta

SEQ ID NO: 73990 - DNA, 20 bp, Artificial Sequence
  chemically synthesized
gggttttttttttcttgtaa

SEQ ID NO: 73991 - DNA, 20 bp, Artificial Sequence
  chemically synthesized
tttttttcttgtaaagttgt

SEQ ID NO: 73992 - DNA, 20 bp, Artificial Sequence
  chemically synthesized
cttgtaaagttgtttaagtt

SEQ ID NO: 73993 - DNA, 20 bp, Artificial Sequence
  chemically synthesized
tattaggcctttgtcagaag

SEQ ID NO: 73994 - DNA, 20 bp, Artificial Sequence
  chemically synthesized
ggaaaatctttttcccattc

SEQ ID NO: 73995 - DNA, 20 bp, Artificial Sequence
  chemically synthesized
agattgtctttcgctctgat

SEQ ID NO: 73996 - DNA, 20 bp, Artificial Sequence
  chemically synthesized
cttttgctgagcaggagctc

SEQ ID NO: 73997 - DNA, 20 bp, Artificial Sequence
  chemically synthesized
agcaggagctctttagttta

SEQ ID NO: 73998 - DNA, 20 bp, Artificial Sequence
  chemically synthesized
attagattccattggtcaat

SEQ ID NO: 73999 - DNA, 20 bp, Artificial Sequence
  chemically synthesized
tcaatttttgcttttgctgc

SEQ ID NO: 74000 - DNA, 20 bp, Artificial Sequence
  chemically synthesized
gcttttgctgcaattgcttt

SEQ ID NO: 74001 - DNA, 20 bp, Artificial Sequence
  chemically synthesized
tttcatcatgaaatctgtgc

SEQ ID NO: 74002 - DNA, 20 bp, Artificial Sequence
  chemically synthesized
ttatatcatgaatagtattg

SEQ ID NO: 74003 - DNA, 20 bp, Artificial Sequence
  chemically synthesized
agtattgccttgattttttt

SEQ ID NO: 74004 - DNA, 20 bp, Artificial Sequence
  chemically synthesized
tgatttttttctaggctttt

SEQ ID NO: 74005 - DNA, 20 bp, Artificial Sequence
  chemically synthesized
tttctaggctttttatagtt

SEQ ID NO: 74006 - DNA, 20 bp, Artificial Sequence
  chemically synthesized
gataaggtataaggaaggag

SEQ ID NO: 74007 - DNA, 20 bp, Artificial Sequence
  chemically synthesized
taaattgaaaatcctttccc

SEQ ID NO: 74008 - DNA, 20 bp, Artificial Sequence
  chemically synthesized
ttgaaaatcctttccccatt

SEQ ID NO: 74009 - DNA, 20 bp, Artificial Sequence
  chemically synthesized
ttccccattgcttgcttttg

SEQ ID NO: 74010 - DNA, 20 bp, Artificial Sequence
  chemically synthesized
agatggttgtaggtacaata

SEQ ID NO: 74011 - DNA, 20 bp, Artificial Sequence
  chemically synthesized
aatctgtctgtctagttcat

SEQ ID NO: 74012 - DNA, 20 bp, Artificial Sequence
  chemically synthesized
ggcagctgttcactggtacg

SEQ ID NO: 74013 - DNA, 20 bp, Artificial Sequence
  chemically synthesized
gaacagaaattcttttggga

SEQ ID NO: 74014 - DNA, 20 bp, Artificial Sequence
  chemically synthesized
ggccattaaaggacatgacc

SEQ ID NO: 74015 - DNA, 20 bp, Artificial Sequence
  chemically synthesized
gtccccacaactcaatataa

SEQ ID NO: 74016 - DNA, 20 bp, Artificial Sequence
  chemically synthesized
tctctgctcttaaagataat

SEQ ID NO: 74017 - DNA, 20 bp, Artificial Sequence
  chemically synthesized
ataatcttggttttgcctca

SEQ ID NO: 74018 - DNA, 20 bp, Artificial Sequence
  chemically synthesized
tgtgtctctaatatcagaaa

SEQ ID NO: 74019 - DNA, 20 bp, Artificial Sequence
  chemically synthesized
agaaattcagctttaatata

SEQ ID NO: 74020 - DNA, 20 bp, Artificial Sequence
  chemically synthesized
tctccttgaaatacacatgg

SEQ ID NO: 74021 - DNA, 20 bp, Artificial Sequence
  chemically synthesized
ttcctaaactttatttcttg

SEQ ID NO: 74022 - DNA, 20 bp, Artificial Sequence
  chemically synthesized
tgtgccctgtctattcctga

SEQ ID NO: 74023 - DNA, 20 bp, Artificial Sequence
  chemically synthesized
ccctgtctattcctgaaatt

SEQ ID NO: 74024 - DNA, 20 bp, Artificial Sequence
  chemically synthesized
tgtcagtgaagaatgtcttt

SEQ ID NO: 74025 - DNA, 20 bp, Artificial Sequence
  chemically synthesized
ggccacggaatctcctatcc

SEQ ID NO: 74026 - DNA, 20 bp, Artificial Sequence
  chemically synthesized
tggcataattttgtagatat

SEQ ID NO: 74027 - DNA, 20 bp, Artificial Sequence
  chemically synthesized
atttgacatggactattgtt

SEQ ID NO: 74028 - DNA, 20 bp, Artificial Sequence
  chemically synthesized
gataagtacactgactacta

SEQ ID NO: 74029 - DNA, 20 bp, Artificial Sequence
  chemically synthesized
taaaaaacacagtaataaaa

SEQ ID NO: 74030 - DNA, 20 bp, Artificial Sequence
  chemically synthesized
cccagttttccccttacttc

SEQ ID NO: 74031 - DNA, 20 bp, Artificial Sequence
  chemically synthesized
gttttccccttacttcccta

SEQ ID NO: 74032 - DNA, 20 bp, Artificial Sequence
  chemically synthesized
cttccctagtttgtttctta

SEQ ID NO: 74033 - DNA, 20 bp, Artificial Sequence
  chemically synthesized
tccaagttgatgctggatag

SEQ ID NO: 74034 - DNA, 20 bp, Artificial Sequence
  chemically synthesized
aatggcgtgaacctgggagg

SEQ ID NO: 74035 - DNA, 20 bp, Artificial Sequence
  chemically synthesized
aattgaaaaccaagaaaggc

SEQ ID NO: 74036 - DNA, 20 bp, Artificial Sequence
  chemically synthesized
gaaaatggaggggaaggaag

SEQ ID NO: 74037 - DNA, 20 bp, Artificial Sequence
  chemically synthesized
aagttcccctgagaaggcca

SEQ ID NO: 74038 - DNA, 20 bp, Artificial Sequence
  chemically synthesized
gtcacaacccacccttgacc

SEQ ID NO: 74039 - DNA, 20 bp, Artificial Sequence
  chemically synthesized
agggaggcaaagggctggtc

SEQ ID NO: 74040 - DNA, 20 bp, Artificial Sequence
  chemically synthesized
cacatgaagcagcaatgcag

SEQ ID NO: 74041 - DNA, 20 bp, Artificial Sequence
  chemically synthesized
ttaaggtgagaaggctggag

SEQ ID NO: 74042 - DNA, 20 bp, Artificial Sequence
  chemically synthesized
acaaggtgcagaaaggcaga

SEQ ID NO: 74043 - DNA, 20 bp, Artificial Sequence
  chemically synthesized
ggcagaaagtgtttctgaaa

SEQ ID NO: 74044 - DNA, 20 bp, Artificial Sequence
  chemically synthesized
agtctgactttgcacctgct

SEQ ID NO: 74045 - DNA, 20 bp, Artificial Sequence
  chemically synthesized
catggacctagaggtacttt

SEQ ID NO: 74046 - DNA, 20 bp, Artificial Sequence
  chemically synthesized
ctggtgagtagtaagtacac

SEQ ID NO: 74047 - DNA, 20 bp, Artificial Sequence
  chemically synthesized
tgggtacttttgaaagcaga

SEQ ID NO: 74048 - DNA, 20 bp, Artificial Sequence
  chemically synthesized
tgggatatgatatttcagca

SEQ ID NO: 74049 - DNA, 20 bp, Artificial Sequence
  chemically synthesized
attctggccaaaatcaaact

SEQ ID NO: 74050 - DNA, 20 bp, Artificial Sequence
  chemically synthesized
gtagtgggaagctgttaaaa

SEQ ID NO: 74051 - DNA, 20 bp, Artificial Sequence
  chemically synthesized
tgggaagctgttaaaaagag

SEQ ID NO: 74052 - DNA, 20 bp, Artificial Sequence
  chemically synthesized
tatacttttgtacgcatggt

SEQ ID NO: 74053 - DNA, 20 bp, Artificial Sequence
  chemically synthesized
ggtacaggattctttgttat

SEQ ID NO: 74054 - DNA, 20 bp, Artificial Sequence
  chemically synthesized
ttatatctatttactgcaag

SEQ ID NO: 74055 - DNA, 20 bp, Artificial Sequence
  chemically synthesized
ccagctcttaggcaacgtga

SEQ ID NO: 74056 - DNA, 20 bp, Artificial Sequence
  chemically synthesized
ctcttaggcaacgtgatatt

SEQ ID NO: 74057 - DNA, 20 bp, Artificial Sequence
  chemically synthesized
gttttggcaacccacttcag

SEQ ID NO: 74058 - DNA, 20 bp, Artificial Sequence
  chemically synthesized
gaggattttaccctacagat

SEQ ID NO: 74059 - DNA, 20 bp, Artificial Sequence
  chemically synthesized
accactgagttccctgtcca

SEQ ID NO: 74060 - DNA, 20 bp, Artificial Sequence
  chemically synthesized
atgtttgtacctatggtcca

SEQ ID NO: 74061 - DNA, 20 bp, Artificial Sequence
  chemically synthesized
gagaagagcagtatcctgcc

SEQ ID NO: 74062 - DNA, 20 bp, Artificial Sequence
  chemically synthesized
ttttctgtctttatatttta

SEQ ID NO: 74063 - DNA, 20 bp, Artificial Sequence
  chemically synthesized
aaatgagaatgttggagaat

SEQ ID NO: 74064 - DNA, 20 bp, Artificial Sequence
  chemically synthesized
aagaaaagagagaactcgtg

SEQ ID NO: 74065 - DNA, 20 bp, Artificial Sequence
  chemically synthesized
aaatcgtctctagaataaga

SEQ ID NO: 74066 - DNA, 20 bp, Artificial Sequence
  chemically synthesized
aggtactctttggaggtgta

SEQ ID NO: 74067 - DNA, 20 bp, Artificial Sequence
  chemically synthesized
tatttataatgaagtgggga

SEQ ID NO: 74068 - DNA, 20 bp, Artificial Sequence
  chemically synthesized
aaggcatgtgaactggctgt

SEQ ID NO: 74069 - DNA, 20 bp, Artificial Sequence
  chemically synthesized
ttccattaagctgtgcatat

SEQ ID NO: 74070 - DNA, 20 bp, Artificial Sequence
  chemically synthesized
ttatcatatgtattttcctt

SEQ ID NO: 74071 - DNA, 20 bp, Artificial Sequence
  chemically synthesized
ataaatctctttgttcagct

SEQ ID NO: 74072 - DNA, 20 bp, Artificial Sequence
  chemically synthesized
ctctgtttctataaatatgt

SEQ ID NO: 74073 - DNA, 20 bp, Artificial Sequence
  chemically synthesized
ctataaatatgtacaagttt

SEQ ID NO: 74074 - DNA, 20 bp, Artificial Sequence
  chemically synthesized
agttttattgtttttagtgg

SEQ ID NO: 74075 - DNA, 20 bp, Artificial Sequence
  chemically synthesized
tagcaatcaatattgaaaac

SEQ ID NO: 74076 - DNA, 20 bp, Artificial Sequence
  chemically synthesized
caatattgaaaaccactgat

SEQ ID NO: 74077 - DNA, 20 bp, Artificial Sequence
  chemically synthesized
ttttgtttatgtgagcaaac

SEQ ID NO: 74078 - DNA, 20 bp, Artificial Sequence
  chemically synthesized
gcaaacagcagattaaaagg

SEQ ID NO: 74079 - DNA, 20 bp, Artificial Sequence
  chemically synthesized
gatgaagtaagaaaaatagc

SEQ ID NO: 74080 - DNA, 20 bp, Artificial Sequence
  chemically synthesized
tcgttttgagcaaaaatcac

SEQ ID NO: 74081 - DNA, 20 bp, Artificial Sequence
  chemically synthesized
ataaatagggaaacgtagaa

SEQ ID NO: 74082 - DNA, 20 bp, Artificial Sequence
  chemically synthesized
acatgtatatatatatatag

SEQ ID NO: 74083 - DNA, 20 bp, Artificial Sequence
  chemically synthesized
tctaacttgggtatagtcag

SEQ ID NO: 74084 - DNA, 20 bp, Artificial Sequence
  chemically synthesized
cgagtaagagaccattgtgg

SEQ ID NO: 74085 - DNA, 20 bp, Artificial Sequence
  chemically synthesized
acagcaaatgcctacaagcc

SEQ ID NO: 74086 - DNA, 20 bp, Artificial Sequence
  chemically synthesized
aaacctaaaacctcaaagaa

SEQ ID NO: 74087 - DNA, 20 bp, Artificial Sequence
  chemically synthesized
agatataataccctttcttc

SEQ ID NO: 74088 - DNA, 20 bp, Artificial Sequence
  chemically synthesized
gataggcggtgctaccatct

SEQ ID NO: 74089 - DNA, 20 bp, Artificial Sequence
  chemically synthesized
ttattgttcatttctcgatg

SEQ ID NO: 74090 - DNA, 20 bp, Artificial Sequence
  chemically synthesized
accaaactgacatgtagcat

SEQ ID NO: 74091 - DNA, 20 bp, Artificial Sequence
  chemically synthesized
accccagtcaatctagagaa

SEQ ID NO: 74092 - DNA, 20 bp, Artificial Sequence
  chemically synthesized
ggatttctgcatttgactct

SEQ ID NO: 74093 - DNA, 20 bp, Artificial Sequence
  chemically synthesized
ctatttttttttaattttaa

SEQ ID NO: 74094 - DNA, 20 bp, Artificial Sequence
  chemically synthesized
gggctctttcttataatatt

SEQ ID NO: 74095 - DNA, 20 bp, Artificial Sequence
  chemically synthesized
ctagtatttggagatgaaaa

SEQ ID NO: 74096 - DNA, 20 bp, Artificial Sequence
  chemically synthesized
gagtattacactatccatag

SEQ ID NO: 74097 - DNA, 20 bp, Artificial Sequence
  chemically synthesized
attacactatccatagagaa

SEQ ID NO: 74098 - DNA, 20 bp, Artificial Sequence
  chemically synthesized
gttccttcctctgcctctgc

SEQ ID NO: 74099 - DNA, 20 bp, Artificial Sequence
  chemically synthesized
cttcctctgcctctgctata

SEQ ID NO: 74100 - DNA, 20 bp, Artificial Sequence
  chemically synthesized
aataagacatagtatcagaa

SEQ ID NO: 74101 - DNA, 20 bp, Artificial Sequence
  chemically synthesized
cctagaagggcagaaggaga

SEQ ID NO: 74102 - DNA, 20 bp, Artificial Sequence
  chemically synthesized
gagcccataaccagaggtcc

SEQ ID NO: 74103 - DNA, 20 bp, Artificial Sequence
  chemically synthesized
gagagagagaccagaaataa

SEQ ID NO: 74104 - DNA, 20 bp, Artificial Sequence
  chemically synthesized
gagaccagaaataatcttgc

SEQ ID NO: 74105 - DNA, 20 bp, Artificial Sequence
  chemically synthesized
tgcttatgctttccctcagc

SEQ ID NO: 74106 - DNA, 20 bp, Artificial Sequence
  chemically synthesized
aaatgaataattacagtgtg

SEQ ID NO: 74107 - DNA, 20 bp, Artificial Sequence
  chemically synthesized
acagtgtgcagtgattattg

SEQ ID NO: 74108 - DNA, 20 bp, Artificial Sequence
  chemically synthesized
agaattcaaacagcagtgaa

SEQ ID NO: 74109 - DNA, 20 bp, Artificial Sequence
  chemically synthesized
aacatctgcctcccaggttc

SEQ ID NO: 74110 - DNA, 20 bp, Artificial Sequence
  chemically synthesized
ttttctatttttagtagata

SEQ ID NO: 74111 - DNA, 20 bp, Artificial Sequence
  chemically synthesized
ctttcaccctaccttttcct

SEQ ID NO: 74112 - DNA, 20 bp, Artificial Sequence
  chemically synthesized
ccctaccttttcctttttgt

SEQ ID NO: 74113 - DNA, 20 bp, Artificial Sequence
  chemically synthesized
atactgagttctaaaatcat

SEQ ID NO: 74114 - DNA, 20 bp, Artificial Sequence
  chemically synthesized
atgtcttacttcatacttcc

SEQ ID NO: 74115 - DNA, 20 bp, Artificial Sequence
  chemically synthesized
aactttgtattcatcacact

SEQ ID NO: 74116 - DNA, 20 bp, Artificial Sequence
  chemically synthesized
tgtataatcccaattcccaa

SEQ ID NO: 74117 - DNA, 20 bp, Artificial Sequence
  chemically synthesized
cccatatatcaaacaatgta

SEQ ID NO: 74118 - DNA, 20 bp, Artificial Sequence
  chemically synthesized
tatttcacttgttatactaa

SEQ ID NO: 74119 - DNA, 20 bp, Artificial Sequence
  chemically synthesized
tactaaaactgtttctcttc

SEQ ID NO: 74120 - DNA, 20 bp, Artificial Sequence
  chemically synthesized
acttgcccattcaccaaggt

SEQ ID NO: 74121 - DNA, 20 bp, Artificial Sequence
  chemically synthesized
ttccctacctctaatcaaca

SEQ ID NO: 74122 - DNA, 20 bp, Artificial Sequence
  chemically synthesized
acctctaatcaacagttcga

SEQ ID NO: 74123 - DNA, 20 bp, Artificial Sequence
  chemically synthesized
ttactgcccagtcaggtcct

SEQ ID NO: 74124 - DNA, 20 bp, Artificial Sequence
  chemically synthesized
tcctggctggatgcggtggc

SEQ ID NO: 74125 - DNA, 20 bp, Artificial Sequence
  chemically synthesized
tcaggtggctgaggcaggag

SEQ ID NO: 74126 - DNA, 20 bp, Artificial Sequence
  chemically synthesized
gaggcagaggttgcggtgag

SEQ ID NO: 74127 - DNA, 20 bp, Artificial Sequence
  chemically synthesized
cctagattgcaccattgcac

SEQ ID NO: 74128 - DNA, 20 bp, Artificial Sequence
  chemically synthesized
tcctccctcacaaacacatt

SEQ ID NO: 74129 - DNA, 20 bp, Artificial Sequence
  chemically synthesized
tcatttttaacaggtagtgg

SEQ ID NO: 74130 - DNA, 20 bp, Artificial Sequence
  chemically synthesized
caatgtatccaagactgtat

SEQ ID NO: 74131 - DNA, 20 bp, Artificial Sequence
  chemically synthesized
tgaattattcaatatctttc

SEQ ID NO: 74132 - DNA, 20 bp, Artificial Sequence
  chemically synthesized
tacagaaaaataacttgtaa

SEQ ID NO: 74133 - DNA, 20 bp, Artificial Sequence
  chemically synthesized
tctatatacaaataaagtca

SEQ ID NO: 74134 - DNA, 20 bp, Artificial Sequence
  chemically synthesized
atcgctacgtgttaagcagt

SEQ ID NO: 74135 - DNA, 20 bp, Artificial Sequence
  chemically synthesized
tggtaagcatttaagtggct

SEQ ID NO: 74136 - DNA, 20 bp, Artificial Sequence
  chemically synthesized
catttaagtggctaccggtt

SEQ ID NO: 74137 - DNA, 20 bp, Artificial Sequence
  chemically synthesized
tggctaccggtttgaggttt

SEQ ID NO: 74138 - DNA, 20 bp, Artificial Sequence
  chemically synthesized
gtctttggatacacacatgc

SEQ ID NO: 74139 - DNA, 20 bp, Artificial Sequence
  chemically synthesized
cagcatttgtggatactatt

SEQ ID NO: 74140 - DNA, 20 bp, Artificial Sequence
  chemically synthesized
ctattgtacagtgtcaccaa

SEQ ID NO: 74141 - DNA, 20 bp, Artificial Sequence
  chemically synthesized
tacagtgtcaccaacagagt

SEQ ID NO: 74142 - DNA, 20 bp, Artificial Sequence
  chemically synthesized
ttttccttcccttcccctct

SEQ ID NO: 74143 - DNA, 20 bp, Artificial Sequence
  chemically synthesized
tcaaaatatttgtatataat

SEQ ID NO: 74144 - DNA, 20 bp, Artificial Sequence
  chemically synthesized
taaaatgttaaccttaaaat

SEQ ID NO: 74145 - DNA, 20 bp, Artificial Sequence
  chemically synthesized
atttcaatataataaaaaat

SEQ ID NO: 74146 - DNA, 20 bp, Artificial Sequence
  chemically synthesized
ccaaaagaaggaggaagcaa

SEQ ID NO: 74147 - DNA, 20 bp, Artificial Sequence
  chemically synthesized
aagcaagtttaaactgcagc

SEQ ID NO: 74148 - DNA, 20 bp, Artificial Sequence
  chemically synthesized
ttgagtcaacttgttaaaac

SEQ ID NO: 74149 - DNA, 20 bp, Artificial Sequence
  chemically synthesized
gttaaaacatctgcttttag

SEQ ID NO: 74150 - DNA, 20 bp, Artificial Sequence
  chemically synthesized
gggagatatgtagaggagaa

SEQ ID NO: 74151 - DNA, 20 bp, Artificial Sequence
  chemically synthesized
attctcacaaactaatgaaa

SEQ ID NO: 74152 - DNA, 20 bp, Artificial Sequence
  chemically synthesized
aaaggcagggcagagtcgac

SEQ ID NO: 74153 - DNA, 20 bp, Artificial Sequence
  chemically synthesized
tgtgtagacagagaagactc

SEQ ID NO: 74154 - DNA, 20 bp, Artificial Sequence
  chemically synthesized
cactgactctctgtcccttg

SEQ ID NO: 74155 - DNA, 20 bp, Artificial Sequence
  chemically synthesized
ccttgggctgttttcctacc

SEQ ID NO: 74156 - DNA, 20 bp, Artificial Sequence
  chemically synthesized
aacttcagggtgagtccagg

SEQ ID NO: 74157 - DNA, 20 bp, Artificial Sequence
  chemically synthesized
ttttactatattttatcatt

SEQ ID NO: 74158 - DNA, 20 bp, Artificial Sequence
  chemically synthesized
caaagatgagaggcatagaa

SEQ ID NO: 74159 - DNA, 20 bp, Artificial Sequence
  chemically synthesized
gaatggaaaggaaagtgaat

SEQ ID NO: 74160 - DNA, 20 bp, Artificial Sequence
  chemically synthesized
taggagacagcccatcatca

SEQ ID NO: 74161 - DNA, 20 bp, Artificial Sequence
  chemically synthesized
caattaatttgtatctatta

SEQ ID NO: 74162 - DNA, 20 bp, Artificial Sequence
  chemically synthesized
ctgatgggaataacctgggg

SEQ ID NO: 74163 - DNA, 20 bp, Artificial Sequence
  chemically synthesized
aacctggggatcagttttgt

SEQ ID NO: 74164 - DNA, 20 bp, Artificial Sequence
  chemically synthesized
cagaaaaaaatgggtgttgg

SEQ ID NO: 74165 - DNA, 20 bp, Artificial Sequence
  chemically synthesized
caagtaccattgagatcctg

SEQ ID NO: 74166 - DNA, 20 bp, Artificial Sequence
  chemically synthesized
ccataagaagaccctatttc

SEQ ID NO: 74167 - DNA, 20 bp, Artificial Sequence
  chemically synthesized
cacaatgcctacttcaaggg

SEQ ID NO: 74168 - DNA, 20 bp, Artificial Sequence
  chemically synthesized
aaagaatgttcagctcaact

SEQ ID NO: 74169 - DNA, 20 bp, Artificial Sequence
  chemically synthesized
aggctctacagatagggagc

SEQ ID NO: 74170 - DNA, 20 bp, Artificial Sequence
  chemically synthesized
acatagcctcaagggtaatg

SEQ ID NO: 74171 - DNA, 20 bp, Artificial Sequence
  chemically synthesized
aatgtgctcaattaaaggca

SEQ ID NO: 74172 - DNA, 20 bp, Artificial Sequence
  chemically synthesized
caagtgttcctgctccaaga

SEQ ID NO: 74173 - DNA, 20 bp, Artificial Sequence
  chemically synthesized
cttatcttcccatatttcag

SEQ ID NO: 74174 - DNA, 20 bp, Artificial Sequence
  chemically synthesized
ttcatgcacacacacacact

SEQ ID NO: 74175 - DNA, 20 bp, Artificial Sequence
  chemically synthesized
gagtaaatgagtaaatgaag

SEQ ID NO: 74176 - DNA, 20 bp, Artificial Sequence
  chemically synthesized
taaatgaaggaatgattatt

SEQ ID NO: 74177 - DNA, 20 bp, Artificial Sequence
  chemically synthesized
atattaataataccatcgca

SEQ ID NO: 74178 - DNA, 20 bp, Artificial Sequence
  chemically synthesized
ttttgccataggtaaaatta

SEQ ID NO: 74179 - DNA, 20 bp, Artificial Sequence
  chemically synthesized
aaaaatctgtattatatgca

SEQ ID NO: 74180 - DNA, 20 bp, Artificial Sequence
  chemically synthesized
ttgaatacctaaacagaatc

SEQ ID NO: 74181 - DNA, 20 bp, Artificial Sequence
  chemically synthesized
aaacagaatctgttgtttcc

SEQ ID NO: 74182 - DNA, 20 bp, Artificial Sequence
  chemically synthesized
tgttgtttccttgtgtttga

SEQ ID NO: 74183 - DNA, 20 bp, Artificial Sequence
  chemically synthesized
actgacaatgtgttatagtt

SEQ ID NO: 74184 - DNA, 20 bp, Artificial Sequence
  chemically synthesized
gcagaagctcttttatatcc

SEQ ID NO: 74185 - DNA, 20 bp, Artificial Sequence
  chemically synthesized
gaataagatatttaggaacc

SEQ ID NO: 74186 - DNA, 20 bp, Artificial Sequence
  chemically synthesized
tggtattcgaaagacagtaa

SEQ ID NO: 74187 - DNA, 20 bp, Artificial Sequence
  chemically synthesized
agtcaaaaaaaaagagcaaa

SEQ ID NO: 74188 - DNA, 20 bp, Artificial Sequence
  chemically synthesized
attaaaattatttgttagag

SEQ ID NO: 74189 - DNA, 20 bp, Artificial Sequence
  chemically synthesized
ataggaatggaattaattcc

SEQ ID NO: 74190 - DNA, 20 bp, Artificial Sequence
  chemically synthesized
atggaattaattcctcaaga

SEQ ID NO: 74191 - DNA, 20 bp, Artificial Sequence
  chemically synthesized
tatttgataatttatcaaat

SEQ ID NO: 74192 - DNA, 20 bp, Artificial Sequence
  chemically synthesized
tttttcttttctcactatgg

SEQ ID NO: 74193 - DNA, 20 bp, Artificial Sequence
  chemically synthesized
tctcctaaatcatccatctc

SEQ ID NO: 74194 - DNA, 20 bp, Artificial Sequence
  chemically synthesized
agtcctctgaattaatgcct

SEQ ID NO: 74195 - DNA, 20 bp, Artificial Sequence
  chemically synthesized
aaagggtgttcagactgaag

SEQ ID NO: 74196 - DNA, 20 bp, Artificial Sequence
  chemically synthesized
agttctgtctatgttgactt

SEQ ID NO: 74197 - DNA, 20 bp, Artificial Sequence
  chemically synthesized
tccaaactattttgtgtgtg

SEQ ID NO: 74198 - DNA, 20 bp, Artificial Sequence
  chemically synthesized
aactattttgtgtgtgtgcg

SEQ ID NO: 74199 - DNA, 20 bp, Artificial Sequence
  chemically synthesized
tgcggtttgtttctatgggt

SEQ ID NO: 74200 - DNA, 20 bp, Artificial Sequence
  chemically synthesized
taattctgagagctgctgag

SEQ ID NO: 74201 - DNA, 20 bp, Artificial Sequence
  chemically synthesized
gctgctgagttgtgtttact

SEQ ID NO: 74202 - DNA, 20 bp, Artificial Sequence
  chemically synthesized
gtctgtagcaagtagctaga

SEQ ID NO: 74203 - DNA, 20 bp, Artificial Sequence
  chemically synthesized
cttgacctaggaacatatac

SEQ ID NO: 74204 - DNA, 20 bp, Artificial Sequence
  chemically synthesized
ataaaaatactctagtcaag

SEQ ID NO: 74205 - DNA, 20 bp, Artificial Sequence
  chemically synthesized
cacactcccatagatgagtg

SEQ ID NO: 74206 - DNA, 20 bp, Artificial Sequence
  chemically synthesized
tataaaacattaggacttaa

SEQ ID NO: 74207 - DNA, 20 bp, Artificial Sequence
  chemically synthesized
tcacaatagtgaagatgtca

SEQ ID NO: 74208 - DNA, 20 bp, Artificial Sequence
  chemically synthesized
tgaagatgtcagtaagcttg

SEQ ID NO: 74209 - DNA, 20 bp, Artificial Sequence
  chemically synthesized
agtttttcaggaactttgaa

SEQ ID NO: 74210 - DNA, 20 bp, Artificial Sequence
  chemically synthesized
tcaggaactttgaatgctga

SEQ ID NO: 74211 - DNA, 20 bp, Artificial Sequence
  chemically synthesized
ataaccaaatttgcactatt

SEQ ID NO: 74212 - DNA, 20 bp, Artificial Sequence
  chemically synthesized
aacttatttgcctggtatgc

SEQ ID NO: 74213 - DNA, 20 bp, Artificial Sequence
  chemically synthesized
tgggcttttgatggtcttag

SEQ ID NO: 74214 - DNA, 20 bp, Artificial Sequence
  chemically synthesized
aaggtgacaatttctgccaa

SEQ ID NO: 74215 - DNA, 20 bp, Artificial Sequence
  chemically synthesized
gccaatcaggatttcaaagc

SEQ ID NO: 74216 - DNA, 20 bp, Artificial Sequence
  chemically synthesized
aaatctaaaacaatgctaat

SEQ ID NO: 74217 - DNA, 20 bp, Artificial Sequence
  chemically synthesized
ctaacagccaagtcaaatct

SEQ ID NO: 74218 - DNA, 20 bp, Artificial Sequence
  chemically synthesized
tattttaaagacgtcttttc

SEQ ID NO: 74219 - DNA, 20 bp, Artificial Sequence
  chemically synthesized
tacacgtgtgcctagatcct

SEQ ID NO: 74220 - DNA, 20 bp, Artificial Sequence
  chemically synthesized
tgtgcctagatcctcattgc

SEQ ID NO: 74221 - DNA, 20 bp, Artificial Sequence
  chemically synthesized
cgtgtgtgagaataatcaga

SEQ ID NO: 74222 - DNA, 20 bp, Artificial Sequence
  chemically synthesized
tgataactagaaatagagga

SEQ ID NO: 74223 - DNA, 20 bp, Artificial Sequence
  chemically synthesized
acctaaattttatttcattt

SEQ ID NO: 74224 - DNA, 20 bp, Artificial Sequence
  chemically synthesized
tttattttattttgtgtaat

SEQ ID NO: 74225 - DNA, 20 bp, Artificial Sequence
  chemically synthesized
actttccttactaaaccgac

SEQ ID NO: 74226 - DNA, 20 bp, Artificial Sequence
  chemically synthesized
acatgggtttccaggtaggg

SEQ ID NO: 74227 - DNA, 20 bp, Artificial Sequence
  chemically synthesized
agaccctacgctgacctcat

SEQ ID NO: 74228 - DNA, 20 bp, Artificial Sequence
  chemically synthesized
tcataaatgcttgctacctt

SEQ ID NO: 74229 - DNA, 20 bp, Artificial Sequence
  chemically synthesized
gaagcagaactctgcacttc

SEQ ID NO: 74230 - DNA, 20 bp, Artificial Sequence
  chemically synthesized
gaagagtaaattttagtaaa

SEQ ID NO: 74231 - DNA, 20 bp, Artificial Sequence
  chemically synthesized
aataggaacttgaatcaagg

SEQ ID NO: 74232 - DNA, 20 bp, Artificial Sequence
  chemically synthesized
acccctactttctaagtcac

SEQ ID NO: 74233 - DNA, 20 bp, Artificial Sequence
  chemically synthesized
tttgttcccccagacactct

SEQ ID NO: 74234 - DNA, 20 bp, Artificial Sequence
  chemically synthesized
gttaacctcctatttgacac

SEQ ID NO: 74235 - DNA, 20 bp, Artificial Sequence
  chemically synthesized
tttgactgcattaagaggtc

SEQ ID NO: 74236 - DNA, 20 bp, Artificial Sequence
  chemically synthesized
gaggtctctagttttttatc

SEQ ID NO: 74237 - DNA, 20 bp, Artificial Sequence
  chemically synthesized
agtaactaatgcacagagca

SEQ ID NO: 74238 - DNA, 20 bp, Artificial Sequence
  chemically synthesized
tattttttcttttcttacca

SEQ ID NO: 74239 - DNA, 20 bp, Artificial Sequence
  chemically synthesized
ttaatccaaataaggagaag

SEQ ID NO: 74240 - DNA, 20 bp, Artificial Sequence
  chemically synthesized
agatatgcttagaaccgagg

SEQ ID NO: 74241 - DNA, 20 bp, Artificial Sequence
  chemically synthesized
aattgggaaaacgatcttca

SEQ ID NO: 74242 - DNA, 20 bp, Artificial Sequence
  chemically synthesized
tcttcaatatgcttaccaag

SEQ ID NO: 74243 - DNA, 20 bp, Artificial Sequence
  chemically synthesized
gtaaatacacttgcaaagga

SEQ ID NO: 74244 - DNA, 20 bp, Artificial Sequence
  chemically synthesized
tatatcttagagggagggct

SEQ ID NO: 74245 - DNA, 20 bp, Artificial Sequence
  chemically synthesized
aaagtcagggcagagccatc

SEQ ID NO: 74246 - DNA, 20 bp, Artificial Sequence
  chemically synthesized
cagagccatctattgcttac

SEQ ID NO: 74247 - DNA, 20 bp, Artificial Sequence
  chemically synthesized
gttggtatcaaggttacaag

SEQ ID NO: 74248 - DNA, 20 bp, Artificial Sequence
  chemically synthesized
tgtggagacagagaagactc

SEQ ID NO: 74249 - DNA, 20 bp, Artificial Sequence
  chemically synthesized
aacttcagggtgagtctatg

SEQ ID NO: 74250 - DNA, 20 bp, Artificial Sequence
  chemically synthesized
gggtgagtctatgggacgct

SEQ ID NO: 74251 - DNA, 20 bp, Artificial Sequence
  chemically synthesized
gaaggggataagtaacaggg

SEQ ID NO: 74252 - DNA, 20 bp, Artificial Sequence
  chemically synthesized
gtttagaatgggaaacagac

SEQ ID NO: 74253 - DNA, 20 bp, Artificial Sequence
  chemically synthesized
catcagtgtggaagtctcag

SEQ ID NO: 74254 - DNA, 20 bp, Artificial Sequence
  chemically synthesized
tgtggaagtctcaggatcgt

SEQ ID NO: 74255 - DNA, 20 bp, Artificial Sequence
  chemically synthesized
ttttatttgctgttcataac

SEQ ID NO: 74256 - DNA, 20 bp, Artificial Sequence
  chemically synthesized
tgttcataacaattgttttc

SEQ ID NO: 74257 - DNA, 20 bp, Artificial Sequence
  chemically synthesized
attgttttcttttgtttaat

SEQ ID NO: 74258 - DNA, 20 bp, Artificial Sequence
  chemically synthesized
cattactatttggaatatat

SEQ ID NO: 74259 - DNA, 20 bp, Artificial Sequence
  chemically synthesized
catatttatgggttaaagtg

SEQ ID NO: 74260 - DNA, 20 bp, Artificial Sequence
  chemically synthesized
tttgcatttgtaattttaaa

SEQ ID NO: 74261 - DNA, 20 bp, Artificial Sequence
  chemically synthesized
tttcttcttttaatatactt

SEQ ID NO: 74262 - DNA, 20 bp, Artificial Sequence
  chemically synthesized
tataaattgtaactgatgta

SEQ ID NO: 74263 - DNA, 20 bp, Artificial Sequence
  chemically synthesized
cagctacaatccagctacca

SEQ ID NO: 74264 - DNA, 20 bp, Artificial Sequence
  chemically synthesized
tattttatggttgggataag

SEQ ID NO: 74265 - DNA, 20 bp, Artificial Sequence
  chemically synthesized
tggcccacaagtatcactaa

SEQ ID NO: 74266 - DNA, 20 bp, Artificial Sequence
  chemically synthesized
attatgaagggccttgagca

SEQ ID NO: 74267 - DNA, 20 bp, Artificial Sequence
  chemically synthesized
tgccttattcatccctcaga

SEQ ID NO: 74268 - DNA, 20 bp, Artificial Sequence
  chemically synthesized
cctcagaaaaggattcaagt

SEQ ID NO: 74269 - DNA, 20 bp, Artificial Sequence
  chemically synthesized
agaaaaggattcaagtagag

SEQ ID NO: 74270 - DNA, 20 bp, Artificial Sequence
  chemically synthesized
tagaggcttgatttggaggt

SEQ ID NO: 74271 - DNA, 20 bp, Artificial Sequence
  chemically synthesized
atgctgtattttacattact

SEQ ID NO: 74272 - DNA, 20 bp, Artificial Sequence
  chemically synthesized
tgaatgtcttttcactaccc

SEQ ID NO: 74273 - DNA, 20 bp, Artificial Sequence
  chemically synthesized
gccttgactccactcagttc

SEQ ID NO: 74274 - DNA, 20 bp, Artificial Sequence
  chemically synthesized
tttcccctgaagtgttcctt

SEQ ID NO: 74275 - DNA, 20 bp, Artificial Sequence
  chemically synthesized
ccttccatgttttacggcga

SEQ ID NO: 74276 - DNA, 20 bp, Artificial Sequence
  chemically synthesized
gaagaaggaaaaacaggggt

SEQ ID NO: 74277 - DNA, 20 bp, Artificial Sequence
  chemically synthesized
ggaactatcactctttcaca

SEQ ID NO: 74278 - DNA, 20 bp, Artificial Sequence
  chemically synthesized
cacagtctgctttggaagga

SEQ ID NO: 74279 - DNA, 20 bp, Artificial Sequence
  chemically synthesized
ggactgagaagaatttgaaa

SEQ ID NO: 74280 - DNA, 20 bp, Artificial Sequence
  chemically synthesized
gaatttgaaaggcggctttt

SEQ ID NO: 74281 - DNA, 20 bp, Artificial Sequence
  chemically synthesized
ggaagtcccattcttcctca

SEQ ID NO: 74282 - DNA, 20 bp, Artificial Sequence
  chemically synthesized
cccattcttcctcaggatgt

SEQ ID NO: 74283 - DNA, 20 bp, Artificial Sequence
  chemically synthesized
ctcccttatcatgtccctta

SEQ ID NO: 74284 - DNA, 20 bp, Artificial Sequence
  chemically synthesized
caatacctaggtaggtagat

SEQ ID NO: 74285 - DNA, 20 bp, Artificial Sequence
  chemically synthesized
tcaaattctgaatctagttg

SEQ ID NO: 74286 - DNA, 20 bp, Artificial Sequence
  chemically synthesized
aattctaatattcacgttgc

SEQ ID NO: 74287 - DNA, 20 bp, Artificial Sequence
  chemically synthesized
ccaaaatatataagaaacac

SEQ ID NO: 74288 - DNA, 20 bp, Artificial Sequence
  chemically synthesized
atggaaacagacagtagagg

SEQ ID NO: 74289 - DNA, 20 bp, Artificial Sequence
  chemically synthesized
tatttaaaatttgcaaagag

SEQ ID NO: 74290 - DNA, 20 bp, Artificial Sequence
  chemically synthesized
gatttttttttttttttaga

SEQ ID NO: 74291 - DNA, 20 bp, Artificial Sequence
  chemically synthesized
tgcctcagcctcccgagtag

SEQ ID NO: 74292 - DNA, 20 bp, Artificial Sequence
  chemically synthesized
ttttgtatttttagtagaga

SEQ ID NO: 74293 - DNA, 20 bp, Artificial Sequence
  chemically synthesized
tgcctcggccacccaaaggg

SEQ ID NO: 74294 - DNA, 20 bp, Artificial Sequence
  chemically synthesized
gtgagataatgggtatgtta

SEQ ID NO: 74295 - DNA, 20 bp, Artificial Sequence
  chemically synthesized
gataatgggtatgttaatta

SEQ ID NO: 74296 - DNA, 20 bp, Artificial Sequence
  chemically synthesized
aaaaataaaaaaatgcatct

SEQ ID NO: 74297 - DNA, 20 bp, Artificial Sequence
  chemically synthesized
cttgatgattagaattgcat

SEQ ID NO: 74298 - DNA, 20 bp, Artificial Sequence
  chemically synthesized
tcagatacaaatatccattt

SEQ ID NO: 74299 - DNA, 20 bp, Artificial Sequence
  chemically synthesized
tatatattttagatattttg

SEQ ID NO: 74300 - DNA, 20 bp, Artificial Sequence
  chemically synthesized
tattttgtatagttttactc

SEQ ID NO: 74301 - DNA, 20 bp, Artificial Sequence
  chemically synthesized
gttattattaaatagtgaag

SEQ ID NO: 74302 - DNA, 20 bp, Artificial Sequence
  chemically synthesized
aatgtttacacttatgtaca

SEQ ID NO: 74303 - DNA, 20 bp, Artificial Sequence
  chemically synthesized
acttatgtacaaaatgtttt

SEQ ID NO: 74304 - DNA, 20 bp, Artificial Sequence
  chemically synthesized
cttcatttctaacattctct

SEQ ID NO: 74305 - DNA, 20 bp, Artificial Sequence
  chemically synthesized
tctaagtttattctattttt

SEQ ID NO: 74306 - DNA, 20 bp, Artificial Sequence
  chemically synthesized
gctggaaatacattgttact

SEQ ID NO: 74307 - DNA, 20 bp, Artificial Sequence
  chemically synthesized
ttacttttggtttatctaaa

SEQ ID NO: 74308 - DNA, 20 bp, Artificial Sequence
  chemically synthesized
aataatgtgatatataaaaa

SEQ ID NO: 74309 - DNA, 20 bp, Artificial Sequence
  chemically synthesized
ataaaaatatagcttttaaa

SEQ ID NO: 74310 - DNA, 20 bp, Artificial Sequence
  chemically synthesized
tttttgaaaagagtaaagtg

SEQ ID NO: 74311 - DNA, 20 bp, Artificial Sequence
  chemically synthesized
tgcttaactgcatataccac

SEQ ID NO: 74312 - DNA, 20 bp, Artificial Sequence
  chemically synthesized
ttgggaggctgaggcaggag

SEQ ID NO: 74313 - DNA, 20 bp, Artificial Sequence
  chemically synthesized
gaggcagaggttgcagtgag

SEQ ID NO: 74314 - DNA, 20 bp, Artificial Sequence
  chemically synthesized
tcgtgagtgacgcagaagac

SEQ ID NO: 74315 - DNA, 20 bp, Artificial Sequence
  chemically synthesized
cctaatactgcgctcttcca

SEQ ID NO: 74316 - DNA, 20 bp, Artificial Sequence
  chemically synthesized
agcttaacaaatggcacacc

SEQ ID NO: 74317 - DNA, 20 bp, Artificial Sequence
  chemically synthesized
ggaggggtgcccaccattgt

SEQ ID NO: 74318 - DNA, 20 bp, Artificial Sequence
  chemically synthesized
agacttaaatgtccctgtct

SEQ ID NO: 74319 - DNA, 20 bp, Artificial Sequence
  chemically synthesized
gagtagtggttctcccagca

SEQ ID NO: 74320 - DNA, 20 bp, Artificial Sequence
  chemically synthesized
ccgctgttgatacccaggaa

SEQ ID NO: 74321 - DNA, 20 bp, Artificial Sequence
  chemically synthesized
actttgacgagttgagagag

SEQ ID NO: 74322 - DNA, 20 bp, Artificial Sequence
  chemically synthesized
gaatgaaatgaagcatgaag

SEQ ID NO: 74323 - DNA, 20 bp, Artificial Sequence
  chemically synthesized
caactccaagacacataact

SEQ ID NO: 74324 - DNA, 20 bp, Artificial Sequence
  chemically synthesized
gaatttcatatccagccaaa

SEQ ID NO: 74325 - DNA, 20 bp, Artificial Sequence
  chemically synthesized
tttacagacaagcaaatgct

SEQ ID NO: 74326 - DNA, 20 bp, Artificial Sequence
  chemically synthesized
gcaatcctagtctctgataa

SEQ ID NO: 74327 - DNA, 20 bp, Artificial Sequence
  chemically synthesized
atgcacccaatacaggagca

SEQ ID NO: 74328 - DNA, 20 bp, Artificial Sequence
  chemically synthesized
cagtgcaatcaaactagaac

SEQ ID NO: 74329 - DNA, 20 bp, Artificial Sequence
  chemically synthesized
aaaaaatcaatgaatccaga

SEQ ID NO: 74330 - DNA, 20 bp, Artificial Sequence
  chemically synthesized
ctgaaattgaggcaataatt

SEQ ID NO: 74331 - DNA, 20 bp, Artificial Sequence
  chemically synthesized
ccaaaaaaagtccgggacca

SEQ ID NO: 74332 - DNA, 20 bp, Artificial Sequence
  chemically synthesized
aactgatccaccatgatcaa

SEQ ID NO: 74333 - DNA, 20 bp, Artificial Sequence
  chemically synthesized
cagaaccaaagacacaaacc

SEQ ID NO: 74334 - DNA, 20 bp, Artificial Sequence
  chemically synthesized
aggcctttgacaaaattcaa

SEQ ID NO: 74335 - DNA, 20 bp, Artificial Sequence
  chemically synthesized
aaaagaggaagtgaaattgt

SEQ ID NO: 74336 - DNA, 20 bp, Artificial Sequence
  chemically synthesized
attgtccctgtttgcagatg

SEQ ID NO: 74337 - DNA, 20 bp, Artificial Sequence
  chemically synthesized
atgagtgaactcccattcac

SEQ ID NO: 74338 - DNA, 20 bp, Artificial Sequence
  chemically synthesized
tcatactgcccaaggtaatt

SEQ ID NO: 74339 - DNA, 20 bp, Artificial Sequence
  chemically synthesized
gagagaaacaagcaatgggg

SEQ ID NO: 74340 - DNA, 20 bp, Artificial Sequence
  chemically synthesized
ttatacaaaaattaattcaa

SEQ ID NO: 74341 - DNA, 20 bp, Artificial Sequence
  chemically synthesized
aacgggatctaattaaacta

SEQ ID NO: 74342 - DNA, 20 bp, Artificial Sequence
  chemically synthesized
ccattactgggtacataccc

SEQ ID NO: 74343 - DNA, 20 bp, Artificial Sequence
  chemically synthesized
ctataaagacacatgcacac

SEQ ID NO: 74344 - DNA, 20 bp, Artificial Sequence
  chemically synthesized
caaatgtccaacaacgatag

SEQ ID NO: 74345 - DNA, 20 bp, Artificial Sequence
  chemically synthesized
ctttgaaatagacagaaatt

SEQ ID NO: 74346 - DNA, 20 bp, Artificial Sequence
  chemically synthesized
agtcagttaacattccttca

SEQ ID NO: 74347 - DNA, 20 bp, Artificial Sequence
  chemically synthesized
ttctgagagtcttccttctt

SEQ ID NO: 74348 - DNA, 20 bp, Artificial Sequence
  chemically synthesized
agaagtagaaaattttggag

SEQ ID NO: 74349 - DNA, 20 bp, Artificial Sequence
  chemically synthesized
gaggtcaagtcagaggtgaa

SEQ ID NO: 74350 - DNA, 20 bp, Artificial Sequence
  chemically synthesized
gaaagagccaagctgggcac

SEQ ID NO: 74351 - DNA, 20 bp, Artificial Sequence
  chemically synthesized
agtgataggatcacttgagc

SEQ ID NO: 74352 - DNA, 20 bp, Artificial Sequence
  chemically synthesized
cacacagatattaagaacat

SEQ ID NO: 74353 - DNA, 20 bp, Artificial Sequence
  chemically synthesized
aaccccttgcagtgcctcgg

SEQ ID NO: 74354 - DNA, 20 bp, Artificial Sequence
  chemically synthesized
tgcctcggggctgtttctcc

SEQ ID NO: 74355 - DNA, 20 bp, Artificial Sequence
  chemically synthesized
aaggtctcacctgtcttatt

SEQ ID NO: 74356 - DNA, 20 bp, Artificial Sequence
  chemically synthesized
ctcacctgtcttattcagag

SEQ ID NO: 74357 - DNA, 20 bp, Artificial Sequence
  chemically synthesized
attcagagcttggattttgg

SEQ ID NO: 74358 - DNA, 20 bp, Artificial Sequence
  chemically synthesized
ggactagctttttctatttc

SEQ ID NO: 74359 - DNA, 20 bp, Artificial Sequence
  chemically synthesized
agcaaaggaggcatcacaga

SEQ ID NO: 74360 - DNA, 20 bp, Artificial Sequence
  chemically synthesized
ccaggaagttatccatttct

SEQ ID NO: 74361 - DNA, 20 bp, Artificial Sequence
  chemically synthesized
tatccatttcttttagattt

SEQ ID NO: 74362 - DNA, 20 bp, Artificial Sequence
  chemically synthesized
atgtacatagagatgttcat

SEQ ID NO: 74363 - DNA, 20 bp, Artificial Sequence
  chemically synthesized
gagatgttcatagtagtttt

SEQ ID NO: 74364 - DNA, 20 bp, Artificial Sequence
  chemically synthesized
attccctttttcatttctaa

SEQ ID NO: 74365 - DNA, 20 bp, Artificial Sequence
  chemically synthesized
ttaatcttttgaatggtatt

SEQ ID NO: 74366 - DNA, 20 bp, Artificial Sequence
  chemically synthesized
ttgtgttttaatatccttca

SEQ ID NO: 74367 - DNA, 20 bp, Artificial Sequence
  chemically synthesized
tatccttcagttagctttga

SEQ ID NO: 74368 - DNA, 20 bp, Artificial Sequence
  chemically synthesized
ttgtttatttcttgtcttct

SEQ ID NO: 74369 - DNA, 20 bp, Artificial Sequence
  chemically synthesized
tgtcttctgctagatttagg

SEQ ID NO: 74370 - DNA, 20 bp, Artificial Sequence
  chemically synthesized
tgacattaggttgttaattt

SEQ ID NO: 74371 - DNA, 20 bp, Artificial Sequence
  chemically synthesized
acactgtctaagctgtgtcc

SEQ ID NO: 74372 - DNA, 20 bp, Artificial Sequence
  chemically synthesized
tatattgtatctttgttctc

SEQ ID NO: 74373 - DNA, 20 bp, Artificial Sequence
  chemically synthesized
aagaactattttatttttgc

SEQ ID NO: 74374 - DNA, 20 bp, Artificial Sequence
  chemically synthesized
ccaaaattcattcaggagca

SEQ ID NO: 74375 - DNA, 20 bp, Artificial Sequence
  chemically synthesized
gtttaatttccatgtaattg

SEQ ID NO: 74376 - DNA, 20 bp, Artificial Sequence
  chemically synthesized
tttattcctctgtggtctga

SEQ ID NO: 74377 - DNA, 20 bp, Artificial Sequence
  chemically synthesized
ctgtggtctgagagtgattg

SEQ ID NO: 74378 - DNA, 20 bp, Artificial Sequence
  chemically synthesized
gattttttttttgcatttgc

SEQ ID NO: 74379 - DNA, 20 bp, Artificial Sequence
  chemically synthesized
ttttttttgcatttgctgag

SEQ ID NO: 74380 - DNA, 20 bp, Artificial Sequence
  chemically synthesized
agatccatgatgagctctga

SEQ ID NO: 74381 - DNA, 20 bp, Artificial Sequence
  chemically synthesized
aacaaaaaaagccctggaca

SEQ ID NO: 74382 - DNA, 20 bp, Artificial Sequence
  chemically synthesized
tactccaaaaaattgagggg

SEQ ID NO: 74383 - DNA, 20 bp, Artificial Sequence
  chemically synthesized
agctaatccacctcaatcaa

SEQ ID NO: 74384 - DNA, 20 bp, Artificial Sequence
  chemically synthesized
gtaggctttatccctgagaa

SEQ ID NO: 74385 - DNA, 20 bp, Artificial Sequence
  chemically synthesized
cagcatatacaaattgataa

SEQ ID NO: 74386 - DNA, 20 bp, Artificial Sequence
  chemically synthesized
atcatttcaatatgtgcaaa

SEQ ID NO: 74387 - DNA, 20 bp, Artificial Sequence
  chemically synthesized
aagagagaaagtcaaagtat

SEQ ID NO: 74388 - DNA, 20 bp, Artificial Sequence
  chemically synthesized
ccttcagctgataacttcag

SEQ ID NO: 74389 - DNA, 20 bp, Artificial Sequence
  chemically synthesized
gcagttgaaagatctctaca

SEQ ID NO: 74390 - DNA, 20 bp, Artificial Sequence
  chemically synthesized
ccatactgcctagagcaatt

SEQ ID NO: 74391 - DNA, 20 bp, Artificial Sequence
  chemically synthesized
ataactgactaaccgtatgt

SEQ ID NO: 74392 - DNA, 20 bp, Artificial Sequence
  chemically synthesized
atatacacaaataaactcaa

SEQ ID NO: 74393 - DNA, 20 bp, Artificial Sequence
  chemically synthesized
atgcaaaacccaaactataa

SEQ ID NO: 74394 - DNA, 20 bp, Artificial Sequence
  chemically synthesized
attccggacataagcagggg

SEQ ID NO: 74395 - DNA, 20 bp, Artificial Sequence
  chemically synthesized
caaataggatctaattaaaa

SEQ ID NO: 74396 - DNA, 20 bp, Artificial Sequence
  chemically synthesized
gtaaggttgtggagaaaagg

SEQ ID NO: 74397 - DNA, 20 bp, Artificial Sequence
  chemically synthesized
caaaagacactgcagcctaa

SEQ ID NO: 74398 - DNA, 20 bp, Artificial Sequence
  chemically synthesized
ctgtacgacaaacccatgac

SEQ ID NO: 74399 - DNA, 20 bp, Artificial Sequence
  chemically synthesized
catatctttttatagttata

SEQ ID NO: 74400 - DNA, 20 bp, Artificial Sequence
  chemically synthesized
tctttttatagttataatca

SEQ ID NO: 74401 - DNA, 20 bp, Artificial Sequence
  chemically synthesized
tgtttttaagtctaacaaaa

SEQ ID NO: 74402 - DNA, 20 bp, Artificial Sequence
  chemically synthesized
tgcgcattatgaaagtaatt

SEQ ID NO: 74403 - DNA, 20 bp, Artificial Sequence
  chemically synthesized
attctctgtccttctttgta

SEQ ID NO: 74404 - DNA, 20 bp, Artificial Sequence
  chemically synthesized
ttttaaaattttttgtagag

SEQ ID NO: 74405 - DNA, 20 bp, Artificial Sequence
  chemically synthesized
cgttctccctccggcctcgg

SEQ ID NO: 74406 - DNA, 20 bp, Artificial Sequence
  chemically synthesized
gtgattacaggtgtgagcca

SEQ ID NO: 74407 - DNA, 20 bp, Artificial Sequence
  chemically synthesized
aactaattcaaaaggtacta

SEQ ID NO: 74408 - DNA, 20 bp, Artificial Sequence
  chemically synthesized
aggagagggtagaagtaaag

SEQ ID NO: 74409 - DNA, 20 bp, Artificial Sequence
  chemically synthesized
gagggtagaagtaaagctgg

SEQ ID NO: 74410 - DNA, 20 bp, Artificial Sequence
  chemically synthesized
gagggcattaggtcagactt

SEQ ID NO: 74411 - DNA, 20 bp, Artificial Sequence
  chemically synthesized
ccacttgctcattctggatg

SEQ ID NO: 74412 - DNA, 20 bp, Artificial Sequence
  chemically synthesized
gctcattctggatggcagga

SEQ ID NO: 74413 - DNA, 20 bp, Artificial Sequence
  chemically synthesized
gctttatatttccctaccat

SEQ ID NO: 74414 - DNA, 20 bp, Artificial Sequence
  chemically synthesized
tattagcttgtgcacttaaa

SEQ ID NO: 74415 - DNA, 20 bp, Artificial Sequence
  chemically synthesized
atttagtggggtgtgggact

SEQ ID NO: 74416 - DNA, 20 bp, Artificial Sequence
  chemically synthesized
ctcattctgttccagttgag

SEQ ID NO: 74417 - DNA, 20 bp, Artificial Sequence
  chemically synthesized
ttctgttccagttgaggcca

SEQ ID NO: 74418 - DNA, 20 bp, Artificial Sequence
  chemically synthesized
caaaaagtattttcatttat

SEQ ID NO: 74419 - DNA, 20 bp, Artificial Sequence
  chemically synthesized
tggaatgataaagagtgagc

SEQ ID NO: 74420 - DNA, 20 bp, Artificial Sequence
  chemically synthesized
actgagatattacattctta

SEQ ID NO: 74421 - DNA, 20 bp, Artificial Sequence
  chemically synthesized
tcttaaatggctttagtcaa

SEQ ID NO: 74422 - DNA, 20 bp, Artificial Sequence
  chemically synthesized
aatttcaccactatataaac

SEQ ID NO: 74423 - DNA, 20 bp, Artificial Sequence
  chemically synthesized
atggtgctctctggtacatc

SEQ ID NO: 74424 - DNA, 20 bp, Artificial Sequence
  chemically synthesized
tcagctagtaagtagctgag

SEQ ID NO: 74425 - DNA, 20 bp, Artificial Sequence
  chemically synthesized
acatgaaaaaaaaatgttac

SEQ ID NO: 74426 - DNA, 20 bp, Artificial Sequence
  chemically synthesized
gtaaattatcctccacttct

SEQ ID NO: 74427 - DNA, 20 bp, Artificial Sequence
  chemically synthesized
ccacttctttcagtttcctc

SEQ ID NO: 74428 - DNA, 20 bp, Artificial Sequence
  chemically synthesized
caaacttgatgaatggttca

SEQ ID NO: 74429 - DNA, 20 bp, Artificial Sequence
  chemically synthesized
gaattattatcataaatact

SEQ ID NO: 74430 - DNA, 20 bp, Artificial Sequence
  chemically synthesized
cttttgagtggcagataatg

SEQ ID NO: 74431 - DNA, 20 bp, Artificial Sequence
  chemically synthesized
atacctaagaaatgacaaaa

SEQ ID NO: 74432 - DNA, 20 bp, Artificial Sequence
  chemically synthesized
agctaattactgcgttcctt

SEQ ID NO: 74433 - DNA, 20 bp, Artificial Sequence
  chemically synthesized
tactctcaggtccataagtt

SEQ ID NO: 74434 - DNA, 20 bp, Artificial Sequence
  chemically synthesized
tcaggtccataagttaatag

SEQ ID NO: 74435 - DNA, 20 bp, Artificial Sequence
  chemically synthesized
tttcttcacctatagccaca

SEQ ID NO: 74436 - DNA, 20 bp, Artificial Sequence
  chemically synthesized
agtcagcttctcaaagacaa

SEQ ID NO: 74437 - DNA, 20 bp, Artificial Sequence
  chemically synthesized
agctactaatttctccacgc

SEQ ID NO: 74438 - DNA, 20 bp, Artificial Sequence
  chemically synthesized
aaaaacgatacaaagggtat

SEQ ID NO: 74439 - DNA, 20 bp, Artificial Sequence
  chemically synthesized
cattctaggacaatggttcc

SEQ ID NO: 74440 - DNA, 20 bp, Artificial Sequence
  chemically synthesized
gagagacatgcctggctcac

SEQ ID NO: 74441 - DNA, 20 bp, Artificial Sequence
  chemically synthesized
atccaaaagtacatagctcc

SEQ ID NO: 74442 - DNA, 20 bp, Artificial Sequence
  chemically synthesized
tctagagaattctaaaaatc

SEQ ID NO: 74443 - DNA, 20 bp, Artificial Sequence
  chemically synthesized
tttatttacataaataaaag

SEQ ID NO: 74444 - DNA, 20 bp, Artificial Sequence
  chemically synthesized
agcaaagtggtcatgttagt

SEQ ID NO: 74445 - DNA, 20 bp, Artificial Sequence
  chemically synthesized
tgtctactcttttgtattcc

SEQ ID NO: 74446 - DNA, 20 bp, Artificial Sequence
  chemically synthesized
atcctagcaataatatcctg

SEQ ID NO: 74447 - DNA, 20 bp, Artificial Sequence
  chemically synthesized
ttgggtctctccggttgtat

SEQ ID NO: 74448 - DNA, 20 bp, Artificial Sequence
  chemically synthesized
gtagtatataaattcaaaat

SEQ ID NO: 74449 - DNA, 20 bp, Artificial Sequence
  chemically synthesized
gtaatattcatactttttct

SEQ ID NO: 74450 - DNA, 20 bp, Artificial Sequence
  chemically synthesized
agtgagagatgttctggaga

SEQ ID NO: 74451 - DNA, 20 bp, Artificial Sequence
  chemically synthesized
ttctggagatggtgattata

SEQ ID NO: 74452 - DNA, 20 bp, Artificial Sequence
  chemically synthesized
ctagcagcctaggtatgggt

SEQ ID NO: 74453 - DNA, 20 bp, Artificial Sequence
  chemically synthesized
ggacaacttaaaatatgtgt

SEQ ID NO: 74454 - DNA, 20 bp, Artificial Sequence
  chemically synthesized
taaggatgaattttttaaaa

SEQ ID NO: 74455 - DNA, 20 bp, Artificial Sequence
  chemically synthesized
tcttcagttagactagagga

SEQ ID NO: 74456 - DNA, 20 bp, Artificial Sequence
  chemically synthesized
tcaccacaaaaaaagttgga

SEQ ID NO: 74457 - DNA, 20 bp, Artificial Sequence
  chemically synthesized
ggaaggtgattcatatgcta

SEQ ID NO: 74458 - DNA, 20 bp, Artificial Sequence
  chemically synthesized
ttatttgccaggcaaataaa

SEQ ID NO: 74459 - DNA, 20 bp, Artificial Sequence
  chemically synthesized
tttgtaacctccttttactt

SEQ ID NO: 74460 - DNA, 20 bp, Artificial Sequence
  chemically synthesized
aacctccttttacttttctg

SEQ ID NO: 74461 - DNA, 20 bp, Artificial Sequence
  chemically synthesized
cttggttttcttctttcatt

SEQ ID NO: 74462 - DNA, 20 bp, Artificial Sequence
  chemically synthesized
tcttctttcattcagtgttt

SEQ ID NO: 74463 - DNA, 20 bp, Artificial Sequence
  chemically synthesized
caaatacactatcttgcatg

SEQ ID NO: 74464 - DNA, 20 bp, Artificial Sequence
  chemically synthesized
accatgtcatatatttttta

SEQ ID NO: 74465 - DNA, 20 bp, Artificial Sequence
  chemically synthesized
atacaataatctattacatt

SEQ ID NO: 74466 - DNA, 20 bp, Artificial Sequence
  chemically synthesized
cactatatatttgtatctat

SEQ ID NO: 74467 - DNA, 20 bp, Artificial Sequence
  chemically synthesized
actggaaatttaagcctact

SEQ ID NO: 74468 - DNA, 20 bp, Artificial Sequence
  chemically synthesized
cctacttcaggtttgtggta

SEQ ID NO: 74469 - DNA, 20 bp, Artificial Sequence
  chemically synthesized
caagactcttgagggcctga

SEQ ID NO: 74470 - DNA, 20 bp, Artificial Sequence
  chemically synthesized
tcactgaagtagggagggaa

SEQ ID NO: 74471 - DNA, 20 bp, Artificial Sequence
  chemically synthesized
tccactgccttggcaaatag

SEQ ID NO: 74472 - DNA, 20 bp, Artificial Sequence
  chemically synthesized
acagaaaaaaaaaaaaaacc

SEQ ID NO: 74473 - DNA, 20 bp, Artificial Sequence
  chemically synthesized
agagatttctgcatatgtag

SEQ ID NO: 74474 - DNA, 20 bp, Artificial Sequence
  chemically synthesized
aatgacctggttattataat

SEQ ID NO: 74475 - DNA, 20 bp, Artificial Sequence
  chemically synthesized
cctggttattataatcacag

SEQ ID NO: 74476 - DNA, 20 bp, Artificial Sequence
  chemically synthesized
tcttggaaaactgtaaatct

SEQ ID NO: 74477 - DNA, 20 bp, Artificial Sequence
  chemically synthesized
tggcacacctgacatattga

SEQ ID NO: 74478 - DNA, 20 bp, Artificial Sequence
  chemically synthesized
tctgaagaagcctgaatgaa

SEQ ID NO: 74479 - DNA, 20 bp, Artificial Sequence
  chemically synthesized
gcctgaatgaaagtagattt

SEQ ID NO: 74480 - DNA, 20 bp, Artificial Sequence
  chemically synthesized
tctgaagaaacctgcatgaa

SEQ ID NO: 74481 - DNA, 20 bp, Artificial Sequence
  chemically synthesized
tgcctcagtctcccaagtaa

SEQ ID NO: 74482 - DNA, 20 bp, Artificial Sequence
  chemically synthesized
ccatgcccagctaattattt

SEQ ID NO: 74483 - DNA, 20 bp, Artificial Sequence
  chemically synthesized
tttttgtgttttagtagaga

SEQ ID NO: 74484 - DNA, 20 bp, Artificial Sequence
  chemically synthesized
tgcctcggcctcccaaagtg

SEQ ID NO: 74485 - DNA, 20 bp, Artificial Sequence
  chemically synthesized
caggctggaaatgagagaaa

SEQ ID NO: 74486 - DNA, 20 bp, Artificial Sequence
  chemically synthesized
agcaagatccctggagcagc

SEQ ID NO: 74487 - DNA, 20 bp, Artificial Sequence
  chemically synthesized
agaaaagactaagtgtacac

SEQ ID NO: 74488 - DNA, 20 bp, Artificial Sequence
  chemically synthesized
ttcatattatctttatatct

SEQ ID NO: 74489 - DNA, 20 bp, Artificial Sequence
  chemically synthesized
gatcctgagacatgcatgta

SEQ ID NO: 74490 - DNA, 20 bp, Artificial Sequence
  chemically synthesized
ctgagacatgcatgtactta

SEQ ID NO: 74491 - DNA, 20 bp, Artificial Sequence
  chemically synthesized
ggcaggtgagccacgttata

SEQ ID NO: 74492 - DNA, 20 bp, Artificial Sequence
  chemically synthesized
caatgggtaagtgaccatca

SEQ ID NO: 74493 - DNA, 20 bp, Artificial Sequence
  chemically synthesized
catcaaagagttttttcaac

SEQ ID NO: 74494 - DNA, 20 bp, Artificial Sequence
  chemically synthesized
agttttttcaacaaaggttt

SEQ ID NO: 74495 - DNA, 20 bp, Artificial Sequence
  chemically synthesized
aaaggtttgtgtgatttagt

SEQ ID NO: 74496 - DNA, 20 bp, Artificial Sequence
  chemically synthesized
agatgtttgtagaaaagcaa

SEQ ID NO: 74497 - DNA, 20 bp, Artificial Sequence
  chemically synthesized
taaaagtgggcctatctggg

SEQ ID NO: 74498 - DNA, 20 bp, Artificial Sequence
  chemically synthesized
tagaaatggtagaaattgat

SEQ ID NO: 74499 - DNA, 20 bp, Artificial Sequence
  chemically synthesized
ttaggagaaaagggacagaa

SEQ ID NO: 74500 - DNA, 20 bp, Artificial Sequence
  chemically synthesized
ttattggcatcattcttatt

SEQ ID NO: 74501 - DNA, 20 bp, Artificial Sequence
  chemically synthesized
caggaatcagaggtgcaaat

SEQ ID NO: 74502 - DNA, 20 bp, Artificial Sequence
  chemically synthesized
gcacattaaggaactgagaa

SEQ ID NO: 74503 - DNA, 20 bp, Artificial Sequence
  chemically synthesized
acagagatattagttaaata

SEQ ID NO: 74504 - DNA, 20 bp, Artificial Sequence
  chemically synthesized
tagctaataaatacaaaatt

SEQ ID NO: 74505 - DNA, 20 bp, Artificial Sequence
  chemically synthesized
gtcttaagaaacttcttgaa

SEQ ID NO: 74506 - DNA, 20 bp, Artificial Sequence
  chemically synthesized
aagtgattgttgagttgcaa

SEQ ID NO: 74507 - DNA, 20 bp, Artificial Sequence
  chemically synthesized
aattttacgaaagaagagaa

SEQ ID NO: 74508 - DNA, 20 bp, Artificial Sequence
  chemically synthesized
gaaagtatggacttttgaac

SEQ ID NO: 74509 - DNA, 20 bp, Artificial Sequence
  chemically synthesized
tgaacatctgtttacattat

SEQ ID NO: 74510 - DNA, 20 bp, Artificial Sequence
  chemically synthesized
tagagctttaaaaaaactta

SEQ ID NO: 74511 - DNA, 20 bp, Artificial Sequence
  chemically synthesized
aacaatgtaaagaagaagcc

SEQ ID NO: 74512 - DNA, 20 bp, Artificial Sequence
  chemically synthesized
gccaattgattctgctacca

SEQ ID NO: 74513 - DNA, 20 bp, Artificial Sequence
  chemically synthesized
accatgaggcttttgaaatt

SEQ ID NO: 74514 - DNA, 20 bp, Artificial Sequence
  chemically synthesized
tgaggcttttgaaattataa

SEQ ID NO: 74515 - DNA, 20 bp, Artificial Sequence
  chemically synthesized
gcttttgaaattataagctt

SEQ ID NO: 74516 - DNA, 20 bp, Artificial Sequence
  chemically synthesized
tataagcttgcttgtttgag

SEQ ID NO: 74517 - DNA, 20 bp, Artificial Sequence
  chemically synthesized
tctcatgcataaatattcct

SEQ ID NO: 74518 - DNA, 20 bp, Artificial Sequence
  chemically synthesized
gacttatgatatttaaagcc

SEQ ID NO: 74519 - DNA, 20 bp, Artificial Sequence
  chemically synthesized
caaagattactcttcacttc

SEQ ID NO: 74520 - DNA, 20 bp, Artificial Sequence
  chemically synthesized
cttttactaatctcttcctt

SEQ ID NO: 74521 - DNA, 20 bp, Artificial Sequence
  chemically synthesized
ctaatctcttccttatttgt

SEQ ID NO: 74522 - DNA, 20 bp, Artificial Sequence
  chemically synthesized
cttccttatttgtttttgct

SEQ ID NO: 74523 - DNA, 20 bp, Artificial Sequence
  chemically synthesized
tcaaagaaacagaatttctc

SEQ ID NO: 74524 - DNA, 20 bp, Artificial Sequence
  chemically synthesized
cagctgttttttttaagtca

SEQ ID NO: 74525 - DNA, 20 bp, Artificial Sequence
  chemically synthesized
tcctttgaaaaaatactctc

SEQ ID NO: 74526 - DNA, 20 bp, Artificial Sequence
  chemically synthesized
tcacatgtttctcagttcca

SEQ ID NO: 74527 - DNA, 20 bp, Artificial Sequence
  chemically synthesized
cgaattcttcctttcttctc

SEQ ID NO: 74528 - DNA, 20 bp, Artificial Sequence
  chemically synthesized
tggcatggagcagcaatacc

SEQ ID NO: 74529 - DNA, 20 bp, Artificial Sequence
  chemically synthesized
cttctcctcaatctatgcca

SEQ ID NO: 74530 - DNA, 20 bp, Artificial Sequence
  chemically synthesized
tgagccaagcctgcaccagc

SEQ ID NO: 74531 - DNA, 20 bp, Artificial Sequence
  chemically synthesized
tgtgggggatcattcgagag

SEQ ID NO: 74532 - DNA, 20 bp, Artificial Sequence
  chemically synthesized
gggatcattcgagagatcag

SEQ ID NO: 74533 - DNA, 20 bp, Artificial Sequence
  chemically synthesized
ttgggctcactataataggt

SEQ ID NO: 74534 - DNA, 20 bp, Artificial Sequence
  chemically synthesized
tctgcctgcaccaggatctt

SEQ ID NO: 74535 - DNA, 20 bp, Artificial Sequence
  chemically synthesized
tccgcttagcctgttcagac

SEQ ID NO: 74536 - DNA, 20 bp, Artificial Sequence
  chemically synthesized
actcatccttttctcctaca

SEQ ID NO: 74537 - DNA, 20 bp, Artificial Sequence
  chemically synthesized
tcattagcctcacaatggtg

SEQ ID NO: 74538 - DNA, 20 bp, Artificial Sequence
  chemically synthesized
catctacagtgtcaagaccc

SEQ ID NO: 74539 - DNA, 20 bp, Artificial Sequence
  chemically synthesized
gacccaacagattcatacca

SEQ ID NO: 74540 - DNA, 20 bp, Artificial Sequence
  chemically synthesized
aaagaaaaaattattaaaat

SEQ ID NO: 74541 - DNA, 20 bp, Artificial Sequence
  chemically synthesized
atatttaagaaagaggaaaa

SEQ ID NO: 74542 - DNA, 20 bp, Artificial Sequence
  chemically synthesized
ttcctttgctgtaaaacaaa

SEQ ID NO: 74543 - DNA, 20 bp, Artificial Sequence
  chemically synthesized
aacaaagctggattaaaaac

SEQ ID NO: 74544 - DNA, 20 bp, Artificial Sequence
  chemically synthesized
tggattaaaaacctaggttt

SEQ ID NO: 74545 - DNA, 20 bp, Artificial Sequence
  chemically synthesized
aagtttcaaagtagaaaact

SEQ ID NO: 74546 - DNA, 20 bp, Artificial Sequence
  chemically synthesized
ttgaagtttctttcattctc

SEQ ID NO: 74547 - DNA, 20 bp, Artificial Sequence
  chemically synthesized
aagtggaatatatggctcct

SEQ ID NO: 74548 - DNA, 20 bp, Artificial Sequence
  chemically synthesized
ctttaagttaatttatattt

SEQ ID NO: 74549 - DNA, 20 bp, Artificial Sequence
  chemically synthesized
aggacacaaagaaatatgac

SEQ ID NO: 74550 - DNA, 20 bp, Artificial Sequence
  chemically synthesized
ttaaattagaatccttattt

SEQ ID NO: 74551 - DNA, 20 bp, Artificial Sequence
  chemically synthesized
tccactgctacaaggctgga

SEQ ID NO: 74552 - DNA, 20 bp, Artificial Sequence
  chemically synthesized
agcagattttgctctagatc

SEQ ID NO: 74553 - DNA, 20 bp, Artificial Sequence
  chemically synthesized
ctgtccgctaccgacttatt

SEQ ID NO: 74554 - DNA, 20 bp, Artificial Sequence
  chemically synthesized
ttcttttctaagtaagctag

SEQ ID NO: 74555 - DNA, 20 bp, Artificial Sequence
  chemically synthesized
tgcatggataacaagaaaat

SEQ ID NO: 74556 - DNA, 20 bp, Artificial Sequence
  chemically synthesized
tttagatatcaactaaaaca

SEQ ID NO: 74557 - DNA, 20 bp, Artificial Sequence
  chemically synthesized
actcagagggaaacaaaaat

SEQ ID NO: 74558 - DNA, 20 bp, Artificial Sequence
  chemically synthesized
agggaaacaaaaatacaggc

SEQ ID NO: 74559 - DNA, 20 bp, Artificial Sequence
  chemically synthesized
aaatacaggctttggtttct

SEQ ID NO: 74560 - DNA, 20 bp, Artificial Sequence
  chemically synthesized
cttaagcctcaaagtgagga

SEQ ID NO: 74561 - DNA, 20 bp, Artificial Sequence
  chemically synthesized
aatggcgtgaacccgggagg

SEQ ID NO: 74562 - DNA, 20 bp, Artificial Sequence
  chemically synthesized
actggaatgtggccaatctg

SEQ ID NO: 74563 - DNA, 20 bp, Artificial Sequence
  chemically synthesized
atctgacaagattcctatgc

SEQ ID NO: 74564 - DNA, 20 bp, Artificial Sequence
  chemically synthesized
tagaggtcatgtgaatgtct

SEQ ID NO: 74565 - DNA, 20 bp, Artificial Sequence
  chemically synthesized
atagatttctcaatggccaa

SEQ ID NO: 74566 - DNA, 20 bp, Artificial Sequence
  chemically synthesized
tggccaaagaagcttccttc

SEQ ID NO: 74567 - DNA, 20 bp, Artificial Sequence
  chemically synthesized
gaattcttcaacaactgaca

SEQ ID NO: 74568 - DNA, 20 bp, Artificial Sequence
  chemically synthesized
atgtctgacacaactgagtt

SEQ ID NO: 74569 - DNA, 20 bp, Artificial Sequence
  chemically synthesized
ctgagttgttggtttgagag

SEQ ID NO: 74570 - DNA, 20 bp, Artificial Sequence
  chemically synthesized
atctgaagacttcatactat

SEQ ID NO: 74571 - DNA, 20 bp, Artificial Sequence
  chemically synthesized
agacttcatactatgagtgt

SEQ ID NO: 74572 - DNA, 20 bp, Artificial Sequence
  chemically synthesized
catactatgagtgtttgtgc

SEQ ID NO: 74573 - DNA, 20 bp, Artificial Sequence
  chemically synthesized
acctatagaatgtgaaccaa

SEQ ID NO: 74574 - DNA, 20 bp, Artificial Sequence
  chemically synthesized
ctaagagtatcctcagaaat

SEQ ID NO: 74575 - DNA, 20 bp, Artificial Sequence
  chemically synthesized
tatataattgtactatgatg

SEQ ID NO: 74576 - DNA, 20 bp, Artificial Sequence
  chemically synthesized
agccaatgaaagtaaacttt

SEQ ID NO: 74577 - DNA, 20 bp, Artificial Sequence
  chemically synthesized
aagtaaactttatatgatta

SEQ ID NO: 74578 - DNA, 20 bp, Artificial Sequence
  chemically synthesized
tgggctttatacagaaagaa

SEQ ID NO: 74579 - DNA, 20 bp, Artificial Sequence
  chemically synthesized
agaaacaggtttagaacatt

SEQ ID NO: 74580 - DNA, 20 bp, Artificial Sequence
  chemically synthesized
caggtttagaacattagtag

SEQ ID NO: 74581 - DNA, 20 bp, Artificial Sequence
  chemically synthesized
tttagaacattagtagttta

SEQ ID NO: 74582 - DNA, 20 bp, Artificial Sequence
  chemically synthesized
gaacattagtagtttagatt

SEQ ID NO: 74583 - DNA, 20 bp, Artificial Sequence
  chemically synthesized
agagcagatggagacatcac

SEQ ID NO: 74584 - DNA, 20 bp, Artificial Sequence
  chemically synthesized
tcacaggtgtttaaaacact

SEQ ID NO: 74585 - DNA, 20 bp, Artificial Sequence
  chemically synthesized
ttttccatatatctcaaaaa

SEQ ID NO: 74586 - DNA, 20 bp, Artificial Sequence
  chemically synthesized
aaaagccagcttctaaggaa

SEQ ID NO: 74587 - DNA, 20 bp, Artificial Sequence
  chemically synthesized
agagccagtgagaagcagtt

SEQ ID NO: 74588 - DNA, 20 bp, Artificial Sequence
  chemically synthesized
ccgagaacaaggtgacaaaa

SEQ ID NO: 74589 - DNA, 20 bp, Artificial Sequence
  chemically synthesized
taaggtccagtgggagaaat

SEQ ID NO: 74590 - DNA, 20 bp, Artificial Sequence
  chemically synthesized
tgattcttagaagtgagagg

SEQ ID NO: 74591 - DNA, 20 bp, Artificial Sequence
  chemically synthesized
tagaagtgagaggacatgat

SEQ ID NO: 74592 - DNA, 20 bp, Artificial Sequence
  chemically synthesized
gacatgattcaggattagaa

SEQ ID NO: 74593 - DNA, 20 bp, Artificial Sequence
  chemically synthesized
cactgtacaccagcagtctt

SEQ ID NO: 74594 - DNA, 20 bp, Artificial Sequence
  chemically synthesized
tcaatgtttttggtaccagg

SEQ ID NO: 74595 - DNA, 20 bp, Artificial Sequence
  chemically synthesized
gaagacaaggtgcaggaggg

SEQ ID NO: 74596 - DNA, 20 bp, Artificial Sequence
  chemically synthesized
tccacctcagagcattaggc

SEQ ID NO: 74597 - DNA, 20 bp, Artificial Sequence
  chemically synthesized
aggaggaggagctcaggcag

SEQ ID NO: 74598 - DNA, 20 bp, Artificial Sequence
  chemically synthesized
cactatacctccctattttc

SEQ ID NO: 74599 - DNA, 20 bp, Artificial Sequence
  chemically synthesized
tgcagtaggagtcgatgtcc

SEQ ID NO: 74600 - DNA, 20 bp, Artificial Sequence
  chemically synthesized
taaagcttttccagtaaaag

SEQ ID NO: 74601 - DNA, 20 bp, Artificial Sequence
  chemically synthesized
tgtaatggcacatagaaaat

SEQ ID NO: 74602 - DNA, 20 bp, Artificial Sequence
  chemically synthesized
gccagaactgaggaatcaat

SEQ ID NO: 74603 - DNA, 20 bp, Artificial Sequence
  chemically synthesized
aactgaggaatcaatcggtg

SEQ ID NO: 74604 - DNA, 20 bp, Artificial Sequence
  chemically synthesized
aatgttctctttcttggtct

SEQ ID NO: 74605 - DNA, 20 bp, Artificial Sequence
  chemically synthesized
tcttggtctgagtgtttgtt

SEQ ID NO: 74606 - DNA, 20 bp, Artificial Sequence
  chemically synthesized
tgataagtatatacatttaa

SEQ ID NO: 74607 - DNA, 20 bp, Artificial Sequence
  chemically synthesized
aaatggtagaaaaggtgaat

SEQ ID NO: 74608 - DNA, 20 bp, Artificial Sequence
  chemically synthesized
atttctctttagttctggca

SEQ ID NO: 74609 - DNA, 20 bp, Artificial Sequence
  chemically synthesized
aaggtgtaatatatgaaaca

SEQ ID NO: 74610 - DNA, 20 bp, Artificial Sequence
  chemically synthesized
atagatattggcatttgagt

SEQ ID NO: 74611 - DNA, 20 bp, Artificial Sequence
  chemically synthesized
tggcatttgagtattcgctt

SEQ ID NO: 74612 - DNA, 20 bp, Artificial Sequence
  chemically synthesized
gtattcgcttactggattag

SEQ ID NO: 74613 - DNA, 20 bp, Artificial Sequence
  chemically synthesized
tattttattattattatact

SEQ ID NO: 74614 - DNA, 20 bp, Artificial Sequence
  chemically synthesized
tgtatacatgtgccatgctg

SEQ ID NO: 74615 - DNA, 20 bp, Artificial Sequence
  chemically synthesized
cacctatgagtgagaacatg

SEQ ID NO: 74616 - DNA, 20 bp, Artificial Sequence
  chemically synthesized
atgagtgagaacatgcagtg

SEQ ID NO: 74617 - DNA, 20 bp, Artificial Sequence
  chemically synthesized
gtttggtttttcgtccttgc

SEQ ID NO: 74618 - DNA, 20 bp, Artificial Sequence
  chemically synthesized
ttgcgatagtttactgagaa

SEQ ID NO: 74619 - DNA, 20 bp, Artificial Sequence
  chemically synthesized
gagaactttcatgtctagct

SEQ ID NO: 74620 - DNA, 20 bp, Artificial Sequence
  chemically synthesized
tcagcaatctgtgtctaact

SEQ ID NO: 74621 - DNA, 20 bp, Artificial Sequence
  chemically synthesized
gagaacttttgtgtctagct

SEQ ID NO: 74622 - DNA, 20 bp, Artificial Sequence
  chemically synthesized
tcagcactctgtgtctagct

SEQ ID NO: 74623 - DNA, 20 bp, Artificial Sequence
  chemically synthesized
tgggttccctaccatgctgt

SEQ ID NO: 74624 - DNA, 20 bp, Artificial Sequence
  chemically synthesized
taacactcactgcgaaggtc

SEQ ID NO: 74625 - DNA, 20 bp, Artificial Sequence
  chemically synthesized
taacactccccgtgggggtc

SEQ ID NO: 74626 - DNA, 20 bp, Artificial Sequence
  chemically synthesized
taacactcaccacgagggtt

SEQ ID NO: 74627 - DNA, 20 bp, Artificial Sequence
  chemically synthesized
tccggacacagaaggatgga

SEQ ID NO: 74628 - DNA, 20 bp, Artificial Sequence
  chemically synthesized
taaagaaaacttatttggag

SEQ ID NO: 74629 - DNA, 20 bp, Artificial Sequence
  chemically synthesized
agccaataagggggacagga

SEQ ID NO: 74630 - DNA, 20 bp, Artificial Sequence
  chemically synthesized
acactttaccaaagaagata

SEQ ID NO: 74631 - DNA, 20 bp, Artificial Sequence
  chemically synthesized
gagcaacagtaactctcact

SEQ ID NO: 74632 - DNA, 20 bp, Artificial Sequence
  chemically synthesized
atagtgcagccaaattggaa

SEQ ID NO: 74633 - DNA, 20 bp, Artificial Sequence
  chemically synthesized
agccaaattggaagacagtt

SEQ ID NO: 74634 - DNA, 20 bp, Artificial Sequence
  chemically synthesized
acacacagacatgaactaac

SEQ ID NO: 74635 - DNA, 20 bp, Artificial Sequence
  chemically synthesized
tcaagctgtgaaaagacata

SEQ ID NO: 74636 - DNA, 20 bp, Artificial Sequence
  chemically synthesized
cataaagagctttaattgta

SEQ ID NO: 74637 - DNA, 20 bp, Artificial Sequence
  chemically synthesized
tagtctttcatatccttctg

SEQ ID NO: 74638 - DNA, 20 bp, Artificial Sequence
  chemically synthesized
aagtatggtacattctttga

SEQ ID NO: 74639 - DNA, 20 bp, Artificial Sequence
  chemically synthesized
acagctattgcatagaatga

SEQ ID NO: 74640 - DNA, 20 bp, Artificial Sequence
  chemically synthesized
atatttaataacaggtaatg

SEQ ID NO: 74641 - DNA, 20 bp, Artificial Sequence
  chemically synthesized
ttaaaaataagatgataaat

SEQ ID NO: 74642 - DNA, 20 bp, Artificial Sequence
  chemically synthesized
tggagataacacacttagat

SEQ ID NO: 74643 - DNA, 20 bp, Artificial Sequence
  chemically synthesized
gacatgagtaaagaggagta

SEQ ID NO: 74644 - DNA, 20 bp, Artificial Sequence
  chemically synthesized
gtgttattggcattgtattg

SEQ ID NO: 74645 - DNA, 20 bp, Artificial Sequence
  chemically synthesized
ctgggtaatttataaagaac

SEQ ID NO: 74646 - DNA, 20 bp, Artificial Sequence
  chemically synthesized
aagaagcatggcagcatctg

SEQ ID NO: 74647 - DNA, 20 bp, Artificial Sequence
  chemically synthesized
cgctgatgagaactctgcca

SEQ ID NO: 74648 - DNA, 20 bp, Artificial Sequence
  chemically synthesized
caaggccccacctccaacgc

SEQ ID NO: 74649 - DNA, 20 bp, Artificial Sequence
  chemically synthesized
gggcagtcattacaccttga

SEQ ID NO: 74650 - DNA, 20 bp, Artificial Sequence
  chemically synthesized
attacaccttgatatggttt

SEQ ID NO: 74651 - DNA, 20 bp, Artificial Sequence
  chemically synthesized
gatgtaattgaatcatgggg

SEQ ID NO: 74652 - DNA, 20 bp, Artificial Sequence
  chemically synthesized
gagtaagtctcacaagatct

SEQ ID NO: 74653 - DNA, 20 bp, Artificial Sequence
  chemically synthesized
tgctcctccttcaccttcca

SEQ ID NO: 74654 - DNA, 20 bp, Artificial Sequence
  chemically synthesized
agtctcgggtatttcttcat

SEQ ID NO: 74655 - DNA, 20 bp, Artificial Sequence
  chemically synthesized
gccttgggcagttccacccc

SEQ ID NO: 74656 - DNA, 20 bp, Artificial Sequence
  chemically synthesized
gttccacccctattgctttg

SEQ ID NO: 74657 - DNA, 20 bp, Artificial Sequence
  chemically synthesized
tagcccctgctgctgctctt

SEQ ID NO: 74658 - DNA, 20 bp, Artificial Sequence
  chemically synthesized
tgctcttaagagattgtatt

SEQ ID NO: 74659 - DNA, 20 bp, Artificial Sequence
  chemically synthesized
aagagattgtattgagtgtt

SEQ ID NO: 74660 - DNA, 20 bp, Artificial Sequence
  chemically synthesized
atgagggttctgcccctgca

SEQ ID NO: 74661 - DNA, 20 bp, Artificial Sequence
  chemically synthesized
ggaggcttctgcctgaacac

SEQ ID NO: 74662 - DNA, 20 bp, Artificial Sequence
  chemically synthesized
acatcctctgaaatctaggt

SEQ ID NO: 74663 - DNA, 20 bp, Artificial Sequence
  chemically synthesized
ctttttgacctttgcacact

SEQ ID NO: 74664 - DNA, 20 bp, Artificial Sequence
  chemically synthesized
tatcaccatgtggaagcctc

SEQ ID NO: 74665 - DNA, 20 bp, Artificial Sequence
  chemically synthesized
catttatgcaaatttctaca

SEQ ID NO: 74666 - DNA, 20 bp, Artificial Sequence
  chemically synthesized
cttgaattgctcctttgaaa

SEQ ID NO: 74667 - DNA, 20 bp, Artificial Sequence
  chemically synthesized
ttgctcctttgaaaatgagc

SEQ ID NO: 74668 - DNA, 20 bp, Artificial Sequence
  chemically synthesized
taattttccaaacttttatg

SEQ ID NO: 74669 - DNA, 20 bp, Artificial Sequence
  chemically synthesized
gcttcccttttaaatataag

SEQ ID NO: 74670 - DNA, 20 bp, Artificial Sequence
  chemically synthesized
aggacacatcttgaacacct

SEQ ID NO: 74671 - DNA, 20 bp, Artificial Sequence
  chemically synthesized
tattatcaacttcgaatttc

SEQ ID NO: 74672 - DNA, 20 bp, Artificial Sequence
  chemically synthesized
ataacaaaagtgacctttgc

SEQ ID NO: 74673 - DNA, 20 bp, Artificial Sequence
  chemically synthesized
tgcctgttatccaatgccaa

SEQ ID NO: 74674 - DNA, 20 bp, Artificial Sequence
  chemically synthesized
actgggtaaatggtgaagaa

SEQ ID NO: 74675 - DNA, 20 bp, Artificial Sequence
  chemically synthesized
aggaagcatggcaacgtctg

SEQ ID NO: 74676 - DNA, 20 bp, Artificial Sequence
  chemically synthesized
aacgtctgctcagcttctag

SEQ ID NO: 74677 - DNA, 20 bp, Artificial Sequence
  chemically synthesized
ccaggccccatcttcaacac

SEQ ID NO: 74678 - DNA, 20 bp, Artificial Sequence
  chemically synthesized
actggggattacagctgaac

SEQ ID NO: 74679 - DNA, 20 bp, Artificial Sequence
  chemically synthesized
atatcaggcatgcattactc

SEQ ID NO: 74680 - DNA, 20 bp, Artificial Sequence
  chemically synthesized
caacaaaacgatgaattaaa

SEQ ID NO: 74681 - DNA, 20 bp, Artificial Sequence
  chemically synthesized
tctttaatacaagcagtcgt

SEQ ID NO: 74682 - DNA, 20 bp, Artificial Sequence
  chemically synthesized
gcagtcgtattggcttctat

SEQ ID NO: 74683 - DNA, 20 bp, Artificial Sequence
  chemically synthesized
aagctacaagactctgcaaa

SEQ ID NO: 74684 - DNA, 20 bp, Artificial Sequence
  chemically synthesized
acagcagggatgtccaatct

SEQ ID NO: 74685 - DNA, 20 bp, Artificial Sequence
  chemically synthesized
aaatgtcccataaaatctca

SEQ ID NO: 74686 - DNA, 20 bp, Artificial Sequence
  chemically synthesized
gcccacgggccacaggttgg

SEQ ID NO: 74687 - DNA, 20 bp, Artificial Sequence
  chemically synthesized
tctcttttctggcaccaact

SEQ ID NO: 74688 - DNA, 20 bp, Artificial Sequence
  chemically synthesized
cagctttactagcaccaact

SEQ ID NO: 74689 - DNA, 20 bp, Artificial Sequence
  chemically synthesized
ggatcatctggaattctttt

SEQ ID NO: 74690 - DNA, 20 bp, Artificial Sequence
  chemically synthesized
ctcaagtcccatagtaagat

SEQ ID NO: 74691 - DNA, 20 bp, Artificial Sequence
  chemically synthesized
tattagataatcatatagat

SEQ ID NO: 74692 - DNA, 20 bp, Artificial Sequence
  chemically synthesized
atatgattattaagggcata

SEQ ID NO: 74693 - DNA, 20 bp, Artificial Sequence
  chemically synthesized
tgcatagaatattgctgaag

SEQ ID NO: 74694 - DNA, 20 bp, Artificial Sequence
  chemically synthesized
ggtacttgtatcacagcagc

SEQ ID NO: 74695 - DNA, 20 bp, Artificial Sequence
  chemically synthesized
tttgctcaaaaaaaaattct

SEQ ID NO: 74696 - DNA, 20 bp, Artificial Sequence
  chemically synthesized
attcttcaagttttagagtc

SEQ ID NO: 74697 - DNA, 20 bp, Artificial Sequence
  chemically synthesized
gttatcagcagagtatacct

SEQ ID NO: 74698 - DNA, 20 bp, Artificial Sequence
  chemically synthesized
atctctttttctataatatc

SEQ ID NO: 74699 - DNA, 20 bp, Artificial Sequence
  chemically synthesized
gccatccaatttaccctcac

SEQ ID NO: 74700 - DNA, 20 bp, Artificial Sequence
  chemically synthesized
gagaactaagatgcctagat

SEQ ID NO: 74701 - DNA, 20 bp, Artificial Sequence
  chemically synthesized
gtcaaacatcatatttatag

SEQ ID NO: 74702 - DNA, 20 bp, Artificial Sequence
  chemically synthesized
agttttactattttttttta

SEQ ID NO: 74703 - DNA, 20 bp, Artificial Sequence
  chemically synthesized
gttttactactataggtgaa

SEQ ID NO: 74704 - DNA, 20 bp, Artificial Sequence
  chemically synthesized
ctataggtgaaaaaagcttc

SEQ ID NO: 74705 - DNA, 20 bp, Artificial Sequence
  chemically synthesized
gaaacatctctctccataaa

SEQ ID NO: 74706 - DNA, 20 bp, Artificial Sequence
  chemically synthesized
atctggcttatcagtgtgaa

SEQ ID NO: 74707 - DNA, 20 bp, Artificial Sequence
  chemically synthesized
aattccatgaatatcatggt

SEQ ID NO: 74708 - DNA, 20 bp, Artificial Sequence
  chemically synthesized
ctaatataatttcttggccc

SEQ ID NO: 74709 - DNA, 20 bp, Artificial Sequence
  chemically synthesized
ttataatgaaagagaatgca

SEQ ID NO: 74710 - DNA, 20 bp, Artificial Sequence
  chemically synthesized
ctgaaaaccttgggcccaag

SEQ ID NO: 74711 - DNA, 20 bp, Artificial Sequence
  chemically synthesized
ttaaaagaagtataaatagt

SEQ ID NO: 74712 - DNA, 20 bp, Artificial Sequence
  chemically synthesized
tctcaacctgctaaatatct

SEQ ID NO: 74713 - DNA, 20 bp, Artificial Sequence
  chemically synthesized
acttaatcatctaacatttt

SEQ ID NO: 74714 - DNA, 20 bp, Artificial Sequence
  chemically synthesized
ttgacccatggaatactaga

SEQ ID NO: 74715 - DNA, 20 bp, Artificial Sequence
  chemically synthesized
ctagacttggctttagctgg

SEQ ID NO: 74716 - DNA, 20 bp, Artificial Sequence
  chemically synthesized
gtcattttcaaaaagaatat

SEQ ID NO: 74717 - DNA, 20 bp, Artificial Sequence
  chemically synthesized
tattttagttttctcttaga

SEQ ID NO: 74718 - DNA, 20 bp, Artificial Sequence
  chemically synthesized
aatgctcattttctttgata

SEQ ID NO: 74719 - DNA, 20 bp, Artificial Sequence
  chemically synthesized
atgcagatttgaatgttgta

SEQ ID NO: 74720 - DNA, 20 bp, Artificial Sequence
  chemically synthesized
gctcagtaataaaaaatttt

SEQ ID NO: 74721 - DNA, 20 bp, Artificial Sequence
  chemically synthesized
tgtgtgtgtgtgcatcgttc

SEQ ID NO: 74722 - DNA, 20 bp, Artificial Sequence
  chemically synthesized
tcatcaggtaatagtctagg

SEQ ID NO: 74723 - DNA, 20 bp, Artificial Sequence
  chemically synthesized
agtaaatgacagatacaggg

SEQ ID NO: 74724 - DNA, 20 bp, Artificial Sequence
  chemically synthesized
atactctaaatcaattcaat

SEQ ID NO: 74725 - DNA, 20 bp, Artificial Sequence
  chemically synthesized
aaaagactcacattttaaat

SEQ ID NO: 74726 - DNA, 20 bp, Artificial Sequence
  chemically synthesized
tattttacaagcaagagaac

SEQ ID NO: 74727 - DNA, 20 bp, Artificial Sequence
  chemically synthesized
tccagggtcatagagtcaga

SEQ ID NO: 74728 - DNA, 20 bp, Artificial Sequence
  chemically synthesized
tatatatgtccttagagcta

SEQ ID NO: 74729 - DNA, 20 bp, Artificial Sequence
  chemically synthesized
tctttgctccgtggatacat

SEQ ID NO: 74730 - DNA, 20 bp, Artificial Sequence
  chemically synthesized
atttgggtcatcacatatga

SEQ ID NO: 74731 - DNA, 20 bp, Artificial Sequence
  chemically synthesized
aaaaatttaaaggccagaaa

SEQ ID NO: 74732 - DNA, 20 bp, Artificial Sequence
  chemically synthesized
attcctgtatttttttttca

SEQ ID NO: 74733 - DNA, 20 bp, Artificial Sequence
  chemically synthesized
tgtaaccctcacttctataa

SEQ ID NO: 74734 - DNA, 20 bp, Artificial Sequence
  chemically synthesized
ctggcctagaactgtgtcag

SEQ ID NO: 74735 - DNA, 20 bp, Artificial Sequence
  chemically synthesized
tttcctttctctgaaacatc

SEQ ID NO: 74736 - DNA, 20 bp, Artificial Sequence
  chemically synthesized
atatattaaatagtaaaaca

SEQ ID NO: 74737 - DNA, 20 bp, Artificial Sequence
  chemically synthesized
ctcaaaaaacaagaacttta

SEQ ID NO: 74738 - DNA, 20 bp, Artificial Sequence
  chemically synthesized
tgtcattcacatattattat

SEQ ID NO: 74739 - DNA, 20 bp, Artificial Sequence
  chemically synthesized
tattttccactcaatattaa

SEQ ID NO: 74740 - DNA, 20 bp, Artificial Sequence
  chemically synthesized
tatattgaagtaatatagac

SEQ ID NO: 74741 - DNA, 20 bp, Artificial Sequence
  chemically synthesized
gagcctattatttgtctatt

SEQ ID NO: 74742 - DNA, 20 bp, Artificial Sequence
  chemically synthesized
attaagagattcaatttctc

SEQ ID NO: 74743 - DNA, 20 bp, Artificial Sequence
  chemically synthesized
cgaggaatttatccatttct

SEQ ID NO: 74744 - DNA, 20 bp, Artificial Sequence
  chemically synthesized
tatccatttctactagattt

SEQ ID NO: 74745 - DNA, 20 bp, Artificial Sequence
  chemically synthesized
tttctagtttatttgcgtag

SEQ ID NO: 74746 - DNA, 20 bp, Artificial Sequence
  chemically synthesized
tgtttatagtattctctgat

SEQ ID NO: 74747 - DNA, 20 bp, Artificial Sequence
  chemically synthesized
tgatggtagtttgtatgtct

SEQ ID NO: 74748 - DNA, 20 bp, Artificial Sequence
  chemically synthesized
atcttttcaaaaaaccagct

SEQ ID NO: 74749 - DNA, 20 bp, Artificial Sequence
  chemically synthesized
aaaaaaccagctcctggatt

SEQ ID NO: 74750 - DNA, 20 bp, Artificial Sequence
  chemically synthesized
ctggattcattgattttttt

SEQ ID NO: 74751 - DNA, 20 bp, Artificial Sequence
  chemically synthesized
ttacttatttcttgccttcc

SEQ ID NO: 74752 - DNA, 20 bp, Artificial Sequence
  chemically synthesized
tgccttccgctagcttttga

SEQ ID NO: 74753 - DNA, 20 bp, Artificial Sequence
  chemically synthesized
tagcttttgaaagtgtttgc

SEQ ID NO: 74754 - DNA, 20 bp, Artificial Sequence
  chemically synthesized
gggtgtcaattttagatctt

SEQ ID NO: 74755 - DNA, 20 bp, Artificial Sequence
  chemically synthesized
gctataaatttccctctaca

SEQ ID NO: 74756 - DNA, 20 bp, Artificial Sequence
  chemically synthesized
acactgctttaaatgtgtcc

SEQ ID NO: 74757 - DNA, 20 bp, Artificial Sequence
  chemically synthesized
ctttaaatgtgtcccagaga

SEQ ID NO: 74758 - DNA, 20 bp, Artificial Sequence
  chemically synthesized
tttgttgtatctttattctc

SEQ ID NO: 74759 - DNA, 20 bp, Artificial Sequence
  chemically synthesized
agtcattcaggagcaggctg

SEQ ID NO: 74760 - DNA, 20 bp, Artificial Sequence
  chemically synthesized
gttcagtttccatgtagttg

SEQ ID NO: 74761 - DNA, 20 bp, Artificial Sequence
  chemically synthesized
atgtagttgagtggttttga

SEQ ID NO: 74762 - DNA, 20 bp, Artificial Sequence
  chemically synthesized
tgagtttcttaatcctgagt

SEQ ID NO: 74763 - DNA, 20 bp, Artificial Sequence
  chemically synthesized
tttcttaatcctgagttcta

SEQ ID NO: 74764 - DNA, 20 bp, Artificial Sequence
  chemically synthesized
gattgcactgtggtctgaga

SEQ ID NO: 74765 - DNA, 20 bp, Artificial Sequence
  chemically synthesized
tggtctgagagacagtttgt

SEQ ID NO: 74766 - DNA, 20 bp, Artificial Sequence
  chemically synthesized
ttgttattgtttctgttctt

SEQ ID NO: 74767 - DNA, 20 bp, Artificial Sequence
  chemically synthesized
gttcttttacgtttgctgag

SEQ ID NO: 74768 - DNA, 20 bp, Artificial Sequence
  chemically synthesized
gctgagaagaatgtatattc

SEQ ID NO: 74769 - DNA, 20 bp, Artificial Sequence
  chemically synthesized
gttctgtagatgtctattag

SEQ ID NO: 74770 - DNA, 20 bp, Artificial Sequence
  chemically synthesized
ctctttgtaggtctctaagg

SEQ ID NO: 74771 - DNA, 20 bp, Artificial Sequence
  chemically synthesized
ctttgtctcttttgatcttt

SEQ ID NO: 74772 - DNA, 20 bp, Artificial Sequence
  chemically synthesized
ttgatctttgttggtttaaa

SEQ ID NO: 74773 - DNA, 20 bp, Artificial Sequence
  chemically synthesized
aaagtctgttttatcagaga

SEQ ID NO: 74774 - DNA, 20 bp, Artificial Sequence
  chemically synthesized
gattgcaaaccctgcctttt

SEQ ID NO: 74775 - DNA, 20 bp, Artificial Sequence
  chemically synthesized
ctgccttttttttgttttcc

SEQ ID NO: 74776 - DNA, 20 bp, Artificial Sequence
  chemically synthesized
gcctatgtgtgtctctccac

SEQ ID NO: 74777 - DNA, 20 bp, Artificial Sequence
  chemically synthesized
tgtgtgtctctccacatgag

SEQ ID NO: 74778 - DNA, 20 bp, Artificial Sequence
  chemically synthesized
attatgatgttagctggtta

SEQ ID NO: 74779 - DNA, 20 bp, Artificial Sequence
  chemically synthesized
ttattttgcttgctagttga

SEQ ID NO: 74780 - DNA, 20 bp, Artificial Sequence
  chemically synthesized
ttgatggtctttacaatttg

SEQ ID NO: 74781 - DNA, 20 bp, Artificial Sequence
  chemically synthesized
tttttgcagtggctggtact

SEQ ID NO: 74782 - DNA, 20 bp, Artificial Sequence
  chemically synthesized
ctggtactggttgtttcttt

SEQ ID NO: 74783 - DNA, 20 bp, Artificial Sequence
  chemically synthesized
tggttgtttctttccatgtt

SEQ ID NO: 74784 - DNA, 20 bp, Artificial Sequence
  chemically synthesized
ctggtggtgacaaaatcagc

SEQ ID NO: 74785 - DNA, 20 bp, Artificial Sequence
  chemically synthesized
ttttatttctccttcactta

SEQ ID NO: 74786 - DNA, 20 bp, Artificial Sequence
  chemically synthesized
ccaaaaaaagtccaggacca

SEQ ID NO: 74787 - DNA, 20 bp, Artificial Sequence
  chemically synthesized
ccaaatccaggagcacatca

SEQ ID NO: 74788 - DNA, 20 bp, Artificial Sequence
  chemically synthesized
agcttatccaccatgatcaa

SEQ ID NO: 74789 - DNA, 20 bp, Artificial Sequence
  chemically synthesized
cagaaccaaagacacaaacc

SEQ ID NO: 74790 - DNA, 20 bp, Artificial Sequence
  chemically synthesized
aggcctttgacaaaattcaa

SEQ ID NO: 74791 - DNA, 20 bp, Artificial Sequence
  chemically synthesized
aaaagaggaagtgaaattgt

SEQ ID NO: 74792 - DNA, 20 bp, Artificial Sequence
  chemically synthesized
attgtccctgtttgcagatg

SEQ ID NO: 74793 - DNA, 20 bp, Artificial Sequence
  chemically synthesized
ccttactgcccaaggtaatt

SEQ ID NO: 74794 - DNA, 20 bp, Artificial Sequence
  chemically synthesized
gacaaaaacaagcaatgggg

SEQ ID NO: 74795 - DNA, 20 bp, Artificial Sequence
  chemically synthesized
ttatacaaaaattatttcaa

SEQ ID NO: 74796 - DNA, 20 bp, Artificial Sequence
  chemically synthesized
aatgggatctaattaaacta

SEQ ID NO: 74797 - DNA, 20 bp, Artificial Sequence
  chemically synthesized
ctataaagacacatgcacac

SEQ ID NO: 74798 - DNA, 20 bp, Artificial Sequence
  chemically synthesized
caaatgtccaacaatgatag

SEQ ID NO: 74799 - DNA, 20 bp, Artificial Sequence
  chemically synthesized
aacttctgcctcccaggttc

SEQ ID NO: 74800 - DNA, 20 bp, Artificial Sequence
  chemically synthesized
tgcctcagcctcttgagtag

SEQ ID NO: 74801 - DNA, 20 bp, Artificial Sequence
  chemically synthesized
ttttgtatttttagtagaga

SEQ ID NO: 74802 - DNA, 20 bp, Artificial Sequence
  chemically synthesized
ttttagtagagacggggttt

SEQ ID NO: 74803 - DNA, 20 bp, Artificial Sequence
  chemically synthesized
cgcctcagcctctcaaagtg

SEQ ID NO: 74804 - DNA, 20 bp, Artificial Sequence
  chemically synthesized
gccaccgtgccaggctggca

SEQ ID NO: 74805 - DNA, 20 bp, Artificial Sequence
  chemically synthesized
cgtctgccattgcaaatatc

SEQ ID NO: 74806 - DNA, 20 bp, Artificial Sequence
  chemically synthesized
ttgcaaatatctaaagttta

SEQ ID NO: 74807 - DNA, 20 bp, Artificial Sequence
  chemically synthesized
tttatcctatatttttgaga

SEQ ID NO: 74808 - DNA, 20 bp, Artificial Sequence
  chemically synthesized
tatgtcttcaatggctagca

SEQ ID NO: 74809 - DNA, 20 bp, Artificial Sequence
  chemically synthesized
ggaagaaggcatacatgcta

SEQ ID NO: 74810 - DNA, 20 bp, Artificial Sequence
  chemically synthesized
gatcagtaaaaaatttgatg

SEQ ID NO: 74811 - DNA, 20 bp, Artificial Sequence
  chemically synthesized
atttgatgctgcgttttata

SEQ ID NO: 74812 - DNA, 20 bp, Artificial Sequence
  chemically synthesized
cattggatggtagtaaagat

SEQ ID NO: 74813 - DNA, 20 bp, Artificial Sequence
  chemically synthesized
tggtagtaaagatcaaagct

SEQ ID NO: 74814 - DNA, 20 bp, Artificial Sequence
  chemically synthesized
gggtaagaggctgaaagtct

SEQ ID NO: 74815 - DNA, 20 bp, Artificial Sequence
  chemically synthesized
atttatataatggttattta

SEQ ID NO: 74816 - DNA, 20 bp, Artificial Sequence
  chemically synthesized
ggcttttcaataggttattg

SEQ ID NO: 74817 - DNA, 20 bp, Artificial Sequence
  chemically synthesized
agacctcattcagcctaagg

SEQ ID NO: 74818 - DNA, 20 bp, Artificial Sequence
  chemically synthesized
tgatgggaatcccagggctg

SEQ ID NO: 74819 - DNA, 20 bp, Artificial Sequence
  chemically synthesized
tttaacctcatcagccgtca

SEQ ID NO: 74820 - DNA, 20 bp, Artificial Sequence
  chemically synthesized
ttggcatagcagctgtggtc

SEQ ID NO: 74821 - DNA, 20 bp, Artificial Sequence
  chemically synthesized
attcctactgtgagcacatt

SEQ ID NO: 74822 - DNA, 20 bp, Artificial Sequence
  chemically synthesized
tactgtgagcacattgccag

SEQ ID NO: 74823 - DNA, 20 bp, Artificial Sequence
  chemically synthesized
actctctacaggactggata

SEQ ID NO: 74824 - DNA, 20 bp, Artificial Sequence
  chemically synthesized
ctacacaatgatccttcact

SEQ ID NO: 74825 - DNA, 20 bp, Artificial Sequence
  chemically synthesized
cattcttttcatttcttgcc

SEQ ID NO: 74826 - DNA, 20 bp, Artificial Sequence
  chemically synthesized
gaccaaacaaattaaagatc

SEQ ID NO: 74827 - DNA, 20 bp, Artificial Sequence
  chemically synthesized
acaaattaaagatcgagtga

SEQ ID NO: 74828 - DNA, 20 bp, Artificial Sequence
  chemically synthesized
tctcctatcagtgtatgctg

SEQ ID NO: 74829 - DNA, 20 bp, Artificial Sequence
  chemically synthesized
tatgctgttaagattaaaaa

SEQ ID NO: 74830 - DNA, 20 bp, Artificial Sequence
  chemically synthesized
tgctaaggcactcaaagatc

SEQ ID NO: 74831 - DNA, 20 bp, Artificial Sequence
  chemically synthesized
gagaaaagagaaatatattt

SEQ ID NO: 74832 - DNA, 20 bp, Artificial Sequence
  chemically synthesized
aaatatattttagggtttaa

SEQ ID NO: 74833 - DNA, 20 bp, Artificial Sequence
  chemically synthesized
tcctacgtagagctaggaag

SEQ ID NO: 74834 - DNA, 20 bp, Artificial Sequence
  chemically synthesized
gtggggttttgagtcagtca

SEQ ID NO: 74835 - DNA, 20 bp, Artificial Sequence
  chemically synthesized
ccaatattaaattaacaaat

SEQ ID NO: 74836 - DNA, 20 bp, Artificial Sequence
  chemically synthesized
atacacatttccccctatag

SEQ ID NO: 74837 - DNA, 20 bp, Artificial Sequence
  chemically synthesized
gaaacatcactgaagaagta

SEQ ID NO: 74838 - DNA, 20 bp, Artificial Sequence
  chemically synthesized
aacattttttaaaaagctag

SEQ ID NO: 74839 - DNA, 20 bp, Artificial Sequence
  chemically synthesized
agcctagaacaatgccatga

SEQ ID NO: 74840 - DNA, 20 bp, Artificial Sequence
  chemically synthesized
cttaaacacttgaaatctac

SEQ ID NO: 74841 - DNA, 20 bp, Artificial Sequence
  chemically synthesized
acacttgaaatctactcatg

SEQ ID NO: 74842 - DNA, 20 bp, Artificial Sequence
  chemically synthesized
gaaatctactcatgcttggc

SEQ ID NO: 74843 - DNA, 20 bp, Artificial Sequence
  chemically synthesized
ctactcatgcttggcttatg

SEQ ID NO: 74844 - DNA, 20 bp, Artificial Sequence
  chemically synthesized
tggcttatgcttagcttttt

SEQ ID NO: 74845 - DNA, 20 bp, Artificial Sequence
  chemically synthesized
aatttatacatgtattaaca

SEQ ID NO: 74846 - DNA, 20 bp, Artificial Sequence
  chemically synthesized
gcatgcacacacacacacac

SEQ ID NO: 74847 - DNA, 20 bp, Artificial Sequence
  chemically synthesized
cattctaaaaaatctaatta

SEQ ID NO: 74848 - DNA, 20 bp, Artificial Sequence
  chemically synthesized
agtacatctgttaaacttca

SEQ ID NO: 74849 - DNA, 20 bp, Artificial Sequence
  chemically synthesized
gtttttttttctactctaca

SEQ ID NO: 74850 - DNA, 20 bp, Artificial Sequence
  chemically synthesized
tgatggaaaatgagggaata

SEQ ID NO: 74851 - DNA, 20 bp, Artificial Sequence
  chemically synthesized
atagattgcagtatgatgac

SEQ ID NO: 74852 - DNA, 20 bp, Artificial Sequence
  chemically synthesized
gaggatttgactgaaaggta

SEQ ID NO: 74853 - DNA, 20 bp, Artificial Sequence
  chemically synthesized
aaggtaggaagattttgtat

SEQ ID NO: 74854 - DNA, 20 bp, Artificial Sequence
  chemically synthesized
agttaaaatggtagaagtaa

SEQ ID NO: 74855 - DNA, 20 bp, Artificial Sequence
  chemically synthesized
aataaactttcagttgagca

SEQ ID NO: 74856 - DNA, 20 bp, Artificial Sequence
  chemically synthesized
agttgagcactcagattctg

SEQ ID NO: 74857 - DNA, 20 bp, Artificial Sequence
  chemically synthesized
ccattgccctggacatgaga

SEQ ID NO: 74858 - DNA, 20 bp, Artificial Sequence
  chemically synthesized
aaccaaacaattttaaagca

SEQ ID NO: 74859 - DNA, 20 bp, Artificial Sequence
  chemically synthesized
aacaaaaggtacagggtgct

SEQ ID NO: 74860 - DNA, 20 bp, Artificial Sequence
  chemically synthesized
agaccagtaccactacagac

SEQ ID NO: 74861 - DNA, 20 bp, Artificial Sequence
  chemically synthesized
ttaatatcaatcaagcaaaa

SEQ ID NO: 74862 - DNA, 20 bp, Artificial Sequence
  chemically synthesized
aaggacaacataaaaatcaa

SEQ ID NO: 74863 - DNA, 20 bp, Artificial Sequence
  chemically synthesized
catgggaggctgaggcagga

SEQ ID NO: 74864 - DNA, 20 bp, Artificial Sequence
  chemically synthesized
gtgcctaaaataaatgaaat

SEQ ID NO: 74865 - DNA, 20 bp, Artificial Sequence
  chemically synthesized
tgaaataattgtttattata

SEQ ID NO: 74866 - DNA, 20 bp, Artificial Sequence
  chemically synthesized
ctaatcaaaataaaaatttg

SEQ ID NO: 74867 - DNA, 20 bp, Artificial Sequence
  chemically synthesized
tctttccatttttattgtga

SEQ ID NO: 74868 - DNA, 20 bp, Artificial Sequence
  chemically synthesized
atagtaacctctaatctact

SEQ ID NO: 74869 - DNA, 20 bp, Artificial Sequence
  chemically synthesized
tattttagataattcatata

SEQ ID NO: 74870 - DNA, 20 bp, Artificial Sequence
  chemically synthesized
aaatagattcatacaatatt

SEQ ID NO: 74871 - DNA, 20 bp, Artificial Sequence
  chemically synthesized
acaatatttgttgttttgtg

SEQ ID NO: 74872 - DNA, 20 bp, Artificial Sequence
  chemically synthesized
ctggcttattttacccaaca

SEQ ID NO: 74873 - DNA, 20 bp, Artificial Sequence
  chemically synthesized
taacatgtatagtggtaagt

SEQ ID NO: 74874 - DNA, 20 bp, Artificial Sequence
  chemically synthesized
tttgcttaatgttgtccatt

SEQ ID NO: 74875 - DNA, 20 bp, Artificial Sequence
  chemically synthesized
taaaacagtgttatttgagg

SEQ ID NO: 74876 - DNA, 20 bp, Artificial Sequence
  chemically synthesized
ccattgtgtgtatatatcac

SEQ ID NO: 74877 - DNA, 20 bp, Artificial Sequence
  chemically synthesized
tcacatttgtttattcattc

SEQ ID NO: 74878 - DNA, 20 bp, Artificial Sequence
  chemically synthesized
catctgtttatgtacattct

SEQ ID NO: 74879 - DNA, 20 bp, Artificial Sequence
  chemically synthesized
atgaacatttcagtacaagt

SEQ ID NO: 74880 - DNA, 20 bp, Artificial Sequence
  chemically synthesized
ggtcatatgttattcagtgc

SEQ ID NO: 74881 - DNA, 20 bp, Artificial Sequence
  chemically synthesized
acatttttagcagcaatata

SEQ ID NO: 74882 - DNA, 20 bp, Artificial Sequence
  chemically synthesized
gtcaacacttgttacttttc

SEQ ID NO: 74883 - DNA, 20 bp, Artificial Sequence
  chemically synthesized
cacttgttacttttcatttg

SEQ ID NO: 74884 - DNA, 20 bp, Artificial Sequence
  chemically synthesized
cttaaagtatagacattcta

SEQ ID NO: 74885 - DNA, 20 bp, Artificial Sequence
  chemically synthesized
agtttgaagtagtgtcttat

SEQ ID NO: 74886 - DNA, 20 bp, Artificial Sequence
  chemically synthesized
aagtagtgtcttattgtggt

SEQ ID NO: 74887 - DNA, 20 bp, Artificial Sequence
  chemically synthesized
atttgcatatttttaaattg

SEQ ID NO: 74888 - DNA, 20 bp, Artificial Sequence
  chemically synthesized
ttaaattgagttgtttgtct

SEQ ID NO: 74889 - DNA, 20 bp, Artificial Sequence
  chemically synthesized
ttgtctttttactttcttaa

SEQ ID NO: 74890 - DNA, 20 bp, Artificial Sequence
  chemically synthesized
tattgtaaaatcaaagttca

SEQ ID NO: 74891 - DNA, 20 bp, Artificial Sequence
  chemically synthesized
caaagttcatgaagatttac

SEQ ID NO: 74892 - DNA, 20 bp, Artificial Sequence
  chemically synthesized
atgcttccttccgagggtgt

SEQ ID NO: 74893 - DNA, 20 bp, Artificial Sequence
  chemically synthesized
attacacaatttttatgcat

SEQ ID NO: 74894 - DNA, 20 bp, Artificial Sequence
  chemically synthesized
agttagcatgacaacaaaaa

SEQ ID NO: 74895 - DNA, 20 bp, Artificial Sequence
  chemically synthesized
aaaatgtatgtaatccctca

SEQ ID NO: 74896 - DNA, 20 bp, Artificial Sequence
  chemically synthesized
cttatacttggtattagaaa

SEQ ID NO: 74897 - DNA, 20 bp, Artificial Sequence
  chemically synthesized
tggtattagaaaaattgttt

SEQ ID NO: 74898 - DNA, 20 bp, Artificial Sequence
  chemically synthesized
actattattacctgtcttta

SEQ ID NO: 74899 - DNA, 20 bp, Artificial Sequence
  chemically synthesized
actttttactttgtatatgg

SEQ ID NO: 74900 - DNA, 20 bp, Artificial Sequence
  chemically synthesized
gtatgttaacctgactacat

SEQ ID NO: 74901 - DNA, 20 bp, Artificial Sequence
  chemically synthesized
tgactacataaaagttttgt

SEQ ID NO: 74902 - DNA, 20 bp, Artificial Sequence
  chemically synthesized
aatgatattgtgtaactatt

SEQ ID NO: 74903 - DNA, 20 bp, Artificial Sequence
  chemically synthesized
tgtaactattttatgtttat

SEQ ID NO: 74904 - DNA, 20 bp, Artificial Sequence
  chemically synthesized
tcttatgtatactctctcca

SEQ ID NO: 74905 - DNA, 20 bp, Artificial Sequence
  chemically synthesized
ccctttctctctaatacacc

SEQ ID NO: 74906 - DNA, 20 bp, Artificial Sequence
  chemically synthesized
gggaataattattcttggtt

SEQ ID NO: 74907 - DNA, 20 bp, Artificial Sequence
  chemically synthesized
aaacagtaacaaatagtatg

SEQ ID NO: 74908 - DNA, 20 bp, Artificial Sequence
  chemically synthesized
tatgcctaatggtataatgt

SEQ ID NO: 74909 - DNA, 20 bp, Artificial Sequence
  chemically synthesized
ggtataatgtgctggcttgc

SEQ ID NO: 74910 - DNA, 20 bp, Artificial Sequence
  chemically synthesized
ggcttgcaccagcttaggaa

SEQ ID NO: 74911 - DNA, 20 bp, Artificial Sequence
  chemically synthesized
ggaaatatttattactatcc

SEQ ID NO: 74912 - DNA, 20 bp, Artificial Sequence
  chemically synthesized
acatgtgacttgtgagatac

SEQ ID NO: 74913 - DNA, 20 bp, Artificial Sequence
  chemically synthesized
gacccttctgcaaaatacag

SEQ ID NO: 74914 - DNA, 20 bp, Artificial Sequence
  chemically synthesized
aaatcaactttaatataatc

SEQ ID NO: 74915 - DNA, 20 bp, Artificial Sequence
  chemically synthesized
ctttataaacactacaagtt

SEQ ID NO: 74916 - DNA, 20 bp, Artificial Sequence
  chemically synthesized
tccatgtgaatctgtcatct

SEQ ID NO: 74917 - DNA, 20 bp, Artificial Sequence
  chemically synthesized
gtcatctctatgcttatttt

SEQ ID NO: 74918 - DNA, 20 bp, Artificial Sequence
  chemically synthesized
actgccatagatgacccaac

SEQ ID NO: 74919 - DNA, 20 bp, Artificial Sequence
  chemically synthesized
atacttttctgcatgaccca

SEQ ID NO: 74920 - DNA, 20 bp, Artificial Sequence
  chemically synthesized
taggtttctcttccactcac

SEQ ID NO: 74921 - DNA, 20 bp, Artificial Sequence
  chemically synthesized
tcactgtggcttacctgtgc

SEQ ID NO: 74922 - DNA, 20 bp, Artificial Sequence
  chemically synthesized
acttatatattccagtctcc

SEQ ID NO: 74923 - DNA, 20 bp, Artificial Sequence
  chemically synthesized
cttcagaggaagtatcacca

SEQ ID NO: 74924 - DNA, 20 bp, Artificial Sequence
  chemically synthesized
gcctttgttgaacttggtgt

SEQ ID NO: 74925 - DNA, 20 bp, Artificial Sequence
  chemically synthesized
tcctctttggcattaacgat

SEQ ID NO: 74926 - DNA, 20 bp, Artificial Sequence
  chemically synthesized
ttttggtggttgcctgctcc

SEQ ID NO: 74927 - DNA, 20 bp, Artificial Sequence
  chemically synthesized
tccttctggcaatgtcagtg

SEQ ID NO: 74928 - DNA, 20 bp, Artificial Sequence
  chemically synthesized
cgccattgccttgcgcagtg

SEQ ID NO: 74929 - DNA, 20 bp, Artificial Sequence
  chemically synthesized
ggactggacttattgttcat

SEQ ID NO: 74930 - DNA, 20 bp, Artificial Sequence
  chemically synthesized
gttcattgtggtttcttatg

SEQ ID NO: 74931 - DNA, 20 bp, Artificial Sequence
  chemically synthesized
attcttcatacagtactgga

SEQ ID NO: 74932 - DNA, 20 bp, Artificial Sequence
  chemically synthesized
atgtgtgtcgcacatatgtg

SEQ ID NO: 74933 - DNA, 20 bp, Artificial Sequence
  chemically synthesized
tgatcagcctctccctgatg

SEQ ID NO: 74934 - DNA, 20 bp, Artificial Sequence
  chemically synthesized
cttttccagactgtcacggc

SEQ ID NO: 74935 - DNA, 20 bp, Artificial Sequence
  chemically synthesized
tgacagcacaggcacttaga

SEQ ID NO: 74936 - DNA, 20 bp, Artificial Sequence
  chemically synthesized
tcaggctttattacctgaat

SEQ ID NO: 74937 - DNA, 20 bp, Artificial Sequence
  chemically synthesized
tttgcaaatatgaaaaattc

SEQ ID NO: 74938 - DNA, 20 bp, Artificial Sequence
  chemically synthesized
tgaaaaattccatggcttat

SEQ ID NO: 74939 - DNA, 20 bp, Artificial Sequence
  chemically synthesized
tggcttattattgcttgtta

SEQ ID NO: 74940 - DNA, 20 bp, Artificial Sequence
  chemically synthesized
ttttgtagatgaagaaaaaa

SEQ ID NO: 74941 - DNA, 20 bp, Artificial Sequence
  chemically synthesized
tgtgggaggaggcatagaac

SEQ ID NO: 74942 - DNA, 20 bp, Artificial Sequence
  chemically synthesized
atatgtagaaagagtcttgg

SEQ ID NO: 74943 - DNA, 20 bp, Artificial Sequence
  chemically synthesized
agaaagagtcttggggaggt

SEQ ID NO: 74944 - DNA, 20 bp, Artificial Sequence
  chemically synthesized
aaagagtacatattgtatta

SEQ ID NO: 74945 - DNA, 20 bp, Artificial Sequence
  chemically synthesized
atattgtattattttgtttg

SEQ ID NO: 74946 - DNA, 20 bp, Artificial Sequence
  chemically synthesized
ttaatgtcaaaaaatcagaa

SEQ ID NO: 74947 - DNA, 20 bp, Artificial Sequence
  chemically synthesized
ttgtgttagggatgtggtga

SEQ ID NO: 74948 - DNA, 20 bp, Artificial Sequence
  chemically synthesized
aatttgtcaaaacggtacag

SEQ ID NO: 74949 - DNA, 20 bp, Artificial Sequence
  chemically synthesized
gaaaatagtaataataatac

SEQ ID NO: 74950 - DNA, 20 bp, Artificial Sequence
  chemically synthesized
tagtaataataatacagatg

SEQ ID NO: 74951 - DNA, 20 bp, Artificial Sequence
  chemically synthesized
cctggaaattaattataata

SEQ ID NO: 74952 - DNA, 20 bp, Artificial Sequence
  chemically synthesized
ataatattctgtttactttg

SEQ ID NO: 74953 - DNA, 20 bp, Artificial Sequence
  chemically synthesized
agtttacaatttctgtaata

SEQ ID NO: 74954 - DNA, 20 bp, Artificial Sequence
  chemically synthesized
cttttaactggtcaggagga

SEQ ID NO: 74955 - DNA, 20 bp, Artificial Sequence
  chemically synthesized
aactggtcaggaggaaactg

SEQ ID NO: 74956 - DNA, 20 bp, Artificial Sequence
  chemically synthesized
aaaccacaactacttgaaaa

SEQ ID NO: 74957 - DNA, 20 bp, Artificial Sequence
  chemically synthesized
catcaatcactcggtagtag

SEQ ID NO: 74958 - DNA, 20 bp, Artificial Sequence
  chemically synthesized
attctagaaaatccctcaga

SEQ ID NO: 74959 - DNA, 20 bp, Artificial Sequence
  chemically synthesized
agggattgcagagcccaact

SEQ ID NO: 74960 - DNA, 20 bp, Artificial Sequence
  chemically synthesized
ctattaaaccacacagtctt

SEQ ID NO: 74961 - DNA, 20 bp, Artificial Sequence
  chemically synthesized
agccaaccaagtaactaata

SEQ ID NO: 74962 - DNA, 20 bp, Artificial Sequence
  chemically synthesized
gtggcaaaatttatattttt

SEQ ID NO: 74963 - DNA, 20 bp, Artificial Sequence
  chemically synthesized
agtgaagtcataaaaacaac

SEQ ID NO: 74964 - DNA, 20 bp, Artificial Sequence
  chemically synthesized
gggatcttgctagtagtatg

SEQ ID NO: 74965 - DNA, 20 bp, Artificial Sequence
  chemically synthesized
aaatgaataagaaaataaaa

SEQ ID NO: 74966 - DNA, 20 bp, Artificial Sequence
  chemically synthesized
aaatccagcttttatgatct

SEQ ID NO: 74967 - DNA, 20 bp, Artificial Sequence
  chemically synthesized
gagctatagtgtaccatact

SEQ ID NO: 74968 - DNA, 20 bp, Artificial Sequence
  chemically synthesized
gtaccatactaagtgattta

SEQ ID NO: 74969 - DNA, 20 bp, Artificial Sequence
  chemically synthesized
aacaaatatatgaagaaatt

SEQ ID NO: 74970 - DNA, 20 bp, Artificial Sequence
  chemically synthesized
accagacaatccaactaaaa

SEQ ID NO: 74971 - DNA, 20 bp, Artificial Sequence
  chemically synthesized
agtggtcccataacttaaaa

SEQ ID NO: 74972 - DNA, 20 bp, Artificial Sequence
  chemically synthesized
tctgtaaaccattttctcct

SEQ ID NO: 74973 - DNA, 20 bp, Artificial Sequence
  chemically synthesized
tgaggacaaaattcactcac

SEQ ID NO: 74974 - DNA, 20 bp, Artificial Sequence
  chemically synthesized
gtcatatattaataatgtat

SEQ ID NO: 74975 - DNA, 20 bp, Artificial Sequence
  chemically synthesized
tataaaaggggccttcccac

SEQ ID NO: 74976 - DNA, 20 bp, Artificial Sequence
  chemically synthesized
gggccttcccacattagttt

SEQ ID NO: 74977 - DNA, 20 bp, Artificial Sequence
  chemically synthesized
cattagtttaactgcttagg

SEQ ID NO: 74978 - DNA, 20 bp, Artificial Sequence
  chemically synthesized
aacacttttagaactatcat

SEQ ID NO: 74979 - DNA, 20 bp, Artificial Sequence
  chemically synthesized
attacatcggtcaaattttc

SEQ ID NO: 74980 - DNA, 20 bp, Artificial Sequence
  chemically synthesized
cagcaacttcacttcactta

SEQ ID NO: 74981 - DNA, 20 bp, Artificial Sequence
  chemically synthesized
ttaaagtgtagaattttttt

SEQ ID NO: 74982 - DNA, 20 bp, Artificial Sequence
  chemically synthesized
atttttttgcctgtttttgc

SEQ ID NO: 74983 - DNA, 20 bp, Artificial Sequence
  chemically synthesized
aataacttgctatatttata

SEQ ID NO: 74984 - DNA, 20 bp, Artificial Sequence
  chemically synthesized
accacagcacaaaaatctat

SEQ ID NO: 74985 - DNA, 20 bp, Artificial Sequence
  chemically synthesized
gccatatgttaggccacaag

SEQ ID NO: 74986 - DNA, 20 bp, Artificial Sequence
  chemically synthesized
tgcatatacacatacagatg

SEQ ID NO: 74987 - DNA, 20 bp, Artificial Sequence
  chemically synthesized
ccaggtgaaataaacagcct

SEQ ID NO: 74988 - DNA, 20 bp, Artificial Sequence
  chemically synthesized
agccttgttgcttacacaaa

SEQ ID NO: 74989 - DNA, 20 bp, Artificial Sequence
  chemically synthesized
catgaaatttggtgccgtga

SEQ ID NO: 74990 - DNA, 20 bp, Artificial Sequence
  chemically synthesized
ttccagtagagacaaaggag

SEQ ID NO: 74991 - DNA, 20 bp, Artificial Sequence
  chemically synthesized
ctgggaaggcagccttccct

SEQ ID NO: 74992 - DNA, 20 bp, Artificial Sequence
  chemically synthesized
taatcattgcagggacacct

SEQ ID NO: 74993 - DNA, 20 bp, Artificial Sequence
  chemically synthesized
acacctctctgattattaaa

SEQ ID NO: 74994 - DNA, 20 bp, Artificial Sequence
  chemically synthesized
tctccatgtctctgcccctt

SEQ ID NO: 74995 - DNA, 20 bp, Artificial Sequence
  chemically synthesized
gtctgtactctttcttttct

SEQ ID NO: 74996 - DNA, 20 bp, Artificial Sequence
  chemically synthesized
tgccttattttcttctgcaa

SEQ ID NO: 74997 - DNA, 20 bp, Artificial Sequence
  chemically synthesized
cctcccctcctcacacccgg

SEQ ID NO: 74998 - DNA, 20 bp, Artificial Sequence
  chemically synthesized
tcctcacacccggtccggtt

SEQ ID NO: 74999 - DNA, 20 bp, Artificial Sequence
  chemically synthesized
atccgacctctcccgaatca

SEQ ID NO: 75000 - DNA, 20 bp, Artificial Sequence
  chemically synthesized
ctcgttcggcagcaaccctg

SEQ ID NO: 75001 - DNA, 20 bp, Artificial Sequence
  chemically synthesized
cctccggaaccacctccccc

SEQ ID NO: 75002 - DNA, 20 bp, Artificial Sequence
  chemically synthesized
ggccaaggaatgcccgcagc

SEQ ID NO: 75003 - DNA, 20 bp, Artificial Sequence
  chemically synthesized
ctgactccttcccagatctt

SEQ ID NO: 75004 - DNA, 20 bp, Artificial Sequence
  chemically synthesized
cctgtagaccatcacagaca

SEQ ID NO: 75005 - DNA, 20 bp, Artificial Sequence
  chemically synthesized
acattaccttcttttcaaag

SEQ ID NO: 75006 - DNA, 20 bp, Artificial Sequence
  chemically synthesized
actgttgtaggtattgatgg

SEQ ID NO: 75007 - DNA, 20 bp, Artificial Sequence
  chemically synthesized
cgagacactttaactaaatt

SEQ ID NO: 75008 - DNA, 20 bp, Artificial Sequence
  chemically synthesized
gctacagccatacctcattg

SEQ ID NO: 75009 - DNA, 20 bp, Artificial Sequence
  chemically synthesized
tgccagtatcccatcccaca

SEQ ID NO: 75010 - DNA, 20 bp, Artificial Sequence
  chemically synthesized
ccatcccacagcatgctttg

SEQ ID NO: 75011 - DNA, 20 bp, Artificial Sequence
  chemically synthesized
aatctgcatcttatcaacca

SEQ ID NO: 75012 - DNA, 20 bp, Artificial Sequence
  chemically synthesized
tattctgttctggatctcaa

SEQ ID NO: 75013 - DNA, 20 bp, Artificial Sequence
  chemically synthesized
cacccttcattccagcctct

SEQ ID NO: 75014 - DNA, 20 bp, Artificial Sequence
  chemically synthesized
ttacctgggctgtactgctg

SEQ ID NO: 75015 - DNA, 20 bp, Artificial Sequence
  chemically synthesized
aaaaacacacgtgctctccc

SEQ ID NO: 75016 - DNA, 20 bp, Artificial Sequence
  chemically synthesized
gtgctctccctgctgattgt

SEQ ID NO: 75017 - DNA, 20 bp, Artificial Sequence
  chemically synthesized
ctgtccaaataacttgacct

SEQ ID NO: 75018 - DNA, 20 bp, Artificial Sequence
  chemically synthesized
ggtctgcatgcagtggctgc

SEQ ID NO: 75019 - DNA, 20 bp, Artificial Sequence
  chemically synthesized
gaggccctaaaaatcacaaa

SEQ ID NO: 75020 - DNA, 20 bp, Artificial Sequence
  chemically synthesized
cctgataccacacctgaccc

SEQ ID NO: 75021 - DNA, 20 bp, Artificial Sequence
  chemically synthesized
ctgttcctcaccctgatcac

SEQ ID NO: 75022 - DNA, 20 bp, Artificial Sequence
  chemically synthesized
tctgctattctgctactcct

SEQ ID NO: 75023 - DNA, 20 bp, Artificial Sequence
  chemically synthesized
ccttccctacacatcaagct

SEQ ID NO: 75024 - DNA, 20 bp, Artificial Sequence
  chemically synthesized
cccccacccaggactggcaa

SEQ ID NO: 75025 - DNA, 20 bp, Artificial Sequence
  chemically synthesized
ccttctgtcagacataattc

SEQ ID NO: 75026 - DNA, 20 bp, Artificial Sequence
  chemically synthesized
tttattagtcaaatcagcca

SEQ ID NO: 75027 - DNA, 20 bp, Artificial Sequence
  chemically synthesized
acagcccatttgagctcctg

SEQ ID NO: 75028 - DNA, 20 bp, Artificial Sequence
  chemically synthesized
actactcatacatgccctgc

SEQ ID NO: 75029 - DNA, 20 bp, Artificial Sequence
  chemically synthesized
gccctgctcttgtttacact

SEQ ID NO: 75030 - DNA, 20 bp, Artificial Sequence
  chemically synthesized
ttgtttacactgccggttta

SEQ ID NO: 75031 - DNA, 20 bp, Artificial Sequence
  chemically synthesized
ccacttcttagtcctttaat

SEQ ID NO: 75032 - DNA, 20 bp, Artificial Sequence
  chemically synthesized
tttctccttctcttattcca

SEQ ID NO: 75033 - DNA, 20 bp, Artificial Sequence
  chemically synthesized
caccaataattctacatgac

SEQ ID NO: 75034 - DNA, 20 bp, Artificial Sequence
  chemically synthesized
cccttaccacaaaatcttcc

SEQ ID NO: 75035 - DNA, 20 bp, Artificial Sequence
  chemically synthesized
gccccaacacttcaacacta

SEQ ID NO: 75036 - DNA, 20 bp, Artificial Sequence
  chemically synthesized
ccgcctgcacccaggtgata

SEQ ID NO: 75037 - DNA, 20 bp, Artificial Sequence
  chemically synthesized
agctttattgctcacacaaa

SEQ ID NO: 75038 - DNA, 20 bp, Artificial Sequence
  chemically synthesized
acctatatccaaaaaagtag

SEQ ID NO: 75039 - DNA, 20 bp, Artificial Sequence
  chemically synthesized
gaaaatcattaaaaacaaac

SEQ ID NO: 75040 - DNA, 20 bp, Artificial Sequence
  chemically synthesized
caatagaacaataatgaata

SEQ ID NO: 75041 - DNA, 20 bp, Artificial Sequence
  chemically synthesized
acaagattaaagttgtaata

SEQ ID NO: 75042 - DNA, 20 bp, Artificial Sequence
  chemically synthesized
aaaggaagaagttaaattag

SEQ ID NO: 75043 - DNA, 20 bp, Artificial Sequence
  chemically synthesized
aacttcactaaatactatta

SEQ ID NO: 75044 - DNA, 20 bp, Artificial Sequence
  chemically synthesized
caatactacccaaagcaatg

SEQ ID NO: 75045 - DNA, 20 bp, Artificial Sequence
  chemically synthesized
tcaggaggctgaggcaggag

SEQ ID NO: 75046 - DNA, 20 bp, Artificial Sequence
  chemically synthesized
gaggcagaagttgcagtgat

SEQ ID NO: 75047 - DNA, 20 bp, Artificial Sequence
  chemically synthesized
atatacaaaaatcaaatcaa

SEQ ID NO: 75048 - DNA, 20 bp, Artificial Sequence
  chemically synthesized
gggaaaccctccagggcatt

SEQ ID NO: 75049 - DNA, 20 bp, Artificial Sequence
  chemically synthesized
accaaaacaaaaatagacaa

SEQ ID NO: 75050 - DNA, 20 bp, Artificial Sequence
  chemically synthesized
aaacaaaaatagacaattgg

SEQ ID NO: 75051 - DNA, 20 bp, Artificial Sequence
  chemically synthesized
tatcatctcaccttagttaa

SEQ ID NO: 75052 - DNA, 20 bp, Artificial Sequence
  chemically synthesized
acaaaacaaaaggaaataac

SEQ ID NO: 75053 - DNA, 20 bp, Artificial Sequence
  chemically synthesized
agcaattatgaaggacagta

SEQ ID NO: 75054 - DNA, 20 bp, Artificial Sequence
  chemically synthesized
tatagcactattcacaaacg

SEQ ID NO: 75055 - DNA, 20 bp, Artificial Sequence
  chemically synthesized
tggatcttatgaagacagag

SEQ ID NO: 75056 - DNA, 20 bp, Artificial Sequence
  chemically synthesized
cctgtaatcccacctacttg

SEQ ID NO: 75057 - DNA, 20 bp, Artificial Sequence
  chemically synthesized
ttgggaggcttgggcaggag

SEQ ID NO: 75058 - DNA, 20 bp, Artificial Sequence
  chemically synthesized
aaaaaaatacaaaaaattag

SEQ ID NO: 75059 - DNA, 20 bp, Artificial Sequence
  chemically synthesized
aatggcgtgaacgcgggggg

SEQ ID NO: 75060 - DNA, 20 bp, Artificial Sequence
  chemically synthesized
ttaagtgtagaactcattga

SEQ ID NO: 75061 - DNA, 20 bp, Artificial Sequence
  chemically synthesized
tggagtcaccagcacatgtg

SEQ ID NO: 75062 - DNA, 20 bp, Artificial Sequence
  chemically synthesized
ccaaatggtatactagtcta

SEQ ID NO: 75063 - DNA, 20 bp, Artificial Sequence
  chemically synthesized
gacaaaagaataacctgaat

SEQ ID NO: 75064 - DNA, 20 bp, Artificial Sequence
  chemically synthesized
cattcaacatgcaacagtac

SEQ ID NO: 75065 - DNA, 20 bp, Artificial Sequence
  chemically synthesized
ataaatattctccaccatta

SEQ ID NO: 75066 - DNA, 20 bp, Artificial Sequence
  chemically synthesized
aatagtgtcatatgcataag

SEQ ID NO: 75067 - DNA, 20 bp, Artificial Sequence
  chemically synthesized
ataaatagtaggaatataat

SEQ ID NO: 75068 - DNA, 20 bp, Artificial Sequence
  chemically synthesized
agagaaaagaggaaatggat

SEQ ID NO: 75069 - DNA, 20 bp, Artificial Sequence
  chemically synthesized
gtttactcaaatgttcaaca

SEQ ID NO: 75070 - DNA, 20 bp, Artificial Sequence
  chemically synthesized
caaatgttcaacaacttgct

SEQ ID NO: 75071 - DNA, 20 bp, Artificial Sequence
  chemically synthesized
tggtaaaaagtagttatgaa

SEQ ID NO: 75072 - DNA, 20 bp, Artificial Sequence
  chemically synthesized
aaataggaattggcatagaa

SEQ ID NO: 75073 - DNA, 20 bp, Artificial Sequence
  chemically synthesized
tagaaacatgtttgcattaa

SEQ ID NO: 75074 - DNA, 20 bp, Artificial Sequence
  chemically synthesized
tagaaatggcagaaaaggaa

SEQ ID NO: 75075 - DNA, 20 bp, Artificial Sequence
  chemically synthesized
gaaaagagaaaaagagagaa

SEQ ID NO: 75076 - DNA, 20 bp, Artificial Sequence
  chemically synthesized
ttaaaatttgctgggtccct

SEQ ID NO: 75077 - DNA, 20 bp, Artificial Sequence
  chemically synthesized
ttgagctcaataaattcatc

SEQ ID NO: 75078 - DNA, 20 bp, Artificial Sequence
  chemically synthesized
agaatgctacagacctcact

SEQ ID NO: 75079 - DNA, 20 bp, Artificial Sequence
  chemically synthesized
taataattgaggagtaagtc

SEQ ID NO: 75080 - DNA, 20 bp, Artificial Sequence
  chemically synthesized
gaggagtaagtctcacgatt

SEQ ID NO: 75081 - DNA, 20 bp, Artificial Sequence
  chemically synthesized
ttcctctccataatttaatt

SEQ ID NO: 75082 - DNA, 20 bp, Artificial Sequence
  chemically synthesized
ggtcttgaataagtcagaca

SEQ ID NO: 75083 - DNA, 20 bp, Artificial Sequence
  chemically synthesized
cagacattgtgattgccatt

SEQ ID NO: 75084 - DNA, 20 bp, Artificial Sequence
  chemically synthesized
ttaaaggattcttattctaa

SEQ ID NO: 75085 - DNA, 20 bp, Artificial Sequence
  chemically synthesized
tcaaagtatttaattgacct

SEQ ID NO: 75086 - DNA, 20 bp, Artificial Sequence
  chemically synthesized
ccctgtcatgaaatgtcctc

SEQ ID NO: 75087 - DNA, 20 bp, Artificial Sequence
  chemically synthesized
gctgatttggttctttcatt

SEQ ID NO: 75088 - DNA, 20 bp, Artificial Sequence
  chemically synthesized
aaaaaaaaaaaaaaaaaaaa

SEQ ID NO: 75089 - DNA, 20 bp, Artificial Sequence
  chemically synthesized
gtgacatgaagcatacggtt

SEQ ID NO: 75090 - DNA, 20 bp, Artificial Sequence
  chemically synthesized
agcatacggttagctgattc

SEQ ID NO: 75091 - DNA, 20 bp, Artificial Sequence
  chemically synthesized
tcacaaacatttctctaatg

SEQ ID NO: 75092 - DNA, 20 bp, Artificial Sequence
  chemically synthesized
ctaatgtatagcttaaaatg

SEQ ID NO: 75093 - DNA, 20 bp, Artificial Sequence
  chemically synthesized
tttatataaagcataagagc

SEQ ID NO: 75094 - DNA, 20 bp, Artificial Sequence
  chemically synthesized
aaattttctttggttattca

SEQ ID NO: 75095 - DNA, 20 bp, Artificial Sequence
  chemically synthesized
tttcctcaattttagtctcc

SEQ ID NO: 75096 - DNA, 20 bp, Artificial Sequence
  chemically synthesized
ttcttctaagaaatctgtcc

SEQ ID NO: 75097 - DNA, 20 bp, Artificial Sequence
  chemically synthesized
aactggactctattctggct

SEQ ID NO: 75098 - DNA, 20 bp, Artificial Sequence
  chemically synthesized
tttgcccattattcagtatc

SEQ ID NO: 75099 - DNA, 20 bp, Artificial Sequence
  chemically synthesized
ttttaaactcacaacatttc

SEQ ID NO: 75100 - DNA, 20 bp, Artificial Sequence
  chemically synthesized
cacaacatttcaagagtttc

SEQ ID NO: 75101 - DNA, 20 bp, Artificial Sequence
  chemically synthesized
aagaaatataaaaagcaacc

SEQ ID NO: 75102 - DNA, 20 bp, Artificial Sequence
  chemically synthesized
aaagcaaccaggagctttgg

SEQ ID NO: 75103 - DNA, 20 bp, Artificial Sequence
  chemically synthesized
gctcagatttgtcaaaagta

SEQ ID NO: 75104 - DNA, 20 bp, Artificial Sequence
  chemically synthesized
gtactggtcagagtctgtta

SEQ ID NO: 75105 - DNA, 20 bp, Artificial Sequence
  chemically synthesized
agctgaaatgtgaaatatgg

SEQ ID NO: 75106 - DNA, 20 bp, Artificial Sequence
  chemically synthesized
agtagtccaatcccctgtcc

SEQ ID NO: 75107 - DNA, 20 bp, Artificial Sequence
  chemically synthesized
attttgctggttctaatgta

SEQ ID NO: 75108 - DNA, 20 bp, Artificial Sequence
  chemically synthesized
ttcaaaactgtgaataagat

SEQ ID NO: 75109 - DNA, 20 bp, Artificial Sequence
  chemically synthesized
aatcagacagactcaatata

SEQ ID NO: 75110 - DNA, 20 bp, Artificial Sequence
  chemically synthesized
aacactgactgagaaacttc

SEQ ID NO: 75111 - DNA, 20 bp, Artificial Sequence
  chemically synthesized
aggcctagaatctgtgcagt

SEQ ID NO: 75112 - DNA, 20 bp, Artificial Sequence
  chemically synthesized
agaatctgtgcagtgctgga

SEQ ID NO: 75113 - DNA, 20 bp, Artificial Sequence
  chemically synthesized
ctgtgccatttatctcattg

SEQ ID NO: 75114 - DNA, 20 bp, Artificial Sequence
  chemically synthesized
cattgctatgattggaaatt

SEQ ID NO: 75115 - DNA, 20 bp, Artificial Sequence
  chemically synthesized
tgctagcagcattatgccaa

SEQ ID NO: 75116 - DNA, 20 bp, Artificial Sequence
  chemically synthesized
gccaaagatgcttggaatat

SEQ ID NO: 75117 - DNA, 20 bp, Artificial Sequence
  chemically synthesized
tttaatgtgcctgaaatcta

SEQ ID NO: 75118 - DNA, 20 bp, Artificial Sequence
  chemically synthesized
tgcctgaaatctattttgat

SEQ ID NO: 75119 - DNA, 20 bp, Artificial Sequence
  chemically synthesized
tgaaatctattttgattcct

SEQ ID NO: 75120 - DNA, 20 bp, Artificial Sequence
  chemically synthesized
acatgccaacatcttcaccc

SEQ ID NO: 75121 - DNA, 20 bp, Artificial Sequence
  chemically synthesized
atgcctagtactgataaagt

SEQ ID NO: 75122 - DNA, 20 bp, Artificial Sequence
  chemically synthesized
atgttcaagtcaacaaaatc

SEQ ID NO: 75123 - DNA, 20 bp, Artificial Sequence
  chemically synthesized
tcaagtcaacaaaatctatg

SEQ ID NO: 75124 - DNA, 20 bp, Artificial Sequence
  chemically synthesized
tgtttgtggccttcactgta

SEQ ID NO: 75125 - DNA, 20 bp, Artificial Sequence
  chemically synthesized
tcctacatccagatatttat

SEQ ID NO: 75126 - DNA, 20 bp, Artificial Sequence
  chemically synthesized
tccagatatttatcacagtt

SEQ ID NO: 75127 - DNA, 20 bp, Artificial Sequence
  chemically synthesized
tcgtttgccccagaaggagg

SEQ ID NO: 75128 - DNA, 20 bp, Artificial Sequence
  chemically synthesized
cttcttctccttcttcacac

SEQ ID NO: 75129 - DNA, 20 bp, Artificial Sequence
  chemically synthesized
tgtctatggtgcaaagacca

SEQ ID NO: 75130 - DNA, 20 bp, Artificial Sequence
  chemically synthesized
atccaccttaattaatgcct

SEQ ID NO: 75131 - DNA, 20 bp, Artificial Sequence
  chemically synthesized
aaaacatattatttgagatg

SEQ ID NO: 75132 - DNA, 20 bp, Artificial Sequence
  chemically synthesized
tgaaatctgccagcacaata

SEQ ID NO: 75133 - DNA, 20 bp, Artificial Sequence
  chemically synthesized
atcatggctcatatcaatca

SEQ ID NO: 75134 - DNA, 20 bp, Artificial Sequence
  chemically synthesized
cttctaagaatatttctcca

SEQ ID NO: 75135 - DNA, 20 bp, Artificial Sequence
  chemically synthesized
tgcatttgacacatcaatgt

SEQ ID NO: 75136 - DNA, 20 bp, Artificial Sequence
  chemically synthesized
tggcacagtgaataattctc

SEQ ID NO: 75137 - DNA, 20 bp, Artificial Sequence
  chemically synthesized
ggggagttgcatttattgta

SEQ ID NO: 75138 - DNA, 20 bp, Artificial Sequence
  chemically synthesized
ttttttggttaggtagttac

SEQ ID NO: 75139 - DNA, 20 bp, Artificial Sequence
  chemically synthesized
tcatgccaggtagatagtag

SEQ ID NO: 75140 - DNA, 20 bp, Artificial Sequence
  chemically synthesized
aggagatttaaactagataa

SEQ ID NO: 75141 - DNA, 20 bp, Artificial Sequence
  chemically synthesized
ataatgtagtttaaggtaac

SEQ ID NO: 75142 - DNA, 20 bp, Artificial Sequence
  chemically synthesized
tgtgccattggagagtattc

SEQ ID NO: 75143 - DNA, 20 bp, Artificial Sequence
  chemically synthesized
ccattggagagtattcattt

SEQ ID NO: 75144 - DNA, 20 bp, Artificial Sequence
  chemically synthesized
gtgtgtgtgtgtgtgtgtgt

SEQ ID NO: 75145 - DNA, 20 bp, Artificial Sequence
  chemically synthesized
catatgggcagatgtccata

SEQ ID NO: 75146 - DNA, 22 bp, Artificial Sequence
  chemically synthesized
gtaaatcaaagtatggacatct

SEQ ID NO: 75147 - DNA, 22 bp, Artificial Sequence
  chemically synthesized
cccatatgtgaatattttccat

SEQ ID NO: 75148 - DNA, 22 bp, Artificial Sequence
  chemically synthesized
tccataaccttgaaaaaaatga

SEQ ID NO: 75149 - DNA, 22 bp, Artificial Sequence
  chemically synthesized
ccataaccttgaaaaaaatgat

SEQ ID NO: 75150 - DNA, 22 bp, Artificial Sequence
  chemically synthesized
cataaccttgaaaaaaatgatc

SEQ ID NO: 75151 - DNA, 22 bp, Artificial Sequence
  chemically synthesized
gaaaaaaatgatctatgacctg

SEQ ID NO: 75152 - DNA, 22 bp, Artificial Sequence
  chemically synthesized
aaaaaaatgatctatgacctga

SEQ ID NO: 75153 - DNA, 22 bp, Artificial Sequence
  chemically synthesized
tgacctgaggtttttcaagaac

SEQ ID NO: 75154 - DNA, 22 bp, Artificial Sequence
  chemically synthesized
aggtttttcaagaacaattgac

SEQ ID NO: 75155 - DNA, 22 bp, Artificial Sequence
  chemically synthesized
ttcaagaacaattgactagccg

SEQ ID NO: 75156 - DNA, 22 bp, Artificial Sequence
  chemically synthesized
tcaagaacaattgactagccgt

SEQ ID NO: 75157 - DNA, 22 bp, Artificial Sequence
  chemically synthesized
caagaacaattgactagccgta

SEQ ID NO: 75158 - DNA, 22 bp, Artificial Sequence
  chemically synthesized
aagaacaattgactagccgtaa

SEQ ID NO: 75159 - DNA, 22 bp, Artificial Sequence
  chemically synthesized
actagccgtaaattcttatgcc

SEQ ID NO: 75160 - DNA, 22 bp, Artificial Sequence
  chemically synthesized
gccgtaaattcttatgccacta

SEQ ID NO: 75161 - DNA, 22 bp, Artificial Sequence
  chemically synthesized
ttatgccactaattttagacaa

SEQ ID NO: 75162 - DNA, 22 bp, Artificial Sequence
  chemically synthesized
atgccactaattttagacaata

SEQ ID NO: 75163 - DNA, 22 bp, Artificial Sequence
  chemically synthesized
tgccactaattttagacaatat

SEQ ID NO: 75164 - DNA, 22 bp, Artificial Sequence
  chemically synthesized
attttagacaatatagtcctcc

SEQ ID NO: 75165 - DNA, 22 bp, Artificial Sequence
  chemically synthesized
tagacaatatagtcctcctctt

SEQ ID NO: 75166 - DNA, 22 bp, Artificial Sequence
  chemically synthesized
agacaatatagtcctcctcttc

SEQ ID NO: 75167 - DNA, 22 bp, Artificial Sequence
  chemically synthesized
gacaatatagtcctcctcttca

SEQ ID NO: 75168 - DNA, 22 bp, Artificial Sequence
  chemically synthesized
ctcttcactaacacaatagccc

SEQ ID NO: 75169 - DNA, 22 bp, Artificial Sequence
  chemically synthesized
ttcactaacacaatagccctag

SEQ ID NO: 75170 - DNA, 22 bp, Artificial Sequence
  chemically synthesized
cactaacacaatagccctagac

SEQ ID NO: 75171 - DNA, 22 bp, Artificial Sequence
  chemically synthesized
actaacacaatagccctagact

SEQ ID NO: 75172 - DNA, 22 bp, Artificial Sequence
  chemically synthesized
acacaatagccctagacttatt

SEQ ID NO: 75173 - DNA, 22 bp, Artificial Sequence
  chemically synthesized
gacttatttatatttgctgtgt

SEQ ID NO: 75174 - DNA, 22 bp, Artificial Sequence
  chemically synthesized
atttatatttgctgtgtggtat

SEQ ID NO: 75175 - DNA, 22 bp, Artificial Sequence
  chemically synthesized
tttatatttgctgtgtggtatg

SEQ ID NO: 75176 - DNA, 22 bp, Artificial Sequence
  chemically synthesized
atatttgctgtgtggtatgctg

SEQ ID NO: 75177 - DNA, 22 bp, Artificial Sequence
  chemically synthesized
tatttgctgtgtggtatgctgc

SEQ ID NO: 75178 - DNA, 22 bp, Artificial Sequence
  chemically synthesized
gctgtgtggtatgctgccacat

SEQ ID NO: 75179 - DNA, 22 bp, Artificial Sequence
  chemically synthesized
ctgtgtggtatgctgccacatg

SEQ ID NO: 75180 - DNA, 22 bp, Artificial Sequence
  chemically synthesized
tgtggtatgctgccacatgccc

SEQ ID NO: 75181 - DNA, 22 bp, Artificial Sequence
  chemically synthesized
ccacatgcccaagcagacacac

SEQ ID NO: 75182 - DNA, 22 bp, Artificial Sequence
  chemically synthesized
acttgtagaacacaagcaaaca

SEQ ID NO: 75183 - DNA, 22 bp, Artificial Sequence
  chemically synthesized
cttgtagaacacaagcaaacaa

SEQ ID NO: 75184 - DNA, 22 bp, Artificial Sequence
  chemically synthesized
gtagaacacaagcaaacaaatg

SEQ ID NO: 75185 - DNA, 22 bp, Artificial Sequence
  chemically synthesized
tagaacacaagcaaacaaatga

SEQ ID NO: 75186 - DNA, 22 bp, Artificial Sequence
  chemically synthesized
tccaatggcacattatagcttt

SEQ ID NO: 75187 - DNA, 22 bp, Artificial Sequence
  chemically synthesized
caatggcacattatagcttttg

SEQ ID NO: 75188 - DNA, 22 bp, Artificial Sequence
  chemically synthesized
tagcttttggaataaagtccag

SEQ ID NO: 75189 - DNA, 22 bp, Artificial Sequence
  chemically synthesized
ttggaataaagtccagcaactc

SEQ ID NO: 75190 - DNA, 22 bp, Artificial Sequence
  chemically synthesized
tggaataaagtccagcaactct

SEQ ID NO: 75191 - DNA, 22 bp, Artificial Sequence
  chemically synthesized
ggaataaagtccagcaactctg

SEQ ID NO: 75192 - DNA, 22 bp, Artificial Sequence
  chemically synthesized
gaataaagtccagcaactctgc

SEQ ID NO: 75193 - DNA, 22 bp, Artificial Sequence
  chemically synthesized
tgcacaacattaatagccattt

SEQ ID NO: 75194 - DNA, 22 bp, Artificial Sequence
  chemically synthesized
cacaacattaatagccattttt

SEQ ID NO: 75195 - DNA, 22 bp, Artificial Sequence
  chemically synthesized
atagccatttttgatattcata

SEQ ID NO: 75196 - DNA, 22 bp, Artificial Sequence
  chemically synthesized
ttgatattcatattttccttgt

SEQ ID NO: 75197 - DNA, 22 bp, Artificial Sequence
  chemically synthesized
tgatattcatattttccttgtc

SEQ ID NO: 75198 - DNA, 22 bp, Artificial Sequence
  chemically synthesized
gatattcatattttccttgtct

SEQ ID NO: 75199 - DNA, 22 bp, Artificial Sequence
  chemically synthesized
atattcatattttccttgtctc

SEQ ID NO: 75200 - DNA, 22 bp, Artificial Sequence
  chemically synthesized
atattttccttgtctccccaag

SEQ ID NO: 75201 - DNA, 22 bp, Artificial Sequence
  chemically synthesized
tccttgtctccccaagttctac

SEQ ID NO: 75202 - DNA, 22 bp, Artificial Sequence
  chemically synthesized
ccttgtctccccaagttctacc

SEQ ID NO: 75203 - DNA, 22 bp, Artificial Sequence
  chemically synthesized
cttgtctccccaagttctacct

SEQ ID NO: 75204 - DNA, 22 bp, Artificial Sequence
  chemically synthesized
gtctccccaagttctaccttgc

SEQ ID NO: 75205 - DNA, 22 bp, Artificial Sequence
  chemically synthesized
tctccccaagttctaccttgca

SEQ ID NO: 75206 - DNA, 22 bp, Artificial Sequence
  chemically synthesized
cccaagttctaccttgcactca

SEQ ID NO: 75207 - DNA, 22 bp, Artificial Sequence
  chemically synthesized
taccttgcactcataccatatt

SEQ ID NO: 75208 - DNA, 22 bp, Artificial Sequence
  chemically synthesized
ccttgcactcataccatattga

SEQ ID NO: 75209 - DNA, 22 bp, Artificial Sequence
  chemically synthesized
gcactcataccatattgaaaaa

SEQ ID NO: 75210 - DNA, 22 bp, Artificial Sequence
  chemically synthesized
cactcataccatattgaaaaaa

SEQ ID NO: 75211 - DNA, 22 bp, Artificial Sequence
  chemically synthesized
ataccatattgaaaaaactaga

SEQ ID NO: 75212 - DNA, 22 bp, Artificial Sequence
  chemically synthesized
aaaaaactagagttaccttaaa

SEQ ID NO: 75213 - DNA, 22 bp, Artificial Sequence
  chemically synthesized
gagttaccttaaactacattat

SEQ ID NO: 75214 - DNA, 22 bp, Artificial Sequence
  chemically synthesized
ccttaaactacattatctagtt

SEQ ID NO: 75215 - DNA, 22 bp, Artificial Sequence
  chemically synthesized
aaactacattatctagtttaaa

SEQ ID NO: 75216 - DNA, 22 bp, Artificial Sequence
  chemically synthesized
aactacattatctagtttaaat

SEQ ID NO: 75217 - DNA, 22 bp, Artificial Sequence
  chemically synthesized
cattatctagtttaaatctcct

SEQ ID NO: 75218 - DNA, 22 bp, Artificial Sequence
  chemically synthesized
tctagtttaaatctcctctact

SEQ ID NO: 75219 - DNA, 22 bp, Artificial Sequence
  chemically synthesized
gtttaaatctcctctactatct

SEQ ID NO: 75220 - DNA, 22 bp, Artificial Sequence
  chemically synthesized
aaatctcctctactatctacct

SEQ ID NO: 75221 - DNA, 22 bp, Artificial Sequence
  chemically synthesized
aatctcctctactatctacctg

SEQ ID NO: 75222 - DNA, 22 bp, Artificial Sequence
  chemically synthesized
ctctactatctacctggcatga

SEQ ID NO: 75223 - DNA, 22 bp, Artificial Sequence
  chemically synthesized
tactatctacctggcatgatgt

SEQ ID NO: 75224 - DNA, 22 bp, Artificial Sequence
  chemically synthesized
ctatctacctggcatgatgtgt

SEQ ID NO: 75225 - DNA, 22 bp, Artificial Sequence
  chemically synthesized
tctacctggcatgatgtgttct

SEQ ID NO: 75226 - DNA, 22 bp, Artificial Sequence
  chemically synthesized
cctggcatgatgtgttcttact

SEQ ID NO: 75227 - DNA, 22 bp, Artificial Sequence
  chemically synthesized
gcatgatgtgttcttacttcct

SEQ ID NO: 75228 - DNA, 22 bp, Artificial Sequence
  chemically synthesized
ttacttccttggctactcatcc

SEQ ID NO: 75229 - DNA, 22 bp, Artificial Sequence
  chemically synthesized
acttccttggctactcatccat

SEQ ID NO: 75230 - DNA, 22 bp, Artificial Sequence
  chemically synthesized
cttccttggctactcatccatc

SEQ ID NO: 75231 - DNA, 22 bp, Artificial Sequence
  chemically synthesized
ccttggctactcatccatcatt

SEQ ID NO: 75232 - DNA, 22 bp, Artificial Sequence
  chemically synthesized
cttggctactcatccatcattc

SEQ ID NO: 75233 - DNA, 22 bp, Artificial Sequence
  chemically synthesized
ggctactcatccatcattcctc

SEQ ID NO: 75234 - DNA, 22 bp, Artificial Sequence
  chemically synthesized
gctactcatccatcattcctca

SEQ ID NO: 75235 - DNA, 22 bp, Artificial Sequence
  chemically synthesized
ctcatccatcattcctcaagaa

SEQ ID NO: 75236 - DNA, 22 bp, Artificial Sequence
  chemically synthesized
atccatcattcctcaagaatca

SEQ ID NO: 75237 - DNA, 22 bp, Artificial Sequence
  chemically synthesized
ctcaagaatcagaggtaactac

SEQ ID NO: 75238 - DNA, 22 bp, Artificial Sequence
  chemically synthesized
aagaatcagaggtaactaccta

SEQ ID NO: 75239 - DNA, 22 bp, Artificial Sequence
  chemically synthesized
cctaaccaaaaaacaaaataca

SEQ ID NO: 75240 - DNA, 22 bp, Artificial Sequence
  chemically synthesized
accaaaaaacaaaatacaataa

SEQ ID NO: 75241 - DNA, 22 bp, Artificial Sequence
  chemically synthesized
ccctgctttggttagatttcaa

SEQ ID NO: 75242 - DNA, 22 bp, Artificial Sequence
  chemically synthesized
ctttggttagatttcaatgctt

SEQ ID NO: 75243 - DNA, 22 bp, Artificial Sequence
  chemically synthesized
tggttagatttcaatgcttcat

SEQ ID NO: 75244 - DNA, 22 bp, Artificial Sequence
  chemically synthesized
ggttagatttcaatgcttcatt

SEQ ID NO: 75245 - DNA, 22 bp, Artificial Sequence
  chemically synthesized
gttagatttcaatgcttcattc

SEQ ID NO: 75246 - DNA, 22 bp, Artificial Sequence
  chemically synthesized
gatttcaatgcttcattctctc

SEQ ID NO: 75247 - DNA, 22 bp, Artificial Sequence
  chemically synthesized
caatgcttcattctctctgaac

SEQ ID NO: 75248 - DNA, 22 bp, Artificial Sequence
  chemically synthesized
aatgcttcattctctctgaact

SEQ ID NO: 75249 - DNA, 22 bp, Artificial Sequence
  chemically synthesized
cattctctctgaactccacatc

SEQ ID NO: 75250 - DNA, 22 bp, Artificial Sequence
  chemically synthesized
attctctctgaactccacatcc

SEQ ID NO: 75251 - DNA, 22 bp, Artificial Sequence
  chemically synthesized
tctctgaactccacatcctatg

SEQ ID NO: 75252 - DNA, 22 bp, Artificial Sequence
  chemically synthesized
tctgaactccacatcctatgtg

SEQ ID NO: 75253 - DNA, 22 bp, Artificial Sequence
  chemically synthesized
tgaactccacatcctatgtgta

SEQ ID NO: 75254 - DNA, 22 bp, Artificial Sequence
  chemically synthesized
aactccacatcctatgtgtaca

SEQ ID NO: 75255 - DNA, 22 bp, Artificial Sequence
  chemically synthesized
cacatcctatgtgtacacttgt

SEQ ID NO: 75256 - DNA, 22 bp, Artificial Sequence
  chemically synthesized
tgtgtacacttgttatttctct

SEQ ID NO: 75257 - DNA, 22 bp, Artificial Sequence
  chemically synthesized
gttatttctctcttctttccct

SEQ ID NO: 75258 - DNA, 22 bp, Artificial Sequence
  chemically synthesized
ttatttctctcttctttccctt

SEQ ID NO: 75259 - DNA, 22 bp, Artificial Sequence
  chemically synthesized
tttctctcttctttcccttgcc

SEQ ID NO: 75260 - DNA, 22 bp, Artificial Sequence
  chemically synthesized
ctctcttctttcccttgcctgc

SEQ ID NO: 75261 - DNA, 22 bp, Artificial Sequence
  chemically synthesized
tctcttctttcccttgcctgcc

SEQ ID NO: 75262 - DNA, 22 bp, Artificial Sequence
  chemically synthesized
tcttctttcccttgcctgccca

SEQ ID NO: 75263 - DNA, 22 bp, Artificial Sequence
  chemically synthesized
ttctttcccttgcctgcccatt

SEQ ID NO: 75264 - DNA, 22 bp, Artificial Sequence
  chemically synthesized
ctttcccttgcctgcccattcc

SEQ ID NO: 75265 - DNA, 22 bp, Artificial Sequence
  chemically synthesized
tttcccttgcctgcccattccc

SEQ ID NO: 75266 - DNA, 22 bp, Artificial Sequence
  chemically synthesized
tcccttgcctgcccattcccca

SEQ ID NO: 75267 - DNA, 22 bp, Artificial Sequence
  chemically synthesized
cccttgcctgcccattccccac

SEQ ID NO: 75268 - DNA, 22 bp, Artificial Sequence
  chemically synthesized
ccttgcctgcccattccccacc

SEQ ID NO: 75269 - DNA, 22 bp, Artificial Sequence
  chemically synthesized
gcctgcccattccccacctctc

SEQ ID NO: 75270 - DNA, 22 bp, Artificial Sequence
  chemically synthesized
cctgcccattccccacctctct

SEQ ID NO: 75271 - DNA, 22 bp, Artificial Sequence
  chemically synthesized
cccattccccacctctcttcct

SEQ ID NO: 75272 - DNA, 22 bp, Artificial Sequence
  chemically synthesized
cccacctctcttcctttcagtc

SEQ ID NO: 75273 - DNA, 22 bp, Artificial Sequence
  chemically synthesized
tcttcctttcagtctctctttt

SEQ ID NO: 75274 - DNA, 22 bp, Artificial Sequence
  chemically synthesized
ttcctttcagtctctcttttcc

SEQ ID NO: 75275 - DNA, 22 bp, Artificial Sequence
  chemically synthesized
cctttcagtctctcttttccag

SEQ ID NO: 75276 - DNA, 22 bp, Artificial Sequence
  chemically synthesized
ctttcagtctctcttttccaga

SEQ ID NO: 75277 - DNA, 22 bp, Artificial Sequence
  chemically synthesized
tcagtctctcttttccagaatt

SEQ ID NO: 75278 - DNA, 22 bp, Artificial Sequence
  chemically synthesized
cagtctctcttttccagaatta

SEQ ID NO: 75279 - DNA, 22 bp, Artificial Sequence
  chemically synthesized
agtctctcttttccagaattac

SEQ ID NO: 75280 - DNA, 22 bp, Artificial Sequence
  chemically synthesized
tcttttccagaattacataggt

SEQ ID NO: 75281 - DNA, 22 bp, Artificial Sequence
  chemically synthesized
ttttccagaattacataggtac

SEQ ID NO: 75282 - DNA, 22 bp, Artificial Sequence
  chemically synthesized
ttccagaattacataggtacaa

SEQ ID NO: 75283 - DNA, 22 bp, Artificial Sequence
  chemically synthesized
tccagaattacataggtacaaa

SEQ ID NO: 75284 - DNA, 22 bp, Artificial Sequence
  chemically synthesized
ccagaattacataggtacaaac

SEQ ID NO: 75285 - DNA, 22 bp, Artificial Sequence
  chemically synthesized
cagaattacataggtacaaact

SEQ ID NO: 75286 - DNA, 22 bp, Artificial Sequence
  chemically synthesized
cataggtacaaactcatgagaa

SEQ ID NO: 75287 - DNA, 22 bp, Artificial Sequence
  chemically synthesized
atgagaattattcactgtgcca

SEQ ID NO: 75288 - DNA, 22 bp, Artificial Sequence
  chemically synthesized
ttcactgtgccagatttactat

SEQ ID NO: 75289 - DNA, 22 bp, Artificial Sequence
  chemically synthesized
actgtgccagatttactattat

SEQ ID NO: 75290 - DNA, 22 bp, Artificial Sequence
  chemically synthesized
tgccagatttactattatgtca

SEQ ID NO: 75291 - DNA, 22 bp, Artificial Sequence
  chemically synthesized
actattatgtcacgattctgta

SEQ ID NO: 75292 - DNA, 22 bp, Artificial Sequence
  chemically synthesized
ctattatgtcacgattctgtag

SEQ ID NO: 75293 - DNA, 22 bp, Artificial Sequence
  chemically synthesized
ttatgtcacgattctgtagtat

SEQ ID NO: 75294 - DNA, 22 bp, Artificial Sequence
  chemically synthesized
tgtcacgattctgtagtatagt

SEQ ID NO: 75295 - DNA, 22 bp, Artificial Sequence
  chemically synthesized
tgtagtatagtatttttaatat

SEQ ID NO: 75296 - DNA, 22 bp, Artificial Sequence
  chemically synthesized
tagtatagtatttttaatattg

SEQ ID NO: 75297 - DNA, 22 bp, Artificial Sequence
  chemically synthesized
ttaatattgcaggtttttgata

SEQ ID NO: 75298 - DNA, 22 bp, Artificial Sequence
  chemically synthesized
taatattgcaggtttttgataa

SEQ ID NO: 75299 - DNA, 22 bp, Artificial Sequence
  chemically synthesized
aatattgcaggtttttgataaa

SEQ ID NO: 75300 - DNA, 22 bp, Artificial Sequence
  chemically synthesized
atattgcaggtttttgataaaa

SEQ ID NO: 75301 - DNA, 22 bp, Artificial Sequence
  chemically synthesized
caggtttttgataaaatgatga

SEQ ID NO: 75302 - DNA, 22 bp, Artificial Sequence
  chemically synthesized
ttgataaaatgatgaattaata

SEQ ID NO: 75303 - DNA, 22 bp, Artificial Sequence
  chemically synthesized
tgataaaatgatgaattaataa

SEQ ID NO: 75304 - DNA, 22 bp, Artificial Sequence
  chemically synthesized
gataaaatgatgaattaataaa

SEQ ID NO: 75305 - DNA, 22 bp, Artificial Sequence
  chemically synthesized
ataaaatgatgaattaataaag

SEQ ID NO: 75306 - DNA, 22 bp, Artificial Sequence
  chemically synthesized
ataaagaagtaaattttgaggt

SEQ ID NO: 75307 - DNA, 22 bp, Artificial Sequence
  chemically synthesized
tgaggttagcaaaaaaaaaaac

SEQ ID NO: 75308 - DNA, 22 bp, Artificial Sequence
  chemically synthesized
gaggttagcaaaaaaaaaaaca

SEQ ID NO: 75309 - DNA, 22 bp, Artificial Sequence
  chemically synthesized
aggttagcaaaaaaaaaaacaa

SEQ ID NO: 75310 - DNA, 22 bp, Artificial Sequence
  chemically synthesized
gcaaaaaaaaaaacaacaacat

SEQ ID NO: 75311 - DNA, 22 bp, Artificial Sequence
  chemically synthesized
atgtgtcaaatgcaacacctgg

SEQ ID NO: 75312 - DNA, 22 bp, Artificial Sequence
  chemically synthesized
gttctaatttttgtgcctgtaa

SEQ ID NO: 75313 - DNA, 22 bp, Artificial Sequence
  chemically synthesized
taatttttgtgcctgtaattcc

SEQ ID NO: 75314 - DNA, 22 bp, Artificial Sequence
  chemically synthesized
atttttgtgcctgtaattcctt

SEQ ID NO: 75315 - DNA, 22 bp, Artificial Sequence
  chemically synthesized
ttgtgcctgtaattccttgtat

SEQ ID NO: 75316 - DNA, 22 bp, Artificial Sequence
  chemically synthesized
tgtgcctgtaattccttgtatg

SEQ ID NO: 75317 - DNA, 22 bp, Artificial Sequence
  chemically synthesized
gtgcctgtaattccttgtatga

SEQ ID NO: 75318 - DNA, 22 bp, Artificial Sequence
  chemically synthesized
tgcctgtaattccttgtatgac

SEQ ID NO: 75319 - DNA, 22 bp, Artificial Sequence
  chemically synthesized
taattccttgtatgactctgaa

SEQ ID NO: 75320 - DNA, 22 bp, Artificial Sequence
  chemically synthesized
cttgtatgactctgaaaatgta

SEQ ID NO: 75321 - DNA, 22 bp, Artificial Sequence
  chemically synthesized
gtatgactctgaaaatgtattt

SEQ ID NO: 75322 - DNA, 22 bp, Artificial Sequence
  chemically synthesized
tatgactctgaaaatgtattta

SEQ ID NO: 75323 - DNA, 22 bp, Artificial Sequence
  chemically synthesized
tgaaaatgtatttaaattttta

SEQ ID NO: 75324 - DNA, 22 bp, Artificial Sequence
  chemically synthesized
aaaatgtatttaaatttttagg

SEQ ID NO: 75325 - DNA, 22 bp, Artificial Sequence
  chemically synthesized
aaatttttaggctttattgtct

SEQ ID NO: 75326 - DNA, 22 bp, Artificial Sequence
  chemically synthesized
aatttttaggctttattgtctc

SEQ ID NO: 75327 - DNA, 22 bp, Artificial Sequence
  chemically synthesized
ttaggctttattgtctcttgat

SEQ ID NO: 75328 - DNA, 22 bp, Artificial Sequence
  chemically synthesized
taggctttattgtctcttgata

SEQ ID NO: 75329 - DNA, 22 bp, Artificial Sequence
  chemically synthesized
aggctttattgtctcttgatat

SEQ ID NO: 75330 - DNA, 22 bp, Artificial Sequence
  chemically synthesized
ggctttattgtctcttgatatt

SEQ ID NO: 75331 - DNA, 22 bp, Artificial Sequence
  chemically synthesized
tattgtctcttgatattcataa

SEQ ID NO: 75332 - DNA, 22 bp, Artificial Sequence
  chemically synthesized
attgtctcttgatattcataag

SEQ ID NO: 75333 - DNA, 22 bp, Artificial Sequence
  chemically synthesized
ttgtctcttgatattcataaga

SEQ ID NO: 75334 - DNA, 22 bp, Artificial Sequence
  chemically synthesized
tctcttgatattcataagattt

SEQ ID NO: 75335 - DNA, 22 bp, Artificial Sequence
  chemically synthesized
ttgatattcataagattttctt

SEQ ID NO: 75336 - DNA, 22 bp, Artificial Sequence
  chemically synthesized
gatattcataagattttctttg

SEQ ID NO: 75337 - DNA, 22 bp, Artificial Sequence
  chemically synthesized
atattcataagattttctttga

SEQ ID NO: 75338 - DNA, 22 bp, Artificial Sequence
  chemically synthesized
ataagattttctttgacaagaa

SEQ ID NO: 75339 - DNA, 22 bp, Artificial Sequence
  chemically synthesized
tctttgacaagaacacagttaa

SEQ ID NO: 75340 - DNA, 22 bp, Artificial Sequence
  chemically synthesized
ctttgacaagaacacagttaac

SEQ ID NO: 75341 - DNA, 22 bp, Artificial Sequence
  chemically synthesized
tttgacaagaacacagttaaca

SEQ ID NO: 75342 - DNA, 22 bp, Artificial Sequence
  chemically synthesized
tgacaagaacacagttaacatg

SEQ ID NO: 75343 - DNA, 22 bp, Artificial Sequence
  chemically synthesized
gacaagaacacagttaacatgt

SEQ ID NO: 75344 - DNA, 22 bp, Artificial Sequence
  chemically synthesized
acaagaacacagttaacatgta

SEQ ID NO: 75345 - DNA, 22 bp, Artificial Sequence
  chemically synthesized
acatgtacttcctttgattttt

SEQ ID NO: 75346 - DNA, 22 bp, Artificial Sequence
  chemically synthesized
cctttgatttttttttttaagg

SEQ ID NO: 75347 - DNA, 22 bp, Artificial Sequence
  chemically synthesized
ctttgatttttttttttaaggc

SEQ ID NO: 75348 - DNA, 22 bp, Artificial Sequence
  chemically synthesized
tgatttttttttttaaggcagg

SEQ ID NO: 75349 - DNA, 22 bp, Artificial Sequence
  chemically synthesized
gatttttttttttaaggcaggg

SEQ ID NO: 75350 - DNA, 22 bp, Artificial Sequence
  chemically synthesized
atttttttttttaaggcaggga

SEQ ID NO: 75351 - DNA, 22 bp, Artificial Sequence
  chemically synthesized
ttttttttaaggcagggatgat

SEQ ID NO: 75352 - DNA, 22 bp, Artificial Sequence
  chemically synthesized
tttttttaaggcagggatgatc

SEQ ID NO: 75353 - DNA, 22 bp, Artificial Sequence
  chemically synthesized
ttttttaaggcagggatgatca

SEQ ID NO: 75354 - DNA, 22 bp, Artificial Sequence
  chemically synthesized
tttttaaggcagggatgatcaa

SEQ ID NO: 75355 - DNA, 22 bp, Artificial Sequence
  chemically synthesized
ttttaaggcagggatgatcaag

SEQ ID NO: 75356 - DNA, 22 bp, Artificial Sequence
  chemically synthesized
tttaaggcagggatgatcaaga

SEQ ID NO: 75357 - DNA, 22 bp, Artificial Sequence
  chemically synthesized
ttaaggcagggatgatcaagaa

SEQ ID NO: 75358 - DNA, 22 bp, Artificial Sequence
  chemically synthesized
taaggcagggatgatcaagaaa

SEQ ID NO: 75359 - DNA, 22 bp, Artificial Sequence
  chemically synthesized
aaggcagggatgatcaagaaaa

SEQ ID NO: 75360 - DNA, 22 bp, Artificial Sequence
  chemically synthesized
aggcagggatgatcaagaaaat

SEQ ID NO: 75361 - DNA, 22 bp, Artificial Sequence
  chemically synthesized
gttttcattgagtccctggatg

SEQ ID NO: 75362 - DNA, 22 bp, Artificial Sequence
  chemically synthesized
ttttcattgagtccctggatgt

SEQ ID NO: 75363 - DNA, 22 bp, Artificial Sequence
  chemically synthesized
tcattgagtccctggatgtttc

SEQ ID NO: 75364 - DNA, 22 bp, Artificial Sequence
  chemically synthesized
cattgagtccctggatgtttca

SEQ ID NO: 75365 - DNA, 22 bp, Artificial Sequence
  chemically synthesized
attgagtccctggatgtttcag

SEQ ID NO: 75366 - DNA, 22 bp, Artificial Sequence
  chemically synthesized
agtccctggatgtttcagaaca

SEQ ID NO: 75367 - DNA, 22 bp, Artificial Sequence
  chemically synthesized
gatgtttcagaacaacgagcct

SEQ ID NO: 75368 - DNA, 22 bp, Artificial Sequence
  chemically synthesized
cagaacaacgagccttaggtgc

SEQ ID NO: 75369 - DNA, 22 bp, Artificial Sequence
  chemically synthesized
agaacaacgagccttaggtgca

SEQ ID NO: 75370 - DNA, 22 bp, Artificial Sequence
  chemically synthesized
aggtgcatttaaattcagtgac

SEQ ID NO: 75371 - DNA, 22 bp, Artificial Sequence
  chemically synthesized
ggtgcatttaaattcagtgaca

SEQ ID NO: 75372 - DNA, 22 bp, Artificial Sequence
  chemically synthesized
aaattcagtgacaaaggcataa

SEQ ID NO: 75373 - DNA, 22 bp, Artificial Sequence
  chemically synthesized
aattcagtgacaaaggcataat

SEQ ID NO: 75374 - DNA, 22 bp, Artificial Sequence
  chemically synthesized
agtgacaaaggcataatttata

SEQ ID NO: 75375 - DNA, 22 bp, Artificial Sequence
  chemically synthesized
ataaatcctcctggagaaatat

SEQ ID NO: 75376 - DNA, 22 bp, Artificial Sequence
  chemically synthesized
taaatcctcctggagaaatatt

SEQ ID NO: 75377 - DNA, 22 bp, Artificial Sequence
  chemically synthesized
ctggagaaatattcttagaaga

SEQ ID NO: 75378 - DNA, 22 bp, Artificial Sequence
  chemically synthesized
gagaaatattcttagaagaata

SEQ ID NO: 75379 - DNA, 22 bp, Artificial Sequence
  chemically synthesized
ttagaagaataactcaaccagg

SEQ ID NO: 75380 - DNA, 22 bp, Artificial Sequence
  chemically synthesized
agaagaataactcaaccagggg

SEQ ID NO: 75381 - DNA, 22 bp, Artificial Sequence
  chemically synthesized
gaagaataactcaaccaggggc

SEQ ID NO: 75382 - DNA, 22 bp, Artificial Sequence
  chemically synthesized
aaccaggggctaaagaataaaa

SEQ ID NO: 75383 - DNA, 22 bp, Artificial Sequence
  chemically synthesized
aagaataaaagagaaaaaataa

SEQ ID NO: 75384 - DNA, 22 bp, Artificial Sequence
  chemically synthesized
actacttcactcatttcacact

SEQ ID NO: 75385 - DNA, 22 bp, Artificial Sequence
  chemically synthesized
cttcactcatttcacacttctc

SEQ ID NO: 75386 - DNA, 22 bp, Artificial Sequence
  chemically synthesized
cactcatttcacacttctcact

SEQ ID NO: 75387 - DNA, 22 bp, Artificial Sequence
  chemically synthesized
actcatttcacacttctcactt

SEQ ID NO: 75388 - DNA, 22 bp, Artificial Sequence
  chemically synthesized
atttcacacttctcactttcat

SEQ ID NO: 75389 - DNA, 22 bp, Artificial Sequence
  chemically synthesized
cacacttctcactttcattagt

SEQ ID NO: 75390 - DNA, 22 bp, Artificial Sequence
  chemically synthesized
acacttctcactttcattagtc

SEQ ID NO: 75391 - DNA, 22 bp, Artificial Sequence
  chemically synthesized
ctcactttcattagtcacgtag

SEQ ID NO: 75392 - DNA, 22 bp, Artificial Sequence
  chemically synthesized
tcactttcattagtcacgtaga

SEQ ID NO: 75393 - DNA, 22 bp, Artificial Sequence
  chemically synthesized
actttcattagtcacgtagaat

SEQ ID NO: 75394 - DNA, 22 bp, Artificial Sequence
  chemically synthesized
tcattagtcacgtagaattcac

SEQ ID NO: 75395 - DNA, 22 bp, Artificial Sequence
  chemically synthesized
cattagtcacgtagaattcaca

SEQ ID NO: 75396 - DNA, 22 bp, Artificial Sequence
  chemically synthesized
attagtcacgtagaattcacaa

SEQ ID NO: 75397 - DNA, 22 bp, Artificial Sequence
  chemically synthesized
gtcacgtagaattcacaatccc

SEQ ID NO: 75398 - DNA, 22 bp, Artificial Sequence
  chemically synthesized
acaatcccactgattgatatga

SEQ ID NO: 75399 - DNA, 22 bp, Artificial Sequence
  chemically synthesized
attgatatgagccatgatgatc

SEQ ID NO: 75400 - DNA, 22 bp, Artificial Sequence
  chemically synthesized
atatgagccatgatgatctaaa

SEQ ID NO: 75401 - DNA, 22 bp, Artificial Sequence
  chemically synthesized
aaaccagctattgtgctggcag

SEQ ID NO: 75402 - DNA, 22 bp, Artificial Sequence
  chemically synthesized
ttgtgctggcagatttcacaaa

SEQ ID NO: 75403 - DNA, 22 bp, Artificial Sequence
  chemically synthesized
tgctggcagatttcacaaaccc

SEQ ID NO: 75404 - DNA, 22 bp, Artificial Sequence
  chemically synthesized
gcagatttcacaaacccagcat

SEQ ID NO: 75405 - DNA, 22 bp, Artificial Sequence
  chemically synthesized
cacaaacccagcatctcaaata

SEQ ID NO: 75406 - DNA, 22 bp, Artificial Sequence
  chemically synthesized
acaaacccagcatctcaaataa

SEQ ID NO: 75407 - DNA, 22 bp, Artificial Sequence
  chemically synthesized
aaataatatgttttttgttttg

SEQ ID NO: 75408 - DNA, 22 bp, Artificial Sequence
  chemically synthesized
tttgttttgttttgatatggtt

SEQ ID NO: 75409 - DNA, 22 bp, Artificial Sequence
  chemically synthesized
ttgttttgttttgatatggtta

SEQ ID NO: 75410 - DNA, 22 bp, Artificial Sequence
  chemically synthesized
tgttttgttttgatatggttac

SEQ ID NO: 75411 - DNA, 22 bp, Artificial Sequence
  chemically synthesized
gttttgttttgatatggttact

SEQ ID NO: 75412 - DNA, 22 bp, Artificial Sequence
  chemically synthesized
ttttgttttgatatggttacta

SEQ ID NO: 75413 - DNA, 22 bp, Artificial Sequence
  chemically synthesized
tgttttgatatggttactactg

SEQ ID NO: 75414 - DNA, 22 bp, Artificial Sequence
  chemically synthesized
gttttgatatggttactactgc

SEQ ID NO: 75415 - DNA, 22 bp, Artificial Sequence
  chemically synthesized
ttttgatatggttactactgca

SEQ ID NO: 75416 - DNA, 22 bp, Artificial Sequence
  chemically synthesized
tgatatggttactactgcaaaa

SEQ ID NO: 75417 - DNA, 22 bp, Artificial Sequence
  chemically synthesized
gatatggttactactgcaaaag

SEQ ID NO: 75418 - DNA, 22 bp, Artificial Sequence
  chemically synthesized
atatggttactactgcaaaaga

SEQ ID NO: 75419 - DNA, 22 bp, Artificial Sequence
  chemically synthesized
ctactgcaaaagaaaaaagcat

SEQ ID NO: 75420 - DNA, 22 bp, Artificial Sequence
  chemically synthesized
ctgcaaaagaaaaaagcatgta

SEQ ID NO: 75421 - DNA, 22 bp, Artificial Sequence
  chemically synthesized
caaaagaaaaaagcatgtaggc

SEQ ID NO: 75422 - DNA, 22 bp, Artificial Sequence
  chemically synthesized
attaaggtggattttatgaaca

SEQ ID NO: 75423 - DNA, 22 bp, Artificial Sequence
  chemically synthesized
aggtggattttatgaacagaac

SEQ ID NO: 75424 - DNA, 22 bp, Artificial Sequence
  chemically synthesized
tatgaacagaacatttttacca

SEQ ID NO: 75425 - DNA, 22 bp, Artificial Sequence
  chemically synthesized
atgaacagaacatttttaccac

SEQ ID NO: 75426 - DNA, 22 bp, Artificial Sequence
  chemically synthesized
tgaacagaacatttttaccaca

SEQ ID NO: 75427 - DNA, 22 bp, Artificial Sequence
  chemically synthesized
ttaccacatgaatgcgaatctg

SEQ ID NO: 75428 - DNA, 22 bp, Artificial Sequence
  chemically synthesized
taccacatgaatgcgaatctgt

SEQ ID NO: 75429 - DNA, 22 bp, Artificial Sequence
  chemically synthesized
accacatgaatgcgaatctgtg

SEQ ID NO: 75430 - DNA, 22 bp, Artificial Sequence
  chemically synthesized
ccacatgaatgcgaatctgtgt

SEQ ID NO: 75431 - DNA, 22 bp, Artificial Sequence
  chemically synthesized
tgtggtctttgcaccatagaca

SEQ ID NO: 75432 - DNA, 22 bp, Artificial Sequence
  chemically synthesized
tgcaccatagacaagtggattg

SEQ ID NO: 75433 - DNA, 22 bp, Artificial Sequence
  chemically synthesized
gcaccatagacaagtggattga

SEQ ID NO: 75434 - DNA, 22 bp, Artificial Sequence
  chemically synthesized
caccatagacaagtggattgag

SEQ ID NO: 75435 - DNA, 22 bp, Artificial Sequence
  chemically synthesized
agaaatggagggaccagcaagt

SEQ ID NO: 75436 - DNA, 22 bp, Artificial Sequence
  chemically synthesized
gaaaagagaatatggatataag

SEQ ID NO: 75437 - DNA, 22 bp, Artificial Sequence
  chemically synthesized
tgtgtgaagaaggagaagaagg

SEQ ID NO: 75438 - DNA, 22 bp, Artificial Sequence
  chemically synthesized
gaggaagacacagatgtgagca

SEQ ID NO: 75439 - DNA, 22 bp, Artificial Sequence
  chemically synthesized
aatgctttaaacctagcctcct

SEQ ID NO: 75440 - DNA, 22 bp, Artificial Sequence
  chemically synthesized
taaacctagcctccttctgggg

SEQ ID NO: 75441 - DNA, 22 bp, Artificial Sequence
  chemically synthesized
aaacctagcctccttctggggc

SEQ ID NO: 75442 - DNA, 22 bp, Artificial Sequence
  chemically synthesized
aacctagcctccttctggggca

SEQ ID NO: 75443 - DNA, 22 bp, Artificial Sequence
  chemically synthesized
gcctccttctggggcaaacgaa

SEQ ID NO: 75444 - DNA, 22 bp, Artificial Sequence
  chemically synthesized
cttctggggcaaacgaaaaact

SEQ ID NO: 75445 - DNA, 22 bp, Artificial Sequence
  chemically synthesized
ctggggcaaacgaaaaactgtg

SEQ ID NO: 75446 - DNA, 22 bp, Artificial Sequence
  chemically synthesized
tggggcaaacgaaaaactgtga

SEQ ID NO: 75447 - DNA, 22 bp, Artificial Sequence
  chemically synthesized
gggcaaacgaaaaactgtgata

SEQ ID NO: 75448 - DNA, 22 bp, Artificial Sequence
  chemically synthesized
tgataaatatctggatgtagga

SEQ ID NO: 75449 - DNA, 22 bp, Artificial Sequence
  chemically synthesized
gatgtaggacaatgtgatgaat

SEQ ID NO: 75450 - DNA, 22 bp, Artificial Sequence
  chemically synthesized
ctacagtgaaggccacaaacaa

SEQ ID NO: 75451 - DNA, 22 bp, Artificial Sequence
  chemically synthesized
cagtgaaggccacaaacaaacc

SEQ ID NO: 75452 - DNA, 22 bp, Artificial Sequence
  chemically synthesized
tgttgacttgaacatttgctgc

SEQ ID NO: 75453 - DNA, 22 bp, Artificial Sequence
  chemically synthesized
gttgacttgaacatttgctgct

SEQ ID NO: 75454 - DNA, 22 bp, Artificial Sequence
  chemically synthesized
ttgacttgaacatttgctgctg

SEQ ID NO: 75455 - DNA, 22 bp, Artificial Sequence
  chemically synthesized
acttgaacatttgctgctgcta

SEQ ID NO: 75456 - DNA, 22 bp, Artificial Sequence
  chemically synthesized
gaacatttgctgctgctagttt

SEQ ID NO: 75457 - DNA, 22 bp, Artificial Sequence
  chemically synthesized
aacatttgctgctgctagtttc

SEQ ID NO: 75458 - DNA, 22 bp, Artificial Sequence
  chemically synthesized
gctgctgctagtttcacaatgg

SEQ ID NO: 75459 - DNA, 22 bp, Artificial Sequence
  chemically synthesized
ctgctgctagtttcacaatggc

SEQ ID NO: 75460 - DNA, 22 bp, Artificial Sequence
  chemically synthesized
ctgctagtttcacaatggccat

SEQ ID NO: 75461 - DNA, 22 bp, Artificial Sequence
  chemically synthesized
ctagtttcacaatggccatatg

SEQ ID NO: 75462 - DNA, 22 bp, Artificial Sequence
  chemically synthesized
gtttcacaatggccatatgctc

SEQ ID NO: 75463 - DNA, 22 bp, Artificial Sequence
  chemically synthesized
cacaatggccatatgctcacag

SEQ ID NO: 75464 - DNA, 22 bp, Artificial Sequence
  chemically synthesized
acaatggccatatgctcacagt

SEQ ID NO: 75465 - DNA, 22 bp, Artificial Sequence
  chemically synthesized
acagtaggagtgggagatgact

SEQ ID NO: 75466 - DNA, 22 bp, Artificial Sequence
  chemically synthesized
ttgtgtgataaaattgaaaccg

SEQ ID NO: 75467 - DNA, 22 bp, Artificial Sequence
  chemically synthesized
tgtgataaaattgaaaccggca

SEQ ID NO: 75468 - DNA, 22 bp, Artificial Sequence
  chemically synthesized
aaaccggcactttatcagtact

SEQ ID NO: 75469 - DNA, 22 bp, Artificial Sequence
  chemically synthesized
tatcagtactaggcatggggct

SEQ ID NO: 75470 - DNA, 22 bp, Artificial Sequence
  chemically synthesized
atcagtactaggcatggggcta

SEQ ID NO: 75471 - DNA, 22 bp, Artificial Sequence
  chemically synthesized
tcagtactaggcatggggctac

SEQ ID NO: 75472 - DNA, 22 bp, Artificial Sequence
  chemically synthesized
ggcatggggctacaagaatagc

SEQ ID NO: 75473 - DNA, 22 bp, Artificial Sequence
  chemically synthesized
caagaatagcagccctgagtac

SEQ ID NO: 75474 - DNA, 22 bp, Artificial Sequence
  chemically synthesized
agtacgaccatagttcctatct

SEQ ID NO: 75475 - DNA, 22 bp, Artificial Sequence
  chemically synthesized
ctatctgaatgacaagctggtg

SEQ ID NO: 75476 - DNA, 22 bp, Artificial Sequence
  chemically synthesized
tctgaatgacaagctggtgggt

SEQ ID NO: 75477 - DNA, 22 bp, Artificial Sequence
  chemically synthesized
aatgacaagctggtgggtgaag

SEQ ID NO: 75478 - DNA, 22 bp, Artificial Sequence
  chemically synthesized
gtgggtgaagatgttggcatgt

SEQ ID NO: 75479 - DNA, 22 bp, Artificial Sequence
  chemically synthesized
gcatgtcttagtggataacaga

SEQ ID NO: 75480 - DNA, 22 bp, Artificial Sequence
  chemically synthesized
agtggataacagatggccacat

SEQ ID NO: 75481 - DNA, 22 bp, Artificial Sequence
  chemically synthesized
gtggataacagatggccacata

SEQ ID NO: 75482 - DNA, 22 bp, Artificial Sequence
  chemically synthesized
actctataccctgcaatgtgtg

SEQ ID NO: 75483 - DNA, 22 bp, Artificial Sequence
  chemically synthesized
tataccctgcaatgtgtggatg

SEQ ID NO: 75484 - DNA, 22 bp, Artificial Sequence
  chemically synthesized
taccctgcaatgtgtggatgaa

SEQ ID NO: 75485 - DNA, 22 bp, Artificial Sequence
  chemically synthesized
caatgtgtggatgaaccacatt

SEQ ID NO: 75486 - DNA, 22 bp, Artificial Sequence
  chemically synthesized
gaagcaagcaggaatcaaaata

SEQ ID NO: 75487 - DNA, 22 bp, Artificial Sequence
  chemically synthesized
aagcaagcaggaatcaaaatag

SEQ ID NO: 75488 - DNA, 22 bp, Artificial Sequence
  chemically synthesized
caggcacattaaaccagaatat

SEQ ID NO: 75489 - DNA, 22 bp, Artificial Sequence
  chemically synthesized
aggcacattaaaccagaatatt

SEQ ID NO: 75490 - DNA, 22 bp, Artificial Sequence
  chemically synthesized
aaccagaatattccaagcatct

SEQ ID NO: 75491 - DNA, 22 bp, Artificial Sequence
  chemically synthesized
caagcatctttggcataatgct

SEQ ID NO: 75492 - DNA, 22 bp, Artificial Sequence
  chemically synthesized
tggcataatgctgctagcaagt

SEQ ID NO: 75493 - DNA, 22 bp, Artificial Sequence
  chemically synthesized
ggcataatgctgctagcaagtg

SEQ ID NO: 75494 - DNA, 22 bp, Artificial Sequence
  chemically synthesized
gcataatgctgctagcaagtgc

SEQ ID NO: 75495 - DNA, 22 bp, Artificial Sequence
  chemically synthesized
ctagcaagtgcaatgtctgtgg

SEQ ID NO: 75496 - DNA, 22 bp, Artificial Sequence
  chemically synthesized
gcaagtgcaatgtctgtggctc

SEQ ID NO: 75497 - DNA, 22 bp, Artificial Sequence
  chemically synthesized
tggctcctagcatgcctaagaa

SEQ ID NO: 75498 - DNA, 22 bp, Artificial Sequence
  chemically synthesized
ctagcatgcctaagaaaatgta

SEQ ID NO: 75499 - DNA, 22 bp, Artificial Sequence
  chemically synthesized
gcatgcctaagaaaatgtacaa

SEQ ID NO: 75500 - DNA, 22 bp, Artificial Sequence
  chemically synthesized
agaaaatgtacaagggctcatg

SEQ ID NO: 75501 - DNA, 22 bp, Artificial Sequence
  chemically synthesized
atggagactgcgctcagatttg

SEQ ID NO: 75502 - DNA, 22 bp, Artificial Sequence
  chemically synthesized
cgctcagatttgatgatgctca

SEQ ID NO: 75503 - DNA, 22 bp, Artificial Sequence
  chemically synthesized
agatttgatgatgctcagaagc

SEQ ID NO: 75504 - DNA, 22 bp, Artificial Sequence
  chemically synthesized
gatgatgctcagaagcaaggaa

SEQ ID NO: 75505 - DNA, 22 bp, Artificial Sequence
  chemically synthesized
atgatgctcagaagcaaggaat

SEQ ID NO: 75506 - DNA, 22 bp, Artificial Sequence
  chemically synthesized
agaagcaaggaatttccaatca

SEQ ID NO: 75507 - DNA, 22 bp, Artificial Sequence
  chemically synthesized
ccaatcatagcaatgagataaa

SEQ ID NO: 75508 - DNA, 22 bp, Artificial Sequence
  chemically synthesized
caatcatagcaatgagataaat

SEQ ID NO: 75509 - DNA, 22 bp, Artificial Sequence
  chemically synthesized
cacagattctaggcctgggatc

SEQ ID NO: 75510 - DNA, 22 bp, Artificial Sequence
  chemically synthesized
taggcctgggatccctactagt

SEQ ID NO: 75511 - DNA, 22 bp, Artificial Sequence
  chemically synthesized
ggcctgggatccctactagtgt

SEQ ID NO: 75512 - DNA, 22 bp, Artificial Sequence
  chemically synthesized
ggatccctactagtgtcaacac

SEQ ID NO: 75513 - DNA, 22 bp, Artificial Sequence
  chemically synthesized
ctagtgtcaacacagagggcat

SEQ ID NO: 75514 - DNA, 22 bp, Artificial Sequence
  chemically synthesized
gtgtcaacacagagggcatgta

SEQ ID NO: 75515 - DNA, 22 bp, Artificial Sequence
  chemically synthesized
tgatgttggaaatggacatagt

SEQ ID NO: 75516 - DNA, 22 bp, Artificial Sequence
  chemically synthesized
gaaatggacatagtgtcgttgg

SEQ ID NO: 75517 - DNA, 22 bp, Artificial Sequence
  chemically synthesized
ggtctcctgatgcaaacaaaag

SEQ ID NO: 75518 - DNA, 22 bp, Artificial Sequence
  chemically synthesized
ctgatgcaaacaaaagaagttt

SEQ ID NO: 75519 - DNA, 22 bp, Artificial Sequence
  chemically synthesized
atgcaaacaaaagaagtttctc

SEQ ID NO: 75520 - DNA, 22 bp, Artificial Sequence
  chemically synthesized
ctcagtcagtgttactgttcct

SEQ ID NO: 75521 - DNA, 22 bp, Artificial Sequence
  chemically synthesized
tcagtcagtgttactgttcctc

SEQ ID NO: 75522 - DNA, 22 bp, Artificial Sequence
  chemically synthesized
agtcagtgttactgttcctctt

SEQ ID NO: 75523 - DNA, 22 bp, Artificial Sequence
  chemically synthesized
ctgttcctcttctgctttctga

SEQ ID NO: 75524 - DNA, 22 bp, Artificial Sequence
  chemically synthesized
ttcctcttctgctttctgattt

SEQ ID NO: 75525 - DNA, 22 bp, Artificial Sequence
  chemically synthesized
ctcttctgctttctgattttct

SEQ ID NO: 75526 - DNA, 22 bp, Artificial Sequence
  chemically synthesized
ttctgctttctgattttctcca

SEQ ID NO: 75527 - DNA, 22 bp, Artificial Sequence
  chemically synthesized
ctgctttctgattttctccaaa

SEQ ID NO: 75528 - DNA, 22 bp, Artificial Sequence
  chemically synthesized
tgctttctgattttctccaaac

SEQ ID NO: 75529 - DNA, 22 bp, Artificial Sequence
  chemically synthesized
ctttctgattttctccaaactc

SEQ ID NO: 75530 - DNA, 22 bp, Artificial Sequence
  chemically synthesized
tctgattttctccaaactcatt

SEQ ID NO: 75531 - DNA, 22 bp, Artificial Sequence
  chemically synthesized
ctgattttctccaaactcatta

SEQ ID NO: 75532 - DNA, 22 bp, Artificial Sequence
  chemically synthesized
tgattttctccaaactcattat

SEQ ID NO: 75533 - DNA, 22 bp, Artificial Sequence
  chemically synthesized
attttctccaaactcattatat

SEQ ID NO: 75534 - DNA, 22 bp, Artificial Sequence
  chemically synthesized
tctccaaactcattatattgag

SEQ ID NO: 75535 - DNA, 22 bp, Artificial Sequence
  chemically synthesized
ctccaaactcattatattgagt

SEQ ID NO: 75536 - DNA, 22 bp, Artificial Sequence
  chemically synthesized
tccaaactcattatattgagtc

SEQ ID NO: 75537 - DNA, 22 bp, Artificial Sequence
  chemically synthesized
caaactcattatattgagtctg

SEQ ID NO: 75538 - DNA, 22 bp, Artificial Sequence
  chemically synthesized
attatattgagtctgtctgatt

SEQ ID NO: 75539 - DNA, 22 bp, Artificial Sequence
  chemically synthesized
tattgagtctgtctgatttggg

SEQ ID NO: 75540 - DNA, 22 bp, Artificial Sequence
  chemically synthesized
agtctgtctgatttgggtataa

SEQ ID NO: 75541 - DNA, 22 bp, Artificial Sequence
  chemically synthesized
tctgatttgggtataactctaa

SEQ ID NO: 75542 - DNA, 22 bp, Artificial Sequence
  chemically synthesized
atttgggtataactctaaaatc

SEQ ID NO: 75543 - DNA, 22 bp, Artificial Sequence
  chemically synthesized
gggtataactctaaaatcatcc

SEQ ID NO: 75544 - DNA, 22 bp, Artificial Sequence
  chemically synthesized
ggtataactctaaaatcatcca

SEQ ID NO: 75545 - DNA, 22 bp, Artificial Sequence
  chemically synthesized
taaaatcatccatcttattcac

SEQ ID NO: 75546 - DNA, 22 bp, Artificial Sequence
  chemically synthesized
aaatcatccatcttattcacag

SEQ ID NO: 75547 - DNA, 22 bp, Artificial Sequence
  chemically synthesized
attcacagttttgaaaggaaaa

SEQ ID NO: 75548 - DNA, 22 bp, Artificial Sequence
  chemically synthesized
ttcacagttttgaaaggaaaag

SEQ ID NO: 75549 - DNA, 22 bp, Artificial Sequence
  chemically synthesized
acagttttgaaaggaaaagatg

SEQ ID NO: 75550 - DNA, 22 bp, Artificial Sequence
  chemically synthesized
tgaaaggaaaagatggattcat

SEQ ID NO: 75551 - DNA, 22 bp, Artificial Sequence
  chemically synthesized
gaaaggaaaagatggattcatg

SEQ ID NO: 75552 - DNA, 22 bp, Artificial Sequence
  chemically synthesized
aaaggaaaagatggattcatgg

SEQ ID NO: 75553 - DNA, 22 bp, Artificial Sequence
  chemically synthesized
atggagatacatcactgttttc

SEQ ID NO: 75554 - DNA, 22 bp, Artificial Sequence
  chemically synthesized
ttttcaggtggggcattcacag

SEQ ID NO: 75555 - DNA, 22 bp, Artificial Sequence
  chemically synthesized
tcaggtggggcattcacaggca

SEQ ID NO: 75556 - DNA, 22 bp, Artificial Sequence
  chemically synthesized
caggtggggcattcacaggcac

SEQ ID NO: 75557 - DNA, 22 bp, Artificial Sequence
  chemically synthesized
aggtggggcattcacaggcact

SEQ ID NO: 75558 - DNA, 22 bp, Artificial Sequence
  chemically synthesized
acaggcactgtgccataatagg

SEQ ID NO: 75559 - DNA, 22 bp, Artificial Sequence
  chemically synthesized
tgccataataggatgttatgtg

SEQ ID NO: 75560 - DNA, 22 bp, Artificial Sequence
  chemically synthesized
tgtgcatggcaatccaaataca

SEQ ID NO: 75561 - DNA, 22 bp, Artificial Sequence
  chemically synthesized
gaaccagcaaaatcacctggac

SEQ ID NO: 75562 - DNA, 22 bp, Artificial Sequence
  chemically synthesized
gacaggggattggactactggc

SEQ ID NO: 75563 - DNA, 22 bp, Artificial Sequence
  chemically synthesized
gactactggccagtctgttatt

SEQ ID NO: 75564 - DNA, 22 bp, Artificial Sequence
  chemically synthesized
ctggccagtctgttatttcttt

SEQ ID NO: 75565 - DNA, 22 bp, Artificial Sequence
  chemically synthesized
gccagtctgttatttctttcca

SEQ ID NO: 75566 - DNA, 22 bp, Artificial Sequence
  chemically synthesized
ttatttctttccagacctgtgg

SEQ ID NO: 75567 - DNA, 22 bp, Artificial Sequence
  chemically synthesized
tttctttccagacctgtggaca

SEQ ID NO: 75568 - DNA, 22 bp, Artificial Sequence
  chemically synthesized
ctttccagacctgtggacaaaa

SEQ ID NO: 75569 - DNA, 22 bp, Artificial Sequence
  chemically synthesized
tttccagacctgtggacaaaaa

SEQ ID NO: 75570 - DNA, 22 bp, Artificial Sequence
  chemically synthesized
tccagacctgtggacaaaaaaa

SEQ ID NO: 75571 - DNA, 22 bp, Artificial Sequence
  chemically synthesized
ccagacctgtggacaaaaaaaa

SEQ ID NO: 75572 - DNA, 22 bp, Artificial Sequence
  chemically synthesized
cagacctgtggacaaaaaaaaa

SEQ ID NO: 75573 - DNA, 22 bp, Artificial Sequence
  chemically synthesized
tggacaaaaaaaaaaagaagtt

SEQ ID NO: 75574 - DNA, 22 bp, Artificial Sequence
  chemically synthesized
atttttattggacattgcattt

SEQ ID NO: 75575 - DNA, 22 bp, Artificial Sequence
  chemically synthesized
tttttattggacattgcatttt

SEQ ID NO: 75576 - DNA, 22 bp, Artificial Sequence
  chemically synthesized
ttattggacattgcattttaat

SEQ ID NO: 75577 - DNA, 22 bp, Artificial Sequence
  chemically synthesized
tattggacattgcattttaatt

SEQ ID NO: 75578 - DNA, 22 bp, Artificial Sequence
  chemically synthesized
attggacattgcattttaattt

SEQ ID NO: 75579 - DNA, 22 bp, Artificial Sequence
  chemically synthesized
ttggacattgcattttaatttg

SEQ ID NO: 75580 - DNA, 22 bp, Artificial Sequence
  chemically synthesized
gacattgcattttaatttggtt

SEQ ID NO: 75581 - DNA, 22 bp, Artificial Sequence
  chemically synthesized
cattttaatttggttaataaac

SEQ ID NO: 75582 - DNA, 22 bp, Artificial Sequence
  chemically synthesized
taatttggttaataaacctctc

SEQ ID NO: 75583 - DNA, 22 bp, Artificial Sequence
  chemically synthesized
aatttggttaataaacctctcc

SEQ ID NO: 75584 - DNA, 22 bp, Artificial Sequence
  chemically synthesized
atttggttaataaacctctcca

SEQ ID NO: 75585 - DNA, 22 bp, Artificial Sequence
  chemically synthesized
ggttaataaacctctccatatt

SEQ ID NO: 75586 - DNA, 22 bp, Artificial Sequence
  chemically synthesized
gttaataaacctctccatattt

SEQ ID NO: 75587 - DNA, 22 bp, Artificial Sequence
  chemically synthesized
ataaacctctccatatttcaca

SEQ ID NO: 75588 - DNA, 22 bp, Artificial Sequence
  chemically synthesized
tccatatttcacatttcagcta

SEQ ID NO: 75589 - DNA, 22 bp, Artificial Sequence
  chemically synthesized
catatttcacatttcagctatt

SEQ ID NO: 75590 - DNA, 22 bp, Artificial Sequence
  chemically synthesized
cacatttcagctattcctctag

SEQ ID NO: 75591 - DNA, 22 bp, Artificial Sequence
  chemically synthesized
acatttcagctattcctctagt

SEQ ID NO: 75592 - DNA, 22 bp, Artificial Sequence
  chemically synthesized
cagctattcctctagtatttaa

SEQ ID NO: 75593 - DNA, 22 bp, Artificial Sequence
  chemically synthesized
agctattcctctagtatttaac

SEQ ID NO: 75594 - DNA, 22 bp, Artificial Sequence
  chemically synthesized
ttcctctagtatttaactattt

SEQ ID NO: 75595 - DNA, 22 bp, Artificial Sequence
  chemically synthesized
ctctagtatttaactatttcca

SEQ ID NO: 75596 - DNA, 22 bp, Artificial Sequence
  chemically synthesized
tagtatttaactatttccaatt

SEQ ID NO: 75597 - DNA, 22 bp, Artificial Sequence
  chemically synthesized
gtatttaactatttccaatttt

SEQ ID NO: 75598 - DNA, 22 bp, Artificial Sequence
  chemically synthesized
aactatttccaattttctttaa

SEQ ID NO: 75599 - DNA, 22 bp, Artificial Sequence
  chemically synthesized
actatttccaattttctttaag

SEQ ID NO: 75600 - DNA, 22 bp, Artificial Sequence
  chemically synthesized
tttccaattttctttaagaaca

SEQ ID NO: 75601 - DNA, 22 bp, Artificial Sequence
  chemically synthesized
ccaattttctttaagaacattt

SEQ ID NO: 75602 - DNA, 22 bp, Artificial Sequence
  chemically synthesized
caattttctttaagaacatttt

SEQ ID NO: 75603 - DNA, 22 bp, Artificial Sequence
  chemically synthesized
tctttaagaacattttagacaa

SEQ ID NO: 75604 - DNA, 22 bp, Artificial Sequence
  chemically synthesized
ctttaagaacattttagacaag

SEQ ID NO: 75605 - DNA, 22 bp, Artificial Sequence
  chemically synthesized
tttaagaacattttagacaagc

SEQ ID NO: 75606 - DNA, 22 bp, Artificial Sequence
  chemically synthesized
taagaacattttagacaagcaa

SEQ ID NO: 75607 - DNA, 22 bp, Artificial Sequence
  chemically synthesized
aagaacattttagacaagcaaa

SEQ ID NO: 75608 - DNA, 22 bp, Artificial Sequence
  chemically synthesized
agaacattttagacaagcaaat

SEQ ID NO: 75609 - DNA, 22 bp, Artificial Sequence
  chemically synthesized
tagacaagcaaattaacagact

SEQ ID NO: 75610 - DNA, 22 bp, Artificial Sequence
  chemically synthesized
agacaagcaaattaacagactc

SEQ ID NO: 75611 - DNA, 22 bp, Artificial Sequence
  chemically synthesized
gacaagcaaattaacagactct

SEQ ID NO: 75612 - DNA, 22 bp, Artificial Sequence
  chemically synthesized
acagactctgaccagtacattg

SEQ ID NO: 75613 - DNA, 22 bp, Artificial Sequence
  chemically synthesized
tgaccagtacattggtgtaaaa

SEQ ID NO: 75614 - DNA, 22 bp, Artificial Sequence
  chemically synthesized
accagtacattggtgtaaaaga

SEQ ID NO: 75615 - DNA, 22 bp, Artificial Sequence
  chemically synthesized
gtgtaaaagattcccaatgaaa

SEQ ID NO: 75616 - DNA, 22 bp, Artificial Sequence
  chemically synthesized
ccaatgaaagagaatagaggta

SEQ ID NO: 75617 - DNA, 22 bp, Artificial Sequence
  chemically synthesized
acacccaagaacataatatatt

SEQ ID NO: 75618 - DNA, 22 bp, Artificial Sequence
  chemically synthesized
ctttttatattcagaataatgt

SEQ ID NO: 75619 - DNA, 22 bp, Artificial Sequence
  chemically synthesized
tttttatattcagaataatgta

SEQ ID NO: 75620 - DNA, 22 bp, Artificial Sequence
  chemically synthesized
tttatattcagaataatgtaaa

SEQ ID NO: 75621 - DNA, 22 bp, Artificial Sequence
  chemically synthesized
ttatattcagaataatgtaaag

SEQ ID NO: 75622 - DNA, 22 bp, Artificial Sequence
  chemically synthesized
tatattcagaataatgtaaaga

SEQ ID NO: 75623 - DNA, 22 bp, Artificial Sequence
  chemically synthesized
atattcagaataatgtaaagag

SEQ ID NO: 75624 - DNA, 22 bp, Artificial Sequence
  chemically synthesized
tattcagaataatgtaaagaga

SEQ ID NO: 75625 - DNA, 22 bp, Artificial Sequence
  chemically synthesized
agaataatgtaaagagaatgct

SEQ ID NO: 75626 - DNA, 22 bp, Artificial Sequence
  chemically synthesized
tagaaataattgaaatctttat

SEQ ID NO: 75627 - DNA, 22 bp, Artificial Sequence
  chemically synthesized
agaaataattgaaatctttata

SEQ ID NO: 75628 - DNA, 22 bp, Artificial Sequence
  chemically synthesized
gaaataattgaaatctttatac

SEQ ID NO: 75629 - DNA, 22 bp, Artificial Sequence
  chemically synthesized
aaatctttatacttttgacaaa

SEQ ID NO: 75630 - DNA, 22 bp, Artificial Sequence
  chemically synthesized
tatacttttgacaaatctgagc

SEQ ID NO: 75631 - DNA, 22 bp, Artificial Sequence
  chemically synthesized
atacttttgacaaatctgagcc

SEQ ID NO: 75632 - DNA, 22 bp, Artificial Sequence
  chemically synthesized
tacttttgacaaatctgagcca

SEQ ID NO: 75633 - DNA, 22 bp, Artificial Sequence
  chemically synthesized
ttgacaaatctgagccaaagct

SEQ ID NO: 75634 - DNA, 22 bp, Artificial Sequence
  chemically synthesized
tgacaaatctgagccaaagctc

SEQ ID NO: 75635 - DNA, 22 bp, Artificial Sequence
  chemically synthesized
gacaaatctgagccaaagctcc

SEQ ID NO: 75636 - DNA, 22 bp, Artificial Sequence
  chemically synthesized
acaaatctgagccaaagctcct

SEQ ID NO: 75637 - DNA, 22 bp, Artificial Sequence
  chemically synthesized
agccaaagctcctggttgcttt

SEQ ID NO: 75638 - DNA, 22 bp, Artificial Sequence
  chemically synthesized
ctggttgctttttatatttctt

SEQ ID NO: 75639 - DNA, 22 bp, Artificial Sequence
  chemically synthesized
gttgctttttatatttctttaa

SEQ ID NO: 75640 - DNA, 22 bp, Artificial Sequence
  chemically synthesized
ctttttatatttctttaaagtt

SEQ ID NO: 75641 - DNA, 22 bp, Artificial Sequence
  chemically synthesized
tttatatttctttaaagttaaa

SEQ ID NO: 75642 - DNA, 22 bp, Artificial Sequence
  chemically synthesized
ttatatttctttaaagttaaag

SEQ ID NO: 75643 - DNA, 22 bp, Artificial Sequence
  chemically synthesized
tatatttctttaaagttaaagg

SEQ ID NO: 75644 - DNA, 22 bp, Artificial Sequence
  chemically synthesized
atatttctttaaagttaaaggg

SEQ ID NO: 75645 - DNA, 22 bp, Artificial Sequence
  chemically synthesized
tatttctttaaagttaaaggga

SEQ ID NO: 75646 - DNA, 22 bp, Artificial Sequence
  chemically synthesized
ctttaaagttaaagggaattat

SEQ ID NO: 75647 - DNA, 22 bp, Artificial Sequence
  chemically synthesized
tttaaagttaaagggaattata

SEQ ID NO: 75648 - DNA, 22 bp, Artificial Sequence
  chemically synthesized
taaagttaaagggaattatatt

SEQ ID NO: 75649 - DNA, 22 bp, Artificial Sequence
  chemically synthesized
aaagttaaagggaattatattt

SEQ ID NO: 75650 - DNA, 22 bp, Artificial Sequence
  chemically synthesized
aagttaaagggaattatatttt

SEQ ID NO: 75651 - DNA, 22 bp, Artificial Sequence
  chemically synthesized
aagggaattatattttttccta

SEQ ID NO: 75652 - DNA, 22 bp, Artificial Sequence
  chemically synthesized
tattttttcctatatattttaa

SEQ ID NO: 75653 - DNA, 22 bp, Artificial Sequence
  chemically synthesized
tttcctatatattttaaacagc

SEQ ID NO: 75654 - DNA, 22 bp, Artificial Sequence
  chemically synthesized
ttcctatatattttaaacagct

SEQ ID NO: 75655 - DNA, 22 bp, Artificial Sequence
  chemically synthesized
tcctatatattttaaacagctg

SEQ ID NO: 75656 - DNA, 22 bp, Artificial Sequence
  chemically synthesized
cctatatattttaaacagctga

SEQ ID NO: 75657 - DNA, 22 bp, Artificial Sequence
  chemically synthesized
ctatatattttaaacagctgaa

SEQ ID NO: 75658 - DNA, 22 bp, Artificial Sequence
  chemically synthesized
tatattttaaacagctgaaact

SEQ ID NO: 75659 - DNA, 22 bp, Artificial Sequence
  chemically synthesized
taaacagctgaaactcttgaaa

SEQ ID NO: 75660 - DNA, 22 bp, Artificial Sequence
  chemically synthesized
aaacagctgaaactcttgaaat

SEQ ID NO: 75661 - DNA, 22 bp, Artificial Sequence
  chemically synthesized
aacagctgaaactcttgaaatg

SEQ ID NO: 75662 - DNA, 22 bp, Artificial Sequence
  chemically synthesized
aaactcttgaaatgttgtgagt

SEQ ID NO: 75663 - DNA, 22 bp, Artificial Sequence
  chemically synthesized
ttgaaatgttgtgagtttaaaa

SEQ ID NO: 75664 - DNA, 22 bp, Artificial Sequence
  chemically synthesized
gaaatgttgtgagtttaaaatt

SEQ ID NO: 75665 - DNA, 22 bp, Artificial Sequence
  chemically synthesized
aaatgttgtgagtttaaaattt

SEQ ID NO: 75666 - DNA, 22 bp, Artificial Sequence
  chemically synthesized
tgagtttaaaattttaatacac

SEQ ID NO: 75667 - DNA, 22 bp, Artificial Sequence
  chemically synthesized
aaaattttaatacactttatgg

SEQ ID NO: 75668 - DNA, 22 bp, Artificial Sequence
  chemically synthesized
aaattttaatacactttatgga

SEQ ID NO: 75669 - DNA, 22 bp, Artificial Sequence
  chemically synthesized
taatacactttatggaatatct

SEQ ID NO: 75670 - DNA, 22 bp, Artificial Sequence
  chemically synthesized
aatacactttatggaatatcta

SEQ ID NO: 75671 - DNA, 22 bp, Artificial Sequence
  chemically synthesized
atacactttatggaatatctag

SEQ ID NO: 75672 - DNA, 22 bp, Artificial Sequence
  chemically synthesized
tatggaatatctagagagaagg

SEQ ID NO: 75673 - DNA, 22 bp, Artificial Sequence
  chemically synthesized
atggaatatctagagagaagga

SEQ ID NO: 75674 - DNA, 22 bp, Artificial Sequence
  chemically synthesized
tggaatatctagagagaaggaa

SEQ ID NO: 75675 - DNA, 22 bp, Artificial Sequence
  chemically synthesized
gagagaaggaactgctaaggga

SEQ ID NO: 75676 - DNA, 22 bp, Artificial Sequence
  chemically synthesized
ctaagggacaagatgagcagca

SEQ ID NO: 75677 - DNA, 22 bp, Artificial Sequence
  chemically synthesized
agggacaagatgagcagcagca

SEQ ID NO: 75678 - DNA, 22 bp, Artificial Sequence
  chemically synthesized
cggcaagagaacttgctcctga

SEQ ID NO: 75679 - DNA, 22 bp, Artificial Sequence
  chemically synthesized
gctcctgataaaccacagatac

SEQ ID NO: 75680 - DNA, 22 bp, Artificial Sequence
  chemically synthesized
ctcctgataaaccacagatact

SEQ ID NO: 75681 - DNA, 22 bp, Artificial Sequence
  chemically synthesized
ctgataaaccacagatactgaa

SEQ ID NO: 75682 - DNA, 22 bp, Artificial Sequence
  chemically synthesized
ataaaccacagatactgaataa

SEQ ID NO: 75683 - DNA, 22 bp, Artificial Sequence
  chemically synthesized
aataatgggcaaatgaatcatt

SEQ ID NO: 75684 - DNA, 22 bp, Artificial Sequence
  chemically synthesized
agccagaatagagtccagtttc

SEQ ID NO: 75685 - DNA, 22 bp, Artificial Sequence
  chemically synthesized
gccagaatagagtccagtttcc

SEQ ID NO: 75686 - DNA, 22 bp, Artificial Sequence
  chemically synthesized
cctggttttaaaatgttcagag

SEQ ID NO: 75687 - DNA, 22 bp, Artificial Sequence
  chemically synthesized
ctggttttaaaatgttcagagt

SEQ ID NO: 75688 - DNA, 22 bp, Artificial Sequence
  chemically synthesized
gttttaaaatgttcagagttat

SEQ ID NO: 75689 - DNA, 22 bp, Artificial Sequence
  chemically synthesized
taaaatgttcagagttataatt

SEQ ID NO: 75690 - DNA, 22 bp, Artificial Sequence
  chemically synthesized
aaaatgttcagagttataatta

SEQ ID NO: 75691 - DNA, 22 bp, Artificial Sequence
  chemically synthesized
aaatgttcagagttataattag

SEQ ID NO: 75692 - DNA, 22 bp, Artificial Sequence
  chemically synthesized
agagttataattagcataatat

SEQ ID NO: 75693 - DNA, 22 bp, Artificial Sequence
  chemically synthesized
taattagcataatatagcccaa

SEQ ID NO: 75694 - DNA, 22 bp, Artificial Sequence
  chemically synthesized
gcataatatagcccaataaagg

SEQ ID NO: 75695 - DNA, 22 bp, Artificial Sequence
  chemically synthesized
attagttcttaatgaaatatag

SEQ ID NO: 75696 - DNA, 22 bp, Artificial Sequence
  chemically synthesized
gttcttaatgaaatataggtga

SEQ ID NO: 75697 - DNA, 22 bp, Artificial Sequence
  chemically synthesized
ttaatgaaatataggtgagatg

SEQ ID NO: 75698 - DNA, 22 bp, Artificial Sequence
  chemically synthesized
aatgaaatataggtgagatgct

SEQ ID NO: 75699 - DNA, 22 bp, Artificial Sequence
  chemically synthesized
atgaaatataggtgagatgctt

SEQ ID NO: 75700 - DNA, 22 bp, Artificial Sequence
  chemically synthesized
atataattttgtgagctctgac

SEQ ID NO: 75701 - DNA, 22 bp, Artificial Sequence
  chemically synthesized
tataattttgtgagctctgaca

SEQ ID NO: 75702 - DNA, 22 bp, Artificial Sequence
  chemically synthesized
tgtgagctctgacataagaaat

SEQ ID NO: 75703 - DNA, 22 bp, Artificial Sequence
  chemically synthesized
gtgagctctgacataagaaatt

SEQ ID NO: 75704 - DNA, 22 bp, Artificial Sequence
  chemically synthesized
tgagctctgacataagaaatta

SEQ ID NO: 75705 - DNA, 22 bp, Artificial Sequence
  chemically synthesized
tgacataagaaattagtaaaaa

SEQ ID NO: 75706 - DNA, 22 bp, Artificial Sequence
  chemically synthesized
acataagaaattagtaaaaata

SEQ ID NO: 75707 - DNA, 22 bp, Artificial Sequence
  chemically synthesized
gtaaaaataaaaaagctaaagg

SEQ ID NO: 75708 - DNA, 22 bp, Artificial Sequence
  chemically synthesized
aaggacagatttcttagaagaa

SEQ ID NO: 75709 - DNA, 22 bp, Artificial Sequence
  chemically synthesized
cttagaagaagtcaaatgtaga

SEQ ID NO: 75710 - DNA, 22 bp, Artificial Sequence
  chemically synthesized
ttagaagaagtcaaatgtagaa

SEQ ID NO: 75711 - DNA, 22 bp, Artificial Sequence
  chemically synthesized
agaagaagtcaaatgtagaact

SEQ ID NO: 75712 - DNA, 22 bp, Artificial Sequence
  chemically synthesized
gaagaagtcaaatgtagaacta

SEQ ID NO: 75713 - DNA, 22 bp, Artificial Sequence
  chemically synthesized
gacagggaagacaggacaaact

SEQ ID NO: 75714 - DNA, 22 bp, Artificial Sequence
  chemically synthesized
ggggagactaaaattgaggaaa

SEQ ID NO: 75715 - DNA, 22 bp, Artificial Sequence
  chemically synthesized
gggagactaaaattgaggaaag

SEQ ID NO: 75716 - DNA, 22 bp, Artificial Sequence
  chemically synthesized
aaattgaggaaagcactatgaa

SEQ ID NO: 75717 - DNA, 22 bp, Artificial Sequence
  chemically synthesized
aggaaagcactatgaataacca

SEQ ID NO: 75718 - DNA, 22 bp, Artificial Sequence
  chemically synthesized
tgaataaccaaagaaaatttag

SEQ ID NO: 75719 - DNA, 22 bp, Artificial Sequence
  chemically synthesized
agtcacttttcaatttcactga

SEQ ID NO: 75720 - DNA, 22 bp, Artificial Sequence
  chemically synthesized
gtcacttttcaatttcactgat

SEQ ID NO: 75721 - DNA, 22 bp, Artificial Sequence
  chemically synthesized
ttcaatttcactgatgattgaa

SEQ ID NO: 75722 - DNA, 22 bp, Artificial Sequence
  chemically synthesized
tcaatttcactgatgattgaat

SEQ ID NO: 75723 - DNA, 22 bp, Artificial Sequence
  chemically synthesized
caatttcactgatgattgaatt

SEQ ID NO: 75724 - DNA, 22 bp, Artificial Sequence
  chemically synthesized
aatttcactgatgattgaattt

SEQ ID NO: 75725 - DNA, 22 bp, Artificial Sequence
  chemically synthesized
cactgatgattgaattttctga

SEQ ID NO: 75726 - DNA, 22 bp, Artificial Sequence
  chemically synthesized
actgatgattgaattttctgaa

SEQ ID NO: 75727 - DNA, 22 bp, Artificial Sequence
  chemically synthesized
atgattgaattttctgaaaaac

SEQ ID NO: 75728 - DNA, 22 bp, Artificial Sequence
  chemically synthesized
aattttctgaaaaacctgggct

SEQ ID NO: 75729 - DNA, 22 bp, Artificial Sequence
  chemically synthesized
tctgaaaaacctgggctcttat

SEQ ID NO: 75730 - DNA, 22 bp, Artificial Sequence
  chemically synthesized
ctgaaaaacctgggctcttatg

SEQ ID NO: 75731 - DNA, 22 bp, Artificial Sequence
  chemically synthesized
tgaaaaacctgggctcttatgc

SEQ ID NO: 75732 - DNA, 22 bp, Artificial Sequence
  chemically synthesized
aaaaacctgggctcttatgctt

SEQ ID NO: 75733 - DNA, 22 bp, Artificial Sequence
  chemically synthesized
ggctcttatgctttatataaaa

SEQ ID NO: 75734 - DNA, 22 bp, Artificial Sequence
  chemically synthesized
ttatgctttatataaaagttct

SEQ ID NO: 75735 - DNA, 22 bp, Artificial Sequence
  chemically synthesized
atgctttatataaaagttctct

SEQ ID NO: 75736 - DNA, 22 bp, Artificial Sequence
  chemically synthesized
tgctttatataaaagttctctg

SEQ ID NO: 75737 - DNA, 22 bp, Artificial Sequence
  chemically synthesized
tatataaaagttctctgatcaa

SEQ ID NO: 75738 - DNA, 22 bp, Artificial Sequence
  chemically synthesized
atataaaagttctctgatcaaa

SEQ ID NO: 75739 - DNA, 22 bp, Artificial Sequence
  chemically synthesized
tataaaagttctctgatcaaaa

SEQ ID NO: 75740 - DNA, 22 bp, Artificial Sequence
  chemically synthesized
tctgatcaaaatagttattttc

SEQ ID NO: 75741 - DNA, 22 bp, Artificial Sequence
  chemically synthesized
tgatcaaaatagttattttcta

SEQ ID NO: 75742 - DNA, 22 bp, Artificial Sequence
  chemically synthesized
atcaaaatagttattttctaaa

SEQ ID NO: 75743 - DNA, 22 bp, Artificial Sequence
  chemically synthesized
ttttctaaaaattacatatttt

SEQ ID NO: 75744 - DNA, 22 bp, Artificial Sequence
  chemically synthesized
tctaaaaattacatattttgaa

SEQ ID NO: 75745 - DNA, 22 bp, Artificial Sequence
  chemically synthesized
ctaaaaattacatattttgaat

SEQ ID NO: 75746 - DNA, 22 bp, Artificial Sequence
  chemically synthesized
taaaaattacatattttgaatc

SEQ ID NO: 75747 - DNA, 22 bp, Artificial Sequence
  chemically synthesized
aaaattacatattttgaatcag

SEQ ID NO: 75748 - DNA, 22 bp, Artificial Sequence
  chemically synthesized
catattttgaatcagtacattt

SEQ ID NO: 75749 - DNA, 22 bp, Artificial Sequence
  chemically synthesized
tgaatcagtacattttaagcta

SEQ ID NO: 75750 - DNA, 22 bp, Artificial Sequence
  chemically synthesized
gaatcagtacattttaagctat

SEQ ID NO: 75751 - DNA, 22 bp, Artificial Sequence
  chemically synthesized
aatcagtacattttaagctata

SEQ ID NO: 75752 - DNA, 22 bp, Artificial Sequence
  chemically synthesized
taagctatacattagagaaatg

SEQ ID NO: 75753 - DNA, 22 bp, Artificial Sequence
  chemically synthesized
aagctatacattagagaaatgt

SEQ ID NO: 75754 - DNA, 22 bp, Artificial Sequence
  chemically synthesized
agctatacattagagaaatgtt

SEQ ID NO: 75755 - DNA, 22 bp, Artificial Sequence
  chemically synthesized
tacattagagaaatgtttgtga

SEQ ID NO: 75756 - DNA, 22 bp, Artificial Sequence
  chemically synthesized
gagaaatgtttgtgatacagtg

SEQ ID NO: 75757 - DNA, 22 bp, Artificial Sequence
  chemically synthesized
gtgatacagtgaaaagtaaagt

SEQ ID NO: 75758 - DNA, 22 bp, Artificial Sequence
  chemically synthesized
tgatacagtgaaaagtaaagtt

SEQ ID NO: 75759 - DNA, 22 bp, Artificial Sequence
  chemically synthesized
cttcattctttcctagacactt

SEQ ID NO: 75760 - DNA, 22 bp, Artificial Sequence
  chemically synthesized
cattctttcctagacacttcaa

SEQ ID NO: 75761 - DNA, 22 bp, Artificial Sequence
  chemically synthesized
attctttcctagacacttcaat

SEQ ID NO: 75762 - DNA, 22 bp, Artificial Sequence
  chemically synthesized
tttcctagacacttcaataaag

SEQ ID NO: 75763 - DNA, 22 bp, Artificial Sequence
  chemically synthesized
tcctagacacttcaataaagtt

SEQ ID NO: 75764 - DNA, 22 bp, Artificial Sequence
  chemically synthesized
cctagacacttcaataaagttg

SEQ ID NO: 75765 - DNA, 22 bp, Artificial Sequence
  chemically synthesized
ctagacacttcaataaagttgt

SEQ ID NO: 75766 - DNA, 22 bp, Artificial Sequence
  chemically synthesized
gacacttcaataaagttgtttt

SEQ ID NO: 75767 - DNA, 22 bp, Artificial Sequence
  chemically synthesized
caataaagttgttttatctcag

SEQ ID NO: 75768 - DNA, 22 bp, Artificial Sequence
  chemically synthesized
aataaagttgttttatctcagt

SEQ ID NO: 75769 - DNA, 22 bp, Artificial Sequence
  chemically synthesized
ttttatctcagtaagctcatga

SEQ ID NO: 75770 - DNA, 22 bp, Artificial Sequence
  chemically synthesized
tatctcagtaagctcatgaatc

SEQ ID NO: 75771 - DNA, 22 bp, Artificial Sequence
  chemically synthesized
atctcagtaagctcatgaatca

SEQ ID NO: 75772 - DNA, 22 bp, Artificial Sequence
  chemically synthesized
tctcagtaagctcatgaatcag

SEQ ID NO: 75773 - DNA, 22 bp, Artificial Sequence
  chemically synthesized
agtaagctcatgaatcagctaa

SEQ ID NO: 75774 - DNA, 22 bp, Artificial Sequence
  chemically synthesized
atgaatcagctaaccgtatgct

SEQ ID NO: 75775 - DNA, 22 bp, Artificial Sequence
  chemically synthesized
accgtatgcttcatgtcaccaa

SEQ ID NO: 75776 - DNA, 22 bp, Artificial Sequence
  chemically synthesized
catgtcaccaatatgctggaaa

SEQ ID NO: 75777 - DNA, 22 bp, Artificial Sequence
  chemically synthesized
atgtcaccaatatgctggaaat

SEQ ID NO: 75778 - DNA, 22 bp, Artificial Sequence
  chemically synthesized
gaaattcaggaagtagctgttc

SEQ ID NO: 75779 - DNA, 22 bp, Artificial Sequence
  chemically synthesized
aggaagtagctgttctttgaaa

SEQ ID NO: 75780 - DNA, 22 bp, Artificial Sequence
  chemically synthesized
ttctttgaaagaaaaagcagct

SEQ ID NO: 75781 - DNA, 22 bp, Artificial Sequence
  chemically synthesized
tttgaaagaaaaagcagctttt

SEQ ID NO: 75782 - DNA, 22 bp, Artificial Sequence
  chemically synthesized
tgaaagaaaaagcagctttttt

SEQ ID NO: 75783 - DNA, 22 bp, Artificial Sequence
  chemically synthesized
gaaagaaaaagcagcttttttt

SEQ ID NO: 75784 - DNA, 22 bp, Artificial Sequence
  chemically synthesized
aaagaaaaagcagctttttttt

SEQ ID NO: 75785 - DNA, 22 bp, Artificial Sequence
  chemically synthesized
tttttttttttttttttttgaa

SEQ ID NO: 75786 - DNA, 22 bp, Artificial Sequence
  chemically synthesized
ttttttttttttttttttgaaa

SEQ ID NO: 75787 - DNA, 22 bp, Artificial Sequence
  chemically synthesized
tttttttttttttttttgaaag

SEQ ID NO: 75788 - DNA, 22 bp, Artificial Sequence
  chemically synthesized
ttttttttttttttttgaaaga

SEQ ID NO: 75789 - DNA, 22 bp, Artificial Sequence
  chemically synthesized
tttttttttttttttgaaagaa

SEQ ID NO: 75790 - DNA, 22 bp, Artificial Sequence
  chemically synthesized
ttttttttttttttgaaagaaa

SEQ ID NO: 75791 - DNA, 22 bp, Artificial Sequence
  chemically synthesized
tttttttttttttgaaagaaaa

SEQ ID NO: 75792 - DNA, 22 bp, Artificial Sequence
  chemically synthesized
ttttttttttttgaaagaaaag

SEQ ID NO: 75793 - DNA, 22 bp, Artificial Sequence
  chemically synthesized
tttttttttttgaaagaaaagg

SEQ ID NO: 75794 - DNA, 22 bp, Artificial Sequence
  chemically synthesized
ttttttttttgaaagaaaagga

SEQ ID NO: 75795 - DNA, 22 bp, Artificial Sequence
  chemically synthesized
tttttttttgaaagaaaaggaa

SEQ ID NO: 75796 - DNA, 22 bp, Artificial Sequence
  chemically synthesized
ttttttttgaaagaaaaggaag

SEQ ID NO: 75797 - DNA, 22 bp, Artificial Sequence
  chemically synthesized
tttttttgaaagaaaaggaagg

SEQ ID NO: 75798 - DNA, 22 bp, Artificial Sequence
  chemically synthesized
ttttttgaaagaaaaggaaggt

SEQ ID NO: 75799 - DNA, 22 bp, Artificial Sequence
  chemically synthesized
tttttgaaagaaaaggaaggta

SEQ ID NO: 75800 - DNA, 22 bp, Artificial Sequence
  chemically synthesized
ttttgaaagaaaaggaaggtaa

SEQ ID NO: 75801 - DNA, 22 bp, Artificial Sequence
  chemically synthesized
tttgaaagaaaaggaaggtaag

SEQ ID NO: 75802 - DNA, 22 bp, Artificial Sequence
  chemically synthesized
ttgaaagaaaaggaaggtaagt

SEQ ID NO: 75803 - DNA, 22 bp, Artificial Sequence
  chemically synthesized
tgaaagaaaaggaaggtaagta

SEQ ID NO: 75804 - DNA, 22 bp, Artificial Sequence
  chemically synthesized
gaaagaaaaggaaggtaagtaa

SEQ ID NO: 75805 - DNA, 22 bp, Artificial Sequence
  chemically synthesized
aaagaaaaggaaggtaagtaac

SEQ ID NO: 75806 - DNA, 22 bp, Artificial Sequence
  chemically synthesized
actcaaatattcaacaacaaat

SEQ ID NO: 75807 - DNA, 22 bp, Artificial Sequence
  chemically synthesized
ctcaaatattcaacaacaaatg

SEQ ID NO: 75808 - DNA, 22 bp, Artificial Sequence
  chemically synthesized
aaatattcaacaacaaatgttc

SEQ ID NO: 75809 - DNA, 22 bp, Artificial Sequence
  chemically synthesized
aacaacaaatgttcaactgctg

SEQ ID NO: 75810 - DNA, 22 bp, Artificial Sequence
  chemically synthesized
aactgctgctaaacttcaaatg

SEQ ID NO: 75811 - DNA, 22 bp, Artificial Sequence
  chemically synthesized
ctgctaaacttcaaatgaaaga

SEQ ID NO: 75812 - DNA, 22 bp, Artificial Sequence
  chemically synthesized
ctaaacttcaaatgaaagaacc

SEQ ID NO: 75813 - DNA, 22 bp, Artificial Sequence
  chemically synthesized
aacttcaaatgaaagaaccaaa

SEQ ID NO: 75814 - DNA, 22 bp, Artificial Sequence
  chemically synthesized
caaatgaaagaaccaaatcagc

SEQ ID NO: 75815 - DNA, 22 bp, Artificial Sequence
  chemically synthesized
aaatgaaagaaccaaatcagca

SEQ ID NO: 75816 - DNA, 22 bp, Artificial Sequence
  chemically synthesized
catgacagggaggctgtatcag

SEQ ID NO: 75817 - DNA, 22 bp, Artificial Sequence
  chemically synthesized
atgacagggaggctgtatcagc

SEQ ID NO: 75818 - DNA, 22 bp, Artificial Sequence
  chemically synthesized
tatcagctaacatacatttacc

SEQ ID NO: 75819 - DNA, 22 bp, Artificial Sequence
  chemically synthesized
acatacatttaccgtaaactag

SEQ ID NO: 75820 - DNA, 22 bp, Artificial Sequence
  chemically synthesized
accgtaaactagtaggtcaatt

SEQ ID NO: 75821 - DNA, 22 bp, Artificial Sequence
  chemically synthesized
ccgtaaactagtaggtcaatta

SEQ ID NO: 75822 - DNA, 22 bp, Artificial Sequence
  chemically synthesized
gtaggtcaattaaatactttga

SEQ ID NO: 75823 - DNA, 22 bp, Artificial Sequence
  chemically synthesized
aatactttgatttccacagatt

SEQ ID NO: 75824 - DNA, 22 bp, Artificial Sequence
  chemically synthesized
tgatttccacagatttgatccc

SEQ ID NO: 75825 - DNA, 22 bp, Artificial Sequence
  chemically synthesized
gatttccacagatttgatcccc

SEQ ID NO: 75826 - DNA, 22 bp, Artificial Sequence
  chemically synthesized
atttccacagatttgatcccca

SEQ ID NO: 75827 - DNA, 22 bp, Artificial Sequence
  chemically synthesized
ccacagatttgatccccaatgc

SEQ ID NO: 75828 - DNA, 22 bp, Artificial Sequence
  chemically synthesized
cacagatttgatccccaatgct

SEQ ID NO: 75829 - DNA, 22 bp, Artificial Sequence
  chemically synthesized
gatccccaatgcttagttttat

SEQ ID NO: 75830 - DNA, 22 bp, Artificial Sequence
  chemically synthesized
atccccaatgcttagttttatg

SEQ ID NO: 75831 - DNA, 22 bp, Artificial Sequence
  chemically synthesized
agttttatgacactcccatcca

SEQ ID NO: 75832 - DNA, 22 bp, Artificial Sequence
  chemically synthesized
gttttatgacactcccatccat

SEQ ID NO: 75833 - DNA, 22 bp, Artificial Sequence
  chemically synthesized
tatgacactcccatccataagt

SEQ ID NO: 75834 - DNA, 22 bp, Artificial Sequence
  chemically synthesized
atgacactcccatccataagtc

SEQ ID NO: 75835 - DNA, 22 bp, Artificial Sequence
  chemically synthesized
tgacactcccatccataagtca

SEQ ID NO: 75836 - DNA, 22 bp, Artificial Sequence
  chemically synthesized
ccatccataagtcactggcttt

SEQ ID NO: 75837 - DNA, 22 bp, Artificial Sequence
  chemically synthesized
gctttttctaataggggcaaat

SEQ ID NO: 75838 - DNA, 22 bp, Artificial Sequence
  chemically synthesized
tttctaataggggcaaattttt

SEQ ID NO: 75839 - DNA, 22 bp, Artificial Sequence
  chemically synthesized
ttctaataggggcaaatttttt

SEQ ID NO: 75840 - DNA, 22 bp, Artificial Sequence
  chemically synthesized
tctaataggggcaaattttttc

SEQ ID NO: 75841 - DNA, 22 bp, Artificial Sequence
  chemically synthesized
ctaataggggcaaattttttct

SEQ ID NO: 75842 - DNA, 22 bp, Artificial Sequence
  chemically synthesized
taataggggcaaattttttctt

SEQ ID NO: 75843 - DNA, 22 bp, Artificial Sequence
  chemically synthesized
ataggggcaaattttttcttct

SEQ ID NO: 75844 - DNA, 22 bp, Artificial Sequence
  chemically synthesized
tttcttctccaaagataatcac

SEQ ID NO: 75845 - DNA, 22 bp, Artificial Sequence
  chemically synthesized
ttcttctccaaagataatcaca

SEQ ID NO: 75846 - DNA, 22 bp, Artificial Sequence
  chemically synthesized
tcttctccaaagataatcacaa

SEQ ID NO: 75847 - DNA, 22 bp, Artificial Sequence
  chemically synthesized
cttctccaaagataatcacaat

SEQ ID NO: 75848 - DNA, 22 bp, Artificial Sequence
  chemically synthesized
ttctccaaagataatcacaatt

SEQ ID NO: 75849 - DNA, 22 bp, Artificial Sequence
  chemically synthesized
ctccaaagataatcacaattag

SEQ ID NO: 75850 - DNA, 22 bp, Artificial Sequence
  chemically synthesized
tccaaagataatcacaattaga

SEQ ID NO: 75851 - DNA, 22 bp, Artificial Sequence
  chemically synthesized
caaagataatcacaattagaat

SEQ ID NO: 75852 - DNA, 22 bp, Artificial Sequence
  chemically synthesized
gaataagaatcctttaatggca

SEQ ID NO: 75853 - DNA, 22 bp, Artificial Sequence
  chemically synthesized
taatggcaatcacaatgtctga

SEQ ID NO: 75854 - DNA, 22 bp, Artificial Sequence
  chemically synthesized
aatggcaatcacaatgtctgac

SEQ ID NO: 75855 - DNA, 22 bp, Artificial Sequence
  chemically synthesized
atggcaatcacaatgtctgact

SEQ ID NO: 75856 - DNA, 22 bp, Artificial Sequence
  chemically synthesized
acttattcaagaccaaagagct

SEQ ID NO: 75857 - DNA, 22 bp, Artificial Sequence
  chemically synthesized
attcaagaccaaagagctgaca

SEQ ID NO: 75858 - DNA, 22 bp, Artificial Sequence
  chemically synthesized
ttcaagaccaaagagctgacat

SEQ ID NO: 75859 - DNA, 22 bp, Artificial Sequence
  chemically synthesized
aagaccaaagagctgacatgtg

SEQ ID NO: 75860 - DNA, 22 bp, Artificial Sequence
  chemically synthesized
acatgtgagtactacctgacag

SEQ ID NO: 75861 - DNA, 22 bp, Artificial Sequence
  chemically synthesized
cctgacaggcacagatagcagg

SEQ ID NO: 75862 - DNA, 22 bp, Artificial Sequence
  chemically synthesized
acaggcacagatagcagggttg

SEQ ID NO: 75863 - DNA, 22 bp, Artificial Sequence
  chemically synthesized
caggtggtggtgtatgtaagtt

SEQ ID NO: 75864 - DNA, 22 bp, Artificial Sequence
  chemically synthesized
ctggttagttggatagagtgat

SEQ ID NO: 75865 - DNA, 22 bp, Artificial Sequence
  chemically synthesized
gttagttggatagagtgattgt

SEQ ID NO: 75866 - DNA, 22 bp, Artificial Sequence
  chemically synthesized
gttggatagagtgattgttatt

SEQ ID NO: 75867 - DNA, 22 bp, Artificial Sequence
  chemically synthesized
gatagagtgattgttattggag

SEQ ID NO: 75868 - DNA, 22 bp, Artificial Sequence
  chemically synthesized
ttattggagaagctggtaatta

SEQ ID NO: 75869 - DNA, 22 bp, Artificial Sequence
  chemically synthesized
ttggagaagctggtaattaaat

SEQ ID NO: 75870 - DNA, 22 bp, Artificial Sequence
  chemically synthesized
gagaagctggtaattaaattat

SEQ ID NO: 75871 - DNA, 22 bp, Artificial Sequence
  chemically synthesized
gtaattaaattatggagaggaa

SEQ ID NO: 75872 - DNA, 22 bp, Artificial Sequence
  chemically synthesized
aattatggagaggaaacttgga

SEQ ID NO: 75873 - DNA, 22 bp, Artificial Sequence
  chemically synthesized
tggagaggaaacttggaatcgt

SEQ ID NO: 75874 - DNA, 22 bp, Artificial Sequence
  chemically synthesized
ggaatcgtgagacttactcctc

SEQ ID NO: 75875 - DNA, 22 bp, Artificial Sequence
  chemically synthesized
gaatcgtgagacttactcctca

SEQ ID NO: 75876 - DNA, 22 bp, Artificial Sequence
  chemically synthesized
actcctcaattattattgagag

SEQ ID NO: 75877 - DNA, 22 bp, Artificial Sequence
  chemically synthesized
ctcctcaattattattgagagc

SEQ ID NO: 75878 - DNA, 22 bp, Artificial Sequence
  chemically synthesized
ctcaattattattgagagctgg

SEQ ID NO: 75879 - DNA, 22 bp, Artificial Sequence
  chemically synthesized
aattattattgagagctggttt

SEQ ID NO: 75880 - DNA, 22 bp, Artificial Sequence
  chemically synthesized
ttattgagagctggttttgctc

SEQ ID NO: 75881 - DNA, 22 bp, Artificial Sequence
  chemically synthesized
ttgagagctggttttgctctta

SEQ ID NO: 75882 - DNA, 22 bp, Artificial Sequence
  chemically synthesized
agagctggttttgctcttacca

SEQ ID NO: 75883 - DNA, 22 bp, Artificial Sequence
  chemically synthesized
gttttgctcttaccagatacct

SEQ ID NO: 75884 - DNA, 22 bp, Artificial Sequence
  chemically synthesized
tgctcttaccagatacctgaag

SEQ ID NO: 75885 - DNA, 22 bp, Artificial Sequence
  chemically synthesized
gctcttaccagatacctgaaga

SEQ ID NO: 75886 - DNA, 22 bp, Artificial Sequence
  chemically synthesized
ctcttaccagatacctgaagaa

SEQ ID NO: 75887 - DNA, 22 bp, Artificial Sequence
  chemically synthesized
ttaccagatacctgaagaatat

SEQ ID NO: 75888 - DNA, 22 bp, Artificial Sequence
  chemically synthesized
accagatacctgaagaatattg

SEQ ID NO: 75889 - DNA, 22 bp, Artificial Sequence
  chemically synthesized
ccagatacctgaagaatattgt

SEQ ID NO: 75890 - DNA, 22 bp, Artificial Sequence
  chemically synthesized
aagaatattgtccatttttcat

SEQ ID NO: 75891 - DNA, 22 bp, Artificial Sequence
  chemically synthesized
tccatttttcataacactttca

SEQ ID NO: 75892 - DNA, 22 bp, Artificial Sequence
  chemically synthesized
ttcataacactttcattcatca

SEQ ID NO: 75893 - DNA, 22 bp, Artificial Sequence
  chemically synthesized
tcataacactttcattcatcac

SEQ ID NO: 75894 - DNA, 22 bp, Artificial Sequence
  chemically synthesized
cataacactttcattcatcact

SEQ ID NO: 75895 - DNA, 22 bp, Artificial Sequence
  chemically synthesized
ataacactttcattcatcactc

SEQ ID NO: 75896 - DNA, 22 bp, Artificial Sequence
  chemically synthesized
tcattcatcactcaccaatttt

SEQ ID NO: 75897 - DNA, 22 bp, Artificial Sequence
  chemically synthesized
cattcatcactcaccaattttt

SEQ ID NO: 75898 - DNA, 22 bp, Artificial Sequence
  chemically synthesized
attcatcactcaccaatttttc

SEQ ID NO: 75899 - DNA, 22 bp, Artificial Sequence
  chemically synthesized
atcactcaccaatttttcttct

SEQ ID NO: 75900 - DNA, 22 bp, Artificial Sequence
  chemically synthesized
accaatttttcttctccaagga

SEQ ID NO: 75901 - DNA, 22 bp, Artificial Sequence
  chemically synthesized
ttcttctccaaggattccagct

SEQ ID NO: 75902 - DNA, 22 bp, Artificial Sequence
  chemically synthesized
tcttctccaaggattccagctt

SEQ ID NO: 75903 - DNA, 22 bp, Artificial Sequence
  chemically synthesized
cttctccaaggattccagcttc

SEQ ID NO: 75904 - DNA, 22 bp, Artificial Sequence
  chemically synthesized
ttctccaaggattccagcttca

SEQ ID NO: 75905 - DNA, 22 bp, Artificial Sequence
  chemically synthesized
ctccaaggattccagcttcatt

SEQ ID NO: 75906 - DNA, 22 bp, Artificial Sequence
  chemically synthesized
tccaaggattccagcttcattc

SEQ ID NO: 75907 - DNA, 22 bp, Artificial Sequence
  chemically synthesized
caaggattccagcttcattccc

SEQ ID NO: 75908 - DNA, 22 bp, Artificial Sequence
  chemically synthesized
cagcttcattcccttaagttgt

SEQ ID NO: 75909 - DNA, 22 bp, Artificial Sequence
  chemically synthesized
cattcccttaagttgtgggttc

SEQ ID NO: 75910 - DNA, 22 bp, Artificial Sequence
  chemically synthesized
attcccttaagttgtgggttct

SEQ ID NO: 75911 - DNA, 22 bp, Artificial Sequence
  chemically synthesized
ccttaagttgtgggttctgtga

SEQ ID NO: 75912 - DNA, 22 bp, Artificial Sequence
  chemically synthesized
aagttgtgggttctgtgatggc

SEQ ID NO: 75913 - DNA, 22 bp, Artificial Sequence
  chemically synthesized
agttgtgggttctgtgatggct

SEQ ID NO: 75914 - DNA, 22 bp, Artificial Sequence
  chemically synthesized
tgggttctgtgatggctctact

SEQ ID NO: 75915 - DNA, 22 bp, Artificial Sequence
  chemically synthesized
tgtgatggctctactttctgtc

SEQ ID NO: 75916 - DNA, 22 bp, Artificial Sequence
  chemically synthesized
tgatggctctactttctgtctg

SEQ ID NO: 75917 - DNA, 22 bp, Artificial Sequence
  chemically synthesized
tactttctgtctgcactctgtg

SEQ ID NO: 75918 - DNA, 22 bp, Artificial Sequence
  chemically synthesized
ctttctgtctgcactctgtgta

SEQ ID NO: 75919 - DNA, 22 bp, Artificial Sequence
  chemically synthesized
tctgtctgcactctgtgtaaca

SEQ ID NO: 75920 - DNA, 22 bp, Artificial Sequence
  chemically synthesized
ctgtctgcactctgtgtaacag

SEQ ID NO: 75921 - DNA, 22 bp, Artificial Sequence
  chemically synthesized
tgtctgcactctgtgtaacagc

SEQ ID NO: 75922 - DNA, 22 bp, Artificial Sequence
  chemically synthesized
tctgcactctgtgtaacagcat

SEQ ID NO: 75923 - DNA, 22 bp, Artificial Sequence
  chemically synthesized
cactctgtgtaacagcatccag

SEQ ID NO: 75924 - DNA, 22 bp, Artificial Sequence
  chemically synthesized
tgtgtaacagcatccagctaat

SEQ ID NO: 75925 - DNA, 22 bp, Artificial Sequence
  chemically synthesized
tgtaacagcatccagctaatgt

SEQ ID NO: 75926 - DNA, 22 bp, Artificial Sequence
  chemically synthesized
atgtcataaattttactctgtt

SEQ ID NO: 75927 - DNA, 22 bp, Artificial Sequence
  chemically synthesized
tactctgtttggtgccaggata

SEQ ID NO: 75928 - DNA, 22 bp, Artificial Sequence
  chemically synthesized
actctgtttggtgccaggatat

SEQ ID NO: 75929 - DNA, 22 bp, Artificial Sequence
  chemically synthesized
ctctgtttggtgccaggatatg

SEQ ID NO: 75930 - DNA, 22 bp, Artificial Sequence
  chemically synthesized
tgtttggtgccaggatatgtgc

SEQ ID NO: 75931 - DNA, 22 bp, Artificial Sequence
  chemically synthesized
tttggtgccaggatatgtgcca

SEQ ID NO: 75932 - DNA, 22 bp, Artificial Sequence
  chemically synthesized
ggtgccaggatatgtgccaata

SEQ ID NO: 75933 - DNA, 22 bp, Artificial Sequence
  chemically synthesized
gtgccaggatatgtgccaatat

SEQ ID NO: 75934 - DNA, 22 bp, Artificial Sequence
  chemically synthesized
tggacattttgcagatgacttt

SEQ ID NO: 75935 - DNA, 22 bp, Artificial Sequence
  chemically synthesized
tgcagatgactttttacacttt

SEQ ID NO: 75936 - DNA, 22 bp, Artificial Sequence
  chemically synthesized
gcagatgactttttacactttt

SEQ ID NO: 75937 - DNA, 22 bp, Artificial Sequence
  chemically synthesized
cagatgactttttacacttttc

SEQ ID NO: 75938 - DNA, 22 bp, Artificial Sequence
  chemically synthesized
tttacacttttcatttatctct

SEQ ID NO: 75939 - DNA, 22 bp, Artificial Sequence
  chemically synthesized
ttacacttttcatttatctcta

SEQ ID NO: 75940 - DNA, 22 bp, Artificial Sequence
  chemically synthesized
tacacttttcatttatctctaa

SEQ ID NO: 75941 - DNA, 22 bp, Artificial Sequence
  chemically synthesized
acacttttcatttatctctaac

SEQ ID NO: 75942 - DNA, 22 bp, Artificial Sequence
  chemically synthesized
cacttttcatttatctctaaca

SEQ ID NO: 75943 - DNA, 22 bp, Artificial Sequence
  chemically synthesized
ttcatttatctctaacacggac

SEQ ID NO: 75944 - DNA, 22 bp, Artificial Sequence
  chemically synthesized
tcatttatctctaacacggaca

SEQ ID NO: 75945 - DNA, 22 bp, Artificial Sequence
  chemically synthesized
catttatctctaacacggacat

SEQ ID NO: 75946 - DNA, 22 bp, Artificial Sequence
  chemically synthesized
atttatctctaacacggacatc

SEQ ID NO: 75947 - DNA, 22 bp, Artificial Sequence
  chemically synthesized
atctctaacacggacatcttct

SEQ ID NO: 75948 - DNA, 22 bp, Artificial Sequence
  chemically synthesized
tctctaacacggacatcttctt

SEQ ID NO: 75949 - DNA, 22 bp, Artificial Sequence
  chemically synthesized
taacacggacatcttcttcttc

SEQ ID NO: 75950 - DNA, 22 bp, Artificial Sequence
  chemically synthesized
acacggacatcttcttcttctt

SEQ ID NO: 75951 - DNA, 22 bp, Artificial Sequence
  chemically synthesized
cttcttcttctggaagtctgtc

SEQ ID NO: 75952 - DNA, 22 bp, Artificial Sequence
  chemically synthesized
ttcttcttctggaagtctgtct

SEQ ID NO: 75953 - DNA, 22 bp, Artificial Sequence
  chemically synthesized
cttcttctggaagtctgtctca

SEQ ID NO: 75954 - DNA, 22 bp, Artificial Sequence
  chemically synthesized
ttcttctggaagtctgtctcag

SEQ ID NO: 75955 - DNA, 22 bp, Artificial Sequence
  chemically synthesized
cttctggaagtctgtctcagac

SEQ ID NO: 75956 - DNA, 22 bp, Artificial Sequence
  chemically synthesized
ttctggaagtctgtctcagacc

SEQ ID NO: 75957 - DNA, 22 bp, Artificial Sequence
  chemically synthesized
ctggaagtctgtctcagaccat

SEQ ID NO: 75958 - DNA, 22 bp, Artificial Sequence
  chemically synthesized
tggaagtctgtctcagaccatc

SEQ ID NO: 75959 - DNA, 22 bp, Artificial Sequence
  chemically synthesized
gaagtctgtctcagaccatctt

SEQ ID NO: 75960 - DNA, 22 bp, Artificial Sequence
  chemically synthesized
tctcagaccatctttgtgtgct

SEQ ID NO: 75961 - DNA, 22 bp, Artificial Sequence
  chemically synthesized
agaccatctttgtgtgctcatc

SEQ ID NO: 75962 - DNA, 22 bp, Artificial Sequence
  chemically synthesized
tgtgtgctcatcccccagtaaa

SEQ ID NO: 75963 - DNA, 22 bp, Artificial Sequence
  chemically synthesized
gtgtgctcatcccccagtaaaa

SEQ ID NO: 75964 - DNA, 22 bp, Artificial Sequence
  chemically synthesized
tgtgctcatcccccagtaaaac

SEQ ID NO: 75965 - DNA, 22 bp, Artificial Sequence
  chemically synthesized
atcccccagtaaaactcatagt

SEQ ID NO: 75966 - DNA, 22 bp, Artificial Sequence
  chemically synthesized
atagtgaggtctgtagcattct

SEQ ID NO: 75967 - DNA, 22 bp, Artificial Sequence
  chemically synthesized
tagcattctgaaacacgggatg

SEQ ID NO: 75968 - DNA, 22 bp, Artificial Sequence
  chemically synthesized
tgaaacacgggatgaatttatt

SEQ ID NO: 75969 - DNA, 22 bp, Artificial Sequence
  chemically synthesized
aaacacgggatgaatttattga

SEQ ID NO: 75970 - DNA, 22 bp, Artificial Sequence
  chemically synthesized
attgagctcaaattggagaaaa

SEQ ID NO: 75971 - DNA, 22 bp, Artificial Sequence
  chemically synthesized
ttgagctcaaattggagaaaaa

SEQ ID NO: 75972 - DNA, 22 bp, Artificial Sequence
  chemically synthesized
agctcaaattggagaaaaaagt

SEQ ID NO: 75973 - DNA, 22 bp, Artificial Sequence
  chemically synthesized
aaattggagaaaaaagtggcta

SEQ ID NO: 75974 - DNA, 22 bp, Artificial Sequence
  chemically synthesized
gagaaaaaagtggctatccacc

SEQ ID NO: 75975 - DNA, 22 bp, Artificial Sequence
  chemically synthesized
tccaccaatttaatattccttt

SEQ ID NO: 75976 - DNA, 22 bp, Artificial Sequence
  chemically synthesized
aatattcctttatgaatgtgtg

SEQ ID NO: 75977 - DNA, 22 bp, Artificial Sequence
  chemically synthesized
atattcctttatgaatgtgtgg

SEQ ID NO: 75978 - DNA, 22 bp, Artificial Sequence
  chemically synthesized
ctttatgaatgtgtggagaagt

SEQ ID NO: 75979 - DNA, 22 bp, Artificial Sequence
  chemically synthesized
tatgaatgtgtggagaagtagg

SEQ ID NO: 75980 - DNA, 22 bp, Artificial Sequence
  chemically synthesized
atgaatgtgtggagaagtagga

SEQ ID NO: 75981 - DNA, 22 bp, Artificial Sequence
  chemically synthesized
tgaatgtgtggagaagtaggag

SEQ ID NO: 75982 - DNA, 22 bp, Artificial Sequence
  chemically synthesized
tgagcatgaaatgagggatttc

SEQ ID NO: 75983 - DNA, 22 bp, Artificial Sequence
  chemically synthesized
cctagttgatagccaaaaccac

SEQ ID NO: 75984 - DNA, 22 bp, Artificial Sequence
  chemically synthesized
ctagttgatagccaaaaccacg

SEQ ID NO: 75985 - DNA, 22 bp, Artificial Sequence
  chemically synthesized
gttgatagccaaaaccacgagg

SEQ ID NO: 75986 - DNA, 22 bp, Artificial Sequence
  chemically synthesized
atagccaaaaccacgagggacc

SEQ ID NO: 75987 - DNA, 22 bp, Artificial Sequence
  chemically synthesized
taagtcagccctcttgggttca

SEQ ID NO: 75988 - DNA, 22 bp, Artificial Sequence
  chemically synthesized
aagtcagccctcttgggttcac

SEQ ID NO: 75989 - DNA, 22 bp, Artificial Sequence
  chemically synthesized
agtcagccctcttgggttcact

SEQ ID NO: 75990 - DNA, 22 bp, Artificial Sequence
  chemically synthesized
ttgggttcactggcacctaata

SEQ ID NO: 75991 - DNA, 22 bp, Artificial Sequence
  chemically synthesized
gggttcactggcacctaatatc

SEQ ID NO: 75992 - DNA, 22 bp, Artificial Sequence
  chemically synthesized
ggttcactggcacctaatatcc

SEQ ID NO: 75993 - DNA, 22 bp, Artificial Sequence
  chemically synthesized
actggcacctaatatccccgta

SEQ ID NO: 75994 - DNA, 22 bp, Artificial Sequence
  chemically synthesized
gcacctaatatccccgtaatta

SEQ ID NO: 75995 - DNA, 22 bp, Artificial Sequence
  chemically synthesized
atatccccgtaattatttctac

SEQ ID NO: 75996 - DNA, 22 bp, Artificial Sequence
  chemically synthesized
tttctacacttgcagaaatctc

SEQ ID NO: 75997 - DNA, 22 bp, Artificial Sequence
  chemically synthesized
ctacacttgcagaaatctcctt

SEQ ID NO: 75998 - DNA, 22 bp, Artificial Sequence
  chemically synthesized
tacacttgcagaaatctccttt

SEQ ID NO: 75999 - DNA, 22 bp, Artificial Sequence
  chemically synthesized
cacttgcagaaatctcctttct

SEQ ID NO: 76000 - DNA, 22 bp, Artificial Sequence
  chemically synthesized
gcagaaatctcctttctctctt

SEQ ID NO: 76001 - DNA, 22 bp, Artificial Sequence
  chemically synthesized
cagaaatctcctttctctcttt

SEQ ID NO: 76002 - DNA, 22 bp, Artificial Sequence
  chemically synthesized
ctttctctctttttctcttttc

SEQ ID NO: 76003 - DNA, 22 bp, Artificial Sequence
  chemically synthesized
tctctctttttctcttttccca

SEQ ID NO: 76004 - DNA, 22 bp, Artificial Sequence
  chemically synthesized
ctctctttttctcttttcccac

SEQ ID NO: 76005 - DNA, 22 bp, Artificial Sequence
  chemically synthesized
tctctttttctcttttcccaca

SEQ ID NO: 76006 - DNA, 22 bp, Artificial Sequence
  chemically synthesized
tctttttctcttttcccacagg

SEQ ID NO: 76007 - DNA, 22 bp, Artificial Sequence
  chemically synthesized
tttttctcttttcccacaggct

SEQ ID NO: 76008 - DNA, 22 bp, Artificial Sequence
  chemically synthesized
tttctcttttcccacaggctaa

SEQ ID NO: 76009 - DNA, 22 bp, Artificial Sequence
  chemically synthesized
ttctcttttcccacaggctaaa

SEQ ID NO: 76010 - DNA, 22 bp, Artificial Sequence
  chemically synthesized
tctcttttcccacaggctaaat

SEQ ID NO: 76011 - DNA, 22 bp, Artificial Sequence
  chemically synthesized
ctcttttcccacaggctaaatg

SEQ ID NO: 76012 - DNA, 22 bp, Artificial Sequence
  chemically synthesized
tcttttcccacaggctaaatgc

SEQ ID NO: 76013 - DNA, 22 bp, Artificial Sequence
  chemically synthesized
ttttcccacaggctaaatgcag

SEQ ID NO: 76014 - DNA, 22 bp, Artificial Sequence
  chemically synthesized
ttcccacaggctaaatgcagaa

SEQ ID NO: 76015 - DNA, 22 bp, Artificial Sequence
  chemically synthesized
tcccacaggctaaatgcagaat

SEQ ID NO: 76016 - DNA, 22 bp, Artificial Sequence
  chemically synthesized
cccacaggctaaatgcagaata

SEQ ID NO: 76017 - DNA, 22 bp, Artificial Sequence
  chemically synthesized
ccacaggctaaatgcagaataa

SEQ ID NO: 76018 - DNA, 22 bp, Artificial Sequence
  chemically synthesized
aatgcagaataattcatatgca

SEQ ID NO: 76019 - DNA, 22 bp, Artificial Sequence
  chemically synthesized
atatgcaaaaaatttttttaca

SEQ ID NO: 76020 - DNA, 22 bp, Artificial Sequence
  chemically synthesized
ttttacaagctatgttcctttt

SEQ ID NO: 76021 - DNA, 22 bp, Artificial Sequence
  chemically synthesized
tttacaagctatgttccttttc

SEQ ID NO: 76022 - DNA, 22 bp, Artificial Sequence
  chemically synthesized
ttacaagctatgttccttttct

SEQ ID NO: 76023 - DNA, 22 bp, Artificial Sequence
  chemically synthesized
tacaagctatgttccttttctg

SEQ ID NO: 76024 - DNA, 22 bp, Artificial Sequence
  chemically synthesized
acaagctatgttccttttctgc

SEQ ID NO: 76025 - DNA, 22 bp, Artificial Sequence
  chemically synthesized
caagctatgttccttttctgcc

SEQ ID NO: 76026 - DNA, 22 bp, Artificial Sequence
  chemically synthesized
tgttccttttctgccatttcta

SEQ ID NO: 76027 - DNA, 22 bp, Artificial Sequence
  chemically synthesized
cttttctgccatttctatttgc

SEQ ID NO: 76028 - DNA, 22 bp, Artificial Sequence
  chemically synthesized
ttctgccatttctatttgcaaa

SEQ ID NO: 76029 - DNA, 22 bp, Artificial Sequence
  chemically synthesized
tctgccatttctatttgcaaaa

SEQ ID NO: 76030 - DNA, 22 bp, Artificial Sequence
  chemically synthesized
ctgccatttctatttgcaaaat

SEQ ID NO: 76031 - DNA, 22 bp, Artificial Sequence
  chemically synthesized
tgccatttctatttgcaaaatt

SEQ ID NO: 76032 - DNA, 22 bp, Artificial Sequence
  chemically synthesized
ccatttctatttgcaaaattct

SEQ ID NO: 76033 - DNA, 22 bp, Artificial Sequence
  chemically synthesized
ctatttgcaaaattctaaagcc

SEQ ID NO: 76034 - DNA, 22 bp, Artificial Sequence
  chemically synthesized
tatttgcaaaattctaaagccc

SEQ ID NO: 76035 - DNA, 22 bp, Artificial Sequence
  chemically synthesized
tttgcaaaattctaaagcccat

SEQ ID NO: 76036 - DNA, 22 bp, Artificial Sequence
  chemically synthesized
gcaaaattctaaagcccattta

SEQ ID NO: 76037 - DNA, 22 bp, Artificial Sequence
  chemically synthesized
caaaattctaaagcccatttaa

SEQ ID NO: 76038 - DNA, 22 bp, Artificial Sequence
  chemically synthesized
taaagcccatttaatgcaaaca

SEQ ID NO: 76039 - DNA, 22 bp, Artificial Sequence
  chemically synthesized
aagcccatttaatgcaaacatg

SEQ ID NO: 76040 - DNA, 22 bp, Artificial Sequence
  chemically synthesized
aatgcaaacatgtttctatgcc

SEQ ID NO: 76041 - DNA, 22 bp, Artificial Sequence
  chemically synthesized
atgcaaacatgtttctatgcca

SEQ ID NO: 76042 - DNA, 22 bp, Artificial Sequence
  chemically synthesized
ctatgccaattcctatttaaat

SEQ ID NO: 76043 - DNA, 22 bp, Artificial Sequence
  chemically synthesized
tatgccaattcctatttaaata

SEQ ID NO: 76044 - DNA, 22 bp, Artificial Sequence
  chemically synthesized
tgccaattcctatttaaataaa

SEQ ID NO: 76045 - DNA, 22 bp, Artificial Sequence
  chemically synthesized
ctatttaaataaatatcttggt

SEQ ID NO: 76046 - DNA, 22 bp, Artificial Sequence
  chemically synthesized
tttaaataaatatcttggtgac

SEQ ID NO: 76047 - DNA, 22 bp, Artificial Sequence
  chemically synthesized
aaataaatatcttggtgacatt

SEQ ID NO: 76048 - DNA, 22 bp, Artificial Sequence
  chemically synthesized
aataaatatcttggtgacattt

SEQ ID NO: 76049 - DNA, 22 bp, Artificial Sequence
  chemically synthesized
ggtgacattttcactgaggcaa

SEQ ID NO: 76050 - DNA, 22 bp, Artificial Sequence
  chemically synthesized
gtgacattttcactgaggcaag

SEQ ID NO: 76051 - DNA, 22 bp, Artificial Sequence
  chemically synthesized
tcactgaggcaaggtttttctc

SEQ ID NO: 76052 - DNA, 22 bp, Artificial Sequence
  chemically synthesized
cactgaggcaaggtttttctct

SEQ ID NO: 76053 - DNA, 22 bp, Artificial Sequence
  chemically synthesized
actgaggcaaggtttttctctt

SEQ ID NO: 76054 - DNA, 22 bp, Artificial Sequence
  chemically synthesized
aggcaaggtttttctcttttta

SEQ ID NO: 76055 - DNA, 22 bp, Artificial Sequence
  chemically synthesized
ttctctttttattcagaaaaga

SEQ ID NO: 76056 - DNA, 22 bp, Artificial Sequence
  chemically synthesized
tctctttttattcagaaaagaa

SEQ ID NO: 76057 - DNA, 22 bp, Artificial Sequence
  chemically synthesized
ctctttttattcagaaaagaaa

SEQ ID NO: 76058 - DNA, 22 bp, Artificial Sequence
  chemically synthesized
tctttttattcagaaaagaaaa

SEQ ID NO: 76059 - DNA, 22 bp, Artificial Sequence
  chemically synthesized
tttttattcagaaaagaaaaat

SEQ ID NO: 76060 - DNA, 22 bp, Artificial Sequence
  chemically synthesized
tttattcagaaaagaaaaatct

SEQ ID NO: 76061 - DNA, 22 bp, Artificial Sequence
  chemically synthesized
ttattcagaaaagaaaaatctg

SEQ ID NO: 76062 - DNA, 22 bp, Artificial Sequence
  chemically synthesized
tattcagaaaagaaaaatctgt

SEQ ID NO: 76063 - DNA, 22 bp, Artificial Sequence
  chemically synthesized
attcagaaaagaaaaatctgta

SEQ ID NO: 76064 - DNA, 22 bp, Artificial Sequence
  chemically synthesized
ttcagaaaagaaaaatctgtat

SEQ ID NO: 76065 - DNA, 22 bp, Artificial Sequence
  chemically synthesized
agaaaagaaaaatctgtattca

SEQ ID NO: 76066 - DNA, 22 bp, Artificial Sequence
  chemically synthesized
tattcataactactttttacca

SEQ ID NO: 76067 - DNA, 22 bp, Artificial Sequence
  chemically synthesized
ataactactttttaccacacaa

SEQ ID NO: 76068 - DNA, 22 bp, Artificial Sequence
  chemically synthesized
ctttttaccacacaattacttc

SEQ ID NO: 76069 - DNA, 22 bp, Artificial Sequence
  chemically synthesized
tttaccacacaattacttcctc

SEQ ID NO: 76070 - DNA, 22 bp, Artificial Sequence
  chemically synthesized
ttaccacacaattacttcctca

SEQ ID NO: 76071 - DNA, 22 bp, Artificial Sequence
  chemically synthesized
taccacacaattacttcctcag

SEQ ID NO: 76072 - DNA, 22 bp, Artificial Sequence
  chemically synthesized
accacacaattacttcctcagt

SEQ ID NO: 76073 - DNA, 22 bp, Artificial Sequence
  chemically synthesized
ccacacaattacttcctcagtc

SEQ ID NO: 76074 - DNA, 22 bp, Artificial Sequence
  chemically synthesized
cttcctcagtcttcttcagtct

SEQ ID NO: 76075 - DNA, 22 bp, Artificial Sequence
  chemically synthesized
cctcagtcttcttcagtctcat

SEQ ID NO: 76076 - DNA, 22 bp, Artificial Sequence
  chemically synthesized
ctcagtcttcttcagtctcatt

SEQ ID NO: 76077 - DNA, 22 bp, Artificial Sequence
  chemically synthesized
agtcttcttcagtctcattctt

SEQ ID NO: 76078 - DNA, 22 bp, Artificial Sequence
  chemically synthesized
cttcagtctcattcttcccatt

SEQ ID NO: 76079 - DNA, 22 bp, Artificial Sequence
  chemically synthesized
ttcagtctcattcttcccattt

SEQ ID NO: 76080 - DNA, 22 bp, Artificial Sequence
  chemically synthesized
cagtctcattcttcccatttta

SEQ ID NO: 76081 - DNA, 22 bp, Artificial Sequence
  chemically synthesized
agtctcattcttcccattttat

SEQ ID NO: 76082 - DNA, 22 bp, Artificial Sequence
  chemically synthesized
attcttcccattttattttatt

SEQ ID NO: 76083 - DNA, 22 bp, Artificial Sequence
  chemically synthesized
ttcccattttattttattgaag

SEQ ID NO: 76084 - DNA, 22 bp, Artificial Sequence
  chemically synthesized
cccattttattttattgaagtt

SEQ ID NO: 76085 - DNA, 22 bp, Artificial Sequence
  chemically synthesized
ccattttattttattgaagttt

SEQ ID NO: 76086 - DNA, 22 bp, Artificial Sequence
  chemically synthesized
tattttattgaagtttttttta

SEQ ID NO: 76087 - DNA, 22 bp, Artificial Sequence
  chemically synthesized
attttattgaagttttttttat

SEQ ID NO: 76088 - DNA, 22 bp, Artificial Sequence
  chemically synthesized
ttttattgaagttttttttatc

SEQ ID NO: 76089 - DNA, 22 bp, Artificial Sequence
  chemically synthesized
tattgaagttttttttatcttt

SEQ ID NO: 76090 - DNA, 22 bp, Artificial Sequence
  chemically synthesized
attgaagttttttttatctttt

SEQ ID NO: 76091 - DNA, 22 bp, Artificial Sequence
  chemically synthesized
ttgaagttttttttatctttta

SEQ ID NO: 76092 - DNA, 22 bp, Artificial Sequence
  chemically synthesized
aagttttttttatcttttagta

SEQ ID NO: 76093 - DNA, 22 bp, Artificial Sequence
  chemically synthesized
tttttatcttttagtaaattaa

SEQ ID NO: 76094 - DNA, 22 bp, Artificial Sequence
  chemically synthesized
ttttatcttttagtaaattaag

SEQ ID NO: 76095 - DNA, 22 bp, Artificial Sequence
  chemically synthesized
tttatcttttagtaaattaagt

SEQ ID NO: 76096 - DNA, 22 bp, Artificial Sequence
  chemically synthesized
ttatcttttagtaaattaagta

SEQ ID NO: 76097 - DNA, 22 bp, Artificial Sequence
  chemically synthesized
tatcttttagtaaattaagtaa

SEQ ID NO: 76098 - DNA, 22 bp, Artificial Sequence
  chemically synthesized
atcttttagtaaattaagtaac

SEQ ID NO: 76099 - DNA, 22 bp, Artificial Sequence
  chemically synthesized
tcttttagtaaattaagtaaca

SEQ ID NO: 76100 - DNA, 22 bp, Artificial Sequence
  chemically synthesized
ttagtaaattaagtaacattct

SEQ ID NO: 76101 - DNA, 22 bp, Artificial Sequence
  chemically synthesized
tagtaaattaagtaacattctt

SEQ ID NO: 76102 - DNA, 22 bp, Artificial Sequence
  chemically synthesized
agtaaattaagtaacattctta

SEQ ID NO: 76103 - DNA, 22 bp, Artificial Sequence
  chemically synthesized
gtaaattaagtaacattcttat

SEQ ID NO: 76104 - DNA, 22 bp, Artificial Sequence
  chemically synthesized
agtaacattcttatagtgacaa

SEQ ID NO: 76105 - DNA, 22 bp, Artificial Sequence
  chemically synthesized
ttatagtgacaaattataatgg

SEQ ID NO: 76106 - DNA, 22 bp, Artificial Sequence
  chemically synthesized
atagtgacaaattataatggac

SEQ ID NO: 76107 - DNA, 22 bp, Artificial Sequence
  chemically synthesized
tagtgacaaattataatggaca

SEQ ID NO: 76108 - DNA, 22 bp, Artificial Sequence
  chemically synthesized
taatggacatttctaagtccta

SEQ ID NO: 76109 - DNA, 22 bp, Artificial Sequence
  chemically synthesized
ctaagtcctacaaatgtaaagc

SEQ ID NO: 76110 - DNA, 22 bp, Artificial Sequence
  chemically synthesized
taagtcctacaaatgtaaagct

SEQ ID NO: 76111 - DNA, 22 bp, Artificial Sequence
  chemically synthesized
agtcctacaaatgtaaagctgg

SEQ ID NO: 76112 - DNA, 22 bp, Artificial Sequence
  chemically synthesized
caaatgtaaagctggaagcaag

SEQ ID NO: 76113 - DNA, 22 bp, Artificial Sequence
  chemically synthesized
gaagcaagttgttgaacatttg

SEQ ID NO: 76114 - DNA, 22 bp, Artificial Sequence
  chemically synthesized
ttgaacatttgagtaaactggt

SEQ ID NO: 76115 - DNA, 22 bp, Artificial Sequence
  chemically synthesized
aacatttgagtaaactggtatc

SEQ ID NO: 76116 - DNA, 22 bp, Artificial Sequence
  chemically synthesized
gagtaaactggtatccatttcc

SEQ ID NO: 76117 - DNA, 22 bp, Artificial Sequence
  chemically synthesized
agtaaactggtatccatttcct

SEQ ID NO: 76118 - DNA, 22 bp, Artificial Sequence
  chemically synthesized
gtatccatttcctcttttctct

SEQ ID NO: 76119 - DNA, 22 bp, Artificial Sequence
  chemically synthesized
cctcttttctctctttcttcct

SEQ ID NO: 76120 - DNA, 22 bp, Artificial Sequence
  chemically synthesized
ctcttttctctctttcttcctt

SEQ ID NO: 76121 - DNA, 22 bp, Artificial Sequence
  chemically synthesized
ttttctctctttcttccttgtt

SEQ ID NO: 76122 - DNA, 22 bp, Artificial Sequence
  chemically synthesized
ttctctctttcttccttgttac

SEQ ID NO: 76123 - DNA, 22 bp, Artificial Sequence
  chemically synthesized
tctctctttcttccttgttact

SEQ ID NO: 76124 - DNA, 22 bp, Artificial Sequence
  chemically synthesized
ctctctttcttccttgttactt

SEQ ID NO: 76125 - DNA, 22 bp, Artificial Sequence
  chemically synthesized
tctctttcttccttgttacttt

SEQ ID NO: 76126 - DNA, 22 bp, Artificial Sequence
  chemically synthesized
tctttcttccttgttactttcc

SEQ ID NO: 76127 - DNA, 22 bp, Artificial Sequence
  chemically synthesized
tttcttccttgttactttcctt

SEQ ID NO: 76128 - DNA, 22 bp, Artificial Sequence
  chemically synthesized
tcttccttgttactttccttcc

SEQ ID NO: 76129 - DNA, 22 bp, Artificial Sequence
  chemically synthesized
cttccttgttactttccttcct

SEQ ID NO: 76130 - DNA, 22 bp, Artificial Sequence
  chemically synthesized
ttccttgttactttccttcctt

SEQ ID NO: 76131 - DNA, 22 bp, Artificial Sequence
  chemically synthesized
ccttgttactttccttccttct

SEQ ID NO: 76132 - DNA, 22 bp, Artificial Sequence
  chemically synthesized
cttgttactttccttccttctt

SEQ ID NO: 76133 - DNA, 22 bp, Artificial Sequence
  chemically synthesized
gttactttccttccttcttttt

SEQ ID NO: 76134 - DNA, 22 bp, Artificial Sequence
  chemically synthesized
ttactttccttccttctttttc

SEQ ID NO: 76135 - DNA, 22 bp, Artificial Sequence
  chemically synthesized
ctttccttccttctttttcttt

SEQ ID NO: 76136 - DNA, 22 bp, Artificial Sequence
  chemically synthesized
tccttccttctttttctttcaa

SEQ ID NO: 76137 - DNA, 22 bp, Artificial Sequence
  chemically synthesized
ccttccttctttttctttcaaa

SEQ ID NO: 76138 - DNA, 22 bp, Artificial Sequence
  chemically synthesized
cttccttctttttctttcaaaa

SEQ ID NO: 76139 - DNA, 22 bp, Artificial Sequence
  chemically synthesized
ccttctttttctttcaaaaaac

SEQ ID NO: 76140 - DNA, 22 bp, Artificial Sequence
  chemically synthesized
cttctttttctttcaaaaaaca

SEQ ID NO: 76141 - DNA, 22 bp, Artificial Sequence
  chemically synthesized
ctttttctttcaaaaaacagtc

SEQ ID NO: 76142 - DNA, 22 bp, Artificial Sequence
  chemically synthesized
tttttctttcaaaaaacagtca

SEQ ID NO: 76143 - DNA, 22 bp, Artificial Sequence
  chemically synthesized
tttctttcaaaaaacagtcatt

SEQ ID NO: 76144 - DNA, 22 bp, Artificial Sequence
  chemically synthesized
ttctttcaaaaaacagtcatta

SEQ ID NO: 76145 - DNA, 22 bp, Artificial Sequence
  chemically synthesized
tctttcaaaaaacagtcattat

SEQ ID NO: 76146 - DNA, 22 bp, Artificial Sequence
  chemically synthesized
ctttcaaaaaacagtcattata

SEQ ID NO: 76147 - DNA, 22 bp, Artificial Sequence
  chemically synthesized
tttcaaaaaacagtcattatat

SEQ ID NO: 76148 - DNA, 22 bp, Artificial Sequence
  chemically synthesized
tcaaaaaacagtcattatattc

SEQ ID NO: 76149 - DNA, 22 bp, Artificial Sequence
  chemically synthesized
caaaaaacagtcattatattcc

SEQ ID NO: 76150 - DNA, 22 bp, Artificial Sequence
  chemically synthesized
aaaaaacagtcattatattcct

SEQ ID NO: 76151 - DNA, 22 bp, Artificial Sequence
  chemically synthesized
tattcctactatttatgagtga

SEQ ID NO: 76152 - DNA, 22 bp, Artificial Sequence
  chemically synthesized
ctactatttatgagtgagatgt

SEQ ID NO: 76153 - DNA, 22 bp, Artificial Sequence
  chemically synthesized
ctatttatgagtgagatgttat

SEQ ID NO: 76154 - DNA, 22 bp, Artificial Sequence
  chemically synthesized
tttatgagtgagatgttatata

SEQ ID NO: 76155 - DNA, 22 bp, Artificial Sequence
  chemically synthesized
atgagtgagatgttatatattc

SEQ ID NO: 76156 - DNA, 22 bp, Artificial Sequence
  chemically synthesized
tgagtgagatgttatatattct

SEQ ID NO: 76157 - DNA, 22 bp, Artificial Sequence
  chemically synthesized
tatattctaaatgaaatgaaaa

SEQ ID NO: 76158 - DNA, 22 bp, Artificial Sequence
  chemically synthesized
taaatgaaatgaaaaaaattat

SEQ ID NO: 76159 - DNA, 22 bp, Artificial Sequence
  chemically synthesized
aatgaaatgaaaaaaattatag

SEQ ID NO: 76160 - DNA, 22 bp, Artificial Sequence
  chemically synthesized
tagtcttacctttaaattatta

SEQ ID NO: 76161 - DNA, 22 bp, Artificial Sequence
  chemically synthesized
acctttaaattattagtaaaat

SEQ ID NO: 76162 - DNA, 22 bp, Artificial Sequence
  chemically synthesized
cctttaaattattagtaaaatg

SEQ ID NO: 76163 - DNA, 22 bp, Artificial Sequence
  chemically synthesized
taaattattagtaaaatgggat

SEQ ID NO: 76164 - DNA, 22 bp, Artificial Sequence
  chemically synthesized
aaattattagtaaaatgggatt

SEQ ID NO: 76165 - DNA, 22 bp, Artificial Sequence
  chemically synthesized
aattattagtaaaatgggatta

SEQ ID NO: 76166 - DNA, 22 bp, Artificial Sequence
  chemically synthesized
ttagtaaaatgggattatgcat

SEQ ID NO: 76167 - DNA, 22 bp, Artificial Sequence
  chemically synthesized
gtaaaatgggattatgcattac

SEQ ID NO: 76168 - DNA, 22 bp, Artificial Sequence
  chemically synthesized
tgcattacaatttcatttatca

SEQ ID NO: 76169 - DNA, 22 bp, Artificial Sequence
  chemically synthesized
caatttcatttatcacgtaagt

SEQ ID NO: 76170 - DNA, 22 bp, Artificial Sequence
  chemically synthesized
catttatcacgtaagtatctga

SEQ ID NO: 76171 - DNA, 22 bp, Artificial Sequence
  chemically synthesized
atttatcacgtaagtatctgat

SEQ ID NO: 76172 - DNA, 22 bp, Artificial Sequence
  chemically synthesized
atcacgtaagtatctgataaat

SEQ ID NO: 76173 - DNA, 22 bp, Artificial Sequence
  chemically synthesized
tcacgtaagtatctgataaatt

SEQ ID NO: 76174 - DNA, 22 bp, Artificial Sequence
  chemically synthesized
ataaattctaagcaagacttat

SEQ ID NO: 76175 - DNA, 22 bp, Artificial Sequence
  chemically synthesized
taagcaagacttatgcatatga

SEQ ID NO: 76176 - DNA, 22 bp, Artificial Sequence
  chemically synthesized
agcaagacttatgcatatgaca

SEQ ID NO: 76177 - DNA, 22 bp, Artificial Sequence
  chemically synthesized
atgcatatgacactattctcct

SEQ ID NO: 76178 - DNA, 22 bp, Artificial Sequence
  chemically synthesized
tgcatatgacactattctcctt

SEQ ID NO: 76179 - DNA, 22 bp, Artificial Sequence
  chemically synthesized
ttctccttgacattttacagct

SEQ ID NO: 76180 - DNA, 22 bp, Artificial Sequence
  chemically synthesized
tccttgacattttacagctggt

SEQ ID NO: 76181 - DNA, 22 bp, Artificial Sequence
  chemically synthesized
cttgacattttacagctggttt

SEQ ID NO: 76182 - DNA, 22 bp, Artificial Sequence
  chemically synthesized
gacattttacagctggtttcta

SEQ ID NO: 76183 - DNA, 22 bp, Artificial Sequence
  chemically synthesized
acattttacagctggtttctag

SEQ ID NO: 76184 - DNA, 22 bp, Artificial Sequence
  chemically synthesized
tacagctggtttctaggctttc

SEQ ID NO: 76185 - DNA, 22 bp, Artificial Sequence
  chemically synthesized
acagctggtttctaggctttct

SEQ ID NO: 76186 - DNA, 22 bp, Artificial Sequence
  chemically synthesized
cagctggtttctaggctttctt

SEQ ID NO: 76187 - DNA, 22 bp, Artificial Sequence
  chemically synthesized
gtttctaggctttcttgaatgt

SEQ ID NO: 76188 - DNA, 22 bp, Artificial Sequence
  chemically synthesized
ctaggctttcttgaatgtagct

SEQ ID NO: 76189 - DNA, 22 bp, Artificial Sequence
  chemically synthesized
taggctttcttgaatgtagcta

SEQ ID NO: 76190 - DNA, 22 bp, Artificial Sequence
  chemically synthesized
ggctttcttgaatgtagctaag

SEQ ID NO: 76191 - DNA, 22 bp, Artificial Sequence
  chemically synthesized
tcttgaatgtagctaagagaca

SEQ ID NO: 76192 - DNA, 22 bp, Artificial Sequence
  chemically synthesized
cttgaatgtagctaagagacac

SEQ ID NO: 76193 - DNA, 22 bp, Artificial Sequence
  chemically synthesized
ttgaatgtagctaagagacact

SEQ ID NO: 76194 - DNA, 22 bp, Artificial Sequence
  chemically synthesized
gaatgtagctaagagacacttg

SEQ ID NO: 76195 - DNA, 22 bp, Artificial Sequence
  chemically synthesized
aatgtagctaagagacacttga

SEQ ID NO: 76196 - DNA, 22 bp, Artificial Sequence
  chemically synthesized
agagacacttgatataatgttt

SEQ ID NO: 76197 - DNA, 22 bp, Artificial Sequence
  chemically synthesized
gatataatgtttagacattggc

SEQ ID NO: 76198 - DNA, 22 bp, Artificial Sequence
  chemically synthesized
atataatgtttagacattggca

SEQ ID NO: 76199 - DNA, 22 bp, Artificial Sequence
  chemically synthesized
agacattggcaaatttaggaag

SEQ ID NO: 76200 - DNA, 22 bp, Artificial Sequence
  chemically synthesized
gacattggcaaatttaggaagc

SEQ ID NO: 76201 - DNA, 22 bp, Artificial Sequence
  chemically synthesized
gcaaatttaggaagcatactaa

SEQ ID NO: 76202 - DNA, 22 bp, Artificial Sequence
  chemically synthesized
aggaagcatactaatggtggag

SEQ ID NO: 76203 - DNA, 22 bp, Artificial Sequence
  chemically synthesized
ggaagcatactaatggtggaga

SEQ ID NO: 76204 - DNA, 22 bp, Artificial Sequence
  chemically synthesized
atggtggagaatatttataatg

SEQ ID NO: 76205 - DNA, 22 bp, Artificial Sequence
  chemically synthesized
ataatggatttccaggagaaca

SEQ ID NO: 76206 - DNA, 22 bp, Artificial Sequence
  chemically synthesized
taatggatttccaggagaacaa

SEQ ID NO: 76207 - DNA, 22 bp, Artificial Sequence
  chemically synthesized
ccaggagaacaaggaatacaga

SEQ ID NO: 76208 - DNA, 22 bp, Artificial Sequence
  chemically synthesized
caggagaacaaggaatacagat

SEQ ID NO: 76209 - DNA, 22 bp, Artificial Sequence
  chemically synthesized
tttccagaatttcctctgtgaa

SEQ ID NO: 76210 - DNA, 22 bp, Artificial Sequence
  chemically synthesized
tccagaatttcctctgtgaagg

SEQ ID NO: 76211 - DNA, 22 bp, Artificial Sequence
  chemically synthesized
ccagaatttcctctgtgaagga

SEQ ID NO: 76212 - DNA, 22 bp, Artificial Sequence
  chemically synthesized
cagaatttcctctgtgaaggag

SEQ ID NO: 76213 - DNA, 22 bp, Artificial Sequence
  chemically synthesized
cctctgtgaaggagcataaaac

SEQ ID NO: 76214 - DNA, 22 bp, Artificial Sequence
  chemically synthesized
ctctgtgaaggagcataaaaca

SEQ ID NO: 76215 - DNA, 22 bp, Artificial Sequence
  chemically synthesized
tgtgaaggagcataaaacaata

SEQ ID NO: 76216 - DNA, 22 bp, Artificial Sequence
  chemically synthesized
tgaaggagcataaaacaatagt

SEQ ID NO: 76217 - DNA, 22 bp, Artificial Sequence
  chemically synthesized
ttgcatgttgaatgaaattgat

SEQ ID NO: 76218 - DNA, 22 bp, Artificial Sequence
  chemically synthesized
catgttgaatgaaattgattca

SEQ ID NO: 76219 - DNA, 22 bp, Artificial Sequence
  chemically synthesized
aatgaaattgattcagagagca

SEQ ID NO: 76220 - DNA, 22 bp, Artificial Sequence
  chemically synthesized
attcagagagcatataggcagc

SEQ ID NO: 76221 - DNA, 22 bp, Artificial Sequence
  chemically synthesized
agagagcatataggcagctaat

SEQ ID NO: 76222 - DNA, 22 bp, Artificial Sequence
  chemically synthesized
atctaatattcaggttattctt

SEQ ID NO: 76223 - DNA, 22 bp, Artificial Sequence
  chemically synthesized
atattcaggttattcttttgtc

SEQ ID NO: 76224 - DNA, 22 bp, Artificial Sequence
  chemically synthesized
aggttattcttttgtcactaag

SEQ ID NO: 76225 - DNA, 22 bp, Artificial Sequence
  chemically synthesized
ttcttttgtcactaagaaacaa

SEQ ID NO: 76226 - DNA, 22 bp, Artificial Sequence
  chemically synthesized
ttttgtcactaagaaacaattt

SEQ ID NO: 76227 - DNA, 22 bp, Artificial Sequence
  chemically synthesized
ttgtcactaagaaacaatttag

SEQ ID NO: 76228 - DNA, 22 bp, Artificial Sequence
  chemically synthesized
tgtcactaagaaacaatttaga

SEQ ID NO: 76229 - DNA, 22 bp, Artificial Sequence
  chemically synthesized
gtcactaagaaacaatttagac

SEQ ID NO: 76230 - DNA, 22 bp, Artificial Sequence
  chemically synthesized
tcactaagaaacaatttagact

SEQ ID NO: 76231 - DNA, 22 bp, Artificial Sequence
  chemically synthesized
agaaacaatttagactagtata

SEQ ID NO: 76232 - DNA, 22 bp, Artificial Sequence
  chemically synthesized
agactagtataccatttggttt

SEQ ID NO: 76233 - DNA, 22 bp, Artificial Sequence
  chemically synthesized
gactagtataccatttggtttc

SEQ ID NO: 76234 - DNA, 22 bp, Artificial Sequence
  chemically synthesized
gtataccatttggtttcttcct

SEQ ID NO: 76235 - DNA, 22 bp, Artificial Sequence
  chemically synthesized
ggtttcttcctcttctcttata

SEQ ID NO: 76236 - DNA, 22 bp, Artificial Sequence
  chemically synthesized
gtttcttcctcttctcttatac

SEQ ID NO: 76237 - DNA, 22 bp, Artificial Sequence
  chemically synthesized
cttcctcttctcttatactgat

SEQ ID NO: 76238 - DNA, 22 bp, Artificial Sequence
  chemically synthesized
ttcctcttctcttatactgatt

SEQ ID NO: 76239 - DNA, 22 bp, Artificial Sequence
  chemically synthesized
cctcttctcttatactgatttt

SEQ ID NO: 76240 - DNA, 22 bp, Artificial Sequence
  chemically synthesized
ctcttctcttatactgatttta

SEQ ID NO: 76241 - DNA, 22 bp, Artificial Sequence
  chemically synthesized
ttctcttatactgattttattt

SEQ ID NO: 76242 - DNA, 22 bp, Artificial Sequence
  chemically synthesized
ctcttatactgattttatttaa

SEQ ID NO: 76243 - DNA, 22 bp, Artificial Sequence
  chemically synthesized
tcttatactgattttatttaaa

SEQ ID NO: 76244 - DNA, 22 bp, Artificial Sequence
  chemically synthesized
ttatactgattttatttaaatt

SEQ ID NO: 76245 - DNA, 22 bp, Artificial Sequence
  chemically synthesized
atactgattttatttaaatttg

SEQ ID NO: 76246 - DNA, 22 bp, Artificial Sequence
  chemically synthesized
tactgattttatttaaatttgg

SEQ ID NO: 76247 - DNA, 22 bp, Artificial Sequence
  chemically synthesized
attttatttaaatttgggggct

SEQ ID NO: 76248 - DNA, 22 bp, Artificial Sequence
  chemically synthesized
tatttaaatttgggggctctcc

SEQ ID NO: 76249 - DNA, 22 bp, Artificial Sequence
  chemically synthesized
atttaaatttgggggctctcca

SEQ ID NO: 76250 - DNA, 22 bp, Artificial Sequence
  chemically synthesized
tttaaatttgggggctctccaa

SEQ ID NO: 76251 - DNA, 22 bp, Artificial Sequence
  chemically synthesized
aaatttgggggctctccaaagt

SEQ ID NO: 76252 - DNA, 22 bp, Artificial Sequence
  chemically synthesized
aatttgggggctctccaaagtt

SEQ ID NO: 76253 - DNA, 22 bp, Artificial Sequence
  chemically synthesized
gggggctctccaaagttctatc

SEQ ID NO: 76254 - DNA, 22 bp, Artificial Sequence
  chemically synthesized
ggggctctccaaagttctatct

SEQ ID NO: 76255 - DNA, 22 bp, Artificial Sequence
  chemically synthesized
tccaaagttctatcttgggtca

SEQ ID NO: 76256 - DNA, 22 bp, Artificial Sequence
  chemically synthesized
caaagttctatcttgggtcatt

SEQ ID NO: 76257 - DNA, 22 bp, Artificial Sequence
  chemically synthesized
tatcttgggtcatttcattcta

SEQ ID NO: 76258 - DNA, 22 bp, Artificial Sequence
  chemically synthesized
tcttgggtcatttcattctaaa

SEQ ID NO: 76259 - DNA, 22 bp, Artificial Sequence
  chemically synthesized
gggtcatttcattctaaaacta

SEQ ID NO: 76260 - DNA, 22 bp, Artificial Sequence
  chemically synthesized
ggtcatttcattctaaaactat

SEQ ID NO: 76261 - DNA, 22 bp, Artificial Sequence
  chemically synthesized
cattctaaaactattcacatgt

SEQ ID NO: 76262 - DNA, 22 bp, Artificial Sequence
  chemically synthesized
attctaaaactattcacatgtg

SEQ ID NO: 76263 - DNA, 22 bp, Artificial Sequence
  chemically synthesized
taaaactattcacatgtgctgg

SEQ ID NO: 76264 - DNA, 22 bp, Artificial Sequence
  chemically synthesized
aaactattcacatgtgctggtg

SEQ ID NO: 76265 - DNA, 22 bp, Artificial Sequence
  chemically synthesized
ttcacatgtgctggtgactcca

SEQ ID NO: 76266 - DNA, 22 bp, Artificial Sequence
  chemically synthesized
acatgtgctggtgactccatct

SEQ ID NO: 76267 - DNA, 22 bp, Artificial Sequence
  chemically synthesized
gtgactccatctactccaaata

SEQ ID NO: 76268 - DNA, 22 bp, Artificial Sequence
  chemically synthesized
catctactccaaataatttagt

SEQ ID NO: 76269 - DNA, 22 bp, Artificial Sequence
  chemically synthesized
ctccaaataatttagttgtcac

SEQ ID NO: 76270 - DNA, 22 bp, Artificial Sequence
  chemically synthesized
caaataatttagttgtcacctt

SEQ ID NO: 76271 - DNA, 22 bp, Artificial Sequence
  chemically synthesized
agttgtcaccttcatgtgctaa

SEQ ID NO: 76272 - DNA, 22 bp, Artificial Sequence
  chemically synthesized
gttgtcaccttcatgtgctaac

SEQ ID NO: 76273 - DNA, 22 bp, Artificial Sequence
  chemically synthesized
tcaccttcatgtgctaactcct

SEQ ID NO: 76274 - DNA, 22 bp, Artificial Sequence
  chemically synthesized
catgtgctaactcctataacaa

SEQ ID NO: 76275 - DNA, 22 bp, Artificial Sequence
  chemically synthesized
atgtgctaactcctataacaat

SEQ ID NO: 76276 - DNA, 22 bp, Artificial Sequence
  chemically synthesized
actcctataacaatatttccag

SEQ ID NO: 76277 - DNA, 22 bp, Artificial Sequence
  chemically synthesized
ctataacaatatttccagccca

SEQ ID NO: 76278 - DNA, 22 bp, Artificial Sequence
  chemically synthesized
taacaatatttccagcccagat

SEQ ID NO: 76279 - DNA, 22 bp, Artificial Sequence
  chemically synthesized
ccagcccagattttctccctct

SEQ ID NO: 76280 - DNA, 22 bp, Artificial Sequence
  chemically synthesized
cagcccagattttctccctctg

SEQ ID NO: 76281 - DNA, 22 bp, Artificial Sequence
  chemically synthesized
tctccctctgttccaagtacac

SEQ ID NO: 76282 - DNA, 22 bp, Artificial Sequence
  chemically synthesized
ctccctctgttccaagtacaca

SEQ ID NO: 76283 - DNA, 22 bp, Artificial Sequence
  chemically synthesized
tccctctgttccaagtacacag

SEQ ID NO: 76284 - DNA, 22 bp, Artificial Sequence
  chemically synthesized
cctctgttccaagtacacagga

SEQ ID NO: 76285 - DNA, 22 bp, Artificial Sequence
  chemically synthesized
tgttccaagtacacaggaacag

SEQ ID NO: 76286 - DNA, 22 bp, Artificial Sequence
  chemically synthesized
ttccaagtacacaggaacagca

SEQ ID NO: 76287 - DNA, 22 bp, Artificial Sequence
  chemically synthesized
caagtacacaggaacagcatgt

SEQ ID NO: 76288 - DNA, 22 bp, Artificial Sequence
  chemically synthesized
cccaaattttagtttatccctc

SEQ ID NO: 76289 - DNA, 22 bp, Artificial Sequence
  chemically synthesized
tagtttatccctcacatccttt

SEQ ID NO: 76290 - DNA, 22 bp, Artificial Sequence
  chemically synthesized
agtttatccctcacatcctttg

SEQ ID NO: 76291 - DNA, 22 bp, Artificial Sequence
  chemically synthesized
gtttatccctcacatcctttga

SEQ ID NO: 76292 - DNA, 22 bp, Artificial Sequence
  chemically synthesized
atccctcacatcctttgaaaca

SEQ ID NO: 76293 - DNA, 22 bp, Artificial Sequence
  chemically synthesized
tccctcacatcctttgaaacat

SEQ ID NO: 76294 - DNA, 22 bp, Artificial Sequence
  chemically synthesized
acatcctttgaaacattgtcaa

SEQ ID NO: 76295 - DNA, 22 bp, Artificial Sequence
  chemically synthesized
tgaaacattgtcaatgagttct

SEQ ID NO: 76296 - DNA, 22 bp, Artificial Sequence
  chemically synthesized
gaaacattgtcaatgagttcta

SEQ ID NO: 76297 - DNA, 22 bp, Artificial Sequence
  chemically synthesized
aaacattgtcaatgagttctac

SEQ ID NO: 76298 - DNA, 22 bp, Artificial Sequence
  chemically synthesized
tcaatgagttctacacttaatt

SEQ ID NO: 76299 - DNA, 22 bp, Artificial Sequence
  chemically synthesized
tacacttaattcaaggttattt

SEQ ID NO: 76300 - DNA, 22 bp, Artificial Sequence
  chemically synthesized
cacttaattcaaggttattttt

SEQ ID NO: 76301 - DNA, 22 bp, Artificial Sequence
  chemically synthesized
aattcaaggttatttttttttc

SEQ ID NO: 76302 - DNA, 22 bp, Artificial Sequence
  chemically synthesized
attcaaggttatttttttttca

SEQ ID NO: 76303 - DNA, 22 bp, Artificial Sequence
  chemically synthesized
aaggttatttttttttcattgt

SEQ ID NO: 76304 - DNA, 22 bp, Artificial Sequence
  chemically synthesized
tttttttttcattgtacttgta

SEQ ID NO: 76305 - DNA, 22 bp, Artificial Sequence
  chemically synthesized
ttttttcattgtacttgtaaat

SEQ ID NO: 76306 - DNA, 22 bp, Artificial Sequence
  chemically synthesized
tttttcattgtacttgtaaata

SEQ ID NO: 76307 - DNA, 22 bp, Artificial Sequence
  chemically synthesized
ttttcattgtacttgtaaatat

SEQ ID NO: 76308 - DNA, 22 bp, Artificial Sequence
  chemically synthesized
tttcattgtacttgtaaatatt

SEQ ID NO: 76309 - DNA, 22 bp, Artificial Sequence
  chemically synthesized
ttcattgtacttgtaaatattg

SEQ ID NO: 76310 - DNA, 22 bp, Artificial Sequence
  chemically synthesized
tcattgtacttgtaaatattgg

SEQ ID NO: 76311 - DNA, 22 bp, Artificial Sequence
  chemically synthesized
cattgtacttgtaaatattgga

SEQ ID NO: 76312 - DNA, 22 bp, Artificial Sequence
  chemically synthesized
attgtacttgtaaatattggaa

SEQ ID NO: 76313 - DNA, 22 bp, Artificial Sequence
  chemically synthesized
tacttgtaaatattggaagact

SEQ ID NO: 76314 - DNA, 22 bp, Artificial Sequence
  chemically synthesized
gtaaatattggaagacttttac

SEQ ID NO: 76315 - DNA, 22 bp, Artificial Sequence
  chemically synthesized
taaatattggaagacttttaca

SEQ ID NO: 76316 - DNA, 22 bp, Artificial Sequence
  chemically synthesized
gaagacttttacatatgcatca

SEQ ID NO: 76317 - DNA, 22 bp, Artificial Sequence
  chemically synthesized
ttacatatgcatcaataactat

SEQ ID NO: 76318 - DNA, 22 bp, Artificial Sequence
  chemically synthesized
tacatatgcatcaataactatc

SEQ ID NO: 76319 - DNA, 22 bp, Artificial Sequence
  chemically synthesized
acatatgcatcaataactatct

SEQ ID NO: 76320 - DNA, 22 bp, Artificial Sequence
  chemically synthesized
catatgcatcaataactatctc

SEQ ID NO: 76321 - DNA, 22 bp, Artificial Sequence
  chemically synthesized
tctctggatttttttagctagt

SEQ ID NO: 76322 - DNA, 22 bp, Artificial Sequence
  chemically synthesized
tggatttttttagctagtctac

SEQ ID NO: 76323 - DNA, 22 bp, Artificial Sequence
  chemically synthesized
gatttttttagctagtctacta

SEQ ID NO: 76324 - DNA, 22 bp, Artificial Sequence
  chemically synthesized
ttttagctagtctactaaattt

SEQ ID NO: 76325 - DNA, 22 bp, Artificial Sequence
  chemically synthesized
tttagctagtctactaaatttt

SEQ ID NO: 76326 - DNA, 22 bp, Artificial Sequence
  chemically synthesized
ttagctagtctactaaattttt

SEQ ID NO: 76327 - DNA, 22 bp, Artificial Sequence
  chemically synthesized
tagctagtctactaaatttttt

SEQ ID NO: 76328 - DNA, 22 bp, Artificial Sequence
  chemically synthesized
agctagtctactaaattttttt

SEQ ID NO: 76329 - DNA, 22 bp, Artificial Sequence
  chemically synthesized
gctagtctactaaatttttttt

SEQ ID NO: 76330 - DNA, 22 bp, Artificial Sequence
  chemically synthesized
gtctactaaattttttttttct

SEQ ID NO: 76331 - DNA, 22 bp, Artificial Sequence
  chemically synthesized
ctaaattttttttttctttttt

SEQ ID NO: 76332 - DNA, 22 bp, Artificial Sequence
  chemically synthesized
aattttttttttcttttttttg

SEQ ID NO: 76333 - DNA, 22 bp, Artificial Sequence
  chemically synthesized
tttttttcttttttttgagaca

SEQ ID NO: 76334 - DNA, 22 bp, Artificial Sequence
  chemically synthesized
ttttttcttttttttgagacag

SEQ ID NO: 76335 - DNA, 22 bp, Artificial Sequence
  chemically synthesized
tttttcttttttttgagacaga

SEQ ID NO: 76336 - DNA, 22 bp, Artificial Sequence
  chemically synthesized
ttttcttttttttgagacagag

SEQ ID NO: 76337 - DNA, 22 bp, Artificial Sequence
  chemically synthesized
tttcttttttttgagacagagt

SEQ ID NO: 76338 - DNA, 22 bp, Artificial Sequence
  chemically synthesized
ttcttttttttgagacagagtc

SEQ ID NO: 76339 - DNA, 22 bp, Artificial Sequence
  chemically synthesized
tcttttttttgagacagagtct

SEQ ID NO: 76340 - DNA, 22 bp, Artificial Sequence
  chemically synthesized
cttttttttgagacagagtctc

SEQ ID NO: 76341 - DNA, 22 bp, Artificial Sequence
  chemically synthesized
ttttttttgagacagagtctct

SEQ ID NO: 76342 - DNA, 22 bp, Artificial Sequence
  chemically synthesized
ttttttgagacagagtctctct

SEQ ID NO: 76343 - DNA, 22 bp, Artificial Sequence
  chemically synthesized
tttttgagacagagtctctctc

SEQ ID NO: 76344 - DNA, 22 bp, Artificial Sequence
  chemically synthesized
ttttgagacagagtctctctct

SEQ ID NO: 76345 - DNA, 22 bp, Artificial Sequence
  chemically synthesized
tttgagacagagtctctctctg

SEQ ID NO: 76346 - DNA, 22 bp, Artificial Sequence
  chemically synthesized
ttgagacagagtctctctctgt

SEQ ID NO: 76347 - DNA, 22 bp, Artificial Sequence
  chemically synthesized
tgagacagagtctctctctgtc

SEQ ID NO: 76348 - DNA, 22 bp, Artificial Sequence
  chemically synthesized
gagacagagtctctctctgtcg

SEQ ID NO: 76349 - DNA, 22 bp, Artificial Sequence
  chemically synthesized
agacagagtctctctctgtcgc

SEQ ID NO: 76350 - DNA, 22 bp, Artificial Sequence
  chemically synthesized
tctctgtcgcccaggctggagt

SEQ ID NO: 76351 - DNA, 22 bp, Artificial Sequence
  chemically synthesized
tctgtcgcccaggctggagtgc

SEQ ID NO: 76352 - DNA, 22 bp, Artificial Sequence
  chemically synthesized
tgtcgcccaggctggagtgcag

SEQ ID NO: 76353 - DNA, 22 bp, Artificial Sequence
  chemically synthesized
tcgcccaggctggagtgcagtg

SEQ ID NO: 76354 - DNA, 22 bp, Artificial Sequence
  chemically synthesized
gagtgcagtggcccctgatctc

SEQ ID NO: 76355 - DNA, 22 bp, Artificial Sequence
  chemically synthesized
atctctgctcactgcaagctcc

SEQ ID NO: 76356 - DNA, 22 bp, Artificial Sequence
  chemically synthesized
tgctcactgcaagctccgcccc

SEQ ID NO: 76357 - DNA, 22 bp, Artificial Sequence
  chemically synthesized
ctcactgcaagctccgcccccc

SEQ ID NO: 76358 - DNA, 22 bp, Artificial Sequence
  chemically synthesized
actgcaagctccgccccccgcg

SEQ ID NO: 76359 - DNA, 22 bp, Artificial Sequence
  chemically synthesized
caagctccgccccccgcgttca

SEQ ID NO: 76360 - DNA, 22 bp, Artificial Sequence
  chemically synthesized
cgccccccgcgttcacgccatt

SEQ ID NO: 76361 - DNA, 22 bp, Artificial Sequence
  chemically synthesized
acgccattctcccgcctcagcc

SEQ ID NO: 76362 - DNA, 22 bp, Artificial Sequence
  chemically synthesized
tcccgcctcagcctccatagta

SEQ ID NO: 76363 - DNA, 22 bp, Artificial Sequence
  chemically synthesized
ccgcctcagcctccatagtagc

SEQ ID NO: 76364 - DNA, 22 bp, Artificial Sequence
  chemically synthesized
agcctccatagtagctgggact

SEQ ID NO: 76365 - DNA, 22 bp, Artificial Sequence
  chemically synthesized
catagtagctgggactacaggc

SEQ ID NO: 76366 - DNA, 22 bp, Artificial Sequence
  chemically synthesized
ggactacaggcacccgccacca

SEQ ID NO: 76367 - DNA, 22 bp, Artificial Sequence
  chemically synthesized
caggcacccgccaccaagcccg

SEQ ID NO: 76368 - DNA, 22 bp, Artificial Sequence
  chemically synthesized
attttttgtatttttttagtag

SEQ ID NO: 76369 - DNA, 22 bp, Artificial Sequence
  chemically synthesized
tttgtatttttttagtagagac

SEQ ID NO: 76370 - DNA, 22 bp, Artificial Sequence
  chemically synthesized
ttgtatttttttagtagagacg

SEQ ID NO: 76371 - DNA, 22 bp, Artificial Sequence
  chemically synthesized
tgtatttttttagtagagacgg

SEQ ID NO: 76372 - DNA, 22 bp, Artificial Sequence
  chemically synthesized
gtatttttttagtagagacggg

SEQ ID NO: 76373 - DNA, 22 bp, Artificial Sequence
  chemically synthesized
tatttttttagtagagacgggg

SEQ ID NO: 76374 - DNA, 22 bp, Artificial Sequence
  chemically synthesized
ttttagtagagacggggtttca

SEQ ID NO: 76375 - DNA, 22 bp, Artificial Sequence
  chemically synthesized
tttagtagagacggggtttcac

SEQ ID NO: 76376 - DNA, 22 bp, Artificial Sequence
  chemically synthesized
ttagtagagacggggtttcact

SEQ ID NO: 76377 - DNA, 22 bp, Artificial Sequence
  chemically synthesized
tagtagagacggggtttcactg

SEQ ID NO: 76378 - DNA, 22 bp, Artificial Sequence
  chemically synthesized
agtagagacggggtttcactgt

SEQ ID NO: 76379 - DNA, 22 bp, Artificial Sequence
  chemically synthesized
gtagagacggggtttcactgtg

SEQ ID NO: 76380 - DNA, 22 bp, Artificial Sequence
  chemically synthesized
cactgtgttagccaggatggtc

SEQ ID NO: 76381 - DNA, 22 bp, Artificial Sequence
  chemically synthesized
actgtgttagccaggatggtct

SEQ ID NO: 76382 - DNA, 22 bp, Artificial Sequence
  chemically synthesized
tgttagccaggatggtctcgat

SEQ ID NO: 76383 - DNA, 22 bp, Artificial Sequence
  chemically synthesized
gccaggatggtctcgatctcgc

SEQ ID NO: 76384 - DNA, 22 bp, Artificial Sequence
  chemically synthesized
gatctcgcgacctcgtgatcca

SEQ ID NO: 76385 - DNA, 22 bp, Artificial Sequence
  chemically synthesized
gcgacctcgtgatccacccgcc

SEQ ID NO: 76386 - DNA, 22 bp, Artificial Sequence
  chemically synthesized
gtgatccacccgcctccgcctc

SEQ ID NO: 76387 - DNA, 22 bp, Artificial Sequence
  chemically synthesized
cgcctcccaaagtgctgggatc

SEQ ID NO: 76388 - DNA, 22 bp, Artificial Sequence
  chemically synthesized
ccaaagtgctgggatcacaggc

SEQ ID NO: 76389 - DNA, 22 bp, Artificial Sequence
  chemically synthesized
ggatcacaggcgtgagccactg

SEQ ID NO: 76390 - DNA, 22 bp, Artificial Sequence
  chemically synthesized
cacccggcctactgaatatttt

SEQ ID NO: 76391 - DNA, 22 bp, Artificial Sequence
  chemically synthesized
ctgaatattttttaaatttatt

SEQ ID NO: 76392 - DNA, 22 bp, Artificial Sequence
  chemically synthesized
aatattttttaaatttattttt

SEQ ID NO: 76393 - DNA, 22 bp, Artificial Sequence
  chemically synthesized
tttaaatttatttttattaagg

SEQ ID NO: 76394 - DNA, 22 bp, Artificial Sequence
  chemically synthesized
ttaaatttatttttattaaggt

SEQ ID NO: 76395 - DNA, 22 bp, Artificial Sequence
  chemically synthesized
taaatttatttttattaaggta

SEQ ID NO: 76396 - DNA, 22 bp, Artificial Sequence
  chemically synthesized
aaatttatttttattaaggtaa

SEQ ID NO: 76397 - DNA, 22 bp, Artificial Sequence
  chemically synthesized
aatttatttttattaaggtaaa

SEQ ID NO: 76398 - DNA, 22 bp, Artificial Sequence
  chemically synthesized
atttttattaaggtaaaatata

SEQ ID NO: 76399 - DNA, 22 bp, Artificial Sequence
  chemically synthesized
tttttattaaggtaaaatatac

SEQ ID NO: 76400 - DNA, 22 bp, Artificial Sequence
  chemically synthesized
ttattaaggtaaaatatacata

SEQ ID NO: 76401 - DNA, 22 bp, Artificial Sequence
  chemically synthesized
tattaaggtaaaatatacatac

SEQ ID NO: 76402 - DNA, 22 bp, Artificial Sequence
  chemically synthesized
attaaggtaaaatatacatacg

SEQ ID NO: 76403 - DNA, 22 bp, Artificial Sequence
  chemically synthesized
ttaaggtaaaatatacatacgt

SEQ ID NO: 76404 - DNA, 22 bp, Artificial Sequence
  chemically synthesized
aggtaaaatatacatacgtaat

SEQ ID NO: 76405 - DNA, 22 bp, Artificial Sequence
  chemically synthesized
accgtctttacttttttttttt

SEQ ID NO: 76406 - DNA, 22 bp, Artificial Sequence
  chemically synthesized
ccgtctttactttttttttttc

SEQ ID NO: 76407 - DNA, 22 bp, Artificial Sequence
  chemically synthesized
tactttttttttttccttgaga

SEQ ID NO: 76408 - DNA, 22 bp, Artificial Sequence
  chemically synthesized
actttttttttttccttgagac

SEQ ID NO: 76409 - DNA, 22 bp, Artificial Sequence
  chemically synthesized
ctttttttttttccttgagacg

SEQ ID NO: 76410 - DNA, 22 bp, Artificial Sequence
  chemically synthesized
tttttttttccttgagacggag

SEQ ID NO: 76411 - DNA, 22 bp, Artificial Sequence
  chemically synthesized
ttttttttccttgagacggagt

SEQ ID NO: 76412 - DNA, 22 bp, Artificial Sequence
  chemically synthesized
tttttttccttgagacggagtc

SEQ ID NO: 76413 - DNA, 22 bp, Artificial Sequence
  chemically synthesized
ttttttccttgagacggagtct

SEQ ID NO: 76414 - DNA, 22 bp, Artificial Sequence
  chemically synthesized
tttttccttgagacggagtctc

SEQ ID NO: 76415 - DNA, 22 bp, Artificial Sequence
  chemically synthesized
ttttccttgagacggagtctcg

SEQ ID NO: 76416 - DNA, 22 bp, Artificial Sequence
  chemically synthesized
tttccttgagacggagtctcgc

SEQ ID NO: 76417 - DNA, 22 bp, Artificial Sequence
  chemically synthesized
ttccttgagacggagtctcgct

SEQ ID NO: 76418 - DNA, 22 bp, Artificial Sequence
  chemically synthesized
tccttgagacggagtctcgctc

SEQ ID NO: 76419 - DNA, 22 bp, Artificial Sequence
  chemically synthesized
ccttgagacggagtctcgctcc

SEQ ID NO: 76420 - DNA, 22 bp, Artificial Sequence
  chemically synthesized
cttgagacggagtctcgctccg

SEQ ID NO: 76421 - DNA, 22 bp, Artificial Sequence
  chemically synthesized
gagacggagtctcgctccgtca

SEQ ID NO: 76422 - DNA, 22 bp, Artificial Sequence
  chemically synthesized
agacggagtctcgctccgtcat

SEQ ID NO: 76423 - DNA, 22 bp, Artificial Sequence
  chemically synthesized
gctccgtcatccaggctggagt

SEQ ID NO: 76424 - DNA, 22 bp, Artificial Sequence
  chemically synthesized
cgtcatccaggctggagtgcag

SEQ ID NO: 76425 - DNA, 22 bp, Artificial Sequence
  chemically synthesized
gagtgcagtggtaggatcttgg

SEQ ID NO: 76426 - DNA, 22 bp, Artificial Sequence
  chemically synthesized
ggctcactgcaacctccgcccc

SEQ ID NO: 76427 - DNA, 22 bp, Artificial Sequence
  chemically synthesized
gctcactgcaacctccgccccc

SEQ ID NO: 76428 - DNA, 22 bp, Artificial Sequence
  chemically synthesized
actgcaacctccgcccccacca

SEQ ID NO: 76429 - DNA, 22 bp, Artificial Sequence
  chemically synthesized
caacctccgcccccaccaggtt

SEQ ID NO: 76430 - DNA, 22 bp, Artificial Sequence
  chemically synthesized
cgcccccaccaggttcaagcga

SEQ ID NO: 76431 - DNA, 22 bp, Artificial Sequence
  chemically synthesized
aagcgattctcctgcccaagcc

SEQ ID NO: 76432 - DNA, 22 bp, Artificial Sequence
  chemically synthesized
tcctgcccaagcctcccaagta

SEQ ID NO: 76433 - DNA, 22 bp, Artificial Sequence
  chemically synthesized
ctgcccaagcctcccaagtagg

SEQ ID NO: 76434 - DNA, 22 bp, Artificial Sequence
  chemically synthesized
cccaagcctcccaagtaggtgg

SEQ ID NO: 76435 - DNA, 22 bp, Artificial Sequence
  chemically synthesized
ccaagtaggtgggattacaggc

SEQ ID NO: 76436 - DNA, 22 bp, Artificial Sequence
  chemically synthesized
caggcgcctgccaccacgcctg

SEQ ID NO: 76437 - DNA, 22 bp, Artificial Sequence
  chemically synthesized
ccaccacgcctggctaattttt

SEQ ID NO: 76438 - DNA, 22 bp, Artificial Sequence
  chemically synthesized
gctaattttttgtatttttagt

SEQ ID NO: 76439 - DNA, 22 bp, Artificial Sequence
  chemically synthesized
attttttgtatttttagtagag

SEQ ID NO: 76440 - DNA, 22 bp, Artificial Sequence
  chemically synthesized
tttgtatttttagtagagacag

SEQ ID NO: 76441 - DNA, 22 bp, Artificial Sequence
  chemically synthesized
ttgtatttttagtagagacagg

SEQ ID NO: 76442 - DNA, 22 bp, Artificial Sequence
  chemically synthesized
tgtatttttagtagagacaggg

SEQ ID NO: 76443 - DNA, 22 bp, Artificial Sequence
  chemically synthesized
gtatttttagtagagacagggt

SEQ ID NO: 76444 - DNA, 22 bp, Artificial Sequence
  chemically synthesized
tatttttagtagagacagggtt

SEQ ID NO: 76445 - DNA, 22 bp, Artificial Sequence
  chemically synthesized
ttagtagagacagggtttcacc

SEQ ID NO: 76446 - DNA, 22 bp, Artificial Sequence
  chemically synthesized
tagtagagacagggtttcacca

SEQ ID NO: 76447 - DNA, 22 bp, Artificial Sequence
  chemically synthesized
agtagagacagggtttcaccat

SEQ ID NO: 76448 - DNA, 22 bp, Artificial Sequence
  chemically synthesized
gtagagacagggtttcaccatg

SEQ ID NO: 76449 - DNA, 22 bp, Artificial Sequence
  chemically synthesized
caccatgttggtcaggctggtc

SEQ ID NO: 76450 - DNA, 22 bp, Artificial Sequence
  chemically synthesized
accatgttggtcaggctggtct

SEQ ID NO: 76451 - DNA, 22 bp, Artificial Sequence
  chemically synthesized
gtcaggctggtcttggactcct

SEQ ID NO: 76452 - DNA, 22 bp, Artificial Sequence
  chemically synthesized
gtcttggactcctgacctcatg

SEQ ID NO: 76453 - DNA, 22 bp, Artificial Sequence
  chemically synthesized
ggactcctgacctcatgatcca

SEQ ID NO: 76454 - DNA, 22 bp, Artificial Sequence
  chemically synthesized
gactcctgacctcatgatccac

SEQ ID NO: 76455 - DNA, 22 bp, Artificial Sequence
  chemically synthesized
ctgacctcatgatccacctgcc

SEQ ID NO: 76456 - DNA, 22 bp, Artificial Sequence
  chemically synthesized
acctcatgatccacctgccttg

SEQ ID NO: 76457 - DNA, 22 bp, Artificial Sequence
  chemically synthesized
atgatccacctgccttggcctc

SEQ ID NO: 76458 - DNA, 22 bp, Artificial Sequence
  chemically synthesized
ccttggcctcccaaagtgctga

SEQ ID NO: 76459 - DNA, 22 bp, Artificial Sequence
  chemically synthesized
ggcctcccaaagtgctgagatt

SEQ ID NO: 76460 - DNA, 22 bp, Artificial Sequence
  chemically synthesized
gcctcccaaagtgctgagatta

SEQ ID NO: 76461 - DNA, 22 bp, Artificial Sequence
  chemically synthesized
ccaaagtgctgagattacaggc

SEQ ID NO: 76462 - DNA, 22 bp, Artificial Sequence
  chemically synthesized
agattacaggcattggccaccg

SEQ ID NO: 76463 - DNA, 22 bp, Artificial Sequence
  chemically synthesized
caggcattggccaccgcaccca

SEQ ID NO: 76464 - DNA, 22 bp, Artificial Sequence
  chemically synthesized
gccaccgcacccagcccatctt

SEQ ID NO: 76465 - DNA, 22 bp, Artificial Sequence
  chemically synthesized
taccatttttgagtgtacggtt

SEQ ID NO: 76466 - DNA, 22 bp, Artificial Sequence
  chemically synthesized
accatttttgagtgtacggttc

SEQ ID NO: 76467 - DNA, 22 bp, Artificial Sequence
  chemically synthesized
ccatttttgagtgtacggttca

SEQ ID NO: 76468 - DNA, 22 bp, Artificial Sequence
  chemically synthesized
ttgagtgtacggttcagtggta

SEQ ID NO: 76469 - DNA, 22 bp, Artificial Sequence
  chemically synthesized
tgagtgtacggttcagtggtaa

SEQ ID NO: 76470 - DNA, 22 bp, Artificial Sequence
  chemically synthesized
gagtgtacggttcagtggtaat

SEQ ID NO: 76471 - DNA, 22 bp, Artificial Sequence
  chemically synthesized
agtgtacggttcagtggtaata

SEQ ID NO: 76472 - DNA, 22 bp, Artificial Sequence
  chemically synthesized
agtggtaatacatacatacata

SEQ ID NO: 76473 - DNA, 22 bp, Artificial Sequence
  chemically synthesized
atatgtatacatacatattcac

SEQ ID NO: 76474 - DNA, 22 bp, Artificial Sequence
  chemically synthesized
tatgtatacatacatattcaca

SEQ ID NO: 76475 - DNA, 22 bp, Artificial Sequence
  chemically synthesized
acatttttatatatatatacac

SEQ ID NO: 76476 - DNA, 22 bp, Artificial Sequence
  chemically synthesized
ttatatatatatacacatacat

SEQ ID NO: 76477 - DNA, 22 bp, Artificial Sequence
  chemically synthesized
tatatatatatacacatacata

SEQ ID NO: 76478 - DNA, 22 bp, Artificial Sequence
  chemically synthesized
atatatatatacacatacatac

SEQ ID NO: 76479 - DNA, 22 bp, Artificial Sequence
  chemically synthesized
tatatatatacacatacataca

SEQ ID NO: 76480 - DNA, 22 bp, Artificial Sequence
  chemically synthesized
ttttgcttgatttctcattcct

SEQ ID NO: 76481 - DNA, 22 bp, Artificial Sequence
  chemically synthesized
tttgcttgatttctcattcctt

SEQ ID NO: 76482 - DNA, 22 bp, Artificial Sequence
  chemically synthesized
ttgcttgatttctcattccttt

SEQ ID NO: 76483 - DNA, 22 bp, Artificial Sequence
  chemically synthesized
tgcttgatttctcattcctttc

SEQ ID NO: 76484 - DNA, 22 bp, Artificial Sequence
  chemically synthesized
gcttgatttctcattcctttct

SEQ ID NO: 76485 - DNA, 22 bp, Artificial Sequence
  chemically synthesized
cttgatttctcattcctttctt

SEQ ID NO: 76486 - DNA, 22 bp, Artificial Sequence
  chemically synthesized
gatttctcattcctttcttccc

SEQ ID NO: 76487 - DNA, 22 bp, Artificial Sequence
  chemically synthesized
atttctcattcctttcttccct

SEQ ID NO: 76488 - DNA, 22 bp, Artificial Sequence
  chemically synthesized
ctcattcctttcttccctcccg

SEQ ID NO: 76489 - DNA, 22 bp, Artificial Sequence
  chemically synthesized
tcattcctttcttccctcccgc

SEQ ID NO: 76490 - DNA, 22 bp, Artificial Sequence
  chemically synthesized
attcctttcttccctcccgccg

SEQ ID NO: 76491 - DNA, 22 bp, Artificial Sequence
  chemically synthesized
ctttcttccctcccgccgccgg

SEQ ID NO: 76492 - DNA, 22 bp, Artificial Sequence
  chemically synthesized
tcttccctcccgccgccggtaa

SEQ ID NO: 76493 - DNA, 22 bp, Artificial Sequence
  chemically synthesized
cttccctcccgccgccggtaac

SEQ ID NO: 76494 - DNA, 22 bp, Artificial Sequence
  chemically synthesized
ttccctcccgccgccggtaact

SEQ ID NO: 76495 - DNA, 22 bp, Artificial Sequence
  chemically synthesized
ccctcccgccgccggtaactac

SEQ ID NO: 76496 - DNA, 22 bp, Artificial Sequence
  chemically synthesized
cctcccgccgccggtaactacc

SEQ ID NO: 76497 - DNA, 22 bp, Artificial Sequence
  chemically synthesized
ccgccgccggtaactaccaatc

SEQ ID NO: 76498 - DNA, 22 bp, Artificial Sequence
  chemically synthesized
ccaatctactctctgtcttcat

SEQ ID NO: 76499 - DNA, 22 bp, Artificial Sequence
  chemically synthesized
ctctctgtcttcataagatcca

SEQ ID NO: 76500 - DNA, 22 bp, Artificial Sequence
  chemically synthesized
tctgtcttcataagatccacgt

SEQ ID NO: 76501 - DNA, 22 bp, Artificial Sequence
  chemically synthesized
tgtcttcataagatccacgttt

SEQ ID NO: 76502 - DNA, 22 bp, Artificial Sequence
  chemically synthesized
tcttcataagatccacgttttt

SEQ ID NO: 76503 - DNA, 22 bp, Artificial Sequence
  chemically synthesized
cataagatccacgtttttaact

SEQ ID NO: 76504 - DNA, 22 bp, Artificial Sequence
  chemically synthesized
ataagatccacgtttttaactt

SEQ ID NO: 76505 - DNA, 22 bp, Artificial Sequence
  chemically synthesized
ttaacttccacacgagttagaa

SEQ ID NO: 76506 - DNA, 22 bp, Artificial Sequence
  chemically synthesized
taacttccacacgagttagaac

SEQ ID NO: 76507 - DNA, 22 bp, Artificial Sequence
  chemically synthesized
aacttccacacgagttagaaca

SEQ ID NO: 76508 - DNA, 22 bp, Artificial Sequence
  chemically synthesized
acttccacacgagttagaacat

SEQ ID NO: 76509 - DNA, 22 bp, Artificial Sequence
  chemically synthesized
ccacacgagttagaacatgtga

SEQ ID NO: 76510 - DNA, 22 bp, Artificial Sequence
  chemically synthesized
cacacgagttagaacatgtgat

SEQ ID NO: 76511 - DNA, 22 bp, Artificial Sequence
  chemically synthesized
gaacatgtgatatttttctttc

SEQ ID NO: 76512 - DNA, 22 bp, Artificial Sequence
  chemically synthesized
ttctttctgtgcttggcttatt

SEQ ID NO: 76513 - DNA, 22 bp, Artificial Sequence
  chemically synthesized
tctttctgtgcttggcttattt

SEQ ID NO: 76514 - DNA, 22 bp, Artificial Sequence
  chemically synthesized
ctttctgtgcttggcttatttc

SEQ ID NO: 76515 - DNA, 22 bp, Artificial Sequence
  chemically synthesized
tttctgtgcttggcttatttca

SEQ ID NO: 76516 - DNA, 22 bp, Artificial Sequence
  chemically synthesized
tctgtgcttggcttatttcact

SEQ ID NO: 76517 - DNA, 22 bp, Artificial Sequence
  chemically synthesized
ctgtgcttggcttatttcactt

SEQ ID NO: 76518 - DNA, 22 bp, Artificial Sequence
  chemically synthesized
tgtgcttggcttatttcactta

SEQ ID NO: 76519 - DNA, 22 bp, Artificial Sequence
  chemically synthesized
tgcttggcttatttcacttaac

SEQ ID NO: 76520 - DNA, 22 bp, Artificial Sequence
  chemically synthesized
ggcttatttcacttaacgtaat

SEQ ID NO: 76521 - DNA, 22 bp, Artificial Sequence
  chemically synthesized
gcttatttcacttaacgtaatt

SEQ ID NO: 76522 - DNA, 22 bp, Artificial Sequence
  chemically synthesized
atttcacttaacgtaattgctt

SEQ ID NO: 76523 - DNA, 22 bp, Artificial Sequence
  chemically synthesized
tttcacttaacgtaattgcttt

SEQ ID NO: 76524 - DNA, 22 bp, Artificial Sequence
  chemically synthesized
cacttaacgtaattgctttcag

SEQ ID NO: 76525 - DNA, 22 bp, Artificial Sequence
  chemically synthesized
acttaacgtaattgctttcagt

SEQ ID NO: 76526 - DNA, 22 bp, Artificial Sequence
  chemically synthesized
aacgtaattgctttcagtacca

SEQ ID NO: 76527 - DNA, 22 bp, Artificial Sequence
  chemically synthesized
acgtaattgctttcagtaccat

SEQ ID NO: 76528 - DNA, 22 bp, Artificial Sequence
  chemically synthesized
ctttcagtaccatttatgttac

SEQ ID NO: 76529 - DNA, 22 bp, Artificial Sequence
  chemically synthesized
tcagtaccatttatgttactgt

SEQ ID NO: 76530 - DNA, 22 bp, Artificial Sequence
  chemically synthesized
cagtaccatttatgttactgta

SEQ ID NO: 76531 - DNA, 22 bp, Artificial Sequence
  chemically synthesized
agtaccatttatgttactgtaa

SEQ ID NO: 76532 - DNA, 22 bp, Artificial Sequence
  chemically synthesized
atgttactgtaattgataatat

SEQ ID NO: 76533 - DNA, 22 bp, Artificial Sequence
  chemically synthesized
tgttactgtaattgataatatt

SEQ ID NO: 76534 - DNA, 22 bp, Artificial Sequence
  chemically synthesized
ctgtaattgataatatttcatt

SEQ ID NO: 76535 - DNA, 22 bp, Artificial Sequence
  chemically synthesized
taattgataatatttcattctt

SEQ ID NO: 76536 - DNA, 22 bp, Artificial Sequence
  chemically synthesized
ataatatttcattcttttttat

SEQ ID NO: 76537 - DNA, 22 bp, Artificial Sequence
  chemically synthesized
cattcttttttatggttgaata

SEQ ID NO: 76538 - DNA, 22 bp, Artificial Sequence
  chemically synthesized
attcttttttatggttgaataa

SEQ ID NO: 76539 - DNA, 22 bp, Artificial Sequence
  chemically synthesized
ttttttatggttgaataatatt

SEQ ID NO: 76540 - DNA, 22 bp, Artificial Sequence
  chemically synthesized
ttttatggttgaataatattcc

SEQ ID NO: 76541 - DNA, 22 bp, Artificial Sequence
  chemically synthesized
tttatggttgaataatattcca

SEQ ID NO: 76542 - DNA, 22 bp, Artificial Sequence
  chemically synthesized
ttatggttgaataatattccat

SEQ ID NO: 76543 - DNA, 22 bp, Artificial Sequence
  chemically synthesized
tatggttgaataatattccatt

SEQ ID NO: 76544 - DNA, 22 bp, Artificial Sequence
  chemically synthesized
atggttgaataatattccattg

SEQ ID NO: 76545 - DNA, 22 bp, Artificial Sequence
  chemically synthesized
tggttgaataatattccattgt

SEQ ID NO: 76546 - DNA, 22 bp, Artificial Sequence
  chemically synthesized
aataatattccattgtgtgtgt

SEQ ID NO: 76547 - DNA, 22 bp, Artificial Sequence
  chemically synthesized
cattgtgtgtgtgtgtgtgtgt

SEQ ID NO: 76548 - DNA, 22 bp, Artificial Sequence
  chemically synthesized
tgtgtgtgtgtgtgtgtgtgtg

SEQ ID NO: 76549 - DNA, 22 bp, Artificial Sequence
  chemically synthesized
ttttctttatccatttatctgt

SEQ ID NO: 76550 - DNA, 22 bp, Artificial Sequence
  chemically synthesized
tctttatccatttatctgttga

SEQ ID NO: 76551 - DNA, 22 bp, Artificial Sequence
  chemically synthesized
ctttatccatttatctgttgac

SEQ ID NO: 76552 - DNA, 22 bp, Artificial Sequence
  chemically synthesized
tttatccatttatctgttgacg

SEQ ID NO: 76553 - DNA, 22 bp, Artificial Sequence
  chemically synthesized
tatccatttatctgttgacgaa

SEQ ID NO: 76554 - DNA, 22 bp, Artificial Sequence
  chemically synthesized
atccatttatctgttgacgaat

SEQ ID NO: 76555 - DNA, 22 bp, Artificial Sequence
  chemically synthesized
tccatttatctgttgacgaata

SEQ ID NO: 76556 - DNA, 22 bp, Artificial Sequence
  chemically synthesized
atctgttgacgaatacatcagt

SEQ ID NO: 76557 - DNA, 22 bp, Artificial Sequence
  chemically synthesized
tctgttgacgaatacatcagtt

SEQ ID NO: 76558 - DNA, 22 bp, Artificial Sequence
  chemically synthesized
ttgacgaatacatcagttgatt

SEQ ID NO: 76559 - DNA, 22 bp, Artificial Sequence
  chemically synthesized
acgaatacatcagttgatttca

SEQ ID NO: 76560 - DNA, 22 bp, Artificial Sequence
  chemically synthesized
atttcaaatcttggcgtttgtg

SEQ ID NO: 76561 - DNA, 22 bp, Artificial Sequence
  chemically synthesized
caaatcttggcgtttgtgaata

SEQ ID NO: 76562 - DNA, 22 bp, Artificial Sequence
  chemically synthesized
aaatcttggcgtttgtgaatag

SEQ ID NO: 76563 - DNA, 22 bp, Artificial Sequence
  chemically synthesized
ggcgtttgtgaatagtgctata

SEQ ID NO: 76564 - DNA, 22 bp, Artificial Sequence
  chemically synthesized
gcgtttgtgaatagtgctataa

SEQ ID NO: 76565 - DNA, 22 bp, Artificial Sequence
  chemically synthesized
gtgaatagtgctataataaaga

SEQ ID NO: 76566 - DNA, 22 bp, Artificial Sequence
  chemically synthesized
tgaatagtgctataataaagat

SEQ ID NO: 76567 - DNA, 22 bp, Artificial Sequence
  chemically synthesized
taataaagatgggagtactgat

SEQ ID NO: 76568 - DNA, 22 bp, Artificial Sequence
  chemically synthesized
atatatcttcgacatactaatt

SEQ ID NO: 76569 - DNA, 22 bp, Artificial Sequence
  chemically synthesized
cgacatactaatttattctttt

SEQ ID NO: 76570 - DNA, 22 bp, Artificial Sequence
  chemically synthesized
gacatactaatttattctttta

SEQ ID NO: 76571 - DNA, 22 bp, Artificial Sequence
  chemically synthesized
atttattcttttaagggtatat

SEQ ID NO: 76572 - DNA, 22 bp, Artificial Sequence
  chemically synthesized
attcttttaagggtatatacct

SEQ ID NO: 76573 - DNA, 22 bp, Artificial Sequence
  chemically synthesized
ttcttttaagggtatataccta

SEQ ID NO: 76574 - DNA, 22 bp, Artificial Sequence
  chemically synthesized
ttttaagggtatatacctagga

SEQ ID NO: 76575 - DNA, 22 bp, Artificial Sequence
  chemically synthesized
ttaagggtatatacctaggagt

SEQ ID NO: 76576 - DNA, 22 bp, Artificial Sequence
  chemically synthesized
taagggtatatacctaggagtg

SEQ ID NO: 76577 - DNA, 22 bp, Artificial Sequence
  chemically synthesized
aagggtatatacctaggagtga

SEQ ID NO: 76578 - DNA, 22 bp, Artificial Sequence
  chemically synthesized
agggtatatacctaggagtgat

SEQ ID NO: 76579 - DNA, 22 bp, Artificial Sequence
  chemically synthesized
ggagtgatattgctggatcata

SEQ ID NO: 76580 - DNA, 22 bp, Artificial Sequence
  chemically synthesized
ctggatcatatggtagttctac

SEQ ID NO: 76581 - DNA, 22 bp, Artificial Sequence
  chemically synthesized
gatcatatggtagttctacttt

SEQ ID NO: 76582 - DNA, 22 bp, Artificial Sequence
  chemically synthesized
tactttacatttttgacaaatc

SEQ ID NO: 76583 - DNA, 22 bp, Artificial Sequence
  chemically synthesized
ctttacatttttgacaaatctc

SEQ ID NO: 76584 - DNA, 22 bp, Artificial Sequence
  chemically synthesized
tacatttttgacaaatctccat

SEQ ID NO: 76585 - DNA, 22 bp, Artificial Sequence
  chemically synthesized
acatttttgacaaatctccata

SEQ ID NO: 76586 - DNA, 22 bp, Artificial Sequence
  chemically synthesized
catttttgacaaatctccatac

SEQ ID NO: 76587 - DNA, 22 bp, Artificial Sequence
  chemically synthesized
ttgacaaatctccatactgtcc

SEQ ID NO: 76588 - DNA, 22 bp, Artificial Sequence
  chemically synthesized
tgacaaatctccatactgtcct

SEQ ID NO: 76589 - DNA, 22 bp, Artificial Sequence
  chemically synthesized
gacaaatctccatactgtcctt

SEQ ID NO: 76590 - DNA, 22 bp, Artificial Sequence
  chemically synthesized
acaaatctccatactgtccttc

SEQ ID NO: 76591 - DNA, 22 bp, Artificial Sequence
  chemically synthesized
catactgtccttcataattgct

SEQ ID NO: 76592 - DNA, 22 bp, Artificial Sequence
  chemically synthesized
tccttcataattgctgtaccaa

SEQ ID NO: 76593 - DNA, 22 bp, Artificial Sequence
  chemically synthesized
cataattgctgtaccaatttgt

SEQ ID NO: 76594 - DNA, 22 bp, Artificial Sequence
  chemically synthesized
ataattgctgtaccaatttgta

SEQ ID NO: 76595 - DNA, 22 bp, Artificial Sequence
  chemically synthesized
ctgtaccaatttgtactcccac

SEQ ID NO: 76596 - DNA, 22 bp, Artificial Sequence
  chemically synthesized
taccaatttgtactcccaccaa

SEQ ID NO: 76597 - DNA, 22 bp, Artificial Sequence
  chemically synthesized
gtactcccaccaacagtgtaag

SEQ ID NO: 76598 - DNA, 22 bp, Artificial Sequence
  chemically synthesized
tactcccaccaacagtgtaaga

SEQ ID NO: 76599 - DNA, 22 bp, Artificial Sequence
  chemically synthesized
ccaccaacagtgtaagagggtt

SEQ ID NO: 76600 - DNA, 22 bp, Artificial Sequence
  chemically synthesized
ccctttgtccacatccacacaa

SEQ ID NO: 76601 - DNA, 22 bp, Artificial Sequence
  chemically synthesized
cctttgtccacatccacacaag

SEQ ID NO: 76602 - DNA, 22 bp, Artificial Sequence
  chemically synthesized
tgtccacatccacacaagcatc

SEQ ID NO: 76603 - DNA, 22 bp, Artificial Sequence
  chemically synthesized
gtccacatccacacaagcatct

SEQ ID NO: 76604 - DNA, 22 bp, Artificial Sequence
  chemically synthesized
tccacatccacacaagcatctg

SEQ ID NO: 76605 - DNA, 22 bp, Artificial Sequence
  chemically synthesized
ttatttccttttgttttgttat

SEQ ID NO: 76606 - DNA, 22 bp, Artificial Sequence
  chemically synthesized
tttccttttgttttgttataag

SEQ ID NO: 76607 - DNA, 22 bp, Artificial Sequence
  chemically synthesized
ccttttgttttgttataagcta

SEQ ID NO: 76608 - DNA, 22 bp, Artificial Sequence
  chemically synthesized
cttttgttttgttataagctat

SEQ ID NO: 76609 - DNA, 22 bp, Artificial Sequence
  chemically synthesized
ttgttttgttataagctatttt

SEQ ID NO: 76610 - DNA, 22 bp, Artificial Sequence
  chemically synthesized
tgttttgttataagctatttta

SEQ ID NO: 76611 - DNA, 22 bp, Artificial Sequence
  chemically synthesized
gttttgttataagctattttaa

SEQ ID NO: 76612 - DNA, 22 bp, Artificial Sequence
  chemically synthesized
ttttgttataagctattttaac

SEQ ID NO: 76613 - DNA, 22 bp, Artificial Sequence
  chemically synthesized
tgttataagctattttaactaa

SEQ ID NO: 76614 - DNA, 22 bp, Artificial Sequence
  chemically synthesized
gttataagctattttaactaag

SEQ ID NO: 76615 - DNA, 22 bp, Artificial Sequence
  chemically synthesized
ttataagctattttaactaagg

SEQ ID NO: 76616 - DNA, 22 bp, Artificial Sequence
  chemically synthesized
taagctattttaactaaggtga

SEQ ID NO: 76617 - DNA, 22 bp, Artificial Sequence
  chemically synthesized
ttttaactaaggtgagatgata

SEQ ID NO: 76618 - DNA, 22 bp, Artificial Sequence
  chemically synthesized
taactaaggtgagatgatatca

SEQ ID NO: 76619 - DNA, 22 bp, Artificial Sequence
  chemically synthesized
aactaaggtgagatgatatcac

SEQ ID NO: 76620 - DNA, 22 bp, Artificial Sequence
  chemically synthesized
actaaggtgagatgatatcaca

SEQ ID NO: 76621 - DNA, 22 bp, Artificial Sequence
  chemically synthesized
aggtgagatgatatcacattgt

SEQ ID NO: 76622 - DNA, 22 bp, Artificial Sequence
  chemically synthesized
tggttttgatttatctggtgat

SEQ ID NO: 76623 - DNA, 22 bp, Artificial Sequence
  chemically synthesized
tgatttatctggtgattagtga

SEQ ID NO: 76624 - DNA, 22 bp, Artificial Sequence
  chemically synthesized
gatttatctggtgattagtgat

SEQ ID NO: 76625 - DNA, 22 bp, Artificial Sequence
  chemically synthesized
atttatctggtgattagtgata

SEQ ID NO: 76626 - DNA, 22 bp, Artificial Sequence
  chemically synthesized
atctggtgattagtgatattga

SEQ ID NO: 76627 - DNA, 22 bp, Artificial Sequence
  chemically synthesized
tctggtgattagtgatattgaa

SEQ ID NO: 76628 - DNA, 22 bp, Artificial Sequence
  chemically synthesized
gtgattagtgatattgaacatt

SEQ ID NO: 76629 - DNA, 22 bp, Artificial Sequence
  chemically synthesized
gtgatattgaacattttttcaa

SEQ ID NO: 76630 - DNA, 22 bp, Artificial Sequence
  chemically synthesized
aacattttttcaaatacctctg

SEQ ID NO: 76631 - DNA, 22 bp, Artificial Sequence
  chemically synthesized
tttcaaatacctctgggccatt

SEQ ID NO: 76632 - DNA, 22 bp, Artificial Sequence
  chemically synthesized
ttcaaatacctctgggccattt

SEQ ID NO: 76633 - DNA, 22 bp, Artificial Sequence
  chemically synthesized
tcaaatacctctgggccatttg

SEQ ID NO: 76634 - DNA, 22 bp, Artificial Sequence
  chemically synthesized
caaatacctctgggccatttgt

SEQ ID NO: 76635 - DNA, 22 bp, Artificial Sequence
  chemically synthesized
aaatacctctgggccatttgta

SEQ ID NO: 76636 - DNA, 22 bp, Artificial Sequence
  chemically synthesized
tgggccatttgtatggcttctt

SEQ ID NO: 76637 - DNA, 22 bp, Artificial Sequence
  chemically synthesized
ggccatttgtatggcttctttt

SEQ ID NO: 76638 - DNA, 22 bp, Artificial Sequence
  chemically synthesized
gtatggcttcttttgagaaata

SEQ ID NO: 76639 - DNA, 22 bp, Artificial Sequence
  chemically synthesized
tatggcttcttttgagaaatat

SEQ ID NO: 76640 - DNA, 22 bp, Artificial Sequence
  chemically synthesized
cttttgagaaatatctattcag

SEQ ID NO: 76641 - DNA, 22 bp, Artificial Sequence
  chemically synthesized
ttttgagaaatatctattcagg

SEQ ID NO: 76642 - DNA, 22 bp, Artificial Sequence
  chemically synthesized
ttgagaaatatctattcaggtc

SEQ ID NO: 76643 - DNA, 22 bp, Artificial Sequence
  chemically synthesized
tgagaaatatctattcaggtct

SEQ ID NO: 76644 - DNA, 22 bp, Artificial Sequence
  chemically synthesized
gagaaatatctattcaggtctt

SEQ ID NO: 76645 - DNA, 22 bp, Artificial Sequence
  chemically synthesized
agaaatatctattcaggtcttt

SEQ ID NO: 76646 - DNA, 22 bp, Artificial Sequence
  chemically synthesized
ttcaggtcttttggccattatt

SEQ ID NO: 76647 - DNA, 22 bp, Artificial Sequence
  chemically synthesized
aggtcttttggccattatttat

SEQ ID NO: 76648 - DNA, 22 bp, Artificial Sequence
  chemically synthesized
ttggccattatttatttattta

SEQ ID NO: 76649 - DNA, 22 bp, Artificial Sequence
  chemically synthesized
tggccattatttatttatttat

SEQ ID NO: 76650 - DNA, 22 bp, Artificial Sequence
  chemically synthesized
ggccattatttatttatttatt

SEQ ID NO: 76651 - DNA, 22 bp, Artificial Sequence
  chemically synthesized
gccattatttatttatttattt

SEQ ID NO: 76652 - DNA, 22 bp, Artificial Sequence
  chemically synthesized
tttatttatttatttattttct

SEQ ID NO: 76653 - DNA, 22 bp, Artificial Sequence
  chemically synthesized
atttatttatttattttctgtt

SEQ ID NO: 76654 - DNA, 22 bp, Artificial Sequence
  chemically synthesized
tttatttatttattttctgttg

SEQ ID NO: 76655 - DNA, 22 bp, Artificial Sequence
  chemically synthesized
atttatttattttctgttgagt

SEQ ID NO: 76656 - DNA, 22 bp, Artificial Sequence
  chemically synthesized
tttatttattttctgttgagtt

SEQ ID NO: 76657 - DNA, 22 bp, Artificial Sequence
  chemically synthesized
atttattttctgttgagttgct

SEQ ID NO: 76658 - DNA, 22 bp, Artificial Sequence
  chemically synthesized
tttattttctgttgagttgctt

SEQ ID NO: 76659 - DNA, 22 bp, Artificial Sequence
  chemically synthesized
attttctgttgagttgcttgag

SEQ ID NO: 76660 - DNA, 22 bp, Artificial Sequence
  chemically synthesized
ttttctgttgagttgcttgagt

SEQ ID NO: 76661 - DNA, 22 bp, Artificial Sequence
  chemically synthesized
tctgttgagttgcttgagtttc

SEQ ID NO: 76662 - DNA, 22 bp, Artificial Sequence
  chemically synthesized
ctgttgagttgcttgagtttct

SEQ ID NO: 76663 - DNA, 22 bp, Artificial Sequence
  chemically synthesized
tgttgagttgcttgagtttctt

SEQ ID NO: 76664 - DNA, 22 bp, Artificial Sequence
  chemically synthesized
ttgagttgcttgagtttcttgc

SEQ ID NO: 76665 - DNA, 22 bp, Artificial Sequence
  chemically synthesized
agttgcttgagtttcttgcata

SEQ ID NO: 76666 - DNA, 22 bp, Artificial Sequence
  chemically synthesized
cttgagtttcttgcatattctg

SEQ ID NO: 76667 - DNA, 22 bp, Artificial Sequence
  chemically synthesized
gagtttcttgcatattctggtt

SEQ ID NO: 76668 - DNA, 22 bp, Artificial Sequence
  chemically synthesized
agtttcttgcatattctggtta

SEQ ID NO: 76669 - DNA, 22 bp, Artificial Sequence
  chemically synthesized
cttgcatattctggttatcaat

SEQ ID NO: 76670 - DNA, 22 bp, Artificial Sequence
  chemically synthesized
ttgcatattctggttatcaatt

SEQ ID NO: 76671 - DNA, 22 bp, Artificial Sequence
  chemically synthesized
gcatattctggttatcaattcc

SEQ ID NO: 76672 - DNA, 22 bp, Artificial Sequence
  chemically synthesized
catattctggttatcaattcct

SEQ ID NO: 76673 - DNA, 22 bp, Artificial Sequence
  chemically synthesized
tggttatcaattccttgtaaaa

SEQ ID NO: 76674 - DNA, 22 bp, Artificial Sequence
  chemically synthesized
gttatcaattccttgtaaaata

SEQ ID NO: 76675 - DNA, 22 bp, Artificial Sequence
  chemically synthesized
tcaattccttgtaaaatatata

SEQ ID NO: 76676 - DNA, 22 bp, Artificial Sequence
  chemically synthesized
cttgtaaaatatatagtttgca

SEQ ID NO: 76677 - DNA, 22 bp, Artificial Sequence
  chemically synthesized
gtaaaatatatagtttgcaaat

SEQ ID NO: 76678 - DNA, 22 bp, Artificial Sequence
  chemically synthesized
taaaatatatagtttgcaaata

SEQ ID NO: 76679 - DNA, 22 bp, Artificial Sequence
  chemically synthesized
gcaaatattttctcccattctt

SEQ ID NO: 76680 - DNA, 22 bp, Artificial Sequence
  chemically synthesized
caaatattttctcccattcttt

SEQ ID NO: 76681 - DNA, 22 bp, Artificial Sequence
  chemically synthesized
tctcccattctttgggttgtct

SEQ ID NO: 76682 - DNA, 22 bp, Artificial Sequence
  chemically synthesized
ctcccattctttgggttgtctc

SEQ ID NO: 76683 - DNA, 22 bp, Artificial Sequence
  chemically synthesized
tcccattctttgggttgtctct

SEQ ID NO: 76684 - DNA, 22 bp, Artificial Sequence
  chemically synthesized
ccattctttgggttgtctcttc

SEQ ID NO: 76685 - DNA, 22 bp, Artificial Sequence
  chemically synthesized
tttgggttgtctcttcacttta

SEQ ID NO: 76686 - DNA, 22 bp, Artificial Sequence
  chemically synthesized
tgggttgtctcttcactttatt

SEQ ID NO: 76687 - DNA, 22 bp, Artificial Sequence
  chemically synthesized
gggttgtctcttcactttatta

SEQ ID NO: 76688 - DNA, 22 bp, Artificial Sequence
  chemically synthesized
ggttgtctcttcactttattat

SEQ ID NO: 76689 - DNA, 22 bp, Artificial Sequence
  chemically synthesized
tctcttcactttattattttct

SEQ ID NO: 76690 - DNA, 22 bp, Artificial Sequence
  chemically synthesized
ttcactttattattttctttgc

SEQ ID NO: 76691 - DNA, 22 bp, Artificial Sequence
  chemically synthesized
cactttattattttctttgctg

SEQ ID NO: 76692 - DNA, 22 bp, Artificial Sequence
  chemically synthesized
actttattattttctttgctgt

SEQ ID NO: 76693 - DNA, 22 bp, Artificial Sequence
  chemically synthesized
tattattttctttgctgtgcag

SEQ ID NO: 76694 - DNA, 22 bp, Artificial Sequence
  chemically synthesized
attattttctttgctgtgcaga

SEQ ID NO: 76695 - DNA, 22 bp, Artificial Sequence
  chemically synthesized
ttattttctttgctgtgcagag

SEQ ID NO: 76696 - DNA, 22 bp, Artificial Sequence
  chemically synthesized
ttttctttgctgtgcagagctt

SEQ ID NO: 76697 - DNA, 22 bp, Artificial Sequence
  chemically synthesized
tctttgctgtgcagagcttcaa

SEQ ID NO: 76698 - DNA, 22 bp, Artificial Sequence
  chemically synthesized
ctttgctgtgcagagcttcaaa

SEQ ID NO: 76699 - DNA, 22 bp, Artificial Sequence
  chemically synthesized
tttgctgtgcagagcttcaaac

SEQ ID NO: 76700 - DNA, 22 bp, Artificial Sequence
  chemically synthesized
tgctgtgcagagcttcaaacaa

SEQ ID NO: 76701 - DNA, 22 bp, Artificial Sequence
  chemically synthesized
gctgtgcagagcttcaaacaat

SEQ ID NO: 76702 - DNA, 22 bp, Artificial Sequence
  chemically synthesized
ctgtgcagagcttcaaacaatc

SEQ ID NO: 76703 - DNA, 22 bp, Artificial Sequence
  chemically synthesized
tgcagagcttcaaacaatccca

SEQ ID NO: 76704 - DNA, 22 bp, Artificial Sequence
  chemically synthesized
caaacaatcccaattgtctatt

SEQ ID NO: 76705 - DNA, 22 bp, Artificial Sequence
  chemically synthesized
aaacaatcccaattgtctattt

SEQ ID NO: 76706 - DNA, 22 bp, Artificial Sequence
  chemically synthesized
tctatttttgttttggttattt

SEQ ID NO: 76707 - DNA, 22 bp, Artificial Sequence
  chemically synthesized
tttttgttttggttatttgtgc

SEQ ID NO: 76708 - DNA, 22 bp, Artificial Sequence
  chemically synthesized
ttgttttggttatttgtgcttt

SEQ ID NO: 76709 - DNA, 22 bp, Artificial Sequence
  chemically synthesized
tgttttggttatttgtgctttt

SEQ ID NO: 76710 - DNA, 22 bp, Artificial Sequence
  chemically synthesized
gttttggttatttgtgcttttg

SEQ ID NO: 76711 - DNA, 22 bp, Artificial Sequence
  chemically synthesized
ttttggttatttgtgcttttga

SEQ ID NO: 76712 - DNA, 22 bp, Artificial Sequence
  chemically synthesized
tggttatttgtgcttttgaagt

SEQ ID NO: 76713 - DNA, 22 bp, Artificial Sequence
  chemically synthesized
ggttatttgtgcttttgaagtc

SEQ ID NO: 76714 - DNA, 22 bp, Artificial Sequence
  chemically synthesized
gttatttgtgcttttgaagtct

SEQ ID NO: 76715 - DNA, 22 bp, Artificial Sequence
  chemically synthesized
tttgtgcttttgaagtctcata

SEQ ID NO: 76716 - DNA, 22 bp, Artificial Sequence
  chemically synthesized
gtgcttttgaagtctcatagac

SEQ ID NO: 76717 - DNA, 22 bp, Artificial Sequence
  chemically synthesized
tgcttttgaagtctcatagaca

SEQ ID NO: 76718 - DNA, 22 bp, Artificial Sequence
  chemically synthesized
ttgaagtctcatagacagtatt

SEQ ID NO: 76719 - DNA, 22 bp, Artificial Sequence
  chemically synthesized
tgaagtctcatagacagtattt

SEQ ID NO: 76720 - DNA, 22 bp, Artificial Sequence
  chemically synthesized
gaagtctcatagacagtatttg

SEQ ID NO: 76721 - DNA, 22 bp, Artificial Sequence
  chemically synthesized
aagtctcatagacagtatttgc

SEQ ID NO: 76722 - DNA, 22 bp, Artificial Sequence
  chemically synthesized
atagacagtatttgcccaaatc

SEQ ID NO: 76723 - DNA, 22 bp, Artificial Sequence
  chemically synthesized
gcccaaatcaatgaatgccctg

SEQ ID NO: 76724 - DNA, 22 bp, Artificial Sequence
  chemically synthesized
cccaaatcaatgaatgccctgg

SEQ ID NO: 76725 - DNA, 22 bp, Artificial Sequence
  chemically synthesized
gagggtttccccactgttttct

SEQ ID NO: 76726 - DNA, 22 bp, Artificial Sequence
  chemically synthesized
ccccactgttttcttccagtag

SEQ ID NO: 76727 - DNA, 22 bp, Artificial Sequence
  chemically synthesized
cccactgttttcttccagtagt

SEQ ID NO: 76728 - DNA, 22 bp, Artificial Sequence
  chemically synthesized
ttttcttccagtagtttcataa

SEQ ID NO: 76729 - DNA, 22 bp, Artificial Sequence
  chemically synthesized
tcttccagtagtttcataattt

SEQ ID NO: 76730 - DNA, 22 bp, Artificial Sequence
  chemically synthesized
cttccagtagtttcataatttc

SEQ ID NO: 76731 - DNA, 22 bp, Artificial Sequence
  chemically synthesized
ttccagtagtttcataatttca

SEQ ID NO: 76732 - DNA, 22 bp, Artificial Sequence
  chemically synthesized
ccagtagtttcataatttcagg

SEQ ID NO: 76733 - DNA, 22 bp, Artificial Sequence
  chemically synthesized
cagtagtttcataatttcaggt

SEQ ID NO: 76734 - DNA, 22 bp, Artificial Sequence
  chemically synthesized
cataatttcaggtattggattc

SEQ ID NO: 76735 - DNA, 22 bp, Artificial Sequence
  chemically synthesized
ataatttcaggtattggattca

SEQ ID NO: 76736 - DNA, 22 bp, Artificial Sequence
  chemically synthesized
caggtattggattcaagtcttt

SEQ ID NO: 76737 - DNA, 22 bp, Artificial Sequence
  chemically synthesized
aggtattggattcaagtcttta

SEQ ID NO: 76738 - DNA, 22 bp, Artificial Sequence
  chemically synthesized
gattcaagtctttaatccatct

SEQ ID NO: 76739 - DNA, 22 bp, Artificial Sequence
  chemically synthesized
aagtctttaatccatcttgatt

SEQ ID NO: 76740 - DNA, 22 bp, Artificial Sequence
  chemically synthesized
taatccatcttgatttgatttt

SEQ ID NO: 76741 - DNA, 22 bp, Artificial Sequence
  chemically synthesized
aatccatcttgatttgattttt

SEQ ID NO: 76742 - DNA, 22 bp, Artificial Sequence
  chemically synthesized
atccatcttgatttgatttttg

SEQ ID NO: 76743 - DNA, 22 bp, Artificial Sequence
  chemically synthesized
gatttgatttttgtatatagtg

SEQ ID NO: 76744 - DNA, 22 bp, Artificial Sequence
  chemically synthesized
atttgatttttgtatatagtga

SEQ ID NO: 76745 - DNA, 22 bp, Artificial Sequence
  chemically synthesized
gatttttgtatatagtgagaga

SEQ ID NO: 76746 - DNA, 22 bp, Artificial Sequence
  chemically synthesized
atttttgtatatagtgagagat

SEQ ID NO: 76747 - DNA, 22 bp, Artificial Sequence
  chemically synthesized
ttgtatatagtgagagataggg

SEQ ID NO: 76748 - DNA, 22 bp, Artificial Sequence
  chemically synthesized
tgtatatagtgagagatagggg

SEQ ID NO: 76749 - DNA, 22 bp, Artificial Sequence
  chemically synthesized
gtatatagtgagagataggggt

SEQ ID NO: 76750 - DNA, 22 bp, Artificial Sequence
  chemically synthesized
tatatagtgagagataggggtc

SEQ ID NO: 76751 - DNA, 22 bp, Artificial Sequence
  chemically synthesized
tactcttttgcaaatggatatc

SEQ ID NO: 76752 - DNA, 22 bp, Artificial Sequence
  chemically synthesized
actcttttgcaaatggatatcc

SEQ ID NO: 76753 - DNA, 22 bp, Artificial Sequence
  chemically synthesized
ctcttttgcaaatggatatcca

SEQ ID NO: 76754 - DNA, 22 bp, Artificial Sequence
  chemically synthesized
ttttgcaaatggatatccagtt

SEQ ID NO: 76755 - DNA, 22 bp, Artificial Sequence
  chemically synthesized
ttgcaaatggatatccagtttt

SEQ ID NO: 76756 - DNA, 22 bp, Artificial Sequence
  chemically synthesized
tgcaaatggatatccagttttc

SEQ ID NO: 76757 - DNA, 22 bp, Artificial Sequence
  chemically synthesized
gcaaatggatatccagttttcc

SEQ ID NO: 76758 - DNA, 22 bp, Artificial Sequence
  chemically synthesized
caaatggatatccagttttcct

SEQ ID NO: 76759 - DNA, 22 bp, Artificial Sequence
  chemically synthesized
tcctagcactgtttcttgaaaa

SEQ ID NO: 76760 - DNA, 22 bp, Artificial Sequence
  chemically synthesized
cctagcactgtttcttgaaaag

SEQ ID NO: 76761 - DNA, 22 bp, Artificial Sequence
  chemically synthesized
ctagcactgtttcttgaaaaga

SEQ ID NO: 76762 - DNA, 22 bp, Artificial Sequence
  chemically synthesized
gcactgtttcttgaaaagactg

SEQ ID NO: 76763 - DNA, 22 bp, Artificial Sequence
  chemically synthesized
tttcttgaaaagactgtttgta

SEQ ID NO: 76764 - DNA, 22 bp, Artificial Sequence
  chemically synthesized
cttgaaaagactgtttgtacct

SEQ ID NO: 76765 - DNA, 22 bp, Artificial Sequence
  chemically synthesized
ttgaaaagactgtttgtacctt

SEQ ID NO: 76766 - DNA, 22 bp, Artificial Sequence
  chemically synthesized
gaaaagactgtttgtacctttt

SEQ ID NO: 76767 - DNA, 22 bp, Artificial Sequence
  chemically synthesized
aaaagactgtttgtaccttttt

SEQ ID NO: 76768 - DNA, 22 bp, Artificial Sequence
  chemically synthesized
tttgtacctttttttttttttt

SEQ ID NO: 76769 - DNA, 22 bp, Artificial Sequence
  chemically synthesized
gtaccttttttttttttttttt

SEQ ID NO: 76770 - DNA, 22 bp, Artificial Sequence
  chemically synthesized
tacctttttttttttttttttt

SEQ ID NO: 76771 - DNA, 22 bp, Artificial Sequence
  chemically synthesized
ttttttttttttttttgagatg

SEQ ID NO: 76772 - DNA, 22 bp, Artificial Sequence
  chemically synthesized
tttttttttttttttgagatgg

SEQ ID NO: 76773 - DNA, 22 bp, Artificial Sequence
  chemically synthesized
ttttttttttttttgagatgga

SEQ ID NO: 76774 - DNA, 22 bp, Artificial Sequence
  chemically synthesized
tttttttttttttgagatggag

SEQ ID NO: 76775 - DNA, 22 bp, Artificial Sequence
  chemically synthesized
ttttttttttttgagatggagt

SEQ ID NO: 76776 - DNA, 22 bp, Artificial Sequence
  chemically synthesized
tttttttttttgagatggagtc

SEQ ID NO: 76777 - DNA, 22 bp, Artificial Sequence
  chemically synthesized
ttttttttttgagatggagtct

SEQ ID NO: 76778 - DNA, 22 bp, Artificial Sequence
  chemically synthesized
tttttttttgagatggagtctc

SEQ ID NO: 76779 - DNA, 22 bp, Artificial Sequence
  chemically synthesized
ttttttttgagatggagtctca

SEQ ID NO: 76780 - DNA, 22 bp, Artificial Sequence
  chemically synthesized
tttttttgagatggagtctcac

SEQ ID NO: 76781 - DNA, 22 bp, Artificial Sequence
  chemically synthesized
ttttttgagatggagtctcact

SEQ ID NO: 76782 - DNA, 22 bp, Artificial Sequence
  chemically synthesized
tttttgagatggagtctcactg

SEQ ID NO: 76783 - DNA, 22 bp, Artificial Sequence
  chemically synthesized
ttttgagatggagtctcactgt

SEQ ID NO: 76784 - DNA, 22 bp, Artificial Sequence
  chemically synthesized
tttgagatggagtctcactgtt

SEQ ID NO: 76785 - DNA, 22 bp, Artificial Sequence
  chemically synthesized
ttgagatggagtctcactgttg

SEQ ID NO: 76786 - DNA, 22 bp, Artificial Sequence
  chemically synthesized
tgagatggagtctcactgttgc

SEQ ID NO: 76787 - DNA, 22 bp, Artificial Sequence
  chemically synthesized
gagatggagtctcactgttgcc

SEQ ID NO: 76788 - DNA, 22 bp, Artificial Sequence
  chemically synthesized
agatggagtctcactgttgccc

SEQ ID NO: 76789 - DNA, 22 bp, Artificial Sequence
  chemically synthesized
actgttgcccaggctggagtgc

SEQ ID NO: 76790 - DNA, 22 bp, Artificial Sequence
  chemically synthesized
ttgcccaggctggagtgcagtg

SEQ ID NO: 76791 - DNA, 22 bp, Artificial Sequence
  chemically synthesized
cccaggctggagtgcagtggca

SEQ ID NO: 76792 - DNA, 22 bp, Artificial Sequence
  chemically synthesized
gagtgcagtggcagcacaatct

SEQ ID NO: 76793 - DNA, 22 bp, Artificial Sequence
  chemically synthesized
ggatcactgcaacttctgcctc

SEQ ID NO: 76794 - DNA, 22 bp, Artificial Sequence
  chemically synthesized
gatcactgcaacttctgcctcc

SEQ ID NO: 76795 - DNA, 22 bp, Artificial Sequence
  chemically synthesized
caacttctgcctcccaggttca

SEQ ID NO: 76796 - DNA, 22 bp, Artificial Sequence
  chemically synthesized
ctgcctcccaggttcaagcgat

SEQ ID NO: 76797 - DNA, 22 bp, Artificial Sequence
  chemically synthesized
tgcctcccaggttcaagcgatt

SEQ ID NO: 76798 - DNA, 22 bp, Artificial Sequence
  chemically synthesized
cctcccaggttcaagcgattct

SEQ ID NO: 76799 - DNA, 22 bp, Artificial Sequence
  chemically synthesized
ccaggttcaagcgattctcctg

SEQ ID NO: 76800 - DNA, 22 bp, Artificial Sequence
  chemically synthesized
aagcgattctcctgcctcagcc

SEQ ID NO: 76801 - DNA, 22 bp, Artificial Sequence
  chemically synthesized
tcctgcctcagcctcctgagta

SEQ ID NO: 76802 - DNA, 22 bp, Artificial Sequence
  chemically synthesized
ctgcctcagcctcctgagtatc

SEQ ID NO: 76803 - DNA, 22 bp, Artificial Sequence
  chemically synthesized
cctcagcctcctgagtatctgg

SEQ ID NO: 76804 - DNA, 22 bp, Artificial Sequence
  chemically synthesized
agcctcctgagtatctgggatt

SEQ ID NO: 76805 - DNA, 22 bp, Artificial Sequence
  chemically synthesized
ctgagtatctgggattacagga

SEQ ID NO: 76806 - DNA, 22 bp, Artificial Sequence
  chemically synthesized
agtatctgggattacaggagcg

SEQ ID NO: 76807 - DNA, 22 bp, Artificial Sequence
  chemically synthesized
ggattacaggagcgccccacca

SEQ ID NO: 76808 - DNA, 22 bp, Artificial Sequence
  chemically synthesized
caggagcgccccaccatgcctg

SEQ ID NO: 76809 - DNA, 22 bp, Artificial Sequence
  chemically synthesized
gctaatttttgtatttttagta

SEQ ID NO: 76810 - DNA, 22 bp, Artificial Sequence
  chemically synthesized
atttttgtatttttagtagaga

SEQ ID NO: 76811 - DNA, 22 bp, Artificial Sequence
  chemically synthesized
ttgtatttttagtagagacgga

SEQ ID NO: 76812 - DNA, 22 bp, Artificial Sequence
  chemically synthesized
tgtatttttagtagagacggag

SEQ ID NO: 76813 - DNA, 22 bp, Artificial Sequence
  chemically synthesized
gtatttttagtagagacggagt

SEQ ID NO: 76814 - DNA, 22 bp, Artificial Sequence
  chemically synthesized
tatttttagtagagacggagtg

SEQ ID NO: 76815 - DNA, 22 bp, Artificial Sequence
  chemically synthesized
ttagtagagacggagtgtcacc

SEQ ID NO: 76816 - DNA, 22 bp, Artificial Sequence
  chemically synthesized
tagtagagacggagtgtcacca

SEQ ID NO: 76817 - DNA, 22 bp, Artificial Sequence
  chemically synthesized
agtagagacggagtgtcaccac

SEQ ID NO: 76818 - DNA, 22 bp, Artificial Sequence
  chemically synthesized
gtagagacggagtgtcaccacg

SEQ ID NO: 76819 - DNA, 22 bp, Artificial Sequence
  chemically synthesized
gtcaggctggtcttgaactcct

SEQ ID NO: 76820 - DNA, 22 bp, Artificial Sequence
  chemically synthesized
gtcttgaactcctgacctcgtg

SEQ ID NO: 76821 - DNA, 22 bp, Artificial Sequence
  chemically synthesized
gaactcctgacctcgtgatccc

SEQ ID NO: 76822 - DNA, 22 bp, Artificial Sequence
  chemically synthesized
aactcctgacctcgtgatcccc

SEQ ID NO: 76823 - DNA, 22 bp, Artificial Sequence
  chemically synthesized
ctgacctcgtgatccccccacc

SEQ ID NO: 76824 - DNA, 22 bp, Artificial Sequence
  chemically synthesized
acctcgtgatccccccacctca

SEQ ID NO: 76825 - DNA, 22 bp, Artificial Sequence
  chemically synthesized
gtgatccccccacctcagcctc

SEQ ID NO: 76826 - DNA, 22 bp, Artificial Sequence
  chemically synthesized
agcctcacaaagtgctgggatt

SEQ ID NO: 76827 - DNA, 22 bp, Artificial Sequence
  chemically synthesized
acaaagtgctgggattacaggt

SEQ ID NO: 76828 - DNA, 22 bp, Artificial Sequence
  chemically synthesized
ggattacaggtgtgagccactg

SEQ ID NO: 76829 - DNA, 22 bp, Artificial Sequence
  chemically synthesized
caggtgtgagccactgcacctg

SEQ ID NO: 76830 - DNA, 22 bp, Artificial Sequence
  chemically synthesized
cacctggcccatttgttcctat

SEQ ID NO: 76831 - DNA, 22 bp, Artificial Sequence
  chemically synthesized
gcccatttgttcctatttttat

SEQ ID NO: 76832 - DNA, 22 bp, Artificial Sequence
  chemically synthesized
gttcctatttttatgttcttga

SEQ ID NO: 76833 - DNA, 22 bp, Artificial Sequence
  chemically synthesized
ttcctatttttatgttcttgat

SEQ ID NO: 76834 - DNA, 22 bp, Artificial Sequence
  chemically synthesized
ctatttttatgttcttgatgcc

SEQ ID NO: 76835 - DNA, 22 bp, Artificial Sequence
  chemically synthesized
tttttatgttcttgatgccttt

SEQ ID NO: 76836 - DNA, 22 bp, Artificial Sequence
  chemically synthesized
ttatgttcttgatgcctttgtt

SEQ ID NO: 76837 - DNA, 22 bp, Artificial Sequence
  chemically synthesized
tatgttcttgatgcctttgtta

SEQ ID NO: 76838 - DNA, 22 bp, Artificial Sequence
  chemically synthesized
atgttcttgatgcctttgttaa

SEQ ID NO: 76839 - DNA, 22 bp, Artificial Sequence
  chemically synthesized
tgttcttgatgcctttgttaaa

SEQ ID NO: 76840 - DNA, 22 bp, Artificial Sequence
  chemically synthesized
ttgatgcctttgttaaagatga

SEQ ID NO: 76841 - DNA, 22 bp, Artificial Sequence
  chemically synthesized
gatgcctttgttaaagatgact

SEQ ID NO: 76842 - DNA, 22 bp, Artificial Sequence
  chemically synthesized
atgcctttgttaaagatgactt

SEQ ID NO: 76843 - DNA, 22 bp, Artificial Sequence
  chemically synthesized
tgttaaagatgacttggttgtt

SEQ ID NO: 76844 - DNA, 22 bp, Artificial Sequence
  chemically synthesized
gttaaagatgacttggttgtta

SEQ ID NO: 76845 - DNA, 22 bp, Artificial Sequence
  chemically synthesized
ttaaagatgacttggttgttaa

SEQ ID NO: 76846 - DNA, 22 bp, Artificial Sequence
  chemically synthesized
aagatgacttggttgttaagtg

SEQ ID NO: 76847 - DNA, 22 bp, Artificial Sequence
  chemically synthesized
ggttgttaagtgcctggatttg

SEQ ID NO: 76848 - DNA, 22 bp, Artificial Sequence
  chemically synthesized
gttgttaagtgcctggatttgc

SEQ ID NO: 76849 - DNA, 22 bp, Artificial Sequence
  chemically synthesized
ttaagtgcctggatttgcatct

SEQ ID NO: 76850 - DNA, 22 bp, Artificial Sequence
  chemically synthesized
agtgcctggatttgcatctggg

SEQ ID NO: 76851 - DNA, 22 bp, Artificial Sequence
  chemically synthesized
gatttgcatctgggttctctat

SEQ ID NO: 76852 - DNA, 22 bp, Artificial Sequence
  chemically synthesized
gcatctgggttctctatgctgt

SEQ ID NO: 76853 - DNA, 22 bp, Artificial Sequence
  chemically synthesized
catctgggttctctatgctgtt

SEQ ID NO: 76854 - DNA, 22 bp, Artificial Sequence
  chemically synthesized
ggttctctatgctgttccattg

SEQ ID NO: 76855 - DNA, 22 bp, Artificial Sequence
  chemically synthesized
tctatgctgttccattgggctg

SEQ ID NO: 76856 - DNA, 22 bp, Artificial Sequence
  chemically synthesized
tatgctgttccattgggctgta

SEQ ID NO: 76857 - DNA, 22 bp, Artificial Sequence
  chemically synthesized
tgctgttccattgggctgtatg

SEQ ID NO: 76858 - DNA, 22 bp, Artificial Sequence
  chemically synthesized
ttccattgggctgtatgtctgt

SEQ ID NO: 76859 - DNA, 22 bp, Artificial Sequence
  chemically synthesized
cattgggctgtatgtctgtctt

SEQ ID NO: 76860 - DNA, 22 bp, Artificial Sequence
  chemically synthesized
ggctgtatgtctgtctttatgc

SEQ ID NO: 76861 - DNA, 22 bp, Artificial Sequence
  chemically synthesized
tatgtctgtctttatgcagtac

SEQ ID NO: 76862 - DNA, 22 bp, Artificial Sequence
  chemically synthesized
tctttatgcagtactgtgctgt

SEQ ID NO: 76863 - DNA, 22 bp, Artificial Sequence
  chemically synthesized
tatgcagtactgtgctgtttgg

SEQ ID NO: 76864 - DNA, 22 bp, Artificial Sequence
  chemically synthesized
atgcagtactgtgctgtttggc

SEQ ID NO: 76865 - DNA, 22 bp, Artificial Sequence
  chemically synthesized
tgcagtactgtgctgtttggct

SEQ ID NO: 76866 - DNA, 22 bp, Artificial Sequence
  chemically synthesized
tgctgtttggctactgtagctt

SEQ ID NO: 76867 - DNA, 22 bp, Artificial Sequence
  chemically synthesized
tttggctactgtagctttgtag

SEQ ID NO: 76868 - DNA, 22 bp, Artificial Sequence
  chemically synthesized
ggctactgtagctttgtagtag

SEQ ID NO: 76869 - DNA, 22 bp, Artificial Sequence
  chemically synthesized
gctactgtagctttgtagtaga

SEQ ID NO: 76870 - DNA, 22 bp, Artificial Sequence
  chemically synthesized
ctgtagctttgtagtagatttt

SEQ ID NO: 76871 - DNA, 22 bp, Artificial Sequence
  chemically synthesized
tagctttgtagtagattttgaa

SEQ ID NO: 76872 - DNA, 22 bp, Artificial Sequence
  chemically synthesized
tgtagtagattttgaagtcata

SEQ ID NO: 76873 - DNA, 22 bp, Artificial Sequence
  chemically synthesized
gtagtagattttgaagtcatat

SEQ ID NO: 76874 - DNA, 22 bp, Artificial Sequence
  chemically synthesized
tagtagattttgaagtcatata

SEQ ID NO: 76875 - DNA, 22 bp, Artificial Sequence
  chemically synthesized
tgaagtcatatagtgtgatagc

SEQ ID NO: 76876 - DNA, 22 bp, Artificial Sequence
  chemically synthesized
gaagtcatatagtgtgatagct

SEQ ID NO: 76877 - DNA, 22 bp, Artificial Sequence
  chemically synthesized
aagtcatatagtgtgatagctt

SEQ ID NO: 76878 - DNA, 22 bp, Artificial Sequence
  chemically synthesized
tggttttgttctttttgctcag

SEQ ID NO: 76879 - DNA, 22 bp, Artificial Sequence
  chemically synthesized
ggttttgttctttttgctcagg

SEQ ID NO: 76880 - DNA, 22 bp, Artificial Sequence
  chemically synthesized
gttttgttctttttgctcagga

SEQ ID NO: 76881 - DNA, 22 bp, Artificial Sequence
  chemically synthesized
tgttctttttgctcaggattgc

SEQ ID NO: 76882 - DNA, 22 bp, Artificial Sequence
  chemically synthesized
gttctttttgctcaggattgct

SEQ ID NO: 76883 - DNA, 22 bp, Artificial Sequence
  chemically synthesized
ttctttttgctcaggattgctt

SEQ ID NO: 76884 - DNA, 22 bp, Artificial Sequence
  chemically synthesized
tttttgctcaggattgctttag

SEQ ID NO: 76885 - DNA, 22 bp, Artificial Sequence
  chemically synthesized
tttgctcaggattgctttagct

SEQ ID NO: 76886 - DNA, 22 bp, Artificial Sequence
  chemically synthesized
ttgctcaggattgctttagcta

SEQ ID NO: 76887 - DNA, 22 bp, Artificial Sequence
  chemically synthesized
tgctcaggattgctttagctat

SEQ ID NO: 76888 - DNA, 22 bp, Artificial Sequence
  chemically synthesized
gctcaggattgctttagctatt

SEQ ID NO: 76889 - DNA, 22 bp, Artificial Sequence
  chemically synthesized
ctcaggattgctttagctattg

SEQ ID NO: 76890 - DNA, 22 bp, Artificial Sequence
  chemically synthesized
aggattgctttagctattgggg

SEQ ID NO: 76891 - DNA, 22 bp, Artificial Sequence
  chemically synthesized
ctttagctattggggatctttt

SEQ ID NO: 76892 - DNA, 22 bp, Artificial Sequence
  chemically synthesized
tagctattggggatcttttgtg

SEQ ID NO: 76893 - DNA, 22 bp, Artificial Sequence
  chemically synthesized
agctattggggatcttttgtgg

SEQ ID NO: 76894 - DNA, 22 bp, Artificial Sequence
  chemically synthesized
gctattggggatcttttgtggt

SEQ ID NO: 76895 - DNA, 22 bp, Artificial Sequence
  chemically synthesized
ttggggatcttttgtggttcca

SEQ ID NO: 76896 - DNA, 22 bp, Artificial Sequence
  chemically synthesized
gggatcttttgtggttccatat

SEQ ID NO: 76897 - DNA, 22 bp, Artificial Sequence
  chemically synthesized
ttgtggttccatataaatatta

SEQ ID NO: 76898 - DNA, 22 bp, Artificial Sequence
  chemically synthesized
tgtggttccatataaatattag

SEQ ID NO: 76899 - DNA, 22 bp, Artificial Sequence
  chemically synthesized
gtggttccatataaatattagg

SEQ ID NO: 76900 - DNA, 22 bp, Artificial Sequence
  chemically synthesized
tggttccatataaatattagga

SEQ ID NO: 76901 - DNA, 22 bp, Artificial Sequence
  chemically synthesized
catataaatattaggattgttt

SEQ ID NO: 76902 - DNA, 22 bp, Artificial Sequence
  chemically synthesized
ggattgtttttctatttctgtg

SEQ ID NO: 76903 - DNA, 22 bp, Artificial Sequence
  chemically synthesized
tttttctatttctgtgaatgcc

SEQ ID NO: 76904 - DNA, 22 bp, Artificial Sequence
  chemically synthesized
ttctatttctgtgaatgccatt

SEQ ID NO: 76905 - DNA, 22 bp, Artificial Sequence
  chemically synthesized
tctatttctgtgaatgccattg

SEQ ID NO: 76906 - DNA, 22 bp, Artificial Sequence
  chemically synthesized
ctatttctgtgaatgccattgg

SEQ ID NO: 76907 - DNA, 22 bp, Artificial Sequence
  chemically synthesized
tatttctgtgaatgccattggt

SEQ ID NO: 76908 - DNA, 22 bp, Artificial Sequence
  chemically synthesized
tttctgtgaatgccattggtat

SEQ ID NO: 76909 - DNA, 22 bp, Artificial Sequence
  chemically synthesized
ctgtgaatgccattggtatttt

SEQ ID NO: 76910 - DNA, 22 bp, Artificial Sequence
  chemically synthesized
tgtgaatgccattggtattttg

SEQ ID NO: 76911 - DNA, 22 bp, Artificial Sequence
  chemically synthesized
tgaatgccattggtattttgac

SEQ ID NO: 76912 - DNA, 22 bp, Artificial Sequence
  chemically synthesized
gtattttgacagaaattgcact

SEQ ID NO: 76913 - DNA, 22 bp, Artificial Sequence
  chemically synthesized
tgacagaaattgcactgaatct

SEQ ID NO: 76914 - DNA, 22 bp, Artificial Sequence
  chemically synthesized
gacagaaattgcactgaatctg

SEQ ID NO: 76915 - DNA, 22 bp, Artificial Sequence
  chemically synthesized
acagaaattgcactgaatctgt

SEQ ID NO: 76916 - DNA, 22 bp, Artificial Sequence
  chemically synthesized
cactgaatctgtacattgcttt

SEQ ID NO: 76917 - DNA, 22 bp, Artificial Sequence
  chemically synthesized
aatctgtacattgctttgggta

SEQ ID NO: 76918 - DNA, 22 bp, Artificial Sequence
  chemically synthesized
tacattgctttgggtagtattg

SEQ ID NO: 76919 - DNA, 22 bp, Artificial Sequence
  chemically synthesized
ctttgggtagtattgtcatttt

SEQ ID NO: 76920 - DNA, 22 bp, Artificial Sequence
  chemically synthesized
tgggtagtattgtcattttaat

SEQ ID NO: 76921 - DNA, 22 bp, Artificial Sequence
  chemically synthesized
gggtagtattgtcattttaata

SEQ ID NO: 76922 - DNA, 22 bp, Artificial Sequence
  chemically synthesized
ggtagtattgtcattttaatat

SEQ ID NO: 76923 - DNA, 22 bp, Artificial Sequence
  chemically synthesized
tcattttaatattaattcttct

SEQ ID NO: 76924 - DNA, 22 bp, Artificial Sequence
  chemically synthesized
taatattaattcttctagttca

SEQ ID NO: 76925 - DNA, 22 bp, Artificial Sequence
  chemically synthesized
aatattaattcttctagttcat

SEQ ID NO: 76926 - DNA, 22 bp, Artificial Sequence
  chemically synthesized
atattaattcttctagttcatg

SEQ ID NO: 76927 - DNA, 22 bp, Artificial Sequence
  chemically synthesized
attcttctagttcatgagcatg

SEQ ID NO: 76928 - DNA, 22 bp, Artificial Sequence
  chemically synthesized
ttctagttcatgagcatggaat

SEQ ID NO: 76929 - DNA, 22 bp, Artificial Sequence
  chemically synthesized
ctagttcatgagcatggaatat

SEQ ID NO: 76930 - DNA, 22 bp, Artificial Sequence
  chemically synthesized
tagttcatgagcatggaatatc

SEQ ID NO: 76931 - DNA, 22 bp, Artificial Sequence
  chemically synthesized
gttcatgagcatggaatatcgt

SEQ ID NO: 76932 - DNA, 22 bp, Artificial Sequence
  chemically synthesized
atgagcatggaatatcgttcca

SEQ ID NO: 76933 - DNA, 22 bp, Artificial Sequence
  chemically synthesized
cattttatttgtgtgccctctt

SEQ ID NO: 76934 - DNA, 22 bp, Artificial Sequence
  chemically synthesized
tatttgtgtgccctcttctatt

SEQ ID NO: 76935 - DNA, 22 bp, Artificial Sequence
  chemically synthesized
atttgtgtgccctcttctattt

SEQ ID NO: 76936 - DNA, 22 bp, Artificial Sequence
  chemically synthesized
tttgtgtgccctcttctatttc

SEQ ID NO: 76937 - DNA, 22 bp, Artificial Sequence
  chemically synthesized
gtgtgccctcttctatttcttt

SEQ ID NO: 76938 - DNA, 22 bp, Artificial Sequence
  chemically synthesized
tgtgccctcttctatttctttc

SEQ ID NO: 76939 - DNA, 22 bp, Artificial Sequence
  chemically synthesized
ttctatttctttcaccagagtt

SEQ ID NO: 76940 - DNA, 22 bp, Artificial Sequence
  chemically synthesized
ctatttctttcaccagagtttt

SEQ ID NO: 76941 - DNA, 22 bp, Artificial Sequence
  chemically synthesized
tatttctttcaccagagtttta

SEQ ID NO: 76942 - DNA, 22 bp, Artificial Sequence
  chemically synthesized
tttctttcaccagagttttata

SEQ ID NO: 76943 - DNA, 22 bp, Artificial Sequence
  chemically synthesized
ctttcaccagagttttataatt

SEQ ID NO: 76944 - DNA, 22 bp, Artificial Sequence
  chemically synthesized
tttcaccagagttttataattt

SEQ ID NO: 76945 - DNA, 22 bp, Artificial Sequence
  chemically synthesized
tcaccagagttttataattttt

SEQ ID NO: 76946 - DNA, 22 bp, Artificial Sequence
  chemically synthesized
caccagagttttataatttttc

SEQ ID NO: 76947 - DNA, 22 bp, Artificial Sequence
  chemically synthesized
accagagttttataatttttct

SEQ ID NO: 76948 - DNA, 22 bp, Artificial Sequence
  chemically synthesized
tataatttttcttatagagatc

SEQ ID NO: 76949 - DNA, 22 bp, Artificial Sequence
  chemically synthesized
ataatttttcttatagagatct

SEQ ID NO: 76950 - DNA, 22 bp, Artificial Sequence
  chemically synthesized
taatttttcttatagagatctt

SEQ ID NO: 76951 - DNA, 22 bp, Artificial Sequence
  chemically synthesized
ttcttatagagatcttttactt

SEQ ID NO: 76952 - DNA, 22 bp, Artificial Sequence
  chemically synthesized
tcttatagagatcttttacttc

SEQ ID NO: 76953 - DNA, 22 bp, Artificial Sequence
  chemically synthesized
cttatagagatcttttacttct

SEQ ID NO: 76954 - DNA, 22 bp, Artificial Sequence
  chemically synthesized
ttatagagatcttttacttctt

SEQ ID NO: 76955 - DNA, 22 bp, Artificial Sequence
  chemically synthesized
atagagatcttttacttcttgg

SEQ ID NO: 76956 - DNA, 22 bp, Artificial Sequence
  chemically synthesized
tagagatcttttacttcttggg

SEQ ID NO: 76957 - DNA, 22 bp, Artificial Sequence
  chemically synthesized
ttacttcttgggttagattgac

SEQ ID NO: 76958 - DNA, 22 bp, Artificial Sequence
  chemically synthesized
tacttcttgggttagattgact

SEQ ID NO: 76959 - DNA, 22 bp, Artificial Sequence
  chemically synthesized
acttcttgggttagattgactc

SEQ ID NO: 76960 - DNA, 22 bp, Artificial Sequence
  chemically synthesized
cttcttgggttagattgactcc

SEQ ID NO: 76961 - DNA, 22 bp, Artificial Sequence
  chemically synthesized
cttgggttagattgactcctgg

SEQ ID NO: 76962 - DNA, 22 bp, Artificial Sequence
  chemically synthesized
ttgggttagattgactcctggg

SEQ ID NO: 76963 - DNA, 22 bp, Artificial Sequence
  chemically synthesized
gggttagattgactcctgggta

SEQ ID NO: 76964 - DNA, 22 bp, Artificial Sequence
  chemically synthesized
ggttagattgactcctgggtat

SEQ ID NO: 76965 - DNA, 22 bp, Artificial Sequence
  chemically synthesized
gattgactcctgggtattttat

SEQ ID NO: 76966 - DNA, 22 bp, Artificial Sequence
  chemically synthesized
actcctgggtattttatatttt

SEQ ID NO: 76967 - DNA, 22 bp, Artificial Sequence
  chemically synthesized
ctgggtattttatatttttatt

SEQ ID NO: 76968 - DNA, 22 bp, Artificial Sequence
  chemically synthesized
ggtattttatatttttattgct

SEQ ID NO: 76969 - DNA, 22 bp, Artificial Sequence
  chemically synthesized
tatatttttattgctattgtaa

SEQ ID NO: 76970 - DNA, 22 bp, Artificial Sequence
  chemically synthesized
atatttttattgctattgtaaa

SEQ ID NO: 76971 - DNA, 22 bp, Artificial Sequence
  chemically synthesized
tatttttattgctattgtaaat

SEQ ID NO: 76972 - DNA, 22 bp, Artificial Sequence
  chemically synthesized
ttattgctattgtaaataagat

SEQ ID NO: 76973 - DNA, 22 bp, Artificial Sequence
  chemically synthesized
tattgctattgtaaataagatt

SEQ ID NO: 76974 - DNA, 22 bp, Artificial Sequence
  chemically synthesized
attgctattgtaaataagattg

SEQ ID NO: 76975 - DNA, 22 bp, Artificial Sequence
  chemically synthesized
ttgctattgtaaataagattgt

SEQ ID NO: 76976 - DNA, 22 bp, Artificial Sequence
  chemically synthesized
ctattgtaaataagattgtttt

SEQ ID NO: 76977 - DNA, 22 bp, Artificial Sequence
  chemically synthesized
ttgtaaataagattgttttatt

SEQ ID NO: 76978 - DNA, 22 bp, Artificial Sequence
  chemically synthesized
taaataagattgttttattgat

SEQ ID NO: 76979 - DNA, 22 bp, Artificial Sequence
  chemically synthesized
ttttattgattttttttgcaga

SEQ ID NO: 76980 - DNA, 22 bp, Artificial Sequence
  chemically synthesized
tattgattttttttgcagattg

SEQ ID NO: 76981 - DNA, 22 bp, Artificial Sequence
  chemically synthesized
attgattttttttgcagattga

SEQ ID NO: 76982 - DNA, 22 bp, Artificial Sequence
  chemically synthesized
ttgattttttttgcagattgat

SEQ ID NO: 76983 - DNA, 22 bp, Artificial Sequence
  chemically synthesized
attttttttgcagattgataac

SEQ ID NO: 76984 - DNA, 22 bp, Artificial Sequence
  chemically synthesized
tttttgcagattgataactttt

SEQ ID NO: 76985 - DNA, 22 bp, Artificial Sequence
  chemically synthesized
ttttgcagattgataacttttt

SEQ ID NO: 76986 - DNA, 22 bp, Artificial Sequence
  chemically synthesized
tttgcagattgataacttttta

SEQ ID NO: 76987 - DNA, 22 bp, Artificial Sequence
  chemically synthesized
ttgcagattgataactttttat

SEQ ID NO: 76988 - DNA, 22 bp, Artificial Sequence
  chemically synthesized
tgcagattgataactttttata

SEQ ID NO: 76989 - DNA, 22 bp, Artificial Sequence
  chemically synthesized
gcagattgataactttttatat

SEQ ID NO: 76990 - DNA, 22 bp, Artificial Sequence
  chemically synthesized
cagattgataactttttatata

SEQ ID NO: 76991 - DNA, 22 bp, Artificial Sequence
  chemically synthesized
ataactttttatatatgaaatg

SEQ ID NO: 76992 - DNA, 22 bp, Artificial Sequence
  chemically synthesized
tttatatatgaaatgctactga

SEQ ID NO: 76993 - DNA, 22 bp, Artificial Sequence
  chemically synthesized
ttatatatgaaatgctactgat

SEQ ID NO: 76994 - DNA, 22 bp, Artificial Sequence
  chemically synthesized
tatatatgaaatgctactgatt

SEQ ID NO: 76995 - DNA, 22 bp, Artificial Sequence
  chemically synthesized
atatatgaaatgctactgattt

SEQ ID NO: 76996 - DNA, 22 bp, Artificial Sequence
  chemically synthesized
tatatgaaatgctactgatttt

SEQ ID NO: 76997 - DNA, 22 bp, Artificial Sequence
  chemically synthesized
ctgattttgtatttttatttca

SEQ ID NO: 76998 - DNA, 22 bp, Artificial Sequence
  chemically synthesized
attttgtatttttatttcatat

SEQ ID NO: 76999 - DNA, 22 bp, Artificial Sequence
  chemically synthesized
tgtatttttatttcatatcctg

SEQ ID NO: 77000 - DNA, 22 bp, Artificial Sequence
  chemically synthesized
gtatttttatttcatatcctgt

SEQ ID NO: 77001 - DNA, 22 bp, Artificial Sequence
  chemically synthesized
tatttttatttcatatcctgta

SEQ ID NO: 77002 - DNA, 22 bp, Artificial Sequence
  chemically synthesized
ttatttcatatcctgtaacttt

SEQ ID NO: 77003 - DNA, 22 bp, Artificial Sequence
  chemically synthesized
tatttcatatcctgtaacttta

SEQ ID NO: 77004 - DNA, 22 bp, Artificial Sequence
  chemically synthesized
atttcatatcctgtaactttat

SEQ ID NO: 77005 - DNA, 22 bp, Artificial Sequence
  chemically synthesized
tttcatatcctgtaactttatt

SEQ ID NO: 77006 - DNA, 22 bp, Artificial Sequence
  chemically synthesized
catatcctgtaactttattgat

SEQ ID NO: 77007 - DNA, 22 bp, Artificial Sequence
  chemically synthesized
atatcctgtaactttattgatt

SEQ ID NO: 77008 - DNA, 22 bp, Artificial Sequence
  chemically synthesized
taactttattgatttttttaaa

SEQ ID NO: 77009 - DNA, 22 bp, Artificial Sequence
  chemically synthesized
tattgatttttttaaatcgttt

SEQ ID NO: 77010 - DNA, 22 bp, Artificial Sequence
  chemically synthesized
attgatttttttaaatcgtttt

SEQ ID NO: 77011 - DNA, 22 bp, Artificial Sequence
  chemically synthesized
ttgatttttttaaatcgtttta

SEQ ID NO: 77012 - DNA, 22 bp, Artificial Sequence
  chemically synthesized
atttttttaaatcgttttaata

SEQ ID NO: 77013 - DNA, 22 bp, Artificial Sequence
  chemically synthesized
ttttaaatcgttttaatagtat

SEQ ID NO: 77014 - DNA, 22 bp, Artificial Sequence
  chemically synthesized
tttaaatcgttttaatagtatt

SEQ ID NO: 77015 - DNA, 22 bp, Artificial Sequence
  chemically synthesized
ttaaatcgttttaatagtattt

SEQ ID NO: 77016 - DNA, 22 bp, Artificial Sequence
  chemically synthesized
taaatcgttttaatagtattta

SEQ ID NO: 77017 - DNA, 22 bp, Artificial Sequence
  chemically synthesized
aaatcgttttaatagtatttag

SEQ ID NO: 77018 - DNA, 22 bp, Artificial Sequence
  chemically synthesized
aatcgttttaatagtatttagt

SEQ ID NO: 77019 - DNA, 22 bp, Artificial Sequence
  chemically synthesized
taatagtatttagtgaagtttt

SEQ ID NO: 77020 - DNA, 22 bp, Artificial Sequence
  chemically synthesized
aatagtatttagtgaagttttt

SEQ ID NO: 77021 - DNA, 22 bp, Artificial Sequence
  chemically synthesized
atagtatttagtgaagttttta

SEQ ID NO: 77022 - DNA, 22 bp, Artificial Sequence
  chemically synthesized
agtgaagtttttaggttttttc

SEQ ID NO: 77023 - DNA, 22 bp, Artificial Sequence
  chemically synthesized
gtgaagtttttaggttttttct

SEQ ID NO: 77024 - DNA, 22 bp, Artificial Sequence
  chemically synthesized
ttaggttttttctaagtataag

SEQ ID NO: 77025 - DNA, 22 bp, Artificial Sequence
  chemically synthesized
taggttttttctaagtataaga

SEQ ID NO: 77026 - DNA, 22 bp, Artificial Sequence
  chemically synthesized
aggttttttctaagtataagat

SEQ ID NO: 77027 - DNA, 22 bp, Artificial Sequence
  chemically synthesized
ggttttttctaagtataagatc

SEQ ID NO: 77028 - DNA, 22 bp, Artificial Sequence
  chemically synthesized
tttctaagtataagatcatgtc

SEQ ID NO: 77029 - DNA, 22 bp, Artificial Sequence
  chemically synthesized
ttctaagtataagatcatgtca

SEQ ID NO: 77030 - DNA, 22 bp, Artificial Sequence
  chemically synthesized
tctaagtataagatcatgtcat

SEQ ID NO: 77031 - DNA, 22 bp, Artificial Sequence
  chemically synthesized
ctaagtataagatcatgtcatc

SEQ ID NO: 77032 - DNA, 22 bp, Artificial Sequence
  chemically synthesized
taagtataagatcatgtcatct

SEQ ID NO: 77033 - DNA, 22 bp, Artificial Sequence
  chemically synthesized
agtataagatcatgtcatctac

SEQ ID NO: 77034 - DNA, 22 bp, Artificial Sequence
  chemically synthesized
caaactaggctaatttaacttc

SEQ ID NO: 77035 - DNA, 22 bp, Artificial Sequence
  chemically synthesized
ggctaatttaacttcttccttt

SEQ ID NO: 77036 - DNA, 22 bp, Artificial Sequence
  chemically synthesized
atttaacttcttcctttccaat

SEQ ID NO: 77037 - DNA, 22 bp, Artificial Sequence
  chemically synthesized
aacttcttcctttccaatttgg

SEQ ID NO: 77038 - DNA, 22 bp, Artificial Sequence
  chemically synthesized
acttcttcctttccaatttgga

SEQ ID NO: 77039 - DNA, 22 bp, Artificial Sequence
  chemically synthesized
cttcctttccaatttggatgca

SEQ ID NO: 77040 - DNA, 22 bp, Artificial Sequence
  chemically synthesized
ttcctttccaatttggatgcac

SEQ ID NO: 77041 - DNA, 22 bp, Artificial Sequence
  chemically synthesized
cctttccaatttggatgcactt

SEQ ID NO: 77042 - DNA, 22 bp, Artificial Sequence
  chemically synthesized
ctttccaatttggatgcacttt

SEQ ID NO: 77043 - DNA, 22 bp, Artificial Sequence
  chemically synthesized
tccaatttggatgcactttctt

SEQ ID NO: 77044 - DNA, 22 bp, Artificial Sequence
  chemically synthesized
ccaatttggatgcactttcttt

SEQ ID NO: 77045 - DNA, 22 bp, Artificial Sequence
  chemically synthesized
caatttggatgcactttctttc

SEQ ID NO: 77046 - DNA, 22 bp, Artificial Sequence
  chemically synthesized
ggatgcactttctttctcttcc

SEQ ID NO: 77047 - DNA, 22 bp, Artificial Sequence
  chemically synthesized
gatgcactttctttctcttcct

SEQ ID NO: 77048 - DNA, 22 bp, Artificial Sequence
  chemically synthesized
tctttctcttcctgaatttctc

SEQ ID NO: 77049 - DNA, 22 bp, Artificial Sequence
  chemically synthesized
ctttctcttcctgaatttctct

SEQ ID NO: 77050 - DNA, 22 bp, Artificial Sequence
  chemically synthesized
tttctcttcctgaatttctctt

SEQ ID NO: 77051 - DNA, 22 bp, Artificial Sequence
  chemically synthesized
tctcttcctgaatttctctttc

SEQ ID NO: 77052 - DNA, 22 bp, Artificial Sequence
  chemically synthesized
ctcttcctgaatttctctttcc

SEQ ID NO: 77053 - DNA, 22 bp, Artificial Sequence
  chemically synthesized
tcttcctgaatttctctttcca

SEQ ID NO: 77054 - DNA, 22 bp, Artificial Sequence
  chemically synthesized
ttcctgaatttctctttccaag

SEQ ID NO: 77055 - DNA, 22 bp, Artificial Sequence
  chemically synthesized
cctgaatttctctttccaagac

SEQ ID NO: 77056 - DNA, 22 bp, Artificial Sequence
  chemically synthesized
ctgaatttctctttccaagact

SEQ ID NO: 77057 - DNA, 22 bp, Artificial Sequence
  chemically synthesized
aatttctctttccaagacttcc

SEQ ID NO: 77058 - DNA, 22 bp, Artificial Sequence
  chemically synthesized
ctctttccaagacttccaatat

SEQ ID NO: 77059 - DNA, 22 bp, Artificial Sequence
  chemically synthesized
tctttccaagacttccaatatt

SEQ ID NO: 77060 - DNA, 22 bp, Artificial Sequence
  chemically synthesized
tttccaagacttccaatattat

SEQ ID NO: 77061 - DNA, 22 bp, Artificial Sequence
  chemically synthesized
tccaagacttccaatattatgt

SEQ ID NO: 77062 - DNA, 22 bp, Artificial Sequence
  chemically synthesized
ccaagacttccaatattatgtt

SEQ ID NO: 77063 - DNA, 22 bp, Artificial Sequence
  chemically synthesized
caagacttccaatattatgtta

SEQ ID NO: 77064 - DNA, 22 bp, Artificial Sequence
  chemically synthesized
ccaatattatgttaaataatgg

SEQ ID NO: 77065 - DNA, 22 bp, Artificial Sequence
  chemically synthesized
caatattatgttaaataatggc

SEQ ID NO: 77066 - DNA, 22 bp, Artificial Sequence
  chemically synthesized
tgttaaataatggcaatgaaag

SEQ ID NO: 77067 - DNA, 22 bp, Artificial Sequence
  chemically synthesized
aataatggcaatgaaagtgagc

SEQ ID NO: 77068 - DNA, 22 bp, Artificial Sequence
  chemically synthesized
ttgccttatttcagtccttaga

SEQ ID NO: 77069 - DNA, 22 bp, Artificial Sequence
  chemically synthesized
gccttatttcagtccttagagg

SEQ ID NO: 77070 - DNA, 22 bp, Artificial Sequence
  chemically synthesized
ccttatttcagtccttagagga

SEQ ID NO: 77071 - DNA, 22 bp, Artificial Sequence
  chemically synthesized
atttcagtccttagaggaaagg

SEQ ID NO: 77072 - DNA, 22 bp, Artificial Sequence
  chemically synthesized
tttcagtccttagaggaaaggc

SEQ ID NO: 77073 - DNA, 22 bp, Artificial Sequence
  chemically synthesized
cagtccttagaggaaaggcctt

SEQ ID NO: 77074 - DNA, 22 bp, Artificial Sequence
  chemically synthesized
agtccttagaggaaaggccttc

SEQ ID NO: 77075 - DNA, 22 bp, Artificial Sequence
  chemically synthesized
agaggaaaggccttcaatgttt

SEQ ID NO: 77076 - DNA, 22 bp, Artificial Sequence
  chemically synthesized
gaggaaaggccttcaatgtttc

SEQ ID NO: 77077 - DNA, 22 bp, Artificial Sequence
  chemically synthesized
caatgtttctctgttcagcata

SEQ ID NO: 77078 - DNA, 22 bp, Artificial Sequence
  chemically synthesized
aatgtttctctgttcagcataa

SEQ ID NO: 77079 - DNA, 22 bp, Artificial Sequence
  chemically synthesized
ctctgttcagcataatgttagc

SEQ ID NO: 77080 - DNA, 22 bp, Artificial Sequence
  chemically synthesized
tctgttcagcataatgttagca

SEQ ID NO: 77081 - DNA, 22 bp, Artificial Sequence
  chemically synthesized
tgttcagcataatgttagcact

SEQ ID NO: 77082 - DNA, 22 bp, Artificial Sequence
  chemically synthesized
ttcagcataatgttagcacttg

SEQ ID NO: 77083 - DNA, 22 bp, Artificial Sequence
  chemically synthesized
agcataatgttagcacttggtt

SEQ ID NO: 77084 - DNA, 22 bp, Artificial Sequence
  chemically synthesized
gcacttggtttgtcctatatgg

SEQ ID NO: 77085 - DNA, 22 bp, Artificial Sequence
  chemically synthesized
ggtttgtcctatatggttttta

SEQ ID NO: 77086 - DNA, 22 bp, Artificial Sequence
  chemically synthesized
gtttgtcctatatggtttttat

SEQ ID NO: 77087 - DNA, 22 bp, Artificial Sequence
  chemically synthesized
gtcctatatggtttttattatt

SEQ ID NO: 77088 - DNA, 22 bp, Artificial Sequence
  chemically synthesized
tcctatatggtttttattattt

SEQ ID NO: 77089 - DNA, 22 bp, Artificial Sequence
  chemically synthesized
tatggtttttattattttgagg

SEQ ID NO: 77090 - DNA, 22 bp, Artificial Sequence
  chemically synthesized
ttattattttgaggtatgttcc

SEQ ID NO: 77091 - DNA, 22 bp, Artificial Sequence
  chemically synthesized
tattattttgaggtatgttcct

SEQ ID NO: 77092 - DNA, 22 bp, Artificial Sequence
  chemically synthesized
attattttgaggtatgttccta

SEQ ID NO: 77093 - DNA, 22 bp, Artificial Sequence
  chemically synthesized
ttattttgaggtatgttcctac

SEQ ID NO: 77094 - DNA, 22 bp, Artificial Sequence
  chemically synthesized
ttttgaggtatgttcctactgt

SEQ ID NO: 77095 - DNA, 22 bp, Artificial Sequence
  chemically synthesized
tgaggtatgttcctactgtacc

SEQ ID NO: 77096 - DNA, 22 bp, Artificial Sequence
  chemically synthesized
gaggtatgttcctactgtacct

SEQ ID NO: 77097 - DNA, 22 bp, Artificial Sequence
  chemically synthesized
aggtatgttcctactgtacctc

SEQ ID NO: 77098 - DNA, 22 bp, Artificial Sequence
  chemically synthesized
ctactgtacctcctttgaggtg

SEQ ID NO: 77099 - DNA, 22 bp, Artificial Sequence
  chemically synthesized
ctgtacctcctttgaggtgcat

SEQ ID NO: 77100 - DNA, 22 bp, Artificial Sequence
  chemically synthesized
tacctcctttgaggtgcatttg

SEQ ID NO: 77101 - DNA, 22 bp, Artificial Sequence
  chemically synthesized
ctttgaggtgcatttgttgttg

SEQ ID NO: 77102 - DNA, 22 bp, Artificial Sequence
  chemically synthesized
tgaggtgcatttgttgttgtgt

SEQ ID NO: 77103 - DNA, 22 bp, Artificial Sequence
  chemically synthesized
gaggtgcatttgttgttgtgtc

SEQ ID NO: 77104 - DNA, 22 bp, Artificial Sequence
  chemically synthesized
aggtgcatttgttgttgtgtcc

SEQ ID NO: 77105 - DNA, 22 bp, Artificial Sequence
  chemically synthesized
gttgttgtgtcctggtctggtt

SEQ ID NO: 77106 - DNA, 22 bp, Artificial Sequence
  chemically synthesized
ttgttgtgtcctggtctggttt

SEQ ID NO: 77107 - DNA, 22 bp, Artificial Sequence
  chemically synthesized
ttgtgtcctggtctggtttggg

SEQ ID NO: 77108 - DNA, 22 bp, Artificial Sequence
  chemically synthesized
tgtcctggtctggtttgggtat

SEQ ID NO: 77109 - DNA, 22 bp, Artificial Sequence
  chemically synthesized
gtctggtttgggtatattagag

SEQ ID NO: 77110 - DNA, 22 bp, Artificial Sequence
  chemically synthesized
gtttgggtatattagagtaatg

SEQ ID NO: 77111 - DNA, 22 bp, Artificial Sequence
  chemically synthesized
gggtatattagagtaatgcttg

SEQ ID NO: 77112 - DNA, 22 bp, Artificial Sequence
  chemically synthesized
ggtatattagagtaatgcttgc

SEQ ID NO: 77113 - DNA, 22 bp, Artificial Sequence
  chemically synthesized
gagtaatgcttgcctcatagaa

SEQ ID NO: 77114 - DNA, 22 bp, Artificial Sequence
  chemically synthesized
gcctcatagaataagtttagaa

SEQ ID NO: 77115 - DNA, 22 bp, Artificial Sequence
  chemically synthesized
cctcatagaataagtttagaag

SEQ ID NO: 77116 - DNA, 22 bp, Artificial Sequence
  chemically synthesized
atagaataagtttagaagtagg

SEQ ID NO: 77117 - DNA, 22 bp, Artificial Sequence
  chemically synthesized
agaagtaggcccttcttttcag

SEQ ID NO: 77118 - DNA, 22 bp, Artificial Sequence
  chemically synthesized
gaagtaggcccttcttttcagt

SEQ ID NO: 77119 - DNA, 22 bp, Artificial Sequence
  chemically synthesized
cttttcagtttttatttgtttg

SEQ ID NO: 77120 - DNA, 22 bp, Artificial Sequence
  chemically synthesized
ttttcagtttttatttgtttgt

SEQ ID NO: 77121 - DNA, 22 bp, Artificial Sequence
  chemically synthesized
ttcagtttttatttgtttgttt

SEQ ID NO: 77122 - DNA, 22 bp, Artificial Sequence
  chemically synthesized
tcagtttttatttgtttgtttg

SEQ ID NO: 77123 - DNA, 22 bp, Artificial Sequence
  chemically synthesized
cagtttttatttgtttgtttgt

SEQ ID NO: 77124 - DNA, 22 bp, Artificial Sequence
  chemically synthesized
agtttttatttgtttgtttgtt

SEQ ID NO: 77125 - DNA, 22 bp, Artificial Sequence
  chemically synthesized
ttatttgtttgtttgtttgagg

SEQ ID NO: 77126 - DNA, 22 bp, Artificial Sequence
  chemically synthesized
tatttgtttgtttgtttgagga

SEQ ID NO: 77127 - DNA, 22 bp, Artificial Sequence
  chemically synthesized
atttgtttgtttgtttgaggaa

SEQ ID NO: 77128 - DNA, 22 bp, Artificial Sequence
  chemically synthesized
tttgtttgtttgtttgaggaat

SEQ ID NO: 77129 - DNA, 22 bp, Artificial Sequence
  chemically synthesized
gtttgtttgtttgaggaatttg

SEQ ID NO: 77130 - DNA, 22 bp, Artificial Sequence
  chemically synthesized
tttgtttgtttgaggaatttga

SEQ ID NO: 77131 - DNA, 22 bp, Artificial Sequence
  chemically synthesized
gtttgtttgaggaatttgagta

SEQ ID NO: 77132 - DNA, 22 bp, Artificial Sequence
  chemically synthesized
tttgtttgaggaatttgagtac

SEQ ID NO: 77133 - DNA, 22 bp, Artificial Sequence
  chemically synthesized
gtttgaggaatttgagtacgat

SEQ ID NO: 77134 - DNA, 22 bp, Artificial Sequence
  chemically synthesized
tttgaggaatttgagtacgatt

SEQ ID NO: 77135 - DNA, 22 bp, Artificial Sequence
  chemically synthesized
gaggaatttgagtacgattagt

SEQ ID NO: 77136 - DNA, 22 bp, Artificial Sequence
  chemically synthesized
aggaatttgagtacgattagta

SEQ ID NO: 77137 - DNA, 22 bp, Artificial Sequence
  chemically synthesized
gagtacgattagtattagttct

SEQ ID NO: 77138 - DNA, 22 bp, Artificial Sequence
  chemically synthesized
agtacgattagtattagttcta

SEQ ID NO: 77139 - DNA, 22 bp, Artificial Sequence
  chemically synthesized
gtattagttctacttgaaatgt

SEQ ID NO: 77140 - DNA, 22 bp, Artificial Sequence
  chemically synthesized
gttctacttgaaatgtttggta

SEQ ID NO: 77141 - DNA, 22 bp, Artificial Sequence
  chemically synthesized
tacttgaaatgtttggtagccc

SEQ ID NO: 77142 - DNA, 22 bp, Artificial Sequence
  chemically synthesized
cttgaaatgtttggtagcccat

SEQ ID NO: 77143 - DNA, 22 bp, Artificial Sequence
  chemically synthesized
gaaatgtttggtagcccatcga

SEQ ID NO: 77144 - DNA, 22 bp, Artificial Sequence
  chemically synthesized
aaatgtttggtagcccatcgag

SEQ ID NO: 77145 - DNA, 22 bp, Artificial Sequence
  chemically synthesized
ggtagcccatcgagtcctgggc

SEQ ID NO: 77146 - DNA, 22 bp, Artificial Sequence
  chemically synthesized
gtagcccatcgagtcctgggct

SEQ ID NO: 77147 - DNA, 22 bp, Artificial Sequence
  chemically synthesized
ggcttttctttaataggaaact

SEQ ID NO: 77148 - DNA, 22 bp, Artificial Sequence
  chemically synthesized
ttctttaataggaaactttata

SEQ ID NO: 77149 - DNA, 22 bp, Artificial Sequence
  chemically synthesized
tctttaataggaaactttatat

SEQ ID NO: 77150 - DNA, 22 bp, Artificial Sequence
  chemically synthesized
ctttaataggaaactttatatt

SEQ ID NO: 77151 - DNA, 22 bp, Artificial Sequence
  chemically synthesized
tttaataggaaactttatatta

SEQ ID NO: 77152 - DNA, 22 bp, Artificial Sequence
  chemically synthesized
taataggaaactttatattaca

SEQ ID NO: 77153 - DNA, 22 bp, Artificial Sequence
  chemically synthesized
aataggaaactttatattacaa

SEQ ID NO: 77154 - DNA, 22 bp, Artificial Sequence
  chemically synthesized
ataggaaactttatattacaac

SEQ ID NO: 77155 - DNA, 22 bp, Artificial Sequence
  chemically synthesized
tatattacaactttaatcttgt

SEQ ID NO: 77156 - DNA, 22 bp, Artificial Sequence
  chemically synthesized
atattacaactttaatcttgtt

SEQ ID NO: 77157 - DNA, 22 bp, Artificial Sequence
  chemically synthesized
tattacaactttaatcttgtta

SEQ ID NO: 77158 - DNA, 22 bp, Artificial Sequence
  chemically synthesized
caactttaatcttgttattcat

SEQ ID NO: 77159 - DNA, 22 bp, Artificial Sequence
  chemically synthesized
taatcttgttattcattattgt

SEQ ID NO: 77160 - DNA, 22 bp, Artificial Sequence
  chemically synthesized
aatcttgttattcattattgtt

SEQ ID NO: 77161 - DNA, 22 bp, Artificial Sequence
  chemically synthesized
atcttgttattcattattgttc

SEQ ID NO: 77162 - DNA, 22 bp, Artificial Sequence
  chemically synthesized
gttattcattattgttctattg

SEQ ID NO: 77163 - DNA, 22 bp, Artificial Sequence
  chemically synthesized
ttattcattattgttctattga

SEQ ID NO: 77164 - DNA, 22 bp, Artificial Sequence
  chemically synthesized
ttcattattgttctattgaggt

SEQ ID NO: 77165 - DNA, 22 bp, Artificial Sequence
  chemically synthesized
attattgttctattgaggtttt

SEQ ID NO: 77166 - DNA, 22 bp, Artificial Sequence
  chemically synthesized
ttgttctattgaggttttctgt

SEQ ID NO: 77167 - DNA, 22 bp, Artificial Sequence
  chemically synthesized
ttctattgaggttttctgtttc

SEQ ID NO: 77168 - DNA, 22 bp, Artificial Sequence
  chemically synthesized
tattgaggttttctgtttctac

SEQ ID NO: 77169 - DNA, 22 bp, Artificial Sequence
  chemically synthesized
ttgaggttttctgtttctacat

SEQ ID NO: 77170 - DNA, 22 bp, Artificial Sequence
  chemically synthesized
aggttttctgtttctacatgct

SEQ ID NO: 77171 - DNA, 22 bp, Artificial Sequence
  chemically synthesized
tctgtttctacatgcttcagtc

SEQ ID NO: 77172 - DNA, 22 bp, Artificial Sequence
  chemically synthesized
ctgtttctacatgcttcagtct

SEQ ID NO: 77173 - DNA, 22 bp, Artificial Sequence
  chemically synthesized
tgtttctacatgcttcagtctt

SEQ ID NO: 77174 - DNA, 22 bp, Artificial Sequence
  chemically synthesized
tttctacatgcttcagtcttgc

SEQ ID NO: 77175 - DNA, 22 bp, Artificial Sequence
  chemically synthesized
ctacatgcttcagtcttgctag

SEQ ID NO: 77176 - DNA, 22 bp, Artificial Sequence
  chemically synthesized
tacatgcttcagtcttgctagg

SEQ ID NO: 77177 - DNA, 22 bp, Artificial Sequence
  chemically synthesized
catgcttcagtcttgctaggct

SEQ ID NO: 77178 - DNA, 22 bp, Artificial Sequence
  chemically synthesized
cagtcttgctaggctgtatgtg

SEQ ID NO: 77179 - DNA, 22 bp, Artificial Sequence
  chemically synthesized
agtcttgctaggctgtatgtgt

SEQ ID NO: 77180 - DNA, 22 bp, Artificial Sequence
  chemically synthesized
gctaggctgtatgtgtccagga

SEQ ID NO: 77181 - DNA, 22 bp, Artificial Sequence
  chemically synthesized
ctaggctgtatgtgtccaggaa

SEQ ID NO: 77182 - DNA, 22 bp, Artificial Sequence
  chemically synthesized
ggctgtatgtgtccaggaattt

SEQ ID NO: 77183 - DNA, 22 bp, Artificial Sequence
  chemically synthesized
tatgtgtccaggaatttatcca

SEQ ID NO: 77184 - DNA, 22 bp, Artificial Sequence
  chemically synthesized
atccatttattctagattttcc

SEQ ID NO: 77185 - DNA, 22 bp, Artificial Sequence
  chemically synthesized
tccatttattctagattttcca

SEQ ID NO: 77186 - DNA, 22 bp, Artificial Sequence
  chemically synthesized
attctagattttccaatttgtt

SEQ ID NO: 77187 - DNA, 22 bp, Artificial Sequence
  chemically synthesized
ttctagattttccaatttgttg

SEQ ID NO: 77188 - DNA, 22 bp, Artificial Sequence
  chemically synthesized
tagattttccaatttgttggaa

SEQ ID NO: 77189 - DNA, 22 bp, Artificial Sequence
  chemically synthesized
gattttccaatttgttggaata

SEQ ID NO: 77190 - DNA, 22 bp, Artificial Sequence
  chemically synthesized
tccaatttgttggaatacagtt

SEQ ID NO: 77191 - DNA, 22 bp, Artificial Sequence
  chemically synthesized
ccaatttgttggaatacagttg

SEQ ID NO: 77192 - DNA, 22 bp, Artificial Sequence
  chemically synthesized
caatttgttggaatacagttgt

SEQ ID NO: 77193 - DNA, 22 bp, Artificial Sequence
  chemically synthesized
gttggaatacagttgttcataa

SEQ ID NO: 77194 - DNA, 22 bp, Artificial Sequence
  chemically synthesized
ttggaatacagttgttcataat

SEQ ID NO: 77195 - DNA, 22 bp, Artificial Sequence
  chemically synthesized
gaatacagttgttcataatagt

SEQ ID NO: 77196 - DNA, 22 bp, Artificial Sequence
  chemically synthesized
ttcataatagtatctaatgagt

SEQ ID NO: 77197 - DNA, 22 bp, Artificial Sequence
  chemically synthesized
ataatagtatctaatgagtctt

SEQ ID NO: 77198 - DNA, 22 bp, Artificial Sequence
  chemically synthesized
atgagtctttgtgttgctgagg

SEQ ID NO: 77199 - DNA, 22 bp, Artificial Sequence
  chemically synthesized
tgtgttgctgaggtctcaattg

SEQ ID NO: 77200 - DNA, 22 bp, Artificial Sequence
  chemically synthesized
gtgttgctgaggtctcaattgt

SEQ ID NO: 77201 - DNA, 22 bp, Artificial Sequence
  chemically synthesized
tgttgctgaggtctcaattgtt

SEQ ID NO: 77202 - DNA, 22 bp, Artificial Sequence
  chemically synthesized
ctgaggtctcaattgttatatc

SEQ ID NO: 77203 - DNA, 22 bp, Artificial Sequence
  chemically synthesized
aggtctcaattgttatatcctc

SEQ ID NO: 77204 - DNA, 22 bp, Artificial Sequence
  chemically synthesized
aattgttatatcctctttttca

SEQ ID NO: 77205 - DNA, 22 bp, Artificial Sequence
  chemically synthesized
ttatatcctctttttcattttc

SEQ ID NO: 77206 - DNA, 22 bp, Artificial Sequence
  chemically synthesized
tatcctctttttcattttctaa

SEQ ID NO: 77207 - DNA, 22 bp, Artificial Sequence
  chemically synthesized
tttttcattttctaattttatt

SEQ ID NO: 77208 - DNA, 22 bp, Artificial Sequence
  chemically synthesized
tttcattttctaattttatttg

SEQ ID NO: 77209 - DNA, 22 bp, Artificial Sequence
  chemically synthesized
ttcattttctaattttatttga

SEQ ID NO: 77210 - DNA, 22 bp, Artificial Sequence
  chemically synthesized
tcattttctaattttatttgac

SEQ ID NO: 77211 - DNA, 22 bp, Artificial Sequence
  chemically synthesized
cattttctaattttatttgact

SEQ ID NO: 77212 - DNA, 22 bp, Artificial Sequence
  chemically synthesized
attttctaattttatttgactc

SEQ ID NO: 77213 - DNA, 22 bp, Artificial Sequence
  chemically synthesized
tctaattttatttgactctttt

SEQ ID NO: 77214 - DNA, 22 bp, Artificial Sequence
  chemically synthesized
ctaattttatttgactcttttt

SEQ ID NO: 77215 - DNA, 22 bp, Artificial Sequence
  chemically synthesized
taattttatttgactctttttt

SEQ ID NO: 77216 - DNA, 22 bp, Artificial Sequence
  chemically synthesized
attttatttgactcttttttct

SEQ ID NO: 77217 - DNA, 22 bp, Artificial Sequence
  chemically synthesized
tatttgactcttttttcttaaa

SEQ ID NO: 77218 - DNA, 22 bp, Artificial Sequence
  chemically synthesized
atttgactcttttttcttaaag

SEQ ID NO: 77219 - DNA, 22 bp, Artificial Sequence
  chemically synthesized
tttgactcttttttcttaaagt

SEQ ID NO: 77220 - DNA, 22 bp, Artificial Sequence
  chemically synthesized
gactcttttttcttaaagtttt

SEQ ID NO: 77221 - DNA, 22 bp, Artificial Sequence
  chemically synthesized
actcttttttcttaaagttttg

SEQ ID NO: 77222 - DNA, 22 bp, Artificial Sequence
  chemically synthesized
ttttttcttaaagttttgttga

SEQ ID NO: 77223 - DNA, 22 bp, Artificial Sequence
  chemically synthesized
ttttcttaaagttttgttgatt

SEQ ID NO: 77224 - DNA, 22 bp, Artificial Sequence
  chemically synthesized
tttcttaaagttttgttgattt

SEQ ID NO: 77225 - DNA, 22 bp, Artificial Sequence
  chemically synthesized
ttcttaaagttttgttgatttt

SEQ ID NO: 77226 - DNA, 22 bp, Artificial Sequence
  chemically synthesized
tcttaaagttttgttgattttg

SEQ ID NO: 77227 - DNA, 22 bp, Artificial Sequence
  chemically synthesized
cttaaagttttgttgattttgt

SEQ ID NO: 77228 - DNA, 22 bp, Artificial Sequence
  chemically synthesized
ttaaagttttgttgattttgtt

SEQ ID NO: 77229 - DNA, 22 bp, Artificial Sequence
  chemically synthesized
aaagttttgttgattttgttta

SEQ ID NO: 77230 - DNA, 22 bp, Artificial Sequence
  chemically synthesized
aagttttgttgattttgtttac

SEQ ID NO: 77231 - DNA, 22 bp, Artificial Sequence
  chemically synthesized
tgttgattttgtttacctttcc

SEQ ID NO: 77232 - DNA, 22 bp, Artificial Sequence
  chemically synthesized
gttgattttgtttacctttcca

SEQ ID NO: 77233 - DNA, 22 bp, Artificial Sequence
  chemically synthesized
ttgattttgtttacctttccaa

SEQ ID NO: 77234 - DNA, 22 bp, Artificial Sequence
  chemically synthesized
attttgtttacctttccaagaa

SEQ ID NO: 77235 - DNA, 22 bp, Artificial Sequence
  chemically synthesized
tgtttacctttccaagaaagca

SEQ ID NO: 77236 - DNA, 22 bp, Artificial Sequence
  chemically synthesized
gtttacctttccaagaaagcaa

SEQ ID NO: 77237 - DNA, 22 bp, Artificial Sequence
  chemically synthesized
tttacctttccaagaaagcaac

SEQ ID NO: 77238 - DNA, 22 bp, Artificial Sequence
  chemically synthesized
acctttccaagaaagcaactgt

SEQ ID NO: 77239 - DNA, 22 bp, Artificial Sequence
  chemically synthesized
cctttccaagaaagcaactgtt

SEQ ID NO: 77240 - DNA, 22 bp, Artificial Sequence
  chemically synthesized
tccaagaaagcaactgtttgtt

SEQ ID NO: 77241 - DNA, 22 bp, Artificial Sequence
  chemically synthesized
ccaagaaagcaactgtttgttt

SEQ ID NO: 77242 - DNA, 22 bp, Artificial Sequence
  chemically synthesized
caagaaagcaactgtttgtttt

SEQ ID NO: 77243 - DNA, 22 bp, Artificial Sequence
  chemically synthesized
tttgtttttaatgattttctgt

SEQ ID NO: 77244 - DNA, 22 bp, Artificial Sequence
  chemically synthesized
gtttttaatgattttctgtatt

SEQ ID NO: 77245 - DNA, 22 bp, Artificial Sequence
  chemically synthesized
tttttaatgattttctgtattt

SEQ ID NO: 77246 - DNA, 22 bp, Artificial Sequence
  chemically synthesized
ttaatgattttctgtatttttt

SEQ ID NO: 77247 - DNA, 22 bp, Artificial Sequence
  chemically synthesized
taatgattttctgtattttttg

SEQ ID NO: 77248 - DNA, 22 bp, Artificial Sequence
  chemically synthesized
aatgattttctgtattttttgg

SEQ ID NO: 77249 - DNA, 22 bp, Artificial Sequence
  chemically synthesized
atgattttctgtattttttggt

SEQ ID NO: 77250 - DNA, 22 bp, Artificial Sequence
  chemically synthesized
tctgtattttttggtctcaatt

SEQ ID NO: 77251 - DNA, 22 bp, Artificial Sequence
  chemically synthesized
ctgtattttttggtctcaattt

SEQ ID NO: 77252 - DNA, 22 bp, Artificial Sequence
  chemically synthesized
tgtattttttggtctcaatttc

SEQ ID NO: 77253 - DNA, 22 bp, Artificial Sequence
  chemically synthesized
tattttttggtctcaatttcat

SEQ ID NO: 77254 - DNA, 22 bp, Artificial Sequence
  chemically synthesized
tttggtctcaatttcatttgtt

SEQ ID NO: 77255 - DNA, 22 bp, Artificial Sequence
  chemically synthesized
ttggtctcaatttcatttgttt

SEQ ID NO: 77256 - DNA, 22 bp, Artificial Sequence
  chemically synthesized
tggtctcaatttcatttgtttc

SEQ ID NO: 77257 - DNA, 22 bp, Artificial Sequence
  chemically synthesized
ggtctcaatttcatttgtttct

SEQ ID NO: 77258 - DNA, 22 bp, Artificial Sequence
  chemically synthesized
gtctcaatttcatttgtttctt

SEQ ID NO: 77259 - DNA, 22 bp, Artificial Sequence
  chemically synthesized
aatttcatttgtttcttctctg

SEQ ID NO: 77260 - DNA, 22 bp, Artificial Sequence
  chemically synthesized
catttgtttcttctctgatctt

SEQ ID NO: 77261 - DNA, 22 bp, Artificial Sequence
  chemically synthesized
atttgtttcttctctgatcttt

SEQ ID NO: 77262 - DNA, 22 bp, Artificial Sequence
  chemically synthesized
gtttcttctctgatctttctta

SEQ ID NO: 77263 - DNA, 22 bp, Artificial Sequence
  chemically synthesized
tttcttctctgatctttcttat

SEQ ID NO: 77264 - DNA, 22 bp, Artificial Sequence
  chemically synthesized
cttctctgatctttcttatttc

SEQ ID NO: 77265 - DNA, 22 bp, Artificial Sequence
  chemically synthesized
ttctctgatctttcttatttct

SEQ ID NO: 77266 - DNA, 22 bp, Artificial Sequence
  chemically synthesized
ctctgatctttcttatttctcc

SEQ ID NO: 77267 - DNA, 22 bp, Artificial Sequence
  chemically synthesized
tctgatctttcttatttctccc

SEQ ID NO: 77268 - DNA, 22 bp, Artificial Sequence
  chemically synthesized
tgatctttcttatttctcccct

SEQ ID NO: 77269 - DNA, 22 bp, Artificial Sequence
  chemically synthesized
atctttcttatttctccccttc

SEQ ID NO: 77270 - DNA, 22 bp, Artificial Sequence
  chemically synthesized
tcttatttctccccttctatta

SEQ ID NO: 77271 - DNA, 22 bp, Artificial Sequence
  chemically synthesized
cttatttctccccttctattaa

SEQ ID NO: 77272 - DNA, 22 bp, Artificial Sequence
  chemically synthesized
ttatttctccccttctattaat

SEQ ID NO: 77273 - DNA, 22 bp, Artificial Sequence
  chemically synthesized
atttctccccttctattaattt

SEQ ID NO: 77274 - DNA, 22 bp, Artificial Sequence
  chemically synthesized
tttctccccttctattaatttt

SEQ ID NO: 77275 - DNA, 22 bp, Artificial Sequence
  chemically synthesized
ctccccttctattaattttgca

SEQ ID NO: 77276 - DNA, 22 bp, Artificial Sequence
  chemically synthesized
tccccttctattaattttgcat

SEQ ID NO: 77277 - DNA, 22 bp, Artificial Sequence
  chemically synthesized
cccttctattaattttgcattt

SEQ ID NO: 77278 - DNA, 22 bp, Artificial Sequence
  chemically synthesized
ctattaattttgcatttggttt

SEQ ID NO: 77279 - DNA, 22 bp, Artificial Sequence
  chemically synthesized
tattaattttgcatttggtttg

SEQ ID NO: 77280 - DNA, 22 bp, Artificial Sequence
  chemically synthesized
ttaattttgcatttggtttgtt

SEQ ID NO: 77281 - DNA, 22 bp, Artificial Sequence
  chemically synthesized
attttgcatttggtttgttctt

SEQ ID NO: 77282 - DNA, 22 bp, Artificial Sequence
  chemically synthesized
tgcatttggtttgttcttgctt

SEQ ID NO: 77283 - DNA, 22 bp, Artificial Sequence
  chemically synthesized
gcatttggtttgttcttgcttt

SEQ ID NO: 77284 - DNA, 22 bp, Artificial Sequence
  chemically synthesized
catttggtttgttcttgctttc

SEQ ID NO: 77285 - DNA, 22 bp, Artificial Sequence
  chemically synthesized
ggtttgttcttgctttcctatt

SEQ ID NO: 77286 - DNA, 22 bp, Artificial Sequence
  chemically synthesized
gtttgttcttgctttcctattt

SEQ ID NO: 77287 - DNA, 22 bp, Artificial Sequence
  chemically synthesized
gttcttgctttcctatttcctt

SEQ ID NO: 77288 - DNA, 22 bp, Artificial Sequence
  chemically synthesized
ttcttgctttcctatttccttg

SEQ ID NO: 77289 - DNA, 22 bp, Artificial Sequence
  chemically synthesized
ttgctttcctatttccttgagg

SEQ ID NO: 77290 - DNA, 22 bp, Artificial Sequence
  chemically synthesized
gctttcctatttccttgaggta

SEQ ID NO: 77291 - DNA, 22 bp, Artificial Sequence
  chemically synthesized
ctttcctatttccttgaggtac

SEQ ID NO: 77292 - DNA, 22 bp, Artificial Sequence
  chemically synthesized
tcctatttccttgaggtacatt

SEQ ID NO: 77293 - DNA, 22 bp, Artificial Sequence
  chemically synthesized
cctatttccttgaggtacattg

SEQ ID NO: 77294 - DNA, 22 bp, Artificial Sequence
  chemically synthesized
ctatttccttgaggtacattgt

SEQ ID NO: 77295 - DNA, 22 bp, Artificial Sequence
  chemically synthesized
tttccttgaggtacattgtttg

SEQ ID NO: 77296 - DNA, 22 bp, Artificial Sequence
  chemically synthesized
ccttgaggtacattgtttggtt

SEQ ID NO: 77297 - DNA, 22 bp, Artificial Sequence
  chemically synthesized
cttgaggtacattgtttggttg

SEQ ID NO: 77298 - DNA, 22 bp, Artificial Sequence
  chemically synthesized
gaggtacattgtttggttgctt

SEQ ID NO: 77299 - DNA, 22 bp, Artificial Sequence
  chemically synthesized
aggtacattgtttggttgctta

SEQ ID NO: 77300 - DNA, 22 bp, Artificial Sequence
  chemically synthesized
tttggttgcttagttgaagcct

SEQ ID NO: 77301 - DNA, 22 bp, Artificial Sequence
  chemically synthesized
ggttgcttagttgaagcctttc

SEQ ID NO: 77302 - DNA, 22 bp, Artificial Sequence
  chemically synthesized
gttgcttagttgaagcctttct

SEQ ID NO: 77303 - DNA, 22 bp, Artificial Sequence
  chemically synthesized
cttagttgaagcctttctactt

SEQ ID NO: 77304 - DNA, 22 bp, Artificial Sequence
  chemically synthesized
agttgaagcctttctacttttt

SEQ ID NO: 77305 - DNA, 22 bp, Artificial Sequence
  chemically synthesized
gttgaagcctttctactttttt

SEQ ID NO: 77306 - DNA, 22 bp, Artificial Sequence
  chemically synthesized
aagcctttctacttttttggat

SEQ ID NO: 77307 - DNA, 22 bp, Artificial Sequence
  chemically synthesized
tctacttttttggatataggtg

SEQ ID NO: 77308 - DNA, 22 bp, Artificial Sequence
  chemically synthesized
ctacttttttggatataggtgt

SEQ ID NO: 77309 - DNA, 22 bp, Artificial Sequence
  chemically synthesized
tacttttttggatataggtgtt

SEQ ID NO: 77310 - DNA, 22 bp, Artificial Sequence
  chemically synthesized
cttttttggatataggtgttta

SEQ ID NO: 77311 - DNA, 22 bp, Artificial Sequence
  chemically synthesized
ttttggatataggtgtttattg

SEQ ID NO: 77312 - DNA, 22 bp, Artificial Sequence
  chemically synthesized
tttggatataggtgtttattgc

SEQ ID NO: 77313 - DNA, 22 bp, Artificial Sequence
  chemically synthesized
ttggatataggtgtttattgct

SEQ ID NO: 77314 - DNA, 22 bp, Artificial Sequence
  chemically synthesized
tggatataggtgtttattgcta

SEQ ID NO: 77315 - DNA, 22 bp, Artificial Sequence
  chemically synthesized
ggatataggtgtttattgctat

SEQ ID NO: 77316 - DNA, 22 bp, Artificial Sequence
  chemically synthesized
gatataggtgtttattgctatg

SEQ ID NO: 77317 - DNA, 22 bp, Artificial Sequence
  chemically synthesized
attgctatgaacttccctctaa

SEQ ID NO: 77318 - DNA, 22 bp, Artificial Sequence
  chemically synthesized
ttgctatgaacttccctctaag

SEQ ID NO: 77319 - DNA, 22 bp, Artificial Sequence
  chemically synthesized
ctatgaacttccctctaagtac

SEQ ID NO: 77320 - DNA, 22 bp, Artificial Sequence
  chemically synthesized
tgaacttccctctaagtactgc

SEQ ID NO: 77321 - DNA, 22 bp, Artificial Sequence
  chemically synthesized
ccctctaagtactgcttttgcc

SEQ ID NO: 77322 - DNA, 22 bp, Artificial Sequence
  chemically synthesized
cctctaagtactgcttttgcca

SEQ ID NO: 77323 - DNA, 22 bp, Artificial Sequence
  chemically synthesized
taagtactgcttttgccatatc

SEQ ID NO: 77324 - DNA, 22 bp, Artificial Sequence
  chemically synthesized
agtactgcttttgccatatcct

SEQ ID NO: 77325 - DNA, 22 bp, Artificial Sequence
  chemically synthesized
cttttgccatatcctgtaggtt

SEQ ID NO: 77326 - DNA, 22 bp, Artificial Sequence
  chemically synthesized
ttgccatatcctgtaggttttg

SEQ ID NO: 77327 - DNA, 22 bp, Artificial Sequence
  chemically synthesized
tgccatatcctgtaggttttgg

SEQ ID NO: 77328 - DNA, 22 bp, Artificial Sequence
  chemically synthesized
gccatatcctgtaggttttggt

SEQ ID NO: 77329 - DNA, 22 bp, Artificial Sequence
  chemically synthesized
ccatatcctgtaggttttggta

SEQ ID NO: 77330 - DNA, 22 bp, Artificial Sequence
  chemically synthesized
taggttttggtatgttgtattt

SEQ ID NO: 77331 - DNA, 22 bp, Artificial Sequence
  chemically synthesized
tggtatgttgtatttccatttt

SEQ ID NO: 77332 - DNA, 22 bp, Artificial Sequence
  chemically synthesized
ggtatgttgtatttccattttc

SEQ ID NO: 77333 - DNA, 22 bp, Artificial Sequence
  chemically synthesized
gtatgttgtatttccattttca

SEQ ID NO: 77334 - DNA, 22 bp, Artificial Sequence
  chemically synthesized
tatttccattttcacttgtttc

SEQ ID NO: 77335 - DNA, 22 bp, Artificial Sequence
  chemically synthesized
ccattttcacttgtttcaagaa

SEQ ID NO: 77336 - DNA, 22 bp, Artificial Sequence
  chemically synthesized
cattttcacttgtttcaagaag

SEQ ID NO: 77337 - DNA, 22 bp, Artificial Sequence
  chemically synthesized
tcacttgtttcaagaagtttta

SEQ ID NO: 77338 - DNA, 22 bp, Artificial Sequence
  chemically synthesized
cacttgtttcaagaagttttaa

SEQ ID NO: 77339 - DNA, 22 bp, Artificial Sequence
  chemically synthesized
acttgtttcaagaagttttaaa

SEQ ID NO: 77340 - DNA, 22 bp, Artificial Sequence
  chemically synthesized
gtttcaagaagttttaaaattt

SEQ ID NO: 77341 - DNA, 22 bp, Artificial Sequence
  chemically synthesized
tttcaagaagttttaaaatttc

SEQ ID NO: 77342 - DNA, 22 bp, Artificial Sequence
  chemically synthesized
caagaagttttaaaatttcctt

SEQ ID NO: 77343 - DNA, 22 bp, Artificial Sequence
  chemically synthesized
aagaagttttaaaatttccttc

SEQ ID NO: 77344 - DNA, 22 bp, Artificial Sequence
  chemically synthesized
taaaatttccttcttaatttct

SEQ ID NO: 77345 - DNA, 22 bp, Artificial Sequence
  chemically synthesized
aaaatttccttcttaatttctt

SEQ ID NO: 77346 - DNA, 22 bp, Artificial Sequence
  chemically synthesized
aaatttccttcttaatttcttt

SEQ ID NO: 77347 - DNA, 22 bp, Artificial Sequence
  chemically synthesized
ccttcttaatttctttagtgac

SEQ ID NO: 77348 - DNA, 22 bp, Artificial Sequence
  chemically synthesized
cttcttaatttctttagtgact

SEQ ID NO: 77349 - DNA, 22 bp, Artificial Sequence
  chemically synthesized
cttaatttctttagtgactcat

SEQ ID NO: 77350 - DNA, 22 bp, Artificial Sequence
  chemically synthesized
ttaatttctttagtgactcatt

SEQ ID NO: 77351 - DNA, 22 bp, Artificial Sequence
  chemically synthesized
aatttctttagtgactcattgg

SEQ ID NO: 77352 - DNA, 22 bp, Artificial Sequence
  chemically synthesized
atttctttagtgactcattggt

SEQ ID NO: 77353 - DNA, 22 bp, Artificial Sequence
  chemically synthesized
ctttagtgactcattggttatt

SEQ ID NO: 77354 - DNA, 22 bp, Artificial Sequence
  chemically synthesized
tttagtgactcattggttattc

SEQ ID NO: 77355 - DNA, 22 bp, Artificial Sequence
  chemically synthesized
tagtgactcattggttattcag

SEQ ID NO: 77356 - DNA, 22 bp, Artificial Sequence
  chemically synthesized
agtgactcattggttattcagt

SEQ ID NO: 77357 - DNA, 22 bp, Artificial Sequence
  chemically synthesized
gtgactcattggttattcagtt

SEQ ID NO: 77358 - DNA, 22 bp, Artificial Sequence
  chemically synthesized
attggttattcagtttcatgcg

SEQ ID NO: 77359 - DNA, 22 bp, Artificial Sequence
  chemically synthesized
gttattcagtttcatgcgcatc

SEQ ID NO: 77360 - DNA, 22 bp, Artificial Sequence
  chemically synthesized
ttcagtttcatgcgcatccctg

SEQ ID NO: 77361 - DNA, 22 bp, Artificial Sequence
  chemically synthesized
agtttcatgcgcatccctgtga

SEQ ID NO: 77362 - DNA, 22 bp, Artificial Sequence
  chemically synthesized
catgcgcatccctgtgaggaga

SEQ ID NO: 77363 - DNA, 22 bp, Artificial Sequence
  chemically synthesized
atgcgcatccctgtgaggagac

SEQ ID NO: 77364 - DNA, 22 bp, Artificial Sequence
  chemically synthesized
tgaggagactaccaaacaggct

SEQ ID NO: 77365 - DNA, 22 bp, Artificial Sequence
  chemically synthesized
ccaaacaggctttgtgtgagca

SEQ ID NO: 77366 - DNA, 22 bp, Artificial Sequence
  chemically synthesized
tgtgtgagcaataaagcttttt

SEQ ID NO: 77367 - DNA, 22 bp, Artificial Sequence
  chemically synthesized
gtgtgagcaataaagcttttta

SEQ ID NO: 77368 - DNA, 22 bp, Artificial Sequence
  chemically synthesized
tgtgagcaataaagctttttat

SEQ ID NO: 77369 - DNA, 22 bp, Artificial Sequence
  chemically synthesized
tttatcacctgggtgcaggcgg

SEQ ID NO: 77370 - DNA, 22 bp, Artificial Sequence
  chemically synthesized
ttatcacctgggtgcaggcggg

SEQ ID NO: 77371 - DNA, 22 bp, Artificial Sequence
  chemically synthesized
tatcacctgggtgcaggcgggc

SEQ ID NO: 77372 - DNA, 22 bp, Artificial Sequence
  chemically synthesized
atcacctgggtgcaggcgggct

SEQ ID NO: 77373 - DNA, 22 bp, Artificial Sequence
  chemically synthesized
tcacctgggtgcaggcgggctg

SEQ ID NO: 77374 - DNA, 22 bp, Artificial Sequence
  chemically synthesized
ggtgcaggcgggctgagtccga

SEQ ID NO: 77375 - DNA, 22 bp, Artificial Sequence
  chemically synthesized
agtccgaaaagagagtcagcaa

SEQ ID NO: 77376 - DNA, 22 bp, Artificial Sequence
  chemically synthesized
ttttataagatttgggtaggta

SEQ ID NO: 77377 - DNA, 22 bp, Artificial Sequence
  chemically synthesized
tataagatttgggtaggtaaag

SEQ ID NO: 77378 - DNA, 22 bp, Artificial Sequence
  chemically synthesized
ataagatttgggtaggtaaagg

SEQ ID NO: 77379 - DNA, 22 bp, Artificial Sequence
  chemically synthesized
taagatttgggtaggtaaagga

SEQ ID NO: 77380 - DNA, 22 bp, Artificial Sequence
  chemically synthesized
gggtaggtaaaggaaaattaca

SEQ ID NO: 77381 - DNA, 22 bp, Artificial Sequence
  chemically synthesized
ggtaggtaaaggaaaattacag

SEQ ID NO: 77382 - DNA, 22 bp, Artificial Sequence
  chemically synthesized
cagtcaaaggggggttgttctc

SEQ ID NO: 77383 - DNA, 22 bp, Artificial Sequence
  chemically synthesized
ttctctggcgggcaggagtggg

SEQ ID NO: 77384 - DNA, 22 bp, Artificial Sequence
  chemically synthesized
tctggcgggcaggagtgggggg

SEQ ID NO: 77385 - DNA, 22 bp, Artificial Sequence
  chemically synthesized
tggcgggcaggagtggggggtc

SEQ ID NO: 77386 - DNA, 22 bp, Artificial Sequence
  chemically synthesized
gcgggcaggagtggggggtcac

SEQ ID NO: 77387 - DNA, 22 bp, Artificial Sequence
  chemically synthesized
agtaggggagcttttgagccag

SEQ ID NO: 77388 - DNA, 22 bp, Artificial Sequence
  chemically synthesized
ttgagccaggatgagccaggag

SEQ ID NO: 77389 - DNA, 22 bp, Artificial Sequence
  chemically synthesized
tgagccaggatgagccaggaga

SEQ ID NO: 77390 - DNA, 22 bp, Artificial Sequence
  chemically synthesized
gagccaggatgagccaggagaa

SEQ ID NO: 77391 - DNA, 22 bp, Artificial Sequence
  chemically synthesized
agccaggatgagccaggagaag

SEQ ID NO: 77392 - DNA, 22 bp, Artificial Sequence
  chemically synthesized
tcacaagacaatgtcatcagtt

SEQ ID NO: 77393 - DNA, 22 bp, Artificial Sequence
  chemically synthesized
cacaagacaatgtcatcagtta

SEQ ID NO: 77394 - DNA, 22 bp, Artificial Sequence
  chemically synthesized
acaagacaatgtcatcagttaa

SEQ ID NO: 77395 - DNA, 22 bp, Artificial Sequence
  chemically synthesized
aggcaggaacaggccattttca

SEQ ID NO: 77396 - DNA, 22 bp, Artificial Sequence
  chemically synthesized
tcacttcttttgtggtggaatg

SEQ ID NO: 77397 - DNA, 22 bp, Artificial Sequence
  chemically synthesized
cacttcttttgtggtggaatgt

SEQ ID NO: 77398 - DNA, 22 bp, Artificial Sequence
  chemically synthesized
acttcttttgtggtggaatgtc

SEQ ID NO: 77399 - DNA, 22 bp, Artificial Sequence
  chemically synthesized
cttttgtggtggaatgtcatca

SEQ ID NO: 77400 - DNA, 22 bp, Artificial Sequence
  chemically synthesized
ttttgtggtggaatgtcatcag

SEQ ID NO: 77401 - DNA, 22 bp, Artificial Sequence
  chemically synthesized
ttgtggtggaatgtcatcagtt

SEQ ID NO: 77402 - DNA, 22 bp, Artificial Sequence
  chemically synthesized
tgtggtggaatgtcatcagtta

SEQ ID NO: 77403 - DNA, 22 bp, Artificial Sequence
  chemically synthesized
gtggtggaatgtcatcagttaa

SEQ ID NO: 77404 - DNA, 22 bp, Artificial Sequence
  chemically synthesized
tggtggaatgtcatcagttaag

SEQ ID NO: 77405 - DNA, 22 bp, Artificial Sequence
  chemically synthesized
aggcaggaactggccatctgta

SEQ ID NO: 77406 - DNA, 22 bp, Artificial Sequence
  chemically synthesized
gccatctgtatgtgtacctgca

SEQ ID NO: 77407 - DNA, 22 bp, Artificial Sequence
  chemically synthesized
tatgtgtacctgcaggtcacag

SEQ ID NO: 77408 - DNA, 22 bp, Artificial Sequence
  chemically synthesized
caggtcacaggggacatgatgg

SEQ ID NO: 77409 - DNA, 22 bp, Artificial Sequence
  chemically synthesized
agcttgggctcagaggcctgac

SEQ ID NO: 77410 - DNA, 22 bp, Artificial Sequence
  chemically synthesized
gcttgggctcagaggcctgaca

SEQ ID NO: 77411 - DNA, 22 bp, Artificial Sequence
  chemically synthesized
gggctcagaggcctgacattcc

SEQ ID NO: 77412 - DNA, 22 bp, Artificial Sequence
  chemically synthesized
ggctcagaggcctgacattcct

SEQ ID NO: 77413 - DNA, 22 bp, Artificial Sequence
  chemically synthesized
agaggcctgacattcctgtctt

SEQ ID NO: 77414 - DNA, 22 bp, Artificial Sequence
  chemically synthesized
acattcctgtcttcttatatta

SEQ ID NO: 77415 - DNA, 22 bp, Artificial Sequence
  chemically synthesized
ctgtcttcttatattaataaga

SEQ ID NO: 77416 - DNA, 22 bp, Artificial Sequence
  chemically synthesized
tcttcttatattaataagaaaa

SEQ ID NO: 77417 - DNA, 22 bp, Artificial Sequence
  chemically synthesized
cttatattaataagaaaaataa

SEQ ID NO: 77418 - DNA, 22 bp, Artificial Sequence
  chemically synthesized
ttatattaataagaaaaataaa

SEQ ID NO: 77419 - DNA, 22 bp, Artificial Sequence
  chemically synthesized
atattaataagaaaaataaaac

SEQ ID NO: 77420 - DNA, 22 bp, Artificial Sequence
  chemically synthesized
tattaataagaaaaataaaaca

SEQ ID NO: 77421 - DNA, 22 bp, Artificial Sequence
  chemically synthesized
ataagaaaaataaaacataata

SEQ ID NO: 77422 - DNA, 22 bp, Artificial Sequence
  chemically synthesized
aagtgttggggcagcgaaaatt

SEQ ID NO: 77423 - DNA, 22 bp, Artificial Sequence
  chemically synthesized
gggcagcgaaaattttggggga

SEQ ID NO: 77424 - DNA, 22 bp, Artificial Sequence
  chemically synthesized
tgggggatggtatggagagata

SEQ ID NO: 77425 - DNA, 22 bp, Artificial Sequence
  chemically synthesized
gggggatggtatggagagataa

SEQ ID NO: 77426 - DNA, 22 bp, Artificial Sequence
  chemically synthesized
ggggatggtatggagagataat

SEQ ID NO: 77427 - DNA, 22 bp, Artificial Sequence
  chemically synthesized
ctcagggctgcttcgagcggga

SEQ ID NO: 77428 - DNA, 22 bp, Artificial Sequence
  chemically synthesized
tcagggctgcttcgagcgggat

SEQ ID NO: 77429 - DNA, 22 bp, Artificial Sequence
  chemically synthesized
agggctgcttcgagcgggatta

SEQ ID NO: 77430 - DNA, 22 bp, Artificial Sequence
  chemically synthesized
cttcgagcgggattaggggcgg

SEQ ID NO: 77431 - DNA, 22 bp, Artificial Sequence
  chemically synthesized
cgagcgggattaggggcggcgt

SEQ ID NO: 77432 - DNA, 22 bp, Artificial Sequence
  chemically synthesized
gagcgggattaggggcggcgtg

SEQ ID NO: 77433 - DNA, 22 bp, Artificial Sequence
  chemically synthesized
ggggcggcgtgggaacctagag

SEQ ID NO: 77434 - DNA, 22 bp, Artificial Sequence
  chemically synthesized
gagtgggagagattaagctgaa

SEQ ID NO: 77435 - DNA, 22 bp, Artificial Sequence
  chemically synthesized
agctgaaggaagattttgtggt

SEQ ID NO: 77436 - DNA, 22 bp, Artificial Sequence
  chemically synthesized
aaggaagattttgtggtaaggg

SEQ ID NO: 77437 - DNA, 22 bp, Artificial Sequence
  chemically synthesized
tgtggtaaggggtgatattgtg

SEQ ID NO: 77438 - DNA, 22 bp, Artificial Sequence
  chemically synthesized
gtggtaaggggtgatattgtgg

SEQ ID NO: 77439 - DNA, 22 bp, Artificial Sequence
  chemically synthesized
tggtaaggggtgatattgtggg

SEQ ID NO: 77440 - DNA, 22 bp, Artificial Sequence
  chemically synthesized
tggggttgttagaagaaacatt

SEQ ID NO: 77441 - DNA, 22 bp, Artificial Sequence
  chemically synthesized
ttagaagaaacatttgtcatgt

SEQ ID NO: 77442 - DNA, 22 bp, Artificial Sequence
  chemically synthesized
gaagaaacatttgtcatgtaga

SEQ ID NO: 77443 - DNA, 22 bp, Artificial Sequence
  chemically synthesized
gtcatgtagaattattggtgat

SEQ ID NO: 77444 - DNA, 22 bp, Artificial Sequence
  chemically synthesized
tcatgtagaattattggtgatg

SEQ ID NO: 77445 - DNA, 22 bp, Artificial Sequence
  chemically synthesized
ttggtgatggcctggatacggt

SEQ ID NO: 77446 - DNA, 22 bp, Artificial Sequence
  chemically synthesized
gtgatggcctggatacggtttt

SEQ ID NO: 77447 - DNA, 22 bp, Artificial Sequence
  chemically synthesized
gatacggttttgtatggattga

SEQ ID NO: 77448 - DNA, 22 bp, Artificial Sequence
  chemically synthesized
tgtatggattgaaaaaccaaat

SEQ ID NO: 77449 - DNA, 22 bp, Artificial Sequence
  chemically synthesized
gtatggattgaaaaaccaaatg

SEQ ID NO: 77450 - DNA, 22 bp, Artificial Sequence
  chemically synthesized
tatggattgaaaaaccaaatgg

SEQ ID NO: 77451 - DNA, 22 bp, Artificial Sequence
  chemically synthesized
aaaaaccaaatggaataagaga

SEQ ID NO: 77452 - DNA, 22 bp, Artificial Sequence
  chemically synthesized
aaggactaagaagtgggaggac

SEQ ID NO: 77453 - DNA, 22 bp, Artificial Sequence
  chemically synthesized
agaagtgggaggacctaggaca

SEQ ID NO: 77454 - DNA, 22 bp, Artificial Sequence
  chemically synthesized
ggacatctgattaaagagtgcc

SEQ ID NO: 77455 - DNA, 22 bp, Artificial Sequence
  chemically synthesized
attaaagagtgcctaaggagat

SEQ ID NO: 77456 - DNA, 22 bp, Artificial Sequence
  chemically synthesized
aagagtgcctaaggagattcaa

SEQ ID NO: 77457 - DNA, 22 bp, Artificial Sequence
  chemically synthesized
aggagattcaacatagtcctgc

SEQ ID NO: 77458 - DNA, 22 bp, Artificial Sequence
  chemically synthesized
aacatagtcctgccagcaaaga

SEQ ID NO: 77459 - DNA, 22 bp, Artificial Sequence
  chemically synthesized
ccagcaaagattatttatttac

SEQ ID NO: 77460 - DNA, 22 bp, Artificial Sequence
  chemically synthesized
tttatttacttcaagagttaag

SEQ ID NO: 77461 - DNA, 22 bp, Artificial Sequence
  chemically synthesized
atttacttcaagagttaagagt

SEQ ID NO: 77462 - DNA, 22 bp, Artificial Sequence
  chemically synthesized
tttacttcaagagttaagagtg

SEQ ID NO: 77463 - DNA, 22 bp, Artificial Sequence
  chemically synthesized
acttcaagagttaagagtggca

SEQ ID NO: 77464 - DNA, 22 bp, Artificial Sequence
  chemically synthesized
cttcaagagttaagagtggcag

SEQ ID NO: 77465 - DNA, 22 bp, Artificial Sequence
  chemically synthesized
caagagttaagagtggcagttt

SEQ ID NO: 77466 - DNA, 22 bp, Artificial Sequence
  chemically synthesized
aagagttaagagtggcagtttg

SEQ ID NO: 77467 - DNA, 22 bp, Artificial Sequence
  chemically synthesized
agagtggcagtttggggatagc

SEQ ID NO: 77468 - DNA, 22 bp, Artificial Sequence
  chemically synthesized
ggggatagcaccaggagatatc

SEQ ID NO: 77469 - DNA, 22 bp, Artificial Sequence
  chemically synthesized
gggatagcaccaggagatatca

SEQ ID NO: 77470 - DNA, 22 bp, Artificial Sequence
  chemically synthesized
tgatggcttggaaaaacagtgt

SEQ ID NO: 77471 - DNA, 22 bp, Artificial Sequence
  chemically synthesized
ggaaaaacagtgtaaaccggca

SEQ ID NO: 77472 - DNA, 22 bp, Artificial Sequence
  chemically synthesized
gaaaaacagtgtaaaccggcag

SEQ ID NO: 77473 - DNA, 22 bp, Artificial Sequence
  chemically synthesized
agaatggtgaataggagtatga

SEQ ID NO: 77474 - DNA, 22 bp, Artificial Sequence
  chemically synthesized
gacagaagatagcagggatgac

SEQ ID NO: 77475 - DNA, 22 bp, Artificial Sequence
  chemically synthesized
ttttggggcacattctaagttg

SEQ ID NO: 77476 - DNA, 22 bp, Artificial Sequence
  chemically synthesized
tttggggcacattctaagttgg

SEQ ID NO: 77477 - DNA, 22 bp, Artificial Sequence
  chemically synthesized
ttggggcacattctaagttggt

SEQ ID NO: 77478 - DNA, 22 bp, Artificial Sequence
  chemically synthesized
tggggcacattctaagttggtc

SEQ ID NO: 77479 - DNA, 22 bp, Artificial Sequence
  chemically synthesized
ggggcacattctaagttggtct

SEQ ID NO: 77480 - DNA, 22 bp, Artificial Sequence
  chemically synthesized
gggcacattctaagttggtctg

SEQ ID NO: 77481 - DNA, 22 bp, Artificial Sequence
  chemically synthesized
taagttggtctggtgtctggaa

SEQ ID NO: 77482 - DNA, 22 bp, Artificial Sequence
  chemically synthesized
agttggtctggtgtctggaatt

SEQ ID NO: 77483 - DNA, 22 bp, Artificial Sequence
  chemically synthesized
gtctggtgtctggaattagact

SEQ ID NO: 77484 - DNA, 22 bp, Artificial Sequence
  chemically synthesized
gtgtctggaattagactggggc

SEQ ID NO: 77485 - DNA, 22 bp, Artificial Sequence
  chemically synthesized
gaattagactggggcctaataa

SEQ ID NO: 77486 - DNA, 22 bp, Artificial Sequence
  chemically synthesized
gactggggcctaataaaaaggc

SEQ ID NO: 77487 - DNA, 22 bp, Artificial Sequence
  chemically synthesized
gggcctaataaaaaggcaaatc

SEQ ID NO: 77488 - DNA, 22 bp, Artificial Sequence
  chemically synthesized
ataaaaaggcaaatctatacag

SEQ ID NO: 77489 - DNA, 22 bp, Artificial Sequence
  chemically synthesized
tacaggagctcaaatgggctgt

SEQ ID NO: 77490 - DNA, 22 bp, Artificial Sequence
  chemically synthesized
aaatgggctgtaccctgtagca

SEQ ID NO: 77491 - DNA, 22 bp, Artificial Sequence
  chemically synthesized
taccctgtagcattctgaggac

SEQ ID NO: 77492 - DNA, 22 bp, Artificial Sequence
  chemically synthesized
tagcattctgaggacaggtctg

SEQ ID NO: 77493 - DNA, 22 bp, Artificial Sequence
  chemically synthesized
tgaggacaggtctgacttctga

SEQ ID NO: 77494 - DNA, 22 bp, Artificial Sequence
  chemically synthesized
aggacaggtctgacttctgaga

SEQ ID NO: 77495 - DNA, 22 bp, Artificial Sequence
  chemically synthesized
acttctgagaaagaaaagtggt

SEQ ID NO: 77496 - DNA, 22 bp, Artificial Sequence
  chemically synthesized
ctgagaaagaaaagtggtaaaa

SEQ ID NO: 77497 - DNA, 22 bp, Artificial Sequence
  chemically synthesized
tgagaaagaaaagtggtaaaag

SEQ ID NO: 77498 - DNA, 22 bp, Artificial Sequence
  chemically synthesized
agaaagaaaagtggtaaaagta

SEQ ID NO: 77499 - DNA, 22 bp, Artificial Sequence
  chemically synthesized
tccagtcctttttaagttggtg

SEQ ID NO: 77500 - DNA, 22 bp, Artificial Sequence
  chemically synthesized
tttaagttggtggctgagcttg

SEQ ID NO: 77501 - DNA, 22 bp, Artificial Sequence
  chemically synthesized
ttaagttggtggctgagcttgg

SEQ ID NO: 77502 - DNA, 22 bp, Artificial Sequence
  chemically synthesized
taagttggtggctgagcttggt

SEQ ID NO: 77503 - DNA, 22 bp, Artificial Sequence
  chemically synthesized
aagttggtggctgagcttggtg

SEQ ID NO: 77504 - DNA, 22 bp, Artificial Sequence
  chemically synthesized
agttggtggctgagcttggtga

SEQ ID NO: 77505 - DNA, 22 bp, Artificial Sequence
  chemically synthesized
gtggctgagcttggtgaggtgt

SEQ ID NO: 77506 - DNA, 22 bp, Artificial Sequence
  chemically synthesized
agcttggtgaggtgtgttttta

SEQ ID NO: 77507 - DNA, 22 bp, Artificial Sequence
  chemically synthesized
ggtgaggtgtgtttttaaaaga

SEQ ID NO: 77508 - DNA, 22 bp, Artificial Sequence
  chemically synthesized
gtgaggtgtgtttttaaaagac

SEQ ID NO: 77509 - DNA, 22 bp, Artificial Sequence
  chemically synthesized
ttaaaagacatttagtccgttc

SEQ ID NO: 77510 - DNA, 22 bp, Artificial Sequence
  chemically synthesized
taaaagacatttagtccgttct

SEQ ID NO: 77511 - DNA, 22 bp, Artificial Sequence
  chemically synthesized
aaaagacatttagtccgttcta

SEQ ID NO: 77512 - DNA, 22 bp, Artificial Sequence
  chemically synthesized
aaagacatttagtccgttctac

SEQ ID NO: 77513 - DNA, 22 bp, Artificial Sequence
  chemically synthesized
agtccgttctacttttcctgaa

SEQ ID NO: 77514 - DNA, 22 bp, Artificial Sequence
  chemically synthesized
gtccgttctacttttcctgaag

SEQ ID NO: 77515 - DNA, 22 bp, Artificial Sequence
  chemically synthesized
tacttttcctgaagacggagga

SEQ ID NO: 77516 - DNA, 22 bp, Artificial Sequence
  chemically synthesized
cttttcctgaagacggaggacc

SEQ ID NO: 77517 - DNA, 22 bp, Artificial Sequence
  chemically synthesized
ttcctgaagacggaggaccgta

SEQ ID NO: 77518 - DNA, 22 bp, Artificial Sequence
  chemically synthesized
tcctgaagacggaggaccgtaa

SEQ ID NO: 77519 - DNA, 22 bp, Artificial Sequence
  chemically synthesized
cctgaagacggaggaccgtaag

SEQ ID NO: 77520 - DNA, 22 bp, Artificial Sequence
  chemically synthesized
ctgaagacggaggaccgtaagg

SEQ ID NO: 77521 - DNA, 22 bp, Artificial Sequence
  chemically synthesized
aagacggaggaccgtaagggat

SEQ ID NO: 77522 - DNA, 22 bp, Artificial Sequence
  chemically synthesized
tactgaatactaagagcctgaa

SEQ ID NO: 77523 - DNA, 22 bp, Artificial Sequence
  chemically synthesized
actgaatactaagagcctgaaa

SEQ ID NO: 77524 - DNA, 22 bp, Artificial Sequence
  chemically synthesized
ctgaatactaagagcctgaaaa

SEQ ID NO: 77525 - DNA, 22 bp, Artificial Sequence
  chemically synthesized
aatactaagagcctgaaaaact

SEQ ID NO: 77526 - DNA, 22 bp, Artificial Sequence
  chemically synthesized
agagcctgaaaaactgcttggc

SEQ ID NO: 77527 - DNA, 22 bp, Artificial Sequence
  chemically synthesized
aaaaactgcttggctgatttga

SEQ ID NO: 77528 - DNA, 22 bp, Artificial Sequence
  chemically synthesized
cttggctgatttgactaataaa

SEQ ID NO: 77529 - DNA, 22 bp, Artificial Sequence
  chemically synthesized
ggctgatttgactaataaaggc

SEQ ID NO: 77530 - DNA, 22 bp, Artificial Sequence
  chemically synthesized
gctgatttgactaataaaggct

SEQ ID NO: 77531 - DNA, 22 bp, Artificial Sequence
  chemically synthesized
atttgactaataaaggctggtc

SEQ ID NO: 77532 - DNA, 22 bp, Artificial Sequence
  chemically synthesized
gactaataaaggctggtctgtt

SEQ ID NO: 77533 - DNA, 22 bp, Artificial Sequence
  chemically synthesized
actaataaaggctggtctgtta

SEQ ID NO: 77534 - DNA, 22 bp, Artificial Sequence
  chemically synthesized
ataaaggctggtctgttatcag

SEQ ID NO: 77535 - DNA, 22 bp, Artificial Sequence
  chemically synthesized
gtctgttatcagactgtataga

SEQ ID NO: 77536 - DNA, 22 bp, Artificial Sequence
  chemically synthesized
ttatcagactgtatagaggtag

SEQ ID NO: 77537 - DNA, 22 bp, Artificial Sequence
  chemically synthesized
tcagactgtatagaggtaggaa

SEQ ID NO: 77538 - DNA, 22 bp, Artificial Sequence
  chemically synthesized
tatagaggtaggaaggctaaac

SEQ ID NO: 77539 - DNA, 22 bp, Artificial Sequence
  chemically synthesized
aactgaggaattatgtctgaca

SEQ ID NO: 77540 - DNA, 22 bp, Artificial Sequence
  chemically synthesized
aggaattatgtctgacagaagg

SEQ ID NO: 77541 - DNA, 22 bp, Artificial Sequence
  chemically synthesized
tgtctgacagaagggaagaaat

SEQ ID NO: 77542 - DNA, 22 bp, Artificial Sequence
  chemically synthesized
acagaagggaagaaatgactgc

SEQ ID NO: 77543 - DNA, 22 bp, Artificial Sequence
  chemically synthesized
cggtggccttctcagaccctgt

SEQ ID NO: 77544 - DNA, 22 bp, Artificial Sequence
  chemically synthesized
ctcagaccctgtaggaaagacc

SEQ ID NO: 77545 - DNA, 22 bp, Artificial Sequence
  chemically synthesized
tcagaccctgtaggaaagacct

SEQ ID NO: 77546 - DNA, 22 bp, Artificial Sequence
  chemically synthesized
agaccctgtaggaaagacctct

SEQ ID NO: 77547 - DNA, 22 bp, Artificial Sequence
  chemically synthesized
taggaaagacctctacttatcc

SEQ ID NO: 77548 - DNA, 22 bp, Artificial Sequence
  chemically synthesized
tacttatccagtgaaagtgtct

SEQ ID NO: 77549 - DNA, 22 bp, Artificial Sequence
  chemically synthesized
cttatccagtgaaagtgtctac

SEQ ID NO: 77550 - DNA, 22 bp, Artificial Sequence
  chemically synthesized
atccagtgaaagtgtctaccta

SEQ ID NO: 77551 - DNA, 22 bp, Artificial Sequence
  chemically synthesized
tccagtgaaagtgtctacctag

SEQ ID NO: 77552 - DNA, 22 bp, Artificial Sequence
  chemically synthesized
cctagactaagaggtattttag

SEQ ID NO: 77553 - DNA, 22 bp, Artificial Sequence
  chemically synthesized
gactaagaggtattttagttat

SEQ ID NO: 77554 - DNA, 22 bp, Artificial Sequence
  chemically synthesized
agaggtattttagttatctgac

SEQ ID NO: 77555 - DNA, 22 bp, Artificial Sequence
  chemically synthesized
tagttatctgactcagggcatg

SEQ ID NO: 77556 - DNA, 22 bp, Artificial Sequence
  chemically synthesized
agttatctgactcagggcatgt

SEQ ID NO: 77557 - DNA, 22 bp, Artificial Sequence
  chemically synthesized
gttatctgactcagggcatgtt

SEQ ID NO: 77558 - DNA, 22 bp, Artificial Sequence
  chemically synthesized
tctgactcagggcatgttgagt

SEQ ID NO: 77559 - DNA, 22 bp, Artificial Sequence
  chemically synthesized
actcagggcatgttgagtaaat

SEQ ID NO: 77560 - DNA, 22 bp, Artificial Sequence
  chemically synthesized
agggcatgttgagtaaatctaa

SEQ ID NO: 77561 - DNA, 22 bp, Artificial Sequence
  chemically synthesized
agtaaatctaatttgccagtcc

SEQ ID NO: 77562 - DNA, 22 bp, Artificial Sequence
  chemically synthesized
atttgccagtcctgggtggggg

SEQ ID NO: 77563 - DNA, 22 bp, Artificial Sequence
  chemically synthesized
gccagtcctgggtgggggcaaa

SEQ ID NO: 77564 - DNA, 22 bp, Artificial Sequence
  chemically synthesized
ccagtcctgggtgggggcaaat

SEQ ID NO: 77565 - DNA, 22 bp, Artificial Sequence
  chemically synthesized
ggtgggggcaaatcctcgagct

SEQ ID NO: 77566 - DNA, 22 bp, Artificial Sequence
  chemically synthesized
gagcttgatgtgtagggaaggg

SEQ ID NO: 77567 - DNA, 22 bp, Artificial Sequence
  chemically synthesized
gatgtgtagggaagggaggggg

SEQ ID NO: 77568 - DNA, 22 bp, Artificial Sequence
  chemically synthesized
atgtgtagggaagggagggggc

SEQ ID NO: 77569 - DNA, 22 bp, Artificial Sequence
  chemically synthesized
aataatccctgaggagtagcag

SEQ ID NO: 77570 - DNA, 22 bp, Artificial Sequence
  chemically synthesized
aggagtagcagaatagcagatg

SEQ ID NO: 77571 - DNA, 22 bp, Artificial Sequence
  chemically synthesized
agaagttatttctttgaggata

SEQ ID NO: 77572 - DNA, 22 bp, Artificial Sequence
  chemically synthesized
tttctttgaggatagatttcta

SEQ ID NO: 77573 - DNA, 22 bp, Artificial Sequence
  chemically synthesized
ctttgaggatagatttctacga

SEQ ID NO: 77574 - DNA, 22 bp, Artificial Sequence
  chemically synthesized
tttgaggatagatttctacgat

SEQ ID NO: 77575 - DNA, 22 bp, Artificial Sequence
  chemically synthesized
tgaggatagatttctacgatgg

SEQ ID NO: 77576 - DNA, 22 bp, Artificial Sequence
  chemically synthesized
gaggatagatttctacgatgga

SEQ ID NO: 77577 - DNA, 22 bp, Artificial Sequence
  chemically synthesized
aggatagatttctacgatggaa

SEQ ID NO: 77578 - DNA, 22 bp, Artificial Sequence
  chemically synthesized
ctacgatggaaaggaaatgaga

SEQ ID NO: 77579 - DNA, 22 bp, Artificial Sequence
  chemically synthesized
tacgatggaaaggaaatgagag

SEQ ID NO: 77580 - DNA, 22 bp, Artificial Sequence
  chemically synthesized
cgatggaaaggaaatgagaggt

SEQ ID NO: 77581 - DNA, 22 bp, Artificial Sequence
  chemically synthesized
gaagaggcaggctagtggtttg

SEQ ID NO: 77582 - DNA, 22 bp, Artificial Sequence
  chemically synthesized
gtggtttgtactatagcatagc

SEQ ID NO: 77583 - DNA, 22 bp, Artificial Sequence
  chemically synthesized
gtactatagcatagcctgcctt

SEQ ID NO: 77584 - DNA, 22 bp, Artificial Sequence
  chemically synthesized
tactatagcatagcctgccttt

SEQ ID NO: 77585 - DNA, 22 bp, Artificial Sequence
  chemically synthesized
tagcatagcctgcctttgctgg

SEQ ID NO: 77586 - DNA, 22 bp, Artificial Sequence
  chemically synthesized
cctttgctggtgtgtggctatt

SEQ ID NO: 77587 - DNA, 22 bp, Artificial Sequence
  chemically synthesized
tgctggtgtgtggctattaggc

SEQ ID NO: 77588 - DNA, 22 bp, Artificial Sequence
  chemically synthesized
gctggtgtgtggctattaggcc

SEQ ID NO: 77589 - DNA, 22 bp, Artificial Sequence
  chemically synthesized
ctggtgtgtggctattaggcct

SEQ ID NO: 77590 - DNA, 22 bp, Artificial Sequence
  chemically synthesized
gtgtgtggctattaggcctggt

SEQ ID NO: 77591 - DNA, 22 bp, Artificial Sequence
  chemically synthesized
ttaggcctggtggaacggccat

SEQ ID NO: 77592 - DNA, 22 bp, Artificial Sequence
  chemically synthesized
ggcctggtggaacggccatcaa

SEQ ID NO: 77593 - DNA, 22 bp, Artificial Sequence
  chemically synthesized
gtggaacggccatcaataaatc

SEQ ID NO: 77594 - DNA, 22 bp, Artificial Sequence
  chemically synthesized
aagtccgggccaggaccaatgg

SEQ ID NO: 77595 - DNA, 22 bp, Artificial Sequence
  chemically synthesized
tgggacttaacaaagagtgagt

SEQ ID NO: 77596 - DNA, 22 bp, Artificial Sequence
  chemically synthesized
aacaaagagtgagtacagctga

SEQ ID NO: 77597 - DNA, 22 bp, Artificial Sequence
  chemically synthesized
acaaagagtgagtacagctgaa

SEQ ID NO: 77598 - DNA, 22 bp, Artificial Sequence
  chemically synthesized
aaggagccggggatcagaaagt

SEQ ID NO: 77599 - DNA, 22 bp, Artificial Sequence
  chemically synthesized
tagaagttatgagaaatgtgaa

SEQ ID NO: 77600 - DNA, 22 bp, Artificial Sequence
  chemically synthesized
agaagttatgagaaatgtgaag

SEQ ID NO: 77601 - DNA, 22 bp, Artificial Sequence
  chemically synthesized
gaagttatgagaaatgtgaaga

SEQ ID NO: 77602 - DNA, 22 bp, Artificial Sequence
  chemically synthesized
tgagaaatgtgaagagtgagct

SEQ ID NO: 77603 - DNA, 22 bp, Artificial Sequence
  chemically synthesized
agcatagtttgtgatttttagg

SEQ ID NO: 77604 - DNA, 22 bp, Artificial Sequence
  chemically synthesized
gtgatttttagggcctctaaaa

SEQ ID NO: 77605 - DNA, 22 bp, Artificial Sequence
  chemically synthesized
tgatttttagggcctctaaaag

SEQ ID NO: 77606 - DNA, 22 bp, Artificial Sequence
  chemically synthesized
ttagggcctctaaaagtattaa

SEQ ID NO: 77607 - DNA, 22 bp, Artificial Sequence
  chemically synthesized
tagggcctctaaaagtattaaa

SEQ ID NO: 77608 - DNA, 22 bp, Artificial Sequence
  chemically synthesized
agggcctctaaaagtattaaag

SEQ ID NO: 77609 - DNA, 22 bp, Artificial Sequence
  chemically synthesized
gggcctctaaaagtattaaagc

SEQ ID NO: 77610 - DNA, 22 bp, Artificial Sequence
  chemically synthesized
taaaagtattaaagcagcggca

SEQ ID NO: 77611 - DNA, 22 bp, Artificial Sequence
  chemically synthesized
aaagtattaaagcagcggcagc

SEQ ID NO: 77612 - DNA, 22 bp, Artificial Sequence
  chemically synthesized
aagcagcggcagccactgcatg

SEQ ID NO: 77613 - DNA, 22 bp, Artificial Sequence
  chemically synthesized
catgcagacctgagggctaggc

SEQ ID NO: 77614 - DNA, 22 bp, Artificial Sequence
  chemically synthesized
agggctaggctaaaacagtaag

SEQ ID NO: 77615 - DNA, 22 bp, Artificial Sequence
  chemically synthesized
ggctaaaacagtaaggtcaagt

SEQ ID NO: 77616 - DNA, 22 bp, Artificial Sequence
  chemically synthesized
aaacagtaaggtcaagttattt

SEQ ID NO: 77617 - DNA, 22 bp, Artificial Sequence
  chemically synthesized
tttggacagaaaggctacaggg

SEQ ID NO: 77618 - DNA, 22 bp, Artificial Sequence
  chemically synthesized
ggacagaaaggctacagggtgc

SEQ ID NO: 77619 - DNA, 22 bp, Artificial Sequence
  chemically synthesized
gacagaaaggctacagggtgca

SEQ ID NO: 77620 - DNA, 22 bp, Artificial Sequence
  chemically synthesized
cagggtgcagtcctggatcttg

SEQ ID NO: 77621 - DNA, 22 bp, Artificial Sequence
  chemically synthesized
gatcttgtgtaagaattctgac

SEQ ID NO: 77622 - DNA, 22 bp, Artificial Sequence
  chemically synthesized
gtgtaagaattctgaccgcact

SEQ ID NO: 77623 - DNA, 22 bp, Artificial Sequence
  chemically synthesized
tgtaagaattctgaccgcacta

SEQ ID NO: 77624 - DNA, 22 bp, Artificial Sequence
  chemically synthesized
tgaccgcactaactatgcctag

SEQ ID NO: 77625 - DNA, 22 bp, Artificial Sequence
  chemically synthesized
accgcactaactatgcctagga

SEQ ID NO: 77626 - DNA, 22 bp, Artificial Sequence
  chemically synthesized
actatgcctaggaaggaaagga

SEQ ID NO: 77627 - DNA, 22 bp, Artificial Sequence
  chemically synthesized
tgcctaggaaggaaaggagttg

SEQ ID NO: 77628 - DNA, 22 bp, Artificial Sequence
  chemically synthesized
ggaaggaaaggagttgttgttt

SEQ ID NO: 77629 - DNA, 22 bp, Artificial Sequence
  chemically synthesized
ttgttttgtagaagggattgag

SEQ ID NO: 77630 - DNA, 22 bp, Artificial Sequence
  chemically synthesized
ttttgtagaagggattgaggtt

SEQ ID NO: 77631 - DNA, 22 bp, Artificial Sequence
  chemically synthesized
tgtagaagggattgaggtttgg

SEQ ID NO: 77632 - DNA, 22 bp, Artificial Sequence
  chemically synthesized
gtagaagggattgaggtttggg

SEQ ID NO: 77633 - DNA, 22 bp, Artificial Sequence
  chemically synthesized
tagaagggattgaggtttggga

SEQ ID NO: 77634 - DNA, 22 bp, Artificial Sequence
  chemically synthesized
aggtttgggagattaatcggac

SEQ ID NO: 77635 - DNA, 22 bp, Artificial Sequence
  chemically synthesized
gggagattaatcggacacaatc

SEQ ID NO: 77636 - DNA, 22 bp, Artificial Sequence
  chemically synthesized
ggagattaatcggacacaatca

SEQ ID NO: 77637 - DNA, 22 bp, Artificial Sequence
  chemically synthesized
atcggacacaatcagcagggag

SEQ ID NO: 77638 - DNA, 22 bp, Artificial Sequence
  chemically synthesized
ttatgagaattatgccgagata

SEQ ID NO: 77639 - DNA, 22 bp, Artificial Sequence
  chemically synthesized
tatgagaattatgccgagatag

SEQ ID NO: 77640 - DNA, 22 bp, Artificial Sequence
  chemically synthesized
atgagaattatgccgagatagg

SEQ ID NO: 77641 - DNA, 22 bp, Artificial Sequence
  chemically synthesized
tgagaattatgccgagataggt

SEQ ID NO: 77642 - DNA, 22 bp, Artificial Sequence
  chemically synthesized
tgccgagataggtaacacatga

SEQ ID NO: 77643 - DNA, 22 bp, Artificial Sequence
  chemically synthesized
gggcttgactgaagtaatgggg

SEQ ID NO: 77644 - DNA, 22 bp, Artificial Sequence
  chemically synthesized
ggcttgactgaagtaatggggt

SEQ ID NO: 77645 - DNA, 22 bp, Artificial Sequence
  chemically synthesized
gactgaagtaatggggtctgtc

SEQ ID NO: 77646 - DNA, 22 bp, Artificial Sequence
  chemically synthesized
actgaagtaatggggtctgtct

SEQ ID NO: 77647 - DNA, 22 bp, Artificial Sequence
  chemically synthesized
aagtaatggggtctgtctgtga

SEQ ID NO: 77648 - DNA, 22 bp, Artificial Sequence
  chemically synthesized
tctgtgaagccttgcagcagta

SEQ ID NO: 77649 - DNA, 22 bp, Artificial Sequence
  chemically synthesized
tgaagccttgcagcagtacagc

SEQ ID NO: 77650 - DNA, 22 bp, Artificial Sequence
  chemically synthesized
gcagcagtacagcccaggtaat

SEQ ID NO: 77651 - DNA, 22 bp, Artificial Sequence
  chemically synthesized
cagcagtacagcccaggtaatt

SEQ ID NO: 77652 - DNA, 22 bp, Artificial Sequence
  chemically synthesized
gctgagcctaatgggtgtcagt

SEQ ID NO: 77653 - DNA, 22 bp, Artificial Sequence
  chemically synthesized
ctgagcctaatgggtgtcagtg

SEQ ID NO: 77654 - DNA, 22 bp, Artificial Sequence
  chemically synthesized
agcctaatgggtgtcagtgtca

SEQ ID NO: 77655 - DNA, 22 bp, Artificial Sequence
  chemically synthesized
atgggtgtcagtgtcagtccaa

SEQ ID NO: 77656 - DNA, 22 bp, Artificial Sequence
  chemically synthesized
gaatgaagggtgcaaaggaata

SEQ ID NO: 77657 - DNA, 22 bp, Artificial Sequence
  chemically synthesized
gagatccagaacagaataatgg

SEQ ID NO: 77658 - DNA, 22 bp, Artificial Sequence
  chemically synthesized
agatccagaacagaataatggg

SEQ ID NO: 77659 - DNA, 22 bp, Artificial Sequence
  chemically synthesized
tagatggaggtattgaggatag

SEQ ID NO: 77660 - DNA, 22 bp, Artificial Sequence
  chemically synthesized
aggataggagagtatatgggtt

SEQ ID NO: 77661 - DNA, 22 bp, Artificial Sequence
  chemically synthesized
ggcaccatggggtggataggca

SEQ ID NO: 77662 - DNA, 22 bp, Artificial Sequence
  chemically synthesized
gcaccatggggtggataggcaa

SEQ ID NO: 77663 - DNA, 22 bp, Artificial Sequence
  chemically synthesized
ggttgataagatgcagattctg

SEQ ID NO: 77664 - DNA, 22 bp, Artificial Sequence
  chemically synthesized
gttgataagatgcagattctga

SEQ ID NO: 77665 - DNA, 22 bp, Artificial Sequence
  chemically synthesized
ataagatgcagattctgaacta

SEQ ID NO: 77666 - DNA, 22 bp, Artificial Sequence
  chemically synthesized
tgaactaacctgtaaggcttgt

SEQ ID NO: 77667 - DNA, 22 bp, Artificial Sequence
  chemically synthesized
aactaacctgtaaggcttgtct

SEQ ID NO: 77668 - DNA, 22 bp, Artificial Sequence
  chemically synthesized
acctgtaaggcttgtctggttt

SEQ ID NO: 77669 - DNA, 22 bp, Artificial Sequence
  chemically synthesized
taaggcttgtctggttttagga

SEQ ID NO: 77670 - DNA, 22 bp, Artificial Sequence
  chemically synthesized
gtctggttttaggacaggtaaa

SEQ ID NO: 77671 - DNA, 22 bp, Artificial Sequence
  chemically synthesized
tctggttttaggacaggtaaaa

SEQ ID NO: 77672 - DNA, 22 bp, Artificial Sequence
  chemically synthesized
gttttaggacaggtaaaatggg

SEQ ID NO: 77673 - DNA, 22 bp, Artificial Sequence
  chemically synthesized
taggacaggtaaaatgggggaa

SEQ ID NO: 77674 - DNA, 22 bp, Artificial Sequence
  chemically synthesized
aggacaggtaaaatgggggaat

SEQ ID NO: 77675 - DNA, 22 bp, Artificial Sequence
  chemically synthesized
ggacaggtaaaatgggggaatg

SEQ ID NO: 77676 - DNA, 22 bp, Artificial Sequence
  chemically synthesized
ataggctttaaaaggccatgct

SEQ ID NO: 77677 - DNA, 22 bp, Artificial Sequence
  chemically synthesized
taggctttaaaaggccatgctg

SEQ ID NO: 77678 - DNA, 22 bp, Artificial Sequence
  chemically synthesized
taaaaggccatgctgtaacagg

SEQ ID NO: 77679 - DNA, 22 bp, Artificial Sequence
  chemically synthesized
aaaaggccatgctgtaacaggc

SEQ ID NO: 77680 - DNA, 22 bp, Artificial Sequence
  chemically synthesized
aaaggccatgctgtaacaggca

SEQ ID NO: 77681 - DNA, 22 bp, Artificial Sequence
  chemically synthesized
taacaggcaagtaataacaggc

SEQ ID NO: 77682 - DNA, 22 bp, Artificial Sequence
  chemically synthesized
taatcctttcaaagcatgctgt

SEQ ID NO: 77683 - DNA, 22 bp, Artificial Sequence
  chemically synthesized
aatcctttcaaagcatgctgtg

SEQ ID NO: 77684 - DNA, 22 bp, Artificial Sequence
  chemically synthesized
atcctttcaaagcatgctgtgg

SEQ ID NO: 77685 - DNA, 22 bp, Artificial Sequence
  chemically synthesized
tcaaagcatgctgtgggatggg

SEQ ID NO: 77686 - DNA, 22 bp, Artificial Sequence
  chemically synthesized
caaagcatgctgtgggatggga

SEQ ID NO: 77687 - DNA, 22 bp, Artificial Sequence
  chemically synthesized
aaagcatgctgtgggatgggat

SEQ ID NO: 77688 - DNA, 22 bp, Artificial Sequence
  chemically synthesized
tgggatgggatactggcattga

SEQ ID NO: 77689 - DNA, 22 bp, Artificial Sequence
  chemically synthesized
gcattgagcggggtaagagtga

SEQ ID NO: 77690 - DNA, 22 bp, Artificial Sequence
  chemically synthesized
agcggggtaagagtgattaggt

SEQ ID NO: 77691 - DNA, 22 bp, Artificial Sequence
  chemically synthesized
ggttttaatgggatggtaaggg

SEQ ID NO: 77692 - DNA, 22 bp, Artificial Sequence
  chemically synthesized
taatgggatggtaaggggcgca

SEQ ID NO: 77693 - DNA, 22 bp, Artificial Sequence
  chemically synthesized
aatgggatggtaaggggcgcat

SEQ ID NO: 77694 - DNA, 22 bp, Artificial Sequence
  chemically synthesized
atgggatggtaaggggcgcatg

SEQ ID NO: 77695 - DNA, 22 bp, Artificial Sequence
  chemically synthesized
atacttgtggattaaggtgggg

SEQ ID NO: 77696 - DNA, 22 bp, Artificial Sequence
  chemically synthesized
tacttgtggattaaggtgggga

SEQ ID NO: 77697 - DNA, 22 bp, Artificial Sequence
  chemically synthesized
gtggattaaggtggggagatac

SEQ ID NO: 77698 - DNA, 22 bp, Artificial Sequence
  chemically synthesized
tggattaaggtggggagataca

SEQ ID NO: 77699 - DNA, 22 bp, Artificial Sequence
  chemically synthesized
aggtggggagatacaaggggag

SEQ ID NO: 77700 - DNA, 22 bp, Artificial Sequence
  chemically synthesized
tgaactgggggaaaacatggca

SEQ ID NO: 77701 - DNA, 22 bp, Artificial Sequence
  chemically synthesized
gaactgggggaaaacatggcaa

SEQ ID NO: 77702 - DNA, 22 bp, Artificial Sequence
  chemically synthesized
aactgggggaaaacatggcaat

SEQ ID NO: 77703 - DNA, 22 bp, Artificial Sequence
  chemically synthesized
ggggaaaacatggcaatgaggt

SEQ ID NO: 77704 - DNA, 22 bp, Artificial Sequence
  chemically synthesized
tagcccaggaatagtcagggaa

SEQ ID NO: 77705 - DNA, 22 bp, Artificial Sequence
  chemically synthesized
agttaaagtgtctcggcctaat

SEQ ID NO: 77706 - DNA, 22 bp, Artificial Sequence
  chemically synthesized
gttaaagtgtctcggcctaata

SEQ ID NO: 77707 - DNA, 22 bp, Artificial Sequence
  chemically synthesized
aagtgtctcggcctaataaggg

SEQ ID NO: 77708 - DNA, 22 bp, Artificial Sequence
  chemically synthesized
ggcctaataagggaactggcag

SEQ ID NO: 77709 - DNA, 22 bp, Artificial Sequence
  chemically synthesized
ataagggaactggcaggtgggg

SEQ ID NO: 77710 - DNA, 22 bp, Artificial Sequence
  chemically synthesized
gcaggtggggataatgaaaaag

SEQ ID NO: 77711 - DNA, 22 bp, Artificial Sequence
  chemically synthesized
aaaagagtatcgtctcggttag

SEQ ID NO: 77712 - DNA, 22 bp, Artificial Sequence
  chemically synthesized
aaagagtatcgtctcggttagc

SEQ ID NO: 77713 - DNA, 22 bp, Artificial Sequence
  chemically synthesized
ggttagcaccagagttggggaa

SEQ ID NO: 77714 - DNA, 22 bp, Artificial Sequence
  chemically synthesized
gcaccagagttggggaatttta

SEQ ID NO: 77715 - DNA, 22 bp, Artificial Sequence
  chemically synthesized
gggaattttaagaggtttagaa

SEQ ID NO: 77716 - DNA, 22 bp, Artificial Sequence
  chemically synthesized
taagaggtttagaagcctggcc

SEQ ID NO: 77717 - DNA, 22 bp, Artificial Sequence
  chemically synthesized
aagaggtttagaagcctggcca

SEQ ID NO: 77718 - DNA, 22 bp, Artificial Sequence
  chemically synthesized
agaggtttagaagcctggccat

SEQ ID NO: 77719 - DNA, 22 bp, Artificial Sequence
  chemically synthesized
agaagcctggccatcaatacct

SEQ ID NO: 77720 - DNA, 22 bp, Artificial Sequence
  chemically synthesized
gaagcctggccatcaataccta

SEQ ID NO: 77721 - DNA, 22 bp, Artificial Sequence
  chemically synthesized
gccatcaatacctacaacagtt

SEQ ID NO: 77722 - DNA, 22 bp, Artificial Sequence
  chemically synthesized
caacagttatggaggcaaggga

SEQ ID NO: 77723 - DNA, 22 bp, Artificial Sequence
  chemically synthesized
tggaggcaagggaaacaggcct

SEQ ID NO: 77724 - DNA, 22 bp, Artificial Sequence
  chemically synthesized
tgaaaagaaggtaatgtggagt

SEQ ID NO: 77725 - DNA, 22 bp, Artificial Sequence
  chemically synthesized
gaaaagaaggtaatgtggagtg

SEQ ID NO: 77726 - DNA, 22 bp, Artificial Sequence
  chemically synthesized
aaaagaaggtaatgtggagtgg

SEQ ID NO: 77727 - DNA, 22 bp, Artificial Sequence
  chemically synthesized
catactgattaagaagggtaca

SEQ ID NO: 77728 - DNA, 22 bp, Artificial Sequence
  chemically synthesized
attaagaagggtacagacttac

SEQ ID NO: 77729 - DNA, 22 bp, Artificial Sequence
  chemically synthesized
agaagggtacagacttaccctc

SEQ ID NO: 77730 - DNA, 22 bp, Artificial Sequence
  chemically synthesized
accctccactgtgagaattacc

SEQ ID NO: 77731 - DNA, 22 bp, Artificial Sequence
  chemically synthesized
ccctccactgtgagaattacct

SEQ ID NO: 77732 - DNA, 22 bp, Artificial Sequence
  chemically synthesized
cactgtgagaattacctaaagc

SEQ ID NO: 77733 - DNA, 22 bp, Artificial Sequence
  chemically synthesized
tgagaattacctaaagctcggt

SEQ ID NO: 77734 - DNA, 22 bp, Artificial Sequence
  chemically synthesized
cctaaagctcggtgtctgtgat

SEQ ID NO: 77735 - DNA, 22 bp, Artificial Sequence
  chemically synthesized
aagctcggtgtctgtgatggtc

SEQ ID NO: 77736 - DNA, 22 bp, Artificial Sequence
  chemically synthesized
ggtgtctgtgatggtctacagg

SEQ ID NO: 77737 - DNA, 22 bp, Artificial Sequence
  chemically synthesized
tgatggtctacagggcttccga

SEQ ID NO: 77738 - DNA, 22 bp, Artificial Sequence
  chemically synthesized
cagggcttccgaggcgatcagg

SEQ ID NO: 77739 - DNA, 22 bp, Artificial Sequence
  chemically synthesized
ccgaggcgatcaggcagtggca

SEQ ID NO: 77740 - DNA, 22 bp, Artificial Sequence
  chemically synthesized
cgaggcgatcaggcagtggcag

SEQ ID NO: 77741 - DNA, 22 bp, Artificial Sequence
  chemically synthesized
cagctgcaaagccgagaagatc

SEQ ID NO: 77742 - DNA, 22 bp, Artificial Sequence
  chemically synthesized
agctgcaaagccgagaagatct

SEQ ID NO: 77743 - DNA, 22 bp, Artificial Sequence
  chemically synthesized
caaagccgagaagatctgggaa

SEQ ID NO: 77744 - DNA, 22 bp, Artificial Sequence
  chemically synthesized
ggaaggagtcagtcagggagcc

SEQ ID NO: 77745 - DNA, 22 bp, Artificial Sequence
  chemically synthesized
gggccagagttccaggggctct

SEQ ID NO: 77746 - DNA, 22 bp, Artificial Sequence
  chemically synthesized
ggccagagttccaggggctcta

SEQ ID NO: 77747 - DNA, 22 bp, Artificial Sequence
  chemically synthesized
caggggctctaggagtggctgc

SEQ ID NO: 77748 - DNA, 22 bp, Artificial Sequence
  chemically synthesized
taggagtggctgccaggtgagt

SEQ ID NO: 77749 - DNA, 22 bp, Artificial Sequence
  chemically synthesized
ggagtggctgccaggtgagttg

SEQ ID NO: 77750 - DNA, 22 bp, Artificial Sequence
  chemically synthesized
ccaggtgagttgaacagtccga

SEQ ID NO: 77751 - DNA, 22 bp, Artificial Sequence
  chemically synthesized
aacagtccgatttctagtgggg

SEQ ID NO: 77752 - DNA, 22 bp, Artificial Sequence
  chemically synthesized
ctagtggggtcctgcacagatg

SEQ ID NO: 77753 - DNA, 22 bp, Artificial Sequence
  chemically synthesized
tagtggggtcctgcacagatgg

SEQ ID NO: 77754 - DNA, 22 bp, Artificial Sequence
  chemically synthesized
gtggggtcctgcacagatggga

SEQ ID NO: 77755 - DNA, 22 bp, Artificial Sequence
  chemically synthesized
cacagatgggacacggcttagg

SEQ ID NO: 77756 - DNA, 22 bp, Artificial Sequence
  chemically synthesized
aggaggaatcctgggctgcggg

SEQ ID NO: 77757 - DNA, 22 bp, Artificial Sequence
  chemically synthesized
ggaggaatcctgggctgcgggc

SEQ ID NO: 77758 - DNA, 22 bp, Artificial Sequence
  chemically synthesized
ggctgcgggcattccttggcct

SEQ ID NO: 77759 - DNA, 22 bp, Artificial Sequence
  chemically synthesized
cgggcattccttggcctggtgg

SEQ ID NO: 77760 - DNA, 22 bp, Artificial Sequence
  chemically synthesized
cttggcctggtggccagatttc

SEQ ID NO: 77761 - DNA, 22 bp, Artificial Sequence
  chemically synthesized
ggcctggtggccagatttctgg

SEQ ID NO: 77762 - DNA, 22 bp, Artificial Sequence
  chemically synthesized
gcctggtggccagatttctggc

SEQ ID NO: 77763 - DNA, 22 bp, Artificial Sequence
  chemically synthesized
gtggccagatttctggcacttg

SEQ ID NO: 77764 - DNA, 22 bp, Artificial Sequence
  chemically synthesized
ctggcacttgtagcaagctcct

SEQ ID NO: 77765 - DNA, 22 bp, Artificial Sequence
  chemically synthesized
tggcacttgtagcaagctcctg

SEQ ID NO: 77766 - DNA, 22 bp, Artificial Sequence
  chemically synthesized
gcacttgtagcaagctcctggg

SEQ ID NO: 77767 - DNA, 22 bp, Artificial Sequence
  chemically synthesized
gtagcaagctcctgggggaggt

SEQ ID NO: 77768 - DNA, 22 bp, Artificial Sequence
  chemically synthesized
tagcaagctcctgggggaggtg

SEQ ID NO: 77769 - DNA, 22 bp, Artificial Sequence
  chemically synthesized
ctgggggaggtggttccggagg

SEQ ID NO: 77770 - DNA, 22 bp, Artificial Sequence
  chemically synthesized
ggggaggtggttccggaggaac

SEQ ID NO: 77771 - DNA, 22 bp, Artificial Sequence
  chemically synthesized
cggaggaacgcctggccactgc

SEQ ID NO: 77772 - DNA, 22 bp, Artificial Sequence
  chemically synthesized
gccactgcggtttaggcatttg

SEQ ID NO: 77773 - DNA, 22 bp, Artificial Sequence
  chemically synthesized
cggtttaggcatttggaagttc

SEQ ID NO: 77774 - DNA, 22 bp, Artificial Sequence
  chemically synthesized
aggcatttggaagttcttgtgt

SEQ ID NO: 77775 - DNA, 22 bp, Artificial Sequence
  chemically synthesized
ggcatttggaagttcttgtgtg

SEQ ID NO: 77776 - DNA, 22 bp, Artificial Sequence
  chemically synthesized
ggaagttcttgtgtgctggaga

SEQ ID NO: 77777 - DNA, 22 bp, Artificial Sequence
  chemically synthesized
gaagttcttgtgtgctggagat

SEQ ID NO: 77778 - DNA, 22 bp, Artificial Sequence
  chemically synthesized
ttgtgtgctggagatgtggctg

SEQ ID NO: 77779 - DNA, 22 bp, Artificial Sequence
  chemically synthesized
gtgtgctggagatgtggctggg

SEQ ID NO: 77780 - DNA, 22 bp, Artificial Sequence
  chemically synthesized
tgtgctggagatgtggctgggg

SEQ ID NO: 77781 - DNA, 22 bp, Artificial Sequence
  chemically synthesized
gagatgtggctggggtttgtct

SEQ ID NO: 77782 - DNA, 22 bp, Artificial Sequence
  chemically synthesized
gggtttgtctcacagtggaggc

SEQ ID NO: 77783 - DNA, 22 bp, Artificial Sequence
  chemically synthesized
gtctcacagtggaggcaaggaa

SEQ ID NO: 77784 - DNA, 22 bp, Artificial Sequence
  chemically synthesized
tctcacagtggaggcaaggaat

SEQ ID NO: 77785 - DNA, 22 bp, Artificial Sequence
  chemically synthesized
acagtggaggcaaggaattgca

SEQ ID NO: 77786 - DNA, 22 bp, Artificial Sequence
  chemically synthesized
caactcaaaaatatgttgctac

SEQ ID NO: 77787 - DNA, 22 bp, Artificial Sequence
  chemically synthesized
aaaaatatgttgctacttggct

SEQ ID NO: 77788 - DNA, 22 bp, Artificial Sequence
  chemically synthesized
ctacttggctgcctctactcta

SEQ ID NO: 77789 - DNA, 22 bp, Artificial Sequence
  chemically synthesized
cttggctgcctctactctatta

SEQ ID NO: 77790 - DNA, 22 bp, Artificial Sequence
  chemically synthesized
ggctgcctctactctattattg

SEQ ID NO: 77791 - DNA, 22 bp, Artificial Sequence
  chemically synthesized
gctgcctctactctattattgt

SEQ ID NO: 77792 - DNA, 22 bp, Artificial Sequence
  chemically synthesized
cctctactctattattgtacac

SEQ ID NO: 77793 - DNA, 22 bp, Artificial Sequence
  chemically synthesized
tactctattattgtacaccttg

SEQ ID NO: 77794 - DNA, 22 bp, Artificial Sequence
  chemically synthesized
ctctattattgtacaccttgaa

SEQ ID NO: 77795 - DNA, 22 bp, Artificial Sequence
  chemically synthesized
tattattgtacaccttgaaggt

SEQ ID NO: 77796 - DNA, 22 bp, Artificial Sequence
  chemically synthesized
ttattgtacaccttgaaggtga

SEQ ID NO: 77797 - DNA, 22 bp, Artificial Sequence
  chemically synthesized
ttgtacaccttgaaggtgaggt

SEQ ID NO: 77798 - DNA, 22 bp, Artificial Sequence
  chemically synthesized
tacaccttgaaggtgaggttaa

SEQ ID NO: 77799 - DNA, 22 bp, Artificial Sequence
  chemically synthesized
gaaggtgaggttaattgagtcc

SEQ ID NO: 77800 - DNA, 22 bp, Artificial Sequence
  chemically synthesized
aaggtgaggttaattgagtcct

SEQ ID NO: 77801 - DNA, 22 bp, Artificial Sequence
  chemically synthesized
attgagtcctgttgtggggttt

SEQ ID NO: 77802 - DNA, 22 bp, Artificial Sequence
  chemically synthesized
agtcctgttgtggggtttgagg

SEQ ID NO: 77803 - DNA, 22 bp, Artificial Sequence
  chemically synthesized
ttgtggggtttgaggtccagaa

SEQ ID NO: 77804 - DNA, 22 bp, Artificial Sequence
  chemically synthesized
tggggtttgaggtccagaattt

SEQ ID NO: 77805 - DNA, 22 bp, Artificial Sequence
  chemically synthesized
gaggtccagaatttaatttttg

SEQ ID NO: 77806 - DNA, 22 bp, Artificial Sequence
  chemically synthesized
aggtccagaatttaatttttgg

SEQ ID NO: 77807 - DNA, 22 bp, Artificial Sequence
  chemically synthesized
aatttttggagttttatttaat

SEQ ID NO: 77808 - DNA, 22 bp, Artificial Sequence
  chemically synthesized
atttttggagttttatttaatg

SEQ ID NO: 77809 - DNA, 22 bp, Artificial Sequence
  chemically synthesized
ttggagttttatttaatgtcag

SEQ ID NO: 77810 - DNA, 22 bp, Artificial Sequence
  chemically synthesized
tggagttttatttaatgtcagg

SEQ ID NO: 77811 - DNA, 22 bp, Artificial Sequence
  chemically synthesized
ggagttttatttaatgtcagga

SEQ ID NO: 77812 - DNA, 22 bp, Artificial Sequence
  chemically synthesized
gagttttatttaatgtcaggag

SEQ ID NO: 77813 - DNA, 22 bp, Artificial Sequence
  chemically synthesized
tatttaatgtcaggagcagatt

SEQ ID NO: 77814 - DNA, 22 bp, Artificial Sequence
  chemically synthesized
atttaatgtcaggagcagattg

SEQ ID NO: 77815 - DNA, 22 bp, Artificial Sequence
  chemically synthesized
tttaatgtcaggagcagattgg

SEQ ID NO: 77816 - DNA, 22 bp, Artificial Sequence
  chemically synthesized
aatgtcaggagcagattgggta

SEQ ID NO: 77817 - DNA, 22 bp, Artificial Sequence
  chemically synthesized
atgtcaggagcagattgggtaa

SEQ ID NO: 77818 - DNA, 22 bp, Artificial Sequence
  chemically synthesized
ggtaataaaatgtatattgaga

SEQ ID NO: 77819 - DNA, 22 bp, Artificial Sequence
  chemically synthesized
agaataaagtggccttttgtcc

SEQ ID NO: 77820 - DNA, 22 bp, Artificial Sequence
  chemically synthesized
ttgtccttttagggtctagggc

SEQ ID NO: 77821 - DNA, 22 bp, Artificial Sequence
  chemically synthesized
tgtccttttagggtctagggct

SEQ ID NO: 77822 - DNA, 22 bp, Artificial Sequence
  chemically synthesized
gtccttttagggtctagggctg

SEQ ID NO: 77823 - DNA, 22 bp, Artificial Sequence
  chemically synthesized
tccttttagggtctagggctgt

SEQ ID NO: 77824 - DNA, 22 bp, Artificial Sequence
  chemically synthesized
ttagggtctagggctgtaaagc

SEQ ID NO: 77825 - DNA, 22 bp, Artificial Sequence
  chemically synthesized
tagggtctagggctgtaaagcg

SEQ ID NO: 77826 - DNA, 22 bp, Artificial Sequence
  chemically synthesized
agggtctagggctgtaaagcgt

SEQ ID NO: 77827 - DNA, 22 bp, Artificial Sequence
  chemically synthesized
gggtctagggctgtaaagcgtc

SEQ ID NO: 77828 - DNA, 22 bp, Artificial Sequence
  chemically synthesized
gggctgtaaagcgtctcagggt

SEQ ID NO: 77829 - DNA, 22 bp, Artificial Sequence
  chemically synthesized
taaagcgtctcagggttgctgc

SEQ ID NO: 77830 - DNA, 22 bp, Artificial Sequence
  chemically synthesized
agggttgctgccgaacgagcca

SEQ ID NO: 77831 - DNA, 22 bp, Artificial Sequence
  chemically synthesized
ctgccgaacgagccatgaactg

SEQ ID NO: 77832 - DNA, 22 bp, Artificial Sequence
  chemically synthesized
ccgaacgagccatgaactgggc

SEQ ID NO: 77833 - DNA, 22 bp, Artificial Sequence
  chemically synthesized
ggctgggtttttcatatttgat

SEQ ID NO: 77834 - DNA, 22 bp, Artificial Sequence
  chemically synthesized
ggtttttcatatttgatgaaag

SEQ ID NO: 77835 - DNA, 22 bp, Artificial Sequence
  chemically synthesized
ttcatatttgatgaaagagcct

SEQ ID NO: 77836 - DNA, 22 bp, Artificial Sequence
  chemically synthesized
tcatatttgatgaaagagccta

SEQ ID NO: 77837 - DNA, 22 bp, Artificial Sequence
  chemically synthesized
catatttgatgaaagagcctaa

SEQ ID NO: 77838 - DNA, 22 bp, Artificial Sequence
  chemically synthesized
atatttgatgaaagagcctaaa

SEQ ID NO: 77839 - DNA, 22 bp, Artificial Sequence
  chemically synthesized
gatgaaagagcctaaacgctct

SEQ ID NO: 77840 - DNA, 22 bp, Artificial Sequence
  chemically synthesized
atgaaagagcctaaacgctctg

SEQ ID NO: 77841 - DNA, 22 bp, Artificial Sequence
  chemically synthesized
aacgctctgattcgggagaggt

SEQ ID NO: 77842 - DNA, 22 bp, Artificial Sequence
  chemically synthesized
tgattcgggagaggtcggataa

SEQ ID NO: 77843 - DNA, 22 bp, Artificial Sequence
  chemically synthesized
attcgggagaggtcggataaag

SEQ ID NO: 77844 - DNA, 22 bp, Artificial Sequence
  chemically synthesized
gggagaggtcggataaagaaaa

SEQ ID NO: 77845 - DNA, 22 bp, Artificial Sequence
  chemically synthesized
accttgactacgcctttagctt

SEQ ID NO: 77846 - DNA, 22 bp, Artificial Sequence
  chemically synthesized
gactacgcctttagcttcagcc

SEQ ID NO: 77847 - DNA, 22 bp, Artificial Sequence
  chemically synthesized
actacgcctttagcttcagcca

SEQ ID NO: 77848 - DNA, 22 bp, Artificial Sequence
  chemically synthesized
cgcctttagcttcagccacctt

SEQ ID NO: 77849 - DNA, 22 bp, Artificial Sequence
  chemically synthesized
tagcttcagccaccttcttaat

SEQ ID NO: 77850 - DNA, 22 bp, Artificial Sequence
  chemically synthesized
agcttcagccaccttcttaata

SEQ ID NO: 77851 - DNA, 22 bp, Artificial Sequence
  chemically synthesized
gcttcagccaccttcttaatag

SEQ ID NO: 77852 - DNA, 22 bp, Artificial Sequence
  chemically synthesized
cagccaccttcttaataggaaa

SEQ ID NO: 77853 - DNA, 22 bp, Artificial Sequence
  chemically synthesized
agccaccttcttaataggaaat

SEQ ID NO: 77854 - DNA, 22 bp, Artificial Sequence
  chemically synthesized
cttaataggaaattgctgggca

SEQ ID NO: 77855 - DNA, 22 bp, Artificial Sequence
  chemically synthesized
ttaataggaaattgctgggcag

SEQ ID NO: 77856 - DNA, 22 bp, Artificial Sequence
  chemically synthesized
aataggaaattgctgggcaggt

SEQ ID NO: 77857 - DNA, 22 bp, Artificial Sequence
  chemically synthesized
ataggaaattgctgggcaggtt

SEQ ID NO: 77858 - DNA, 22 bp, Artificial Sequence
  chemically synthesized
ctgggcaggttggggagggcta

SEQ ID NO: 77859 - DNA, 22 bp, Artificial Sequence
  chemically synthesized
ggcaggttggggagggctagtc

SEQ ID NO: 77860 - DNA, 22 bp, Artificial Sequence
  chemically synthesized
gggagggctagtcacggaatga

SEQ ID NO: 77861 - DNA, 22 bp, Artificial Sequence
  chemically synthesized
gtcacggaatgaaactgtaaac

SEQ ID NO: 77862 - DNA, 22 bp, Artificial Sequence
  chemically synthesized
taaaccggaccgggtgtgagga

SEQ ID NO: 77863 - DNA, 22 bp, Artificial Sequence
  chemically synthesized
cagggtggaggagctgaggctg

SEQ ID NO: 77864 - DNA, 22 bp, Artificial Sequence
  chemically synthesized
aggctgaggaagatttgggacc

SEQ ID NO: 77865 - DNA, 22 bp, Artificial Sequence
  chemically synthesized
aggaagatttgggacctagctc

SEQ ID NO: 77866 - DNA, 22 bp, Artificial Sequence
  chemically synthesized
gggacctagctcggcctggcaa

SEQ ID NO: 77867 - DNA, 22 bp, Artificial Sequence
  chemically synthesized
ggacctagctcggcctggcaag

SEQ ID NO: 77868 - DNA, 22 bp, Artificial Sequence
  chemically synthesized
gctcggcctggcaaggagcagc

SEQ ID NO: 77869 - DNA, 22 bp, Artificial Sequence
  chemically synthesized
ggcctggcaaggagcagcctgg

SEQ ID NO: 77870 - DNA, 22 bp, Artificial Sequence
  chemically synthesized
gcaaggagcagcctggggagga

SEQ ID NO: 77871 - DNA, 22 bp, Artificial Sequence
  chemically synthesized
gggaggaggggagacgtcagat

SEQ ID NO: 77872 - DNA, 22 bp, Artificial Sequence
  chemically synthesized
tagaaaaggaagattagaaaga

SEQ ID NO: 77873 - DNA, 22 bp, Artificial Sequence
  chemically synthesized
gaaagactcagcgacgcttgga

SEQ ID NO: 77874 - DNA, 22 bp, Artificial Sequence
  chemically synthesized
agcgacgcttggagttgggact

SEQ ID NO: 77875 - DNA, 22 bp, Artificial Sequence
  chemically synthesized
ggagttgggactgaggggacag

SEQ ID NO: 77876 - DNA, 22 bp, Artificial Sequence
  chemically synthesized
gagttgggactgaggggacagg

SEQ ID NO: 77877 - DNA, 22 bp, Artificial Sequence
  chemically synthesized
ggactgaggggacaggcgggag

SEQ ID NO: 77878 - DNA, 22 bp, Artificial Sequence
  chemically synthesized
aggggacaggcgggagggaaag

SEQ ID NO: 77879 - DNA, 22 bp, Artificial Sequence
  chemically synthesized
gggacaagttgcattgggaaga

SEQ ID NO: 77880 - DNA, 22 bp, Artificial Sequence
  chemically synthesized
ggacaagttgcattgggaagag

SEQ ID NO: 77881 - DNA, 22 bp, Artificial Sequence
  chemically synthesized
cattgggaagagactagggagg

SEQ ID NO: 77882 - DNA, 22 bp, Artificial Sequence
  chemically synthesized
ggaagagactagggagggacca

SEQ ID NO: 77883 - DNA, 22 bp, Artificial Sequence
  chemically synthesized
gggagggaccaatgtgtaaaag

SEQ ID NO: 77884 - DNA, 22 bp, Artificial Sequence
  chemically synthesized
gacgtcaggcacctcagactgt

SEQ ID NO: 77885 - DNA, 22 bp, Artificial Sequence
  chemically synthesized
agactgtttgcctgttttacga

SEQ ID NO: 77886 - DNA, 22 bp, Artificial Sequence
  chemically synthesized
tttgcctgttttacgacaaaaa

SEQ ID NO: 77887 - DNA, 22 bp, Artificial Sequence
  chemically synthesized
gcctgttttacgacaaaaatta

SEQ ID NO: 77888 - DNA, 22 bp, Artificial Sequence
  chemically synthesized
cctgttttacgacaaaaattat

SEQ ID NO: 77889 - DNA, 22 bp, Artificial Sequence
  chemically synthesized
ttttacgacaaaaattatttag

SEQ ID NO: 77890 - DNA, 22 bp, Artificial Sequence
  chemically synthesized
tacgacaaaaattatttagatc

SEQ ID NO: 77891 - DNA, 22 bp, Artificial Sequence
  chemically synthesized
acgacaaaaattatttagatct

SEQ ID NO: 77892 - DNA, 22 bp, Artificial Sequence
  chemically synthesized
cgacaaaaattatttagatctt

SEQ ID NO: 77893 - DNA, 22 bp, Artificial Sequence
  chemically synthesized
tttagatcttgaagaatggaaa

SEQ ID NO: 77894 - DNA, 22 bp, Artificial Sequence
  chemically synthesized
agatcttgaagaatggaaaaat

SEQ ID NO: 77895 - DNA, 22 bp, Artificial Sequence
  chemically synthesized
gatcttgaagaatggaaaaatt

SEQ ID NO: 77896 - DNA, 22 bp, Artificial Sequence
  chemically synthesized
gaagaatggaaaaattgaaagt

SEQ ID NO: 77897 - DNA, 22 bp, Artificial Sequence
  chemically synthesized
aagaatggaaaaattgaaagtg

SEQ ID NO: 77898 - DNA, 22 bp, Artificial Sequence
  chemically synthesized
aaagtgccattttctggctatt

SEQ ID NO: 77899 - DNA, 22 bp, Artificial Sequence
  chemically synthesized
tctggctatttggaaccactgt

SEQ ID NO: 77900 - DNA, 22 bp, Artificial Sequence
  chemically synthesized
ctggctatttggaaccactgtc

SEQ ID NO: 77901 - DNA, 22 bp, Artificial Sequence
  chemically synthesized
tggctatttggaaccactgtcg

SEQ ID NO: 77902 - DNA, 22 bp, Artificial Sequence
  chemically synthesized
gctatttggaaccactgtcgag

SEQ ID NO: 77903 - DNA, 22 bp, Artificial Sequence
  chemically synthesized
tttggaaccactgtcgagtttg

SEQ ID NO: 77904 - DNA, 22 bp, Artificial Sequence
  chemically synthesized
ggaaccactgtcgagtttgtat

SEQ ID NO: 77905 - DNA, 22 bp, Artificial Sequence
  chemically synthesized
gaaccactgtcgagtttgtatt

SEQ ID NO: 77906 - DNA, 22 bp, Artificial Sequence
  chemically synthesized
tcgagtttgtattggagtcaag

SEQ ID NO: 77907 - DNA, 22 bp, Artificial Sequence
  chemically synthesized
gtattggagtcaagcggccttg

SEQ ID NO: 77908 - DNA, 22 bp, Artificial Sequence
  chemically synthesized
tattggagtcaagcggccttgc

SEQ ID NO: 77909 - DNA, 22 bp, Artificial Sequence
  chemically synthesized
gagtcaagcggccttgcagaag

SEQ ID NO: 77910 - DNA, 22 bp, Artificial Sequence
  chemically synthesized
gcagaagaaaataaggcattta

SEQ ID NO: 77911 - DNA, 22 bp, Artificial Sequence
  chemically synthesized
cagaagaaaataaggcatttag

SEQ ID NO: 77912 - DNA, 22 bp, Artificial Sequence
  chemically synthesized
aggttttaggtcaggtgtgagt

SEQ ID NO: 77913 - DNA, 22 bp, Artificial Sequence
  chemically synthesized
ggttttaggtcaggtgtgagtt

SEQ ID NO: 77914 - DNA, 22 bp, Artificial Sequence
  chemically synthesized
taggtcaggtgtgagttgaaga

SEQ ID NO: 77915 - DNA, 22 bp, Artificial Sequence
  chemically synthesized
aggtcaggtgtgagttgaagag

SEQ ID NO: 77916 - DNA, 22 bp, Artificial Sequence
  chemically synthesized
ggtcaggtgtgagttgaagagg

SEQ ID NO: 77917 - DNA, 22 bp, Artificial Sequence
  chemically synthesized
aagaggttttaagttcttgaga

SEQ ID NO: 77918 - DNA, 22 bp, Artificial Sequence
  chemically synthesized
taagttcttgagagcacaggct

SEQ ID NO: 77919 - DNA, 22 bp, Artificial Sequence
  chemically synthesized
aagttcttgagagcacaggcta

SEQ ID NO: 77920 - DNA, 22 bp, Artificial Sequence
  chemically synthesized
agttcttgagagcacaggctaa

SEQ ID NO: 77921 - DNA, 22 bp, Artificial Sequence
  chemically synthesized
ttgagagcacaggctaagggag

SEQ ID NO: 77922 - DNA, 22 bp, Artificial Sequence
  chemically synthesized
gagagcacaggctaagggagag

SEQ ID NO: 77923 - DNA, 22 bp, Artificial Sequence
  chemically synthesized
agagcacaggctaagggagagg

SEQ ID NO: 77924 - DNA, 22 bp, Artificial Sequence
  chemically synthesized
agggagagggaggaatggaggg

SEQ ID NO: 77925 - DNA, 22 bp, Artificial Sequence
  chemically synthesized
cccctagtgaaggaggcaagcc

SEQ ID NO: 77926 - DNA, 22 bp, Artificial Sequence
  chemically synthesized
gtgaaggaggcaagcccagaga

SEQ ID NO: 77927 - DNA, 22 bp, Artificial Sequence
  chemically synthesized
gggggttcttactcaccagaaa

SEQ ID NO: 77928 - DNA, 22 bp, Artificial Sequence
  chemically synthesized
ttactcaccagaaaaatgggca

SEQ ID NO: 77929 - DNA, 22 bp, Artificial Sequence
  chemically synthesized
actcaccagaaaaatgggcaag

SEQ ID NO: 77930 - DNA, 22 bp, Artificial Sequence
  chemically synthesized
ctcaccagaaaaatgggcaagg

SEQ ID NO: 77931 - DNA, 22 bp, Artificial Sequence
  chemically synthesized
accagaaaaatgggcaaggggt

SEQ ID NO: 77932 - DNA, 22 bp, Artificial Sequence
  chemically synthesized
gggcacggaaataaggggttgg

SEQ ID NO: 77933 - DNA, 22 bp, Artificial Sequence
  chemically synthesized
gggtgcagagataagaggtcag

SEQ ID NO: 77934 - DNA, 22 bp, Artificial Sequence
  chemically synthesized
gggtgcagagataagaggttgg

SEQ ID NO: 77935 - DNA, 22 bp, Artificial Sequence
  chemically synthesized
gggcacagaaataagggatcgg

SEQ ID NO: 77936 - DNA, 22 bp, Artificial Sequence
  chemically synthesized
gggtgcagaaataagggatcag

SEQ ID NO: 77937 - DNA, 22 bp, Artificial Sequence
  chemically synthesized
gggtgcagagataagaggatgg

SEQ ID NO: 77938 - DNA, 22 bp, Artificial Sequence
  chemically synthesized
agataagaggttggggcacaga

SEQ ID NO: 77939 - DNA, 22 bp, Artificial Sequence
  chemically synthesized
gggcacagaaataagggattgg

SEQ ID NO: 77940 - DNA, 22 bp, Artificial Sequence
  chemically synthesized
gggttcttgcccccagaaaagc

SEQ ID NO: 77941 - DNA, 22 bp, Artificial Sequence
  chemically synthesized
ttgcccccagaaaagcagtgaa

SEQ ID NO: 77942 - DNA, 22 bp, Artificial Sequence
  chemically synthesized
gcccccagaaaagcagtgaagg

SEQ ID NO: 77943 - DNA, 22 bp, Artificial Sequence
  chemically synthesized
cccccagaaaagcagtgaaggg

SEQ ID NO: 77944 - DNA, 22 bp, Artificial Sequence
  chemically synthesized
gggtacttacccccctccagaa

SEQ ID NO: 77945 - DNA, 22 bp, Artificial Sequence
  chemically synthesized
acccccctccagaaaagtggga

SEQ ID NO: 77946 - DNA, 22 bp, Artificial Sequence
  chemically synthesized
cccccctccagaaaagtgggat

SEQ ID NO: 77947 - DNA, 22 bp, Artificial Sequence
  chemically synthesized
cagaaaagtgggatttgccgct

SEQ ID NO: 77948 - DNA, 22 bp, Artificial Sequence
  chemically synthesized
gccgctaagggtgaaggaccaa

SEQ ID NO: 77949 - DNA, 22 bp, Artificial Sequence
  chemically synthesized
ccgctaagggtgaaggaccaag

SEQ ID NO: 77950 - DNA, 22 bp, Artificial Sequence
  chemically synthesized
agggtgaaggaccaaggcaggc

SEQ ID NO: 77951 - DNA, 22 bp, Artificial Sequence
  chemically synthesized
cgtggtctgacacctctgaaac

SEQ ID NO: 77952 - DNA, 22 bp, Artificial Sequence
  chemically synthesized
acacctctgaaacatggtttaa

SEQ ID NO: 77953 - DNA, 22 bp, Artificial Sequence
  chemically synthesized
tgaaacatggtttaataatcag

SEQ ID NO: 77954 - DNA, 22 bp, Artificial Sequence
  chemically synthesized
aaacatggtttaataatcagag

SEQ ID NO: 77955 - DNA, 22 bp, Artificial Sequence
  chemically synthesized
aataatcagagaggtgtccctg

SEQ ID NO: 77956 - DNA, 22 bp, Artificial Sequence
  chemically synthesized
ataatcagagaggtgtccctgc

SEQ ID NO: 77957 - DNA, 22 bp, Artificial Sequence
  chemically synthesized
caatgattaaacaccaagggaa

SEQ ID NO: 77958 - DNA, 22 bp, Artificial Sequence
  chemically synthesized
aacaccaagggaaggctgcctt

SEQ ID NO: 77959 - DNA, 22 bp, Artificial Sequence
  chemically synthesized
ccttcccagtccgtgactggca

SEQ ID NO: 77960 - DNA, 22 bp, Artificial Sequence
  chemically synthesized
cccagtccgtgactggcaccgg

SEQ ID NO: 77961 - DNA, 22 bp, Artificial Sequence
  chemically synthesized
ccagtccgtgactggcaccgga

SEQ ID NO: 77962 - DNA, 22 bp, Artificial Sequence
  chemically synthesized
gcaccggagttttgggtccacg

SEQ ID NO: 77963 - DNA, 22 bp, Artificial Sequence
  chemically synthesized
tgggtccacggataaaacatgt

SEQ ID NO: 77964 - DNA, 22 bp, Artificial Sequence
  chemically synthesized
gggtccacggataaaacatgtc

SEQ ID NO: 77965 - DNA, 22 bp, Artificial Sequence
  chemically synthesized
ggtccacggataaaacatgtct

SEQ ID NO: 77966 - DNA, 22 bp, Artificial Sequence
  chemically synthesized
ctttgtctctactggaaaatga

SEQ ID NO: 77967 - DNA, 22 bp, Artificial Sequence
  chemically synthesized
tgtctctactggaaaatgaaag

SEQ ID NO: 77968 - DNA, 22 bp, Artificial Sequence
  chemically synthesized
gtctctactggaaaatgaaagg

SEQ ID NO: 77969 - DNA, 22 bp, Artificial Sequence
  chemically synthesized
tctctactggaaaatgaaagga

SEQ ID NO: 77970 - DNA, 22 bp, Artificial Sequence
  chemically synthesized
tactggaaaatgaaaggaattg

SEQ ID NO: 77971 - DNA, 22 bp, Artificial Sequence
  chemically synthesized
ctggaaaatgaaaggaattgaa

SEQ ID NO: 77972 - DNA, 22 bp, Artificial Sequence
  chemically synthesized
gaaaatgaaaggaattgaaatt

SEQ ID NO: 77973 - DNA, 22 bp, Artificial Sequence
  chemically synthesized
aaattaagagaagggagaaatt

SEQ ID NO: 77974 - DNA, 22 bp, Artificial Sequence
  chemically synthesized
agagaagggagaaattgaagtg

SEQ ID NO: 77975 - DNA, 22 bp, Artificial Sequence
  chemically synthesized
aagtgtggtgccaagattgaaa

SEQ ID NO: 77976 - DNA, 22 bp, Artificial Sequence
  chemically synthesized
aaaggagaaagaagttgaggga

SEQ ID NO: 77977 - DNA, 22 bp, Artificial Sequence
  chemically synthesized
agggatagtgagggaggttgga

SEQ ID NO: 77978 - DNA, 22 bp, Artificial Sequence
  chemically synthesized
gagaagacagtaaaaagaggcc

SEQ ID NO: 77979 - DNA, 22 bp, Artificial Sequence
  chemically synthesized
accggatttgaaattggtgaaa

SEQ ID NO: 77980 - DNA, 22 bp, Artificial Sequence
  chemically synthesized
ccggatttgaaattggtgaaat

SEQ ID NO: 77981 - DNA, 22 bp, Artificial Sequence
  chemically synthesized
gaaattggtgaaatgtttcttg

SEQ ID NO: 77982 - DNA, 22 bp, Artificial Sequence
  chemically synthesized
aaattggtgaaatgtttcttgg

SEQ ID NO: 77983 - DNA, 22 bp, Artificial Sequence
  chemically synthesized
gtgaaatgtttcttgggctggt

SEQ ID NO: 77984 - DNA, 22 bp, Artificial Sequence
  chemically synthesized
cttgggctggtcagtttgagga

SEQ ID NO: 77985 - DNA, 22 bp, Artificial Sequence
  chemically synthesized
ttgggctggtcagtttgaggac

SEQ ID NO: 77986 - DNA, 22 bp, Artificial Sequence
  chemically synthesized
gggctggtcagtttgaggacct

SEQ ID NO: 77987 - DNA, 22 bp, Artificial Sequence
  chemically synthesized
ggctggtcagtttgaggacctg

SEQ ID NO: 77988 - DNA, 22 bp, Artificial Sequence
  chemically synthesized
gtcagtttgaggacctgaggtc

SEQ ID NO: 77989 - DNA, 22 bp, Artificial Sequence
  chemically synthesized
gaggacctgaggtcgtaggtgg

SEQ ID NO: 77990 - DNA, 22 bp, Artificial Sequence
  chemically synthesized
aggacctgaggtcgtaggtgga

SEQ ID NO: 77991 - DNA, 22 bp, Artificial Sequence
  chemically synthesized
aggtcgtaggtggatctttctc

SEQ ID NO: 77992 - DNA, 22 bp, Artificial Sequence
  chemically synthesized
tctcacggagcaaagagcagga

SEQ ID NO: 77993 - DNA, 22 bp, Artificial Sequence
  chemically synthesized
ctcacggagcaaagagcaggag

SEQ ID NO: 77994 - DNA, 22 bp, Artificial Sequence
  chemically synthesized
tcacggagcaaagagcaggagg

SEQ ID NO: 77995 - DNA, 22 bp, Artificial Sequence
  chemically synthesized
acggagcaaagagcaggaggac

SEQ ID NO: 77996 - DNA, 22 bp, Artificial Sequence
  chemically synthesized
atctcccaagggaggtccccca

SEQ ID NO: 77997 - DNA, 22 bp, Artificial Sequence
  chemically synthesized
ccaagggaggtcccccaatctg

SEQ ID NO: 77998 - DNA, 22 bp, Artificial Sequence
  chemically synthesized
agtcacggcaccaaatttcatg

SEQ ID NO: 77999 - DNA, 22 bp, Artificial Sequence
  chemically synthesized
catgcgcgtccatatgaagaga

SEQ ID NO: 78000 - DNA, 22 bp, Artificial Sequence
  chemically synthesized
atgcgcgtccatatgaagagac

SEQ ID NO: 78001 - DNA, 22 bp, Artificial Sequence
  chemically synthesized
ccaaacaggctttgtgtaagca

SEQ ID NO: 78002 - DNA, 22 bp, Artificial Sequence
  chemically synthesized
tgtgtaagcaacaaggctgttt

SEQ ID NO: 78003 - DNA, 22 bp, Artificial Sequence
  chemically synthesized
gtgtaagcaacaaggctgttta

SEQ ID NO: 78004 - DNA, 22 bp, Artificial Sequence
  chemically synthesized
tgtaagcaacaaggctgtttat

SEQ ID NO: 78005 - DNA, 22 bp, Artificial Sequence
  chemically synthesized
tttatttcacctgggtgcaggc

SEQ ID NO: 78006 - DNA, 22 bp, Artificial Sequence
  chemically synthesized
atttcacctgggtgcaggcagg

SEQ ID NO: 78007 - DNA, 22 bp, Artificial Sequence
  chemically synthesized
tttcacctgggtgcaggcaggc

SEQ ID NO: 78008 - DNA, 22 bp, Artificial Sequence
  chemically synthesized
cacctgggtgcaggcaggctga

SEQ ID NO: 78009 - DNA, 22 bp, Artificial Sequence
  chemically synthesized
acctgggtgcaggcaggctgag

SEQ ID NO: 78010 - DNA, 22 bp, Artificial Sequence
  chemically synthesized
ggtgcaggcaggctgagtccaa

SEQ ID NO: 78011 - DNA, 22 bp, Artificial Sequence
  chemically synthesized
agtccaaaaagagagtcagcaa

SEQ ID NO: 78012 - DNA, 22 bp, Artificial Sequence
  chemically synthesized
ttttataagatttgggtaggta

SEQ ID NO: 78013 - DNA, 22 bp, Artificial Sequence
  chemically synthesized
tataagatttgggtaggtaaag

SEQ ID NO: 78014 - DNA, 22 bp, Artificial Sequence
  chemically synthesized
ataagatttgggtaggtaaagg

SEQ ID NO: 78015 - DNA, 22 bp, Artificial Sequence
  chemically synthesized
taagatttgggtaggtaaagga

SEQ ID NO: 78016 - DNA, 22 bp, Artificial Sequence
  chemically synthesized
gggtaggtaaaggaaaattaca

SEQ ID NO: 78017 - DNA, 22 bp, Artificial Sequence
  chemically synthesized
ggtaggtaaaggaaaattacag

SEQ ID NO: 78018 - DNA, 22 bp, Artificial Sequence
  chemically synthesized
cagtcaaaggggggttgttctc

SEQ ID NO: 78019 - DNA, 22 bp, Artificial Sequence
  chemically synthesized
ttctctggcgggcaggagtggg

SEQ ID NO: 78020 - DNA, 22 bp, Artificial Sequence
  chemically synthesized
tctggcgggcaggagtgggggt

SEQ ID NO: 78021 - DNA, 22 bp, Artificial Sequence
  chemically synthesized
tggcgggcaggagtgggggtca

SEQ ID NO: 78022 - DNA, 22 bp, Artificial Sequence
  chemically synthesized
gcgggcaggagtgggggtcaca

SEQ ID NO: 78023 - DNA, 22 bp, Artificial Sequence
  chemically synthesized
agtaggggagcttttgagccag

SEQ ID NO: 78024 - DNA, 22 bp, Artificial Sequence
  chemically synthesized
ttgagccaggatgagccaggag

SEQ ID NO: 78025 - DNA, 22 bp, Artificial Sequence
  chemically synthesized
tgagccaggatgagccaggaga

SEQ ID NO: 78026 - DNA, 22 bp, Artificial Sequence
  chemically synthesized
gagccaggatgagccaggagaa

SEQ ID NO: 78027 - DNA, 22 bp, Artificial Sequence
  chemically synthesized
agccaggatgagccaggagaag

SEQ ID NO: 78028 - DNA, 22 bp, Artificial Sequence
  chemically synthesized
cacaagacaatgtcatcagtta

SEQ ID NO: 78029 - DNA, 22 bp, Artificial Sequence
  chemically synthesized
acaagacaatgtcatcagttaa

SEQ ID NO: 78030 - DNA, 22 bp, Artificial Sequence
  chemically synthesized
aggcaggaacaggccattttca

SEQ ID NO: 78031 - DNA, 22 bp, Artificial Sequence
  chemically synthesized
tcacttcttttgtggtggaatg

SEQ ID NO: 78032 - DNA, 22 bp, Artificial Sequence
  chemically synthesized
cacttcttttgtggtggaatgt

SEQ ID NO: 78033 - DNA, 22 bp, Artificial Sequence
  chemically synthesized
acttcttttgtggtggaatgtc

SEQ ID NO: 78034 - DNA, 22 bp, Artificial Sequence
  chemically synthesized
cttttgtggtggaatgtcatca

SEQ ID NO: 78035 - DNA, 22 bp, Artificial Sequence
  chemically synthesized
ttttgtggtggaatgtcatcag

SEQ ID NO: 78036 - DNA, 22 bp, Artificial Sequence
  chemically synthesized
ttgtggtggaatgtcatcagtt

SEQ ID NO: 78037 - DNA, 22 bp, Artificial Sequence
  chemically synthesized
tgtggtggaatgtcatcagtta

SEQ ID NO: 78038 - DNA, 22 bp, Artificial Sequence
  chemically synthesized
gtggtggaatgtcatcagttaa

SEQ ID NO: 78039 - DNA, 22 bp, Artificial Sequence
  chemically synthesized
tggtggaatgtcatcagttaag

SEQ ID NO: 78040 - DNA, 22 bp, Artificial Sequence
  chemically synthesized
aggcagaaactggccatctgta

SEQ ID NO: 78041 - DNA, 22 bp, Artificial Sequence
  chemically synthesized
gccatctgtatgtgtatatgca

SEQ ID NO: 78042 - DNA, 22 bp, Artificial Sequence
  chemically synthesized
tatgtgtatatgcaggtcacag

SEQ ID NO: 78043 - DNA, 22 bp, Artificial Sequence
  chemically synthesized
agcttgggctcagaggcctgac

SEQ ID NO: 78044 - DNA, 22 bp, Artificial Sequence
  chemically synthesized
gcttgggctcagaggcctgaca

SEQ ID NO: 78045 - DNA, 22 bp, Artificial Sequence
  chemically synthesized
gggctcagaggcctgacattca

SEQ ID NO: 78046 - DNA, 22 bp, Artificial Sequence
  chemically synthesized
ggctcagaggcctgacattcag

SEQ ID NO: 78047 - DNA, 22 bp, Artificial Sequence
  chemically synthesized
agaggcctgacattcaggagca

SEQ ID NO: 78048 - DNA, 22 bp, Artificial Sequence
  chemically synthesized
acattcaggagcatactgtttg

SEQ ID NO: 78049 - DNA, 22 bp, Artificial Sequence
  chemically synthesized
aggagcatactgtttgatttcc

SEQ ID NO: 78050 - DNA, 22 bp, Artificial Sequence
  chemically synthesized
tttgatttccatatgtttctat

SEQ ID NO: 78051 - DNA, 22 bp, Artificial Sequence
  chemically synthesized
gatttccatatgtttctatatt

SEQ ID NO: 78052 - DNA, 22 bp, Artificial Sequence
  chemically synthesized
atttccatatgtttctatattt

SEQ ID NO: 78053 - DNA, 22 bp, Artificial Sequence
  chemically synthesized
ccatatgtttctatattttctg

SEQ ID NO: 78054 - DNA, 22 bp, Artificial Sequence
  chemically synthesized
catatgtttctatattttctga

SEQ ID NO: 78055 - DNA, 22 bp, Artificial Sequence
  chemically synthesized
ctatattttctgatgatcttct

SEQ ID NO: 78056 - DNA, 22 bp, Artificial Sequence
  chemically synthesized
tatattttctgatgatcttctt

SEQ ID NO: 78057 - DNA, 22 bp, Artificial Sequence
  chemically synthesized
tattttctgatgatcttcttgt

SEQ ID NO: 78058 - DNA, 22 bp, Artificial Sequence
  chemically synthesized
tctgatgatcttcttgttattc

SEQ ID NO: 78059 - DNA, 22 bp, Artificial Sequence
  chemically synthesized
ctgatgatcttcttgttattca

SEQ ID NO: 78060 - DNA, 22 bp, Artificial Sequence
  chemically synthesized
tgatgatcttcttgttattcat

SEQ ID NO: 78061 - DNA, 22 bp, Artificial Sequence
  chemically synthesized
atgatcttcttgttattcattt

SEQ ID NO: 78062 - DNA, 22 bp, Artificial Sequence
  chemically synthesized
cttgttattcatttctagtttt

SEQ ID NO: 78063 - DNA, 22 bp, Artificial Sequence
  chemically synthesized
ttgttattcatttctagtttta

SEQ ID NO: 78064 - DNA, 22 bp, Artificial Sequence
  chemically synthesized
gttattcatttctagttttatt

SEQ ID NO: 78065 - DNA, 22 bp, Artificial Sequence
  chemically synthesized
ttattcatttctagttttattc

SEQ ID NO: 78066 - DNA, 22 bp, Artificial Sequence
  chemically synthesized
ttcatttctagttttattccac

SEQ ID NO: 78067 - DNA, 22 bp, Artificial Sequence
  chemically synthesized
atttctagttttattccactgt

SEQ ID NO: 78068 - DNA, 22 bp, Artificial Sequence
  chemically synthesized
ctagttttattccactgtggtc

SEQ ID NO: 78069 - DNA, 22 bp, Artificial Sequence
  chemically synthesized
tagttttattccactgtggtca

SEQ ID NO: 78070 - DNA, 22 bp, Artificial Sequence
  chemically synthesized
gttttattccactgtggtcaga

SEQ ID NO: 78071 - DNA, 22 bp, Artificial Sequence
  chemically synthesized
tattccactgtggtcagaaaat

SEQ ID NO: 78072 - DNA, 22 bp, Artificial Sequence
  chemically synthesized
attccactgtggtcagaaaata

SEQ ID NO: 78073 - DNA, 22 bp, Artificial Sequence
  chemically synthesized
ttccactgtggtcagaaaatat

SEQ ID NO: 78074 - DNA, 22 bp, Artificial Sequence
  chemically synthesized
cactgtggtcagaaaatatact

SEQ ID NO: 78075 - DNA, 22 bp, Artificial Sequence
  chemically synthesized
tggtcagaaaatatacttgata

SEQ ID NO: 78076 - DNA, 22 bp, Artificial Sequence
  chemically synthesized
gataaaatttctacttctgaaa

SEQ ID NO: 78077 - DNA, 22 bp, Artificial Sequence
  chemically synthesized
ataaaatttctacttctgaaaa

SEQ ID NO: 78078 - DNA, 22 bp, Artificial Sequence
  chemically synthesized
ctacttctgaaaaatttgtaca

SEQ ID NO: 78079 - DNA, 22 bp, Artificial Sequence
  chemically synthesized
tacttctgaaaaatttgtacaa

SEQ ID NO: 78080 - DNA, 22 bp, Artificial Sequence
  chemically synthesized
cttctgaaaaatttgtacaaac

SEQ ID NO: 78081 - DNA, 22 bp, Artificial Sequence
  chemically synthesized
ctgaaaaatttgtacaaactta

SEQ ID NO: 78082 - DNA, 22 bp, Artificial Sequence
  chemically synthesized
tgaaaaatttgtacaaacttac

SEQ ID NO: 78083 - DNA, 22 bp, Artificial Sequence
  chemically synthesized
aaaaatttgtacaaacttacct

SEQ ID NO: 78084 - DNA, 22 bp, Artificial Sequence
  chemically synthesized
gtacaaacttaccttgtggcct

SEQ ID NO: 78085 - DNA, 22 bp, Artificial Sequence
  chemically synthesized
tacaaacttaccttgtggccta

SEQ ID NO: 78086 - DNA, 22 bp, Artificial Sequence
  chemically synthesized
accttgtggcctaacatatggc

SEQ ID NO: 78087 - DNA, 22 bp, Artificial Sequence
  chemically synthesized
ccttgtggcctaacatatggcc

SEQ ID NO: 78088 - DNA, 22 bp, Artificial Sequence
  chemically synthesized
gtggcctaacatatggccttat

SEQ ID NO: 78089 - DNA, 22 bp, Artificial Sequence
  chemically synthesized
tggcctaacatatggccttatt

SEQ ID NO: 78090 - DNA, 22 bp, Artificial Sequence
  chemically synthesized
acatatggccttatttaggaaa

SEQ ID NO: 78091 - DNA, 22 bp, Artificial Sequence
  chemically synthesized
atttaggaaaatgttgtacatg

SEQ ID NO: 78092 - DNA, 22 bp, Artificial Sequence
  chemically synthesized
tttaggaaaatgttgtacatgc

SEQ ID NO: 78093 - DNA, 22 bp, Artificial Sequence
  chemically synthesized
aggaaaatgttgtacatgctgc

SEQ ID NO: 78094 - DNA, 22 bp, Artificial Sequence
  chemically synthesized
ggaaaatgttgtacatgctgct

SEQ ID NO: 78095 - DNA, 22 bp, Artificial Sequence
  chemically synthesized
tacatgctgctttaaagaaatg

SEQ ID NO: 78096 - DNA, 22 bp, Artificial Sequence
  chemically synthesized
ctttaaagaaatgtatcttctt

SEQ ID NO: 78097 - DNA, 22 bp, Artificial Sequence
  chemically synthesized
taaagaaatgtatcttcttcag

SEQ ID NO: 78098 - DNA, 22 bp, Artificial Sequence
  chemically synthesized
aaagaaatgtatcttcttcagc

SEQ ID NO: 78099 - DNA, 22 bp, Artificial Sequence
  chemically synthesized
aagaaatgtatcttcttcagca

SEQ ID NO: 78100 - DNA, 22 bp, Artificial Sequence
  chemically synthesized
cttcagcagttgggggacaagt

SEQ ID NO: 78101 - DNA, 22 bp, Artificial Sequence
  chemically synthesized
ttcagcagttgggggacaagtt

SEQ ID NO: 78102 - DNA, 22 bp, Artificial Sequence
  chemically synthesized
cagcagttgggggacaagttct

SEQ ID NO: 78103 - DNA, 22 bp, Artificial Sequence
  chemically synthesized
agcagttgggggacaagttctg

SEQ ID NO: 78104 - DNA, 22 bp, Artificial Sequence
  chemically synthesized
ggggacaagttctgttaatgtc

SEQ ID NO: 78105 - DNA, 22 bp, Artificial Sequence
  chemically synthesized
tgttaatgtcagttgggtctat

SEQ ID NO: 78106 - DNA, 22 bp, Artificial Sequence
  chemically synthesized
ttaatgtcagttgggtctatta

SEQ ID NO: 78107 - DNA, 22 bp, Artificial Sequence
  chemically synthesized
atgtcagttgggtctattagat

SEQ ID NO: 78108 - DNA, 22 bp, Artificial Sequence
  chemically synthesized
ggtctattagatatagtgggta

SEQ ID NO: 78109 - DNA, 22 bp, Artificial Sequence
  chemically synthesized
ttagatatagtgggtacattaa

SEQ ID NO: 78110 - DNA, 22 bp, Artificial Sequence
  chemically synthesized
gatatagtgggtacattaactg

SEQ ID NO: 78111 - DNA, 22 bp, Artificial Sequence
  chemically synthesized
actgtgttgttcatttgttgat

SEQ ID NO: 78112 - DNA, 22 bp, Artificial Sequence
  chemically synthesized
tgttgttcatttgttgattttt

SEQ ID NO: 78113 - DNA, 22 bp, Artificial Sequence
  chemically synthesized
ttcatttgttgatttttagtct

SEQ ID NO: 78114 - DNA, 22 bp, Artificial Sequence
  chemically synthesized
atttgttgatttttagtctggc

SEQ ID NO: 78115 - DNA, 22 bp, Artificial Sequence
  chemically synthesized
gttgatttttagtctggccgat

SEQ ID NO: 78116 - DNA, 22 bp, Artificial Sequence
  chemically synthesized
ttgatttttagtctggccgatc

SEQ ID NO: 78117 - DNA, 22 bp, Artificial Sequence
  chemically synthesized
atttttagtctggccgatctgt

SEQ ID NO: 78118 - DNA, 22 bp, Artificial Sequence
  chemically synthesized
ttagtctggccgatctgttcat

SEQ ID NO: 78119 - DNA, 22 bp, Artificial Sequence
  chemically synthesized
tagtctggccgatctgttcatt

SEQ ID NO: 78120 - DNA, 22 bp, Artificial Sequence
  chemically synthesized
agtctggccgatctgttcatta

SEQ ID NO: 78121 - DNA, 22 bp, Artificial Sequence
  chemically synthesized
gtctggccgatctgttcattac

SEQ ID NO: 78122 - DNA, 22 bp, Artificial Sequence
  chemically synthesized
gccgatctgttcattactgaga

SEQ ID NO: 78123 - DNA, 22 bp, Artificial Sequence
  chemically synthesized
ttcattactgagactgaagtgt

SEQ ID NO: 78124 - DNA, 22 bp, Artificial Sequence
  chemically synthesized
attactgagactgaagtgttta

SEQ ID NO: 78125 - DNA, 22 bp, Artificial Sequence
  chemically synthesized
ctgagactgaagtgtttaaagt

SEQ ID NO: 78126 - DNA, 22 bp, Artificial Sequence
  chemically synthesized
agactgaagtgtttaaagttcc

SEQ ID NO: 78127 - DNA, 22 bp, Artificial Sequence
  chemically synthesized
aagtgtttaaagttccctacta

SEQ ID NO: 78128 - DNA, 22 bp, Artificial Sequence
  chemically synthesized
aaagttccctactattattgta

SEQ ID NO: 78129 - DNA, 22 bp, Artificial Sequence
  chemically synthesized
aagttccctactattattgtat

SEQ ID NO: 78130 - DNA, 22 bp, Artificial Sequence
  chemically synthesized
cctactattattgtattgcagt

SEQ ID NO: 78131 - DNA, 22 bp, Artificial Sequence
  chemically synthesized
ctattattgtattgcagtctgt

SEQ ID NO: 78132 - DNA, 22 bp, Artificial Sequence
  chemically synthesized
ttattgtattgcagtctgtctc

SEQ ID NO: 78133 - DNA, 22 bp, Artificial Sequence
  chemically synthesized
ttgtattgcagtctgtctcgcc

SEQ ID NO: 78134 - DNA, 22 bp, Artificial Sequence
  chemically synthesized
tattgcagtctgtctcgccctt

SEQ ID NO: 78135 - DNA, 22 bp, Artificial Sequence
  chemically synthesized
cagtctgtctcgccctttagga

SEQ ID NO: 78136 - DNA, 22 bp, Artificial Sequence
  chemically synthesized
tctcgccctttaggactattaa

SEQ ID NO: 78137 - DNA, 22 bp, Artificial Sequence
  chemically synthesized
gccctttaggactattaatgtt

SEQ ID NO: 78138 - DNA, 22 bp, Artificial Sequence
  chemically synthesized
taggactattaatgttttcctt

SEQ ID NO: 78139 - DNA, 22 bp, Artificial Sequence
  chemically synthesized
aggactattaatgttttcctta

SEQ ID NO: 78140 - DNA, 22 bp, Artificial Sequence
  chemically synthesized
ggactattaatgttttccttat

SEQ ID NO: 78141 - DNA, 22 bp, Artificial Sequence
  chemically synthesized
ttaatgttttccttatatactt

SEQ ID NO: 78142 - DNA, 22 bp, Artificial Sequence
  chemically synthesized
atgttttccttatatacttggg

SEQ ID NO: 78143 - DNA, 22 bp, Artificial Sequence
  chemically synthesized
tccttatatacttgggaacttt

SEQ ID NO: 78144 - DNA, 22 bp, Artificial Sequence
  chemically synthesized
ccttatatacttgggaactttg

SEQ ID NO: 78145 - DNA, 22 bp, Artificial Sequence
  chemically synthesized
cttatatacttgggaactttga

SEQ ID NO: 78146 - DNA, 22 bp, Artificial Sequence
  chemically synthesized
atatacttgggaactttgatgt

SEQ ID NO: 78147 - DNA, 22 bp, Artificial Sequence
  chemically synthesized
tatacttgggaactttgatgtt

SEQ ID NO: 78148 - DNA, 22 bp, Artificial Sequence
  chemically synthesized
gggaactttgatgttggataca

SEQ ID NO: 78149 - DNA, 22 bp, Artificial Sequence
  chemically synthesized
ggaactttgatgttggatacat

SEQ ID NO: 78150 - DNA, 22 bp, Artificial Sequence
  chemically synthesized
tgatgttggatacatcaatatt

SEQ ID NO: 78151 - DNA, 22 bp, Artificial Sequence
  chemically synthesized
gatgttggatacatcaatattt

SEQ ID NO: 78152 - DNA, 22 bp, Artificial Sequence
  chemically synthesized
atgttggatacatcaatattta

SEQ ID NO: 78153 - DNA, 22 bp, Artificial Sequence
  chemically synthesized
gatacatcaatatttataattg

SEQ ID NO: 78154 - DNA, 22 bp, Artificial Sequence
  chemically synthesized
ataattgtatcctcttgctgaa

SEQ ID NO: 78155 - DNA, 22 bp, Artificial Sequence
  chemically synthesized
taattgtatcctcttgctgaat

SEQ ID NO: 78156 - DNA, 22 bp, Artificial Sequence
  chemically synthesized
tatcctcttgctgaattgaccc

SEQ ID NO: 78157 - DNA, 22 bp, Artificial Sequence
  chemically synthesized
ttgctgaattgacccctttatt

SEQ ID NO: 78158 - DNA, 22 bp, Artificial Sequence
  chemically synthesized
gctgaattgacccctttattat

SEQ ID NO: 78159 - DNA, 22 bp, Artificial Sequence
  chemically synthesized
ctgaattgacccctttattatt

SEQ ID NO: 78160 - DNA, 22 bp, Artificial Sequence
  chemically synthesized
aattgacccctttattattata

SEQ ID NO: 78161 - DNA, 22 bp, Artificial Sequence
  chemically synthesized
acccctttattattatacagtg

SEQ ID NO: 78162 - DNA, 22 bp, Artificial Sequence
  chemically synthesized
tattattatacagtgaccctcc

SEQ ID NO: 78163 - DNA, 22 bp, Artificial Sequence
  chemically synthesized
attattatacagtgaccctcct

SEQ ID NO: 78164 - DNA, 22 bp, Artificial Sequence
  chemically synthesized
ttattatacagtgaccctcctt

SEQ ID NO: 78165 - DNA, 22 bp, Artificial Sequence
  chemically synthesized
ttatacagtgaccctccttatc

SEQ ID NO: 78166 - DNA, 22 bp, Artificial Sequence
  chemically synthesized
tacagtgaccctccttatcttt

SEQ ID NO: 78167 - DNA, 22 bp, Artificial Sequence
  chemically synthesized
cttatcttttcttacagttttt

SEQ ID NO: 78168 - DNA, 22 bp, Artificial Sequence
  chemically synthesized
atcttttcttacagtttttaaa

SEQ ID NO: 78169 - DNA, 22 bp, Artificial Sequence
  chemically synthesized
tcttttcttacagtttttaaat

SEQ ID NO: 78170 - DNA, 22 bp, Artificial Sequence
  chemically synthesized
ttcttacagtttttaaatttgt

SEQ ID NO: 78171 - DNA, 22 bp, Artificial Sequence
  chemically synthesized
tcttacagtttttaaatttgta

SEQ ID NO: 78172 - DNA, 22 bp, Artificial Sequence
  chemically synthesized
cttacagtttttaaatttgtag

SEQ ID NO: 78173 - DNA, 22 bp, Artificial Sequence
  chemically synthesized
ttacagtttttaaatttgtagt

SEQ ID NO: 78174 - DNA, 22 bp, Artificial Sequence
  chemically synthesized
acagtttttaaatttgtagtct

SEQ ID NO: 78175 - DNA, 22 bp, Artificial Sequence
  chemically synthesized
cagtttttaaatttgtagtcta

SEQ ID NO: 78176 - DNA, 22 bp, Artificial Sequence
  chemically synthesized
ttaaatttgtagtctattttat

SEQ ID NO: 78177 - DNA, 22 bp, Artificial Sequence
  chemically synthesized
taaatttgtagtctattttatc

SEQ ID NO: 78178 - DNA, 22 bp, Artificial Sequence
  chemically synthesized
aaatttgtagtctattttatct

SEQ ID NO: 78179 - DNA, 22 bp, Artificial Sequence
  chemically synthesized
aatttgtagtctattttatctg

SEQ ID NO: 78180 - DNA, 22 bp, Artificial Sequence
  chemically synthesized
gtagtctattttatctgattta

SEQ ID NO: 78181 - DNA, 22 bp, Artificial Sequence
  chemically synthesized
tagtctattttatctgatttaa

SEQ ID NO: 78182 - DNA, 22 bp, Artificial Sequence
  chemically synthesized
ttttatctgatttaagtacaat

SEQ ID NO: 78183 - DNA, 22 bp, Artificial Sequence
  chemically synthesized
tatctgatttaagtacaattac

SEQ ID NO: 78184 - DNA, 22 bp, Artificial Sequence
  chemically synthesized
atctgatttaagtacaattact

SEQ ID NO: 78185 - DNA, 22 bp, Artificial Sequence
  chemically synthesized
tctgatttaagtacaattacta

SEQ ID NO: 78186 - DNA, 22 bp, Artificial Sequence
  chemically synthesized
atttaagtacaattactactgc

SEQ ID NO: 78187 - DNA, 22 bp, Artificial Sequence
  chemically synthesized
aagtacaattactactgctctt

SEQ ID NO: 78188 - DNA, 22 bp, Artificial Sequence
  chemically synthesized
agtacaattactactgctcttt

SEQ ID NO: 78189 - DNA, 22 bp, Artificial Sequence
  chemically synthesized
ctactgctctttctggtttcca

SEQ ID NO: 78190 - DNA, 22 bp, Artificial Sequence
  chemically synthesized
ctgctctttctggtttccagtt

SEQ ID NO: 78191 - DNA, 22 bp, Artificial Sequence
  chemically synthesized
ctctttctggtttccagttcat

SEQ ID NO: 78192 - DNA, 22 bp, Artificial Sequence
  chemically synthesized
tttctggtttccagttcatgga

SEQ ID NO: 78193 - DNA, 22 bp, Artificial Sequence
  chemically synthesized
tctggtttccagttcatggaat

SEQ ID NO: 78194 - DNA, 22 bp, Artificial Sequence
  chemically synthesized
ctggtttccagttcatggaatt

SEQ ID NO: 78195 - DNA, 22 bp, Artificial Sequence
  chemically synthesized
tggtttccagttcatggaattt

SEQ ID NO: 78196 - DNA, 22 bp, Artificial Sequence
  chemically synthesized
gtttccagttcatggaattttt

SEQ ID NO: 78197 - DNA, 22 bp, Artificial Sequence
  chemically synthesized
ccagttcatggaatttttttcc

SEQ ID NO: 78198 - DNA, 22 bp, Artificial Sequence
  chemically synthesized
cagttcatggaatttttttcca

SEQ ID NO: 78199 - DNA, 22 bp, Artificial Sequence
  chemically synthesized
atggaatttttttccaaccctt

SEQ ID NO: 78200 - DNA, 22 bp, Artificial Sequence
  chemically synthesized
ttttccaacccttcactttcat

SEQ ID NO: 78201 - DNA, 22 bp, Artificial Sequence
  chemically synthesized
tttccaacccttcactttcatt

SEQ ID NO: 78202 - DNA, 22 bp, Artificial Sequence
  chemically synthesized
ttccaacccttcactttcattt

SEQ ID NO: 78203 - DNA, 22 bp, Artificial Sequence
  chemically synthesized
tccaacccttcactttcattta

SEQ ID NO: 78204 - DNA, 22 bp, Artificial Sequence
  chemically synthesized
ccaacccttcactttcatttat

SEQ ID NO: 78205 - DNA, 22 bp, Artificial Sequence
  chemically synthesized
caacccttcactttcatttatg

SEQ ID NO: 78206 - DNA, 22 bp, Artificial Sequence
  chemically synthesized
cactttcatttatgtgtgcctt

SEQ ID NO: 78207 - DNA, 22 bp, Artificial Sequence
  chemically synthesized
actttcatttatgtgtgccttt

SEQ ID NO: 78208 - DNA, 22 bp, Artificial Sequence
  chemically synthesized
tcatttatgtgtgcctttatag

SEQ ID NO: 78209 - DNA, 22 bp, Artificial Sequence
  chemically synthesized
catttatgtgtgcctttatagg

SEQ ID NO: 78210 - DNA, 22 bp, Artificial Sequence
  chemically synthesized
atttatgtgtgcctttataggt

SEQ ID NO: 78211 - DNA, 22 bp, Artificial Sequence
  chemically synthesized
atgtgtgcctttataggtgaag

SEQ ID NO: 78212 - DNA, 22 bp, Artificial Sequence
  chemically synthesized
tgtgtgcctttataggtgaagt

SEQ ID NO: 78213 - DNA, 22 bp, Artificial Sequence
  chemically synthesized
tataggtgaagtgggtttcttg

SEQ ID NO: 78214 - DNA, 22 bp, Artificial Sequence
  chemically synthesized
ataggtgaagtgggtttcttga

SEQ ID NO: 78215 - DNA, 22 bp, Artificial Sequence
  chemically synthesized
taggtgaagtgggtttcttgaa

SEQ ID NO: 78216 - DNA, 22 bp, Artificial Sequence
  chemically synthesized
cttgaagatcgcataaagttgg

SEQ ID NO: 78217 - DNA, 22 bp, Artificial Sequence
  chemically synthesized
ttgaagatcgcataaagttgga

SEQ ID NO: 78218 - DNA, 22 bp, Artificial Sequence
  chemically synthesized
gaagatcgcataaagttggata

SEQ ID NO: 78219 - DNA, 22 bp, Artificial Sequence
  chemically synthesized
aagatcgcataaagttggatat

SEQ ID NO: 78220 - DNA, 22 bp, Artificial Sequence
  chemically synthesized
gatattgtttctttatccattt

SEQ ID NO: 78221 - DNA, 22 bp, Artificial Sequence
  chemically synthesized
tttctttatccatttaccattc

SEQ ID NO: 78222 - DNA, 22 bp, Artificial Sequence
  chemically synthesized
ctttatccatttaccattctat

SEQ ID NO: 78223 - DNA, 22 bp, Artificial Sequence
  chemically synthesized
tttatccatttaccattctatt

SEQ ID NO: 78224 - DNA, 22 bp, Artificial Sequence
  chemically synthesized
tatccatttaccattctattac

SEQ ID NO: 78225 - DNA, 22 bp, Artificial Sequence
  chemically synthesized
atccatttaccattctattact

SEQ ID NO: 78226 - DNA, 22 bp, Artificial Sequence
  chemically synthesized
tccatttaccattctattactt

SEQ ID NO: 78227 - DNA, 22 bp, Artificial Sequence
  chemically synthesized
accattctattacttttaattg

SEQ ID NO: 78228 - DNA, 22 bp, Artificial Sequence
  chemically synthesized
ccattctattacttttaattgg

SEQ ID NO: 78229 - DNA, 22 bp, Artificial Sequence
  chemically synthesized
tattacttttaattggggaact

SEQ ID NO: 78230 - DNA, 22 bp, Artificial Sequence
  chemically synthesized
ttacttttaattggggaactga

SEQ ID NO: 78231 - DNA, 22 bp, Artificial Sequence
  chemically synthesized
cttttaattggggaactgagac

SEQ ID NO: 78232 - DNA, 22 bp, Artificial Sequence
  chemically synthesized
ttaattggggaactgagactat

SEQ ID NO: 78233 - DNA, 22 bp, Artificial Sequence
  chemically synthesized
taattggggaactgagactatt

SEQ ID NO: 78234 - DNA, 22 bp, Artificial Sequence
  chemically synthesized
aattggggaactgagactattt

SEQ ID NO: 78235 - DNA, 22 bp, Artificial Sequence
  chemically synthesized
attggggaactgagactattta

SEQ ID NO: 78236 - DNA, 22 bp, Artificial Sequence
  chemically synthesized
gggaactgagactatttacact

SEQ ID NO: 78237 - DNA, 22 bp, Artificial Sequence
  chemically synthesized
agactatttacactcagtgtag

SEQ ID NO: 78238 - DNA, 22 bp, Artificial Sequence
  chemically synthesized
tttacactcagtgtagttacta

SEQ ID NO: 78239 - DNA, 22 bp, Artificial Sequence
  chemically synthesized
acactcagtgtagttactaagt

SEQ ID NO: 78240 - DNA, 22 bp, Artificial Sequence
  chemically synthesized
cactcagtgtagttactaagta

SEQ ID NO: 78241 - DNA, 22 bp, Artificial Sequence
  chemically synthesized
agtgtagttactaagtaaggat

SEQ ID NO: 78242 - DNA, 22 bp, Artificial Sequence
  chemically synthesized
ctaagtaaggatttcctttttt

SEQ ID NO: 78243 - DNA, 22 bp, Artificial Sequence
  chemically synthesized
agtaaggatttccttttttttt

SEQ ID NO: 78244 - DNA, 22 bp, Artificial Sequence
  chemically synthesized
cctttttttttttttttttttt

SEQ ID NO: 78245 - DNA, 22 bp, Artificial Sequence
  chemically synthesized
cttttttttttttttttttttt

SEQ ID NO: 78246 - DNA, 22 bp, Artificial Sequence
  chemically synthesized
tttttttttttttttttttttt

SEQ ID NO: 78247 - DNA, 22 bp, Artificial Sequence
  chemically synthesized
tttttttttttttttttttttt

SEQ ID NO: 78248 - DNA, 22 bp, Artificial Sequence
  chemically synthesized
tttttttttttttttttttttg

SEQ ID NO: 78249 - DNA, 22 bp, Artificial Sequence
  chemically synthesized
ttttttttttttttttttttgc

SEQ ID NO: 78250 - DNA, 22 bp, Artificial Sequence
  chemically synthesized
tttttttttttttttttttgct

SEQ ID NO: 78251 - DNA, 22 bp, Artificial Sequence
  chemically synthesized
ttttttttttttttttttgctt

SEQ ID NO: 78252 - DNA, 22 bp, Artificial Sequence
  chemically synthesized
tttttttttttttttttgctta

SEQ ID NO: 78253 - DNA, 22 bp, Artificial Sequence
  chemically synthesized
ttttttttttttttttgcttat

SEQ ID NO: 78254 - DNA, 22 bp, Artificial Sequence
  chemically synthesized
tttttttttttttttgcttatt

SEQ ID NO: 78255 - DNA, 22 bp, Artificial Sequence
  chemically synthesized
ttttttttttttttgcttattt

SEQ ID NO: 78256 - DNA, 22 bp, Artificial Sequence
  chemically synthesized
tttttttttttttgcttatttt

SEQ ID NO: 78257 - DNA, 22 bp, Artificial Sequence
  chemically synthesized
ttttttttttttgcttattttt

SEQ ID NO: 78258 - DNA, 22 bp, Artificial Sequence
  chemically synthesized
tttttttttttgcttatttttg

SEQ ID NO: 78259 - DNA, 22 bp, Artificial Sequence
  chemically synthesized
ttttttttttgcttatttttgg

SEQ ID NO: 78260 - DNA, 22 bp, Artificial Sequence
  chemically synthesized
tttttttttgcttatttttggc

SEQ ID NO: 78261 - DNA, 22 bp, Artificial Sequence
  chemically synthesized
ttttttttgcttatttttggct

SEQ ID NO: 78262 - DNA, 22 bp, Artificial Sequence
  chemically synthesized
tttttttgcttatttttggctg

SEQ ID NO: 78263 - DNA, 22 bp, Artificial Sequence
  chemically synthesized
ttttttgcttatttttggctgt

SEQ ID NO: 78264 - DNA, 22 bp, Artificial Sequence
  chemically synthesized
tttttgcttatttttggctgta

SEQ ID NO: 78265 - DNA, 22 bp, Artificial Sequence
  chemically synthesized
ttttgcttatttttggctgtat

SEQ ID NO: 78266 - DNA, 22 bp, Artificial Sequence
  chemically synthesized
tttgcttatttttggctgtatg

SEQ ID NO: 78267 - DNA, 22 bp, Artificial Sequence
  chemically synthesized
ttgcttatttttggctgtatgg

SEQ ID NO: 78268 - DNA, 22 bp, Artificial Sequence
  chemically synthesized
tgcttatttttggctgtatgga

SEQ ID NO: 78269 - DNA, 22 bp, Artificial Sequence
  chemically synthesized
gcttatttttggctgtatggag

SEQ ID NO: 78270 - DNA, 22 bp, Artificial Sequence
  chemically synthesized
cttatttttggctgtatggaga

SEQ ID NO: 78271 - DNA, 22 bp, Artificial Sequence
  chemically synthesized
atttttggctgtatggagactc

SEQ ID NO: 78272 - DNA, 22 bp, Artificial Sequence
  chemically synthesized
tttttggctgtatggagactcc

SEQ ID NO: 78273 - DNA, 22 bp, Artificial Sequence
  chemically synthesized
ttggctgtatggagactcctct

SEQ ID NO: 78274 - DNA, 22 bp, Artificial Sequence
  chemically synthesized
tggctgtatggagactcctctc

SEQ ID NO: 78275 - DNA, 22 bp, Artificial Sequence
  chemically synthesized
ggctgtatggagactcctctct

SEQ ID NO: 78276 - DNA, 22 bp, Artificial Sequence
  chemically synthesized
gctgtatggagactcctctctt

SEQ ID NO: 78277 - DNA, 22 bp, Artificial Sequence
  chemically synthesized
tatggagactcctctcttcctt

SEQ ID NO: 78278 - DNA, 22 bp, Artificial Sequence
  chemically synthesized
ctctcttccttttttttccttc

SEQ ID NO: 78279 - DNA, 22 bp, Artificial Sequence
  chemically synthesized
tcttccttttttttccttcatg

SEQ ID NO: 78280 - DNA, 22 bp, Artificial Sequence
  chemically synthesized
ttccttttttttccttcatggt

SEQ ID NO: 78281 - DNA, 22 bp, Artificial Sequence
  chemically synthesized
ccttttttttccttcatggtta

SEQ ID NO: 78282 - DNA, 22 bp, Artificial Sequence
  chemically synthesized
cttttttttccttcatggttat

SEQ ID NO: 78283 - DNA, 22 bp, Artificial Sequence
  chemically synthesized
ttttttccttcatggttatgtg

SEQ ID NO: 78284 - DNA, 22 bp, Artificial Sequence
  chemically synthesized
tttttccttcatggttatgtga

SEQ ID NO: 78285 - DNA, 22 bp, Artificial Sequence
  chemically synthesized
ttttccttcatggttatgtgat

SEQ ID NO: 78286 - DNA, 22 bp, Artificial Sequence
  chemically synthesized
tttccttcatggttatgtgatt

SEQ ID NO: 78287 - DNA, 22 bp, Artificial Sequence
  chemically synthesized
ttccttcatggttatgtgatta

SEQ ID NO: 78288 - DNA, 22 bp, Artificial Sequence
  chemically synthesized
tccttcatggttatgtgattat

SEQ ID NO: 78289 - DNA, 22 bp, Artificial Sequence
  chemically synthesized
ccttcatggttatgtgattatc

SEQ ID NO: 78290 - DNA, 22 bp, Artificial Sequence
  chemically synthesized
cttcatggttatgtgattatct

SEQ ID NO: 78291 - DNA, 22 bp, Artificial Sequence
  chemically synthesized
catggttatgtgattatctctg

SEQ ID NO: 78292 - DNA, 22 bp, Artificial Sequence
  chemically synthesized
atggttatgtgattatctctgg

SEQ ID NO: 78293 - DNA, 22 bp, Artificial Sequence
  chemically synthesized
tgtgattatctctggtagcata

SEQ ID NO: 78294 - DNA, 22 bp, Artificial Sequence
  chemically synthesized
tctctggtagcatattttaatt

SEQ ID NO: 78295 - DNA, 22 bp, Artificial Sequence
  chemically synthesized
tggtagcatattttaatttgtt

SEQ ID NO: 78296 - DNA, 22 bp, Artificial Sequence
  chemically synthesized
gtagcatattttaatttgttac

SEQ ID NO: 78297 - DNA, 22 bp, Artificial Sequence
  chemically synthesized
taatttgttactttttattttt

SEQ ID NO: 78298 - DNA, 22 bp, Artificial Sequence
  chemically synthesized
aatttgttactttttattttta

SEQ ID NO: 78299 - DNA, 22 bp, Artificial Sequence
  chemically synthesized
atttgttactttttatttttag

SEQ ID NO: 78300 - DNA, 22 bp, Artificial Sequence
  chemically synthesized
gttactttttatttttagtaaa

SEQ ID NO: 78301 - DNA, 22 bp, Artificial Sequence
  chemically synthesized
ttactttttatttttagtaaat

SEQ ID NO: 78302 - DNA, 22 bp, Artificial Sequence
  chemically synthesized
ctttttatttttagtaaatcta

SEQ ID NO: 78303 - DNA, 22 bp, Artificial Sequence
  chemically synthesized
tttatttttagtaaatctatta

SEQ ID NO: 78304 - DNA, 22 bp, Artificial Sequence
  chemically synthesized
ttatttttagtaaatctattat

SEQ ID NO: 78305 - DNA, 22 bp, Artificial Sequence
  chemically synthesized
tatttttagtaaatctattata

SEQ ID NO: 78306 - DNA, 22 bp, Artificial Sequence
  chemically synthesized
atttttagtaaatctattatag

SEQ ID NO: 78307 - DNA, 22 bp, Artificial Sequence
  chemically synthesized
tttttagtaaatctattataga

SEQ ID NO: 78308 - DNA, 22 bp, Artificial Sequence
  chemically synthesized
ttagtaaatctattatagattt

SEQ ID NO: 78309 - DNA, 22 bp, Artificial Sequence
  chemically synthesized
tagtaaatctattatagatttt

SEQ ID NO: 78310 - DNA, 22 bp, Artificial Sequence
  chemically synthesized
agtaaatctattatagattttt

SEQ ID NO: 78311 - DNA, 22 bp, Artificial Sequence
  chemically synthesized
gtaaatctattatagatttttg

SEQ ID NO: 78312 - DNA, 22 bp, Artificial Sequence
  chemically synthesized
ttatagatttttgtgctgtggt

SEQ ID NO: 78313 - DNA, 22 bp, Artificial Sequence
  chemically synthesized
tagatttttgtgctgtggttac

SEQ ID NO: 78314 - DNA, 22 bp, Artificial Sequence
  chemically synthesized
ttgtgctgtggttaccatgggg

SEQ ID NO: 78315 - DNA, 22 bp, Artificial Sequence
  chemically synthesized
tgtgctgtggttaccatggggc

SEQ ID NO: 78316 - DNA, 22 bp, Artificial Sequence
  chemically synthesized
gtgctgtggttaccatggggct

SEQ ID NO: 78317 - DNA, 22 bp, Artificial Sequence
  chemically synthesized
tgctgtggttaccatggggctt

SEQ ID NO: 78318 - DNA, 22 bp, Artificial Sequence
  chemically synthesized
tggttaccatggggcttacaag

SEQ ID NO: 78319 - DNA, 22 bp, Artificial Sequence
  chemically synthesized
ccatggggcttacaagaaacat

SEQ ID NO: 78320 - DNA, 22 bp, Artificial Sequence
  chemically synthesized
acaagaaacatcttataaatat

SEQ ID NO: 78321 - DNA, 22 bp, Artificial Sequence
  chemically synthesized
caagaaacatcttataaatata

SEQ ID NO: 78322 - DNA, 22 bp, Artificial Sequence
  chemically synthesized
ataaatatagcaagttatttta

SEQ ID NO: 78323 - DNA, 22 bp, Artificial Sequence
  chemically synthesized
taaatatagcaagttattttaa

SEQ ID NO: 78324 - DNA, 22 bp, Artificial Sequence
  chemically synthesized
ttttaaaggatgacgaattatc

SEQ ID NO: 78325 - DNA, 22 bp, Artificial Sequence
  chemically synthesized
taaaggatgacgaattatctta

SEQ ID NO: 78326 - DNA, 22 bp, Artificial Sequence
  chemically synthesized
aaaggatgacgaattatcttag

SEQ ID NO: 78327 - DNA, 22 bp, Artificial Sequence
  chemically synthesized
aaggatgacgaattatcttaga

SEQ ID NO: 78328 - DNA, 22 bp, Artificial Sequence
  chemically synthesized
tcttagatcgcaaataaaggaa

SEQ ID NO: 78329 - DNA, 22 bp, Artificial Sequence
  chemically synthesized
agatcgcaaataaaggaatata

SEQ ID NO: 78330 - DNA, 22 bp, Artificial Sequence
  chemically synthesized
gatcgcaaataaaggaatataa

SEQ ID NO: 78331 - DNA, 22 bp, Artificial Sequence
  chemically synthesized
tacactttaactccactccacc

SEQ ID NO: 78332 - DNA, 22 bp, Artificial Sequence
  chemically synthesized
cactttaactccactccacccc

SEQ ID NO: 78333 - DNA, 22 bp, Artificial Sequence
  chemically synthesized
taactccactccacccccacat

SEQ ID NO: 78334 - DNA, 22 bp, Artificial Sequence
  chemically synthesized
aactccactccacccccacatt

SEQ ID NO: 78335 - DNA, 22 bp, Artificial Sequence
  chemically synthesized
actccactccacccccacattt

SEQ ID NO: 78336 - DNA, 22 bp, Artificial Sequence
  chemically synthesized
cactccacccccacattttgac

SEQ ID NO: 78337 - DNA, 22 bp, Artificial Sequence
  chemically synthesized
cacccccacattttgacttttg

SEQ ID NO: 78338 - DNA, 22 bp, Artificial Sequence
  chemically synthesized
tgacttttgtctcattttacat

SEQ ID NO: 78339 - DNA, 22 bp, Artificial Sequence
  chemically synthesized
gacttttgtctcattttacata

SEQ ID NO: 78340 - DNA, 22 bp, Artificial Sequence
  chemically synthesized
acttttgtctcattttacatat

SEQ ID NO: 78341 - DNA, 22 bp, Artificial Sequence
  chemically synthesized
ttgtctcattttacatatttta

SEQ ID NO: 78342 - DNA, 22 bp, Artificial Sequence
  chemically synthesized
tgtctcattttacatattttat

SEQ ID NO: 78343 - DNA, 22 bp, Artificial Sequence
  chemically synthesized
gtctcattttacatattttata

SEQ ID NO: 78344 - DNA, 22 bp, Artificial Sequence
  chemically synthesized
tctcattttacatattttatat

SEQ ID NO: 78345 - DNA, 22 bp, Artificial Sequence
  chemically synthesized
attttacatattttatattacc

SEQ ID NO: 78346 - DNA, 22 bp, Artificial Sequence
  chemically synthesized
tacatattttatattacctaca

SEQ ID NO: 78347 - DNA, 22 bp, Artificial Sequence
  chemically synthesized
acatattttatattacctacat

SEQ ID NO: 78348 - DNA, 22 bp, Artificial Sequence
  chemically synthesized
catattttatattacctacatc

SEQ ID NO: 78349 - DNA, 22 bp, Artificial Sequence
  chemically synthesized
tatattacctacatcttaaaag

SEQ ID NO: 78350 - DNA, 22 bp, Artificial Sequence
  chemically synthesized
atattacctacatcttaaaagg

SEQ ID NO: 78351 - DNA, 22 bp, Artificial Sequence
  chemically synthesized
tattacctacatcttaaaaggt

SEQ ID NO: 78352 - DNA, 22 bp, Artificial Sequence
  chemically synthesized
cctacatcttaaaaggttgcta

SEQ ID NO: 78353 - DNA, 22 bp, Artificial Sequence
  chemically synthesized
catcttaaaaggttgctatagc

SEQ ID NO: 78354 - DNA, 22 bp, Artificial Sequence
  chemically synthesized
aaaaggttgctatagctattac

SEQ ID NO: 78355 - DNA, 22 bp, Artificial Sequence
  chemically synthesized
aaaggttgctatagctattact

SEQ ID NO: 78356 - DNA, 22 bp, Artificial Sequence
  chemically synthesized
ctatagctattactgtttttga

SEQ ID NO: 78357 - DNA, 22 bp, Artificial Sequence
  chemically synthesized
tagctattactgtttttgaaag

SEQ ID NO: 78358 - DNA, 22 bp, Artificial Sequence
  chemically synthesized
ttactgtttttgaaagatttgt

SEQ ID NO: 78359 - DNA, 22 bp, Artificial Sequence
  chemically synthesized
ctgtttttgaaagatttgtttt

SEQ ID NO: 78360 - DNA, 22 bp, Artificial Sequence
  chemically synthesized
tttttgaaagatttgttttttg

SEQ ID NO: 78361 - DNA, 22 bp, Artificial Sequence
  chemically synthesized
ttgaaagatttgttttttgggt

SEQ ID NO: 78362 - DNA, 22 bp, Artificial Sequence
  chemically synthesized
tgaaagatttgttttttgggtt

SEQ ID NO: 78363 - DNA, 22 bp, Artificial Sequence
  chemically synthesized
gaaagatttgttttttgggttt

SEQ ID NO: 78364 - DNA, 22 bp, Artificial Sequence
  chemically synthesized
aaagatttgttttttgggtttc

SEQ ID NO: 78365 - DNA, 22 bp, Artificial Sequence
  chemically synthesized
gttttttgggtttcatactgga

SEQ ID NO: 78366 - DNA, 22 bp, Artificial Sequence
  chemically synthesized
ttttttgggtttcatactggag

SEQ ID NO: 78367 - DNA, 22 bp, Artificial Sequence
  chemically synthesized
tttgggtttcatactggagttc

SEQ ID NO: 78368 - DNA, 22 bp, Artificial Sequence
  chemically synthesized
ttgggtttcatactggagttct

SEQ ID NO: 78369 - DNA, 22 bp, Artificial Sequence
  chemically synthesized
tgggtttcatactggagttctg

SEQ ID NO: 78370 - DNA, 22 bp, Artificial Sequence
  chemically synthesized
gggtttcatactggagttctgt

SEQ ID NO: 78371 - DNA, 22 bp, Artificial Sequence
  chemically synthesized
ggtttcatactggagttctgtg

SEQ ID NO: 78372 - DNA, 22 bp, Artificial Sequence
  chemically synthesized
catactggagttctgtgtggat

SEQ ID NO: 78373 - DNA, 22 bp, Artificial Sequence
  chemically synthesized
atactggagttctgtgtggatt

SEQ ID NO: 78374 - DNA, 22 bp, Artificial Sequence
  chemically synthesized
gagttctgtgtggattgcacac

SEQ ID NO: 78375 - DNA, 22 bp, Artificial Sequence
  chemically synthesized
tgtgtggattgcacaccaaaaa

SEQ ID NO: 78376 - DNA, 22 bp, Artificial Sequence
  chemically synthesized
tgtggattgcacaccaaaaaat

SEQ ID NO: 78377 - DNA, 22 bp, Artificial Sequence
  chemically synthesized
cacaccaaaaaatacagtaatg

SEQ ID NO: 78378 - DNA, 22 bp, Artificial Sequence
  chemically synthesized
taggtttgtctatgtacttaat

SEQ ID NO: 78379 - DNA, 22 bp, Artificial Sequence
  chemically synthesized
ggtttgtctatgtacttaattt

SEQ ID NO: 78380 - DNA, 22 bp, Artificial Sequence
  chemically synthesized
gtctatgtacttaattttacca

SEQ ID NO: 78381 - DNA, 22 bp, Artificial Sequence
  chemically synthesized
tctatgtacttaattttaccag

SEQ ID NO: 78382 - DNA, 22 bp, Artificial Sequence
  chemically synthesized
tgtacttaattttaccagtggg

SEQ ID NO: 78383 - DNA, 22 bp, Artificial Sequence
  chemically synthesized
aattttaccagtgggtttcata

SEQ ID NO: 78384 - DNA, 22 bp, Artificial Sequence
  chemically synthesized
attttaccagtgggtttcatac

SEQ ID NO: 78385 - DNA, 22 bp, Artificial Sequence
  chemically synthesized
taccagtgggtttcatactttg

SEQ ID NO: 78386 - DNA, 22 bp, Artificial Sequence
  chemically synthesized
accagtgggtttcatactttga

SEQ ID NO: 78387 - DNA, 22 bp, Artificial Sequence
  chemically synthesized
ccagtgggtttcatactttgaa

SEQ ID NO: 78388 - DNA, 22 bp, Artificial Sequence
  chemically synthesized
catactttgaaaagttttcttt

SEQ ID NO: 78389 - DNA, 22 bp, Artificial Sequence
  chemically synthesized
atactttgaaaagttttctttt

SEQ ID NO: 78390 - DNA, 22 bp, Artificial Sequence
  chemically synthesized
tgaaaagttttcttttgcatgt

SEQ ID NO: 78391 - DNA, 22 bp, Artificial Sequence
  chemically synthesized
gaaaagttttcttttgcatgtt

SEQ ID NO: 78392 - DNA, 22 bp, Artificial Sequence
  chemically synthesized
aaaagttttcttttgcatgtta

SEQ ID NO: 78393 - DNA, 22 bp, Artificial Sequence
  chemically synthesized
tcttttgcatgttaatgtcttt

SEQ ID NO: 78394 - DNA, 22 bp, Artificial Sequence
  chemically synthesized
cttttgcatgttaatgtctttt

SEQ ID NO: 78395 - DNA, 22 bp, Artificial Sequence
  chemically synthesized
ttttgcatgttaatgtcttttt

SEQ ID NO: 78396 - DNA, 22 bp, Artificial Sequence
  chemically synthesized
ttgcatgttaatgtcttttttc

SEQ ID NO: 78397 - DNA, 22 bp, Artificial Sequence
  chemically synthesized
tgcatgttaatgtcttttttct

SEQ ID NO: 78398 - DNA, 22 bp, Artificial Sequence
  chemically synthesized
gcatgttaatgtcttttttctt

SEQ ID NO: 78399 - DNA, 22 bp, Artificial Sequence
  chemically synthesized
catgttaatgtcttttttcttt

SEQ ID NO: 78400 - DNA, 22 bp, Artificial Sequence
  chemically synthesized
atgtcttttttctttcagattg

SEQ ID NO: 78401 - DNA, 22 bp, Artificial Sequence
  chemically synthesized
ttttctttcagattgcataact

SEQ ID NO: 78402 - DNA, 22 bp, Artificial Sequence
  chemically synthesized
tttctttcagattgcataactc

SEQ ID NO: 78403 - DNA, 22 bp, Artificial Sequence
  chemically synthesized
ttctttcagattgcataactcc

SEQ ID NO: 78404 - DNA, 22 bp, Artificial Sequence
  chemically synthesized
tctttcagattgcataactccc

SEQ ID NO: 78405 - DNA, 22 bp, Artificial Sequence
  chemically synthesized
ctttcagattgcataactccct

SEQ ID NO: 78406 - DNA, 22 bp, Artificial Sequence
  chemically synthesized
tttcagattgcataactccctt

SEQ ID NO: 78407 - DNA, 22 bp, Artificial Sequence
  chemically synthesized
tcagattgcataactcccttta

SEQ ID NO: 78408 - DNA, 22 bp, Artificial Sequence
  chemically synthesized
cagattgcataactccctttag

SEQ ID NO: 78409 - DNA, 22 bp, Artificial Sequence
  chemically synthesized
agattgcataactccctttagc

SEQ ID NO: 78410 - DNA, 22 bp, Artificial Sequence
  chemically synthesized
cataactccctttagcattttt

SEQ ID NO: 78411 - DNA, 22 bp, Artificial Sequence
  chemically synthesized
cctttagcattttttgcaagat

SEQ ID NO: 78412 - DNA, 22 bp, Artificial Sequence
  chemically synthesized
tagcattttttgcaagatggtc

SEQ ID NO: 78413 - DNA, 22 bp, Artificial Sequence
  chemically synthesized
agcattttttgcaagatggtct

SEQ ID NO: 78414 - DNA, 22 bp, Artificial Sequence
  chemically synthesized
gcattttttgcaagatggtctg

SEQ ID NO: 78415 - DNA, 22 bp, Artificial Sequence
  chemically synthesized
tttgcaagatggtctggtgttg

SEQ ID NO: 78416 - DNA, 22 bp, Artificial Sequence
  chemically synthesized
ttgcaagatggtctggtgttgg

SEQ ID NO: 78417 - DNA, 22 bp, Artificial Sequence
  chemically synthesized
tgcaagatggtctggtgttggt

SEQ ID NO: 78418 - DNA, 22 bp, Artificial Sequence
  chemically synthesized
gcaagatggtctggtgttggtg

SEQ ID NO: 78419 - DNA, 22 bp, Artificial Sequence
  chemically synthesized
caagatggtctggtgttggtga

SEQ ID NO: 78420 - DNA, 22 bp, Artificial Sequence
  chemically synthesized
gtgttggtgaattctctcaact

SEQ ID NO: 78421 - DNA, 22 bp, Artificial Sequence
  chemically synthesized
gtgaattctctcaacttttgtt

SEQ ID NO: 78422 - DNA, 22 bp, Artificial Sequence
  chemically synthesized
tctcaacttttgtttgtctggg

SEQ ID NO: 78423 - DNA, 22 bp, Artificial Sequence
  chemically synthesized
tcaacttttgtttgtctgggaa

SEQ ID NO: 78424 - DNA, 22 bp, Artificial Sequence
  chemically synthesized
aacttttgtttgtctgggaaag

SEQ ID NO: 78425 - DNA, 22 bp, Artificial Sequence
  chemically synthesized
ttgtttgtctgggaaagacttt

SEQ ID NO: 78426 - DNA, 22 bp, Artificial Sequence
  chemically synthesized
tgtttgtctgggaaagacttta

SEQ ID NO: 78427 - DNA, 22 bp, Artificial Sequence
  chemically synthesized
gtttgtctgggaaagactttat

SEQ ID NO: 78428 - DNA, 22 bp, Artificial Sequence
  chemically synthesized
tttgtctgggaaagactttata

SEQ ID NO: 78429 - DNA, 22 bp, Artificial Sequence
  chemically synthesized
gtctgggaaagactttatatat

SEQ ID NO: 78430 - DNA, 22 bp, Artificial Sequence
  chemically synthesized
tctgggaaagactttatatatt

SEQ ID NO: 78431 - DNA, 22 bp, Artificial Sequence
  chemically synthesized
ggaaagactttatatattgctt

SEQ ID NO: 78432 - DNA, 22 bp, Artificial Sequence
  chemically synthesized
tatatattgcttatatttgaat

SEQ ID NO: 78433 - DNA, 22 bp, Artificial Sequence
  chemically synthesized
atatattgcttatatttgaata

SEQ ID NO: 78434 - DNA, 22 bp, Artificial Sequence
  chemically synthesized
tatattgcttatatttgaataa

SEQ ID NO: 78435 - DNA, 22 bp, Artificial Sequence
  chemically synthesized
cttatatttgaataacagtttt

SEQ ID NO: 78436 - DNA, 22 bp, Artificial Sequence
  chemically synthesized
atatttgaataacagttttacc

SEQ ID NO: 78437 - DNA, 22 bp, Artificial Sequence
  chemically synthesized
tatttgaataacagttttaccc

SEQ ID NO: 78438 - DNA, 22 bp, Artificial Sequence
  chemically synthesized
gaataacagttttaccctataa

SEQ ID NO: 78439 - DNA, 22 bp, Artificial Sequence
  chemically synthesized
aataacagttttaccctataaa

SEQ ID NO: 78440 - DNA, 22 bp, Artificial Sequence
  chemically synthesized
taccctataaaatattcttgaa

SEQ ID NO: 78441 - DNA, 22 bp, Artificial Sequence
  chemically synthesized
accctataaaatattcttgaat

SEQ ID NO: 78442 - DNA, 22 bp, Artificial Sequence
  chemically synthesized
ccctataaaatattcttgaata

SEQ ID NO: 78443 - DNA, 22 bp, Artificial Sequence
  chemically synthesized
taaaatattcttgaatatcagt

SEQ ID NO: 78444 - DNA, 22 bp, Artificial Sequence
  chemically synthesized
ttgaatatcagttttcttttat

SEQ ID NO: 78445 - DNA, 22 bp, Artificial Sequence
  chemically synthesized
gaatatcagttttcttttatcc

SEQ ID NO: 78446 - DNA, 22 bp, Artificial Sequence
  chemically synthesized
aatatcagttttcttttatccc

SEQ ID NO: 78447 - DNA, 22 bp, Artificial Sequence
  chemically synthesized
tcttttatccctgagcgctttg

SEQ ID NO: 78448 - DNA, 22 bp, Artificial Sequence
  chemically synthesized
cttttatccctgagcgctttga

SEQ ID NO: 78449 - DNA, 22 bp, Artificial Sequence
  chemically synthesized
ttttatccctgagcgctttgaa

SEQ ID NO: 78450 - DNA, 22 bp, Artificial Sequence
  chemically synthesized
ttatccctgagcgctttgaaaa

SEQ ID NO: 78451 - DNA, 22 bp, Artificial Sequence
  chemically synthesized
tatccctgagcgctttgaaaat

SEQ ID NO: 78452 - DNA, 22 bp, Artificial Sequence
  chemically synthesized
atccctgagcgctttgaaaatt

SEQ ID NO: 78453 - DNA, 22 bp, Artificial Sequence
  chemically synthesized
tccctgagcgctttgaaaattt

SEQ ID NO: 78454 - DNA, 22 bp, Artificial Sequence
  chemically synthesized
agcgctttgaaaatttcattcg

SEQ ID NO: 78455 - DNA, 22 bp, Artificial Sequence
  chemically synthesized
tgaaaatttcattcgactctct

SEQ ID NO: 78456 - DNA, 22 bp, Artificial Sequence
  chemically synthesized
gaaaatttcattcgactctctc

SEQ ID NO: 78457 - DNA, 22 bp, Artificial Sequence
  chemically synthesized
aaaatttcattcgactctctct

SEQ ID NO: 78458 - DNA, 22 bp, Artificial Sequence
  chemically synthesized
cattcgactctctcttggactg

SEQ ID NO: 78459 - DNA, 22 bp, Artificial Sequence
  chemically synthesized
attcgactctctcttggactgt

SEQ ID NO: 78460 - DNA, 22 bp, Artificial Sequence
  chemically synthesized
gactctctcttggactgtgtga

SEQ ID NO: 78461 - DNA, 22 bp, Artificial Sequence
  chemically synthesized
tctcttggactgtgtgatttct

SEQ ID NO: 78462 - DNA, 22 bp, Artificial Sequence
  chemically synthesized
tcttggactgtgtgatttctat

SEQ ID NO: 78463 - DNA, 22 bp, Artificial Sequence
  chemically synthesized
ttggactgtgtgatttctattg

SEQ ID NO: 78464 - DNA, 22 bp, Artificial Sequence
  chemically synthesized
ggactgtgtgatttctattgag

SEQ ID NO: 78465 - DNA, 22 bp, Artificial Sequence
  chemically synthesized
gactgtgtgatttctattgaga

SEQ ID NO: 78466 - DNA, 22 bp, Artificial Sequence
  chemically synthesized
tgtgatttctattgagatgttt

SEQ ID NO: 78467 - DNA, 22 bp, Artificial Sequence
  chemically synthesized
ctattgagatgtttgttgtcac

SEQ ID NO: 78468 - DNA, 22 bp, Artificial Sequence
  chemically synthesized
tattgagatgtttgttgtcaca

SEQ ID NO: 78469 - DNA, 22 bp, Artificial Sequence
  chemically synthesized
ttgagatgtttgttgtcacagg

SEQ ID NO: 78470 - DNA, 22 bp, Artificial Sequence
  chemically synthesized
agatgtttgttgtcacaggatt

SEQ ID NO: 78471 - DNA, 22 bp, Artificial Sequence
  chemically synthesized
gttgtcacaggatttggagctc

SEQ ID NO: 78472 - DNA, 22 bp, Artificial Sequence
  chemically synthesized
ttgtcacaggatttggagctcc

SEQ ID NO: 78473 - DNA, 22 bp, Artificial Sequence
  chemically synthesized
tcacaggatttggagctccttt

SEQ ID NO: 78474 - DNA, 22 bp, Artificial Sequence
  chemically synthesized
ggagctcctttatatgctattt

SEQ ID NO: 78475 - DNA, 22 bp, Artificial Sequence
  chemically synthesized
gagctcctttatatgctatttg

SEQ ID NO: 78476 - DNA, 22 bp, Artificial Sequence
  chemically synthesized
ctttatatgctatttgtttctc

SEQ ID NO: 78477 - DNA, 22 bp, Artificial Sequence
  chemically synthesized
tatatgctatttgtttctcatc

SEQ ID NO: 78478 - DNA, 22 bp, Artificial Sequence
  chemically synthesized
atatgctatttgtttctcatct

SEQ ID NO: 78479 - DNA, 22 bp, Artificial Sequence
  chemically synthesized
tatgctatttgtttctcatctc

SEQ ID NO: 78480 - DNA, 22 bp, Artificial Sequence
  chemically synthesized
tttgtttctcatctcttctgct

SEQ ID NO: 78481 - DNA, 22 bp, Artificial Sequence
  chemically synthesized
gtttctcatctcttctgctttt

SEQ ID NO: 78482 - DNA, 22 bp, Artificial Sequence
  chemically synthesized
tttctcatctcttctgctttta

SEQ ID NO: 78483 - DNA, 22 bp, Artificial Sequence
  chemically synthesized
ctcatctcttctgcttttagga

SEQ ID NO: 78484 - DNA, 22 bp, Artificial Sequence
  chemically synthesized
tcatctcttctgcttttaggat

SEQ ID NO: 78485 - DNA, 22 bp, Artificial Sequence
  chemically synthesized
atctcttctgcttttaggatca

SEQ ID NO: 78486 - DNA, 22 bp, Artificial Sequence
  chemically synthesized
ttctgcttttaggatcatcttt

SEQ ID NO: 78487 - DNA, 22 bp, Artificial Sequence
  chemically synthesized
ctgcttttaggatcatcttttt

SEQ ID NO: 78488 - DNA, 22 bp, Artificial Sequence
  chemically synthesized
tgcttttaggatcatctttttg

SEQ ID NO: 78489 - DNA, 22 bp, Artificial Sequence
  chemically synthesized
cttttaggatcatctttttgtc

SEQ ID NO: 78490 - DNA, 22 bp, Artificial Sequence
  chemically synthesized
ttaggatcatctttttgtcctt

SEQ ID NO: 78491 - DNA, 22 bp, Artificial Sequence
  chemically synthesized
taggatcatctttttgtccttg

SEQ ID NO: 78492 - DNA, 22 bp, Artificial Sequence
  chemically synthesized
aggatcatctttttgtccttga

SEQ ID NO: 78493 - DNA, 22 bp, Artificial Sequence
  chemically synthesized
ggatcatctttttgtccttgac

SEQ ID NO: 78494 - DNA, 22 bp, Artificial Sequence
  chemically synthesized
tttgtccttgacctgatgtctt

SEQ ID NO: 78495 - DNA, 22 bp, Artificial Sequence
  chemically synthesized
ttgtccttgacctgatgtcttg

SEQ ID NO: 78496 - DNA, 22 bp, Artificial Sequence
  chemically synthesized
tgtccttgacctgatgtcttgg

SEQ ID NO: 78497 - DNA, 22 bp, Artificial Sequence
  chemically synthesized
gtccttgacctgatgtcttggc

SEQ ID NO: 78498 - DNA, 22 bp, Artificial Sequence
  chemically synthesized
tccttgacctgatgtcttggcg

SEQ ID NO: 78499 - DNA, 22 bp, Artificial Sequence
  chemically synthesized
gacctgatgtcttggcgtagta

SEQ ID NO: 78500 - DNA, 22 bp, Artificial Sequence
  chemically synthesized
acctgatgtcttggcgtagtac

SEQ ID NO: 78501 - DNA, 22 bp, Artificial Sequence
  chemically synthesized
atgtcttggcgtagtactctac

SEQ ID NO: 78502 - DNA, 22 bp, Artificial Sequence
  chemically synthesized
ggcgtagtactctactatatct

SEQ ID NO: 78503 - DNA, 22 bp, Artificial Sequence
  chemically synthesized
gcgtagtactctactatatcta

SEQ ID NO: 78504 - DNA, 22 bp, Artificial Sequence
  chemically synthesized
tactatatctaggactacactt

SEQ ID NO: 78505 - DNA, 22 bp, Artificial Sequence
  chemically synthesized
ctatatctaggactacacttag

SEQ ID NO: 78506 - DNA, 22 bp, Artificial Sequence
  chemically synthesized
tatctaggactacacttagaat

SEQ ID NO: 78507 - DNA, 22 bp, Artificial Sequence
  chemically synthesized
ggactacacttagaatgaataa

SEQ ID NO: 78508 - DNA, 22 bp, Artificial Sequence
  chemically synthesized
cacttagaatgaataatatgta

SEQ ID NO: 78509 - DNA, 22 bp, Artificial Sequence
  chemically synthesized
agaatgaataatatgtaataaa

SEQ ID NO: 78510 - DNA, 22 bp, Artificial Sequence
  chemically synthesized
gaatgaataatatgtaataaaa

SEQ ID NO: 78511 - DNA, 22 bp, Artificial Sequence
  chemically synthesized
ctggcttaaaaagtatttattt

SEQ ID NO: 78512 - DNA, 22 bp, Artificial Sequence
  chemically synthesized
gcttaaaaagtatttatttatt

SEQ ID NO: 78513 - DNA, 22 bp, Artificial Sequence
  chemically synthesized
aaaaagtatttatttattgtaa

SEQ ID NO: 78514 - DNA, 22 bp, Artificial Sequence
  chemically synthesized
aaaagtatttatttattgtaag

SEQ ID NO: 78515 - DNA, 22 bp, Artificial Sequence
  chemically synthesized
atttattgtaagcataagaaaa

SEQ ID NO: 78516 - DNA, 22 bp, Artificial Sequence
  chemically synthesized
tttattgtaagcataagaaaat

SEQ ID NO: 78517 - DNA, 22 bp, Artificial Sequence
  chemically synthesized
attgtaagcataagaaaatttg

SEQ ID NO: 78518 - DNA, 22 bp, Artificial Sequence
  chemically synthesized
ttgtaagcataagaaaatttga

SEQ ID NO: 78519 - DNA, 22 bp, Artificial Sequence
  chemically synthesized
taagcataagaaaatttgaccg

SEQ ID NO: 78520 - DNA, 22 bp, Artificial Sequence
  chemically synthesized
gaccgatgtaatcttagatgat

SEQ ID NO: 78521 - DNA, 22 bp, Artificial Sequence
  chemically synthesized
accgatgtaatcttagatgata

SEQ ID NO: 78522 - DNA, 22 bp, Artificial Sequence
  chemically synthesized
agatgatagttctaaaagtgtt

SEQ ID NO: 78523 - DNA, 22 bp, Artificial Sequence
  chemically synthesized
gatgatagttctaaaagtgttg

SEQ ID NO: 78524 - DNA, 22 bp, Artificial Sequence
  chemically synthesized
taaaagtgttggttgaggaagt

SEQ ID NO: 78525 - DNA, 22 bp, Artificial Sequence
  chemically synthesized
aaagtgttggttgaggaagtag

SEQ ID NO: 78526 - DNA, 22 bp, Artificial Sequence
  chemically synthesized
gttgaggaagtagaagagaatc

SEQ ID NO: 78527 - DNA, 22 bp, Artificial Sequence
  chemically synthesized
aggaagtagaagagaatcagta

SEQ ID NO: 78528 - DNA, 22 bp, Artificial Sequence
  chemically synthesized
agcagttaaactaatgtgggaa

SEQ ID NO: 78529 - DNA, 22 bp, Artificial Sequence
  chemically synthesized
aactaatgtgggaaggcccctt

SEQ ID NO: 78530 - DNA, 22 bp, Artificial Sequence
  chemically synthesized
atgtgggaaggccccttttata

SEQ ID NO: 78531 - DNA, 22 bp, Artificial Sequence
  chemically synthesized
ttataaagatcctcttgagaaa

SEQ ID NO: 78532 - DNA, 22 bp, Artificial Sequence
  chemically synthesized
tataaagatcctcttgagaaaa

SEQ ID NO: 78533 - DNA, 22 bp, Artificial Sequence
  chemically synthesized
ataaagatcctcttgagaaaac

SEQ ID NO: 78534 - DNA, 22 bp, Artificial Sequence
  chemically synthesized
taaagatcctcttgagaaaacc

SEQ ID NO: 78535 - DNA, 22 bp, Artificial Sequence
  chemically synthesized
ttgagaaaacctttatacatta

SEQ ID NO: 78536 - DNA, 22 bp, Artificial Sequence
  chemically synthesized
gagaaaacctttatacattatt

SEQ ID NO: 78537 - DNA, 22 bp, Artificial Sequence
  chemically synthesized
agaaaacctttatacattatta

SEQ ID NO: 78538 - DNA, 22 bp, Artificial Sequence
  chemically synthesized
tatacattattaatatatgact

SEQ ID NO: 78539 - DNA, 22 bp, Artificial Sequence
  chemically synthesized
atacattattaatatatgacta

SEQ ID NO: 78540 - DNA, 22 bp, Artificial Sequence
  chemically synthesized
tacattattaatatatgactat

SEQ ID NO: 78541 - DNA, 22 bp, Artificial Sequence
  chemically synthesized
ttaatatatgactataattaga

SEQ ID NO: 78542 - DNA, 22 bp, Artificial Sequence
  chemically synthesized
atatatgactataattagagga

SEQ ID NO: 78543 - DNA, 22 bp, Artificial Sequence
  chemically synthesized
taattagaggaaacagaggtga

SEQ ID NO: 78544 - DNA, 22 bp, Artificial Sequence
  chemically synthesized
gaggaaacagaggtgagtgaat

SEQ ID NO: 78545 - DNA, 22 bp, Artificial Sequence
  chemically synthesized
tgtcctcatgaatctcaaagga

SEQ ID NO: 78546 - DNA, 22 bp, Artificial Sequence
  chemically synthesized
gtcctcatgaatctcaaaggag

SEQ ID NO: 78547 - DNA, 22 bp, Artificial Sequence
  chemically synthesized
tcctcatgaatctcaaaggaga

SEQ ID NO: 78548 - DNA, 22 bp, Artificial Sequence
  chemically synthesized
atgaatctcaaaggagaaaatg

SEQ ID NO: 78549 - DNA, 22 bp, Artificial Sequence
  chemically synthesized
aaaggagaaaatggtttacaga

SEQ ID NO: 78550 - DNA, 22 bp, Artificial Sequence
  chemically synthesized
acagaattgcttggtgttcttc

SEQ ID NO: 78551 - DNA, 22 bp, Artificial Sequence
  chemically synthesized
cagaattgcttggtgttcttca

SEQ ID NO: 78552 - DNA, 22 bp, Artificial Sequence
  chemically synthesized
cttggtgttcttcagattccaa

SEQ ID NO: 78553 - DNA, 22 bp, Artificial Sequence
  chemically synthesized
ggtgttcttcagattccaattt

SEQ ID NO: 78554 - DNA, 22 bp, Artificial Sequence
  chemically synthesized
gtgttcttcagattccaatttt

SEQ ID NO: 78555 - DNA, 22 bp, Artificial Sequence
  chemically synthesized
ttcagattccaattttaaagtc

SEQ ID NO: 78556 - DNA, 22 bp, Artificial Sequence
  chemically synthesized
cagattccaattttaaagtcaa

SEQ ID NO: 78557 - DNA, 22 bp, Artificial Sequence
  chemically synthesized
agattccaattttaaagtcaaa

SEQ ID NO: 78558 - DNA, 22 bp, Artificial Sequence
  chemically synthesized
caattttaaagtcaaatctgaa

SEQ ID NO: 78559 - DNA, 22 bp, Artificial Sequence
  chemically synthesized
taaagtcaaatctgaattttaa

SEQ ID NO: 78560 - DNA, 22 bp, Artificial Sequence
  chemically synthesized
aaagtcaaatctgaattttaag

SEQ ID NO: 78561 - DNA, 22 bp, Artificial Sequence
  chemically synthesized
aagtcaaatctgaattttaagt

SEQ ID NO: 78562 - DNA, 22 bp, Artificial Sequence
  chemically synthesized
aattttaagttatgggaccact

SEQ ID NO: 78563 - DNA, 22 bp, Artificial Sequence
  chemically synthesized
taagttatgggaccactgataa

SEQ ID NO: 78564 - DNA, 22 bp, Artificial Sequence
  chemically synthesized
aagttatgggaccactgataat

SEQ ID NO: 78565 - DNA, 22 bp, Artificial Sequence
  chemically synthesized
agttatgggaccactgataata

SEQ ID NO: 78566 - DNA, 22 bp, Artificial Sequence
  chemically synthesized
tgggaccactgataatatggtg

SEQ ID NO: 78567 - DNA, 22 bp, Artificial Sequence
  chemically synthesized
ataatatggtgggctaaagaat

SEQ ID NO: 78568 - DNA, 22 bp, Artificial Sequence
  chemically synthesized
aagaatcaggtttttagttgga

SEQ ID NO: 78569 - DNA, 22 bp, Artificial Sequence
  chemically synthesized
ttagttggattgtctggttttg

SEQ ID NO: 78570 - DNA, 22 bp, Artificial Sequence
  chemically synthesized
tagttggattgtctggttttga

SEQ ID NO: 78571 - DNA, 22 bp, Artificial Sequence
  chemically synthesized
agttggattgtctggttttgag

SEQ ID NO: 78572 - DNA, 22 bp, Artificial Sequence
  chemically synthesized
gttggattgtctggttttgagt

SEQ ID NO: 78573 - DNA, 22 bp, Artificial Sequence
  chemically synthesized
gattgtctggttttgagttgtg

SEQ ID NO: 78574 - DNA, 22 bp, Artificial Sequence
  chemically synthesized
tctggttttgagttgtgattct

SEQ ID NO: 78575 - DNA, 22 bp, Artificial Sequence
  chemically synthesized
gttttgagttgtgattctgcca

SEQ ID NO: 78576 - DNA, 22 bp, Artificial Sequence
  chemically synthesized
tgagttgtgattctgccactta

SEQ ID NO: 78577 - DNA, 22 bp, Artificial Sequence
  chemically synthesized
gagttgtgattctgccacttat

SEQ ID NO: 78578 - DNA, 22 bp, Artificial Sequence
  chemically synthesized
agttgtgattctgccacttatt

SEQ ID NO: 78579 - DNA, 22 bp, Artificial Sequence
  chemically synthesized
tgattctgccacttattaactc

SEQ ID NO: 78580 - DNA, 22 bp, Artificial Sequence
  chemically synthesized
tgccacttattaactctttgac

SEQ ID NO: 78581 - DNA, 22 bp, Artificial Sequence
  chemically synthesized
ccacttattaactctttgactt

SEQ ID NO: 78582 - DNA, 22 bp, Artificial Sequence
  chemically synthesized
attaactctttgacttggggca

SEQ ID NO: 78583 - DNA, 22 bp, Artificial Sequence
  chemically synthesized
ttaactctttgacttggggcat

SEQ ID NO: 78584 - DNA, 22 bp, Artificial Sequence
  chemically synthesized
actctttgacttggggcatgat

SEQ ID NO: 78585 - DNA, 22 bp, Artificial Sequence
  chemically synthesized
tttgacttggggcatgatgact

SEQ ID NO: 78586 - DNA, 22 bp, Artificial Sequence
  chemically synthesized
tgacttggggcatgatgacttg

SEQ ID NO: 78587 - DNA, 22 bp, Artificial Sequence
  chemically synthesized
gacttggggcatgatgacttga

SEQ ID NO: 78588 - DNA, 22 bp, Artificial Sequence
  chemically synthesized
acttggggcatgatgacttgac

SEQ ID NO: 78589 - DNA, 22 bp, Artificial Sequence
  chemically synthesized
ggggcatgatgacttgacttct

SEQ ID NO: 78590 - DNA, 22 bp, Artificial Sequence
  chemically synthesized
gggcatgatgacttgacttctc

SEQ ID NO: 78591 - DNA, 22 bp, Artificial Sequence
  chemically synthesized
gacttctctatgtttctgtttc

SEQ ID NO: 78592 - DNA, 22 bp, Artificial Sequence
  chemically synthesized
acttctctatgtttctgtttct

SEQ ID NO: 78593 - DNA, 22 bp, Artificial Sequence
  chemically synthesized
ctctatgtttctgtttctacat

SEQ ID NO: 78594 - DNA, 22 bp, Artificial Sequence
  chemically synthesized
tctatgtttctgtttctacatt

SEQ ID NO: 78595 - DNA, 22 bp, Artificial Sequence
  chemically synthesized
tatgtttctgtttctacatttg

SEQ ID NO: 78596 - DNA, 22 bp, Artificial Sequence
  chemically synthesized
tgtttctgtttctacatttgta

SEQ ID NO: 78597 - DNA, 22 bp, Artificial Sequence
  chemically synthesized
ctgtttctacatttgtaacatg

SEQ ID NO: 78598 - DNA, 22 bp, Artificial Sequence
  chemically synthesized
tgtttctacatttgtaacatgt

SEQ ID NO: 78599 - DNA, 22 bp, Artificial Sequence
  chemically synthesized
tttctacatttgtaacatgtag

SEQ ID NO: 78600 - DNA, 22 bp, Artificial Sequence
  chemically synthesized
ctacatttgtaacatgtagaca

SEQ ID NO: 78601 - DNA, 22 bp, Artificial Sequence
  chemically synthesized
tacatttgtaacatgtagacaa

SEQ ID NO: 78602 - DNA, 22 bp, Artificial Sequence
  chemically synthesized
catttgtaacatgtagacaaac

SEQ ID NO: 78603 - DNA, 22 bp, Artificial Sequence
  chemically synthesized
gtaacatgtagacaaactgata

SEQ ID NO: 78604 - DNA, 22 bp, Artificial Sequence
  chemically synthesized
taacatgtagacaaactgataa

SEQ ID NO: 78605 - DNA, 22 bp, Artificial Sequence
  chemically synthesized
ataatttcttcatatatttgtt

SEQ ID NO: 78606 - DNA, 22 bp, Artificial Sequence
  chemically synthesized
cttcatatatttgttccgtgga

SEQ ID NO: 78607 - DNA, 22 bp, Artificial Sequence
  chemically synthesized
ttcatatatttgttccgtggat

SEQ ID NO: 78608 - DNA, 22 bp, Artificial Sequence
  chemically synthesized
catatatttgttccgtggatta

SEQ ID NO: 78609 - DNA, 22 bp, Artificial Sequence
  chemically synthesized
atatatttgttccgtggattaa

SEQ ID NO: 78610 - DNA, 22 bp, Artificial Sequence
  chemically synthesized
gttccgtggattaaatgaacta

SEQ ID NO: 78611 - DNA, 22 bp, Artificial Sequence
  chemically synthesized
ttccgtggattaaatgaactaa

SEQ ID NO: 78612 - DNA, 22 bp, Artificial Sequence
  chemically synthesized
cgtggattaaatgaactaatct

SEQ ID NO: 78613 - DNA, 22 bp, Artificial Sequence
  chemically synthesized
aatgaactaatctatataaatc

SEQ ID NO: 78614 - DNA, 22 bp, Artificial Sequence
  chemically synthesized
atctatataaatcacttagtat

SEQ ID NO: 78615 - DNA, 22 bp, Artificial Sequence
  chemically synthesized
tataaatcacttagtatggtac

SEQ ID NO: 78616 - DNA, 22 bp, Artificial Sequence
  chemically synthesized
agtatggtacactatagctcgt

SEQ ID NO: 78617 - DNA, 22 bp, Artificial Sequence
  chemically synthesized
gtatggtacactatagctcgtg

SEQ ID NO: 78618 - DNA, 22 bp, Artificial Sequence
  chemically synthesized
tagctcgtgacagagaaatttg

SEQ ID NO: 78619 - DNA, 22 bp, Artificial Sequence
  chemically synthesized
gtgacagagaaatttgtgactt

SEQ ID NO: 78620 - DNA, 22 bp, Artificial Sequence
  chemically synthesized
gtgactttaatttttatgtact

SEQ ID NO: 78621 - DNA, 22 bp, Artificial Sequence
  chemically synthesized
tgactttaatttttatgtactt

SEQ ID NO: 78622 - DNA, 22 bp, Artificial Sequence
  chemically synthesized
taatttttatgtacttgagttt

SEQ ID NO: 78623 - DNA, 22 bp, Artificial Sequence
  chemically synthesized
aatttttatgtacttgagttta

SEQ ID NO: 78624 - DNA, 22 bp, Artificial Sequence
  chemically synthesized
atttttatgtacttgagtttaa

SEQ ID NO: 78625 - DNA, 22 bp, Artificial Sequence
  chemically synthesized
ttatgtacttgagtttaaaatt

SEQ ID NO: 78626 - DNA, 22 bp, Artificial Sequence
  chemically synthesized
tatgtacttgagtttaaaatta

SEQ ID NO: 78627 - DNA, 22 bp, Artificial Sequence
  chemically synthesized
atgtacttgagtttaaaattag

SEQ ID NO: 78628 - DNA, 22 bp, Artificial Sequence
  chemically synthesized
tgtacttgagtttaaaattagc

SEQ ID NO: 78629 - DNA, 22 bp, Artificial Sequence
  chemically synthesized
gagtttaaaattagcatttaga

SEQ ID NO: 78630 - DNA, 22 bp, Artificial Sequence
  chemically synthesized
agtttaaaattagcatttagag

SEQ ID NO: 78631 - DNA, 22 bp, Artificial Sequence
  chemically synthesized
aaaattagcatttagagagact

SEQ ID NO: 78632 - DNA, 22 bp, Artificial Sequence
  chemically synthesized
aaattagcatttagagagactg

SEQ ID NO: 78633 - DNA, 22 bp, Artificial Sequence
  chemically synthesized
gcatttagagagactgtcagga

SEQ ID NO: 78634 - DNA, 22 bp, Artificial Sequence
  chemically synthesized
agagagactgtcaggaattgtg

SEQ ID NO: 78635 - DNA, 22 bp, Artificial Sequence
  chemically synthesized
gagagactgtcaggaattgtga

SEQ ID NO: 78636 - DNA, 22 bp, Artificial Sequence
  chemically synthesized
tcaggaattgtgaaatttgact

SEQ ID NO: 78637 - DNA, 22 bp, Artificial Sequence
  chemically synthesized
tgaaatttgactgtgtattcac

SEQ ID NO: 78638 - DNA, 22 bp, Artificial Sequence
  chemically synthesized
gactgtgtattcacgtattgta

SEQ ID NO: 78639 - DNA, 22 bp, Artificial Sequence
  chemically synthesized
actgtgtattcacgtattgtag

SEQ ID NO: 78640 - DNA, 22 bp, Artificial Sequence
  chemically synthesized
tgtattcacgtattgtagtcag

SEQ ID NO: 78641 - DNA, 22 bp, Artificial Sequence
  chemically synthesized
acgtattgtagtcagatttggt

SEQ ID NO: 78642 - DNA, 22 bp, Artificial Sequence
  chemically synthesized
tagtcagatttggtgaaaaagt

SEQ ID NO: 78643 - DNA, 22 bp, Artificial Sequence
  chemically synthesized
ggtgaaaaagtaattacttaat

SEQ ID NO: 78644 - DNA, 22 bp, Artificial Sequence
  chemically synthesized
gtgaaaaagtaattacttaata

SEQ ID NO: 78645 - DNA, 22 bp, Artificial Sequence
  chemically synthesized
cttaataaaatataattactta

SEQ ID NO: 78646 - DNA, 22 bp, Artificial Sequence
  chemically synthesized
aataaaatataattacttattg

SEQ ID NO: 78647 - DNA, 22 bp, Artificial Sequence
  chemically synthesized
ataaaatataattacttattga

SEQ ID NO: 78648 - DNA, 22 bp, Artificial Sequence
  chemically synthesized
cttattgagcaaattttactag

SEQ ID NO: 78649 - DNA, 22 bp, Artificial Sequence
  chemically synthesized
attgagcaaattttactaggaa

SEQ ID NO: 78650 - DNA, 22 bp, Artificial Sequence
  chemically synthesized
ttgagcaaattttactaggaac

SEQ ID NO: 78651 - DNA, 22 bp, Artificial Sequence
  chemically synthesized
agcaaattttactaggaacttt

SEQ ID NO: 78652 - DNA, 22 bp, Artificial Sequence
  chemically synthesized
tactaggaactttgctaattgc

SEQ ID NO: 78653 - DNA, 22 bp, Artificial Sequence
  chemically synthesized
actaggaactttgctaattgct

SEQ ID NO: 78654 - DNA, 22 bp, Artificial Sequence
  chemically synthesized
ctaggaactttgctaattgctt

SEQ ID NO: 78655 - DNA, 22 bp, Artificial Sequence
  chemically synthesized
ggaactttgctaattgcttaat

SEQ ID NO: 78656 - DNA, 22 bp, Artificial Sequence
  chemically synthesized
tgctaattgcttaatgtgcacc

SEQ ID NO: 78657 - DNA, 22 bp, Artificial Sequence
  chemically synthesized
gctaattgcttaatgtgcacca

SEQ ID NO: 78658 - DNA, 22 bp, Artificial Sequence
  chemically synthesized
ctaattgcttaatgtgcaccat

SEQ ID NO: 78659 - DNA, 22 bp, Artificial Sequence
  chemically synthesized
attgcttaatgtgcaccatttc

SEQ ID NO: 78660 - DNA, 22 bp, Artificial Sequence
  chemically synthesized
cttaatgtgcaccatttcattt

SEQ ID NO: 78661 - DNA, 22 bp, Artificial Sequence
  chemically synthesized
aatgtgcaccatttcatttaat

SEQ ID NO: 78662 - DNA, 22 bp, Artificial Sequence
  chemically synthesized
atgtgcaccatttcatttaatc

SEQ ID NO: 78663 - DNA, 22 bp, Artificial Sequence
  chemically synthesized
catttaatcttcaagatcataa

SEQ ID NO: 78664 - DNA, 22 bp, Artificial Sequence
  chemically synthesized
atttaatcttcaagatcataaa

SEQ ID NO: 78665 - DNA, 22 bp, Artificial Sequence
  chemically synthesized
aatcttcaagatcataaaagct

SEQ ID NO: 78666 - DNA, 22 bp, Artificial Sequence
  chemically synthesized
atcttcaagatcataaaagctg

SEQ ID NO: 78667 - DNA, 22 bp, Artificial Sequence
  chemically synthesized
caagatcataaaagctggattt

SEQ ID NO: 78668 - DNA, 22 bp, Artificial Sequence
  chemically synthesized
aagatcataaaagctggatttt

SEQ ID NO: 78669 - DNA, 22 bp, Artificial Sequence
  chemically synthesized
gattttattttcttattcattt

SEQ ID NO: 78670 - DNA, 22 bp, Artificial Sequence
  chemically synthesized
tattttcttattcatttataaa

SEQ ID NO: 78671 - DNA, 22 bp, Artificial Sequence
  chemically synthesized
attttcttattcatttataaat

SEQ ID NO: 78672 - DNA, 22 bp, Artificial Sequence
  chemically synthesized
ttttcttattcatttataaatg

SEQ ID NO: 78673 - DNA, 22 bp, Artificial Sequence
  chemically synthesized
tcttattcatttataaatgaat

SEQ ID NO: 78674 - DNA, 22 bp, Artificial Sequence
  chemically synthesized
cttattcatttataaatgaata

SEQ ID NO: 78675 - DNA, 22 bp, Artificial Sequence
  chemically synthesized
ttattcatttataaatgaataa

SEQ ID NO: 78676 - DNA, 22 bp, Artificial Sequence
  chemically synthesized
attcatttataaatgaataaat

SEQ ID NO: 78677 - DNA, 22 bp, Artificial Sequence
  chemically synthesized
ttcatttataaatgaataaatt

SEQ ID NO: 78678 - DNA, 22 bp, Artificial Sequence
  chemically synthesized
atttataaatgaataaattata

SEQ ID NO: 78679 - DNA, 22 bp, Artificial Sequence
  chemically synthesized
ataaatgaataaattatattca

SEQ ID NO: 78680 - DNA, 22 bp, Artificial Sequence
  chemically synthesized
taaatgaataaattatattcaa

SEQ ID NO: 78681 - DNA, 22 bp, Artificial Sequence
  chemically synthesized
tattcaaacaggtcatactact

SEQ ID NO: 78682 - DNA, 22 bp, Artificial Sequence
  chemically synthesized
aaacaggtcatactactagcaa

SEQ ID NO: 78683 - DNA, 22 bp, Artificial Sequence
  chemically synthesized
ctagcaagatcccacaattact

SEQ ID NO: 78684 - DNA, 22 bp, Artificial Sequence
  chemically synthesized
gcaagatcccacaattactaat

SEQ ID NO: 78685 - DNA, 22 bp, Artificial Sequence
  chemically synthesized
ctaatagcaagatagctaagat

SEQ ID NO: 78686 - DNA, 22 bp, Artificial Sequence
  chemically synthesized
atagcaagatagctaagatttc

SEQ ID NO: 78687 - DNA, 22 bp, Artificial Sequence
  chemically synthesized
agatttcaacctaggtacatct

SEQ ID NO: 78688 - DNA, 22 bp, Artificial Sequence
  chemically synthesized
caacctaggtacatctggttca

SEQ ID NO: 78689 - DNA, 22 bp, Artificial Sequence
  chemically synthesized
aacctaggtacatctggttcaa

SEQ ID NO: 78690 - DNA, 22 bp, Artificial Sequence
  chemically synthesized
ggtacatctggttcaagtgtat

SEQ ID NO: 78691 - DNA, 22 bp, Artificial Sequence
  chemically synthesized
gttcaagtgtataacatcacac

SEQ ID NO: 78692 - DNA, 22 bp, Artificial Sequence
  chemically synthesized
aagtgtataacatcacactgag

SEQ ID NO: 78693 - DNA, 22 bp, Artificial Sequence
  chemically synthesized
aggacttggctcttgggtgtac

SEQ ID NO: 78694 - DNA, 22 bp, Artificial Sequence
  chemically synthesized
ggctcttgggtgtacaagtttt

SEQ ID NO: 78695 - DNA, 22 bp, Artificial Sequence
  chemically synthesized
gctcttgggtgtacaagttttc

SEQ ID NO: 78696 - DNA, 22 bp, Artificial Sequence
  chemically synthesized
ttgggtgtacaagttttccatt

SEQ ID NO: 78697 - DNA, 22 bp, Artificial Sequence
  chemically synthesized
gggtgtacaagttttccattgt

SEQ ID NO: 78698 - DNA, 22 bp, Artificial Sequence
  chemically synthesized
ggtgtacaagttttccattgtg

SEQ ID NO: 78699 - DNA, 22 bp, Artificial Sequence
  chemically synthesized
tccattgtgtgaacttgataaa

SEQ ID NO: 78700 - DNA, 22 bp, Artificial Sequence
  chemically synthesized
ccattgtgtgaacttgataaag

SEQ ID NO: 78701 - DNA, 22 bp, Artificial Sequence
  chemically synthesized
cattgtgtgaacttgataaagt

SEQ ID NO: 78702 - DNA, 22 bp, Artificial Sequence
  chemically synthesized
tgtgaacttgataaagttacaa

SEQ ID NO: 78703 - DNA, 22 bp, Artificial Sequence
  chemically synthesized
gataaagttacaaaaattatct

SEQ ID NO: 78704 - DNA, 22 bp, Artificial Sequence
  chemically synthesized
ataaagttacaaaaattatctc

SEQ ID NO: 78705 - DNA, 22 bp, Artificial Sequence
  chemically synthesized
caaaaattatctcttagttttt

SEQ ID NO: 78706 - DNA, 22 bp, Artificial Sequence
  chemically synthesized
tctcttagttttttcatgtata

SEQ ID NO: 78707 - DNA, 22 bp, Artificial Sequence
  chemically synthesized
ttagttttttcatgtataccat

SEQ ID NO: 78708 - DNA, 22 bp, Artificial Sequence
  chemically synthesized
agttttttcatgtataccataa

SEQ ID NO: 78709 - DNA, 22 bp, Artificial Sequence
  chemically synthesized
gttttttcatgtataccataag

SEQ ID NO: 78710 - DNA, 22 bp, Artificial Sequence
  chemically synthesized
tttcatgtataccataagaata

SEQ ID NO: 78711 - DNA, 22 bp, Artificial Sequence
  chemically synthesized
ttcatgtataccataagaatag

SEQ ID NO: 78712 - DNA, 22 bp, Artificial Sequence
  chemically synthesized
tcatgtataccataagaatagt

SEQ ID NO: 78713 - DNA, 22 bp, Artificial Sequence
  chemically synthesized
catgtataccataagaatagta

SEQ ID NO: 78714 - DNA, 22 bp, Artificial Sequence
  chemically synthesized
atgtataccataagaatagtaa

SEQ ID NO: 78715 - DNA, 22 bp, Artificial Sequence
  chemically synthesized
taatggaggttaccaataatta

SEQ ID NO: 78716 - DNA, 22 bp, Artificial Sequence
  chemically synthesized
ccaataattattgttaaggaag

SEQ ID NO: 78717 - DNA, 22 bp, Artificial Sequence
  chemically synthesized
ttgttaaggaagggcttctaaa

SEQ ID NO: 78718 - DNA, 22 bp, Artificial Sequence
  chemically synthesized
ttaaggaagggcttctaaatta

SEQ ID NO: 78719 - DNA, 22 bp, Artificial Sequence
  chemically synthesized
aggaagggcttctaaattactc

SEQ ID NO: 78720 - DNA, 22 bp, Artificial Sequence
  chemically synthesized
ctaaattactctgaaattttga

SEQ ID NO: 78721 - DNA, 22 bp, Artificial Sequence
  chemically synthesized
taaattactctgaaattttgag

SEQ ID NO: 78722 - DNA, 22 bp, Artificial Sequence
  chemically synthesized
aattactctgaaattttgagaa

SEQ ID NO: 78723 - DNA, 22 bp, Artificial Sequence
  chemically synthesized
ctctgaaattttgagaattttt

SEQ ID NO: 78724 - DNA, 22 bp, Artificial Sequence
  chemically synthesized
tgaaattttgagaatttttttt

SEQ ID NO: 78725 - DNA, 22 bp, Artificial Sequence
  chemically synthesized
aaattttgagaattttttttta

SEQ ID NO: 78726 - DNA, 22 bp, Artificial Sequence
  chemically synthesized
tgagaatttttttttaaatccc

SEQ ID NO: 78727 - DNA, 22 bp, Artificial Sequence
  chemically synthesized
gagaatttttttttaaatccca

SEQ ID NO: 78728 - DNA, 22 bp, Artificial Sequence
  chemically synthesized
agaatttttttttaaatcccat

SEQ ID NO: 78729 - DNA, 22 bp, Artificial Sequence
  chemically synthesized
ttttttaaatcccatgttgttt

SEQ ID NO: 78730 - DNA, 22 bp, Artificial Sequence
  chemically synthesized
tttttaaatcccatgttgtttt

SEQ ID NO: 78731 - DNA, 22 bp, Artificial Sequence
  chemically synthesized
ttttaaatcccatgttgttttt

SEQ ID NO: 78732 - DNA, 22 bp, Artificial Sequence
  chemically synthesized
tttaaatcccatgttgttttta

SEQ ID NO: 78733 - DNA, 22 bp, Artificial Sequence
  chemically synthesized
ttaaatcccatgttgtttttat

SEQ ID NO: 78734 - DNA, 22 bp, Artificial Sequence
  chemically synthesized
taaatcccatgttgtttttatg

SEQ ID NO: 78735 - DNA, 22 bp, Artificial Sequence
  chemically synthesized
aaatcccatgttgtttttatga

SEQ ID NO: 78736 - DNA, 22 bp, Artificial Sequence
  chemically synthesized
aatcccatgttgtttttatgac

SEQ ID NO: 78737 - DNA, 22 bp, Artificial Sequence
  chemically synthesized
tttttatgacttcactacattg

SEQ ID NO: 78738 - DNA, 22 bp, Artificial Sequence
  chemically synthesized
ttatgacttcactacattgaac

SEQ ID NO: 78739 - DNA, 22 bp, Artificial Sequence
  chemically synthesized
tatgacttcactacattgaaca

SEQ ID NO: 78740 - DNA, 22 bp, Artificial Sequence
  chemically synthesized
atgacttcactacattgaacac

SEQ ID NO: 78741 - DNA, 22 bp, Artificial Sequence
  chemically synthesized
tgacttcactacattgaacact

SEQ ID NO: 78742 - DNA, 22 bp, Artificial Sequence
  chemically synthesized
cactacattgaacactttcaaa

SEQ ID NO: 78743 - DNA, 22 bp, Artificial Sequence
  chemically synthesized
actacattgaacactttcaaag

SEQ ID NO: 78744 - DNA, 22 bp, Artificial Sequence
  chemically synthesized
cattgaacactttcaaaggtgt

SEQ ID NO: 78745 - DNA, 22 bp, Artificial Sequence
  chemically synthesized
aacactttcaaaggtgtttcat

SEQ ID NO: 78746 - DNA, 22 bp, Artificial Sequence
  chemically synthesized
tcaaaggtgtttcatacattaa

SEQ ID NO: 78747 - DNA, 22 bp, Artificial Sequence
  chemically synthesized
caaaggtgtttcatacattaaa

SEQ ID NO: 78748 - DNA, 22 bp, Artificial Sequence
  chemically synthesized
aaaggtgtttcatacattaaaa

SEQ ID NO: 78749 - DNA, 22 bp, Artificial Sequence
  chemically synthesized
catacattaaaaattttttaag

SEQ ID NO: 78750 - DNA, 22 bp, Artificial Sequence
  chemically synthesized
atacattaaaaattttttaagt

SEQ ID NO: 78751 - DNA, 22 bp, Artificial Sequence
  chemically synthesized
aaaattttttaagtccataaat

SEQ ID NO: 78752 - DNA, 22 bp, Artificial Sequence
  chemically synthesized
tttaagtccataaattaatttc

SEQ ID NO: 78753 - DNA, 22 bp, Artificial Sequence
  chemically synthesized
ttaagtccataaattaatttcg

SEQ ID NO: 78754 - DNA, 22 bp, Artificial Sequence
  chemically synthesized
taagtccataaattaatttcga

SEQ ID NO: 78755 - DNA, 22 bp, Artificial Sequence
  chemically synthesized
aagtccataaattaatttcgag

SEQ ID NO: 78756 - DNA, 22 bp, Artificial Sequence
  chemically synthesized
agtccataaattaatttcgagg

SEQ ID NO: 78757 - DNA, 22 bp, Artificial Sequence
  chemically synthesized
atttcgaggaaaacagaaaaaa

SEQ ID NO: 78758 - DNA, 22 bp, Artificial Sequence
  chemically synthesized
cgaggaaaacagaaaaaaatat

SEQ ID NO: 78759 - DNA, 22 bp, Artificial Sequence
  chemically synthesized
gaggaaaacagaaaaaaatata

SEQ ID NO: 78760 - DNA, 22 bp, Artificial Sequence
  chemically synthesized
tgccactcattacttgatacat

SEQ ID NO: 78761 - DNA, 22 bp, Artificial Sequence
  chemically synthesized
gccactcattacttgatacata

SEQ ID NO: 78762 - DNA, 22 bp, Artificial Sequence
  chemically synthesized
ccactcattacttgatacatat

SEQ ID NO: 78763 - DNA, 22 bp, Artificial Sequence
  chemically synthesized
attacttgatacatatttttat

SEQ ID NO: 78764 - DNA, 22 bp, Artificial Sequence
  chemically synthesized
cttgatacatatttttatttga

SEQ ID NO: 78765 - DNA, 22 bp, Artificial Sequence
  chemically synthesized
gatacatatttttatttgacca

SEQ ID NO: 78766 - DNA, 22 bp, Artificial Sequence
  chemically synthesized
atacatatttttatttgaccaa

SEQ ID NO: 78767 - DNA, 22 bp, Artificial Sequence
  chemically synthesized
ttatttgaccaaaccttctatt

SEQ ID NO: 78768 - DNA, 22 bp, Artificial Sequence
  chemically synthesized
tatttgaccaaaccttctatta

SEQ ID NO: 78769 - DNA, 22 bp, Artificial Sequence
  chemically synthesized
atttgaccaaaccttctattag

SEQ ID NO: 78770 - DNA, 22 bp, Artificial Sequence
  chemically synthesized
tttgaccaaaccttctattagt

SEQ ID NO: 78771 - DNA, 22 bp, Artificial Sequence
  chemically synthesized
gaccaaaccttctattagttac

SEQ ID NO: 78772 - DNA, 22 bp, Artificial Sequence
  chemically synthesized
accaaaccttctattagttact

SEQ ID NO: 78773 - DNA, 22 bp, Artificial Sequence
  chemically synthesized
ctattagttacttggttggctg

SEQ ID NO: 78774 - DNA, 22 bp, Artificial Sequence
  chemically synthesized
tattagttacttggttggctga

SEQ ID NO: 78775 - DNA, 22 bp, Artificial Sequence
  chemically synthesized
ttagttacttggttggctgata

SEQ ID NO: 78776 - DNA, 22 bp, Artificial Sequence
  chemically synthesized
gttacttggttggctgataatc

SEQ ID NO: 78777 - DNA, 22 bp, Artificial Sequence
  chemically synthesized
cttggttggctgataatcactc

SEQ ID NO: 78778 - DNA, 22 bp, Artificial Sequence
  chemically synthesized
ggttggctgataatcactcaag

SEQ ID NO: 78779 - DNA, 22 bp, Artificial Sequence
  chemically synthesized
gttggctgataatcactcaaga

SEQ ID NO: 78780 - DNA, 22 bp, Artificial Sequence
  chemically synthesized
gctgataatcactcaagactgt

SEQ ID NO: 78781 - DNA, 22 bp, Artificial Sequence
  chemically synthesized
ataatcactcaagactgtgtgg

SEQ ID NO: 78782 - DNA, 22 bp, Artificial Sequence
  chemically synthesized
aagactgtgtggtttaatagga

SEQ ID NO: 78783 - DNA, 22 bp, Artificial Sequence
  chemically synthesized
tgtggtttaataggatattcac

SEQ ID NO: 78784 - DNA, 22 bp, Artificial Sequence
  chemically synthesized
aataggatattcactgtggttc

SEQ ID NO: 78785 - DNA, 22 bp, Artificial Sequence
  chemically synthesized
ataggatattcactgtggttca

SEQ ID NO: 78786 - DNA, 22 bp, Artificial Sequence
  chemically synthesized
actgtggttcatggaaattcaa

SEQ ID NO: 78787 - DNA, 22 bp, Artificial Sequence
  chemically synthesized
tggttcatggaaattcaaaatt

SEQ ID NO: 78788 - DNA, 22 bp, Artificial Sequence
  chemically synthesized
atggaaattcaaaattatctga

SEQ ID NO: 78789 - DNA, 22 bp, Artificial Sequence
  chemically synthesized
aaaattatctgaagaaaacaaa

SEQ ID NO: 78790 - DNA, 22 bp, Artificial Sequence
  chemically synthesized
tctgaagaaaacaaaaagttgg

SEQ ID NO: 78791 - DNA, 22 bp, Artificial Sequence
  chemically synthesized
aagaaaacaaaaagttgggctc

SEQ ID NO: 78792 - DNA, 22 bp, Artificial Sequence
  chemically synthesized
ggctctgcaatccctgtctgag

SEQ ID NO: 78793 - DNA, 22 bp, Artificial Sequence
  chemically synthesized
tgcaatccctgtctgagggatt

SEQ ID NO: 78794 - DNA, 22 bp, Artificial Sequence
  chemically synthesized
caatccctgtctgagggatttt

SEQ ID NO: 78795 - DNA, 22 bp, Artificial Sequence
  chemically synthesized
tctgagggattttctagaattc

SEQ ID NO: 78796 - DNA, 22 bp, Artificial Sequence
  chemically synthesized
agggattttctagaattcttct

SEQ ID NO: 78797 - DNA, 22 bp, Artificial Sequence
  chemically synthesized
tctagaattcttctggtcctcc

SEQ ID NO: 78798 - DNA, 22 bp, Artificial Sequence
  chemically synthesized
ctagaattcttctggtcctccc

SEQ ID NO: 78799 - DNA, 22 bp, Artificial Sequence
  chemically synthesized
tagaattcttctggtcctccct

SEQ ID NO: 78800 - DNA, 22 bp, Artificial Sequence
  chemically synthesized
gaattcttctggtcctccctac

SEQ ID NO: 78801 - DNA, 22 bp, Artificial Sequence
  chemically synthesized
ttctggtcctccctaccttttt

SEQ ID NO: 78802 - DNA, 22 bp, Artificial Sequence
  chemically synthesized
ctggtcctccctacctttttgt

SEQ ID NO: 78803 - DNA, 22 bp, Artificial Sequence
  chemically synthesized
tggtcctccctacctttttgtt

SEQ ID NO: 78804 - DNA, 22 bp, Artificial Sequence
  chemically synthesized
gtcctccctacctttttgtttg

SEQ ID NO: 78805 - DNA, 22 bp, Artificial Sequence
  chemically synthesized
cctacctttttgtttgtcagaa

SEQ ID NO: 78806 - DNA, 22 bp, Artificial Sequence
  chemically synthesized
cctttttgtttgtcagaagctt

SEQ ID NO: 78807 - DNA, 22 bp, Artificial Sequence
  chemically synthesized
tttgtttgtcagaagcttgtct

SEQ ID NO: 78808 - DNA, 22 bp, Artificial Sequence
  chemically synthesized
ttgtttgtcagaagcttgtcta

SEQ ID NO: 78809 - DNA, 22 bp, Artificial Sequence
  chemically synthesized
tgtttgtcagaagcttgtctac

SEQ ID NO: 78810 - DNA, 22 bp, Artificial Sequence
  chemically synthesized
gtttgtcagaagcttgtctact

SEQ ID NO: 78811 - DNA, 22 bp, Artificial Sequence
  chemically synthesized
tttgtcagaagcttgtctacta

SEQ ID NO: 78812 - DNA, 22 bp, Artificial Sequence
  chemically synthesized
gtcagaagcttgtctactaccg

SEQ ID NO: 78813 - DNA, 22 bp, Artificial Sequence
  chemically synthesized
tcagaagcttgtctactaccga

SEQ ID NO: 78814 - DNA, 22 bp, Artificial Sequence
  chemically synthesized
gtctactaccgagtgattgatg

SEQ ID NO: 78815 - DNA, 22 bp, Artificial Sequence
  chemically synthesized
tctactaccgagtgattgatgt

SEQ ID NO: 78816 - DNA, 22 bp, Artificial Sequence
  chemically synthesized
ctaccgagtgattgatgtcacc

SEQ ID NO: 78817 - DNA, 22 bp, Artificial Sequence
  chemically synthesized
ccgagtgattgatgtcaccaaa

SEQ ID NO: 78818 - DNA, 22 bp, Artificial Sequence
  chemically synthesized
atgtcaccaaagactattgcag

SEQ ID NO: 78819 - DNA, 22 bp, Artificial Sequence
  chemically synthesized
ttgcaggagtaggccttgcttt

SEQ ID NO: 78820 - DNA, 22 bp, Artificial Sequence
  chemically synthesized
caggagtaggccttgctttttc

SEQ ID NO: 78821 - DNA, 22 bp, Artificial Sequence
  chemically synthesized
gctttttctgttttttagttat

SEQ ID NO: 78822 - DNA, 22 bp, Artificial Sequence
  chemically synthesized
ctttttctgttttttagttatt

SEQ ID NO: 78823 - DNA, 22 bp, Artificial Sequence
  chemically synthesized
tttctgttttttagttattttc

SEQ ID NO: 78824 - DNA, 22 bp, Artificial Sequence
  chemically synthesized
ttctgttttttagttattttct

SEQ ID NO: 78825 - DNA, 22 bp, Artificial Sequence
  chemically synthesized
tctgttttttagttattttctt

SEQ ID NO: 78826 - DNA, 22 bp, Artificial Sequence
  chemically synthesized
ctgttttttagttattttcttc

SEQ ID NO: 78827 - DNA, 22 bp, Artificial Sequence
  chemically synthesized
tgttttttagttattttcttct

SEQ ID NO: 78828 - DNA, 22 bp, Artificial Sequence
  chemically synthesized
ttttttagttattttcttctaa

SEQ ID NO: 78829 - DNA, 22 bp, Artificial Sequence
  chemically synthesized
tttagttattttcttctaaaac

SEQ ID NO: 78830 - DNA, 22 bp, Artificial Sequence
  chemically synthesized
ttagttattttcttctaaaaca

SEQ ID NO: 78831 - DNA, 22 bp, Artificial Sequence
  chemically synthesized
tagttattttcttctaaaacag

SEQ ID NO: 78832 - DNA, 22 bp, Artificial Sequence
  chemically synthesized
agttattttcttctaaaacagt

SEQ ID NO: 78833 - DNA, 22 bp, Artificial Sequence
  chemically synthesized
gttattttcttctaaaacagta

SEQ ID NO: 78834 - DNA, 22 bp, Artificial Sequence
  chemically synthesized
ttttcttctaaaacagtatttt

SEQ ID NO: 78835 - DNA, 22 bp, Artificial Sequence
  chemically synthesized
tcttctaaaacagtattttcaa

SEQ ID NO: 78836 - DNA, 22 bp, Artificial Sequence
  chemically synthesized
cttctaaaacagtattttcaag

SEQ ID NO: 78837 - DNA, 22 bp, Artificial Sequence
  chemically synthesized
ttctaaaacagtattttcaagt

SEQ ID NO: 78838 - DNA, 22 bp, Artificial Sequence
  chemically synthesized
ctaaaacagtattttcaagtag

SEQ ID NO: 78839 - DNA, 22 bp, Artificial Sequence
  chemically synthesized
taaaacagtattttcaagtagt

SEQ ID NO: 78840 - DNA, 22 bp, Artificial Sequence
  chemically synthesized
aaacagtattttcaagtagttg

SEQ ID NO: 78841 - DNA, 22 bp, Artificial Sequence
  chemically synthesized
tcaagtagttgtggtttttttt

SEQ ID NO: 78842 - DNA, 22 bp, Artificial Sequence
  chemically synthesized
caagtagttgtggttttttttc

SEQ ID NO: 78843 - DNA, 22 bp, Artificial Sequence
  chemically synthesized
aagtagttgtggttttttttct

SEQ ID NO: 78844 - DNA, 22 bp, Artificial Sequence
  chemically synthesized
tggttttttttctttctagtat

SEQ ID NO: 78845 - DNA, 22 bp, Artificial Sequence
  chemically synthesized
tttttctttctagtattgaact

SEQ ID NO: 78846 - DNA, 22 bp, Artificial Sequence
  chemically synthesized
ttttctttctagtattgaactc

SEQ ID NO: 78847 - DNA, 22 bp, Artificial Sequence
  chemically synthesized
tttctttctagtattgaactca

SEQ ID NO: 78848 - DNA, 22 bp, Artificial Sequence
  chemically synthesized
ttctttctagtattgaactcat

SEQ ID NO: 78849 - DNA, 22 bp, Artificial Sequence
  chemically synthesized
tctttctagtattgaactcatt

SEQ ID NO: 78850 - DNA, 22 bp, Artificial Sequence
  chemically synthesized
ctttctagtattgaactcatta

SEQ ID NO: 78851 - DNA, 22 bp, Artificial Sequence
  chemically synthesized
tttctagtattgaactcattaa

SEQ ID NO: 78852 - DNA, 22 bp, Artificial Sequence
  chemically synthesized
tctagtattgaactcattaaaa

SEQ ID NO: 78853 - DNA, 22 bp, Artificial Sequence
  chemically synthesized
ctagtattgaactcattaaaaa

SEQ ID NO: 78854 - DNA, 22 bp, Artificial Sequence
  chemically synthesized
tagtattgaactcattaaaaat

SEQ ID NO: 78855 - DNA, 22 bp, Artificial Sequence
  chemically synthesized
gtattgaactcattaaaaataa

SEQ ID NO: 78856 - DNA, 22 bp, Artificial Sequence
  chemically synthesized
aactcattaaaaataaaatagc

SEQ ID NO: 78857 - DNA, 22 bp, Artificial Sequence
  chemically synthesized
attaaaaataaaatagctttct

SEQ ID NO: 78858 - DNA, 22 bp, Artificial Sequence
  chemically synthesized
aaaataaaatagctttctaaag

SEQ ID NO: 78859 - DNA, 22 bp, Artificial Sequence
  chemically synthesized
tctaaagccaaacagtttcctc

SEQ ID NO: 78860 - DNA, 22 bp, Artificial Sequence
  chemically synthesized
ctaaagccaaacagtttcctcc

SEQ ID NO: 78861 - DNA, 22 bp, Artificial Sequence
  chemically synthesized
taaagccaaacagtttcctcct

SEQ ID NO: 78862 - DNA, 22 bp, Artificial Sequence
  chemically synthesized
aagccaaacagtttcctcctga

SEQ ID NO: 78863 - DNA, 22 bp, Artificial Sequence
  chemically synthesized
cctcctgaccagttaaaagtta

SEQ ID NO: 78864 - DNA, 22 bp, Artificial Sequence
  chemically synthesized
ctcctgaccagttaaaagttat

SEQ ID NO: 78865 - DNA, 22 bp, Artificial Sequence
  chemically synthesized
ctgaccagttaaaagttatctc

SEQ ID NO: 78866 - DNA, 22 bp, Artificial Sequence
  chemically synthesized
accagttaaaagttatctctgc

SEQ ID NO: 78867 - DNA, 22 bp, Artificial Sequence
  chemically synthesized
aaagttatctctgcttcatggt

SEQ ID NO: 78868 - DNA, 22 bp, Artificial Sequence
  chemically synthesized
tctctgcttcatggtgcatatt

SEQ ID NO: 78869 - DNA, 22 bp, Artificial Sequence
  chemically synthesized
tgcttcatggtgcatattcaat

SEQ ID NO: 78870 - DNA, 22 bp, Artificial Sequence
  chemically synthesized
cttcatggtgcatattcaatta

SEQ ID NO: 78871 - DNA, 22 bp, Artificial Sequence
  chemically synthesized
catggtgcatattcaattaaga

SEQ ID NO: 78872 - DNA, 22 bp, Artificial Sequence
  chemically synthesized
atggtgcatattcaattaagat

SEQ ID NO: 78873 - DNA, 22 bp, Artificial Sequence
  chemically synthesized
aattaagatttaacattagcac

SEQ ID NO: 78874 - DNA, 22 bp, Artificial Sequence
  chemically synthesized
agatttaacattagcacactga

SEQ ID NO: 78875 - DNA, 22 bp, Artificial Sequence
  chemically synthesized
aacattagcacactgagtataa

SEQ ID NO: 78876 - DNA, 22 bp, Artificial Sequence
  chemically synthesized
acattagcacactgagtataat

SEQ ID NO: 78877 - DNA, 22 bp, Artificial Sequence
  chemically synthesized
gcacactgagtataattttttt

SEQ ID NO: 78878 - DNA, 22 bp, Artificial Sequence
  chemically synthesized
agtataatttttttaagaatct

SEQ ID NO: 78879 - DNA, 22 bp, Artificial Sequence
  chemically synthesized
ttttaagaatctttttattaca

SEQ ID NO: 78880 - DNA, 22 bp, Artificial Sequence
  chemically synthesized
tttaagaatctttttattacag

SEQ ID NO: 78881 - DNA, 22 bp, Artificial Sequence
  chemically synthesized
ttaagaatctttttattacaga

SEQ ID NO: 78882 - DNA, 22 bp, Artificial Sequence
  chemically synthesized
taagaatctttttattacagaa

SEQ ID NO: 78883 - DNA, 22 bp, Artificial Sequence
  chemically synthesized
aagaatctttttattacagaaa

SEQ ID NO: 78884 - DNA, 22 bp, Artificial Sequence
  chemically synthesized
agaatctttttattacagaaat

SEQ ID NO: 78885 - DNA, 22 bp, Artificial Sequence
  chemically synthesized
tttattacagaaattgtaaact

SEQ ID NO: 78886 - DNA, 22 bp, Artificial Sequence
  chemically synthesized
ttattacagaaattgtaaacta

SEQ ID NO: 78887 - DNA, 22 bp, Artificial Sequence
  chemically synthesized
tattacagaaattgtaaactac

SEQ ID NO: 78888 - DNA, 22 bp, Artificial Sequence
  chemically synthesized
attacagaaattgtaaactaca

SEQ ID NO: 78889 - DNA, 22 bp, Artificial Sequence
  chemically synthesized
ttacagaaattgtaaactacac

SEQ ID NO: 78890 - DNA, 22 bp, Artificial Sequence
  chemically synthesized
cagaaattgtaaactacacaaa

SEQ ID NO: 78891 - DNA, 22 bp, Artificial Sequence
  chemically synthesized
taaactacacaaagtaaacaga

SEQ ID NO: 78892 - DNA, 22 bp, Artificial Sequence
  chemically synthesized
cacaaagtaaacagaatattat

SEQ ID NO: 78893 - DNA, 22 bp, Artificial Sequence
  chemically synthesized
taattaatttccaggcacccat

SEQ ID NO: 78894 - DNA, 22 bp, Artificial Sequence
  chemically synthesized
atttccaggcacccatgacaca

SEQ ID NO: 78895 - DNA, 22 bp, Artificial Sequence
  chemically synthesized
ccaggcacccatgacacaactt

SEQ ID NO: 78896 - DNA, 22 bp, Artificial Sequence
  chemically synthesized
caggcacccatgacacaacttc

SEQ ID NO: 78897 - DNA, 22 bp, Artificial Sequence
  chemically synthesized
caacaattatcaacattacacc

SEQ ID NO: 78898 - DNA, 22 bp, Artificial Sequence
  chemically synthesized
aacaattatcaacattacacca

SEQ ID NO: 78899 - DNA, 22 bp, Artificial Sequence
  chemically synthesized
tcaacattacaccattcttgta

SEQ ID NO: 78900 - DNA, 22 bp, Artificial Sequence
  chemically synthesized
caccattcttgtattttccaca

SEQ ID NO: 78901 - DNA, 22 bp, Artificial Sequence
  chemically synthesized
ttgtattttccacacttgtatt

SEQ ID NO: 78902 - DNA, 22 bp, Artificial Sequence
  chemically synthesized
gtattttccacacttgtattca

SEQ ID NO: 78903 - DNA, 22 bp, Artificial Sequence
  chemically synthesized
tattttccacacttgtattcac

SEQ ID NO: 78904 - DNA, 22 bp, Artificial Sequence
  chemically synthesized
tccacacttgtattcactatga

SEQ ID NO: 78905 - DNA, 22 bp, Artificial Sequence
  chemically synthesized
ccacacttgtattcactatgaa

SEQ ID NO: 78906 - DNA, 22 bp, Artificial Sequence
  chemically synthesized
cacacttgtattcactatgaaa

SEQ ID NO: 78907 - DNA, 22 bp, Artificial Sequence
  chemically synthesized
gtattcactatgaaatctaatc

SEQ ID NO: 78908 - DNA, 22 bp, Artificial Sequence
  chemically synthesized
tattcactatgaaatctaatca

SEQ ID NO: 78909 - DNA, 22 bp, Artificial Sequence
  chemically synthesized
actatgaaatctaatcatctgt

SEQ ID NO: 78910 - DNA, 22 bp, Artificial Sequence
  chemically synthesized
tgaaatctaatcatctgtatta

SEQ ID NO: 78911 - DNA, 22 bp, Artificial Sequence
  chemically synthesized
atcatctgtattattattacta

SEQ ID NO: 78912 - DNA, 22 bp, Artificial Sequence
  chemically synthesized
tattattattactattttcctt

SEQ ID NO: 78913 - DNA, 22 bp, Artificial Sequence
  chemically synthesized
ttattactattttcctttttgt

SEQ ID NO: 78914 - DNA, 22 bp, Artificial Sequence
  chemically synthesized
ttactattttcctttttgttat

SEQ ID NO: 78915 - DNA, 22 bp, Artificial Sequence
  chemically synthesized
ctattttcctttttgttattat

SEQ ID NO: 78916 - DNA, 22 bp, Artificial Sequence
  chemically synthesized
ttttcctttttgttattattat

SEQ ID NO: 78917 - DNA, 22 bp, Artificial Sequence
  chemically synthesized
tcctttttgttattattatcat

SEQ ID NO: 78918 - DNA, 22 bp, Artificial Sequence
  chemically synthesized
cctttttgttattattatcatt

SEQ ID NO: 78919 - DNA, 22 bp, Artificial Sequence
  chemically synthesized
ctttttgttattattatcattc

SEQ ID NO: 78920 - DNA, 22 bp, Artificial Sequence
  chemically synthesized
tttgttattattatcattcaga

SEQ ID NO: 78921 - DNA, 22 bp, Artificial Sequence
  chemically synthesized
ttgttattattatcattcagaa

SEQ ID NO: 78922 - DNA, 22 bp, Artificial Sequence
  chemically synthesized
tgttattattatcattcagaag

SEQ ID NO: 78923 - DNA, 22 bp, Artificial Sequence
  chemically synthesized
gttattattatcattcagaagt

SEQ ID NO: 78924 - DNA, 22 bp, Artificial Sequence
  chemically synthesized
ttattattatcattcagaagtt

SEQ ID NO: 78925 - DNA, 22 bp, Artificial Sequence
  chemically synthesized
ttattatcattcagaagttttg

SEQ ID NO: 78926 - DNA, 22 bp, Artificial Sequence
  chemically synthesized
ttatcattcagaagttttgatg

SEQ ID NO: 78927 - DNA, 22 bp, Artificial Sequence
  chemically synthesized
tcattcagaagttttgatgtaa

SEQ ID NO: 78928 - DNA, 22 bp, Artificial Sequence
  chemically synthesized
agaagttttgatgtaaaattga

SEQ ID NO: 78929 - DNA, 22 bp, Artificial Sequence
  chemically synthesized
tgatgtaaaattgatgtaccta

SEQ ID NO: 78930 - DNA, 22 bp, Artificial Sequence
  chemically synthesized
gatgtaaaattgatgtacctag

SEQ ID NO: 78931 - DNA, 22 bp, Artificial Sequence
  chemically synthesized
atgtaaaattgatgtacctaga

SEQ ID NO: 78932 - DNA, 22 bp, Artificial Sequence
  chemically synthesized
atgtacctagaaatgtgcaaat

SEQ ID NO: 78933 - DNA, 22 bp, Artificial Sequence
  chemically synthesized
gaaatgtgcaaatcttagctgt

SEQ ID NO: 78934 - DNA, 22 bp, Artificial Sequence
  chemically synthesized
agctgtaccgttttgacaaatt

SEQ ID NO: 78935 - DNA, 22 bp, Artificial Sequence
  chemically synthesized
gctgtaccgttttgacaaattg

SEQ ID NO: 78936 - DNA, 22 bp, Artificial Sequence
  chemically synthesized
taccgttttgacaaattgacaa

SEQ ID NO: 78937 - DNA, 22 bp, Artificial Sequence
  chemically synthesized
tgacaaattgacaaaacaatgt

SEQ ID NO: 78938 - DNA, 22 bp, Artificial Sequence
  chemically synthesized
gacaaattgacaaaacaatgtc

SEQ ID NO: 78939 - DNA, 22 bp, Artificial Sequence
  chemically synthesized
acaaattgacaaaacaatgtca

SEQ ID NO: 78940 - DNA, 22 bp, Artificial Sequence
  chemically synthesized
acaaaacaatgtcaccacatcc

SEQ ID NO: 78941 - DNA, 22 bp, Artificial Sequence
  chemically synthesized
acacaacaaaatatttccatct

SEQ ID NO: 78942 - DNA, 22 bp, Artificial Sequence
  chemically synthesized
ccatctccccagaaattgcctc

SEQ ID NO: 78943 - DNA, 22 bp, Artificial Sequence
  chemically synthesized
catctccccagaaattgcctca

SEQ ID NO: 78944 - DNA, 22 bp, Artificial Sequence
  chemically synthesized
cccagaaattgcctcatgtctc

SEQ ID NO: 78945 - DNA, 22 bp, Artificial Sequence
  chemically synthesized
cctcatgtctctccccattctt

SEQ ID NO: 78946 - DNA, 22 bp, Artificial Sequence
  chemically synthesized
atgtctctccccattcttccat

SEQ ID NO: 78947 - DNA, 22 bp, Artificial Sequence
  chemically synthesized
tccccattcttccatctttata

SEQ ID NO: 78948 - DNA, 22 bp, Artificial Sequence
  chemically synthesized
cccattcttccatctttatatc

SEQ ID NO: 78949 - DNA, 22 bp, Artificial Sequence
  chemically synthesized
ttccatctttatatccatcaga

SEQ ID NO: 78950 - DNA, 22 bp, Artificial Sequence
  chemically synthesized
ccatctttatatccatcagagg

SEQ ID NO: 78951 - DNA, 22 bp, Artificial Sequence
  chemically synthesized
catctttatatccatcagaggt

SEQ ID NO: 78952 - DNA, 22 bp, Artificial Sequence
  chemically synthesized
tatatccatcagaggtaagcag

SEQ ID NO: 78953 - DNA, 22 bp, Artificial Sequence
  chemically synthesized
atatccatcagaggtaagcagg

SEQ ID NO: 78954 - DNA, 22 bp, Artificial Sequence
  chemically synthesized
tatccatcagaggtaagcaggg

SEQ ID NO: 78955 - DNA, 22 bp, Artificial Sequence
  chemically synthesized
tgattttttgacattaaattag

SEQ ID NO: 78956 - DNA, 22 bp, Artificial Sequence
  chemically synthesized
attttttgacattaaattagat

SEQ ID NO: 78957 - DNA, 22 bp, Artificial Sequence
  chemically synthesized
tttgacattaaattagatgtac

SEQ ID NO: 78958 - DNA, 22 bp, Artificial Sequence
  chemically synthesized
ttgacattaaattagatgtaca

SEQ ID NO: 78959 - DNA, 22 bp, Artificial Sequence
  chemically synthesized
tgacattaaattagatgtacat

SEQ ID NO: 78960 - DNA, 22 bp, Artificial Sequence
  chemically synthesized
gacattaaattagatgtacatg

SEQ ID NO: 78961 - DNA, 22 bp, Artificial Sequence
  chemically synthesized
acattaaattagatgtacatgt

SEQ ID NO: 78962 - DNA, 22 bp, Artificial Sequence
  chemically synthesized
aattagatgtacatgttctgaa

SEQ ID NO: 78963 - DNA, 22 bp, Artificial Sequence
  chemically synthesized
gatgtacatgttctgaaactat

SEQ ID NO: 78964 - DNA, 22 bp, Artificial Sequence
  chemically synthesized
tgaaactatacaaacaaaataa

SEQ ID NO: 78965 - DNA, 22 bp, Artificial Sequence
  chemically synthesized
aaactatacaaacaaaataata

SEQ ID NO: 78966 - DNA, 22 bp, Artificial Sequence
  chemically synthesized
tacaaacaaaataatacaatat

SEQ ID NO: 78967 - DNA, 22 bp, Artificial Sequence
  chemically synthesized
ttttgtgtcctgattattttcc

SEQ ID NO: 78968 - DNA, 22 bp, Artificial Sequence
  chemically synthesized
ttgtgtcctgattattttcctt

SEQ ID NO: 78969 - DNA, 22 bp, Artificial Sequence
  chemically synthesized
tgtgtcctgattattttccttc

SEQ ID NO: 78970 - DNA, 22 bp, Artificial Sequence
  chemically synthesized
gtgtcctgattattttccttca

SEQ ID NO: 78971 - DNA, 22 bp, Artificial Sequence
  chemically synthesized
tgtcctgattattttccttcac

SEQ ID NO: 78972 - DNA, 22 bp, Artificial Sequence
  chemically synthesized
attattttccttcacaagtatg

SEQ ID NO: 78973 - DNA, 22 bp, Artificial Sequence
  chemically synthesized
ttttccttcacaagtatgtatc

SEQ ID NO: 78974 - DNA, 22 bp, Artificial Sequence
  chemically synthesized
tccttcacaagtatgtatcact

SEQ ID NO: 78975 - DNA, 22 bp, Artificial Sequence
  chemically synthesized
ccttcacaagtatgtatcacta

SEQ ID NO: 78976 - DNA, 22 bp, Artificial Sequence
  chemically synthesized
cttcacaagtatgtatcactaa

SEQ ID NO: 78977 - DNA, 22 bp, Artificial Sequence
  chemically synthesized
cacaagtatgtatcactaattt

SEQ ID NO: 78978 - DNA, 22 bp, Artificial Sequence
  chemically synthesized
acaagtatgtatcactaatttt

SEQ ID NO: 78979 - DNA, 22 bp, Artificial Sequence
  chemically synthesized
attttaatataaccagaaactt

SEQ ID NO: 78980 - DNA, 22 bp, Artificial Sequence
  chemically synthesized
taatataaccagaaacttaaac

SEQ ID NO: 78981 - DNA, 22 bp, Artificial Sequence
  chemically synthesized
aatataaccagaaacttaaacc

SEQ ID NO: 78982 - DNA, 22 bp, Artificial Sequence
  chemically synthesized
atataaccagaaacttaaacct

SEQ ID NO: 78983 - DNA, 22 bp, Artificial Sequence
  chemically synthesized
aaacctccccaagactctttct

SEQ ID NO: 78984 - DNA, 22 bp, Artificial Sequence
  chemically synthesized
aacctccccaagactctttcta

SEQ ID NO: 78985 - DNA, 22 bp, Artificial Sequence
  chemically synthesized
cccaagactctttctacatatt

SEQ ID NO: 78986 - DNA, 22 bp, Artificial Sequence
  chemically synthesized
tttctacatattcccagaacca

SEQ ID NO: 78987 - DNA, 22 bp, Artificial Sequence
  chemically synthesized
tctacatattcccagaaccaaa

SEQ ID NO: 78988 - DNA, 22 bp, Artificial Sequence
  chemically synthesized
ctacatattcccagaaccaaat

SEQ ID NO: 78989 - DNA, 22 bp, Artificial Sequence
  chemically synthesized
tacatattcccagaaccaaatg

SEQ ID NO: 78990 - DNA, 22 bp, Artificial Sequence
  chemically synthesized
catattcccagaaccaaatgtc

SEQ ID NO: 78991 - DNA, 22 bp, Artificial Sequence
  chemically synthesized
ccagaaccaaatgtcactgaat

SEQ ID NO: 78992 - DNA, 22 bp, Artificial Sequence
  chemically synthesized
aattgagtattcaaggattcag

SEQ ID NO: 78993 - DNA, 22 bp, Artificial Sequence
  chemically synthesized
agtattcaaggattcagcacac

SEQ ID NO: 78994 - DNA, 22 bp, Artificial Sequence
  chemically synthesized
aaggattcagcacacaaagtgt

SEQ ID NO: 78995 - DNA, 22 bp, Artificial Sequence
  chemically synthesized
agcacacaaagtgtgtcatcac

SEQ ID NO: 78996 - DNA, 22 bp, Artificial Sequence
  chemically synthesized
tgttctatgcctcctcccacaa

SEQ ID NO: 78997 - DNA, 22 bp, Artificial Sequence
  chemically synthesized
tatgcctcctcccacaatttta

SEQ ID NO: 78998 - DNA, 22 bp, Artificial Sequence
  chemically synthesized
tgcctcctcccacaattttatt

SEQ ID NO: 78999 - DNA, 22 bp, Artificial Sequence
  chemically synthesized
ctcccacaattttatttcagag

SEQ ID NO: 79000 - DNA, 22 bp, Artificial Sequence
  chemically synthesized
ccacaattttatttcagagtaa

SEQ ID NO: 79001 - DNA, 22 bp, Artificial Sequence
  chemically synthesized
tatttcagagtaatgccatttc

SEQ ID NO: 79002 - DNA, 22 bp, Artificial Sequence
  chemically synthesized
atttcagagtaatgccatttcc

SEQ ID NO: 79003 - DNA, 22 bp, Artificial Sequence
  chemically synthesized
tttcagagtaatgccatttcct

SEQ ID NO: 79004 - DNA, 22 bp, Artificial Sequence
  chemically synthesized
cagagtaatgccatttcctatt

SEQ ID NO: 79005 - DNA, 22 bp, Artificial Sequence
  chemically synthesized
agagtaatgccatttcctattc

SEQ ID NO: 79006 - DNA, 22 bp, Artificial Sequence
  chemically synthesized
cctattctcagggaaatatata

SEQ ID NO: 79007 - DNA, 22 bp, Artificial Sequence
  chemically synthesized
ctattctcagggaaatatataa

SEQ ID NO: 79008 - DNA, 22 bp, Artificial Sequence
  chemically synthesized
ttctcagggaaatatataaaac

SEQ ID NO: 79009 - DNA, 22 bp, Artificial Sequence
  chemically synthesized
tcagggaaatatataaaactgt

SEQ ID NO: 79010 - DNA, 22 bp, Artificial Sequence
  chemically synthesized
agggaaatatataaaactgttt

SEQ ID NO: 79011 - DNA, 22 bp, Artificial Sequence
  chemically synthesized
ttttttttcttcatctacaaaa

SEQ ID NO: 79012 - DNA, 22 bp, Artificial Sequence
  chemically synthesized
tttttcttcatctacaaaatgt

SEQ ID NO: 79013 - DNA, 22 bp, Artificial Sequence
  chemically synthesized
ttttcttcatctacaaaatgtt

SEQ ID NO: 79014 - DNA, 22 bp, Artificial Sequence
  chemically synthesized
tttcttcatctacaaaatgtta

SEQ ID NO: 79015 - DNA, 22 bp, Artificial Sequence
  chemically synthesized
ttcttcatctacaaaatgttaa

SEQ ID NO: 79016 - DNA, 22 bp, Artificial Sequence
  chemically synthesized
tcttcatctacaaaatgttaaa

SEQ ID NO: 79017 - DNA, 22 bp, Artificial Sequence
  chemically synthesized
cttcatctacaaaatgttaaag

SEQ ID NO: 79018 - DNA, 22 bp, Artificial Sequence
  chemically synthesized
ttcatctacaaaatgttaaagc

SEQ ID NO: 79019 - DNA, 22 bp, Artificial Sequence
  chemically synthesized
catctacaaaatgttaaagctc

SEQ ID NO: 79020 - DNA, 22 bp, Artificial Sequence
  chemically synthesized
atctacaaaatgttaaagctca

SEQ ID NO: 79021 - DNA, 22 bp, Artificial Sequence
  chemically synthesized
caaaatgttaaagctcattaac

SEQ ID NO: 79022 - DNA, 22 bp, Artificial Sequence
  chemically synthesized
aagctcattaacaagcaataat

SEQ ID NO: 79023 - DNA, 22 bp, Artificial Sequence
  chemically synthesized
attaacaagcaataataagcca

SEQ ID NO: 79024 - DNA, 22 bp, Artificial Sequence
  chemically synthesized
acaagcaataataagccatgga

SEQ ID NO: 79025 - DNA, 22 bp, Artificial Sequence
  chemically synthesized
ttcatatttgcaaagctaatat

SEQ ID NO: 79026 - DNA, 22 bp, Artificial Sequence
  chemically synthesized
tcatatttgcaaagctaatatt

SEQ ID NO: 79027 - DNA, 22 bp, Artificial Sequence
  chemically synthesized
catatttgcaaagctaatattc

SEQ ID NO: 79028 - DNA, 22 bp, Artificial Sequence
  chemically synthesized
atatttgcaaagctaatattca

SEQ ID NO: 79029 - DNA, 22 bp, Artificial Sequence
  chemically synthesized
gcaaagctaatattcaggtaat

SEQ ID NO: 79030 - DNA, 22 bp, Artificial Sequence
  chemically synthesized
caaagctaatattcaggtaata

SEQ ID NO: 79031 - DNA, 22 bp, Artificial Sequence
  chemically synthesized
atattcaggtaataaagcctga

SEQ ID NO: 79032 - DNA, 22 bp, Artificial Sequence
  chemically synthesized
aggtaataaagcctgatctaag

SEQ ID NO: 79033 - DNA, 22 bp, Artificial Sequence
  chemically synthesized
atctaagtgcctgtgctgtcag

SEQ ID NO: 79034 - DNA, 22 bp, Artificial Sequence
  chemically synthesized
agtgcctgtgctgtcagggtat

SEQ ID NO: 79035 - DNA, 22 bp, Artificial Sequence
  chemically synthesized
tgctgtcagggtatcttcagtc

SEQ ID NO: 79036 - DNA, 22 bp, Artificial Sequence
  chemically synthesized
tcagggtatcttcagtctccat

SEQ ID NO: 79037 - DNA, 22 bp, Artificial Sequence
  chemically synthesized
cagtctccattagaactcaccc

SEQ ID NO: 79038 - DNA, 22 bp, Artificial Sequence
  chemically synthesized
agtctccattagaactcacccc

SEQ ID NO: 79039 - DNA, 22 bp, Artificial Sequence
  chemically synthesized
cattagaactcacccctcttcc

SEQ ID NO: 79040 - DNA, 22 bp, Artificial Sequence
  chemically synthesized
gaactcacccctcttcctggat

SEQ ID NO: 79041 - DNA, 22 bp, Artificial Sequence
  chemically synthesized
acccctcttcctggatagtgta

SEQ ID NO: 79042 - DNA, 22 bp, Artificial Sequence
  chemically synthesized
ttcctggatagtgtaagaacaa

SEQ ID NO: 79043 - DNA, 22 bp, Artificial Sequence
  chemically synthesized
cctggatagtgtaagaacaacg

SEQ ID NO: 79044 - DNA, 22 bp, Artificial Sequence
  chemically synthesized
ctggatagtgtaagaacaacgc

SEQ ID NO: 79045 - DNA, 22 bp, Artificial Sequence
  chemically synthesized
gatagtgtaagaacaacgctgt

SEQ ID NO: 79046 - DNA, 22 bp, Artificial Sequence
  chemically synthesized
ttgcgaatttctttgattttga

SEQ ID NO: 79047 - DNA, 22 bp, Artificial Sequence
  chemically synthesized
cgaatttctttgattttgatac

SEQ ID NO: 79048 - DNA, 22 bp, Artificial Sequence
  chemically synthesized
ctttgattttgatactatagac

SEQ ID NO: 79049 - DNA, 22 bp, Artificial Sequence
  chemically synthesized
tttgattttgatactatagaca

SEQ ID NO: 79050 - DNA, 22 bp, Artificial Sequence
  chemically synthesized
tgattttgatactatagacaat

SEQ ID NO: 79051 - DNA, 22 bp, Artificial Sequence
  chemically synthesized
gattttgatactatagacaatg

SEQ ID NO: 79052 - DNA, 22 bp, Artificial Sequence
  chemically synthesized
attttgatactatagacaatgg

SEQ ID NO: 79053 - DNA, 22 bp, Artificial Sequence
  chemically synthesized
tgatactatagacaatggggtt

SEQ ID NO: 79054 - DNA, 22 bp, Artificial Sequence
  chemically synthesized
gatactatagacaatggggttg

SEQ ID NO: 79055 - DNA, 22 bp, Artificial Sequence
  chemically synthesized
atactatagacaatggggttga

SEQ ID NO: 79056 - DNA, 22 bp, Artificial Sequence
  chemically synthesized
tagacaatggggttgaccacag

SEQ ID NO: 79057 - DNA, 22 bp, Artificial Sequence
  chemically synthesized
accacaggaggaaaaaagaggt

SEQ ID NO: 79058 - DNA, 22 bp, Artificial Sequence
  chemically synthesized
gccgtgacagtctggaaaagtg

SEQ ID NO: 79059 - DNA, 22 bp, Artificial Sequence
  chemically synthesized
gaaaagtggaggtaaatgccgt

SEQ ID NO: 79060 - DNA, 22 bp, Artificial Sequence
  chemically synthesized
atcatgggcacatagtacacaa

SEQ ID NO: 79061 - DNA, 22 bp, Artificial Sequence
  chemically synthesized
agtgcctgccaccgccctgctc

SEQ ID NO: 79062 - DNA, 22 bp, Artificial Sequence
  chemically synthesized
ccaccgccctgctccagaagct

SEQ ID NO: 79063 - DNA, 22 bp, Artificial Sequence
  chemically synthesized
ctccagaagctatttccagtac

SEQ ID NO: 79064 - DNA, 22 bp, Artificial Sequence
  chemically synthesized
cagaagctatttccagtactgt

SEQ ID NO: 79065 - DNA, 22 bp, Artificial Sequence
  chemically synthesized
tttccagtactgtatgaagaat

SEQ ID NO: 79066 - DNA, 22 bp, Artificial Sequence
  chemically synthesized
ccagtactgtatgaagaatcag

SEQ ID NO: 79067 - DNA, 22 bp, Artificial Sequence
  chemically synthesized
cagtactgtatgaagaatcagc

SEQ ID NO: 79068 - DNA, 22 bp, Artificial Sequence
  chemically synthesized
tatgaagaatcagcacataaga

SEQ ID NO: 79069 - DNA, 22 bp, Artificial Sequence
  chemically synthesized
ttgggacgtgtgtctccacagg

SEQ ID NO: 79070 - DNA, 22 bp, Artificial Sequence
  chemically synthesized
ggacgtgtgtctccacagggca

SEQ ID NO: 79071 - DNA, 22 bp, Artificial Sequence
  chemically synthesized
cacagggcaatttgatcagatc

SEQ ID NO: 79072 - DNA, 22 bp, Artificial Sequence
  chemically synthesized
gatcagatctgagtggaggcaa

SEQ ID NO: 79073 - DNA, 22 bp, Artificial Sequence
  chemically synthesized
atcagatctgagtggaggcaat

SEQ ID NO: 79074 - DNA, 22 bp, Artificial Sequence
  chemically synthesized
agtggaggcaataagagtgtgt

SEQ ID NO: 79075 - DNA, 22 bp, Artificial Sequence
  chemically synthesized
tggccacagaaaggcagacgcc

SEQ ID NO: 79076 - DNA, 22 bp, Artificial Sequence
  chemically synthesized
aggagaaagagcagtgggagca

SEQ ID NO: 79077 - DNA, 22 bp, Artificial Sequence
  chemically synthesized
cactgcgcaaggcaatggcggc

SEQ ID NO: 79078 - DNA, 22 bp, Artificial Sequence
  chemically synthesized
cgcaaggcaatggcggcacccg

SEQ ID NO: 79079 - DNA, 22 bp, Artificial Sequence
  chemically synthesized
tcagaatggttgtgtagcgcag

SEQ ID NO: 79080 - DNA, 22 bp, Artificial Sequence
  chemically synthesized
tgtagcgcagtgggctgtagat

SEQ ID NO: 79081 - DNA, 22 bp, Artificial Sequence
  chemically synthesized
tagatggccacaaagcggtcca

SEQ ID NO: 79082 - DNA, 22 bp, Artificial Sequence
  chemically synthesized
acattgccagaaggacacctga

SEQ ID NO: 79083 - DNA, 22 bp, Artificial Sequence
  chemically synthesized
ccagaaggacacctgactccat

SEQ ID NO: 79084 - DNA, 22 bp, Artificial Sequence
  chemically synthesized
actccataagagtgaaagagtg

SEQ ID NO: 79085 - DNA, 22 bp, Artificial Sequence
  chemically synthesized
cataagagtgaaagagtgcata

SEQ ID NO: 79086 - DNA, 22 bp, Artificial Sequence
  chemically synthesized
gagcaggcaaccaccaaaactg

SEQ ID NO: 79087 - DNA, 22 bp, Artificial Sequence
  chemically synthesized
acatcgttaatgccaaagagga

SEQ ID NO: 79088 - DNA, 22 bp, Artificial Sequence
  chemically synthesized
atgccaaagaggaatatgctta

SEQ ID NO: 79089 - DNA, 22 bp, Artificial Sequence
  chemically synthesized
aacacagtgggcatggtggaag

SEQ ID NO: 79090 - DNA, 22 bp, Artificial Sequence
  chemically synthesized
acacagtgggcatggtggaagc

SEQ ID NO: 79091 - DNA, 22 bp, Artificial Sequence
  chemically synthesized
aacaaaggccggcatggccaga

SEQ ID NO: 79092 - DNA, 22 bp, Artificial Sequence
  chemically synthesized
gtgcaaggaagagtcaattcgg

SEQ ID NO: 79093 - DNA, 22 bp, Artificial Sequence
  chemically synthesized
ggatgatgtgaagaatgatgcc

SEQ ID NO: 79094 - DNA, 22 bp, Artificial Sequence
  chemically synthesized
cccggaaagatgatggtgtata

SEQ ID NO: 79095 - DNA, 22 bp, Artificial Sequence
  chemically synthesized
ccggaaagatgatggtgtatat

SEQ ID NO: 79096 - DNA, 22 bp, Artificial Sequence
  chemically synthesized
tgcctccagtcccgggatgcca

SEQ ID NO: 79097 - DNA, 22 bp, Artificial Sequence
  chemically synthesized
cctccagtcccgggatgccaac

SEQ ID NO: 79098 - DNA, 22 bp, Artificial Sequence
  chemically synthesized
cagtcccgggatgccaacgaga

SEQ ID NO: 79099 - DNA, 22 bp, Artificial Sequence
  chemically synthesized
taggtgtgaatgttatggaacg

SEQ ID NO: 79100 - DNA, 22 bp, Artificial Sequence
  chemically synthesized
tggaacgtttgaaaacgtcatg

SEQ ID NO: 79101 - DNA, 22 bp, Artificial Sequence
  chemically synthesized
gaaaacgtcatggtgatacttc

SEQ ID NO: 79102 - DNA, 22 bp, Artificial Sequence
  chemically synthesized
aaaacgtcatggtgatacttcc

SEQ ID NO: 79103 - DNA, 22 bp, Artificial Sequence
  chemically synthesized
cctctgaagatattgagaagca

SEQ ID NO: 79104 - DNA, 22 bp, Artificial Sequence
  chemically synthesized
ctctgaagatattgagaagcac

SEQ ID NO: 79105 - DNA, 22 bp, Artificial Sequence
  chemically synthesized
tgaagatattgagaagcacatg

SEQ ID NO: 79106 - DNA, 22 bp, Artificial Sequence
  chemically synthesized
aagatattgagaagcacatgga

SEQ ID NO: 79107 - DNA, 22 bp, Artificial Sequence
  chemically synthesized
agaagcacatggagactggaat

SEQ ID NO: 79108 - DNA, 22 bp, Artificial Sequence
  chemically synthesized
gaatatataagtttctactcag

SEQ ID NO: 79109 - DNA, 22 bp, Artificial Sequence
  chemically synthesized
ctactcagttattgcacatcaa

SEQ ID NO: 79110 - DNA, 22 bp, Artificial Sequence
  chemically synthesized
tactcagttattgcacatcaag

SEQ ID NO: 79111 - DNA, 22 bp, Artificial Sequence
  chemically synthesized
ctcagttattgcacatcaagtt

SEQ ID NO: 79112 - DNA, 22 bp, Artificial Sequence
  chemically synthesized
agttattgcacatcaagttctg

SEQ ID NO: 79113 - DNA, 22 bp, Artificial Sequence
  chemically synthesized
ttgcacatcaagttctgagcta

SEQ ID NO: 79114 - DNA, 22 bp, Artificial Sequence
  chemically synthesized
cacatcaagttctgagctaaca

SEQ ID NO: 79115 - DNA, 22 bp, Artificial Sequence
  chemically synthesized
tgagctaacagtcatatctaag

SEQ ID NO: 79116 - DNA, 22 bp, Artificial Sequence
  chemically synthesized
agctaacagtcatatctaagac

SEQ ID NO: 79117 - DNA, 22 bp, Artificial Sequence
  chemically synthesized
acagtcatatctaagacatttc

SEQ ID NO: 79118 - DNA, 22 bp, Artificial Sequence
  chemically synthesized
agacatttcctcagaaaaaggg

SEQ ID NO: 79119 - DNA, 22 bp, Artificial Sequence
  chemically synthesized
cctcagaaaaagggataaaaaa

SEQ ID NO: 79120 - DNA, 22 bp, Artificial Sequence
  chemically synthesized
ctcagaaaaagggataaaaaat

SEQ ID NO: 79121 - DNA, 22 bp, Artificial Sequence
  chemically synthesized
agaaaaagggataaaaaattta

SEQ ID NO: 79122 - DNA, 22 bp, Artificial Sequence
  chemically synthesized
atttctgaaacaagggcacagg

SEQ ID NO: 79123 - DNA, 22 bp, Artificial Sequence
  chemically synthesized
tttctgaaacaagggcacaggt

SEQ ID NO: 79124 - DNA, 22 bp, Artificial Sequence
  chemically synthesized
ctgaaacaagggcacaggtaag

SEQ ID NO: 79125 - DNA, 22 bp, Artificial Sequence
  chemically synthesized
tgaaacaagggcacaggtaagc

SEQ ID NO: 79126 - DNA, 22 bp, Artificial Sequence
  chemically synthesized
aaacaagggcacaggtaagcca

SEQ ID NO: 79127 - DNA, 22 bp, Artificial Sequence
  chemically synthesized
atgggtcatgcagaaaagtatt

SEQ ID NO: 79128 - DNA, 22 bp, Artificial Sequence
  chemically synthesized
caacatagcctatatgccagat

SEQ ID NO: 79129 - DNA, 22 bp, Artificial Sequence
  chemically synthesized
tatgccagataaggcattaata

SEQ ID NO: 79130 - DNA, 22 bp, Artificial Sequence
  chemically synthesized
atagaaatctcaagttgggtca

SEQ ID NO: 79131 - DNA, 22 bp, Artificial Sequence
  chemically synthesized
aagttgggtcatctatggcagt

SEQ ID NO: 79132 - DNA, 22 bp, Artificial Sequence
  chemically synthesized
ggtcatctatggcagtgaaaaa

SEQ ID NO: 79133 - DNA, 22 bp, Artificial Sequence
  chemically synthesized
tggcagtgaaaaacagttaaaa

SEQ ID NO: 79134 - DNA, 22 bp, Artificial Sequence
  chemically synthesized
aaataagcatagagatgacaga

SEQ ID NO: 79135 - DNA, 22 bp, Artificial Sequence
  chemically synthesized
acatggaaattatgactgaaga

SEQ ID NO: 79136 - DNA, 22 bp, Artificial Sequence
  chemically synthesized
tgactgaagaaactgctaactt

SEQ ID NO: 79137 - DNA, 22 bp, Artificial Sequence
  chemically synthesized
aagaaactgctaacttgtagtg

SEQ ID NO: 79138 - DNA, 22 bp, Artificial Sequence
  chemically synthesized
ctaacttgtagtgtttataaag

SEQ ID NO: 79139 - DNA, 22 bp, Artificial Sequence
  chemically synthesized
acttgtagtgtttataaagaga

SEQ ID NO: 79140 - DNA, 22 bp, Artificial Sequence
  chemically synthesized
gtagtgtttataaagagagtag

SEQ ID NO: 79141 - DNA, 22 bp, Artificial Sequence
  chemically synthesized
tagtgtttataaagagagtaga

SEQ ID NO: 79142 - DNA, 22 bp, Artificial Sequence
  chemically synthesized
ataaagagagtagatgaatagc

SEQ ID NO: 79143 - DNA, 22 bp, Artificial Sequence
  chemically synthesized
taaagagagtagatgaatagct

SEQ ID NO: 79144 - DNA, 22 bp, Artificial Sequence
  chemically synthesized
aagtaatataacactaataaag

SEQ ID NO: 79145 - DNA, 22 bp, Artificial Sequence
  chemically synthesized
ataaagagtattgatggttcta

SEQ ID NO: 79146 - DNA, 22 bp, Artificial Sequence
  chemically synthesized
atggttctaacatttaattgac

SEQ ID NO: 79147 - DNA, 22 bp, Artificial Sequence
  chemically synthesized
taacatttaattgacgtgtaat

SEQ ID NO: 79148 - DNA, 22 bp, Artificial Sequence
  chemically synthesized
acatttaattgacgtgtaatct

SEQ ID NO: 79149 - DNA, 22 bp, Artificial Sequence
  chemically synthesized
aattgacgtgtaatcttgggat

SEQ ID NO: 79150 - DNA, 22 bp, Artificial Sequence
  chemically synthesized
attgacgtgtaatcttgggatt

SEQ ID NO: 79151 - DNA, 22 bp, Artificial Sequence
  chemically synthesized
acgtgtaatcttgggattatat

SEQ ID NO: 79152 - DNA, 22 bp, Artificial Sequence
  chemically synthesized
gggattatattaaagttgattt

SEQ ID NO: 79153 - DNA, 22 bp, Artificial Sequence
  chemically synthesized
ggattatattaaagttgattta

SEQ ID NO: 79154 - DNA, 22 bp, Artificial Sequence
  chemically synthesized
tattaaagttgatttatattgc

SEQ ID NO: 79155 - DNA, 22 bp, Artificial Sequence
  chemically synthesized
aagttgatttatattgcaagtt

SEQ ID NO: 79156 - DNA, 22 bp, Artificial Sequence
  chemically synthesized
atttatattgcaagttatctga

SEQ ID NO: 79157 - DNA, 22 bp, Artificial Sequence
  chemically synthesized
atattgcaagttatctgagacc

SEQ ID NO: 79158 - DNA, 22 bp, Artificial Sequence
  chemically synthesized
tattgcaagttatctgagaccc

SEQ ID NO: 79159 - DNA, 22 bp, Artificial Sequence
  chemically synthesized
caagttatctgagacccagata

SEQ ID NO: 79160 - DNA, 22 bp, Artificial Sequence
  chemically synthesized
tctgagacccagatatttgcta

SEQ ID NO: 79161 - DNA, 22 bp, Artificial Sequence
  chemically synthesized
agacccagatatttgctataaa

SEQ ID NO: 79162 - DNA, 22 bp, Artificial Sequence
  chemically synthesized
gctataaagacaataatagtat

SEQ ID NO: 79163 - DNA, 22 bp, Artificial Sequence
  chemically synthesized
ctataaagacaataatagtatt

SEQ ID NO: 79164 - DNA, 22 bp, Artificial Sequence
  chemically synthesized
taaagacaataatagtatttta

SEQ ID NO: 79165 - DNA, 22 bp, Artificial Sequence
  chemically synthesized
taaagtaatatttatatattgt

SEQ ID NO: 79166 - DNA, 22 bp, Artificial Sequence
  chemically synthesized
aaagtaatatttatatattgtt

SEQ ID NO: 79167 - DNA, 22 bp, Artificial Sequence
  chemically synthesized
aagtaatatttatatattgttt

SEQ ID NO: 79168 - DNA, 22 bp, Artificial Sequence
  chemically synthesized
atatattgtttatcattatatg

SEQ ID NO: 79169 - DNA, 22 bp, Artificial Sequence
  chemically synthesized
tatattgtttatcattatatgt

SEQ ID NO: 79170 - DNA, 22 bp, Artificial Sequence
  chemically synthesized
tttatcattatatgtggaatat

SEQ ID NO: 79171 - DNA, 22 bp, Artificial Sequence
  chemically synthesized
atcattatatgtggaatatagt

SEQ ID NO: 79172 - DNA, 22 bp, Artificial Sequence
  chemically synthesized
tcattatatgtggaatatagta

SEQ ID NO: 79173 - DNA, 22 bp, Artificial Sequence
  chemically synthesized
tatgtggaatatagtaaatatt

SEQ ID NO: 79174 - DNA, 22 bp, Artificial Sequence
  chemically synthesized
aatgtatagaataaaaagaaca

SEQ ID NO: 79175 - DNA, 22 bp, Artificial Sequence
  chemically synthesized
aatatattagaacacaaggata

SEQ ID NO: 79176 - DNA, 22 bp, Artificial Sequence
  chemically synthesized
atatattagaacacaaggatag

SEQ ID NO: 79177 - DNA, 22 bp, Artificial Sequence
  chemically synthesized
gaacacaaggatagtttctcct

SEQ ID NO: 79178 - DNA, 22 bp, Artificial Sequence
  chemically synthesized
ctcctagaataaagtattttcc

SEQ ID NO: 79179 - DNA, 22 bp, Artificial Sequence
  chemically synthesized
tcctagaataaagtattttcca

SEQ ID NO: 79180 - DNA, 22 bp, Artificial Sequence
  chemically synthesized
ctagaataaagtattttccatt

SEQ ID NO: 79181 - DNA, 22 bp, Artificial Sequence
  chemically synthesized
gaataaagtattttccattttt

SEQ ID NO: 79182 - DNA, 22 bp, Artificial Sequence
  chemically synthesized
tccatttttttctttaacttac

SEQ ID NO: 79183 - DNA, 22 bp, Artificial Sequence
  chemically synthesized
ccatttttttctttaacttacc

SEQ ID NO: 79184 - DNA, 22 bp, Artificial Sequence
  chemically synthesized
catttttttctttaacttacca

SEQ ID NO: 79185 - DNA, 22 bp, Artificial Sequence
  chemically synthesized
ttttctttaacttaccagttca

SEQ ID NO: 79186 - DNA, 22 bp, Artificial Sequence
  chemically synthesized
tttctttaacttaccagttcac

SEQ ID NO: 79187 - DNA, 22 bp, Artificial Sequence
  chemically synthesized
ttctttaacttaccagttcact

SEQ ID NO: 79188 - DNA, 22 bp, Artificial Sequence
  chemically synthesized
tctttaacttaccagttcactc

SEQ ID NO: 79189 - DNA, 22 bp, Artificial Sequence
  chemically synthesized
ctttaacttaccagttcactct

SEQ ID NO: 79190 - DNA, 22 bp, Artificial Sequence
  chemically synthesized
tttaacttaccagttcactctt

SEQ ID NO: 79191 - DNA, 22 bp, Artificial Sequence
  chemically synthesized
taacttaccagttcactctttc

SEQ ID NO: 79192 - DNA, 22 bp, Artificial Sequence
  chemically synthesized
aacttaccagttcactctttct

SEQ ID NO: 79193 - DNA, 22 bp, Artificial Sequence
  chemically synthesized
acttaccagttcactctttctc

SEQ ID NO: 79194 - DNA, 22 bp, Artificial Sequence
  chemically synthesized
accagttcactctttctccacc

SEQ ID NO: 79195 - DNA, 22 bp, Artificial Sequence
  chemically synthesized
ccagttcactctttctccacct

SEQ ID NO: 79196 - DNA, 22 bp, Artificial Sequence
  chemically synthesized
actctttctccacctgctatcc

SEQ ID NO: 79197 - DNA, 22 bp, Artificial Sequence
  chemically synthesized
tttctccacctgctatccatag

SEQ ID NO: 79198 - DNA, 22 bp, Artificial Sequence
  chemically synthesized
tctccacctgctatccatagat

SEQ ID NO: 79199 - DNA, 22 bp, Artificial Sequence
  chemically synthesized
ctccacctgctatccatagatt

SEQ ID NO: 79200 - DNA, 22 bp, Artificial Sequence
  chemically synthesized
tccacctgctatccatagatta

SEQ ID NO: 79201 - DNA, 22 bp, Artificial Sequence
  chemically synthesized
cacctgctatccatagattaga

SEQ ID NO: 79202 - DNA, 22 bp, Artificial Sequence
  chemically synthesized
ctatccatagattagaaaagct

SEQ ID NO: 79203 - DNA, 22 bp, Artificial Sequence
  chemically synthesized
tccatagattagaaaagctcct

SEQ ID NO: 79204 - DNA, 22 bp, Artificial Sequence
  chemically synthesized
gaaaagctcctctgtattttgc

SEQ ID NO: 79205 - DNA, 22 bp, Artificial Sequence
  chemically synthesized
ctctgtattttgcagaagggtc

SEQ ID NO: 79206 - DNA, 22 bp, Artificial Sequence
  chemically synthesized
tgtattttgcagaagggtcagt

SEQ ID NO: 79207 - DNA, 22 bp, Artificial Sequence
  chemically synthesized
tattttgcagaagggtcagtct

SEQ ID NO: 79208 - DNA, 22 bp, Artificial Sequence
  chemically synthesized
tgcagaagggtcagtcttctgc

SEQ ID NO: 79209 - DNA, 22 bp, Artificial Sequence
  chemically synthesized
gcagaagggtcagtcttctgct

SEQ ID NO: 79210 - DNA, 22 bp, Artificial Sequence
  chemically synthesized
cagaagggtcagtcttctgctg

SEQ ID NO: 79211 - DNA, 22 bp, Artificial Sequence
  chemically synthesized
ctgctggaaccgggtcagggag

SEQ ID NO: 79212 - DNA, 22 bp, Artificial Sequence
  chemically synthesized
tgctggaaccgggtcagggagc

SEQ ID NO: 79213 - DNA, 22 bp, Artificial Sequence
  chemically synthesized
ctggaaccgggtcagggagcaa

SEQ ID NO: 79214 - DNA, 22 bp, Artificial Sequence
  chemically synthesized
gaaccgggtcagggagcaagat

SEQ ID NO: 79215 - DNA, 22 bp, Artificial Sequence
  chemically synthesized
acaagtcacatgtgatggtggg

SEQ ID NO: 79216 - DNA, 22 bp, Artificial Sequence
  chemically synthesized
gggtacaggcttagagatattt

SEQ ID NO: 79217 - DNA, 22 bp, Artificial Sequence
  chemically synthesized
agagatatttatctgggaacaa

SEQ ID NO: 79218 - DNA, 22 bp, Artificial Sequence
  chemically synthesized
gagatatttatctgggaacaag

SEQ ID NO: 79219 - DNA, 22 bp, Artificial Sequence
  chemically synthesized
atctgggaacaagtttattaac

SEQ ID NO: 79220 - DNA, 22 bp, Artificial Sequence
  chemically synthesized
tctgggaacaagtttattaaca

SEQ ID NO: 79221 - DNA, 22 bp, Artificial Sequence
  chemically synthesized
ggaacaagtttattaacactaa

SEQ ID NO: 79222 - DNA, 22 bp, Artificial Sequence
  chemically synthesized
attaacactaaagttccactta

SEQ ID NO: 79223 - DNA, 22 bp, Artificial Sequence
  chemically synthesized
ttaacactaaagttccacttat

SEQ ID NO: 79224 - DNA, 22 bp, Artificial Sequence
  chemically synthesized
acactaaagttccacttatctg

SEQ ID NO: 79225 - DNA, 22 bp, Artificial Sequence
  chemically synthesized
aagttccacttatctgcagcag

SEQ ID NO: 79226 - DNA, 22 bp, Artificial Sequence
  chemically synthesized
cacttatctgcagcagagcctt

SEQ ID NO: 79227 - DNA, 22 bp, Artificial Sequence
  chemically synthesized
atctgcagcagagccttaggta

SEQ ID NO: 79228 - DNA, 22 bp, Artificial Sequence
  chemically synthesized
tctgcagcagagccttaggtat

SEQ ID NO: 79229 - DNA, 22 bp, Artificial Sequence
  chemically synthesized
cagcagagccttaggtattaac

SEQ ID NO: 79230 - DNA, 22 bp, Artificial Sequence
  chemically synthesized
aggtattaacgttggaggccag

SEQ ID NO: 79231 - DNA, 22 bp, Artificial Sequence
  chemically synthesized
ggtattaacgttggaggccaga

SEQ ID NO: 79232 - DNA, 22 bp, Artificial Sequence
  chemically synthesized
acgttggaggccagaaatggaa

SEQ ID NO: 79233 - DNA, 22 bp, Artificial Sequence
  chemically synthesized
gaggccagaaatggaattcagg

SEQ ID NO: 79234 - DNA, 22 bp, Artificial Sequence
  chemically synthesized
aggatggggctcagaaataaga

SEQ ID NO: 79235 - DNA, 22 bp, Artificial Sequence
  chemically synthesized
agaaataagaatgtgaccaagg

SEQ ID NO: 79236 - DNA, 22 bp, Artificial Sequence
  chemically synthesized
aactcttcttcccgtgttgggc

SEQ ID NO: 79237 - DNA, 22 bp, Artificial Sequence
  chemically synthesized
ttcttcccgtgttgggccaggg

SEQ ID NO: 79238 - DNA, 22 bp, Artificial Sequence
  chemically synthesized
cttcccgtgttgggccagggct

SEQ ID NO: 79239 - DNA, 22 bp, Artificial Sequence
  chemically synthesized
ttcccgtgttgggccagggctc

SEQ ID NO: 79240 - DNA, 22 bp, Artificial Sequence
  chemically synthesized
cccgtgttgggccagggctctt

SEQ ID NO: 79241 - DNA, 22 bp, Artificial Sequence
  chemically synthesized
ccgtgttgggccagggctcttc

SEQ ID NO: 79242 - DNA, 22 bp, Artificial Sequence
  chemically synthesized
ggccagggctcttcgttaggca

SEQ ID NO: 79243 - DNA, 22 bp, Artificial Sequence
  chemically synthesized
ttcgttaggcataatcagtggg

SEQ ID NO: 79244 - DNA, 22 bp, Artificial Sequence
  chemically synthesized
cgttaggcataatcagtgggat

SEQ ID NO: 79245 - DNA, 22 bp, Artificial Sequence
  chemically synthesized
gttaggcataatcagtgggata

SEQ ID NO: 79246 - DNA, 22 bp, Artificial Sequence
  chemically synthesized
ggcataatcagtgggatagtaa

SEQ ID NO: 79247 - DNA, 22 bp, Artificial Sequence
  chemically synthesized
ccaaataaaaatgccctgattt

SEQ ID NO: 79248 - DNA, 22 bp, Artificial Sequence
  chemically synthesized
caaataaaaatgccctgatttt

SEQ ID NO: 79249 - DNA, 22 bp, Artificial Sequence
  chemically synthesized
atttttaccagttaccgatttt

SEQ ID NO: 79250 - DNA, 22 bp, Artificial Sequence
  chemically synthesized
ttaccagttaccgattttttgt

SEQ ID NO: 79251 - DNA, 22 bp, Artificial Sequence
  chemically synthesized
taccagttaccgattttttgtg

SEQ ID NO: 79252 - DNA, 22 bp, Artificial Sequence
  chemically synthesized
accagttaccgattttttgtgt

SEQ ID NO: 79253 - DNA, 22 bp, Artificial Sequence
  chemically synthesized
ccagttaccgattttttgtgtt

SEQ ID NO: 79254 - DNA, 22 bp, Artificial Sequence
  chemically synthesized
ccgattttttgtgttttaatga

SEQ ID NO: 79255 - DNA, 22 bp, Artificial Sequence
  chemically synthesized
tttgtgttttaatgactcctac

SEQ ID NO: 79256 - DNA, 22 bp, Artificial Sequence
  chemically synthesized
ttgtgttttaatgactcctacc

SEQ ID NO: 79257 - DNA, 22 bp, Artificial Sequence
  chemically synthesized
tgtgttttaatgactcctacca

SEQ ID NO: 79258 - DNA, 22 bp, Artificial Sequence
  chemically synthesized
gtgttttaatgactcctaccat

SEQ ID NO: 79259 - DNA, 22 bp, Artificial Sequence
  chemically synthesized
tgttttaatgactcctaccatg

SEQ ID NO: 79260 - DNA, 22 bp, Artificial Sequence
  chemically synthesized
taatgactcctaccatgatcaa

SEQ ID NO: 79261 - DNA, 22 bp, Artificial Sequence
  chemically synthesized
aatgactcctaccatgatcaat

SEQ ID NO: 79262 - DNA, 22 bp, Artificial Sequence
  chemically synthesized
atgactcctaccatgatcaatt

SEQ ID NO: 79263 - DNA, 22 bp, Artificial Sequence
  chemically synthesized
ctaccatgatcaatttcagact

SEQ ID NO: 79264 - DNA, 22 bp, Artificial Sequence
  chemically synthesized
ccatgatcaatttcagactacc

SEQ ID NO: 79265 - DNA, 22 bp, Artificial Sequence
  chemically synthesized
cagactaccaaagagatgctat

SEQ ID NO: 79266 - DNA, 22 bp, Artificial Sequence
  chemically synthesized
agactaccaaagagatgctatt

SEQ ID NO: 79267 - DNA, 22 bp, Artificial Sequence
  chemically synthesized
ccaaagagatgctattaaatgc

SEQ ID NO: 79268 - DNA, 22 bp, Artificial Sequence
  chemically synthesized
ttaaatgcagagctgagatgag

SEQ ID NO: 79269 - DNA, 22 bp, Artificial Sequence
  chemically synthesized
aatgcagagctgagatgagcat

SEQ ID NO: 79270 - DNA, 22 bp, Artificial Sequence
  chemically synthesized
agatgagcataatcagctttcc

SEQ ID NO: 79271 - DNA, 22 bp, Artificial Sequence
  chemically synthesized
tcctaagctggtgcaagccagc

SEQ ID NO: 79272 - DNA, 22 bp, Artificial Sequence
  chemically synthesized
cctaagctggtgcaagccagca

SEQ ID NO: 79273 - DNA, 22 bp, Artificial Sequence
  chemically synthesized
ctaagctggtgcaagccagcac

SEQ ID NO: 79274 - DNA, 22 bp, Artificial Sequence
  chemically synthesized
agctggtgcaagccagcacatt

SEQ ID NO: 79275 - DNA, 22 bp, Artificial Sequence
  chemically synthesized
gtgcaagccagcacattatacc

SEQ ID NO: 79276 - DNA, 22 bp, Artificial Sequence
  chemically synthesized
taccattaggcataactatagt

SEQ ID NO: 79277 - DNA, 22 bp, Artificial Sequence
  chemically synthesized
ggcataactatagttgatccta

SEQ ID NO: 79278 - DNA, 22 bp, Artificial Sequence
  chemically synthesized
tagttgatcctagacctcagat

SEQ ID NO: 79279 - DNA, 22 bp, Artificial Sequence
  chemically synthesized
atcctagacctcagatacttac

SEQ ID NO: 79280 - DNA, 22 bp, Artificial Sequence
  chemically synthesized
gacctcagatacttacctaggt

SEQ ID NO: 79281 - DNA, 22 bp, Artificial Sequence
  chemically synthesized
agatacttacctaggtggaact

SEQ ID NO: 79282 - DNA, 22 bp, Artificial Sequence
  chemically synthesized
acctaggtggaactgagagcta

SEQ ID NO: 79283 - DNA, 22 bp, Artificial Sequence
  chemically synthesized
cctaggtggaactgagagctac

SEQ ID NO: 79284 - DNA, 22 bp, Artificial Sequence
  chemically synthesized
ggtggaactgagagctaccaca

SEQ ID NO: 79285 - DNA, 22 bp, Artificial Sequence
  chemically synthesized
agagctaccacatcaatccatg

SEQ ID NO: 79286 - DNA, 22 bp, Artificial Sequence
  chemically synthesized
ccacatcaatccatgcatacta

SEQ ID NO: 79287 - DNA, 22 bp, Artificial Sequence
  chemically synthesized
tttgttactgtttactttcaac

SEQ ID NO: 79288 - DNA, 22 bp, Artificial Sequence
  chemically synthesized
gttactgtttactttcaactgg

SEQ ID NO: 79289 - DNA, 22 bp, Artificial Sequence
  chemically synthesized
ttactgtttactttcaactggg

SEQ ID NO: 79290 - DNA, 22 bp, Artificial Sequence
  chemically synthesized
ctgtttactttcaactgggctg

SEQ ID NO: 79291 - DNA, 22 bp, Artificial Sequence
  chemically synthesized
tttactttcaactgggctgtgg

SEQ ID NO: 79292 - DNA, 22 bp, Artificial Sequence
  chemically synthesized
actttcaactgggctgtggaca

SEQ ID NO: 79293 - DNA, 22 bp, Artificial Sequence
  chemically synthesized
ctttcaactgggctgtggacat

SEQ ID NO: 79294 - DNA, 22 bp, Artificial Sequence
  chemically synthesized
tcaactgggctgtggacatagt

SEQ ID NO: 79295 - DNA, 22 bp, Artificial Sequence
  chemically synthesized
caactgggctgtggacatagtt

SEQ ID NO: 79296 - DNA, 22 bp, Artificial Sequence
  chemically synthesized
aactgggctgtggacatagtta

SEQ ID NO: 79297 - DNA, 22 bp, Artificial Sequence
  chemically synthesized
ggctgtggacatagttactacc

SEQ ID NO: 79298 - DNA, 22 bp, Artificial Sequence
  chemically synthesized
tggacatagttactacctccct

SEQ ID NO: 79299 - DNA, 22 bp, Artificial Sequence
  chemically synthesized
ctacctccctgtatatgtgctt

SEQ ID NO: 79300 - DNA, 22 bp, Artificial Sequence
  chemically synthesized
cctccctgtatatgtgcttagt

SEQ ID NO: 79301 - DNA, 22 bp, Artificial Sequence
  chemically synthesized
cctgtatatgtgcttagttgac

SEQ ID NO: 79302 - DNA, 22 bp, Artificial Sequence
  chemically synthesized
tatatgtgcttagttgactgga

SEQ ID NO: 79303 - DNA, 22 bp, Artificial Sequence
  chemically synthesized
agttgactggaggacatagaga

SEQ ID NO: 79304 - DNA, 22 bp, Artificial Sequence
  chemically synthesized
gttgactggaggacatagagac

SEQ ID NO: 79305 - DNA, 22 bp, Artificial Sequence
  chemically synthesized
actggaggacatagagacagaa

SEQ ID NO: 79306 - DNA, 22 bp, Artificial Sequence
  chemically synthesized
gaggacatagagacagaatgat

SEQ ID NO: 79307 - DNA, 22 bp, Artificial Sequence
  chemically synthesized
agtatccctcaagaagcaatta

SEQ ID NO: 79308 - DNA, 22 bp, Artificial Sequence
  chemically synthesized
aagaagcaattaaccaagaata

SEQ ID NO: 79309 - DNA, 22 bp, Artificial Sequence
  chemically synthesized
accaagaataattattcccaga

SEQ ID NO: 79310 - DNA, 22 bp, Artificial Sequence
  chemically synthesized
ttcccagaaacttcgggtgtat

SEQ ID NO: 79311 - DNA, 22 bp, Artificial Sequence
  chemically synthesized
ccagaaacttcgggtgtattag

SEQ ID NO: 79312 - DNA, 22 bp, Artificial Sequence
  chemically synthesized
cgggtgtattagagagaaaggg

SEQ ID NO: 79313 - DNA, 22 bp, Artificial Sequence
  chemically synthesized
gggtgtattagagagaaagggg

SEQ ID NO: 79314 - DNA, 22 bp, Artificial Sequence
  chemically synthesized
gagagaaaggggggaatagttc

SEQ ID NO: 79315 - DNA, 22 bp, Artificial Sequence
  chemically synthesized
ctgagaagcatgctggagagag

SEQ ID NO: 79316 - DNA, 22 bp, Artificial Sequence
  chemically synthesized
agaagcatgctggagagagtat

SEQ ID NO: 79317 - DNA, 22 bp, Artificial Sequence
  chemically synthesized
gagagagtatacataagaacat

SEQ ID NO: 79318 - DNA, 22 bp, Artificial Sequence
  chemically synthesized
cacaatatcattaattataatt

SEQ ID NO: 79319 - DNA, 22 bp, Artificial Sequence
  chemically synthesized
attataatttaaatataagaca

SEQ ID NO: 79320 - DNA, 22 bp, Artificial Sequence
  chemically synthesized
taatttaaatataagacattgg

SEQ ID NO: 79321 - DNA, 22 bp, Artificial Sequence
  chemically synthesized
aaatataagacattggtttata

SEQ ID NO: 79322 - DNA, 22 bp, Artificial Sequence
  chemically synthesized
aatataagacattggtttatat

SEQ ID NO: 79323 - DNA, 22 bp, Artificial Sequence
  chemically synthesized
gtttatatttcttatatacttc

SEQ ID NO: 79324 - DNA, 22 bp, Artificial Sequence
  chemically synthesized
atatttcttatatacttccccc

SEQ ID NO: 79325 - DNA, 22 bp, Artificial Sequence
  chemically synthesized
tatttcttatatacttcccccg

SEQ ID NO: 79326 - DNA, 22 bp, Artificial Sequence
  chemically synthesized
cttatatacttcccccgcatct

SEQ ID NO: 79327 - DNA, 22 bp, Artificial Sequence
  chemically synthesized
ttatatacttcccccgcatctt

SEQ ID NO: 79328 - DNA, 22 bp, Artificial Sequence
  chemically synthesized
atatacttcccccgcatcttat

SEQ ID NO: 79329 - DNA, 22 bp, Artificial Sequence
  chemically synthesized
tatacttcccccgcatcttatc

SEQ ID NO: 79330 - DNA, 22 bp, Artificial Sequence
  chemically synthesized
cccccgcatcttatcttcatta

SEQ ID NO: 79331 - DNA, 22 bp, Artificial Sequence
  chemically synthesized
ccccgcatcttatcttcattaa

SEQ ID NO: 79332 - DNA, 22 bp, Artificial Sequence
  chemically synthesized
atcttcattaattttttcatac

SEQ ID NO: 79333 - DNA, 22 bp, Artificial Sequence
  chemically synthesized
tcttcattaattttttcataca

SEQ ID NO: 79334 - DNA, 22 bp, Artificial Sequence
  chemically synthesized
cattaattttttcatacacaat

SEQ ID NO: 79335 - DNA, 22 bp, Artificial Sequence
  chemically synthesized
attaattttttcatacacaatc

SEQ ID NO: 79336 - DNA, 22 bp, Artificial Sequence
  chemically synthesized
attttttcatacacaatcattt

SEQ ID NO: 79337 - DNA, 22 bp, Artificial Sequence
  chemically synthesized
tttcatacacaatcatttacaa

SEQ ID NO: 79338 - DNA, 22 bp, Artificial Sequence
  chemically synthesized
ttcatacacaatcatttacaaa

SEQ ID NO: 79339 - DNA, 22 bp, Artificial Sequence
  chemically synthesized
tcatacacaatcatttacaaaa

SEQ ID NO: 79340 - DNA, 22 bp, Artificial Sequence
  chemically synthesized
catacacaatcatttacaaaac

SEQ ID NO: 79341 - DNA, 22 bp, Artificial Sequence
  chemically synthesized
atacacaatcatttacaaaact

SEQ ID NO: 79342 - DNA, 22 bp, Artificial Sequence
  chemically synthesized
acaaaacttttatgtagtcagg

SEQ ID NO: 79343 - DNA, 22 bp, Artificial Sequence
  chemically synthesized
caaaacttttatgtagtcaggt

SEQ ID NO: 79344 - DNA, 22 bp, Artificial Sequence
  chemically synthesized
ttatgtagtcaggttaacatac

SEQ ID NO: 79345 - DNA, 22 bp, Artificial Sequence
  chemically synthesized
tatgtagtcaggttaacataca

SEQ ID NO: 79346 - DNA, 22 bp, Artificial Sequence
  chemically synthesized
atgtagtcaggttaacatacat

SEQ ID NO: 79347 - DNA, 22 bp, Artificial Sequence
  chemically synthesized
tgtagtcaggttaacatacatt

SEQ ID NO: 79348 - DNA, 22 bp, Artificial Sequence
  chemically synthesized
acatacattttattaatattat

SEQ ID NO: 79349 - DNA, 22 bp, Artificial Sequence
  chemically synthesized
tattaatattatatacttttca

SEQ ID NO: 79350 - DNA, 22 bp, Artificial Sequence
  chemically synthesized
attaatattatatacttttcat

SEQ ID NO: 79351 - DNA, 22 bp, Artificial Sequence
  chemically synthesized
ttaatattatatacttttcatt

SEQ ID NO: 79352 - DNA, 22 bp, Artificial Sequence
  chemically synthesized
atattatatacttttcattctt

SEQ ID NO: 79353 - DNA, 22 bp, Artificial Sequence
  chemically synthesized
tatacttttcattcttaagaag

SEQ ID NO: 79354 - DNA, 22 bp, Artificial Sequence
  chemically synthesized
ttcattcttaagaagctattcc

SEQ ID NO: 79355 - DNA, 22 bp, Artificial Sequence
  chemically synthesized
tcattcttaagaagctattcca

SEQ ID NO: 79356 - DNA, 22 bp, Artificial Sequence
  chemically synthesized
cattcttaagaagctattccat

SEQ ID NO: 79357 - DNA, 22 bp, Artificial Sequence
  chemically synthesized
attcttaagaagctattccata

SEQ ID NO: 79358 - DNA, 22 bp, Artificial Sequence
  chemically synthesized
ttaagaagctattccatataca

SEQ ID NO: 79359 - DNA, 22 bp, Artificial Sequence
  chemically synthesized
aagaagctattccatatacaaa

SEQ ID NO: 79360 - DNA, 22 bp, Artificial Sequence
  chemically synthesized
agaagctattccatatacaaag

SEQ ID NO: 79361 - DNA, 22 bp, Artificial Sequence
  chemically synthesized
ttccatatacaaagtaaaaagt

SEQ ID NO: 79362 - DNA, 22 bp, Artificial Sequence
  chemically synthesized
catatacaaagtaaaaagtgga

SEQ ID NO: 79363 - DNA, 22 bp, Artificial Sequence
  chemically synthesized
gatctagagctagagacggaac

SEQ ID NO: 79364 - DNA, 22 bp, Artificial Sequence
  chemically synthesized
gagctagagacggaactgcaga

SEQ ID NO: 79365 - DNA, 22 bp, Artificial Sequence
  chemically synthesized
gagacggaactgcagataggga

SEQ ID NO: 79366 - DNA, 22 bp, Artificial Sequence
  chemically synthesized
cagatagggatagtggtgtaga

SEQ ID NO: 79367 - DNA, 22 bp, Artificial Sequence
  chemically synthesized
gagattcttgattccacctgaa

SEQ ID NO: 79368 - DNA, 22 bp, Artificial Sequence
  chemically synthesized
ttgattccacctgaaatttgtt

SEQ ID NO: 79369 - DNA, 22 bp, Artificial Sequence
  chemically synthesized
gattccacctgaaatttgtttg

SEQ ID NO: 79370 - DNA, 22 bp, Artificial Sequence
  chemically synthesized
attccacctgaaatttgtttgg

SEQ ID NO: 79371 - DNA, 22 bp, Artificial Sequence
  chemically synthesized
cacctgaaatttgtttggggga

SEQ ID NO: 79372 - DNA, 22 bp, Artificial Sequence
  chemically synthesized
aaatttgtttgggggacttggg

SEQ ID NO: 79373 - DNA, 22 bp, Artificial Sequence
  chemically synthesized
gtttgggggacttgggtaatta

SEQ ID NO: 79374 - DNA, 22 bp, Artificial Sequence
  chemically synthesized
tttgggggacttgggtaattag

SEQ ID NO: 79375 - DNA, 22 bp, Artificial Sequence
  chemically synthesized
gggggacttgggtaattagaat

SEQ ID NO: 79376 - DNA, 22 bp, Artificial Sequence
  chemically synthesized
ggggacttgggtaattagaatt

SEQ ID NO: 79377 - DNA, 22 bp, Artificial Sequence
  chemically synthesized
gggtaattagaattttacttaa

SEQ ID NO: 79378 - DNA, 22 bp, Artificial Sequence
  chemically synthesized
ggtaattagaattttacttaag

SEQ ID NO: 79379 - DNA, 22 bp, Artificial Sequence
  chemically synthesized
gaattttacttaagtattctca

SEQ ID NO: 79380 - DNA, 22 bp, Artificial Sequence
  chemically synthesized
tacttaagtattctcaaacata

SEQ ID NO: 79381 - DNA, 22 bp, Artificial Sequence
  chemically synthesized
acttaagtattctcaaacatat

SEQ ID NO: 79382 - DNA, 22 bp, Artificial Sequence
  chemically synthesized
cttaagtattctcaaacatata

SEQ ID NO: 79383 - DNA, 22 bp, Artificial Sequence
  chemically synthesized
aagtattctcaaacatataaac

SEQ ID NO: 79384 - DNA, 22 bp, Artificial Sequence
  chemically synthesized
agtattctcaaacatataaaca

SEQ ID NO: 79385 - DNA, 22 bp, Artificial Sequence
  chemically synthesized
tcaaacatataaacaatttttc

SEQ ID NO: 79386 - DNA, 22 bp, Artificial Sequence
  chemically synthesized
aaacatataaacaatttttcta

SEQ ID NO: 79387 - DNA, 22 bp, Artificial Sequence
  chemically synthesized
ttctaataccaagtataagatc

SEQ ID NO: 79388 - DNA, 22 bp, Artificial Sequence
  chemically synthesized
tctaataccaagtataagatca

SEQ ID NO: 79389 - DNA, 22 bp, Artificial Sequence
  chemically synthesized
ctaataccaagtataagatcaa

SEQ ID NO: 79390 - DNA, 22 bp, Artificial Sequence
  chemically synthesized
taataccaagtataagatcaag

SEQ ID NO: 79391 - DNA, 22 bp, Artificial Sequence
  chemically synthesized
ataccaagtataagatcaaggg

SEQ ID NO: 79392 - DNA, 22 bp, Artificial Sequence
  chemically synthesized
gtctccaagcatgatgagggat

SEQ ID NO: 79393 - DNA, 22 bp, Artificial Sequence
  chemically synthesized
caagcatgatgagggattacat

SEQ ID NO: 79394 - DNA, 22 bp, Artificial Sequence
  chemically synthesized
catacattttattttatatttt

SEQ ID NO: 79395 - DNA, 22 bp, Artificial Sequence
  chemically synthesized
tattttatatttttatataaat

SEQ ID NO: 79396 - DNA, 22 bp, Artificial Sequence
  chemically synthesized
attttatatttttatataaata

SEQ ID NO: 79397 - DNA, 22 bp, Artificial Sequence
  chemically synthesized
ttttatatttttatataaatat

SEQ ID NO: 79398 - DNA, 22 bp, Artificial Sequence
  chemically synthesized
tatatttttatataaatatgga

SEQ ID NO: 79399 - DNA, 22 bp, Artificial Sequence
  chemically synthesized
atatttttatataaatatggat

SEQ ID NO: 79400 - DNA, 22 bp, Artificial Sequence
  chemically synthesized
tatttttatataaatatggatc

SEQ ID NO: 79401 - DNA, 22 bp, Artificial Sequence
  chemically synthesized
ttatataaatatggatctaatt

SEQ ID NO: 79402 - DNA, 22 bp, Artificial Sequence
  chemically synthesized
tatataaatatggatctaattc

SEQ ID NO: 79403 - DNA, 22 bp, Artificial Sequence
  chemically synthesized
atataaatatggatctaattct

SEQ ID NO: 79404 - DNA, 22 bp, Artificial Sequence
  chemically synthesized
tataaatatggatctaattcta

SEQ ID NO: 79405 - DNA, 22 bp, Artificial Sequence
  chemically synthesized
attctagactgttttctgttgt

SEQ ID NO: 79406 - DNA, 22 bp, Artificial Sequence
  chemically synthesized
tagactgttttctgttgtttga

SEQ ID NO: 79407 - DNA, 22 bp, Artificial Sequence
  chemically synthesized
gactgttttctgttgtttgatc

SEQ ID NO: 79408 - DNA, 22 bp, Artificial Sequence
  chemically synthesized
ttttctgttgtttgatctgtgt

SEQ ID NO: 79409 - DNA, 22 bp, Artificial Sequence
  chemically synthesized
tctgttgtttgatctgtgtcct

SEQ ID NO: 79410 - DNA, 22 bp, Artificial Sequence
  chemically synthesized
ctgttgtttgatctgtgtcctt

SEQ ID NO: 79411 - DNA, 22 bp, Artificial Sequence
  chemically synthesized
tgttgtttgatctgtgtccttt

SEQ ID NO: 79412 - DNA, 22 bp, Artificial Sequence
  chemically synthesized
ttgtttgatctgtgtccttttt

SEQ ID NO: 79413 - DNA, 22 bp, Artificial Sequence
  chemically synthesized
tttgatctgtgtcctttttgcc

SEQ ID NO: 79414 - DNA, 22 bp, Artificial Sequence
  chemically synthesized
gatctgtgtcctttttgccaca

SEQ ID NO: 79415 - DNA, 22 bp, Artificial Sequence
  chemically synthesized
atctgtgtcctttttgccacat

SEQ ID NO: 79416 - DNA, 22 bp, Artificial Sequence
  chemically synthesized
tgtcctttttgccacatgcaca

SEQ ID NO: 79417 - DNA, 22 bp, Artificial Sequence
  chemically synthesized
tttgccacatgcacatactgcc

SEQ ID NO: 79418 - DNA, 22 bp, Artificial Sequence
  chemically synthesized
ttgccacatgcacatactgccg

SEQ ID NO: 79419 - DNA, 22 bp, Artificial Sequence
  chemically synthesized
tgccacatgcacatactgccgt

SEQ ID NO: 79420 - DNA, 22 bp, Artificial Sequence
  chemically synthesized
gccacatgcacatactgccgtt

SEQ ID NO: 79421 - DNA, 22 bp, Artificial Sequence
  chemically synthesized
ccacatgcacatactgccgttc

SEQ ID NO: 79422 - DNA, 22 bp, Artificial Sequence
  chemically synthesized
ccgttcttattctgtttttata

SEQ ID NO: 79423 - DNA, 22 bp, Artificial Sequence
  chemically synthesized
ttattctgtttttatatacaac

SEQ ID NO: 79424 - DNA, 22 bp, Artificial Sequence
  chemically synthesized
attctgtttttatatacaactt

SEQ ID NO: 79425 - DNA, 22 bp, Artificial Sequence
  chemically synthesized
ttctgtttttatatacaacttc

SEQ ID NO: 79426 - DNA, 22 bp, Artificial Sequence
  chemically synthesized
tgtttttatatacaacttcata

SEQ ID NO: 79427 - DNA, 22 bp, Artificial Sequence
  chemically synthesized
tttttatatacaacttcatatt

SEQ ID NO: 79428 - DNA, 22 bp, Artificial Sequence
  chemically synthesized
ttatatacaacttcatattcaa

SEQ ID NO: 79429 - DNA, 22 bp, Artificial Sequence
  chemically synthesized
tatatacaacttcatattcaat

SEQ ID NO: 79430 - DNA, 22 bp, Artificial Sequence
  chemically synthesized
atatacaacttcatattcaatt

SEQ ID NO: 79431 - DNA, 22 bp, Artificial Sequence
  chemically synthesized
tatacaacttcatattcaattg

SEQ ID NO: 79432 - DNA, 22 bp, Artificial Sequence
  chemically synthesized
catattcaattggtcaagctat

SEQ ID NO: 79433 - DNA, 22 bp, Artificial Sequence
  chemically synthesized
atattcaattggtcaagctata

SEQ ID NO: 79434 - DNA, 22 bp, Artificial Sequence
  chemically synthesized
aattggtcaagctatatttttg

SEQ ID NO: 79435 - DNA, 22 bp, Artificial Sequence
  chemically synthesized
gtcaagctatatttttgttgtc

SEQ ID NO: 79436 - DNA, 22 bp, Artificial Sequence
  chemically synthesized
tatttttgttgtcatgctaact

SEQ ID NO: 79437 - DNA, 22 bp, Artificial Sequence
  chemically synthesized
ttgttgtcatgctaactttgta

SEQ ID NO: 79438 - DNA, 22 bp, Artificial Sequence
  chemically synthesized
tgttgtcatgctaactttgtat

SEQ ID NO: 79439 - DNA, 22 bp, Artificial Sequence
  chemically synthesized
gttgtcatgctaactttgtatt

SEQ ID NO: 79440 - DNA, 22 bp, Artificial Sequence
  chemically synthesized
ttgtcatgctaactttgtattc

SEQ ID NO: 79441 - DNA, 22 bp, Artificial Sequence
  chemically synthesized
tcatgctaactttgtattcttt

SEQ ID NO: 79442 - DNA, 22 bp, Artificial Sequence
  chemically synthesized
actttgtattctttcaaataag

SEQ ID NO: 79443 - DNA, 22 bp, Artificial Sequence
  chemically synthesized
tgtattctttcaaataaggatt

SEQ ID NO: 79444 - DNA, 22 bp, Artificial Sequence
  chemically synthesized
gtattctttcaaataaggatta

SEQ ID NO: 79445 - DNA, 22 bp, Artificial Sequence
  chemically synthesized
tattctttcaaataaggattaa

SEQ ID NO: 79446 - DNA, 22 bp, Artificial Sequence
  chemically synthesized
tttcaaataaggattaaaagcc

SEQ ID NO: 79447 - DNA, 22 bp, Artificial Sequence
  chemically synthesized
tcaaataaggattaaaagccag

SEQ ID NO: 79448 - DNA, 22 bp, Artificial Sequence
  chemically synthesized
caaataaggattaaaagccagc

SEQ ID NO: 79449 - DNA, 22 bp, Artificial Sequence
  chemically synthesized
aaataaggattaaaagccagca

SEQ ID NO: 79450 - DNA, 22 bp, Artificial Sequence
  chemically synthesized
aaagccagcatgcataaaaatt

SEQ ID NO: 79451 - DNA, 22 bp, Artificial Sequence
  chemically synthesized
tgtaatgacctaaattgaacta

SEQ ID NO: 79452 - DNA, 22 bp, Artificial Sequence
  chemically synthesized
aattgaactaaagccataacac

SEQ ID NO: 79453 - DNA, 22 bp, Artificial Sequence
  chemically synthesized
aactaaagccataacaccctcg

SEQ ID NO: 79454 - DNA, 22 bp, Artificial Sequence
  chemically synthesized
aagccataacaccctcggaagg

SEQ ID NO: 79455 - DNA, 22 bp, Artificial Sequence
  chemically synthesized
ggaaggaagcatgggtaaatct

SEQ ID NO: 79456 - DNA, 22 bp, Artificial Sequence
  chemically synthesized
catgaactttgattttacaata

SEQ ID NO: 79457 - DNA, 22 bp, Artificial Sequence
  chemically synthesized
atgaactttgattttacaatag

SEQ ID NO: 79458 - DNA, 22 bp, Artificial Sequence
  chemically synthesized
tgattttacaatagattcttag

SEQ ID NO: 79459 - DNA, 22 bp, Artificial Sequence
  chemically synthesized
gattttacaatagattcttaga

SEQ ID NO: 79460 - DNA, 22 bp, Artificial Sequence
  chemically synthesized
attttacaatagattcttagat

SEQ ID NO: 79461 - DNA, 22 bp, Artificial Sequence
  chemically synthesized
tacaatagattcttagatatga

SEQ ID NO: 79462 - DNA, 22 bp, Artificial Sequence
  chemically synthesized
acaatagattcttagatatgac

SEQ ID NO: 79463 - DNA, 22 bp, Artificial Sequence
  chemically synthesized
caatagattcttagatatgaca

SEQ ID NO: 79464 - DNA, 22 bp, Artificial Sequence
  chemically synthesized
ttagatatgacacaaaaagtat

SEQ ID NO: 79465 - DNA, 22 bp, Artificial Sequence
  chemically synthesized
agatatgacacaaaaagtatga

SEQ ID NO: 79466 - DNA, 22 bp, Artificial Sequence
  chemically synthesized
gatatgacacaaaaagtatgag

SEQ ID NO: 79467 - DNA, 22 bp, Artificial Sequence
  chemically synthesized
gatttcatttaaaaagttcatg

SEQ ID NO: 79468 - DNA, 22 bp, Artificial Sequence
  chemically synthesized
catttaaaaagttcatgcaaca

SEQ ID NO: 79469 - DNA, 22 bp, Artificial Sequence
  chemically synthesized
atttaaaaagttcatgcaacaa

SEQ ID NO: 79470 - DNA, 22 bp, Artificial Sequence
  chemically synthesized
aaaaagttcatgcaacaaacga

SEQ ID NO: 79471 - DNA, 22 bp, Artificial Sequence
  chemically synthesized
aaaagttcatgcaacaaacgac

SEQ ID NO: 79472 - DNA, 22 bp, Artificial Sequence
  chemically synthesized
atgcaacaaacgactttaagaa

SEQ ID NO: 79473 - DNA, 22 bp, Artificial Sequence
  chemically synthesized
taagaaagtaaaaagacaacct

SEQ ID NO: 79474 - DNA, 22 bp, Artificial Sequence
  chemically synthesized
aagaaagtaaaaagacaaccta

SEQ ID NO: 79475 - DNA, 22 bp, Artificial Sequence
  chemically synthesized
agaaagtaaaaagacaacctat

SEQ ID NO: 79476 - DNA, 22 bp, Artificial Sequence
  chemically synthesized
taagatgagagaacatctttgc

SEQ ID NO: 79477 - DNA, 22 bp, Artificial Sequence
  chemically synthesized
tgcaaattatgtatttcataag

SEQ ID NO: 79478 - DNA, 22 bp, Artificial Sequence
  chemically synthesized
gcaaattatgtatttcataagt

SEQ ID NO: 79479 - DNA, 22 bp, Artificial Sequence
  chemically synthesized
caaattatgtatttcataagtt

SEQ ID NO: 79480 - DNA, 22 bp, Artificial Sequence
  chemically synthesized
tgtatttcataagtttaatatc

SEQ ID NO: 79481 - DNA, 22 bp, Artificial Sequence
  chemically synthesized
cataagtttaatatccagaatg

SEQ ID NO: 79482 - DNA, 22 bp, Artificial Sequence
  chemically synthesized
ataagtttaatatccagaatgt

SEQ ID NO: 79483 - DNA, 22 bp, Artificial Sequence
  chemically synthesized
aatatccagaatgtatgaaaaa

SEQ ID NO: 79484 - DNA, 22 bp, Artificial Sequence
  chemically synthesized
atatccagaatgtatgaaaaag

SEQ ID NO: 79485 - DNA, 22 bp, Artificial Sequence
  chemically synthesized
caactcaaaaacaaaaagacaa

SEQ ID NO: 79486 - DNA, 22 bp, Artificial Sequence
  chemically synthesized
aaaaacaaaaagacaaacaact

SEQ ID NO: 79487 - DNA, 22 bp, Artificial Sequence
  chemically synthesized
aatttaaaaatatgcaaatgat

SEQ ID NO: 79488 - DNA, 22 bp, Artificial Sequence
  chemically synthesized
aaaaatatgcaaatgatgggaa

SEQ ID NO: 79489 - DNA, 22 bp, Artificial Sequence
  chemically synthesized
aaaatatgcaaatgatgggaat

SEQ ID NO: 79490 - DNA, 22 bp, Artificial Sequence
  chemically synthesized
ctagaaagaagatatacaaatg

SEQ ID NO: 79491 - DNA, 22 bp, Artificial Sequence
  chemically synthesized
tagaaagaagatatacaaatga

SEQ ID NO: 79492 - DNA, 22 bp, Artificial Sequence
  chemically synthesized
gaaagaagatatacaaatgaac

SEQ ID NO: 79493 - DNA, 22 bp, Artificial Sequence
  chemically synthesized
gcacataaaatgcaaaccaaaa

SEQ ID NO: 79494 - DNA, 22 bp, Artificial Sequence
  chemically synthesized
cttcaaacttactagaatgtct

SEQ ID NO: 79495 - DNA, 22 bp, Artificial Sequence
  chemically synthesized
caaacttactagaatgtctata

SEQ ID NO: 79496 - DNA, 22 bp, Artificial Sequence
  chemically synthesized
aaacttactagaatgtctatac

SEQ ID NO: 79497 - DNA, 22 bp, Artificial Sequence
  chemically synthesized
actagaatgtctatactttaag

SEQ ID NO: 79498 - DNA, 22 bp, Artificial Sequence
  chemically synthesized
ctagaatgtctatactttaaga

SEQ ID NO: 79499 - DNA, 22 bp, Artificial Sequence
  chemically synthesized
gaatgtctatactttaagagaa

SEQ ID NO: 79500 - DNA, 22 bp, Artificial Sequence
  chemically synthesized
tactttaagagaaacaaaacaa

SEQ ID NO: 79501 - DNA, 22 bp, Artificial Sequence
  chemically synthesized
taagagaaacaaaacaaatgaa

SEQ ID NO: 79502 - DNA, 22 bp, Artificial Sequence
  chemically synthesized
aagagaaacaaaacaaatgaaa

SEQ ID NO: 79503 - DNA, 22 bp, Artificial Sequence
  chemically synthesized
agagaaacaaaacaaatgaaaa

SEQ ID NO: 79504 - DNA, 22 bp, Artificial Sequence
  chemically synthesized
acaaagatataagaaaattgga

SEQ ID NO: 79505 - DNA, 22 bp, Artificial Sequence
  chemically synthesized
gaatcctcatatattgctgcta

SEQ ID NO: 79506 - DNA, 22 bp, Artificial Sequence
  chemically synthesized
atatattgctgctaaaaatgtt

SEQ ID NO: 79507 - DNA, 22 bp, Artificial Sequence
  chemically synthesized
ctgctaaaaatgttaagtggtg

SEQ ID NO: 79508 - DNA, 22 bp, Artificial Sequence
  chemically synthesized
ctaaaaatgttaagtggtgcaa

SEQ ID NO: 79509 - DNA, 22 bp, Artificial Sequence
  chemically synthesized
aaaatgttaagtggtgcaactt

SEQ ID NO: 79510 - DNA, 22 bp, Artificial Sequence
  chemically synthesized
agtggtgcaacttctgtagaaa

SEQ ID NO: 79511 - DNA, 22 bp, Artificial Sequence
  chemically synthesized
ctgtagaaaatattttgacagt

SEQ ID NO: 79512 - DNA, 22 bp, Artificial Sequence
  chemically synthesized
tgtagaaaatattttgacagtt

SEQ ID NO: 79513 - DNA, 22 bp, Artificial Sequence
  chemically synthesized
tagaaaatattttgacagttct

SEQ ID NO: 79514 - DNA, 22 bp, Artificial Sequence
  chemically synthesized
tgacagttcttcaaaaacttag

SEQ ID NO: 79515 - DNA, 22 bp, Artificial Sequence
  chemically synthesized
gacagttcttcaaaaacttagg

SEQ ID NO: 79516 - DNA, 22 bp, Artificial Sequence
  chemically synthesized
acagttcttcaaaaacttaggc

SEQ ID NO: 79517 - DNA, 22 bp, Artificial Sequence
  chemically synthesized
ttcaaaaacttaggcactgaat

SEQ ID NO: 79518 - DNA, 22 bp, Artificial Sequence
  chemically synthesized
caaaaacttaggcactgaataa

SEQ ID NO: 79519 - DNA, 22 bp, Artificial Sequence
  chemically synthesized
aaaaacttaggcactgaataac

SEQ ID NO: 79520 - DNA, 22 bp, Artificial Sequence
  chemically synthesized
aggcactgaataacatatgacc

SEQ ID NO: 79521 - DNA, 22 bp, Artificial Sequence
  chemically synthesized
ggcactgaataacatatgaccc

SEQ ID NO: 79522 - DNA, 22 bp, Artificial Sequence
  chemically synthesized
aataacatatgaccccaaaatt

SEQ ID NO: 79523 - DNA, 22 bp, Artificial Sequence
  chemically synthesized
ctctcctaggtatatattaaaa

SEQ ID NO: 79524 - DNA, 22 bp, Artificial Sequence
  chemically synthesized
tcctaggtatatattaaaaata

SEQ ID NO: 79525 - DNA, 22 bp, Artificial Sequence
  chemically synthesized
ctaggtatatattaaaaatata

SEQ ID NO: 79526 - DNA, 22 bp, Artificial Sequence
  chemically synthesized
ggtatatattaaaaatatatat

SEQ ID NO: 79527 - DNA, 22 bp, Artificial Sequence
  chemically synthesized
aaaatatatataaagatttaaa

SEQ ID NO: 79528 - DNA, 22 bp, Artificial Sequence
  chemically synthesized
aaacaggtacttgtactgaaat

SEQ ID NO: 79529 - DNA, 22 bp, Artificial Sequence
  chemically synthesized
aacaggtacttgtactgaaatg

SEQ ID NO: 79530 - DNA, 22 bp, Artificial Sequence
  chemically synthesized
gtactgaaatgttcattgtagc

SEQ ID NO: 79531 - DNA, 22 bp, Artificial Sequence
  chemically synthesized
tactgaaatgttcattgtagca

SEQ ID NO: 79532 - DNA, 22 bp, Artificial Sequence
  chemically synthesized
aaatgttcattgtagcattatt

SEQ ID NO: 79533 - DNA, 22 bp, Artificial Sequence
  chemically synthesized
attgtagcattattcacaatag

SEQ ID NO: 79534 - DNA, 22 bp, Artificial Sequence
  chemically synthesized
tagcattattcacaatagccaa

SEQ ID NO: 79535 - DNA, 22 bp, Artificial Sequence
  chemically synthesized
ttcacaatagccaaaaggtgga

SEQ ID NO: 79536 - DNA, 22 bp, Artificial Sequence
  chemically synthesized
acaatagccaaaaggtggaaac

SEQ ID NO: 79537 - DNA, 22 bp, Artificial Sequence
  chemically synthesized
tgtagcaataaaaaagaatgaa

SEQ ID NO: 79538 - DNA, 22 bp, Artificial Sequence
  chemically synthesized
atttaatgtcatgaataggttt

SEQ ID NO: 79539 - DNA, 22 bp, Artificial Sequence
  chemically synthesized
tttaatgtcatgaataggtttt

SEQ ID NO: 79540 - DNA, 22 bp, Artificial Sequence
  chemically synthesized
aatgtcatgaataggtttttgg

SEQ ID NO: 79541 - DNA, 22 bp, Artificial Sequence
  chemically synthesized
atgtcatgaataggtttttgga

SEQ ID NO: 79542 - DNA, 22 bp, Artificial Sequence
  chemically synthesized
ttggaaatggcaactttaagtg

SEQ ID NO: 79543 - DNA, 22 bp, Artificial Sequence
  chemically synthesized
tggaaatggcaactttaagtga

SEQ ID NO: 79544 - DNA, 22 bp, Artificial Sequence
  chemically synthesized
ggaaatggcaactttaagtgaa

SEQ ID NO: 79545 - DNA, 22 bp, Artificial Sequence
  chemically synthesized
gaaatggcaactttaagtgaaa

SEQ ID NO: 79546 - DNA, 22 bp, Artificial Sequence
  chemically synthesized
taagtgaaatgatgtaaaacag

SEQ ID NO: 79547 - DNA, 22 bp, Artificial Sequence
  chemically synthesized
aagtgaaatgatgtaaaacaga

SEQ ID NO: 79548 - DNA, 22 bp, Artificial Sequence
  chemically synthesized
agtgaaatgatgtaaaacagat

SEQ ID NO: 79549 - DNA, 22 bp, Artificial Sequence
  chemically synthesized
aaataacactgttttagccaac

SEQ ID NO: 79550 - DNA, 22 bp, Artificial Sequence
  chemically synthesized
ttttagccaacactgttagatg

SEQ ID NO: 79551 - DNA, 22 bp, Artificial Sequence
  chemically synthesized
tagccaacactgttagatgaga

SEQ ID NO: 79552 - DNA, 22 bp, Artificial Sequence
  chemically synthesized
agccaacactgttagatgagaa

SEQ ID NO: 79553 - DNA, 22 bp, Artificial Sequence
  chemically synthesized
gccaacactgttagatgagaaa

SEQ ID NO: 79554 - DNA, 22 bp, Artificial Sequence
  chemically synthesized
ttagatgagaaaaaaaatggat

SEQ ID NO: 79555 - DNA, 22 bp, Artificial Sequence
  chemically synthesized
gatgagaaaaaaaatggatatc

SEQ ID NO: 79556 - DNA, 22 bp, Artificial Sequence
  chemically synthesized
tatgtcacttggcttaaagttt

SEQ ID NO: 79557 - DNA, 22 bp, Artificial Sequence
  chemically synthesized
ggcttaaagtttcagtttccaa

SEQ ID NO: 79558 - DNA, 22 bp, Artificial Sequence
  chemically synthesized
gcttaaagtttcagtttccaag

SEQ ID NO: 79559 - DNA, 22 bp, Artificial Sequence
  chemically synthesized
aaagtttcagtttccaagaatc

SEQ ID NO: 79560 - DNA, 22 bp, Artificial Sequence
  chemically synthesized
aagtttcagtttccaagaatct

SEQ ID NO: 79561 - DNA, 22 bp, Artificial Sequence
  chemically synthesized
cagtttccaagaatctatgaat

SEQ ID NO: 79562 - DNA, 22 bp, Artificial Sequence
  chemically synthesized
agtttccaagaatctatgaatg

SEQ ID NO: 79563 - DNA, 22 bp, Artificial Sequence
  chemically synthesized
ccaagaatctatgaatggacaa

SEQ ID NO: 79564 - DNA, 22 bp, Artificial Sequence
  chemically synthesized
caagaatctatgaatggacaac

SEQ ID NO: 79565 - DNA, 22 bp, Artificial Sequence
  chemically synthesized
tgaatggacaacattaagcaaa

SEQ ID NO: 79566 - DNA, 22 bp, Artificial Sequence
  chemically synthesized
agcaaagacttaccactataca

SEQ ID NO: 79567 - DNA, 22 bp, Artificial Sequence
  chemically synthesized
accactatacatgttatggcat

SEQ ID NO: 79568 - DNA, 22 bp, Artificial Sequence
  chemically synthesized
ccactatacatgttatggcatg

SEQ ID NO: 79569 - DNA, 22 bp, Artificial Sequence
  chemically synthesized
tacatgttatggcatggatgga

SEQ ID NO: 79570 - DNA, 22 bp, Artificial Sequence
  chemically synthesized
tggcatggatggactttgaaac

SEQ ID NO: 79571 - DNA, 22 bp, Artificial Sequence
  chemically synthesized
tgaaaccttatgttgggtaaaa

SEQ ID NO: 79572 - DNA, 22 bp, Artificial Sequence
  chemically synthesized
gaaaccttatgttgggtaaaat

SEQ ID NO: 79573 - DNA, 22 bp, Artificial Sequence
  chemically synthesized
aaaccttatgttgggtaaaata

SEQ ID NO: 79574 - DNA, 22 bp, Artificial Sequence
  chemically synthesized
atgttgggtaaaataagccaga

SEQ ID NO: 79575 - DNA, 22 bp, Artificial Sequence
  chemically synthesized
tgttgggtaaaataagccagac

SEQ ID NO: 79576 - DNA, 22 bp, Artificial Sequence
  chemically synthesized
ggtaaaataagccagacacaaa

SEQ ID NO: 79577 - DNA, 22 bp, Artificial Sequence
  chemically synthesized
tatgaatctatttatatgaatt

SEQ ID NO: 79578 - DNA, 22 bp, Artificial Sequence
  chemically synthesized
tttatatgaattatctaaaata

SEQ ID NO: 79579 - DNA, 22 bp, Artificial Sequence
  chemically synthesized
atatgaattatctaaaatagac

SEQ ID NO: 79580 - DNA, 22 bp, Artificial Sequence
  chemically synthesized
tatgaattatctaaaatagact

SEQ ID NO: 79581 - DNA, 22 bp, Artificial Sequence
  chemically synthesized
tctaaaatagactgatttagag

SEQ ID NO: 79582 - DNA, 22 bp, Artificial Sequence
  chemically synthesized
aaatagactgatttagagaaac

SEQ ID NO: 79583 - DNA, 22 bp, Artificial Sequence
  chemically synthesized
atttagagaaacatatagtaga

SEQ ID NO: 79584 - DNA, 22 bp, Artificial Sequence
  chemically synthesized
agagaaacatatagtagattag

SEQ ID NO: 79585 - DNA, 22 bp, Artificial Sequence
  chemically synthesized
gagaaacatatagtagattaga

SEQ ID NO: 79586 - DNA, 22 bp, Artificial Sequence
  chemically synthesized
gaggttactatgggactgggga

SEQ ID NO: 79587 - DNA, 22 bp, Artificial Sequence
  chemically synthesized
ctatgggactggggagttactg

SEQ ID NO: 79588 - DNA, 22 bp, Artificial Sequence
  chemically synthesized
tgggactggggagttactgcct

SEQ ID NO: 79589 - DNA, 22 bp, Artificial Sequence
  chemically synthesized
gggagttactgcctaacaagta

SEQ ID NO: 79590 - DNA, 22 bp, Artificial Sequence
  chemically synthesized
ctgcctaacaagtatagcattt

SEQ ID NO: 79591 - DNA, 22 bp, Artificial Sequence
  chemically synthesized
cctaacaagtatagcatttctg

SEQ ID NO: 79592 - DNA, 22 bp, Artificial Sequence
  chemically synthesized
acaagtatagcatttctgcttg

SEQ ID NO: 79593 - DNA, 22 bp, Artificial Sequence
  chemically synthesized
ctgcttggatgatgaaaaagtt

SEQ ID NO: 79594 - DNA, 22 bp, Artificial Sequence
  chemically synthesized
tgcttggatgatgaaaaagttt

SEQ ID NO: 79595 - DNA, 22 bp, Artificial Sequence
  chemically synthesized
cttggatgatgaaaaagttttg

SEQ ID NO: 79596 - DNA, 22 bp, Artificial Sequence
  chemically synthesized
ggatgatgaaaaagttttggca

SEQ ID NO: 79597 - DNA, 22 bp, Artificial Sequence
  chemically synthesized
gatgatgaaaaagttttggcat

SEQ ID NO: 79598 - DNA, 22 bp, Artificial Sequence
  chemically synthesized
tggcatgagatcatggtgatag

SEQ ID NO: 79599 - DNA, 22 bp, Artificial Sequence
  chemically synthesized
ggcatgagatcatggtgatagc

SEQ ID NO: 79600 - DNA, 22 bp, Artificial Sequence
  chemically synthesized
gcatgagatcatggtgatagcg

SEQ ID NO: 79601 - DNA, 22 bp, Artificial Sequence
  chemically synthesized
ttaatataattaatgccacata

SEQ ID NO: 79602 - DNA, 22 bp, Artificial Sequence
  chemically synthesized
atataattaatgccacataatt

SEQ ID NO: 79603 - DNA, 22 bp, Artificial Sequence
  chemically synthesized
atgccacataattatacttaaa

SEQ ID NO: 79604 - DNA, 22 bp, Artificial Sequence
  chemically synthesized
tacttaaaaatggttaatatgg

SEQ ID NO: 79605 - DNA, 22 bp, Artificial Sequence
  chemically synthesized
aaaaatggttaatatggtgagc

SEQ ID NO: 79606 - DNA, 22 bp, Artificial Sequence
  chemically synthesized
aaaatggttaatatggtgagct

SEQ ID NO: 79607 - DNA, 22 bp, Artificial Sequence
  chemically synthesized
atatggtgagctttattatata

SEQ ID NO: 79608 - DNA, 22 bp, Artificial Sequence
  chemically synthesized
tattatatatgatatacggtat

SEQ ID NO: 79609 - DNA, 22 bp, Artificial Sequence
  chemically synthesized
attatatatgatatacggtatt

SEQ ID NO: 79610 - DNA, 22 bp, Artificial Sequence
  chemically synthesized
ttatatatgatatacggtatta

SEQ ID NO: 79611 - DNA, 22 bp, Artificial Sequence
  chemically synthesized
tatatgatatacggtattatat

SEQ ID NO: 79612 - DNA, 22 bp, Artificial Sequence
  chemically synthesized
tatgtagcatatttataaactt

SEQ ID NO: 79613 - DNA, 22 bp, Artificial Sequence
  chemically synthesized
ataaactttatcacaataaaaa

SEQ ID NO: 79614 - DNA, 22 bp, Artificial Sequence
  chemically synthesized
taaactttatcacaataaaaat

SEQ ID NO: 79615 - DNA, 22 bp, Artificial Sequence
  chemically synthesized
tatcacaataaaaatggaaaga

SEQ ID NO: 79616 - DNA, 22 bp, Artificial Sequence
  chemically synthesized
atcacaataaaaatggaaagaa

SEQ ID NO: 79617 - DNA, 22 bp, Artificial Sequence
  chemically synthesized
tcacaataaaaatggaaagaaa

SEQ ID NO: 79618 - DNA, 22 bp, Artificial Sequence
  chemically synthesized
aaaacaagacaaatttttattt

SEQ ID NO: 79619 - DNA, 22 bp, Artificial Sequence
  chemically synthesized
aaacaagacaaatttttatttt

SEQ ID NO: 79620 - DNA, 22 bp, Artificial Sequence
  chemically synthesized
ttattttgattagggttgaatt

SEQ ID NO: 79621 - DNA, 22 bp, Artificial Sequence
  chemically synthesized
tattttgattagggttgaattg

SEQ ID NO: 79622 - DNA, 22 bp, Artificial Sequence
  chemically synthesized
attttgattagggttgaattga

SEQ ID NO: 79623 - DNA, 22 bp, Artificial Sequence
  chemically synthesized
ttttgattagggttgaattgaa

SEQ ID NO: 79624 - DNA, 22 bp, Artificial Sequence
  chemically synthesized
tgattagggttgaattgaattt

SEQ ID NO: 79625 - DNA, 22 bp, Artificial Sequence
  chemically synthesized
gattagggttgaattgaattta

SEQ ID NO: 79626 - DNA, 22 bp, Artificial Sequence
  chemically synthesized
attagggttgaattgaatttat

SEQ ID NO: 79627 - DNA, 22 bp, Artificial Sequence
  chemically synthesized
gggttgaattgaatttattatg

SEQ ID NO: 79628 - DNA, 22 bp, Artificial Sequence
  chemically synthesized
aattgaatttattatgagttgt

SEQ ID NO: 79629 - DNA, 22 bp, Artificial Sequence
  chemically synthesized
aatttattatgagttgtttctg

SEQ ID NO: 79630 - DNA, 22 bp, Artificial Sequence
  chemically synthesized
attatgagttgtttctgagaga

SEQ ID NO: 79631 - DNA, 22 bp, Artificial Sequence
  chemically synthesized
ttatgagttgtttctgagagaa

SEQ ID NO: 79632 - DNA, 22 bp, Artificial Sequence
  chemically synthesized
tgagttgtttctgagagaattg

SEQ ID NO: 79633 - DNA, 22 bp, Artificial Sequence
  chemically synthesized
tttctgagagaattgttacaat

SEQ ID NO: 79634 - DNA, 22 bp, Artificial Sequence
  chemically synthesized
ctgagagaattgttacaataaa

SEQ ID NO: 79635 - DNA, 22 bp, Artificial Sequence
  chemically synthesized
tgagagaattgttacaataaac

SEQ ID NO: 79636 - DNA, 22 bp, Artificial Sequence
  chemically synthesized
agagaattgttacaataaacaa

SEQ ID NO: 79637 - DNA, 22 bp, Artificial Sequence
  chemically synthesized
ttacaataaacaatgtataata

SEQ ID NO: 79638 - DNA, 22 bp, Artificial Sequence
  chemically synthesized
caataaacaatgtataataaac

SEQ ID NO: 79639 - DNA, 22 bp, Artificial Sequence
  chemically synthesized
tttcatttattttaggcacata

SEQ ID NO: 79640 - DNA, 22 bp, Artificial Sequence
  chemically synthesized
catttattttaggcacatatac

SEQ ID NO: 79641 - DNA, 22 bp, Artificial Sequence
  chemically synthesized
atttattttaggcacatataca

SEQ ID NO: 79642 - DNA, 22 bp, Artificial Sequence
  chemically synthesized
attttaggcacatatacagttc

SEQ ID NO: 79643 - DNA, 22 bp, Artificial Sequence
  chemically synthesized
ttttaggcacatatacagttct

SEQ ID NO: 79644 - DNA, 22 bp, Artificial Sequence
  chemically synthesized
taggcacatatacagttctatt

SEQ ID NO: 79645 - DNA, 22 bp, Artificial Sequence
  chemically synthesized
aggcacatatacagttctatta

SEQ ID NO: 79646 - DNA, 22 bp, Artificial Sequence
  chemically synthesized
ggcacatatacagttctattat

SEQ ID NO: 79647 - DNA, 22 bp, Artificial Sequence
  chemically synthesized
tattatcattttgggttttatt

SEQ ID NO: 79648 - DNA, 22 bp, Artificial Sequence
  chemically synthesized
ttatcattttgggttttatttt

SEQ ID NO: 79649 - DNA, 22 bp, Artificial Sequence
  chemically synthesized
tcattttgggttttattttttg

SEQ ID NO: 79650 - DNA, 22 bp, Artificial Sequence
  chemically synthesized
tgggttttattttttgtttttc

SEQ ID NO: 79651 - DNA, 22 bp, Artificial Sequence
  chemically synthesized
gggttttattttttgtttttct

SEQ ID NO: 79652 - DNA, 22 bp, Artificial Sequence
  chemically synthesized
ggttttattttttgtttttctt

SEQ ID NO: 79653 - DNA, 22 bp, Artificial Sequence
  chemically synthesized
tattttttgtttttctttttgt

SEQ ID NO: 79654 - DNA, 22 bp, Artificial Sequence
  chemically synthesized
attttttgtttttctttttgtt

SEQ ID NO: 79655 - DNA, 22 bp, Artificial Sequence
  chemically synthesized
ttttttgtttttctttttgttt

SEQ ID NO: 79656 - DNA, 22 bp, Artificial Sequence
  chemically synthesized
tttgtttttctttttgtttttg

SEQ ID NO: 79657 - DNA, 22 bp, Artificial Sequence
  chemically synthesized
ttgtttttctttttgtttttgt

SEQ ID NO: 79658 - DNA, 22 bp, Artificial Sequence
  chemically synthesized
tgtttttctttttgtttttgtt

SEQ ID NO: 79659 - DNA, 22 bp, Artificial Sequence
  chemically synthesized
gtttttctttttgtttttgttt

SEQ ID NO: 79660 - DNA, 22 bp, Artificial Sequence
  chemically synthesized
tttttctttttgtttttgtttt

SEQ ID NO: 79661 - DNA, 22 bp, Artificial Sequence
  chemically synthesized
ttctttttgtttttgttttacg

SEQ ID NO: 79662 - DNA, 22 bp, Artificial Sequence
  chemically synthesized
tctttttgtttttgttttacgt

SEQ ID NO: 79663 - DNA, 22 bp, Artificial Sequence
  chemically synthesized
ctttttgtttttgttttacgta

SEQ ID NO: 79664 - DNA, 22 bp, Artificial Sequence
  chemically synthesized
tttttgtttttgttttacgtat

SEQ ID NO: 79665 - DNA, 22 bp, Artificial Sequence
  chemically synthesized
tttgtttttgttttacgtattt

SEQ ID NO: 79666 - DNA, 22 bp, Artificial Sequence
  chemically synthesized
ttgtttttgttttacgtatttt

SEQ ID NO: 79667 - DNA, 22 bp, Artificial Sequence
  chemically synthesized
tgtttttgttttacgtattttt

SEQ ID NO: 79668 - DNA, 22 bp, Artificial Sequence
  chemically synthesized
gtttttgttttacgtatttttg

SEQ ID NO: 79669 - DNA, 22 bp, Artificial Sequence
  chemically synthesized
tttttgttttacgtatttttgg

SEQ ID NO: 79670 - DNA, 22 bp, Artificial Sequence
  chemically synthesized
ttgttttacgtatttttggttt

SEQ ID NO: 79671 - DNA, 22 bp, Artificial Sequence
  chemically synthesized
tgttttacgtatttttggtttt

SEQ ID NO: 79672 - DNA, 22 bp, Artificial Sequence
  chemically synthesized
gttttacgtatttttggttttt

SEQ ID NO: 79673 - DNA, 22 bp, Artificial Sequence
  chemically synthesized
ttttacgtatttttggtttttt

SEQ ID NO: 79674 - DNA, 22 bp, Artificial Sequence
  chemically synthesized
tacgtatttttggtttttttga

SEQ ID NO: 79675 - DNA, 22 bp, Artificial Sequence
  chemically synthesized
acgtatttttggtttttttgag

SEQ ID NO: 79676 - DNA, 22 bp, Artificial Sequence
  chemically synthesized
cgtatttttggtttttttgaga

SEQ ID NO: 79677 - DNA, 22 bp, Artificial Sequence
  chemically synthesized
ttggtttttttgagatggagtc

SEQ ID NO: 79678 - DNA, 22 bp, Artificial Sequence
  chemically synthesized
tggtttttttgagatggagtct

SEQ ID NO: 79679 - DNA, 22 bp, Artificial Sequence
  chemically synthesized
ggtttttttgagatggagtctc

SEQ ID NO: 79680 - DNA, 22 bp, Artificial Sequence
  chemically synthesized
gtttttttgagatggagtctct

SEQ ID NO: 79681 - DNA, 22 bp, Artificial Sequence
  chemically synthesized
ttttgagatggagtctctctct

SEQ ID NO: 79682 - DNA, 22 bp, Artificial Sequence
  chemically synthesized
tttgagatggagtctctctctg

SEQ ID NO: 79683 - DNA, 22 bp, Artificial Sequence
  chemically synthesized
ttgagatggagtctctctctgt

SEQ ID NO: 79684 - DNA, 22 bp, Artificial Sequence
  chemically synthesized
tgagatggagtctctctctgtg

SEQ ID NO: 79685 - DNA, 22 bp, Artificial Sequence
  chemically synthesized
gagatggagtctctctctgtgg

SEQ ID NO: 79686 - DNA, 22 bp, Artificial Sequence
  chemically synthesized
agatggagtctctctctgtggt

SEQ ID NO: 79687 - DNA, 22 bp, Artificial Sequence
  chemically synthesized
tctctgtggtccaggctagagt

SEQ ID NO: 79688 - DNA, 22 bp, Artificial Sequence
  chemically synthesized
tctgtggtccaggctagagtga

SEQ ID NO: 79689 - DNA, 22 bp, Artificial Sequence
  chemically synthesized
tgtggtccaggctagagtgagg

SEQ ID NO: 79690 - DNA, 22 bp, Artificial Sequence
  chemically synthesized
tggtccaggctagagtgaggtg

SEQ ID NO: 79691 - DNA, 22 bp, Artificial Sequence
  chemically synthesized
gagtgaggtgacgcgatctcgg

SEQ ID NO: 79692 - DNA, 22 bp, Artificial Sequence
  chemically synthesized
ggctcactgcaacctccgcctc

SEQ ID NO: 79693 - DNA, 22 bp, Artificial Sequence
  chemically synthesized
actgcaacctccgcctccagaa

SEQ ID NO: 79694 - DNA, 22 bp, Artificial Sequence
  chemically synthesized
caacctccgcctccagaattca

SEQ ID NO: 79695 - DNA, 22 bp, Artificial Sequence
  chemically synthesized
cgcctccagaattcaaatcatt

SEQ ID NO: 79696 - DNA, 22 bp, Artificial Sequence
  chemically synthesized
cagaattcaaatcattctcctg

SEQ ID NO: 79697 - DNA, 22 bp, Artificial Sequence
  chemically synthesized
aaatcattctcctgcctcagcc

SEQ ID NO: 79698 - DNA, 22 bp, Artificial Sequence
  chemically synthesized
tcctgcctcagcctcccatgta

SEQ ID NO: 79699 - DNA, 22 bp, Artificial Sequence
  chemically synthesized
ctgcctcagcctcccatgtagc

SEQ ID NO: 79700 - DNA, 22 bp, Artificial Sequence
  chemically synthesized
cctcagcctcccatgtagctgg

SEQ ID NO: 79701 - DNA, 22 bp, Artificial Sequence
  chemically synthesized
agcctcccatgtagctgggatt

SEQ ID NO: 79702 - DNA, 22 bp, Artificial Sequence
  chemically synthesized
ccatgtagctgggattacaggt

SEQ ID NO: 79703 - DNA, 22 bp, Artificial Sequence
  chemically synthesized
ggattacaggtgtgcgccacca

SEQ ID NO: 79704 - DNA, 22 bp, Artificial Sequence
  chemically synthesized
caggtgtgcgccaccacgtctg

SEQ ID NO: 79705 - DNA, 22 bp, Artificial Sequence
  chemically synthesized
gcctctatcatcattttgaatg

SEQ ID NO: 79706 - DNA, 22 bp, Artificial Sequence
  chemically synthesized
tatcatcattttgaatgtgaca

SEQ ID NO: 79707 - DNA, 22 bp, Artificial Sequence
  chemically synthesized
tcatcattttgaatgtgacatt

SEQ ID NO: 79708 - DNA, 22 bp, Artificial Sequence
  chemically synthesized
tgaatgtgacatttttcccatt

SEQ ID NO: 79709 - DNA, 22 bp, Artificial Sequence
  chemically synthesized
gaatgtgacatttttcccattc

SEQ ID NO: 79710 - DNA, 22 bp, Artificial Sequence
  chemically synthesized
aatgtgacatttttcccattct

SEQ ID NO: 79711 - DNA, 22 bp, Artificial Sequence
  chemically synthesized
ttcccattctattttcctattg

SEQ ID NO: 79712 - DNA, 22 bp, Artificial Sequence
  chemically synthesized
tcccattctattttcctattgg

SEQ ID NO: 79713 - DNA, 22 bp, Artificial Sequence
  chemically synthesized
cccattctattttcctattggt

SEQ ID NO: 79714 - DNA, 22 bp, Artificial Sequence
  chemically synthesized
ccattctattttcctattggtt

SEQ ID NO: 79715 - DNA, 22 bp, Artificial Sequence
  chemically synthesized
tattttcctattggttcttgca

SEQ ID NO: 79716 - DNA, 22 bp, Artificial Sequence
  chemically synthesized
ttttcctattggttcttgcagt

SEQ ID NO: 79717 - DNA, 22 bp, Artificial Sequence
  chemically synthesized
tcctattggttcttgcagttgc

SEQ ID NO: 79718 - DNA, 22 bp, Artificial Sequence
  chemically synthesized
cctattggttcttgcagttgca

SEQ ID NO: 79719 - DNA, 22 bp, Artificial Sequence
  chemically synthesized
ctattggttcttgcagttgcat

SEQ ID NO: 79720 - DNA, 22 bp, Artificial Sequence
  chemically synthesized
ttggttcttgcagttgcataaa

SEQ ID NO: 79721 - DNA, 22 bp, Artificial Sequence
  chemically synthesized
gttcttgcagttgcataaaaca

SEQ ID NO: 79722 - DNA, 22 bp, Artificial Sequence
  chemically synthesized
ttgcagttgcataaaacattat

SEQ ID NO: 79723 - DNA, 22 bp, Artificial Sequence
  chemically synthesized
gcagttgcataaaacattattg

SEQ ID NO: 79724 - DNA, 22 bp, Artificial Sequence
  chemically synthesized
cagttgcataaaacattattga

SEQ ID NO: 79725 - DNA, 22 bp, Artificial Sequence
  chemically synthesized
cataaaacattattgattttta

SEQ ID NO: 79726 - DNA, 22 bp, Artificial Sequence
  chemically synthesized
ttgatttttatgttgtccttat

SEQ ID NO: 79727 - DNA, 22 bp, Artificial Sequence
  chemically synthesized
atttttatgttgtccttatata

SEQ ID NO: 79728 - DNA, 22 bp, Artificial Sequence
  chemically synthesized
ttatgttgtccttatataactc

SEQ ID NO: 79729 - DNA, 22 bp, Artificial Sequence
  chemically synthesized
tatgttgtccttatataactct

SEQ ID NO: 79730 - DNA, 22 bp, Artificial Sequence
  chemically synthesized
atgttgtccttatataactctt

SEQ ID NO: 79731 - DNA, 22 bp, Artificial Sequence
  chemically synthesized
tgttgtccttatataactcttt

SEQ ID NO: 79732 - DNA, 22 bp, Artificial Sequence
  chemically synthesized
tccttatataactctttttact

SEQ ID NO: 79733 - DNA, 22 bp, Artificial Sequence
  chemically synthesized
atataactctttttactttcag

SEQ ID NO: 79734 - DNA, 22 bp, Artificial Sequence
  chemically synthesized
tataactctttttactttcagg

SEQ ID NO: 79735 - DNA, 22 bp, Artificial Sequence
  chemically synthesized
tttttactttcaggtgacttat

SEQ ID NO: 79736 - DNA, 22 bp, Artificial Sequence
  chemically synthesized
tttactttcaggtgacttatac

SEQ ID NO: 79737 - DNA, 22 bp, Artificial Sequence
  chemically synthesized
ttactttcaggtgacttatact

SEQ ID NO: 79738 - DNA, 22 bp, Artificial Sequence
  chemically synthesized
tactttcaggtgacttatactt

SEQ ID NO: 79739 - DNA, 22 bp, Artificial Sequence
  chemically synthesized
actttcaggtgacttatactta

SEQ ID NO: 79740 - DNA, 22 bp, Artificial Sequence
  chemically synthesized
ctttcaggtgacttatacttaa

SEQ ID NO: 79741 - DNA, 22 bp, Artificial Sequence
  chemically synthesized
tcaggtgacttatacttaaatg

SEQ ID NO: 79742 - DNA, 22 bp, Artificial Sequence
  chemically synthesized
caggtgacttatacttaaatga

SEQ ID NO: 79743 - DNA, 22 bp, Artificial Sequence
  chemically synthesized
aggtgacttatacttaaatgat

SEQ ID NO: 79744 - DNA, 22 bp, Artificial Sequence
  chemically synthesized
atacttaaatgatcatatcata

SEQ ID NO: 79745 - DNA, 22 bp, Artificial Sequence
  chemically synthesized
tacttaaatgatcatatcatat

SEQ ID NO: 79746 - DNA, 22 bp, Artificial Sequence
  chemically synthesized
aaatgatcatatcatatacaaa

SEQ ID NO: 79747 - DNA, 22 bp, Artificial Sequence
  chemically synthesized
aatgatcatatcatatacaaaa

SEQ ID NO: 79748 - DNA, 22 bp, Artificial Sequence
  chemically synthesized
aaaaataaaggcaaagatgtaa

SEQ ID NO: 79749 - DNA, 22 bp, Artificial Sequence
  chemically synthesized
caatttggtcttttttctcccc

SEQ ID NO: 79750 - DNA, 22 bp, Artificial Sequence
  chemically synthesized
ggtcttttttctccccccgaaa

SEQ ID NO: 79751 - DNA, 22 bp, Artificial Sequence
  chemically synthesized
gtcttttttctccccccgaaat

SEQ ID NO: 79752 - DNA, 22 bp, Artificial Sequence
  chemically synthesized
ttttctccccccgaaatcaaaa

SEQ ID NO: 79753 - DNA, 22 bp, Artificial Sequence
  chemically synthesized
tttctccccccgaaatcaaaat

SEQ ID NO: 79754 - DNA, 22 bp, Artificial Sequence
  chemically synthesized
ttctccccccgaaatcaaaatt

SEQ ID NO: 79755 - DNA, 22 bp, Artificial Sequence
  chemically synthesized
tctccccccgaaatcaaaattt

SEQ ID NO: 79756 - DNA, 22 bp, Artificial Sequence
  chemically synthesized
ctccccccgaaatcaaaatttt

SEQ ID NO: 79757 - DNA, 22 bp, Artificial Sequence
  chemically synthesized
tccccccgaaatcaaaattttg

SEQ ID NO: 79758 - DNA, 22 bp, Artificial Sequence
  chemically synthesized
cccccgaaatcaaaattttgct

SEQ ID NO: 79759 - DNA, 22 bp, Artificial Sequence
  chemically synthesized
tgcttgattgatattaactaag

SEQ ID NO: 79760 - DNA, 22 bp, Artificial Sequence
  chemically synthesized
gcttgattgatattaactaaga

SEQ ID NO: 79761 - DNA, 22 bp, Artificial Sequence
  chemically synthesized
cttgattgatattaactaagac

SEQ ID NO: 79762 - DNA, 22 bp, Artificial Sequence
  chemically synthesized
gattgatattaactaagacctc

SEQ ID NO: 79763 - DNA, 22 bp, Artificial Sequence
  chemically synthesized
attgatattaactaagacctca

SEQ ID NO: 79764 - DNA, 22 bp, Artificial Sequence
  chemically synthesized
atattaactaagacctcagtta

SEQ ID NO: 79765 - DNA, 22 bp, Artificial Sequence
  chemically synthesized
actaagacctcagttataaaac

SEQ ID NO: 79766 - DNA, 22 bp, Artificial Sequence
  chemically synthesized
agacctcagttataaaacaata

SEQ ID NO: 79767 - DNA, 22 bp, Artificial Sequence
  chemically synthesized
agttataaaacaatagtctgta

SEQ ID NO: 79768 - DNA, 22 bp, Artificial Sequence
  chemically synthesized
taaaacaatagtctgtagtggt

SEQ ID NO: 79769 - DNA, 22 bp, Artificial Sequence
  chemically synthesized
tagtggtactggtcttggatct

SEQ ID NO: 79770 - DNA, 22 bp, Artificial Sequence
  chemically synthesized
gtcttggatctcttgctcattt

SEQ ID NO: 79771 - DNA, 22 bp, Artificial Sequence
  chemically synthesized
ggatctcttgctcatttgaaat

SEQ ID NO: 79772 - DNA, 22 bp, Artificial Sequence
  chemically synthesized
gatctcttgctcatttgaaata

SEQ ID NO: 79773 - DNA, 22 bp, Artificial Sequence
  chemically synthesized
ttgctcatttgaaatactattc

SEQ ID NO: 79774 - DNA, 22 bp, Artificial Sequence
  chemically synthesized
gctcatttgaaatactattctc

SEQ ID NO: 79775 - DNA, 22 bp, Artificial Sequence
  chemically synthesized
ctcatttgaaatactattctca

SEQ ID NO: 79776 - DNA, 22 bp, Artificial Sequence
  chemically synthesized
atttgaaatactattctcacct

SEQ ID NO: 79777 - DNA, 22 bp, Artificial Sequence
  chemically synthesized
gaaatactattctcaccttatc

SEQ ID NO: 79778 - DNA, 22 bp, Artificial Sequence
  chemically synthesized
aaatactattctcaccttatca

SEQ ID NO: 79779 - DNA, 22 bp, Artificial Sequence
  chemically synthesized
ttctcaccttatcaatcactta

SEQ ID NO: 79780 - DNA, 22 bp, Artificial Sequence
  chemically synthesized
tcaccttatcaatcacttagca

SEQ ID NO: 79781 - DNA, 22 bp, Artificial Sequence
  chemically synthesized
accttatcaatcacttagcacc

SEQ ID NO: 79782 - DNA, 22 bp, Artificial Sequence
  chemically synthesized
atcaatcacttagcaccctgta

SEQ ID NO: 79783 - DNA, 22 bp, Artificial Sequence
  chemically synthesized
tcaatcacttagcaccctgtac

SEQ ID NO: 79784 - DNA, 22 bp, Artificial Sequence
  chemically synthesized
agcaccctgtaccttttgtttt

SEQ ID NO: 79785 - DNA, 22 bp, Artificial Sequence
  chemically synthesized
gcaccctgtaccttttgttttt

SEQ ID NO: 79786 - DNA, 22 bp, Artificial Sequence
  chemically synthesized
taccttttgttttttgtttttg

SEQ ID NO: 79787 - DNA, 22 bp, Artificial Sequence
  chemically synthesized
ttgttttttgtttttgctaatt

SEQ ID NO: 79788 - DNA, 22 bp, Artificial Sequence
  chemically synthesized
tgttttttgtttttgctaattc

SEQ ID NO: 79789 - DNA, 22 bp, Artificial Sequence
  chemically synthesized
gttttttgtttttgctaattct

SEQ ID NO: 79790 - DNA, 22 bp, Artificial Sequence
  chemically synthesized
ttttttgtttttgctaattctg

SEQ ID NO: 79791 - DNA, 22 bp, Artificial Sequence
  chemically synthesized
tttgtttttgctaattctgtct

SEQ ID NO: 79792 - DNA, 22 bp, Artificial Sequence
  chemically synthesized
ttgtttttgctaattctgtcta

SEQ ID NO: 79793 - DNA, 22 bp, Artificial Sequence
  chemically synthesized
tgtttttgctaattctgtctag

SEQ ID NO: 79794 - DNA, 22 bp, Artificial Sequence
  chemically synthesized
gtttttgctaattctgtctaga

SEQ ID NO: 79795 - DNA, 22 bp, Artificial Sequence
  chemically synthesized
tttttgctaattctgtctagaa

SEQ ID NO: 79796 - DNA, 22 bp, Artificial Sequence
  chemically synthesized
ttgctaattctgtctagaacac

SEQ ID NO: 79797 - DNA, 22 bp, Artificial Sequence
  chemically synthesized
tgctaattctgtctagaacacc

SEQ ID NO: 79798 - DNA, 22 bp, Artificial Sequence
  chemically synthesized
gctaattctgtctagaacacca

SEQ ID NO: 79799 - DNA, 22 bp, Artificial Sequence
  chemically synthesized
ctaattctgtctagaacaccat

SEQ ID NO: 79800 - DNA, 22 bp, Artificial Sequence
  chemically synthesized
attctgtctagaacaccatatc

SEQ ID NO: 79801 - DNA, 22 bp, Artificial Sequence
  chemically synthesized
tgtctagaacaccatatcagtt

SEQ ID NO: 79802 - DNA, 22 bp, Artificial Sequence
  chemically synthesized
tctagaacaccatatcagtttt

SEQ ID NO: 79803 - DNA, 22 bp, Artificial Sequence
  chemically synthesized
gaacaccatatcagttttagct

SEQ ID NO: 79804 - DNA, 22 bp, Artificial Sequence
  chemically synthesized
tagctaagtgcttccaaaactc

SEQ ID NO: 79805 - DNA, 22 bp, Artificial Sequence
  chemically synthesized
agctaagtgcttccaaaactcc

SEQ ID NO: 79806 - DNA, 22 bp, Artificial Sequence
  chemically synthesized
gctaagtgcttccaaaactccc

SEQ ID NO: 79807 - DNA, 22 bp, Artificial Sequence
  chemically synthesized
agtgcttccaaaactccctgct

SEQ ID NO: 79808 - DNA, 22 bp, Artificial Sequence
  chemically synthesized
ccaaaactccctgctttaaaat

SEQ ID NO: 79809 - DNA, 22 bp, Artificial Sequence
  chemically synthesized
caaaactccctgctttaaaatt

SEQ ID NO: 79810 - DNA, 22 bp, Artificial Sequence
  chemically synthesized
cctgctttaaaattgtttggtt

SEQ ID NO: 79811 - DNA, 22 bp, Artificial Sequence
  chemically synthesized
ctttaaaattgtttggtttctg

SEQ ID NO: 79812 - DNA, 22 bp, Artificial Sequence
  chemically synthesized
taaaattgtttggtttctgccc

SEQ ID NO: 79813 - DNA, 22 bp, Artificial Sequence
  chemically synthesized
aaaattgtttggtttctgccct

SEQ ID NO: 79814 - DNA, 22 bp, Artificial Sequence
  chemically synthesized
aaattgtttggtttctgccctt

SEQ ID NO: 79815 - DNA, 22 bp, Artificial Sequence
  chemically synthesized
tttggtttctgcccttttttgg

SEQ ID NO: 79816 - DNA, 22 bp, Artificial Sequence
  chemically synthesized
ggtttctgcccttttttggacc

SEQ ID NO: 79817 - DNA, 22 bp, Artificial Sequence
  chemically synthesized
gtttctgcccttttttggacct

SEQ ID NO: 79818 - DNA, 22 bp, Artificial Sequence
  chemically synthesized
ctgcccttttttggacctttcc

SEQ ID NO: 79819 - DNA, 22 bp, Artificial Sequence
  chemically synthesized
tgcccttttttggacctttcct

SEQ ID NO: 79820 - DNA, 22 bp, Artificial Sequence
  chemically synthesized
cccttttttggacctttccttt

SEQ ID NO: 79821 - DNA, 22 bp, Artificial Sequence
  chemically synthesized
ttttggacctttcctttccttt

SEQ ID NO: 79822 - DNA, 22 bp, Artificial Sequence
  chemically synthesized
tttggacctttcctttcctttc

SEQ ID NO: 79823 - DNA, 22 bp, Artificial Sequence
  chemically synthesized
ttggacctttcctttcctttcc

SEQ ID NO: 79824 - DNA, 22 bp, Artificial Sequence
  chemically synthesized
tggacctttcctttcctttcct

SEQ ID NO: 79825 - DNA, 22 bp, Artificial Sequence
  chemically synthesized
ggacctttcctttcctttcctt

SEQ ID NO: 79826 - DNA, 22 bp, Artificial Sequence
  chemically synthesized
gacctttcctttcctttccttt

SEQ ID NO: 79827 - DNA, 22 bp, Artificial Sequence
  chemically synthesized
tcctttcctttcctttcctttc

SEQ ID NO: 79828 - DNA, 22 bp, Artificial Sequence
  chemically synthesized
cctttcctttcctttcctttcc

SEQ ID NO: 79829 - DNA, 22 bp, Artificial Sequence
  chemically synthesized
ctttcctttcctttcctttcct

SEQ ID NO: 79830 - DNA, 22 bp, Artificial Sequence
  chemically synthesized
tcctttcctttcctttcctttc

SEQ ID NO: 79831 - DNA, 22 bp, Artificial Sequence
  chemically synthesized
cctttcctttcctttcctttcc

SEQ ID NO: 79832 - DNA, 22 bp, Artificial Sequence
  chemically synthesized
ctttcctttcctttcctttcct

SEQ ID NO: 79833 - DNA, 22 bp, Artificial Sequence
  chemically synthesized
tcctttcctttcctttcctttc

SEQ ID NO: 79834 - DNA, 22 bp, Artificial Sequence
  chemically synthesized
cctttcctttcctttcctttcc

SEQ ID NO: 79835 - DNA, 22 bp, Artificial Sequence
  chemically synthesized
ctttcctttcctttcctttcct

SEQ ID NO: 79836 - DNA, 22 bp, Artificial Sequence
  chemically synthesized
tcctttcctttcctttcctttc

SEQ ID NO: 79837 - DNA, 22 bp, Artificial Sequence
  chemically synthesized
cctttcctttcctttcctttcc

SEQ ID NO: 79838 - DNA, 22 bp, Artificial Sequence
  chemically synthesized
ctttcctttcctttcctttcct

SEQ ID NO: 79839 - DNA, 22 bp, Artificial Sequence
  chemically synthesized
tcctttcctttcctttcctttt

SEQ ID NO: 79840 - DNA, 22 bp, Artificial Sequence
  chemically synthesized
cctttcctttcctttccttttt

SEQ ID NO: 79841 - DNA, 22 bp, Artificial Sequence
  chemically synthesized
ctttcctttcctttcctttttc

SEQ ID NO: 79842 - DNA, 22 bp, Artificial Sequence
  chemically synthesized
tcctttcctttcctttttcctt

SEQ ID NO: 79843 - DNA, 22 bp, Artificial Sequence
  chemically synthesized
cctttcctttcctttttccttt

SEQ ID NO: 79844 - DNA, 22 bp, Artificial Sequence
  chemically synthesized
ctttcctttcctttttcctttc

SEQ ID NO: 79845 - DNA, 22 bp, Artificial Sequence
  chemically synthesized
tcctttcctttttcctttcctt

SEQ ID NO: 79846 - DNA, 22 bp, Artificial Sequence
  chemically synthesized
cctttcctttttcctttccttt

SEQ ID NO: 79847 - DNA, 22 bp, Artificial Sequence
  chemically synthesized
ctttcctttttcctttcctttc

SEQ ID NO: 79848 - DNA, 22 bp, Artificial Sequence
  chemically synthesized
tcctttttcctttcctttcctt

SEQ ID NO: 79849 - DNA, 22 bp, Artificial Sequence
  chemically synthesized
cctttttcctttcctttccttc

SEQ ID NO: 79850 - DNA, 22 bp, Artificial Sequence
  chemically synthesized
ctttttcctttcctttccttcc

SEQ ID NO: 79851 - DNA, 22 bp, Artificial Sequence
  chemically synthesized
tttcctttcctttccttccctt

SEQ ID NO: 79852 - DNA, 22 bp, Artificial Sequence
  chemically synthesized
ttcctttcctttccttcccttc

SEQ ID NO: 79853 - DNA, 22 bp, Artificial Sequence
  chemically synthesized
tcctttcctttccttcccttcc

SEQ ID NO: 79854 - DNA, 22 bp, Artificial Sequence
  chemically synthesized
cctttcctttccttcccttccc

SEQ ID NO: 79855 - DNA, 22 bp, Artificial Sequence
  chemically synthesized
ctttcctttccttcccttccct

SEQ ID NO: 79856 - DNA, 22 bp, Artificial Sequence
  chemically synthesized
tcctttccttcccttccctttc

SEQ ID NO: 79857 - DNA, 22 bp, Artificial Sequence
  chemically synthesized
cctttccttcccttccctttcc

SEQ ID NO: 79858 - DNA, 22 bp, Artificial Sequence
  chemically synthesized
ctttccttcccttccctttcct

SEQ ID NO: 79859 - DNA, 22 bp, Artificial Sequence
  chemically synthesized
tccttcccttccctttcctttc

SEQ ID NO: 79860 - DNA, 22 bp, Artificial Sequence
  chemically synthesized
ccttcccttccctttcctttcc

SEQ ID NO: 79861 - DNA, 22 bp, Artificial Sequence
  chemically synthesized
cttcccttccctttcctttccc

SEQ ID NO: 79862 - DNA, 22 bp, Artificial Sequence
  chemically synthesized
cccttccctttcctttcccttc

SEQ ID NO: 79863 - DNA, 22 bp, Artificial Sequence
  chemically synthesized
ccttccctttcctttcccttcc

SEQ ID NO: 79864 - DNA, 22 bp, Artificial Sequence
  chemically synthesized
ccctttcctttcccttccctcc

SEQ ID NO: 79865 - DNA, 22 bp, Artificial Sequence
  chemically synthesized
cctttcctttcccttccctccc

SEQ ID NO: 79866 - DNA, 22 bp, Artificial Sequence
  chemically synthesized
tcctttcccttccctccctttc

SEQ ID NO: 79867 - DNA, 22 bp, Artificial Sequence
  chemically synthesized
cctttcccttccctccctttcc

SEQ ID NO: 79868 - DNA, 22 bp, Artificial Sequence
  chemically synthesized
ctttcccttccctccctttccc

SEQ ID NO: 79869 - DNA, 22 bp, Artificial Sequence
  chemically synthesized
tcccttccctccctttcccttt

SEQ ID NO: 79870 - DNA, 22 bp, Artificial Sequence
  chemically synthesized
cccttccctccctttccctttc

SEQ ID NO: 79871 - DNA, 22 bp, Artificial Sequence
  chemically synthesized
ccttccctccctttccctttcc

SEQ ID NO: 79872 - DNA, 22 bp, Artificial Sequence
  chemically synthesized
ccctccctttccctttcccttt

SEQ ID NO: 79873 - DNA, 22 bp, Artificial Sequence
  chemically synthesized
cctccctttccctttccctttc

SEQ ID NO: 79874 - DNA, 22 bp, Artificial Sequence
  chemically synthesized
cctttccctttccctttccctt

SEQ ID NO: 79875 - DNA, 22 bp, Artificial Sequence
  chemically synthesized
tccctttccctttccctttccc

SEQ ID NO: 79876 - DNA, 22 bp, Artificial Sequence
  chemically synthesized
ccctttccctttccctttccct

SEQ ID NO: 79877 - DNA, 22 bp, Artificial Sequence
  chemically synthesized
cctttccctttccctttccctt

SEQ ID NO: 79878 - DNA, 22 bp, Artificial Sequence
  chemically synthesized
tccctttccctttccctttccc

SEQ ID NO: 79879 - DNA, 22 bp, Artificial Sequence
  chemically synthesized
ccctttccctttccctttccct

SEQ ID NO: 79880 - DNA, 22 bp, Artificial Sequence
  chemically synthesized
cctttccctttccctttccctt

SEQ ID NO: 79881 - DNA, 22 bp, Artificial Sequence
  chemically synthesized
tccctttccctttccctttccc

SEQ ID NO: 79882 - DNA, 22 bp, Artificial Sequence
  chemically synthesized
ccctttccctttccctttccct

SEQ ID NO: 79883 - DNA, 22 bp, Artificial Sequence
  chemically synthesized
cctttccctttccctttccctt

SEQ ID NO: 79884 - DNA, 22 bp, Artificial Sequence
  chemically synthesized
tccctttccctttcccttcctg

SEQ ID NO: 79885 - DNA, 22 bp, Artificial Sequence
  chemically synthesized
ccctttccctttcccttcctgc

SEQ ID NO: 79886 - DNA, 22 bp, Artificial Sequence
  chemically synthesized
cctttccctttcccttcctgct

SEQ ID NO: 79887 - DNA, 22 bp, Artificial Sequence
  chemically synthesized
tccctttcccttcctgctgaag

SEQ ID NO: 79888 - DNA, 22 bp, Artificial Sequence
  chemically synthesized
ccctttcccttcctgctgaagg

SEQ ID NO: 79889 - DNA, 22 bp, Artificial Sequence
  chemically synthesized
cctttcccttcctgctgaagga

SEQ ID NO: 79890 - DNA, 22 bp, Artificial Sequence
  chemically synthesized
tcccttcctgctgaaggattac

SEQ ID NO: 79891 - DNA, 22 bp, Artificial Sequence
  chemically synthesized
cccttcctgctgaaggattact

SEQ ID NO: 79892 - DNA, 22 bp, Artificial Sequence
  chemically synthesized
ccttcctgctgaaggattactg

SEQ ID NO: 79893 - DNA, 22 bp, Artificial Sequence
  chemically synthesized
cctgctgaaggattactggtta

SEQ ID NO: 79894 - DNA, 22 bp, Artificial Sequence
  chemically synthesized
ctgctgaaggattactggttaa

SEQ ID NO: 79895 - DNA, 22 bp, Artificial Sequence
  chemically synthesized
ctgaaggattactggttaagga

SEQ ID NO: 79896 - DNA, 22 bp, Artificial Sequence
  chemically synthesized
aaggattactggttaaggagac

SEQ ID NO: 79897 - DNA, 22 bp, Artificial Sequence
  chemically synthesized
ctggttaaggagacagtagaac

SEQ ID NO: 79898 - DNA, 22 bp, Artificial Sequence
  chemically synthesized
gttaaggagacagtagaacatg

SEQ ID NO: 79899 - DNA, 22 bp, Artificial Sequence
  chemically synthesized
aggagacagtagaacatgaaaa

SEQ ID NO: 79900 - DNA, 22 bp, Artificial Sequence
  chemically synthesized
cttctcatgtccagggcaatgg

SEQ ID NO: 79901 - DNA, 22 bp, Artificial Sequence
  chemically synthesized
ttctcatgtccagggcaatggc

SEQ ID NO: 79902 - DNA, 22 bp, Artificial Sequence
  chemically synthesized
ctcatgtccagggcaatggctc

SEQ ID NO: 79903 - DNA, 22 bp, Artificial Sequence
  chemically synthesized
tcatgtccagggcaatggctca

SEQ ID NO: 79904 - DNA, 22 bp, Artificial Sequence
  chemically synthesized
atgtccagggcaatggctcagt

SEQ ID NO: 79905 - DNA, 22 bp, Artificial Sequence
  chemically synthesized
agtaatgttaaattcagcagct

SEQ ID NO: 79906 - DNA, 22 bp, Artificial Sequence
  chemically synthesized
aattcagcagctgcatagcaac

SEQ ID NO: 79907 - DNA, 22 bp, Artificial Sequence
  chemically synthesized
agcagctgcatagcaacagcca

SEQ ID NO: 79908 - DNA, 22 bp, Artificial Sequence
  chemically synthesized
catagcaacagccatttcctaa

SEQ ID NO: 79909 - DNA, 22 bp, Artificial Sequence
  chemically synthesized
cctaaatcctttcagaatctga

SEQ ID NO: 79910 - DNA, 22 bp, Artificial Sequence
  chemically synthesized
ctaaatcctttcagaatctgag

SEQ ID NO: 79911 - DNA, 22 bp, Artificial Sequence
  chemically synthesized
aatcctttcagaatctgagtgc

SEQ ID NO: 79912 - DNA, 22 bp, Artificial Sequence
  chemically synthesized
tcagaatctgagtgctcaactg

SEQ ID NO: 79913 - DNA, 22 bp, Artificial Sequence
  chemically synthesized
cagaatctgagtgctcaactga

SEQ ID NO: 79914 - DNA, 22 bp, Artificial Sequence
  chemically synthesized
agaatctgagtgctcaactgaa

SEQ ID NO: 79915 - DNA, 22 bp, Artificial Sequence
  chemically synthesized
agtgctcaactgaaagtttatt

SEQ ID NO: 79916 - DNA, 22 bp, Artificial Sequence
  chemically synthesized
aactgaaagtttatttagagat

SEQ ID NO: 79917 - DNA, 22 bp, Artificial Sequence
  chemically synthesized
aaagtttatttagagattgtaa

SEQ ID NO: 79918 - DNA, 22 bp, Artificial Sequence
  chemically synthesized
atttagagattgtaaattcaat

SEQ ID NO: 79919 - DNA, 22 bp, Artificial Sequence
  chemically synthesized
tttagagattgtaaattcaatc

SEQ ID NO: 79920 - DNA, 22 bp, Artificial Sequence
  chemically synthesized
agagattgtaaattcaatcatt

SEQ ID NO: 79921 - DNA, 22 bp, Artificial Sequence
  chemically synthesized
gagattgtaaattcaatcattt

SEQ ID NO: 79922 - DNA, 22 bp, Artificial Sequence
  chemically synthesized
taaattcaatcatttttacttc

SEQ ID NO: 79923 - DNA, 22 bp, Artificial Sequence
  chemically synthesized
aatcatttttacttctaccatt

SEQ ID NO: 79924 - DNA, 22 bp, Artificial Sequence
  chemically synthesized
ttacttctaccattttaactgt

SEQ ID NO: 79925 - DNA, 22 bp, Artificial Sequence
  chemically synthesized
tacttctaccattttaactgtc

SEQ ID NO: 79926 - DNA, 22 bp, Artificial Sequence
  chemically synthesized
acttctaccattttaactgtca

SEQ ID NO: 79927 - DNA, 22 bp, Artificial Sequence
  chemically synthesized
cttctaccattttaactgtcaa

SEQ ID NO: 79928 - DNA, 22 bp, Artificial Sequence
  chemically synthesized
ctaccattttaactgtcaaaat

SEQ ID NO: 79929 - DNA, 22 bp, Artificial Sequence
  chemically synthesized
taccattttaactgtcaaaatg

SEQ ID NO: 79930 - DNA, 22 bp, Artificial Sequence
  chemically synthesized
ccattttaactgtcaaaatgac

SEQ ID NO: 79931 - DNA, 22 bp, Artificial Sequence
  chemically synthesized
taactgtcaaaatgacatgtat

SEQ ID NO: 79932 - DNA, 22 bp, Artificial Sequence
  chemically synthesized
aactgtcaaaatgacatgtata

SEQ ID NO: 79933 - DNA, 22 bp, Artificial Sequence
  chemically synthesized
actgtcaaaatgacatgtatat

SEQ ID NO: 79934 - DNA, 22 bp, Artificial Sequence
  chemically synthesized
tcaaaatgacatgtatatgtta

SEQ ID NO: 79935 - DNA, 22 bp, Artificial Sequence
  chemically synthesized
ctgtgtagctatatatgtatat

SEQ ID NO: 79936 - DNA, 22 bp, Artificial Sequence
  chemically synthesized
tgtagctatatatgtatatatg

SEQ ID NO: 79937 - DNA, 22 bp, Artificial Sequence
  chemically synthesized
tatatgtatatatgattatata

SEQ ID NO: 79938 - DNA, 22 bp, Artificial Sequence
  chemically synthesized
tatatattcatatacctattta

SEQ ID NO: 79939 - DNA, 22 bp, Artificial Sequence
  chemically synthesized
atatacctatttaagatatcat

SEQ ID NO: 79940 - DNA, 22 bp, Artificial Sequence
  chemically synthesized
tttaagatatcatgttgcatgc

SEQ ID NO: 79941 - DNA, 22 bp, Artificial Sequence
  chemically synthesized
aagatatcatgttgcatgcatt

SEQ ID NO: 79942 - DNA, 22 bp, Artificial Sequence
  chemically synthesized
agatatcatgttgcatgcattt

SEQ ID NO: 79943 - DNA, 22 bp, Artificial Sequence
  chemically synthesized
catgcattttggatgtgaaatt

SEQ ID NO: 79944 - DNA, 22 bp, Artificial Sequence
  chemically synthesized
tggatgtgaaattggcattttc

SEQ ID NO: 79945 - DNA, 22 bp, Artificial Sequence
  chemically synthesized
ggatgtgaaattggcattttct

SEQ ID NO: 79946 - DNA, 22 bp, Artificial Sequence
  chemically synthesized
gatgtgaaattggcattttctt

SEQ ID NO: 79947 - DNA, 22 bp, Artificial Sequence
  chemically synthesized
gcattttcttagctccccactg

SEQ ID NO: 79948 - DNA, 22 bp, Artificial Sequence
  chemically synthesized
tcttagctccccactgctaaaa

SEQ ID NO: 79949 - DNA, 22 bp, Artificial Sequence
  chemically synthesized
cttagctccccactgctaaaat

SEQ ID NO: 79950 - DNA, 22 bp, Artificial Sequence
  chemically synthesized
ttagctccccactgctaaaatc

SEQ ID NO: 79951 - DNA, 22 bp, Artificial Sequence
  chemically synthesized
agctccccactgctaaaatcaa

SEQ ID NO: 79952 - DNA, 22 bp, Artificial Sequence
  chemically synthesized
gctccccactgctaaaatcaag

SEQ ID NO: 79953 - DNA, 22 bp, Artificial Sequence
  chemically synthesized
cccactgctaaaatcaagtata

SEQ ID NO: 79954 - DNA, 22 bp, Artificial Sequence
  chemically synthesized
ctaaaatcaagtatacaaaatc

SEQ ID NO: 79955 - DNA, 22 bp, Artificial Sequence
  chemically synthesized
aaatcaagtatacaaaatcttc

SEQ ID NO: 79956 - DNA, 22 bp, Artificial Sequence
  chemically synthesized
cctacctttcagtcaaatcctc

SEQ ID NO: 79957 - DNA, 22 bp, Artificial Sequence
  chemically synthesized
ctacctttcagtcaaatcctct

SEQ ID NO: 79958 - DNA, 22 bp, Artificial Sequence
  chemically synthesized
cctttcagtcaaatcctctgtc

SEQ ID NO: 79959 - DNA, 22 bp, Artificial Sequence
  chemically synthesized
tcagtcaaatcctctgtcatca

SEQ ID NO: 79960 - DNA, 22 bp, Artificial Sequence
  chemically synthesized
cagtcaaatcctctgtcatcat

SEQ ID NO: 79961 - DNA, 22 bp, Artificial Sequence
  chemically synthesized
agtcaaatcctctgtcatcata

SEQ ID NO: 79962 - DNA, 22 bp, Artificial Sequence
  chemically synthesized
tgtcatcatactgcaatctatc

SEQ ID NO: 79963 - DNA, 22 bp, Artificial Sequence
  chemically synthesized
tcatcatactgcaatctatcta

SEQ ID NO: 79964 - DNA, 22 bp, Artificial Sequence
  chemically synthesized
caatctatctattccctcattt

SEQ ID NO: 79965 - DNA, 22 bp, Artificial Sequence
  chemically synthesized
tctattccctcattttccatca

SEQ ID NO: 79966 - DNA, 22 bp, Artificial Sequence
  chemically synthesized
ttccctcattttccatcatatt

SEQ ID NO: 79967 - DNA, 22 bp, Artificial Sequence
  chemically synthesized
cctcattttccatcatattatt

SEQ ID NO: 79968 - DNA, 22 bp, Artificial Sequence
  chemically synthesized
attttccatcatattattactt

SEQ ID NO: 79969 - DNA, 22 bp, Artificial Sequence
  chemically synthesized
tccatcatattattacttttat

SEQ ID NO: 79970 - DNA, 22 bp, Artificial Sequence
  chemically synthesized
ccatcatattattacttttatg

SEQ ID NO: 79971 - DNA, 22 bp, Artificial Sequence
  chemically synthesized
catcatattattacttttatgg

SEQ ID NO: 79972 - DNA, 22 bp, Artificial Sequence
  chemically synthesized
ttacttttatggagaaatgcaa

SEQ ID NO: 79973 - DNA, 22 bp, Artificial Sequence
  chemically synthesized
cttttatggagaaatgcaacgc

SEQ ID NO: 79974 - DNA, 22 bp, Artificial Sequence
  chemically synthesized
ttatggagaaatgcaacgctga

SEQ ID NO: 79975 - DNA, 22 bp, Artificial Sequence
  chemically synthesized
tatggagaaatgcaacgctgag

SEQ ID NO: 79976 - DNA, 22 bp, Artificial Sequence
  chemically synthesized
atggagaaatgcaacgctgagt

SEQ ID NO: 79977 - DNA, 22 bp, Artificial Sequence
  chemically synthesized
tggagaaatgcaacgctgagtg

SEQ ID NO: 79978 - DNA, 22 bp, Artificial Sequence
  chemically synthesized
agtgtaaatttcacattagaat

SEQ ID NO: 79979 - DNA, 22 bp, Artificial Sequence
  chemically synthesized
cacattagaatgtccaaaacat

SEQ ID NO: 79980 - DNA, 22 bp, Artificial Sequence
  chemically synthesized
acattagaatgtccaaaacatt

SEQ ID NO: 79981 - DNA, 22 bp, Artificial Sequence
  chemically synthesized
gaatgtccaaaacattgtgtag

SEQ ID NO: 79982 - DNA, 22 bp, Artificial Sequence
  chemically synthesized
tgtagagtagaaaaaaaaacta

SEQ ID NO: 79983 - DNA, 22 bp, Artificial Sequence
  chemically synthesized
tatgaagtttaacagatgtact

SEQ ID NO: 79984 - DNA, 22 bp, Artificial Sequence
  chemically synthesized
aacagatgtactgagaaatgca

SEQ ID NO: 79985 - DNA, 22 bp, Artificial Sequence
  chemically synthesized
acagatgtactgagaaatgcaa

SEQ ID NO: 79986 - DNA, 22 bp, Artificial Sequence
  chemically synthesized
agaaatgcaaatattttgaaga

SEQ ID NO: 79987 - DNA, 22 bp, Artificial Sequence
  chemically synthesized
tgaagacaattcaaaatagcac

SEQ ID NO: 79988 - DNA, 22 bp, Artificial Sequence
  chemically synthesized
gaagacaattcaaaatagcact

SEQ ID NO: 79989 - DNA, 22 bp, Artificial Sequence
  chemically synthesized
aagacaattcaaaatagcactt

SEQ ID NO: 79990 - DNA, 22 bp, Artificial Sequence
  chemically synthesized
aaaatagcacttaaatatttag

SEQ ID NO: 79991 - DNA, 22 bp, Artificial Sequence
  chemically synthesized
aaatatttagtgtagtactagc

SEQ ID NO: 79992 - DNA, 22 bp, Artificial Sequence
  chemically synthesized
aatatttagtgtagtactagca

SEQ ID NO: 79993 - DNA, 22 bp, Artificial Sequence
  chemically synthesized
agtgtagtactagcagaaacaa

SEQ ID NO: 79994 - DNA, 22 bp, Artificial Sequence
  chemically synthesized
gtgtagtactagcagaaacaaa

SEQ ID NO: 79995 - DNA, 22 bp, Artificial Sequence
  chemically synthesized
gcagaaacaaattaattagatt

SEQ ID NO: 79996 - DNA, 22 bp, Artificial Sequence
  chemically synthesized
attagattttttagaatgtttt

SEQ ID NO: 79997 - DNA, 22 bp, Artificial Sequence
  chemically synthesized
gattttttagaatgttttatgt

SEQ ID NO: 79998 - DNA, 22 bp, Artificial Sequence
  chemically synthesized
tttagaatgttttatgtattct

SEQ ID NO: 79999 - DNA, 22 bp, Artificial Sequence
  chemically synthesized
ttagaatgttttatgtattctc

SEQ ID NO: 80000 - DNA, 22 bp, Artificial Sequence
  chemically synthesized
tagaatgttttatgtattctcc

SEQ ID NO: 80001 - DNA, 22 bp, Artificial Sequence
  chemically synthesized
agaatgttttatgtattctccc

SEQ ID NO: 80002 - DNA, 22 bp, Artificial Sequence
  chemically synthesized
gaatgttttatgtattctccct

SEQ ID NO: 80003 - DNA, 22 bp, Artificial Sequence
  chemically synthesized
tatgtattctcccttcccaata

SEQ ID NO: 80004 - DNA, 22 bp, Artificial Sequence
  chemically synthesized
atgtattctcccttcccaataa

SEQ ID NO: 80005 - DNA, 22 bp, Artificial Sequence
  chemically synthesized
tgtattctcccttcccaataat

SEQ ID NO: 80006 - DNA, 22 bp, Artificial Sequence
  chemically synthesized
tcccttcccaataatggaaata

SEQ ID NO: 80007 - DNA, 22 bp, Artificial Sequence
  chemically synthesized
ccttcccaataatggaaatact

SEQ ID NO: 80008 - DNA, 22 bp, Artificial Sequence
  chemically synthesized
cccaataatggaaatactgtag

SEQ ID NO: 80009 - DNA, 22 bp, Artificial Sequence
  chemically synthesized
ccaataatggaaatactgtagg

SEQ ID NO: 80010 - DNA, 22 bp, Artificial Sequence
  chemically synthesized
taggaagtctatttctaacttt

SEQ ID NO: 80011 - DNA, 22 bp, Artificial Sequence
  chemically synthesized
tttctaactttcttattctttg

SEQ ID NO: 80012 - DNA, 22 bp, Artificial Sequence
  chemically synthesized
ctaactttcttattctttggtg

SEQ ID NO: 80013 - DNA, 22 bp, Artificial Sequence
  chemically synthesized
taactttcttattctttggtgc

SEQ ID NO: 80014 - DNA, 22 bp, Artificial Sequence
  chemically synthesized
actttcttattctttggtgcac

SEQ ID NO: 80015 - DNA, 22 bp, Artificial Sequence
  chemically synthesized
tcttattctttggtgcacaaac

SEQ ID NO: 80016 - DNA, 22 bp, Artificial Sequence
  chemically synthesized
cttattctttggtgcacaaacg

SEQ ID NO: 80017 - DNA, 22 bp, Artificial Sequence
  chemically synthesized
ttattctttggtgcacaaacgt

SEQ ID NO: 80018 - DNA, 22 bp, Artificial Sequence
  chemically synthesized
attctttggtgcacaaacgtgt

SEQ ID NO: 80019 - DNA, 22 bp, Artificial Sequence
  chemically synthesized
ttctttggtgcacaaacgtgtg

SEQ ID NO: 80020 - DNA, 22 bp, Artificial Sequence
  chemically synthesized
tttggtgcacaaacgtgtgtgt

SEQ ID NO: 80021 - DNA, 22 bp, Artificial Sequence
  chemically synthesized
tggtgcacaaacgtgtgtgtgt

SEQ ID NO: 80022 - DNA, 22 bp, Artificial Sequence
  chemically synthesized
ggtgcacaaacgtgtgtgtgtg

SEQ ID NO: 80023 - DNA, 22 bp, Artificial Sequence
  chemically synthesized
gtgcacaaacgtgtgtgtgtgt

SEQ ID NO: 80024 - DNA, 22 bp, Artificial Sequence
  chemically synthesized
agtgtgtgtatatgtaaatcta

SEQ ID NO: 80025 - DNA, 22 bp, Artificial Sequence
  chemically synthesized
agtgttaatacatgtataaatt

SEQ ID NO: 80026 - DNA, 22 bp, Artificial Sequence
  chemically synthesized
atacatgtataaatttctataa

SEQ ID NO: 80027 - DNA, 22 bp, Artificial Sequence
  chemically synthesized
ctataaaaatcacagaaaaagc

SEQ ID NO: 80028 - DNA, 22 bp, Artificial Sequence
  chemically synthesized
tataaaaatcacagaaaaagct

SEQ ID NO: 80029 - DNA, 22 bp, Artificial Sequence
  chemically synthesized
taaaaatcacagaaaaagctaa

SEQ ID NO: 80030 - DNA, 22 bp, Artificial Sequence
  chemically synthesized
agcataagccaagcatgagtag

SEQ ID NO: 80031 - DNA, 22 bp, Artificial Sequence
  chemically synthesized
caagtgtttaagatagtacctc

SEQ ID NO: 80032 - DNA, 22 bp, Artificial Sequence
  chemically synthesized
aagtgtttaagatagtacctca

SEQ ID NO: 80033 - DNA, 22 bp, Artificial Sequence
  chemically synthesized
aagatagtacctcagatttctc

SEQ ID NO: 80034 - DNA, 22 bp, Artificial Sequence
  chemically synthesized
agatagtacctcagatttctca

SEQ ID NO: 80035 - DNA, 22 bp, Artificial Sequence
  chemically synthesized
agatttctcaaagttttttttt

SEQ ID NO: 80036 - DNA, 22 bp, Artificial Sequence
  chemically synthesized
ctcaaagttttttttttgtctt

SEQ ID NO: 80037 - DNA, 22 bp, Artificial Sequence
  chemically synthesized
tcaaagttttttttttgtcttt

SEQ ID NO: 80038 - DNA, 22 bp, Artificial Sequence
  chemically synthesized
aaagttttttttttgtctttct

SEQ ID NO: 80039 - DNA, 22 bp, Artificial Sequence
  chemically synthesized
tttttttgtctttctttaggtg

SEQ ID NO: 80040 - DNA, 22 bp, Artificial Sequence
  chemically synthesized
ttttttgtctttctttaggtgt

SEQ ID NO: 80041 - DNA, 22 bp, Artificial Sequence
  chemically synthesized
tttttgtctttctttaggtgta

SEQ ID NO: 80042 - DNA, 22 bp, Artificial Sequence
  chemically synthesized
ttttgtctttctttaggtgtaa

SEQ ID NO: 80043 - DNA, 22 bp, Artificial Sequence
  chemically synthesized
tttgtctttctttaggtgtaaa

SEQ ID NO: 80044 - DNA, 22 bp, Artificial Sequence
  chemically synthesized
ttgtctttctttaggtgtaaat

SEQ ID NO: 80045 - DNA, 22 bp, Artificial Sequence
  chemically synthesized
tgtctttctttaggtgtaaata

SEQ ID NO: 80046 - DNA, 22 bp, Artificial Sequence
  chemically synthesized
gtctttctttaggtgtaaataa

SEQ ID NO: 80047 - DNA, 22 bp, Artificial Sequence
  chemically synthesized
tctttctttaggtgtaaataag

SEQ ID NO: 80048 - DNA, 22 bp, Artificial Sequence
  chemically synthesized
tctttaggtgtaaataaggtca

SEQ ID NO: 80049 - DNA, 22 bp, Artificial Sequence
  chemically synthesized
ctttaggtgtaaataaggtcat

SEQ ID NO: 80050 - DNA, 22 bp, Artificial Sequence
  chemically synthesized
tttaggtgtaaataaggtcatt

SEQ ID NO: 80051 - DNA, 22 bp, Artificial Sequence
  chemically synthesized
taggtgtaaataaggtcatttt

SEQ ID NO: 80052 - DNA, 22 bp, Artificial Sequence
  chemically synthesized
aggtgtaaataaggtcattttt

SEQ ID NO: 80053 - DNA, 22 bp, Artificial Sequence
  chemically synthesized
ggtgtaaataaggtcatttttt

SEQ ID NO: 80054 - DNA, 22 bp, Artificial Sequence
  chemically synthesized
tttaaacattctcatggcattg

SEQ ID NO: 80055 - DNA, 22 bp, Artificial Sequence
  chemically synthesized
ttaaacattctcatggcattgt

SEQ ID NO: 80056 - DNA, 22 bp, Artificial Sequence
  chemically synthesized
taaacattctcatggcattgtt

SEQ ID NO: 80057 - DNA, 22 bp, Artificial Sequence
  chemically synthesized
aaacattctcatggcattgttc

SEQ ID NO: 80058 - DNA, 22 bp, Artificial Sequence
  chemically synthesized
aacattctcatggcattgttct

SEQ ID NO: 80059 - DNA, 22 bp, Artificial Sequence
  chemically synthesized
tcatggcattgttctaggcttt

SEQ ID NO: 80060 - DNA, 22 bp, Artificial Sequence
  chemically synthesized
atggcattgttctaggctttta

SEQ ID NO: 80061 - DNA, 22 bp, Artificial Sequence
  chemically synthesized
ttctaggcttttaagaaggaga

SEQ ID NO: 80062 - DNA, 22 bp, Artificial Sequence
  chemically synthesized
taggcttttaagaaggagagat

SEQ ID NO: 80063 - DNA, 22 bp, Artificial Sequence
  chemically synthesized
ggcttttaagaaggagagattg

SEQ ID NO: 80064 - DNA, 22 bp, Artificial Sequence
  chemically synthesized
ttaagaaggagagattgtaaaa

SEQ ID NO: 80065 - DNA, 22 bp, Artificial Sequence
  chemically synthesized
taagaaggagagattgtaaaaa

SEQ ID NO: 80066 - DNA, 22 bp, Artificial Sequence
  chemically synthesized
aagaaggagagattgtaaaaat

SEQ ID NO: 80067 - DNA, 22 bp, Artificial Sequence
  chemically synthesized
agaaggagagattgtaaaaatt

SEQ ID NO: 80068 - DNA, 22 bp, Artificial Sequence
  chemically synthesized
taaaaatttgtattgatgtgaa

SEQ ID NO: 80069 - DNA, 22 bp, Artificial Sequence
  chemically synthesized
gtattgatgtgaagggattaag

SEQ ID NO: 80070 - DNA, 22 bp, Artificial Sequence
  chemically synthesized
tattgatgtgaagggattaagg

SEQ ID NO: 80071 - DNA, 22 bp, Artificial Sequence
  chemically synthesized
atgtgaagggattaaggtatag

SEQ ID NO: 80072 - DNA, 22 bp, Artificial Sequence
  chemically synthesized
aggtatagtctgtagataatat

SEQ ID NO: 80073 - DNA, 22 bp, Artificial Sequence
  chemically synthesized
tagataatatcatagataatta

SEQ ID NO: 80074 - DNA, 22 bp, Artificial Sequence
  chemically synthesized
cttttgctgggattacattctt

SEQ ID NO: 80075 - DNA, 22 bp, Artificial Sequence
  chemically synthesized
ttgctgggattacattcttttt

SEQ ID NO: 80076 - DNA, 22 bp, Artificial Sequence
  chemically synthesized
tgctgggattacattctttttt

SEQ ID NO: 80077 - DNA, 22 bp, Artificial Sequence
  chemically synthesized
gctgggattacattctttttta

SEQ ID NO: 80078 - DNA, 22 bp, Artificial Sequence
  chemically synthesized
ctgggattacattcttttttat

SEQ ID NO: 80079 - DNA, 22 bp, Artificial Sequence
  chemically synthesized
ggattacattcttttttattta

SEQ ID NO: 80080 - DNA, 22 bp, Artificial Sequence
  chemically synthesized
cattcttttttatttaagtttc

SEQ ID NO: 80081 - DNA, 22 bp, Artificial Sequence
  chemically synthesized
ttttttatttaagtttcttgga

SEQ ID NO: 80082 - DNA, 22 bp, Artificial Sequence
  chemically synthesized
ttttatttaagtttcttggaaa

SEQ ID NO: 80083 - DNA, 22 bp, Artificial Sequence
  chemically synthesized
tttatttaagtttcttggaaaa

SEQ ID NO: 80084 - DNA, 22 bp, Artificial Sequence
  chemically synthesized
ttatttaagtttcttggaaaat

SEQ ID NO: 80085 - DNA, 22 bp, Artificial Sequence
  chemically synthesized
tatttaagtttcttggaaaata

SEQ ID NO: 80086 - DNA, 22 bp, Artificial Sequence
  chemically synthesized
atttaagtttcttggaaaatat

SEQ ID NO: 80087 - DNA, 22 bp, Artificial Sequence
  chemically synthesized
tttaagtttcttggaaaatatt

SEQ ID NO: 80088 - DNA, 22 bp, Artificial Sequence
  chemically synthesized
aagtttcttggaaaatattctc

SEQ ID NO: 80089 - DNA, 22 bp, Artificial Sequence
  chemically synthesized
agtttcttggaaaatattctcc

SEQ ID NO: 80090 - DNA, 22 bp, Artificial Sequence
  chemically synthesized
cttggaaaatattctccttaat

SEQ ID NO: 80091 - DNA, 22 bp, Artificial Sequence
  chemically synthesized
ttggaaaatattctccttaatc

SEQ ID NO: 80092 - DNA, 22 bp, Artificial Sequence
  chemically synthesized
ggaaaatattctccttaatctt

SEQ ID NO: 80093 - DNA, 22 bp, Artificial Sequence
  chemically synthesized
gaaaatattctccttaatcttc

SEQ ID NO: 80094 - DNA, 22 bp, Artificial Sequence
  chemically synthesized
tccttaatcttctctagctttt

SEQ ID NO: 80095 - DNA, 22 bp, Artificial Sequence
  chemically synthesized
cttaatcttctctagcttttta

SEQ ID NO: 80096 - DNA, 22 bp, Artificial Sequence
  chemically synthesized
aatcttctctagctttttaaaa

SEQ ID NO: 80097 - DNA, 22 bp, Artificial Sequence
  chemically synthesized
atcttctctagctttttaaaaa

SEQ ID NO: 80098 - DNA, 22 bp, Artificial Sequence
  chemically synthesized
ctctagctttttaaaaaatgtt

SEQ ID NO: 80099 - DNA, 22 bp, Artificial Sequence
  chemically synthesized
tctagctttttaaaaaatgttt

SEQ ID NO: 80100 - DNA, 22 bp, Artificial Sequence
  chemically synthesized
tagctttttaaaaaatgtttat

SEQ ID NO: 80101 - DNA, 22 bp, Artificial Sequence
  chemically synthesized
gctttttaaaaaatgtttattt

SEQ ID NO: 80102 - DNA, 22 bp, Artificial Sequence
  chemically synthesized
tttaaaaaatgtttattttaaa

SEQ ID NO: 80103 - DNA, 22 bp, Artificial Sequence
  chemically synthesized
ttaaaaaatgtttattttaaaa

SEQ ID NO: 80104 - DNA, 22 bp, Artificial Sequence
  chemically synthesized
taaaaaatgtttattttaaaaa

SEQ ID NO: 80105 - DNA, 22 bp, Artificial Sequence
  chemically synthesized
aaaaaatgtttattttaaaaat

SEQ ID NO: 80106 - DNA, 22 bp, Artificial Sequence
  chemically synthesized
aaaaatgtttattttaaaaatt

SEQ ID NO: 80107 - DNA, 22 bp, Artificial Sequence
  chemically synthesized
attttaaaaatttatttatcac

SEQ ID NO: 80108 - DNA, 22 bp, Artificial Sequence
  chemically synthesized
ttttaaaaatttatttatcacc

SEQ ID NO: 80109 - DNA, 22 bp, Artificial Sequence
  chemically synthesized
taaaaatttatttatcacccag

SEQ ID NO: 80110 - DNA, 22 bp, Artificial Sequence
  chemically synthesized
aaaaatttatttatcacccagg

SEQ ID NO: 80111 - DNA, 22 bp, Artificial Sequence
  chemically synthesized
aaaatttatttatcacccaggt

SEQ ID NO: 80112 - DNA, 22 bp, Artificial Sequence
  chemically synthesized
atttatcacccaggtatagaaa

SEQ ID NO: 80113 - DNA, 22 bp, Artificial Sequence
  chemically synthesized
tttatcacccaggtatagaaat

SEQ ID NO: 80114 - DNA, 22 bp, Artificial Sequence
  chemically synthesized
atcacccaggtatagaaatttt

SEQ ID NO: 80115 - DNA, 22 bp, Artificial Sequence
  chemically synthesized
tcacccaggtatagaaattttc

SEQ ID NO: 80116 - DNA, 22 bp, Artificial Sequence
  chemically synthesized
tcaatcattttacttcttcagt

SEQ ID NO: 80117 - DNA, 22 bp, Artificial Sequence
  chemically synthesized
caatcattttacttcttcagtg

SEQ ID NO: 80118 - DNA, 22 bp, Artificial Sequence
  chemically synthesized
aatcattttacttcttcagtga

SEQ ID NO: 80119 - DNA, 22 bp, Artificial Sequence
  chemically synthesized
tacttcttcagtgatgtttctg

SEQ ID NO: 80120 - DNA, 22 bp, Artificial Sequence
  chemically synthesized
acttcttcagtgatgtttctgt

SEQ ID NO: 80121 - DNA, 22 bp, Artificial Sequence
  chemically synthesized
cttcttcagtgatgtttctgtt

SEQ ID NO: 80122 - DNA, 22 bp, Artificial Sequence
  chemically synthesized
cttcagtgatgtttctgttgat

SEQ ID NO: 80123 - DNA, 22 bp, Artificial Sequence
  chemically synthesized
ttcagtgatgtttctgttgatg

SEQ ID NO: 80124 - DNA, 22 bp, Artificial Sequence
  chemically synthesized
cagtgatgtttctgttgatgcc

SEQ ID NO: 80125 - DNA, 22 bp, Artificial Sequence
  chemically synthesized
agtgatgtttctgttgatgcca

SEQ ID NO: 80126 - DNA, 22 bp, Artificial Sequence
  chemically synthesized
ctgttgatgccatgatgctcca

SEQ ID NO: 80127 - DNA, 22 bp, Artificial Sequence
  chemically synthesized
tgttgatgccatgatgctccat

SEQ ID NO: 80128 - DNA, 22 bp, Artificial Sequence
  chemically synthesized
ttgatgccatgatgctccattg

SEQ ID NO: 80129 - DNA, 22 bp, Artificial Sequence
  chemically synthesized
atgccatgatgctccattgatg

SEQ ID NO: 80130 - DNA, 22 bp, Artificial Sequence
  chemically synthesized
cattgatgacttgggtctaaaa

SEQ ID NO: 80131 - DNA, 22 bp, Artificial Sequence
  chemically synthesized
atgacttgggtctaaaatctcc

SEQ ID NO: 80132 - DNA, 22 bp, Artificial Sequence
  chemically synthesized
gggtctaaaatctccactatag

SEQ ID NO: 80133 - DNA, 22 bp, Artificial Sequence
  chemically synthesized
ggtctaaaatctccactatagg

SEQ ID NO: 80134 - DNA, 22 bp, Artificial Sequence
  chemically synthesized
aaatctccactatagggggaaa

SEQ ID NO: 80135 - DNA, 22 bp, Artificial Sequence
  chemically synthesized
cactatagggggaaatgtgtat

SEQ ID NO: 80136 - DNA, 22 bp, Artificial Sequence
  chemically synthesized
tagggggaaatgtgtatcagat

SEQ ID NO: 80137 - DNA, 22 bp, Artificial Sequence
  chemically synthesized
tacatcatccaggcaatctcat

SEQ ID NO: 80138 - DNA, 22 bp, Artificial Sequence
  chemically synthesized
acatcatccaggcaatctcata

SEQ ID NO: 80139 - DNA, 22 bp, Artificial Sequence
  chemically synthesized
catcatccaggcaatctcatat

SEQ ID NO: 80140 - DNA, 22 bp, Artificial Sequence
  chemically synthesized
atatttgttaatttaatattgg

SEQ ID NO: 80141 - DNA, 22 bp, Artificial Sequence
  chemically synthesized
gttaatttaatattggttatta

SEQ ID NO: 80142 - DNA, 22 bp, Artificial Sequence
  chemically synthesized
ttaatttaatattggttattat

SEQ ID NO: 80143 - DNA, 22 bp, Artificial Sequence
  chemically synthesized
atttaatattggttattatttg

SEQ ID NO: 80144 - DNA, 22 bp, Artificial Sequence
  chemically synthesized
aatattggttattatttgcttt

SEQ ID NO: 80145 - DNA, 22 bp, Artificial Sequence
  chemically synthesized
atattggttattatttgcttta

SEQ ID NO: 80146 - DNA, 22 bp, Artificial Sequence
  chemically synthesized
gttattatttgctttaattcac

SEQ ID NO: 80147 - DNA, 22 bp, Artificial Sequence
  chemically synthesized
ttatttgctttaattcactatt

SEQ ID NO: 80148 - DNA, 22 bp, Artificial Sequence
  chemically synthesized
tttgctttaattcactattatt

SEQ ID NO: 80149 - DNA, 22 bp, Artificial Sequence
  chemically synthesized
gctttaattcactattattcac

SEQ ID NO: 80150 - DNA, 22 bp, Artificial Sequence
  chemically synthesized
ctttaattcactattattcact

SEQ ID NO: 80151 - DNA, 22 bp, Artificial Sequence
  chemically synthesized
taattcactattattcacttgt

SEQ ID NO: 80152 - DNA, 22 bp, Artificial Sequence
  chemically synthesized
aattcactattattcacttgtt

SEQ ID NO: 80153 - DNA, 22 bp, Artificial Sequence
  chemically synthesized
attcactattattcacttgttg

SEQ ID NO: 80154 - DNA, 22 bp, Artificial Sequence
  chemically synthesized
actattattcacttgttgaata

SEQ ID NO: 80155 - DNA, 22 bp, Artificial Sequence
  chemically synthesized
ttattcacttgttgaatacata

SEQ ID NO: 80156 - DNA, 22 bp, Artificial Sequence
  chemically synthesized
ttcacttgttgaatacatatgt

SEQ ID NO: 80157 - DNA, 22 bp, Artificial Sequence
  chemically synthesized
acttgttgaatacatatgtatt

SEQ ID NO: 80158 - DNA, 22 bp, Artificial Sequence
  chemically synthesized
gttgaatacatatgtattatgt

SEQ ID NO: 80159 - DNA, 22 bp, Artificial Sequence
  chemically synthesized
ttgaatacatatgtattatgtg

SEQ ID NO: 80160 - DNA, 22 bp, Artificial Sequence
  chemically synthesized
aatacatatgtattatgtgtct

SEQ ID NO: 80161 - DNA, 22 bp, Artificial Sequence
  chemically synthesized
tgtgtctattccatacaagaga

SEQ ID NO: 80162 - DNA, 22 bp, Artificial Sequence
  chemically synthesized
ttccatacaagagactttgtga

SEQ ID NO: 80163 - DNA, 22 bp, Artificial Sequence
  chemically synthesized
catacaagagactttgtgagat

SEQ ID NO: 80164 - DNA, 22 bp, Artificial Sequence
  chemically synthesized
tgtgagatgtcagtgagttaga

SEQ ID NO: 80165 - DNA, 22 bp, Artificial Sequence
  chemically synthesized
gtgagatgtcagtgagttagaa

SEQ ID NO: 80166 - DNA, 22 bp, Artificial Sequence
  chemically synthesized
tgagatgtcagtgagttagaaa

SEQ ID NO: 80167 - DNA, 22 bp, Artificial Sequence
  chemically synthesized
gaaaatattctagggataacat

SEQ ID NO: 80168 - DNA, 22 bp, Artificial Sequence
  chemically synthesized
tagggataacattttaacttaa

SEQ ID NO: 80169 - DNA, 22 bp, Artificial Sequence
  chemically synthesized
gggataacattttaacttaagt

SEQ ID NO: 80170 - DNA, 22 bp, Artificial Sequence
  chemically synthesized
taacttaagtaacaggtgttga

SEQ ID NO: 80171 - DNA, 22 bp, Artificial Sequence
  chemically synthesized
aacttaagtaacaggtgttgac

SEQ ID NO: 80172 - DNA, 22 bp, Artificial Sequence
  chemically synthesized
acttaagtaacaggtgttgaca

SEQ ID NO: 80173 - DNA, 22 bp, Artificial Sequence
  chemically synthesized
aagtaacaggtgttgacaaaaa

SEQ ID NO: 80174 - DNA, 22 bp, Artificial Sequence
  chemically synthesized
agtaacaggtgttgacaaaaat

SEQ ID NO: 80175 - DNA, 22 bp, Artificial Sequence
  chemically synthesized
acaaaaataatattatggcttc

SEQ ID NO: 80176 - DNA, 22 bp, Artificial Sequence
  chemically synthesized
tggcttcatgttattggttcaa

SEQ ID NO: 80177 - DNA, 22 bp, Artificial Sequence
  chemically synthesized
catgttattggttcaagtctct

SEQ ID NO: 80178 - DNA, 22 bp, Artificial Sequence
  chemically synthesized
atgttattggttcaagtctctg

SEQ ID NO: 80179 - DNA, 22 bp, Artificial Sequence
  chemically synthesized
ttggttcaagtctctgcagagt

SEQ ID NO: 80180 - DNA, 22 bp, Artificial Sequence
  chemically synthesized
gttcaagtctctgcagagtaca

SEQ ID NO: 80181 - DNA, 22 bp, Artificial Sequence
  chemically synthesized
aagtctctgcagagtacagcgg

SEQ ID NO: 80182 - DNA, 22 bp, Artificial Sequence
  chemically synthesized
tgcagagtacagcgggagtgtt

SEQ ID NO: 80183 - DNA, 22 bp, Artificial Sequence
  chemically synthesized
cagagtacagcgggagtgttgt

SEQ ID NO: 80184 - DNA, 22 bp, Artificial Sequence
  chemically synthesized
tacatttcagcagaatttcaga

SEQ ID NO: 80185 - DNA, 22 bp, Artificial Sequence
  chemically synthesized
cagcagaatttcagactgacta

SEQ ID NO: 80186 - DNA, 22 bp, Artificial Sequence
  chemically synthesized
agcagaatttcagactgactat

SEQ ID NO: 80187 - DNA, 22 bp, Artificial Sequence
  chemically synthesized
cagactgactataaaaagccca

SEQ ID NO: 80188 - DNA, 22 bp, Artificial Sequence
  chemically synthesized
agactgactataaaaagcccag

SEQ ID NO: 80189 - DNA, 22 bp, Artificial Sequence
  chemically synthesized
actataaaaagcccagtgactg

SEQ ID NO: 80190 - DNA, 22 bp, Artificial Sequence
  chemically synthesized
taaaaagcccagtgactgactc

SEQ ID NO: 80191 - DNA, 22 bp, Artificial Sequence
  chemically synthesized
actcaaaaccccacttcctagc

SEQ ID NO: 80192 - DNA, 22 bp, Artificial Sequence
  chemically synthesized
aaaaccccacttcctagctcta

SEQ ID NO: 80193 - DNA, 22 bp, Artificial Sequence
  chemically synthesized
cctagctctacgtaggaaaagt

SEQ ID NO: 80194 - DNA, 22 bp, Artificial Sequence
  chemically synthesized
ctagctctacgtaggaaaagtc

SEQ ID NO: 80195 - DNA, 22 bp, Artificial Sequence
  chemically synthesized
gctctacgtaggaaaagtcaat

SEQ ID NO: 80196 - DNA, 22 bp, Artificial Sequence
  chemically synthesized
tacgtaggaaaagtcaatctgg

SEQ ID NO: 80197 - DNA, 22 bp, Artificial Sequence
  chemically synthesized
cgtaggaaaagtcaatctggat

SEQ ID NO: 80198 - DNA, 22 bp, Artificial Sequence
  chemically synthesized
gattaaaccctaaaatatattt

SEQ ID NO: 80199 - DNA, 22 bp, Artificial Sequence
  chemically synthesized
aaccctaaaatatatttctctt

SEQ ID NO: 80200 - DNA, 22 bp, Artificial Sequence
  chemically synthesized
aaatatatttctcttttctcga

SEQ ID NO: 80201 - DNA, 22 bp, Artificial Sequence
  chemically synthesized
ctcttttctcgattatctttat

SEQ ID NO: 80202 - DNA, 22 bp, Artificial Sequence
  chemically synthesized
tcttttctcgattatctttata

SEQ ID NO: 80203 - DNA, 22 bp, Artificial Sequence
  chemically synthesized
ttttctcgattatctttatata

SEQ ID NO: 80204 - DNA, 22 bp, Artificial Sequence
  chemically synthesized
ttctcgattatctttatatatt

SEQ ID NO: 80205 - DNA, 22 bp, Artificial Sequence
  chemically synthesized
tctcgattatctttatatattt

SEQ ID NO: 80206 - DNA, 22 bp, Artificial Sequence
  chemically synthesized
ctcgattatctttatatatttt

SEQ ID NO: 80207 - DNA, 22 bp, Artificial Sequence
  chemically synthesized
tcgattatctttatatattttt

SEQ ID NO: 80208 - DNA, 22 bp, Artificial Sequence
  chemically synthesized
gattatctttatatatttttaa

SEQ ID NO: 80209 - DNA, 22 bp, Artificial Sequence
  chemically synthesized
tctttatatatttttaagttaa

SEQ ID NO: 80210 - DNA, 22 bp, Artificial Sequence
  chemically synthesized
tatatatttttaagttaaaatt

SEQ ID NO: 80211 - DNA, 22 bp, Artificial Sequence
  chemically synthesized
atatatttttaagttaaaattc

SEQ ID NO: 80212 - DNA, 22 bp, Artificial Sequence
  chemically synthesized
tatatttttaagttaaaattca

SEQ ID NO: 80213 - DNA, 22 bp, Artificial Sequence
  chemically synthesized
ttaagttaaaattcatgaaaat

SEQ ID NO: 80214 - DNA, 22 bp, Artificial Sequence
  chemically synthesized
taagttaaaattcatgaaaata

SEQ ID NO: 80215 - DNA, 22 bp, Artificial Sequence
  chemically synthesized
aagttaaaattcatgaaaatag

SEQ ID NO: 80216 - DNA, 22 bp, Artificial Sequence
  chemically synthesized
agttaaaattcatgaaaatagt

SEQ ID NO: 80217 - DNA, 22 bp, Artificial Sequence
  chemically synthesized
aaattcatgaaaatagtatttc

SEQ ID NO: 80218 - DNA, 22 bp, Artificial Sequence
  chemically synthesized
atgaaaatagtatttctgaaaa

SEQ ID NO: 80219 - DNA, 22 bp, Artificial Sequence
  chemically synthesized
ctgaaaaaatggagaatttcat

SEQ ID NO: 80220 - DNA, 22 bp, Artificial Sequence
  chemically synthesized
tgaaaaaatggagaatttcatt

SEQ ID NO: 80221 - DNA, 22 bp, Artificial Sequence
  chemically synthesized
aaaaaatggagaatttcattaa

SEQ ID NO: 80222 - DNA, 22 bp, Artificial Sequence
  chemically synthesized
cattaaagtattttttttttca

SEQ ID NO: 80223 - DNA, 22 bp, Artificial Sequence
  chemically synthesized
attaaagtattttttttttcaa

SEQ ID NO: 80224 - DNA, 22 bp, Artificial Sequence
  chemically synthesized
aagtattttttttttcaaaacc

SEQ ID NO: 80225 - DNA, 22 bp, Artificial Sequence
  chemically synthesized
tttttttcaaaacctttgatct

SEQ ID NO: 80226 - DNA, 22 bp, Artificial Sequence
  chemically synthesized
ttttttcaaaacctttgatctt

SEQ ID NO: 80227 - DNA, 22 bp, Artificial Sequence
  chemically synthesized
tttttcaaaacctttgatcttt

SEQ ID NO: 80228 - DNA, 22 bp, Artificial Sequence
  chemically synthesized
ttttcaaaacctttgatctttg

SEQ ID NO: 80229 - DNA, 22 bp, Artificial Sequence
  chemically synthesized
tttcaaaacctttgatctttga

SEQ ID NO: 80230 - DNA, 22 bp, Artificial Sequence
  chemically synthesized
ttcaaaacctttgatctttgag

SEQ ID NO: 80231 - DNA, 22 bp, Artificial Sequence
  chemically synthesized
tcaaaacctttgatctttgagt

SEQ ID NO: 80232 - DNA, 22 bp, Artificial Sequence
  chemically synthesized
caaaacctttgatctttgagtg

SEQ ID NO: 80233 - DNA, 22 bp, Artificial Sequence
  chemically synthesized
aaaacctttgatctttgagtgc

SEQ ID NO: 80234 - DNA, 22 bp, Artificial Sequence
  chemically synthesized
tgatctttgagtgccttagcaa

SEQ ID NO: 80235 - DNA, 22 bp, Artificial Sequence
  chemically synthesized
gatctttgagtgccttagcaaa

SEQ ID NO: 80236 - DNA, 22 bp, Artificial Sequence
  chemically synthesized
atctttgagtgccttagcaaaa

SEQ ID NO: 80237 - DNA, 22 bp, Artificial Sequence
  chemically synthesized
tgagtgccttagcaaaattccg

SEQ ID NO: 80238 - DNA, 22 bp, Artificial Sequence
  chemically synthesized
gagtgccttagcaaaattccgt

SEQ ID NO: 80239 - DNA, 22 bp, Artificial Sequence
  chemically synthesized
agtgccttagcaaaattccgtg

SEQ ID NO: 80240 - DNA, 22 bp, Artificial Sequence
  chemically synthesized
agcaaaattccgtggacacttt

SEQ ID NO: 80241 - DNA, 22 bp, Artificial Sequence
  chemically synthesized
gcaaaattccgtggacactttg

SEQ ID NO: 80242 - DNA, 22 bp, Artificial Sequence
  chemically synthesized
cgtggacactttgatagacacc

SEQ ID NO: 80243 - DNA, 22 bp, Artificial Sequence
  chemically synthesized
tgatagacaccatcattttaag

SEQ ID NO: 80244 - DNA, 22 bp, Artificial Sequence
  chemically synthesized
gatagacaccatcattttaagt

SEQ ID NO: 80245 - DNA, 22 bp, Artificial Sequence
  chemically synthesized
atagacaccatcattttaagtg

SEQ ID NO: 80246 - DNA, 22 bp, Artificial Sequence
  chemically synthesized
taagtgtgtttgaggatttcta

SEQ ID NO: 80247 - DNA, 22 bp, Artificial Sequence
  chemically synthesized
aagtgtgtttgaggatttctat

SEQ ID NO: 80248 - DNA, 22 bp, Artificial Sequence
  chemically synthesized
agtgtgtttgaggatttctatg

SEQ ID NO: 80249 - DNA, 22 bp, Artificial Sequence
  chemically synthesized
gaggatttctatggattgtatt

SEQ ID NO: 80250 - DNA, 22 bp, Artificial Sequence
  chemically synthesized
aggatttctatggattgtattt

SEQ ID NO: 80251 - DNA, 22 bp, Artificial Sequence
  chemically synthesized
ctatggattgtatttattctat

SEQ ID NO: 80252 - DNA, 22 bp, Artificial Sequence
  chemically synthesized
tatggattgtatttattctatt

SEQ ID NO: 80253 - DNA, 22 bp, Artificial Sequence
  chemically synthesized
tggattgtatttattctattcc

SEQ ID NO: 80254 - DNA, 22 bp, Artificial Sequence
  chemically synthesized
tatttattctattccctaaaac

SEQ ID NO: 80255 - DNA, 22 bp, Artificial Sequence
  chemically synthesized
attctattccctaaaacagact

SEQ ID NO: 80256 - DNA, 22 bp, Artificial Sequence
  chemically synthesized
ttctattccctaaaacagactt

SEQ ID NO: 80257 - DNA, 22 bp, Artificial Sequence
  chemically synthesized
tattccctaaaacagacttttt

SEQ ID NO: 80258 - DNA, 22 bp, Artificial Sequence
  chemically synthesized
ttccctaaaacagactttttaa

SEQ ID NO: 80259 - DNA, 22 bp, Artificial Sequence
  chemically synthesized
cctaaaacagactttttaatct

SEQ ID NO: 80260 - DNA, 22 bp, Artificial Sequence
  chemically synthesized
aaacagactttttaatcttaac

SEQ ID NO: 80261 - DNA, 22 bp, Artificial Sequence
  chemically synthesized
tttaatcttaacagcatacact

SEQ ID NO: 80262 - DNA, 22 bp, Artificial Sequence
  chemically synthesized
ttaatcttaacagcatacactg

SEQ ID NO: 80263 - DNA, 22 bp, Artificial Sequence
  chemically synthesized
taatcttaacagcatacactga

SEQ ID NO: 80264 - DNA, 22 bp, Artificial Sequence
  chemically synthesized
aatcttaacagcatacactgat

SEQ ID NO: 80265 - DNA, 22 bp, Artificial Sequence
  chemically synthesized
atcttaacagcatacactgata

SEQ ID NO: 80266 - DNA, 22 bp, Artificial Sequence
  chemically synthesized
aacagcatacactgataggaga

SEQ ID NO: 80267 - DNA, 22 bp, Artificial Sequence
  chemically synthesized
acagcatacactgataggagag

SEQ ID NO: 80268 - DNA, 22 bp, Artificial Sequence
  chemically synthesized
ataggagagaaaagcaaaatca

SEQ ID NO: 80269 - DNA, 22 bp, Artificial Sequence
  chemically synthesized
gatctttaatttgtttggtctt

SEQ ID NO: 80270 - DNA, 22 bp, Artificial Sequence
  chemically synthesized
taatttgtttggtcttcacccc

SEQ ID NO: 80271 - DNA, 22 bp, Artificial Sequence
  chemically synthesized
aatttgtttggtcttcacccca

SEQ ID NO: 80272 - DNA, 22 bp, Artificial Sequence
  chemically synthesized
atttgtttggtcttcaccccat

SEQ ID NO: 80273 - DNA, 22 bp, Artificial Sequence
  chemically synthesized
gtttggtcttcaccccataaat

SEQ ID NO: 80274 - DNA, 22 bp, Artificial Sequence
  chemically synthesized
tttggtcttcaccccataaatg

SEQ ID NO: 80275 - DNA, 22 bp, Artificial Sequence
  chemically synthesized
ggtcttcaccccataaatgatg

SEQ ID NO: 80276 - DNA, 22 bp, Artificial Sequence
  chemically synthesized
gtcttcaccccataaatgatgg

SEQ ID NO: 80277 - DNA, 22 bp, Artificial Sequence
  chemically synthesized
caccccataaatgatggggttt

SEQ ID NO: 80278 - DNA, 22 bp, Artificial Sequence
  chemically synthesized
accccataaatgatggggttta

SEQ ID NO: 80279 - DNA, 22 bp, Artificial Sequence
  chemically synthesized
agcatagggggcactaacacat

SEQ ID NO: 80280 - DNA, 22 bp, Artificial Sequence
  chemically synthesized
gcatagggggcactaacacata

SEQ ID NO: 80281 - DNA, 22 bp, Artificial Sequence
  chemically synthesized
acacatagagactgcccactag

SEQ ID NO: 80282 - DNA, 22 bp, Artificial Sequence
  chemically synthesized
cccactaggatgtgaatgtggt

SEQ ID NO: 80283 - DNA, 22 bp, Artificial Sequence
  chemically synthesized
ggatgtgaatgtggtgagggat

SEQ ID NO: 80284 - DNA, 22 bp, Artificial Sequence
  chemically synthesized
tacctccaaagcgatgggcaag

SEQ ID NO: 80285 - DNA, 22 bp, Artificial Sequence
  chemically synthesized
acctccaaagcgatgggcaaga

SEQ ID NO: 80286 - DNA, 22 bp, Artificial Sequence
  chemically synthesized
cctccaaagcgatgggcaagaa

SEQ ID NO: 80287 - DNA, 22 bp, Artificial Sequence
  chemically synthesized
caaagcgatgggcaagaaatga

SEQ ID NO: 80288 - DNA, 22 bp, Artificial Sequence
  chemically synthesized
gggtatagaacataaatatgac

SEQ ID NO: 80289 - DNA, 22 bp, Artificial Sequence
  chemically synthesized
agggccttgaacctggcagccc

SEQ ID NO: 80290 - DNA, 22 bp, Artificial Sequence
  chemically synthesized
gaacctggcagcccaggaagat

SEQ ID NO: 80291 - DNA, 22 bp, Artificial Sequence
  chemically synthesized
aacctggcagcccaggaagata

SEQ ID NO: 80292 - DNA, 22 bp, Artificial Sequence
  chemically synthesized
gcagcccaggaagatatctgaa

SEQ ID NO: 80293 - DNA, 22 bp, Artificial Sequence
  chemically synthesized
aaacactgagtgaaggatcatt

SEQ ID NO: 80294 - DNA, 22 bp, Artificial Sequence
  chemically synthesized
agtgaaggatcattgtgtagga

SEQ ID NO: 80295 - DNA, 22 bp, Artificial Sequence
  chemically synthesized
tgtaggatataatgataagcac

SEQ ID NO: 80296 - DNA, 22 bp, Artificial Sequence
  chemically synthesized
tatccagtcctgtagagagtag

SEQ ID NO: 80297 - DNA, 22 bp, Artificial Sequence
  chemically synthesized
tagagagtagggccacagtgag

SEQ ID NO: 80298 - DNA, 22 bp, Artificial Sequence
  chemically synthesized
acattgatattgccacaagcca

SEQ ID NO: 80299 - DNA, 22 bp, Artificial Sequence
  chemically synthesized
atattgccacaagccaatctgg

SEQ ID NO: 80300 - DNA, 22 bp, Artificial Sequence
  chemically synthesized
ccacaagccaatctggcaatgt

SEQ ID NO: 80301 - DNA, 22 bp, Artificial Sequence
  chemically synthesized
gcaatgtgctcacagtaggaat

SEQ ID NO: 80302 - DNA, 22 bp, Artificial Sequence
  chemically synthesized
acagtaggaatgaggaatgatg

SEQ ID NO: 80303 - DNA, 22 bp, Artificial Sequence
  chemically synthesized
ctcccacaatatgtaagtcggt

SEQ ID NO: 80304 - DNA, 22 bp, Artificial Sequence
  chemically synthesized
tcccacaatatgtaagtcggta

SEQ ID NO: 80305 - DNA, 22 bp, Artificial Sequence
  chemically synthesized
ccacaatatgtaagtcggtata

SEQ ID NO: 80306 - DNA, 22 bp, Artificial Sequence
  chemically synthesized
ctgaccacagctgctatgccaa

SEQ ID NO: 80307 - DNA, 22 bp, Artificial Sequence
  chemically synthesized
accacagctgctatgccaatct

SEQ ID NO: 80308 - DNA, 22 bp, Artificial Sequence
  chemically synthesized
ctatgccaatcttcctgacggc

SEQ ID NO: 80309 - DNA, 22 bp, Artificial Sequence
  chemically synthesized
tgccaatcttcctgacggctga

SEQ ID NO: 80310 - DNA, 22 bp, Artificial Sequence
  chemically synthesized
cctgacggctgatgaggttaaa

SEQ ID NO: 80311 - DNA, 22 bp, Artificial Sequence
  chemically synthesized
ctgacggctgatgaggttaaaa

SEQ ID NO: 80312 - DNA, 22 bp, Artificial Sequence
  chemically synthesized
acggctgatgaggttaaaatgg

SEQ ID NO: 80313 - DNA, 22 bp, Artificial Sequence
  chemically synthesized
atgaggttaaaatggtgtatct

SEQ ID NO: 80314 - DNA, 22 bp, Artificial Sequence
  chemically synthesized
aaatggtgtatctcagtgggta

SEQ ID NO: 80315 - DNA, 22 bp, Artificial Sequence
  chemically synthesized
agtgggtaacagatggccacat

SEQ ID NO: 80316 - DNA, 22 bp, Artificial Sequence
  chemically synthesized
ccaggagaatagcagattctgc

SEQ ID NO: 80317 - DNA, 22 bp, Artificial Sequence
  chemically synthesized
tgccacaaagatgaaatgtatg

SEQ ID NO: 80318 - DNA, 22 bp, Artificial Sequence
  chemically synthesized
ccacaaagatgaaatgtatgaa

SEQ ID NO: 80319 - DNA, 22 bp, Artificial Sequence
  chemically synthesized
agacacacaactaccaaaggat

SEQ ID NO: 80320 - DNA, 22 bp, Artificial Sequence
  chemically synthesized
ccaaaggatatgtccatggagt

SEQ ID NO: 80321 - DNA, 22 bp, Artificial Sequence
  chemically synthesized
aggggctgcagcagtggcgagc

SEQ ID NO: 80322 - DNA, 22 bp, Artificial Sequence
  chemically synthesized
ggggctgcagcagtggcgagca

SEQ ID NO: 80323 - DNA, 22 bp, Artificial Sequence
  chemically synthesized
cagcagtggcgagcaggaagtc

SEQ ID NO: 80324 - DNA, 22 bp, Artificial Sequence
  chemically synthesized
aggccagcatggataggaagag

SEQ ID NO: 80325 - DNA, 22 bp, Artificial Sequence
  chemically synthesized
atggagactgcgctcagtcatg

SEQ ID NO: 80326 - DNA, 22 bp, Artificial Sequence
  chemically synthesized
cgctcagtcatgatcaggaaga

SEQ ID NO: 80327 - DNA, 22 bp, Artificial Sequence
  chemically synthesized
agtcatgatcaggaagatcaag

SEQ ID NO: 80328 - DNA, 22 bp, Artificial Sequence
  chemically synthesized
cctgcaacagccacaatgtaca

SEQ ID NO: 80329 - DNA, 22 bp, Artificial Sequence
  chemically synthesized
caacagccacaatgtacataaa

SEQ ID NO: 80330 - DNA, 22 bp, Artificial Sequence
  chemically synthesized
ccagccctgggattcccatcag

SEQ ID NO: 80331 - DNA, 22 bp, Artificial Sequence
  chemically synthesized
cagccctgggattcccatcagg

SEQ ID NO: 80332 - DNA, 22 bp, Artificial Sequence
  chemically synthesized
ggattcccatcaggacatacca

SEQ ID NO: 80333 - DNA, 22 bp, Artificial Sequence
  chemically synthesized
ccatcaggacataccacacatc

SEQ ID NO: 80334 - DNA, 22 bp, Artificial Sequence
  chemically synthesized
ggaattagtgtgattgcgaaag

SEQ ID NO: 80335 - DNA, 22 bp, Artificial Sequence
  chemically synthesized
gtgtgattgcgaaagaaaggag

SEQ ID NO: 80336 - DNA, 22 bp, Artificial Sequence
  chemically synthesized
cgaaagaaaggagccgtatgta

SEQ ID NO: 80337 - DNA, 22 bp, Artificial Sequence
  chemically synthesized
attccaggcctagtgccattag

SEQ ID NO: 80338 - DNA, 22 bp, Artificial Sequence
  chemically synthesized
ttccaggcctagtgccattagt

SEQ ID NO: 80339 - DNA, 22 bp, Artificial Sequence
  chemically synthesized
caggcctagtgccattagtgaa

SEQ ID NO: 80340 - DNA, 22 bp, Artificial Sequence
  chemically synthesized
gtgccattagtgaaagactaca

SEQ ID NO: 80341 - DNA, 22 bp, Artificial Sequence
  chemically synthesized
gtgaaagactacaaagttgagg

SEQ ID NO: 80342 - DNA, 22 bp, Artificial Sequence
  chemically synthesized
caaagttgaggatttagaaaca

SEQ ID NO: 80343 - DNA, 22 bp, Artificial Sequence
  chemically synthesized
aggatttagaaacactacctta

SEQ ID NO: 80344 - DNA, 22 bp, Artificial Sequence
  chemically synthesized
agaaacactaccttaggctgaa

SEQ ID NO: 80345 - DNA, 22 bp, Artificial Sequence
  chemically synthesized
gaaacactaccttaggctgaat

SEQ ID NO: 80346 - DNA, 22 bp, Artificial Sequence
  chemically synthesized
ccttaggctgaatgaggtctca

SEQ ID NO: 80347 - DNA, 22 bp, Artificial Sequence
  chemically synthesized
aggctgaatgaggtctcatcag

SEQ ID NO: 80348 - DNA, 22 bp, Artificial Sequence
  chemically synthesized
ggctgaatgaggtctcatcaga

SEQ ID NO: 80349 - DNA, 22 bp, Artificial Sequence
  chemically synthesized
aatgaggtctcatcagatttgt

SEQ ID NO: 80350 - DNA, 22 bp, Artificial Sequence
  chemically synthesized
atcagatttgttttctttccaa

SEQ ID NO: 80351 - DNA, 22 bp, Artificial Sequence
  chemically synthesized
gttttctttccaatgttttctt

SEQ ID NO: 80352 - DNA, 22 bp, Artificial Sequence
  chemically synthesized
ttttctttccaatgttttcttc

SEQ ID NO: 80353 - DNA, 22 bp, Artificial Sequence
  chemically synthesized
tctttccaatgttttcttctct

SEQ ID NO: 80354 - DNA, 22 bp, Artificial Sequence
  chemically synthesized
ctttccaatgttttcttctctg

SEQ ID NO: 80355 - DNA, 22 bp, Artificial Sequence
  chemically synthesized
tttccaatgttttcttctctgg

SEQ ID NO: 80356 - DNA, 22 bp, Artificial Sequence
  chemically synthesized
tccaatgttttcttctctggga

SEQ ID NO: 80357 - DNA, 22 bp, Artificial Sequence
  chemically synthesized
ccaatgttttcttctctgggaa

SEQ ID NO: 80358 - DNA, 22 bp, Artificial Sequence
  chemically synthesized
caatgttttcttctctgggaaa

SEQ ID NO: 80359 - DNA, 22 bp, Artificial Sequence
  chemically synthesized
tcttctctgggaaaggagagta

SEQ ID NO: 80360 - DNA, 22 bp, Artificial Sequence
  chemically synthesized
cttctctgggaaaggagagtaa

SEQ ID NO: 80361 - DNA, 22 bp, Artificial Sequence
  chemically synthesized
ttctctgggaaaggagagtaaa

SEQ ID NO: 80362 - DNA, 22 bp, Artificial Sequence
  chemically synthesized
ctctgggaaaggagagtaaaat

SEQ ID NO: 80363 - DNA, 22 bp, Artificial Sequence
  chemically synthesized
tctgggaaaggagagtaaaatg

SEQ ID NO: 80364 - DNA, 22 bp, Artificial Sequence
  chemically synthesized
tgggaaaggagagtaaaatggg

SEQ ID NO: 80365 - DNA, 22 bp, Artificial Sequence
  chemically synthesized
ggaaaggagagtaaaatgggtt

SEQ ID NO: 80366 - DNA, 22 bp, Artificial Sequence
  chemically synthesized
atagaccgaatatataagtcct

SEQ ID NO: 80367 - DNA, 22 bp, Artificial Sequence
  chemically synthesized
ccaaataattaattttttgtac

SEQ ID NO: 80368 - DNA, 22 bp, Artificial Sequence
  chemically synthesized
attttttgtaccttaaaaaatt

SEQ ID NO: 80369 - DNA, 22 bp, Artificial Sequence
  chemically synthesized
tttgtaccttaaaaaattagta

SEQ ID NO: 80370 - DNA, 22 bp, Artificial Sequence
  chemically synthesized
ttgtaccttaaaaaattagtag

SEQ ID NO: 80371 - DNA, 22 bp, Artificial Sequence
  chemically synthesized
tgtaccttaaaaaattagtaga

SEQ ID NO: 80372 - DNA, 22 bp, Artificial Sequence
  chemically synthesized
gtaccttaaaaaattagtagat

SEQ ID NO: 80373 - DNA, 22 bp, Artificial Sequence
  chemically synthesized
taccttaaaaaattagtagata

SEQ ID NO: 80374 - DNA, 22 bp, Artificial Sequence
  chemically synthesized
aaaaaattagtagatattattt

SEQ ID NO: 80375 - DNA, 22 bp, Artificial Sequence
  chemically synthesized
aaaaattagtagatattattta

SEQ ID NO: 80376 - DNA, 22 bp, Artificial Sequence
  chemically synthesized
gtagatattatttaataactgc

SEQ ID NO: 80377 - DNA, 22 bp, Artificial Sequence
  chemically synthesized
tttaataactgcttaatatgtg

SEQ ID NO: 80378 - DNA, 22 bp, Artificial Sequence
  chemically synthesized
aataactgcttaatatgtgtca

SEQ ID NO: 80379 - DNA, 22 bp, Artificial Sequence
  chemically synthesized
ataactgcttaatatgtgtcat

SEQ ID NO: 80380 - DNA, 22 bp, Artificial Sequence
  chemically synthesized
cttaatatgtgtcatactactt

SEQ ID NO: 80381 - DNA, 22 bp, Artificial Sequence
  chemically synthesized
aatatgtgtcatactactttac

SEQ ID NO: 80382 - DNA, 22 bp, Artificial Sequence
  chemically synthesized
atatgtgtcatactactttaca

SEQ ID NO: 80383 - DNA, 22 bp, Artificial Sequence
  chemically synthesized
ctttacaaatattaacttatta

SEQ ID NO: 80384 - DNA, 22 bp, Artificial Sequence
  chemically synthesized
tacaaatattaacttattaaat

SEQ ID NO: 80385 - DNA, 22 bp, Artificial Sequence
  chemically synthesized
acaaatattaacttattaaatc

SEQ ID NO: 80386 - DNA, 22 bp, Artificial Sequence
  chemically synthesized
caaatattaacttattaaatct

SEQ ID NO: 80387 - DNA, 22 bp, Artificial Sequence
  chemically synthesized
acttattaaatcttcacaataa

SEQ ID NO: 80388 - DNA, 22 bp, Artificial Sequence
  chemically synthesized
attaaatcttcacaataaccta

SEQ ID NO: 80389 - DNA, 22 bp, Artificial Sequence
  chemically synthesized
ttaaatcttcacaataacctat

SEQ ID NO: 80390 - DNA, 22 bp, Artificial Sequence
  chemically synthesized
aatcttcacaataacctattga

SEQ ID NO: 80391 - DNA, 22 bp, Artificial Sequence
  chemically synthesized
cacaataacctattgaaaagcc

SEQ ID NO: 80392 - DNA, 22 bp, Artificial Sequence
  chemically synthesized
acaataacctattgaaaagccc

SEQ ID NO: 80393 - DNA, 22 bp, Artificial Sequence
  chemically synthesized
ttgaaaagccctttaaataacc

SEQ ID NO: 80394 - DNA, 22 bp, Artificial Sequence
  chemically synthesized
aaaagccctttaaataaccatt

SEQ ID NO: 80395 - DNA, 22 bp, Artificial Sequence
  chemically synthesized
taaataaccattatataaatac

SEQ ID NO: 80396 - DNA, 22 bp, Artificial Sequence
  chemically synthesized
aaataaccattatataaatact

SEQ ID NO: 80397 - DNA, 22 bp, Artificial Sequence
  chemically synthesized
aataaccattatataaatacta

SEQ ID NO: 80398 - DNA, 22 bp, Artificial Sequence
  chemically synthesized
tataaatactattatttctaca

SEQ ID NO: 80399 - DNA, 22 bp, Artificial Sequence
  chemically synthesized
ttatttctacagatgtaaaaaa

SEQ ID NO: 80400 - DNA, 22 bp, Artificial Sequence
  chemically synthesized
tttctacagatgtaaaaaaaac

SEQ ID NO: 80401 - DNA, 22 bp, Artificial Sequence
  chemically synthesized
ctacagatgtaaaaaaaaccca

SEQ ID NO: 80402 - DNA, 22 bp, Artificial Sequence
  chemically synthesized
tacagatgtaaaaaaaacccac

SEQ ID NO: 80403 - DNA, 22 bp, Artificial Sequence
  chemically synthesized
cagatgtaaaaaaaacccacag

SEQ ID NO: 80404 - DNA, 22 bp, Artificial Sequence
  chemically synthesized
tcagcctcttaccctaggccct

SEQ ID NO: 80405 - DNA, 22 bp, Artificial Sequence
  chemically synthesized
cagcctcttaccctaggcccta

SEQ ID NO: 80406 - DNA, 22 bp, Artificial Sequence
  chemically synthesized
agcctcttaccctaggccctac

SEQ ID NO: 80407 - DNA, 22 bp, Artificial Sequence
  chemically synthesized
ttaccctaggccctactggatt

SEQ ID NO: 80408 - DNA, 22 bp, Artificial Sequence
  chemically synthesized
accctaggccctactggattta

SEQ ID NO: 80409 - DNA, 22 bp, Artificial Sequence
  chemically synthesized
ccctaggccctactggatttaa

SEQ ID NO: 80410 - DNA, 22 bp, Artificial Sequence
  chemically synthesized
ggccctactggatttaaagtaa

SEQ ID NO: 80411 - DNA, 22 bp, Artificial Sequence
  chemically synthesized
ctggatttaaagtaaggcagga

SEQ ID NO: 80412 - DNA, 22 bp, Artificial Sequence
  chemically synthesized
gatttaaagtaaggcaggataa

SEQ ID NO: 80413 - DNA, 22 bp, Artificial Sequence
  chemically synthesized
aaagtaaggcaggataaatctg

SEQ ID NO: 80414 - DNA, 22 bp, Artificial Sequence
  chemically synthesized
aagtaaggcaggataaatctga

SEQ ID NO: 80415 - DNA, 22 bp, Artificial Sequence
  chemically synthesized
aaagctttgatctttactacca

SEQ ID NO: 80416 - DNA, 22 bp, Artificial Sequence
  chemically synthesized
tgatctttactaccatccaatg

SEQ ID NO: 80417 - DNA, 22 bp, Artificial Sequence
  chemically synthesized
gatctttactaccatccaatgc

SEQ ID NO: 80418 - DNA, 22 bp, Artificial Sequence
  chemically synthesized
atctttactaccatccaatgct

SEQ ID NO: 80419 - DNA, 22 bp, Artificial Sequence
  chemically synthesized
tactaccatccaatgctgccta

SEQ ID NO: 80420 - DNA, 22 bp, Artificial Sequence
  chemically synthesized
actaccatccaatgctgcctat

SEQ ID NO: 80421 - DNA, 22 bp, Artificial Sequence
  chemically synthesized
ctaccatccaatgctgcctatc

SEQ ID NO: 80422 - DNA, 22 bp, Artificial Sequence
  chemically synthesized
ccatccaatgctgcctatcaag

SEQ ID NO: 80423 - DNA, 22 bp, Artificial Sequence
  chemically synthesized
cctatcaaggtaaaactagata

SEQ ID NO: 80424 - DNA, 22 bp, Artificial Sequence
  chemically synthesized
tcaaggtaaaactagatataaa

SEQ ID NO: 80425 - DNA, 22 bp, Artificial Sequence
  chemically synthesized
gatataaaacgcagcatcaaat

SEQ ID NO: 80426 - DNA, 22 bp, Artificial Sequence
  chemically synthesized
tttactgatcatatccctaagg

SEQ ID NO: 80427 - DNA, 22 bp, Artificial Sequence
  chemically synthesized
ttactgatcatatccctaagga

SEQ ID NO: 80428 - DNA, 22 bp, Artificial Sequence
  chemically synthesized
tactgatcatatccctaaggaa

SEQ ID NO: 80429 - DNA, 22 bp, Artificial Sequence
  chemically synthesized
actgatcatatccctaaggaaa

SEQ ID NO: 80430 - DNA, 22 bp, Artificial Sequence
  chemically synthesized
ctgatcatatccctaaggaaaa

SEQ ID NO: 80431 - DNA, 22 bp, Artificial Sequence
  chemically synthesized
atcatatccctaaggaaaatag

SEQ ID NO: 80432 - DNA, 22 bp, Artificial Sequence
  chemically synthesized
aggaaaatagagagttatgaaa

SEQ ID NO: 80433 - DNA, 22 bp, Artificial Sequence
  chemically synthesized
tgaaatttagttgtgctgctta

SEQ ID NO: 80434 - DNA, 22 bp, Artificial Sequence
  chemically synthesized
agttgtgctgcttacagaaatg

SEQ ID NO: 80435 - DNA, 22 bp, Artificial Sequence
  chemically synthesized
gttgtgctgcttacagaaatgg

SEQ ID NO: 80436 - DNA, 22 bp, Artificial Sequence
  chemically synthesized
tgctgcttacagaaatgggagg

SEQ ID NO: 80437 - DNA, 22 bp, Artificial Sequence
  chemically synthesized
cttacagaaatgggagggaatt

SEQ ID NO: 80438 - DNA, 22 bp, Artificial Sequence
  chemically synthesized
acagaaatgggagggaattaag

SEQ ID NO: 80439 - DNA, 22 bp, Artificial Sequence
  chemically synthesized
cagaaatgggagggaattaagt

SEQ ID NO: 80440 - DNA, 22 bp, Artificial Sequence
  chemically synthesized
agtctgacaaaatagatttcaa

SEQ ID NO: 80441 - DNA, 22 bp, Artificial Sequence
  chemically synthesized
acaaaatagatttcaagcaata

SEQ ID NO: 80442 - DNA, 22 bp, Artificial Sequence
  chemically synthesized
caagcaatatagcatgtatgcc

SEQ ID NO: 80443 - DNA, 22 bp, Artificial Sequence
  chemically synthesized
aagcaatatagcatgtatgcct

SEQ ID NO: 80444 - DNA, 22 bp, Artificial Sequence
  chemically synthesized
cttccacattgattggccttaa

SEQ ID NO: 80445 - DNA, 22 bp, Artificial Sequence
  chemically synthesized
ttccacattgattggccttaac

SEQ ID NO: 80446 - DNA, 22 bp, Artificial Sequence
  chemically synthesized
ccacattgattggccttaactt

SEQ ID NO: 80447 - DNA, 22 bp, Artificial Sequence
  chemically synthesized
cacattgattggccttaactta

SEQ ID NO: 80448 - DNA, 22 bp, Artificial Sequence
  chemically synthesized
attggccttaacttattgttaa

SEQ ID NO: 80449 - DNA, 22 bp, Artificial Sequence
  chemically synthesized
gccttaacttattgttaagcca

SEQ ID NO: 80450 - DNA, 22 bp, Artificial Sequence
  chemically synthesized
aacttattgttaagccatatgc

SEQ ID NO: 80451 - DNA, 22 bp, Artificial Sequence
  chemically synthesized
acttattgttaagccatatgct

SEQ ID NO: 80452 - DNA, 22 bp, Artificial Sequence
  chemically synthesized
attgttaagccatatgctagcc

SEQ ID NO: 80453 - DNA, 22 bp, Artificial Sequence
  chemically synthesized
ttgttaagccatatgctagcca

SEQ ID NO: 80454 - DNA, 22 bp, Artificial Sequence
  chemically synthesized
ttaagccatatgctagccattg

SEQ ID NO: 80455 - DNA, 22 bp, Artificial Sequence
  chemically synthesized
agccatatgctagccattgaag

SEQ ID NO: 80456 - DNA, 22 bp, Artificial Sequence
  chemically synthesized
gccattgaagacatacagcaaa

SEQ ID NO: 80457 - DNA, 22 bp, Artificial Sequence
  chemically synthesized
aagacatacagcaaattaaatt

SEQ ID NO: 80458 - DNA, 22 bp, Artificial Sequence
  chemically synthesized
aattgttctgccaattaatcta

SEQ ID NO: 80459 - DNA, 22 bp, Artificial Sequence
  chemically synthesized
ttctgccaattaatctatttct

SEQ ID NO: 80460 - DNA, 22 bp, Artificial Sequence
  chemically synthesized
tgccaattaatctatttctcaa

SEQ ID NO: 80461 - DNA, 22 bp, Artificial Sequence
  chemically synthesized
ccaattaatctatttctcaaaa

SEQ ID NO: 80462 - DNA, 22 bp, Artificial Sequence
  chemically synthesized
atctatttctcaaaaatatagg

SEQ ID NO: 80463 - DNA, 22 bp, Artificial Sequence
  chemically synthesized
tttctcaaaaatataggataaa

SEQ ID NO: 80464 - DNA, 22 bp, Artificial Sequence
  chemically synthesized
ctcaaaaatataggataaaaca

SEQ ID NO: 80465 - DNA, 22 bp, Artificial Sequence
  chemically synthesized
tcaaaaatataggataaaacat

SEQ ID NO: 80466 - DNA, 22 bp, Artificial Sequence
  chemically synthesized
aaaaatataggataaaacatta

SEQ ID NO: 80467 - DNA, 22 bp, Artificial Sequence
  chemically synthesized
taaactttagatatttgcaatg

SEQ ID NO: 80468 - DNA, 22 bp, Artificial Sequence
  chemically synthesized
tagatatttgcaatggcagacg

SEQ ID NO: 80469 - DNA, 22 bp, Artificial Sequence
  chemically synthesized
agatatttgcaatggcagacgg

SEQ ID NO: 80470 - DNA, 22 bp, Artificial Sequence
  chemically synthesized
gatatttgcaatggcagacgga

SEQ ID NO: 80471 - DNA, 22 bp, Artificial Sequence
  chemically synthesized
gcaatggcagacggagctgggt

SEQ ID NO: 80472 - DNA, 22 bp, Artificial Sequence
  chemically synthesized
caatggcagacggagctgggtt

SEQ ID NO: 80473 - DNA, 22 bp, Artificial Sequence
  chemically synthesized
ggtttttaaatctatatgccag

SEQ ID NO: 80474 - DNA, 22 bp, Artificial Sequence
  chemically synthesized
ttaaatctatatgccagcctgg

SEQ ID NO: 80475 - DNA, 22 bp, Artificial Sequence
  chemically synthesized
taaatctatatgccagcctggc

SEQ ID NO: 80476 - DNA, 22 bp, Artificial Sequence
  chemically synthesized
aaatctatatgccagcctggca

SEQ ID NO: 80477 - DNA, 22 bp, Artificial Sequence
  chemically synthesized
aatctatatgccagcctggcac

SEQ ID NO: 80478 - DNA, 22 bp, Artificial Sequence
  chemically synthesized
tatgccagcctggcacggtggc

SEQ ID NO: 80479 - DNA, 22 bp, Artificial Sequence
  chemically synthesized
gcacggtggctcacacctgtaa

SEQ ID NO: 80480 - DNA, 22 bp, Artificial Sequence
  chemically synthesized
acacctgtaatcccagcacttt

SEQ ID NO: 80481 - DNA, 22 bp, Artificial Sequence
  chemically synthesized
taatcccagcactttgagaggc

SEQ ID NO: 80482 - DNA, 22 bp, Artificial Sequence
  chemically synthesized
tgagaggctgaggcgggtagat

SEQ ID NO: 80483 - DNA, 22 bp, Artificial Sequence
  chemically synthesized
gagaggctgaggcgggtagatc

SEQ ID NO: 80484 - DNA, 22 bp, Artificial Sequence
  chemically synthesized
agaggctgaggcgggtagatca

SEQ ID NO: 80485 - DNA, 22 bp, Artificial Sequence
  chemically synthesized
aggcgggtagatcacaaggtca

SEQ ID NO: 80486 - DNA, 22 bp, Artificial Sequence
  chemically synthesized
cagaccagcttgaccaaaacaa

SEQ ID NO: 80487 - DNA, 22 bp, Artificial Sequence
  chemically synthesized
gaccaaaacaatgaaaccccgt

SEQ ID NO: 80488 - DNA, 22 bp, Artificial Sequence
  chemically synthesized
accaaaacaatgaaaccccgtc

SEQ ID NO: 80489 - DNA, 22 bp, Artificial Sequence
  chemically synthesized
tactaaaaatacaaaaattagc

SEQ ID NO: 80490 - DNA, 22 bp, Artificial Sequence
  chemically synthesized
ctaaaaatacaaaaattagctg

SEQ ID NO: 80491 - DNA, 22 bp, Artificial Sequence
  chemically synthesized
aaaatacaaaaattagctgggc

SEQ ID NO: 80492 - DNA, 22 bp, Artificial Sequence
  chemically synthesized
gctgggcatagtggtgtgcacc

SEQ ID NO: 80493 - DNA, 22 bp, Artificial Sequence
  chemically synthesized
ggcatagtggtgtgcaccttta

SEQ ID NO: 80494 - DNA, 22 bp, Artificial Sequence
  chemically synthesized
taatcccagctactcaagaggc

SEQ ID NO: 80495 - DNA, 22 bp, Artificial Sequence
  chemically synthesized
aatcccagctactcaagaggct

SEQ ID NO: 80496 - DNA, 22 bp, Artificial Sequence
  chemically synthesized
atcccagctactcaagaggctg

SEQ ID NO: 80497 - DNA, 22 bp, Artificial Sequence
  chemically synthesized
ctcaagaggctgaggcaggaga

SEQ ID NO: 80498 - DNA, 22 bp, Artificial Sequence
  chemically synthesized
aagaggctgaggcaggagaatc

SEQ ID NO: 80499 - DNA, 22 bp, Artificial Sequence
  chemically synthesized
aggcaggagaatcgcttgaacc

SEQ ID NO: 80500 - DNA, 22 bp, Artificial Sequence
  chemically synthesized
gaacctgggaggcagaagtttc

SEQ ID NO: 80501 - DNA, 22 bp, Artificial Sequence
  chemically synthesized
aacctgggaggcagaagtttca

SEQ ID NO: 80502 - DNA, 22 bp, Artificial Sequence
  chemically synthesized
ggaggcagaagtttcagtgagc

SEQ ID NO: 80503 - DNA, 22 bp, Artificial Sequence
  chemically synthesized
cagtgagcagagatcgcgcaac

SEQ ID NO: 80504 - DNA, 22 bp, Artificial Sequence
  chemically synthesized
agtgagcagagatcgcgcaact

SEQ ID NO: 80505 - DNA, 22 bp, Artificial Sequence
  chemically synthesized
cactccagcctaggtgacagag

SEQ ID NO: 80506 - DNA, 22 bp, Artificial Sequence
  chemically synthesized
cagcctaggtgacagagcgaga

SEQ ID NO: 80507 - DNA, 22 bp, Artificial Sequence
  chemically synthesized
ggtgacagagcgagactccctc

SEQ ID NO: 80508 - DNA, 22 bp, Artificial Sequence
  chemically synthesized
cctctcaaaaaaaaaagtatat

SEQ ID NO: 80509 - DNA, 22 bp, Artificial Sequence
  chemically synthesized
tcaaaaaaaaaagtatatgcct

SEQ ID NO: 80510 - DNA, 22 bp, Artificial Sequence
  chemically synthesized
aaaaaaaaaagtatatgcctca

SEQ ID NO: 80511 - DNA, 22 bp, Artificial Sequence
  chemically synthesized
ataggtggtaaagaataaaata

SEQ ID NO: 80512 - DNA, 22 bp, Artificial Sequence
  chemically synthesized
tgtttctttccacttcagtcac

SEQ ID NO: 80513 - DNA, 22 bp, Artificial Sequence
  chemically synthesized
gtttctttccacttcagtcact

SEQ ID NO: 80514 - DNA, 22 bp, Artificial Sequence
  chemically synthesized
tttctttccacttcagtcactg

SEQ ID NO: 80515 - DNA, 22 bp, Artificial Sequence
  chemically synthesized
ctttccacttcagtcactgatt

SEQ ID NO: 80516 - DNA, 22 bp, Artificial Sequence
  chemically synthesized
tttccacttcagtcactgattg

SEQ ID NO: 80517 - DNA, 22 bp, Artificial Sequence
  chemically synthesized
tccacttcagtcactgattgaa

SEQ ID NO: 80518 - DNA, 22 bp, Artificial Sequence
  chemically synthesized
ccacttcagtcactgattgaaa

SEQ ID NO: 80519 - DNA, 22 bp, Artificial Sequence
  chemically synthesized
cacttcagtcactgattgaaaa

SEQ ID NO: 80520 - DNA, 22 bp, Artificial Sequence
  chemically synthesized
cagtcactgattgaaaatgaga

SEQ ID NO: 80521 - DNA, 22 bp, Artificial Sequence
  chemically synthesized
agtcactgattgaaaatgagac

SEQ ID NO: 80522 - DNA, 22 bp, Artificial Sequence
  chemically synthesized
attgaaaatgagacaatacaca

SEQ ID NO: 80523 - DNA, 22 bp, Artificial Sequence
  chemically synthesized
aaaatgagacaatacacattgt

SEQ ID NO: 80524 - DNA, 22 bp, Artificial Sequence
  chemically synthesized
tatatatatatatatgtttatt

SEQ ID NO: 80525 - DNA, 22 bp, Artificial Sequence
  chemically synthesized
attatactttaagttctagggt

SEQ ID NO: 80526 - DNA, 22 bp, Artificial Sequence
  chemically synthesized
ttatactttaagttctagggta

SEQ ID NO: 80527 - DNA, 22 bp, Artificial Sequence
  chemically synthesized
tactttaagttctagggtacat

SEQ ID NO: 80528 - DNA, 22 bp, Artificial Sequence
  chemically synthesized
taagttctagggtacatgtgca

SEQ ID NO: 80529 - DNA, 22 bp, Artificial Sequence
  chemically synthesized
aagttctagggtacatgtgcac

SEQ ID NO: 80530 - DNA, 22 bp, Artificial Sequence
  chemically synthesized
agttctagggtacatgtgcaca

SEQ ID NO: 80531 - DNA, 22 bp, Artificial Sequence
  chemically synthesized
tagggtacatgtgcacaacatg

SEQ ID NO: 80532 - DNA, 22 bp, Artificial Sequence
  chemically synthesized
gggtacatgtgcacaacatgca

SEQ ID NO: 80533 - DNA, 22 bp, Artificial Sequence
  chemically synthesized
gttacatatgtatacatgtgcc

SEQ ID NO: 80534 - DNA, 22 bp, Artificial Sequence
  chemically synthesized
ttacatatgtatacatgtgcca

SEQ ID NO: 80535 - DNA, 22 bp, Artificial Sequence
  chemically synthesized
catatgtatacatgtgccatgt

SEQ ID NO: 80536 - DNA, 22 bp, Artificial Sequence
  chemically synthesized
gtgtgctgcacccattaactcg

SEQ ID NO: 80537 - DNA, 22 bp, Artificial Sequence
  chemically synthesized
cacccattaactcgtcatttac

SEQ ID NO: 80538 - DNA, 22 bp, Artificial Sequence
  chemically synthesized
actcgtcatttacattaggtat

SEQ ID NO: 80539 - DNA, 22 bp, Artificial Sequence
  chemically synthesized
gtcatttacattaggtatatct

SEQ ID NO: 80540 - DNA, 22 bp, Artificial Sequence
  chemically synthesized
acattaggtatatctcctaatg

SEQ ID NO: 80541 - DNA, 22 bp, Artificial Sequence
  chemically synthesized
cattaggtatatctcctaatgc

SEQ ID NO: 80542 - DNA, 22 bp, Artificial Sequence
  chemically synthesized
ggtatatctcctaatgctatcc

SEQ ID NO: 80543 - DNA, 22 bp, Artificial Sequence
  chemically synthesized
ctaatgctatccctccccccgg

SEQ ID NO: 80544 - DNA, 22 bp, Artificial Sequence
  chemically synthesized
atgctatccctccccccggccc

SEQ ID NO: 80545 - DNA, 22 bp, Artificial Sequence
  chemically synthesized
tccctccccccggcccccaccc

SEQ ID NO: 80546 - DNA, 22 bp, Artificial Sequence
  chemically synthesized
cccccggcccccaccccacaac

SEQ ID NO: 80547 - DNA, 22 bp, Artificial Sequence
  chemically synthesized
ccctcactgtgtccaaatgttc

SEQ ID NO: 80548 - DNA, 22 bp, Artificial Sequence
  chemically synthesized
actgtgtccaaatgttctcatt

SEQ ID NO: 80549 - DNA, 22 bp, Artificial Sequence
  chemically synthesized
tgtccaaatgttctcattgttc

SEQ ID NO: 80550 - DNA, 22 bp, Artificial Sequence
  chemically synthesized
tcattgttcaactcccacctat

SEQ ID NO: 80551 - DNA, 22 bp, Artificial Sequence
  chemically synthesized
attgttcaactcccacctatga

SEQ ID NO: 80552 - DNA, 22 bp, Artificial Sequence
  chemically synthesized
ttcaactcccacctatgagtga

SEQ ID NO: 80553 - DNA, 22 bp, Artificial Sequence
  chemically synthesized
aactcccacctatgagtgagaa

SEQ ID NO: 80554 - DNA, 22 bp, Artificial Sequence
  chemically synthesized
ccacctatgagtgagaatatgt

SEQ ID NO: 80555 - DNA, 22 bp, Artificial Sequence
  chemically synthesized
tgagtgagaatatgtggtgttt

SEQ ID NO: 80556 - DNA, 22 bp, Artificial Sequence
  chemically synthesized
ggtttttcgtccttgcgatact

SEQ ID NO: 80557 - DNA, 22 bp, Artificial Sequence
  chemically synthesized
gtttttcgtccttgcgatactt

SEQ ID NO: 80558 - DNA, 22 bp, Artificial Sequence
  chemically synthesized
ttcgtccttgcgatactttgct

SEQ ID NO: 80559 - DNA, 22 bp, Artificial Sequence
  chemically synthesized
tcgtccttgcgatactttgctc

SEQ ID NO: 80560 - DNA, 22 bp, Artificial Sequence
  chemically synthesized
cgtccttgcgatactttgctca

SEQ ID NO: 80561 - DNA, 22 bp, Artificial Sequence
  chemically synthesized
gtccttgcgatactttgctcag

SEQ ID NO: 80562 - DNA, 22 bp, Artificial Sequence
  chemically synthesized
gcgatactttgctcagaatgat

SEQ ID NO: 80563 - DNA, 22 bp, Artificial Sequence
  chemically synthesized
cgatactttgctcagaatgatg

SEQ ID NO: 80564 - DNA, 22 bp, Artificial Sequence
  chemically synthesized
tgctcagaatgatggtttccag

SEQ ID NO: 80565 - DNA, 22 bp, Artificial Sequence
  chemically synthesized
gctcagaatgatggtttccagt

SEQ ID NO: 80566 - DNA, 22 bp, Artificial Sequence
  chemically synthesized
ctcagaatgatggtttccagtt

SEQ ID NO: 80567 - DNA, 22 bp, Artificial Sequence
  chemically synthesized
agaatgatggtttccagtttca

SEQ ID NO: 80568 - DNA, 22 bp, Artificial Sequence
  chemically synthesized
ccagtttcatccatgtccctac

SEQ ID NO: 80569 - DNA, 22 bp, Artificial Sequence
  chemically synthesized
cagtttcatccatgtccctaca

SEQ ID NO: 80570 - DNA, 22 bp, Artificial Sequence
  chemically synthesized
catccatgtccctacaaaggac

SEQ ID NO: 80571 - DNA, 22 bp, Artificial Sequence
  chemically synthesized
atccatgtccctacaaaggaca

SEQ ID NO: 80572 - DNA, 22 bp, Artificial Sequence
  chemically synthesized
caaaggacatgaactcatcatt

SEQ ID NO: 80573 - DNA, 22 bp, Artificial Sequence
  chemically synthesized
atcattttttatggctgcatag

SEQ ID NO: 80574 - DNA, 22 bp, Artificial Sequence
  chemically synthesized
tttatggctgcatagtattcca

SEQ ID NO: 80575 - DNA, 22 bp, Artificial Sequence
  chemically synthesized
ttatggctgcatagtattccat

SEQ ID NO: 80576 - DNA, 22 bp, Artificial Sequence
  chemically synthesized
tatggctgcatagtattccatg

SEQ ID NO: 80577 - DNA, 22 bp, Artificial Sequence
  chemically synthesized
atggctgcatagtattccatga

SEQ ID NO: 80578 - DNA, 22 bp, Artificial Sequence
  chemically synthesized
tggctgcatagtattccatgat

SEQ ID NO: 80579 - DNA, 22 bp, Artificial Sequence
  chemically synthesized
catagtattccatgatgtatat

SEQ ID NO: 80580 - DNA, 22 bp, Artificial Sequence
  chemically synthesized
catgatgtatatgtgccacatt

SEQ ID NO: 80581 - DNA, 22 bp, Artificial Sequence
  chemically synthesized
tcttaatccagtctatcattgt

SEQ ID NO: 80582 - DNA, 22 bp, Artificial Sequence
  chemically synthesized
cttaatccagtctatcattgtt

SEQ ID NO: 80583 - DNA, 22 bp, Artificial Sequence
  chemically synthesized
ttaatccagtctatcattgttg

SEQ ID NO: 80584 - DNA, 22 bp, Artificial Sequence
  chemically synthesized
aatccagtctatcattgttgga

SEQ ID NO: 80585 - DNA, 22 bp, Artificial Sequence
  chemically synthesized
atccagtctatcattgttggac

SEQ ID NO: 80586 - DNA, 22 bp, Artificial Sequence
  chemically synthesized
tcattgttggacatttgggttg

SEQ ID NO: 80587 - DNA, 22 bp, Artificial Sequence
  chemically synthesized
ttggacatttgggttggttcca

SEQ ID NO: 80588 - DNA, 22 bp, Artificial Sequence
  chemically synthesized
gacatttgggttggttccaagt

SEQ ID NO: 80589 - DNA, 22 bp, Artificial Sequence
  chemically synthesized
gggttggttccaagtctttgct

SEQ ID NO: 80590 - DNA, 22 bp, Artificial Sequence
  chemically synthesized
ggttggttccaagtctttgcta

SEQ ID NO: 80591 - DNA, 22 bp, Artificial Sequence
  chemically synthesized
gttccaagtctttgctattgtg

SEQ ID NO: 80592 - DNA, 22 bp, Artificial Sequence
  chemically synthesized
caagtctttgctattgtgaata

SEQ ID NO: 80593 - DNA, 22 bp, Artificial Sequence
  chemically synthesized
tgctattgtgaatagtgccaca

SEQ ID NO: 80594 - DNA, 22 bp, Artificial Sequence
  chemically synthesized
gctattgtgaatagtgccacaa

SEQ ID NO: 80595 - DNA, 22 bp, Artificial Sequence
  chemically synthesized
ctattgtgaatagtgccacaat

SEQ ID NO: 80596 - DNA, 22 bp, Artificial Sequence
  chemically synthesized
ttgtgaatagtgccacaataaa

SEQ ID NO: 80597 - DNA, 22 bp, Artificial Sequence
  chemically synthesized
tgaatagtgccacaataaacat

SEQ ID NO: 80598 - DNA, 22 bp, Artificial Sequence
  chemically synthesized
tatagcagcatgatttacattc

SEQ ID NO: 80599 - DNA, 22 bp, Artificial Sequence
  chemically synthesized
atagcagcatgatttacattcc

SEQ ID NO: 80600 - DNA, 22 bp, Artificial Sequence
  chemically synthesized
tagcagcatgatttacattcct

SEQ ID NO: 80601 - DNA, 22 bp, Artificial Sequence
  chemically synthesized
acattcctttgggtatataccc

SEQ ID NO: 80602 - DNA, 22 bp, Artificial Sequence
  chemically synthesized
cattcctttgggtatataccca

SEQ ID NO: 80603 - DNA, 22 bp, Artificial Sequence
  chemically synthesized
ctttgggtatatacccagtaat

SEQ ID NO: 80604 - DNA, 22 bp, Artificial Sequence
  chemically synthesized
tgggtatatacccagtaatagg

SEQ ID NO: 80605 - DNA, 22 bp, Artificial Sequence
  chemically synthesized
gggtatatacccagtaatagga

SEQ ID NO: 80606 - DNA, 22 bp, Artificial Sequence
  chemically synthesized
ggtatatacccagtaataggat

SEQ ID NO: 80607 - DNA, 22 bp, Artificial Sequence
  chemically synthesized
ggtcaaatggtatttctagttc

SEQ ID NO: 80608 - DNA, 22 bp, Artificial Sequence
  chemically synthesized
ctagttctagatccctgaggaa

SEQ ID NO: 80609 - DNA, 22 bp, Artificial Sequence
  chemically synthesized
tagttctagatccctgaggaat

SEQ ID NO: 80610 - DNA, 22 bp, Artificial Sequence
  chemically synthesized
gttctagatccctgaggaattg

SEQ ID NO: 80611 - DNA, 22 bp, Artificial Sequence
  chemically synthesized
tagatccctgaggaattgccac

SEQ ID NO: 80612 - DNA, 22 bp, Artificial Sequence
  chemically synthesized
gatccctgaggaattgccacac

SEQ ID NO: 80613 - DNA, 22 bp, Artificial Sequence
  chemically synthesized
aggaattgccacactgacttcc

SEQ ID NO: 80614 - DNA, 22 bp, Artificial Sequence
  chemically synthesized
ccacactgacttccacaatggt

SEQ ID NO: 80615 - DNA, 22 bp, Artificial Sequence
  chemically synthesized
acttccacaatggttgaactag

SEQ ID NO: 80616 - DNA, 22 bp, Artificial Sequence
  chemically synthesized
ccacaatggttgaactagttta

SEQ ID NO: 80617 - DNA, 22 bp, Artificial Sequence
  chemically synthesized
cacaatggttgaactagtttat

SEQ ID NO: 80618 - DNA, 22 bp, Artificial Sequence
  chemically synthesized
aactagtttatagtcccaccaa

SEQ ID NO: 80619 - DNA, 22 bp, Artificial Sequence
  chemically synthesized
gtttatagtcccaccaacagtg

SEQ ID NO: 80620 - DNA, 22 bp, Artificial Sequence
  chemically synthesized
atagtcccaccaacagtgtaaa

SEQ ID NO: 80621 - DNA, 22 bp, Artificial Sequence
  chemically synthesized
tagtcccaccaacagtgtaaaa

SEQ ID NO: 80622 - DNA, 22 bp, Artificial Sequence
  chemically synthesized
ctatttctccacatcctctcca

SEQ ID NO: 80623 - DNA, 22 bp, Artificial Sequence
  chemically synthesized
tttctccacatcctctccagca

SEQ ID NO: 80624 - DNA, 22 bp, Artificial Sequence
  chemically synthesized
ctccacatcctctccagcacct

SEQ ID NO: 80625 - DNA, 22 bp, Artificial Sequence
  chemically synthesized
tccacatcctctccagcacctg

SEQ ID NO: 80626 - DNA, 22 bp, Artificial Sequence
  chemically synthesized
cacatcctctccagcacctgtg

SEQ ID NO: 80627 - DNA, 22 bp, Artificial Sequence
  chemically synthesized
tccagcacctgtggtttcctga

SEQ ID NO: 80628 - DNA, 22 bp, Artificial Sequence
  chemically synthesized
cagcacctgtggtttcctgact

SEQ ID NO: 80629 - DNA, 22 bp, Artificial Sequence
  chemically synthesized
tggtttcctgactttttaatga

SEQ ID NO: 80630 - DNA, 22 bp, Artificial Sequence
  chemically synthesized
cctgactttttaatgatcacca

SEQ ID NO: 80631 - DNA, 22 bp, Artificial Sequence
  chemically synthesized
ctgactttttaatgatcaccat

SEQ ID NO: 80632 - DNA, 22 bp, Artificial Sequence
  chemically synthesized
actttttaatgatcaccattct

SEQ ID NO: 80633 - DNA, 22 bp, Artificial Sequence
  chemically synthesized
tttaatgatcaccattctaact

SEQ ID NO: 80634 - DNA, 22 bp, Artificial Sequence
  chemically synthesized
ttaatgatcaccattctaactg

SEQ ID NO: 80635 - DNA, 22 bp, Artificial Sequence
  chemically synthesized
taatgatcaccattctaactgg

SEQ ID NO: 80636 - DNA, 22 bp, Artificial Sequence
  chemically synthesized
aatgatcaccattctaactggt

SEQ ID NO: 80637 - DNA, 22 bp, Artificial Sequence
  chemically synthesized
atgatcaccattctaactggtg

SEQ ID NO: 80638 - DNA, 22 bp, Artificial Sequence
  chemically synthesized
taactggtgtgagatgatatct

SEQ ID NO: 80639 - DNA, 22 bp, Artificial Sequence
  chemically synthesized
actggtgtgagatgatatctca

SEQ ID NO: 80640 - DNA, 22 bp, Artificial Sequence
  chemically synthesized
gtgtgagatgatatctcattgt

SEQ ID NO: 80641 - DNA, 22 bp, Artificial Sequence
  chemically synthesized
attgtggttttgatttgcattt

SEQ ID NO: 80642 - DNA, 22 bp, Artificial Sequence
  chemically synthesized
tggttttgatttgcatttctct

SEQ ID NO: 80643 - DNA, 22 bp, Artificial Sequence
  chemically synthesized
tgatttgcatttctctgatggc

SEQ ID NO: 80644 - DNA, 22 bp, Artificial Sequence
  chemically synthesized
gatttgcatttctctgatggcc

SEQ ID NO: 80645 - DNA, 22 bp, Artificial Sequence
  chemically synthesized
atttgcatttctctgatggcca

SEQ ID NO: 80646 - DNA, 22 bp, Artificial Sequence
  chemically synthesized
gcatttctctgatggccagtga

SEQ ID NO: 80647 - DNA, 22 bp, Artificial Sequence
  chemically synthesized
catttctctgatggccagtgat

SEQ ID NO: 80648 - DNA, 22 bp, Artificial Sequence
  chemically synthesized
ctctgatggccagtgatgatga

SEQ ID NO: 80649 - DNA, 22 bp, Artificial Sequence
  chemically synthesized
tctgatggccagtgatgatgag

SEQ ID NO: 80650 - DNA, 22 bp, Artificial Sequence
  chemically synthesized
tgatggccagtgatgatgagca

SEQ ID NO: 80651 - DNA, 22 bp, Artificial Sequence
  chemically synthesized
atggccagtgatgatgagcatt

SEQ ID NO: 80652 - DNA, 22 bp, Artificial Sequence
  chemically synthesized
tttcatgtgttttttggctgca

SEQ ID NO: 80653 - DNA, 22 bp, Artificial Sequence
  chemically synthesized
ttcatgtgttttttggctgcat

SEQ ID NO: 80654 - DNA, 22 bp, Artificial Sequence
  chemically synthesized
tcatgtgttttttggctgcata

SEQ ID NO: 80655 - DNA, 22 bp, Artificial Sequence
  chemically synthesized
catgtgttttttggctgcataa

SEQ ID NO: 80656 - DNA, 22 bp, Artificial Sequence
  chemically synthesized
atgtgttttttggctgcataaa

SEQ ID NO: 80657 - DNA, 22 bp, Artificial Sequence
  chemically synthesized
tttggctgcataaatgtcttct

SEQ ID NO: 80658 - DNA, 22 bp, Artificial Sequence
  chemically synthesized
ttggctgcataaatgtcttctt

SEQ ID NO: 80659 - DNA, 22 bp, Artificial Sequence
  chemically synthesized
tggctgcataaatgtcttcttt

SEQ ID NO: 80660 - DNA, 22 bp, Artificial Sequence
  chemically synthesized
ggctgcataaatgtcttctttt

SEQ ID NO: 80661 - DNA, 22 bp, Artificial Sequence
  chemically synthesized
gctgcataaatgtcttcttttg

SEQ ID NO: 80662 - DNA, 22 bp, Artificial Sequence
  chemically synthesized
cataaatgtcttcttttgagaa

SEQ ID NO: 80663 - DNA, 22 bp, Artificial Sequence
  chemically synthesized
cttttgagaagtgtctgttcat

SEQ ID NO: 80664 - DNA, 22 bp, Artificial Sequence
  chemically synthesized
ttttgagaagtgtctgttcata

SEQ ID NO: 80665 - DNA, 22 bp, Artificial Sequence
  chemically synthesized
ttgagaagtgtctgttcatatc

SEQ ID NO: 80666 - DNA, 22 bp, Artificial Sequence
  chemically synthesized
tgagaagtgtctgttcatatcc

SEQ ID NO: 80667 - DNA, 22 bp, Artificial Sequence
  chemically synthesized
gagaagtgtctgttcatatcct

SEQ ID NO: 80668 - DNA, 22 bp, Artificial Sequence
  chemically synthesized
agaagtgtctgttcatatcctt

SEQ ID NO: 80669 - DNA, 22 bp, Artificial Sequence
  chemically synthesized
ttcatatccttcacccccttgt

SEQ ID NO: 80670 - DNA, 22 bp, Artificial Sequence
  chemically synthesized
atatccttcacccccttgttga

SEQ ID NO: 80671 - DNA, 22 bp, Artificial Sequence
  chemically synthesized
cacccccttgttgatgcagttg

SEQ ID NO: 80672 - DNA, 22 bp, Artificial Sequence
  chemically synthesized
acccccttgttgatgcagttgt

SEQ ID NO: 80673 - DNA, 22 bp, Artificial Sequence
  chemically synthesized
gttgatgcagttgtttgttttt

SEQ ID NO: 80674 - DNA, 22 bp, Artificial Sequence
  chemically synthesized
ttgatgcagttgtttgtttttt

SEQ ID NO: 80675 - DNA, 22 bp, Artificial Sequence
  chemically synthesized
atgcagttgtttgtttttttct

SEQ ID NO: 80676 - DNA, 22 bp, Artificial Sequence
  chemically synthesized
tttgtttttttcttgtaaattt

SEQ ID NO: 80677 - DNA, 22 bp, Artificial Sequence
  chemically synthesized
gtttttttcttgtaaatttgtt

SEQ ID NO: 80678 - DNA, 22 bp, Artificial Sequence
  chemically synthesized
tttttttcttgtaaatttgttt

SEQ ID NO: 80679 - DNA, 22 bp, Artificial Sequence
  chemically synthesized
ttttcttgtaaatttgtttgag

SEQ ID NO: 80680 - DNA, 22 bp, Artificial Sequence
  chemically synthesized
tttcttgtaaatttgtttgagt

SEQ ID NO: 80681 - DNA, 22 bp, Artificial Sequence
  chemically synthesized
ttcttgtaaatttgtttgagtt

SEQ ID NO: 80682 - DNA, 22 bp, Artificial Sequence
  chemically synthesized
tcttgtaaatttgtttgagttc

SEQ ID NO: 80683 - DNA, 22 bp, Artificial Sequence
  chemically synthesized
cttgtaaatttgtttgagttca

SEQ ID NO: 80684 - DNA, 22 bp, Artificial Sequence
  chemically synthesized
ttgtaaatttgtttgagttcat

SEQ ID NO: 80685 - DNA, 22 bp, Artificial Sequence
  chemically synthesized
gtaaatttgtttgagttcattg

SEQ ID NO: 80686 - DNA, 22 bp, Artificial Sequence
  chemically synthesized
taaatttgtttgagttcattgt

SEQ ID NO: 80687 - DNA, 22 bp, Artificial Sequence
  chemically synthesized
gtttgagttcattgtagattct

SEQ ID NO: 80688 - DNA, 22 bp, Artificial Sequence
  chemically synthesized
tttgagttcattgtagattctg

SEQ ID NO: 80689 - DNA, 22 bp, Artificial Sequence
  chemically synthesized
gagttcattgtagattctggat

SEQ ID NO: 80690 - DNA, 22 bp, Artificial Sequence
  chemically synthesized
agttcattgtagattctggata

SEQ ID NO: 80691 - DNA, 22 bp, Artificial Sequence
  chemically synthesized
attgtagattctggatattagc

SEQ ID NO: 80692 - DNA, 22 bp, Artificial Sequence
  chemically synthesized
tagattctggatattagccctt

SEQ ID NO: 80693 - DNA, 22 bp, Artificial Sequence
  chemically synthesized
tggatattagccctttgtcaga

SEQ ID NO: 80694 - DNA, 22 bp, Artificial Sequence
  chemically synthesized
gatattagccctttgtcagatg

SEQ ID NO: 80695 - DNA, 22 bp, Artificial Sequence
  chemically synthesized
gccctttgtcagatgagtagat

SEQ ID NO: 80696 - DNA, 22 bp, Artificial Sequence
  chemically synthesized
tgtcagatgagtagattgcaaa

SEQ ID NO: 80697 - DNA, 22 bp, Artificial Sequence
  chemically synthesized
gtcagatgagtagattgcaaaa

SEQ ID NO: 80698 - DNA, 22 bp, Artificial Sequence
  chemically synthesized
tcagatgagtagattgcaaaaa

SEQ ID NO: 80699 - DNA, 22 bp, Artificial Sequence
  chemically synthesized
caaaaattttctcccattgtgt

SEQ ID NO: 80700 - DNA, 22 bp, Artificial Sequence
  chemically synthesized
tctcccattgtgtaggttgcct

SEQ ID NO: 80701 - DNA, 22 bp, Artificial Sequence
  chemically synthesized
ctcccattgtgtaggttgcctg

SEQ ID NO: 80702 - DNA, 22 bp, Artificial Sequence
  chemically synthesized
tcccattgtgtaggttgcctgt

SEQ ID NO: 80703 - DNA, 22 bp, Artificial Sequence
  chemically synthesized
ccattgtgtaggttgcctgttc

SEQ ID NO: 80704 - DNA, 22 bp, Artificial Sequence
  chemically synthesized
tgtaggttgcctgttcactctg

SEQ ID NO: 80705 - DNA, 22 bp, Artificial Sequence
  chemically synthesized
cctgttcactctgatggtagtt

SEQ ID NO: 80706 - DNA, 22 bp, Artificial Sequence
  chemically synthesized
ttcactctgatggtagtttctt

SEQ ID NO: 80707 - DNA, 22 bp, Artificial Sequence
  chemically synthesized
actctgatggtagtttcttttg

SEQ ID NO: 80708 - DNA, 22 bp, Artificial Sequence
  chemically synthesized
tgatggtagtttcttttgctgt

SEQ ID NO: 80709 - DNA, 22 bp, Artificial Sequence
  chemically synthesized
atggtagtttcttttgctgtgc

SEQ ID NO: 80710 - DNA, 22 bp, Artificial Sequence
  chemically synthesized
cttttgctgtgcagaagctctt

SEQ ID NO: 80711 - DNA, 22 bp, Artificial Sequence
  chemically synthesized
ttttgctgtgcagaagctcttt

SEQ ID NO: 80712 - DNA, 22 bp, Artificial Sequence
  chemically synthesized
ttgctgtgcagaagctctttag

SEQ ID NO: 80713 - DNA, 22 bp, Artificial Sequence
  chemically synthesized
tgctgtgcagaagctctttagt

SEQ ID NO: 80714 - DNA, 22 bp, Artificial Sequence
  chemically synthesized
gctgtgcagaagctctttagtt

SEQ ID NO: 80715 - DNA, 22 bp, Artificial Sequence
  chemically synthesized
ctgtgcagaagctctttagttt

SEQ ID NO: 80716 - DNA, 22 bp, Artificial Sequence
  chemically synthesized
tgcagaagctctttagtttaat

SEQ ID NO: 80717 - DNA, 22 bp, Artificial Sequence
  chemically synthesized
tttagtttaattagatcccatt

SEQ ID NO: 80718 - DNA, 22 bp, Artificial Sequence
  chemically synthesized
tagtttaattagatcccatttg

SEQ ID NO: 80719 - DNA, 22 bp, Artificial Sequence
  chemically synthesized
agtttaattagatcccatttgt

SEQ ID NO: 80720 - DNA, 22 bp, Artificial Sequence
  chemically synthesized
gtttaattagatcccatttgtc

SEQ ID NO: 80721 - DNA, 22 bp, Artificial Sequence
  chemically synthesized
aattagatcccatttgtccatt

SEQ ID NO: 80722 - DNA, 22 bp, Artificial Sequence
  chemically synthesized
attagatcccatttgtccattt

SEQ ID NO: 80723 - DNA, 22 bp, Artificial Sequence
  chemically synthesized
gatcccatttgtccattttgtc

SEQ ID NO: 80724 - DNA, 22 bp, Artificial Sequence
  chemically synthesized
gtccattttgtcttttgttgcc

SEQ ID NO: 80725 - DNA, 22 bp, Artificial Sequence
  chemically synthesized
tccattttgtcttttgttgcca

SEQ ID NO: 80726 - DNA, 22 bp, Artificial Sequence
  chemically synthesized
tgtcttttgttgccattgcttt

SEQ ID NO: 80727 - DNA, 22 bp, Artificial Sequence
  chemically synthesized
gtcttttgttgccattgctttt

SEQ ID NO: 80728 - DNA, 22 bp, Artificial Sequence
  chemically synthesized
tcttttgttgccattgcttttg

SEQ ID NO: 80729 - DNA, 22 bp, Artificial Sequence
  chemically synthesized
ttgttgccattgcttttggtgt

SEQ ID NO: 80730 - DNA, 22 bp, Artificial Sequence
  chemically synthesized
tgttgccattgcttttggtgtt

SEQ ID NO: 80731 - DNA, 22 bp, Artificial Sequence
  chemically synthesized
gttgccattgcttttggtgttt

SEQ ID NO: 80732 - DNA, 22 bp, Artificial Sequence
  chemically synthesized
ttgccattgcttttggtgtttt

SEQ ID NO: 80733 - DNA, 22 bp, Artificial Sequence
  chemically synthesized
ccattgcttttggtgttttaga

SEQ ID NO: 80734 - DNA, 22 bp, Artificial Sequence
  chemically synthesized
cttttggtgttttagacatgaa

SEQ ID NO: 80735 - DNA, 22 bp, Artificial Sequence
  chemically synthesized
ttggtgttttagacatgaagtc

SEQ ID NO: 80736 - DNA, 22 bp, Artificial Sequence
  chemically synthesized
tggtgttttagacatgaagtcc

SEQ ID NO: 80737 - DNA, 22 bp, Artificial Sequence
  chemically synthesized
ggtgttttagacatgaagtcct

SEQ ID NO: 80738 - DNA, 22 bp, Artificial Sequence
  chemically synthesized
gtgttttagacatgaagtcctt

SEQ ID NO: 80739 - DNA, 22 bp, Artificial Sequence
  chemically synthesized
tagacatgaagtccttgcccat

SEQ ID NO: 80740 - DNA, 22 bp, Artificial Sequence
  chemically synthesized
agacatgaagtccttgcccatg

SEQ ID NO: 80741 - DNA, 22 bp, Artificial Sequence
  chemically synthesized
gacatgaagtccttgcccatgc

SEQ ID NO: 80742 - DNA, 22 bp, Artificial Sequence
  chemically synthesized
gcccatgcctatgtcctgaatg

SEQ ID NO: 80743 - DNA, 22 bp, Artificial Sequence
  chemically synthesized
cccatgcctatgtcctgaatgg

SEQ ID NO: 80744 - DNA, 22 bp, Artificial Sequence
  chemically synthesized
tgtcctgaatggtattgcttag

SEQ ID NO: 80745 - DNA, 22 bp, Artificial Sequence
  chemically synthesized
aatggtattgcttaggttttct

SEQ ID NO: 80746 - DNA, 22 bp, Artificial Sequence
  chemically synthesized
cttaggttttcttctaaggttt

SEQ ID NO: 80747 - DNA, 22 bp, Artificial Sequence
  chemically synthesized
aggttttcttctaaggttttta

SEQ ID NO: 80748 - DNA, 22 bp, Artificial Sequence
  chemically synthesized
ggttttcttctaaggtttttat

SEQ ID NO: 80749 - DNA, 22 bp, Artificial Sequence
  chemically synthesized
tcttctaaggtttttatggttt

SEQ ID NO: 80750 - DNA, 22 bp, Artificial Sequence
  chemically synthesized
cttctaaggtttttatggtttt

SEQ ID NO: 80751 - DNA, 22 bp, Artificial Sequence
  chemically synthesized
ttctaaggtttttatggtttta

SEQ ID NO: 80752 - DNA, 22 bp, Artificial Sequence
  chemically synthesized
ctaaggtttttatggttttagg

SEQ ID NO: 80753 - DNA, 22 bp, Artificial Sequence
  chemically synthesized
taaggtttttatggttttaggt

SEQ ID NO: 80754 - DNA, 22 bp, Artificial Sequence
  chemically synthesized
aggtttttatggttttaggtct

SEQ ID NO: 80755 - DNA, 22 bp, Artificial Sequence
  chemically synthesized
ttatggttttaggtctaacatg

SEQ ID NO: 80756 - DNA, 22 bp, Artificial Sequence
  chemically synthesized
tatggttttaggtctaacatgt

SEQ ID NO: 80757 - DNA, 22 bp, Artificial Sequence
  chemically synthesized
atggttttaggtctaacatgta

SEQ ID NO: 80758 - DNA, 22 bp, Artificial Sequence
  chemically synthesized
tggttttaggtctaacatgtaa

SEQ ID NO: 80759 - DNA, 22 bp, Artificial Sequence
  chemically synthesized
taggtctaacatgtaagtcttt

SEQ ID NO: 80760 - DNA, 22 bp, Artificial Sequence
  chemically synthesized
aggtctaacatgtaagtcttta

SEQ ID NO: 80761 - DNA, 22 bp, Artificial Sequence
  chemically synthesized
ggtctaacatgtaagtctttaa

SEQ ID NO: 80762 - DNA, 22 bp, Artificial Sequence
  chemically synthesized
acatgtaagtctttaatccatc

SEQ ID NO: 80763 - DNA, 22 bp, Artificial Sequence
  chemically synthesized
taatccatcttgaaataatttt

SEQ ID NO: 80764 - DNA, 22 bp, Artificial Sequence
  chemically synthesized
aatccatcttgaaataattttt

SEQ ID NO: 80765 - DNA, 22 bp, Artificial Sequence
  chemically synthesized
atccatcttgaaataatttttg

SEQ ID NO: 80766 - DNA, 22 bp, Artificial Sequence
  chemically synthesized
gaaataatttttgtataaggtg

SEQ ID NO: 80767 - DNA, 22 bp, Artificial Sequence
  chemically synthesized
aaataatttttgtataaggtgt

SEQ ID NO: 80768 - DNA, 22 bp, Artificial Sequence
  chemically synthesized
ttgtataaggtgtaaggaaggg

SEQ ID NO: 80769 - DNA, 22 bp, Artificial Sequence
  chemically synthesized
tgtataaggtgtaaggaaggga

SEQ ID NO: 80770 - DNA, 22 bp, Artificial Sequence
  chemically synthesized
gtataaggtgtaaggaagggat

SEQ ID NO: 80771 - DNA, 22 bp, Artificial Sequence
  chemically synthesized
tataaggtgtaaggaagggatc

SEQ ID NO: 80772 - DNA, 22 bp, Artificial Sequence
  chemically synthesized
cagctttctacatatggctagc

SEQ ID NO: 80773 - DNA, 22 bp, Artificial Sequence
  chemically synthesized
agctttctacatatggctagcc

SEQ ID NO: 80774 - DNA, 22 bp, Artificial Sequence
  chemically synthesized
tctacatatggctagccagttt

SEQ ID NO: 80775 - DNA, 22 bp, Artificial Sequence
  chemically synthesized
ctacatatggctagccagtttt

SEQ ID NO: 80776 - DNA, 22 bp, Artificial Sequence
  chemically synthesized
tacatatggctagccagttttc

SEQ ID NO: 80777 - DNA, 22 bp, Artificial Sequence
  chemically synthesized
catatggctagccagttttccc

SEQ ID NO: 80778 - DNA, 22 bp, Artificial Sequence
  chemically synthesized
gccagttttcccagcatcattt

SEQ ID NO: 80779 - DNA, 22 bp, Artificial Sequence
  chemically synthesized
tcccagcatcatttattaaata

SEQ ID NO: 80780 - DNA, 22 bp, Artificial Sequence
  chemically synthesized
cccagcatcatttattaaatag

SEQ ID NO: 80781 - DNA, 22 bp, Artificial Sequence
  chemically synthesized
ccagcatcatttattaaatagg

SEQ ID NO: 80782 - DNA, 22 bp, Artificial Sequence
  chemically synthesized
attaaatagggaatcctttccc

SEQ ID NO: 80783 - DNA, 22 bp, Artificial Sequence
  chemically synthesized
ttaaatagggaatcctttcccc

SEQ ID NO: 80784 - DNA, 22 bp, Artificial Sequence
  chemically synthesized
aatagggaatcctttccccatt

SEQ ID NO: 80785 - DNA, 22 bp, Artificial Sequence
  chemically synthesized
tccccattgcttgtttttgtca

SEQ ID NO: 80786 - DNA, 22 bp, Artificial Sequence
  chemically synthesized
ccccattgcttgtttttgtcag

SEQ ID NO: 80787 - DNA, 22 bp, Artificial Sequence
  chemically synthesized
cccattgcttgtttttgtcagg

SEQ ID NO: 80788 - DNA, 22 bp, Artificial Sequence
  chemically synthesized
cttgtttttgtcaggtttgtca

SEQ ID NO: 80789 - DNA, 22 bp, Artificial Sequence
  chemically synthesized
gtttttgtcaggtttgtcaaag

SEQ ID NO: 80790 - DNA, 22 bp, Artificial Sequence
  chemically synthesized
tttttgtcaggtttgtcaaaga

SEQ ID NO: 80791 - DNA, 22 bp, Artificial Sequence
  chemically synthesized
ttgtcaggtttgtcaaagatca

SEQ ID NO: 80792 - DNA, 22 bp, Artificial Sequence
  chemically synthesized
tgtcaggtttgtcaaagatcag

SEQ ID NO: 80793 - DNA, 22 bp, Artificial Sequence
  chemically synthesized
gtcaggtttgtcaaagatcaga

SEQ ID NO: 80794 - DNA, 22 bp, Artificial Sequence
  chemically synthesized
tcaggtttgtcaaagatcagat

SEQ ID NO: 80795 - DNA, 22 bp, Artificial Sequence
  chemically synthesized
gtcaaagatcagatagttgtgg

SEQ ID NO: 80796 - DNA, 22 bp, Artificial Sequence
  chemically synthesized
tcaaagatcagatagttgtgga

SEQ ID NO: 80797 - DNA, 22 bp, Artificial Sequence
  chemically synthesized
tggatgtgtggtattatttctg

SEQ ID NO: 80798 - DNA, 22 bp, Artificial Sequence
  chemically synthesized
tttctgagagctctgttctgct

SEQ ID NO: 80799 - DNA, 22 bp, Artificial Sequence
  chemically synthesized
ctgagagctctgttctgctcca

SEQ ID NO: 80800 - DNA, 22 bp, Artificial Sequence
  chemically synthesized
tgagagctctgttctgctccat

SEQ ID NO: 80801 - DNA, 22 bp, Artificial Sequence
  chemically synthesized
agagctctgttctgctccattg

SEQ ID NO: 80802 - DNA, 22 bp, Artificial Sequence
  chemically synthesized
tgttctgctccattggtctaca

SEQ ID NO: 80803 - DNA, 22 bp, Artificial Sequence
  chemically synthesized
ttctgctccattggtctacatc

SEQ ID NO: 80804 - DNA, 22 bp, Artificial Sequence
  chemically synthesized
tgctccattggtctacatctct

SEQ ID NO: 80805 - DNA, 22 bp, Artificial Sequence
  chemically synthesized
ctccattggtctacatctctgt

SEQ ID NO: 80806 - DNA, 22 bp, Artificial Sequence
  chemically synthesized
cattggtctacatctctgtttt

SEQ ID NO: 80807 - DNA, 22 bp, Artificial Sequence
  chemically synthesized
gtctacatctctgttttggtac

SEQ ID NO: 80808 - DNA, 22 bp, Artificial Sequence
  chemically synthesized
catctctgttttggtaccagta

SEQ ID NO: 80809 - DNA, 22 bp, Artificial Sequence
  chemically synthesized
tgttttggtaccagtaccatgt

SEQ ID NO: 80810 - DNA, 22 bp, Artificial Sequence
  chemically synthesized
ttttggtaccagtaccatgttg

SEQ ID NO: 80811 - DNA, 22 bp, Artificial Sequence
  chemically synthesized
tggtaccagtaccatgttgttt

SEQ ID NO: 80812 - DNA, 22 bp, Artificial Sequence
  chemically synthesized
ggtaccagtaccatgttgtttt

SEQ ID NO: 80813 - DNA, 22 bp, Artificial Sequence
  chemically synthesized
gtaccagtaccatgttgttttg

SEQ ID NO: 80814 - DNA, 22 bp, Artificial Sequence
  chemically synthesized
ttttggttactgtaccttgtag

SEQ ID NO: 80815 - DNA, 22 bp, Artificial Sequence
  chemically synthesized
tggttactgtaccttgtagtat

SEQ ID NO: 80816 - DNA, 22 bp, Artificial Sequence
  chemically synthesized
ggttactgtaccttgtagtata

SEQ ID NO: 80817 - DNA, 22 bp, Artificial Sequence
  chemically synthesized
gttactgtaccttgtagtatag

SEQ ID NO: 80818 - DNA, 22 bp, Artificial Sequence
  chemically synthesized
ctgtaccttgtagtatagtttg

SEQ ID NO: 80819 - DNA, 22 bp, Artificial Sequence
  chemically synthesized
taccttgtagtatagtttgaag

SEQ ID NO: 80820 - DNA, 22 bp, Artificial Sequence
  chemically synthesized
gtagtatagtttgaagtcaggt

SEQ ID NO: 80821 - DNA, 22 bp, Artificial Sequence
  chemically synthesized
tagtatagtttgaagtcaggta

SEQ ID NO: 80822 - DNA, 22 bp, Artificial Sequence
  chemically synthesized
gaagtcaggtagcatgatgcct

SEQ ID NO: 80823 - DNA, 22 bp, Artificial Sequence
  chemically synthesized
aagtcaggtagcatgatgcctc

SEQ ID NO: 80824 - DNA, 22 bp, Artificial Sequence
  chemically synthesized
tagctttgttcttttggcttag

SEQ ID NO: 80825 - DNA, 22 bp, Artificial Sequence
  chemically synthesized
gctttgttcttttggcttagga

SEQ ID NO: 80826 - DNA, 22 bp, Artificial Sequence
  chemically synthesized
tgttcttttggcttaggattga

SEQ ID NO: 80827 - DNA, 22 bp, Artificial Sequence
  chemically synthesized
gttcttttggcttaggattgac

SEQ ID NO: 80828 - DNA, 22 bp, Artificial Sequence
  chemically synthesized
ttcttttggcttaggattgact

SEQ ID NO: 80829 - DNA, 22 bp, Artificial Sequence
  chemically synthesized
ttttggcttaggattgacttgt

SEQ ID NO: 80830 - DNA, 22 bp, Artificial Sequence
  chemically synthesized
ttggcttaggattgacttgtca

SEQ ID NO: 80831 - DNA, 22 bp, Artificial Sequence
  chemically synthesized
tggcttaggattgacttgtcaa

SEQ ID NO: 80832 - DNA, 22 bp, Artificial Sequence
  chemically synthesized
ggcttaggattgacttgtcaat

SEQ ID NO: 80833 - DNA, 22 bp, Artificial Sequence
  chemically synthesized
gcttaggattgacttgtcaatg

SEQ ID NO: 80834 - DNA, 22 bp, Artificial Sequence
  chemically synthesized
aggattgacttgtcaatgcggg

SEQ ID NO: 80835 - DNA, 22 bp, Artificial Sequence
  chemically synthesized
ggattgacttgtcaatgcgggc

SEQ ID NO: 80836 - DNA, 22 bp, Artificial Sequence
  chemically synthesized
acttgtcaatgcgggctctttt

SEQ ID NO: 80837 - DNA, 22 bp, Artificial Sequence
  chemically synthesized
gtcaatgcgggctcttttttgg

SEQ ID NO: 80838 - DNA, 22 bp, Artificial Sequence
  chemically synthesized
tcaatgcgggctcttttttggt

SEQ ID NO: 80839 - DNA, 22 bp, Artificial Sequence
  chemically synthesized
ttttttggttccatatgaactt

SEQ ID NO: 80840 - DNA, 22 bp, Artificial Sequence
  chemically synthesized
ttttggttccatatgaacttta

SEQ ID NO: 80841 - DNA, 22 bp, Artificial Sequence
  chemically synthesized
tttggttccatatgaactttaa

SEQ ID NO: 80842 - DNA, 22 bp, Artificial Sequence
  chemically synthesized
ttggttccatatgaactttaaa

SEQ ID NO: 80843 - DNA, 22 bp, Artificial Sequence
  chemically synthesized
tggttccatatgaactttaaag

SEQ ID NO: 80844 - DNA, 22 bp, Artificial Sequence
  chemically synthesized
ggttccatatgaactttaaagt

SEQ ID NO: 80845 - DNA, 22 bp, Artificial Sequence
  chemically synthesized
gttccatatgaactttaaagta

SEQ ID NO: 80846 - DNA, 22 bp, Artificial Sequence
  chemically synthesized
catatgaactttaaagtagttt

SEQ ID NO: 80847 - DNA, 22 bp, Artificial Sequence
  chemically synthesized
taaagtagttttttccaattct

SEQ ID NO: 80848 - DNA, 22 bp, Artificial Sequence
  chemically synthesized
aaagtagttttttccaattctg

SEQ ID NO: 80849 - DNA, 22 bp, Artificial Sequence
  chemically synthesized
aagtagttttttccaattctgt

SEQ ID NO: 80850 - DNA, 22 bp, Artificial Sequence
  chemically synthesized
tttccaattctgtgaagaaagt

SEQ ID NO: 80851 - DNA, 22 bp, Artificial Sequence
  chemically synthesized
ttccaattctgtgaagaaagtc

SEQ ID NO: 80852 - DNA, 22 bp, Artificial Sequence
  chemically synthesized
tccaattctgtgaagaaagtca

SEQ ID NO: 80853 - DNA, 22 bp, Artificial Sequence
  chemically synthesized
ccaattctgtgaagaaagtcat

SEQ ID NO: 80854 - DNA, 22 bp, Artificial Sequence
  chemically synthesized
caattctgtgaagaaagtcatt

SEQ ID NO: 80855 - DNA, 22 bp, Artificial Sequence
  chemically synthesized
tgtgaagaaagtcattggtagc

SEQ ID NO: 80856 - DNA, 22 bp, Artificial Sequence
  chemically synthesized
tgaagaaagtcattggtagctt

SEQ ID NO: 80857 - DNA, 22 bp, Artificial Sequence
  chemically synthesized
gtagcttgatggggatggcatt

SEQ ID NO: 80858 - DNA, 22 bp, Artificial Sequence
  chemically synthesized
gatggggatggcattgaatcta

SEQ ID NO: 80859 - DNA, 22 bp, Artificial Sequence
  chemically synthesized
atggggatggcattgaatctat

SEQ ID NO: 80860 - DNA, 22 bp, Artificial Sequence
  chemically synthesized
aatctataaattaccttgggca

SEQ ID NO: 80861 - DNA, 22 bp, Artificial Sequence
  chemically synthesized
taaattaccttgggcagtaagg

SEQ ID NO: 80862 - DNA, 22 bp, Artificial Sequence
  chemically synthesized
ccttgggcagtaaggccatttt

SEQ ID NO: 80863 - DNA, 22 bp, Artificial Sequence
  chemically synthesized
gggcagtaaggccattttcacg

SEQ ID NO: 80864 - DNA, 22 bp, Artificial Sequence
  chemically synthesized
ggcagtaaggccattttcacga

SEQ ID NO: 80865 - DNA, 22 bp, Artificial Sequence
  chemically synthesized
tcacgatattgattcttcctat

SEQ ID NO: 80866 - DNA, 22 bp, Artificial Sequence
  chemically synthesized
cacgatattgattcttcctatc

SEQ ID NO: 80867 - DNA, 22 bp, Artificial Sequence
  chemically synthesized
acgatattgattcttcctatcc

SEQ ID NO: 80868 - DNA, 22 bp, Artificial Sequence
  chemically synthesized
attcttcctatccatgagcatg

SEQ ID NO: 80869 - DNA, 22 bp, Artificial Sequence
  chemically synthesized
ttcctatccatgagcatggaat

SEQ ID NO: 80870 - DNA, 22 bp, Artificial Sequence
  chemically synthesized
cctatccatgagcatggaatgt

SEQ ID NO: 80871 - DNA, 22 bp, Artificial Sequence
  chemically synthesized
ctatccatgagcatggaatgtt

SEQ ID NO: 80872 - DNA, 22 bp, Artificial Sequence
  chemically synthesized
tccatgagcatggaatgttctt

SEQ ID NO: 80873 - DNA, 22 bp, Artificial Sequence
  chemically synthesized
ttccatttgtttgtatcctctt

SEQ ID NO: 80874 - DNA, 22 bp, Artificial Sequence
  chemically synthesized
ccatttgtttgtatcctctttt

SEQ ID NO: 80875 - DNA, 22 bp, Artificial Sequence
  chemically synthesized
catttgtttgtatcctctttta

SEQ ID NO: 80876 - DNA, 22 bp, Artificial Sequence
  chemically synthesized
gtttgtatcctcttttatttcg

SEQ ID NO: 80877 - DNA, 22 bp, Artificial Sequence
  chemically synthesized
tttgtatcctcttttatttcgt

SEQ ID NO: 80878 - DNA, 22 bp, Artificial Sequence
  chemically synthesized
gtatcctcttttatttcgttga

SEQ ID NO: 80879 - DNA, 22 bp, Artificial Sequence
  chemically synthesized
tatcctcttttatttcgttgag

SEQ ID NO: 80880 - DNA, 22 bp, Artificial Sequence
  chemically synthesized
ttttatttcgttgagcagtgtt

SEQ ID NO: 80881 - DNA, 22 bp, Artificial Sequence
  chemically synthesized
ttatttcgttgagcagtgtttt

SEQ ID NO: 80882 - DNA, 22 bp, Artificial Sequence
  chemically synthesized
tatttcgttgagcagtgttttg

SEQ ID NO: 80883 - DNA, 22 bp, Artificial Sequence
  chemically synthesized
atttcgttgagcagtgttttgt

SEQ ID NO: 80884 - DNA, 22 bp, Artificial Sequence
  chemically synthesized
tttcgttgagcagtgttttgtt

SEQ ID NO: 80885 - DNA, 22 bp, Artificial Sequence
  chemically synthesized
cgttgagcagtgttttgttgtt

SEQ ID NO: 80886 - DNA, 22 bp, Artificial Sequence
  chemically synthesized
gttgagcagtgttttgttgttc

SEQ ID NO: 80887 - DNA, 22 bp, Artificial Sequence
  chemically synthesized
agcagtgttttgttgttctcct

SEQ ID NO: 80888 - DNA, 22 bp, Artificial Sequence
  chemically synthesized
tgttgttctccttgaagaggtc

SEQ ID NO: 80889 - DNA, 22 bp, Artificial Sequence
  chemically synthesized
gttgttctccttgaagaggtcc

SEQ ID NO: 80890 - DNA, 22 bp, Artificial Sequence
  chemically synthesized
ttgttctccttgaagaggtcct

SEQ ID NO: 80891 - DNA, 22 bp, Artificial Sequence
  chemically synthesized
ttctccttgaagaggtccttca

SEQ ID NO: 80892 - DNA, 22 bp, Artificial Sequence
  chemically synthesized
tccttgaagaggtccttcacat

SEQ ID NO: 80893 - DNA, 22 bp, Artificial Sequence
  chemically synthesized
cttgaagaggtccttcacatcc

SEQ ID NO: 80894 - DNA, 22 bp, Artificial Sequence
  chemically synthesized
gaagaggtccttcacatccctt

SEQ ID NO: 80895 - DNA, 22 bp, Artificial Sequence
  chemically synthesized
aagaggtccttcacatcccttg

SEQ ID NO: 80896 - DNA, 22 bp, Artificial Sequence
  chemically synthesized
cacatcccttgtaagttggatt

SEQ ID NO: 80897 - DNA, 22 bp, Artificial Sequence
  chemically synthesized
acatcccttgtaagttggattc

SEQ ID NO: 80898 - DNA, 22 bp, Artificial Sequence
  chemically synthesized
gtaagttggattcctaggtatt

SEQ ID NO: 80899 - DNA, 22 bp, Artificial Sequence
  chemically synthesized
taagttggattcctaggtattt

SEQ ID NO: 80900 - DNA, 22 bp, Artificial Sequence
  chemically synthesized
gattcctaggtattttattctc

SEQ ID NO: 80901 - DNA, 22 bp, Artificial Sequence
  chemically synthesized
ctaggtattttattctctttga

SEQ ID NO: 80902 - DNA, 22 bp, Artificial Sequence
  chemically synthesized
ggtattttattctctttgaggc

SEQ ID NO: 80903 - DNA, 22 bp, Artificial Sequence
  chemically synthesized
tattctctttgaggcaattgtg

SEQ ID NO: 80904 - DNA, 22 bp, Artificial Sequence
  chemically synthesized
attctctttgaggcaattgtga

SEQ ID NO: 80905 - DNA, 22 bp, Artificial Sequence
  chemically synthesized
ttctctttgaggcaattgtgaa

SEQ ID NO: 80906 - DNA, 22 bp, Artificial Sequence
  chemically synthesized
tctttgaggcaattgtgaatgg

SEQ ID NO: 80907 - DNA, 22 bp, Artificial Sequence
  chemically synthesized
tttgaggcaattgtgaatggga

SEQ ID NO: 80908 - DNA, 22 bp, Artificial Sequence
  chemically synthesized
tgaggcaattgtgaatgggagt

SEQ ID NO: 80909 - DNA, 22 bp, Artificial Sequence
  chemically synthesized
gaggcaattgtgaatgggagtt

SEQ ID NO: 80910 - DNA, 22 bp, Artificial Sequence
  chemically synthesized
aggcaattgtgaatgggagttc

SEQ ID NO: 80911 - DNA, 22 bp, Artificial Sequence
  chemically synthesized
tgaatgggagttcactcatgat

SEQ ID NO: 80912 - DNA, 22 bp, Artificial Sequence
  chemically synthesized
actcatgatttggctctctgtt

SEQ ID NO: 80913 - DNA, 22 bp, Artificial Sequence
  chemically synthesized
atgatttggctctctgtttgtc

SEQ ID NO: 80914 - DNA, 22 bp, Artificial Sequence
  chemically synthesized
ggctctctgtttgtctgttatt

SEQ ID NO: 80915 - DNA, 22 bp, Artificial Sequence
  chemically synthesized
gctctctgtttgtctgttattg

SEQ ID NO: 80916 - DNA, 22 bp, Artificial Sequence
  chemically synthesized
tctgtttgtctgttattggtgt

SEQ ID NO: 80917 - DNA, 22 bp, Artificial Sequence
  chemically synthesized
tgtttgtctgttattggtgtat

SEQ ID NO: 80918 - DNA, 22 bp, Artificial Sequence
  chemically synthesized
tttgtctgttattggtgtatag

SEQ ID NO: 80919 - DNA, 22 bp, Artificial Sequence
  chemically synthesized
gtctgttattggtgtataggaa

SEQ ID NO: 80920 - DNA, 22 bp, Artificial Sequence
  chemically synthesized
tctgttattggtgtataggaat

SEQ ID NO: 80921 - DNA, 22 bp, Artificial Sequence
  chemically synthesized
ttattggtgtataggaatgctt

SEQ ID NO: 80922 - DNA, 22 bp, Artificial Sequence
  chemically synthesized
ttggtgtataggaatgcttgtg

SEQ ID NO: 80923 - DNA, 22 bp, Artificial Sequence
  chemically synthesized
gtgtataggaatgcttgtgatt

SEQ ID NO: 80924 - DNA, 22 bp, Artificial Sequence
  chemically synthesized
gtgatttttgcacattgatttt

SEQ ID NO: 80925 - DNA, 22 bp, Artificial Sequence
  chemically synthesized
tgatttttgcacattgattttg

SEQ ID NO: 80926 - DNA, 22 bp, Artificial Sequence
  chemically synthesized
ttgcacattgattttgtatgct

SEQ ID NO: 80927 - DNA, 22 bp, Artificial Sequence
  chemically synthesized
tgcacattgattttgtatgctg

SEQ ID NO: 80928 - DNA, 22 bp, Artificial Sequence
  chemically synthesized
gcacattgattttgtatgctga

SEQ ID NO: 80929 - DNA, 22 bp, Artificial Sequence
  chemically synthesized
cacattgattttgtatgctgag

SEQ ID NO: 80930 - DNA, 22 bp, Artificial Sequence
  chemically synthesized
attttgtatgctgagacttttc

SEQ ID NO: 80931 - DNA, 22 bp, Artificial Sequence
  chemically synthesized
tgtatgctgagacttttctgaa

SEQ ID NO: 80932 - DNA, 22 bp, Artificial Sequence
  chemically synthesized
gtatgctgagacttttctgaag

SEQ ID NO: 80933 - DNA, 22 bp, Artificial Sequence
  chemically synthesized
tatgctgagacttttctgaagt

SEQ ID NO: 80934 - DNA, 22 bp, Artificial Sequence
  chemically synthesized
agacttttctgaagttgcttat

SEQ ID NO: 80935 - DNA, 22 bp, Artificial Sequence
  chemically synthesized
ttctgaagttgcttatcagctt

SEQ ID NO: 80936 - DNA, 22 bp, Artificial Sequence
  chemically synthesized
tctgaagttgcttatcagctta

SEQ ID NO: 80937 - DNA, 22 bp, Artificial Sequence
  chemically synthesized
ctgaagttgcttatcagcttaa

SEQ ID NO: 80938 - DNA, 22 bp, Artificial Sequence
  chemically synthesized
tgaagttgcttatcagcttaag

SEQ ID NO: 80939 - DNA, 22 bp, Artificial Sequence
  chemically synthesized
aagttgcttatcagcttaagga

SEQ ID NO: 80940 - DNA, 22 bp, Artificial Sequence
  chemically synthesized
cttatcagcttaaggagatttt

SEQ ID NO: 80941 - DNA, 22 bp, Artificial Sequence
  chemically synthesized
atcagcttaaggagattttggg

SEQ ID NO: 80942 - DNA, 22 bp, Artificial Sequence
  chemically synthesized
tcagcttaaggagattttgggc

SEQ ID NO: 80943 - DNA, 22 bp, Artificial Sequence
  chemically synthesized
aaggagattttgggctgagacg

SEQ ID NO: 80944 - DNA, 22 bp, Artificial Sequence
  chemically synthesized
aggagattttgggctgagacga

SEQ ID NO: 80945 - DNA, 22 bp, Artificial Sequence
  chemically synthesized
tgggctgagacgatggggtttt

SEQ ID NO: 80946 - DNA, 22 bp, Artificial Sequence
  chemically synthesized
gggctgagacgatggggttttc

SEQ ID NO: 80947 - DNA, 22 bp, Artificial Sequence
  chemically synthesized
ggctgagacgatggggttttct

SEQ ID NO: 80948 - DNA, 22 bp, Artificial Sequence
  chemically synthesized
agacgatggggttttctagata

SEQ ID NO: 80949 - DNA, 22 bp, Artificial Sequence
  chemically synthesized
tctagatatacaatcacgtcat

SEQ ID NO: 80950 - DNA, 22 bp, Artificial Sequence
  chemically synthesized
ctagatatacaatcacgtcatc

SEQ ID NO: 80951 - DNA, 22 bp, Artificial Sequence
  chemically synthesized
tagatatacaatcacgtcatct

SEQ ID NO: 80952 - DNA, 22 bp, Artificial Sequence
  chemically synthesized
gatatacaatcacgtcatctgc

SEQ ID NO: 80953 - DNA, 22 bp, Artificial Sequence
  chemically synthesized
caaacagggacaatttcacttc

SEQ ID NO: 80954 - DNA, 22 bp, Artificial Sequence
  chemically synthesized
cacttcctcttttcctaattga

SEQ ID NO: 80955 - DNA, 22 bp, Artificial Sequence
  chemically synthesized
acttcctcttttcctaattgaa

SEQ ID NO: 80956 - DNA, 22 bp, Artificial Sequence
  chemically synthesized
cctcttttcctaattgaatgcc

SEQ ID NO: 80957 - DNA, 22 bp, Artificial Sequence
  chemically synthesized
ctcttttcctaattgaatgccc

SEQ ID NO: 80958 - DNA, 22 bp, Artificial Sequence
  chemically synthesized
ttttcctaattgaatgcccttt

SEQ ID NO: 80959 - DNA, 22 bp, Artificial Sequence
  chemically synthesized
ttcctaattgaatgccctttat

SEQ ID NO: 80960 - DNA, 22 bp, Artificial Sequence
  chemically synthesized
tcctaattgaatgccctttatt

SEQ ID NO: 80961 - DNA, 22 bp, Artificial Sequence
  chemically synthesized
cctaattgaatgccctttattt

SEQ ID NO: 80962 - DNA, 22 bp, Artificial Sequence
  chemically synthesized
ctaattgaatgccctttatttc

SEQ ID NO: 80963 - DNA, 22 bp, Artificial Sequence
  chemically synthesized
attgaatgccctttatttcttt

SEQ ID NO: 80964 - DNA, 22 bp, Artificial Sequence
  chemically synthesized
aatgccctttatttctttctct

SEQ ID NO: 80965 - DNA, 22 bp, Artificial Sequence
  chemically synthesized
tatttctttctcttgcctgatt

SEQ ID NO: 80966 - DNA, 22 bp, Artificial Sequence
  chemically synthesized
atttctttctcttgcctgattg

SEQ ID NO: 80967 - DNA, 22 bp, Artificial Sequence
  chemically synthesized
tttctttctcttgcctgattgc

SEQ ID NO: 80968 - DNA, 22 bp, Artificial Sequence
  chemically synthesized
ctttctcttgcctgattgccct

SEQ ID NO: 80969 - DNA, 22 bp, Artificial Sequence
  chemically synthesized
tttctcttgcctgattgccctg

SEQ ID NO: 80970 - DNA, 22 bp, Artificial Sequence
  chemically synthesized
tctcttgcctgattgccctggc

SEQ ID NO: 80971 - DNA, 22 bp, Artificial Sequence
  chemically synthesized
ctcttgcctgattgccctggcc

SEQ ID NO: 80972 - DNA, 22 bp, Artificial Sequence
  chemically synthesized
tcttgcctgattgccctggcca

SEQ ID NO: 80973 - DNA, 22 bp, Artificial Sequence
  chemically synthesized
ttgcctgattgccctggccaga

SEQ ID NO: 80974 - DNA, 22 bp, Artificial Sequence
  chemically synthesized
gcctgattgccctggccagaac

SEQ ID NO: 80975 - DNA, 22 bp, Artificial Sequence
  chemically synthesized
cctgattgccctggccagaact

SEQ ID NO: 80976 - DNA, 22 bp, Artificial Sequence
  chemically synthesized
attgccctggccagaacttcca

SEQ ID NO: 80977 - DNA, 22 bp, Artificial Sequence
  chemically synthesized
ccctggccagaacttccaacac

SEQ ID NO: 80978 - DNA, 22 bp, Artificial Sequence
  chemically synthesized
gccagaacttccaacactatgt

SEQ ID NO: 80979 - DNA, 22 bp, Artificial Sequence
  chemically synthesized
ccaacactatgttgaataggag

SEQ ID NO: 80980 - DNA, 22 bp, Artificial Sequence
  chemically synthesized
caacactatgttgaataggagt

SEQ ID NO: 80981 - DNA, 22 bp, Artificial Sequence
  chemically synthesized
tgttgaataggagtggtgagag

SEQ ID NO: 80982 - DNA, 22 bp, Artificial Sequence
  chemically synthesized
aataggagtggtgagagagggc

SEQ ID NO: 80983 - DNA, 22 bp, Artificial Sequence
  chemically synthesized
tcttgtgccagttttcaaaggg

SEQ ID NO: 80984 - DNA, 22 bp, Artificial Sequence
  chemically synthesized
gtgccagttttcaaagggaatg

SEQ ID NO: 80985 - DNA, 22 bp, Artificial Sequence
  chemically synthesized
tgccagttttcaaagggaatgc

SEQ ID NO: 80986 - DNA, 22 bp, Artificial Sequence
  chemically synthesized
tcaaagggaatgcttccagttt

SEQ ID NO: 80987 - DNA, 22 bp, Artificial Sequence
  chemically synthesized
caaagggaatgcttccagtttt

SEQ ID NO: 80988 - DNA, 22 bp, Artificial Sequence
  chemically synthesized
aaagggaatgcttccagttttt

SEQ ID NO: 80989 - DNA, 22 bp, Artificial Sequence
  chemically synthesized
ccagtttttgtccattcagtat

SEQ ID NO: 80990 - DNA, 22 bp, Artificial Sequence
  chemically synthesized
cagtttttgtccattcagtatg

SEQ ID NO: 80991 - DNA, 22 bp, Artificial Sequence
  chemically synthesized
ttgtccattcagtatgatattg

SEQ ID NO: 80992 - DNA, 22 bp, Artificial Sequence
  chemically synthesized
tgtccattcagtatgatattgg

SEQ ID NO: 80993 - DNA, 22 bp, Artificial Sequence
  chemically synthesized
gtccattcagtatgatattggc

SEQ ID NO: 80994 - DNA, 22 bp, Artificial Sequence
  chemically synthesized
tccattcagtatgatattggct

SEQ ID NO: 80995 - DNA, 22 bp, Artificial Sequence
  chemically synthesized
agtatgatattggctgtgggtt

SEQ ID NO: 80996 - DNA, 22 bp, Artificial Sequence
  chemically synthesized
gctgtgggtttgtcatagatag

SEQ ID NO: 80997 - DNA, 22 bp, Artificial Sequence
  chemically synthesized
tgggtttgtcatagatagctct

SEQ ID NO: 80998 - DNA, 22 bp, Artificial Sequence
  chemically synthesized
gtcatagatagctcttattatt

SEQ ID NO: 80999 - DNA, 22 bp, Artificial Sequence
  chemically synthesized
tcatagatagctcttattattt

SEQ ID NO: 81000 - DNA, 22 bp, Artificial Sequence
  chemically synthesized
ttattattttgagatatgtccc

SEQ ID NO: 81001 - DNA, 22 bp, Artificial Sequence
  chemically synthesized
attattttgagatatgtcccat

SEQ ID NO: 81002 - DNA, 22 bp, Artificial Sequence
  chemically synthesized
ttattttgagatatgtcccatc

SEQ ID NO: 81003 - DNA, 22 bp, Artificial Sequence
  chemically synthesized
ttttgagatatgtcccatcgat

SEQ ID NO: 81004 - DNA, 22 bp, Artificial Sequence
  chemically synthesized
tgagatatgtcccatcgatacc

SEQ ID NO: 81005 - DNA, 22 bp, Artificial Sequence
  chemically synthesized
gagatatgtcccatcgatacct

SEQ ID NO: 81006 - DNA, 22 bp, Artificial Sequence
  chemically synthesized
agatatgtcccatcgataccta

SEQ ID NO: 81007 - DNA, 22 bp, Artificial Sequence
  chemically synthesized
atttattgagagtttttagtat

SEQ ID NO: 81008 - DNA, 22 bp, Artificial Sequence
  chemically synthesized
attgagagtttttagtatgaag

SEQ ID NO: 81009 - DNA, 22 bp, Artificial Sequence
  chemically synthesized
ttgagagtttttagtatgaagc

SEQ ID NO: 81010 - DNA, 22 bp, Artificial Sequence
  chemically synthesized
agagtttttagtatgaagcatt

SEQ ID NO: 81011 - DNA, 22 bp, Artificial Sequence
  chemically synthesized
ttagtatgaagcattgttgaat

SEQ ID NO: 81012 - DNA, 22 bp, Artificial Sequence
  chemically synthesized
tagtatgaagcattgttgaatt

SEQ ID NO: 81013 - DNA, 22 bp, Artificial Sequence
  chemically synthesized
agtatgaagcattgttgaattt

SEQ ID NO: 81014 - DNA, 22 bp, Artificial Sequence
  chemically synthesized
gtatgaagcattgttgaatttt

SEQ ID NO: 81015 - DNA, 22 bp, Artificial Sequence
  chemically synthesized
ttgaattttgtcaaaggccttt

SEQ ID NO: 81016 - DNA, 22 bp, Artificial Sequence
  chemically synthesized
aattttgtcaaaggccttttct

SEQ ID NO: 81017 - DNA, 22 bp, Artificial Sequence
  chemically synthesized
tgtcaaaggccttttctgcatc

SEQ ID NO: 81018 - DNA, 22 bp, Artificial Sequence
  chemically synthesized
gtcaaaggccttttctgcatct

SEQ ID NO: 81019 - DNA, 22 bp, Artificial Sequence
  chemically synthesized
tcaaaggccttttctgcatcta

SEQ ID NO: 81020 - DNA, 22 bp, Artificial Sequence
  chemically synthesized
ttctgcatctattgagataatc

SEQ ID NO: 81021 - DNA, 22 bp, Artificial Sequence
  chemically synthesized
tctgcatctattgagataatca

SEQ ID NO: 81022 - DNA, 22 bp, Artificial Sequence
  chemically synthesized
ctgcatctattgagataatcat

SEQ ID NO: 81023 - DNA, 22 bp, Artificial Sequence
  chemically synthesized
tgcatctattgagataatcatg

SEQ ID NO: 81024 - DNA, 22 bp, Artificial Sequence
  chemically synthesized
catctattgagataatcatgtg

SEQ ID NO: 81025 - DNA, 22 bp, Artificial Sequence
  chemically synthesized
ttgagataatcatgtggtttgt

SEQ ID NO: 81026 - DNA, 22 bp, Artificial Sequence
  chemically synthesized
agataatcatgtggtttgtgtc

SEQ ID NO: 81027 - DNA, 22 bp, Artificial Sequence
  chemically synthesized
gtgtctttggttctgtttatat

SEQ ID NO: 81028 - DNA, 22 bp, Artificial Sequence
  chemically synthesized
tgtctttggttctgtttatatg

SEQ ID NO: 81029 - DNA, 22 bp, Artificial Sequence
  chemically synthesized
tggttctgtttatatgctggat

SEQ ID NO: 81030 - DNA, 22 bp, Artificial Sequence
  chemically synthesized
ggttctgtttatatgctggatt

SEQ ID NO: 81031 - DNA, 22 bp, Artificial Sequence
  chemically synthesized
gttctgtttatatgctggatta

SEQ ID NO: 81032 - DNA, 22 bp, Artificial Sequence
  chemically synthesized
tgtttatatgctggattatgtt

SEQ ID NO: 81033 - DNA, 22 bp, Artificial Sequence
  chemically synthesized
tttatatgctggattatgttta

SEQ ID NO: 81034 - DNA, 22 bp, Artificial Sequence
  chemically synthesized
atatgctggattatgtttattg

SEQ ID NO: 81035 - DNA, 22 bp, Artificial Sequence
  chemically synthesized
tatgctggattatgtttattga

SEQ ID NO: 81036 - DNA, 22 bp, Artificial Sequence
  chemically synthesized
gattatgtttattgatttgcat

SEQ ID NO: 81037 - DNA, 22 bp, Artificial Sequence
  chemically synthesized
tgtttattgatttgcatatgtt

SEQ ID NO: 81038 - DNA, 22 bp, Artificial Sequence
  chemically synthesized
attgatttgcatatgttgaacc

SEQ ID NO: 81039 - DNA, 22 bp, Artificial Sequence
  chemically synthesized
ttgatttgcatatgttgaacca

SEQ ID NO: 81040 - DNA, 22 bp, Artificial Sequence
  chemically synthesized
atttgcatatgttgaaccagcc

SEQ ID NO: 81041 - DNA, 22 bp, Artificial Sequence
  chemically synthesized
gcatatgttgaaccagccctgc

SEQ ID NO: 81042 - DNA, 22 bp, Artificial Sequence
  chemically synthesized
catatgttgaaccagccctgca

SEQ ID NO: 81043 - DNA, 22 bp, Artificial Sequence
  chemically synthesized
aaccagccctgcatcccaggga

SEQ ID NO: 81044 - DNA, 22 bp, Artificial Sequence
  chemically synthesized
catcccagggatgaagcccact

SEQ ID NO: 81045 - DNA, 22 bp, Artificial Sequence
  chemically synthesized
gatcatggtggataagcttttt

SEQ ID NO: 81046 - DNA, 22 bp, Artificial Sequence
  chemically synthesized
atcatggtggataagctttttg

SEQ ID NO: 81047 - DNA, 22 bp, Artificial Sequence
  chemically synthesized
tttgatgtgctcctggatttgg

SEQ ID NO: 81048 - DNA, 22 bp, Artificial Sequence
  chemically synthesized
ttgatgtgctcctggatttggt

SEQ ID NO: 81049 - DNA, 22 bp, Artificial Sequence
  chemically synthesized
tgatgtgctcctggatttggtt

SEQ ID NO: 81050 - DNA, 22 bp, Artificial Sequence
  chemically synthesized
gatgtgctcctggatttggttt

SEQ ID NO: 81051 - DNA, 22 bp, Artificial Sequence
  chemically synthesized
atgtgctcctggatttggtttg

SEQ ID NO: 81052 - DNA, 22 bp, Artificial Sequence
  chemically synthesized
ctggatttggtttgccagtatt

SEQ ID NO: 81053 - DNA, 22 bp, Artificial Sequence
  chemically synthesized
gatttggtttgccagtatttta

SEQ ID NO: 81054 - DNA, 22 bp, Artificial Sequence
  chemically synthesized
ggtttgccagtattttactgag

SEQ ID NO: 81055 - DNA, 22 bp, Artificial Sequence
  chemically synthesized
gtttgccagtattttactgagg

SEQ ID NO: 81056 - DNA, 22 bp, Artificial Sequence
  chemically synthesized
gccagtattttactgaggattt

SEQ ID NO: 81057 - DNA, 22 bp, Artificial Sequence
  chemically synthesized
ccagtattttactgaggatttt

SEQ ID NO: 81058 - DNA, 22 bp, Artificial Sequence
  chemically synthesized
tactgaggatttttgcatcgat

SEQ ID NO: 81059 - DNA, 22 bp, Artificial Sequence
  chemically synthesized
actgaggatttttgcatcgatg

SEQ ID NO: 81060 - DNA, 22 bp, Artificial Sequence
  chemically synthesized
ctgaggatttttgcatcgatgt

SEQ ID NO: 81061 - DNA, 22 bp, Artificial Sequence
  chemically synthesized
aggatttttgcatcgatgttca

SEQ ID NO: 81062 - DNA, 22 bp, Artificial Sequence
  chemically synthesized
ttgcatcgatgttcatcaggga

SEQ ID NO: 81063 - DNA, 22 bp, Artificial Sequence
  chemically synthesized
tgcatcgatgttcatcagggat

SEQ ID NO: 81064 - DNA, 22 bp, Artificial Sequence
  chemically synthesized
gcatcgatgttcatcagggata

SEQ ID NO: 81065 - DNA, 22 bp, Artificial Sequence
  chemically synthesized
catcgatgttcatcagggatat

SEQ ID NO: 81066 - DNA, 22 bp, Artificial Sequence
  chemically synthesized
atcagggatattggtgtaaaat

SEQ ID NO: 81067 - DNA, 22 bp, Artificial Sequence
  chemically synthesized
gtgtaaaattctctttttttgt

SEQ ID NO: 81068 - DNA, 22 bp, Artificial Sequence
  chemically synthesized
tctttttttgttgtgtgtctgc

SEQ ID NO: 81069 - DNA, 22 bp, Artificial Sequence
  chemically synthesized
tttttttgttgtgtgtctgcta

SEQ ID NO: 81070 - DNA, 22 bp, Artificial Sequence
  chemically synthesized
tttttgttgtgtgtctgctagg

SEQ ID NO: 81071 - DNA, 22 bp, Artificial Sequence
  chemically synthesized
ttttgttgtgtgtctgctaggc

SEQ ID NO: 81072 - DNA, 22 bp, Artificial Sequence
  chemically synthesized
tttgttgtgtgtctgctaggct

SEQ ID NO: 81073 - DNA, 22 bp, Artificial Sequence
  chemically synthesized
ttgttgtgtgtctgctaggctt

SEQ ID NO: 81074 - DNA, 22 bp, Artificial Sequence
  chemically synthesized
tgttgtgtgtctgctaggcttt

SEQ ID NO: 81075 - DNA, 22 bp, Artificial Sequence
  chemically synthesized
gttgtgtgtctgctaggctttg

SEQ ID NO: 81076 - DNA, 22 bp, Artificial Sequence
  chemically synthesized
ttgtgtgtctgctaggctttgg

SEQ ID NO: 81077 - DNA, 22 bp, Artificial Sequence
  chemically synthesized
tgtgtctgctaggctttggtat

SEQ ID NO: 81078 - DNA, 22 bp, Artificial Sequence
  chemically synthesized
ctaggctttggtatcaagatga

SEQ ID NO: 81079 - DNA, 22 bp, Artificial Sequence
  chemically synthesized
ggctttggtatcaagatgatgc

SEQ ID NO: 81080 - DNA, 22 bp, Artificial Sequence
  chemically synthesized
tggtatcaagatgatgctggcc

SEQ ID NO: 81081 - DNA, 22 bp, Artificial Sequence
  chemically synthesized
ggtatcaagatgatgctggcct

SEQ ID NO: 81082 - DNA, 22 bp, Artificial Sequence
  chemically synthesized
gtatcaagatgatgctggcctc

SEQ ID NO: 81083 - DNA, 22 bp, Artificial Sequence
  chemically synthesized
gcctcataaaatgagttaggga

SEQ ID NO: 81084 - DNA, 22 bp, Artificial Sequence
  chemically synthesized
ataaaatgagttagggaggatt

SEQ ID NO: 81085 - DNA, 22 bp, Artificial Sequence
  chemically synthesized
gggaggattccctctttttcta

SEQ ID NO: 81086 - DNA, 22 bp, Artificial Sequence
  chemically synthesized
cctctttttctattgattggaa

SEQ ID NO: 81087 - DNA, 22 bp, Artificial Sequence
  chemically synthesized
tttttctattgattggaatagt

SEQ ID NO: 81088 - DNA, 22 bp, Artificial Sequence
  chemically synthesized
tttctattgattggaatagttt

SEQ ID NO: 81089 - DNA, 22 bp, Artificial Sequence
  chemically synthesized
ttctattgattggaatagtttc

SEQ ID NO: 81090 - DNA, 22 bp, Artificial Sequence
  chemically synthesized
tctattgattggaatagtttca

SEQ ID NO: 81091 - DNA, 22 bp, Artificial Sequence
  chemically synthesized
ctattgattggaatagtttcag

SEQ ID NO: 81092 - DNA, 22 bp, Artificial Sequence
  chemically synthesized
tattgattggaatagtttcaga

SEQ ID NO: 81093 - DNA, 22 bp, Artificial Sequence
  chemically synthesized
ttgattggaatagtttcagaag

SEQ ID NO: 81094 - DNA, 22 bp, Artificial Sequence
  chemically synthesized
attggaatagtttcagaaggaa

SEQ ID NO: 81095 - DNA, 22 bp, Artificial Sequence
  chemically synthesized
gaatagtttcagaaggaatggt

SEQ ID NO: 81096 - DNA, 22 bp, Artificial Sequence
  chemically synthesized
cagaaggaatggtaccagctcc

SEQ ID NO: 81097 - DNA, 22 bp, Artificial Sequence
  chemically synthesized
agaaggaatggtaccagctcct

SEQ ID NO: 81098 - DNA, 22 bp, Artificial Sequence
  chemically synthesized
ctccttgtacctctggtagaat

SEQ ID NO: 81099 - DNA, 22 bp, Artificial Sequence
  chemically synthesized
cttgtacctctggtagaattcg

SEQ ID NO: 81100 - DNA, 22 bp, Artificial Sequence
  chemically synthesized
gtacctctggtagaattcggct

SEQ ID NO: 81101 - DNA, 22 bp, Artificial Sequence
  chemically synthesized
tacctctggtagaattcggctg

SEQ ID NO: 81102 - DNA, 22 bp, Artificial Sequence
  chemically synthesized
tggtagaattcggctgtgaatc

SEQ ID NO: 81103 - DNA, 22 bp, Artificial Sequence
  chemically synthesized
gtagaattcggctgtgaatcca

SEQ ID NO: 81104 - DNA, 22 bp, Artificial Sequence
  chemically synthesized
ggctgtgaatccatctggtcct

SEQ ID NO: 81105 - DNA, 22 bp, Artificial Sequence
  chemically synthesized
tgaatccatctggtcctggact

SEQ ID NO: 81106 - DNA, 22 bp, Artificial Sequence
  chemically synthesized
gtcctggactttttttggttgg

SEQ ID NO: 81107 - DNA, 22 bp, Artificial Sequence
  chemically synthesized
gactttttttggttggtaagct

SEQ ID NO: 81108 - DNA, 22 bp, Artificial Sequence
  chemically synthesized
tttttggttggtaagcttcata

SEQ ID NO: 81109 - DNA, 22 bp, Artificial Sequence
  chemically synthesized
ttttggttggtaagcttcataa

SEQ ID NO: 81110 - DNA, 22 bp, Artificial Sequence
  chemically synthesized
tttggttggtaagcttcataag

SEQ ID NO: 81111 - DNA, 22 bp, Artificial Sequence
  chemically synthesized
ttggttggtaagcttcataagt

SEQ ID NO: 81112 - DNA, 22 bp, Artificial Sequence
  chemically synthesized
tggttggtaagcttcataagtg

SEQ ID NO: 81113 - DNA, 22 bp, Artificial Sequence
  chemically synthesized
ggttggtaagcttcataagtga

SEQ ID NO: 81114 - DNA, 22 bp, Artificial Sequence
  chemically synthesized
gttggtaagcttcataagtgaa

SEQ ID NO: 81115 - DNA, 22 bp, Artificial Sequence
  chemically synthesized
gtaagcttcataagtgaaggag

SEQ ID NO: 81116 - DNA, 22 bp, Artificial Sequence
  chemically synthesized
cataagtgaaggagaaataaaa

SEQ ID NO: 81117 - DNA, 22 bp, Artificial Sequence
  chemically synthesized
ataagtgaaggagaaataaaat

SEQ ID NO: 81118 - DNA, 22 bp, Artificial Sequence
  chemically synthesized
tacagacaagcaattgctgatt

SEQ ID NO: 81119 - DNA, 22 bp, Artificial Sequence
  chemically synthesized
acagacaagcaattgctgattt

SEQ ID NO: 81120 - DNA, 22 bp, Artificial Sequence
  chemically synthesized
cagacaagcaattgctgatttt

SEQ ID NO: 81121 - DNA, 22 bp, Artificial Sequence
  chemically synthesized
ctgattttgtcaccaccaggcc

SEQ ID NO: 81122 - DNA, 22 bp, Artificial Sequence
  chemically synthesized
attttgtcaccaccaggcctgc

SEQ ID NO: 81123 - DNA, 22 bp, Artificial Sequence
  chemically synthesized
tgtcaccaccaggcctgcccta

SEQ ID NO: 81124 - DNA, 22 bp, Artificial Sequence
  chemically synthesized
gtcaccaccaggcctgccctaa

SEQ ID NO: 81125 - DNA, 22 bp, Artificial Sequence
  chemically synthesized
tcaccaccaggcctgccctaaa

SEQ ID NO: 81126 - DNA, 22 bp, Artificial Sequence
  chemically synthesized
ccctaaaagagctcctgaagga

SEQ ID NO: 81127 - DNA, 22 bp, Artificial Sequence
  chemically synthesized
aaagagctcctgaaggaagcag

SEQ ID NO: 81128 - DNA, 22 bp, Artificial Sequence
  chemically synthesized
ctgaaggaagcagtaaacatgg

SEQ ID NO: 81129 - DNA, 22 bp, Artificial Sequence
  chemically synthesized
aaggaagcagtaaacatggaaa

SEQ ID NO: 81130 - DNA, 22 bp, Artificial Sequence
  chemically synthesized
caaaaacatgccaaattgtaaa

SEQ ID NO: 81131 - DNA, 22 bp, Artificial Sequence
  chemically synthesized
taaagaccatcaaggctaggga

SEQ ID NO: 81132 - DNA, 22 bp, Artificial Sequence
  chemically synthesized
gggagaaactgcatcaactagc

SEQ ID NO: 81133 - DNA, 22 bp, Artificial Sequence
  chemically synthesized
catcaactagcaagcaaaataa

SEQ ID NO: 81134 - DNA, 22 bp, Artificial Sequence
  chemically synthesized
gcaagcaaaataaccagctaac

SEQ ID NO: 81135 - DNA, 22 bp, Artificial Sequence
  chemically synthesized
acatcataatgacaggatcaaa

SEQ ID NO: 81136 - DNA, 22 bp, Artificial Sequence
  chemically synthesized
tcacataacaatattaacctta

SEQ ID NO: 81137 - DNA, 22 bp, Artificial Sequence
  chemically synthesized
acataacaatattaaccttaaa

SEQ ID NO: 81138 - DNA, 22 bp, Artificial Sequence
  chemically synthesized
accttaaatgtaaatgagctaa

SEQ ID NO: 81139 - DNA, 22 bp, Artificial Sequence
  chemically synthesized
aaatgtaaatgagctaaatgct

SEQ ID NO: 81140 - DNA, 22 bp, Artificial Sequence
  chemically synthesized
aatgtaaatgagctaaatgctc

SEQ ID NO: 81141 - DNA, 22 bp, Artificial Sequence
  chemically synthesized
aatgctccaattaaaagacaca

SEQ ID NO: 81142 - DNA, 22 bp, Artificial Sequence
  chemically synthesized
caattaaaagacacagactggc

SEQ ID NO: 81143 - DNA, 22 bp, Artificial Sequence
  chemically synthesized
aaagacacagactggcaaattg

SEQ ID NO: 81144 - DNA, 22 bp, Artificial Sequence
  chemically synthesized
gcaaattggataaagagtcaag

SEQ ID NO: 81145 - DNA, 22 bp, Artificial Sequence
  chemically synthesized
gataaagagtcaagacctatca

SEQ ID NO: 81146 - DNA, 22 bp, Artificial Sequence
  chemically synthesized
tcagtgtgctgtattcaggaaa

SEQ ID NO: 81147 - DNA, 22 bp, Artificial Sequence
  chemically synthesized
tattcaggaaaccaatctcatg

SEQ ID NO: 81148 - DNA, 22 bp, Artificial Sequence
  chemically synthesized
aggaaaccaatctcatgtggag

SEQ ID NO: 81149 - DNA, 22 bp, Artificial Sequence
  chemically synthesized
atgtggagagacacacataggc

SEQ ID NO: 81150 - DNA, 22 bp, Artificial Sequence
  chemically synthesized
aaaataaagggatggaggaaga

SEQ ID NO: 81151 - DNA, 22 bp, Artificial Sequence
  chemically synthesized
ccaagcaaatggaaaacaaaaa

SEQ ID NO: 81152 - DNA, 22 bp, Artificial Sequence
  chemically synthesized
gcaatcttagtctctgataaaa

SEQ ID NO: 81153 - DNA, 22 bp, Artificial Sequence
  chemically synthesized
caatcttagtctctgataaaac

SEQ ID NO: 81154 - DNA, 22 bp, Artificial Sequence
  chemically synthesized
agtctctgataaaacagacttt

SEQ ID NO: 81155 - DNA, 22 bp, Artificial Sequence
  chemically synthesized
gtctctgataaaacagacttta

SEQ ID NO: 81156 - DNA, 22 bp, Artificial Sequence
  chemically synthesized
tgataaaacagactttaaacca

SEQ ID NO: 81157 - DNA, 22 bp, Artificial Sequence
  chemically synthesized
ataaaacagactttaaaccaac

SEQ ID NO: 81158 - DNA, 22 bp, Artificial Sequence
  chemically synthesized
taaaccaacaaagatcaaaaga

SEQ ID NO: 81159 - DNA, 22 bp, Artificial Sequence
  chemically synthesized
aaaccaacaaagatcaaaagag

SEQ ID NO: 81160 - DNA, 22 bp, Artificial Sequence
  chemically synthesized
aaccaacaaagatcaaaagaga

SEQ ID NO: 81161 - DNA, 22 bp, Artificial Sequence
  chemically synthesized
catactggtaaagggatcaatt

SEQ ID NO: 81162 - DNA, 22 bp, Artificial Sequence
  chemically synthesized
gtaaagggatcaattcaacaag

SEQ ID NO: 81163 - DNA, 22 bp, Artificial Sequence
  chemically synthesized
aacaagaagagctaactatcct

SEQ ID NO: 81164 - DNA, 22 bp, Artificial Sequence
  chemically synthesized
actatcctaaatatatatgcac

SEQ ID NO: 81165 - DNA, 22 bp, Artificial Sequence
  chemically synthesized
tcctaaatatatatgcacccaa

SEQ ID NO: 81166 - DNA, 22 bp, Artificial Sequence
  chemically synthesized
aatatatatgcacccaatacag

SEQ ID NO: 81167 - DNA, 22 bp, Artificial Sequence
  chemically synthesized
ataaagcaagtccttagagacc

SEQ ID NO: 81168 - DNA, 22 bp, Artificial Sequence
  chemically synthesized
agagacctacaaagagacttag

SEQ ID NO: 81169 - DNA, 22 bp, Artificial Sequence
  chemically synthesized
gagacctacaaagagacttaga

SEQ ID NO: 81170 - DNA, 22 bp, Artificial Sequence
  chemically synthesized
caaagagacttagactcccaca

SEQ ID NO: 81171 - DNA, 22 bp, Artificial Sequence
  chemically synthesized
agactcccacacaataataatg

SEQ ID NO: 81172 - DNA, 22 bp, Artificial Sequence
  chemically synthesized
gactcccacacaataataatgg

SEQ ID NO: 81173 - DNA, 22 bp, Artificial Sequence
  chemically synthesized
ccacacaataataatgggagac

SEQ ID NO: 81174 - DNA, 22 bp, Artificial Sequence
  chemically synthesized
taacaccccactgtcaacatta

SEQ ID NO: 81175 - DNA, 22 bp, Artificial Sequence
  chemically synthesized
aacaccccactgtcaacattag

SEQ ID NO: 81176 - DNA, 22 bp, Artificial Sequence
  chemically synthesized
acaccccactgtcaacattaga

SEQ ID NO: 81177 - DNA, 22 bp, Artificial Sequence
  chemically synthesized
tcaacattagacagatcaacga

SEQ ID NO: 81178 - DNA, 22 bp, Artificial Sequence
  chemically synthesized
gacagatcaacgagacagaaag

SEQ ID NO: 81179 - DNA, 22 bp, Artificial Sequence
  chemically synthesized
acaaggatatccaggaattgaa

SEQ ID NO: 81180 - DNA, 22 bp, Artificial Sequence
  chemically synthesized
aattcagctctgcaccaagcag

SEQ ID NO: 81181 - DNA, 22 bp, Artificial Sequence
  chemically synthesized
agctctgcaccaagcagaccta

SEQ ID NO: 81182 - DNA, 22 bp, Artificial Sequence
  chemically synthesized
tgcaccaagcagacctaataga

SEQ ID NO: 81183 - DNA, 22 bp, Artificial Sequence
  chemically synthesized
caccaagcagacctaatagaca

SEQ ID NO: 81184 - DNA, 22 bp, Artificial Sequence
  chemically synthesized
atagacatctacagaactctcc

SEQ ID NO: 81185 - DNA, 22 bp, Artificial Sequence
  chemically synthesized
cagaactctccatcccaaatca

SEQ ID NO: 81186 - DNA, 22 bp, Artificial Sequence
  chemically synthesized
tccatcccaaatcaatagaata

SEQ ID NO: 81187 - DNA, 22 bp, Artificial Sequence
  chemically synthesized
catcccaaatcaatagaatata

SEQ ID NO: 81188 - DNA, 22 bp, Artificial Sequence
  chemically synthesized
ttctcagcaccacaccacacct

SEQ ID NO: 81189 - DNA, 22 bp, Artificial Sequence
  chemically synthesized
ctcagcaccacaccacacctat

SEQ ID NO: 81190 - DNA, 22 bp, Artificial Sequence
  chemically synthesized
tcagcaccacaccacacctatt

SEQ ID NO: 81191 - DNA, 22 bp, Artificial Sequence
  chemically synthesized
agcaccacaccacacctattcc

SEQ ID NO: 81192 - DNA, 22 bp, Artificial Sequence
  chemically synthesized
ttccagttgaccacatagttgg

SEQ ID NO: 81193 - DNA, 22 bp, Artificial Sequence
  chemically synthesized
cagttgaccacatagttggaag

SEQ ID NO: 81194 - DNA, 22 bp, Artificial Sequence
  chemically synthesized
accacatagttggaagtgaagc

SEQ ID NO: 81195 - DNA, 22 bp, Artificial Sequence
  chemically synthesized
gaagtgaagcactcctcagcaa

SEQ ID NO: 81196 - DNA, 22 bp, Artificial Sequence
  chemically synthesized
ctcagcaaacgtaaaagaacag

SEQ ID NO: 81197 - DNA, 22 bp, Artificial Sequence
  chemically synthesized
agcaaacgtaaaagaacagaaa

SEQ ID NO: 81198 - DNA, 22 bp, Artificial Sequence
  chemically synthesized
tctctcagaccacagtgcaatc

SEQ ID NO: 81199 - DNA, 22 bp, Artificial Sequence
  chemically synthesized
tcagaccacagtgcaatcaaac

SEQ ID NO: 81200 - DNA, 22 bp, Artificial Sequence
  chemically synthesized
agaccacagtgcaatcaaacta

SEQ ID NO: 81201 - DNA, 22 bp, Artificial Sequence
  chemically synthesized
gaactcaggattaagaaactca

SEQ ID NO: 81202 - DNA, 22 bp, Artificial Sequence
  chemically synthesized
aggattaagaaactcactcaaa

SEQ ID NO: 81203 - DNA, 22 bp, Artificial Sequence
  chemically synthesized
agaaactcactcaaaaccactc

SEQ ID NO: 81204 - DNA, 22 bp, Artificial Sequence
  chemically synthesized
actcaaaaccactcaactacat

SEQ ID NO: 81205 - DNA, 22 bp, Artificial Sequence
  chemically synthesized
aaaaccactcaactacatggaa

SEQ ID NO: 81206 - DNA, 22 bp, Artificial Sequence
  chemically synthesized
aactacatggaaactgaacagc

SEQ ID NO: 81207 - DNA, 22 bp, Artificial Sequence
  chemically synthesized
catggaaactgaacagcctgct

SEQ ID NO: 81208 - DNA, 22 bp, Artificial Sequence
  chemically synthesized
aacagcctgctcctgaatgact

SEQ ID NO: 81209 - DNA, 22 bp, Artificial Sequence
  chemically synthesized
ctcctgaatgactactgggtac

SEQ ID NO: 81210 - DNA, 22 bp, Artificial Sequence
  chemically synthesized
ctgaatgactactgggtacata

SEQ ID NO: 81211 - DNA, 22 bp, Artificial Sequence
  chemically synthesized
aatgactactgggtacataaca

SEQ ID NO: 81212 - DNA, 22 bp, Artificial Sequence
  chemically synthesized
ctgggtacataacaaaatgaag

SEQ ID NO: 81213 - DNA, 22 bp, Artificial Sequence
  chemically synthesized
ggtacataacaaaatgaaggca

SEQ ID NO: 81214 - DNA, 22 bp, Artificial Sequence
  chemically synthesized
tttgaaaccaacgagaataaag

SEQ ID NO: 81215 - DNA, 22 bp, Artificial Sequence
  chemically synthesized
tgaaaccaacgagaataaagat

SEQ ID NO: 81216 - DNA, 22 bp, Artificial Sequence
  chemically synthesized
gaaaccaacgagaataaagata

SEQ ID NO: 81217 - DNA, 22 bp, Artificial Sequence
  chemically synthesized
aaaccaacgagaataaagatac

SEQ ID NO: 81218 - DNA, 22 bp, Artificial Sequence
  chemically synthesized
tgggacacatttaaagcagtgt

SEQ ID NO: 81219 - DNA, 22 bp, Artificial Sequence
  chemically synthesized
ggacacatttaaagcagtgtgt

SEQ ID NO: 81220 - DNA, 22 bp, Artificial Sequence
  chemically synthesized
aaagcagtgtgtagagggaaat

SEQ ID NO: 81221 - DNA, 22 bp, Artificial Sequence
  chemically synthesized
aagcagtgtgtagagggaaatt

SEQ ID NO: 81222 - DNA, 22 bp, Artificial Sequence
  chemically synthesized
atagcactaaatgcccacaaaa

SEQ ID NO: 81223 - DNA, 22 bp, Artificial Sequence
  chemically synthesized
tagcactaaatgcccacaaaag

SEQ ID NO: 81224 - DNA, 22 bp, Artificial Sequence
  chemically synthesized
aatgcccacaaaagaaagcagg

SEQ ID NO: 81225 - DNA, 22 bp, Artificial Sequence
  chemically synthesized
aaattgacaccctaacatcaca

SEQ ID NO: 81226 - DNA, 22 bp, Artificial Sequence
  chemically synthesized
acaccctaacatcacaattaaa

SEQ ID NO: 81227 - DNA, 22 bp, Artificial Sequence
  chemically synthesized
acatcacaattaaaagaactag

SEQ ID NO: 81228 - DNA, 22 bp, Artificial Sequence
  chemically synthesized
aaagaactagagaagcaagagc

SEQ ID NO: 81229 - DNA, 22 bp, Artificial Sequence
  chemically synthesized
gagaagcaagagcaaacacttt

SEQ ID NO: 81230 - DNA, 22 bp, Artificial Sequence
  chemically synthesized
tcaaaagctagcggaaggcaag

SEQ ID NO: 81231 - DNA, 22 bp, Artificial Sequence
  chemically synthesized
caaaagctagcggaaggcaaga

SEQ ID NO: 81232 - DNA, 22 bp, Artificial Sequence
  chemically synthesized
aaaagctagcggaaggcaagaa

SEQ ID NO: 81233 - DNA, 22 bp, Artificial Sequence
  chemically synthesized
gcggaaggcaagaaataagtaa

SEQ ID NO: 81234 - DNA, 22 bp, Artificial Sequence
  chemically synthesized
agacacaaaaaacccttaaaaa

SEQ ID NO: 81235 - DNA, 22 bp, Artificial Sequence
  chemically synthesized
aaaaaaatcaatgaatccagga

SEQ ID NO: 81236 - DNA, 22 bp, Artificial Sequence
  chemically synthesized
aaaaaatcaatgaatccaggag

SEQ ID NO: 81237 - DNA, 22 bp, Artificial Sequence
  chemically synthesized
gttttttgaaaagatcaacaaa

SEQ ID NO: 81238 - DNA, 22 bp, Artificial Sequence
  chemically synthesized
tttgaaaagatcaacaaaattg

SEQ ID NO: 81239 - DNA, 22 bp, Artificial Sequence
  chemically synthesized
ttgaaaagatcaacaaaattga

SEQ ID NO: 81240 - DNA, 22 bp, Artificial Sequence
  chemically synthesized
tgaaaagatcaacaaaattgat

SEQ ID NO: 81241 - DNA, 22 bp, Artificial Sequence
  chemically synthesized
gaaaagatcaacaaaattgata

SEQ ID NO: 81242 - DNA, 22 bp, Artificial Sequence
  chemically synthesized
aaaagatcaacaaaattgatag

SEQ ID NO: 81243 - DNA, 22 bp, Artificial Sequence
  chemically synthesized
atagactgctagcaagactaat

SEQ ID NO: 81244 - DNA, 22 bp, Artificial Sequence
  chemically synthesized
ctagcaagactaataaagaaga

SEQ ID NO: 81245 - DNA, 22 bp, Artificial Sequence
  chemically synthesized
gcaagactaataaagaagaaaa

SEQ ID NO: 81246 - DNA, 22 bp, Artificial Sequence
  chemically synthesized
ataaagaagaaaagagagaaga

SEQ ID NO: 81247 - DNA, 22 bp, Artificial Sequence
  chemically synthesized
aaatagatgcaataagaaatga

SEQ ID NO: 81248 - DNA, 22 bp, Artificial Sequence
  chemically synthesized
ccatcagagaatactataaaca

SEQ ID NO: 81249 - DNA, 22 bp, Artificial Sequence
  chemically synthesized
taaacacctctacgcaaataaa

SEQ ID NO: 81250 - DNA, 22 bp, Artificial Sequence
  chemically synthesized
tacgcaaataaactagaaaatc

SEQ ID NO: 81251 - DNA, 22 bp, Artificial Sequence
  chemically synthesized
cgcaaataaactagaaaatcta

SEQ ID NO: 81252 - DNA, 22 bp, Artificial Sequence
  chemically synthesized
gaaaatctagtagaaatggata

SEQ ID NO: 81253 - DNA, 22 bp, Artificial Sequence
  chemically synthesized
gtagaaatggataaattcctcg

SEQ ID NO: 81254 - DNA, 22 bp, Artificial Sequence
  chemically synthesized
ctcgacacatacaccctcccaa

SEQ ID NO: 81255 - DNA, 22 bp, Artificial Sequence
  chemically synthesized
gacacatacaccctcccaagac

SEQ ID NO: 81256 - DNA, 22 bp, Artificial Sequence
  chemically synthesized
ccaagactaaaccagggagaaa

SEQ ID NO: 81257 - DNA, 22 bp, Artificial Sequence
  chemically synthesized
aaccagggagaaattgaatctc

SEQ ID NO: 81258 - DNA, 22 bp, Artificial Sequence
  chemically synthesized
aatctcttaatagacaaataat

SEQ ID NO: 81259 - DNA, 22 bp, Artificial Sequence
  chemically synthesized
ttaatagacaaataataggctc

SEQ ID NO: 81260 - DNA, 22 bp, Artificial Sequence
  chemically synthesized
aatagacaaataataggctctg

SEQ ID NO: 81261 - DNA, 22 bp, Artificial Sequence
  chemically synthesized
atagacaaataataggctctga

SEQ ID NO: 81262 - DNA, 22 bp, Artificial Sequence
  chemically synthesized
tgaaattgagacaataattaat

SEQ ID NO: 81263 - DNA, 22 bp, Artificial Sequence
  chemically synthesized
aaattgagacaataattaatag

SEQ ID NO: 81264 - DNA, 22 bp, Artificial Sequence
  chemically synthesized
agacaataattaatagtttaca

SEQ ID NO: 81265 - DNA, 22 bp, Artificial Sequence
  chemically synthesized
atagtttacacattgtatatct

SEQ ID NO: 81266 - DNA, 22 bp, Artificial Sequence
  chemically synthesized
acacattgtatatctaagtacc

SEQ ID NO: 81267 - DNA, 22 bp, Artificial Sequence
  chemically synthesized
cacattgtatatctaagtacca

SEQ ID NO: 81268 - DNA, 22 bp, Artificial Sequence
  chemically synthesized
tatatctaagtaccaccacagc

SEQ ID NO: 81269 - DNA, 22 bp, Artificial Sequence
  chemically synthesized
agtaccaccacagcagcaagta

SEQ ID NO: 81270 - DNA, 22 bp, Artificial Sequence
  chemically synthesized
aatgttttcacattataaaaca

SEQ ID NO: 81271 - DNA, 22 bp, Artificial Sequence
  chemically synthesized
atgttttcacattataaaacag

SEQ ID NO: 81272 - DNA, 22 bp, Artificial Sequence
  chemically synthesized
tcacattataaaacaggagtct

SEQ ID NO: 81273 - DNA, 22 bp, Artificial Sequence
  chemically synthesized
cacattataaaacaggagtcta

SEQ ID NO: 81274 - DNA, 22 bp, Artificial Sequence
  chemically synthesized
acattataaaacaggagtctat

SEQ ID NO: 81275 - DNA, 22 bp, Artificial Sequence
  chemically synthesized
taaaacaggagtctatattact

SEQ ID NO: 81276 - DNA, 22 bp, Artificial Sequence
  chemically synthesized
tattacttcaatatattacttg

SEQ ID NO: 81277 - DNA, 22 bp, Artificial Sequence
  chemically synthesized
cttcaatatattacttgttatt

SEQ ID NO: 81278 - DNA, 22 bp, Artificial Sequence
  chemically synthesized
caatatattacttgttattact

SEQ ID NO: 81279 - DNA, 22 bp, Artificial Sequence
  chemically synthesized
aatatattacttgttattacta

SEQ ID NO: 81280 - DNA, 22 bp, Artificial Sequence
  chemically synthesized
cttgttattactaattactagt

SEQ ID NO: 81281 - DNA, 22 bp, Artificial Sequence
  chemically synthesized
gttattactaattactagttct

SEQ ID NO: 81282 - DNA, 22 bp, Artificial Sequence
  chemically synthesized
ttattactaattactagttcta

SEQ ID NO: 81283 - DNA, 22 bp, Artificial Sequence
  chemically synthesized
ttactaattactagttctaaaa

SEQ ID NO: 81284 - DNA, 22 bp, Artificial Sequence
  chemically synthesized
ctaattactagttctaaaaaat

SEQ ID NO: 81285 - DNA, 22 bp, Artificial Sequence
  chemically synthesized
attactagttctaaaaaatgtg

SEQ ID NO: 81286 - DNA, 22 bp, Artificial Sequence
  chemically synthesized
ctagttctaaaaaatgtggata

SEQ ID NO: 81287 - DNA, 22 bp, Artificial Sequence
  chemically synthesized
gttctaaaaaatgtggatagaa

SEQ ID NO: 81288 - DNA, 22 bp, Artificial Sequence
  chemically synthesized
taaaaaatgtggatagaagcaa

SEQ ID NO: 81289 - DNA, 22 bp, Artificial Sequence
  chemically synthesized
aaaaatgtggatagaagcaagt

SEQ ID NO: 81290 - DNA, 22 bp, Artificial Sequence
  chemically synthesized
aatattgagtggaaaataagat

SEQ ID NO: 81291 - DNA, 22 bp, Artificial Sequence
  chemically synthesized
atattgagtggaaaataagatt

SEQ ID NO: 81292 - DNA, 22 bp, Artificial Sequence
  chemically synthesized
agtggaaaataagattaggaga

SEQ ID NO: 81293 - DNA, 22 bp, Artificial Sequence
  chemically synthesized
ggagatgcaacaccagggtagg

SEQ ID NO: 81294 - DNA, 22 bp, Artificial Sequence
  chemically synthesized
gataggtagatagctagctagc

SEQ ID NO: 81295 - DNA, 22 bp, Artificial Sequence
  chemically synthesized
gctagctagctagctagctagc

SEQ ID NO: 81296 - DNA, 22 bp, Artificial Sequence
  chemically synthesized
gctagctagctagctagctaga

SEQ ID NO: 81297 - DNA, 22 bp, Artificial Sequence
  chemically synthesized
gctagctagctagctagaaaga

SEQ ID NO: 81298 - DNA, 22 bp, Artificial Sequence
  chemically synthesized
gctagctagctagaaagataga

SEQ ID NO: 81299 - DNA, 22 bp, Artificial Sequence
  chemically synthesized
gctagctagaaagatagataga

SEQ ID NO: 81300 - DNA, 22 bp, Artificial Sequence
  chemically synthesized
gctagaaagatagatagataga

SEQ ID NO: 81301 - DNA, 22 bp, Artificial Sequence
  chemically synthesized
gaaagatagatagatagataga

SEQ ID NO: 81302 - DNA, 22 bp, Artificial Sequence
  chemically synthesized
ctatactctctaagttcccttt

SEQ ID NO: 81303 - DNA, 22 bp, Artificial Sequence
  chemically synthesized
tatactctctaagttccctttc

SEQ ID NO: 81304 - DNA, 22 bp, Artificial Sequence
  chemically synthesized
tactctctaagttccctttctc

SEQ ID NO: 81305 - DNA, 22 bp, Artificial Sequence
  chemically synthesized
tctaagttccctttctcaagta

SEQ ID NO: 81306 - DNA, 22 bp, Artificial Sequence
  chemically synthesized
taagttccctttctcaagtaaa

SEQ ID NO: 81307 - DNA, 22 bp, Artificial Sequence
  chemically synthesized
agttccctttctcaagtaaaag

SEQ ID NO: 81308 - DNA, 22 bp, Artificial Sequence
  chemically synthesized
cctttctcaagtaaaagctggc

SEQ ID NO: 81309 - DNA, 22 bp, Artificial Sequence
  chemically synthesized
tctcaagtaaaagctggctaaa

SEQ ID NO: 81310 - DNA, 22 bp, Artificial Sequence
  chemically synthesized
ctcaagtaaaagctggctaaag

SEQ ID NO: 81311 - DNA, 22 bp, Artificial Sequence
  chemically synthesized
tcaagtaaaagctggctaaagt

SEQ ID NO: 81312 - DNA, 22 bp, Artificial Sequence
  chemically synthesized
aagtaaaagctggctaaagttc

SEQ ID NO: 81313 - DNA, 22 bp, Artificial Sequence
  chemically synthesized
gctaaagttcttgttttttgag

SEQ ID NO: 81314 - DNA, 22 bp, Artificial Sequence
  chemically synthesized
aagttcttgttttttgaggtgg

SEQ ID NO: 81315 - DNA, 22 bp, Artificial Sequence
  chemically synthesized
ttgttttttgaggtggcacagg

SEQ ID NO: 81316 - DNA, 22 bp, Artificial Sequence
  chemically synthesized
gttttttgaggtggcacagggg

SEQ ID NO: 81317 - DNA, 22 bp, Artificial Sequence
  chemically synthesized
ttttttgaggtggcacaggggc

SEQ ID NO: 81318 - DNA, 22 bp, Artificial Sequence
  chemically synthesized
tttgaggtggcacaggggctta

SEQ ID NO: 81319 - DNA, 22 bp, Artificial Sequence
  chemically synthesized
ttgaggtggcacaggggcttaa

SEQ ID NO: 81320 - DNA, 22 bp, Artificial Sequence
  chemically synthesized
tgaggtggcacaggggcttaag

SEQ ID NO: 81321 - DNA, 22 bp, Artificial Sequence
  chemically synthesized
gaggtggcacaggggcttaaga

SEQ ID NO: 81322 - DNA, 22 bp, Artificial Sequence
  chemically synthesized
aggtggcacaggggcttaagaa

SEQ ID NO: 81323 - DNA, 22 bp, Artificial Sequence
  chemically synthesized
aagaaatgactgctcccccatc

SEQ ID NO: 81324 - DNA, 22 bp, Artificial Sequence
  chemically synthesized
agaaatgactgctcccccatct

SEQ ID NO: 81325 - DNA, 22 bp, Artificial Sequence
  chemically synthesized
ctcccccatctcttgattccat

SEQ ID NO: 81326 - DNA, 22 bp, Artificial Sequence
  chemically synthesized
ccccatctcttgattccattac

SEQ ID NO: 81327 - DNA, 22 bp, Artificial Sequence
  chemically synthesized
ttgattccattacagttcaata

SEQ ID NO: 81328 - DNA, 22 bp, Artificial Sequence
  chemically synthesized
gattccattacagttcaatata

SEQ ID NO: 81329 - DNA, 22 bp, Artificial Sequence
  chemically synthesized
attccattacagttcaatatac

SEQ ID NO: 81330 - DNA, 22 bp, Artificial Sequence
  chemically synthesized
cattacagttcaatatactgat

SEQ ID NO: 81331 - DNA, 22 bp, Artificial Sequence
  chemically synthesized
cagttcaatatactgatcattg

SEQ ID NO: 81332 - DNA, 22 bp, Artificial Sequence
  chemically synthesized
aatatactgatcattgtatagc

SEQ ID NO: 81333 - DNA, 22 bp, Artificial Sequence
  chemically synthesized
atcattgtatagcatagtctgc

SEQ ID NO: 81334 - DNA, 22 bp, Artificial Sequence
  chemically synthesized
tatagcatagtctgctaccttt

SEQ ID NO: 81335 - DNA, 22 bp, Artificial Sequence
  chemically synthesized
ctacctttacttttgtttttgc

SEQ ID NO: 81336 - DNA, 22 bp, Artificial Sequence
  chemically synthesized
cctttacttttgtttttgctaa

SEQ ID NO: 81337 - DNA, 22 bp, Artificial Sequence
  chemically synthesized
tacttttgtttttgctaagtgc

SEQ ID NO: 81338 - DNA, 22 bp, Artificial Sequence
  chemically synthesized
acttttgtttttgctaagtgct

SEQ ID NO: 81339 - DNA, 22 bp, Artificial Sequence
  chemically synthesized
cttttgtttttgctaagtgcta

SEQ ID NO: 81340 - DNA, 22 bp, Artificial Sequence
  chemically synthesized
ttgtttttgctaagtgctaaat

SEQ ID NO: 81341 - DNA, 22 bp, Artificial Sequence
  chemically synthesized
tgtttttgctaagtgctaaata

SEQ ID NO: 81342 - DNA, 22 bp, Artificial Sequence
  chemically synthesized
gtttttgctaagtgctaaatat

SEQ ID NO: 81343 - DNA, 22 bp, Artificial Sequence
  chemically synthesized
tttttgctaagtgctaaatatt

SEQ ID NO: 81344 - DNA, 22 bp, Artificial Sequence
  chemically synthesized
ttgctaagtgctaaatattctg

SEQ ID NO: 81345 - DNA, 22 bp, Artificial Sequence
  chemically synthesized
tgctaagtgctaaatattctgg

SEQ ID NO: 81346 - DNA, 22 bp, Artificial Sequence
  chemically synthesized
gctaagtgctaaatattctggt

SEQ ID NO: 81347 - DNA, 22 bp, Artificial Sequence
  chemically synthesized
ctaagtgctaaatattctggtc

SEQ ID NO: 81348 - DNA, 22 bp, Artificial Sequence
  chemically synthesized
agtgctaaatattctggtctca

SEQ ID NO: 81349 - DNA, 22 bp, Artificial Sequence
  chemically synthesized
aatattctggtctcaaatttta

SEQ ID NO: 81350 - DNA, 22 bp, Artificial Sequence
  chemically synthesized
tggtctcaaattttatatgatg

SEQ ID NO: 81351 - DNA, 22 bp, Artificial Sequence
  chemically synthesized
gtctcaaattttatatgatgga

SEQ ID NO: 81352 - DNA, 22 bp, Artificial Sequence
  chemically synthesized
aaattttatatgatggaaatgt

SEQ ID NO: 81353 - DNA, 22 bp, Artificial Sequence
  chemically synthesized
tatatgatggaaatgtttgggt

SEQ ID NO: 81354 - DNA, 22 bp, Artificial Sequence
  chemically synthesized
atatgatggaaatgtttgggtc

SEQ ID NO: 81355 - DNA, 22 bp, Artificial Sequence
  chemically synthesized
tatgatggaaatgtttgggtcc

SEQ ID NO: 81356 - DNA, 22 bp, Artificial Sequence
  chemically synthesized
gggtcccattttttgagttaca

SEQ ID NO: 81357 - DNA, 22 bp, Artificial Sequence
  chemically synthesized
ggtcccattttttgagttacag

SEQ ID NO: 81358 - DNA, 22 bp, Artificial Sequence
  chemically synthesized
tttgagttacagtttagaattt

SEQ ID NO: 81359 - DNA, 22 bp, Artificial Sequence
  chemically synthesized
ttgagttacagtttagaattta

SEQ ID NO: 81360 - DNA, 22 bp, Artificial Sequence
  chemically synthesized
tgagttacagtttagaatttaa

SEQ ID NO: 81361 - DNA, 22 bp, Artificial Sequence
  chemically synthesized
gagttacagtttagaatttaaa

SEQ ID NO: 81362 - DNA, 22 bp, Artificial Sequence
  chemically synthesized
agttacagtttagaatttaaaa

SEQ ID NO: 81363 - DNA, 22 bp, Artificial Sequence
  chemically synthesized
cagtttagaatttaaaataccc

SEQ ID NO: 81364 - DNA, 22 bp, Artificial Sequence
  chemically synthesized
agaatttaaaatacccacacag

SEQ ID NO: 81365 - DNA, 22 bp, Artificial Sequence
  chemically synthesized
gaatttaaaatacccacacagc

SEQ ID NO: 81366 - DNA, 22 bp, Artificial Sequence
  chemically synthesized
aaaatacccacacagctgagca

SEQ ID NO: 81367 - DNA, 22 bp, Artificial Sequence
  chemically synthesized
aaatacccacacagctgagcaa

SEQ ID NO: 81368 - DNA, 22 bp, Artificial Sequence
  chemically synthesized
agcaatttacccttgctttaag

SEQ ID NO: 81369 - DNA, 22 bp, Artificial Sequence
  chemically synthesized
acccttgctttaagttggaatg

SEQ ID NO: 81370 - DNA, 22 bp, Artificial Sequence
  chemically synthesized
cccttgctttaagttggaatga

SEQ ID NO: 81371 - DNA, 22 bp, Artificial Sequence
  chemically synthesized
gctttaagttggaatgaggttc

SEQ ID NO: 81372 - DNA, 22 bp, Artificial Sequence
  chemically synthesized
ctttaagttggaatgaggttct

SEQ ID NO: 81373 - DNA, 22 bp, Artificial Sequence
  chemically synthesized
taagttggaatgaggttcttta

SEQ ID NO: 81374 - DNA, 22 bp, Artificial Sequence
  chemically synthesized
aagttggaatgaggttctttaa

SEQ ID NO: 81375 - DNA, 22 bp, Artificial Sequence
  chemically synthesized
agttggaatgaggttctttaaa

SEQ ID NO: 81376 - DNA, 22 bp, Artificial Sequence
  chemically synthesized
gaatgaggttctttaaaaatat

SEQ ID NO: 81377 - DNA, 22 bp, Artificial Sequence
  chemically synthesized
tttaaaaatattaagataaaat

SEQ ID NO: 81378 - DNA, 22 bp, Artificial Sequence
  chemically synthesized
taaaaatattaagataaaattt

SEQ ID NO: 81379 - DNA, 22 bp, Artificial Sequence
  chemically synthesized
aaaaatattaagataaaatttg

SEQ ID NO: 81380 - DNA, 22 bp, Artificial Sequence
  chemically synthesized
aaaatattaagataaaatttga

SEQ ID NO: 81381 - DNA, 22 bp, Artificial Sequence
  chemically synthesized
agataaaatttgaagttattta

SEQ ID NO: 81382 - DNA, 22 bp, Artificial Sequence
  chemically synthesized
gaagttatttaactctgtggat

SEQ ID NO: 81383 - DNA, 22 bp, Artificial Sequence
  chemically synthesized
aagttatttaactctgtggatc

SEQ ID NO: 81384 - DNA, 22 bp, Artificial Sequence
  chemically synthesized
tttaactctgtggatctacttt

SEQ ID NO: 81385 - DNA, 22 bp, Artificial Sequence
  chemically synthesized
aactctgtggatctactttatt

SEQ ID NO: 81386 - DNA, 22 bp, Artificial Sequence
  chemically synthesized
actctgtggatctactttattt

SEQ ID NO: 81387 - DNA, 22 bp, Artificial Sequence
  chemically synthesized
tgtggatctactttatttacat

SEQ ID NO: 81388 - DNA, 22 bp, Artificial Sequence
  chemically synthesized
tggatctactttatttacataa

SEQ ID NO: 81389 - DNA, 22 bp, Artificial Sequence
  chemically synthesized
ctttatttacataaactaattg

SEQ ID NO: 81390 - DNA, 22 bp, Artificial Sequence
  chemically synthesized
tatttacataaactaattgttt

SEQ ID NO: 81391 - DNA, 22 bp, Artificial Sequence
  chemically synthesized
atttacataaactaattgtttt

SEQ ID NO: 81392 - DNA, 22 bp, Artificial Sequence
  chemically synthesized
tttacataaactaattgtttta

SEQ ID NO: 81393 - DNA, 22 bp, Artificial Sequence
  chemically synthesized
acataaactaattgttttacta

SEQ ID NO: 81394 - DNA, 22 bp, Artificial Sequence
  chemically synthesized
cataaactaattgttttactat

SEQ ID NO: 81395 - DNA, 22 bp, Artificial Sequence
  chemically synthesized
attgttttactatttaatatat

SEQ ID NO: 81396 - DNA, 22 bp, Artificial Sequence
  chemically synthesized
ttttactatttaatatatatct

SEQ ID NO: 81397 - DNA, 22 bp, Artificial Sequence
  chemically synthesized
tactatttaatatatatctcac

SEQ ID NO: 81398 - DNA, 22 bp, Artificial Sequence
  chemically synthesized
actatttaatatatatctcaca

SEQ ID NO: 81399 - DNA, 22 bp, Artificial Sequence
  chemically synthesized
ctatttaatatatatctcacat

SEQ ID NO: 81400 - DNA, 22 bp, Artificial Sequence
  chemically synthesized
tttaatatatatctcacattgt

SEQ ID NO: 81401 - DNA, 22 bp, Artificial Sequence
  chemically synthesized
aatatatatctcacattgttag

SEQ ID NO: 81402 - DNA, 22 bp, Artificial Sequence
  chemically synthesized
atatatatctcacattgttaga

SEQ ID NO: 81403 - DNA, 22 bp, Artificial Sequence
  chemically synthesized
acattgttagaatattttaagt

SEQ ID NO: 81404 - DNA, 22 bp, Artificial Sequence
  chemically synthesized
ttagaatattttaagtaaactg

SEQ ID NO: 81405 - DNA, 22 bp, Artificial Sequence
  chemically synthesized
gaatattttaagtaaactgttg

SEQ ID NO: 81406 - DNA, 22 bp, Artificial Sequence
  chemically synthesized
taagtaaactgttgatgtttca

SEQ ID NO: 81407 - DNA, 22 bp, Artificial Sequence
  chemically synthesized
aagtaaactgttgatgtttcag

SEQ ID NO: 81408 - DNA, 22 bp, Artificial Sequence
  chemically synthesized
agtaaactgttgatgtttcaga

SEQ ID NO: 81409 - DNA, 22 bp, Artificial Sequence
  chemically synthesized
ttgatgtttcagagaaaggaaa

SEQ ID NO: 81410 - DNA, 22 bp, Artificial Sequence
  chemically synthesized
atgtttcagagaaaggaaagaa

SEQ ID NO: 81411 - DNA, 22 bp, Artificial Sequence
  chemically synthesized
cagagaaaggaaagaataattt

SEQ ID NO: 81412 - DNA, 22 bp, Artificial Sequence
  chemically synthesized
agagaaaggaaagaataatttt

SEQ ID NO: 81413 - DNA, 22 bp, Artificial Sequence
  chemically synthesized
tgaagcattcctgacacagttc

SEQ ID NO: 81414 - DNA, 22 bp, Artificial Sequence
  chemically synthesized
gaagcattcctgacacagttct

SEQ ID NO: 81415 - DNA, 22 bp, Artificial Sequence
  chemically synthesized
aagcattcctgacacagttcta

SEQ ID NO: 81416 - DNA, 22 bp, Artificial Sequence
  chemically synthesized
ctgacacagttctaggccagag

SEQ ID NO: 81417 - DNA, 22 bp, Artificial Sequence
  chemically synthesized
acacagttctaggccagagcca

SEQ ID NO: 81418 - DNA, 22 bp, Artificial Sequence
  chemically synthesized
taggccagagccatgcatgtga

SEQ ID NO: 81419 - DNA, 22 bp, Artificial Sequence
  chemically synthesized
ggccagagccatgcatgtgagt

SEQ ID NO: 81420 - DNA, 22 bp, Artificial Sequence
  chemically synthesized
tagaagtgagggttacagtgac

SEQ ID NO: 81421 - DNA, 22 bp, Artificial Sequence
  chemically synthesized
cagtgactggggcttcatcagg

SEQ ID NO: 81422 - DNA, 22 bp, Artificial Sequence
  chemically synthesized
gggcttcatcaggacattaggg

SEQ ID NO: 81423 - DNA, 22 bp, Artificial Sequence
  chemically synthesized
catcaggacattagggatggga

SEQ ID NO: 81424 - DNA, 22 bp, Artificial Sequence
  chemically synthesized
atcaggacattagggatgggag

SEQ ID NO: 81425 - DNA, 22 bp, Artificial Sequence
  chemically synthesized
gggatgggagagaagaatctaa

SEQ ID NO: 81426 - DNA, 22 bp, Artificial Sequence
  chemically synthesized
agtgaaaaaaaaatacaggaat

SEQ ID NO: 81427 - DNA, 22 bp, Artificial Sequence
  chemically synthesized
tctggcctttaaattttttctg

SEQ ID NO: 81428 - DNA, 22 bp, Artificial Sequence
  chemically synthesized
ctggcctttaaattttttctgg

SEQ ID NO: 81429 - DNA, 22 bp, Artificial Sequence
  chemically synthesized
tggcctttaaattttttctggt

SEQ ID NO: 81430 - DNA, 22 bp, Artificial Sequence
  chemically synthesized
gcctttaaattttttctggtga

SEQ ID NO: 81431 - DNA, 22 bp, Artificial Sequence
  chemically synthesized
taaattttttctggtgatcttt

SEQ ID NO: 81432 - DNA, 22 bp, Artificial Sequence
  chemically synthesized
aaattttttctggtgatctttt

SEQ ID NO: 81433 - DNA, 22 bp, Artificial Sequence
  chemically synthesized
aattttttctggtgatcttttg

SEQ ID NO: 81434 - DNA, 22 bp, Artificial Sequence
  chemically synthesized
tttctggtgatcttttgtgata

SEQ ID NO: 81435 - DNA, 22 bp, Artificial Sequence
  chemically synthesized
ttctggtgatcttttgtgatac

SEQ ID NO: 81436 - DNA, 22 bp, Artificial Sequence
  chemically synthesized
tctggtgatcttttgtgatacc

SEQ ID NO: 81437 - DNA, 22 bp, Artificial Sequence
  chemically synthesized
ctggtgatcttttgtgatacct

SEQ ID NO: 81438 - DNA, 22 bp, Artificial Sequence
  chemically synthesized
tggtgatcttttgtgataccta

SEQ ID NO: 81439 - DNA, 22 bp, Artificial Sequence
  chemically synthesized
gtgatcttttgtgatacctatg

SEQ ID NO: 81440 - DNA, 22 bp, Artificial Sequence
  chemically synthesized
ttgtgatacctatggtttttaa

SEQ ID NO: 81441 - DNA, 22 bp, Artificial Sequence
  chemically synthesized
tgtgatacctatggtttttaaa

SEQ ID NO: 81442 - DNA, 22 bp, Artificial Sequence
  chemically synthesized
gtgatacctatggtttttaaat

SEQ ID NO: 81443 - DNA, 22 bp, Artificial Sequence
  chemically synthesized
tgatacctatggtttttaaata

SEQ ID NO: 81444 - DNA, 22 bp, Artificial Sequence
  chemically synthesized
tggtttttaaatatttgtttgt

SEQ ID NO: 81445 - DNA, 22 bp, Artificial Sequence
  chemically synthesized
ttaaatatttgtttgttttttt

SEQ ID NO: 81446 - DNA, 22 bp, Artificial Sequence
  chemically synthesized
taaatatttgtttgtttttttg

SEQ ID NO: 81447 - DNA, 22 bp, Artificial Sequence
  chemically synthesized
aaatatttgtttgtttttttgt

SEQ ID NO: 81448 - DNA, 22 bp, Artificial Sequence
  chemically synthesized
aatatttgtttgtttttttgtt

SEQ ID NO: 81449 - DNA, 22 bp, Artificial Sequence
  chemically synthesized
gtttgtttttttgtttttccta

SEQ ID NO: 81450 - DNA, 22 bp, Artificial Sequence
  chemically synthesized
tttgtttttttgtttttcctaa

SEQ ID NO: 81451 - DNA, 22 bp, Artificial Sequence
  chemically synthesized
gtttttttgtttttcctaaaac

SEQ ID NO: 81452 - DNA, 22 bp, Artificial Sequence
  chemically synthesized
tttttttgtttttcctaaaaca

SEQ ID NO: 81453 - DNA, 22 bp, Artificial Sequence
  chemically synthesized
ttttgtttttcctaaaacattg

SEQ ID NO: 81454 - DNA, 22 bp, Artificial Sequence
  chemically synthesized
tttgtttttcctaaaacattgt

SEQ ID NO: 81455 - DNA, 22 bp, Artificial Sequence
  chemically synthesized
ttgtttttcctaaaacattgtc

SEQ ID NO: 81456 - DNA, 22 bp, Artificial Sequence
  chemically synthesized
tgtttttcctaaaacattgtca

SEQ ID NO: 81457 - DNA, 22 bp, Artificial Sequence
  chemically synthesized
gtttttcctaaaacattgtcat

SEQ ID NO: 81458 - DNA, 22 bp, Artificial Sequence
  chemically synthesized
tttttcctaaaacattgtcata

SEQ ID NO: 81459 - DNA, 22 bp, Artificial Sequence
  chemically synthesized
ttcctaaaacattgtcatatgt

SEQ ID NO: 81460 - DNA, 22 bp, Artificial Sequence
  chemically synthesized
tcctaaaacattgtcatatgtg

SEQ ID NO: 81461 - DNA, 22 bp, Artificial Sequence
  chemically synthesized
cctaaaacattgtcatatgtga

SEQ ID NO: 81462 - DNA, 22 bp, Artificial Sequence
  chemically synthesized
ctaaaacattgtcatatgtgat

SEQ ID NO: 81463 - DNA, 22 bp, Artificial Sequence
  chemically synthesized
aaacattgtcatatgtgatgac

SEQ ID NO: 81464 - DNA, 22 bp, Artificial Sequence
  chemically synthesized
tcatatgtgatgacccaaatta

SEQ ID NO: 81465 - DNA, 22 bp, Artificial Sequence
  chemically synthesized
taggcctgggttccttgtagca

SEQ ID NO: 81466 - DNA, 22 bp, Artificial Sequence
  chemically synthesized
ggttccttgtagcattattcta

SEQ ID NO: 81467 - DNA, 22 bp, Artificial Sequence
  chemically synthesized
cttgtagcattattctaggata

SEQ ID NO: 81468 - DNA, 22 bp, Artificial Sequence
  chemically synthesized
gtagcattattctaggatattt

SEQ ID NO: 81469 - DNA, 22 bp, Artificial Sequence
  chemically synthesized
tagcattattctaggatatttc

SEQ ID NO: 81470 - DNA, 22 bp, Artificial Sequence
  chemically synthesized
ttctaggatatttctgacagca

SEQ ID NO: 81471 - DNA, 22 bp, Artificial Sequence
  chemically synthesized
taggatatttctgacagcatat

SEQ ID NO: 81472 - DNA, 22 bp, Artificial Sequence
  chemically synthesized
ggatatttctgacagcatattc

SEQ ID NO: 81473 - DNA, 22 bp, Artificial Sequence
  chemically synthesized
ctgacagcatattctgactgaa

SEQ ID NO: 81474 - DNA, 22 bp, Artificial Sequence
  chemically synthesized
tgacagcatattctgactgaat

SEQ ID NO: 81475 - DNA, 22 bp, Artificial Sequence
  chemically synthesized
acagcatattctgactgaatca

SEQ ID NO: 81476 - DNA, 22 bp, Artificial Sequence
  chemically synthesized
tgactgaatcatgaatgtatcc

SEQ ID NO: 81477 - DNA, 22 bp, Artificial Sequence
  chemically synthesized
actgaatcatgaatgtatccac

SEQ ID NO: 81478 - DNA, 22 bp, Artificial Sequence
  chemically synthesized
aatcatgaatgtatccacggag

SEQ ID NO: 81479 - DNA, 22 bp, Artificial Sequence
  chemically synthesized
taaggacatatatagttgtatt

SEQ ID NO: 81480 - DNA, 22 bp, Artificial Sequence
  chemically synthesized
aggacatatatagttgtattta

SEQ ID NO: 81481 - DNA, 22 bp, Artificial Sequence
  chemically synthesized
tatttaaatactggctaaatct

SEQ ID NO: 81482 - DNA, 22 bp, Artificial Sequence
  chemically synthesized
aaatactggctaaatcttattc

SEQ ID NO: 81483 - DNA, 22 bp, Artificial Sequence
  chemically synthesized
aatactggctaaatcttattct

SEQ ID NO: 81484 - DNA, 22 bp, Artificial Sequence
  chemically synthesized
gctaaatcttattctgactcta

SEQ ID NO: 81485 - DNA, 22 bp, Artificial Sequence
  chemically synthesized
aatcttattctgactctatgac

SEQ ID NO: 81486 - DNA, 22 bp, Artificial Sequence
  chemically synthesized
attctgactctatgaccctgga

SEQ ID NO: 81487 - DNA, 22 bp, Artificial Sequence
  chemically synthesized
ttctgactctatgaccctggac

SEQ ID NO: 81488 - DNA, 22 bp, Artificial Sequence
  chemically synthesized
tgactctatgaccctggacacg

SEQ ID NO: 81489 - DNA, 22 bp, Artificial Sequence
  chemically synthesized
actctatgaccctggacacgtc

SEQ ID NO: 81490 - DNA, 22 bp, Artificial Sequence
  chemically synthesized
tatgaccctggacacgtcattt

SEQ ID NO: 81491 - DNA, 22 bp, Artificial Sequence
  chemically synthesized
tgaccctggacacgtcatttaa

SEQ ID NO: 81492 - DNA, 22 bp, Artificial Sequence
  chemically synthesized
gacacgtcatttaatttaaact

SEQ ID NO: 81493 - DNA, 22 bp, Artificial Sequence
  chemically synthesized
aatttaaactttagttctcttg

SEQ ID NO: 81494 - DNA, 22 bp, Artificial Sequence
  chemically synthesized
atttaaactttagttctcttgc

SEQ ID NO: 81495 - DNA, 22 bp, Artificial Sequence
  chemically synthesized
aaactttagttctcttgcttgt

SEQ ID NO: 81496 - DNA, 22 bp, Artificial Sequence
  chemically synthesized
aactttagttctcttgcttgta

SEQ ID NO: 81497 - DNA, 22 bp, Artificial Sequence
  chemically synthesized
tagttctcttgcttgtaaaata

SEQ ID NO: 81498 - DNA, 22 bp, Artificial Sequence
  chemically synthesized
agttctcttgcttgtaaaatac

SEQ ID NO: 81499 - DNA, 22 bp, Artificial Sequence
  chemically synthesized
gttctcttgcttgtaaaatacc

SEQ ID NO: 81500 - DNA, 22 bp, Artificial Sequence
  chemically synthesized
tcttgcttgtaaaatacctaac

SEQ ID NO: 81501 - DNA, 22 bp, Artificial Sequence
  chemically synthesized
ttgcttgtaaaatacctaacaa

SEQ ID NO: 81502 - DNA, 22 bp, Artificial Sequence
  chemically synthesized
gcttgtaaaatacctaacaata

SEQ ID NO: 81503 - DNA, 22 bp, Artificial Sequence
  chemically synthesized
cttgtaaaatacctaacaataa

SEQ ID NO: 81504 - DNA, 22 bp, Artificial Sequence
  chemically synthesized
gtaaaatacctaacaataagca

SEQ ID NO: 81505 - DNA, 22 bp, Artificial Sequence
  chemically synthesized
taaaatacctaacaataagcat

SEQ ID NO: 81506 - DNA, 22 bp, Artificial Sequence
  chemically synthesized
acaataagcataaatttaaaat

SEQ ID NO: 81507 - DNA, 22 bp, Artificial Sequence
  chemically synthesized
aaaatgtgagtcttttctgaag

SEQ ID NO: 81508 - DNA, 22 bp, Artificial Sequence
  chemically synthesized
aaatgtgagtcttttctgaagt

SEQ ID NO: 81509 - DNA, 22 bp, Artificial Sequence
  chemically synthesized
ttctgaagtcagtgtcttagga

SEQ ID NO: 81510 - DNA, 22 bp, Artificial Sequence
  chemically synthesized
tctgaagtcagtgtcttaggaa

SEQ ID NO: 81511 - DNA, 22 bp, Artificial Sequence
  chemically synthesized
ctgaagtcagtgtcttaggaag

SEQ ID NO: 81512 - DNA, 22 bp, Artificial Sequence
  chemically synthesized
tgaagtcagtgtcttaggaagg

SEQ ID NO: 81513 - DNA, 22 bp, Artificial Sequence
  chemically synthesized
aagtcagtgtcttaggaaggta

SEQ ID NO: 81514 - DNA, 22 bp, Artificial Sequence
  chemically synthesized
aggaaggtagctacataagtca

SEQ ID NO: 81515 - DNA, 22 bp, Artificial Sequence
  chemically synthesized
ggaaggtagctacataagtcat

SEQ ID NO: 81516 - DNA, 22 bp, Artificial Sequence
  chemically synthesized
cataagtcatttatatctctat

SEQ ID NO: 81517 - DNA, 22 bp, Artificial Sequence
  chemically synthesized
atatctctatcccaacaataga

SEQ ID NO: 81518 - DNA, 22 bp, Artificial Sequence
  chemically synthesized
tatctctatcccaacaatagat

SEQ ID NO: 81519 - DNA, 22 bp, Artificial Sequence
  chemically synthesized
tatcccaacaatagatgacatc

SEQ ID NO: 81520 - DNA, 22 bp, Artificial Sequence
  chemically synthesized
tcccaacaatagatgacatcag

SEQ ID NO: 81521 - DNA, 22 bp, Artificial Sequence
  chemically synthesized
acaaaattgtagcaattaagac

SEQ ID NO: 81522 - DNA, 22 bp, Artificial Sequence
  chemically synthesized
tagcaattaagaccaaaattat

SEQ ID NO: 81523 - DNA, 22 bp, Artificial Sequence
  chemically synthesized
agaccaaaattattgtcaactg

SEQ ID NO: 81524 - DNA, 22 bp, Artificial Sequence
  chemically synthesized
ttgtcaactggaataagtttaa

SEQ ID NO: 81525 - DNA, 22 bp, Artificial Sequence
  chemically synthesized
tcaactggaataagtttaactt

SEQ ID NO: 81526 - DNA, 22 bp, Artificial Sequence
  chemically synthesized
gaataagtttaactttcaggac

SEQ ID NO: 81527 - DNA, 22 bp, Artificial Sequence
  chemically synthesized
aactttcaggacttcaggctta

SEQ ID NO: 81528 - DNA, 22 bp, Artificial Sequence
  chemically synthesized
actttcaggacttcaggcttat

SEQ ID NO: 81529 - DNA, 22 bp, Artificial Sequence
  chemically synthesized
tcaggacttcaggcttattatc

SEQ ID NO: 81530 - DNA, 22 bp, Artificial Sequence
  chemically synthesized
caggacttcaggcttattatcc

SEQ ID NO: 81531 - DNA, 22 bp, Artificial Sequence
  chemically synthesized
aggacttcaggcttattatcca

SEQ ID NO: 81532 - DNA, 22 bp, Artificial Sequence
  chemically synthesized
caggcttattatccatcaaact

SEQ ID NO: 81533 - DNA, 22 bp, Artificial Sequence
  chemically synthesized
aggcttattatccatcaaactg

SEQ ID NO: 81534 - DNA, 22 bp, Artificial Sequence
  chemically synthesized
attatccatcaaactgagattg

SEQ ID NO: 81535 - DNA, 22 bp, Artificial Sequence
  chemically synthesized
ttatccatcaaactgagattga

SEQ ID NO: 81536 - DNA, 22 bp, Artificial Sequence
  chemically synthesized
tccatcaaactgagattgaatt

SEQ ID NO: 81537 - DNA, 22 bp, Artificial Sequence
  chemically synthesized
agattgaattgatttagagtat

SEQ ID NO: 81538 - DNA, 22 bp, Artificial Sequence
  chemically synthesized
aattgatttagagtatccataa

SEQ ID NO: 81539 - DNA, 22 bp, Artificial Sequence
  chemically synthesized
atttagagtatccataaatact

SEQ ID NO: 81540 - DNA, 22 bp, Artificial Sequence
  chemically synthesized
agagtatccataaatactagga

SEQ ID NO: 81541 - DNA, 22 bp, Artificial Sequence
  chemically synthesized
gagtatccataaatactaggaa

SEQ ID NO: 81542 - DNA, 22 bp, Artificial Sequence
  chemically synthesized
ggaataaatttttttttaataa

SEQ ID NO: 81543 - DNA, 22 bp, Artificial Sequence
  chemically synthesized
ttttttaataaatttcttatac

SEQ ID NO: 81544 - DNA, 22 bp, Artificial Sequence
  chemically synthesized
tttttaataaatttcttatact

SEQ ID NO: 81545 - DNA, 22 bp, Artificial Sequence
  chemically synthesized
ttttaataaatttcttatactg

SEQ ID NO: 81546 - DNA, 22 bp, Artificial Sequence
  chemically synthesized
tttaataaatttcttatactgg

SEQ ID NO: 81547 - DNA, 22 bp, Artificial Sequence
  chemically synthesized
ttaataaatttcttatactggg

SEQ ID NO: 81548 - DNA, 22 bp, Artificial Sequence
  chemically synthesized
taataaatttcttatactgggc

SEQ ID NO: 81549 - DNA, 22 bp, Artificial Sequence
  chemically synthesized
aataaatttcttatactgggca

SEQ ID NO: 81550 - DNA, 22 bp, Artificial Sequence
  chemically synthesized
ataaatttcttatactgggcac

SEQ ID NO: 81551 - DNA, 22 bp, Artificial Sequence
  chemically synthesized
cttatactgggcacatggtatc

SEQ ID NO: 81552 - DNA, 22 bp, Artificial Sequence
  chemically synthesized
ttatactgggcacatggtatca

SEQ ID NO: 81553 - DNA, 22 bp, Artificial Sequence
  chemically synthesized
atactgggcacatggtatcaat

SEQ ID NO: 81554 - DNA, 22 bp, Artificial Sequence
  chemically synthesized
tactgggcacatggtatcaatt

SEQ ID NO: 81555 - DNA, 22 bp, Artificial Sequence
  chemically synthesized
ggcacatggtatcaattggtaa

SEQ ID NO: 81556 - DNA, 22 bp, Artificial Sequence
  chemically synthesized
gtaatcttcaccctgtatctgt

SEQ ID NO: 81557 - DNA, 22 bp, Artificial Sequence
  chemically synthesized
caccctgtatctgtcatttact

SEQ ID NO: 81558 - DNA, 22 bp, Artificial Sequence
  chemically synthesized
accctgtatctgtcatttactt

SEQ ID NO: 81559 - DNA, 22 bp, Artificial Sequence
  chemically synthesized
tatctgtcatttacttttataa

SEQ ID NO: 81560 - DNA, 22 bp, Artificial Sequence
  chemically synthesized
tcatttacttttataaggtgca

SEQ ID NO: 81561 - DNA, 22 bp, Artificial Sequence
  chemically synthesized
acttttataaggtgcaaatagt

SEQ ID NO: 81562 - DNA, 22 bp, Artificial Sequence
  chemically synthesized
cttttataaggtgcaaatagtt

SEQ ID NO: 81563 - DNA, 22 bp, Artificial Sequence
  chemically synthesized
ttataaggtgcaaatagttcag

SEQ ID NO: 81564 - DNA, 22 bp, Artificial Sequence
  chemically synthesized
tataaggtgcaaatagttcagc

SEQ ID NO: 81565 - DNA, 22 bp, Artificial Sequence
  chemically synthesized
ataaggtgcaaatagttcagca

SEQ ID NO: 81566 - DNA, 22 bp, Artificial Sequence
  chemically synthesized
taaggtgcaaatagttcagcat

SEQ ID NO: 81567 - DNA, 22 bp, Artificial Sequence
  chemically synthesized
agcatggtgacagacacatgaa

SEQ ID NO: 81568 - DNA, 22 bp, Artificial Sequence
  chemically synthesized
tgaaatggagttttatttttgc

SEQ ID NO: 81569 - DNA, 22 bp, Artificial Sequence
  chemically synthesized
gaaatggagttttatttttgcc

SEQ ID NO: 81570 - DNA, 22 bp, Artificial Sequence
  chemically synthesized
aaatggagttttatttttgccc

SEQ ID NO: 81571 - DNA, 22 bp, Artificial Sequence
  chemically synthesized
tatttttgccccatcaccagta

SEQ ID NO: 81572 - DNA, 22 bp, Artificial Sequence
  chemically synthesized
atttttgccccatcaccagtat

SEQ ID NO: 81573 - DNA, 22 bp, Artificial Sequence
  chemically synthesized
tttttgccccatcaccagtata

SEQ ID NO: 81574 - DNA, 22 bp, Artificial Sequence
  chemically synthesized
ttgccccatcaccagtataata

SEQ ID NO: 81575 - DNA, 22 bp, Artificial Sequence
  chemically synthesized
tgccccatcaccagtataatat

SEQ ID NO: 81576 - DNA, 22 bp, Artificial Sequence
  chemically synthesized
gccccatcaccagtataatatc

SEQ ID NO: 81577 - DNA, 22 bp, Artificial Sequence
  chemically synthesized
ccccatcaccagtataatatct

SEQ ID NO: 81578 - DNA, 22 bp, Artificial Sequence
  chemically synthesized
tgttacatagggaagagagtta

SEQ ID NO: 81579 - DNA, 22 bp, Artificial Sequence
  chemically synthesized
gttacatagggaagagagttaa

SEQ ID NO: 81580 - DNA, 22 bp, Artificial Sequence
  chemically synthesized
ttacatagggaagagagttaaa

SEQ ID NO: 81581 - DNA, 22 bp, Artificial Sequence
  chemically synthesized
catagggaagagagttaaaaat

SEQ ID NO: 81582 - DNA, 22 bp, Artificial Sequence
  chemically synthesized
aaaattttggagtgccagcttc

SEQ ID NO: 81583 - DNA, 22 bp, Artificial Sequence
  chemically synthesized
tggagtgccagcttcttaatct

SEQ ID NO: 81584 - DNA, 22 bp, Artificial Sequence
  chemically synthesized
ggagtgccagcttcttaatctg

SEQ ID NO: 81585 - DNA, 22 bp, Artificial Sequence
  chemically synthesized
gagtgccagcttcttaatctgt

SEQ ID NO: 81586 - DNA, 22 bp, Artificial Sequence
  chemically synthesized
cttaatctgtgcctagactatt

SEQ ID NO: 81587 - DNA, 22 bp, Artificial Sequence
  chemically synthesized
ttaatctgtgcctagactatta

SEQ ID NO: 81588 - DNA, 22 bp, Artificial Sequence
  chemically synthesized
aatctgtgcctagactattacc

SEQ ID NO: 81589 - DNA, 22 bp, Artificial Sequence
  chemically synthesized
atctgtgcctagactattacct

SEQ ID NO: 81590 - DNA, 22 bp, Artificial Sequence
  chemically synthesized
tgcctagactattacctgatga

SEQ ID NO: 81591 - DNA, 22 bp, Artificial Sequence
  chemically synthesized
gactattacctgatgagtaata

SEQ ID NO: 81592 - DNA, 22 bp, Artificial Sequence
  chemically synthesized
ttacctgatgagtaatagtcaa

SEQ ID NO: 81593 - DNA, 22 bp, Artificial Sequence
  chemically synthesized
cctgatgagtaatagtcaataa

SEQ ID NO: 81594 - DNA, 22 bp, Artificial Sequence
  chemically synthesized
atgagtaatagtcaataaacta

SEQ ID NO: 81595 - DNA, 22 bp, Artificial Sequence
  chemically synthesized
cagaacgatgcacacacacaca

SEQ ID NO: 81596 - DNA, 22 bp, Artificial Sequence
  chemically synthesized
aactactaaaattttttattac

SEQ ID NO: 81597 - DNA, 22 bp, Artificial Sequence
  chemically synthesized
ctaaaattttttattactgagc

SEQ ID NO: 81598 - DNA, 22 bp, Artificial Sequence
  chemically synthesized
aaattttttattactgagcctt

SEQ ID NO: 81599 - DNA, 22 bp, Artificial Sequence
  chemically synthesized
tttattactgagccttgtttta

SEQ ID NO: 81600 - DNA, 22 bp, Artificial Sequence
  chemically synthesized
ttattactgagccttgttttaa

SEQ ID NO: 81601 - DNA, 22 bp, Artificial Sequence
  chemically synthesized
tattactgagccttgttttaac

SEQ ID NO: 81602 - DNA, 22 bp, Artificial Sequence
  chemically synthesized
attactgagccttgttttaact

SEQ ID NO: 81603 - DNA, 22 bp, Artificial Sequence
  chemically synthesized
ttactgagccttgttttaacta

SEQ ID NO: 81604 - DNA, 22 bp, Artificial Sequence
  chemically synthesized
ctgagccttgttttaactacta

SEQ ID NO: 81605 - DNA, 22 bp, Artificial Sequence
  chemically synthesized
agccttgttttaactactagaa

SEQ ID NO: 81606 - DNA, 22 bp, Artificial Sequence
  chemically synthesized
gttttaactactagaatataaa

SEQ ID NO: 81607 - DNA, 22 bp, Artificial Sequence
  chemically synthesized
ttttaactactagaatataaat

SEQ ID NO: 81608 - DNA, 22 bp, Artificial Sequence
  chemically synthesized
taactactagaatataaattca

SEQ ID NO: 81609 - DNA, 22 bp, Artificial Sequence
  chemically synthesized
aactactagaatataaattcat

SEQ ID NO: 81610 - DNA, 22 bp, Artificial Sequence
  chemically synthesized
actactagaatataaattcatt

SEQ ID NO: 81611 - DNA, 22 bp, Artificial Sequence
  chemically synthesized
ctagaatataaattcattgaat

SEQ ID NO: 81612 - DNA, 22 bp, Artificial Sequence
  chemically synthesized
gaatataaattcattgaatctt

SEQ ID NO: 81613 - DNA, 22 bp, Artificial Sequence
  chemically synthesized
attgaatctttgtacaacattc

SEQ ID NO: 81614 - DNA, 22 bp, Artificial Sequence
  chemically synthesized
aatctttgtacaacattcaaat

SEQ ID NO: 81615 - DNA, 22 bp, Artificial Sequence
  chemically synthesized
tgtacaacattcaaatctgcat

SEQ ID NO: 81616 - DNA, 22 bp, Artificial Sequence
  chemically synthesized
gtacaacattcaaatctgcata

SEQ ID NO: 81617 - DNA, 22 bp, Artificial Sequence
  chemically synthesized
tacaacattcaaatctgcatat

SEQ ID NO: 81618 - DNA, 22 bp, Artificial Sequence
  chemically synthesized
aaatctgcatatcaaagaaaat

SEQ ID NO: 81619 - DNA, 22 bp, Artificial Sequence
  chemically synthesized
catatcaaagaaaatgagcatt

SEQ ID NO: 81620 - DNA, 22 bp, Artificial Sequence
  chemically synthesized
tttaaacatattctaagagaaa

SEQ ID NO: 81621 - DNA, 22 bp, Artificial Sequence
  chemically synthesized
aaacatattctaagagaaaact

SEQ ID NO: 81622 - DNA, 22 bp, Artificial Sequence
  chemically synthesized
aacatattctaagagaaaacta

SEQ ID NO: 81623 - DNA, 22 bp, Artificial Sequence
  chemically synthesized
taagagaaaactaaaatattct

SEQ ID NO: 81624 - DNA, 22 bp, Artificial Sequence
  chemically synthesized
agagaaaactaaaatattcttt

SEQ ID NO: 81625 - DNA, 22 bp, Artificial Sequence
  chemically synthesized
aaatattctttttgaaaatgac

SEQ ID NO: 81626 - DNA, 22 bp, Artificial Sequence
  chemically synthesized
tttttgaaaatgacttacttaa

SEQ ID NO: 81627 - DNA, 22 bp, Artificial Sequence
  chemically synthesized
tttgaaaatgacttacttaata

SEQ ID NO: 81628 - DNA, 22 bp, Artificial Sequence
  chemically synthesized
ttgaaaatgacttacttaatac

SEQ ID NO: 81629 - DNA, 22 bp, Artificial Sequence
  chemically synthesized
tgaaaatgacttacttaataca

SEQ ID NO: 81630 - DNA, 22 bp, Artificial Sequence
  chemically synthesized
gaaaatgacttacttaatacaa

SEQ ID NO: 81631 - DNA, 22 bp, Artificial Sequence
  chemically synthesized
aaaatgacttacttaatacaag

SEQ ID NO: 81632 - DNA, 22 bp, Artificial Sequence
  chemically synthesized
acttaatacaagaacacaaaaa

SEQ ID NO: 81633 - DNA, 22 bp, Artificial Sequence
  chemically synthesized
cttaatacaagaacacaaaaaa

SEQ ID NO: 81634 - DNA, 22 bp, Artificial Sequence
  chemically synthesized
aatacaagaacacaaaaaatac

SEQ ID NO: 81635 - DNA, 22 bp, Artificial Sequence
  chemically synthesized
atacaagaacacaaaaaatact

SEQ ID NO: 81636 - DNA, 22 bp, Artificial Sequence
  chemically synthesized
caattgcaaatcaactccagct

SEQ ID NO: 81637 - DNA, 22 bp, Artificial Sequence
  chemically synthesized
caaatcaactccagctaaagcc

SEQ ID NO: 81638 - DNA, 22 bp, Artificial Sequence
  chemically synthesized
cagctaaagccaagtctagtat

SEQ ID NO: 81639 - DNA, 22 bp, Artificial Sequence
  chemically synthesized
aagccaagtctagtattccatg

SEQ ID NO: 81640 - DNA, 22 bp, Artificial Sequence
  chemically synthesized
gtattccatgggtcaaaaatca

SEQ ID NO: 81641 - DNA, 22 bp, Artificial Sequence
  chemically synthesized
catgggtcaaaaatcaaggaaa

SEQ ID NO: 81642 - DNA, 22 bp, Artificial Sequence
  chemically synthesized
gatgattaagttatcggaagaa

SEQ ID NO: 81643 - DNA, 22 bp, Artificial Sequence
  chemically synthesized
agttatcggaagaatgagctgc

SEQ ID NO: 81644 - DNA, 22 bp, Artificial Sequence
  chemically synthesized
tcggaagaatgagctgcttctg

SEQ ID NO: 81645 - DNA, 22 bp, Artificial Sequence
  chemically synthesized
cttctgcagtttcttgcctttt

SEQ ID NO: 81646 - DNA, 22 bp, Artificial Sequence
  chemically synthesized
ctgcagtttcttgccttttttt

SEQ ID NO: 81647 - DNA, 22 bp, Artificial Sequence
  chemically synthesized
tgcagtttcttgcctttttttt

SEQ ID NO: 81648 - DNA, 22 bp, Artificial Sequence
  chemically synthesized
cagtttcttgcctttttttttt

SEQ ID NO: 81649 - DNA, 22 bp, Artificial Sequence
  chemically synthesized
cttgccttttttttttctggtg

SEQ ID NO: 81650 - DNA, 22 bp, Artificial Sequence
  chemically synthesized
ttgccttttttttttctggtgt

SEQ ID NO: 81651 - DNA, 22 bp, Artificial Sequence
  chemically synthesized
gccttttttttttctggtgtta

SEQ ID NO: 81652 - DNA, 22 bp, Artificial Sequence
  chemically synthesized
ccttttttttttctggtgttat

SEQ ID NO: 81653 - DNA, 22 bp, Artificial Sequence
  chemically synthesized
ttttttttctggtgttattttc

SEQ ID NO: 81654 - DNA, 22 bp, Artificial Sequence
  chemically synthesized
tttttttctggtgttattttct

SEQ ID NO: 81655 - DNA, 22 bp, Artificial Sequence
  chemically synthesized
ttttttctggtgttattttcta

SEQ ID NO: 81656 - DNA, 22 bp, Artificial Sequence
  chemically synthesized
tttttctggtgttattttctac

SEQ ID NO: 81657 - DNA, 22 bp, Artificial Sequence
  chemically synthesized
ttttctggtgttattttctaca

SEQ ID NO: 81658 - DNA, 22 bp, Artificial Sequence
  chemically synthesized
tttctggtgttattttctacaa

SEQ ID NO: 81659 - DNA, 22 bp, Artificial Sequence
  chemically synthesized
ttctggtgttattttctacaag

SEQ ID NO: 81660 - DNA, 22 bp, Artificial Sequence
  chemically synthesized
tctggtgttattttctacaagt

SEQ ID NO: 81661 - DNA, 22 bp, Artificial Sequence
  chemically synthesized
ctggtgttattttctacaagtt

SEQ ID NO: 81662 - DNA, 22 bp, Artificial Sequence
  chemically synthesized
tggtgttattttctacaagttt

SEQ ID NO: 81663 - DNA, 22 bp, Artificial Sequence
  chemically synthesized
gtgttattttctacaagttttc

SEQ ID NO: 81664 - DNA, 22 bp, Artificial Sequence
  chemically synthesized
ttttctacaagttttcattgag

SEQ ID NO: 81665 - DNA, 22 bp, Artificial Sequence
  chemically synthesized
tctacaagttttcattgagcat

SEQ ID NO: 81666 - DNA, 22 bp, Artificial Sequence
  chemically synthesized
ctacaagttttcattgagcata

SEQ ID NO: 81667 - DNA, 22 bp, Artificial Sequence
  chemically synthesized
tacaagttttcattgagcataa

SEQ ID NO: 81668 - DNA, 22 bp, Artificial Sequence
  chemically synthesized
caagttttcattgagcataact

SEQ ID NO: 81669 - DNA, 22 bp, Artificial Sequence
  chemically synthesized
tcattgagcataactcagttta

SEQ ID NO: 81670 - DNA, 22 bp, Artificial Sequence
  chemically synthesized
cattgagcataactcagtttac

SEQ ID NO: 81671 - DNA, 22 bp, Artificial Sequence
  chemically synthesized
attgagcataactcagtttact

SEQ ID NO: 81672 - DNA, 22 bp, Artificial Sequence
  chemically synthesized
agcataactcagtttacttact

SEQ ID NO: 81673 - DNA, 22 bp, Artificial Sequence
  chemically synthesized
agtttacttacttgcattttct

SEQ ID NO: 81674 - DNA, 22 bp, Artificial Sequence
  chemically synthesized
acttacttgcattttctagaat

SEQ ID NO: 81675 - DNA, 22 bp, Artificial Sequence
  chemically synthesized
cttacttgcattttctagaatc

SEQ ID NO: 81676 - DNA, 22 bp, Artificial Sequence
  chemically synthesized
acttgcattttctagaatcctg

SEQ ID NO: 81677 - DNA, 22 bp, Artificial Sequence
  chemically synthesized
cttgcattttctagaatcctga

SEQ ID NO: 81678 - DNA, 22 bp, Artificial Sequence
  chemically synthesized
gcattttctagaatcctgaaga

SEQ ID NO: 81679 - DNA, 22 bp, Artificial Sequence
  chemically synthesized
cattttctagaatcctgaagat

SEQ ID NO: 81680 - DNA, 22 bp, Artificial Sequence
  chemically synthesized
tctagaatcctgaagatattta

SEQ ID NO: 81681 - DNA, 22 bp, Artificial Sequence
  chemically synthesized
ctagaatcctgaagatatttag

SEQ ID NO: 81682 - DNA, 22 bp, Artificial Sequence
  chemically synthesized
tagaatcctgaagatatttagc

SEQ ID NO: 81683 - DNA, 22 bp, Artificial Sequence
  chemically synthesized
gaatcctgaagatatttagcag

SEQ ID NO: 81684 - DNA, 22 bp, Artificial Sequence
  chemically synthesized
aagatatttagcaggttgagag

SEQ ID NO: 81685 - DNA, 22 bp, Artificial Sequence
  chemically synthesized
agcaggttgagaggagacaaaa

SEQ ID NO: 81686 - DNA, 22 bp, Artificial Sequence
  chemically synthesized
gcaggttgagaggagacaaaat

SEQ ID NO: 81687 - DNA, 22 bp, Artificial Sequence
  chemically synthesized
agaggagacaaaataaatgcaa

SEQ ID NO: 81688 - DNA, 22 bp, Artificial Sequence
  chemically synthesized
ggaaatctggaactatttatac

SEQ ID NO: 81689 - DNA, 22 bp, Artificial Sequence
  chemically synthesized
gaactatttatacttcttttaa

SEQ ID NO: 81690 - DNA, 22 bp, Artificial Sequence
  chemically synthesized
tttatacttcttttaaagcatg

SEQ ID NO: 81691 - DNA, 22 bp, Artificial Sequence
  chemically synthesized
atacttcttttaaagcatgtct

SEQ ID NO: 81692 - DNA, 22 bp, Artificial Sequence
  chemically synthesized
tacttcttttaaagcatgtctt

SEQ ID NO: 81693 - DNA, 22 bp, Artificial Sequence
  chemically synthesized
cttttaaagcatgtcttgggcc

SEQ ID NO: 81694 - DNA, 22 bp, Artificial Sequence
  chemically synthesized
ttttaaagcatgtcttgggccc

SEQ ID NO: 81695 - DNA, 22 bp, Artificial Sequence
  chemically synthesized
ttaaagcatgtcttgggcccaa

SEQ ID NO: 81696 - DNA, 22 bp, Artificial Sequence
  chemically synthesized
taaagcatgtcttgggcccaag

SEQ ID NO: 81697 - DNA, 22 bp, Artificial Sequence
  chemically synthesized
aaagcatgtcttgggcccaagg

SEQ ID NO: 81698 - DNA, 22 bp, Artificial Sequence
  chemically synthesized
aagcatgtcttgggcccaaggt

SEQ ID NO: 81699 - DNA, 22 bp, Artificial Sequence
  chemically synthesized
gggcccaaggttttcagcttaa

SEQ ID NO: 81700 - DNA, 22 bp, Artificial Sequence
  chemically synthesized
ggcccaaggttttcagcttaag

SEQ ID NO: 81701 - DNA, 22 bp, Artificial Sequence
  chemically synthesized
tcagcttaagaggacgaatttt

SEQ ID NO: 81702 - DNA, 22 bp, Artificial Sequence
  chemically synthesized
cagcttaagaggacgaatttta

SEQ ID NO: 81703 - DNA, 22 bp, Artificial Sequence
  chemically synthesized
agcttaagaggacgaattttac

SEQ ID NO: 81704 - DNA, 22 bp, Artificial Sequence
  chemically synthesized
aagaggacgaattttactcctc

SEQ ID NO: 81705 - DNA, 22 bp, Artificial Sequence
  chemically synthesized
agaggacgaattttactcctcc

SEQ ID NO: 81706 - DNA, 22 bp, Artificial Sequence
  chemically synthesized
tactcctcccatggaaggagat

SEQ ID NO: 81707 - DNA, 22 bp, Artificial Sequence
  chemically synthesized
actcctcccatggaaggagatg

SEQ ID NO: 81708 - DNA, 22 bp, Artificial Sequence
  chemically synthesized
ctcctcccatggaaggagatga

SEQ ID NO: 81709 - DNA, 22 bp, Artificial Sequence
  chemically synthesized
ctcccatggaaggagatgacac

SEQ ID NO: 81710 - DNA, 22 bp, Artificial Sequence
  chemically synthesized
ccatggaaggagatgacacaga

SEQ ID NO: 81711 - DNA, 22 bp, Artificial Sequence
  chemically synthesized
cttctggtacatagtccacagg

SEQ ID NO: 81712 - DNA, 22 bp, Artificial Sequence
  chemically synthesized
ctggtacatagtccacagggag

SEQ ID NO: 81713 - DNA, 22 bp, Artificial Sequence
  chemically synthesized
tggtacatagtccacagggaga

SEQ ID NO: 81714 - DNA, 22 bp, Artificial Sequence
  chemically synthesized
gtacatagtccacagggagaaa

SEQ ID NO: 81715 - DNA, 22 bp, Artificial Sequence
  chemically synthesized
cattctctttcattataatttg

SEQ ID NO: 81716 - DNA, 22 bp, Artificial Sequence
  chemically synthesized
tctttcattataatttgtgcat

SEQ ID NO: 81717 - DNA, 22 bp, Artificial Sequence
  chemically synthesized
tttcattataatttgtgcattt

SEQ ID NO: 81718 - DNA, 22 bp, Artificial Sequence
  chemically synthesized
tcattataatttgtgcattttt

SEQ ID NO: 81719 - DNA, 22 bp, Artificial Sequence
  chemically synthesized
cattataatttgtgcatttttt

SEQ ID NO: 81720 - DNA, 22 bp, Artificial Sequence
  chemically synthesized
attataatttgtgcattttttt

SEQ ID NO: 81721 - DNA, 22 bp, Artificial Sequence
  chemically synthesized
taatttgtgcattttttttctt

SEQ ID NO: 81722 - DNA, 22 bp, Artificial Sequence
  chemically synthesized
gtgcattttttttcttcagcca

SEQ ID NO: 81723 - DNA, 22 bp, Artificial Sequence
  chemically synthesized
tgcattttttttcttcagccac

SEQ ID NO: 81724 - DNA, 22 bp, Artificial Sequence
  chemically synthesized
tttttcttcagccaccactctc

SEQ ID NO: 81725 - DNA, 22 bp, Artificial Sequence
  chemically synthesized
ttttcttcagccaccactctct

SEQ ID NO: 81726 - DNA, 22 bp, Artificial Sequence
  chemically synthesized
tttcttcagccaccactctctg

SEQ ID NO: 81727 - DNA, 22 bp, Artificial Sequence
  chemically synthesized
ttcttcagccaccactctctga

SEQ ID NO: 81728 - DNA, 22 bp, Artificial Sequence
  chemically synthesized
tcttcagccaccactctctgac

SEQ ID NO: 81729 - DNA, 22 bp, Artificial Sequence
  chemically synthesized
cttcagccaccactctctgaca

SEQ ID NO: 81730 - DNA, 22 bp, Artificial Sequence
  chemically synthesized
ttcagccaccactctctgacac

SEQ ID NO: 81731 - DNA, 22 bp, Artificial Sequence
  chemically synthesized
cagccaccactctctgacacct

SEQ ID NO: 81732 - DNA, 22 bp, Artificial Sequence
  chemically synthesized
agccaccactctctgacaccta

SEQ ID NO: 81733 - DNA, 22 bp, Artificial Sequence
  chemically synthesized
tctgacacctaagttaatacat

SEQ ID NO: 81734 - DNA, 22 bp, Artificial Sequence
  chemically synthesized
tgacacctaagttaatacatac

SEQ ID NO: 81735 - DNA, 22 bp, Artificial Sequence
  chemically synthesized
acacctaagttaatacatacat

SEQ ID NO: 81736 - DNA, 22 bp, Artificial Sequence
  chemically synthesized
agttaatacatacatctacatg

SEQ ID NO: 81737 - DNA, 22 bp, Artificial Sequence
  chemically synthesized
atacatacatctacatgtccag

SEQ ID NO: 81738 - DNA, 22 bp, Artificial Sequence
  chemically synthesized
catgtccaggtcttttgtccct

SEQ ID NO: 81739 - DNA, 22 bp, Artificial Sequence
  chemically synthesized
ttgtccctgtcatatattgttt

SEQ ID NO: 81740 - DNA, 22 bp, Artificial Sequence
  chemically synthesized
tgtccctgtcatatattgtttc

SEQ ID NO: 81741 - DNA, 22 bp, Artificial Sequence
  chemically synthesized
gtccctgtcatatattgtttcc

SEQ ID NO: 81742 - DNA, 22 bp, Artificial Sequence
  chemically synthesized
tccctgtcatatattgtttcca

SEQ ID NO: 81743 - DNA, 22 bp, Artificial Sequence
  chemically synthesized
tcatatattgtttccaatgagc

SEQ ID NO: 81744 - DNA, 22 bp, Artificial Sequence
  chemically synthesized
tttccaatgagccattggcaaa

SEQ ID NO: 81745 - DNA, 22 bp, Artificial Sequence
  chemically synthesized
ccaatgagccattggcaaatat

SEQ ID NO: 81746 - DNA, 22 bp, Artificial Sequence
  chemically synthesized
caatgagccattggcaaatata

SEQ ID NO: 81747 - DNA, 22 bp, Artificial Sequence
  chemically synthesized
gcaaatataggttgcaaaggag

SEQ ID NO: 81748 - DNA, 22 bp, Artificial Sequence
  chemically synthesized
caaaggagacatgtgggagaag

SEQ ID NO: 81749 - DNA, 22 bp, Artificial Sequence
  chemically synthesized
tacacatcttagatggcaccta

SEQ ID NO: 81750 - DNA, 22 bp, Artificial Sequence
  chemically synthesized
acacatcttagatggcacctaa

SEQ ID NO: 81751 - DNA, 22 bp, Artificial Sequence
  chemically synthesized
cacatcttagatggcacctaaa

SEQ ID NO: 81752 - DNA, 22 bp, Artificial Sequence
  chemically synthesized
agatggcacctaaaagttaatt

SEQ ID NO: 81753 - DNA, 22 bp, Artificial Sequence
  chemically synthesized
gatggcacctaaaagttaattc

SEQ ID NO: 81754 - DNA, 22 bp, Artificial Sequence
  chemically synthesized
aaagttaattctctcattttat

SEQ ID NO: 81755 - DNA, 22 bp, Artificial Sequence
  chemically synthesized
attctctcattttatttccctt

SEQ ID NO: 81756 - DNA, 22 bp, Artificial Sequence
  chemically synthesized
tctcattttatttccctttaat

SEQ ID NO: 81757 - DNA, 22 bp, Artificial Sequence
  chemically synthesized
tcattttatttccctttaattt

SEQ ID NO: 81758 - DNA, 22 bp, Artificial Sequence
  chemically synthesized
attttatttccctttaattttt

SEQ ID NO: 81759 - DNA, 22 bp, Artificial Sequence
  chemically synthesized
tatttccctttaatttttaagg

SEQ ID NO: 81760 - DNA, 22 bp, Artificial Sequence
  chemically synthesized
atttccctttaatttttaaggt

SEQ ID NO: 81761 - DNA, 22 bp, Artificial Sequence
  chemically synthesized
tttccctttaatttttaaggtt

SEQ ID NO: 81762 - DNA, 22 bp, Artificial Sequence
  chemically synthesized
ccctttaatttttaaggttcta

SEQ ID NO: 81763 - DNA, 22 bp, Artificial Sequence
  chemically synthesized
cctttaatttttaaggttctat

SEQ ID NO: 81764 - DNA, 22 bp, Artificial Sequence
  chemically synthesized
taatttttaaggttctattgct

SEQ ID NO: 81765 - DNA, 22 bp, Artificial Sequence
  chemically synthesized
aatttttaaggttctattgctt

SEQ ID NO: 81766 - DNA, 22 bp, Artificial Sequence
  chemically synthesized
atttttaaggttctattgcttt

SEQ ID NO: 81767 - DNA, 22 bp, Artificial Sequence
  chemically synthesized
ttaaggttctattgctttccct

SEQ ID NO: 81768 - DNA, 22 bp, Artificial Sequence
  chemically synthesized
taaggttctattgctttccctg

SEQ ID NO: 81769 - DNA, 22 bp, Artificial Sequence
  chemically synthesized
aaggttctattgctttccctgc

SEQ ID NO: 81770 - DNA, 22 bp, Artificial Sequence
  chemically synthesized
aggttctattgctttccctgct

SEQ ID NO: 81771 - DNA, 22 bp, Artificial Sequence
  chemically synthesized
tattgctttccctgctttttct

SEQ ID NO: 81772 - DNA, 22 bp, Artificial Sequence
  chemically synthesized
ttgctttccctgctttttcttg

SEQ ID NO: 81773 - DNA, 22 bp, Artificial Sequence
  chemically synthesized
ctttccctgctttttcttggtc

SEQ ID NO: 81774 - DNA, 22 bp, Artificial Sequence
  chemically synthesized
tccctgctttttcttggtcaca

SEQ ID NO: 81775 - DNA, 22 bp, Artificial Sequence
  chemically synthesized
ccctgctttttcttggtcacat

SEQ ID NO: 81776 - DNA, 22 bp, Artificial Sequence
  chemically synthesized
cctgctttttcttggtcacatg

SEQ ID NO: 81777 - DNA, 22 bp, Artificial Sequence
  chemically synthesized
ctttttcttggtcacatggtaa

SEQ ID NO: 81778 - DNA, 22 bp, Artificial Sequence
  chemically synthesized
tttcttggtcacatggtaaatg

SEQ ID NO: 81779 - DNA, 22 bp, Artificial Sequence
  chemically synthesized
ttcttggtcacatggtaaatgg

SEQ ID NO: 81780 - DNA, 22 bp, Artificial Sequence
  chemically synthesized
tcttggtcacatggtaaatggg

SEQ ID NO: 81781 - DNA, 22 bp, Artificial Sequence
  chemically synthesized
cttggtcacatggtaaatgggt

SEQ ID NO: 81782 - DNA, 22 bp, Artificial Sequence
  chemically synthesized
ttggtcacatggtaaatgggtc

SEQ ID NO: 81783 - DNA, 22 bp, Artificial Sequence
  chemically synthesized
ggtcacatggtaaatgggtcag

SEQ ID NO: 81784 - DNA, 22 bp, Artificial Sequence
  chemically synthesized
gtcacatggtaaatgggtcaga

SEQ ID NO: 81785 - DNA, 22 bp, Artificial Sequence
  chemically synthesized
aagggccaagaaattatattag

SEQ ID NO: 81786 - DNA, 22 bp, Artificial Sequence
  chemically synthesized
tattagctactgtagatatccc

SEQ ID NO: 81787 - DNA, 22 bp, Artificial Sequence
  chemically synthesized
gctactgtagatatcccattct

SEQ ID NO: 81788 - DNA, 22 bp, Artificial Sequence
  chemically synthesized
ctgtagatatcccattctcttg

SEQ ID NO: 81789 - DNA, 22 bp, Artificial Sequence
  chemically synthesized
tagatatcccattctcttgaag

SEQ ID NO: 81790 - DNA, 22 bp, Artificial Sequence
  chemically synthesized
tcttgaaggatactttaatgag

SEQ ID NO: 81791 - DNA, 22 bp, Artificial Sequence
  chemically synthesized
ttgaaggatactttaatgagga

SEQ ID NO: 81792 - DNA, 22 bp, Artificial Sequence
  chemically synthesized
gaaggatactttaatgaggaat

SEQ ID NO: 81793 - DNA, 22 bp, Artificial Sequence
  chemically synthesized
aaggatactttaatgaggaata

SEQ ID NO: 81794 - DNA, 22 bp, Artificial Sequence
  chemically synthesized
taatgaggaatacagatgaaga

SEQ ID NO: 81795 - DNA, 22 bp, Artificial Sequence
  chemically synthesized
aatgaggaatacagatgaagat

SEQ ID NO: 81796 - DNA, 22 bp, Artificial Sequence
  chemically synthesized
atgaggaatacagatgaagata

SEQ ID NO: 81797 - DNA, 22 bp, Artificial Sequence
  chemically synthesized
atggaattaaaaactggcttca

SEQ ID NO: 81798 - DNA, 22 bp, Artificial Sequence
  chemically synthesized
aaaactggcttcacactgataa

SEQ ID NO: 81799 - DNA, 22 bp, Artificial Sequence
  chemically synthesized
gcttcacactgataagccagat

SEQ ID NO: 81800 - DNA, 22 bp, Artificial Sequence
  chemically synthesized
cacactgataagccagatttat

SEQ ID NO: 81801 - DNA, 22 bp, Artificial Sequence
  chemically synthesized
acactgataagccagatttatg

SEQ ID NO: 81802 - DNA, 22 bp, Artificial Sequence
  chemically synthesized
ataagccagatttatggagaga

SEQ ID NO: 81803 - DNA, 22 bp, Artificial Sequence
  chemically synthesized
atggagagagatgtttccttat

SEQ ID NO: 81804 - DNA, 22 bp, Artificial Sequence
  chemically synthesized
tggagagagatgtttccttatt

SEQ ID NO: 81805 - DNA, 22 bp, Artificial Sequence
  chemically synthesized
ccttattctctcaagtggagcc

SEQ ID NO: 81806 - DNA, 22 bp, Artificial Sequence
  chemically synthesized
cttattctctcaagtggagcct

SEQ ID NO: 81807 - DNA, 22 bp, Artificial Sequence
  chemically synthesized
attctctcaagtggagccttcc

SEQ ID NO: 81808 - DNA, 22 bp, Artificial Sequence
  chemically synthesized
ttctctcaagtggagccttcca

SEQ ID NO: 81809 - DNA, 22 bp, Artificial Sequence
  chemically synthesized
tctcaagtggagccttccatat

SEQ ID NO: 81810 - DNA, 22 bp, Artificial Sequence
  chemically synthesized
tcaagtggagccttccatatat

SEQ ID NO: 81811 - DNA, 22 bp, Artificial Sequence
  chemically synthesized
aagtggagccttccatatatct

SEQ ID NO: 81812 - DNA, 22 bp, Artificial Sequence
  chemically synthesized
ccatatatctgtgattttctga

SEQ ID NO: 81813 - DNA, 22 bp, Artificial Sequence
  chemically synthesized
catatatctgtgattttctgat

SEQ ID NO: 81814 - DNA, 22 bp, Artificial Sequence
  chemically synthesized
tgattttctgatatttttcaaa

SEQ ID NO: 81815 - DNA, 22 bp, Artificial Sequence
  chemically synthesized
tctgatatttttcaaagaatcc

SEQ ID NO: 81816 - DNA, 22 bp, Artificial Sequence
  chemically synthesized
ctgatatttttcaaagaatccc

SEQ ID NO: 81817 - DNA, 22 bp, Artificial Sequence
  chemically synthesized
tgatatttttcaaagaatccct

SEQ ID NO: 81818 - DNA, 22 bp, Artificial Sequence
  chemically synthesized
atatttttcaaagaatccctag

SEQ ID NO: 81819 - DNA, 22 bp, Artificial Sequence
  chemically synthesized
ttcaaagaatccctagaagctt

SEQ ID NO: 81820 - DNA, 22 bp, Artificial Sequence
  chemically synthesized
tcaaagaatccctagaagcttt

SEQ ID NO: 81821 - DNA, 22 bp, Artificial Sequence
  chemically synthesized
caaagaatccctagaagctttt

SEQ ID NO: 81822 - DNA, 22 bp, Artificial Sequence
  chemically synthesized
aaagaatccctagaagcttttt

SEQ ID NO: 81823 - DNA, 22 bp, Artificial Sequence
  chemically synthesized
gaagcttttttcacctatagta

SEQ ID NO: 81824 - DNA, 22 bp, Artificial Sequence
  chemically synthesized
ttttcacctatagtagtaaaac

SEQ ID NO: 81825 - DNA, 22 bp, Artificial Sequence
  chemically synthesized
tttcacctatagtagtaaaact

SEQ ID NO: 81826 - DNA, 22 bp, Artificial Sequence
  chemically synthesized
ttcacctatagtagtaaaactt

SEQ ID NO: 81827 - DNA, 22 bp, Artificial Sequence
  chemically synthesized
tcacctatagtagtaaaactta

SEQ ID NO: 81828 - DNA, 22 bp, Artificial Sequence
  chemically synthesized
cacctatagtagtaaaacttag

SEQ ID NO: 81829 - DNA, 22 bp, Artificial Sequence
  chemically synthesized
acctatagtagtaaaacttagt

SEQ ID NO: 81830 - DNA, 22 bp, Artificial Sequence
  chemically synthesized
tagtagtaaaacttagtaaaaa

SEQ ID NO: 81831 - DNA, 22 bp, Artificial Sequence
  chemically synthesized
agtaaaaaaaaatagtaaaact

SEQ ID NO: 81832 - DNA, 22 bp, Artificial Sequence
  chemically synthesized
gtaaaaaaaaatagtaaaactt

SEQ ID NO: 81833 - DNA, 22 bp, Artificial Sequence
  chemically synthesized
ccctataaatatgatgtttgac

SEQ ID NO: 81834 - DNA, 22 bp, Artificial Sequence
  chemically synthesized
cctataaatatgatgtttgaca

SEQ ID NO: 81835 - DNA, 22 bp, Artificial Sequence
  chemically synthesized
taaatatgatgtttgacatcag

SEQ ID NO: 81836 - DNA, 22 bp, Artificial Sequence
  chemically synthesized
gacatcagctgaccctgactgg

SEQ ID NO: 81837 - DNA, 22 bp, Artificial Sequence
  chemically synthesized
acatcagctgaccctgactgga

SEQ ID NO: 81838 - DNA, 22 bp, Artificial Sequence
  chemically synthesized
accctgactggatgatcttgat

SEQ ID NO: 81839 - DNA, 22 bp, Artificial Sequence
  chemically synthesized
actggatgatcttgattggatg

SEQ ID NO: 81840 - DNA, 22 bp, Artificial Sequence
  chemically synthesized
gatgatcttgattggatgctag

SEQ ID NO: 81841 - DNA, 22 bp, Artificial Sequence
  chemically synthesized
gattggatgctaggcaagtgcc

SEQ ID NO: 81842 - DNA, 22 bp, Artificial Sequence
  chemically synthesized
attggatgctaggcaagtgccc

SEQ ID NO: 81843 - DNA, 22 bp, Artificial Sequence
  chemically synthesized
gatgctaggcaagtgcccaggt

SEQ ID NO: 81844 - DNA, 22 bp, Artificial Sequence
  chemically synthesized
ggcaagtgcccaggtcctccaa

SEQ ID NO: 81845 - DNA, 22 bp, Artificial Sequence
  chemically synthesized
caatcagtcatctaggcatctt

SEQ ID NO: 81846 - DNA, 22 bp, Artificial Sequence
  chemically synthesized
ggcatcttagttctcactggct

SEQ ID NO: 81847 - DNA, 22 bp, Artificial Sequence
  chemically synthesized
agttctcactggctaagagagg

SEQ ID NO: 81848 - DNA, 22 bp, Artificial Sequence
  chemically synthesized
gttctcactggctaagagaggt

SEQ ID NO: 81849 - DNA, 22 bp, Artificial Sequence
  chemically synthesized
tcactggctaagagaggtcata

SEQ ID NO: 81850 - DNA, 22 bp, Artificial Sequence
  chemically synthesized
actggctaagagaggtcatatt

SEQ ID NO: 81851 - DNA, 22 bp, Artificial Sequence
  chemically synthesized
gctaagagaggtcatattttat

SEQ ID NO: 81852 - DNA, 22 bp, Artificial Sequence
  chemically synthesized
agagaggtcatattttattacg

SEQ ID NO: 81853 - DNA, 22 bp, Artificial Sequence
  chemically synthesized
tattacgtaagtgtgagtgcta

SEQ ID NO: 81854 - DNA, 22 bp, Artificial Sequence
  chemically synthesized
attacgtaagtgtgagtgctat

SEQ ID NO: 81855 - DNA, 22 bp, Artificial Sequence
  chemically synthesized
ttacgtaagtgtgagtgctata

SEQ ID NO: 81856 - DNA, 22 bp, Artificial Sequence
  chemically synthesized
cgtaagtgtgagtgctatatgg

SEQ ID NO: 81857 - DNA, 22 bp, Artificial Sequence
  chemically synthesized
tatggtgggagatataagaatt

SEQ ID NO: 81858 - DNA, 22 bp, Artificial Sequence
  chemically synthesized
tcacatgcatttcaagtgcttt

SEQ ID NO: 81859 - DNA, 22 bp, Artificial Sequence
  chemically synthesized
caagtgctttccattcaaaggt

SEQ ID NO: 81860 - DNA, 22 bp, Artificial Sequence
  chemically synthesized
aagtgctttccattcaaaggtc

SEQ ID NO: 81861 - DNA, 22 bp, Artificial Sequence
  chemically synthesized
tccattcaaaggtcttgaaacc

SEQ ID NO: 81862 - DNA, 22 bp, Artificial Sequence
  chemically synthesized
ccattcaaaggtcttgaaacca

SEQ ID NO: 81863 - DNA, 22 bp, Artificial Sequence
  chemically synthesized
cattcaaaggtcttgaaaccat

SEQ ID NO: 81864 - DNA, 22 bp, Artificial Sequence
  chemically synthesized
aaaggtcttgaaaccatagtga

SEQ ID NO: 81865 - DNA, 22 bp, Artificial Sequence
  chemically synthesized
gaaaccatagtgagggtaaatt

SEQ ID NO: 81866 - DNA, 22 bp, Artificial Sequence
  chemically synthesized
aaaccatagtgagggtaaattg

SEQ ID NO: 81867 - DNA, 22 bp, Artificial Sequence
  chemically synthesized
gatggcttcaccttgctttttt

SEQ ID NO: 81868 - DNA, 22 bp, Artificial Sequence
  chemically synthesized
caccttgcttttttagacatta

SEQ ID NO: 81869 - DNA, 22 bp, Artificial Sequence
  chemically synthesized
accttgcttttttagacattaa

SEQ ID NO: 81870 - DNA, 22 bp, Artificial Sequence
  chemically synthesized
gcttttttagacattaaagaaa

SEQ ID NO: 81871 - DNA, 22 bp, Artificial Sequence
  chemically synthesized
cttttttagacattaaagaaag

SEQ ID NO: 81872 - DNA, 22 bp, Artificial Sequence
  chemically synthesized
ttttagacattaaagaaaggac

SEQ ID NO: 81873 - DNA, 22 bp, Artificial Sequence
  chemically synthesized
tttagacattaaagaaaggaca

SEQ ID NO: 81874 - DNA, 22 bp, Artificial Sequence
  chemically synthesized
ttagacattaaagaaaggacag

SEQ ID NO: 81875 - DNA, 22 bp, Artificial Sequence
  chemically synthesized
tagacattaaagaaaggacagt

SEQ ID NO: 81876 - DNA, 22 bp, Artificial Sequence
  chemically synthesized
agacattaaagaaaggacagta

SEQ ID NO: 81877 - DNA, 22 bp, Artificial Sequence
  chemically synthesized
gacattaaagaaaggacagtac

SEQ ID NO: 81878 - DNA, 22 bp, Artificial Sequence
  chemically synthesized
aagaaaggacagtacttatctt

SEQ ID NO: 81879 - DNA, 22 bp, Artificial Sequence
  chemically synthesized
atcttcccacctatccttggaa

SEQ ID NO: 81880 - DNA, 22 bp, Artificial Sequence
  chemically synthesized
tcttcccacctatccttggaaa

SEQ ID NO: 81881 - DNA, 22 bp, Artificial Sequence
  chemically synthesized
cccacctatccttggaaaagaa

SEQ ID NO: 81882 - DNA, 22 bp, Artificial Sequence
  chemically synthesized
ccacctatccttggaaaagaaa

SEQ ID NO: 81883 - DNA, 22 bp, Artificial Sequence
  chemically synthesized
tccttggaaaagaaattaaagg

SEQ ID NO: 81884 - DNA, 22 bp, Artificial Sequence
  chemically synthesized
ggaaaagaaattaaaggaatca

SEQ ID NO: 81885 - DNA, 22 bp, Artificial Sequence
  chemically synthesized
gaaaagaaattaaaggaatcaa

SEQ ID NO: 81886 - DNA, 22 bp, Artificial Sequence
  chemically synthesized
aaggaatcaaaggatattatag

SEQ ID NO: 81887 - DNA, 22 bp, Artificial Sequence
  chemically synthesized
tagaaaaagagatggagaaagg

SEQ ID NO: 81888 - DNA, 22 bp, Artificial Sequence
  chemically synthesized
aggggacaacagaaattgatgt

SEQ ID NO: 81889 - DNA, 22 bp, Artificial Sequence
  chemically synthesized
ggggacaacagaaattgatgtc

SEQ ID NO: 81890 - DNA, 22 bp, Artificial Sequence
  chemically synthesized
atgtctgcatctgactacctga

SEQ ID NO: 81891 - DNA, 22 bp, Artificial Sequence
  chemically synthesized
catctgactacctgatagtgac

SEQ ID NO: 81892 - DNA, 22 bp, Artificial Sequence
  chemically synthesized
actacctgatagtgacaggaag

SEQ ID NO: 81893 - DNA, 22 bp, Artificial Sequence
  chemically synthesized
cctgatagtgacaggaagaaca

SEQ ID NO: 81894 - DNA, 22 bp, Artificial Sequence
  chemically synthesized
atagtgacaggaagaacaaaga

SEQ ID NO: 81895 - DNA, 22 bp, Artificial Sequence
  chemically synthesized
tgctgataacttattataatgt

SEQ ID NO: 81896 - DNA, 22 bp, Artificial Sequence
  chemically synthesized
ctgataacttattataatgttt

SEQ ID NO: 81897 - DNA, 22 bp, Artificial Sequence
  chemically synthesized
ataacttattataatgttttta

SEQ ID NO: 81898 - DNA, 22 bp, Artificial Sequence
  chemically synthesized
attataatgtttttaaatctgg

SEQ ID NO: 81899 - DNA, 22 bp, Artificial Sequence
  chemically synthesized
ttataatgtttttaaatctggg

SEQ ID NO: 81900 - DNA, 22 bp, Artificial Sequence
  chemically synthesized
taatgtttttaaatctggggac

SEQ ID NO: 81901 - DNA, 22 bp, Artificial Sequence
  chemically synthesized
ttaaatctggggactctaaaac

SEQ ID NO: 81902 - DNA, 22 bp, Artificial Sequence
  chemically synthesized
taaatctggggactctaaaact

SEQ ID NO: 81903 - DNA, 22 bp, Artificial Sequence
  chemically synthesized
aaatctggggactctaaaactt

SEQ ID NO: 81904 - DNA, 22 bp, Artificial Sequence
  chemically synthesized
aatctggggactctaaaacttg

SEQ ID NO: 81905 - DNA, 22 bp, Artificial Sequence
  chemically synthesized
gggactctaaaacttgaagaat

SEQ ID NO: 81906 - DNA, 22 bp, Artificial Sequence
  chemically synthesized
taaaacttgaagaatttttttt

SEQ ID NO: 81907 - DNA, 22 bp, Artificial Sequence
  chemically synthesized
aaacttgaagaatttttttttg

SEQ ID NO: 81908 - DNA, 22 bp, Artificial Sequence
  chemically synthesized
gaagaatttttttttgagcaaa

SEQ ID NO: 81909 - DNA, 22 bp, Artificial Sequence
  chemically synthesized
aagaatttttttttgagcaaat

SEQ ID NO: 81910 - DNA, 22 bp, Artificial Sequence
  chemically synthesized
ttttttgagcaaatgttttcag

SEQ ID NO: 81911 - DNA, 22 bp, Artificial Sequence
  chemically synthesized
tttttgagcaaatgttttcagt

SEQ ID NO: 81912 - DNA, 22 bp, Artificial Sequence
  chemically synthesized
ttttgagcaaatgttttcagta

SEQ ID NO: 81913 - DNA, 22 bp, Artificial Sequence
  chemically synthesized
tttgagcaaatgttttcagtaa

SEQ ID NO: 81914 - DNA, 22 bp, Artificial Sequence
  chemically synthesized
ttgagcaaatgttttcagtaaa

SEQ ID NO: 81915 - DNA, 22 bp, Artificial Sequence
  chemically synthesized
tgagcaaatgttttcagtaaat

SEQ ID NO: 81916 - DNA, 22 bp, Artificial Sequence
  chemically synthesized
gagcaaatgttttcagtaaata

SEQ ID NO: 81917 - DNA, 22 bp, Artificial Sequence
  chemically synthesized
agcaaatgttttcagtaaataa

SEQ ID NO: 81918 - DNA, 22 bp, Artificial Sequence
  chemically synthesized
tcagtaaataatgatttctgat

SEQ ID NO: 81919 - DNA, 22 bp, Artificial Sequence
  chemically synthesized
cagtaaataatgatttctgata

SEQ ID NO: 81920 - DNA, 22 bp, Artificial Sequence
  chemically synthesized
agtaaataatgatttctgataa

SEQ ID NO: 81921 - DNA, 22 bp, Artificial Sequence
  chemically synthesized
ctgataaatataatatgcaaga

SEQ ID NO: 81922 - DNA, 22 bp, Artificial Sequence
  chemically synthesized
tgataaatataatatgcaagag

SEQ ID NO: 81923 - DNA, 22 bp, Artificial Sequence
  chemically synthesized
ataaatataatatgcaagaggg

SEQ ID NO: 81924 - DNA, 22 bp, Artificial Sequence
  chemically synthesized
cggctgctgtgatacaagtacc

SEQ ID NO: 81925 - DNA, 22 bp, Artificial Sequence
  chemically synthesized
ctgtgatacaagtaccatgtta

SEQ ID NO: 81926 - DNA, 22 bp, Artificial Sequence
  chemically synthesized
tgatacaagtaccatgttacta

SEQ ID NO: 81927 - DNA, 22 bp, Artificial Sequence
  chemically synthesized
ctactttaaaacacaccttcag

SEQ ID NO: 81928 - DNA, 22 bp, Artificial Sequence
  chemically synthesized
ctttaaaacacaccttcagcaa

SEQ ID NO: 81929 - DNA, 22 bp, Artificial Sequence
  chemically synthesized
taaaacacaccttcagcaatat

SEQ ID NO: 81930 - DNA, 22 bp, Artificial Sequence
  chemically synthesized
aaaacacaccttcagcaatatt

SEQ ID NO: 81931 - DNA, 22 bp, Artificial Sequence
  chemically synthesized
aaacacaccttcagcaatattc

SEQ ID NO: 81932 - DNA, 22 bp, Artificial Sequence
  chemically synthesized
cagcaatattctatgcagatga

SEQ ID NO: 81933 - DNA, 22 bp, Artificial Sequence
  chemically synthesized
agcaatattctatgcagatgaa

SEQ ID NO: 81934 - DNA, 22 bp, Artificial Sequence
  chemically synthesized
tatgcagatgaaataatagtta

SEQ ID NO: 81935 - DNA, 22 bp, Artificial Sequence
  chemically synthesized
tgcagatgaaataatagttatt

SEQ ID NO: 81936 - DNA, 22 bp, Artificial Sequence
  chemically synthesized
ttgatatgtttaatttaatatg

SEQ ID NO: 81937 - DNA, 22 bp, Artificial Sequence
  chemically synthesized
atatgtttaatttaatatgttt

SEQ ID NO: 81938 - DNA, 22 bp, Artificial Sequence
  chemically synthesized
aatttaatatgtttagttttct

SEQ ID NO: 81939 - DNA, 22 bp, Artificial Sequence
  chemically synthesized
atttaatatgtttagttttctt

SEQ ID NO: 81940 - DNA, 22 bp, Artificial Sequence
  chemically synthesized
aatatgtttagttttcttatag

SEQ ID NO: 81941 - DNA, 22 bp, Artificial Sequence
  chemically synthesized
atatgtttagttttcttataga

SEQ ID NO: 81942 - DNA, 22 bp, Artificial Sequence
  chemically synthesized
agttttcttatagaagtctaca

SEQ ID NO: 81943 - DNA, 22 bp, Artificial Sequence
  chemically synthesized
gttttcttatagaagtctacag

SEQ ID NO: 81944 - DNA, 22 bp, Artificial Sequence
  chemically synthesized
tcttatagaagtctacagtctt

SEQ ID NO: 81945 - DNA, 22 bp, Artificial Sequence
  chemically synthesized
cttatagaagtctacagtcttt

SEQ ID NO: 81946 - DNA, 22 bp, Artificial Sequence
  chemically synthesized
ttatagaagtctacagtctttg

SEQ ID NO: 81947 - DNA, 22 bp, Artificial Sequence
  chemically synthesized
atagaagtctacagtctttgag

SEQ ID NO: 81948 - DNA, 22 bp, Artificial Sequence
  chemically synthesized
tagaagtctacagtctttgagc

SEQ ID NO: 81949 - DNA, 22 bp, Artificial Sequence
  chemically synthesized
cagtctttgagccacatgcttt

SEQ ID NO: 81950 - DNA, 22 bp, Artificial Sequence
  chemically synthesized
tgagccacatgctttagaaaaa

SEQ ID NO: 81951 - DNA, 22 bp, Artificial Sequence
  chemically synthesized
gagccacatgctttagaaaaat

SEQ ID NO: 81952 - DNA, 22 bp, Artificial Sequence
  chemically synthesized
agccacatgctttagaaaaata

SEQ ID NO: 81953 - DNA, 22 bp, Artificial Sequence
  chemically synthesized
tagaaaaataattttccaattt

SEQ ID NO: 81954 - DNA, 22 bp, Artificial Sequence
  chemically synthesized
agaaaaataattttccaatttt

SEQ ID NO: 81955 - DNA, 22 bp, Artificial Sequence
  chemically synthesized
gaaaaataattttccaattttt

SEQ ID NO: 81956 - DNA, 22 bp, Artificial Sequence
  chemically synthesized
tccaatttttatgaatgttata

SEQ ID NO: 81957 - DNA, 22 bp, Artificial Sequence
  chemically synthesized
ccaatttttatgaatgttatat

SEQ ID NO: 81958 - DNA, 22 bp, Artificial Sequence
  chemically synthesized
caatttttatgaatgttatata

SEQ ID NO: 81959 - DNA, 22 bp, Artificial Sequence
  chemically synthesized
ttatgaatgttatataatatta

SEQ ID NO: 81960 - DNA, 22 bp, Artificial Sequence
  chemically synthesized
tatgaatgttatataatattat

SEQ ID NO: 81961 - DNA, 22 bp, Artificial Sequence
  chemically synthesized
atgaatgttatataatattatt

SEQ ID NO: 81962 - DNA, 22 bp, Artificial Sequence
  chemically synthesized
tgaatgttatataatattattg

SEQ ID NO: 81963 - DNA, 22 bp, Artificial Sequence
  chemically synthesized
tataatattattgacatcaagt

SEQ ID NO: 81964 - DNA, 22 bp, Artificial Sequence
  chemically synthesized
ttgacatcaagtaacaatatca

SEQ ID NO: 81965 - DNA, 22 bp, Artificial Sequence
  chemically synthesized
acatcaagtaacaatatcattg

SEQ ID NO: 81966 - DNA, 22 bp, Artificial Sequence
  chemically synthesized
gaatctcggtatgcccttaata

SEQ ID NO: 81967 - DNA, 22 bp, Artificial Sequence
  chemically synthesized
ggtatgcccttaataatcatat

SEQ ID NO: 81968 - DNA, 22 bp, Artificial Sequence
  chemically synthesized
aataatcatatatctatatgat

SEQ ID NO: 81969 - DNA, 22 bp, Artificial Sequence
  chemically synthesized
ataatcatatatctatatgatt

SEQ ID NO: 81970 - DNA, 22 bp, Artificial Sequence
  chemically synthesized
tatgattatctaatatacctag

SEQ ID NO: 81971 - DNA, 22 bp, Artificial Sequence
  chemically synthesized
tctaatatacctagatattttt

SEQ ID NO: 81972 - DNA, 22 bp, Artificial Sequence
  chemically synthesized
atatacctagatatttttgcag

SEQ ID NO: 81973 - DNA, 22 bp, Artificial Sequence
  chemically synthesized
gatatttttgcagggaacatgt

SEQ ID NO: 81974 - DNA, 22 bp, Artificial Sequence
  chemically synthesized
ttgcagggaacatgtaagtatt

SEQ ID NO: 81975 - DNA, 22 bp, Artificial Sequence
  chemically synthesized
tgcagggaacatgtaagtatta

SEQ ID NO: 81976 - DNA, 22 bp, Artificial Sequence
  chemically synthesized
gcagggaacatgtaagtattat

SEQ ID NO: 81977 - DNA, 22 bp, Artificial Sequence
  chemically synthesized
cagggaacatgtaagtattatg

SEQ ID NO: 81978 - DNA, 22 bp, Artificial Sequence
  chemically synthesized
tgtagaataaataaagattata

SEQ ID NO: 81979 - DNA, 22 bp, Artificial Sequence
  chemically synthesized
taaaaattctcacataagttca

SEQ ID NO: 81980 - DNA, 22 bp, Artificial Sequence
  chemically synthesized
tcacataagttcatgtcagaaa

SEQ ID NO: 81981 - DNA, 22 bp, Artificial Sequence
  chemically synthesized
acataagttcatgtcagaaatt

SEQ ID NO: 81982 - DNA, 22 bp, Artificial Sequence
  chemically synthesized
atgtcagaaattgccatcactt

SEQ ID NO: 81983 - DNA, 22 bp, Artificial Sequence
  chemically synthesized
ccatcactttagagcagattgt

SEQ ID NO: 81984 - DNA, 22 bp, Artificial Sequence
  chemically synthesized
tagagcagattgtgctgttaaa

SEQ ID NO: 81985 - DNA, 22 bp, Artificial Sequence
  chemically synthesized
agagcagattgtgctgttaaaa

SEQ ID NO: 81986 - DNA, 22 bp, Artificial Sequence
  chemically synthesized
gagcagattgtgctgttaaaag

SEQ ID NO: 81987 - DNA, 22 bp, Artificial Sequence
  chemically synthesized
tgctgttaaaagactcagtttt

SEQ ID NO: 81988 - DNA, 22 bp, Artificial Sequence
  chemically synthesized
ttaaaagactcagtttttaaat

SEQ ID NO: 81989 - DNA, 22 bp, Artificial Sequence
  chemically synthesized
aaagactcagtttttaaatttc

SEQ ID NO: 81990 - DNA, 22 bp, Artificial Sequence
  chemically synthesized
agtttttaaatttctatggatt

SEQ ID NO: 81991 - DNA, 22 bp, Artificial Sequence
  chemically synthesized
ttaaatttctatggatttcaag

SEQ ID NO: 81992 - DNA, 22 bp, Artificial Sequence
  chemically synthesized
taaatttctatggatttcaagg

SEQ ID NO: 81993 - DNA, 22 bp, Artificial Sequence
  chemically synthesized
aaatttctatggatttcaagga

SEQ ID NO: 81994 - DNA, 22 bp, Artificial Sequence
  chemically synthesized
aatttctatggatttcaaggaa

SEQ ID NO: 81995 - DNA, 22 bp, Artificial Sequence
  chemically synthesized
ctatggatttcaaggaaatgga

SEQ ID NO: 81996 - DNA, 22 bp, Artificial Sequence
  chemically synthesized
tatggatttcaaggaaatggat

SEQ ID NO: 81997 - DNA, 22 bp, Artificial Sequence
  chemically synthesized
tggatttcaaggaaatggataa

SEQ ID NO: 81998 - DNA, 22 bp, Artificial Sequence
  chemically synthesized
caaggaaatggataaatgattg

SEQ ID NO: 81999 - DNA, 22 bp, Artificial Sequence
  chemically synthesized
aaggaaatggataaatgattgt

SEQ ID NO: 82000 - DNA, 22 bp, Artificial Sequence
  chemically synthesized
tggccctgttaaccaaaatagc

SEQ ID NO: 82001 - DNA, 22 bp, Artificial Sequence
  chemically synthesized
ttaaccaaaatagcagtaaaaa

SEQ ID NO: 82002 - DNA, 22 bp, Artificial Sequence
  chemically synthesized
accaaaatagcagtaaaaatgg

SEQ ID NO: 82003 - DNA, 22 bp, Artificial Sequence
  chemically synthesized
tggctactgatttagtatctgt

SEQ ID NO: 82004 - DNA, 22 bp, Artificial Sequence
  chemically synthesized
ggctactgatttagtatctgta

SEQ ID NO: 82005 - DNA, 22 bp, Artificial Sequence
  chemically synthesized
gctactgatttagtatctgtaa

SEQ ID NO: 82006 - DNA, 22 bp, Artificial Sequence
  chemically synthesized
ctgatttagtatctgtaaatta

SEQ ID NO: 82007 - DNA, 22 bp, Artificial Sequence
  chemically synthesized
atttagtatctgtaaattaagg

SEQ ID NO: 82008 - DNA, 22 bp, Artificial Sequence
  chemically synthesized
agtatctgtaaattaaggatgt

SEQ ID NO: 82009 - DNA, 22 bp, Artificial Sequence
  chemically synthesized
gtatctgtaaattaaggatgtt

SEQ ID NO: 82010 - DNA, 22 bp, Artificial Sequence
  chemically synthesized
taaattaaggatgttggattgc

SEQ ID NO: 82011 - DNA, 22 bp, Artificial Sequence
  chemically synthesized
aggatgttggattgcttgagat

SEQ ID NO: 82012 - DNA, 22 bp, Artificial Sequence
  chemically synthesized
gattgcttgagattttagctct

SEQ ID NO: 82013 - DNA, 22 bp, Artificial Sequence
  chemically synthesized
cttgagattttagctctaactc

SEQ ID NO: 82014 - DNA, 22 bp, Artificial Sequence
  chemically synthesized
gagattttagctctaactctgc

SEQ ID NO: 82015 - DNA, 22 bp, Artificial Sequence
  chemically synthesized
agattttagctctaactctgct

SEQ ID NO: 82016 - DNA, 22 bp, Artificial Sequence
  chemically synthesized
tagctctaactctgcttcaata

SEQ ID NO: 82017 - DNA, 22 bp, Artificial Sequence
  chemically synthesized
agctctaactctgcttcaatat

SEQ ID NO: 82018 - DNA, 22 bp, Artificial Sequence
  chemically synthesized
gctctaactctgcttcaatatg

SEQ ID NO: 82019 - DNA, 22 bp, Artificial Sequence
  chemically synthesized
taactctgcttcaatatgtaag

SEQ ID NO: 82020 - DNA, 22 bp, Artificial Sequence
  chemically synthesized
actctgcttcaatatgtaagat

SEQ ID NO: 82021 - DNA, 22 bp, Artificial Sequence
  chemically synthesized
tgcttcaatatgtaagatactt

SEQ ID NO: 82022 - DNA, 22 bp, Artificial Sequence
  chemically synthesized
cttcaatatgtaagatacttct

SEQ ID NO: 82023 - DNA, 22 bp, Artificial Sequence
  chemically synthesized
caatatgtaagatacttctaat

SEQ ID NO: 82024 - DNA, 22 bp, Artificial Sequence
  chemically synthesized
aatatgtaagatacttctaatt

SEQ ID NO: 82025 - DNA, 22 bp, Artificial Sequence
  chemically synthesized
ctaattgagtctagataattgt

SEQ ID NO: 82026 - DNA, 22 bp, Artificial Sequence
  chemically synthesized
taattgagtctagataattgtt

SEQ ID NO: 82027 - DNA, 22 bp, Artificial Sequence
  chemically synthesized
attgagtctagataattgttct

SEQ ID NO: 82028 - DNA, 22 bp, Artificial Sequence
  chemically synthesized
agtctagataattgttctatag

SEQ ID NO: 82029 - DNA, 22 bp, Artificial Sequence
  chemically synthesized
gataattgttctataggtaaat

SEQ ID NO: 82030 - DNA, 22 bp, Artificial Sequence
  chemically synthesized
ttctataggtaaattagtgtcc

SEQ ID NO: 82031 - DNA, 22 bp, Artificial Sequence
  chemically synthesized
tataggtaaattagtgtcctgg

SEQ ID NO: 82032 - DNA, 22 bp, Artificial Sequence
  chemically synthesized
taggtaaattagtgtcctggat

SEQ ID NO: 82033 - DNA, 22 bp, Artificial Sequence
  chemically synthesized
gtgtcctggatgctagtgcttc

SEQ ID NO: 82034 - DNA, 22 bp, Artificial Sequence
  chemically synthesized
gatgctagtgcttcagccaaaa

SEQ ID NO: 82035 - DNA, 22 bp, Artificial Sequence
  chemically synthesized
gtgcttcagccaaaaaatgaaa

SEQ ID NO: 82036 - DNA, 22 bp, Artificial Sequence
  chemically synthesized
cagccaaaaaatgaaaaagata

SEQ ID NO: 82037 - DNA, 22 bp, Artificial Sequence
  chemically synthesized
agccaaaaaatgaaaaagatac

SEQ ID NO: 82038 - DNA, 22 bp, Artificial Sequence
  chemically synthesized
aatgaaagcctttatcttacta

SEQ ID NO: 82039 - DNA, 22 bp, Artificial Sequence
  chemically synthesized
tatcttactatgggacttgagt

SEQ ID NO: 82040 - DNA, 22 bp, Artificial Sequence
  chemically synthesized
atcttactatgggacttgagtg

SEQ ID NO: 82041 - DNA, 22 bp, Artificial Sequence
  chemically synthesized
tcttactatgggacttgagtgg

SEQ ID NO: 82042 - DNA, 22 bp, Artificial Sequence
  chemically synthesized
actatgggacttgagtggagga

SEQ ID NO: 82043 - DNA, 22 bp, Artificial Sequence
  chemically synthesized
ctatgggacttgagtggaggaa

SEQ ID NO: 82044 - DNA, 22 bp, Artificial Sequence
  chemically synthesized
tgggacttgagtggaggaaatc

SEQ ID NO: 82045 - DNA, 22 bp, Artificial Sequence
  chemically synthesized
gagtggaggaaatccaagaaaa

SEQ ID NO: 82046 - DNA, 22 bp, Artificial Sequence
  chemically synthesized
agtggaggaaatccaagaaaag

SEQ ID NO: 82047 - DNA, 22 bp, Artificial Sequence
  chemically synthesized
cagatgatcctttcttcgaaca

SEQ ID NO: 82048 - DNA, 22 bp, Artificial Sequence
  chemically synthesized
tcttcgaacaagtaatttggca

SEQ ID NO: 82049 - DNA, 22 bp, Artificial Sequence
  chemically synthesized
cttcgaacaagtaatttggcat

SEQ ID NO: 82050 - DNA, 22 bp, Artificial Sequence
  chemically synthesized
ttcgaacaagtaatttggcata

SEQ ID NO: 82051 - DNA, 22 bp, Artificial Sequence
  chemically synthesized
cgaacaagtaatttggcataat

SEQ ID NO: 82052 - DNA, 22 bp, Artificial Sequence
  chemically synthesized
gaacaagtaatttggcataatt

SEQ ID NO: 82053 - DNA, 22 bp, Artificial Sequence
  chemically synthesized
ggcataattggacacctggttt

SEQ ID NO: 82054 - DNA, 22 bp, Artificial Sequence
  chemically synthesized
gcataattggacacctggtttc

SEQ ID NO: 82055 - DNA, 22 bp, Artificial Sequence
  chemically synthesized
gacacctggtttcttctcattt

SEQ ID NO: 82056 - DNA, 22 bp, Artificial Sequence
  chemically synthesized
gtttcttctcatttgtaagtta

SEQ ID NO: 82057 - DNA, 22 bp, Artificial Sequence
  chemically synthesized
cttctcatttgtaagttagtaa

SEQ ID NO: 82058 - DNA, 22 bp, Artificial Sequence
  chemically synthesized
ttctcatttgtaagttagtaaa

SEQ ID NO: 82059 - DNA, 22 bp, Artificial Sequence
  chemically synthesized
ctcatttgtaagttagtaaagc

SEQ ID NO: 82060 - DNA, 22 bp, Artificial Sequence
  chemically synthesized
tcatttgtaagttagtaaagct

SEQ ID NO: 82061 - DNA, 22 bp, Artificial Sequence
  chemically synthesized
atttgtaagttagtaaagctgg

SEQ ID NO: 82062 - DNA, 22 bp, Artificial Sequence
  chemically synthesized
gtaagttagtaaagctgggagt

SEQ ID NO: 82063 - DNA, 22 bp, Artificial Sequence
  chemically synthesized
taagttagtaaagctgggagtt

SEQ ID NO: 82064 - DNA, 22 bp, Artificial Sequence
  chemically synthesized
gtaaagctgggagttggtgcta

SEQ ID NO: 82065 - DNA, 22 bp, Artificial Sequence
  chemically synthesized
ggagttggtgctagtaaagctg

SEQ ID NO: 82066 - DNA, 22 bp, Artificial Sequence
  chemically synthesized
gtgctagtaaagctgggagttg

SEQ ID NO: 82067 - DNA, 22 bp, Artificial Sequence
  chemically synthesized
gtaaagctgggagttggtgcca

SEQ ID NO: 82068 - DNA, 22 bp, Artificial Sequence
  chemically synthesized
ggagttggtgccagaaaagaga

SEQ ID NO: 82069 - DNA, 22 bp, Artificial Sequence
  chemically synthesized
gtgccagaaaagagaacagaaa

SEQ ID NO: 82070 - DNA, 22 bp, Artificial Sequence
  chemically synthesized
atttatttcttccttgtttgta

SEQ ID NO: 82071 - DNA, 22 bp, Artificial Sequence
  chemically synthesized
atttcttccttgtttgtaggct

SEQ ID NO: 82072 - DNA, 22 bp, Artificial Sequence
  chemically synthesized
tttcttccttgtttgtaggctg

SEQ ID NO: 82073 - DNA, 22 bp, Artificial Sequence
  chemically synthesized
cttccttgtttgtaggctgtag

SEQ ID NO: 82074 - DNA, 22 bp, Artificial Sequence
  chemically synthesized
ttccttgtttgtaggctgtaga

SEQ ID NO: 82075 - DNA, 22 bp, Artificial Sequence
  chemically synthesized
ccttgtttgtaggctgtagagc

SEQ ID NO: 82076 - DNA, 22 bp, Artificial Sequence
  chemically synthesized
cttgtttgtaggctgtagagca

SEQ ID NO: 82077 - DNA, 22 bp, Artificial Sequence
  chemically synthesized
gtttgtaggctgtagagcaagc

SEQ ID NO: 82078 - DNA, 22 bp, Artificial Sequence
  chemically synthesized
tttgtaggctgtagagcaagct

SEQ ID NO: 82079 - DNA, 22 bp, Artificial Sequence
  chemically synthesized
gtaggctgtagagcaagcttgt

SEQ ID NO: 82080 - DNA, 22 bp, Artificial Sequence
  chemically synthesized
taggctgtagagcaagcttgtc

SEQ ID NO: 82081 - DNA, 22 bp, Artificial Sequence
  chemically synthesized
tagagcaagcttgtccaacctg

SEQ ID NO: 82082 - DNA, 22 bp, Artificial Sequence
  chemically synthesized
gtccaacctgtggcccgtgggc

SEQ ID NO: 82083 - DNA, 22 bp, Artificial Sequence
  chemically synthesized
tccaacctgtggcccgtgggct

SEQ ID NO: 82084 - DNA, 22 bp, Artificial Sequence
  chemically synthesized
tggcccgtgggctgcatgcatc

SEQ ID NO: 82085 - DNA, 22 bp, Artificial Sequence
  chemically synthesized
catgcatcccaagatggctttg

SEQ ID NO: 82086 - DNA, 22 bp, Artificial Sequence
  chemically synthesized
tgaatgctatccaacacaactt

SEQ ID NO: 82087 - DNA, 22 bp, Artificial Sequence
  chemically synthesized
gaatgctatccaacacaacttt

SEQ ID NO: 82088 - DNA, 22 bp, Artificial Sequence
  chemically synthesized
aatgctatccaacacaactttc

SEQ ID NO: 82089 - DNA, 22 bp, Artificial Sequence
  chemically synthesized
tccaacacaactttcttaaaac

SEQ ID NO: 82090 - DNA, 22 bp, Artificial Sequence
  chemically synthesized
tcttaaaacattatgagatttt

SEQ ID NO: 82091 - DNA, 22 bp, Artificial Sequence
  chemically synthesized
cttaaaacattatgagatttta

SEQ ID NO: 82092 - DNA, 22 bp, Artificial Sequence
  chemically synthesized
ttaaaacattatgagattttat

SEQ ID NO: 82093 - DNA, 22 bp, Artificial Sequence
  chemically synthesized
aaaacattatgagattttatgg

SEQ ID NO: 82094 - DNA, 22 bp, Artificial Sequence
  chemically synthesized
aaacattatgagattttatggg

SEQ ID NO: 82095 - DNA, 22 bp, Artificial Sequence
  chemically synthesized
tgagattttatgggacattttg

SEQ ID NO: 82096 - DNA, 22 bp, Artificial Sequence
  chemically synthesized
tatgggacattttgtgattttt

SEQ ID NO: 82097 - DNA, 22 bp, Artificial Sequence
  chemically synthesized
atgggacattttgtgatttttt

SEQ ID NO: 82098 - DNA, 22 bp, Artificial Sequence
  chemically synthesized
tgggacattttgtgattttttt

SEQ ID NO: 82099 - DNA, 22 bp, Artificial Sequence
  chemically synthesized
tgtgatttttttttttttttgg

SEQ ID NO: 82100 - DNA, 22 bp, Artificial Sequence
  chemically synthesized
gtgatttttttttttttttggc

SEQ ID NO: 82101 - DNA, 22 bp, Artificial Sequence
  chemically synthesized
tgatttttttttttttttggct

SEQ ID NO: 82102 - DNA, 22 bp, Artificial Sequence
  chemically synthesized
ttttttttttttggctcatgag

SEQ ID NO: 82103 - DNA, 22 bp, Artificial Sequence
  chemically synthesized
tttttttttttggctcatgagc

SEQ ID NO: 82104 - DNA, 22 bp, Artificial Sequence
  chemically synthesized
ttttttttttggctcatgagct

SEQ ID NO: 82105 - DNA, 22 bp, Artificial Sequence
  chemically synthesized
tttttttttggctcatgagctg

SEQ ID NO: 82106 - DNA, 22 bp, Artificial Sequence
  chemically synthesized
ttttttttggctcatgagctgt

SEQ ID NO: 82107 - DNA, 22 bp, Artificial Sequence
  chemically synthesized
tttttttggctcatgagctgtc

SEQ ID NO: 82108 - DNA, 22 bp, Artificial Sequence
  chemically synthesized
ttttttggctcatgagctgtca

SEQ ID NO: 82109 - DNA, 22 bp, Artificial Sequence
  chemically synthesized
tttttggctcatgagctgtcat

SEQ ID NO: 82110 - DNA, 22 bp, Artificial Sequence
  chemically synthesized
ttttggctcatgagctgtcatt

SEQ ID NO: 82111 - DNA, 22 bp, Artificial Sequence
  chemically synthesized
tttggctcatgagctgtcatta

SEQ ID NO: 82112 - DNA, 22 bp, Artificial Sequence
  chemically synthesized
ttggctcatgagctgtcattag

SEQ ID NO: 82113 - DNA, 22 bp, Artificial Sequence
  chemically synthesized
tggctcatgagctgtcattagt

SEQ ID NO: 82114 - DNA, 22 bp, Artificial Sequence
  chemically synthesized
ggctcatgagctgtcattagtg

SEQ ID NO: 82115 - DNA, 22 bp, Artificial Sequence
  chemically synthesized
gctcatgagctgtcattagtgt

SEQ ID NO: 82116 - DNA, 22 bp, Artificial Sequence
  chemically synthesized
atgagctgtcattagtgttagt

SEQ ID NO: 82117 - DNA, 22 bp, Artificial Sequence
  chemically synthesized
tcattagtgttagtatatttta

SEQ ID NO: 82118 - DNA, 22 bp, Artificial Sequence
  chemically synthesized
gtgttagtatattttatgtgtg

SEQ ID NO: 82119 - DNA, 22 bp, Artificial Sequence
  chemically synthesized
gtatattttatgtgtggcccag

SEQ ID NO: 82120 - DNA, 22 bp, Artificial Sequence
  chemically synthesized
tatgtgtggcccagggaagcca

SEQ ID NO: 82121 - DNA, 22 bp, Artificial Sequence
  chemically synthesized
atgtgtggcccagggaagccaa

SEQ ID NO: 82122 - DNA, 22 bp, Artificial Sequence
  chemically synthesized
tgtgtggcccagggaagccaaa

SEQ ID NO: 82123 - DNA, 22 bp, Artificial Sequence
  chemically synthesized
gacatccctgctgtagagtttc

SEQ ID NO: 82124 - DNA, 22 bp, Artificial Sequence
  chemically synthesized
ctgtagagtttctcagtggttg

SEQ ID NO: 82125 - DNA, 22 bp, Artificial Sequence
  chemically synthesized
tagagtttctcagtggttggaa

SEQ ID NO: 82126 - DNA, 22 bp, Artificial Sequence
  chemically synthesized
ctcagtggttggaatcaatatt

SEQ ID NO: 82127 - DNA, 22 bp, Artificial Sequence
  chemically synthesized
tcagtggttggaatcaatattt

SEQ ID NO: 82128 - DNA, 22 bp, Artificial Sequence
  chemically synthesized
agtggttggaatcaatatttgc

SEQ ID NO: 82129 - DNA, 22 bp, Artificial Sequence
  chemically synthesized
gaatcaatatttgcagagtctt

SEQ ID NO: 82130 - DNA, 22 bp, Artificial Sequence
  chemically synthesized
gcagagtcttgtagctttttca

SEQ ID NO: 82131 - DNA, 22 bp, Artificial Sequence
  chemically synthesized
cagagtcttgtagctttttcaa

SEQ ID NO: 82132 - DNA, 22 bp, Artificial Sequence
  chemically synthesized
gtagctttttcaaagatttttc

SEQ ID NO: 82133 - DNA, 22 bp, Artificial Sequence
  chemically synthesized
tagctttttcaaagatttttcc

SEQ ID NO: 82134 - DNA, 22 bp, Artificial Sequence
  chemically synthesized
tttcaaagatttttcccctgcc

SEQ ID NO: 82135 - DNA, 22 bp, Artificial Sequence
  chemically synthesized
ttcaaagatttttcccctgcca

SEQ ID NO: 82136 - DNA, 22 bp, Artificial Sequence
  chemically synthesized
tcaaagatttttcccctgccac

SEQ ID NO: 82137 - DNA, 22 bp, Artificial Sequence
  chemically synthesized
caaagatttttcccctgccaca

SEQ ID NO: 82138 - DNA, 22 bp, Artificial Sequence
  chemically synthesized
aaagatttttcccctgccacat

SEQ ID NO: 82139 - DNA, 22 bp, Artificial Sequence
  chemically synthesized
ttcccctgccacattgaagaat

SEQ ID NO: 82140 - DNA, 22 bp, Artificial Sequence
  chemically synthesized
tcccctgccacattgaagaata

SEQ ID NO: 82141 - DNA, 22 bp, Artificial Sequence
  chemically synthesized
cccctgccacattgaagaatag

SEQ ID NO: 82142 - DNA, 22 bp, Artificial Sequence
  chemically synthesized
ccctgccacattgaagaatagc

SEQ ID NO: 82143 - DNA, 22 bp, Artificial Sequence
  chemically synthesized
ccacattgaagaatagcttgag

SEQ ID NO: 82144 - DNA, 22 bp, Artificial Sequence
  chemically synthesized
aagaatagcttgagcaatagcc

SEQ ID NO: 82145 - DNA, 22 bp, Artificial Sequence
  chemically synthesized
gagcaatagccactcttctttc

SEQ ID NO: 82146 - DNA, 22 bp, Artificial Sequence
  chemically synthesized
agcaatagccactcttctttcc

SEQ ID NO: 82147 - DNA, 22 bp, Artificial Sequence
  chemically synthesized
ttctttccaggtggagtttgtg

SEQ ID NO: 82148 - DNA, 22 bp, Artificial Sequence
  chemically synthesized
ctttccaggtggagtttgtgaa

SEQ ID NO: 82149 - DNA, 22 bp, Artificial Sequence
  chemically synthesized
tttccaggtggagtttgtgaat

SEQ ID NO: 82150 - DNA, 22 bp, Artificial Sequence
  chemically synthesized
tccaggtggagtttgtgaatta

SEQ ID NO: 82151 - DNA, 22 bp, Artificial Sequence
  chemically synthesized
ccaggtggagtttgtgaattac

SEQ ID NO: 82152 - DNA, 22 bp, Artificial Sequence
  chemically synthesized
caggtggagtttgtgaattact

SEQ ID NO: 82153 - DNA, 22 bp, Artificial Sequence
  chemically synthesized
gtgaattactttagagatgatc

SEQ ID NO: 82154 - DNA, 22 bp, Artificial Sequence
  chemically synthesized
tgaattactttagagatgatct

SEQ ID NO: 82155 - DNA, 22 bp, Artificial Sequence
  chemically synthesized
ctttagagatgatctttatctg

SEQ ID NO: 82156 - DNA, 22 bp, Artificial Sequence
  chemically synthesized
tagagatgatctttatctggga

SEQ ID NO: 82157 - DNA, 22 bp, Artificial Sequence
  chemically synthesized
agagatgatctttatctgggaa

SEQ ID NO: 82158 - DNA, 22 bp, Artificial Sequence
  chemically synthesized
gagatgatctttatctgggaag

SEQ ID NO: 82159 - DNA, 22 bp, Artificial Sequence
  chemically synthesized
tatctgggaagaattactaata

SEQ ID NO: 82160 - DNA, 22 bp, Artificial Sequence
  chemically synthesized
atctgggaagaattactaatat

SEQ ID NO: 82161 - DNA, 22 bp, Artificial Sequence
  chemically synthesized
tctgggaagaattactaatata

SEQ ID NO: 82162 - DNA, 22 bp, Artificial Sequence
  chemically synthesized
ggaagaattactaatatattat

SEQ ID NO: 82163 - DNA, 22 bp, Artificial Sequence
  chemically synthesized
ctaatatattatctcttcgttt

SEQ ID NO: 82164 - DNA, 22 bp, Artificial Sequence
  chemically synthesized
atatattatctcttcgtttagc

SEQ ID NO: 82165 - DNA, 22 bp, Artificial Sequence
  chemically synthesized
tctcttcgtttagctaacgtaa

SEQ ID NO: 82166 - DNA, 22 bp, Artificial Sequence
  chemically synthesized
ttcgtttagctaacgtaaggtt

SEQ ID NO: 82167 - DNA, 22 bp, Artificial Sequence
  chemically synthesized
cgtttagctaacgtaaggttat

SEQ ID NO: 82168 - DNA, 22 bp, Artificial Sequence
  chemically synthesized
gtttagctaacgtaaggttatt

SEQ ID NO: 82169 - DNA, 22 bp, Artificial Sequence
  chemically synthesized
agctaacgtaaggttattagat

SEQ ID NO: 82170 - DNA, 22 bp, Artificial Sequence
  chemically synthesized
gctaacgtaaggttattagata

SEQ ID NO: 82171 - DNA, 22 bp, Artificial Sequence
  chemically synthesized
acgtaaggttattagatacttt

SEQ ID NO: 82172 - DNA, 22 bp, Artificial Sequence
  chemically synthesized
ttagatacttttctttaaggaa

SEQ ID NO: 82173 - DNA, 22 bp, Artificial Sequence
  chemically synthesized
gatacttttctttaaggaagga

SEQ ID NO: 82174 - DNA, 22 bp, Artificial Sequence
  chemically synthesized
ttctttaaggaaggatacacca

SEQ ID NO: 82175 - DNA, 22 bp, Artificial Sequence
  chemically synthesized
tctttaaggaaggatacaccag

SEQ ID NO: 82176 - DNA, 22 bp, Artificial Sequence
  chemically synthesized
ctttaaggaaggatacaccagg

SEQ ID NO: 82177 - DNA, 22 bp, Artificial Sequence
  chemically synthesized
tttaaggaaggatacaccagga

SEQ ID NO: 82178 - DNA, 22 bp, Artificial Sequence
  chemically synthesized
taaggaaggatacaccaggacc

SEQ ID NO: 82179 - DNA, 22 bp, Artificial Sequence
  chemically synthesized
aaggaaggatacaccaggacct

SEQ ID NO: 82180 - DNA, 22 bp, Artificial Sequence
  chemically synthesized
aggaaggatacaccaggacctg

SEQ ID NO: 82181 - DNA, 22 bp, Artificial Sequence
  chemically synthesized
ccttaataaggcttgatgacat

SEQ ID NO: 82182 - DNA, 22 bp, Artificial Sequence
  chemically synthesized
aataaggcttgatgacatttat

SEQ ID NO: 82183 - DNA, 22 bp, Artificial Sequence
  chemically synthesized
ataaggcttgatgacatttatc

SEQ ID NO: 82184 - DNA, 22 bp, Artificial Sequence
  chemically synthesized
gatgacatttatcttccttcta

SEQ ID NO: 82185 - DNA, 22 bp, Artificial Sequence
  chemically synthesized
atgacatttatcttccttctaa

SEQ ID NO: 82186 - DNA, 22 bp, Artificial Sequence
  chemically synthesized
atcttccttctaatacatcata

SEQ ID NO: 82187 - DNA, 22 bp, Artificial Sequence
  chemically synthesized
tcttccttctaatacatcataa

SEQ ID NO: 82188 - DNA, 22 bp, Artificial Sequence
  chemically synthesized
ccttctaatacatcataatatg

SEQ ID NO: 82189 - DNA, 22 bp, Artificial Sequence
  chemically synthesized
cttctaatacatcataatatgt

SEQ ID NO: 82190 - DNA, 22 bp, Artificial Sequence
  chemically synthesized
ctaatacatcataatatgtgtg

SEQ ID NO: 82191 - DNA, 22 bp, Artificial Sequence
  chemically synthesized
taatacatcataatatgtgtgt

SEQ ID NO: 82192 - DNA, 22 bp, Artificial Sequence
  chemically synthesized
atacatcataatatgtgtgtcg

SEQ ID NO: 82193 - DNA, 22 bp, Artificial Sequence
  chemically synthesized
gtatagaagccaatacgactgc

SEQ ID NO: 82194 - DNA, 22 bp, Artificial Sequence
  chemically synthesized
tatagaagccaatacgactgct

SEQ ID NO: 82195 - DNA, 22 bp, Artificial Sequence
  chemically synthesized
cttgtattaaagaaacaaagtt

SEQ ID NO: 82196 - DNA, 22 bp, Artificial Sequence
  chemically synthesized
gtattaaagaaacaaagtttaa

SEQ ID NO: 82197 - DNA, 22 bp, Artificial Sequence
  chemically synthesized
tattaaagaaacaaagtttaat

SEQ ID NO: 82198 - DNA, 22 bp, Artificial Sequence
  chemically synthesized
aagaaacaaagtttaattcatc

SEQ ID NO: 82199 - DNA, 22 bp, Artificial Sequence
  chemically synthesized
aattcatcgttttgttgttgtg

SEQ ID NO: 82200 - DNA, 22 bp, Artificial Sequence
  chemically synthesized
attcatcgttttgttgttgtgt

SEQ ID NO: 82201 - DNA, 22 bp, Artificial Sequence
  chemically synthesized
atcgttttgttgttgtgttttg

SEQ ID NO: 82202 - DNA, 22 bp, Artificial Sequence
  chemically synthesized
tgttgttgtgttttgcttacat

SEQ ID NO: 82203 - DNA, 22 bp, Artificial Sequence
  chemically synthesized
gttgttgtgttttgcttacatt

SEQ ID NO: 82204 - DNA, 22 bp, Artificial Sequence
  chemically synthesized
ttgttgtgttttgcttacattt

SEQ ID NO: 82205 - DNA, 22 bp, Artificial Sequence
  chemically synthesized
ttgtgttttgcttacattttat

SEQ ID NO: 82206 - DNA, 22 bp, Artificial Sequence
  chemically synthesized
tgttttgcttacattttatgta

SEQ ID NO: 82207 - DNA, 22 bp, Artificial Sequence
  chemically synthesized
tgcttacattttatgtattttg

SEQ ID NO: 82208 - DNA, 22 bp, Artificial Sequence
  chemically synthesized
gcttacattttatgtattttgt

SEQ ID NO: 82209 - DNA, 22 bp, Artificial Sequence
  chemically synthesized
cttacattttatgtattttgtt

SEQ ID NO: 82210 - DNA, 22 bp, Artificial Sequence
  chemically synthesized
acattttatgtattttgttgaa

SEQ ID NO: 82211 - DNA, 22 bp, Artificial Sequence
  chemically synthesized
cattttatgtattttgttgaat

SEQ ID NO: 82212 - DNA, 22 bp, Artificial Sequence
  chemically synthesized
tatgtattttgttgaattgtgt

SEQ ID NO: 82213 - DNA, 22 bp, Artificial Sequence
  chemically synthesized
atgtattttgttgaattgtgtt

SEQ ID NO: 82214 - DNA, 22 bp, Artificial Sequence
  chemically synthesized
tgtattttgttgaattgtgttt

SEQ ID NO: 82215 - DNA, 22 bp, Artificial Sequence
  chemically synthesized
tgttgaattgtgtttaatcaca

SEQ ID NO: 82216 - DNA, 22 bp, Artificial Sequence
  chemically synthesized
gttgaattgtgtttaatcacaa

SEQ ID NO: 82217 - DNA, 22 bp, Artificial Sequence
  chemically synthesized
ttgaattgtgtttaatcacaag

SEQ ID NO: 82218 - DNA, 22 bp, Artificial Sequence
  chemically synthesized
aattgtgtttaatcacaagagt

SEQ ID NO: 82219 - DNA, 22 bp, Artificial Sequence
  chemically synthesized
tgtttaatcacaagagtaatgc

SEQ ID NO: 82220 - DNA, 22 bp, Artificial Sequence
  chemically synthesized
aatcacaagagtaatgcatgcc

SEQ ID NO: 82221 - DNA, 22 bp, Artificial Sequence
  chemically synthesized
atcacaagagtaatgcatgcct

SEQ ID NO: 82222 - DNA, 22 bp, Artificial Sequence
  chemically synthesized
atatggtttggatctgtgtctc

SEQ ID NO: 82223 - DNA, 22 bp, Artificial Sequence
  chemically synthesized
ggatctgtgtctccaccctaat

SEQ ID NO: 82224 - DNA, 22 bp, Artificial Sequence
  chemically synthesized
gatctgtgtctccaccctaatc

SEQ ID NO: 82225 - DNA, 22 bp, Artificial Sequence
  chemically synthesized
tgtctccaccctaatctcatgt

SEQ ID NO: 82226 - DNA, 22 bp, Artificial Sequence
  chemically synthesized
caccctaatctcatgttcagct

SEQ ID NO: 82227 - DNA, 22 bp, Artificial Sequence
  chemically synthesized
atctcatgttcagctgtaatcc

SEQ ID NO: 82228 - DNA, 22 bp, Artificial Sequence
  chemically synthesized
atgttcagctgtaatccccagt

SEQ ID NO: 82229 - DNA, 22 bp, Artificial Sequence
  chemically synthesized
agctgtaatccccagtgttgaa

SEQ ID NO: 82230 - DNA, 22 bp, Artificial Sequence
  chemically synthesized
taatccccagtgttgaagatgg

SEQ ID NO: 82231 - DNA, 22 bp, Artificial Sequence
  chemically synthesized
aagatggggcctggtgggaagt

SEQ ID NO: 82232 - DNA, 22 bp, Artificial Sequence
  chemically synthesized
gtgggaagtgattggatcatag

SEQ ID NO: 82233 - DNA, 22 bp, Artificial Sequence
  chemically synthesized
gatcataggagcagagttatca

SEQ ID NO: 82234 - DNA, 22 bp, Artificial Sequence
  chemically synthesized
tcataaatagcttaatatcagt

SEQ ID NO: 82235 - DNA, 22 bp, Artificial Sequence
  chemically synthesized
aatatcagtcccttttggtacg

SEQ ID NO: 82236 - DNA, 22 bp, Artificial Sequence
  chemically synthesized
atatcagtcccttttggtacgt

SEQ ID NO: 82237 - DNA, 22 bp, Artificial Sequence
  chemically synthesized
ttggtacgtatagtgggtgagt

SEQ ID NO: 82238 - DNA, 22 bp, Artificial Sequence
  chemically synthesized
tggtacgtatagtgggtgagtt

SEQ ID NO: 82239 - DNA, 22 bp, Artificial Sequence
  chemically synthesized
ggtacgtatagtgggtgagttc

SEQ ID NO: 82240 - DNA, 22 bp, Artificial Sequence
  chemically synthesized
gtacgtatagtgggtgagttct

SEQ ID NO: 82241 - DNA, 22 bp, Artificial Sequence
  chemically synthesized
tcatgagatatggttgtttact

SEQ ID NO: 82242 - DNA, 22 bp, Artificial Sequence
  chemically synthesized
atgagatatggttgtttactac

SEQ ID NO: 82243 - DNA, 22 bp, Artificial Sequence
  chemically synthesized
tttactacctccctgcctcttc

SEQ ID NO: 82244 - DNA, 22 bp, Artificial Sequence
  chemically synthesized
actacctccctgcctcttcttc

SEQ ID NO: 82245 - DNA, 22 bp, Artificial Sequence
  chemically synthesized
ctacctccctgcctcttcttcc

SEQ ID NO: 82246 - DNA, 22 bp, Artificial Sequence
  chemically synthesized
cctccctgcctcttcttcctgc

SEQ ID NO: 82247 - DNA, 22 bp, Artificial Sequence
  chemically synthesized
cctgcctcttcttcctgctcca

SEQ ID NO: 82248 - DNA, 22 bp, Artificial Sequence
  chemically synthesized
cctcttcttcctgctccagcca

SEQ ID NO: 82249 - DNA, 22 bp, Artificial Sequence
  chemically synthesized
ttcttcctgctccagccatgtg

SEQ ID NO: 82250 - DNA, 22 bp, Artificial Sequence
  chemically synthesized
cttcctgctccagccatgtgaa

SEQ ID NO: 82251 - DNA, 22 bp, Artificial Sequence
  chemically synthesized
ttcctgctccagccatgtgaag

SEQ ID NO: 82252 - DNA, 22 bp, Artificial Sequence
  chemically synthesized
cctgctccagccatgtgaagac

SEQ ID NO: 82253 - DNA, 22 bp, Artificial Sequence
  chemically synthesized
ctgctccagccatgtgaagaca

SEQ ID NO: 82254 - DNA, 22 bp, Artificial Sequence
  chemically synthesized
ctccagccatgtgaagacacat

SEQ ID NO: 82255 - DNA, 22 bp, Artificial Sequence
  chemically synthesized
cagccatgtgaagacacatgct

SEQ ID NO: 82256 - DNA, 22 bp, Artificial Sequence
  chemically synthesized
ctgtttttctctctgccatgat

SEQ ID NO: 82257 - DNA, 22 bp, Artificial Sequence
  chemically synthesized
tttttctctctgccatgattat

SEQ ID NO: 82258 - DNA, 22 bp, Artificial Sequence
  chemically synthesized
ttctctctgccatgattataag

SEQ ID NO: 82259 - DNA, 22 bp, Artificial Sequence
  chemically synthesized
tctctctgccatgattataagt

SEQ ID NO: 82260 - DNA, 22 bp, Artificial Sequence
  chemically synthesized
ctctctgccatgattataagtt

SEQ ID NO: 82261 - DNA, 22 bp, Artificial Sequence
  chemically synthesized
tctctgccatgattataagttt

SEQ ID NO: 82262 - DNA, 22 bp, Artificial Sequence
  chemically synthesized
tctgccatgattataagtttcc

SEQ ID NO: 82263 - DNA, 22 bp, Artificial Sequence
  chemically synthesized
tgccatgattataagtttcctg

SEQ ID NO: 82264 - DNA, 22 bp, Artificial Sequence
  chemically synthesized
ccatgattataagtttcctgaa

SEQ ID NO: 82265 - DNA, 22 bp, Artificial Sequence
  chemically synthesized
taagtttcctgaaacctcccta

SEQ ID NO: 82266 - DNA, 22 bp, Artificial Sequence
  chemically synthesized
cctgaaacctccctagaagctg

SEQ ID NO: 82267 - DNA, 22 bp, Artificial Sequence
  chemically synthesized
ctgaaacctccctagaagctga

SEQ ID NO: 82268 - DNA, 22 bp, Artificial Sequence
  chemically synthesized
aaacctccctagaagctgagca

SEQ ID NO: 82269 - DNA, 22 bp, Artificial Sequence
  chemically synthesized
cctagaagctgagcagacgttg

SEQ ID NO: 82270 - DNA, 22 bp, Artificial Sequence
  chemically synthesized
gaagctgagcagacgttgccat

SEQ ID NO: 82271 - DNA, 22 bp, Artificial Sequence
  chemically synthesized
agcagacgttgccatgcttcct

SEQ ID NO: 82272 - DNA, 22 bp, Artificial Sequence
  chemically synthesized
ccatgcttcctgtacagccttt

SEQ ID NO: 82273 - DNA, 22 bp, Artificial Sequence
  chemically synthesized
cctgtacagcctttagaactgt

SEQ ID NO: 82274 - DNA, 22 bp, Artificial Sequence
  chemically synthesized
ctgtacagcctttagaactgtg

SEQ ID NO: 82275 - DNA, 22 bp, Artificial Sequence
  chemically synthesized
tacagcctttagaactgtgagc

SEQ ID NO: 82276 - DNA, 22 bp, Artificial Sequence
  chemically synthesized
tagaactgtgagccaattaaat

SEQ ID NO: 82277 - DNA, 22 bp, Artificial Sequence
  chemically synthesized
agaactgtgagccaattaaatc

SEQ ID NO: 82278 - DNA, 22 bp, Artificial Sequence
  chemically synthesized
gaactgtgagccaattaaatct

SEQ ID NO: 82279 - DNA, 22 bp, Artificial Sequence
  chemically synthesized
tgagccaattaaatctctgttc

SEQ ID NO: 82280 - DNA, 22 bp, Artificial Sequence
  chemically synthesized
aatctctgttcttcaccattta

SEQ ID NO: 82281 - DNA, 22 bp, Artificial Sequence
  chemically synthesized
tgttcttcaccatttacccagt

SEQ ID NO: 82282 - DNA, 22 bp, Artificial Sequence
  chemically synthesized
ttcttcaccatttacccagtct

SEQ ID NO: 82283 - DNA, 22 bp, Artificial Sequence
  chemically synthesized
ttcaccatttacccagtctcag

SEQ ID NO: 82284 - DNA, 22 bp, Artificial Sequence
  chemically synthesized
caccatttacccagtctcaggt

SEQ ID NO: 82285 - DNA, 22 bp, Artificial Sequence
  chemically synthesized
accatttacccagtctcaggta

SEQ ID NO: 82286 - DNA, 22 bp, Artificial Sequence
  chemically synthesized
acccagtctcaggtatttcctt

SEQ ID NO: 82287 - DNA, 22 bp, Artificial Sequence
  chemically synthesized
cccagtctcaggtatttcctta

SEQ ID NO: 82288 - DNA, 22 bp, Artificial Sequence
  chemically synthesized
aggtatttccttatagcaagat

SEQ ID NO: 82289 - DNA, 22 bp, Artificial Sequence
  chemically synthesized
ccttatagcaagatgagaatgg

SEQ ID NO: 82290 - DNA, 22 bp, Artificial Sequence
  chemically synthesized
cttatagcaagatgagaatgga

SEQ ID NO: 82291 - DNA, 22 bp, Artificial Sequence
  chemically synthesized
atagcaagatgagaatggacca

SEQ ID NO: 82292 - DNA, 22 bp, Artificial Sequence
  chemically synthesized
tagcaagatgagaatggaccag

SEQ ID NO: 82293 - DNA, 22 bp, Artificial Sequence
  chemically synthesized
gtaccaaaagtggggtactgct

SEQ ID NO: 82294 - DNA, 22 bp, Artificial Sequence
  chemically synthesized
ctataaagatacatgaaaatgt

SEQ ID NO: 82295 - DNA, 22 bp, Artificial Sequence
  chemically synthesized
taaagatacatgaaaatgtgga

SEQ ID NO: 82296 - DNA, 22 bp, Artificial Sequence
  chemically synthesized
tggcattggataacaggcagaa

SEQ ID NO: 82297 - DNA, 22 bp, Artificial Sequence
  chemically synthesized
ggcattggataacaggcagaag

SEQ ID NO: 82298 - DNA, 22 bp, Artificial Sequence
  chemically synthesized
gcattggataacaggcagaagt

SEQ ID NO: 82299 - DNA, 22 bp, Artificial Sequence
  chemically synthesized
gataacaggcagaagttggaag

SEQ ID NO: 82300 - DNA, 22 bp, Artificial Sequence
  chemically synthesized
gaagagtgtggacggctcagaa

SEQ ID NO: 82301 - DNA, 22 bp, Artificial Sequence
  chemically synthesized
agaagaagacagggagatgagg

SEQ ID NO: 82302 - DNA, 22 bp, Artificial Sequence
  chemically synthesized
ggaactttctagagacttgtgg

SEQ ID NO: 82303 - DNA, 22 bp, Artificial Sequence
  chemically synthesized
gaactttctagagacttgtgga

SEQ ID NO: 82304 - DNA, 22 bp, Artificial Sequence
  chemically synthesized
tctagagacttgtggaatggtt

SEQ ID NO: 82305 - DNA, 22 bp, Artificial Sequence
  chemically synthesized
ctagagacttgtggaatggttg

SEQ ID NO: 82306 - DNA, 22 bp, Artificial Sequence
  chemically synthesized
tagagacttgtggaatggttgt

SEQ ID NO: 82307 - DNA, 22 bp, Artificial Sequence
  chemically synthesized
gagacttgtggaatggttgtga

SEQ ID NO: 82308 - DNA, 22 bp, Artificial Sequence
  chemically synthesized
gtggaatggttgtgaccaaaat

SEQ ID NO: 82309 - DNA, 22 bp, Artificial Sequence
  chemically synthesized
tggaatggttgtgaccaaaatt

SEQ ID NO: 82310 - DNA, 22 bp, Artificial Sequence
  chemically synthesized
tgaccaaaattctgatagtgat

SEQ ID NO: 82311 - DNA, 22 bp, Artificial Sequence
  chemically synthesized
tgatagtgatatggacaatgaa

SEQ ID NO: 82312 - DNA, 22 bp, Artificial Sequence
  chemically synthesized
atagtgatatggacaatgaagt

SEQ ID NO: 82313 - DNA, 22 bp, Artificial Sequence
  chemically synthesized
aggtggtctcagatggaaatga

SEQ ID NO: 82314 - DNA, 22 bp, Artificial Sequence
  chemically synthesized
agatggaaatgaatttattgga

SEQ ID NO: 82315 - DNA, 22 bp, Artificial Sequence
  chemically synthesized
attggaaactggagcaaaggtc

SEQ ID NO: 82316 - DNA, 22 bp, Artificial Sequence
  chemically synthesized
ttggaaactggagcaaaggtca

SEQ ID NO: 82317 - DNA, 22 bp, Artificial Sequence
  chemically synthesized
gaaactggagcaaaggtcactt

SEQ ID NO: 82318 - DNA, 22 bp, Artificial Sequence
  chemically synthesized
gagcaaaggtcacttttgttat

SEQ ID NO: 82319 - DNA, 22 bp, Artificial Sequence
  chemically synthesized
ttgttatacattagcaaagagg

SEQ ID NO: 82320 - DNA, 22 bp, Artificial Sequence
  chemically synthesized
tgttatacattagcaaagaggt

SEQ ID NO: 82321 - DNA, 22 bp, Artificial Sequence
  chemically synthesized
gttatacattagcaaagaggtt

SEQ ID NO: 82322 - DNA, 22 bp, Artificial Sequence
  chemically synthesized
ttatacattagcaaagaggttg

SEQ ID NO: 82323 - DNA, 22 bp, Artificial Sequence
  chemically synthesized
tacattagcaaagaggttgact

SEQ ID NO: 82324 - DNA, 22 bp, Artificial Sequence
  chemically synthesized
gcaaagaggttgactgcactgt

SEQ ID NO: 82325 - DNA, 22 bp, Artificial Sequence
  chemically synthesized
actgcactgtgcctctacctta

SEQ ID NO: 82326 - DNA, 22 bp, Artificial Sequence
  chemically synthesized
cactgtgcctctaccttagaga

SEQ ID NO: 82327 - DNA, 22 bp, Artificial Sequence
  chemically synthesized
tgcctctaccttagagaatctg

SEQ ID NO: 82328 - DNA, 22 bp, Artificial Sequence
  chemically synthesized
taccttagagaatctgtggaaa

SEQ ID NO: 82329 - DNA, 22 bp, Artificial Sequence
  chemically synthesized
ccttagagaatctgtggaaatt

SEQ ID NO: 82330 - DNA, 22 bp, Artificial Sequence
  chemically synthesized
agagaatctgtggaaattcgaa

SEQ ID NO: 82331 - DNA, 22 bp, Artificial Sequence
  chemically synthesized
gagaatctgtggaaattcgaag

SEQ ID NO: 82332 - DNA, 22 bp, Artificial Sequence
  chemically synthesized
tggaaattcgaagttgataata

SEQ ID NO: 82333 - DNA, 22 bp, Artificial Sequence
  chemically synthesized
gaagttgataatattatttaag

SEQ ID NO: 82334 - DNA, 22 bp, Artificial Sequence
  chemically synthesized
ataatattatttaagttatgtg

SEQ ID NO: 82335 - DNA, 22 bp, Artificial Sequence
  chemically synthesized
tttaagttatgtgacagaagtt

SEQ ID NO: 82336 - DNA, 22 bp, Artificial Sequence
  chemically synthesized
aagttatgtgacagaagtttct

SEQ ID NO: 82337 - DNA, 22 bp, Artificial Sequence
  chemically synthesized
agttatgtgacagaagtttcta

SEQ ID NO: 82338 - DNA, 22 bp, Artificial Sequence
  chemically synthesized
tgtgacagaagtttctaagcag

SEQ ID NO: 82339 - DNA, 22 bp, Artificial Sequence
  chemically synthesized
ctaagcagcaaggtgttcaaga

SEQ ID NO: 82340 - DNA, 22 bp, Artificial Sequence
  chemically synthesized
taagcagcaaggtgttcaagat

SEQ ID NO: 82341 - DNA, 22 bp, Artificial Sequence
  chemically synthesized
agcagcaaggtgttcaagatgt

SEQ ID NO: 82342 - DNA, 22 bp, Artificial Sequence
  chemically synthesized
aagatgtgtcctggctgcttct

SEQ ID NO: 82343 - DNA, 22 bp, Artificial Sequence
  chemically synthesized
gctgcttctaacaacctatgct

SEQ ID NO: 82344 - DNA, 22 bp, Artificial Sequence
  chemically synthesized
cttctaacaacctatgctcata

SEQ ID NO: 82345 - DNA, 22 bp, Artificial Sequence
  chemically synthesized
ctaacaacctatgctcatatgt

SEQ ID NO: 82346 - DNA, 22 bp, Artificial Sequence
  chemically synthesized
taacaacctatgctcatatgtg

SEQ ID NO: 82347 - DNA, 22 bp, Artificial Sequence
  chemically synthesized
acaacctatgctcatatgtgtg

SEQ ID NO: 82348 - DNA, 22 bp, Artificial Sequence
  chemically synthesized
tgctcatatgtgtgagcaaaga

SEQ ID NO: 82349 - DNA, 22 bp, Artificial Sequence
  chemically synthesized
atatgtgtgagcaaagaaataa

SEQ ID NO: 82350 - DNA, 22 bp, Artificial Sequence
  chemically synthesized
atatttaaaagggaagcagagc

SEQ ID NO: 82351 - DNA, 22 bp, Artificial Sequence
  chemically synthesized
tatttaaaagggaagcagagca

SEQ ID NO: 82352 - DNA, 22 bp, Artificial Sequence
  chemically synthesized
aaaagggaagcagagcataaaa

SEQ ID NO: 82353 - DNA, 22 bp, Artificial Sequence
  chemically synthesized
aaagggaagcagagcataaaag

SEQ ID NO: 82354 - DNA, 22 bp, Artificial Sequence
  chemically synthesized
ggaaaattatctgctcggccat

SEQ ID NO: 82355 - DNA, 22 bp, Artificial Sequence
  chemically synthesized
gaaaattatctgctcggccatg

SEQ ID NO: 82356 - DNA, 22 bp, Artificial Sequence
  chemically synthesized
tctgctcggccatgtggtagaa

SEQ ID NO: 82357 - DNA, 22 bp, Artificial Sequence
  chemically synthesized
ctcggccatgtggtagaaaaca

SEQ ID NO: 82358 - DNA, 22 bp, Artificial Sequence
  chemically synthesized
ggccatgtggtagaaaacagaa

SEQ ID NO: 82359 - DNA, 22 bp, Artificial Sequence
  chemically synthesized
attttcaaaggagcaattcaag

SEQ ID NO: 82360 - DNA, 22 bp, Artificial Sequence
  chemically synthesized
tcaaaggagcaattcaagcagg

SEQ ID NO: 82361 - DNA, 22 bp, Artificial Sequence
  chemically synthesized
caaaggagcaattcaagcaggc

SEQ ID NO: 82362 - DNA, 22 bp, Artificial Sequence
  chemically synthesized
aaaggagcaattcaagcaggct

SEQ ID NO: 82363 - DNA, 22 bp, Artificial Sequence
  chemically synthesized
aagcaggctgtagaaatttgca

SEQ ID NO: 82364 - DNA, 22 bp, Artificial Sequence
  chemically synthesized
tagaaatttgcataaatgaaga

SEQ ID NO: 82365 - DNA, 22 bp, Artificial Sequence
  chemically synthesized
gcataaatgaagaggagccgag

SEQ ID NO: 82366 - DNA, 22 bp, Artificial Sequence
  chemically synthesized
cataaatgaagaggagccgagt

SEQ ID NO: 82367 - DNA, 22 bp, Artificial Sequence
  chemically synthesized
taatagccaaaataaaggggag

SEQ ID NO: 82368 - DNA, 22 bp, Artificial Sequence
  chemically synthesized
atagccaaaataaaggggagaa

SEQ ID NO: 82369 - DNA, 22 bp, Artificial Sequence
  chemically synthesized
aaagacatttcagagacccttg

SEQ ID NO: 82370 - DNA, 22 bp, Artificial Sequence
  chemically synthesized
cagagacccttgtagcagcccc

SEQ ID NO: 82371 - DNA, 22 bp, Artificial Sequence
  chemically synthesized
agagacccttgtagcagcccct

SEQ ID NO: 82372 - DNA, 22 bp, Artificial Sequence
  chemically synthesized
gtagcagcccctcacatcacag

SEQ ID NO: 82373 - DNA, 22 bp, Artificial Sequence
  chemically synthesized
tagcagcccctcacatcacagg

SEQ ID NO: 82374 - DNA, 22 bp, Artificial Sequence
  chemically synthesized
acatcacaggcctggtggccta

SEQ ID NO: 82375 - DNA, 22 bp, Artificial Sequence
  chemically synthesized
gtggcctaggagtactgaatga

SEQ ID NO: 82376 - DNA, 22 bp, Artificial Sequence
  chemically synthesized
ggagtactgaatgattttgtgg

SEQ ID NO: 82377 - DNA, 22 bp, Artificial Sequence
  chemically synthesized
aatgattttgtgggtgagattc

SEQ ID NO: 82378 - DNA, 22 bp, Artificial Sequence
  chemically synthesized
tgtgggtgagattcaggaccct

SEQ ID NO: 82379 - DNA, 22 bp, Artificial Sequence
  chemically synthesized
gtgggtgagattcaggaccctg

SEQ ID NO: 82380 - DNA, 22 bp, Artificial Sequence
  chemically synthesized
tgggtgagattcaggaccctgc

SEQ ID NO: 82381 - DNA, 22 bp, Artificial Sequence
  chemically synthesized
aggaccctgctgccttgagcag

SEQ ID NO: 82382 - DNA, 22 bp, Artificial Sequence
  chemically synthesized
ctgccttgagcagcttcaggac

SEQ ID NO: 82383 - DNA, 22 bp, Artificial Sequence
  chemically synthesized
ccttgagcagcttcaggacact

SEQ ID NO: 82384 - DNA, 22 bp, Artificial Sequence
  chemically synthesized
gagcagcttcaggacactgttc

SEQ ID NO: 82385 - DNA, 22 bp, Artificial Sequence
  chemically synthesized
agcagcttcaggacactgttcc

SEQ ID NO: 82386 - DNA, 22 bp, Artificial Sequence
  chemically synthesized
caggacactgttccttgcatcc

SEQ ID NO: 82387 - DNA, 22 bp, Artificial Sequence
  chemically synthesized
aggacactgttccttgcatcct

SEQ ID NO: 82388 - DNA, 22 bp, Artificial Sequence
  chemically synthesized
ttccttgcatcctggctgctcc

SEQ ID NO: 82389 - DNA, 22 bp, Artificial Sequence
  chemically synthesized
cttgcatcctggctgctccagc

SEQ ID NO: 82390 - DNA, 22 bp, Artificial Sequence
  chemically synthesized
gcatcctggctgctccagcacc

SEQ ID NO: 82391 - DNA, 22 bp, Artificial Sequence
  chemically synthesized
catcctggctgctccagcacca

SEQ ID NO: 82392 - DNA, 22 bp, Artificial Sequence
  chemically synthesized
gctgctccagcaccagctgtgg

SEQ ID NO: 82393 - DNA, 22 bp, Artificial Sequence
  chemically synthesized
ctccagcaccagctgtggctca

SEQ ID NO: 82394 - DNA, 22 bp, Artificial Sequence
  chemically synthesized
cagcaccagctgtggctcaaag

SEQ ID NO: 82395 - DNA, 22 bp, Artificial Sequence
  chemically synthesized
tggctcaaaggggcccaagaac

SEQ ID NO: 82396 - DNA, 22 bp, Artificial Sequence
  chemically synthesized
aaaggggcccaagaacagctaa

SEQ ID NO: 82397 - DNA, 22 bp, Artificial Sequence
  chemically synthesized
aggccactgcttcagagggtgc

SEQ ID NO: 82398 - DNA, 22 bp, Artificial Sequence
  chemically synthesized
cttcagagggtgcaagacataa

SEQ ID NO: 82399 - DNA, 22 bp, Artificial Sequence
  chemically synthesized
cagagggtgcaagacataagcc

SEQ ID NO: 82400 - DNA, 22 bp, Artificial Sequence
  chemically synthesized
agagggtgcaagacataagcct

SEQ ID NO: 82401 - DNA, 22 bp, Artificial Sequence
  chemically synthesized
ggaggcttccacatggtgataa

SEQ ID NO: 82402 - DNA, 22 bp, Artificial Sequence
  chemically synthesized
gaggcttccacatggtgataaa

SEQ ID NO: 82403 - DNA, 22 bp, Artificial Sequence
  chemically synthesized
ccacatggtgataaatctggga

SEQ ID NO: 82404 - DNA, 22 bp, Artificial Sequence
  chemically synthesized
cacatggtgataaatctgggag

SEQ ID NO: 82405 - DNA, 22 bp, Artificial Sequence
  chemically synthesized
ggagtgtgcaaaggtcaaaaag

SEQ ID NO: 82406 - DNA, 22 bp, Artificial Sequence
  chemically synthesized
aggcttgtaagcctccacctag

SEQ ID NO: 82407 - DNA, 22 bp, Artificial Sequence
  chemically synthesized
gtaagcctccacctagatttca

SEQ ID NO: 82408 - DNA, 22 bp, Artificial Sequence
  chemically synthesized
taagcctccacctagatttcag

SEQ ID NO: 82409 - DNA, 22 bp, Artificial Sequence
  chemically synthesized
cacctagatttcagaggatgtg

SEQ ID NO: 82410 - DNA, 22 bp, Artificial Sequence
  chemically synthesized
gatttcagaggatgtgtagaaa

SEQ ID NO: 82411 - DNA, 22 bp, Artificial Sequence
  chemically synthesized
cagaggatgtgtagaaaagcct

SEQ ID NO: 82412 - DNA, 22 bp, Artificial Sequence
  chemically synthesized
agaggatgtgtagaaaagcctg

SEQ ID NO: 82413 - DNA, 22 bp, Artificial Sequence
  chemically synthesized
agtgttcaggcagaagcctcct

SEQ ID NO: 82414 - DNA, 22 bp, Artificial Sequence
  chemically synthesized
aggcagaagcctcctgcagggg

SEQ ID NO: 82415 - DNA, 22 bp, Artificial Sequence
  chemically synthesized
ctgcaggggcagaaccctcatg

SEQ ID NO: 82416 - DNA, 22 bp, Artificial Sequence
  chemically synthesized
caggggcagaaccctcatgaag

SEQ ID NO: 82417 - DNA, 22 bp, Artificial Sequence
  chemically synthesized
atgaagaacctctaatagggca

SEQ ID NO: 82418 - DNA, 22 bp, Artificial Sequence
  chemically synthesized
taatagggcaatgtggaggaaa

SEQ ID NO: 82419 - DNA, 22 bp, Artificial Sequence
  chemically synthesized
atagggcaatgtggaggaaaaa

SEQ ID NO: 82420 - DNA, 22 bp, Artificial Sequence
  chemically synthesized
gaaccccctcacagagtctcca

SEQ ID NO: 82421 - DNA, 22 bp, Artificial Sequence
  chemically synthesized
acagagtctccactggggcact

SEQ ID NO: 82422 - DNA, 22 bp, Artificial Sequence
  chemically synthesized
cactggggcactgcctagcaga

SEQ ID NO: 82423 - DNA, 22 bp, Artificial Sequence
  chemically synthesized
gggcactgcctagcagagctat

SEQ ID NO: 82424 - DNA, 22 bp, Artificial Sequence
  chemically synthesized
cctagcagagctatgagaaaag

SEQ ID NO: 82425 - DNA, 22 bp, Artificial Sequence
  chemically synthesized
gcagagctatgagaaaagggcc

SEQ ID NO: 82426 - DNA, 22 bp, Artificial Sequence
  chemically synthesized
tgagaaaagggccaccgtcctc

SEQ ID NO: 82427 - DNA, 22 bp, Artificial Sequence
  chemically synthesized
cagaccccagaatggtagatcc

SEQ ID NO: 82428 - DNA, 22 bp, Artificial Sequence
  chemically synthesized
acagtttgcaccgtgcacctag

SEQ ID NO: 82429 - DNA, 22 bp, Artificial Sequence
  chemically synthesized
gcaccgtgcacctagaaaagct

SEQ ID NO: 82430 - DNA, 22 bp, Artificial Sequence
  chemically synthesized
caccgtgcacctagaaaagctg

SEQ ID NO: 82431 - DNA, 22 bp, Artificial Sequence
  chemically synthesized
gaaaagctgcaaacactcaata

SEQ ID NO: 82432 - DNA, 22 bp, Artificial Sequence
  chemically synthesized
caaacactcaatacaatctctt

SEQ ID NO: 82433 - DNA, 22 bp, Artificial Sequence
  chemically synthesized
aatacaatctcttaagagcagc

SEQ ID NO: 82434 - DNA, 22 bp, Artificial Sequence
  chemically synthesized
ttaagagcagcagcaggggcta

SEQ ID NO: 82435 - DNA, 22 bp, Artificial Sequence
  chemically synthesized
aagagcagcagcaggggctaaa

SEQ ID NO: 82436 - DNA, 22 bp, Artificial Sequence
  chemically synthesized
agagcagcagcaggggctaaac

SEQ ID NO: 82437 - DNA, 22 bp, Artificial Sequence
  chemically synthesized
aactgtgcaaagcaataggggt

SEQ ID NO: 82438 - DNA, 22 bp, Artificial Sequence
  chemically synthesized
tgcaaagcaataggggtggaac

SEQ ID NO: 82439 - DNA, 22 bp, Artificial Sequence
  chemically synthesized
cccaaggccttgggagcccacc

SEQ ID NO: 82440 - DNA, 22 bp, Artificial Sequence
  chemically synthesized
gggagcccacctcttgcatcag

SEQ ID NO: 82441 - DNA, 22 bp, Artificial Sequence
  chemically synthesized
ggagcccacctcttgcatcagt

SEQ ID NO: 82442 - DNA, 22 bp, Artificial Sequence
  chemically synthesized
ttgcatcagtgtgtccctgata

SEQ ID NO: 82443 - DNA, 22 bp, Artificial Sequence
  chemically synthesized
gcatcagtgtgtccctgatatg

SEQ ID NO: 82444 - DNA, 22 bp, Artificial Sequence
  chemically synthesized
catcagtgtgtccctgatatga

SEQ ID NO: 82445 - DNA, 22 bp, Artificial Sequence
  chemically synthesized
atatgagacatggggtcaaagg

SEQ ID NO: 82446 - DNA, 22 bp, Artificial Sequence
  chemically synthesized
ttttggagtgttaaggtgtgta

SEQ ID NO: 82447 - DNA, 22 bp, Artificial Sequence
  chemically synthesized
tggagtgttaaggtgtgtattt

SEQ ID NO: 82448 - DNA, 22 bp, Artificial Sequence
  chemically synthesized
ggagtgttaaggtgtgtatttg

SEQ ID NO: 82449 - DNA, 22 bp, Artificial Sequence
  chemically synthesized
gagtgttaaggtgtgtatttgt

SEQ ID NO: 82450 - DNA, 22 bp, Artificial Sequence
  chemically synthesized
aggtgtgtatttgtccgtttta

SEQ ID NO: 82451 - DNA, 22 bp, Artificial Sequence
  chemically synthesized
gtccgttttaaactgctatgaa

SEQ ID NO: 82452 - DNA, 22 bp, Artificial Sequence
  chemically synthesized
tccgttttaaactgctatgaag

SEQ ID NO: 82453 - DNA, 22 bp, Artificial Sequence
  chemically synthesized
taaactgctatgaagaaatacc

SEQ ID NO: 82454 - DNA, 22 bp, Artificial Sequence
  chemically synthesized
aaactgctatgaagaaataccc

SEQ ID NO: 82455 - DNA, 22 bp, Artificial Sequence
  chemically synthesized
aactgctatgaagaaatacccg

SEQ ID NO: 82456 - DNA, 22 bp, Artificial Sequence
  chemically synthesized
ctatgaagaaatacccgagact

SEQ ID NO: 82457 - DNA, 22 bp, Artificial Sequence
  chemically synthesized
tgaagaaatacccgagactggg

SEQ ID NO: 82458 - DNA, 22 bp, Artificial Sequence
  chemically synthesized
ggtaatttataaagaaaaagag

SEQ ID NO: 82459 - DNA, 22 bp, Artificial Sequence
  chemically synthesized
ataaagaaaaagagatttaatg

SEQ ID NO: 82460 - DNA, 22 bp, Artificial Sequence
  chemically synthesized
taaagaaaaagagatttaatgg

SEQ ID NO: 82461 - DNA, 22 bp, Artificial Sequence
  chemically synthesized
aatggactcatagatccacatt

SEQ ID NO: 82462 - DNA, 22 bp, Artificial Sequence
  chemically synthesized
atggactcatagatccacattg

SEQ ID NO: 82463 - DNA, 22 bp, Artificial Sequence
  chemically synthesized
atagatccacattgctggggag

SEQ ID NO: 82464 - DNA, 22 bp, Artificial Sequence
  chemically synthesized
ctggggaggccttacaatcatg

SEQ ID NO: 82465 - DNA, 22 bp, Artificial Sequence
  chemically synthesized
gggaggccttacaatcatggtg

SEQ ID NO: 82466 - DNA, 22 bp, Artificial Sequence
  chemically synthesized
acaatcatggtggaaggtgaag

SEQ ID NO: 82467 - DNA, 22 bp, Artificial Sequence
  chemically synthesized
caatcatggtggaaggtgaagg

SEQ ID NO: 82468 - DNA, 22 bp, Artificial Sequence
  chemically synthesized
acatggtggcaggcaagagagc

SEQ ID NO: 82469 - DNA, 22 bp, Artificial Sequence
  chemically synthesized
tataaaaccatcagatcttgtg

SEQ ID NO: 82470 - DNA, 22 bp, Artificial Sequence
  chemically synthesized
ataaaaccatcagatcttgtga

SEQ ID NO: 82471 - DNA, 22 bp, Artificial Sequence
  chemically synthesized
taaaaccatcagatcttgtgag

SEQ ID NO: 82472 - DNA, 22 bp, Artificial Sequence
  chemically synthesized
gtgagacttactcactatcatg

SEQ ID NO: 82473 - DNA, 22 bp, Artificial Sequence
  chemically synthesized
tgagacttactcactatcatga

SEQ ID NO: 82474 - DNA, 22 bp, Artificial Sequence
  chemically synthesized
actcactatcatgagaacagca

SEQ ID NO: 82475 - DNA, 22 bp, Artificial Sequence
  chemically synthesized
ctcactatcatgagaacagcat

SEQ ID NO: 82476 - DNA, 22 bp, Artificial Sequence
  chemically synthesized
actatcatgagaacagcatgtg

SEQ ID NO: 82477 - DNA, 22 bp, Artificial Sequence
  chemically synthesized
tcatgagaacagcatgtgaaaa

SEQ ID NO: 82478 - DNA, 22 bp, Artificial Sequence
  chemically synthesized
cccccatgattcaattacatcc

SEQ ID NO: 82479 - DNA, 22 bp, Artificial Sequence
  chemically synthesized
aattacatcccagtgtgttcct

SEQ ID NO: 82480 - DNA, 22 bp, Artificial Sequence
  chemically synthesized
catcccagtgtgttccttccat

SEQ ID NO: 82481 - DNA, 22 bp, Artificial Sequence
  chemically synthesized
cttccatgacaggcagggatta

SEQ ID NO: 82482 - DNA, 22 bp, Artificial Sequence
  chemically synthesized
ccatgacaggcagggattatgg

SEQ ID NO: 82483 - DNA, 22 bp, Artificial Sequence
  chemically synthesized
catgacaggcagggattatggg

SEQ ID NO: 82484 - DNA, 22 bp, Artificial Sequence
  chemically synthesized
tgggacctactattcaagaaga

SEQ ID NO: 82485 - DNA, 22 bp, Artificial Sequence
  chemically synthesized
ctattcaagaagaaatttgggt

SEQ ID NO: 82486 - DNA, 22 bp, Artificial Sequence
  chemically synthesized
ttcaagaagaaatttgggtggg

SEQ ID NO: 82487 - DNA, 22 bp, Artificial Sequence
  chemically synthesized
aagaagaaatttgggtgggaaa

SEQ ID NO: 82488 - DNA, 22 bp, Artificial Sequence
  chemically synthesized
gggtgggaaaactgccaaacca

SEQ ID NO: 82489 - DNA, 22 bp, Artificial Sequence
  chemically synthesized
ggtgggaaaactgccaaaccat

SEQ ID NO: 82490 - DNA, 22 bp, Artificial Sequence
  chemically synthesized
ccaaaccatatcaaggtgtaat

SEQ ID NO: 82491 - DNA, 22 bp, Artificial Sequence
  chemically synthesized
ccctgctgggttttctactcgt

SEQ ID NO: 82492 - DNA, 22 bp, Artificial Sequence
  chemically synthesized
ctgggttttctactcgtgtggg

SEQ ID NO: 82493 - DNA, 22 bp, Artificial Sequence
  chemically synthesized
ggttttctactcgtgtgggatc

SEQ ID NO: 82494 - DNA, 22 bp, Artificial Sequence
  chemically synthesized
tctactcgtgtgggatctttag

SEQ ID NO: 82495 - DNA, 22 bp, Artificial Sequence
  chemically synthesized
ctactcgtgtgggatctttagc

SEQ ID NO: 82496 - DNA, 22 bp, Artificial Sequence
  chemically synthesized
tactcgtgtgggatctttagcc

SEQ ID NO: 82497 - DNA, 22 bp, Artificial Sequence
  chemically synthesized
ctcgtgtgggatctttagcccc

SEQ ID NO: 82498 - DNA, 22 bp, Artificial Sequence
  chemically synthesized
gtgtgggatctttagccccttt

SEQ ID NO: 82499 - DNA, 22 bp, Artificial Sequence
  chemically synthesized
tagcccctttcttttggtgcat

SEQ ID NO: 82500 - DNA, 22 bp, Artificial Sequence
  chemically synthesized
agcccctttcttttggtgcatt

SEQ ID NO: 82501 - DNA, 22 bp, Artificial Sequence
  chemically synthesized
gcccctttcttttggtgcattt

SEQ ID NO: 82502 - DNA, 22 bp, Artificial Sequence
  chemically synthesized
tcttttggtgcatttctctctt

SEQ ID NO: 82503 - DNA, 22 bp, Artificial Sequence
  chemically synthesized
cttttggtgcatttctctcttt

SEQ ID NO: 82504 - DNA, 22 bp, Artificial Sequence
  chemically synthesized
ttttggtgcatttctctctttt

SEQ ID NO: 82505 - DNA, 22 bp, Artificial Sequence
  chemically synthesized
ttggtgcatttctctcttttgg

SEQ ID NO: 82506 - DNA, 22 bp, Artificial Sequence
  chemically synthesized
tggtgcatttctctcttttgga

SEQ ID NO: 82507 - DNA, 22 bp, Artificial Sequence
  chemically synthesized
ggtgcatttctctcttttggaa

SEQ ID NO: 82508 - DNA, 22 bp, Artificial Sequence
  chemically synthesized
gtgcatttctctcttttggaat

SEQ ID NO: 82509 - DNA, 22 bp, Artificial Sequence
  chemically synthesized
ctctcttttggaatgggaattt

SEQ ID NO: 82510 - DNA, 22 bp, Artificial Sequence
  chemically synthesized
tctcttttggaatgggaatttg

SEQ ID NO: 82511 - DNA, 22 bp, Artificial Sequence
  chemically synthesized
tcttttggaatgggaatttgta

SEQ ID NO: 82512 - DNA, 22 bp, Artificial Sequence
  chemically synthesized
ttttggaatgggaatttgtacc

SEQ ID NO: 82513 - DNA, 22 bp, Artificial Sequence
  chemically synthesized
ttggaatgggaatttgtaccca

SEQ ID NO: 82514 - DNA, 22 bp, Artificial Sequence
  chemically synthesized
tggaatgggaatttgtacccaa

SEQ ID NO: 82515 - DNA, 22 bp, Artificial Sequence
  chemically synthesized
ggaatgggaatttgtacccaat

SEQ ID NO: 82516 - DNA, 22 bp, Artificial Sequence
  chemically synthesized
gaatgggaatttgtacccaatg

SEQ ID NO: 82517 - DNA, 22 bp, Artificial Sequence
  chemically synthesized
gtacccaatgccagtacctcca

SEQ ID NO: 82518 - DNA, 22 bp, Artificial Sequence
  chemically synthesized
tacccaatgccagtacctccat

SEQ ID NO: 82519 - DNA, 22 bp, Artificial Sequence
  chemically synthesized
cattatgtcttggaagtaacta

SEQ ID NO: 82520 - DNA, 22 bp, Artificial Sequence
  chemically synthesized
tgtcttggaagtaactaacttg

SEQ ID NO: 82521 - DNA, 22 bp, Artificial Sequence
  chemically synthesized
ggaagtaactaacttgtttttg

SEQ ID NO: 82522 - DNA, 22 bp, Artificial Sequence
  chemically synthesized
gaagtaactaacttgtttttga

SEQ ID NO: 82523 - DNA, 22 bp, Artificial Sequence
  chemically synthesized
acttgtttttgattttacaggc

SEQ ID NO: 82524 - DNA, 22 bp, Artificial Sequence
  chemically synthesized
gtttttgattttacaggctcat

SEQ ID NO: 82525 - DNA, 22 bp, Artificial Sequence
  chemically synthesized
tttttgattttacaggctcata

SEQ ID NO: 82526 - DNA, 22 bp, Artificial Sequence
  chemically synthesized
ttgattttacaggctcataggt

SEQ ID NO: 82527 - DNA, 22 bp, Artificial Sequence
  chemically synthesized
tgattttacaggctcataggtt

SEQ ID NO: 82528 - DNA, 22 bp, Artificial Sequence
  chemically synthesized
gattttacaggctcataggttg

SEQ ID NO: 82529 - DNA, 22 bp, Artificial Sequence
  chemically synthesized
attttacaggctcataggttga

SEQ ID NO: 82530 - DNA, 22 bp, Artificial Sequence
  chemically synthesized
tacaggctcataggttgaaggg

SEQ ID NO: 82531 - DNA, 22 bp, Artificial Sequence
  chemically synthesized
acaggctcataggttgaaggga

SEQ ID NO: 82532 - DNA, 22 bp, Artificial Sequence
  chemically synthesized
caggctcataggttgaagggac

SEQ ID NO: 82533 - DNA, 22 bp, Artificial Sequence
  chemically synthesized
ataggttgaagggacttgcctt

SEQ ID NO: 82534 - DNA, 22 bp, Artificial Sequence
  chemically synthesized
aagggacttgccttgtcttgga

SEQ ID NO: 82535 - DNA, 22 bp, Artificial Sequence
  chemically synthesized
gccttgtcttggataagacttt

SEQ ID NO: 82536 - DNA, 22 bp, Artificial Sequence
  chemically synthesized
ccttgtcttggataagactttg

SEQ ID NO: 82537 - DNA, 22 bp, Artificial Sequence
  chemically synthesized
gtcttggataagactttggact

SEQ ID NO: 82538 - DNA, 22 bp, Artificial Sequence
  chemically synthesized
tcttggataagactttggactt

SEQ ID NO: 82539 - DNA, 22 bp, Artificial Sequence
  chemically synthesized
ggataagactttggactttgga

SEQ ID NO: 82540 - DNA, 22 bp, Artificial Sequence
  chemically synthesized
gataagactttggactttggac

SEQ ID NO: 82541 - DNA, 22 bp, Artificial Sequence
  chemically synthesized
tggactttggacttttgagtta

SEQ ID NO: 82542 - DNA, 22 bp, Artificial Sequence
  chemically synthesized
ggactttggacttttgagttaa

SEQ ID NO: 82543 - DNA, 22 bp, Artificial Sequence
  chemically synthesized
gactttggacttttgagttaat

SEQ ID NO: 82544 - DNA, 22 bp, Artificial Sequence
  chemically synthesized
tggacttttgagttaatgctgg

SEQ ID NO: 82545 - DNA, 22 bp, Artificial Sequence
  chemically synthesized
ggacttttgagttaatgctgga

SEQ ID NO: 82546 - DNA, 22 bp, Artificial Sequence
  chemically synthesized
gacttttgagttaatgctggaa

SEQ ID NO: 82547 - DNA, 22 bp, Artificial Sequence
  chemically synthesized
ttgagttaatgctggaatgagt

SEQ ID NO: 82548 - DNA, 22 bp, Artificial Sequence
  chemically synthesized
tgagttaatgctggaatgagtt

SEQ ID NO: 82549 - DNA, 22 bp, Artificial Sequence
  chemically synthesized
gagttaatgctggaatgagtta

SEQ ID NO: 82550 - DNA, 22 bp, Artificial Sequence
  chemically synthesized
agttaatgctggaatgagttaa

SEQ ID NO: 82551 - DNA, 22 bp, Artificial Sequence
  chemically synthesized
atgctggaatgagttaagactt

SEQ ID NO: 82552 - DNA, 22 bp, Artificial Sequence
  chemically synthesized
gaatgagttaagactttgtagg

SEQ ID NO: 82553 - DNA, 22 bp, Artificial Sequence
  chemically synthesized
agactttgtaggactgttggga

SEQ ID NO: 82554 - DNA, 22 bp, Artificial Sequence
  chemically synthesized
tgtaggactgttgggaagtaat

SEQ ID NO: 82555 - DNA, 22 bp, Artificial Sequence
  chemically synthesized
gtaggactgttgggaagtaatg

SEQ ID NO: 82556 - DNA, 22 bp, Artificial Sequence
  chemically synthesized
taggactgttgggaagtaatga

SEQ ID NO: 82557 - DNA, 22 bp, Artificial Sequence
  chemically synthesized
ttgggaagtaatgattgtattt

SEQ ID NO: 82558 - DNA, 22 bp, Artificial Sequence
  chemically synthesized
ggaagtaatgattgtattttgt

SEQ ID NO: 82559 - DNA, 22 bp, Artificial Sequence
  chemically synthesized
tattttgtgatgtgagaagaac

SEQ ID NO: 82560 - DNA, 22 bp, Artificial Sequence
  chemically synthesized
tgtgatgtgagaagaacatgag

SEQ ID NO: 82561 - DNA, 22 bp, Artificial Sequence
  chemically synthesized
gtgatgtgagaagaacatgaga

SEQ ID NO: 82562 - DNA, 22 bp, Artificial Sequence
  chemically synthesized
tgatgtgagaagaacatgagat

SEQ ID NO: 82563 - DNA, 22 bp, Artificial Sequence
  chemically synthesized
ggaaggggccagaggtggaagg

SEQ ID NO: 82564 - DNA, 22 bp, Artificial Sequence
  chemically synthesized
gaaggggccagaggtggaagga

SEQ ID NO: 82565 - DNA, 22 bp, Artificial Sequence
  chemically synthesized
ggatctgtgtcaccacccaaat

SEQ ID NO: 82566 - DNA, 22 bp, Artificial Sequence
  chemically synthesized
gatctgtgtcaccacccaaata

SEQ ID NO: 82567 - DNA, 22 bp, Artificial Sequence
  chemically synthesized
tgtcaccacccaaatatcatgt

SEQ ID NO: 82568 - DNA, 22 bp, Artificial Sequence
  chemically synthesized
aattataatcaccagcgttgga

SEQ ID NO: 82569 - DNA, 22 bp, Artificial Sequence
  chemically synthesized
taatcaccagcgttggaggtgg

SEQ ID NO: 82570 - DNA, 22 bp, Artificial Sequence
  chemically synthesized
gaggtggggccttgtgggaggt

SEQ ID NO: 82571 - DNA, 22 bp, Artificial Sequence
  chemically synthesized
gtgggaggtaattcaatcatgg

SEQ ID NO: 82572 - DNA, 22 bp, Artificial Sequence
  chemically synthesized
tgggaggtaattcaatcatggt

SEQ ID NO: 82573 - DNA, 22 bp, Artificial Sequence
  chemically synthesized
aatcatggtggcagagttctca

SEQ ID NO: 82574 - DNA, 22 bp, Artificial Sequence
  chemically synthesized
tcatcagcgatttagtaccatc

SEQ ID NO: 82575 - DNA, 22 bp, Artificial Sequence
  chemically synthesized
atcagcgatttagtaccatccc

SEQ ID NO: 82576 - DNA, 22 bp, Artificial Sequence
  chemically synthesized
agtaccatcccccttggtactg

SEQ ID NO: 82577 - DNA, 22 bp, Artificial Sequence
  chemically synthesized
gtaccatcccccttggtactgt

SEQ ID NO: 82578 - DNA, 22 bp, Artificial Sequence
  chemically synthesized
ggtactgtatagtgagttctca

SEQ ID NO: 82579 - DNA, 22 bp, Artificial Sequence
  chemically synthesized
gtactgtatagtgagttctcaa

SEQ ID NO: 82580 - DNA, 22 bp, Artificial Sequence
  chemically synthesized
tatagtgagttctcaagaggct

SEQ ID NO: 82581 - DNA, 22 bp, Artificial Sequence
  chemically synthesized
tcaagaggctggttgtttgaaa

SEQ ID NO: 82582 - DNA, 22 bp, Artificial Sequence
  chemically synthesized
aagaggctggttgtttgaaagt

SEQ ID NO: 82583 - DNA, 22 bp, Artificial Sequence
  chemically synthesized
gttgtttgaaagtgtgtagcac

SEQ ID NO: 82584 - DNA, 22 bp, Artificial Sequence
  chemically synthesized
tttgaaagtgtgtagcacctcc

SEQ ID NO: 82585 - DNA, 22 bp, Artificial Sequence
  chemically synthesized
gaaagtgtgtagcacctcctac

SEQ ID NO: 82586 - DNA, 22 bp, Artificial Sequence
  chemically synthesized
aaagtgtgtagcacctcctacc

SEQ ID NO: 82587 - DNA, 22 bp, Artificial Sequence
  chemically synthesized
ctaccctgcttctccctgtcct

SEQ ID NO: 82588 - DNA, 22 bp, Artificial Sequence
  chemically synthesized
ccctgcttctccctgtcctggc

SEQ ID NO: 82589 - DNA, 22 bp, Artificial Sequence
  chemically synthesized
cttctccctgtcctggccatgt

SEQ ID NO: 82590 - DNA, 22 bp, Artificial Sequence
  chemically synthesized
ctccctgtcctggccatgtgaa

SEQ ID NO: 82591 - DNA, 22 bp, Artificial Sequence
  chemically synthesized
tccctgtcctggccatgtgaag

SEQ ID NO: 82592 - DNA, 22 bp, Artificial Sequence
  chemically synthesized
cctgtcctggccatgtgaagat

SEQ ID NO: 82593 - DNA, 22 bp, Artificial Sequence
  chemically synthesized
tcctggccatgtgaagatactt

SEQ ID NO: 82594 - DNA, 22 bp, Artificial Sequence
  chemically synthesized
gccatgtgaagatacttgctcc

SEQ ID NO: 82595 - DNA, 22 bp, Artificial Sequence
  chemically synthesized
gctcctgctttgtcttctgcca

SEQ ID NO: 82596 - DNA, 22 bp, Artificial Sequence
  chemically synthesized
ctcctgctttgtcttctgccat

SEQ ID NO: 82597 - DNA, 22 bp, Artificial Sequence
  chemically synthesized
ctgctttgtcttctgccatgat

SEQ ID NO: 82598 - DNA, 22 bp, Artificial Sequence
  chemically synthesized
ctttgtcttctgccatgattgt

SEQ ID NO: 82599 - DNA, 22 bp, Artificial Sequence
  chemically synthesized
tgtcttctgccatgattgtaag

SEQ ID NO: 82600 - DNA, 22 bp, Artificial Sequence
  chemically synthesized
gtcttctgccatgattgtaagt

SEQ ID NO: 82601 - DNA, 22 bp, Artificial Sequence
  chemically synthesized
tcttctgccatgattgtaagtt

SEQ ID NO: 82602 - DNA, 22 bp, Artificial Sequence
  chemically synthesized
ctgccatgattgtaagtttctt

SEQ ID NO: 82603 - DNA, 22 bp, Artificial Sequence
  chemically synthesized
tgccatgattgtaagtttcttg

SEQ ID NO: 82604 - DNA, 22 bp, Artificial Sequence
  chemically synthesized
ccatgattgtaagtttcttgag

SEQ ID NO: 82605 - DNA, 22 bp, Artificial Sequence
  chemically synthesized
taagtttcttgaggtctcccta

SEQ ID NO: 82606 - DNA, 22 bp, Artificial Sequence
  chemically synthesized
cttgaggtctccctagaagctg

SEQ ID NO: 82607 - DNA, 22 bp, Artificial Sequence
  chemically synthesized
ttgaggtctccctagaagctga

SEQ ID NO: 82608 - DNA, 22 bp, Artificial Sequence
  chemically synthesized
gaggtctccctagaagctgagc

SEQ ID NO: 82609 - DNA, 22 bp, Artificial Sequence
  chemically synthesized
aggtctccctagaagctgagca

SEQ ID NO: 82610 - DNA, 22 bp, Artificial Sequence
  chemically synthesized
cctagaagctgagcagatgctg

SEQ ID NO: 82611 - DNA, 22 bp, Artificial Sequence
  chemically synthesized
gaagctgagcagatgctgccat

SEQ ID NO: 82612 - DNA, 22 bp, Artificial Sequence
  chemically synthesized
agcagatgctgccatgcttctt

SEQ ID NO: 82613 - DNA, 22 bp, Artificial Sequence
  chemically synthesized
ccatgcttcttgtacagcctga

SEQ ID NO: 82614 - DNA, 22 bp, Artificial Sequence
  chemically synthesized
cttgtacagcctgaagaacttt

SEQ ID NO: 82615 - DNA, 22 bp, Artificial Sequence
  chemically synthesized
ttgtacagcctgaagaactttg

SEQ ID NO: 82616 - DNA, 22 bp, Artificial Sequence
  chemically synthesized
gtacagcctgaagaactttgag

SEQ ID NO: 82617 - DNA, 22 bp, Artificial Sequence
  chemically synthesized
tacagcctgaagaactttgagc

SEQ ID NO: 82618 - DNA, 22 bp, Artificial Sequence
  chemically synthesized
aagaactttgagccaattaaac

SEQ ID NO: 82619 - DNA, 22 bp, Artificial Sequence
  chemically synthesized
tgagccaattaaacctctgttc

SEQ ID NO: 82620 - DNA, 22 bp, Artificial Sequence
  chemically synthesized
gagccaattaaacctctgttct

SEQ ID NO: 82621 - DNA, 22 bp, Artificial Sequence
  chemically synthesized
agccaattaaacctctgttctt

SEQ ID NO: 82622 - DNA, 22 bp, Artificial Sequence
  chemically synthesized
aacctctgttctttataaatta

SEQ ID NO: 82623 - DNA, 22 bp, Artificial Sequence
  chemically synthesized
tgttctttataaattacccagt

SEQ ID NO: 82624 - DNA, 22 bp, Artificial Sequence
  chemically synthesized
ttctttataaattacccagtct

SEQ ID NO: 82625 - DNA, 22 bp, Artificial Sequence
  chemically synthesized
tttataaattacccagtctcag

SEQ ID NO: 82626 - DNA, 22 bp, Artificial Sequence
  chemically synthesized
tataaattacccagtctcaggt

SEQ ID NO: 82627 - DNA, 22 bp, Artificial Sequence
  chemically synthesized
ataaattacccagtctcaggta

SEQ ID NO: 82628 - DNA, 22 bp, Artificial Sequence
  chemically synthesized
taaattacccagtctcaggtat

SEQ ID NO: 82629 - DNA, 22 bp, Artificial Sequence
  chemically synthesized
cccagtctcaggtattttttta

SEQ ID NO: 82630 - DNA, 22 bp, Artificial Sequence
  chemically synthesized
aggtatttttttacagcagtgt

SEQ ID NO: 82631 - DNA, 22 bp, Artificial Sequence
  chemically synthesized
ttttacagcagtgtgaaaacat

SEQ ID NO: 82632 - DNA, 22 bp, Artificial Sequence
  chemically synthesized
tttacagcagtgtgaaaacatg

SEQ ID NO: 82633 - DNA, 22 bp, Artificial Sequence
  chemically synthesized
ttacagcagtgtgaaaacatgc

SEQ ID NO: 82634 - DNA, 22 bp, Artificial Sequence
  chemically synthesized
tacagcagtgtgaaaacatgcc

SEQ ID NO: 82635 - DNA, 22 bp, Artificial Sequence
  chemically synthesized
acagcagtgtgaaaacatgcca

SEQ ID NO: 82636 - DNA, 22 bp, Artificial Sequence
  chemically synthesized
cagcagtgtgaaaacatgccaa

SEQ ID NO: 82637 - DNA, 22 bp, Artificial Sequence
  chemically synthesized
aatgccaccattaataattttt

SEQ ID NO: 82638 - DNA, 22 bp, Artificial Sequence
  chemically synthesized
atgccaccattaataatttttt

SEQ ID NO: 82639 - DNA, 22 bp, Artificial Sequence
  chemically synthesized
ataattttttcttcttccttcc

SEQ ID NO: 82640 - DNA, 22 bp, Artificial Sequence
  chemically synthesized
tttcttcttccttcctttgata

SEQ ID NO: 82641 - DNA, 22 bp, Artificial Sequence
  chemically synthesized
ttcttcttccttcctttgatac

SEQ ID NO: 82642 - DNA, 22 bp, Artificial Sequence
  chemically synthesized
tcttcttccttcctttgatact

SEQ ID NO: 82643 - DNA, 22 bp, Artificial Sequence
  chemically synthesized
cttcttccttcctttgatactc

SEQ ID NO: 82644 - DNA, 22 bp, Artificial Sequence
  chemically synthesized
ttcttccttcctttgatactca

SEQ ID NO: 82645 - DNA, 22 bp, Artificial Sequence
  chemically synthesized
cttccttcctttgatactcaat

SEQ ID NO: 82646 - DNA, 22 bp, Artificial Sequence
  chemically synthesized
ttccttcctttgatactcaatg

SEQ ID NO: 82647 - DNA, 22 bp, Artificial Sequence
  chemically synthesized
ccttcctttgatactcaatgtg

SEQ ID NO: 82648 - DNA, 22 bp, Artificial Sequence
  chemically synthesized
cttcctttgatactcaatgtga

SEQ ID NO: 82649 - DNA, 22 bp, Artificial Sequence
  chemically synthesized
cctttgatactcaatgtgatca

SEQ ID NO: 82650 - DNA, 22 bp, Artificial Sequence
  chemically synthesized
ctttgatactcaatgtgatcaa

SEQ ID NO: 82651 - DNA, 22 bp, Artificial Sequence
  chemically synthesized
tgatactcaatgtgatcaagat

SEQ ID NO: 82652 - DNA, 22 bp, Artificial Sequence
  chemically synthesized
gatactcaatgtgatcaagatt

SEQ ID NO: 82653 - DNA, 22 bp, Artificial Sequence
  chemically synthesized
atactcaatgtgatcaagattt

SEQ ID NO: 82654 - DNA, 22 bp, Artificial Sequence
  chemically synthesized
aatgtgatcaagatttgggagt

SEQ ID NO: 82655 - DNA, 22 bp, Artificial Sequence
  chemically synthesized
gggagttaatcattttactcct

SEQ ID NO: 82656 - DNA, 22 bp, Artificial Sequence
  chemically synthesized
ggagttaatcattttactcctc

SEQ ID NO: 82657 - DNA, 22 bp, Artificial Sequence
  chemically synthesized
atcattttactcctctttactc

SEQ ID NO: 82658 - DNA, 22 bp, Artificial Sequence
  chemically synthesized
tactcctctttactcatgtcca

SEQ ID NO: 82659 - DNA, 22 bp, Artificial Sequence
  chemically synthesized
actcctctttactcatgtccaa

SEQ ID NO: 82660 - DNA, 22 bp, Artificial Sequence
  chemically synthesized
ctcctctttactcatgtccaaa

SEQ ID NO: 82661 - DNA, 22 bp, Artificial Sequence
  chemically synthesized
ctctttactcatgtccaaagtg

SEQ ID NO: 82662 - DNA, 22 bp, Artificial Sequence
  chemically synthesized
tttactcatgtccaaagtgaca

SEQ ID NO: 82663 - DNA, 22 bp, Artificial Sequence
  chemically synthesized
tactcatgtccaaagtgacatg

SEQ ID NO: 82664 - DNA, 22 bp, Artificial Sequence
  chemically synthesized
actcatgtccaaagtgacatga

SEQ ID NO: 82665 - DNA, 22 bp, Artificial Sequence
  chemically synthesized
ctcatgtccaaagtgacatgaa

SEQ ID NO: 82666 - DNA, 22 bp, Artificial Sequence
  chemically synthesized
atgtccaaagtgacatgaaacc

SEQ ID NO: 82667 - DNA, 22 bp, Artificial Sequence
  chemically synthesized
tatctaagtgtgttatctccat

SEQ ID NO: 82668 - DNA, 22 bp, Artificial Sequence
  chemically synthesized
agtgtgttatctccatgggaag

SEQ ID NO: 82669 - DNA, 22 bp, Artificial Sequence
  chemically synthesized
tctccatgggaagatactaaat

SEQ ID NO: 82670 - DNA, 22 bp, Artificial Sequence
  chemically synthesized
catgggaagatactaaatcttt

SEQ ID NO: 82671 - DNA, 22 bp, Artificial Sequence
  chemically synthesized
aatcttttatttatcatcttat

SEQ ID NO: 82672 - DNA, 22 bp, Artificial Sequence
  chemically synthesized
ttatttatcatcttatttttaa

SEQ ID NO: 82673 - DNA, 22 bp, Artificial Sequence
  chemically synthesized
tatttatcatcttatttttaat

SEQ ID NO: 82674 - DNA, 22 bp, Artificial Sequence
  chemically synthesized
atttatcatcttatttttaata

SEQ ID NO: 82675 - DNA, 22 bp, Artificial Sequence
  chemically synthesized
tttatcatcttatttttaataa

SEQ ID NO: 82676 - DNA, 22 bp, Artificial Sequence
  chemically synthesized
atcatcttatttttaataaatc

SEQ ID NO: 82677 - DNA, 22 bp, Artificial Sequence
  chemically synthesized
tcatcttatttttaataaatca

SEQ ID NO: 82678 - DNA, 22 bp, Artificial Sequence
  chemically synthesized
atttttaataaatcataacatt

SEQ ID NO: 82679 - DNA, 22 bp, Artificial Sequence
  chemically synthesized
tttttaataaatcataacatta

SEQ ID NO: 82680 - DNA, 22 bp, Artificial Sequence
  chemically synthesized
ttaataaatcataacattacct

SEQ ID NO: 82681 - DNA, 22 bp, Artificial Sequence
  chemically synthesized
taataaatcataacattacctg

SEQ ID NO: 82682 - DNA, 22 bp, Artificial Sequence
  chemically synthesized
aataaatcataacattacctgt

SEQ ID NO: 82683 - DNA, 22 bp, Artificial Sequence
  chemically synthesized
ataaatcataacattacctgtt

SEQ ID NO: 82684 - DNA, 22 bp, Artificial Sequence
  chemically synthesized
cctgttattaaatattaatcta

SEQ ID NO: 82685 - DNA, 22 bp, Artificial Sequence
  chemically synthesized
ttattaaatattaatctatttc

SEQ ID NO: 82686 - DNA, 22 bp, Artificial Sequence
  chemically synthesized
ttaaatattaatctatttcatt

SEQ ID NO: 82687 - DNA, 22 bp, Artificial Sequence
  chemically synthesized
aatattaatctatttcattcta

SEQ ID NO: 82688 - DNA, 22 bp, Artificial Sequence
  chemically synthesized
atctatttcattctatgcaata

SEQ ID NO: 82689 - DNA, 22 bp, Artificial Sequence
  chemically synthesized
tttcattctatgcaatagctgt

SEQ ID NO: 82690 - DNA, 22 bp, Artificial Sequence
  chemically synthesized
cattctatgcaatagctgtctg

SEQ ID NO: 82691 - DNA, 22 bp, Artificial Sequence
  chemically synthesized
attctatgcaatagctgtctga

SEQ ID NO: 82692 - DNA, 22 bp, Artificial Sequence
  chemically synthesized
tatgcaatagctgtctgaaact

SEQ ID NO: 82693 - DNA, 22 bp, Artificial Sequence
  chemically synthesized
tgcaatagctgtctgaaactaa

SEQ ID NO: 82694 - DNA, 22 bp, Artificial Sequence
  chemically synthesized
tctgaaactaagtcaaagaatg

SEQ ID NO: 82695 - DNA, 22 bp, Artificial Sequence
  chemically synthesized
aaactaagtcaaagaatgtacc

SEQ ID NO: 82696 - DNA, 22 bp, Artificial Sequence
  chemically synthesized
agtcaaagaatgtaccatactt

SEQ ID NO: 82697 - DNA, 22 bp, Artificial Sequence
  chemically synthesized
tattcactatttgtctattatt

SEQ ID NO: 82698 - DNA, 22 bp, Artificial Sequence
  chemically synthesized
attcactatttgtctattattg

SEQ ID NO: 82699 - DNA, 22 bp, Artificial Sequence
  chemically synthesized
ttcactatttgtctattattga

SEQ ID NO: 82700 - DNA, 22 bp, Artificial Sequence
  chemically synthesized
actatttgtctattattgaata

SEQ ID NO: 82701 - DNA, 22 bp, Artificial Sequence
  chemically synthesized
tttgtctattattgaatatcta

SEQ ID NO: 82702 - DNA, 22 bp, Artificial Sequence
  chemically synthesized
gtctattattgaatatctatat

SEQ ID NO: 82703 - DNA, 22 bp, Artificial Sequence
  chemically synthesized
tctattattgaatatctatatt

SEQ ID NO: 82704 - DNA, 22 bp, Artificial Sequence
  chemically synthesized
ttattgaatatctatatttgtt

SEQ ID NO: 82705 - DNA, 22 bp, Artificial Sequence
  chemically synthesized
ttgaatatctatatttgtttga

SEQ ID NO: 82706 - DNA, 22 bp, Artificial Sequence
  chemically synthesized
aatatctatatttgtttgagga

SEQ ID NO: 82707 - DNA, 22 bp, Artificial Sequence
  chemically synthesized
tatttgtttgaggaataataat

SEQ ID NO: 82708 - DNA, 22 bp, Artificial Sequence
  chemically synthesized
gtttgaggaataataatcagaa

SEQ ID NO: 82709 - DNA, 22 bp, Artificial Sequence
  chemically synthesized
tttgaggaataataatcagaac

SEQ ID NO: 82710 - DNA, 22 bp, Artificial Sequence
  chemically synthesized
gaggaataataatcagaacaga

SEQ ID NO: 82711 - DNA, 22 bp, Artificial Sequence
  chemically synthesized
aggaataataatcagaacagaa

SEQ ID NO: 82712 - DNA, 22 bp, Artificial Sequence
  chemically synthesized
taggaatggaagtttctcaaca

SEQ ID NO: 82713 - DNA, 22 bp, Artificial Sequence
  chemically synthesized
ctcaacagcaagataaaatagg

SEQ ID NO: 82714 - DNA, 22 bp, Artificial Sequence
  chemically synthesized
tcaacagcaagataaaataggt

SEQ ID NO: 82715 - DNA, 22 bp, Artificial Sequence
  chemically synthesized
aacagcaagataaaataggtta

SEQ ID NO: 82716 - DNA, 22 bp, Artificial Sequence
  chemically synthesized
atggagtaatatgtagagaatg

SEQ ID NO: 82717 - DNA, 22 bp, Artificial Sequence
  chemically synthesized
taattaaagaaaatgaattaag

SEQ ID NO: 82718 - DNA, 22 bp, Artificial Sequence
  chemically synthesized
aagaaaatgaattaagcaatat

SEQ ID NO: 82719 - DNA, 22 bp, Artificial Sequence
  chemically synthesized
agcaatatacaattaaagctct

SEQ ID NO: 82720 - DNA, 22 bp, Artificial Sequence
  chemically synthesized
aagctctttatgtcttttcaca

SEQ ID NO: 82721 - DNA, 22 bp, Artificial Sequence
  chemically synthesized
tttatgtcttttcacagcttga

SEQ ID NO: 82722 - DNA, 22 bp, Artificial Sequence
  chemically synthesized
tatgtcttttcacagcttgata

SEQ ID NO: 82723 - DNA, 22 bp, Artificial Sequence
  chemically synthesized
atgtcttttcacagcttgatag

SEQ ID NO: 82724 - DNA, 22 bp, Artificial Sequence
  chemically synthesized
tgtcttttcacagcttgataga

SEQ ID NO: 82725 - DNA, 22 bp, Artificial Sequence
  chemically synthesized
ttcacagcttgatagaccttta

SEQ ID NO: 82726 - DNA, 22 bp, Artificial Sequence
  chemically synthesized
tcacagcttgatagacctttat

SEQ ID NO: 82727 - DNA, 22 bp, Artificial Sequence
  chemically synthesized
cacagcttgatagacctttatt

SEQ ID NO: 82728 - DNA, 22 bp, Artificial Sequence
  chemically synthesized
acagcttgatagacctttattt

SEQ ID NO: 82729 - DNA, 22 bp, Artificial Sequence
  chemically synthesized
gatagacctttatttatatcac

SEQ ID NO: 82730 - DNA, 22 bp, Artificial Sequence
  chemically synthesized
atagacctttatttatatcact

SEQ ID NO: 82731 - DNA, 22 bp, Artificial Sequence
  chemically synthesized
tatttatatcactgaataatat

SEQ ID NO: 82732 - DNA, 22 bp, Artificial Sequence
  chemically synthesized
atttatatcactgaataatatt

SEQ ID NO: 82733 - DNA, 22 bp, Artificial Sequence
  chemically synthesized
tttatatcactgaataatattc

SEQ ID NO: 82734 - DNA, 22 bp, Artificial Sequence
  chemically synthesized
atatcactgaataatattctat

SEQ ID NO: 82735 - DNA, 22 bp, Artificial Sequence
  chemically synthesized
tatcactgaataatattctatc

SEQ ID NO: 82736 - DNA, 22 bp, Artificial Sequence
  chemically synthesized
aataatattctatcctatggat

SEQ ID NO: 82737 - DNA, 22 bp, Artificial Sequence
  chemically synthesized
tatcctatggatgttccacagt

SEQ ID NO: 82738 - DNA, 22 bp, Artificial Sequence
  chemically synthesized
tcctatggatgttccacagttt

SEQ ID NO: 82739 - DNA, 22 bp, Artificial Sequence
  chemically synthesized
tggatgttccacagtttatcca

SEQ ID NO: 82740 - DNA, 22 bp, Artificial Sequence
  chemically synthesized
cacagtttatccattcatcttg

SEQ ID NO: 82741 - DNA, 22 bp, Artificial Sequence
  chemically synthesized
atccattcatcttggttacttt

SEQ ID NO: 82742 - DNA, 22 bp, Artificial Sequence
  chemically synthesized
tccattcatcttggttactttc

SEQ ID NO: 82743 - DNA, 22 bp, Artificial Sequence
  chemically synthesized
atcttggttactttcaactttt

SEQ ID NO: 82744 - DNA, 22 bp, Artificial Sequence
  chemically synthesized
ggttactttcaacttttggcaa

SEQ ID NO: 82745 - DNA, 22 bp, Artificial Sequence
  chemically synthesized
gttactttcaacttttggcaat

SEQ ID NO: 82746 - DNA, 22 bp, Artificial Sequence
  chemically synthesized
ctttcaacttttggcaattatg

SEQ ID NO: 82747 - DNA, 22 bp, Artificial Sequence
  chemically synthesized
tcaacttttggcaattatgagt

SEQ ID NO: 82748 - DNA, 22 bp, Artificial Sequence
  chemically synthesized
caacttttggcaattatgagta

SEQ ID NO: 82749 - DNA, 22 bp, Artificial Sequence
  chemically synthesized
aacttttggcaattatgagtaa

SEQ ID NO: 82750 - DNA, 22 bp, Artificial Sequence
  chemically synthesized
ttggcaattatgagtaaagttc

SEQ ID NO: 82751 - DNA, 22 bp, Artificial Sequence
  chemically synthesized
tggcaattatgagtaaagttcc

SEQ ID NO: 82752 - DNA, 22 bp, Artificial Sequence
  chemically synthesized
ggcaattatgagtaaagttcct

SEQ ID NO: 82753 - DNA, 22 bp, Artificial Sequence
  chemically synthesized
gcaattatgagtaaagttccta

SEQ ID NO: 82754 - DNA, 22 bp, Artificial Sequence
  chemically synthesized
tgagtaaagttcctataaacct

SEQ ID NO: 82755 - DNA, 22 bp, Artificial Sequence
  chemically synthesized
ctataaaccttggttagttcat

SEQ ID NO: 82756 - DNA, 22 bp, Artificial Sequence
  chemically synthesized
taaaccttggttagttcatgtc

SEQ ID NO: 82757 - DNA, 22 bp, Artificial Sequence
  chemically synthesized
ggttagttcatgtctgtgtgtg

SEQ ID NO: 82758 - DNA, 22 bp, Artificial Sequence
  chemically synthesized
gttagttcatgtctgtgtgtgg

SEQ ID NO: 82759 - DNA, 22 bp, Artificial Sequence
  chemically synthesized
gttcatgtctgtgtgtggacat

SEQ ID NO: 82760 - DNA, 22 bp, Artificial Sequence
  chemically synthesized
atgtctgtgtgtggacataaat

SEQ ID NO: 82761 - DNA, 22 bp, Artificial Sequence
  chemically synthesized
tgtgtggacataaatttttgac

SEQ ID NO: 82762 - DNA, 22 bp, Artificial Sequence
  chemically synthesized
ttgactcatttgggtaaataca

SEQ ID NO: 82763 - DNA, 22 bp, Artificial Sequence
  chemically synthesized
tgactcatttgggtaaatacat

SEQ ID NO: 82764 - DNA, 22 bp, Artificial Sequence
  chemically synthesized
gactcatttgggtaaatacata

SEQ ID NO: 82765 - DNA, 22 bp, Artificial Sequence
  chemically synthesized
actcatttgggtaaatacatag

SEQ ID NO: 82766 - DNA, 22 bp, Artificial Sequence
  chemically synthesized
atttgggtaaatacataggagt

SEQ ID NO: 82767 - DNA, 22 bp, Artificial Sequence
  chemically synthesized
gggtaaatacataggagtgtga

SEQ ID NO: 82768 - DNA, 22 bp, Artificial Sequence
  chemically synthesized
ggtaaatacataggagtgtgat

SEQ ID NO: 82769 - DNA, 22 bp, Artificial Sequence
  chemically synthesized
ttgggtcacatgaaaagactag

SEQ ID NO: 82770 - DNA, 22 bp, Artificial Sequence
  chemically synthesized
ggtcacatgaaaagactagttt

SEQ ID NO: 82771 - DNA, 22 bp, Artificial Sequence
  chemically synthesized
gttttgtaagaaactgtaaact

SEQ ID NO: 82772 - DNA, 22 bp, Artificial Sequence
  chemically synthesized
tgtaagaaactgtaaactgtct

SEQ ID NO: 82773 - DNA, 22 bp, Artificial Sequence
  chemically synthesized
gtaagaaactgtaaactgtctt

SEQ ID NO: 82774 - DNA, 22 bp, Artificial Sequence
  chemically synthesized
taagaaactgtaaactgtcttc

SEQ ID NO: 82775 - DNA, 22 bp, Artificial Sequence
  chemically synthesized
taaactgtcttccaatttggct

SEQ ID NO: 82776 - DNA, 22 bp, Artificial Sequence
  chemically synthesized
tcttccaatttggctgcactat

SEQ ID NO: 82777 - DNA, 22 bp, Artificial Sequence
  chemically synthesized
ccaatttggctgcactatttct

SEQ ID NO: 82778 - DNA, 22 bp, Artificial Sequence
  chemically synthesized
caatttggctgcactatttctc

SEQ ID NO: 82779 - DNA, 22 bp, Artificial Sequence
  chemically synthesized
ggctgcactatttctcatccct

SEQ ID NO: 82780 - DNA, 22 bp, Artificial Sequence
  chemically synthesized
gctgcactatttctcatcccta

SEQ ID NO: 82781 - DNA, 22 bp, Artificial Sequence
  chemically synthesized
cactatttctcatccctacaag

SEQ ID NO: 82782 - DNA, 22 bp, Artificial Sequence
  chemically synthesized
tttctcatccctacaagcaata

SEQ ID NO: 82783 - DNA, 22 bp, Artificial Sequence
  chemically synthesized
ctcatccctacaagcaataagt

SEQ ID NO: 82784 - DNA, 22 bp, Artificial Sequence
  chemically synthesized
tcatccctacaagcaataagtg

SEQ ID NO: 82785 - DNA, 22 bp, Artificial Sequence
  chemically synthesized
atccctacaagcaataagtgag

SEQ ID NO: 82786 - DNA, 22 bp, Artificial Sequence
  chemically synthesized
caagcaataagtgagagttact

SEQ ID NO: 82787 - DNA, 22 bp, Artificial Sequence
  chemically synthesized
ctgttgctccacttcgttgcca

SEQ ID NO: 82788 - DNA, 22 bp, Artificial Sequence
  chemically synthesized
ttgctccacttcgttgccagtg

SEQ ID NO: 82789 - DNA, 22 bp, Artificial Sequence
  chemically synthesized
ctccacttcgttgccagtgttt

SEQ ID NO: 82790 - DNA, 22 bp, Artificial Sequence
  chemically synthesized
cacttcgttgccagtgtttggt

SEQ ID NO: 82791 - DNA, 22 bp, Artificial Sequence
  chemically synthesized
cgttgccagtgtttggtggatg

SEQ ID NO: 82792 - DNA, 22 bp, Artificial Sequence
  chemically synthesized
gttgccagtgtttggtggatgt

SEQ ID NO: 82793 - DNA, 22 bp, Artificial Sequence
  chemically synthesized
ccagtgtttggtggatgtcagt

SEQ ID NO: 82794 - DNA, 22 bp, Artificial Sequence
  chemically synthesized
ggtggatgtcagtattttggaa

SEQ ID NO: 82795 - DNA, 22 bp, Artificial Sequence
  chemically synthesized
gtggatgtcagtattttggaat

SEQ ID NO: 82796 - DNA, 22 bp, Artificial Sequence
  chemically synthesized
tggaatttggccttctaatatg

SEQ ID NO: 82797 - DNA, 22 bp, Artificial Sequence
  chemically synthesized
ggaatttggccttctaatatgt

SEQ ID NO: 82798 - DNA, 22 bp, Artificial Sequence
  chemically synthesized
gaatttggccttctaatatgtg

SEQ ID NO: 82799 - DNA, 22 bp, Artificial Sequence
  chemically synthesized
ggccttctaatatgtgtgtagt

SEQ ID NO: 82800 - DNA, 22 bp, Artificial Sequence
  chemically synthesized
gccttctaatatgtgtgtagtg

SEQ ID NO: 82801 - DNA, 22 bp, Artificial Sequence
  chemically synthesized
ctaatatgtgtgtagtggttgg

SEQ ID NO: 82802 - DNA, 22 bp, Artificial Sequence
  chemically synthesized
taatatgtgtgtagtggttggt

SEQ ID NO: 82803 - DNA, 22 bp, Artificial Sequence
  chemically synthesized
atatgtgtgtagtggttggtat

SEQ ID NO: 82804 - DNA, 22 bp, Artificial Sequence
  chemically synthesized
gtatcttcttgttttaatgtgc

SEQ ID NO: 82805 - DNA, 22 bp, Artificial Sequence
  chemically synthesized
cttgttttaatgtgcagtttct

SEQ ID NO: 82806 - DNA, 22 bp, Artificial Sequence
  chemically synthesized
ttgttttaatgtgcagtttctt

SEQ ID NO: 82807 - DNA, 22 bp, Artificial Sequence
  chemically synthesized
gttttaatgtgcagtttcttaa

SEQ ID NO: 82808 - DNA, 22 bp, Artificial Sequence
  chemically synthesized
ttttaatgtgcagtttcttaat

SEQ ID NO: 82809 - DNA, 22 bp, Artificial Sequence
  chemically synthesized
taatgtgcagtttcttaatgac

SEQ ID NO: 82810 - DNA, 22 bp, Artificial Sequence
  chemically synthesized
aatgtgcagtttcttaatgaca

SEQ ID NO: 82811 - DNA, 22 bp, Artificial Sequence
  chemically synthesized
atgtgcagtttcttaatgacat

SEQ ID NO: 82812 - DNA, 22 bp, Artificial Sequence
  chemically synthesized
cttaatgacatgtgttactgag

SEQ ID NO: 82813 - DNA, 22 bp, Artificial Sequence
  chemically synthesized
ttaatgacatgtgttactgagt

SEQ ID NO: 82814 - DNA, 22 bp, Artificial Sequence
  chemically synthesized
aatgacatgtgttactgagtat

SEQ ID NO: 82815 - DNA, 22 bp, Artificial Sequence
  chemically synthesized
atgacatgtgttactgagtata

SEQ ID NO: 82816 - DNA, 22 bp, Artificial Sequence
  chemically synthesized
ctgagtatattttcatgtgctt

SEQ ID NO: 82817 - DNA, 22 bp, Artificial Sequence
  chemically synthesized
agtatattttcatgtgcttatt

SEQ ID NO: 82818 - DNA, 22 bp, Artificial Sequence
  chemically synthesized
tcatgtgcttattgcaatctat

SEQ ID NO: 82819 - DNA, 22 bp, Artificial Sequence
  chemically synthesized
catgtgcttattgcaatctata

SEQ ID NO: 82820 - DNA, 22 bp, Artificial Sequence
  chemically synthesized
atgtgcttattgcaatctatat

SEQ ID NO: 82821 - DNA, 22 bp, Artificial Sequence
  chemically synthesized
attgcaatctatatatcttctt

SEQ ID NO: 82822 - DNA, 22 bp, Artificial Sequence
  chemically synthesized
ttgcaatctatatatcttcttt

SEQ ID NO: 82823 - DNA, 22 bp, Artificial Sequence
  chemically synthesized
caatctatatatcttctttggt

SEQ ID NO: 82824 - DNA, 22 bp, Artificial Sequence
  chemically synthesized
tatatcttctttggtaaagtgt

SEQ ID NO: 82825 - DNA, 22 bp, Artificial Sequence
  chemically synthesized
ctttggtaaagtgtctgttcag

SEQ ID NO: 82826 - DNA, 22 bp, Artificial Sequence
  chemically synthesized
tttggtaaagtgtctgttcaga

SEQ ID NO: 82827 - DNA, 22 bp, Artificial Sequence
  chemically synthesized
tggtaaagtgtctgttcagatc

SEQ ID NO: 82828 - DNA, 22 bp, Artificial Sequence
  chemically synthesized
ggtaaagtgtctgttcagatct

SEQ ID NO: 82829 - DNA, 22 bp, Artificial Sequence
  chemically synthesized
gtaaagtgtctgttcagatctt

SEQ ID NO: 82830 - DNA, 22 bp, Artificial Sequence
  chemically synthesized
ttcagatcttttgcccactttg

SEQ ID NO: 82831 - DNA, 22 bp, Artificial Sequence
  chemically synthesized
agatcttttgcccactttgcaa

SEQ ID NO: 82832 - DNA, 22 bp, Artificial Sequence
  chemically synthesized
ttgcccactttgcaattggatt

SEQ ID NO: 82833 - DNA, 22 bp, Artificial Sequence
  chemically synthesized
tgcccactttgcaattggattg

SEQ ID NO: 82834 - DNA, 22 bp, Artificial Sequence
  chemically synthesized
gcccactttgcaattggattgt

SEQ ID NO: 82835 - DNA, 22 bp, Artificial Sequence
  chemically synthesized
cccactttgcaattggattgtt

SEQ ID NO: 82836 - DNA, 22 bp, Artificial Sequence
  chemically synthesized
tgcaattggattgtttgttttt

SEQ ID NO: 82837 - DNA, 22 bp, Artificial Sequence
  chemically synthesized
gcaattggattgtttgtttttt

SEQ ID NO: 82838 - DNA, 22 bp, Artificial Sequence
  chemically synthesized
caattggattgtttgtttttta

SEQ ID NO: 82839 - DNA, 22 bp, Artificial Sequence
  chemically synthesized
gattgtttgttttttattgtag

SEQ ID NO: 82840 - DNA, 22 bp, Artificial Sequence
  chemically synthesized
tttgttttttattgtagaattt

SEQ ID NO: 82841 - DNA, 22 bp, Artificial Sequence
  chemically synthesized
gttttttattgtagaattttaa

SEQ ID NO: 82842 - DNA, 22 bp, Artificial Sequence
  chemically synthesized
ttttttattgtagaattttaaa

SEQ ID NO: 82843 - DNA, 22 bp, Artificial Sequence
  chemically synthesized
tttattgtagaattttaaaagt

SEQ ID NO: 82844 - DNA, 22 bp, Artificial Sequence
  chemically synthesized
ttattgtagaattttaaaagtt

SEQ ID NO: 82845 - DNA, 22 bp, Artificial Sequence
  chemically synthesized
tattgtagaattttaaaagttc

SEQ ID NO: 82846 - DNA, 22 bp, Artificial Sequence
  chemically synthesized
attgtagaattttaaaagttct

SEQ ID NO: 82847 - DNA, 22 bp, Artificial Sequence
  chemically synthesized
ttgtagaattttaaaagttctt

SEQ ID NO: 82848 - DNA, 22 bp, Artificial Sequence
  chemically synthesized
tagaattttaaaagttctttgt

SEQ ID NO: 82849 - DNA, 22 bp, Artificial Sequence
  chemically synthesized
taaaagttctttgtataatatg

SEQ ID NO: 82850 - DNA, 22 bp, Artificial Sequence
  chemically synthesized
aaaagttctttgtataatatgt

SEQ ID NO: 82851 - DNA, 22 bp, Artificial Sequence
  chemically synthesized
aaagttctttgtataatatgta

SEQ ID NO: 82852 - DNA, 22 bp, Artificial Sequence
  chemically synthesized
tttgtataatatgtatacaagt

SEQ ID NO: 82853 - DNA, 22 bp, Artificial Sequence
  chemically synthesized
tgtataatatgtatacaagtcc

SEQ ID NO: 82854 - DNA, 22 bp, Artificial Sequence
  chemically synthesized
gtataatatgtatacaagtcct

SEQ ID NO: 82855 - DNA, 22 bp, Artificial Sequence
  chemically synthesized
tataatatgtatacaagtcctt

SEQ ID NO: 82856 - DNA, 22 bp, Artificial Sequence
  chemically synthesized
tatcagataatatgttttgcaa

SEQ ID NO: 82857 - DNA, 22 bp, Artificial Sequence
  chemically synthesized
atcagataatatgttttgcaaa

SEQ ID NO: 82858 - DNA, 22 bp, Artificial Sequence
  chemically synthesized
tcagataatatgttttgcaaat

SEQ ID NO: 82859 - DNA, 22 bp, Artificial Sequence
  chemically synthesized
tgcaaatatgttctctgtggct

SEQ ID NO: 82860 - DNA, 22 bp, Artificial Sequence
  chemically synthesized
gcaaatatgttctctgtggctt

SEQ ID NO: 82861 - DNA, 22 bp, Artificial Sequence
  chemically synthesized
caaatatgttctctgtggcttg

SEQ ID NO: 82862 - DNA, 22 bp, Artificial Sequence
  chemically synthesized
tctgtggcttgtttttttcatt

SEQ ID NO: 82863 - DNA, 22 bp, Artificial Sequence
  chemically synthesized
tgtggcttgtttttttcattct

SEQ ID NO: 82864 - DNA, 22 bp, Artificial Sequence
  chemically synthesized
tggcttgtttttttcattctct

SEQ ID NO: 82865 - DNA, 22 bp, Artificial Sequence
  chemically synthesized
gtttttttcattctcttaactt

SEQ ID NO: 82866 - DNA, 22 bp, Artificial Sequence
  chemically synthesized
tttttttcattctcttaactta

SEQ ID NO: 82867 - DNA, 22 bp, Artificial Sequence
  chemically synthesized
ttttcattctcttaacttacca

SEQ ID NO: 82868 - DNA, 22 bp, Artificial Sequence
  chemically synthesized
tttcattctcttaacttaccat

SEQ ID NO: 82869 - DNA, 22 bp, Artificial Sequence
  chemically synthesized
ttcattctcttaacttaccatg

SEQ ID NO: 82870 - DNA, 22 bp, Artificial Sequence
  chemically synthesized
tcattctcttaacttaccatga

SEQ ID NO: 82871 - DNA, 22 bp, Artificial Sequence
  chemically synthesized
cattctcttaacttaccatgaa

SEQ ID NO: 82872 - DNA, 22 bp, Artificial Sequence
  chemically synthesized
attctcttaacttaccatgaat

SEQ ID NO: 82873 - DNA, 22 bp, Artificial Sequence
  chemically synthesized
tcttaacttaccatgaattttt

SEQ ID NO: 82874 - DNA, 22 bp, Artificial Sequence
  chemically synthesized
ttaacttaccatgaatttttat

SEQ ID NO: 82875 - DNA, 22 bp, Artificial Sequence
  chemically synthesized
aacttaccatgaatttttattt

SEQ ID NO: 82876 - DNA, 22 bp, Artificial Sequence
  chemically synthesized
acttaccatgaatttttatttt

SEQ ID NO: 82877 - DNA, 22 bp, Artificial Sequence
  chemically synthesized
accatgaatttttattttattt

SEQ ID NO: 82878 - DNA, 22 bp, Artificial Sequence
  chemically synthesized
ccatgaatttttattttatttt

SEQ ID NO: 82879 - DNA, 22 bp, Artificial Sequence
  chemically synthesized
ttattttattttattttgttct

SEQ ID NO: 82880 - DNA, 22 bp, Artificial Sequence
  chemically synthesized
tattttattttattttgttctg

SEQ ID NO: 82881 - DNA, 22 bp, Artificial Sequence
  chemically synthesized
attttattttattttgttctgg

SEQ ID NO: 82882 - DNA, 22 bp, Artificial Sequence
  chemically synthesized
ttttattttattttgttctggg

SEQ ID NO: 82883 - DNA, 22 bp, Artificial Sequence
  chemically synthesized
tattttattttgttctgggtat

SEQ ID NO: 82884 - DNA, 22 bp, Artificial Sequence
  chemically synthesized
attttattttgttctgggtatt

SEQ ID NO: 82885 - DNA, 22 bp, Artificial Sequence
  chemically synthesized
ttttattttgttctgggtattt

SEQ ID NO: 82886 - DNA, 22 bp, Artificial Sequence
  chemically synthesized
tattttgttctgggtattttgt

SEQ ID NO: 82887 - DNA, 22 bp, Artificial Sequence
  chemically synthesized
attttgttctgggtattttgtg

SEQ ID NO: 82888 - DNA, 22 bp, Artificial Sequence
  chemically synthesized
ttttgttctgggtattttgtgg

SEQ ID NO: 82889 - DNA, 22 bp, Artificial Sequence
  chemically synthesized
tgttctgggtattttgtggata

SEQ ID NO: 82890 - DNA, 22 bp, Artificial Sequence
  chemically synthesized
gttctgggtattttgtggatac

SEQ ID NO: 82891 - DNA, 22 bp, Artificial Sequence
  chemically synthesized
ttctgggtattttgtggatact

SEQ ID NO: 82892 - DNA, 22 bp, Artificial Sequence
  chemically synthesized
tgggtattttgtggatactctc

SEQ ID NO: 82893 - DNA, 22 bp, Artificial Sequence
  chemically synthesized
ggtattttgtggatactctcaa

SEQ ID NO: 82894 - DNA, 22 bp, Artificial Sequence
  chemically synthesized
tgtggatactctcaatttcaac

SEQ ID NO: 82895 - DNA, 22 bp, Artificial Sequence
  chemically synthesized
gtggatactctcaatttcaact

SEQ ID NO: 82896 - DNA, 22 bp, Artificial Sequence
  chemically synthesized
tggatactctcaatttcaactg

SEQ ID NO: 82897 - DNA, 22 bp, Artificial Sequence
  chemically synthesized
tcaatttcaactgctgtgttct

SEQ ID NO: 82898 - DNA, 22 bp, Artificial Sequence
  chemically synthesized
aatttcaactgctgtgttcttt

SEQ ID NO: 82899 - DNA, 22 bp, Artificial Sequence
  chemically synthesized
caactgctgtgttcttttgttc

SEQ ID NO: 82900 - DNA, 22 bp, Artificial Sequence
  chemically synthesized
aactgctgtgttcttttgttca

SEQ ID NO: 82901 - DNA, 22 bp, Artificial Sequence
  chemically synthesized
ctgtgttcttttgttcagaaaa

SEQ ID NO: 82902 - DNA, 22 bp, Artificial Sequence
  chemically synthesized
tgttcttttgttcagaaaattg

SEQ ID NO: 82903 - DNA, 22 bp, Artificial Sequence
  chemically synthesized
ttttgttcagaaaattgtcttg

SEQ ID NO: 82904 - DNA, 22 bp, Artificial Sequence
  chemically synthesized
ttgttcagaaaattgtcttgta

SEQ ID NO: 82905 - DNA, 22 bp, Artificial Sequence
  chemically synthesized
tgttcagaaaattgtcttgtat

SEQ ID NO: 82906 - DNA, 22 bp, Artificial Sequence
  chemically synthesized
gttcagaaaattgtcttgtatt

SEQ ID NO: 82907 - DNA, 22 bp, Artificial Sequence
  chemically synthesized
ttcagaaaattgtcttgtattg

SEQ ID NO: 82908 - DNA, 22 bp, Artificial Sequence
  chemically synthesized
agaaaattgtcttgtattgatc

SEQ ID NO: 82909 - DNA, 22 bp, Artificial Sequence
  chemically synthesized
tcttgtattgatctctagtaag

SEQ ID NO: 82910 - DNA, 22 bp, Artificial Sequence
  chemically synthesized
gtattgatctctagtaagttcc

SEQ ID NO: 82911 - DNA, 22 bp, Artificial Sequence
  chemically synthesized
tattgatctctagtaagttcct

SEQ ID NO: 82912 - DNA, 22 bp, Artificial Sequence
  chemically synthesized
atctctagtaagttccttctac

SEQ ID NO: 82913 - DNA, 22 bp, Artificial Sequence
  chemically synthesized
tagtaagttccttctacatgtt

SEQ ID NO: 82914 - DNA, 22 bp, Artificial Sequence
  chemically synthesized
gtaagttccttctacatgttct

SEQ ID NO: 82915 - DNA, 22 bp, Artificial Sequence
  chemically synthesized
cttctacatgttctattttcac

SEQ ID NO: 82916 - DNA, 22 bp, Artificial Sequence
  chemically synthesized
ctacatgttctattttcactct

SEQ ID NO: 82917 - DNA, 22 bp, Artificial Sequence
  chemically synthesized
tacatgttctattttcactctc

SEQ ID NO: 82918 - DNA, 22 bp, Artificial Sequence
  chemically synthesized
catgttctattttcactctctc

SEQ ID NO: 82919 - DNA, 22 bp, Artificial Sequence
  chemically synthesized
tattttcactctctcctgaact

SEQ ID NO: 82920 - DNA, 22 bp, Artificial Sequence
  chemically synthesized
ttttcactctctcctgaactcc

SEQ ID NO: 82921 - DNA, 22 bp, Artificial Sequence
  chemically synthesized
tcactctctcctgaactccagt

SEQ ID NO: 82922 - DNA, 22 bp, Artificial Sequence
  chemically synthesized
cactctctcctgaactccagtt

SEQ ID NO: 82923 - DNA, 22 bp, Artificial Sequence
  chemically synthesized
actctctcctgaactccagtta

SEQ ID NO: 82924 - DNA, 22 bp, Artificial Sequence
  chemically synthesized
tctcctgaactccagttaagat

SEQ ID NO: 82925 - DNA, 22 bp, Artificial Sequence
  chemically synthesized
tcctgaactccagttaagattt

SEQ ID NO: 82926 - DNA, 22 bp, Artificial Sequence
  chemically synthesized
ctgaactccagttaagattttg

SEQ ID NO: 82927 - DNA, 22 bp, Artificial Sequence
  chemically synthesized
aactccagttaagattttggag

SEQ ID NO: 82928 - DNA, 22 bp, Artificial Sequence
  chemically synthesized
cagttaagattttggagttcct

SEQ ID NO: 82929 - DNA, 22 bp, Artificial Sequence
  chemically synthesized
agattttggagttcctgacttc

SEQ ID NO: 82930 - DNA, 22 bp, Artificial Sequence
  chemically synthesized
tggagttcctgacttcacccta

SEQ ID NO: 82931 - DNA, 22 bp, Artificial Sequence
  chemically synthesized
ggagttcctgacttcaccctat

SEQ ID NO: 82932 - DNA, 22 bp, Artificial Sequence
  chemically synthesized
gagttcctgacttcaccctatt

SEQ ID NO: 82933 - DNA, 22 bp, Artificial Sequence
  chemically synthesized
ctgacttcaccctattttttcc

SEQ ID NO: 82934 - DNA, 22 bp, Artificial Sequence
  chemically synthesized
acttcaccctattttttcctcc

SEQ ID NO: 82935 - DNA, 22 bp, Artificial Sequence
  chemically synthesized
caccctattttttcctccatgc

SEQ ID NO: 82936 - DNA, 22 bp, Artificial Sequence
  chemically synthesized
accctattttttcctccatgcc

SEQ ID NO: 82937 - DNA, 22 bp, Artificial Sequence
  chemically synthesized
ttttttcctccatgccccccat

SEQ ID NO: 82938 - DNA, 22 bp, Artificial Sequence
  chemically synthesized
tttcctccatgccccccatatt

SEQ ID NO: 82939 - DNA, 22 bp, Artificial Sequence
  chemically synthesized
ttcctccatgccccccatattt

SEQ ID NO: 82940 - DNA, 22 bp, Artificial Sequence
  chemically synthesized
tcctccatgccccccatattta

SEQ ID NO: 82941 - DNA, 22 bp, Artificial Sequence
  chemically synthesized
cctccatgccccccatatttat

SEQ ID NO: 82942 - DNA, 22 bp, Artificial Sequence
  chemically synthesized
ctccatgccccccatatttatt

SEQ ID NO: 82943 - DNA, 22 bp, Artificial Sequence
  chemically synthesized
catgccccccatatttattcct

SEQ ID NO: 82944 - DNA, 22 bp, Artificial Sequence
  chemically synthesized
attcctttgtcctttttttctg

SEQ ID NO: 82945 - DNA, 22 bp, Artificial Sequence
  chemically synthesized
ttcctttgtcctttttttctgc

SEQ ID NO: 82946 - DNA, 22 bp, Artificial Sequence
  chemically synthesized
ctttgtcctttttttctgcact

SEQ ID NO: 82947 - DNA, 22 bp, Artificial Sequence
  chemically synthesized
tgtcctttttttctgcactctt

SEQ ID NO: 82948 - DNA, 22 bp, Artificial Sequence
  chemically synthesized
gtcctttttttctgcactctta

SEQ ID NO: 82949 - DNA, 22 bp, Artificial Sequence
  chemically synthesized
tcctttttttctgcactcttaa

SEQ ID NO: 82950 - DNA, 22 bp, Artificial Sequence
  chemically synthesized
tttttctgcactcttaaatcta

SEQ ID NO: 82951 - DNA, 22 bp, Artificial Sequence
  chemically synthesized
ttttctgcactcttaaatctac

SEQ ID NO: 82952 - DNA, 22 bp, Artificial Sequence
  chemically synthesized
tttctgcactcttaaatctact

SEQ ID NO: 82953 - DNA, 22 bp, Artificial Sequence
  chemically synthesized
ttctgcactcttaaatctactt

SEQ ID NO: 82954 - DNA, 22 bp, Artificial Sequence
  chemically synthesized
tctgcactcttaaatctacttc

SEQ ID NO: 82955 - DNA, 22 bp, Artificial Sequence
  chemically synthesized
ctgcactcttaaatctacttcc

SEQ ID NO: 82956 - DNA, 22 bp, Artificial Sequence
  chemically synthesized
tgcactcttaaatctacttcct

SEQ ID NO: 82957 - DNA, 22 bp, Artificial Sequence
  chemically synthesized
cactcttaaatctacttcctgt

SEQ ID NO: 82958 - DNA, 22 bp, Artificial Sequence
  chemically synthesized
ttaaatctacttcctgtccccc

SEQ ID NO: 82959 - DNA, 22 bp, Artificial Sequence
  chemically synthesized
aaatctacttcctgtccccctt

SEQ ID NO: 82960 - DNA, 22 bp, Artificial Sequence
  chemically synthesized
aatctacttcctgtccccctta

SEQ ID NO: 82961 - DNA, 22 bp, Artificial Sequence
  chemically synthesized
cttcctgtcccccttattggct

SEQ ID NO: 82962 - DNA, 22 bp, Artificial Sequence
  chemically synthesized
cctgtcccccttattggctact

SEQ ID NO: 82963 - DNA, 22 bp, Artificial Sequence
  chemically synthesized
ctgtcccccttattggctactt

SEQ ID NO: 82964 - DNA, 22 bp, Artificial Sequence
  chemically synthesized
tcccccttattggctacttcat

SEQ ID NO: 82965 - DNA, 22 bp, Artificial Sequence
  chemically synthesized
attggctacttcatctcatctc

SEQ ID NO: 82966 - DNA, 22 bp, Artificial Sequence
  chemically synthesized
ttggctacttcatctcatctct

SEQ ID NO: 82967 - DNA, 22 bp, Artificial Sequence
  chemically synthesized
gctacttcatctcatctctcat

SEQ ID NO: 82968 - DNA, 22 bp, Artificial Sequence
  chemically synthesized
cttcatctcatctctcatattt

SEQ ID NO: 82969 - DNA, 22 bp, Artificial Sequence
  chemically synthesized
catctcatctctcatatttttg

SEQ ID NO: 82970 - DNA, 22 bp, Artificial Sequence
  chemically synthesized
atctcatctctcatatttttgc

SEQ ID NO: 82971 - DNA, 22 bp, Artificial Sequence
  chemically synthesized
atctctcatatttttgctttat

SEQ ID NO: 82972 - DNA, 22 bp, Artificial Sequence
  chemically synthesized
tcatatttttgctttatttact

SEQ ID NO: 82973 - DNA, 22 bp, Artificial Sequence
  chemically synthesized
atatttttgctttatttactat

SEQ ID NO: 82974 - DNA, 22 bp, Artificial Sequence
  chemically synthesized
ttgctttatttactatttatca

SEQ ID NO: 82975 - DNA, 22 bp, Artificial Sequence
  chemically synthesized
tgctttatttactatttatcat

SEQ ID NO: 82976 - DNA, 22 bp, Artificial Sequence
  chemically synthesized
gctttatttactatttatcatg

SEQ ID NO: 82977 - DNA, 22 bp, Artificial Sequence
  chemically synthesized
ctttatttactatttatcatgc

SEQ ID NO: 82978 - DNA, 22 bp, Artificial Sequence
  chemically synthesized
tatttactatttatcatgccct

SEQ ID NO: 82979 - DNA, 22 bp, Artificial Sequence
  chemically synthesized
atttactatttatcatgccctc

SEQ ID NO: 82980 - DNA, 22 bp, Artificial Sequence
  chemically synthesized
tttactatttatcatgccctct

SEQ ID NO: 82981 - DNA, 22 bp, Artificial Sequence
  chemically synthesized
actatttatcatgccctctatt

SEQ ID NO: 82982 - DNA, 22 bp, Artificial Sequence
  chemically synthesized
ctatttatcatgccctctattt

SEQ ID NO: 82983 - DNA, 22 bp, Artificial Sequence
  chemically synthesized
tttatcatgccctctatttttt

SEQ ID NO: 82984 - DNA, 22 bp, Artificial Sequence
  chemically synthesized
atcatgccctctattttttata

SEQ ID NO: 82985 - DNA, 22 bp, Artificial Sequence
  chemically synthesized
tcatgccctctattttttatac

SEQ ID NO: 82986 - DNA, 22 bp, Artificial Sequence
  chemically synthesized
tattttttatactattctgttc

SEQ ID NO: 82987 - DNA, 22 bp, Artificial Sequence
  chemically synthesized
ttttttatactattctgttcaa

SEQ ID NO: 82988 - DNA, 22 bp, Artificial Sequence
  chemically synthesized
tttatactattctgttcaaata

SEQ ID NO: 82989 - DNA, 22 bp, Artificial Sequence
  chemically synthesized
ttatactattctgttcaaatat

SEQ ID NO: 82990 - DNA, 22 bp, Artificial Sequence
  chemically synthesized
tatactattctgttcaaatatc

SEQ ID NO: 82991 - DNA, 22 bp, Artificial Sequence
  chemically synthesized
atactattctgttcaaatatca

SEQ ID NO: 82992 - DNA, 22 bp, Artificial Sequence
  chemically synthesized
tactattctgttcaaatatcaa

SEQ ID NO: 82993 - DNA, 22 bp, Artificial Sequence
  chemically synthesized
ttctgttcaaatatcaaggatc

SEQ ID NO: 82994 - DNA, 22 bp, Artificial Sequence
  chemically synthesized
tgttcaaatatcaaggatctaa

SEQ ID NO: 82995 - DNA, 22 bp, Artificial Sequence
  chemically synthesized
ttcaaatatcaaggatctaaaa

SEQ ID NO: 82996 - DNA, 22 bp, Artificial Sequence
  chemically synthesized
aaatatcaaggatctaaaatga

SEQ ID NO: 82997 - DNA, 22 bp, Artificial Sequence
  chemically synthesized
aaatgagtggttatttaattaa

SEQ ID NO: 82998 - DNA, 22 bp, Artificial Sequence
  chemically synthesized
tttaattaagaatatttattat

SEQ ID NO: 82999 - DNA, 22 bp, Artificial Sequence
  chemically synthesized
aattaagaatatttattatgca

SEQ ID NO: 83000 - DNA, 22 bp, Artificial Sequence
  chemically synthesized
attaagaatatttattatgcac

SEQ ID NO: 83001 - DNA, 22 bp, Artificial Sequence
  chemically synthesized
agaatatttattatgcacctct

SEQ ID NO: 83002 - DNA, 22 bp, Artificial Sequence
  chemically synthesized
attatgcacctcttttattatt

SEQ ID NO: 83003 - DNA, 22 bp, Artificial Sequence
  chemically synthesized
ttatgcacctcttttattatta

SEQ ID NO: 83004 - DNA, 22 bp, Artificial Sequence
  chemically synthesized
tgcacctcttttattattagct

SEQ ID NO: 83005 - DNA, 22 bp, Artificial Sequence
  chemically synthesized
ttttattattagcttttatttt

SEQ ID NO: 83006 - DNA, 22 bp, Artificial Sequence
  chemically synthesized
ttattattagcttttattttct

SEQ ID NO: 83007 - DNA, 22 bp, Artificial Sequence
  chemically synthesized
tattattagcttttattttctg

SEQ ID NO: 83008 - DNA, 22 bp, Artificial Sequence
  chemically synthesized
attattagcttttattttctgc

SEQ ID NO: 83009 - DNA, 22 bp, Artificial Sequence
  chemically synthesized
ttattagcttttattttctgcc

SEQ ID NO: 83010 - DNA, 22 bp, Artificial Sequence
  chemically synthesized
ttagcttttattttctgccctg

SEQ ID NO: 83011 - DNA, 22 bp, Artificial Sequence
  chemically synthesized
gcttttattttctgccctgaat

SEQ ID NO: 83012 - DNA, 22 bp, Artificial Sequence
  chemically synthesized
ttattttctgccctgaataagc

SEQ ID NO: 83013 - DNA, 22 bp, Artificial Sequence
  chemically synthesized
tattttctgccctgaataagct

SEQ ID NO: 83014 - DNA, 22 bp, Artificial Sequence
  chemically synthesized
attttctgccctgaataagctg

SEQ ID NO: 83015 - DNA, 22 bp, Artificial Sequence
  chemically synthesized
ttttctgccctgaataagctgt

SEQ ID NO: 83016 - DNA, 22 bp, Artificial Sequence
  chemically synthesized
tctgccctgaataagctgtgct

SEQ ID NO: 83017 - DNA, 22 bp, Artificial Sequence
  chemically synthesized
ctgccctgaataagctgtgctc

SEQ ID NO: 83018 - DNA, 22 bp, Artificial Sequence
  chemically synthesized
tgccctgaataagctgtgctcc

SEQ ID NO: 83019 - DNA, 22 bp, Artificial Sequence
  chemically synthesized
ccctgaataagctgtgctccaa

SEQ ID NO: 83020 - DNA, 22 bp, Artificial Sequence
  chemically synthesized
aataagctgtgctccaaataag

SEQ ID NO: 83021 - DNA, 22 bp, Artificial Sequence
  chemically synthesized
tgctccaaataagttttcttta

SEQ ID NO: 83022 - DNA, 22 bp, Artificial Sequence
  chemically synthesized
caaataagttttctttattaaa

SEQ ID NO: 83023 - DNA, 22 bp, Artificial Sequence
  chemically synthesized
tctttattaaaattgattctag

SEQ ID NO: 83024 - DNA, 22 bp, Artificial Sequence
  chemically synthesized
ctttattaaaattgattctagg

SEQ ID NO: 83025 - DNA, 22 bp, Artificial Sequence
  chemically synthesized
tttattaaaattgattctaggt

SEQ ID NO: 83026 - DNA, 22 bp, Artificial Sequence
  chemically synthesized
tattaaaattgattctaggtat

SEQ ID NO: 83027 - DNA, 22 bp, Artificial Sequence
  chemically synthesized
attaaaattgattctaggtatg

SEQ ID NO: 83028 - DNA, 22 bp, Artificial Sequence
  chemically synthesized
ttaaaattgattctaggtatgt

SEQ ID NO: 83029 - DNA, 22 bp, Artificial Sequence
  chemically synthesized
aaattgattctaggtatgtaat

SEQ ID NO: 83030 - DNA, 22 bp, Artificial Sequence
  chemically synthesized
attctaggtatgtaatttttgt

SEQ ID NO: 83031 - DNA, 22 bp, Artificial Sequence
  chemically synthesized
taggtatgtaatttttgtgttg

SEQ ID NO: 83032 - DNA, 22 bp, Artificial Sequence
  chemically synthesized
ggtatgtaatttttgtgttggt

SEQ ID NO: 83033 - DNA, 22 bp, Artificial Sequence
  chemically synthesized
ttgtgttggtggacttaattgc

SEQ ID NO: 83034 - DNA, 22 bp, Artificial Sequence
  chemically synthesized
tgtgttggtggacttaattgca

SEQ ID NO: 83035 - DNA, 22 bp, Artificial Sequence
  chemically synthesized
gtgttggtggacttaattgcat

SEQ ID NO: 83036 - DNA, 22 bp, Artificial Sequence
  chemically synthesized
tgttggtggacttaattgcatt

SEQ ID NO: 83037 - DNA, 22 bp, Artificial Sequence
  chemically synthesized
gtggacttaattgcattcctga

SEQ ID NO: 83038 - DNA, 22 bp, Artificial Sequence
  chemically synthesized
aattgcattcctgataatcttt

SEQ ID NO: 83039 - DNA, 22 bp, Artificial Sequence
  chemically synthesized
attgcattcctgataatctttg

SEQ ID NO: 83040 - DNA, 22 bp, Artificial Sequence
  chemically synthesized
cattcctgataatctttgtcca

SEQ ID NO: 83041 - DNA, 22 bp, Artificial Sequence
  chemically synthesized
ctgataatctttgtccatcctt

SEQ ID NO: 83042 - DNA, 22 bp, Artificial Sequence
  chemically synthesized
ataatctttgtccatccttctg

SEQ ID NO: 83043 - DNA, 22 bp, Artificial Sequence
  chemically synthesized
tgtccatccttctgtgtccgga

SEQ ID NO: 83044 - DNA, 22 bp, Artificial Sequence
  chemically synthesized
gtccatccttctgtgtccggaa

SEQ ID NO: 83045 - DNA, 22 bp, Artificial Sequence
  chemically synthesized
tccatccttctgtgtccggaat

SEQ ID NO: 83046 - DNA, 22 bp, Artificial Sequence
  chemically synthesized
ctgtgtccggaattggtgggtt

SEQ ID NO: 83047 - DNA, 22 bp, Artificial Sequence
  chemically synthesized
tgtgtccggaattggtgggttc

SEQ ID NO: 83048 - DNA, 22 bp, Artificial Sequence
  chemically synthesized
tgtccggaattggtgggttctt

SEQ ID NO: 83049 - DNA, 22 bp, Artificial Sequence
  chemically synthesized
gtgggttcttggtctcgctgac

SEQ ID NO: 83050 - DNA, 22 bp, Artificial Sequence
  chemically synthesized
ttggtctcgctgacttaaagaa

SEQ ID NO: 83051 - DNA, 22 bp, Artificial Sequence
  chemically synthesized
ggtctcgctgacttaaagaatg

SEQ ID NO: 83052 - DNA, 22 bp, Artificial Sequence
  chemically synthesized
gtctcgctgacttaaagaatga

SEQ ID NO: 83053 - DNA, 22 bp, Artificial Sequence
  chemically synthesized
gctgacttaaagaatgaagccg

SEQ ID NO: 83054 - DNA, 22 bp, Artificial Sequence
  chemically synthesized
acttaaagaatgaagccgcgaa

SEQ ID NO: 83055 - DNA, 22 bp, Artificial Sequence
  chemically synthesized
aaagaatgaagccgcgaaccct

SEQ ID NO: 83056 - DNA, 22 bp, Artificial Sequence
  chemically synthesized
aagaatgaagccgcgaaccctc

SEQ ID NO: 83057 - DNA, 22 bp, Artificial Sequence
  chemically synthesized
gtggtgagtgttacaattctta

SEQ ID NO: 83058 - DNA, 22 bp, Artificial Sequence
  chemically synthesized
caattcttaaagatggtgtgtt

SEQ ID NO: 83059 - DNA, 22 bp, Artificial Sequence
  chemically synthesized
ttaaagatggtgtgttcaaagg

SEQ ID NO: 83060 - DNA, 22 bp, Artificial Sequence
  chemically synthesized
aaagatggtgtgttcaaaggat

SEQ ID NO: 83061 - DNA, 22 bp, Artificial Sequence
  chemically synthesized
aagatggtgtgttcaaaggatg

SEQ ID NO: 83062 - DNA, 22 bp, Artificial Sequence
  chemically synthesized
aaaggatggtgtgtccaaagtt

SEQ ID NO: 83063 - DNA, 22 bp, Artificial Sequence
  chemically synthesized
gttacttcagatgtgtccagag

SEQ ID NO: 83064 - DNA, 22 bp, Artificial Sequence
  chemically synthesized
ttacttcagatgtgtccagagt

SEQ ID NO: 83065 - DNA, 22 bp, Artificial Sequence
  chemically synthesized
cttcagatgtgtccagagtttc

SEQ ID NO: 83066 - DNA, 22 bp, Artificial Sequence
  chemically synthesized
cagatgtgtccagagtttcttc

SEQ ID NO: 83067 - DNA, 22 bp, Artificial Sequence
  chemically synthesized
agatgtgtccagagtttcttcc

SEQ ID NO: 83068 - DNA, 22 bp, Artificial Sequence
  chemically synthesized
cttccttctggtgtgttcacgg

SEQ ID NO: 83069 - DNA, 22 bp, Artificial Sequence
  chemically synthesized
ttccttctggtgtgttcacggt

SEQ ID NO: 83070 - DNA, 22 bp, Artificial Sequence
  chemically synthesized
ccttctggtgtgttcacggtct

SEQ ID NO: 83071 - DNA, 22 bp, Artificial Sequence
  chemically synthesized
cttctggtgtgttcacggtctt

SEQ ID NO: 83072 - DNA, 22 bp, Artificial Sequence
  chemically synthesized
ctggtgtgttcacggtcttgct

SEQ ID NO: 83073 - DNA, 22 bp, Artificial Sequence
  chemically synthesized
tggtgtgttcacggtcttgctg

SEQ ID NO: 83074 - DNA, 22 bp, Artificial Sequence
  chemically synthesized
gtgtgttcacggtcttgctggc

SEQ ID NO: 83075 - DNA, 22 bp, Artificial Sequence
  chemically synthesized
acggtcttgctggctccaggag

SEQ ID NO: 83076 - DNA, 22 bp, Artificial Sequence
  chemically synthesized
gctggctccaggagtgaagctg

SEQ ID NO: 83077 - DNA, 22 bp, Artificial Sequence
  chemically synthesized
ctggctccaggagtgaagctgc

SEQ ID NO: 83078 - DNA, 22 bp, Artificial Sequence
  chemically synthesized
gctccaggagtgaagctgcaga

SEQ ID NO: 83079 - DNA, 22 bp, Artificial Sequence
  chemically synthesized
caggagtgaagctgcagacccc

SEQ ID NO: 83080 - DNA, 22 bp, Artificial Sequence
  chemically synthesized
cagacccccacggggagtgtta

SEQ ID NO: 83081 - DNA, 22 bp, Artificial Sequence
  chemically synthesized
cagctcttaaaggcggagcgta

SEQ ID NO: 83082 - DNA, 22 bp, Artificial Sequence
  chemically synthesized
ttaaaggcggagcgtatggagt

SEQ ID NO: 83083 - DNA, 22 bp, Artificial Sequence
  chemically synthesized
aaaggcggagcgtatggagttg

SEQ ID NO: 83084 - DNA, 22 bp, Artificial Sequence
  chemically synthesized
aaggcggagcgtatggagttgc

SEQ ID NO: 83085 - DNA, 22 bp, Artificial Sequence
  chemically synthesized
ctcattcctcctgtcttgggtt

SEQ ID NO: 83086 - DNA, 22 bp, Artificial Sequence
  chemically synthesized
attcctcctgtcttgggttgtt

SEQ ID NO: 83087 - DNA, 22 bp, Artificial Sequence
  chemically synthesized
ctcctgtcttgggttgttcatc

SEQ ID NO: 83088 - DNA, 22 bp, Artificial Sequence
  chemically synthesized
ctgtcttgggttgttcatcccc

SEQ ID NO: 83089 - DNA, 22 bp, Artificial Sequence
  chemically synthesized
tcttgggttgttcatcccccat

SEQ ID NO: 83090 - DNA, 22 bp, Artificial Sequence
  chemically synthesized
gggttgttcatcccccatgctg

SEQ ID NO: 83091 - DNA, 22 bp, Artificial Sequence
  chemically synthesized
ggttgttcatcccccatgctgg

SEQ ID NO: 83092 - DNA, 22 bp, Artificial Sequence
  chemically synthesized
ttcatcccccatgctgggttcg

SEQ ID NO: 83093 - DNA, 22 bp, Artificial Sequence
  chemically synthesized
atcccccatgctgggttcgtgg

SEQ ID NO: 83094 - DNA, 22 bp, Artificial Sequence
  chemically synthesized
ggttcgtggtcttgctggcttc

SEQ ID NO: 83095 - DNA, 22 bp, Artificial Sequence
  chemically synthesized
gtggtcttgctggcttcagaag

SEQ ID NO: 83096 - DNA, 22 bp, Artificial Sequence
  chemically synthesized
gctggcttcagaagtgaagccg

SEQ ID NO: 83097 - DNA, 22 bp, Artificial Sequence
  chemically synthesized
ctggcttcagaagtgaagccgc

SEQ ID NO: 83098 - DNA, 22 bp, Artificial Sequence
  chemically synthesized
gcttcagaagtgaagccgcaga

SEQ ID NO: 83099 - DNA, 22 bp, Artificial Sequence
  chemically synthesized
cagaagtgaagccgcagacctt

SEQ ID NO: 83100 - DNA, 22 bp, Artificial Sequence
  chemically synthesized
agaagtgaagccgcagaccttc

SEQ ID NO: 83101 - DNA, 22 bp, Artificial Sequence
  chemically synthesized
cgcagtgagtgttacagctcat

SEQ ID NO: 83102 - DNA, 22 bp, Artificial Sequence
  chemically synthesized
gcagtgagtgttacagctcata

SEQ ID NO: 83103 - DNA, 22 bp, Artificial Sequence
  chemically synthesized
cagctcataaaggcagcgcgga

SEQ ID NO: 83104 - DNA, 22 bp, Artificial Sequence
  chemically synthesized
ataaaggcagcgcggatccaaa

SEQ ID NO: 83105 - DNA, 22 bp, Artificial Sequence
  chemically synthesized
attgtgaagaataaaagaacaa

SEQ ID NO: 83106 - DNA, 22 bp, Artificial Sequence
  chemically synthesized
ttgtgaagaataaaagaacaaa

SEQ ID NO: 83107 - DNA, 22 bp, Artificial Sequence
  chemically synthesized
tgaagaataaaagaacaaagct

SEQ ID NO: 83108 - DNA, 22 bp, Artificial Sequence
  chemically synthesized
ccacagcatggtagggaaccca

SEQ ID NO: 83109 - DNA, 22 bp, Artificial Sequence
  chemically synthesized
cacagcatggtagggaacccaa

SEQ ID NO: 83110 - DNA, 22 bp, Artificial Sequence
  chemically synthesized
tcacagctggctccggcagcct

SEQ ID NO: 83111 - DNA, 22 bp, Artificial Sequence
  chemically synthesized
gctccggcagcctgcctttatt

SEQ ID NO: 83112 - DNA, 22 bp, Artificial Sequence
  chemically synthesized
cggcagcctgcctttatttcct

SEQ ID NO: 83113 - DNA, 22 bp, Artificial Sequence
  chemically synthesized
cctttatttccttatctgaccc

SEQ ID NO: 83114 - DNA, 22 bp, Artificial Sequence
  chemically synthesized
tatttccttatctgaccccacc

SEQ ID NO: 83115 - DNA, 22 bp, Artificial Sequence
  chemically synthesized
atttccttatctgaccccaccc

SEQ ID NO: 83116 - DNA, 22 bp, Artificial Sequence
  chemically synthesized
tttccttatctgaccccaccca

SEQ ID NO: 83117 - DNA, 22 bp, Artificial Sequence
  chemically synthesized
ccttatctgaccccacccacat

SEQ ID NO: 83118 - DNA, 22 bp, Artificial Sequence
  chemically synthesized
cttatctgaccccacccacatc

SEQ ID NO: 83119 - DNA, 22 bp, Artificial Sequence
  chemically synthesized
atctgaccccacccacatcctg

SEQ ID NO: 83120 - DNA, 22 bp, Artificial Sequence
  chemically synthesized
tctgaccccacccacatcctgc

SEQ ID NO: 83121 - DNA, 22 bp, Artificial Sequence
  chemically synthesized
accccacccacatcctgctgat

SEQ ID NO: 83122 - DNA, 22 bp, Artificial Sequence
  chemically synthesized
ctgattggtccattttacagag

SEQ ID NO: 83123 - DNA, 22 bp, Artificial Sequence
  chemically synthesized
attggtccattttacagagagc

SEQ ID NO: 83124 - DNA, 22 bp, Artificial Sequence
  chemically synthesized
gtccattttacagagagctgat

SEQ ID NO: 83125 - DNA, 22 bp, Artificial Sequence
  chemically synthesized
tacagagagctgattggcccat

SEQ ID NO: 83126 - DNA, 22 bp, Artificial Sequence
  chemically synthesized
acagagagctgattggcccatt

SEQ ID NO: 83127 - DNA, 22 bp, Artificial Sequence
  chemically synthesized
cagagagctgattggcccattt

SEQ ID NO: 83128 - DNA, 22 bp, Artificial Sequence
  chemically synthesized
attggcccattttacagagagc

SEQ ID NO: 83129 - DNA, 22 bp, Artificial Sequence
  chemically synthesized
gcccattttacagagagctggt

SEQ ID NO: 83130 - DNA, 22 bp, Artificial Sequence
  chemically synthesized
tacagagagctggttggtccgt

SEQ ID NO: 83131 - DNA, 22 bp, Artificial Sequence
  chemically synthesized
acagagagctggttggtccgtt

SEQ ID NO: 83132 - DNA, 22 bp, Artificial Sequence
  chemically synthesized
cagagagctggttggtccgttt

SEQ ID NO: 83133 - DNA, 22 bp, Artificial Sequence
  chemically synthesized
gttggtccgttttggcagagtg

SEQ ID NO: 83134 - DNA, 22 bp, Artificial Sequence
  chemically synthesized
gtccgttttggcagagtgctga

SEQ ID NO: 83135 - DNA, 22 bp, Artificial Sequence
  chemically synthesized
tggcagagtgctgattggtgca

SEQ ID NO: 83136 - DNA, 22 bp, Artificial Sequence
  chemically synthesized
ggcagagtgctgattggtgcat

SEQ ID NO: 83137 - DNA, 22 bp, Artificial Sequence
  chemically synthesized
gcagagtgctgattggtgcatt

SEQ ID NO: 83138 - DNA, 22 bp, Artificial Sequence
  chemically synthesized
attggtgcatttacaaaccttg

SEQ ID NO: 83139 - DNA, 22 bp, Artificial Sequence
  chemically synthesized
gtgcatttacaaaccttgagct

SEQ ID NO: 83140 - DNA, 22 bp, Artificial Sequence
  chemically synthesized
acaaaccttgagctagacacag

SEQ ID NO: 83141 - DNA, 22 bp, Artificial Sequence
  chemically synthesized
caaaccttgagctagacacaga

SEQ ID NO: 83142 - DNA, 22 bp, Artificial Sequence
  chemically synthesized
gagctagacacagagtgctgat

SEQ ID NO: 83143 - DNA, 22 bp, Artificial Sequence
  chemically synthesized
agctagacacagagtgctgatt

SEQ ID NO: 83144 - DNA, 22 bp, Artificial Sequence
  chemically synthesized
gacacagagtgctgattagtgc

SEQ ID NO: 83145 - DNA, 22 bp, Artificial Sequence
  chemically synthesized
attagtgcatttacaatccttt

SEQ ID NO: 83146 - DNA, 22 bp, Artificial Sequence
  chemically synthesized
gtgcatttacaatcctttagct

SEQ ID NO: 83147 - DNA, 22 bp, Artificial Sequence
  chemically synthesized
acaatcctttagctagacacaa

SEQ ID NO: 83148 - DNA, 22 bp, Artificial Sequence
  chemically synthesized
caatcctttagctagacacaaa

SEQ ID NO: 83149 - DNA, 22 bp, Artificial Sequence
  chemically synthesized
tagctagacacaaaagttctcc

SEQ ID NO: 83150 - DNA, 22 bp, Artificial Sequence
  chemically synthesized
agctagacacaaaagttctcca

SEQ ID NO: 83151 - DNA, 22 bp, Artificial Sequence
  chemically synthesized
gctagacacaaaagttctccaa

SEQ ID NO: 83152 - DNA, 22 bp, Artificial Sequence
  chemically synthesized
gacacaaaagttctccaagtcc

SEQ ID NO: 83153 - DNA, 22 bp, Artificial Sequence
  chemically synthesized
tccaagtccccactagattagc

SEQ ID NO: 83154 - DNA, 22 bp, Artificial Sequence
  chemically synthesized
caagtccccactagattagcta

SEQ ID NO: 83155 - DNA, 22 bp, Artificial Sequence
  chemically synthesized
gattagctagacacagagcact

SEQ ID NO: 83156 - DNA, 22 bp, Artificial Sequence
  chemically synthesized
gctagacacagagcactgattg

SEQ ID NO: 83157 - DNA, 22 bp, Artificial Sequence
  chemically synthesized
gacacagagcactgattggtgc

SEQ ID NO: 83158 - DNA, 22 bp, Artificial Sequence
  chemically synthesized
attggtgcatttacaaaccttg

SEQ ID NO: 83159 - DNA, 22 bp, Artificial Sequence
  chemically synthesized
gtgcatttacaaaccttgagtt

SEQ ID NO: 83160 - DNA, 22 bp, Artificial Sequence
  chemically synthesized
acaaaccttgagttagacacag

SEQ ID NO: 83161 - DNA, 22 bp, Artificial Sequence
  chemically synthesized
caaaccttgagttagacacaga

SEQ ID NO: 83162 - DNA, 22 bp, Artificial Sequence
  chemically synthesized
gagttagacacagattgctgat

SEQ ID NO: 83163 - DNA, 22 bp, Artificial Sequence
  chemically synthesized
agttagacacagattgctgatt

SEQ ID NO: 83164 - DNA, 22 bp, Artificial Sequence
  chemically synthesized
gacacagattgctgattggtgc

SEQ ID NO: 83165 - DNA, 22 bp, Artificial Sequence
  chemically synthesized
ctgattggtgcatttacaaacc

SEQ ID NO: 83166 - DNA, 22 bp, Artificial Sequence
  chemically synthesized
attggtgcatttacaaaccttt

SEQ ID NO: 83167 - DNA, 22 bp, Artificial Sequence
  chemically synthesized
gtgcatttacaaacctttagct

SEQ ID NO: 83168 - DNA, 22 bp, Artificial Sequence
  chemically synthesized
acaaacctttagctagacatga

SEQ ID NO: 83169 - DNA, 22 bp, Artificial Sequence
  chemically synthesized
caaacctttagctagacatgaa

SEQ ID NO: 83170 - DNA, 22 bp, Artificial Sequence
  chemically synthesized
tagctagacatgaaagttctcc

SEQ ID NO: 83171 - DNA, 22 bp, Artificial Sequence
  chemically synthesized
agctagacatgaaagttctcca

SEQ ID NO: 83172 - DNA, 22 bp, Artificial Sequence
  chemically synthesized
gctagacatgaaagttctccag

SEQ ID NO: 83173 - DNA, 22 bp, Artificial Sequence
  chemically synthesized
gacatgaaagttctccagttcc

SEQ ID NO: 83174 - DNA, 22 bp, Artificial Sequence
  chemically synthesized
tccagttccatatttcatggtg

SEQ ID NO: 83175 - DNA, 22 bp, Artificial Sequence
  chemically synthesized
cagttccatatttcatggtgag

SEQ ID NO: 83176 - DNA, 22 bp, Artificial Sequence
  chemically synthesized
catatttcatggtgaggaacaa

SEQ ID NO: 83177 - DNA, 22 bp, Artificial Sequence
  chemically synthesized
catggtgaggaacaaagaatat

SEQ ID NO: 83178 - DNA, 22 bp, Artificial Sequence
  chemically synthesized
atggtgaggaacaaagaatata

SEQ ID NO: 83179 - DNA, 22 bp, Artificial Sequence
  chemically synthesized
tttgttcctcaccatgaaatat

SEQ ID NO: 83180 - DNA, 22 bp, Artificial Sequence
  chemically synthesized
tgttcctcaccatgaaatatgg

SEQ ID NO: 83181 - DNA, 22 bp, Artificial Sequence
  chemically synthesized
gttcctcaccatgaaatatgga

SEQ ID NO: 83182 - DNA, 22 bp, Artificial Sequence
  chemically synthesized
ttcctcaccatgaaatatggaa

SEQ ID NO: 83183 - DNA, 22 bp, Artificial Sequence
  chemically synthesized
ctcaccatgaaatatggaactg

SEQ ID NO: 83184 - DNA, 22 bp, Artificial Sequence
  chemically synthesized
accatgaaatatggaactggag

SEQ ID NO: 83185 - DNA, 22 bp, Artificial Sequence
  chemically synthesized
gagaactttcatgtctagctaa

SEQ ID NO: 83186 - DNA, 22 bp, Artificial Sequence
  chemically synthesized
tcatgtctagctaaaggtttgt

SEQ ID NO: 83187 - DNA, 22 bp, Artificial Sequence
  chemically synthesized
catgtctagctaaaggtttgta

SEQ ID NO: 83188 - DNA, 22 bp, Artificial Sequence
  chemically synthesized
atgtctagctaaaggtttgtaa

SEQ ID NO: 83189 - DNA, 22 bp, Artificial Sequence
  chemically synthesized
gctaaaggtttgtaaatgcaat

SEQ ID NO: 83190 - DNA, 22 bp, Artificial Sequence
  chemically synthesized
aaggtttgtaaatgcaatttat

SEQ ID NO: 83191 - DNA, 22 bp, Artificial Sequence
  chemically synthesized
gtaaatgcaatttattgcggca

SEQ ID NO: 83192 - DNA, 22 bp, Artificial Sequence
  chemically synthesized
taaatgcaatttattgcggcac

SEQ ID NO: 83193 - DNA, 22 bp, Artificial Sequence
  chemically synthesized
attgcggcactattcacaatag

SEQ ID NO: 83194 - DNA, 22 bp, Artificial Sequence
  chemically synthesized
ttgcggcactattcacaatagc

SEQ ID NO: 83195 - DNA, 22 bp, Artificial Sequence
  chemically synthesized
cggcactattcacaatagcaaa

SEQ ID NO: 83196 - DNA, 22 bp, Artificial Sequence
  chemically synthesized
ttcacaatagcaaagacttgga

SEQ ID NO: 83197 - DNA, 22 bp, Artificial Sequence
  chemically synthesized
acaatagcaaagacttggaacc

SEQ ID NO: 83198 - DNA, 22 bp, Artificial Sequence
  chemically synthesized
ggaaccaacccaaatgtccaac

SEQ ID NO: 83199 - DNA, 22 bp, Artificial Sequence
  chemically synthesized
gaaccaacccaaatgtccaaca

SEQ ID NO: 83200 - DNA, 22 bp, Artificial Sequence
  chemically synthesized
gattaagaaaatgtggcacata

SEQ ID NO: 83201 - DNA, 22 bp, Artificial Sequence
  chemically synthesized
agaaaatgtggcacatacacac

SEQ ID NO: 83202 - DNA, 22 bp, Artificial Sequence
  chemically synthesized
tgcagccataaaaaaggatgag

SEQ ID NO: 83203 - DNA, 22 bp, Artificial Sequence
  chemically synthesized
atgtcctttgtagggacatgga

SEQ ID NO: 83204 - DNA, 22 bp, Artificial Sequence
  chemically synthesized
tgtagggacatggatgaaattg

SEQ ID NO: 83205 - DNA, 22 bp, Artificial Sequence
  chemically synthesized
gtagggacatggatgaaattgg

SEQ ID NO: 83206 - DNA, 22 bp, Artificial Sequence
  chemically synthesized
tagggacatggatgaaattgga

SEQ ID NO: 83207 - DNA, 22 bp, Artificial Sequence
  chemically synthesized
gaaatcatcattctcagtaaac

SEQ ID NO: 83208 - DNA, 22 bp, Artificial Sequence
  chemically synthesized
tcagtaaactatcgcaaggacg

SEQ ID NO: 83209 - DNA, 22 bp, Artificial Sequence
  chemically synthesized
agtaaactatcgcaaggacgaa

SEQ ID NO: 83210 - DNA, 22 bp, Artificial Sequence
  chemically synthesized
tcgcaaggacgaaaaaccaaac

SEQ ID NO: 83211 - DNA, 22 bp, Artificial Sequence
  chemically synthesized
catgttctcactcataggtggg

SEQ ID NO: 83212 - DNA, 22 bp, Artificial Sequence
  chemically synthesized
tcactcataggtgggaattgaa

SEQ ID NO: 83213 - DNA, 22 bp, Artificial Sequence
  chemically synthesized
actcataggtgggaattgaaca

SEQ ID NO: 83214 - DNA, 22 bp, Artificial Sequence
  chemically synthesized
ataggtgggaattgaacaatga

SEQ ID NO: 83215 - DNA, 22 bp, Artificial Sequence
  chemically synthesized
aacaatgagaacacatggacac

SEQ ID NO: 83216 - DNA, 22 bp, Artificial Sequence
  chemically synthesized
tggggactgttgtggggtgggg

SEQ ID NO: 83217 - DNA, 22 bp, Artificial Sequence
  chemically synthesized
gggactgttgtggggtgggggg

SEQ ID NO: 83218 - DNA, 22 bp, Artificial Sequence
  chemically synthesized
ttgtggggtggggggagggagg

SEQ ID NO: 83219 - DNA, 22 bp, Artificial Sequence
  chemically synthesized
tggggtggggggagggaggagg

SEQ ID NO: 83220 - DNA, 22 bp, Artificial Sequence
  chemically synthesized
ggagatatacctaatgctaaat

SEQ ID NO: 83221 - DNA, 22 bp, Artificial Sequence
  chemically synthesized
atgctaaatgatgagttaatgg

SEQ ID NO: 83222 - DNA, 22 bp, Artificial Sequence
  chemically synthesized
aatgatgagttaatgggtgaag

SEQ ID NO: 83223 - DNA, 22 bp, Artificial Sequence
  chemically synthesized
atgggtgaagcacaccagcatg

SEQ ID NO: 83224 - DNA, 22 bp, Artificial Sequence
  chemically synthesized
acctgcacattgtgcacatgta

SEQ ID NO: 83225 - DNA, 22 bp, Artificial Sequence
  chemically synthesized
cacattgtgcacatgtacccta

SEQ ID NO: 83226 - DNA, 22 bp, Artificial Sequence
  chemically synthesized
tgcacatgtaccctaaaactta

SEQ ID NO: 83227 - DNA, 22 bp, Artificial Sequence
  chemically synthesized
aaacttaaagtataataataat

SEQ ID NO: 83228 - DNA, 22 bp, Artificial Sequence
  chemically synthesized
aaagtataataataataaaata

SEQ ID NO: 83229 - DNA, 22 bp, Artificial Sequence
  chemically synthesized
aagtataataataataaaataa

SEQ ID NO: 83230 - DNA, 22 bp, Artificial Sequence
  chemically synthesized
taaaaagagtatagtggggatt

SEQ ID NO: 83231 - DNA, 22 bp, Artificial Sequence
  chemically synthesized
aaaaagagtatagtggggattt

SEQ ID NO: 83232 - DNA, 22 bp, Artificial Sequence
  chemically synthesized
aaaagagtatagtggggatttc

SEQ ID NO: 83233 - DNA, 22 bp, Artificial Sequence
  chemically synthesized
ctatgaacacggtacaattagt

SEQ ID NO: 83234 - DNA, 22 bp, Artificial Sequence
  chemically synthesized
tatgaacacggtacaattagtt

SEQ ID NO: 83235 - DNA, 22 bp, Artificial Sequence
  chemically synthesized
tgaacacggtacaattagttat

SEQ ID NO: 83236 - DNA, 22 bp, Artificial Sequence
  chemically synthesized
gttatctggccagttactttga

SEQ ID NO: 83237 - DNA, 22 bp, Artificial Sequence
  chemically synthesized
tctggccagttactttgaaggc

SEQ ID NO: 83238 - DNA, 22 bp, Artificial Sequence
  chemically synthesized
gccagttactttgaaggctgat

SEQ ID NO: 83239 - DNA, 22 bp, Artificial Sequence
  chemically synthesized
ctttgaaggctgatcagaaaga

SEQ ID NO: 83240 - DNA, 22 bp, Artificial Sequence
  chemically synthesized
tgaaggctgatcagaaagaagc

SEQ ID NO: 83241 - DNA, 22 bp, Artificial Sequence
  chemically synthesized
gaaggctgatcagaaagaagcc

SEQ ID NO: 83242 - DNA, 22 bp, Artificial Sequence
  chemically synthesized
aaggctgatcagaaagaagcct

SEQ ID NO: 83243 - DNA, 22 bp, Artificial Sequence
  chemically synthesized
atcagaaagaagcctagctaat

SEQ ID NO: 83244 - DNA, 22 bp, Artificial Sequence
  chemically synthesized
gctaatccagtaagcgaatact

SEQ ID NO: 83245 - DNA, 22 bp, Artificial Sequence
  chemically synthesized
atccagtaagcgaatactcaaa

SEQ ID NO: 83246 - DNA, 22 bp, Artificial Sequence
  chemically synthesized
aaatgccaatatctattagtcc

SEQ ID NO: 83247 - DNA, 22 bp, Artificial Sequence
  chemically synthesized
ttagtcctttctcttgagacag

SEQ ID NO: 83248 - DNA, 22 bp, Artificial Sequence
  chemically synthesized
gtcctttctcttgagacagttt

SEQ ID NO: 83249 - DNA, 22 bp, Artificial Sequence
  chemically synthesized
tctcttgagacagtttatcatc

SEQ ID NO: 83250 - DNA, 22 bp, Artificial Sequence
  chemically synthesized
ctcttgagacagtttatcatca

SEQ ID NO: 83251 - DNA, 22 bp, Artificial Sequence
  chemically synthesized
tcttgagacagtttatcatcat

SEQ ID NO: 83252 - DNA, 22 bp, Artificial Sequence
  chemically synthesized
ttgagacagtttatcatcattc

SEQ ID NO: 83253 - DNA, 22 bp, Artificial Sequence
  chemically synthesized
gagacagtttatcatcattcaa

SEQ ID NO: 83254 - DNA, 22 bp, Artificial Sequence
  chemically synthesized
agacagtttatcatcattcaat

SEQ ID NO: 83255 - DNA, 22 bp, Artificial Sequence
  chemically synthesized
atcatcattcaatatgtattct

SEQ ID NO: 83256 - DNA, 22 bp, Artificial Sequence
  chemically synthesized
tcatcattcaatatgtattctt

SEQ ID NO: 83257 - DNA, 22 bp, Artificial Sequence
  chemically synthesized
aatatgtattcttttgcataat

SEQ ID NO: 83258 - DNA, 22 bp, Artificial Sequence
  chemically synthesized
ttttgcataatctctctgtttc

SEQ ID NO: 83259 - DNA, 22 bp, Artificial Sequence
  chemically synthesized
ttgcataatctctctgtttcat

SEQ ID NO: 83260 - DNA, 22 bp, Artificial Sequence
  chemically synthesized
tgcataatctctctgtttcata

SEQ ID NO: 83261 - DNA, 22 bp, Artificial Sequence
  chemically synthesized
gcataatctctctgtttcatat

SEQ ID NO: 83262 - DNA, 22 bp, Artificial Sequence
  chemically synthesized
cataatctctctgtttcatata

SEQ ID NO: 83263 - DNA, 22 bp, Artificial Sequence
  chemically synthesized
tctgtttcatatattacacctt

SEQ ID NO: 83264 - DNA, 22 bp, Artificial Sequence
  chemically synthesized
tgtttcatatattacaccttag

SEQ ID NO: 83265 - DNA, 22 bp, Artificial Sequence
  chemically synthesized
tttcatatattacaccttagtc

SEQ ID NO: 83266 - DNA, 22 bp, Artificial Sequence
  chemically synthesized
catatattacaccttagtcctg

SEQ ID NO: 83267 - DNA, 22 bp, Artificial Sequence
  chemically synthesized
atatattacaccttagtcctgg

SEQ ID NO: 83268 - DNA, 22 bp, Artificial Sequence
  chemically synthesized
caccttagtcctggcatccttt

SEQ ID NO: 83269 - DNA, 22 bp, Artificial Sequence
  chemically synthesized
agtcctggcatcctttgcactg

SEQ ID NO: 83270 - DNA, 22 bp, Artificial Sequence
  chemically synthesized
gtcctggcatcctttgcactga

SEQ ID NO: 83271 - DNA, 22 bp, Artificial Sequence
  chemically synthesized
gcatcctttgcactgaatttcc

SEQ ID NO: 83272 - DNA, 22 bp, Artificial Sequence
  chemically synthesized
tgcactgaatttcccagtgtct

SEQ ID NO: 83273 - DNA, 22 bp, Artificial Sequence
  chemically synthesized
gcactgaatttcccagtgtctg

SEQ ID NO: 83274 - DNA, 22 bp, Artificial Sequence
  chemically synthesized
cactgaatttcccagtgtctgg

SEQ ID NO: 83275 - DNA, 22 bp, Artificial Sequence
  chemically synthesized
aatttcccagtgtctggatcat

SEQ ID NO: 83276 - DNA, 22 bp, Artificial Sequence
  chemically synthesized
cccagtgtctggatcatcattg

SEQ ID NO: 83277 - DNA, 22 bp, Artificial Sequence
  chemically synthesized
ccagtgtctggatcatcattga

SEQ ID NO: 83278 - DNA, 22 bp, Artificial Sequence
  chemically synthesized
gatcatcattgatttggttact

SEQ ID NO: 83279 - DNA, 22 bp, Artificial Sequence
  chemically synthesized
atttggttactacagacactaa

SEQ ID NO: 83280 - DNA, 22 bp, Artificial Sequence
  chemically synthesized
ggttactacagacactaatcat

SEQ ID NO: 83281 - DNA, 22 bp, Artificial Sequence
  chemically synthesized
gttactacagacactaatcatt

SEQ ID NO: 83282 - DNA, 22 bp, Artificial Sequence
  chemically synthesized
ctacagacactaatcattttgc

SEQ ID NO: 83283 - DNA, 22 bp, Artificial Sequence
  chemically synthesized
cagacactaatcattttgccag

SEQ ID NO: 83284 - DNA, 22 bp, Artificial Sequence
  chemically synthesized
atcattttgccagaactaaaga

SEQ ID NO: 83285 - DNA, 22 bp, Artificial Sequence
  chemically synthesized
tgccagaactaaagagaaatga

SEQ ID NO: 83286 - DNA, 22 bp, Artificial Sequence
  chemically synthesized
gccagaactaaagagaaatgag

SEQ ID NO: 83287 - DNA, 22 bp, Artificial Sequence
  chemically synthesized
ccagaactaaagagaaatgagt

SEQ ID NO: 83288 - DNA, 22 bp, Artificial Sequence
  chemically synthesized
aagagaaatgagtacctggcta

SEQ ID NO: 83289 - DNA, 22 bp, Artificial Sequence
  chemically synthesized
gctatcttttaggcaaccttaa

SEQ ID NO: 83290 - DNA, 22 bp, Artificial Sequence
  chemically synthesized
tcttttaggcaaccttaaacag

SEQ ID NO: 83291 - DNA, 22 bp, Artificial Sequence
  chemically synthesized
ttaggcaaccttaaacaggtat

SEQ ID NO: 83292 - DNA, 22 bp, Artificial Sequence
  chemically synthesized
taggcaaccttaaacaggtatt

SEQ ID NO: 83293 - DNA, 22 bp, Artificial Sequence
  chemically synthesized
aggcaaccttaaacaggtattc

SEQ ID NO: 83294 - DNA, 22 bp, Artificial Sequence
  chemically synthesized
ggcaaccttaaacaggtattca

SEQ ID NO: 83295 - DNA, 22 bp, Artificial Sequence
  chemically synthesized
aaacaggtattcaccttttcta

SEQ ID NO: 83296 - DNA, 22 bp, Artificial Sequence
  chemically synthesized
aacaggtattcaccttttctac

SEQ ID NO: 83297 - DNA, 22 bp, Artificial Sequence
  chemically synthesized
accttttctaccatttttagcc

SEQ ID NO: 83298 - DNA, 22 bp, Artificial Sequence
  chemically synthesized
ttctaccatttttagccctacc

SEQ ID NO: 83299 - DNA, 22 bp, Artificial Sequence
  chemically synthesized
tctaccatttttagccctaccc

SEQ ID NO: 83300 - DNA, 22 bp, Artificial Sequence
  chemically synthesized
ctaccatttttagccctacccc

SEQ ID NO: 83301 - DNA, 22 bp, Artificial Sequence
  chemically synthesized
taccatttttagccctacccct

SEQ ID NO: 83302 - DNA, 22 bp, Artificial Sequence
  chemically synthesized
ccatttttagccctacccctca

SEQ ID NO: 83303 - DNA, 22 bp, Artificial Sequence
  chemically synthesized
ttagccctacccctcacgaatg

SEQ ID NO: 83304 - DNA, 22 bp, Artificial Sequence
  chemically synthesized
tagccctacccctcacgaatgc

SEQ ID NO: 83305 - DNA, 22 bp, Artificial Sequence
  chemically synthesized
agccctacccctcacgaatgct

SEQ ID NO: 83306 - DNA, 22 bp, Artificial Sequence
  chemically synthesized
gccctacccctcacgaatgctt

SEQ ID NO: 83307 - DNA, 22 bp, Artificial Sequence
  chemically synthesized
cccctcacgaatgctttataag

SEQ ID NO: 83308 - DNA, 22 bp, Artificial Sequence
  chemically synthesized
acgaatgctttataagtaattt

SEQ ID NO: 83309 - DNA, 22 bp, Artificial Sequence
  chemically synthesized
tataagtaatttctgtgttttt

SEQ ID NO: 83310 - DNA, 22 bp, Artificial Sequence
  chemically synthesized
ataagtaatttctgtgtttttc

SEQ ID NO: 83311 - DNA, 22 bp, Artificial Sequence
  chemically synthesized
taagtaatttctgtgtttttcc

SEQ ID NO: 83312 - DNA, 22 bp, Artificial Sequence
  chemically synthesized
ctgtgtttttccagaaaatgct

SEQ ID NO: 83313 - DNA, 22 bp, Artificial Sequence
  chemically synthesized
tgtgtttttccagaaaatgctc

SEQ ID NO: 83314 - DNA, 22 bp, Artificial Sequence
  chemically synthesized
tgtttttccagaaaatgctctt

SEQ ID NO: 83315 - DNA, 22 bp, Artificial Sequence
  chemically synthesized
ttccagaaaatgctctttgcag

SEQ ID NO: 83316 - DNA, 22 bp, Artificial Sequence
  chemically synthesized
tccagaaaatgctctttgcaga

SEQ ID NO: 83317 - DNA, 22 bp, Artificial Sequence
  chemically synthesized
ccagaaaatgctctttgcagat

SEQ ID NO: 83318 - DNA, 22 bp, Artificial Sequence
  chemically synthesized
cagaaaatgctctttgcagata

SEQ ID NO: 83319 - DNA, 22 bp, Artificial Sequence
  chemically synthesized
tttgcagataacgttttttctc

SEQ ID NO: 83320 - DNA, 22 bp, Artificial Sequence
  chemically synthesized
tgcagataacgttttttctcat

SEQ ID NO: 83321 - DNA, 22 bp, Artificial Sequence
  chemically synthesized
gcagataacgttttttctcatt

SEQ ID NO: 83322 - DNA, 22 bp, Artificial Sequence
  chemically synthesized
cagataacgttttttctcattg

SEQ ID NO: 83323 - DNA, 22 bp, Artificial Sequence
  chemically synthesized
tttctcattggtatccttttct

SEQ ID NO: 83324 - DNA, 22 bp, Artificial Sequence
  chemically synthesized
ttctcattggtatccttttctg

SEQ ID NO: 83325 - DNA, 22 bp, Artificial Sequence
  chemically synthesized
tctcattggtatccttttctgt

SEQ ID NO: 83326 - DNA, 22 bp, Artificial Sequence
  chemically synthesized
ctcattggtatccttttctgta

SEQ ID NO: 83327 - DNA, 22 bp, Artificial Sequence
  chemically synthesized
tcattggtatccttttctgtag

SEQ ID NO: 83328 - DNA, 22 bp, Artificial Sequence
  chemically synthesized
attggtatccttttctgtagac

SEQ ID NO: 83329 - DNA, 22 bp, Artificial Sequence
  chemically synthesized
gtatccttttctgtagacatat

SEQ ID NO: 83330 - DNA, 22 bp, Artificial Sequence
  chemically synthesized
ttctgtagacatatagatttca

SEQ ID NO: 83331 - DNA, 22 bp, Artificial Sequence
  chemically synthesized
tctgtagacatatagatttcag

SEQ ID NO: 83332 - DNA, 22 bp, Artificial Sequence
  chemically synthesized
ctgtagacatatagatttcaga

SEQ ID NO: 83333 - DNA, 22 bp, Artificial Sequence
  chemically synthesized
tgtagacatatagatttcagat

SEQ ID NO: 83334 - DNA, 22 bp, Artificial Sequence
  chemically synthesized
tagacatatagatttcagatta

SEQ ID NO: 83335 - DNA, 22 bp, Artificial Sequence
  chemically synthesized
cagattatcctgttctgttttt

SEQ ID NO: 83336 - DNA, 22 bp, Artificial Sequence
  chemically synthesized
agattatcctgttctgtttttt

SEQ ID NO: 83337 - DNA, 22 bp, Artificial Sequence
  chemically synthesized
tcctgttctgttttttaaaaaa

SEQ ID NO: 83338 - DNA, 22 bp, Artificial Sequence
  chemically synthesized
ttctgttttttaaaaaatcata

SEQ ID NO: 83339 - DNA, 22 bp, Artificial Sequence
  chemically synthesized
tgttttttaaaaaatcatattt

SEQ ID NO: 83340 - DNA, 22 bp, Artificial Sequence
  chemically synthesized
ttttttaaaaaatcatatttaa

SEQ ID NO: 83341 - DNA, 22 bp, Artificial Sequence
  chemically synthesized
tttaaaaaatcatatttaaatg

SEQ ID NO: 83342 - DNA, 22 bp, Artificial Sequence
  chemically synthesized
ttaaaaaatcatatttaaatgt

SEQ ID NO: 83343 - DNA, 22 bp, Artificial Sequence
  chemically synthesized
taaaaaatcatatttaaatgta

SEQ ID NO: 83344 - DNA, 22 bp, Artificial Sequence
  chemically synthesized
aaaaaatcatatttaaatgtat

SEQ ID NO: 83345 - DNA, 22 bp, Artificial Sequence
  chemically synthesized
aaaaatcatatttaaatgtata

SEQ ID NO: 83346 - DNA, 22 bp, Artificial Sequence
  chemically synthesized
aaatgtatatacttatcaattt

SEQ ID NO: 83347 - DNA, 22 bp, Artificial Sequence
  chemically synthesized
aatgtatatacttatcaatttg

SEQ ID NO: 83348 - DNA, 22 bp, Artificial Sequence
  chemically synthesized
atcaatttgttcatacatattg

SEQ ID NO: 83349 - DNA, 22 bp, Artificial Sequence
  chemically synthesized
tcaatttgttcatacatattgt

SEQ ID NO: 83350 - DNA, 22 bp, Artificial Sequence
  chemically synthesized
gttcatacatattgtgctattt

SEQ ID NO: 83351 - DNA, 22 bp, Artificial Sequence
  chemically synthesized
ttcatacatattgtgctatttt

SEQ ID NO: 83352 - DNA, 22 bp, Artificial Sequence
  chemically synthesized
atacatattgtgctattttctt

SEQ ID NO: 83353 - DNA, 22 bp, Artificial Sequence
  chemically synthesized
tgctattttcttcacagtgtct

SEQ ID NO: 83354 - DNA, 22 bp, Artificial Sequence
  chemically synthesized
ttttcttcacagtgtctctgtg

SEQ ID NO: 83355 - DNA, 22 bp, Artificial Sequence
  chemically synthesized
tcttcacagtgtctctgtgtac

SEQ ID NO: 83356 - DNA, 22 bp, Artificial Sequence
  chemically synthesized
cttcacagtgtctctgtgtaca

SEQ ID NO: 83357 - DNA, 22 bp, Artificial Sequence
  chemically synthesized
ttcacagtgtctctgtgtacat

SEQ ID NO: 83358 - DNA, 22 bp, Artificial Sequence
  chemically synthesized
cacagtgtctctgtgtacatct

SEQ ID NO: 83359 - DNA, 22 bp, Artificial Sequence
  chemically synthesized
acagtgtctctgtgtacatcta

SEQ ID NO: 83360 - DNA, 22 bp, Artificial Sequence
  chemically synthesized
tgtgtacatctatagctttagt

SEQ ID NO: 83361 - DNA, 22 bp, Artificial Sequence
  chemically synthesized
tgtacatctatagctttagtgg

SEQ ID NO: 83362 - DNA, 22 bp, Artificial Sequence
  chemically synthesized
tagctttagtggattagagaaa

SEQ ID NO: 83363 - DNA, 22 bp, Artificial Sequence
  chemically synthesized
tagtggattagagaaagtagca

SEQ ID NO: 83364 - DNA, 22 bp, Artificial Sequence
  chemically synthesized
agtggattagagaaagtagcag

SEQ ID NO: 83365 - DNA, 22 bp, Artificial Sequence
  chemically synthesized
gtggattagagaaagtagcaga

SEQ ID NO: 83366 - DNA, 22 bp, Artificial Sequence
  chemically synthesized
gagaaagtagcagaaatgaaca

SEQ ID NO: 83367 - DNA, 22 bp, Artificial Sequence
  chemically synthesized
agtctgccaggtttatatgtaa

SEQ ID NO: 83368 - DNA, 22 bp, Artificial Sequence
  chemically synthesized
ccaggtttatatgtaaattgac

SEQ ID NO: 83369 - DNA, 22 bp, Artificial Sequence
  chemically synthesized
atatgtaaattgacactttcac

SEQ ID NO: 83370 - DNA, 22 bp, Artificial Sequence
  chemically synthesized
tatgtaaattgacactttcact

SEQ ID NO: 83371 - DNA, 22 bp, Artificial Sequence
  chemically synthesized
acactttcactcatatttctta

SEQ ID NO: 83372 - DNA, 22 bp, Artificial Sequence
  chemically synthesized
tcactcatatttcttaaattta

SEQ ID NO: 83373 - DNA, 22 bp, Artificial Sequence
  chemically synthesized
cactcatatttcttaaatttat

SEQ ID NO: 83374 - DNA, 22 bp, Artificial Sequence
  chemically synthesized
actcatatttcttaaatttata

SEQ ID NO: 83375 - DNA, 22 bp, Artificial Sequence
  chemically synthesized
atatttcttaaatttatatttt

SEQ ID NO: 83376 - DNA, 22 bp, Artificial Sequence
  chemically synthesized
cttaaatttatattttattatt

SEQ ID NO: 83377 - DNA, 22 bp, Artificial Sequence
  chemically synthesized
ttaaatttatattttattattc

SEQ ID NO: 83378 - DNA, 22 bp, Artificial Sequence
  chemically synthesized
aaatttatattttattattcag

SEQ ID NO: 83379 - DNA, 22 bp, Artificial Sequence
  chemically synthesized
aatttatattttattattcagt

SEQ ID NO: 83380 - DNA, 22 bp, Artificial Sequence
  chemically synthesized
atattttattattcagtacaga

SEQ ID NO: 83381 - DNA, 22 bp, Artificial Sequence
  chemically synthesized
tattttattattcagtacagaa

SEQ ID NO: 83382 - DNA, 22 bp, Artificial Sequence
  chemically synthesized
tattattcagtacagaaaaata

SEQ ID NO: 83383 - DNA, 22 bp, Artificial Sequence
  chemically synthesized
attattcagtacagaaaaatac

SEQ ID NO: 83384 - DNA, 22 bp, Artificial Sequence
  chemically synthesized
ttattcagtacagaaaaataca

SEQ ID NO: 83385 - DNA, 22 bp, Artificial Sequence
  chemically synthesized
ttcagtacagaaaaatacataa

SEQ ID NO: 83386 - DNA, 22 bp, Artificial Sequence
  chemically synthesized
agtacagaaaaatacataaata

SEQ ID NO: 83387 - DNA, 22 bp, Artificial Sequence
  chemically synthesized
gttaaattgacacaaaattagc

SEQ ID NO: 83388 - DNA, 22 bp, Artificial Sequence
  chemically synthesized
ttaaattgacacaaaattagca

SEQ ID NO: 83389 - DNA, 22 bp, Artificial Sequence
  chemically synthesized
aattgacacaaaattagcaaaa

SEQ ID NO: 83390 - DNA, 22 bp, Artificial Sequence
  chemically synthesized
acacaaaattagcaaaagcttt

SEQ ID NO: 83391 - DNA, 22 bp, Artificial Sequence
  chemically synthesized
gcaaaagcttttaacaaacact

SEQ ID NO: 83392 - DNA, 22 bp, Artificial Sequence
  chemically synthesized
ttaacaaacactcagaccaaga

SEQ ID NO: 83393 - DNA, 22 bp, Artificial Sequence
  chemically synthesized
taacaaacactcagaccaagaa

SEQ ID NO: 83394 - DNA, 22 bp, Artificial Sequence
  chemically synthesized
aacaaacactcagaccaagaaa

SEQ ID NO: 83395 - DNA, 22 bp, Artificial Sequence
  chemically synthesized
acaaacactcagaccaagaaag

SEQ ID NO: 83396 - DNA, 22 bp, Artificial Sequence
  chemically synthesized
agaccaagaaagagaacattac

SEQ ID NO: 83397 - DNA, 22 bp, Artificial Sequence
  chemically synthesized
ccagcatctcaaaagctaaaca

SEQ ID NO: 83398 - DNA, 22 bp, Artificial Sequence
  chemically synthesized
aaaagctaaacaccgattgatt

SEQ ID NO: 83399 - DNA, 22 bp, Artificial Sequence
  chemically synthesized
aacaccgattgattcctcagtt

SEQ ID NO: 83400 - DNA, 22 bp, Artificial Sequence
  chemically synthesized
attcctcagttctggctgcaac

SEQ ID NO: 83401 - DNA, 22 bp, Artificial Sequence
  chemically synthesized
ctcagttctggctgcaacctga

SEQ ID NO: 83402 - DNA, 22 bp, Artificial Sequence
  chemically synthesized
agttctggctgcaacctgaaag

SEQ ID NO: 83403 - DNA, 22 bp, Artificial Sequence
  chemically synthesized
tggctgcaacctgaaagcctgc

SEQ ID NO: 83404 - DNA, 22 bp, Artificial Sequence
  chemically synthesized
gctgcaacctgaaagcctgcat

SEQ ID NO: 83405 - DNA, 22 bp, Artificial Sequence
  chemically synthesized
caacctgaaagcctgcattttc

SEQ ID NO: 83406 - DNA, 22 bp, Artificial Sequence
  chemically synthesized
aaagcctgcattttctatgtgc

SEQ ID NO: 83407 - DNA, 22 bp, Artificial Sequence
  chemically synthesized
cattttctatgtgccattacat

SEQ ID NO: 83408 - DNA, 22 bp, Artificial Sequence
  chemically synthesized
tctatgtgccattacatggtgc

SEQ ID NO: 83409 - DNA, 22 bp, Artificial Sequence
  chemically synthesized
ctatgtgccattacatggtgcc

SEQ ID NO: 83410 - DNA, 22 bp, Artificial Sequence
  chemically synthesized
tatgtgccattacatggtgcca

SEQ ID NO: 83411 - DNA, 22 bp, Artificial Sequence
  chemically synthesized
tgtgccattacatggtgccaag

SEQ ID NO: 83412 - DNA, 22 bp, Artificial Sequence
  chemically synthesized
catggtgccaagactgcagggg

SEQ ID NO: 83413 - DNA, 22 bp, Artificial Sequence
  chemically synthesized
caggggcagaaaccacactttt

SEQ ID NO: 83414 - DNA, 22 bp, Artificial Sequence
  chemically synthesized
ttactggaaaagctttaggaca

SEQ ID NO: 83415 - DNA, 22 bp, Artificial Sequence
  chemically synthesized
tactggaaaagctttaggacat

SEQ ID NO: 83416 - DNA, 22 bp, Artificial Sequence
  chemically synthesized
actggaaaagctttaggacatc

SEQ ID NO: 83417 - DNA, 22 bp, Artificial Sequence
  chemically synthesized
ctggaaaagctttaggacatcg

SEQ ID NO: 83418 - DNA, 22 bp, Artificial Sequence
  chemically synthesized
gaaaagctttaggacatcgact

SEQ ID NO: 83419 - DNA, 22 bp, Artificial Sequence
  chemically synthesized
taggacatcgactcctactgca

SEQ ID NO: 83420 - DNA, 22 bp, Artificial Sequence
  chemically synthesized
aggacatcgactcctactgcag

SEQ ID NO: 83421 - DNA, 22 bp, Artificial Sequence
  chemically synthesized
ggacatcgactcctactgcagg

SEQ ID NO: 83422 - DNA, 22 bp, Artificial Sequence
  chemically synthesized
ctactgcaggggtgttcttggc

SEQ ID NO: 83423 - DNA, 22 bp, Artificial Sequence
  chemically synthesized
ctgcaggggtgttcttggctag

SEQ ID NO: 83424 - DNA, 22 bp, Artificial Sequence
  chemically synthesized
caggggtgttcttggctaggtt

SEQ ID NO: 83425 - DNA, 22 bp, Artificial Sequence
  chemically synthesized
ttggctaggttggcattaattt

SEQ ID NO: 83426 - DNA, 22 bp, Artificial Sequence
  chemically synthesized
ggctaggttggcattaattttt

SEQ ID NO: 83427 - DNA, 22 bp, Artificial Sequence
  chemically synthesized
gctaggttggcattaattttta

SEQ ID NO: 83428 - DNA, 22 bp, Artificial Sequence
  chemically synthesized
ggttggcattaatttttaagtt

SEQ ID NO: 83429 - DNA, 22 bp, Artificial Sequence
  chemically synthesized
gcattaatttttaagtttctgc

SEQ ID NO: 83430 - DNA, 22 bp, Artificial Sequence
  chemically synthesized
atttttaagtttctgcaagaga

SEQ ID NO: 83431 - DNA, 22 bp, Artificial Sequence
  chemically synthesized
ttaagtttctgcaagagacttc

SEQ ID NO: 83432 - DNA, 22 bp, Artificial Sequence
  chemically synthesized
taagtttctgcaagagacttct

SEQ ID NO: 83433 - DNA, 22 bp, Artificial Sequence
  chemically synthesized
aagtttctgcaagagacttctg

SEQ ID NO: 83434 - DNA, 22 bp, Artificial Sequence
  chemically synthesized
agtttctgcaagagacttctgg

SEQ ID NO: 83435 - DNA, 22 bp, Artificial Sequence
  chemically synthesized
ctgcaagagacttctgggaaaa

SEQ ID NO: 83436 - DNA, 22 bp, Artificial Sequence
  chemically synthesized
tgcaagagacttctgggaaaat

SEQ ID NO: 83437 - DNA, 22 bp, Artificial Sequence
  chemically synthesized
caagagacttctgggaaaatgg

SEQ ID NO: 83438 - DNA, 22 bp, Artificial Sequence
  chemically synthesized
ctgggaaaatggactattttta

SEQ ID NO: 83439 - DNA, 22 bp, Artificial Sequence
  chemically synthesized
tgggaaaatggactatttttat

SEQ ID NO: 83440 - DNA, 22 bp, Artificial Sequence
  chemically synthesized
ggaaaatggactatttttattt

SEQ ID NO: 83441 - DNA, 22 bp, Artificial Sequence
  chemically synthesized
tttttatttccttcatctggag

SEQ ID NO: 83442 - DNA, 22 bp, Artificial Sequence
  chemically synthesized
ttatttccttcatctggaggcc

SEQ ID NO: 83443 - DNA, 22 bp, Artificial Sequence
  chemically synthesized
tatttccttcatctggaggcct

SEQ ID NO: 83444 - DNA, 22 bp, Artificial Sequence
  chemically synthesized
atttccttcatctggaggcctc

SEQ ID NO: 83445 - DNA, 22 bp, Artificial Sequence
  chemically synthesized
tttccttcatctggaggcctct

SEQ ID NO: 83446 - DNA, 22 bp, Artificial Sequence
  chemically synthesized
ccttcatctggaggcctctatt

SEQ ID NO: 83447 - DNA, 22 bp, Artificial Sequence
  chemically synthesized
cttcatctggaggcctctattc

SEQ ID NO: 83448 - DNA, 22 bp, Artificial Sequence
  chemically synthesized
catctggaggcctctattcact

SEQ ID NO: 83449 - DNA, 22 bp, Artificial Sequence
  chemically synthesized
atctggaggcctctattcacta

SEQ ID NO: 83450 - DNA, 22 bp, Artificial Sequence
  chemically synthesized
gaggcctctattcactactcta

SEQ ID NO: 83451 - DNA, 22 bp, Artificial Sequence
  chemically synthesized
tattcactactctagcaattat

SEQ ID NO: 83452 - DNA, 22 bp, Artificial Sequence
  chemically synthesized
ttcactactctagcaattatct

SEQ ID NO: 83453 - DNA, 22 bp, Artificial Sequence
  chemically synthesized
actactctagcaattatcttct

SEQ ID NO: 83454 - DNA, 22 bp, Artificial Sequence
  chemically synthesized
ctctagcaattatcttctgcaa

SEQ ID NO: 83455 - DNA, 22 bp, Artificial Sequence
  chemically synthesized
tagcaattatcttctgcaagta

SEQ ID NO: 83456 - DNA, 22 bp, Artificial Sequence
  chemically synthesized
gcaattatcttctgcaagtaat

SEQ ID NO: 83457 - DNA, 22 bp, Artificial Sequence
  chemically synthesized
tcttctgcaagtaatggtaaca

SEQ ID NO: 83458 - DNA, 22 bp, Artificial Sequence
  chemically synthesized
ctgcaagtaatggtaacaaata

SEQ ID NO: 83459 - DNA, 22 bp, Artificial Sequence
  chemically synthesized
tgcaagtaatggtaacaaatat

SEQ ID NO: 83460 - DNA, 22 bp, Artificial Sequence
  chemically synthesized
caagtaatggtaacaaatatcc

SEQ ID NO: 83461 - DNA, 22 bp, Artificial Sequence
  chemically synthesized
gggaatggagacacaacctcaa

SEQ ID NO: 83462 - DNA, 22 bp, Artificial Sequence
  chemically synthesized
aagtagaacatctcttaagtct

SEQ ID NO: 83463 - DNA, 22 bp, Artificial Sequence
  chemically synthesized
ttaagtctgtttaacaatacga

SEQ ID NO: 83464 - DNA, 22 bp, Artificial Sequence
  chemically synthesized
aagtctgtttaacaatacgatt

SEQ ID NO: 83465 - DNA, 22 bp, Artificial Sequence
  chemically synthesized
agtctgtttaacaatacgattt

SEQ ID NO: 83466 - DNA, 22 bp, Artificial Sequence
  chemically synthesized
tttaacaatacgattttgataa

SEQ ID NO: 83467 - DNA, 22 bp, Artificial Sequence
  chemically synthesized
aacaatacgattttgataagcc

SEQ ID NO: 83468 - DNA, 22 bp, Artificial Sequence
  chemically synthesized
acaatacgattttgataagcct

SEQ ID NO: 83469 - DNA, 22 bp, Artificial Sequence
  chemically synthesized
tgataagcctaggaaaataggg

SEQ ID NO: 83470 - DNA, 22 bp, Artificial Sequence
  chemically synthesized
gataagcctaggaaaataggga

SEQ ID NO: 83471 - DNA, 22 bp, Artificial Sequence
  chemically synthesized
ataagcctaggaaaatagggag

SEQ ID NO: 83472 - DNA, 22 bp, Artificial Sequence
  chemically synthesized
ggaaaatagggaggtatagtgt

SEQ ID NO: 83473 - DNA, 22 bp, Artificial Sequence
  chemically synthesized
gccacttaccagtactggtccg

SEQ ID NO: 83474 - DNA, 22 bp, Artificial Sequence
  chemically synthesized
accagtactggtccgtggcctg

SEQ ID NO: 83475 - DNA, 22 bp, Artificial Sequence
  chemically synthesized
ccagtactggtccgtggcctgc

SEQ ID NO: 83476 - DNA, 22 bp, Artificial Sequence
  chemically synthesized
gtccgtggcctgctaggaacct

SEQ ID NO: 83477 - DNA, 22 bp, Artificial Sequence
  chemically synthesized
ctaggaacctggtctcacagca

SEQ ID NO: 83478 - DNA, 22 bp, Artificial Sequence
  chemically synthesized
ggaacctggtctcacagcaggg

SEQ ID NO: 83479 - DNA, 22 bp, Artificial Sequence
  chemically synthesized
gtctcacagcagggggatgagc

SEQ ID NO: 83480 - DNA, 22 bp, Artificial Sequence
  chemically synthesized
acagcagggggatgagcaagca

SEQ ID NO: 83481 - DNA, 22 bp, Artificial Sequence
  chemically synthesized
ctgcctgagctcctcctcctgt

SEQ ID NO: 83482 - DNA, 22 bp, Artificial Sequence
  chemically synthesized
cctgagctcctcctcctgtcac

SEQ ID NO: 83483 - DNA, 22 bp, Artificial Sequence
  chemically synthesized
agctcctcctcctgtcacatcg

SEQ ID NO: 83484 - DNA, 22 bp, Artificial Sequence
  chemically synthesized
ctcctcctgtcacatcggcagt

SEQ ID NO: 83485 - DNA, 22 bp, Artificial Sequence
  chemically synthesized
ctcctgtcacatcggcagtggc

SEQ ID NO: 83486 - DNA, 22 bp, Artificial Sequence
  chemically synthesized
ctgtcacatcggcagtggcggc

SEQ ID NO: 83487 - DNA, 22 bp, Artificial Sequence
  chemically synthesized
tcacatcggcagtggcggcatt

SEQ ID NO: 83488 - DNA, 22 bp, Artificial Sequence
  chemically synthesized
gattctcatagaggcatgcaag

SEQ ID NO: 83489 - DNA, 22 bp, Artificial Sequence
  chemically synthesized
tcatagaggcatgcaagggatc

SEQ ID NO: 83490 - DNA, 22 bp, Artificial Sequence
  chemically synthesized
atagaggcatgcaagggatcta

SEQ ID NO: 83491 - DNA, 22 bp, Artificial Sequence
  chemically synthesized
ggttgcggcttcttatgagaat

SEQ ID NO: 83492 - DNA, 22 bp, Artificial Sequence
  chemically synthesized
cggcttcttatgagaatctaat

SEQ ID NO: 83493 - DNA, 22 bp, Artificial Sequence
  chemically synthesized
cttatgagaatctaatgcctaa

SEQ ID NO: 83494 - DNA, 22 bp, Artificial Sequence
  chemically synthesized
ttatgagaatctaatgcctaat

SEQ ID NO: 83495 - DNA, 22 bp, Artificial Sequence
  chemically synthesized
atgagaatctaatgcctaatgc

SEQ ID NO: 83496 - DNA, 22 bp, Artificial Sequence
  chemically synthesized
tgagaatctaatgcctaatgct

SEQ ID NO: 83497 - DNA, 22 bp, Artificial Sequence
  chemically synthesized
atgcctaatgctctgaggtgga

SEQ ID NO: 83498 - DNA, 22 bp, Artificial Sequence
  chemically synthesized
atgctctgaggtggaacagttt

SEQ ID NO: 83499 - DNA, 22 bp, Artificial Sequence
  chemically synthesized
tgaggtggaacagtttcatcct

SEQ ID NO: 83500 - DNA, 22 bp, Artificial Sequence
  chemically synthesized
aggtggaacagtttcatcctga

SEQ ID NO: 83501 - DNA, 22 bp, Artificial Sequence
  chemically synthesized
catcctgaaaccatgccctcct

SEQ ID NO: 83502 - DNA, 22 bp, Artificial Sequence
  chemically synthesized
atcctgaaaccatgccctcctg

SEQ ID NO: 83503 - DNA, 22 bp, Artificial Sequence
  chemically synthesized
aaaccatgccctcctgcacctt

SEQ ID NO: 83504 - DNA, 22 bp, Artificial Sequence
  chemically synthesized
ctgcaccttgtcttccacaaaa

SEQ ID NO: 83505 - DNA, 22 bp, Artificial Sequence
  chemically synthesized
caccttgtcttccacaaaagca

SEQ ID NO: 83506 - DNA, 22 bp, Artificial Sequence
  chemically synthesized
gtcttccacaaaagcagtccct

SEQ ID NO: 83507 - DNA, 22 bp, Artificial Sequence
  chemically synthesized
tcttccacaaaagcagtccctg

SEQ ID NO: 83508 - DNA, 22 bp, Artificial Sequence
  chemically synthesized
ccacaaaagcagtccctggtac

SEQ ID NO: 83509 - DNA, 22 bp, Artificial Sequence
  chemically synthesized
cacaaaagcagtccctggtacc

SEQ ID NO: 83510 - DNA, 22 bp, Artificial Sequence
  chemically synthesized
gtaccaaaaacattgaagactg

SEQ ID NO: 83511 - DNA, 22 bp, Artificial Sequence
  chemically synthesized
aagactgctggtgtacagtgaa

SEQ ID NO: 83512 - DNA, 22 bp, Artificial Sequence
  chemically synthesized
ctggtgtacagtgaacatctgc

SEQ ID NO: 83513 - DNA, 22 bp, Artificial Sequence
  chemically synthesized
gtgtacagtgaacatctgcctg

SEQ ID NO: 83514 - DNA, 22 bp, Artificial Sequence
  chemically synthesized
cctgtggatttattattagcag

SEQ ID NO: 83515 - DNA, 22 bp, Artificial Sequence
  chemically synthesized
tggatttattattagcagatca

SEQ ID NO: 83516 - DNA, 22 bp, Artificial Sequence
  chemically synthesized
attattagcagatcatttttac

SEQ ID NO: 83517 - DNA, 22 bp, Artificial Sequence
  chemically synthesized
ttattagcagatcatttttact

SEQ ID NO: 83518 - DNA, 22 bp, Artificial Sequence
  chemically synthesized
ttagcagatcatttttactaaa

SEQ ID NO: 83519 - DNA, 22 bp, Artificial Sequence
  chemically synthesized
gcagatcatttttactaaaaac

SEQ ID NO: 83520 - DNA, 22 bp, Artificial Sequence
  chemically synthesized
ttactaaaaacacatttctaat

SEQ ID NO: 83521 - DNA, 22 bp, Artificial Sequence
  chemically synthesized
tactaaaaacacatttctaatc

SEQ ID NO: 83522 - DNA, 22 bp, Artificial Sequence
  chemically synthesized
actaaaaacacatttctaatcc

SEQ ID NO: 83523 - DNA, 22 bp, Artificial Sequence
  chemically synthesized
ctaaaaacacatttctaatcct

SEQ ID NO: 83524 - DNA, 22 bp, Artificial Sequence
  chemically synthesized
aaaacacatttctaatcctgaa

SEQ ID NO: 83525 - DNA, 22 bp, Artificial Sequence
  chemically synthesized
ctaatcctgaatcatgtcctct

SEQ ID NO: 83526 - DNA, 22 bp, Artificial Sequence
  chemically synthesized
taatcctgaatcatgtcctctc

SEQ ID NO: 83527 - DNA, 22 bp, Artificial Sequence
  chemically synthesized
atcctgaatcatgtcctctcac

SEQ ID NO: 83528 - DNA, 22 bp, Artificial Sequence
  chemically synthesized
aatcatgtcctctcacttctaa

SEQ ID NO: 83529 - DNA, 22 bp, Artificial Sequence
  chemically synthesized
tcacttctaagaatcactgatt

SEQ ID NO: 83530 - DNA, 22 bp, Artificial Sequence
  chemically synthesized
acttctaagaatcactgatttc

SEQ ID NO: 83531 - DNA, 22 bp, Artificial Sequence
  chemically synthesized
ctaagaatcactgatttctccc

SEQ ID NO: 83532 - DNA, 22 bp, Artificial Sequence
  chemically synthesized
taagaatcactgatttctccca

SEQ ID NO: 83533 - DNA, 22 bp, Artificial Sequence
  chemically synthesized
agaatcactgatttctcccact

SEQ ID NO: 83534 - DNA, 22 bp, Artificial Sequence
  chemically synthesized
atttctcccactggaccttagc

SEQ ID NO: 83535 - DNA, 22 bp, Artificial Sequence
  chemically synthesized
ctcccactggaccttagctttt

SEQ ID NO: 83536 - DNA, 22 bp, Artificial Sequence
  chemically synthesized
tcccactggaccttagcttttc

SEQ ID NO: 83537 - DNA, 22 bp, Artificial Sequence
  chemically synthesized
ccactggaccttagcttttcgg

SEQ ID NO: 83538 - DNA, 22 bp, Artificial Sequence
  chemically synthesized
gaccttagcttttcggtgtaag

SEQ ID NO: 83539 - DNA, 22 bp, Artificial Sequence
  chemically synthesized
agcttttcggtgtaagagttaa

SEQ ID NO: 83540 - DNA, 22 bp, Artificial Sequence
  chemically synthesized
gcttttcggtgtaagagttaaa

SEQ ID NO: 83541 - DNA, 22 bp, Artificial Sequence
  chemically synthesized
ttcggtgtaagagttaaatgaa

SEQ ID NO: 83542 - DNA, 22 bp, Artificial Sequence
  chemically synthesized
tcggtgtaagagttaaatgaat

SEQ ID NO: 83543 - DNA, 22 bp, Artificial Sequence
  chemically synthesized
cggtgtaagagttaaatgaata

SEQ ID NO: 83544 - DNA, 22 bp, Artificial Sequence
  chemically synthesized
ggtgtaagagttaaatgaatag

SEQ ID NO: 83545 - DNA, 22 bp, Artificial Sequence
  chemically synthesized
aatgaatagcaattgaatggac

SEQ ID NO: 83546 - DNA, 22 bp, Artificial Sequence
  chemically synthesized
aatggactagactttctgattt

SEQ ID NO: 83547 - DNA, 22 bp, Artificial Sequence
  chemically synthesized
gactttctgattttctgaatct

SEQ ID NO: 83548 - DNA, 22 bp, Artificial Sequence
  chemically synthesized
tctgattttctgaatcttactt

SEQ ID NO: 83549 - DNA, 22 bp, Artificial Sequence
  chemically synthesized
ctgattttctgaatcttacttt

SEQ ID NO: 83550 - DNA, 22 bp, Artificial Sequence
  chemically synthesized
tgattttctgaatcttactttt

SEQ ID NO: 83551 - DNA, 22 bp, Artificial Sequence
  chemically synthesized
attttctgaatcttacttttgt

SEQ ID NO: 83552 - DNA, 22 bp, Artificial Sequence
  chemically synthesized
tctgaatcttacttttgtcacc

SEQ ID NO: 83553 - DNA, 22 bp, Artificial Sequence
  chemically synthesized
ctgaatcttacttttgtcacct

SEQ ID NO: 83554 - DNA, 22 bp, Artificial Sequence
  chemically synthesized
tgaatcttacttttgtcacctt

SEQ ID NO: 83555 - DNA, 22 bp, Artificial Sequence
  chemically synthesized
aatcttacttttgtcaccttgt

SEQ ID NO: 83556 - DNA, 22 bp, Artificial Sequence
  chemically synthesized
acttttgtcaccttgttctcgg

SEQ ID NO: 83557 - DNA, 22 bp, Artificial Sequence
  chemically synthesized
cttttgtcaccttgttctcggc

SEQ ID NO: 83558 - DNA, 22 bp, Artificial Sequence
  chemically synthesized
ttgtcaccttgttctcggcaat

SEQ ID NO: 83559 - DNA, 22 bp, Artificial Sequence
  chemically synthesized
tgtcaccttgttctcggcaata

SEQ ID NO: 83560 - DNA, 22 bp, Artificial Sequence
  chemically synthesized
gtcaccttgttctcggcaatat

SEQ ID NO: 83561 - DNA, 22 bp, Artificial Sequence
  chemically synthesized
tcaccttgttctcggcaatatt

SEQ ID NO: 83562 - DNA, 22 bp, Artificial Sequence
  chemically synthesized
gttctcggcaatatttttgttt

SEQ ID NO: 83563 - DNA, 22 bp, Artificial Sequence
  chemically synthesized
ttctcggcaatatttttgtttt

SEQ ID NO: 83564 - DNA, 22 bp, Artificial Sequence
  chemically synthesized
tcggcaatatttttgttttctc

SEQ ID NO: 83565 - DNA, 22 bp, Artificial Sequence
  chemically synthesized
ggcaatatttttgttttctcct

SEQ ID NO: 83566 - DNA, 22 bp, Artificial Sequence
  chemically synthesized
ttgttttctccttattataata

SEQ ID NO: 83567 - DNA, 22 bp, Artificial Sequence
  chemically synthesized
tgttttctccttattataataa

SEQ ID NO: 83568 - DNA, 22 bp, Artificial Sequence
  chemically synthesized
gttttctccttattataataac

SEQ ID NO: 83569 - DNA, 22 bp, Artificial Sequence
  chemically synthesized
ttttctccttattataataacc

SEQ ID NO: 83570 - DNA, 22 bp, Artificial Sequence
  chemically synthesized
tctccttattataataaccgtg

SEQ ID NO: 83571 - DNA, 22 bp, Artificial Sequence
  chemically synthesized
ctccttattataataaccgtga

SEQ ID NO: 83572 - DNA, 22 bp, Artificial Sequence
  chemically synthesized
tccttattataataaccgtgac

SEQ ID NO: 83573 - DNA, 22 bp, Artificial Sequence
  chemically synthesized
cttattataataaccgtgactt

SEQ ID NO: 83574 - DNA, 22 bp, Artificial Sequence
  chemically synthesized
attataataaccgtgacttcat

SEQ ID NO: 83575 - DNA, 22 bp, Artificial Sequence
  chemically synthesized
ttataataaccgtgacttcatt

SEQ ID NO: 83576 - DNA, 22 bp, Artificial Sequence
  chemically synthesized
taataaccgtgacttcatttaa

SEQ ID NO: 83577 - DNA, 22 bp, Artificial Sequence
  chemically synthesized
catttaaggcagcagttacaat

SEQ ID NO: 83578 - DNA, 22 bp, Artificial Sequence
  chemically synthesized
atttaaggcagcagttacaatg

SEQ ID NO: 83579 - DNA, 22 bp, Artificial Sequence
  chemically synthesized
aaggcagcagttacaatgatat

SEQ ID NO: 83580 - DNA, 22 bp, Artificial Sequence
  chemically synthesized
aggcagcagttacaatgatatg

SEQ ID NO: 83581 - DNA, 22 bp, Artificial Sequence
  chemically synthesized
caatgatatgacagtctaccta

SEQ ID NO: 83582 - DNA, 22 bp, Artificial Sequence
  chemically synthesized
cctattaaaaaaaaaaaggcaa

SEQ ID NO: 83583 - DNA, 22 bp, Artificial Sequence
  chemically synthesized
ttaaaaaaaaaaaggcaaaaga

SEQ ID NO: 83584 - DNA, 22 bp, Artificial Sequence
  chemically synthesized
aaaaaaaaaaggcaaaagagaa

SEQ ID NO: 83585 - DNA, 22 bp, Artificial Sequence
  chemically synthesized
tgtttccctaacatcactgtgg

SEQ ID NO: 83586 - DNA, 22 bp, Artificial Sequence
  chemically synthesized
ccctaacatcactgtggctgtt

SEQ ID NO: 83587 - DNA, 22 bp, Artificial Sequence
  chemically synthesized
cctaacatcactgtggctgttt

SEQ ID NO: 83588 - DNA, 22 bp, Artificial Sequence
  chemically synthesized
acatcactgtggctgttttcgt

SEQ ID NO: 83589 - DNA, 22 bp, Artificial Sequence
  chemically synthesized
tggctgttttcgtaacgtttct

SEQ ID NO: 83590 - DNA, 22 bp, Artificial Sequence
  chemically synthesized
ttttcgtaacgtttctcagtga

SEQ ID NO: 83591 - DNA, 22 bp, Artificial Sequence
  chemically synthesized
tcgtaacgtttctcagtgacgc

SEQ ID NO: 83592 - DNA, 22 bp, Artificial Sequence
  chemically synthesized
cgtaacgtttctcagtgacgct

SEQ ID NO: 83593 - DNA, 22 bp, Artificial Sequence
  chemically synthesized
gtaacgtttctcagtgacgctg

SEQ ID NO: 83594 - DNA, 22 bp, Artificial Sequence
  chemically synthesized
ctcagtgacgctggatagtagc

SEQ ID NO: 83595 - DNA, 22 bp, Artificial Sequence
  chemically synthesized
tcagtgacgctggatagtagcc

SEQ ID NO: 83596 - DNA, 22 bp, Artificial Sequence
  chemically synthesized
agtgacgctggatagtagcctt

SEQ ID NO: 83597 - DNA, 22 bp, Artificial Sequence
  chemically synthesized
gatagtagccttgcaggcctta

SEQ ID NO: 83598 - DNA, 22 bp, Artificial Sequence
  chemically synthesized
gcaggccttacaaaggaatctg

SEQ ID NO: 83599 - DNA, 22 bp, Artificial Sequence
  chemically synthesized
caggccttacaaaggaatctga

SEQ ID NO: 83600 - DNA, 22 bp, Artificial Sequence
  chemically synthesized
acaaaggaatctgataactgct

SEQ ID NO: 83601 - DNA, 22 bp, Artificial Sequence
  chemically synthesized
caaaggaatctgataactgctt

SEQ ID NO: 83602 - DNA, 22 bp, Artificial Sequence
  chemically synthesized
ataactgcttctcactggctct

SEQ ID NO: 83603 - DNA, 22 bp, Artificial Sequence
  chemically synthesized
cttctcactggctctgcaggct

SEQ ID NO: 83604 - DNA, 22 bp, Artificial Sequence
  chemically synthesized
ctcactggctctgcaggctacc

SEQ ID NO: 83605 - DNA, 22 bp, Artificial Sequence
  chemically synthesized
tcactggctctgcaggctacca

SEQ ID NO: 83606 - DNA, 22 bp, Artificial Sequence
  chemically synthesized
actggctctgcaggctaccaca

SEQ ID NO: 83607 - DNA, 22 bp, Artificial Sequence
  chemically synthesized
gctctgcaggctaccacatcaa

SEQ ID NO: 83608 - DNA, 22 bp, Artificial Sequence
  chemically synthesized
tgcaggctaccacatcaacaac

SEQ ID NO: 83609 - DNA, 22 bp, Artificial Sequence
  chemically synthesized
caggctaccacatcaacaacag

SEQ ID NO: 83610 - DNA, 22 bp, Artificial Sequence
  chemically synthesized
ccacatcaacaacagtttcagc

SEQ ID NO: 83611 - DNA, 22 bp, Artificial Sequence
  chemically synthesized
cagctgttgttgcctaattcat

SEQ ID NO: 83612 - DNA, 22 bp, Artificial Sequence
  chemically synthesized
agctgttgttgcctaattcatg

SEQ ID NO: 83613 - DNA, 22 bp, Artificial Sequence
  chemically synthesized
ttgttgcctaattcatggaaaa

SEQ ID NO: 83614 - DNA, 22 bp, Artificial Sequence
  chemically synthesized
ttgcctaattcatggaaaacaa

SEQ ID NO: 83615 - DNA, 22 bp, Artificial Sequence
  chemically synthesized
cctaattcatggaaaacaagtt

SEQ ID NO: 83616 - DNA, 22 bp, Artificial Sequence
  chemically synthesized
attcatggaaaacaagtttcct

SEQ ID NO: 83617 - DNA, 22 bp, Artificial Sequence
  chemically synthesized
atggaaaacaagtttccttaga

SEQ ID NO: 83618 - DNA, 22 bp, Artificial Sequence
  chemically synthesized
ccttagaagctggctttttgag

SEQ ID NO: 83619 - DNA, 22 bp, Artificial Sequence
  chemically synthesized
cttagaagctggctttttgaga

SEQ ID NO: 83620 - DNA, 22 bp, Artificial Sequence
  chemically synthesized
agaagctggctttttgagatat

SEQ ID NO: 83621 - DNA, 22 bp, Artificial Sequence
  chemically synthesized
gaagctggctttttgagatata

SEQ ID NO: 83622 - DNA, 22 bp, Artificial Sequence
  chemically synthesized
gctttttgagatatatggaaaa

SEQ ID NO: 83623 - DNA, 22 bp, Artificial Sequence
  chemically synthesized
tttgagatatatggaaaaatgt

SEQ ID NO: 83624 - DNA, 22 bp, Artificial Sequence
  chemically synthesized
ttgagatatatggaaaaatgtc

SEQ ID NO: 83625 - DNA, 22 bp, Artificial Sequence
  chemically synthesized
tgagatatatggaaaaatgtct

SEQ ID NO: 83626 - DNA, 22 bp, Artificial Sequence
  chemically synthesized
gagatatatggaaaaatgtctc

SEQ ID NO: 83627 - DNA, 22 bp, Artificial Sequence
  chemically synthesized
agatatatggaaaaatgtctcc

SEQ ID NO: 83628 - DNA, 22 bp, Artificial Sequence
  chemically synthesized
cacctggctactatgtagcttt

SEQ ID NO: 83629 - DNA, 22 bp, Artificial Sequence
  chemically synthesized
gctactatgtagcttttcaaaa

SEQ ID NO: 83630 - DNA, 22 bp, Artificial Sequence
  chemically synthesized
ctatgtagcttttcaaaacaga

SEQ ID NO: 83631 - DNA, 22 bp, Artificial Sequence
  chemically synthesized
tgtagcttttcaaaacagacag

SEQ ID NO: 83632 - DNA, 22 bp, Artificial Sequence
  chemically synthesized
ttcaaaacagacagtgttttaa

SEQ ID NO: 83633 - DNA, 22 bp, Artificial Sequence
  chemically synthesized
tcaaaacagacagtgttttaaa

SEQ ID NO: 83634 - DNA, 22 bp, Artificial Sequence
  chemically synthesized
caaaacagacagtgttttaaac

SEQ ID NO: 83635 - DNA, 22 bp, Artificial Sequence
  chemically synthesized
aaaacagacagtgttttaaaca

SEQ ID NO: 83636 - DNA, 22 bp, Artificial Sequence
  chemically synthesized
taaacacctgtgatgtctccat

SEQ ID NO: 83637 - DNA, 22 bp, Artificial Sequence
  chemically synthesized
aaacacctgtgatgtctccatc

SEQ ID NO: 83638 - DNA, 22 bp, Artificial Sequence
  chemically synthesized
aacacctgtgatgtctccatct

SEQ ID NO: 83639 - DNA, 22 bp, Artificial Sequence
  chemically synthesized
tgatgtctccatctgctcttcc

SEQ ID NO: 83640 - DNA, 22 bp, Artificial Sequence
  chemically synthesized
catctgctcttcctttcaggac

SEQ ID NO: 83641 - DNA, 22 bp, Artificial Sequence
  chemically synthesized
ctcttcctttcaggacctgggc

SEQ ID NO: 83642 - DNA, 22 bp, Artificial Sequence
  chemically synthesized
ttcctttcaggacctgggctga

SEQ ID NO: 83643 - DNA, 22 bp, Artificial Sequence
  chemically synthesized
cctttcaggacctgggctgatg

SEQ ID NO: 83644 - DNA, 22 bp, Artificial Sequence
  chemically synthesized
ctttcaggacctgggctgatgt

SEQ ID NO: 83645 - DNA, 22 bp, Artificial Sequence
  chemically synthesized
tcaggacctgggctgatgtctc

SEQ ID NO: 83646 - DNA, 22 bp, Artificial Sequence
  chemically synthesized
caggacctgggctgatgtctct

SEQ ID NO: 83647 - DNA, 22 bp, Artificial Sequence
  chemically synthesized
aggacctgggctgatgtctctg

SEQ ID NO: 83648 - DNA, 22 bp, Artificial Sequence
  chemically synthesized
ggctgatgtctctgaaattgcc

SEQ ID NO: 83649 - DNA, 22 bp, Artificial Sequence
  chemically synthesized
atgtctctgaaattgccttttc

SEQ ID NO: 83650 - DNA, 22 bp, Artificial Sequence
  chemically synthesized
tgaaattgccttttcttcctca

SEQ ID NO: 83651 - DNA, 22 bp, Artificial Sequence
  chemically synthesized
aaattgccttttcttcctcagg

SEQ ID NO: 83652 - DNA, 22 bp, Artificial Sequence
  chemically synthesized
ccttttcttcctcaggagaggt

SEQ ID NO: 83653 - DNA, 22 bp, Artificial Sequence
  chemically synthesized
ttcttcctcaggagaggtttag

SEQ ID NO: 83654 - DNA, 22 bp, Artificial Sequence
  chemically synthesized
tcttcctcaggagaggtttagt

SEQ ID NO: 83655 - DNA, 22 bp, Artificial Sequence
  chemically synthesized
cttcctcaggagaggtttagtt

SEQ ID NO: 83656 - DNA, 22 bp, Artificial Sequence
  chemically synthesized
ttcctcaggagaggtttagtta

SEQ ID NO: 83657 - DNA, 22 bp, Artificial Sequence
  chemically synthesized
cctcaggagaggtttagttatt

SEQ ID NO: 83658 - DNA, 22 bp, Artificial Sequence
  chemically synthesized
ctcaggagaggtttagttattt

SEQ ID NO: 83659 - DNA, 22 bp, Artificial Sequence
  chemically synthesized
aggagaggtttagttatttttt

SEQ ID NO: 83660 - DNA, 22 bp, Artificial Sequence
  chemically synthesized
agttatttttttaagtaattgc

SEQ ID NO: 83661 - DNA, 22 bp, Artificial Sequence
  chemically synthesized
gttatttttttaagtaattgct

SEQ ID NO: 83662 - DNA, 22 bp, Artificial Sequence
  chemically synthesized
tttttttaagtaattgcttcca

SEQ ID NO: 83663 - DNA, 22 bp, Artificial Sequence
  chemically synthesized
ttttaagtaattgcttccagat

SEQ ID NO: 83664 - DNA, 22 bp, Artificial Sequence
  chemically synthesized
tttaagtaattgcttccagata

SEQ ID NO: 83665 - DNA, 22 bp, Artificial Sequence
  chemically synthesized
ttaagtaattgcttccagatag

SEQ ID NO: 83666 - DNA, 22 bp, Artificial Sequence
  chemically synthesized
taagtaattgcttccagataga

SEQ ID NO: 83667 - DNA, 22 bp, Artificial Sequence
  chemically synthesized
aagtaattgcttccagatagag

SEQ ID NO: 83668 - DNA, 22 bp, Artificial Sequence
  chemically synthesized
agtaattgcttccagatagagg

SEQ ID NO: 83669 - DNA, 22 bp, Artificial Sequence
  chemically synthesized
cttccagatagaggcctttgca

SEQ ID NO: 83670 - DNA, 22 bp, Artificial Sequence
  chemically synthesized
ccagatagaggcctttgcaaaa

SEQ ID NO: 83671 - DNA, 22 bp, Artificial Sequence
  chemically synthesized
cagatagaggcctttgcaaaac

SEQ ID NO: 83672 - DNA, 22 bp, Artificial Sequence
  chemically synthesized
tgcaaaacaaacaatctaaact

SEQ ID NO: 83673 - DNA, 22 bp, Artificial Sequence
  chemically synthesized
gcaaaacaaacaatctaaacta

SEQ ID NO: 83674 - DNA, 22 bp, Artificial Sequence
  chemically synthesized
caaaacaaacaatctaaactac

SEQ ID NO: 83675 - DNA, 22 bp, Artificial Sequence
  chemically synthesized
aactactaatgttctaaacctg

SEQ ID NO: 83676 - DNA, 22 bp, Artificial Sequence
  chemically synthesized
ctaatgttctaaacctgtttct

SEQ ID NO: 83677 - DNA, 22 bp, Artificial Sequence
  chemically synthesized
atgttctaaacctgtttctttc

SEQ ID NO: 83678 - DNA, 22 bp, Artificial Sequence
  chemically synthesized
taaacctgtttctttctgtata

SEQ ID NO: 83679 - DNA, 22 bp, Artificial Sequence
  chemically synthesized
aacctgtttctttctgtataaa

SEQ ID NO: 83680 - DNA, 22 bp, Artificial Sequence
  chemically synthesized
tttctttctgtataaagcccag

SEQ ID NO: 83681 - DNA, 22 bp, Artificial Sequence
  chemically synthesized
ctttctgtataaagcccagtaa

SEQ ID NO: 83682 - DNA, 22 bp, Artificial Sequence
  chemically synthesized
tttctgtataaagcccagtaat

SEQ ID NO: 83683 - DNA, 22 bp, Artificial Sequence
  chemically synthesized
tctgtataaagcccagtaatca

SEQ ID NO: 83684 - DNA, 22 bp, Artificial Sequence
  chemically synthesized
ctgtataaagcccagtaatcat

SEQ ID NO: 83685 - DNA, 22 bp, Artificial Sequence
  chemically synthesized
tgtataaagcccagtaatcata

SEQ ID NO: 83686 - DNA, 22 bp, Artificial Sequence
  chemically synthesized
tataaagcccagtaatcatata

SEQ ID NO: 83687 - DNA, 22 bp, Artificial Sequence
  chemically synthesized
actttcattggctttttttttt

SEQ ID NO: 83688 - DNA, 22 bp, Artificial Sequence
  chemically synthesized
ctttcattggcttttttttttt

SEQ ID NO: 83689 - DNA, 22 bp, Artificial Sequence
  chemically synthesized
tcattggctttttttttttttt

SEQ ID NO: 83690 - DNA, 22 bp, Artificial Sequence
  chemically synthesized
cattggcttttttttttttttt

SEQ ID NO: 83691 - DNA, 22 bp, Artificial Sequence
  chemically synthesized
attggctttttttttttttttt

SEQ ID NO: 83692 - DNA, 22 bp, Artificial Sequence
  chemically synthesized
gctttttttttttttttttact

SEQ ID NO: 83693 - DNA, 22 bp, Artificial Sequence
  chemically synthesized
tttttttttttttttactgatt

SEQ ID NO: 83694 - DNA, 22 bp, Artificial Sequence
  chemically synthesized
ttttttttttttttactgattt

SEQ ID NO: 83695 - DNA, 22 bp, Artificial Sequence
  chemically synthesized
tttttttttttttactgatttt

SEQ ID NO: 83696 - DNA, 22 bp, Artificial Sequence
  chemically synthesized
ttttttttttttactgattttc

SEQ ID NO: 83697 - DNA, 22 bp, Artificial Sequence
  chemically synthesized
tttttttttttactgattttcc

SEQ ID NO: 83698 - DNA, 22 bp, Artificial Sequence
  chemically synthesized
ttttttttttactgattttcct

SEQ ID NO: 83699 - DNA, 22 bp, Artificial Sequence
  chemically synthesized
tttttttttactgattttcctc

SEQ ID NO: 83700 - DNA, 22 bp, Artificial Sequence
  chemically synthesized
ttttttttactgattttcctcc

SEQ ID NO: 83701 - DNA, 22 bp, Artificial Sequence
  chemically synthesized
tttttttactgattttcctccc

SEQ ID NO: 83702 - DNA, 22 bp, Artificial Sequence
  chemically synthesized
ttttttactgattttcctccct

SEQ ID NO: 83703 - DNA, 22 bp, Artificial Sequence
  chemically synthesized
tttttactgattttcctccctt

SEQ ID NO: 83704 - DNA, 22 bp, Artificial Sequence
  chemically synthesized
ttttactgattttcctcccttt

SEQ ID NO: 83705 - DNA, 22 bp, Artificial Sequence
  chemically synthesized
tttactgattttcctccctttg

SEQ ID NO: 83706 - DNA, 22 bp, Artificial Sequence
  chemically synthesized
ttactgattttcctccctttgg

SEQ ID NO: 83707 - DNA, 22 bp, Artificial Sequence
  chemically synthesized
tactgattttcctccctttggc

SEQ ID NO: 83708 - DNA, 22 bp, Artificial Sequence
  chemically synthesized
actgattttcctccctttggct

SEQ ID NO: 83709 - DNA, 22 bp, Artificial Sequence
  chemically synthesized
ctgattttcctccctttggctg

SEQ ID NO: 83710 - DNA, 22 bp, Artificial Sequence
  chemically synthesized
attttcctccctttggctgaat

SEQ ID NO: 83711 - DNA, 22 bp, Artificial Sequence
  chemically synthesized
tcctccctttggctgaattgta

SEQ ID NO: 83712 - DNA, 22 bp, Artificial Sequence
  chemically synthesized
cctccctttggctgaattgtaa

SEQ ID NO: 83713 - DNA, 22 bp, Artificial Sequence
  chemically synthesized
ctccctttggctgaattgtaaa

SEQ ID NO: 83714 - DNA, 22 bp, Artificial Sequence
  chemically synthesized
cctttggctgaattgtaaagat

SEQ ID NO: 83715 - DNA, 22 bp, Artificial Sequence
  chemically synthesized
tggctgaattgtaaagattctg

SEQ ID NO: 83716 - DNA, 22 bp, Artificial Sequence
  chemically synthesized
ggctgaattgtaaagattctga

SEQ ID NO: 83717 - DNA, 22 bp, Artificial Sequence
  chemically synthesized
gctgaattgtaaagattctgaa

SEQ ID NO: 83718 - DNA, 22 bp, Artificial Sequence
  chemically synthesized
aattgtaaagattctgaagttc

SEQ ID NO: 83719 - DNA, 22 bp, Artificial Sequence
  chemically synthesized
taaagattctgaagttcttcat

SEQ ID NO: 83720 - DNA, 22 bp, Artificial Sequence
  chemically synthesized
tgaagttcttcataaatcttat

SEQ ID NO: 83721 - DNA, 22 bp, Artificial Sequence
  chemically synthesized
aagttcttcataaatcttatca

SEQ ID NO: 83722 - DNA, 22 bp, Artificial Sequence
  chemically synthesized
ttcataaatcttatcatcatag

SEQ ID NO: 83723 - DNA, 22 bp, Artificial Sequence
  chemically synthesized
cataaatcttatcatcatagta

SEQ ID NO: 83724 - DNA, 22 bp, Artificial Sequence
  chemically synthesized
ataaatcttatcatcatagtac

SEQ ID NO: 83725 - DNA, 22 bp, Artificial Sequence
  chemically synthesized
atcatcatagtacaattatata

SEQ ID NO: 83726 - DNA, 22 bp, Artificial Sequence
  chemically synthesized
tcatcatagtacaattatatag

SEQ ID NO: 83727 - DNA, 22 bp, Artificial Sequence
  chemically synthesized
tatagctctaaaataagcaatg

SEQ ID NO: 83728 - DNA, 22 bp, Artificial Sequence
  chemically synthesized
taaaataagcaatgatttctga

SEQ ID NO: 83729 - DNA, 22 bp, Artificial Sequence
  chemically synthesized
aaataagcaatgatttctgagg

SEQ ID NO: 83730 - DNA, 22 bp, Artificial Sequence
  chemically synthesized
ctgaggatactcttaggtattt

SEQ ID NO: 83731 - DNA, 22 bp, Artificial Sequence
  chemically synthesized
tgaggatactcttaggtatttt

SEQ ID NO: 83732 - DNA, 22 bp, Artificial Sequence
  chemically synthesized
aggatactcttaggtatttttt

SEQ ID NO: 83733 - DNA, 22 bp, Artificial Sequence
  chemically synthesized
ttaggtattttttattaactgt

SEQ ID NO: 83734 - DNA, 22 bp, Artificial Sequence
  chemically synthesized
aggtattttttattaactgttt

SEQ ID NO: 83735 - DNA, 22 bp, Artificial Sequence
  chemically synthesized
ggtattttttattaactgtttt

SEQ ID NO: 83736 - DNA, 22 bp, Artificial Sequence
  chemically synthesized
tttattaactgttttgtcacgg

SEQ ID NO: 83737 - DNA, 22 bp, Artificial Sequence
  chemically synthesized
ttattaactgttttgtcacggc

SEQ ID NO: 83738 - DNA, 22 bp, Artificial Sequence
  chemically synthesized
tattaactgttttgtcacggcc

SEQ ID NO: 83739 - DNA, 22 bp, Artificial Sequence
  chemically synthesized
attaactgttttgtcacggcca

SEQ ID NO: 83740 - DNA, 22 bp, Artificial Sequence
  chemically synthesized
ttaactgttttgtcacggccat

SEQ ID NO: 83741 - DNA, 22 bp, Artificial Sequence
  chemically synthesized
actgttttgtcacggccattat

SEQ ID NO: 83742 - DNA, 22 bp, Artificial Sequence
  chemically synthesized
ttttgtcacggccattatttca

SEQ ID NO: 83743 - DNA, 22 bp, Artificial Sequence
  chemically synthesized
tgtcacggccattatttcaaac

SEQ ID NO: 83744 - DNA, 22 bp, Artificial Sequence
  chemically synthesized
gtcacggccattatttcaaact

SEQ ID NO: 83745 - DNA, 22 bp, Artificial Sequence
  chemically synthesized
tcacggccattatttcaaacta

SEQ ID NO: 83746 - DNA, 22 bp, Artificial Sequence
  chemically synthesized
tttcaaactattttggttcaca

SEQ ID NO: 83747 - DNA, 22 bp, Artificial Sequence
  chemically synthesized
caaactattttggttcacattc

SEQ ID NO: 83748 - DNA, 22 bp, Artificial Sequence
  chemically synthesized
aaactattttggttcacattct

SEQ ID NO: 83749 - DNA, 22 bp, Artificial Sequence
  chemically synthesized
ttttggttcacattctataggt

SEQ ID NO: 83750 - DNA, 22 bp, Artificial Sequence
  chemically synthesized
tggttcacattctataggttgc

SEQ ID NO: 83751 - DNA, 22 bp, Artificial Sequence
  chemically synthesized
ggttcacattctataggttgcc

SEQ ID NO: 83752 - DNA, 22 bp, Artificial Sequence
  chemically synthesized
gttcacattctataggttgcct

SEQ ID NO: 83753 - DNA, 22 bp, Artificial Sequence
  chemically synthesized
acattctataggttgcctaatc

SEQ ID NO: 83754 - DNA, 22 bp, Artificial Sequence
  chemically synthesized
tataggttgcctaatctgaagc

SEQ ID NO: 83755 - DNA, 22 bp, Artificial Sequence
  chemically synthesized
taggttgcctaatctgaagcac

SEQ ID NO: 83756 - DNA, 22 bp, Artificial Sequence
  chemically synthesized
cctaatctgaagcacaaacact

SEQ ID NO: 83757 - DNA, 22 bp, Artificial Sequence
  chemically synthesized
atctgaagcacaaacactcata

SEQ ID NO: 83758 - DNA, 22 bp, Artificial Sequence
  chemically synthesized
aagcacaaacactcatagtatg

SEQ ID NO: 83759 - DNA, 22 bp, Artificial Sequence
  chemically synthesized
atagtatgaagtcttcagatga

SEQ ID NO: 83760 - DNA, 22 bp, Artificial Sequence
  chemically synthesized
cagatgagccttcctactctcc

SEQ ID NO: 83761 - DNA, 22 bp, Artificial Sequence
  chemically synthesized
agatgagccttcctactctccc

SEQ ID NO: 83762 - DNA, 22 bp, Artificial Sequence
  chemically synthesized
cctactctccctgttaaacata

SEQ ID NO: 83763 - DNA, 22 bp, Artificial Sequence
  chemically synthesized
ctactctccctgttaaacataa

SEQ ID NO: 83764 - DNA, 22 bp, Artificial Sequence
  chemically synthesized
ctctccctgttaaacataactc

SEQ ID NO: 83765 - DNA, 22 bp, Artificial Sequence
  chemically synthesized
tccctgttaaacataactctca

SEQ ID NO: 83766 - DNA, 22 bp, Artificial Sequence
  chemically synthesized
cctgttaaacataactctcaaa

SEQ ID NO: 83767 - DNA, 22 bp, Artificial Sequence
  chemically synthesized
ttaaacataactctcaaaccaa

SEQ ID NO: 83768 - DNA, 22 bp, Artificial Sequence
  chemically synthesized
aacataactctcaaaccaacaa

SEQ ID NO: 83769 - DNA, 22 bp, Artificial Sequence
  chemically synthesized
tcaaaccaacaactcagttgtg

SEQ ID NO: 83770 - DNA, 22 bp, Artificial Sequence
  chemically synthesized
aaaccaacaactcagttgtgtc

SEQ ID NO: 83771 - DNA, 22 bp, Artificial Sequence
  chemically synthesized
agttgtgtcagacatgtaatat

SEQ ID NO: 83772 - DNA, 22 bp, Artificial Sequence
  chemically synthesized
tgtcagacatgtaatattgttc

SEQ ID NO: 83773 - DNA, 22 bp, Artificial Sequence
  chemically synthesized
ttcaaataataaatataaattc

SEQ ID NO: 83774 - DNA, 22 bp, Artificial Sequence
  chemically synthesized
aaataataaatataaattcatt

SEQ ID NO: 83775 - DNA, 22 bp, Artificial Sequence
  chemically synthesized
attctgatgcttccctatgagt

SEQ ID NO: 83776 - DNA, 22 bp, Artificial Sequence
  chemically synthesized
tgatgcttccctatgagtggct

SEQ ID NO: 83777 - DNA, 22 bp, Artificial Sequence
  chemically synthesized
atgcttccctatgagtggctgg

SEQ ID NO: 83778 - DNA, 22 bp, Artificial Sequence
  chemically synthesized
ccctatgagtggctggtggaaa

SEQ ID NO: 83779 - DNA, 22 bp, Artificial Sequence
  chemically synthesized
cctatgagtggctggtggaaaa

SEQ ID NO: 83780 - DNA, 22 bp, Artificial Sequence
  chemically synthesized
tgagtggctggtggaaaacata

SEQ ID NO: 83781 - DNA, 22 bp, Artificial Sequence
  chemically synthesized
gtggaaaacatattgtcagttg

SEQ ID NO: 83782 - DNA, 22 bp, Artificial Sequence
  chemically synthesized
tcagttgttgaagaattctctg

SEQ ID NO: 83783 - DNA, 22 bp, Artificial Sequence
  chemically synthesized
ttgaagaattctctgcttcccc

SEQ ID NO: 83784 - DNA, 22 bp, Artificial Sequence
  chemically synthesized
aagaattctctgcttccccagt

SEQ ID NO: 83785 - DNA, 22 bp, Artificial Sequence
  chemically synthesized
tctgcttccccagtgttgtgtc

SEQ ID NO: 83786 - DNA, 22 bp, Artificial Sequence
  chemically synthesized
tgcttccccagtgttgtgtcag

SEQ ID NO: 83787 - DNA, 22 bp, Artificial Sequence
  chemically synthesized
cttccccagtgttgtgtcagct

SEQ ID NO: 83788 - DNA, 22 bp, Artificial Sequence
  chemically synthesized
ccccagtgttgtgtcagctctc

SEQ ID NO: 83789 - DNA, 22 bp, Artificial Sequence
  chemically synthesized
cccagtgttgtgtcagctctcc

SEQ ID NO: 83790 - DNA, 22 bp, Artificial Sequence
  chemically synthesized
tgtcagctctccggcgtatggg

SEQ ID NO: 83791 - DNA, 22 bp, Artificial Sequence
  chemically synthesized
tccggcgtatgggagggtggat

SEQ ID NO: 83792 - DNA, 22 bp, Artificial Sequence
  chemically synthesized
cggcgtatgggagggtggatgc

SEQ ID NO: 83793 - DNA, 22 bp, Artificial Sequence
  chemically synthesized
attcactttcaaagcattagaa

SEQ ID NO: 83794 - DNA, 22 bp, Artificial Sequence
  chemically synthesized
ttcactttcaaagcattagaag

SEQ ID NO: 83795 - DNA, 22 bp, Artificial Sequence
  chemically synthesized
actttcaaagcattagaaggaa

SEQ ID NO: 83796 - DNA, 22 bp, Artificial Sequence
  chemically synthesized
tcaaagcattagaaggaagctt

SEQ ID NO: 83797 - DNA, 22 bp, Artificial Sequence
  chemically synthesized
caaagcattagaaggaagcttc

SEQ ID NO: 83798 - DNA, 22 bp, Artificial Sequence
  chemically synthesized
aaagcattagaaggaagcttct

SEQ ID NO: 83799 - DNA, 22 bp, Artificial Sequence
  chemically synthesized
gaaggaagcttctttggccatt

SEQ ID NO: 83800 - DNA, 22 bp, Artificial Sequence
  chemically synthesized
ctttggccattgagaaatctat

SEQ ID NO: 83801 - DNA, 22 bp, Artificial Sequence
  chemically synthesized
tttggccattgagaaatctatg

SEQ ID NO: 83802 - DNA, 22 bp, Artificial Sequence
  chemically synthesized
tggccattgagaaatctatgag

SEQ ID NO: 83803 - DNA, 22 bp, Artificial Sequence
  chemically synthesized
ggccattgagaaatctatgaga

SEQ ID NO: 83804 - DNA, 22 bp, Artificial Sequence
  chemically synthesized
gccattgagaaatctatgagac

SEQ ID NO: 83805 - DNA, 22 bp, Artificial Sequence
  chemically synthesized
agaaatctatgagacattcaca

SEQ ID NO: 83806 - DNA, 22 bp, Artificial Sequence
  chemically synthesized
tgagacattcacatgacctcta

SEQ ID NO: 83807 - DNA, 22 bp, Artificial Sequence
  chemically synthesized
acatgacctctacagattcagc

SEQ ID NO: 83808 - DNA, 22 bp, Artificial Sequence
  chemically synthesized
tacagattcagcagctaacttc

SEQ ID NO: 83809 - DNA, 22 bp, Artificial Sequence
  chemically synthesized
cagattcagcagctaacttctc

SEQ ID NO: 83810 - DNA, 22 bp, Artificial Sequence
  chemically synthesized
agcagctaacttctcttttcat

SEQ ID NO: 83811 - DNA, 22 bp, Artificial Sequence
  chemically synthesized
acttctcttttcattataaaac

SEQ ID NO: 83812 - DNA, 22 bp, Artificial Sequence
  chemically synthesized
ctcttttcattataaaactggg

SEQ ID NO: 83813 - DNA, 22 bp, Artificial Sequence
  chemically synthesized
tcttttcattataaaactgggg

SEQ ID NO: 83814 - DNA, 22 bp, Artificial Sequence
  chemically synthesized
ttttcattataaaactggggca

SEQ ID NO: 83815 - DNA, 22 bp, Artificial Sequence
  chemically synthesized
ttcattataaaactggggcata

SEQ ID NO: 83816 - DNA, 22 bp, Artificial Sequence
  chemically synthesized
tcattataaaactggggcatag

SEQ ID NO: 83817 - DNA, 22 bp, Artificial Sequence
  chemically synthesized
cattataaaactggggcatagg

SEQ ID NO: 83818 - DNA, 22 bp, Artificial Sequence
  chemically synthesized
attataaaactggggcatagga

SEQ ID NO: 83819 - DNA, 22 bp, Artificial Sequence
  chemically synthesized
taaaactggggcataggaatct

SEQ ID NO: 83820 - DNA, 22 bp, Artificial Sequence
  chemically synthesized
gggcataggaatcttgtcagat

SEQ ID NO: 83821 - DNA, 22 bp, Artificial Sequence
  chemically synthesized
gtcagattggccacattccagt

SEQ ID NO: 83822 - DNA, 22 bp, Artificial Sequence
  chemically synthesized
tcagattggccacattccagtc

SEQ ID NO: 83823 - DNA, 22 bp, Artificial Sequence
  chemically synthesized
gccacattccagtcggccagga

SEQ ID NO: 83824 - DNA, 22 bp, Artificial Sequence
  chemically synthesized
cagtcggccaggagggaccatg

SEQ ID NO: 83825 - DNA, 22 bp, Artificial Sequence
  chemically synthesized
attatcattagggaacctggag

SEQ ID NO: 83826 - DNA, 22 bp, Artificial Sequence
  chemically synthesized
ttatcattagggaacctggagc

SEQ ID NO: 83827 - DNA, 22 bp, Artificial Sequence
  chemically synthesized
tcattagggaacctggagcagt

SEQ ID NO: 83828 - DNA, 22 bp, Artificial Sequence
  chemically synthesized
gggaacctggagcagtactacc

SEQ ID NO: 83829 - DNA, 22 bp, Artificial Sequence
  chemically synthesized
gagcagtactaccacctgacat

SEQ ID NO: 83830 - DNA, 22 bp, Artificial Sequence
  chemically synthesized
ccacctgacattcatatcaact

SEQ ID NO: 83831 - DNA, 22 bp, Artificial Sequence
  chemically synthesized
acattcatatcaacttttcttt

SEQ ID NO: 83832 - DNA, 22 bp, Artificial Sequence
  chemically synthesized
atatcaacttttcttttttttt

SEQ ID NO: 83833 - DNA, 22 bp, Artificial Sequence
  chemically synthesized
ttctttttttttctcttttttt

SEQ ID NO: 83834 - DNA, 22 bp, Artificial Sequence
  chemically synthesized
tctttttttttctctttttttt

SEQ ID NO: 83835 - DNA, 22 bp, Artificial Sequence
  chemically synthesized
ctttttttttctcttttttttt

SEQ ID NO: 83836 - DNA, 22 bp, Artificial Sequence
  chemically synthesized
tttttttttctctttttttttt

SEQ ID NO: 83837 - DNA, 22 bp, Artificial Sequence
  chemically synthesized
tttttttctctttttttttttt

SEQ ID NO: 83838 - DNA, 22 bp, Artificial Sequence
  chemically synthesized
ttttttctcttttttttttttt

SEQ ID NO: 83839 - DNA, 22 bp, Artificial Sequence
  chemically synthesized
tttttctctttttttttttttt

SEQ ID NO: 83840 - DNA, 22 bp, Artificial Sequence
  chemically synthesized
ttttctcttttttttttttttt

SEQ ID NO: 83841 - DNA, 22 bp, Artificial Sequence
  chemically synthesized
tttctctttttttttttttttt

SEQ ID NO: 83842 - DNA, 22 bp, Artificial Sequence
  chemically synthesized
ttctcttttttttttttttttt

SEQ ID NO: 83843 - DNA, 22 bp, Artificial Sequence
  chemically synthesized
tctctttttttttttttttttg

SEQ ID NO: 83844 - DNA, 22 bp, Artificial Sequence
  chemically synthesized
ctctttttttttttttttttga

SEQ ID NO: 83845 - DNA, 22 bp, Artificial Sequence
  chemically synthesized
tctttttttttttttttttgag

SEQ ID NO: 83846 - DNA, 22 bp, Artificial Sequence
  chemically synthesized
tttttttttttttttttgagac

SEQ ID NO: 83847 - DNA, 22 bp, Artificial Sequence
  chemically synthesized
tttttttttttttttgagacag

SEQ ID NO: 83848 - DNA, 22 bp, Artificial Sequence
  chemically synthesized
ttttttttttttttgagacaga

SEQ ID NO: 83849 - DNA, 22 bp, Artificial Sequence
  chemically synthesized
tttttttttttttgagacagag

SEQ ID NO: 83850 - DNA, 22 bp, Artificial Sequence
  chemically synthesized
ttttttttttttgagacagagt

SEQ ID NO: 83851 - DNA, 22 bp, Artificial Sequence
  chemically synthesized
tttttttttttgagacagagtc

SEQ ID NO: 83852 - DNA, 22 bp, Artificial Sequence
  chemically synthesized
ttttttttttgagacagagtct

SEQ ID NO: 83853 - DNA, 22 bp, Artificial Sequence
  chemically synthesized
tttttttttgagacagagtctc

SEQ ID NO: 83854 - DNA, 22 bp, Artificial Sequence
  chemically synthesized
ttttttttgagacagagtctct

SEQ ID NO: 83855 - DNA, 22 bp, Artificial Sequence
  chemically synthesized
tttttttgagacagagtctctc

SEQ ID NO: 83856 - DNA, 22 bp, Artificial Sequence
  chemically synthesized
ttttttgagacagagtctctct

SEQ ID NO: 83857 - DNA, 22 bp, Artificial Sequence
  chemically synthesized
tttttgagacagagtctctctc

SEQ ID NO: 83858 - DNA, 22 bp, Artificial Sequence
  chemically synthesized
ttttgagacagagtctctctct

SEQ ID NO: 83859 - DNA, 22 bp, Artificial Sequence
  chemically synthesized
tttgagacagagtctctctctg

SEQ ID NO: 83860 - DNA, 22 bp, Artificial Sequence
  chemically synthesized
ttgagacagagtctctctctgt

SEQ ID NO: 83861 - DNA, 22 bp, Artificial Sequence
  chemically synthesized
tgagacagagtctctctctgtc

SEQ ID NO: 83862 - DNA, 22 bp, Artificial Sequence
  chemically synthesized
gagacagagtctctctctgtcg

SEQ ID NO: 83863 - DNA, 22 bp, Artificial Sequence
  chemically synthesized
agacagagtctctctctgtcgc

SEQ ID NO: 83864 - DNA, 22 bp, Artificial Sequence
  chemically synthesized
tctctgtcgcccaggctggagt

SEQ ID NO: 83865 - DNA, 22 bp, Artificial Sequence
  chemically synthesized
tctgtcgcccaggctggagtgc

SEQ ID NO: 83866 - DNA, 22 bp, Artificial Sequence
  chemically synthesized
tgtcgcccaggctggagtgcag

SEQ ID NO: 83867 - DNA, 22 bp, Artificial Sequence
  chemically synthesized
tcgcccaggctggagtgcagtg

SEQ ID NO: 83868 - DNA, 22 bp, Artificial Sequence
  chemically synthesized
gagtgcagtggcgtgatctcga

SEQ ID NO: 83869 - DNA, 22 bp, Artificial Sequence
  chemically synthesized
gactcactgcaagctccacctc

SEQ ID NO: 83870 - DNA, 22 bp, Artificial Sequence
  chemically synthesized
actgcaagctccacctcccggg

SEQ ID NO: 83871 - DNA, 22 bp, Artificial Sequence
  chemically synthesized
caagctccacctcccgggttca

SEQ ID NO: 83872 - DNA, 22 bp, Artificial Sequence
  chemically synthesized
cacctcccgggttcacgccatt

SEQ ID NO: 83873 - DNA, 22 bp, Artificial Sequence
  chemically synthesized
ccgggttcacgccattctcctg

SEQ ID NO: 83874 - DNA, 22 bp, Artificial Sequence
  chemically synthesized
acgccattctcctgtctcagcc

SEQ ID NO: 83875 - DNA, 22 bp, Artificial Sequence
  chemically synthesized
tcctgtctcagcctcccgagta

SEQ ID NO: 83876 - DNA, 22 bp, Artificial Sequence
  chemically synthesized
ctgtctcagcctcccgagtacc

SEQ ID NO: 83877 - DNA, 22 bp, Artificial Sequence
  chemically synthesized
tctcagcctcccgagtacctgg

SEQ ID NO: 83878 - DNA, 22 bp, Artificial Sequence
  chemically synthesized
agcctcccgagtacctgggact

SEQ ID NO: 83879 - DNA, 22 bp, Artificial Sequence
  chemically synthesized
ccgagtacctgggactacaggt

SEQ ID NO: 83880 - DNA, 22 bp, Artificial Sequence
  chemically synthesized
ggactacaggtgcccgccacca

SEQ ID NO: 83881 - DNA, 22 bp, Artificial Sequence
  chemically synthesized
caggtgcccgccaccacgcctg

SEQ ID NO: 83882 - DNA, 22 bp, Artificial Sequence
  chemically synthesized
gatactttcttgtgttttttta

SEQ ID NO: 83883 - DNA, 22 bp, Artificial Sequence
  chemically synthesized
tcttgtgtttttttagtagaga

SEQ ID NO: 83884 - DNA, 22 bp, Artificial Sequence
  chemically synthesized
cttgtgtttttttagtagagac

SEQ ID NO: 83885 - DNA, 22 bp, Artificial Sequence
  chemically synthesized
ttgtgtttttttagtagagacg

SEQ ID NO: 83886 - DNA, 22 bp, Artificial Sequence
  chemically synthesized
gtgtttttttagtagagacggg

SEQ ID NO: 83887 - DNA, 22 bp, Artificial Sequence
  chemically synthesized
tgtttttttagtagagacgggg

SEQ ID NO: 83888 - DNA, 22 bp, Artificial Sequence
  chemically synthesized
ttttagtagagacggggtttca

SEQ ID NO: 83889 - DNA, 22 bp, Artificial Sequence
  chemically synthesized
tttagtagagacggggtttcac

SEQ ID NO: 83890 - DNA, 22 bp, Artificial Sequence
  chemically synthesized
ttagtagagacggggtttcacc

SEQ ID NO: 83891 - DNA, 22 bp, Artificial Sequence
  chemically synthesized
tagtagagacggggtttcacca

SEQ ID NO: 83892 - DNA, 22 bp, Artificial Sequence
  chemically synthesized
agtagagacggggtttcaccat

SEQ ID NO: 83893 - DNA, 22 bp, Artificial Sequence
  chemically synthesized
gtagagacggggtttcaccatt

SEQ ID NO: 83894 - DNA, 22 bp, Artificial Sequence
  chemically synthesized
caccattgctggccaggatggt

SEQ ID NO: 83895 - DNA, 22 bp, Artificial Sequence
  chemically synthesized
accattgctggccaggatggtc

SEQ ID NO: 83896 - DNA, 22 bp, Artificial Sequence
  chemically synthesized
ctggccaggatggtctcgatct

SEQ ID NO: 83897 - DNA, 22 bp, Artificial Sequence
  chemically synthesized
gccaggatggtctcgatctcct

SEQ ID NO: 83898 - DNA, 22 bp, Artificial Sequence
  chemically synthesized
gatctcctgacctcatgatccg

SEQ ID NO: 83899 - DNA, 22 bp, Artificial Sequence
  chemically synthesized
ctgacctcatgatccgcccgcc

SEQ ID NO: 83900 - DNA, 22 bp, Artificial Sequence
  chemically synthesized
acctcatgatccgcccgcctcg

SEQ ID NO: 83901 - DNA, 22 bp, Artificial Sequence
  chemically synthesized
atgatccgcccgcctcggcagc

SEQ ID NO: 83902 - DNA, 22 bp, Artificial Sequence
  chemically synthesized
ggcagctactatgattatatag

SEQ ID NO: 83903 - DNA, 22 bp, Artificial Sequence
  chemically synthesized
ctatgattatatagtaaaaaat

SEQ ID NO: 83904 - DNA, 22 bp, Artificial Sequence
  chemically synthesized
tgattatatagtaaaaaatata

SEQ ID NO: 83905 - DNA, 22 bp, Artificial Sequence
  chemically synthesized
tatagtaaaaaatatatatatt

SEQ ID NO: 83906 - DNA, 22 bp, Artificial Sequence
  chemically synthesized
acattttcccctctagaaccta

SEQ ID NO: 83907 - DNA, 22 bp, Artificial Sequence
  chemically synthesized
tcccctctagaacctacctcac

SEQ ID NO: 83908 - DNA, 22 bp, Artificial Sequence
  chemically synthesized
cccctctagaacctacctcaca

SEQ ID NO: 83909 - DNA, 22 bp, Artificial Sequence
  chemically synthesized
ccctctagaacctacctcacag

SEQ ID NO: 83910 - DNA, 22 bp, Artificial Sequence
  chemically synthesized
tagaacctacctcacagttttc

SEQ ID NO: 83911 - DNA, 22 bp, Artificial Sequence
  chemically synthesized
gaacctacctcacagttttcac

SEQ ID NO: 83912 - DNA, 22 bp, Artificial Sequence
  chemically synthesized
cctcacagttttcacttctgat

SEQ ID NO: 83913 - DNA, 22 bp, Artificial Sequence
  chemically synthesized
acagttttcacttctgatagct

SEQ ID NO: 83914 - DNA, 22 bp, Artificial Sequence
  chemically synthesized
tcacttctgatagctataccag

SEQ ID NO: 83915 - DNA, 22 bp, Artificial Sequence
  chemically synthesized
cacttctgatagctataccaga

SEQ ID NO: 83916 - DNA, 22 bp, Artificial Sequence
  chemically synthesized
acttctgatagctataccagaa

SEQ ID NO: 83917 - DNA, 22 bp, Artificial Sequence
  chemically synthesized
ctgatagctataccagaagatg

SEQ ID NO: 83918 - DNA, 22 bp, Artificial Sequence
  chemically synthesized
tgatagctataccagaagatgc

SEQ ID NO: 83919 - DNA, 22 bp, Artificial Sequence
  chemically synthesized
atagctataccagaagatgcac

SEQ ID NO: 83920 - DNA, 22 bp, Artificial Sequence
  chemically synthesized
taccagaagatgcactagatcc

SEQ ID NO: 83921 - DNA, 22 bp, Artificial Sequence
  chemically synthesized
gatcctctttgacatcaggaaa

SEQ ID NO: 83922 - DNA, 22 bp, Artificial Sequence
  chemically synthesized
tttgacatcaggaaattcactc

SEQ ID NO: 83923 - DNA, 22 bp, Artificial Sequence
  chemically synthesized
tgacatcaggaaattcactcct

SEQ ID NO: 83924 - DNA, 22 bp, Artificial Sequence
  chemically synthesized
gacatcaggaaattcactcctt

SEQ ID NO: 83925 - DNA, 22 bp, Artificial Sequence
  chemically synthesized
acatcaggaaattcactccttt

SEQ ID NO: 83926 - DNA, 22 bp, Artificial Sequence
  chemically synthesized
actcctttatccttcaaattaa

SEQ ID NO: 83927 - DNA, 22 bp, Artificial Sequence
  chemically synthesized
ctttatccttcaaattaacctt

SEQ ID NO: 83928 - DNA, 22 bp, Artificial Sequence
  chemically synthesized
tatccttcaaattaaccttata

SEQ ID NO: 83929 - DNA, 22 bp, Artificial Sequence
  chemically synthesized
atccttcaaattaaccttatac

SEQ ID NO: 83930 - DNA, 22 bp, Artificial Sequence
  chemically synthesized
tccttcaaattaaccttatact

SEQ ID NO: 83931 - DNA, 22 bp, Artificial Sequence
  chemically synthesized
caaattaaccttatactgtaac

SEQ ID NO: 83932 - DNA, 22 bp, Artificial Sequence
  chemically synthesized
aaattaaccttatactgtaacc

SEQ ID NO: 83933 - DNA, 22 bp, Artificial Sequence
  chemically synthesized
accttatactgtaacccagaag

SEQ ID NO: 83934 - DNA, 22 bp, Artificial Sequence
  chemically synthesized
atactgtaacccagaagaccta

SEQ ID NO: 83935 - DNA, 22 bp, Artificial Sequence
  chemically synthesized
tactgtaacccagaagacctaa

SEQ ID NO: 83936 - DNA, 22 bp, Artificial Sequence
  chemically synthesized
taacccagaagacctaatttat

SEQ ID NO: 83937 - DNA, 22 bp, Artificial Sequence
  chemically synthesized
atttattgttctaggaataatt

SEQ ID NO: 83938 - DNA, 22 bp, Artificial Sequence
  chemically synthesized
attgttctaggaataattttac

SEQ ID NO: 83939 - DNA, 22 bp, Artificial Sequence
  chemically synthesized
ttgttctaggaataattttaca

SEQ ID NO: 83940 - DNA, 22 bp, Artificial Sequence
  chemically synthesized
ttctaggaataattttacactt

SEQ ID NO: 83941 - DNA, 22 bp, Artificial Sequence
  chemically synthesized
taggaataattttacacttatc

SEQ ID NO: 83942 - DNA, 22 bp, Artificial Sequence
  chemically synthesized
ggaataattttacacttatctt

SEQ ID NO: 83943 - DNA, 22 bp, Artificial Sequence
  chemically synthesized
tacacttatctttctaaccaga

SEQ ID NO: 83944 - DNA, 22 bp, Artificial Sequence
  chemically synthesized
acacttatctttctaaccagat

SEQ ID NO: 83945 - DNA, 22 bp, Artificial Sequence
  chemically synthesized
cacttatctttctaaccagata

SEQ ID NO: 83946 - DNA, 22 bp, Artificial Sequence
  chemically synthesized
atctttctaaccagatacttta

SEQ ID NO: 83947 - DNA, 22 bp, Artificial Sequence
  chemically synthesized
tctttctaaccagatactttac

SEQ ID NO: 83948 - DNA, 22 bp, Artificial Sequence
  chemically synthesized
tctaaccagatactttactctg

SEQ ID NO: 83949 - DNA, 22 bp, Artificial Sequence
  chemically synthesized
ctaaccagatactttactctgt

SEQ ID NO: 83950 - DNA, 22 bp, Artificial Sequence
  chemically synthesized
taaccagatactttactctgtc

SEQ ID NO: 83951 - DNA, 22 bp, Artificial Sequence
  chemically synthesized
accagatactttactctgtcca

SEQ ID NO: 83952 - DNA, 22 bp, Artificial Sequence
  chemically synthesized
tactctgtccagaaacaatttc

SEQ ID NO: 83953 - DNA, 22 bp, Artificial Sequence
  chemically synthesized
actctgtccagaaacaatttcc

SEQ ID NO: 83954 - DNA, 22 bp, Artificial Sequence
  chemically synthesized
ctctgtccagaaacaatttcct

SEQ ID NO: 83955 - DNA, 22 bp, Artificial Sequence
  chemically synthesized
tgtccagaaacaatttcctcac

SEQ ID NO: 83956 - DNA, 22 bp, Artificial Sequence
  chemically synthesized
tccagaaacaatttcctcactt

SEQ ID NO: 83957 - DNA, 22 bp, Artificial Sequence
  chemically synthesized
cctcactttgaggcttaagcta

SEQ ID NO: 83958 - DNA, 22 bp, Artificial Sequence
  chemically synthesized
ctcactttgaggcttaagctat

SEQ ID NO: 83959 - DNA, 22 bp, Artificial Sequence
  chemically synthesized
actttgaggcttaagctattag

SEQ ID NO: 83960 - DNA, 22 bp, Artificial Sequence
  chemically synthesized
tgaggcttaagctattagaaac

SEQ ID NO: 83961 - DNA, 22 bp, Artificial Sequence
  chemically synthesized
gaggcttaagctattagaaacc

SEQ ID NO: 83962 - DNA, 22 bp, Artificial Sequence
  chemically synthesized
aggcttaagctattagaaacca

SEQ ID NO: 83963 - DNA, 22 bp, Artificial Sequence
  chemically synthesized
aagctattagaaaccaaagcct

SEQ ID NO: 83964 - DNA, 22 bp, Artificial Sequence
  chemically synthesized
agctattagaaaccaaagcctg

SEQ ID NO: 83965 - DNA, 22 bp, Artificial Sequence
  chemically synthesized
ttagaaaccaaagcctgtattt

SEQ ID NO: 83966 - DNA, 22 bp, Artificial Sequence
  chemically synthesized
gaaaccaaagcctgtatttttg

SEQ ID NO: 83967 - DNA, 22 bp, Artificial Sequence
  chemically synthesized
tatttttgtttccctctgagtc

SEQ ID NO: 83968 - DNA, 22 bp, Artificial Sequence
  chemically synthesized
ttgtttccctctgagtcaaata

SEQ ID NO: 83969 - DNA, 22 bp, Artificial Sequence
  chemically synthesized
tgtttccctctgagtcaaataa

SEQ ID NO: 83970 - DNA, 22 bp, Artificial Sequence
  chemically synthesized
gtttccctctgagtcaaataag

SEQ ID NO: 83971 - DNA, 22 bp, Artificial Sequence
  chemically synthesized
tttccctctgagtcaaataagt

SEQ ID NO: 83972 - DNA, 22 bp, Artificial Sequence
  chemically synthesized
ccctctgagtcaaataagtaga

SEQ ID NO: 83973 - DNA, 22 bp, Artificial Sequence
  chemically synthesized
cctctgagtcaaataagtagac

SEQ ID NO: 83974 - DNA, 22 bp, Artificial Sequence
  chemically synthesized
tgagtcaaataagtagacagag

SEQ ID NO: 83975 - DNA, 22 bp, Artificial Sequence
  chemically synthesized
agtcaaataagtagacagaggc

SEQ ID NO: 83976 - DNA, 22 bp, Artificial Sequence
  chemically synthesized
tgttattgaatgaagtccaaag

SEQ ID NO: 83977 - DNA, 22 bp, Artificial Sequence
  chemically synthesized
ttgaatgaagtccaaagtgaaa

SEQ ID NO: 83978 - DNA, 22 bp, Artificial Sequence
  chemically synthesized
aatgaagtccaaagtgaaagga

SEQ ID NO: 83979 - DNA, 22 bp, Artificial Sequence
  chemically synthesized
caggaagacaaatctggttgtt

SEQ ID NO: 83980 - DNA, 22 bp, Artificial Sequence
  chemically synthesized
gttgttttagttgatatctaaa

SEQ ID NO: 83981 - DNA, 22 bp, Artificial Sequence
  chemically synthesized
ttttagttgatatctaaaaata

SEQ ID NO: 83982 - DNA, 22 bp, Artificial Sequence
  chemically synthesized
tagttgatatctaaaaataaaa

SEQ ID NO: 83983 - DNA, 22 bp, Artificial Sequence
  chemically synthesized
agttgatatctaaaaataaaaa

SEQ ID NO: 83984 - DNA, 22 bp, Artificial Sequence
  chemically synthesized
gttgatatctaaaaataaaaat

SEQ ID NO: 83985 - DNA, 22 bp, Artificial Sequence
  chemically synthesized
atatctaaaaataaaaataaat

SEQ ID NO: 83986 - DNA, 22 bp, Artificial Sequence
  chemically synthesized
aaaataaaaataaatatttgct

SEQ ID NO: 83987 - DNA, 22 bp, Artificial Sequence
  chemically synthesized
gctttttggtgtaaaatgactc

SEQ ID NO: 83988 - DNA, 22 bp, Artificial Sequence
  chemically synthesized
ctttttggtgtaaaatgactct

SEQ ID NO: 83989 - DNA, 22 bp, Artificial Sequence
  chemically synthesized
tttggtgtaaaatgactcttat

SEQ ID NO: 83990 - DNA, 22 bp, Artificial Sequence
  chemically synthesized
ttggtgtaaaatgactcttatg

SEQ ID NO: 83991 - DNA, 22 bp, Artificial Sequence
  chemically synthesized
tggtgtaaaatgactcttatgc

SEQ ID NO: 83992 - DNA, 22 bp, Artificial Sequence
  chemically synthesized
ggtgtaaaatgactcttatgca

SEQ ID NO: 83993 - DNA, 22 bp, Artificial Sequence
  chemically synthesized
gtgtaaaatgactcttatgcat

SEQ ID NO: 83994 - DNA, 22 bp, Artificial Sequence
  chemically synthesized
ttatgcattaatttgtccaatt

SEQ ID NO: 83995 - DNA, 22 bp, Artificial Sequence
  chemically synthesized
atgcattaatttgtccaatttt

SEQ ID NO: 83996 - DNA, 22 bp, Artificial Sequence
  chemically synthesized
tgcattaatttgtccaatttta

SEQ ID NO: 83997 - DNA, 22 bp, Artificial Sequence
  chemically synthesized
atttgtccaattttaacactta

SEQ ID NO: 83998 - DNA, 22 bp, Artificial Sequence
  chemically synthesized
gtccaattttaacacttacctt

SEQ ID NO: 83999 - DNA, 22 bp, Artificial Sequence
  chemically synthesized
tccaattttaacacttaccttc

SEQ ID NO: 84000 - DNA, 22 bp, Artificial Sequence
  chemically synthesized
taacacttaccttcttagatac

SEQ ID NO: 84001 - DNA, 22 bp, Artificial Sequence
  chemically synthesized
aacacttaccttcttagatacc

SEQ ID NO: 84002 - DNA, 22 bp, Artificial Sequence
  chemically synthesized
acacttaccttcttagatacct

SEQ ID NO: 84003 - DNA, 22 bp, Artificial Sequence
  chemically synthesized
accttcttagatacctaataga

SEQ ID NO: 84004 - DNA, 22 bp, Artificial Sequence
  chemically synthesized
ccttcttagatacctaatagaa

SEQ ID NO: 84005 - DNA, 22 bp, Artificial Sequence
  chemically synthesized
cttagatacctaatagaatata

SEQ ID NO: 84006 - DNA, 22 bp, Artificial Sequence
  chemically synthesized
ttagatacctaatagaatatag

SEQ ID NO: 84007 - DNA, 22 bp, Artificial Sequence
  chemically synthesized
agatacctaatagaatatagga

SEQ ID NO: 84008 - DNA, 22 bp, Artificial Sequence
  chemically synthesized
gatacctaatagaatataggaa

SEQ ID NO: 84009 - DNA, 22 bp, Artificial Sequence
  chemically synthesized
atagaatataggaagattaaaa

SEQ ID NO: 84010 - DNA, 22 bp, Artificial Sequence
  chemically synthesized
aaacaattattttcttgttatc

SEQ ID NO: 84011 - DNA, 22 bp, Artificial Sequence
  chemically synthesized
ttttcttgttatccatgcatag

SEQ ID NO: 84012 - DNA, 22 bp, Artificial Sequence
  chemically synthesized
tcttgttatccatgcatagttt

SEQ ID NO: 84013 - DNA, 22 bp, Artificial Sequence
  chemically synthesized
cttgttatccatgcatagtttt

SEQ ID NO: 84014 - DNA, 22 bp, Artificial Sequence
  chemically synthesized
ttgttatccatgcatagttttg

SEQ ID NO: 84015 - DNA, 22 bp, Artificial Sequence
  chemically synthesized
gttatccatgcatagttttgta

SEQ ID NO: 84016 - DNA, 22 bp, Artificial Sequence
  chemically synthesized
ttatccatgcatagttttgtac

SEQ ID NO: 84017 - DNA, 22 bp, Artificial Sequence
  chemically synthesized
tccatgcatagttttgtacctg

SEQ ID NO: 84018 - DNA, 22 bp, Artificial Sequence
  chemically synthesized
tgtacctgatttccttcctttc

SEQ ID NO: 84019 - DNA, 22 bp, Artificial Sequence
  chemically synthesized
gtacctgatttccttcctttct

SEQ ID NO: 84020 - DNA, 22 bp, Artificial Sequence
  chemically synthesized
tacctgatttccttcctttctt

SEQ ID NO: 84021 - DNA, 22 bp, Artificial Sequence
  chemically synthesized
atttccttcctttctttccttc

SEQ ID NO: 84022 - DNA, 22 bp, Artificial Sequence
  chemically synthesized
ccttcctttctttccttctttg

SEQ ID NO: 84023 - DNA, 22 bp, Artificial Sequence
  chemically synthesized
cttcctttctttccttctttgg

SEQ ID NO: 84024 - DNA, 22 bp, Artificial Sequence
  chemically synthesized
cctttctttccttctttggaaa

SEQ ID NO: 84025 - DNA, 22 bp, Artificial Sequence
  chemically synthesized
ctttctttccttctttggaaag

SEQ ID NO: 84026 - DNA, 22 bp, Artificial Sequence
  chemically synthesized
tctttccttctttggaaagctg

SEQ ID NO: 84027 - DNA, 22 bp, Artificial Sequence
  chemically synthesized
ctttccttctttggaaagctgc

SEQ ID NO: 84028 - DNA, 22 bp, Artificial Sequence
  chemically synthesized
tttccttctttggaaagctgca

SEQ ID NO: 84029 - DNA, 22 bp, Artificial Sequence
  chemically synthesized
tccttctttggaaagctgcact

SEQ ID NO: 84030 - DNA, 22 bp, Artificial Sequence
  chemically synthesized
ccttctttggaaagctgcacta

SEQ ID NO: 84031 - DNA, 22 bp, Artificial Sequence
  chemically synthesized
cttctttggaaagctgcactag

SEQ ID NO: 84032 - DNA, 22 bp, Artificial Sequence
  chemically synthesized
ctttggaaagctgcactagctt

SEQ ID NO: 84033 - DNA, 22 bp, Artificial Sequence
  chemically synthesized
tttggaaagctgcactagctta

SEQ ID NO: 84034 - DNA, 22 bp, Artificial Sequence
  chemically synthesized
tggaaagctgcactagcttact

SEQ ID NO: 84035 - DNA, 22 bp, Artificial Sequence
  chemically synthesized
ggaaagctgcactagcttactt

SEQ ID NO: 84036 - DNA, 22 bp, Artificial Sequence
  chemically synthesized
gaaagctgcactagcttactta

SEQ ID NO: 84037 - DNA, 22 bp, Artificial Sequence
  chemically synthesized
cactagcttacttagaaaagaa

SEQ ID NO: 84038 - DNA, 22 bp, Artificial Sequence
  chemically synthesized
gcttacttagaaaagaaccgct

SEQ ID NO: 84039 - DNA, 22 bp, Artificial Sequence
  chemically synthesized
acttagaaaagaaccgctttat

SEQ ID NO: 84040 - DNA, 22 bp, Artificial Sequence
  chemically synthesized
cttagaaaagaaccgctttatg

SEQ ID NO: 84041 - DNA, 22 bp, Artificial Sequence
  chemically synthesized
agaaaagaaccgctttatgttc

SEQ ID NO: 84042 - DNA, 22 bp, Artificial Sequence
  chemically synthesized
gaaaagaaccgctttatgttct

SEQ ID NO: 84043 - DNA, 22 bp, Artificial Sequence
  chemically synthesized
tatgttcttttatcttttttct

SEQ ID NO: 84044 - DNA, 22 bp, Artificial Sequence
  chemically synthesized
atgttcttttatcttttttctt

SEQ ID NO: 84045 - DNA, 22 bp, Artificial Sequence
  chemically synthesized
tgttcttttatcttttttcttt

SEQ ID NO: 84046 - DNA, 22 bp, Artificial Sequence
  chemically synthesized
ttttatcttttttcttttaaac

SEQ ID NO: 84047 - DNA, 22 bp, Artificial Sequence
  chemically synthesized
ttatcttttttcttttaaactc

SEQ ID NO: 84048 - DNA, 22 bp, Artificial Sequence
  chemically synthesized
tatcttttttcttttaaactca

SEQ ID NO: 84049 - DNA, 22 bp, Artificial Sequence
  chemically synthesized
atcttttttcttttaaactcag

SEQ ID NO: 84050 - DNA, 22 bp, Artificial Sequence
  chemically synthesized
tcttttttcttttaaactcaga

SEQ ID NO: 84051 - DNA, 22 bp, Artificial Sequence
  chemically synthesized
ttttcttttaaactcagaataa

SEQ ID NO: 84052 - DNA, 22 bp, Artificial Sequence
  chemically synthesized
tttcttttaaactcagaataag

SEQ ID NO: 84053 - DNA, 22 bp, Artificial Sequence
  chemically synthesized
ttcttttaaactcagaataagt

SEQ ID NO: 84054 - DNA, 22 bp, Artificial Sequence
  chemically synthesized
tcttttaaactcagaataagtc

SEQ ID NO: 84055 - DNA, 22 bp, Artificial Sequence
  chemically synthesized
cttttaaactcagaataagtcg

SEQ ID NO: 84056 - DNA, 22 bp, Artificial Sequence
  chemically synthesized
ttttaaactcagaataagtcgg

SEQ ID NO: 84057 - DNA, 22 bp, Artificial Sequence
  chemically synthesized
ttaaactcagaataagtcggta

SEQ ID NO: 84058 - DNA, 22 bp, Artificial Sequence
  chemically synthesized
taaactcagaataagtcggtag

SEQ ID NO: 84059 - DNA, 22 bp, Artificial Sequence
  chemically synthesized
aaactcagaataagtcggtagc

SEQ ID NO: 84060 - DNA, 22 bp, Artificial Sequence
  chemically synthesized
aactcagaataagtcggtagcg

SEQ ID NO: 84061 - DNA, 22 bp, Artificial Sequence
  chemically synthesized
agaataagtcggtagcggacag

SEQ ID NO: 84062 - DNA, 22 bp, Artificial Sequence
  chemically synthesized
atctgttcagaagatcccccac

SEQ ID NO: 84063 - DNA, 22 bp, Artificial Sequence
  chemically synthesized
ttcagaagatcccccacttaga

SEQ ID NO: 84064 - DNA, 22 bp, Artificial Sequence
  chemically synthesized
agaagatcccccacttagatat

SEQ ID NO: 84065 - DNA, 22 bp, Artificial Sequence
  chemically synthesized
agatataaaagcaaaagatcta

SEQ ID NO: 84066 - DNA, 22 bp, Artificial Sequence
  chemically synthesized
gatataaaagcaaaagatctag

SEQ ID NO: 84067 - DNA, 22 bp, Artificial Sequence
  chemically synthesized
gagcaaaatctgcttccagcct

SEQ ID NO: 84068 - DNA, 22 bp, Artificial Sequence
  chemically synthesized
cttccagccttgtagcagtgga

SEQ ID NO: 84069 - DNA, 22 bp, Artificial Sequence
  chemically synthesized
ccagccttgtagcagtggagtc

SEQ ID NO: 84070 - DNA, 22 bp, Artificial Sequence
  chemically synthesized
cagccttgtagcagtggagtcc

SEQ ID NO: 84071 - DNA, 22 bp, Artificial Sequence
  chemically synthesized
gtagcagtggagtccacatata

SEQ ID NO: 84072 - DNA, 22 bp, Artificial Sequence
  chemically synthesized
tagcagtggagtccacatataa

SEQ ID NO: 84073 - DNA, 22 bp, Artificial Sequence
  chemically synthesized
aaaaataaggattctaatttaa

SEQ ID NO: 84074 - DNA, 22 bp, Artificial Sequence
  chemically synthesized
taatttaaattagacatggtag

SEQ ID NO: 84075 - DNA, 22 bp, Artificial Sequence
  chemically synthesized
atttaaattagacatggtagaa

SEQ ID NO: 84076 - DNA, 22 bp, Artificial Sequence
  chemically synthesized
aaattagacatggtagaagttg

SEQ ID NO: 84077 - DNA, 22 bp, Artificial Sequence
  chemically synthesized
aattagacatggtagaagttga

SEQ ID NO: 84078 - DNA, 22 bp, Artificial Sequence
  chemically synthesized
gacatggtagaagttgaatcca

SEQ ID NO: 84079 - DNA, 22 bp, Artificial Sequence
  chemically synthesized
aatccaaagtcatatttctttg

SEQ ID NO: 84080 - DNA, 22 bp, Artificial Sequence
  chemically synthesized
ctttgtgtcctctttatgaact

SEQ ID NO: 84081 - DNA, 22 bp, Artificial Sequence
  chemically synthesized
tttgtgtcctctttatgaactg

SEQ ID NO: 84082 - DNA, 22 bp, Artificial Sequence
  chemically synthesized
tgtgtcctctttatgaactgta

SEQ ID NO: 84083 - DNA, 22 bp, Artificial Sequence
  chemically synthesized
gtgtcctctttatgaactgtag

SEQ ID NO: 84084 - DNA, 22 bp, Artificial Sequence
  chemically synthesized
tgtcctctttatgaactgtagc

SEQ ID NO: 84085 - DNA, 22 bp, Artificial Sequence
  chemically synthesized
tttatgaactgtagcttccctg

SEQ ID NO: 84086 - DNA, 22 bp, Artificial Sequence
  chemically synthesized
tatgaactgtagcttccctgtc

SEQ ID NO: 84087 - DNA, 22 bp, Artificial Sequence
  chemically synthesized
atgaactgtagcttccctgtcc

SEQ ID NO: 84088 - DNA, 22 bp, Artificial Sequence
  chemically synthesized
tgaactgtagcttccctgtcca

SEQ ID NO: 84089 - DNA, 22 bp, Artificial Sequence
  chemically synthesized
tagcttccctgtccaatatagt

SEQ ID NO: 84090 - DNA, 22 bp, Artificial Sequence
  chemically synthesized
ccctgtccaatatagtggctgc

SEQ ID NO: 84091 - DNA, 22 bp, Artificial Sequence
  chemically synthesized
cctgtccaatatagtggctgct

SEQ ID NO: 84092 - DNA, 22 bp, Artificial Sequence
  chemically synthesized
tccaatatagtggctgctgaac

SEQ ID NO: 84093 - DNA, 22 bp, Artificial Sequence
  chemically synthesized
ctgaactgaactgtccaataca

SEQ ID NO: 84094 - DNA, 22 bp, Artificial Sequence
  chemically synthesized
aactgaactgtccaatacaagg

SEQ ID NO: 84095 - DNA, 22 bp, Artificial Sequence
  chemically synthesized
aactgtccaatacaaggacatt

SEQ ID NO: 84096 - DNA, 22 bp, Artificial Sequence
  chemically synthesized
tccaatacaaggacattaaaca

SEQ ID NO: 84097 - DNA, 22 bp, Artificial Sequence
  chemically synthesized
aacatttaaatataaattaact

SEQ ID NO: 84098 - DNA, 22 bp, Artificial Sequence
  chemically synthesized
aaatataaattaacttaaagta

SEQ ID NO: 84099 - DNA, 22 bp, Artificial Sequence
  chemically synthesized
aatataaattaacttaaagtaa

SEQ ID NO: 84100 - DNA, 22 bp, Artificial Sequence
  chemically synthesized
acttaaagtaactgaaattgta

SEQ ID NO: 84101 - DNA, 22 bp, Artificial Sequence
  chemically synthesized
aaagtaactgaaattgtaaatg

SEQ ID NO: 84102 - DNA, 22 bp, Artificial Sequence
  chemically synthesized
aagtaactgaaattgtaaatgc

SEQ ID NO: 84103 - DNA, 22 bp, Artificial Sequence
  chemically synthesized
aaattgtaaatgcagttgttca

SEQ ID NO: 84104 - DNA, 22 bp, Artificial Sequence
  chemically synthesized
taaatgcagttgttcaattaca

SEQ ID NO: 84105 - DNA, 22 bp, Artificial Sequence
  chemically synthesized
ttcaattacactaccatcattt

SEQ ID NO: 84106 - DNA, 22 bp, Artificial Sequence
  chemically synthesized
aattacactaccatcatttcaa

SEQ ID NO: 84107 - DNA, 22 bp, Artificial Sequence
  chemically synthesized
cactaccatcatttcaagcgca

SEQ ID NO: 84108 - DNA, 22 bp, Artificial Sequence
  chemically synthesized
ccatcatttcaagcgcacagga

SEQ ID NO: 84109 - DNA, 22 bp, Artificial Sequence
  chemically synthesized
caagcgcacaggagccatatat

SEQ ID NO: 84110 - DNA, 22 bp, Artificial Sequence
  chemically synthesized
aagcgcacaggagccatatatt

SEQ ID NO: 84111 - DNA, 22 bp, Artificial Sequence
  chemically synthesized
cactttagccattttatggtat

SEQ ID NO: 84112 - DNA, 22 bp, Artificial Sequence
  chemically synthesized
tagccattttatggtattttat

SEQ ID NO: 84113 - DNA, 22 bp, Artificial Sequence
  chemically synthesized
agccattttatggtattttata

SEQ ID NO: 84114 - DNA, 22 bp, Artificial Sequence
  chemically synthesized
gccattttatggtattttatag

SEQ ID NO: 84115 - DNA, 22 bp, Artificial Sequence
  chemically synthesized
tatggtattttatagaacatcg

SEQ ID NO: 84116 - DNA, 22 bp, Artificial Sequence
  chemically synthesized
atggtattttatagaacatcgc

SEQ ID NO: 84117 - DNA, 22 bp, Artificial Sequence
  chemically synthesized
tggtattttatagaacatcgcc

SEQ ID NO: 84118 - DNA, 22 bp, Artificial Sequence
  chemically synthesized
tatagaacatcgccatcagttt

SEQ ID NO: 84119 - DNA, 22 bp, Artificial Sequence
  chemically synthesized
atagaacatcgccatcagttta

SEQ ID NO: 84120 - DNA, 22 bp, Artificial Sequence
  chemically synthesized
tagaacatcgccatcagtttag

SEQ ID NO: 84121 - DNA, 22 bp, Artificial Sequence
  chemically synthesized
agaaaagttcccttggacaatt

SEQ ID NO: 84122 - DNA, 22 bp, Artificial Sequence
  chemically synthesized
gaaaagttcccttggacaattc

SEQ ID NO: 84123 - DNA, 22 bp, Artificial Sequence
  chemically synthesized
ccttggacaattctggtccata

SEQ ID NO: 84124 - DNA, 22 bp, Artificial Sequence
  chemically synthesized
ggacaattctggtccatacaga

SEQ ID NO: 84125 - DNA, 22 bp, Artificial Sequence
  chemically synthesized
gacaattctggtccatacagat

SEQ ID NO: 84126 - DNA, 22 bp, Artificial Sequence
  chemically synthesized
tggtccatacagatatcacaac

SEQ ID NO: 84127 - DNA, 22 bp, Artificial Sequence
  chemically synthesized
gtccatacagatatcacaacat

SEQ ID NO: 84128 - DNA, 22 bp, Artificial Sequence
  chemically synthesized
ctgtgagttggctatagtctcc

SEQ ID NO: 84129 - DNA, 22 bp, Artificial Sequence
  chemically synthesized
tgagttggctatagtctccatt

SEQ ID NO: 84130 - DNA, 22 bp, Artificial Sequence
  chemically synthesized
gctatagtctccattttgaagg

SEQ ID NO: 84131 - DNA, 22 bp, Artificial Sequence
  chemically synthesized
tagtctccattttgaaggttaa

SEQ ID NO: 84132 - DNA, 22 bp, Artificial Sequence
  chemically synthesized
cattttgaaggttaattaagta

SEQ ID NO: 84133 - DNA, 22 bp, Artificial Sequence
  chemically synthesized
tgaaggttaattaagtaaacct

SEQ ID NO: 84134 - DNA, 22 bp, Artificial Sequence
  chemically synthesized
gaaggttaattaagtaaacctc

SEQ ID NO: 84135 - DNA, 22 bp, Artificial Sequence
  chemically synthesized
aaggttaattaagtaaacctca

SEQ ID NO: 84136 - DNA, 22 bp, Artificial Sequence
  chemically synthesized
attaagtaaacctcagagaatg

SEQ ID NO: 84137 - DNA, 22 bp, Artificial Sequence
  chemically synthesized
agtaaacctcagagaatgaaag

SEQ ID NO: 84138 - DNA, 22 bp, Artificial Sequence
  chemically synthesized
agagaatgaaagaaacttcaag

SEQ ID NO: 84139 - DNA, 22 bp, Artificial Sequence
  chemically synthesized
caagttttctactttgaaactt

SEQ ID NO: 84140 - DNA, 22 bp, Artificial Sequence
  chemically synthesized
aagttttctactttgaaacttg

SEQ ID NO: 84141 - DNA, 22 bp, Artificial Sequence
  chemically synthesized
tctactttgaaacttgaaaacc

SEQ ID NO: 84142 - DNA, 22 bp, Artificial Sequence
  chemically synthesized
ctactttgaaacttgaaaacct

SEQ ID NO: 84143 - DNA, 22 bp, Artificial Sequence
  chemically synthesized
tactttgaaacttgaaaaccta

SEQ ID NO: 84144 - DNA, 22 bp, Artificial Sequence
  chemically synthesized
ctttgaaacttgaaaacctagg

SEQ ID NO: 84145 - DNA, 22 bp, Artificial Sequence
  chemically synthesized
tgaaacttgaaaacctaggttt

SEQ ID NO: 84146 - DNA, 22 bp, Artificial Sequence
  chemically synthesized
gaaacttgaaaacctaggtttt

SEQ ID NO: 84147 - DNA, 22 bp, Artificial Sequence
  chemically synthesized
aaacttgaaaacctaggttttt

SEQ ID NO: 84148 - DNA, 22 bp, Artificial Sequence
  chemically synthesized
gaaaacctaggtttttaatcca

SEQ ID NO: 84149 - DNA, 22 bp, Artificial Sequence
  chemically synthesized
aaaacctaggtttttaatccag

SEQ ID NO: 84150 - DNA, 22 bp, Artificial Sequence
  chemically synthesized
ggtttttaatccagctttgttt

SEQ ID NO: 84151 - DNA, 22 bp, Artificial Sequence
  chemically synthesized
ttaatccagctttgttttacag

SEQ ID NO: 84152 - DNA, 22 bp, Artificial Sequence
  chemically synthesized
taatccagctttgttttacagc

SEQ ID NO: 84153 - DNA, 22 bp, Artificial Sequence
  chemically synthesized
aatccagctttgttttacagca

SEQ ID NO: 84154 - DNA, 22 bp, Artificial Sequence
  chemically synthesized
atccagctttgttttacagcaa

SEQ ID NO: 84155 - DNA, 22 bp, Artificial Sequence
  chemically synthesized
tgttttacagcaaaggaaatgc

SEQ ID NO: 84156 - DNA, 22 bp, Artificial Sequence
  chemically synthesized
gttttacagcaaaggaaatgct

SEQ ID NO: 84157 - DNA, 22 bp, Artificial Sequence
  chemically synthesized
ttttacagcaaaggaaatgctc

SEQ ID NO: 84158 - DNA, 22 bp, Artificial Sequence
  chemically synthesized
tacagcaaaggaaatgctcaaa

SEQ ID NO: 84159 - DNA, 22 bp, Artificial Sequence
  chemically synthesized
acagcaaaggaaatgctcaaaa

SEQ ID NO: 84160 - DNA, 22 bp, Artificial Sequence
  chemically synthesized
cagcaaaggaaatgctcaaaag

SEQ ID NO: 84161 - DNA, 22 bp, Artificial Sequence
  chemically synthesized
aaaagtacatttcaggcaaata

SEQ ID NO: 84162 - DNA, 22 bp, Artificial Sequence
  chemically synthesized
caggcaaataaacaattttttc

SEQ ID NO: 84163 - DNA, 22 bp, Artificial Sequence
  chemically synthesized
aggcaaataaacaattttttcc

SEQ ID NO: 84164 - DNA, 22 bp, Artificial Sequence
  chemically synthesized
tttcctctttcttaaatatggt

SEQ ID NO: 84165 - DNA, 22 bp, Artificial Sequence
  chemically synthesized
ttcctctttcttaaatatggtc

SEQ ID NO: 84166 - DNA, 22 bp, Artificial Sequence
  chemically synthesized
tcctctttcttaaatatggtca

SEQ ID NO: 84167 - DNA, 22 bp, Artificial Sequence
  chemically synthesized
cctctttcttaaatatggtcag

SEQ ID NO: 84168 - DNA, 22 bp, Artificial Sequence
  chemically synthesized
ctctttcttaaatatggtcaga

SEQ ID NO: 84169 - DNA, 22 bp, Artificial Sequence
  chemically synthesized
tttcttaaatatggtcagactg

SEQ ID NO: 84170 - DNA, 22 bp, Artificial Sequence
  chemically synthesized
tcttaaatatggtcagactgat

SEQ ID NO: 84171 - DNA, 22 bp, Artificial Sequence
  chemically synthesized
cttaaatatggtcagactgata

SEQ ID NO: 84172 - DNA, 22 bp, Artificial Sequence
  chemically synthesized
ttaaatatggtcagactgatag

SEQ ID NO: 84173 - DNA, 22 bp, Artificial Sequence
  chemically synthesized
aaatatggtcagactgatagag

SEQ ID NO: 84174 - DNA, 22 bp, Artificial Sequence
  chemically synthesized
aatatggtcagactgatagagt

SEQ ID NO: 84175 - DNA, 22 bp, Artificial Sequence
  chemically synthesized
atagagtgacctacatgtgtcc

SEQ ID NO: 84176 - DNA, 22 bp, Artificial Sequence
  chemically synthesized
catgtgtccaggctgacacaat

SEQ ID NO: 84177 - DNA, 22 bp, Artificial Sequence
  chemically synthesized
acacaatggaacttgtttgttg

SEQ ID NO: 84178 - DNA, 22 bp, Artificial Sequence
  chemically synthesized
gtttgttgattctctgactata

SEQ ID NO: 84179 - DNA, 22 bp, Artificial Sequence
  chemically synthesized
tttgttgattctctgactatat

SEQ ID NO: 84180 - DNA, 22 bp, Artificial Sequence
  chemically synthesized
gttgattctctgactatattta

SEQ ID NO: 84181 - DNA, 22 bp, Artificial Sequence
  chemically synthesized
ttgattctctgactatatttaa

SEQ ID NO: 84182 - DNA, 22 bp, Artificial Sequence
  chemically synthesized
attctctgactatatttaaata

SEQ ID NO: 84183 - DNA, 22 bp, Artificial Sequence
  chemically synthesized
tctgactatatttaaatatttt

SEQ ID NO: 84184 - DNA, 22 bp, Artificial Sequence
  chemically synthesized
tgactatatttaaatatttttt

SEQ ID NO: 84185 - DNA, 22 bp, Artificial Sequence
  chemically synthesized
actatatttaaatattttttaa

SEQ ID NO: 84186 - DNA, 22 bp, Artificial Sequence
  chemically synthesized
tatttaaatattttttaaggtc

SEQ ID NO: 84187 - DNA, 22 bp, Artificial Sequence
  chemically synthesized
aaatattttttaaggtcatttg

SEQ ID NO: 84188 - DNA, 22 bp, Artificial Sequence
  chemically synthesized
aatattttttaaggtcatttgt

SEQ ID NO: 84189 - DNA, 22 bp, Artificial Sequence
  chemically synthesized
tttaaggtcatttgtcatggac

SEQ ID NO: 84190 - DNA, 22 bp, Artificial Sequence
  chemically synthesized
ttaaggtcatttgtcatggact

SEQ ID NO: 84191 - DNA, 22 bp, Artificial Sequence
  chemically synthesized
taaggtcatttgtcatggactc

SEQ ID NO: 84192 - DNA, 22 bp, Artificial Sequence
  chemically synthesized
aaggtcatttgtcatggactca

SEQ ID NO: 84193 - DNA, 22 bp, Artificial Sequence
  chemically synthesized
aggtcatttgtcatggactcag

SEQ ID NO: 84194 - DNA, 22 bp, Artificial Sequence
  chemically synthesized
gtcatggactcagagtaaatct

SEQ ID NO: 84195 - DNA, 22 bp, Artificial Sequence
  chemically synthesized
tcatggactcagagtaaatcta

SEQ ID NO: 84196 - DNA, 22 bp, Artificial Sequence
  chemically synthesized
agagtaaatctacaattttaat

SEQ ID NO: 84197 - DNA, 22 bp, Artificial Sequence
  chemically synthesized
caattttaataattttttcttt

SEQ ID NO: 84198 - DNA, 22 bp, Artificial Sequence
  chemically synthesized
taataattttttcttttttatg

SEQ ID NO: 84199 - DNA, 22 bp, Artificial Sequence
  chemically synthesized
aataattttttcttttttatgg

SEQ ID NO: 84200 - DNA, 22 bp, Artificial Sequence
  chemically synthesized
ataattttttcttttttatggc

SEQ ID NO: 84201 - DNA, 22 bp, Artificial Sequence
  chemically synthesized
tttcttttttatggcactgatt

SEQ ID NO: 84202 - DNA, 22 bp, Artificial Sequence
  chemically synthesized
ttcttttttatggcactgattt

SEQ ID NO: 84203 - DNA, 22 bp, Artificial Sequence
  chemically synthesized
tcttttttatggcactgatttt

SEQ ID NO: 84204 - DNA, 22 bp, Artificial Sequence
  chemically synthesized
cttttttatggcactgattttt

SEQ ID NO: 84205 - DNA, 22 bp, Artificial Sequence
  chemically synthesized
ttttttatggcactgatttttg

SEQ ID NO: 84206 - DNA, 22 bp, Artificial Sequence
  chemically synthesized
ttttatggcactgatttttgtt

SEQ ID NO: 84207 - DNA, 22 bp, Artificial Sequence
  chemically synthesized
tttatggcactgatttttgttt

SEQ ID NO: 84208 - DNA, 22 bp, Artificial Sequence
  chemically synthesized
ttatggcactgatttttgttta

SEQ ID NO: 84209 - DNA, 22 bp, Artificial Sequence
  chemically synthesized
tatggcactgatttttgtttat

SEQ ID NO: 84210 - DNA, 22 bp, Artificial Sequence
  chemically synthesized
atggcactgatttttgtttatt

SEQ ID NO: 84211 - DNA, 22 bp, Artificial Sequence
  chemically synthesized
tggcactgatttttgtttatta

SEQ ID NO: 84212 - DNA, 22 bp, Artificial Sequence
  chemically synthesized
atttttgtttattattgttgct

SEQ ID NO: 84213 - DNA, 22 bp, Artificial Sequence
  chemically synthesized
ttgtttattattgttgctgctt

SEQ ID NO: 84214 - DNA, 22 bp, Artificial Sequence
  chemically synthesized
tgtttattattgttgctgcttt

SEQ ID NO: 84215 - DNA, 22 bp, Artificial Sequence
  chemically synthesized
gtttattattgttgctgctttt

SEQ ID NO: 84216 - DNA, 22 bp, Artificial Sequence
  chemically synthesized
tttattattgttgctgcttttc

SEQ ID NO: 84217 - DNA, 22 bp, Artificial Sequence
  chemically synthesized
attattgttgctgcttttcttt

SEQ ID NO: 84218 - DNA, 22 bp, Artificial Sequence
  chemically synthesized
ttattgttgctgcttttctttc

SEQ ID NO: 84219 - DNA, 22 bp, Artificial Sequence
  chemically synthesized
ttgttgctgcttttctttcttt

SEQ ID NO: 84220 - DNA, 22 bp, Artificial Sequence
  chemically synthesized
ttgctgcttttctttctttttt

SEQ ID NO: 84221 - DNA, 22 bp, Artificial Sequence
  chemically synthesized
ctgcttttctttctttttttta

SEQ ID NO: 84222 - DNA, 22 bp, Artificial Sequence
  chemically synthesized
cttttctttcttttttttaggc

SEQ ID NO: 84223 - DNA, 22 bp, Artificial Sequence
  chemically synthesized
ttctttcttttttttaggcaat

SEQ ID NO: 84224 - DNA, 22 bp, Artificial Sequence
  chemically synthesized
tctttcttttttttaggcaata

SEQ ID NO: 84225 - DNA, 22 bp, Artificial Sequence
  chemically synthesized
ctttcttttttttaggcaatac

SEQ ID NO: 84226 - DNA, 22 bp, Artificial Sequence
  chemically synthesized
tttcttttttttaggcaataca

SEQ ID NO: 84227 - DNA, 22 bp, Artificial Sequence
  chemically synthesized
tcttttttttaggcaatacatc

SEQ ID NO: 84228 - DNA, 22 bp, Artificial Sequence
  chemically synthesized
cttttttttaggcaatacatct

SEQ ID NO: 84229 - DNA, 22 bp, Artificial Sequence
  chemically synthesized
ttttttttaggcaatacatctc

SEQ ID NO: 84230 - DNA, 22 bp, Artificial Sequence
  chemically synthesized
ttttttaggcaatacatctcaa

SEQ ID NO: 84231 - DNA, 22 bp, Artificial Sequence
  chemically synthesized
tttttaggcaatacatctcaat

SEQ ID NO: 84232 - DNA, 22 bp, Artificial Sequence
  chemically synthesized
ttttaggcaatacatctcaata

SEQ ID NO: 84233 - DNA, 22 bp, Artificial Sequence
  chemically synthesized
tttaggcaatacatctcaatat

SEQ ID NO: 84234 - DNA, 22 bp, Artificial Sequence
  chemically synthesized
ttaggcaatacatctcaatatc

SEQ ID NO: 84235 - DNA, 22 bp, Artificial Sequence
  chemically synthesized
taggcaatacatctcaatatct

SEQ ID NO: 84236 - DNA, 22 bp, Artificial Sequence
  chemically synthesized
aggcaatacatctcaatatctc

SEQ ID NO: 84237 - DNA, 22 bp, Artificial Sequence
  chemically synthesized
ggcaatacatctcaatatctct

SEQ ID NO: 84238 - DNA, 22 bp, Artificial Sequence
  chemically synthesized
aatatctctcaatatcttttca

SEQ ID NO: 84239 - DNA, 22 bp, Artificial Sequence
  chemically synthesized
tcaatatcttttcagagaaaag

SEQ ID NO: 84240 - DNA, 22 bp, Artificial Sequence
  chemically synthesized
aatatcttttcagagaaaagag

SEQ ID NO: 84241 - DNA, 22 bp, Artificial Sequence
  chemically synthesized
ttcagagaaaagagtctaagca

SEQ ID NO: 84242 - DNA, 22 bp, Artificial Sequence
  chemically synthesized
tcagagaaaagagtctaagcat

SEQ ID NO: 84243 - DNA, 22 bp, Artificial Sequence
  chemically synthesized
cagagaaaagagtctaagcatt

SEQ ID NO: 84244 - DNA, 22 bp, Artificial Sequence
  chemically synthesized
agagaaaagagtctaagcattc

SEQ ID NO: 84245 - DNA, 22 bp, Artificial Sequence
  chemically synthesized
agcattctggtatgaatctgtt

SEQ ID NO: 84246 - DNA, 22 bp, Artificial Sequence
  chemically synthesized
tggtatgaatctgttgggtctt

SEQ ID NO: 84247 - DNA, 22 bp, Artificial Sequence
  chemically synthesized
gtatgaatctgttgggtcttga

SEQ ID NO: 84248 - DNA, 22 bp, Artificial Sequence
  chemically synthesized
ttgggtcttgacactgtagatg

SEQ ID NO: 84249 - DNA, 22 bp, Artificial Sequence
  chemically synthesized
ggtcttgacactgtagatgatg

SEQ ID NO: 84250 - DNA, 22 bp, Artificial Sequence
  chemically synthesized
gacactgtagatgatgggattc

SEQ ID NO: 84251 - DNA, 22 bp, Artificial Sequence
  chemically synthesized
acactgtagatgatgggattca

SEQ ID NO: 84252 - DNA, 22 bp, Artificial Sequence
  chemically synthesized
tagatgatgggattcattaaag

SEQ ID NO: 84253 - DNA, 22 bp, Artificial Sequence
  chemically synthesized
attaaaggtgggaaaaggatgt

SEQ ID NO: 84254 - DNA, 22 bp, Artificial Sequence
  chemically synthesized
aaggtgggaaaaggatgtagat

SEQ ID NO: 84255 - DNA, 22 bp, Artificial Sequence
  chemically synthesized
ccaatgagaacgtgggccacgg

SEQ ID NO: 84256 - DNA, 22 bp, Artificial Sequence
  chemically synthesized
gccaaaacggtgcaccattgtg

SEQ ID NO: 84257 - DNA, 22 bp, Artificial Sequence
  chemically synthesized
ccaaaacggtgcaccattgtga

SEQ ID NO: 84258 - DNA, 22 bp, Artificial Sequence
  chemically synthesized
tgaggctaatgatagggatgta

SEQ ID NO: 84259 - DNA, 22 bp, Artificial Sequence
  chemically synthesized
atgatagggatgtagaacacaa

SEQ ID NO: 84260 - DNA, 22 bp, Artificial Sequence
  chemically synthesized
aaataatttatgcctctcttcc

SEQ ID NO: 84261 - DNA, 22 bp, Artificial Sequence
  chemically synthesized
atgcctctcttcctgagaggca

SEQ ID NO: 84262 - DNA, 22 bp, Artificial Sequence
  chemically synthesized
tgcctctcttcctgagaggcaa

SEQ ID NO: 84263 - DNA, 22 bp, Artificial Sequence
  chemically synthesized
tcttcctgagaggcaactgcca

SEQ ID NO: 84264 - DNA, 22 bp, Artificial Sequence
  chemically synthesized
ttcctgagaggcaactgccagg

SEQ ID NO: 84265 - DNA, 22 bp, Artificial Sequence
  chemically synthesized
cctgagaggcaactgccaggac

SEQ ID NO: 84266 - DNA, 22 bp, Artificial Sequence
  chemically synthesized
ctgagaggcaactgccaggact

SEQ ID NO: 84267 - DNA, 22 bp, Artificial Sequence
  chemically synthesized
agaggcaactgccaggactgac

SEQ ID NO: 84268 - DNA, 22 bp, Artificial Sequence
  chemically synthesized
ccaggactgacttaagaatcag

SEQ ID NO: 84269 - DNA, 22 bp, Artificial Sequence
  chemically synthesized
acttaagaatcaggatgtagga

SEQ ID NO: 84270 - DNA, 22 bp, Artificial Sequence
  chemically synthesized
aagaatcaggatgtaggagaaa

SEQ ID NO: 84271 - DNA, 22 bp, Artificial Sequence
  chemically synthesized
agaatcaggatgtaggagaaaa

SEQ ID NO: 84272 - DNA, 22 bp, Artificial Sequence
  chemically synthesized
ttgaatcggatgtctgaacagg

SEQ ID NO: 84273 - DNA, 22 bp, Artificial Sequence
  chemically synthesized
aatcggatgtctgaacaggcta

SEQ ID NO: 84274 - DNA, 22 bp, Artificial Sequence
  chemically synthesized
aacaggctaagcggagaagatc

SEQ ID NO: 84275 - DNA, 22 bp, Artificial Sequence
  chemically synthesized
agcggagaagatcctggtgcag

SEQ ID NO: 84276 - DNA, 22 bp, Artificial Sequence
  chemically synthesized
gtgcaggcagaaagagtgagaa

SEQ ID NO: 84277 - DNA, 22 bp, Artificial Sequence
  chemically synthesized
aaaaatttcagacagatgatgg

SEQ ID NO: 84278 - DNA, 22 bp, Artificial Sequence
  chemically synthesized
cagacagatgatggggggtgta

SEQ ID NO: 84279 - DNA, 22 bp, Artificial Sequence
  chemically synthesized
agacagatgatggggggtgtaa

SEQ ID NO: 84280 - DNA, 22 bp, Artificial Sequence
  chemically synthesized
ctacctattatagtgagcccaa

SEQ ID NO: 84281 - DNA, 22 bp, Artificial Sequence
  chemically synthesized
cctattatagtgagcccaattt

SEQ ID NO: 84282 - DNA, 22 bp, Artificial Sequence
  chemically synthesized
ttatagtgagcccaattttgat

SEQ ID NO: 84283 - DNA, 22 bp, Artificial Sequence
  chemically synthesized
tagtgagcccaattttgataat

SEQ ID NO: 84284 - DNA, 22 bp, Artificial Sequence
  chemically synthesized
tgataattctggaattagtcag

SEQ ID NO: 84285 - DNA, 22 bp, Artificial Sequence
  chemically synthesized
gataattctggaattagtcagg

SEQ ID NO: 84286 - DNA, 22 bp, Artificial Sequence
  chemically synthesized
ataattctggaattagtcagga

SEQ ID NO: 84287 - DNA, 22 bp, Artificial Sequence
  chemically synthesized
tggaattagtcaggatggagga

SEQ ID NO: 84288 - DNA, 22 bp, Artificial Sequence
  chemically synthesized
gaattagtcaggatggaggaat

SEQ ID NO: 84289 - DNA, 22 bp, Artificial Sequence
  chemically synthesized
gtcaggatggaggaataacgta

SEQ ID NO: 84290 - DNA, 22 bp, Artificial Sequence
  chemically synthesized
caaattgcaatgtaccggtcaa

SEQ ID NO: 84291 - DNA, 22 bp, Artificial Sequence
  chemically synthesized
caatgtaccggtcaaaggccat

SEQ ID NO: 84292 - DNA, 22 bp, Artificial Sequence
  chemically synthesized
catgaaggacagaccatggatg

SEQ ID NO: 84293 - DNA, 22 bp, Artificial Sequence
  chemically synthesized
ggcaatgcaggaatccaagctg

SEQ ID NO: 84294 - DNA, 22 bp, Artificial Sequence
  chemically synthesized
atctctcgaatgatcccccaca

SEQ ID NO: 84295 - DNA, 22 bp, Artificial Sequence
  chemically synthesized
tcgaatgatcccccacaggatc

SEQ ID NO: 84296 - DNA, 22 bp, Artificial Sequence
  chemically synthesized
gaatgatcccccacaggatccc

SEQ ID NO: 84297 - DNA, 22 bp, Artificial Sequence
  chemically synthesized
tgtacacagtggacagccccat

SEQ ID NO: 84298 - DNA, 22 bp, Artificial Sequence
  chemically synthesized
gtgcaggcttggctcagtccat

SEQ ID NO: 84299 - DNA, 22 bp, Artificial Sequence
  chemically synthesized
ggctcagtccatatcacatgga

SEQ ID NO: 84300 - DNA, 22 bp, Artificial Sequence
  chemically synthesized
gctcagtccatatcacatggag

SEQ ID NO: 84301 - DNA, 22 bp, Artificial Sequence
  chemically synthesized
agtccatatcacatggagaacc

SEQ ID NO: 84302 - DNA, 22 bp, Artificial Sequence
  chemically synthesized
cccaaaagcaccatggcataga

SEQ ID NO: 84303 - DNA, 22 bp, Artificial Sequence
  chemically synthesized
aggagaaggggatggaaagcca

SEQ ID NO: 84304 - DNA, 22 bp, Artificial Sequence
  chemically synthesized
ctgctccatgccagaaaatcca

SEQ ID NO: 84305 - DNA, 22 bp, Artificial Sequence
  chemically synthesized
ctccatgccagaaaatccagtg

SEQ ID NO: 84306 - DNA, 22 bp, Artificial Sequence
  chemically synthesized
catgccagaaaatccagtgaga

SEQ ID NO: 84307 - DNA, 22 bp, Artificial Sequence
  chemically synthesized
gtgctggtgctagggcttactg

SEQ ID NO: 84308 - DNA, 22 bp, Artificial Sequence
  chemically synthesized
gtgctagggcttactgaagtaa

SEQ ID NO: 84309 - DNA, 22 bp, Artificial Sequence
  chemically synthesized
gggcttactgaagtaatcattc

SEQ ID NO: 84310 - DNA, 22 bp, Artificial Sequence
  chemically synthesized
actgaagtaatcattctggaac

SEQ ID NO: 84311 - DNA, 22 bp, Artificial Sequence
  chemically synthesized
ctgaagtaatcattctggaact

SEQ ID NO: 84312 - DNA, 22 bp, Artificial Sequence
  chemically synthesized
aagtaatcattctggaactgag

SEQ ID NO: 84313 - DNA, 22 bp, Artificial Sequence
  chemically synthesized
tggaactgagaaacatgtgaga

SEQ ID NO: 84314 - DNA, 22 bp, Artificial Sequence
  chemically synthesized
gaactgagaaacatgtgagagt

SEQ ID NO: 84315 - DNA, 22 bp, Artificial Sequence
  chemically synthesized
agaaacatgtgagagtattttt

SEQ ID NO: 84316 - DNA, 22 bp, Artificial Sequence
  chemically synthesized
tttcaaaggaaatgtttcaatt

SEQ ID NO: 84317 - DNA, 22 bp, Artificial Sequence
  chemically synthesized
ttcaaaggaaatgtttcaattt

SEQ ID NO: 84318 - DNA, 22 bp, Artificial Sequence
  chemically synthesized
tcaaaggaaatgtttcaatttc

SEQ ID NO: 84319 - DNA, 22 bp, Artificial Sequence
  chemically synthesized
caaaggaaatgtttcaatttca

SEQ ID NO: 84320 - DNA, 22 bp, Artificial Sequence
  chemically synthesized
aaaggaaatgtttcaatttcac

SEQ ID NO: 84321 - DNA, 22 bp, Artificial Sequence
  chemically synthesized
caatttcacctgaatacaatga

SEQ ID NO: 84322 - DNA, 22 bp, Artificial Sequence
  chemically synthesized
aatttcacctgaatacaatgaa

SEQ ID NO: 84323 - DNA, 22 bp, Artificial Sequence
  chemically synthesized
cacctgaatacaatgaaatttc

SEQ ID NO: 84324 - DNA, 22 bp, Artificial Sequence
  chemically synthesized
acctgaatacaatgaaatttct

SEQ ID NO: 84325 - DNA, 22 bp, Artificial Sequence
  chemically synthesized
aatacaatgaaatttctaagta

SEQ ID NO: 84326 - DNA, 22 bp, Artificial Sequence
  chemically synthesized
ctaagtaaatgaaataccctaa

SEQ ID NO: 84327 - DNA, 22 bp, Artificial Sequence
  chemically synthesized
taagtaaatgaaataccctaaa

SEQ ID NO: 84328 - DNA, 22 bp, Artificial Sequence
  chemically synthesized
agtaaatgaaataccctaaaac

SEQ ID NO: 84329 - DNA, 22 bp, Artificial Sequence
  chemically synthesized
aaacttactgacttaaaaaaaa

SEQ ID NO: 84330 - DNA, 22 bp, Artificial Sequence
  chemically synthesized
actgacttaaaaaaaacagctg

SEQ ID NO: 84331 - DNA, 22 bp, Artificial Sequence
  chemically synthesized
ctgacttaaaaaaaacagctga

SEQ ID NO: 84332 - DNA, 22 bp, Artificial Sequence
  chemically synthesized
acttaaaaaaaacagctgagaa

SEQ ID NO: 84333 - DNA, 22 bp, Artificial Sequence
  chemically synthesized
aaaaaaaacagctgagaaattc

SEQ ID NO: 84334 - DNA, 22 bp, Artificial Sequence
  chemically synthesized
aaaaaaacagctgagaaattct

SEQ ID NO: 84335 - DNA, 22 bp, Artificial Sequence
  chemically synthesized
agaaattctgtttctttgagac

SEQ ID NO: 84336 - DNA, 22 bp, Artificial Sequence
  chemically synthesized
tgtttctttgagacatagtatc

SEQ ID NO: 84337 - DNA, 22 bp, Artificial Sequence
  chemically synthesized
tttctttgagacatagtatcca

SEQ ID NO: 84338 - DNA, 22 bp, Artificial Sequence
  chemically synthesized
ctttgagacatagtatccattg

SEQ ID NO: 84339 - DNA, 22 bp, Artificial Sequence
  chemically synthesized
tttgagacatagtatccattgc

SEQ ID NO: 84340 - DNA, 22 bp, Artificial Sequence
  chemically synthesized
tgagacatagtatccattgcct

SEQ ID NO: 84341 - DNA, 22 bp, Artificial Sequence
  chemically synthesized
gagacatagtatccattgcctt

SEQ ID NO: 84342 - DNA, 22 bp, Artificial Sequence
  chemically synthesized
agacatagtatccattgccttt

SEQ ID NO: 84343 - DNA, 22 bp, Artificial Sequence
  chemically synthesized
cctttgagaaaatggtcttctt

SEQ ID NO: 84344 - DNA, 22 bp, Artificial Sequence
  chemically synthesized
tgagaaaatggtcttcttttga

SEQ ID NO: 84345 - DNA, 22 bp, Artificial Sequence
  chemically synthesized
gagaaaatggtcttcttttgat

SEQ ID NO: 84346 - DNA, 22 bp, Artificial Sequence
  chemically synthesized
agaaaatggtcttcttttgatg

SEQ ID NO: 84347 - DNA, 22 bp, Artificial Sequence
  chemically synthesized
cttttgatgtcatttaaaagtc

SEQ ID NO: 84348 - DNA, 22 bp, Artificial Sequence
  chemically synthesized
ttttgatgtcatttaaaagtca

SEQ ID NO: 84349 - DNA, 22 bp, Artificial Sequence
  chemically synthesized
ttgatgtcatttaaaagtcatt

SEQ ID NO: 84350 - DNA, 22 bp, Artificial Sequence
  chemically synthesized
tgatgtcatttaaaagtcatta

SEQ ID NO: 84351 - DNA, 22 bp, Artificial Sequence
  chemically synthesized
gatgtcatttaaaagtcattat

SEQ ID NO: 84352 - DNA, 22 bp, Artificial Sequence
  chemically synthesized
atgtcatttaaaagtcattatt

SEQ ID NO: 84353 - DNA, 22 bp, Artificial Sequence
  chemically synthesized
aaaagtcattattttttcactg

SEQ ID NO: 84354 - DNA, 22 bp, Artificial Sequence
  chemically synthesized
aaagtcattattttttcactgt

SEQ ID NO: 84355 - DNA, 22 bp, Artificial Sequence
  chemically synthesized
ttttttcactgtctggatgtga

SEQ ID NO: 84356 - DNA, 22 bp, Artificial Sequence
  chemically synthesized
tttcactgtctggatgtgaaca

SEQ ID NO: 84357 - DNA, 22 bp, Artificial Sequence
  chemically synthesized
ttcactgtctggatgtgaacat

SEQ ID NO: 84358 - DNA, 22 bp, Artificial Sequence
  chemically synthesized
tcactgtctggatgtgaacata

SEQ ID NO: 84359 - DNA, 22 bp, Artificial Sequence
  chemically synthesized
cactgtctggatgtgaacatat

SEQ ID NO: 84360 - DNA, 22 bp, Artificial Sequence
  chemically synthesized
actgtctggatgtgaacatatc

SEQ ID NO: 84361 - DNA, 22 bp, Artificial Sequence
  chemically synthesized
tctggatgtgaacatatcctta

SEQ ID NO: 84362 - DNA, 22 bp, Artificial Sequence
  chemically synthesized
gatgtgaacatatccttagaag

SEQ ID NO: 84363 - DNA, 22 bp, Artificial Sequence
  chemically synthesized
agaagccataagcaaaaacaaa

SEQ ID NO: 84364 - DNA, 22 bp, Artificial Sequence
  chemically synthesized
gaagccataagcaaaaacaaat

SEQ ID NO: 84365 - DNA, 22 bp, Artificial Sequence
  chemically synthesized
gtaaaaggagaaggctagtttt

SEQ ID NO: 84366 - DNA, 22 bp, Artificial Sequence
  chemically synthesized
gttttaaaaaaatacgttgctt

SEQ ID NO: 84367 - DNA, 22 bp, Artificial Sequence
  chemically synthesized
taaaaaaatacgttgcttagac

SEQ ID NO: 84368 - DNA, 22 bp, Artificial Sequence
  chemically synthesized
aaaaaaatacgttgcttagaca

SEQ ID NO: 84369 - DNA, 22 bp, Artificial Sequence
  chemically synthesized
aaaaaatacgttgcttagacat

SEQ ID NO: 84370 - DNA, 22 bp, Artificial Sequence
  chemically synthesized
cttagacattttcccaaggata

SEQ ID NO: 84371 - DNA, 22 bp, Artificial Sequence
  chemically synthesized
agacattttcccaaggatagtg

SEQ ID NO: 84372 - DNA, 22 bp, Artificial Sequence
  chemically synthesized
gacattttcccaaggatagtgg

SEQ ID NO: 84373 - DNA, 22 bp, Artificial Sequence
  chemically synthesized
tcccaaggatagtggtaaaaat

SEQ ID NO: 84374 - DNA, 22 bp, Artificial Sequence
  chemically synthesized
cccaaggatagtggtaaaaatt

SEQ ID NO: 84375 - DNA, 22 bp, Artificial Sequence
  chemically synthesized
ccaaggatagtggtaaaaattt

SEQ ID NO: 84376 - DNA, 22 bp, Artificial Sequence
  chemically synthesized
tataccagtaaagagccgaggt

SEQ ID NO: 84377 - DNA, 22 bp, Artificial Sequence
  chemically synthesized
ataccagtaaagagccgaggtt

SEQ ID NO: 84378 - DNA, 22 bp, Artificial Sequence
  chemically synthesized
taccagtaaagagccgaggttc

SEQ ID NO: 84379 - DNA, 22 bp, Artificial Sequence
  chemically synthesized
ttgaaaaattattttcttctct

SEQ ID NO: 84380 - DNA, 22 bp, Artificial Sequence
  chemically synthesized
gaaaaattattttcttctctcc

SEQ ID NO: 84381 - DNA, 22 bp, Artificial Sequence
  chemically synthesized
aaaaattattttcttctctcca

SEQ ID NO: 84382 - DNA, 22 bp, Artificial Sequence
  chemically synthesized
ttttcttctctccaattcatta

SEQ ID NO: 84383 - DNA, 22 bp, Artificial Sequence
  chemically synthesized
tcttctctccaattcattaaac

SEQ ID NO: 84384 - DNA, 22 bp, Artificial Sequence
  chemically synthesized
cttctctccaattcattaaaca

SEQ ID NO: 84385 - DNA, 22 bp, Artificial Sequence
  chemically synthesized
ttctctccaattcattaaacat

SEQ ID NO: 84386 - DNA, 22 bp, Artificial Sequence
  chemically synthesized
ctctccaattcattaaacattc

SEQ ID NO: 84387 - DNA, 22 bp, Artificial Sequence
  chemically synthesized
tctccaattcattaaacattcg

SEQ ID NO: 84388 - DNA, 22 bp, Artificial Sequence
  chemically synthesized
tccaattcattaaacattcgaa

SEQ ID NO: 84389 - DNA, 22 bp, Artificial Sequence
  chemically synthesized
caattcattaaacattcgaagt

SEQ ID NO: 84390 - DNA, 22 bp, Artificial Sequence
  chemically synthesized
attaaacattcgaagtgaagag

SEQ ID NO: 84391 - DNA, 22 bp, Artificial Sequence
  chemically synthesized
aacattcgaagtgaagagtaat

SEQ ID NO: 84392 - DNA, 22 bp, Artificial Sequence
  chemically synthesized
gaagtgaagagtaatctttggg

SEQ ID NO: 84393 - DNA, 22 bp, Artificial Sequence
  chemically synthesized
tgggctttaaatatcataagtc

SEQ ID NO: 84394 - DNA, 22 bp, Artificial Sequence
  chemically synthesized
gggctttaaatatcataagtct

SEQ ID NO: 84395 - DNA, 22 bp, Artificial Sequence
  chemically synthesized
ggctttaaatatcataagtcta

SEQ ID NO: 84396 - DNA, 22 bp, Artificial Sequence
  chemically synthesized
taaatatcataagtctattaaa

SEQ ID NO: 84397 - DNA, 22 bp, Artificial Sequence
  chemically synthesized
aaatatcataagtctattaaat

SEQ ID NO: 84398 - DNA, 22 bp, Artificial Sequence
  chemically synthesized
aatatcataagtctattaaata

SEQ ID NO: 84399 - DNA, 22 bp, Artificial Sequence
  chemically synthesized
ttaaatagtcacttttccgtca

SEQ ID NO: 84400 - DNA, 22 bp, Artificial Sequence
  chemically synthesized
aatagtcacttttccgtcattt

SEQ ID NO: 84401 - DNA, 22 bp, Artificial Sequence
  chemically synthesized
ttccgtcattttccattttgtg

SEQ ID NO: 84402 - DNA, 22 bp, Artificial Sequence
  chemically synthesized
tccgtcattttccattttgtgc

SEQ ID NO: 84403 - DNA, 22 bp, Artificial Sequence
  chemically synthesized
ccgtcattttccattttgtgcc

SEQ ID NO: 84404 - DNA, 22 bp, Artificial Sequence
  chemically synthesized
cgtcattttccattttgtgccg

SEQ ID NO: 84405 - DNA, 22 bp, Artificial Sequence
  chemically synthesized
tccattttgtgccgtctccaag

SEQ ID NO: 84406 - DNA, 22 bp, Artificial Sequence
  chemically synthesized
ccattttgtgccgtctccaagt

SEQ ID NO: 84407 - DNA, 22 bp, Artificial Sequence
  chemically synthesized
cattttgtgccgtctccaagta

SEQ ID NO: 84408 - DNA, 22 bp, Artificial Sequence
  chemically synthesized
tgtgccgtctccaagtatattt

SEQ ID NO: 84409 - DNA, 22 bp, Artificial Sequence
  chemically synthesized
gtgccgtctccaagtatatttt

SEQ ID NO: 84410 - DNA, 22 bp, Artificial Sequence
  chemically synthesized
tgccgtctccaagtatattttt

SEQ ID NO: 84411 - DNA, 22 bp, Artificial Sequence
  chemically synthesized
caagtatattttttctccaaat

SEQ ID NO: 84412 - DNA, 22 bp, Artificial Sequence
  chemically synthesized
tttctccaaatactatttaatg

SEQ ID NO: 84413 - DNA, 22 bp, Artificial Sequence
  chemically synthesized
ttctccaaatactatttaatga

SEQ ID NO: 84414 - DNA, 22 bp, Artificial Sequence
  chemically synthesized
tctccaaatactatttaatgaa

SEQ ID NO: 84415 - DNA, 22 bp, Artificial Sequence
  chemically synthesized
ctccaaatactatttaatgaag

SEQ ID NO: 84416 - DNA, 22 bp, Artificial Sequence
  chemically synthesized
tccaaatactatttaatgaaga

SEQ ID NO: 84417 - DNA, 22 bp, Artificial Sequence
  chemically synthesized
caaatactatttaatgaagata

SEQ ID NO: 84418 - DNA, 22 bp, Artificial Sequence
  chemically synthesized
tttaatgaagatactcctgttt

SEQ ID NO: 84419 - DNA, 22 bp, Artificial Sequence
  chemically synthesized
aatgaagatactcctgttttct

SEQ ID NO: 84420 - DNA, 22 bp, Artificial Sequence
  chemically synthesized
atgaagatactcctgttttctc

SEQ ID NO: 84421 - DNA, 22 bp, Artificial Sequence
  chemically synthesized
ctgttttctccccctccagatg

SEQ ID NO: 84422 - DNA, 22 bp, Artificial Sequence
  chemically synthesized
ttttctccccctccagatgacg

SEQ ID NO: 84423 - DNA, 22 bp, Artificial Sequence
  chemically synthesized
tctccccctccagatgacgtag

SEQ ID NO: 84424 - DNA, 22 bp, Artificial Sequence
  chemically synthesized
ctccccctccagatgacgtagc

SEQ ID NO: 84425 - DNA, 22 bp, Artificial Sequence
  chemically synthesized
tccccctccagatgacgtagcc

SEQ ID NO: 84426 - DNA, 22 bp, Artificial Sequence
  chemically synthesized
cccctccagatgacgtagccag

SEQ ID NO: 84427 - DNA, 22 bp, Artificial Sequence
  chemically synthesized
cagatgacgtagccagcaatta

SEQ ID NO: 84428 - DNA, 22 bp, Artificial Sequence
  chemically synthesized
ctttttcttcattggtgataag

SEQ ID NO: 84429 - DNA, 22 bp, Artificial Sequence
  chemically synthesized
tttcttcattggtgataagcag

SEQ ID NO: 84430 - DNA, 22 bp, Artificial Sequence
  chemically synthesized
ttcttcattggtgataagcaga

SEQ ID NO: 84431 - DNA, 22 bp, Artificial Sequence
  chemically synthesized
tcttcattggtgataagcagac

SEQ ID NO: 84432 - DNA, 22 bp, Artificial Sequence
  chemically synthesized
cttcattggtgataagcagaca

SEQ ID NO: 84433 - DNA, 22 bp, Artificial Sequence
  chemically synthesized
ttcattggtgataagcagacag

SEQ ID NO: 84434 - DNA, 22 bp, Artificial Sequence
  chemically synthesized
cattggtgataagcagacagga

SEQ ID NO: 84435 - DNA, 22 bp, Artificial Sequence
  chemically synthesized
attggtgataagcagacaggaa

SEQ ID NO: 84436 - DNA, 22 bp, Artificial Sequence
  chemically synthesized
gtgataagcagacaggaatatt

SEQ ID NO: 84437 - DNA, 22 bp, Artificial Sequence
  chemically synthesized
atgcatgagaccttgggtaaat

SEQ ID NO: 84438 - DNA, 22 bp, Artificial Sequence
  chemically synthesized
tgcatgagaccttgggtaaatg

SEQ ID NO: 84439 - DNA, 22 bp, Artificial Sequence
  chemically synthesized
gggtaaatgatttctcactgga

SEQ ID NO: 84440 - DNA, 22 bp, Artificial Sequence
  chemically synthesized
ggtaaatgatttctcactggag

SEQ ID NO: 84441 - DNA, 22 bp, Artificial Sequence
  chemically synthesized
ctcactggagctctggcctctt

SEQ ID NO: 84442 - DNA, 22 bp, Artificial Sequence
  chemically synthesized
tcactggagctctggcctcttg

SEQ ID NO: 84443 - DNA, 22 bp, Artificial Sequence
  chemically synthesized
actggagctctggcctcttgag

SEQ ID NO: 84444 - DNA, 22 bp, Artificial Sequence
  chemically synthesized
gagctctggcctcttgagatgt

SEQ ID NO: 84445 - DNA, 22 bp, Artificial Sequence
  chemically synthesized
tggcctcttgagatgttcaact

SEQ ID NO: 84446 - DNA, 22 bp, Artificial Sequence
  chemically synthesized
gcctcttgagatgttcaactca

SEQ ID NO: 84447 - DNA, 22 bp, Artificial Sequence
  chemically synthesized
ttgagatgttcaactcatttgt

SEQ ID NO: 84448 - DNA, 22 bp, Artificial Sequence
  chemically synthesized
gagatgttcaactcatttgtgc

SEQ ID NO: 84449 - DNA, 22 bp, Artificial Sequence
  chemically synthesized
agatgttcaactcatttgtgcc

SEQ ID NO: 84450 - DNA, 22 bp, Artificial Sequence
  chemically synthesized
aactcatttgtgcctttgtgat

SEQ ID NO: 84451 - DNA, 22 bp, Artificial Sequence
  chemically synthesized
atttgtgcctttgtgatgtaga

SEQ ID NO: 84452 - DNA, 22 bp, Artificial Sequence
  chemically synthesized
gtgcctttgtgatgtagagaat

SEQ ID NO: 84453 - DNA, 22 bp, Artificial Sequence
  chemically synthesized
tgcctttgtgatgtagagaatt

SEQ ID NO: 84454 - DNA, 22 bp, Artificial Sequence
  chemically synthesized
tgtgatgtagagaattagattg

SEQ ID NO: 84455 - DNA, 22 bp, Artificial Sequence
  chemically synthesized
gtgatgtagagaattagattga

SEQ ID NO: 84456 - DNA, 22 bp, Artificial Sequence
  chemically synthesized
tgatgtagagaattagattgaa

SEQ ID NO: 84457 - DNA, 22 bp, Artificial Sequence
  chemically synthesized
gattgaagacactgagcctttg

SEQ ID NO: 84458 - DNA, 22 bp, Artificial Sequence
  chemically synthesized
aagacactgagcctttgatagc

SEQ ID NO: 84459 - DNA, 22 bp, Artificial Sequence
  chemically synthesized
agcctttgatagcagctcagtg

SEQ ID NO: 84460 - DNA, 22 bp, Artificial Sequence
  chemically synthesized
tgatagcagctcagtgcttccc

SEQ ID NO: 84461 - DNA, 22 bp, Artificial Sequence
  chemically synthesized
gatagcagctcagtgcttccca

SEQ ID NO: 84462 - DNA, 22 bp, Artificial Sequence
  chemically synthesized
atagcagctcagtgcttcccat

SEQ ID NO: 84463 - DNA, 22 bp, Artificial Sequence
  chemically synthesized
agtgcttcccattcctttattt

SEQ ID NO: 84464 - DNA, 22 bp, Artificial Sequence
  chemically synthesized
cccattcctttatttattcagt

SEQ ID NO: 84465 - DNA, 22 bp, Artificial Sequence
  chemically synthesized
ccattcctttatttattcagtt

SEQ ID NO: 84466 - DNA, 22 bp, Artificial Sequence
  chemically synthesized
ctttatttattcagttaatgag

SEQ ID NO: 84467 - DNA, 22 bp, Artificial Sequence
  chemically synthesized
tatttattcagttaatgagctg

SEQ ID NO: 84468 - DNA, 22 bp, Artificial Sequence
  chemically synthesized
atttattcagttaatgagctga

SEQ ID NO: 84469 - DNA, 22 bp, Artificial Sequence
  chemically synthesized
tttattcagttaatgagctgat

SEQ ID NO: 84470 - DNA, 22 bp, Artificial Sequence
  chemically synthesized
attcagttaatgagctgattaa

SEQ ID NO: 84471 - DNA, 22 bp, Artificial Sequence
  chemically synthesized
ttcagttaatgagctgattaac

SEQ ID NO: 84472 - DNA, 22 bp, Artificial Sequence
  chemically synthesized
agttaatgagctgattaactat

SEQ ID NO: 84473 - DNA, 22 bp, Artificial Sequence
  chemically synthesized
atgagctgattaactatttatt

SEQ ID NO: 84474 - DNA, 22 bp, Artificial Sequence
  chemically synthesized
attaactatttattcaatatac

SEQ ID NO: 84475 - DNA, 22 bp, Artificial Sequence
  chemically synthesized
actatttattcaatatacattt

SEQ ID NO: 84476 - DNA, 22 bp, Artificial Sequence
  chemically synthesized
tttattcaatatacatttattc

SEQ ID NO: 84477 - DNA, 22 bp, Artificial Sequence
  chemically synthesized
attcaatatacatttattcaat

SEQ ID NO: 84478 - DNA, 22 bp, Artificial Sequence
  chemically synthesized
ttcaatatacatttattcaatg

SEQ ID NO: 84479 - DNA, 22 bp, Artificial Sequence
  chemically synthesized
aatatacatttattcaatgtat

SEQ ID NO: 84480 - DNA, 22 bp, Artificial Sequence
  chemically synthesized
attcaatgtattggccaattgt

SEQ ID NO: 84481 - DNA, 22 bp, Artificial Sequence
  chemically synthesized
ttcaatgtattggccaattgtg

SEQ ID NO: 84482 - DNA, 22 bp, Artificial Sequence
  chemically synthesized
aatgtattggccaattgtgttt

SEQ ID NO: 84483 - DNA, 22 bp, Artificial Sequence
  chemically synthesized
gccaattgtgttttctttctta

SEQ ID NO: 84484 - DNA, 22 bp, Artificial Sequence
  chemically synthesized
tgttttctttcttagaacctgc

SEQ ID NO: 84485 - DNA, 22 bp, Artificial Sequence
  chemically synthesized
tctttcttagaacctgcagttc

SEQ ID NO: 84486 - DNA, 22 bp, Artificial Sequence
  chemically synthesized
ctttcttagaacctgcagttct

SEQ ID NO: 84487 - DNA, 22 bp, Artificial Sequence
  chemically synthesized
tttcttagaacctgcagttcta

SEQ ID NO: 84488 - DNA, 22 bp, Artificial Sequence
  chemically synthesized
tcttagaacctgcagttctaca

SEQ ID NO: 84489 - DNA, 22 bp, Artificial Sequence
  chemically synthesized
cttagaacctgcagttctacag

SEQ ID NO: 84490 - DNA, 22 bp, Artificial Sequence
  chemically synthesized
ttagaacctgcagttctacaga

SEQ ID NO: 84491 - DNA, 22 bp, Artificial Sequence
  chemically synthesized
agaacctgcagttctacagatc

SEQ ID NO: 84492 - DNA, 22 bp, Artificial Sequence
  chemically synthesized
gaacctgcagttctacagatca

SEQ ID NO: 84493 - DNA, 22 bp, Artificial Sequence
  chemically synthesized
cagttctacagatcacaaagcc

SEQ ID NO: 84494 - DNA, 22 bp, Artificial Sequence
  chemically synthesized
tacagatcacaaagccaggctc

SEQ ID NO: 84495 - DNA, 22 bp, Artificial Sequence
  chemically synthesized
cagatcacaaagccaggctcaa

SEQ ID NO: 84496 - DNA, 22 bp, Artificial Sequence
  chemically synthesized
aaacaagcaagcttataatttc

SEQ ID NO: 84497 - DNA, 22 bp, Artificial Sequence
  chemically synthesized
ataatttcaaaagcctcatggt

SEQ ID NO: 84498 - DNA, 22 bp, Artificial Sequence
  chemically synthesized
taatttcaaaagcctcatggta

SEQ ID NO: 84499 - DNA, 22 bp, Artificial Sequence
  chemically synthesized
caaaagcctcatggtagcagaa

SEQ ID NO: 84500 - DNA, 22 bp, Artificial Sequence
  chemically synthesized
aaaagcctcatggtagcagaat

SEQ ID NO: 84501 - DNA, 22 bp, Artificial Sequence
  chemically synthesized
atggtagcagaatcaattggct

SEQ ID NO: 84502 - DNA, 22 bp, Artificial Sequence
  chemically synthesized
gcttcttctttacattgtttgc

SEQ ID NO: 84503 - DNA, 22 bp, Artificial Sequence
  chemically synthesized
cttctttacattgtttgcctgc

SEQ ID NO: 84504 - DNA, 22 bp, Artificial Sequence
  chemically synthesized
ttctttacattgtttgcctgct

SEQ ID NO: 84505 - DNA, 22 bp, Artificial Sequence
  chemically synthesized
ctttacattgtttgcctgcttt

SEQ ID NO: 84506 - DNA, 22 bp, Artificial Sequence
  chemically synthesized
tttacattgtttgcctgcttta

SEQ ID NO: 84507 - DNA, 22 bp, Artificial Sequence
  chemically synthesized
tacattgtttgcctgctttaag

SEQ ID NO: 84508 - DNA, 22 bp, Artificial Sequence
  chemically synthesized
acattgtttgcctgctttaagt

SEQ ID NO: 84509 - DNA, 22 bp, Artificial Sequence
  chemically synthesized
cattgtttgcctgctttaagtt

SEQ ID NO: 84510 - DNA, 22 bp, Artificial Sequence
  chemically synthesized
tttgcctgctttaagttccaga

SEQ ID NO: 84511 - DNA, 22 bp, Artificial Sequence
  chemically synthesized
gcctgctttaagttccagacct

SEQ ID NO: 84512 - DNA, 22 bp, Artificial Sequence
  chemically synthesized
cctgctttaagttccagacctg

SEQ ID NO: 84513 - DNA, 22 bp, Artificial Sequence
  chemically synthesized
ctttaagttccagacctgagaa

SEQ ID NO: 84514 - DNA, 22 bp, Artificial Sequence
  chemically synthesized
taagttccagacctgagaatca

SEQ ID NO: 84515 - DNA, 22 bp, Artificial Sequence
  chemically synthesized
aagttccagacctgagaatcat

SEQ ID NO: 84516 - DNA, 22 bp, Artificial Sequence
  chemically synthesized
agttccagacctgagaatcatc

SEQ ID NO: 84517 - DNA, 22 bp, Artificial Sequence
  chemically synthesized
cagacctgagaatcatcataag

SEQ ID NO: 84518 - DNA, 22 bp, Artificial Sequence
  chemically synthesized
agaatcatcataagttttttta

SEQ ID NO: 84519 - DNA, 22 bp, Artificial Sequence
  chemically synthesized
ttttaaagctctaataatgtaa

SEQ ID NO: 84520 - DNA, 22 bp, Artificial Sequence
  chemically synthesized
tttaaagctctaataatgtaaa

SEQ ID NO: 84521 - DNA, 22 bp, Artificial Sequence
  chemically synthesized
ttaaagctctaataatgtaaac

SEQ ID NO: 84522 - DNA, 22 bp, Artificial Sequence
  chemically synthesized
taaagctctaataatgtaaaca

SEQ ID NO: 84523 - DNA, 22 bp, Artificial Sequence
  chemically synthesized
aaagctctaataatgtaaacag

SEQ ID NO: 84524 - DNA, 22 bp, Artificial Sequence
  chemically synthesized
aagctctaataatgtaaacaga

SEQ ID NO: 84525 - DNA, 22 bp, Artificial Sequence
  chemically synthesized
taataatgtaaacagatgttca

SEQ ID NO: 84526 - DNA, 22 bp, Artificial Sequence
  chemically synthesized
ataatgtaaacagatgttcaaa

SEQ ID NO: 84527 - DNA, 22 bp, Artificial Sequence
  chemically synthesized
aaaagtccatactttcatgttt

SEQ ID NO: 84528 - DNA, 22 bp, Artificial Sequence
  chemically synthesized
tcatgtttgattgagtaacttc

SEQ ID NO: 84529 - DNA, 22 bp, Artificial Sequence
  chemically synthesized
catgtttgattgagtaacttcg

SEQ ID NO: 84530 - DNA, 22 bp, Artificial Sequence
  chemically synthesized
atgtttgattgagtaacttcga

SEQ ID NO: 84531 - DNA, 22 bp, Artificial Sequence
  chemically synthesized
gattgagtaacttcgagatgtt

SEQ ID NO: 84532 - DNA, 22 bp, Artificial Sequence
  chemically synthesized
attgagtaacttcgagatgtta

SEQ ID NO: 84533 - DNA, 22 bp, Artificial Sequence
  chemically synthesized
agtaacttcgagatgttaaagt

SEQ ID NO: 84534 - DNA, 22 bp, Artificial Sequence
  chemically synthesized
cgagatgttaaagtaacttcag

SEQ ID NO: 84535 - DNA, 22 bp, Artificial Sequence
  chemically synthesized
gagatgttaaagtaacttcaga

SEQ ID NO: 84536 - DNA, 22 bp, Artificial Sequence
  chemically synthesized
aagtaacttcagatttgggctg

SEQ ID NO: 84537 - DNA, 22 bp, Artificial Sequence
  chemically synthesized
cagatttgggctgccctttatg

SEQ ID NO: 84538 - DNA, 22 bp, Artificial Sequence
  chemically synthesized
agatttgggctgccctttatgt

SEQ ID NO: 84539 - DNA, 22 bp, Artificial Sequence
  chemically synthesized
gggctgccctttatgtcctact

SEQ ID NO: 84540 - DNA, 22 bp, Artificial Sequence
  chemically synthesized
ggctgccctttatgtcctactt

SEQ ID NO: 84541 - DNA, 22 bp, Artificial Sequence
  chemically synthesized
ccctttatgtcctacttttcag

SEQ ID NO: 84542 - DNA, 22 bp, Artificial Sequence
  chemically synthesized
tatgtcctacttttcagctttg

SEQ ID NO: 84543 - DNA, 22 bp, Artificial Sequence
  chemically synthesized
atgtcctacttttcagctttgt

SEQ ID NO: 84544 - DNA, 22 bp, Artificial Sequence
  chemically synthesized
tgtcctacttttcagctttgtc

SEQ ID NO: 84545 - DNA, 22 bp, Artificial Sequence
  chemically synthesized
cttttcagctttgtcttattag

SEQ ID NO: 84546 - DNA, 22 bp, Artificial Sequence
  chemically synthesized
ttcagctttgtcttattagcct

SEQ ID NO: 84547 - DNA, 22 bp, Artificial Sequence
  chemically synthesized
tcagctttgtcttattagcctc

SEQ ID NO: 84548 - DNA, 22 bp, Artificial Sequence
  chemically synthesized
cagctttgtcttattagcctca

SEQ ID NO: 84549 - DNA, 22 bp, Artificial Sequence
  chemically synthesized
agctttgtcttattagcctcac

SEQ ID NO: 84550 - DNA, 22 bp, Artificial Sequence
  chemically synthesized
tgtcttattagcctcacaacac

SEQ ID NO: 84551 - DNA, 22 bp, Artificial Sequence
  chemically synthesized
gtcttattagcctcacaacaca

SEQ ID NO: 84552 - DNA, 22 bp, Artificial Sequence
  chemically synthesized
tcttattagcctcacaacacag

SEQ ID NO: 84553 - DNA, 22 bp, Artificial Sequence
  chemically synthesized
attagcctcacaacacagttcc

SEQ ID NO: 84554 - DNA, 22 bp, Artificial Sequence
  chemically synthesized
ttagcctcacaacacagttcca

SEQ ID NO: 84555 - DNA, 22 bp, Artificial Sequence
  chemically synthesized
gcctcacaacacagttccacag

SEQ ID NO: 84556 - DNA, 22 bp, Artificial Sequence
  chemically synthesized
acaacacagttccacagacttt

SEQ ID NO: 84557 - DNA, 22 bp, Artificial Sequence
  chemically synthesized
cacagactttcttctcaatgta

SEQ ID NO: 84558 - DNA, 22 bp, Artificial Sequence
  chemically synthesized
tcttctcaatgtactctctata

SEQ ID NO: 84559 - DNA, 22 bp, Artificial Sequence
  chemically synthesized
cttctcaatgtactctctatac

SEQ ID NO: 84560 - DNA, 22 bp, Artificial Sequence
  chemically synthesized
ttctcaatgtactctctatact

SEQ ID NO: 84561 - DNA, 22 bp, Artificial Sequence
  chemically synthesized
ctcaatgtactctctatactac

SEQ ID NO: 84562 - DNA, 22 bp, Artificial Sequence
  chemically synthesized
tcaatgtactctctatactaca

SEQ ID NO: 84563 - DNA, 22 bp, Artificial Sequence
  chemically synthesized
aatgtactctctatactacact

SEQ ID NO: 84564 - DNA, 22 bp, Artificial Sequence
  chemically synthesized
tctatactacactgacgtcttc

SEQ ID NO: 84565 - DNA, 22 bp, Artificial Sequence
  chemically synthesized
tatactacactgacgtcttcta

SEQ ID NO: 84566 - DNA, 22 bp, Artificial Sequence
  chemically synthesized
tactacactgacgtcttctagc

SEQ ID NO: 84567 - DNA, 22 bp, Artificial Sequence
  chemically synthesized
cactgacgtcttctagcagtct

SEQ ID NO: 84568 - DNA, 22 bp, Artificial Sequence
  chemically synthesized
acgtcttctagcagtctaacca

SEQ ID NO: 84569 - DNA, 22 bp, Artificial Sequence
  chemically synthesized
ctagcagtctaaccattgtttt

SEQ ID NO: 84570 - DNA, 22 bp, Artificial Sequence
  chemically synthesized
tagcagtctaaccattgttttt

SEQ ID NO: 84571 - DNA, 22 bp, Artificial Sequence
  chemically synthesized
gcagtctaaccattgtttttct

SEQ ID NO: 84572 - DNA, 22 bp, Artificial Sequence
  chemically synthesized
accattgtttttcttgccctga

SEQ ID NO: 84573 - DNA, 22 bp, Artificial Sequence
  chemically synthesized
tttttcttgccctgactccttc

SEQ ID NO: 84574 - DNA, 22 bp, Artificial Sequence
  chemically synthesized
ttcttgccctgactccttctca

SEQ ID NO: 84575 - DNA, 22 bp, Artificial Sequence
  chemically synthesized
tcttgccctgactccttctcag

SEQ ID NO: 84576 - DNA, 22 bp, Artificial Sequence
  chemically synthesized
cttgccctgactccttctcagc

SEQ ID NO: 84577 - DNA, 22 bp, Artificial Sequence
  chemically synthesized
ttgccctgactccttctcagca

SEQ ID NO: 84578 - DNA, 22 bp, Artificial Sequence
  chemically synthesized
gccctgactccttctcagcatt

SEQ ID NO: 84579 - DNA, 22 bp, Artificial Sequence
  chemically synthesized
ccctgactccttctcagcattg

SEQ ID NO: 84580 - DNA, 22 bp, Artificial Sequence
  chemically synthesized
actccttctcagcattgaataa

SEQ ID NO: 84581 - DNA, 22 bp, Artificial Sequence
  chemically synthesized
cttctcagcattgaataactta

SEQ ID NO: 84582 - DNA, 22 bp, Artificial Sequence
  chemically synthesized
ctcagcattgaataacttagct

SEQ ID NO: 84583 - DNA, 22 bp, Artificial Sequence
  chemically synthesized
tcagcattgaataacttagctc

SEQ ID NO: 84584 - DNA, 22 bp, Artificial Sequence
  chemically synthesized
agcattgaataacttagctcac

SEQ ID NO: 84585 - DNA, 22 bp, Artificial Sequence
  chemically synthesized
aataacttagctcactattttt

SEQ ID NO: 84586 - DNA, 22 bp, Artificial Sequence
  chemically synthesized
agctcactatttttaatacttt

SEQ ID NO: 84587 - DNA, 22 bp, Artificial Sequence
  chemically synthesized
gctcactatttttaatactttt

SEQ ID NO: 84588 - DNA, 22 bp, Artificial Sequence
  chemically synthesized
actatttttaatacttttttct

SEQ ID NO: 84589 - DNA, 22 bp, Artificial Sequence
  chemically synthesized
tttttaatacttttttctccat

SEQ ID NO: 84590 - DNA, 22 bp, Artificial Sequence
  chemically synthesized
ttaatacttttttctccataga

SEQ ID NO: 84591 - DNA, 22 bp, Artificial Sequence
  chemically synthesized
taatacttttttctccatagaa

SEQ ID NO: 84592 - DNA, 22 bp, Artificial Sequence
  chemically synthesized
aatacttttttctccatagaat

SEQ ID NO: 84593 - DNA, 22 bp, Artificial Sequence
  chemically synthesized
atacttttttctccatagaatg

SEQ ID NO: 84594 - DNA, 22 bp, Artificial Sequence
  chemically synthesized
ttttctccatagaatgcttgaa

SEQ ID NO: 84595 - DNA, 22 bp, Artificial Sequence
  chemically synthesized
tttctccatagaatgcttgaag

SEQ ID NO: 84596 - DNA, 22 bp, Artificial Sequence
  chemically synthesized
ttctccatagaatgcttgaagt

SEQ ID NO: 84597 - DNA, 22 bp, Artificial Sequence
  chemically synthesized
tctccatagaatgcttgaagtt

SEQ ID NO: 84598 - DNA, 22 bp, Artificial Sequence
  chemically synthesized
ctccatagaatgcttgaagttt

SEQ ID NO: 84599 - DNA, 22 bp, Artificial Sequence
  chemically synthesized
tccatagaatgcttgaagtttc

SEQ ID NO: 84600 - DNA, 22 bp, Artificial Sequence
  chemically synthesized
catagaatgcttgaagtttctt

SEQ ID NO: 84601 - DNA, 22 bp, Artificial Sequence
  chemically synthesized
gaagtttcttcgtttcttgcag

SEQ ID NO: 84602 - DNA, 22 bp, Artificial Sequence
  chemically synthesized
aagtttcttcgtttcttgcaga

SEQ ID NO: 84603 - DNA, 22 bp, Artificial Sequence
  chemically synthesized
cttcgtttcttgcagaggattt

SEQ ID NO: 84604 - DNA, 22 bp, Artificial Sequence
  chemically synthesized
ttcgtttcttgcagaggatttt

SEQ ID NO: 84605 - DNA, 22 bp, Artificial Sequence
  chemically synthesized
cgtttcttgcagaggatttttc

SEQ ID NO: 84606 - DNA, 22 bp, Artificial Sequence
  chemically synthesized
gtttcttgcagaggatttttca

SEQ ID NO: 84607 - DNA, 22 bp, Artificial Sequence
  chemically synthesized
cttgcagaggatttttcagtct

SEQ ID NO: 84608 - DNA, 22 bp, Artificial Sequence
  chemically synthesized
ttgcagaggatttttcagtctt

SEQ ID NO: 84609 - DNA, 22 bp, Artificial Sequence
  chemically synthesized
gcagaggatttttcagtctttt

SEQ ID NO: 84610 - DNA, 22 bp, Artificial Sequence
  chemically synthesized
cagaggatttttcagtcttttg

SEQ ID NO: 84611 - DNA, 22 bp, Artificial Sequence
  chemically synthesized
ttcagtcttttgaatacgtatc

SEQ ID NO: 84612 - DNA, 22 bp, Artificial Sequence
  chemically synthesized
tcagtcttttgaatacgtatct

SEQ ID NO: 84613 - DNA, 22 bp, Artificial Sequence
  chemically synthesized
cagtcttttgaatacgtatctt

SEQ ID NO: 84614 - DNA, 22 bp, Artificial Sequence
  chemically synthesized
agtcttttgaatacgtatcttc

SEQ ID NO: 84615 - DNA, 22 bp, Artificial Sequence
  chemically synthesized
ttgaatacgtatcttctttcat

SEQ ID NO: 84616 - DNA, 22 bp, Artificial Sequence
  chemically synthesized
tgaatacgtatcttctttcatt

SEQ ID NO: 84617 - DNA, 22 bp, Artificial Sequence
  chemically synthesized
gaatacgtatcttctttcattt

SEQ ID NO: 84618 - DNA, 22 bp, Artificial Sequence
  chemically synthesized
aatacgtatcttctttcatttc

SEQ ID NO: 84619 - DNA, 22 bp, Artificial Sequence
  chemically synthesized
ctttcatttctctaaatcgaat

SEQ ID NO: 84620 - DNA, 22 bp, Artificial Sequence
  chemically synthesized
tttcatttctctaaatcgaatt

SEQ ID NO: 84621 - DNA, 22 bp, Artificial Sequence
  chemically synthesized
tcatttctctaaatcgaatttc

SEQ ID NO: 84622 - DNA, 22 bp, Artificial Sequence
  chemically synthesized
catttctctaaatcgaatttct

SEQ ID NO: 84623 - DNA, 22 bp, Artificial Sequence
  chemically synthesized
atttctctaaatcgaatttctc

SEQ ID NO: 84624 - DNA, 22 bp, Artificial Sequence
  chemically synthesized
ctctaaatcgaatttctcttct

SEQ ID NO: 84625 - DNA, 22 bp, Artificial Sequence
  chemically synthesized
tctaaatcgaatttctcttctt

SEQ ID NO: 84626 - DNA, 22 bp, Artificial Sequence
  chemically synthesized
taaatcgaatttctcttctttc

SEQ ID NO: 84627 - DNA, 22 bp, Artificial Sequence
  chemically synthesized
aatcgaatttctcttctttcgt

SEQ ID NO: 84628 - DNA, 22 bp, Artificial Sequence
  chemically synthesized
ctcttctttcgtaaaatttttc

SEQ ID NO: 84629 - DNA, 22 bp, Artificial Sequence
  chemically synthesized
tcttctttcgtaaaatttttct

SEQ ID NO: 84630 - DNA, 22 bp, Artificial Sequence
  chemically synthesized
ttctttcgtaaaatttttctcg

SEQ ID NO: 84631 - DNA, 22 bp, Artificial Sequence
  chemically synthesized
ctttcgtaaaatttttctcgaa

SEQ ID NO: 84632 - DNA, 22 bp, Artificial Sequence
  chemically synthesized
tttcgtaaaatttttctcgaaa

SEQ ID NO: 84633 - DNA, 22 bp, Artificial Sequence
  chemically synthesized
tcgtaaaatttttctcgaaatg

SEQ ID NO: 84634 - DNA, 22 bp, Artificial Sequence
  chemically synthesized
cgtaaaatttttctcgaaatgt

SEQ ID NO: 84635 - DNA, 22 bp, Artificial Sequence
  chemically synthesized
gtaaaatttttctcgaaatgtt

SEQ ID NO: 84636 - DNA, 22 bp, Artificial Sequence
  chemically synthesized
ttctcgaaatgttctatctgcc

SEQ ID NO: 84637 - DNA, 22 bp, Artificial Sequence
  chemically synthesized
tctcgaaatgttctatctgcct

SEQ ID NO: 84638 - DNA, 22 bp, Artificial Sequence
  chemically synthesized
ctcgaaatgttctatctgccta

SEQ ID NO: 84639 - DNA, 22 bp, Artificial Sequence
  chemically synthesized
tcgaaatgttctatctgcctaa

SEQ ID NO: 84640 - DNA, 22 bp, Artificial Sequence
  chemically synthesized
gaaatgttctatctgcctaaat

SEQ ID NO: 84641 - DNA, 22 bp, Artificial Sequence
  chemically synthesized
tatctgcctaaattattcatca

SEQ ID NO: 84642 - DNA, 22 bp, Artificial Sequence
  chemically synthesized
tctgcctaaattattcatcatc

SEQ ID NO: 84643 - DNA, 22 bp, Artificial Sequence
  chemically synthesized
cctaaattattcatcatctttt

SEQ ID NO: 84644 - DNA, 22 bp, Artificial Sequence
  chemically synthesized
aattattcatcatcttttcctc

SEQ ID NO: 84645 - DNA, 22 bp, Artificial Sequence
  chemically synthesized
ttcatcatcttttcctcaattt

SEQ ID NO: 84646 - DNA, 22 bp, Artificial Sequence
  chemically synthesized
atcatcttttcctcaatttctt

SEQ ID NO: 84647 - DNA, 22 bp, Artificial Sequence
  chemically synthesized
ttcctcaatttcttcctaccct

SEQ ID NO: 84648 - DNA, 22 bp, Artificial Sequence
  chemically synthesized
tcctcaatttcttcctaccctt

SEQ ID NO: 84649 - DNA, 22 bp, Artificial Sequence
  chemically synthesized
cctcaatttcttcctacccttt

SEQ ID NO: 84650 - DNA, 22 bp, Artificial Sequence
  chemically synthesized
ctcaatttcttcctaccctttt

SEQ ID NO: 84651 - DNA, 22 bp, Artificial Sequence
  chemically synthesized
aatttcttcctaccctttttaa

SEQ ID NO: 84652 - DNA, 22 bp, Artificial Sequence
  chemically synthesized
cttcctaccctttttaaaacga

SEQ ID NO: 84653 - DNA, 22 bp, Artificial Sequence
  chemically synthesized
ttcctaccctttttaaaacgat

SEQ ID NO: 84654 - DNA, 22 bp, Artificial Sequence
  chemically synthesized
cctaccctttttaaaacgatct

SEQ ID NO: 84655 - DNA, 22 bp, Artificial Sequence
  chemically synthesized
ctaccctttttaaaacgatctt

SEQ ID NO: 84656 - DNA, 22 bp, Artificial Sequence
  chemically synthesized
ccctttttaaaacgatcttgca

SEQ ID NO: 84657 - DNA, 22 bp, Artificial Sequence
  chemically synthesized
tttaaaacgatcttgcaactca

SEQ ID NO: 84658 - DNA, 22 bp, Artificial Sequence
  chemically synthesized
ttaaaacgatcttgcaactcaa

SEQ ID NO: 84659 - DNA, 22 bp, Artificial Sequence
  chemically synthesized
taaaacgatcttgcaactcaac

SEQ ID NO: 84660 - DNA, 22 bp, Artificial Sequence
  chemically synthesized
aaaacgatcttgcaactcaaca

SEQ ID NO: 84661 - DNA, 22 bp, Artificial Sequence
  chemically synthesized
aaacgatcttgcaactcaacaa

SEQ ID NO: 84662 - DNA, 22 bp, Artificial Sequence
  chemically synthesized
gcaactcaacaatcacttttca

SEQ ID NO: 84663 - DNA, 22 bp, Artificial Sequence
  chemically synthesized
caactcaacaatcacttttcaa

SEQ ID NO: 84664 - DNA, 22 bp, Artificial Sequence
  chemically synthesized
aacaatcacttttcaagaagtt

SEQ ID NO: 84665 - DNA, 22 bp, Artificial Sequence
  chemically synthesized
ttcaagaagtttcttaagacaa

SEQ ID NO: 84666 - DNA, 22 bp, Artificial Sequence
  chemically synthesized
tcaagaagtttcttaagacaaa

SEQ ID NO: 84667 - DNA, 22 bp, Artificial Sequence
  chemically synthesized
caagaagtttcttaagacaaat

SEQ ID NO: 84668 - DNA, 22 bp, Artificial Sequence
  chemically synthesized
aagaagtttcttaagacaaatt

SEQ ID NO: 84669 - DNA, 22 bp, Artificial Sequence
  chemically synthesized
cttaagacaaatttatccatat

SEQ ID NO: 84670 - DNA, 22 bp, Artificial Sequence
  chemically synthesized
ttaagacaaatttatccatata

SEQ ID NO: 84671 - DNA, 22 bp, Artificial Sequence
  chemically synthesized
aagacaaatttatccatatatc

SEQ ID NO: 84672 - DNA, 22 bp, Artificial Sequence
  chemically synthesized
agacaaatttatccatatatct

SEQ ID NO: 84673 - DNA, 22 bp, Artificial Sequence
  chemically synthesized
atccatatatctattattttgg

SEQ ID NO: 84674 - DNA, 22 bp, Artificial Sequence
  chemically synthesized
tccatatatctattattttggt

SEQ ID NO: 84675 - DNA, 22 bp, Artificial Sequence
  chemically synthesized
ttattttggtatcatgtttcaa

SEQ ID NO: 84676 - DNA, 22 bp, Artificial Sequence
  chemically synthesized
ttttggtatcatgtttcaattt

SEQ ID NO: 84677 - DNA, 22 bp, Artificial Sequence
  chemically synthesized
tggtatcatgtttcaattttaa

SEQ ID NO: 84678 - DNA, 22 bp, Artificial Sequence
  chemically synthesized
ggtatcatgtttcaattttaaa

SEQ ID NO: 84679 - DNA, 22 bp, Artificial Sequence
  chemically synthesized
gtatcatgtttcaattttaaat

SEQ ID NO: 84680 - DNA, 22 bp, Artificial Sequence
  chemically synthesized
caattttaaataaaacttataa

SEQ ID NO: 84681 - DNA, 22 bp, Artificial Sequence
  chemically synthesized
aattttaaataaaacttataat

SEQ ID NO: 84682 - DNA, 22 bp, Artificial Sequence
  chemically synthesized
taaataaaacttataattttgt

SEQ ID NO: 84683 - DNA, 22 bp, Artificial Sequence
  chemically synthesized
aaataaaacttataattttgta

SEQ ID NO: 84684 - DNA, 22 bp, Artificial Sequence
  chemically synthesized
aataaaacttataattttgtat

SEQ ID NO: 84685 - DNA, 22 bp, Artificial Sequence
  chemically synthesized
ataattttgtatttattagcta

SEQ ID NO: 84686 - DNA, 22 bp, Artificial Sequence
  chemically synthesized
taattttgtatttattagctaa

SEQ ID NO: 84687 - DNA, 22 bp, Artificial Sequence
  chemically synthesized
tgtatttattagctaaatattt

SEQ ID NO: 84688 - DNA, 22 bp, Artificial Sequence
  chemically synthesized
gtatttattagctaaatattta

SEQ ID NO: 84689 - DNA, 22 bp, Artificial Sequence
  chemically synthesized
tatttattagctaaatatttaa

SEQ ID NO: 84690 - DNA, 22 bp, Artificial Sequence
  chemically synthesized
attagctaaatatttaactaat

SEQ ID NO: 84691 - DNA, 22 bp, Artificial Sequence
  chemically synthesized
ttagctaaatatttaactaata

SEQ ID NO: 84692 - DNA, 22 bp, Artificial Sequence
  chemically synthesized
gctaaatatttaactaatattt

SEQ ID NO: 84693 - DNA, 22 bp, Artificial Sequence
  chemically synthesized
aatatttaactaatatttaaac

SEQ ID NO: 84694 - DNA, 22 bp, Artificial Sequence
  chemically synthesized
aactaatatttaaactaaatat

SEQ ID NO: 84695 - DNA, 22 bp, Artificial Sequence
  chemically synthesized
actaatatttaaactaaatatt

SEQ ID NO: 84696 - DNA, 22 bp, Artificial Sequence
  chemically synthesized
atatttaaactaaatatttaac

SEQ ID NO: 84697 - DNA, 22 bp, Artificial Sequence
  chemically synthesized
aaactaaatatttaactaatat

SEQ ID NO: 84698 - DNA, 22 bp, Artificial Sequence
  chemically synthesized
aactaaatatttaactaatatc

SEQ ID NO: 84699 - DNA, 22 bp, Artificial Sequence
  chemically synthesized
aatatttaactaatatctctgt

SEQ ID NO: 84700 - DNA, 22 bp, Artificial Sequence
  chemically synthesized
aactaatatctctgttacaaac

SEQ ID NO: 84701 - DNA, 22 bp, Artificial Sequence
  chemically synthesized
actaatatctctgttacaaact

SEQ ID NO: 84702 - DNA, 22 bp, Artificial Sequence
  chemically synthesized
atatctctgttacaaactaaat

SEQ ID NO: 84703 - DNA, 22 bp, Artificial Sequence
  chemically synthesized
tgttacaaactaaattctcagt

SEQ ID NO: 84704 - DNA, 22 bp, Artificial Sequence
  chemically synthesized
ttacaaactaaattctcagttc

SEQ ID NO: 84705 - DNA, 22 bp, Artificial Sequence
  chemically synthesized
caaactaaattctcagttcctt

SEQ ID NO: 84706 - DNA, 22 bp, Artificial Sequence
  chemically synthesized
aattctcagttccttaatgtgc

SEQ ID NO: 84707 - DNA, 22 bp, Artificial Sequence
  chemically synthesized
tcagttccttaatgtgcagact

SEQ ID NO: 84708 - DNA, 22 bp, Artificial Sequence
  chemically synthesized
agttccttaatgtgcagactat

SEQ ID NO: 84709 - DNA, 22 bp, Artificial Sequence
  chemically synthesized
cttaatgtgcagactatgtcaa

SEQ ID NO: 84710 - DNA, 22 bp, Artificial Sequence
  chemically synthesized
aatgtgcagactatgtcaactt

SEQ ID NO: 84711 - DNA, 22 bp, Artificial Sequence
  chemically synthesized
atgtgcagactatgtcaacttt

SEQ ID NO: 84712 - DNA, 22 bp, Artificial Sequence
  chemically synthesized
tgtcaactttttcttattattt

SEQ ID NO: 84713 - DNA, 22 bp, Artificial Sequence
  chemically synthesized
tttcttattatttgaaactaac

SEQ ID NO: 84714 - DNA, 22 bp, Artificial Sequence
  chemically synthesized
ttcttattatttgaaactaaca

SEQ ID NO: 84715 - DNA, 22 bp, Artificial Sequence
  chemically synthesized
tcttattatttgaaactaacat

SEQ ID NO: 84716 - DNA, 22 bp, Artificial Sequence
  chemically synthesized
cttattatttgaaactaacatt

SEQ ID NO: 84717 - DNA, 22 bp, Artificial Sequence
  chemically synthesized
ttattatttgaaactaacattt

SEQ ID NO: 84718 - DNA, 22 bp, Artificial Sequence
  chemically synthesized
attatttgaaactaacatttgc

SEQ ID NO: 84719 - DNA, 22 bp, Artificial Sequence
  chemically synthesized
ttatttgaaactaacatttgca

SEQ ID NO: 84720 - DNA, 22 bp, Artificial Sequence
  chemically synthesized
tttgaaactaacatttgcacct

SEQ ID NO: 84721 - DNA, 22 bp, Artificial Sequence
  chemically synthesized
gaaactaacatttgcacctctg

SEQ ID NO: 84722 - DNA, 22 bp, Artificial Sequence
  chemically synthesized
aaactaacatttgcacctctga

SEQ ID NO: 84723 - DNA, 22 bp, Artificial Sequence
  chemically synthesized
acatttgcacctctgattcctg

SEQ ID NO: 84724 - DNA, 22 bp, Artificial Sequence
  chemically synthesized
gcacctctgattcctgaccact

SEQ ID NO: 84725 - DNA, 22 bp, Artificial Sequence
  chemically synthesized
cacctctgattcctgaccactc

SEQ ID NO: 84726 - DNA, 22 bp, Artificial Sequence
  chemically synthesized
tgattcctgaccactcctgaga

SEQ ID NO: 84727 - DNA, 22 bp, Artificial Sequence
  chemically synthesized
attcctgaccactcctgagagc

SEQ ID NO: 84728 - DNA, 22 bp, Artificial Sequence
  chemically synthesized
ctgaccactcctgagagctcaa

SEQ ID NO: 84729 - DNA, 22 bp, Artificial Sequence
  chemically synthesized
accactcctgagagctcaaatt

SEQ ID NO: 84730 - DNA, 22 bp, Artificial Sequence
  chemically synthesized
ctgagagctcaaattcatgaat

SEQ ID NO: 84731 - DNA, 22 bp, Artificial Sequence
  chemically synthesized
agagctcaaattcatgaataca

SEQ ID NO: 84732 - DNA, 22 bp, Artificial Sequence
  chemically synthesized
aaattcatgaatacaactggct

SEQ ID NO: 84733 - DNA, 22 bp, Artificial Sequence
  chemically synthesized
atgaatacaactggctatttaa

SEQ ID NO: 84734 - DNA, 22 bp, Artificial Sequence
  chemically synthesized
gctatttaatatattcatctga

SEQ ID NO: 84735 - DNA, 22 bp, Artificial Sequence
  chemically synthesized
tttaatatattcatctgagtgt

SEQ ID NO: 84736 - DNA, 22 bp, Artificial Sequence
  chemically synthesized
aatatattcatctgagtgttta

SEQ ID NO: 84737 - DNA, 22 bp, Artificial Sequence
  chemically synthesized
atatattcatctgagtgtttaa

SEQ ID NO: 84738 - DNA, 22 bp, Artificial Sequence
  chemically synthesized
atctgagtgtttaatcttaaaa

SEQ ID NO: 84739 - DNA, 22 bp, Artificial Sequence
  chemically synthesized
agtgtttaatcttaaaataaga

SEQ ID NO: 84740 - DNA, 22 bp, Artificial Sequence
  chemically synthesized
aatcttaaaataagaatgatgc

SEQ ID NO: 84741 - DNA, 22 bp, Artificial Sequence
  chemically synthesized
atcttaaaataagaatgatgcc

SEQ ID NO: 84742 - DNA, 22 bp, Artificial Sequence
  chemically synthesized
aaaataagaatgatgccaataa

SEQ ID NO: 84743 - DNA, 22 bp, Artificial Sequence
  chemically synthesized
aaataagaatgatgccaataaa

SEQ ID NO: 84744 - DNA, 22 bp, Artificial Sequence
  chemically synthesized
gattttccccccaaaatctatt

SEQ ID NO: 84745 - DNA, 22 bp, Artificial Sequence
  chemically synthesized
attttccccccaaaatctattt

SEQ ID NO: 84746 - DNA, 22 bp, Artificial Sequence
  chemically synthesized
tccccccaaaatctattttctg

SEQ ID NO: 84747 - DNA, 22 bp, Artificial Sequence
  chemically synthesized
ccccccaaaatctattttctgt

SEQ ID NO: 84748 - DNA, 22 bp, Artificial Sequence
  chemically synthesized
cccccaaaatctattttctgtc

SEQ ID NO: 84749 - DNA, 22 bp, Artificial Sequence
  chemically synthesized
ttttctgtcccttttctcctaa

SEQ ID NO: 84750 - DNA, 22 bp, Artificial Sequence
  chemically synthesized
tctgtcccttttctcctaatat

SEQ ID NO: 84751 - DNA, 22 bp, Artificial Sequence
  chemically synthesized
ctgtcccttttctcctaatatt

SEQ ID NO: 84752 - DNA, 22 bp, Artificial Sequence
  chemically synthesized
tgtcccttttctcctaatatta

SEQ ID NO: 84753 - DNA, 22 bp, Artificial Sequence
  chemically synthesized
tcccttttctcctaatattata

SEQ ID NO: 84754 - DNA, 22 bp, Artificial Sequence
  chemically synthesized
ttctcctaatattataaagtga

SEQ ID NO: 84755 - DNA, 22 bp, Artificial Sequence
  chemically synthesized
tctcctaatattataaagtgac

SEQ ID NO: 84756 - DNA, 22 bp, Artificial Sequence
  chemically synthesized
ctcctaatattataaagtgact

SEQ ID NO: 84757 - DNA, 22 bp, Artificial Sequence
  chemically synthesized
tcctaatattataaagtgactc

SEQ ID NO: 84758 - DNA, 22 bp, Artificial Sequence
  chemically synthesized
ctaatattataaagtgactcca

SEQ ID NO: 84759 - DNA, 22 bp, Artificial Sequence
  chemically synthesized
atattataaagtgactccacca

SEQ ID NO: 84760 - DNA, 22 bp, Artificial Sequence
  chemically synthesized
taaagtgactccaccaataaca

SEQ ID NO: 84761 - DNA, 22 bp, Artificial Sequence
  chemically synthesized
caccaataacacaattgcataa

SEQ ID NO: 84762 - DNA, 22 bp, Artificial Sequence
  chemically synthesized
cataagacaagtcttgagtcat

SEQ ID NO: 84763 - DNA, 22 bp, Artificial Sequence
  chemically synthesized
gagtcatttttaaaatttttta

SEQ ID NO: 84764 - DNA, 22 bp, Artificial Sequence
  chemically synthesized
agtcatttttaaaattttttat

SEQ ID NO: 84765 - DNA, 22 bp, Artificial Sequence
  chemically synthesized
ttaaaattttttatttctctct

SEQ ID NO: 84766 - DNA, 22 bp, Artificial Sequence
  chemically synthesized
taaaattttttatttctctctt

SEQ ID NO: 84767 - DNA, 22 bp, Artificial Sequence
  chemically synthesized
aaaattttttatttctctcttt

SEQ ID NO: 84768 - DNA, 22 bp, Artificial Sequence
  chemically synthesized
aaattttttatttctctctttc

SEQ ID NO: 84769 - DNA, 22 bp, Artificial Sequence
  chemically synthesized
tttatttctctctttccttccc

SEQ ID NO: 84770 - DNA, 22 bp, Artificial Sequence
  chemically synthesized
ttatttctctctttccttccct

SEQ ID NO: 84771 - DNA, 22 bp, Artificial Sequence
  chemically synthesized
tatttctctctttccttccctt

SEQ ID NO: 84772 - DNA, 22 bp, Artificial Sequence
  chemically synthesized
atttctctctttccttcccttt

SEQ ID NO: 84773 - DNA, 22 bp, Artificial Sequence
  chemically synthesized
tttctctctttccttccctttc

SEQ ID NO: 84774 - DNA, 22 bp, Artificial Sequence
  chemically synthesized
ctctctttccttccctttcctc

SEQ ID NO: 84775 - DNA, 22 bp, Artificial Sequence
  chemically synthesized
tctctttccttccctttcctct

SEQ ID NO: 84776 - DNA, 22 bp, Artificial Sequence
  chemically synthesized
tctttccttccctttcctctct

SEQ ID NO: 84777 - DNA, 22 bp, Artificial Sequence
  chemically synthesized
tttccttccctttcctctctcc

SEQ ID NO: 84778 - DNA, 22 bp, Artificial Sequence
  chemically synthesized
tccttccctttcctctctccat

SEQ ID NO: 84779 - DNA, 22 bp, Artificial Sequence
  chemically synthesized
ccttccctttcctctctccatc

SEQ ID NO: 84780 - DNA, 22 bp, Artificial Sequence
  chemically synthesized
cttccctttcctctctccatca

SEQ ID NO: 84781 - DNA, 22 bp, Artificial Sequence
  chemically synthesized
ccctttcctctctccatcaaat

SEQ ID NO: 84782 - DNA, 22 bp, Artificial Sequence
  chemically synthesized
cctttcctctctccatcaaatc

SEQ ID NO: 84783 - DNA, 22 bp, Artificial Sequence
  chemically synthesized
tcctctctccatcaaatctttc

SEQ ID NO: 84784 - DNA, 22 bp, Artificial Sequence
  chemically synthesized
cctctctccatcaaatctttca

SEQ ID NO: 84785 - DNA, 22 bp, Artificial Sequence
  chemically synthesized
ctctctccatcaaatctttcat

SEQ ID NO: 84786 - DNA, 22 bp, Artificial Sequence
  chemically synthesized
tctccatcaaatctttcatcaa

SEQ ID NO: 84787 - DNA, 22 bp, Artificial Sequence
  chemically synthesized
tccatcaaatctttcatcaatt

SEQ ID NO: 84788 - DNA, 22 bp, Artificial Sequence
  chemically synthesized
catcaaatctttcatcaatttc

SEQ ID NO: 84789 - DNA, 22 bp, Artificial Sequence
  chemically synthesized
tcatcaatttctaccatttcta

SEQ ID NO: 84790 - DNA, 22 bp, Artificial Sequence
  chemically synthesized
catcaatttctaccatttctac

SEQ ID NO: 84791 - DNA, 22 bp, Artificial Sequence
  chemically synthesized
atcaatttctaccatttctacc

SEQ ID NO: 84792 - DNA, 22 bp, Artificial Sequence
  chemically synthesized
ctaccatttctaccagaaacac

SEQ ID NO: 84793 - DNA, 22 bp, Artificial Sequence
  chemically synthesized
taccatttctaccagaaacaca

SEQ ID NO: 84794 - DNA, 22 bp, Artificial Sequence
  chemically synthesized
ccatttctaccagaaacacatc

SEQ ID NO: 84795 - DNA, 22 bp, Artificial Sequence
  chemically synthesized
ctaccagaaacacatcccagat

SEQ ID NO: 84796 - DNA, 22 bp, Artificial Sequence
  chemically synthesized
taccagaaacacatcccagata

SEQ ID NO: 84797 - DNA, 22 bp, Artificial Sequence
  chemically synthesized
ccagaaacacatcccagatagg

SEQ ID NO: 84798 - DNA, 22 bp, Artificial Sequence
  chemically synthesized
ttacacattgcccgtcttggtt

SEQ ID NO: 84799 - DNA, 22 bp, Artificial Sequence
  chemically synthesized
tacacattgcccgtcttggttt

SEQ ID NO: 84800 - DNA, 22 bp, Artificial Sequence
  chemically synthesized
acacattgcccgtcttggttta

SEQ ID NO: 84801 - DNA, 22 bp, Artificial Sequence
  chemically synthesized
cacattgcccgtcttggtttat

SEQ ID NO: 84802 - DNA, 22 bp, Artificial Sequence
  chemically synthesized
cccgtcttggtttataatatca

SEQ ID NO: 84803 - DNA, 22 bp, Artificial Sequence
  chemically synthesized
ggtttataatatcattgtttcc

SEQ ID NO: 84804 - DNA, 22 bp, Artificial Sequence
  chemically synthesized
gtttataatatcattgtttccc

SEQ ID NO: 84805 - DNA, 22 bp, Artificial Sequence
  chemically synthesized
ataatatcattgtttccctggc

SEQ ID NO: 84806 - DNA, 22 bp, Artificial Sequence
  chemically synthesized
taatatcattgtttccctggct

SEQ ID NO: 84807 - DNA, 22 bp, Artificial Sequence
  chemically synthesized
tttccctggctactatgataat

SEQ ID NO: 84808 - DNA, 22 bp, Artificial Sequence
  chemically synthesized
ccctggctactatgataattta

SEQ ID NO: 84809 - DNA, 22 bp, Artificial Sequence
  chemically synthesized
cctggctactatgataatttat

SEQ ID NO: 84810 - DNA, 22 bp, Artificial Sequence
  chemically synthesized
gctactatgataatttattaaa

SEQ ID NO: 84811 - DNA, 22 bp, Artificial Sequence
  chemically synthesized
ctatgataatttattaaattaa

SEQ ID NO: 84812 - DNA, 22 bp, Artificial Sequence
  chemically synthesized
tgataatttattaaattaataa

SEQ ID NO: 84813 - DNA, 22 bp, Artificial Sequence
  chemically synthesized
attaaattaataataatttaat

SEQ ID NO: 84814 - DNA, 22 bp, Artificial Sequence
  chemically synthesized
ttaaattaataataatttaata

SEQ ID NO: 84815 - DNA, 22 bp, Artificial Sequence
  chemically synthesized
aattaataataatttaatatta

SEQ ID NO: 84816 - DNA, 22 bp, Artificial Sequence
  chemically synthesized
ataataatttaatattattact

SEQ ID NO: 84817 - DNA, 22 bp, Artificial Sequence
  chemically synthesized
aatattattactagctaatatc

SEQ ID NO: 84818 - DNA, 22 bp, Artificial Sequence
  chemically synthesized
atattattactagctaatatca

SEQ ID NO: 84819 - DNA, 22 bp, Artificial Sequence
  chemically synthesized
ttactagctaatatcatgattt

SEQ ID NO: 84820 - DNA, 22 bp, Artificial Sequence
  chemically synthesized
ctagctaatatcatgatttatc

SEQ ID NO: 84821 - DNA, 22 bp, Artificial Sequence
  chemically synthesized
gctaatatcatgatttatctgt

SEQ ID NO: 84822 - DNA, 22 bp, Artificial Sequence
  chemically synthesized
atatcatgatttatctgtttgt

SEQ ID NO: 84823 - DNA, 22 bp, Artificial Sequence
  chemically synthesized
atctgtttgtcctctaaaaaat

SEQ ID NO: 84824 - DNA, 22 bp, Artificial Sequence
  chemically synthesized
tctgtttgtcctctaaaaaatg

SEQ ID NO: 84825 - DNA, 22 bp, Artificial Sequence
  chemically synthesized
tttgtcctctaaaaaatgtatt

SEQ ID NO: 84826 - DNA, 22 bp, Artificial Sequence
  chemically synthesized
gtcctctaaaaaatgtattatc

SEQ ID NO: 84827 - DNA, 22 bp, Artificial Sequence
  chemically synthesized
tcctctaaaaaatgtattatct

SEQ ID NO: 84828 - DNA, 22 bp, Artificial Sequence
  chemically synthesized
taaaaaatgtattatctccagg

SEQ ID NO: 84829 - DNA, 22 bp, Artificial Sequence
  chemically synthesized
aaaaatgtattatctccaggga

SEQ ID NO: 84830 - DNA, 22 bp, Artificial Sequence
  chemically synthesized
tctccagggaaaccaaattgct

SEQ ID NO: 84831 - DNA, 22 bp, Artificial Sequence
  chemically synthesized
cagggaaaccaaattgcttttc

SEQ ID NO: 84832 - DNA, 22 bp, Artificial Sequence
  chemically synthesized
cttttctacaaacatctactaa

SEQ ID NO: 84833 - DNA, 22 bp, Artificial Sequence
  chemically synthesized
ttctacaaacatctactaaatc

SEQ ID NO: 84834 - DNA, 22 bp, Artificial Sequence
  chemically synthesized
tctacaaacatctactaaatca

SEQ ID NO: 84835 - DNA, 22 bp, Artificial Sequence
  chemically synthesized
ctacaaacatctactaaatcac

SEQ ID NO: 84836 - DNA, 22 bp, Artificial Sequence
  chemically synthesized
tacaaacatctactaaatcaca

SEQ ID NO: 84837 - DNA, 22 bp, Artificial Sequence
  chemically synthesized
caaacatctactaaatcacaca

SEQ ID NO: 84838 - DNA, 22 bp, Artificial Sequence
  chemically synthesized
ctaaatcacacaaacctttgtt

SEQ ID NO: 84839 - DNA, 22 bp, Artificial Sequence
  chemically synthesized
aatcacacaaacctttgttgaa

SEQ ID NO: 84840 - DNA, 22 bp, Artificial Sequence
  chemically synthesized
tgttgaaaaaactctttgatgg

SEQ ID NO: 84841 - DNA, 22 bp, Artificial Sequence
  chemically synthesized
gttgaaaaaactctttgatggt

SEQ ID NO: 84842 - DNA, 22 bp, Artificial Sequence
  chemically synthesized
ttgaaaaaactctttgatggtc

SEQ ID NO: 84843 - DNA, 22 bp, Artificial Sequence
  chemically synthesized
aaaaaactctttgatggtcact

SEQ ID NO: 84844 - DNA, 22 bp, Artificial Sequence
  chemically synthesized
tttgatggtcacttacccattg

SEQ ID NO: 84845 - DNA, 22 bp, Artificial Sequence
  chemically synthesized
tgatggtcacttacccattgct

SEQ ID NO: 84846 - DNA, 22 bp, Artificial Sequence
  chemically synthesized
gatggtcacttacccattgctc

SEQ ID NO: 84847 - DNA, 22 bp, Artificial Sequence
  chemically synthesized
atggtcacttacccattgctcg

SEQ ID NO: 84848 - DNA, 22 bp, Artificial Sequence
  chemically synthesized
acccattgctcgtaatgtaaaa

SEQ ID NO: 84849 - DNA, 22 bp, Artificial Sequence
  chemically synthesized
cccattgctcgtaatgtaaaat

SEQ ID NO: 84850 - DNA, 22 bp, Artificial Sequence
  chemically synthesized
ctcgtaatgtaaaatacaaatt

SEQ ID NO: 84851 - DNA, 22 bp, Artificial Sequence
  chemically synthesized
gtaatgtaaaatacaaattctt

SEQ ID NO: 84852 - DNA, 22 bp, Artificial Sequence
  chemically synthesized
tttatcatagtcaaaaagcctt

SEQ ID NO: 84853 - DNA, 22 bp, Artificial Sequence
  chemically synthesized
tatcatagtcaaaaagccttgt

SEQ ID NO: 84854 - DNA, 22 bp, Artificial Sequence
  chemically synthesized
atcatagtcaaaaagccttgta

SEQ ID NO: 84855 - DNA, 22 bp, Artificial Sequence
  chemically synthesized
tcatagtcaaaaagccttgtat

SEQ ID NO: 84856 - DNA, 22 bp, Artificial Sequence
  chemically synthesized
gtataacgtggctcacctgcct

SEQ ID NO: 84857 - DNA, 22 bp, Artificial Sequence
  chemically synthesized
tataacgtggctcacctgcctc

SEQ ID NO: 84858 - DNA, 22 bp, Artificial Sequence
  chemically synthesized
acctgcctcttctattacatct

SEQ ID NO: 84859 - DNA, 22 bp, Artificial Sequence
  chemically synthesized
cctcttctattacatctttaga

SEQ ID NO: 84860 - DNA, 22 bp, Artificial Sequence
  chemically synthesized
ttctattacatctttagaccac

SEQ ID NO: 84861 - DNA, 22 bp, Artificial Sequence
  chemically synthesized
ctattacatctttagaccacta

SEQ ID NO: 84862 - DNA, 22 bp, Artificial Sequence
  chemically synthesized
tattacatctttagaccactac

SEQ ID NO: 84863 - DNA, 22 bp, Artificial Sequence
  chemically synthesized
ttacatctttagaccactactg

SEQ ID NO: 84864 - DNA, 22 bp, Artificial Sequence
  chemically synthesized
catctttagaccactactgcct

SEQ ID NO: 84865 - DNA, 22 bp, Artificial Sequence
  chemically synthesized
tagaccactactgcctacactc

SEQ ID NO: 84866 - DNA, 22 bp, Artificial Sequence
  chemically synthesized
agaccactactgcctacactcc

SEQ ID NO: 84867 - DNA, 22 bp, Artificial Sequence
  chemically synthesized
gaccactactgcctacactcct

SEQ ID NO: 84868 - DNA, 22 bp, Artificial Sequence
  chemically synthesized
ctgcctacactccttaatattt

SEQ ID NO: 84869 - DNA, 22 bp, Artificial Sequence
  chemically synthesized
cctacactccttaatatttagg

SEQ ID NO: 84870 - DNA, 22 bp, Artificial Sequence
  chemically synthesized
cactccttaatatttaggtatc

SEQ ID NO: 84871 - DNA, 22 bp, Artificial Sequence
  chemically synthesized
cttaatatttaggtatctttat

SEQ ID NO: 84872 - DNA, 22 bp, Artificial Sequence
  chemically synthesized
aatatttaggtatctttatctt

SEQ ID NO: 84873 - DNA, 22 bp, Artificial Sequence
  chemically synthesized
atatttaggtatctttatcttc

SEQ ID NO: 84874 - DNA, 22 bp, Artificial Sequence
  chemically synthesized
aggtatctttatcttcctcaaa

SEQ ID NO: 84875 - DNA, 22 bp, Artificial Sequence
  chemically synthesized
ggtatctttatcttcctcaaaa

SEQ ID NO: 84876 - DNA, 22 bp, Artificial Sequence
  chemically synthesized
tatcttcctcaaaacaagctaa

SEQ ID NO: 84877 - DNA, 22 bp, Artificial Sequence
  chemically synthesized
atcttcctcaaaacaagctaag

SEQ ID NO: 84878 - DNA, 22 bp, Artificial Sequence
  chemically synthesized
tcttcctcaaaacaagctaagt

SEQ ID NO: 84879 - DNA, 22 bp, Artificial Sequence
  chemically synthesized
cctcaaaacaagctaagtacat

SEQ ID NO: 84880 - DNA, 22 bp, Artificial Sequence
  chemically synthesized
ctcaaaacaagctaagtacatg

SEQ ID NO: 84881 - DNA, 22 bp, Artificial Sequence
  chemically synthesized
aaaacaagctaagtacatgcat

SEQ ID NO: 84882 - DNA, 22 bp, Artificial Sequence
  chemically synthesized
agtacatgcatgtctcaggatc

SEQ ID NO: 84883 - DNA, 22 bp, Artificial Sequence
  chemically synthesized
aggatctttgcccatggtcttc

SEQ ID NO: 84884 - DNA, 22 bp, Artificial Sequence
  chemically synthesized
tgcccatggtcttctctgtgct

SEQ ID NO: 84885 - DNA, 22 bp, Artificial Sequence
  chemically synthesized
gcccatggtcttctctgtgctc

SEQ ID NO: 84886 - DNA, 22 bp, Artificial Sequence
  chemically synthesized
cccatggtcttctctgtgctcc

SEQ ID NO: 84887 - DNA, 22 bp, Artificial Sequence
  chemically synthesized
ctctgtgctccgaattatctac

SEQ ID NO: 84888 - DNA, 22 bp, Artificial Sequence
  chemically synthesized
tctgtgctccgaattatctacc

SEQ ID NO: 84889 - DNA, 22 bp, Artificial Sequence
  chemically synthesized
tgtgctccgaattatctacccc

SEQ ID NO: 84890 - DNA, 22 bp, Artificial Sequence
  chemically synthesized
tgctccgaattatctaccccaa

SEQ ID NO: 84891 - DNA, 22 bp, Artificial Sequence
  chemically synthesized
cgaattatctaccccaagtatt

SEQ ID NO: 84892 - DNA, 22 bp, Artificial Sequence
  chemically synthesized
tctaccccaagtatttgcacag

SEQ ID NO: 84893 - DNA, 22 bp, Artificial Sequence
  chemically synthesized
ccccaagtatttgcacagcaat

SEQ ID NO: 84894 - DNA, 22 bp, Artificial Sequence
  chemically synthesized
gcacagcaattcctttcaccat

SEQ ID NO: 84895 - DNA, 22 bp, Artificial Sequence
  chemically synthesized
cacagcaattcctttcaccatt

SEQ ID NO: 84896 - DNA, 22 bp, Artificial Sequence
  chemically synthesized
ctttcaccattaacttttgagt

SEQ ID NO: 84897 - DNA, 22 bp, Artificial Sequence
  chemically synthesized
tcaccattaacttttgagttaa

SEQ ID NO: 84898 - DNA, 22 bp, Artificial Sequence
  chemically synthesized
caccattaacttttgagttaaa

SEQ ID NO: 84899 - DNA, 22 bp, Artificial Sequence
  chemically synthesized
accattaacttttgagttaaaa

SEQ ID NO: 84900 - DNA, 22 bp, Artificial Sequence
  chemically synthesized
acttttgagttaaaatgattac

SEQ ID NO: 84901 - DNA, 22 bp, Artificial Sequence
  chemically synthesized
ttgagttaaaatgattacttcc

SEQ ID NO: 84902 - DNA, 22 bp, Artificial Sequence
  chemically synthesized
tgagttaaaatgattacttcct

SEQ ID NO: 84903 - DNA, 22 bp, Artificial Sequence
  chemically synthesized
gagttaaaatgattacttcctc

SEQ ID NO: 84904 - DNA, 22 bp, Artificial Sequence
  chemically synthesized
agttaaaatgattacttcctca

SEQ ID NO: 84905 - DNA, 22 bp, Artificial Sequence
  chemically synthesized
aaatgattacttcctcaggggg

SEQ ID NO: 84906 - DNA, 22 bp, Artificial Sequence
  chemically synthesized
cttcctcagggggatttttcta

SEQ ID NO: 84907 - DNA, 22 bp, Artificial Sequence
  chemically synthesized
cctcagggggatttttctaata

SEQ ID NO: 84908 - DNA, 22 bp, Artificial Sequence
  chemically synthesized
ctcagggggatttttctaatac

SEQ ID NO: 84909 - DNA, 22 bp, Artificial Sequence
  chemically synthesized
agggggatttttctaatactgc

SEQ ID NO: 84910 - DNA, 22 bp, Artificial Sequence
  chemically synthesized
ttctaatactgctccccaccta

SEQ ID NO: 84911 - DNA, 22 bp, Artificial Sequence
  chemically synthesized
tctaatactgctccccacctag

SEQ ID NO: 84912 - DNA, 22 bp, Artificial Sequence
  chemically synthesized
ctaatactgctccccacctaga

SEQ ID NO: 84913 - DNA, 22 bp, Artificial Sequence
  chemically synthesized
taatactgctccccacctagat

SEQ ID NO: 84914 - DNA, 22 bp, Artificial Sequence
  chemically synthesized
atactgctccccacctagatta

SEQ ID NO: 84915 - DNA, 22 bp, Artificial Sequence
  chemically synthesized
ctccccacctagattatctcat

SEQ ID NO: 84916 - DNA, 22 bp, Artificial Sequence
  chemically synthesized
cccacctagattatctcatttc

SEQ ID NO: 84917 - DNA, 22 bp, Artificial Sequence
  chemically synthesized
gattatctcatttcttcaaccc

SEQ ID NO: 84918 - DNA, 22 bp, Artificial Sequence
  chemically synthesized
tctcatttcttcaaccccctta

SEQ ID NO: 84919 - DNA, 22 bp, Artificial Sequence
  chemically synthesized
atttcttcaacccccttaacta

SEQ ID NO: 84920 - DNA, 22 bp, Artificial Sequence
  chemically synthesized
cttcaacccccttaactaactt

SEQ ID NO: 84921 - DNA, 22 bp, Artificial Sequence
  chemically synthesized
ttcaacccccttaactaactta

SEQ ID NO: 84922 - DNA, 22 bp, Artificial Sequence
  chemically synthesized
caacccccttaactaacttact

SEQ ID NO: 84923 - DNA, 22 bp, Artificial Sequence
  chemically synthesized
aacccccttaactaacttactc

SEQ ID NO: 84924 - DNA, 22 bp, Artificial Sequence
  chemically synthesized
aactaacttactctcatcacag

SEQ ID NO: 84925 - DNA, 22 bp, Artificial Sequence
  chemically synthesized
actaacttactctcatcacagt

SEQ ID NO: 84926 - DNA, 22 bp, Artificial Sequence
  chemically synthesized
acttactctcatcacagtatac

SEQ ID NO: 84927 - DNA, 22 bp, Artificial Sequence
  chemically synthesized
actctcatcacagtatactagt

SEQ ID NO: 84928 - DNA, 22 bp, Artificial Sequence
  chemically synthesized
ctctcatcacagtatactagtt

SEQ ID NO: 84929 - DNA, 22 bp, Artificial Sequence
  chemically synthesized
tcatcacagtatactagtttat

SEQ ID NO: 84930 - DNA, 22 bp, Artificial Sequence
  chemically synthesized
atcacagtatactagtttatat

SEQ ID NO: 84931 - DNA, 22 bp, Artificial Sequence
  chemically synthesized
gtttatatttataccacttatt

SEQ ID NO: 84932 - DNA, 22 bp, Artificial Sequence
  chemically synthesized
atatttataccacttattatac

SEQ ID NO: 84933 - DNA, 22 bp, Artificial Sequence
  chemically synthesized
tatttataccacttattataca

SEQ ID NO: 84934 - DNA, 22 bp, Artificial Sequence
  chemically synthesized
ataccacttattatacactgaa

SEQ ID NO: 84935 - DNA, 22 bp, Artificial Sequence
  chemically synthesized
taccacttattatacactgaat

SEQ ID NO: 84936 - DNA, 22 bp, Artificial Sequence
  chemically synthesized
attatacactgaatttccatta

SEQ ID NO: 84937 - DNA, 22 bp, Artificial Sequence
  chemically synthesized
ttatacactgaatttccattag

SEQ ID NO: 84938 - DNA, 22 bp, Artificial Sequence
  chemically synthesized
tacactgaatttccattagatt

SEQ ID NO: 84939 - DNA, 22 bp, Artificial Sequence
  chemically synthesized
aatttccattagattcattaga

SEQ ID NO: 84940 - DNA, 22 bp, Artificial Sequence
  chemically synthesized
ccattagattcattagaggctg

SEQ ID NO: 84941 - DNA, 22 bp, Artificial Sequence
  chemically synthesized
cattagattcattagaggctgt

SEQ ID NO: 84942 - DNA, 22 bp, Artificial Sequence
  chemically synthesized
gattcattagaggctgtagaag

SEQ ID NO: 84943 - DNA, 22 bp, Artificial Sequence
  chemically synthesized
attagaggctgtagaagattag

SEQ ID NO: 84944 - DNA, 22 bp, Artificial Sequence
  chemically synthesized
gaggctgtagaagattaggaac

SEQ ID NO: 84945 - DNA, 22 bp, Artificial Sequence
  chemically synthesized
tagaagattaggaaccatatct

SEQ ID NO: 84946 - DNA, 22 bp, Artificial Sequence
  chemically synthesized
ggaaccatatctgttttttgct

SEQ ID NO: 84947 - DNA, 22 bp, Artificial Sequence
  chemically synthesized
ttttttgctcaagaatatgaaa

SEQ ID NO: 84948 - DNA, 22 bp, Artificial Sequence
  chemically synthesized
tttgctcaagaatatgaaaaat

SEQ ID NO: 84949 - DNA, 22 bp, Artificial Sequence
  chemically synthesized
ttgctcaagaatatgaaaaata

SEQ ID NO: 84950 - DNA, 22 bp, Artificial Sequence
  chemically synthesized
tgctcaagaatatgaaaaataa

SEQ ID NO: 84951 - DNA, 22 bp, Artificial Sequence
  chemically synthesized
gctcaagaatatgaaaaataag

SEQ ID NO: 84952 - DNA, 22 bp, Artificial Sequence
  chemically synthesized
ctcaagaatatgaaaaataagg

SEQ ID NO: 84953 - DNA, 22 bp, Artificial Sequence
  chemically synthesized
aagaatatgaaaaataagggtt

SEQ ID NO: 84954 - DNA, 22 bp, Artificial Sequence
  chemically synthesized
gcatagaatgggcacttatcaa

SEQ ID NO: 84955 - DNA, 22 bp, Artificial Sequence
  chemically synthesized
atcaaataatttttaattaatt

SEQ ID NO: 84956 - DNA, 22 bp, Artificial Sequence
  chemically synthesized
tcaaataatttttaattaatta

SEQ ID NO: 84957 - DNA, 22 bp, Artificial Sequence
  chemically synthesized
ttaattaattattctatgaaat

SEQ ID NO: 84958 - DNA, 22 bp, Artificial Sequence
  chemically synthesized
taattaattattctatgaaata

SEQ ID NO: 84959 - DNA, 22 bp, Artificial Sequence
  chemically synthesized
aattaattattctatgaaataa

SEQ ID NO: 84960 - DNA, 22 bp, Artificial Sequence
  chemically synthesized
attaattattctatgaaataag

SEQ ID NO: 84961 - DNA, 22 bp, Artificial Sequence
  chemically synthesized
attattctatgaaataagagct

SEQ ID NO: 84962 - DNA, 22 bp, Artificial Sequence
  chemically synthesized
ttctatgaaataagagctagac

SEQ ID NO: 84963 - DNA, 22 bp, Artificial Sequence
  chemically synthesized
tatgaaataagagctagacaat

SEQ ID NO: 84964 - DNA, 22 bp, Artificial Sequence
  chemically synthesized
tgaaataagagctagacaatca

SEQ ID NO: 84965 - DNA, 22 bp, Artificial Sequence
  chemically synthesized
gacaatcacagagatataaaga

SEQ ID NO: 84966 - DNA, 22 bp, Artificial Sequence
  chemically synthesized
ctatcaaagtgtgtgtaaaatc

SEQ ID NO: 84967 - DNA, 22 bp, Artificial Sequence
  chemically synthesized
tcaaagtgtgtgtaaaatcatc

SEQ ID NO: 84968 - DNA, 22 bp, Artificial Sequence
  chemically synthesized
tgtacacttagtcttttctgac

SEQ ID NO: 84969 - DNA, 22 bp, Artificial Sequence
  chemically synthesized
agtcttttctgacctttggcca

SEQ ID NO: 84970 - DNA, 22 bp, Artificial Sequence
  chemically synthesized
gtcttttctgacctttggccac

SEQ ID NO: 84971 - DNA, 22 bp, Artificial Sequence
  chemically synthesized
ttctgacctttggccaccaatt

SEQ ID NO: 84972 - DNA, 22 bp, Artificial Sequence
  chemically synthesized
tctgacctttggccaccaattg

SEQ ID NO: 84973 - DNA, 22 bp, Artificial Sequence
  chemically synthesized
ctgacctttggccaccaattga

SEQ ID NO: 84974 - DNA, 22 bp, Artificial Sequence
  chemically synthesized
tgacctttggccaccaattgag

SEQ ID NO: 84975 - DNA, 22 bp, Artificial Sequence
  chemically synthesized
acctttggccaccaattgagtc

SEQ ID NO: 84976 - DNA, 22 bp, Artificial Sequence
  chemically synthesized
tggccaccaattgagtcatcat

SEQ ID NO: 84977 - DNA, 22 bp, Artificial Sequence
  chemically synthesized
ggccaccaattgagtcatcata

SEQ ID NO: 84978 - DNA, 22 bp, Artificial Sequence
  chemically synthesized
gccaccaattgagtcatcatat

SEQ ID NO: 84979 - DNA, 22 bp, Artificial Sequence
  chemically synthesized
agtcatcatataccaagtttga

SEQ ID NO: 84980 - DNA, 22 bp, Artificial Sequence
  chemically synthesized
gaatggtttataaaacagatgc

SEQ ID NO: 84981 - DNA, 22 bp, Artificial Sequence
  chemically synthesized
aatggtttataaaacagatgct

SEQ ID NO: 84982 - DNA, 22 bp, Artificial Sequence
  chemically synthesized
ataaaacagatgctgctccagg

SEQ ID NO: 84983 - DNA, 22 bp, Artificial Sequence
  chemically synthesized
taaaacagatgctgctccaggg

SEQ ID NO: 84984 - DNA, 22 bp, Artificial Sequence
  chemically synthesized
ctccagggatcttgctgacctt

SEQ ID NO: 84985 - DNA, 22 bp, Artificial Sequence
  chemically synthesized
cagggatcttgctgaccttgaa

SEQ ID NO: 84986 - DNA, 22 bp, Artificial Sequence
  chemically synthesized
gctgaccttgaatacaacactc

SEQ ID NO: 84987 - DNA, 22 bp, Artificial Sequence
  chemically synthesized
ctgaccttgaatacaacactcc

SEQ ID NO: 84988 - DNA, 22 bp, Artificial Sequence
  chemically synthesized
accttgaatacaacactccaat

SEQ ID NO: 84989 - DNA, 22 bp, Artificial Sequence
  chemically synthesized
gaatacaacactccaatttcaa

SEQ ID NO: 84990 - DNA, 22 bp, Artificial Sequence
  chemically synthesized
aatacaacactccaatttcaaa

SEQ ID NO: 84991 - DNA, 22 bp, Artificial Sequence
  chemically synthesized
caatttcaaacatgatttctct

SEQ ID NO: 84992 - DNA, 22 bp, Artificial Sequence
  chemically synthesized
caaacatgatttctctcatttc

SEQ ID NO: 84993 - DNA, 22 bp, Artificial Sequence
  chemically synthesized
aaacatgatttctctcatttcc

SEQ ID NO: 84994 - DNA, 22 bp, Artificial Sequence
  chemically synthesized
ctctcatttccagcctgactca

SEQ ID NO: 84995 - DNA, 22 bp, Artificial Sequence
  chemically synthesized
tctcatttccagcctgactcag

SEQ ID NO: 84996 - DNA, 22 bp, Artificial Sequence
  chemically synthesized
tcatttccagcctgactcagac

SEQ ID NO: 84997 - DNA, 22 bp, Artificial Sequence
  chemically synthesized
atttccagcctgactcagacat

SEQ ID NO: 84998 - DNA, 22 bp, Artificial Sequence
  chemically synthesized
ccagcctgactcagacatatcg

SEQ ID NO: 84999 - DNA, 22 bp, Artificial Sequence
  chemically synthesized
cagcctgactcagacatatcgt

SEQ ID NO: 85000 - DNA, 22 bp, Artificial Sequence
  chemically synthesized
actcagacatatcgtcaaggat

SEQ ID NO: 85001 - DNA, 22 bp, Artificial Sequence
  chemically synthesized
agacatatcgtcaaggatctgg

SEQ ID NO: 85002 - DNA, 22 bp, Artificial Sequence
  chemically synthesized
ggattgatcacaaaagatttaa

SEQ ID NO: 85003 - DNA, 22 bp, Artificial Sequence
  chemically synthesized
atcacaaaagatttaatattct

SEQ ID NO: 85004 - DNA, 22 bp, Artificial Sequence
  chemically synthesized
aatattctgtgaatgtaggtat

SEQ ID NO: 85005 - DNA, 22 bp, Artificial Sequence
  chemically synthesized
atattctgtgaatgtaggtatg

SEQ ID NO: 85006 - DNA, 22 bp, Artificial Sequence
  chemically synthesized
tgtgaatgtaggtatgtgttaa

SEQ ID NO: 85007 - DNA, 22 bp, Artificial Sequence
  chemically synthesized
tgaatgtaggtatgtgttaaaa

SEQ ID NO: 85008 - DNA, 22 bp, Artificial Sequence
  chemically synthesized
aaagtatctactttcagccagg

SEQ ID NO: 85009 - DNA, 22 bp, Artificial Sequence
  chemically synthesized
ctttcagccaggcttggtggct

SEQ ID NO: 85010 - DNA, 22 bp, Artificial Sequence
  chemically synthesized
tcagccaggcttggtggctcac

SEQ ID NO: 85011 - DNA, 22 bp, Artificial Sequence
  chemically synthesized
cagccaggcttggtggctcacg

SEQ ID NO: 85012 - DNA, 22 bp, Artificial Sequence
  chemically synthesized
agccaggcttggtggctcacgc

SEQ ID NO: 85013 - DNA, 22 bp, Artificial Sequence
  chemically synthesized
ggtggctcacgcctgtaatcct

SEQ ID NO: 85014 - DNA, 22 bp, Artificial Sequence
  chemically synthesized
gtggctcacgcctgtaatccta

SEQ ID NO: 85015 - DNA, 22 bp, Artificial Sequence
  chemically synthesized
acgcctgtaatcctagcacttt

SEQ ID NO: 85016 - DNA, 22 bp, Artificial Sequence
  chemically synthesized
taatcctagcactttgggaggc

SEQ ID NO: 85017 - DNA, 22 bp, Artificial Sequence
  chemically synthesized
gcactttgggaggccgaggcag

SEQ ID NO: 85018 - DNA, 22 bp, Artificial Sequence
  chemically synthesized
tgggaggccgaggcaggtggat

SEQ ID NO: 85019 - DNA, 22 bp, Artificial Sequence
  chemically synthesized
gggaggccgaggcaggtggatt

SEQ ID NO: 85020 - DNA, 22 bp, Artificial Sequence
  chemically synthesized
ggaggccgaggcaggtggattg

SEQ ID NO: 85021 - DNA, 22 bp, Artificial Sequence
  chemically synthesized
gctgagctcaggagttggagac

SEQ ID NO: 85022 - DNA, 22 bp, Artificial Sequence
  chemically synthesized
agctcaggagttggagaccaac

SEQ ID NO: 85023 - DNA, 22 bp, Artificial Sequence
  chemically synthesized
aggagttggagaccaacctggg

SEQ ID NO: 85024 - DNA, 22 bp, Artificial Sequence
  chemically synthesized
gagaccaacctgggcaaaatgg

SEQ ID NO: 85025 - DNA, 22 bp, Artificial Sequence
  chemically synthesized
ggcaaaatggtgaaaccctgtc

SEQ ID NO: 85026 - DNA, 22 bp, Artificial Sequence
  chemically synthesized
tctctactaaaacacaaaaata

SEQ ID NO: 85027 - DNA, 22 bp, Artificial Sequence
  chemically synthesized
tactaaaacacaaaaataatta

SEQ ID NO: 85028 - DNA, 22 bp, Artificial Sequence
  chemically synthesized
ctaaaacacaaaaataattagc

SEQ ID NO: 85029 - DNA, 22 bp, Artificial Sequence
  chemically synthesized
aaacacaaaaataattagctgg

SEQ ID NO: 85030 - DNA, 22 bp, Artificial Sequence
  chemically synthesized
gctgggcatggcagtgtgctcc

SEQ ID NO: 85031 - DNA, 22 bp, Artificial Sequence
  chemically synthesized
ggcatggcagtgtgctcctgta

SEQ ID NO: 85032 - DNA, 22 bp, Artificial Sequence
  chemically synthesized
ctgtaatcccagttacttggga

SEQ ID NO: 85033 - DNA, 22 bp, Artificial Sequence
  chemically synthesized
taatcccagttacttgggagac

SEQ ID NO: 85034 - DNA, 22 bp, Artificial Sequence
  chemically synthesized
cttgggagactgaggcaggaga

SEQ ID NO: 85035 - DNA, 22 bp, Artificial Sequence
  chemically synthesized
gggagactgaggcaggagaatt

SEQ ID NO: 85036 - DNA, 22 bp, Artificial Sequence
  chemically synthesized
ggagactgaggcaggagaattg

SEQ ID NO: 85037 - DNA, 22 bp, Artificial Sequence
  chemically synthesized
aggcaggagaattgcttgatcc

SEQ ID NO: 85038 - DNA, 22 bp, Artificial Sequence
  chemically synthesized
cttgatcctgggaggtggaagt

SEQ ID NO: 85039 - DNA, 22 bp, Artificial Sequence
  chemically synthesized
gatcctgggaggtggaagttgc

SEQ ID NO: 85040 - DNA, 22 bp, Artificial Sequence
  chemically synthesized
atcctgggaggtggaagttgca

SEQ ID NO: 85041 - DNA, 22 bp, Artificial Sequence
  chemically synthesized
ggaggtggaagttgcagtgagc

SEQ ID NO: 85042 - DNA, 22 bp, Artificial Sequence
  chemically synthesized
cagtgagccgagatcgcgccat

SEQ ID NO: 85043 - DNA, 22 bp, Artificial Sequence
  chemically synthesized
cactccagtctgggcgacagag

SEQ ID NO: 85044 - DNA, 22 bp, Artificial Sequence
  chemically synthesized
cagtctgggcgacagagcaaga

SEQ ID NO: 85045 - DNA, 22 bp, Artificial Sequence
  chemically synthesized
ggcgacagagcaagactctgtc

SEQ ID NO: 85046 - DNA, 22 bp, Artificial Sequence
  chemically synthesized
tgtcccaaaggaaaaaaaaaat

SEQ ID NO: 85047 - DNA, 22 bp, Artificial Sequence
  chemically synthesized
tcccaaaggaaaaaaaaaatct

SEQ ID NO: 85048 - DNA, 22 bp, Artificial Sequence
  chemically synthesized
ttttcatgcaggtttcttcaga

SEQ ID NO: 85049 - DNA, 22 bp, Artificial Sequence
  chemically synthesized
tcatgcaggtttcttcagactg

SEQ ID NO: 85050 - DNA, 22 bp, Artificial Sequence
  chemically synthesized
catgcaggtttcttcagactga

SEQ ID NO: 85051 - DNA, 22 bp, Artificial Sequence
  chemically synthesized
atgcaggtttcttcagactgac

SEQ ID NO: 85052 - DNA, 22 bp, Artificial Sequence
  chemically synthesized
cttcagactgactacaaaggct

SEQ ID NO: 85053 - DNA, 22 bp, Artificial Sequence
  chemically synthesized
ttcagactgactacaaaggctt

SEQ ID NO: 85054 - DNA, 22 bp, Artificial Sequence
  chemically synthesized
cagactgactacaaaggcttca

SEQ ID NO: 85055 - DNA, 22 bp, Artificial Sequence
  chemically synthesized
agactgactacaaaggcttcag

SEQ ID NO: 85056 - DNA, 22 bp, Artificial Sequence
  chemically synthesized
actacaaaggcttcagactagc

SEQ ID NO: 85057 - DNA, 22 bp, Artificial Sequence
  chemically synthesized
caaaggcttcagactagctaca

SEQ ID NO: 85058 - DNA, 22 bp, Artificial Sequence
  chemically synthesized
cagactagctacaaagcttaaa

SEQ ID NO: 85059 - DNA, 22 bp, Artificial Sequence
  chemically synthesized
agactagctacaaagcttaaaa

SEQ ID NO: 85060 - DNA, 22 bp, Artificial Sequence
  chemically synthesized
gctacaaagcttaaaaatctac

SEQ ID NO: 85061 - DNA, 22 bp, Artificial Sequence
  chemically synthesized
caaagcttaaaaatctactttc

SEQ ID NO: 85062 - DNA, 22 bp, Artificial Sequence
  chemically synthesized
aaaaatctactttcattcaggc

SEQ ID NO: 85063 - DNA, 22 bp, Artificial Sequence
  chemically synthesized
aaaatctactttcattcaggct

SEQ ID NO: 85064 - DNA, 22 bp, Artificial Sequence
  chemically synthesized
ctttcattcaggcttcttcaga

SEQ ID NO: 85065 - DNA, 22 bp, Artificial Sequence
  chemically synthesized
tcattcaggcttcttcagacta

SEQ ID NO: 85066 - DNA, 22 bp, Artificial Sequence
  chemically synthesized
cattcaggcttcttcagactag

SEQ ID NO: 85067 - DNA, 22 bp, Artificial Sequence
  chemically synthesized
attcaggcttcttcagactaga

SEQ ID NO: 85068 - DNA, 22 bp, Artificial Sequence
  chemically synthesized
aggcttcttcagactagataca

SEQ ID NO: 85069 - DNA, 22 bp, Artificial Sequence
  chemically synthesized
cttcagactagatacagaagaa

SEQ ID NO: 85070 - DNA, 22 bp, Artificial Sequence
  chemically synthesized
ttcagactagatacagaagaaa

SEQ ID NO: 85071 - DNA, 22 bp, Artificial Sequence
  chemically synthesized
cagactagatacagaagaaatg

SEQ ID NO: 85072 - DNA, 22 bp, Artificial Sequence
  chemically synthesized
agactagatacagaagaaatga

SEQ ID NO: 85073 - DNA, 22 bp, Artificial Sequence
  chemically synthesized
gatacagaagaaatgagaccat

SEQ ID NO: 85074 - DNA, 22 bp, Artificial Sequence
  chemically synthesized
gatggggaacagtattatccat

SEQ ID NO: 85075 - DNA, 22 bp, Artificial Sequence
  chemically synthesized
tccatgttgccaccatagagac

SEQ ID NO: 85076 - DNA, 22 bp, Artificial Sequence
  chemically synthesized
ccaccatagagactatcagcct

SEQ ID NO: 85077 - DNA, 22 bp, Artificial Sequence
  chemically synthesized
tcagccttttgggattaccaga

SEQ ID NO: 85078 - DNA, 22 bp, Artificial Sequence
  chemically synthesized
ttgggattaccagagcaaaata

SEQ ID NO: 85079 - DNA, 22 bp, Artificial Sequence
  chemically synthesized
tgggattaccagagcaaaatac

SEQ ID NO: 85080 - DNA, 22 bp, Artificial Sequence
  chemically synthesized
gggattaccagagcaaaataca

SEQ ID NO: 85081 - DNA, 22 bp, Artificial Sequence
  chemically synthesized
ggattaccagagcaaaatacat

SEQ ID NO: 85082 - DNA, 22 bp, Artificial Sequence
  chemically synthesized
ccagagcaaaatacatgttgga

SEQ ID NO: 85083 - DNA, 22 bp, Artificial Sequence
  chemically synthesized
gaggattttttaaaatatgttt

SEQ ID NO: 85084 - DNA, 22 bp, Artificial Sequence
  chemically synthesized
tttaaaatatgttttgaaaggt

SEQ ID NO: 85085 - DNA, 22 bp, Artificial Sequence
  chemically synthesized
ttaaaatatgttttgaaaggta

SEQ ID NO: 85086 - DNA, 22 bp, Artificial Sequence
  chemically synthesized
taaaatatgttttgaaaggtag

SEQ ID NO: 85087 - DNA, 22 bp, Artificial Sequence
  chemically synthesized
aaaatatgttttgaaaggtagg

SEQ ID NO: 85088 - DNA, 22 bp, Artificial Sequence
  chemically synthesized
aaatatgttttgaaaggtagga

SEQ ID NO: 85089 - DNA, 22 bp, Artificial Sequence
  chemically synthesized
tgaaaggtaggatgaaagagca

SEQ ID NO: 85090 - DNA, 22 bp, Artificial Sequence
  chemically synthesized
gaaaggtaggatgaaagagcat

SEQ ID NO: 85091 - DNA, 22 bp, Artificial Sequence
  chemically synthesized
aaaggtaggatgaaagagcata

SEQ ID NO: 85092 - DNA, 22 bp, Artificial Sequence
  chemically synthesized
tgataaggtaaataaatgaaga

SEQ ID NO: 85093 - DNA, 22 bp, Artificial Sequence
  chemically synthesized
gataaggtaaataaatgaagat

SEQ ID NO: 85094 - DNA, 22 bp, Artificial Sequence
  chemically synthesized
ataaggtaaataaatgaagatt

SEQ ID NO: 85095 - DNA, 22 bp, Artificial Sequence
  chemically synthesized
aaagaaaaacaagatcaatatg

SEQ ID NO: 85096 - DNA, 22 bp, Artificial Sequence
  chemically synthesized
aagaaaaacaagatcaatatgt

SEQ ID NO: 85097 - DNA, 22 bp, Artificial Sequence
  chemically synthesized
cacctgtatttaaaaaacaaaa

SEQ ID NO: 85098 - DNA, 22 bp, Artificial Sequence
  chemically synthesized
tatttaaaaaacaaaaagattt

SEQ ID NO: 85099 - DNA, 22 bp, Artificial Sequence
  chemically synthesized
aaaaaacaaaaagatttacagt

SEQ ID NO: 85100 - DNA, 22 bp, Artificial Sequence
  chemically synthesized
aaaaacaaaaagatttacagtt

SEQ ID NO: 85101 - DNA, 22 bp, Artificial Sequence
  chemically synthesized
acagttttccaagacatcatgt

SEQ ID NO: 85102 - DNA, 22 bp, Artificial Sequence
  chemically synthesized
cagttttccaagacatcatgtt

SEQ ID NO: 85103 - DNA, 22 bp, Artificial Sequence
  chemically synthesized
tccaagacatcatgttgtgtta

SEQ ID NO: 85104 - DNA, 22 bp, Artificial Sequence
  chemically synthesized
ccaagacatcatgttgtgttat

SEQ ID NO: 85105 - DNA, 22 bp, Artificial Sequence
  chemically synthesized
caagacatcatgttgtgttatg

SEQ ID NO: 85106 - DNA, 22 bp, Artificial Sequence
  chemically synthesized
tgttatgctatctgagagtcag

SEQ ID NO: 85107 - DNA, 22 bp, Artificial Sequence
  chemically synthesized
tgctatctgagagtcagtgtat

SEQ ID NO: 85108 - DNA, 22 bp, Artificial Sequence
  chemically synthesized
tctgagagtcagtgtatggtat

SEQ ID NO: 85109 - DNA, 22 bp, Artificial Sequence
  chemically synthesized
agagtcagtgtatggtatctca

SEQ ID NO: 85110 - DNA, 22 bp, Artificial Sequence
  chemically synthesized
agtctgagttcccagcaaccag

SEQ ID NO: 85111 - DNA, 22 bp, Artificial Sequence
  chemically synthesized
agttcccagcaaccagaacaat

SEQ ID NO: 85112 - DNA, 22 bp, Artificial Sequence
  chemically synthesized
ccagcaaccagaacaatgccta

SEQ ID NO: 85113 - DNA, 22 bp, Artificial Sequence
  chemically synthesized
taataaaataaatagagaagac

SEQ ID NO: 85114 - DNA, 22 bp, Artificial Sequence
  chemically synthesized
gagtctggagaaataaaagggt

SEQ ID NO: 85115 - DNA, 22 bp, Artificial Sequence
  chemically synthesized
agtctggagaaataaaagggtt

SEQ ID NO: 85116 - DNA, 22 bp, Artificial Sequence
  chemically synthesized
gagaaataaaagggttttcgta

SEQ ID NO: 85117 - DNA, 22 bp, Artificial Sequence
  chemically synthesized
tcgtatcccctctgagcactgt

SEQ ID NO: 85118 - DNA, 22 bp, Artificial Sequence
  chemically synthesized
cgtatcccctctgagcactgtc

SEQ ID NO: 85119 - DNA, 22 bp, Artificial Sequence
  chemically synthesized
gtatcccctctgagcactgtct

SEQ ID NO: 85120 - DNA, 22 bp, Artificial Sequence
  chemically synthesized
tgagcactgtctggaatgttga

SEQ ID NO: 85121 - DNA, 22 bp, Artificial Sequence
  chemically synthesized
agcactgtctggaatgttgact

SEQ ID NO: 85122 - DNA, 22 bp, Artificial Sequence
  chemically synthesized
tctggaatgttgacttggaaag

SEQ ID NO: 85123 - DNA, 22 bp, Artificial Sequence
  chemically synthesized
gaatgttgacttggaaagcaaa

SEQ ID NO: 85124 - DNA, 22 bp, Artificial Sequence
  chemically synthesized
acttggaaagcaaatctgtgat

SEQ ID NO: 85125 - DNA, 22 bp, Artificial Sequence
  chemically synthesized
ggaaagcaaatctgtgattata

SEQ ID NO: 85126 - DNA, 22 bp, Artificial Sequence
  chemically synthesized
gaaagcaaatctgtgattataa

SEQ ID NO: 85127 - DNA, 22 bp, Artificial Sequence
  chemically synthesized
tgattataataaccaggtcatt

SEQ ID NO: 85128 - DNA, 22 bp, Artificial Sequence
  chemically synthesized
taataaccaggtcattctttca

SEQ ID NO: 85129 - DNA, 22 bp, Artificial Sequence
  chemically synthesized
tttcaggagtcttttctgatgc

SEQ ID NO: 85130 - DNA, 22 bp, Artificial Sequence
  chemically synthesized
tcaggagtcttttctgatgccc

SEQ ID NO: 85131 - DNA, 22 bp, Artificial Sequence
  chemically synthesized
caggagtcttttctgatgccct

SEQ ID NO: 85132 - DNA, 22 bp, Artificial Sequence
  chemically synthesized
aggagtcttttctgatgccctc

SEQ ID NO: 85133 - DNA, 22 bp, Artificial Sequence
  chemically synthesized
ttctgatgccctctgattaaaa

SEQ ID NO: 85134 - DNA, 22 bp, Artificial Sequence
  chemically synthesized
tctgatgccctctgattaaaac

SEQ ID NO: 85135 - DNA, 22 bp, Artificial Sequence
  chemically synthesized
ctgatgccctctgattaaaact

SEQ ID NO: 85136 - DNA, 22 bp, Artificial Sequence
  chemically synthesized
tgatgccctctgattaaaactg

SEQ ID NO: 85137 - DNA, 22 bp, Artificial Sequence
  chemically synthesized
atgccctctgattaaaactgac

SEQ ID NO: 85138 - DNA, 22 bp, Artificial Sequence
  chemically synthesized
tgattaaaactgacctacatat

SEQ ID NO: 85139 - DNA, 22 bp, Artificial Sequence
  chemically synthesized
attaaaactgacctacatatgc

SEQ ID NO: 85140 - DNA, 22 bp, Artificial Sequence
  chemically synthesized
aaactgacctacatatgcagaa

SEQ ID NO: 85141 - DNA, 22 bp, Artificial Sequence
  chemically synthesized
acctacatatgcagaaatctct

SEQ ID NO: 85142 - DNA, 22 bp, Artificial Sequence
  chemically synthesized
catatgcagaaatctcttggtt

SEQ ID NO: 85143 - DNA, 22 bp, Artificial Sequence
  chemically synthesized
ttggttttttttttttttctgt

SEQ ID NO: 85144 - DNA, 22 bp, Artificial Sequence
  chemically synthesized
ggttttttttttttttctgtct

SEQ ID NO: 85145 - DNA, 22 bp, Artificial Sequence
  chemically synthesized
gttttttttttttttctgtctt

SEQ ID NO: 85146 - DNA, 22 bp, Artificial Sequence
  chemically synthesized
tttttttttttctgtcttttca

SEQ ID NO: 85147 - DNA, 22 bp, Artificial Sequence
  chemically synthesized
ttttttttttctgtcttttcag

SEQ ID NO: 85148 - DNA, 22 bp, Artificial Sequence
  chemically synthesized
tttttttttctgtcttttcaga

SEQ ID NO: 85149 - DNA, 22 bp, Artificial Sequence
  chemically synthesized
ttttttttctgtcttttcagaa

SEQ ID NO: 85150 - DNA, 22 bp, Artificial Sequence
  chemically synthesized
tttttttctgtcttttcagaat

SEQ ID NO: 85151 - DNA, 22 bp, Artificial Sequence
  chemically synthesized
ttttttctgtcttttcagaata

SEQ ID NO: 85152 - DNA, 22 bp, Artificial Sequence
  chemically synthesized
tttttctgtcttttcagaataa

SEQ ID NO: 85153 - DNA, 22 bp, Artificial Sequence
  chemically synthesized
ttttctgtcttttcagaataat

SEQ ID NO: 85154 - DNA, 22 bp, Artificial Sequence
  chemically synthesized
tttctgtcttttcagaataatt

SEQ ID NO: 85155 - DNA, 22 bp, Artificial Sequence
  chemically synthesized
ttctgtcttttcagaataattc

SEQ ID NO: 85156 - DNA, 22 bp, Artificial Sequence
  chemically synthesized
tctgtcttttcagaataattcc

SEQ ID NO: 85157 - DNA, 22 bp, Artificial Sequence
  chemically synthesized
ctgtcttttcagaataattccc

SEQ ID NO: 85158 - DNA, 22 bp, Artificial Sequence
  chemically synthesized
tgtcttttcagaataattccct

SEQ ID NO: 85159 - DNA, 22 bp, Artificial Sequence
  chemically synthesized
tcttttcagaataattccctgt

SEQ ID NO: 85160 - DNA, 22 bp, Artificial Sequence
  chemically synthesized
ttcagaataattccctgtgtga

SEQ ID NO: 85161 - DNA, 22 bp, Artificial Sequence
  chemically synthesized
tcagaataattccctgtgtgat

SEQ ID NO: 85162 - DNA, 22 bp, Artificial Sequence
  chemically synthesized
cagaataattccctgtgtgatt

SEQ ID NO: 85163 - DNA, 22 bp, Artificial Sequence
  chemically synthesized
agaataattccctgtgtgatta

SEQ ID NO: 85164 - DNA, 22 bp, Artificial Sequence
  chemically synthesized
cctgtgtgattacttgcttact

SEQ ID NO: 85165 - DNA, 22 bp, Artificial Sequence
  chemically synthesized
tgtgattacttgcttactttaa

SEQ ID NO: 85166 - DNA, 22 bp, Artificial Sequence
  chemically synthesized
cttgcttactttaaaatagggt

SEQ ID NO: 85167 - DNA, 22 bp, Artificial Sequence
  chemically synthesized
gcttactttaaaatagggtaat

SEQ ID NO: 85168 - DNA, 22 bp, Artificial Sequence
  chemically synthesized
cttactttaaaatagggtaatg

SEQ ID NO: 85169 - DNA, 22 bp, Artificial Sequence
  chemically synthesized
actttaaaatagggtaatgacc

SEQ ID NO: 85170 - DNA, 22 bp, Artificial Sequence
  chemically synthesized
ctttaaaatagggtaatgacca

SEQ ID NO: 85171 - DNA, 22 bp, Artificial Sequence
  chemically synthesized
taaaatagggtaatgaccaata

SEQ ID NO: 85172 - DNA, 22 bp, Artificial Sequence
  chemically synthesized
aaaatagggtaatgaccaatag

SEQ ID NO: 85173 - DNA, 22 bp, Artificial Sequence
  chemically synthesized
aaatagggtaatgaccaatagt

SEQ ID NO: 85174 - DNA, 22 bp, Artificial Sequence
  chemically synthesized
ttccaaagacatagagaaagta

SEQ ID NO: 85175 - DNA, 22 bp, Artificial Sequence
  chemically synthesized
caaagacatagagaaagtatat

SEQ ID NO: 85176 - DNA, 22 bp, Artificial Sequence
  chemically synthesized
tgtttaaaagacagcttcttta

SEQ ID NO: 85177 - DNA, 22 bp, Artificial Sequence
  chemically synthesized
aaaagacagcttctttataatt

SEQ ID NO: 85178 - DNA, 22 bp, Artificial Sequence
  chemically synthesized
aaagacagcttctttataattc

SEQ ID NO: 85179 - DNA, 22 bp, Artificial Sequence
  chemically synthesized
ctttataattctatagaactaa

SEQ ID NO: 85180 - DNA, 22 bp, Artificial Sequence
  chemically synthesized
tttataattctatagaactaaa

SEQ ID NO: 85181 - DNA, 22 bp, Artificial Sequence
  chemically synthesized
tataattctatagaactaaaac

SEQ ID NO: 85182 - DNA, 22 bp, Artificial Sequence
  chemically synthesized
ataattctatagaactaaaaca

SEQ ID NO: 85183 - DNA, 22 bp, Artificial Sequence
  chemically synthesized
taattctatagaactaaaacat

SEQ ID NO: 85184 - DNA, 22 bp, Artificial Sequence
  chemically synthesized
tatagaactaaaacattcctat

SEQ ID NO: 85185 - DNA, 22 bp, Artificial Sequence
  chemically synthesized
tagaactaaaacattcctattt

SEQ ID NO: 85186 - DNA, 22 bp, Artificial Sequence
  chemically synthesized
aaacattcctatttgccaaggc

SEQ ID NO: 85187 - DNA, 22 bp, Artificial Sequence
  chemically synthesized
ctatttgccaaggcagtggagt

SEQ ID NO: 85188 - DNA, 22 bp, Artificial Sequence
  chemically synthesized
tttgccaaggcagtggagtttt

SEQ ID NO: 85189 - DNA, 22 bp, Artificial Sequence
  chemically synthesized
gccaaggcagtggagtttttgc

SEQ ID NO: 85190 - DNA, 22 bp, Artificial Sequence
  chemically synthesized
ccaaggcagtggagtttttgct

SEQ ID NO: 85191 - DNA, 22 bp, Artificial Sequence
  chemically synthesized
ttgctgttcttagaacataatt

SEQ ID NO: 85192 - DNA, 22 bp, Artificial Sequence
  chemically synthesized
tgctgttcttagaacataatta

SEQ ID NO: 85193 - DNA, 22 bp, Artificial Sequence
  chemically synthesized
gctgttcttagaacataattac

SEQ ID NO: 85194 - DNA, 22 bp, Artificial Sequence
  chemically synthesized
ctgttcttagaacataattact

SEQ ID NO: 85195 - DNA, 22 bp, Artificial Sequence
  chemically synthesized
ttcttagaacataattactgaa

SEQ ID NO: 85196 - DNA, 22 bp, Artificial Sequence
  chemically synthesized
ttagaacataattactgaaaga

SEQ ID NO: 85197 - DNA, 22 bp, Artificial Sequence
  chemically synthesized
agaacataattactgaaagaca

SEQ ID NO: 85198 - DNA, 22 bp, Artificial Sequence
  chemically synthesized
gaacataattactgaaagacac

SEQ ID NO: 85199 - DNA, 22 bp, Artificial Sequence
  chemically synthesized
ctgaaagacacccacacatgtc

SEQ ID NO: 85200 - DNA, 22 bp, Artificial Sequence
  chemically synthesized
aaagacacccacacatgtcctg

SEQ ID NO: 85201 - DNA, 22 bp, Artificial Sequence
  chemically synthesized
ccttggacaaaaaattgtatgt

SEQ ID NO: 85202 - DNA, 22 bp, Artificial Sequence
  chemically synthesized
ggacaaaaaattgtatgtccat

SEQ ID NO: 85203 - DNA, 22 bp, Artificial Sequence
  chemically synthesized
gacaaaaaattgtatgtccatc

SEQ ID NO: 85204 - DNA, 22 bp, Artificial Sequence
  chemically synthesized
tatgtccatcctttaaaggtca

SEQ ID NO: 85205 - DNA, 22 bp, Artificial Sequence
  chemically synthesized
taaaggtcattcctttaatggt

SEQ ID NO: 85206 - DNA, 22 bp, Artificial Sequence
  chemically synthesized
aaaggtcattcctttaatggtc

SEQ ID NO: 85207 - DNA, 22 bp, Artificial Sequence
  chemically synthesized
aaggtcattcctttaatggtct

SEQ ID NO: 85208 - DNA, 22 bp, Artificial Sequence
  chemically synthesized
ctttaatggtcttttctggaca

SEQ ID NO: 85209 - DNA, 22 bp, Artificial Sequence
  chemically synthesized
taatggtcttttctggacacca

SEQ ID NO: 85210 - DNA, 22 bp, Artificial Sequence
  chemically synthesized
aatggtcttttctggacaccac

SEQ ID NO: 85211 - DNA, 22 bp, Artificial Sequence
  chemically synthesized
atggtcttttctggacaccact

SEQ ID NO: 85212 - DNA, 22 bp, Artificial Sequence
  chemically synthesized
ttctggacaccactaggggtca

SEQ ID NO: 85213 - DNA, 22 bp, Artificial Sequence
  chemically synthesized
tctggacaccactaggggtcag

SEQ ID NO: 85214 - DNA, 22 bp, Artificial Sequence
  chemically synthesized
ctggacaccactaggggtcaga

SEQ ID NO: 85215 - DNA, 22 bp, Artificial Sequence
  chemically synthesized
tggacaccactaggggtcagaa

SEQ ID NO: 85216 - DNA, 22 bp, Artificial Sequence
  chemically synthesized
gacaccactaggggtcagaagt

SEQ ID NO: 85217 - DNA, 22 bp, Artificial Sequence
  chemically synthesized
ggggtcagaagtagttcatcaa

SEQ ID NO: 85218 - DNA, 22 bp, Artificial Sequence
  chemically synthesized
atcaaactttcttccctcccta

SEQ ID NO: 85219 - DNA, 22 bp, Artificial Sequence
  chemically synthesized
tcttccctccctacttcagtga

SEQ ID NO: 85220 - DNA, 22 bp, Artificial Sequence
  chemically synthesized
cttccctccctacttcagtgat

SEQ ID NO: 85221 - DNA, 22 bp, Artificial Sequence
  chemically synthesized
ttccctccctacttcagtgatg

SEQ ID NO: 85222 - DNA, 22 bp, Artificial Sequence
  chemically synthesized
ccctccctacttcagtgatgca

SEQ ID NO: 85223 - DNA, 22 bp, Artificial Sequence
  chemically synthesized
cctccctacttcagtgatgcat

SEQ ID NO: 85224 - DNA, 22 bp, Artificial Sequence
  chemically synthesized
cctacttcagtgatgcataagg

SEQ ID NO: 85225 - DNA, 22 bp, Artificial Sequence
  chemically synthesized
cttcagtgatgcataaggcaga

SEQ ID NO: 85226 - DNA, 22 bp, Artificial Sequence
  chemically synthesized
cagtgatgcataaggcagatct

SEQ ID NO: 85227 - DNA, 22 bp, Artificial Sequence
  chemically synthesized
agtgatgcataaggcagatctg

SEQ ID NO: 85228 - DNA, 22 bp, Artificial Sequence
  chemically synthesized
ctttagtgtaagcgaggtcagg

SEQ ID NO: 85229 - DNA, 22 bp, Artificial Sequence
  chemically synthesized
tagtgtaagcgaggtcaggccc

SEQ ID NO: 85230 - DNA, 22 bp, Artificial Sequence
  chemically synthesized
agtgtaagcgaggtcaggccct

SEQ ID NO: 85231 - DNA, 22 bp, Artificial Sequence
  chemically synthesized
gtgtaagcgaggtcaggccctc

SEQ ID NO: 85232 - DNA, 22 bp, Artificial Sequence
  chemically synthesized
aagagtcttgggatggctgaag

SEQ ID NO: 85233 - DNA, 22 bp, Artificial Sequence
  chemically synthesized
gggatggctgaagaggtaagaa

SEQ ID NO: 85234 - DNA, 22 bp, Artificial Sequence
  chemically synthesized
ggatggctgaagaggtaagaac

SEQ ID NO: 85235 - DNA, 22 bp, Artificial Sequence
  chemically synthesized
aagaggtaagaacattctataa

SEQ ID NO: 85236 - DNA, 22 bp, Artificial Sequence
  chemically synthesized
tataagacttgtccaaagaact

SEQ ID NO: 85237 - DNA, 22 bp, Artificial Sequence
  chemically synthesized
taagacttgtccaaagaactga

SEQ ID NO: 85238 - DNA, 22 bp, Artificial Sequence
  chemically synthesized
gtccaaagaactgactgtttaa

SEQ ID NO: 85239 - DNA, 22 bp, Artificial Sequence
  chemically synthesized
tccaaagaactgactgtttaat

SEQ ID NO: 85240 - DNA, 22 bp, Artificial Sequence
  chemically synthesized
actgtttaatgattctgaatat

SEQ ID NO: 85241 - DNA, 22 bp, Artificial Sequence
  chemically synthesized
tttaatgattctgaatatgcta

SEQ ID NO: 85242 - DNA, 22 bp, Artificial Sequence
  chemically synthesized
aatgattctgaatatgctagtt

SEQ ID NO: 85243 - DNA, 22 bp, Artificial Sequence
  chemically synthesized
atgattctgaatatgctagttc

SEQ ID NO: 85244 - DNA, 22 bp, Artificial Sequence
  chemically synthesized
tgaatatgctagttcagagaga

SEQ ID NO: 85245 - DNA, 22 bp, Artificial Sequence
  chemically synthesized
aatatgctagttcagagagaat

SEQ ID NO: 85246 - DNA, 22 bp, Artificial Sequence
  chemically synthesized
gttcagagagaatctatttacc

SEQ ID NO: 85247 - DNA, 22 bp, Artificial Sequence
  chemically synthesized
agagagaatctatttaccacaa

SEQ ID NO: 85248 - DNA, 22 bp, Artificial Sequence
  chemically synthesized
tttaccacaaacctgaagtagg

SEQ ID NO: 85249 - DNA, 22 bp, Artificial Sequence
  chemically synthesized
accacaaacctgaagtaggctt

SEQ ID NO: 85250 - DNA, 22 bp, Artificial Sequence
  chemically synthesized
ccacaaacctgaagtaggctta

SEQ ID NO: 85251 - DNA, 22 bp, Artificial Sequence
  chemically synthesized
aagtaggcttaaatttccagtt

SEQ ID NO: 85252 - DNA, 22 bp, Artificial Sequence
  chemically synthesized
aaatttccagtttacctgaatg

SEQ ID NO: 85253 - DNA, 22 bp, Artificial Sequence
  chemically synthesized
aatttccagtttacctgaatgg

SEQ ID NO: 85254 - DNA, 22 bp, Artificial Sequence
  chemically synthesized
ccagtttacctgaatggttatg

SEQ ID NO: 85255 - DNA, 22 bp, Artificial Sequence
  chemically synthesized
cagtttacctgaatggttatga

SEQ ID NO: 85256 - DNA, 22 bp, Artificial Sequence
  chemically synthesized
acctgaatggttatgacctaat

SEQ ID NO: 85257 - DNA, 22 bp, Artificial Sequence
  chemically synthesized
cctgaatggttatgacctaatt

SEQ ID NO: 85258 - DNA, 22 bp, Artificial Sequence
  chemically synthesized
aatggttatgacctaattagag

SEQ ID NO: 85259 - DNA, 22 bp, Artificial Sequence
  chemically synthesized
tgacctaattagaggaatgact

SEQ ID NO: 85260 - DNA, 22 bp, Artificial Sequence
  chemically synthesized
attagaggaatgactttataaa

SEQ ID NO: 85261 - DNA, 22 bp, Artificial Sequence
  chemically synthesized
gaggaatgactttataaacata

SEQ ID NO: 85262 - DNA, 22 bp, Artificial Sequence
  chemically synthesized
tataaacatatatagatacaaa

SEQ ID NO: 85263 - DNA, 22 bp, Artificial Sequence
  chemically synthesized
ataaacatatatagatacaaat

SEQ ID NO: 85264 - DNA, 22 bp, Artificial Sequence
  chemically synthesized
taaacatatatagatacaaata

SEQ ID NO: 85265 - DNA, 22 bp, Artificial Sequence
  chemically synthesized
attatatactatatatttatta

SEQ ID NO: 85266 - DNA, 22 bp, Artificial Sequence
  chemically synthesized
ttatatactatatatttattat

SEQ ID NO: 85267 - DNA, 22 bp, Artificial Sequence
  chemically synthesized
tatactatatatttattatata

SEQ ID NO: 85268 - DNA, 22 bp, Artificial Sequence
  chemically synthesized
tatatttattatatattatata

SEQ ID NO: 85269 - DNA, 22 bp, Artificial Sequence
  chemically synthesized
attatatattatataagcataa

SEQ ID NO: 85270 - DNA, 22 bp, Artificial Sequence
  chemically synthesized
ttatatattatataagcataaa

SEQ ID NO: 85271 - DNA, 22 bp, Artificial Sequence
  chemically synthesized
tatattatataagcataaaatg

SEQ ID NO: 85272 - DNA, 22 bp, Artificial Sequence
  chemically synthesized
tataagcataaaatgtaataga

SEQ ID NO: 85273 - DNA, 22 bp, Artificial Sequence
  chemically synthesized
ttgtatatatttaataacatat

SEQ ID NO: 85274 - DNA, 22 bp, Artificial Sequence
  chemically synthesized
tatatatttaataacatattat

SEQ ID NO: 85275 - DNA, 22 bp, Artificial Sequence
  chemically synthesized
aataacatattattacatattt

SEQ ID NO: 85276 - DNA, 22 bp, Artificial Sequence
  chemically synthesized
ataacatattattacatatttt

SEQ ID NO: 85277 - DNA, 22 bp, Artificial Sequence
  chemically synthesized
ttacatattttaatatataata

SEQ ID NO: 85278 - DNA, 22 bp, Artificial Sequence
  chemically synthesized
catattttaatatataatatat

SEQ ID NO: 85279 - DNA, 22 bp, Artificial Sequence
  chemically synthesized
taatatataatatataaaatgt

SEQ ID NO: 85280 - DNA, 22 bp, Artificial Sequence
  chemically synthesized
aatatataatatataaaatgta

SEQ ID NO: 85281 - DNA, 22 bp, Artificial Sequence
  chemically synthesized
atatataatatataaaatgtat

SEQ ID NO: 85282 - DNA, 22 bp, Artificial Sequence
  chemically synthesized
tatttaatatataatgcatgta

SEQ ID NO: 85283 - DNA, 22 bp, Artificial Sequence
  chemically synthesized
aatatataatgcatgtaatata

SEQ ID NO: 85284 - DNA, 22 bp, Artificial Sequence
  chemically synthesized
atatataatgcatgtaatatat

SEQ ID NO: 85285 - DNA, 22 bp, Artificial Sequence
  chemically synthesized
tatattatatattatgtaataa

SEQ ID NO: 85286 - DNA, 22 bp, Artificial Sequence
  chemically synthesized
tatattatgtaataaatatata

SEQ ID NO: 85287 - DNA, 22 bp, Artificial Sequence
  chemically synthesized
tgtaataaatatatattatgta

SEQ ID NO: 85288 - DNA, 22 bp, Artificial Sequence
  chemically synthesized
tgtatatacacatttatctaga

SEQ ID NO: 85289 - DNA, 22 bp, Artificial Sequence
  chemically synthesized
atctagactttattacatattt

SEQ ID NO: 85290 - DNA, 22 bp, Artificial Sequence
  chemically synthesized
tctagactttattacatatttc

SEQ ID NO: 85291 - DNA, 22 bp, Artificial Sequence
  chemically synthesized
gactttattacatatttcatta

SEQ ID NO: 85292 - DNA, 22 bp, Artificial Sequence
  chemically synthesized
tattacatatttcattatatat

SEQ ID NO: 85293 - DNA, 22 bp, Artificial Sequence
  chemically synthesized
attacatatttcattatatatt

SEQ ID NO: 85294 - DNA, 22 bp, Artificial Sequence
  chemically synthesized
ttacatatttcattatatattt

SEQ ID NO: 85295 - DNA, 22 bp, Artificial Sequence
  chemically synthesized
catatttcattatatattttat

SEQ ID NO: 85296 - DNA, 22 bp, Artificial Sequence
  chemically synthesized
cattatatattttataagattt

SEQ ID NO: 85297 - DNA, 22 bp, Artificial Sequence
  chemically synthesized
attatatattttataagatttc

SEQ ID NO: 85298 - DNA, 22 bp, Artificial Sequence
  chemically synthesized
tatattttataagatttctata

SEQ ID NO: 85299 - DNA, 22 bp, Artificial Sequence
  chemically synthesized
tataagatttctataaataata

SEQ ID NO: 85300 - DNA, 22 bp, Artificial Sequence
  chemically synthesized
ataagatttctataaataatat

SEQ ID NO: 85301 - DNA, 22 bp, Artificial Sequence
  chemically synthesized
taagatttctataaataatatt

SEQ ID NO: 85302 - DNA, 22 bp, Artificial Sequence
  chemically synthesized
ctataaataatattcccatcat

SEQ ID NO: 85303 - DNA, 22 bp, Artificial Sequence
  chemically synthesized
tataaataatattcccatcatt

SEQ ID NO: 85304 - DNA, 22 bp, Artificial Sequence
  chemically synthesized
taaataatattcccatcattac

SEQ ID NO: 85305 - DNA, 22 bp, Artificial Sequence
  chemically synthesized
ccatcattactaaaatattttt

SEQ ID NO: 85306 - DNA, 22 bp, Artificial Sequence
  chemically synthesized
ctaaaatattttttaaaaatta

SEQ ID NO: 85307 - DNA, 22 bp, Artificial Sequence
  chemically synthesized
aaatattttttaaaaattagcc

SEQ ID NO: 85308 - DNA, 22 bp, Artificial Sequence
  chemically synthesized
tttaaaaattagccatacctta

SEQ ID NO: 85309 - DNA, 22 bp, Artificial Sequence
  chemically synthesized
ttaaaaattagccataccttag

SEQ ID NO: 85310 - DNA, 22 bp, Artificial Sequence
  chemically synthesized
taaaaattagccataccttaga

SEQ ID NO: 85311 - DNA, 22 bp, Artificial Sequence
  chemically synthesized
aaaaattagccataccttagaa

SEQ ID NO: 85312 - DNA, 22 bp, Artificial Sequence
  chemically synthesized
aaaattagccataccttagaag

SEQ ID NO: 85313 - DNA, 22 bp, Artificial Sequence
  chemically synthesized
gccataccttagaagcattata

SEQ ID NO: 85314 - DNA, 22 bp, Artificial Sequence
  chemically synthesized
agaagcattataaaaaatatat

SEQ ID NO: 85315 - DNA, 22 bp, Artificial Sequence
  chemically synthesized
gaagcattataaaaaatatatg

SEQ ID NO: 85316 - DNA, 22 bp, Artificial Sequence
  chemically synthesized
taaaaaatatatgacatggtcc

SEQ ID NO: 85317 - DNA, 22 bp, Artificial Sequence
  chemically synthesized
ttcaactgtagccatctaacca

SEQ ID NO: 85318 - DNA, 22 bp, Artificial Sequence
  chemically synthesized
aactgtagccatctaaccattt

SEQ ID NO: 85319 - DNA, 22 bp, Artificial Sequence
  chemically synthesized
tagccatctaaccatttgagaa

SEQ ID NO: 85320 - DNA, 22 bp, Artificial Sequence
  chemically synthesized
accatttgagaagtttttataa

SEQ ID NO: 85321 - DNA, 22 bp, Artificial Sequence
  chemically synthesized
gagaagtttttataagatttat

SEQ ID NO: 85322 - DNA, 22 bp, Artificial Sequence
  chemically synthesized
agaagtttttataagatttata

SEQ ID NO: 85323 - DNA, 22 bp, Artificial Sequence
  chemically synthesized
ttataagatttatagcatttga

SEQ ID NO: 85324 - DNA, 22 bp, Artificial Sequence
  chemically synthesized
tataagatttatagcatttgat

SEQ ID NO: 85325 - DNA, 22 bp, Artificial Sequence
  chemically synthesized
ataagatttatagcatttgatt

SEQ ID NO: 85326 - DNA, 22 bp, Artificial Sequence
  chemically synthesized
taagatttatagcatttgattg

SEQ ID NO: 85327 - DNA, 22 bp, Artificial Sequence
  chemically synthesized
atagcatttgattgtaccatga

SEQ ID NO: 85328 - DNA, 22 bp, Artificial Sequence
  chemically synthesized
tagcatttgattgtaccatgac

SEQ ID NO: 85329 - DNA, 22 bp, Artificial Sequence
  chemically synthesized
gattgtaccatgacataaatca

SEQ ID NO: 85330 - DNA, 22 bp, Artificial Sequence
  chemically synthesized
attgtaccatgacataaatcat

SEQ ID NO: 85331 - DNA, 22 bp, Artificial Sequence
  chemically synthesized
taccatgacataaatcatctca

SEQ ID NO: 85332 - DNA, 22 bp, Artificial Sequence
  chemically synthesized
atgcaagatagtgtatttgttt

SEQ ID NO: 85333 - DNA, 22 bp, Artificial Sequence
  chemically synthesized
gttttgttggctttaatatgtt

SEQ ID NO: 85334 - DNA, 22 bp, Artificial Sequence
  chemically synthesized
ttttgttggctttaatatgttc

SEQ ID NO: 85335 - DNA, 22 bp, Artificial Sequence
  chemically synthesized
tgttggctttaatatgttccct

SEQ ID NO: 85336 - DNA, 22 bp, Artificial Sequence
  chemically synthesized
gttggctttaatatgttccctt

SEQ ID NO: 85337 - DNA, 22 bp, Artificial Sequence
  chemically synthesized
ttggctttaatatgttcccttt

SEQ ID NO: 85338 - DNA, 22 bp, Artificial Sequence
  chemically synthesized
gctttaatatgttcccttttct

SEQ ID NO: 85339 - DNA, 22 bp, Artificial Sequence
  chemically synthesized
taatatgttcccttttcttcag

SEQ ID NO: 85340 - DNA, 22 bp, Artificial Sequence
  chemically synthesized
aatatgttcccttttcttcaga

SEQ ID NO: 85341 - DNA, 22 bp, Artificial Sequence
  chemically synthesized
atatgttcccttttcttcagaa

SEQ ID NO: 85342 - DNA, 22 bp, Artificial Sequence
  chemically synthesized
ccttttcttcagaaaatgtgag

SEQ ID NO: 85343 - DNA, 22 bp, Artificial Sequence
  chemically synthesized
ttcttcagaaaatgtgagacag

SEQ ID NO: 85344 - DNA, 22 bp, Artificial Sequence
  chemically synthesized
tcttcagaaaatgtgagacagc

SEQ ID NO: 85345 - DNA, 22 bp, Artificial Sequence
  chemically synthesized
cttcagaaaatgtgagacagct

SEQ ID NO: 85346 - DNA, 22 bp, Artificial Sequence
  chemically synthesized
ttcagaaaatgtgagacagctt

SEQ ID NO: 85347 - DNA, 22 bp, Artificial Sequence
  chemically synthesized
cagaaaatgtgagacagcttaa

SEQ ID NO: 85348 - DNA, 22 bp, Artificial Sequence
  chemically synthesized
agaaaatgtgagacagcttaaa

SEQ ID NO: 85349 - DNA, 22 bp, Artificial Sequence
  chemically synthesized
aaaataaaattaactataagaa

SEQ ID NO: 85350 - DNA, 22 bp, Artificial Sequence
  chemically synthesized
aaataaaattaactataagaaa

SEQ ID NO: 85351 - DNA, 22 bp, Artificial Sequence
  chemically synthesized
actataagaaactggtaaacac

SEQ ID NO: 85352 - DNA, 22 bp, Artificial Sequence
  chemically synthesized
taagaaactggtaaacactgaa

SEQ ID NO: 85353 - DNA, 22 bp, Artificial Sequence
  chemically synthesized
gtaaacactgaatgaaagaaga

SEQ ID NO: 85354 - DNA, 22 bp, Artificial Sequence
  chemically synthesized
aatgaaagaagaaaaccaagca

SEQ ID NO: 85355 - DNA, 22 bp, Artificial Sequence
  chemically synthesized
caaataaatttatattttaaaa

SEQ ID NO: 85356 - DNA, 22 bp, Artificial Sequence
  chemically synthesized
atattttaaaaacattttttat

SEQ ID NO: 85357 - DNA, 22 bp, Artificial Sequence
  chemically synthesized
tattttaaaaacattttttatt

SEQ ID NO: 85358 - DNA, 22 bp, Artificial Sequence
  chemically synthesized
taaaaacattttttatttgcct

SEQ ID NO: 85359 - DNA, 22 bp, Artificial Sequence
  chemically synthesized
aaaaacattttttatttgcctg

SEQ ID NO: 85360 - DNA, 22 bp, Artificial Sequence
  chemically synthesized
aaaacattttttatttgcctgg

SEQ ID NO: 85361 - DNA, 22 bp, Artificial Sequence
  chemically synthesized
tttatttgcctggcaaataata

SEQ ID NO: 85362 - DNA, 22 bp, Artificial Sequence
  chemically synthesized
ttatttgcctggcaaataataa

SEQ ID NO: 85363 - DNA, 22 bp, Artificial Sequence
  chemically synthesized
tatttgcctggcaaataataag

SEQ ID NO: 85364 - DNA, 22 bp, Artificial Sequence
  chemically synthesized
atttgcctggcaaataataagt

SEQ ID NO: 85365 - DNA, 22 bp, Artificial Sequence
  chemically synthesized
tttgcctggcaaataataagtg

SEQ ID NO: 85366 - DNA, 22 bp, Artificial Sequence
  chemically synthesized
gcctggcaaataataagtgcat

SEQ ID NO: 85367 - DNA, 22 bp, Artificial Sequence
  chemically synthesized
cctggcaaataataagtgcata

SEQ ID NO: 85368 - DNA, 22 bp, Artificial Sequence
  chemically synthesized
gcaaataataagtgcatatatt

SEQ ID NO: 85369 - DNA, 22 bp, Artificial Sequence
  chemically synthesized
atggatacaataataatatata

SEQ ID NO: 85370 - DNA, 22 bp, Artificial Sequence
  chemically synthesized
tgggatacaatgtgatgtttga

SEQ ID NO: 85371 - DNA, 22 bp, Artificial Sequence
  chemically synthesized
gatctatatatacattgtagag

SEQ ID NO: 85372 - DNA, 22 bp, Artificial Sequence
  chemically synthesized
atctatatatacattgtagaga

SEQ ID NO: 85373 - DNA, 22 bp, Artificial Sequence
  chemically synthesized
tatatacattgtagagagagtc

SEQ ID NO: 85374 - DNA, 22 bp, Artificial Sequence
  chemically synthesized
tagagagagtctatcaagctaa

SEQ ID NO: 85375 - DNA, 22 bp, Artificial Sequence
  chemically synthesized
tcaagctaattagcatatgaat

SEQ ID NO: 85376 - DNA, 22 bp, Artificial Sequence
  chemically synthesized
attagcatatgaatcaccttcc

SEQ ID NO: 85377 - DNA, 22 bp, Artificial Sequence
  chemically synthesized
gcatatgaatcaccttccaact

SEQ ID NO: 85378 - DNA, 22 bp, Artificial Sequence
  chemically synthesized
ccaactttttttgtggtgagaa

SEQ ID NO: 85379 - DNA, 22 bp, Artificial Sequence
  chemically synthesized
caactttttttgtggtgagaac

SEQ ID NO: 85380 - DNA, 22 bp, Artificial Sequence
  chemically synthesized
tttttgtggtgagaacataaaa

SEQ ID NO: 85381 - DNA, 22 bp, Artificial Sequence
  chemically synthesized
ttttgtggtgagaacataaaat

SEQ ID NO: 85382 - DNA, 22 bp, Artificial Sequence
  chemically synthesized
tttgtggtgagaacataaaata

SEQ ID NO: 85383 - DNA, 22 bp, Artificial Sequence
  chemically synthesized
ttgtggtgagaacataaaatat

SEQ ID NO: 85384 - DNA, 22 bp, Artificial Sequence
  chemically synthesized
tgtggtgagaacataaaatatt

SEQ ID NO: 85385 - DNA, 22 bp, Artificial Sequence
  chemically synthesized
gtggtgagaacataaaatattt

SEQ ID NO: 85386 - DNA, 22 bp, Artificial Sequence
  chemically synthesized
tggtgagaacataaaatattta

SEQ ID NO: 85387 - DNA, 22 bp, Artificial Sequence
  chemically synthesized
attttttagcaatttttaattt

SEQ ID NO: 85388 - DNA, 22 bp, Artificial Sequence
  chemically synthesized
ttttttagcaatttttaattta

SEQ ID NO: 85389 - DNA, 22 bp, Artificial Sequence
  chemically synthesized
tttagcaatttttaatttaaat

SEQ ID NO: 85390 - DNA, 22 bp, Artificial Sequence
  chemically synthesized
ttagcaatttttaatttaaata

SEQ ID NO: 85391 - DNA, 22 bp, Artificial Sequence
  chemically synthesized
tagcaatttttaatttaaatac

SEQ ID NO: 85392 - DNA, 22 bp, Artificial Sequence
  chemically synthesized
agcaatttttaatttaaataca

SEQ ID NO: 85393 - DNA, 22 bp, Artificial Sequence
  chemically synthesized
gcaatttttaatttaaatacat

SEQ ID NO: 85394 - DNA, 22 bp, Artificial Sequence
  chemically synthesized
ttaatttaaatacataatatat

SEQ ID NO: 85395 - DNA, 22 bp, Artificial Sequence
  chemically synthesized
taatttaaatacataatatatt

SEQ ID NO: 85396 - DNA, 22 bp, Artificial Sequence
  chemically synthesized
aatttaaatacataatatatta

SEQ ID NO: 85397 - DNA, 22 bp, Artificial Sequence
  chemically synthesized
atttaaatacataatatattat

SEQ ID NO: 85398 - DNA, 22 bp, Artificial Sequence
  chemically synthesized
aaatacataatatattattaac

SEQ ID NO: 85399 - DNA, 22 bp, Artificial Sequence
  chemically synthesized
aatacataatatattattaact

SEQ ID NO: 85400 - DNA, 22 bp, Artificial Sequence
  chemically synthesized
ttaactgtgttcactatgcagt

SEQ ID NO: 85401 - DNA, 22 bp, Artificial Sequence
  chemically synthesized
actgtgttcactatgcagtgtg

SEQ ID NO: 85402 - DNA, 22 bp, Artificial Sequence
  chemically synthesized
tgttcactatgcagtgtgagag

SEQ ID NO: 85403 - DNA, 22 bp, Artificial Sequence
  chemically synthesized
actatgcagtgtgagagatcac

SEQ ID NO: 85404 - DNA, 22 bp, Artificial Sequence
  chemically synthesized
tgcagtgtgagagatcactaaa

SEQ ID NO: 85405 - DNA, 22 bp, Artificial Sequence
  chemically synthesized
aaacttattcctctagtctaac

SEQ ID NO: 85406 - DNA, 22 bp, Artificial Sequence
  chemically synthesized
attcctctagtctaactgaaga

SEQ ID NO: 85407 - DNA, 22 bp, Artificial Sequence
  chemically synthesized
ttcctctagtctaactgaagat

SEQ ID NO: 85408 - DNA, 22 bp, Artificial Sequence
  chemically synthesized
ctctagtctaactgaagatcaa

SEQ ID NO: 85409 - DNA, 22 bp, Artificial Sequence
  chemically synthesized
tagtctaactgaagatcaactt

SEQ ID NO: 85410 - DNA, 22 bp, Artificial Sequence
  chemically synthesized
gtctaactgaagatcaacttct

SEQ ID NO: 85411 - DNA, 22 bp, Artificial Sequence
  chemically synthesized
actgaagatcaacttctttccc

SEQ ID NO: 85412 - DNA, 22 bp, Artificial Sequence
  chemically synthesized
aagatcaacttctttcccttcc

SEQ ID NO: 85413 - DNA, 22 bp, Artificial Sequence
  chemically synthesized
ctttcccttcccatccctcctc

SEQ ID NO: 85414 - DNA, 22 bp, Artificial Sequence
  chemically synthesized
tttcccttcccatccctcctct

SEQ ID NO: 85415 - DNA, 22 bp, Artificial Sequence
  chemically synthesized
tcccttcccatccctcctctac

SEQ ID NO: 85416 - DNA, 22 bp, Artificial Sequence
  chemically synthesized
cccttcccatccctcctctaca

SEQ ID NO: 85417 - DNA, 22 bp, Artificial Sequence
  chemically synthesized
ccttcccatccctcctctacac

SEQ ID NO: 85418 - DNA, 22 bp, Artificial Sequence
  chemically synthesized
cccatccctcctctacactctc

SEQ ID NO: 85419 - DNA, 22 bp, Artificial Sequence
  chemically synthesized
ccatccctcctctacactctca

SEQ ID NO: 85420 - DNA, 22 bp, Artificial Sequence
  chemically synthesized
ctctacactctcagtcagccta

SEQ ID NO: 85421 - DNA, 22 bp, Artificial Sequence
  chemically synthesized
tacactctcagtcagcctatgg

SEQ ID NO: 85422 - DNA, 22 bp, Artificial Sequence
  chemically synthesized
cactctcagtcagcctatggaa

SEQ ID NO: 85423 - DNA, 22 bp, Artificial Sequence
  chemically synthesized
tcagtcagcctatggaaccatc

SEQ ID NO: 85424 - DNA, 22 bp, Artificial Sequence
  chemically synthesized
agtcagcctatggaaccatctt

SEQ ID NO: 85425 - DNA, 22 bp, Artificial Sequence
  chemically synthesized
tggaaccatctttctattcccg

SEQ ID NO: 85426 - DNA, 22 bp, Artificial Sequence
  chemically synthesized
tctattcccgtttttatgaaat

SEQ ID NO: 85427 - DNA, 22 bp, Artificial Sequence
  chemically synthesized
ctattcccgtttttatgaaatc

SEQ ID NO: 85428 - DNA, 22 bp, Artificial Sequence
  chemically synthesized
tattcccgtttttatgaaatca

SEQ ID NO: 85429 - DNA, 22 bp, Artificial Sequence
  chemically synthesized
ttcccgtttttatgaaatcaac

SEQ ID NO: 85430 - DNA, 22 bp, Artificial Sequence
  chemically synthesized
ccgtttttatgaaatcaacttt

SEQ ID NO: 85431 - DNA, 22 bp, Artificial Sequence
  chemically synthesized
ttatgaaatcaactttttaaaa

SEQ ID NO: 85432 - DNA, 22 bp, Artificial Sequence
  chemically synthesized
tatgaaatcaactttttaaaaa

SEQ ID NO: 85433 - DNA, 22 bp, Artificial Sequence
  chemically synthesized
atgaaatcaactttttaaaaaa

SEQ ID NO: 85434 - DNA, 22 bp, Artificial Sequence
  chemically synthesized
tgaaatcaactttttaaaaaat

SEQ ID NO: 85435 - DNA, 22 bp, Artificial Sequence
  chemically synthesized
tttaaaaaattcatccttaaat

SEQ ID NO: 85436 - DNA, 22 bp, Artificial Sequence
  chemically synthesized
ttaaaaaattcatccttaaata

SEQ ID NO: 85437 - DNA, 22 bp, Artificial Sequence
  chemically synthesized
taaaaaattcatccttaaatat

SEQ ID NO: 85438 - DNA, 22 bp, Artificial Sequence
  chemically synthesized
aaaaaattcatccttaaatata

SEQ ID NO: 85439 - DNA, 22 bp, Artificial Sequence
  chemically synthesized
aaaaattcatccttaaatatat

SEQ ID NO: 85440 - DNA, 22 bp, Artificial Sequence
  chemically synthesized
atccttaaatatattaaaatga

SEQ ID NO: 85441 - DNA, 22 bp, Artificial Sequence
  chemically synthesized
aaatatattaaaatgaacagtt

SEQ ID NO: 85442 - DNA, 22 bp, Artificial Sequence
  chemically synthesized
aatatattaaaatgaacagtta

SEQ ID NO: 85443 - DNA, 22 bp, Artificial Sequence
  chemically synthesized
aaatgaacagttaaatttatga

SEQ ID NO: 85444 - DNA, 22 bp, Artificial Sequence
  chemically synthesized
aatttatgaggataaataatta

SEQ ID NO: 85445 - DNA, 22 bp, Artificial Sequence
  chemically synthesized
atgaggataaataattaaaact

SEQ ID NO: 85446 - DNA, 22 bp, Artificial Sequence
  chemically synthesized
tgaggataaataattaaaacta

SEQ ID NO: 85447 - DNA, 22 bp, Artificial Sequence
  chemically synthesized
aaactattacacatattttaag

SEQ ID NO: 85448 - DNA, 22 bp, Artificial Sequence
  chemically synthesized
ttacacatattttaagttgtcc

SEQ ID NO: 85449 - DNA, 22 bp, Artificial Sequence
  chemically synthesized
cacatattttaagttgtcctct

SEQ ID NO: 85450 - DNA, 22 bp, Artificial Sequence
  chemically synthesized
taagttgtcctctgaaaattct

SEQ ID NO: 85451 - DNA, 22 bp, Artificial Sequence
  chemically synthesized
aagttgtcctctgaaaattcta

SEQ ID NO: 85452 - DNA, 22 bp, Artificial Sequence
  chemically synthesized
agttgtcctctgaaaattctag

SEQ ID NO: 85453 - DNA, 22 bp, Artificial Sequence
  chemically synthesized
tcctctgaaaattctagaattc

SEQ ID NO: 85454 - DNA, 22 bp, Artificial Sequence
  chemically synthesized
tgaaaattctagaattctactt

SEQ ID NO: 85455 - DNA, 22 bp, Artificial Sequence
  chemically synthesized
aaaattctagaattctacttca

SEQ ID NO: 85456 - DNA, 22 bp, Artificial Sequence
  chemically synthesized
tagaattctacttcaataccct

SEQ ID NO: 85457 - DNA, 22 bp, Artificial Sequence
  chemically synthesized
gaattctacttcaataccctta

SEQ ID NO: 85458 - DNA, 22 bp, Artificial Sequence
  chemically synthesized
tacttcaatacccttattttta

SEQ ID NO: 85459 - DNA, 22 bp, Artificial Sequence
  chemically synthesized
cttcaatacccttatttttaag

SEQ ID NO: 85460 - DNA, 22 bp, Artificial Sequence
  chemically synthesized
caatacccttatttttaagata

SEQ ID NO: 85461 - DNA, 22 bp, Artificial Sequence
  chemically synthesized
aatacccttatttttaagataa

SEQ ID NO: 85462 - DNA, 22 bp, Artificial Sequence
  chemically synthesized
atttttaagataaaggaaattg

SEQ ID NO: 85463 - DNA, 22 bp, Artificial Sequence
  chemically synthesized
tttttaagataaaggaaattgt

SEQ ID NO: 85464 - DNA, 22 bp, Artificial Sequence
  chemically synthesized
ttaagataaaggaaattgtaaa

SEQ ID NO: 85465 - DNA, 22 bp, Artificial Sequence
  chemically synthesized
taagataaaggaaattgtaaag

SEQ ID NO: 85466 - DNA, 22 bp, Artificial Sequence
  chemically synthesized
aagataaaggaaattgtaaagg

SEQ ID NO: 85467 - DNA, 22 bp, Artificial Sequence
  chemically synthesized
agataaaggaaattgtaaaggc

SEQ ID NO: 85468 - DNA, 22 bp, Artificial Sequence
  chemically synthesized
taaaggctttctaagaaatcga

SEQ ID NO: 85469 - DNA, 22 bp, Artificial Sequence
  chemically synthesized
tctaagaaatcgagtacccata

SEQ ID NO: 85470 - DNA, 22 bp, Artificial Sequence
  chemically synthesized
ctaagaaatcgagtacccatac

SEQ ID NO: 85471 - DNA, 22 bp, Artificial Sequence
  chemically synthesized
taagaaatcgagtacccatacc

SEQ ID NO: 85472 - DNA, 22 bp, Artificial Sequence
  chemically synthesized
agaaatcgagtacccataccta

SEQ ID NO: 85473 - DNA, 22 bp, Artificial Sequence
  chemically synthesized
ggctgctagactccaggtccaa

SEQ ID NO: 85474 - DNA, 22 bp, Artificial Sequence
  chemically synthesized
ctagactccaggtccaattttt

SEQ ID NO: 85475 - DNA, 22 bp, Artificial Sequence
  chemically synthesized
gactccaggtccaatttttctc

SEQ ID NO: 85476 - DNA, 22 bp, Artificial Sequence
  chemically synthesized
caggtccaatttttctccaggg

SEQ ID NO: 85477 - DNA, 22 bp, Artificial Sequence
  chemically synthesized
ttctccagggggttactatggc

SEQ ID NO: 85478 - DNA, 22 bp, Artificial Sequence
  chemically synthesized
tctccagggggttactatggct

SEQ ID NO: 85479 - DNA, 22 bp, Artificial Sequence
  chemically synthesized
ctccagggggttactatggctt

SEQ ID NO: 85480 - DNA, 22 bp, Artificial Sequence
  chemically synthesized
tccagggggttactatggcttc

SEQ ID NO: 85481 - DNA, 22 bp, Artificial Sequence
  chemically synthesized
cagggggttactatggcttcag

SEQ ID NO: 85482 - DNA, 22 bp, Artificial Sequence
  chemically synthesized
ctatggcttcagggaagctatc

SEQ ID NO: 85483 - DNA, 22 bp, Artificial Sequence
  chemically synthesized
tggcttcagggaagctatctat

SEQ ID NO: 85484 - DNA, 22 bp, Artificial Sequence
  chemically synthesized
cagggaagctatctataatcac

SEQ ID NO: 85485 - DNA, 22 bp, Artificial Sequence
  chemically synthesized
agggaagctatctataatcacc

SEQ ID NO: 85486 - DNA, 22 bp, Artificial Sequence
  chemically synthesized
tctataatcaccatctccagaa

SEQ ID NO: 85487 - DNA, 22 bp, Artificial Sequence
  chemically synthesized
taatcaccatctccagaacatc

SEQ ID NO: 85488 - DNA, 22 bp, Artificial Sequence
  chemically synthesized
cagaacatctctcactttctca

SEQ ID NO: 85489 - DNA, 22 bp, Artificial Sequence
  chemically synthesized
tcactttctcatcaccacacag

SEQ ID NO: 85490 - DNA, 22 bp, Artificial Sequence
  chemically synthesized
actttctcatcaccacacagtg

SEQ ID NO: 85491 - DNA, 22 bp, Artificial Sequence
  chemically synthesized
tctcatcaccacacagtggaat

SEQ ID NO: 85492 - DNA, 22 bp, Artificial Sequence
  chemically synthesized
ctcatcaccacacagtggaata

SEQ ID NO: 85493 - DNA, 22 bp, Artificial Sequence
  chemically synthesized
tcatcaccacacagtggaataa

SEQ ID NO: 85494 - DNA, 22 bp, Artificial Sequence
  chemically synthesized
atcaccacacagtggaataaga

SEQ ID NO: 85495 - DNA, 22 bp, Artificial Sequence
  chemically synthesized
tggcagcaataaaaaagtaatg

SEQ ID NO: 85496 - DNA, 22 bp, Artificial Sequence
  chemically synthesized
ggcagcaataaaaaagtaatgc

SEQ ID NO: 85497 - DNA, 22 bp, Artificial Sequence
  chemically synthesized
gcagcaataaaaaagtaatgcc

SEQ ID NO: 85498 - DNA, 22 bp, Artificial Sequence
  chemically synthesized
gtaaagccttcagaaaaagtat

SEQ ID NO: 85499 - DNA, 22 bp, Artificial Sequence
  chemically synthesized
cagaaaaagtatgaatattaca

SEQ ID NO: 85500 - DNA, 22 bp, Artificial Sequence
  chemically synthesized
agaaaaagtatgaatattacac

SEQ ID NO: 85501 - DNA, 22 bp, Artificial Sequence
  chemically synthesized
cacagttacacttatattagaa

SEQ ID NO: 85502 - DNA, 22 bp, Artificial Sequence
  chemically synthesized
cacttatattagaactaaaatt

SEQ ID NO: 85503 - DNA, 22 bp, Artificial Sequence
  chemically synthesized
atattagaactaaaatttattt

SEQ ID NO: 85504 - DNA, 22 bp, Artificial Sequence
  chemically synthesized
tattagaactaaaatttattta

SEQ ID NO: 85505 - DNA, 22 bp, Artificial Sequence
  chemically synthesized
gaactaaaatttatttattgaa

SEQ ID NO: 85506 - DNA, 22 bp, Artificial Sequence
  chemically synthesized
aaatttatttattgaaattcac

SEQ ID NO: 85507 - DNA, 22 bp, Artificial Sequence
  chemically synthesized
atttattgaaattcacattacc

SEQ ID NO: 85508 - DNA, 22 bp, Artificial Sequence
  chemically synthesized
tttattgaaattcacattacca

SEQ ID NO: 85509 - DNA, 22 bp, Artificial Sequence
  chemically synthesized
attgaaattcacattaccataa

SEQ ID NO: 85510 - DNA, 22 bp, Artificial Sequence
  chemically synthesized
ttgaaattcacattaccataat

SEQ ID NO: 85511 - DNA, 22 bp, Artificial Sequence
  chemically synthesized
aaattcacattaccataattat

SEQ ID NO: 85512 - DNA, 22 bp, Artificial Sequence
  chemically synthesized
acattaccataattatttatgt

SEQ ID NO: 85513 - DNA, 22 bp, Artificial Sequence
  chemically synthesized
ccataattatttatgtctgatt

SEQ ID NO: 85514 - DNA, 22 bp, Artificial Sequence
  chemically synthesized
tttatgtctgattaaatgttat

SEQ ID NO: 85515 - DNA, 22 bp, Artificial Sequence
  chemically synthesized
atgtctgattaaatgttattaa

SEQ ID NO: 85516 - DNA, 22 bp, Artificial Sequence
  chemically synthesized
tgtctgattaaatgttattaaa

SEQ ID NO: 85517 - DNA, 22 bp, Artificial Sequence
  chemically synthesized
attaaatgttattaaagctaaa

SEQ ID NO: 85518 - DNA, 22 bp, Artificial Sequence
  chemically synthesized
aatgttattaaagctaaaattt

SEQ ID NO: 85519 - DNA, 22 bp, Artificial Sequence
  chemically synthesized
ttaaagctaaaattttgaattt

SEQ ID NO: 85520 - DNA, 22 bp, Artificial Sequence
  chemically synthesized
aagctaaaattttgaatttata

SEQ ID NO: 85521 - DNA, 22 bp, Artificial Sequence
  chemically synthesized
aaattttgaatttatatactac

SEQ ID NO: 85522 - DNA, 22 bp, Artificial Sequence
  chemically synthesized
tgaatttatatactactattaa

SEQ ID NO: 85523 - DNA, 22 bp, Artificial Sequence
  chemically synthesized
gaatttatatactactattaat

SEQ ID NO: 85524 - DNA, 22 bp, Artificial Sequence
  chemically synthesized
aatttatatactactattaatt

SEQ ID NO: 85525 - DNA, 22 bp, Artificial Sequence
  chemically synthesized
atatactactattaatttccag

SEQ ID NO: 85526 - DNA, 22 bp, Artificial Sequence
  chemically synthesized
tatactactattaatttccagt

SEQ ID NO: 85527 - DNA, 22 bp, Artificial Sequence
  chemically synthesized
ctattaatttccagttctatct

SEQ ID NO: 85528 - DNA, 22 bp, Artificial Sequence
  chemically synthesized
ttaatttccagttctatctttc

SEQ ID NO: 85529 - DNA, 22 bp, Artificial Sequence
  chemically synthesized
atttccagttctatctttctgt

SEQ ID NO: 85530 - DNA, 22 bp, Artificial Sequence
  chemically synthesized
ccagttctatctttctgttcaa

SEQ ID NO: 85531 - DNA, 22 bp, Artificial Sequence
  chemically synthesized
cagttctatctttctgttcaag

SEQ ID NO: 85532 - DNA, 22 bp, Artificial Sequence
  chemically synthesized
tatctttctgttcaagaaaaga

SEQ ID NO: 85533 - DNA, 22 bp, Artificial Sequence
  chemically synthesized
tctttctgttcaagaaaagaat

SEQ ID NO: 85534 - DNA, 22 bp, Artificial Sequence
  chemically synthesized
tctgttcaagaaaagaatgtga

SEQ ID NO: 85535 - DNA, 22 bp, Artificial Sequence
  chemically synthesized
ctgttcaagaaaagaatgtgag

SEQ ID NO: 85536 - DNA, 22 bp, Artificial Sequence
  chemically synthesized
tgttcaagaaaagaatgtgaga

SEQ ID NO: 85537 - DNA, 22 bp, Artificial Sequence
  chemically synthesized
ttcaagaaaagaatgtgagaag

SEQ ID NO: 85538 - DNA, 22 bp, Artificial Sequence
  chemically synthesized
aagaaaagaatgtgagaagtaa

SEQ ID NO: 85539 - DNA, 22 bp, Artificial Sequence
  chemically synthesized
gtgcctcaaatttgcctacttc

SEQ ID NO: 85540 - DNA, 22 bp, Artificial Sequence
  chemically synthesized
aaatttgcctacttcatcccca

SEQ ID NO: 85541 - DNA, 22 bp, Artificial Sequence
  chemically synthesized
gcctacttcatccccaacagag

SEQ ID NO: 85542 - DNA, 22 bp, Artificial Sequence
  chemically synthesized
cctacttcatccccaacagagg

SEQ ID NO: 85543 - DNA, 22 bp, Artificial Sequence
  chemically synthesized
cttcatccccaacagaggagat

SEQ ID NO: 85544 - DNA, 22 bp, Artificial Sequence
  chemically synthesized
catccccaacagaggagatcat

SEQ ID NO: 85545 - DNA, 22 bp, Artificial Sequence
  chemically synthesized
atccccaacagaggagatcatg

SEQ ID NO: 85546 - DNA, 22 bp, Artificial Sequence
  chemically synthesized
tatcaataatggagcctgggcc

SEQ ID NO: 85547 - DNA, 22 bp, Artificial Sequence
  chemically synthesized
ggcccagacaactggttaagag

SEQ ID NO: 85548 - DNA, 22 bp, Artificial Sequence
  chemically synthesized
gttaagagagaggtcattctga

SEQ ID NO: 85549 - DNA, 22 bp, Artificial Sequence
  chemically synthesized
agagagaggtcattctgacctc

SEQ ID NO: 85550 - DNA, 22 bp, Artificial Sequence
  chemically synthesized
tgacctcagaacataggagaga

SEQ ID NO: 85551 - DNA, 22 bp, Artificial Sequence
  chemically synthesized
acctcagaacataggagagatg

SEQ ID NO: 85552 - DNA, 22 bp, Artificial Sequence
  chemically synthesized
agaacataggagagatggatat

SEQ ID NO: 85553 - DNA, 22 bp, Artificial Sequence
  chemically synthesized
tacaccacagagtccaggatga

SEQ ID NO: 85554 - DNA, 22 bp, Artificial Sequence
  chemically synthesized
gcagtgaaggattcaaatgcct

SEQ ID NO: 85555 - DNA, 22 bp, Artificial Sequence
  chemically synthesized
aaatgcctggcgaaatctccta

SEQ ID NO: 85556 - DNA, 22 bp, Artificial Sequence
  chemically synthesized
gcgaaatctcctatacaaccgg

SEQ ID NO: 85557 - DNA, 22 bp, Artificial Sequence
  chemically synthesized
ctatacaaccggagagacccaa

SEQ ID NO: 85558 - DNA, 22 bp, Artificial Sequence
  chemically synthesized
tacaaccggagagacccaagtc

SEQ ID NO: 85559 - DNA, 22 bp, Artificial Sequence
  chemically synthesized
tgcatgacatgacttgcctatg

SEQ ID NO: 85560 - DNA, 22 bp, Artificial Sequence
  chemically synthesized
catgacatgacttgcctatgag

SEQ ID NO: 85561 - DNA, 22 bp, Artificial Sequence
  chemically synthesized
gcctatgagccctcccattgct

SEQ ID NO: 85562 - DNA, 22 bp, Artificial Sequence
  chemically synthesized
cctatgagccctcccattgcta

SEQ ID NO: 85563 - DNA, 22 bp, Artificial Sequence
  chemically synthesized
tgagccctcccattgctataag

SEQ ID NO: 85564 - DNA, 22 bp, Artificial Sequence
  chemically synthesized
ccattgctataaggatggggat

SEQ ID NO: 85565 - DNA, 22 bp, Artificial Sequence
  chemically synthesized
ctataaggatggggatcttagc

SEQ ID NO: 85566 - DNA, 22 bp, Artificial Sequence
  chemically synthesized
taaggatggggatcttagcaca

SEQ ID NO: 85567 - DNA, 22 bp, Artificial Sequence
  chemically synthesized
agcacagtgccttgtgtgaaca

SEQ ID NO: 85568 - DNA, 22 bp, Artificial Sequence
  chemically synthesized
gcacagtgccttgtgtgaacag

SEQ ID NO: 85569 - DNA, 22 bp, Artificial Sequence
  chemically synthesized
gtgtgaacagtaatgctagcct

SEQ ID NO: 85570 - DNA, 22 bp, Artificial Sequence
  chemically synthesized
tgtgaacagtaatgctagcctt

SEQ ID NO: 85571 - DNA, 22 bp, Artificial Sequence
  chemically synthesized
gccttgattttaccatggcaag

SEQ ID NO: 85572 - DNA, 22 bp, Artificial Sequence
  chemically synthesized
gattttaccatggcaagtttgt

SEQ ID NO: 85573 - DNA, 22 bp, Artificial Sequence
  chemically synthesized
attttaccatggcaagtttgtt

SEQ ID NO: 85574 - DNA, 22 bp, Artificial Sequence
  chemically synthesized
taccatggcaagtttgtttagg

SEQ ID NO: 85575 - DNA, 22 bp, Artificial Sequence
  chemically synthesized
accatggcaagtttgtttaggg

SEQ ID NO: 85576 - DNA, 22 bp, Artificial Sequence
  chemically synthesized
ccatggcaagtttgtttaggga

SEQ ID NO: 85577 - DNA, 22 bp, Artificial Sequence
  chemically synthesized
gtttagggaaaaattcaaccca

SEQ ID NO: 85578 - DNA, 22 bp, Artificial Sequence
  chemically synthesized
tttagggaaaaattcaacccac

SEQ ID NO: 85579 - DNA, 22 bp, Artificial Sequence
  chemically synthesized
agggaaaaattcaacccaccca

SEQ ID NO: 85580 - DNA, 22 bp, Artificial Sequence
  chemically synthesized
gggaaaaattcaacccacccat

SEQ ID NO: 85581 - DNA, 22 bp, Artificial Sequence
  chemically synthesized
aacccacccattgaaattccaa

SEQ ID NO: 85582 - DNA, 22 bp, Artificial Sequence
  chemically synthesized
aaattccaacctcaaccaaatg

SEQ ID NO: 85583 - DNA, 22 bp, Artificial Sequence
  chemically synthesized
caacctcaaccaaatgagggat

SEQ ID NO: 85584 - DNA, 22 bp, Artificial Sequence
  chemically synthesized
aaccaaatgagggatggctggg

SEQ ID NO: 85585 - DNA, 22 bp, Artificial Sequence
  chemically synthesized
gggatgcaaccacaaagatact

SEQ ID NO: 85586 - DNA, 22 bp, Artificial Sequence
  chemically synthesized
tatcttaggaggggagtttttt

SEQ ID NO: 85587 - DNA, 22 bp, Artificial Sequence
  chemically synthesized
aggaggggagtttttttttttt

SEQ ID NO: 85588 - DNA, 22 bp, Artificial Sequence
  chemically synthesized
ggaggggagtttttttttttta

SEQ ID NO: 85589 - DNA, 22 bp, Artificial Sequence
  chemically synthesized
tttttttttatagaaactcgtc

SEQ ID NO: 85590 - DNA, 22 bp, Artificial Sequence
  chemically synthesized
ttttttttatagaaactcgtca

SEQ ID NO: 85591 - DNA, 22 bp, Artificial Sequence
  chemically synthesized
tttttttatagaaactcgtcag

SEQ ID NO: 85592 - DNA, 22 bp, Artificial Sequence
  chemically synthesized
ttttttatagaaactcgtcagg

SEQ ID NO: 85593 - DNA, 22 bp, Artificial Sequence
  chemically synthesized
tttttatagaaactcgtcagga

SEQ ID NO: 85594 - DNA, 22 bp, Artificial Sequence
  chemically synthesized
ttttatagaaactcgtcaggat

SEQ ID NO: 85595 - DNA, 22 bp, Artificial Sequence
  chemically synthesized
tttatagaaactcgtcaggata

SEQ ID NO: 85596 - DNA, 22 bp, Artificial Sequence
  chemically synthesized
ttatagaaactcgtcaggatat

SEQ ID NO: 85597 - DNA, 22 bp, Artificial Sequence
  chemically synthesized
tatagaaactcgtcaggatatt

SEQ ID NO: 85598 - DNA, 22 bp, Artificial Sequence
  chemically synthesized
atagaaactcgtcaggatatta

SEQ ID NO: 85599 - DNA, 22 bp, Artificial Sequence
  chemically synthesized
tagaaactcgtcaggatattat

SEQ ID NO: 85600 - DNA, 22 bp, Artificial Sequence
  chemically synthesized
gtcaggatattattgctaggat

SEQ ID NO: 85601 - DNA, 22 bp, Artificial Sequence
  chemically synthesized
ttgctaggatgtgttgttactg

SEQ ID NO: 85602 - DNA, 22 bp, Artificial Sequence
  chemically synthesized
ctaggatgtgttgttactggga

SEQ ID NO: 85603 - DNA, 22 bp, Artificial Sequence
  chemically synthesized
ggatgtgttgttactgggaaaa

SEQ ID NO: 85604 - DNA, 22 bp, Artificial Sequence
  chemically synthesized
ttactgggaaaaaagctgatgg

SEQ ID NO: 85605 - DNA, 22 bp, Artificial Sequence
  chemically synthesized
ctgggaaaaaagctgatggaat

SEQ ID NO: 85606 - DNA, 22 bp, Artificial Sequence
  chemically synthesized
ggaaaaaagctgatggaataca

SEQ ID NO: 85607 - DNA, 22 bp, Artificial Sequence
  chemically synthesized
atggaatacaaaagagtagaca

SEQ ID NO: 85608 - DNA, 22 bp, Artificial Sequence
  chemically synthesized
tttgaggcaatcagtgactaac

SEQ ID NO: 85609 - DNA, 22 bp, Artificial Sequence
  chemically synthesized
gaggcaatcagtgactaacatg

SEQ ID NO: 85610 - DNA, 22 bp, Artificial Sequence
  chemically synthesized
aggcaatcagtgactaacatga

SEQ ID NO: 85611 - DNA, 22 bp, Artificial Sequence
  chemically synthesized
acatgaccactttgctttctct

SEQ ID NO: 85612 - DNA, 22 bp, Artificial Sequence
  chemically synthesized
tgctttctctatgcaggtgtca

SEQ ID NO: 85613 - DNA, 22 bp, Artificial Sequence
  chemically synthesized
gctttctctatgcaggtgtcat

SEQ ID NO: 85614 - DNA, 22 bp, Artificial Sequence
  chemically synthesized
ctttctctatgcaggtgtcatc

SEQ ID NO: 85615 - DNA, 22 bp, Artificial Sequence
  chemically synthesized
tctctatgcaggtgtcatctat

SEQ ID NO: 85616 - DNA, 22 bp, Artificial Sequence
  chemically synthesized
ctctatgcaggtgtcatctatt

SEQ ID NO: 85617 - DNA, 22 bp, Artificial Sequence
  chemically synthesized
tctatgcaggtgtcatctattg

SEQ ID NO: 85618 - DNA, 22 bp, Artificial Sequence
  chemically synthesized
tatgcaggtgtcatctattgtg

SEQ ID NO: 85619 - DNA, 22 bp, Artificial Sequence
  chemically synthesized
tgcaggtgtcatctattgtgat

SEQ ID NO: 85620 - DNA, 22 bp, Artificial Sequence
  chemically synthesized
ttgtgatatagtgccaggaggt

SEQ ID NO: 85621 - DNA, 22 bp, Artificial Sequence
  chemically synthesized
tgatatagtgccaggaggttgc

SEQ ID NO: 85622 - DNA, 22 bp, Artificial Sequence
  chemically synthesized
cctttgctgtggctttcgaccc

SEQ ID NO: 85623 - DNA, 22 bp, Artificial Sequence
  chemically synthesized
tgctgtggctttcgaccctaga

SEQ ID NO: 85624 - DNA, 22 bp, Artificial Sequence
  chemically synthesized
gctgtggctttcgaccctagat

SEQ ID NO: 85625 - DNA, 22 bp, Artificial Sequence
  chemically synthesized
ctgtggctttcgaccctagatt

SEQ ID NO: 85626 - DNA, 22 bp, Artificial Sequence
  chemically synthesized
tggctttcgaccctagattttt

SEQ ID NO: 85627 - DNA, 22 bp, Artificial Sequence
  chemically synthesized
tcgaccctagatttttaaattg

SEQ ID NO: 85628 - DNA, 22 bp, Artificial Sequence
  chemically synthesized
cgaccctagatttttaaattgt

SEQ ID NO: 85629 - DNA, 22 bp, Artificial Sequence
  chemically synthesized
gaccctagatttttaaattgtg

SEQ ID NO: 85630 - DNA, 22 bp, Artificial Sequence
  chemically synthesized
gatttttaaattgtgtgacaaa

SEQ ID NO: 85631 - DNA, 22 bp, Artificial Sequence
  chemically synthesized
ttaaattgtgtgacaaacccat

SEQ ID NO: 85632 - DNA, 22 bp, Artificial Sequence
  chemically synthesized
taaattgtgtgacaaacccatc

SEQ ID NO: 85633 - DNA, 22 bp, Artificial Sequence
  chemically synthesized
aaattgtgtgacaaacccatct

SEQ ID NO: 85634 - DNA, 22 bp, Artificial Sequence
  chemically synthesized
aattgtgtgacaaacccatctt

SEQ ID NO: 85635 - DNA, 22 bp, Artificial Sequence
  chemically synthesized
tgtgacaaacccatcttttatt

SEQ ID NO: 85636 - DNA, 22 bp, Artificial Sequence
  chemically synthesized
ttatttatgtaaataaaatgtc

SEQ ID NO: 85637 - DNA, 22 bp, Artificial Sequence
  chemically synthesized
tatttatgtaaataaaatgtcc

SEQ ID NO: 85638 - DNA, 22 bp, Artificial Sequence
  chemically synthesized
atttatgtaaataaaatgtccg

SEQ ID NO: 85639 - DNA, 22 bp, Artificial Sequence
  chemically synthesized
tttatgtaaataaaatgtccgt

SEQ ID NO: 85640 - DNA, 22 bp, Artificial Sequence
  chemically synthesized
atgtaaataaaatgtccgtgtt

SEQ ID NO: 85641 - DNA, 22 bp, Artificial Sequence
  chemically synthesized
tgtaaataaaatgtccgtgttt

SEQ ID NO: 85642 - DNA, 22 bp, Artificial Sequence
  chemically synthesized
attggttattgttatattgtga

SEQ ID NO: 85643 - DNA, 22 bp, Artificial Sequence
  chemically synthesized
ttggttattgttatattgtgaa

SEQ ID NO: 85644 - DNA, 22 bp, Artificial Sequence
  chemically synthesized
gttattgttatattgtgaaatt

SEQ ID NO: 85645 - DNA, 22 bp, Artificial Sequence
  chemically synthesized
ttgttatattgtgaaattgtag

SEQ ID NO: 85646 - DNA, 22 bp, Artificial Sequence
  chemically synthesized
ttatattgtgaaattgtagtag

SEQ ID NO: 85647 - DNA, 22 bp, Artificial Sequence
  chemically synthesized
tattgtgaaattgtagtagatc

SEQ ID NO: 85648 - DNA, 22 bp, Artificial Sequence
  chemically synthesized
tgaaattgtagtagatctaaaa

SEQ ID NO: 85649 - DNA, 22 bp, Artificial Sequence
  chemically synthesized
tagtagatctaaaattgtaatt

SEQ ID NO: 85650 - DNA, 22 bp, Artificial Sequence
  chemically synthesized
aaattgtaatttcttggattcc

SEQ ID NO: 85651 - DNA, 22 bp, Artificial Sequence
  chemically synthesized
taatttcttggattcctagaat

SEQ ID NO: 85652 - DNA, 22 bp, Artificial Sequence
  chemically synthesized
cttggattcctagaatttctaa

SEQ ID NO: 85653 - DNA, 22 bp, Artificial Sequence
  chemically synthesized
ttggattcctagaatttctaaa

SEQ ID NO: 85654 - DNA, 22 bp, Artificial Sequence
  chemically synthesized
ggattcctagaatttctaaatc

SEQ ID NO: 85655 - DNA, 22 bp, Artificial Sequence
  chemically synthesized
gattcctagaatttctaaatct

SEQ ID NO: 85656 - DNA, 22 bp, Artificial Sequence
  chemically synthesized
ctagaatttctaaatctgtgga

SEQ ID NO: 85657 - DNA, 22 bp, Artificial Sequence
  chemically synthesized
gaatttctaaatctgtggattt

SEQ ID NO: 85658 - DNA, 22 bp, Artificial Sequence
  chemically synthesized
ctaaatctgtggatttttagaa

SEQ ID NO: 85659 - DNA, 22 bp, Artificial Sequence
  chemically synthesized
taaatctgtggatttttagaat

SEQ ID NO: 85660 - DNA, 22 bp, Artificial Sequence
  chemically synthesized
aatctgtggatttttagaattc

SEQ ID NO: 85661 - DNA, 22 bp, Artificial Sequence
  chemically synthesized
tggatttttagaattctctaga

SEQ ID NO: 85662 - DNA, 22 bp, Artificial Sequence
  chemically synthesized
ttagaattctctagaggtgaca

SEQ ID NO: 85663 - DNA, 22 bp, Artificial Sequence
  chemically synthesized
tagaattctctagaggtgacaa

SEQ ID NO: 85664 - DNA, 22 bp, Artificial Sequence
  chemically synthesized
agaattctctagaggtgacaaa

SEQ ID NO: 85665 - DNA, 22 bp, Artificial Sequence
  chemically synthesized
gaattctctagaggtgacaaag

SEQ ID NO: 85666 - DNA, 22 bp, Artificial Sequence
  chemically synthesized
tctagaggtgacaaaggtttat

SEQ ID NO: 85667 - DNA, 22 bp, Artificial Sequence
  chemically synthesized
tagaggtgacaaaggtttatta

SEQ ID NO: 85668 - DNA, 22 bp, Artificial Sequence
  chemically synthesized
gaggtgacaaaggtttattatc

SEQ ID NO: 85669 - DNA, 22 bp, Artificial Sequence
  chemically synthesized
attatctaagctaccggagcta

SEQ ID NO: 85670 - DNA, 22 bp, Artificial Sequence
  chemically synthesized
ttatctaagctaccggagctat

SEQ ID NO: 85671 - DNA, 22 bp, Artificial Sequence
  chemically synthesized
tctaagctaccggagctatgta

SEQ ID NO: 85672 - DNA, 22 bp, Artificial Sequence
  chemically synthesized
agctaccggagctatgtacttt

SEQ ID NO: 85673 - DNA, 22 bp, Artificial Sequence
  chemically synthesized
ccggagctatgtacttttggat

SEQ ID NO: 85674 - DNA, 22 bp, Artificial Sequence
  chemically synthesized
tgtacttttggatataagagtg

SEQ ID NO: 85675 - DNA, 22 bp, Artificial Sequence
  chemically synthesized
ttggatataagagtgtctccat

SEQ ID NO: 85676 - DNA, 22 bp, Artificial Sequence
  chemically synthesized
tggatataagagtgtctccatc

SEQ ID NO: 85677 - DNA, 22 bp, Artificial Sequence
  chemically synthesized
ggatataagagtgtctccatct

SEQ ID NO: 85678 - DNA, 22 bp, Artificial Sequence
  chemically synthesized
gatataagagtgtctccatctc

SEQ ID NO: 85679 - DNA, 22 bp, Artificial Sequence
  chemically synthesized
catctccattgccttacaaatc

SEQ ID NO: 85680 - DNA, 22 bp, Artificial Sequence
  chemically synthesized
cattgccttacaaatcaggtgt

SEQ ID NO: 85681 - DNA, 22 bp, Artificial Sequence
  chemically synthesized
ccttacaaatcaggtgtgagcc

SEQ ID NO: 85682 - DNA, 22 bp, Artificial Sequence
  chemically synthesized
acaaatcaggtgtgagccaggc

SEQ ID NO: 85683 - DNA, 22 bp, Artificial Sequence
  chemically synthesized
caaatcaggtgtgagccaggca

SEQ ID NO: 85684 - DNA, 22 bp, Artificial Sequence
  chemically synthesized
tcagactggaaaaggtaactaa

SEQ ID NO: 85685 - DNA, 22 bp, Artificial Sequence
  chemically synthesized
agactggaaaaggtaactaatc

SEQ ID NO: 85686 - DNA, 22 bp, Artificial Sequence
  chemically synthesized
gaaaaggtaactaatcagaagg

SEQ ID NO: 85687 - DNA, 22 bp, Artificial Sequence
  chemically synthesized
atcagaaggaaccattgtccta

SEQ ID NO: 85688 - DNA, 22 bp, Artificial Sequence
  chemically synthesized
tcctagaatggggcaagtgtac

SEQ ID NO: 85689 - DNA, 22 bp, Artificial Sequence
  chemically synthesized
gaatggggcaagtgtacaatac

SEQ ID NO: 85690 - DNA, 22 bp, Artificial Sequence
  chemically synthesized
gtgccgtagcatataacatatt

SEQ ID NO: 85691 - DNA, 22 bp, Artificial Sequence
  chemically synthesized
actcaatccttcataccctttg

SEQ ID NO: 85692 - DNA, 22 bp, Artificial Sequence
  chemically synthesized
aatccttcataccctttgtatc

SEQ ID NO: 85693 - DNA, 22 bp, Artificial Sequence
  chemically synthesized
cataccctttgtatcgtttttt

SEQ ID NO: 85694 - DNA, 22 bp, Artificial Sequence
  chemically synthesized
ataccctttgtatcgttttttt

SEQ ID NO: 85695 - DNA, 22 bp, Artificial Sequence
  chemically synthesized
tgtatcgttttttttctgtttt

SEQ ID NO: 85696 - DNA, 22 bp, Artificial Sequence
  chemically synthesized
gtatcgttttttttctgtttta

SEQ ID NO: 85697 - DNA, 22 bp, Artificial Sequence
  chemically synthesized
tatcgttttttttctgttttat

SEQ ID NO: 85698 - DNA, 22 bp, Artificial Sequence
  chemically synthesized
tttttctgttttatttatttta

SEQ ID NO: 85699 - DNA, 22 bp, Artificial Sequence
  chemically synthesized
ttttctgttttatttattttat

SEQ ID NO: 85700 - DNA, 22 bp, Artificial Sequence
  chemically synthesized
tttctgttttatttattttatt

SEQ ID NO: 85701 - DNA, 22 bp, Artificial Sequence
  chemically synthesized
ttctgttttatttattttattt

SEQ ID NO: 85702 - DNA, 22 bp, Artificial Sequence
  chemically synthesized
tctgttttatttattttattta

SEQ ID NO: 85703 - DNA, 22 bp, Artificial Sequence
  chemically synthesized
ctgttttatttattttatttat

SEQ ID NO: 85704 - DNA, 22 bp, Artificial Sequence
  chemically synthesized
tgttttatttattttatttatt

SEQ ID NO: 85705 - DNA, 22 bp, Artificial Sequence
  chemically synthesized
ttttatttattttatttattta

SEQ ID NO: 85706 - DNA, 22 bp, Artificial Sequence
  chemically synthesized
tatttattttatttatttatta

SEQ ID NO: 85707 - DNA, 22 bp, Artificial Sequence
  chemically synthesized
atttattttatttatttattag

SEQ ID NO: 85708 - DNA, 22 bp, Artificial Sequence
  chemically synthesized
tttattttatttatttattaga

SEQ ID NO: 85709 - DNA, 22 bp, Artificial Sequence
  chemically synthesized
attttatttatttattagagat

SEQ ID NO: 85710 - DNA, 22 bp, Artificial Sequence
  chemically synthesized
ttttatttatttattagagatc

SEQ ID NO: 85711 - DNA, 22 bp, Artificial Sequence
  chemically synthesized
tatttatttattagagatcata

SEQ ID NO: 85712 - DNA, 22 bp, Artificial Sequence
  chemically synthesized
atttatttattagagatcatag

SEQ ID NO: 85713 - DNA, 22 bp, Artificial Sequence
  chemically synthesized
tttatttattagagatcatagt

SEQ ID NO: 85714 - DNA, 22 bp, Artificial Sequence
  chemically synthesized
atttattagagatcatagtgtg

SEQ ID NO: 85715 - DNA, 22 bp, Artificial Sequence
  chemically synthesized
tttattagagatcatagtgtgt

SEQ ID NO: 85716 - DNA, 22 bp, Artificial Sequence
  chemically synthesized
attagagatcatagtgtgtgca

SEQ ID NO: 85717 - DNA, 22 bp, Artificial Sequence
  chemically synthesized
ttagagatcatagtgtgtgcaa

SEQ ID NO: 85718 - DNA, 22 bp, Artificial Sequence
  chemically synthesized
gagatcatagtgtgtgcaacac

SEQ ID NO: 85719 - DNA, 22 bp, Artificial Sequence
  chemically synthesized
tgtccaggttctgtggtaaacg

SEQ ID NO: 85720 - DNA, 22 bp, Artificial Sequence
  chemically synthesized
tgtggtaaacgtcagcgtggag

SEQ ID NO: 85721 - DNA, 22 bp, Artificial Sequence
  chemically synthesized
tggtaaacgtcagcgtggagaa

SEQ ID NO: 85722 - DNA, 22 bp, Artificial Sequence
  chemically synthesized
gtagctattagatcataaaaag

SEQ ID NO: 85723 - DNA, 22 bp, Artificial Sequence
  chemically synthesized
ttagatcataaaaaggtgaggc

SEQ ID NO: 85724 - DNA, 22 bp, Artificial Sequence
  chemically synthesized
gatcataaaaaggtgaggcata

SEQ ID NO: 85725 - DNA, 22 bp, Artificial Sequence
  chemically synthesized
gtctttgagaagctgactgtgg

SEQ ID NO: 85726 - DNA, 22 bp, Artificial Sequence
  chemically synthesized
tctttgagaagctgactgtggc

SEQ ID NO: 85727 - DNA, 22 bp, Artificial Sequence
  chemically synthesized
tgagaagctgactgtggctata

SEQ ID NO: 85728 - DNA, 22 bp, Artificial Sequence
  chemically synthesized
gagaagctgactgtggctatag

SEQ ID NO: 85729 - DNA, 22 bp, Artificial Sequence
  chemically synthesized
agaagctgactgtggctatagg

SEQ ID NO: 85730 - DNA, 22 bp, Artificial Sequence
  chemically synthesized
actgtggctataggtgaagaaa

SEQ ID NO: 85731 - DNA, 22 bp, Artificial Sequence
  chemically synthesized
tggctataggtgaagaaaaaaa

SEQ ID NO: 85732 - DNA, 22 bp, Artificial Sequence
  chemically synthesized
taggtgaagaaaaaaattataa

SEQ ID NO: 85733 - DNA, 22 bp, Artificial Sequence
  chemically synthesized
taattttagttttattattaat

SEQ ID NO: 85734 - DNA, 22 bp, Artificial Sequence
  chemically synthesized
tagttttattattaatatcacc

SEQ ID NO: 85735 - DNA, 22 bp, Artificial Sequence
  chemically synthesized
agttttattattaatatcacca

SEQ ID NO: 85736 - DNA, 22 bp, Artificial Sequence
  chemically synthesized
gttttattattaatatcaccat

SEQ ID NO: 85737 - DNA, 22 bp, Artificial Sequence
  chemically synthesized
tattattaatatcaccatgatc

SEQ ID NO: 85738 - DNA, 22 bp, Artificial Sequence
  chemically synthesized
attattaatatcaccatgatca

SEQ ID NO: 85739 - DNA, 22 bp, Artificial Sequence
  chemically synthesized
ttattaatatcaccatgatcat

SEQ ID NO: 85740 - DNA, 22 bp, Artificial Sequence
  chemically synthesized
ttaatatcaccatgatcatcat

SEQ ID NO: 85741 - DNA, 22 bp, Artificial Sequence
  chemically synthesized
atatcaccatgatcatcatgat

SEQ ID NO: 85742 - DNA, 22 bp, Artificial Sequence
  chemically synthesized
atatttactgggaacttatttg

SEQ ID NO: 85743 - DNA, 22 bp, Artificial Sequence
  chemically synthesized
actgggaacttatttggtttgt

SEQ ID NO: 85744 - DNA, 22 bp, Artificial Sequence
  chemically synthesized
ctgggaacttatttggtttgtc

SEQ ID NO: 85745 - DNA, 22 bp, Artificial Sequence
  chemically synthesized
ggaacttatttggtttgtcatt

SEQ ID NO: 85746 - DNA, 22 bp, Artificial Sequence
  chemically synthesized
atttggtttgtcatttttcgaa

SEQ ID NO: 85747 - DNA, 22 bp, Artificial Sequence
  chemically synthesized
tttggtttgtcatttttcgaag

SEQ ID NO: 85748 - DNA, 22 bp, Artificial Sequence
  chemically synthesized
ggtttgtcatttttcgaaggaa

SEQ ID NO: 85749 - DNA, 22 bp, Artificial Sequence
  chemically synthesized
gtttgtcatttttcgaaggaat

SEQ ID NO: 85750 - DNA, 22 bp, Artificial Sequence
  chemically synthesized
gtcatttttcgaaggaatttat

SEQ ID NO: 85751 - DNA, 22 bp, Artificial Sequence
  chemically synthesized
tcatttttcgaaggaatttatg

SEQ ID NO: 85752 - DNA, 22 bp, Artificial Sequence
  chemically synthesized
ttcgaaggaatttatgttaatt

SEQ ID NO: 85753 - DNA, 22 bp, Artificial Sequence
  chemically synthesized
tcgaaggaatttatgttaattt

SEQ ID NO: 85754 - DNA, 22 bp, Artificial Sequence
  chemically synthesized
cgaaggaatttatgttaattta

SEQ ID NO: 85755 - DNA, 22 bp, Artificial Sequence
  chemically synthesized
gaaggaatttatgttaatttac

SEQ ID NO: 85756 - DNA, 22 bp, Artificial Sequence
  chemically synthesized
atgttaatttactcactataag

SEQ ID NO: 85757 - DNA, 22 bp, Artificial Sequence
  chemically synthesized
tgttaatttactcactataaga

SEQ ID NO: 85758 - DNA, 22 bp, Artificial Sequence
  chemically synthesized
atttactcactataagaaattt

SEQ ID NO: 85759 - DNA, 22 bp, Artificial Sequence
  chemically synthesized
actcactataagaaatttataa

SEQ ID NO: 85760 - DNA, 22 bp, Artificial Sequence
  chemically synthesized
ctcactataagaaatttataaa

SEQ ID NO: 85761 - DNA, 22 bp, Artificial Sequence
  chemically synthesized
actataagaaatttataaagta

SEQ ID NO: 85762 - DNA, 22 bp, Artificial Sequence
  chemically synthesized
taagaaatttataaagtagatt

SEQ ID NO: 85763 - DNA, 22 bp, Artificial Sequence
  chemically synthesized
ataaagtagattccattatagc

SEQ ID NO: 85764 - DNA, 22 bp, Artificial Sequence
  chemically synthesized
taaagtagattccattatagct

SEQ ID NO: 85765 - DNA, 22 bp, Artificial Sequence
  chemically synthesized
cattatagctcttaatttatta

SEQ ID NO: 85766 - DNA, 22 bp, Artificial Sequence
  chemically synthesized
tagctcttaatttattattgag

SEQ ID NO: 85767 - DNA, 22 bp, Artificial Sequence
  chemically synthesized
ttaatttattattgaggaatgt

SEQ ID NO: 85768 - DNA, 22 bp, Artificial Sequence
  chemically synthesized
aatttattattgaggaatgtaa

SEQ ID NO: 85769 - DNA, 22 bp, Artificial Sequence
  chemically synthesized
atttattattgaggaatgtaag

SEQ ID NO: 85770 - DNA, 22 bp, Artificial Sequence
  chemically synthesized
attattgaggaatgtaaggcat

SEQ ID NO: 85771 - DNA, 22 bp, Artificial Sequence
  chemically synthesized
ttattgaggaatgtaaggcata

SEQ ID NO: 85772 - DNA, 22 bp, Artificial Sequence
  chemically synthesized
ttgaggaatgtaaggcatagag

SEQ ID NO: 85773 - DNA, 22 bp, Artificial Sequence
  chemically synthesized
aggaatgtaaggcatagagaag

SEQ ID NO: 85774 - DNA, 22 bp, Artificial Sequence
  chemically synthesized
atcctcaaaacaaagctattaa

SEQ ID NO: 85775 - DNA, 22 bp, Artificial Sequence
  chemically synthesized
tcctcaaaacaaagctattaac

SEQ ID NO: 85776 - DNA, 22 bp, Artificial Sequence
  chemically synthesized
aaaacaaagctattaacttatg

SEQ ID NO: 85777 - DNA, 22 bp, Artificial Sequence
  chemically synthesized
ttaacttatggacctgagagta

SEQ ID NO: 85778 - DNA, 22 bp, Artificial Sequence
  chemically synthesized
acttatggacctgagagtagag

SEQ ID NO: 85779 - DNA, 22 bp, Artificial Sequence
  chemically synthesized
atggacctgagagtagagcccg

SEQ ID NO: 85780 - DNA, 22 bp, Artificial Sequence
  chemically synthesized
tggacctgagagtagagcccgg

SEQ ID NO: 85781 - DNA, 22 bp, Artificial Sequence
  chemically synthesized
agagtagagcccgggctgtctc

SEQ ID NO: 85782 - DNA, 22 bp, Artificial Sequence
  chemically synthesized
tctcatgccagaacctattatc

SEQ ID NO: 85783 - DNA, 22 bp, Artificial Sequence
  chemically synthesized
atgccagaacctattatcccat

SEQ ID NO: 85784 - DNA, 22 bp, Artificial Sequence
  chemically synthesized
ttatcccatgttgcaagacaca

SEQ ID NO: 85785 - DNA, 22 bp, Artificial Sequence
  chemically synthesized
tcccatgttgcaagacacaaat

SEQ ID NO: 85786 - DNA, 22 bp, Artificial Sequence
  chemically synthesized
caagacacaaataggaaaatag

SEQ ID NO: 85787 - DNA, 22 bp, Artificial Sequence
  chemically synthesized
gaagttattgaagggcatgaaa

SEQ ID NO: 85788 - DNA, 22 bp, Artificial Sequence
  chemically synthesized
ttgaagggcatgaaataatagt

SEQ ID NO: 85789 - DNA, 22 bp, Artificial Sequence
  chemically synthesized
aagggcatgaaataatagtggt

SEQ ID NO: 85790 - DNA, 22 bp, Artificial Sequence
  chemically synthesized
gaaatttgagtagagtaggacc

SEQ ID NO: 85791 - DNA, 22 bp, Artificial Sequence
  chemically synthesized
aaatttgagtagagtaggacca

SEQ ID NO: 85792 - DNA, 22 bp, Artificial Sequence
  chemically synthesized
gagtagagtaggaccaagaaaa

SEQ ID NO: 85793 - DNA, 22 bp, Artificial Sequence
  chemically synthesized
agtagagtaggaccaagaaaat

SEQ ID NO: 85794 - DNA, 22 bp, Artificial Sequence
  chemically synthesized
cagggaatacctgagaggaaaa

SEQ ID NO: 85795 - DNA, 22 bp, Artificial Sequence
  chemically synthesized
agggaatacctgagaggaaaaa

SEQ ID NO: 85796 - DNA, 22 bp, Artificial Sequence
  chemically synthesized
agaggaaaaaaaaaaactatga

SEQ ID NO: 85797 - DNA, 22 bp, Artificial Sequence
  chemically synthesized
tgaaggaacgcagtaattagct

SEQ ID NO: 85798 - DNA, 22 bp, Artificial Sequence
  chemically synthesized
gctccttagctgaaagaatgat

SEQ ID NO: 85799 - DNA, 22 bp, Artificial Sequence
  chemically synthesized
cttagctgaaagaatgatcttc

SEQ ID NO: 85800 - DNA, 22 bp, Artificial Sequence
  chemically synthesized
agctgaaagaatgatcttctgg

SEQ ID NO: 85801 - DNA, 22 bp, Artificial Sequence
  chemically synthesized
gctgaaagaatgatcttctggt

SEQ ID NO: 85802 - DNA, 22 bp, Artificial Sequence
  chemically synthesized
aaagaatgatcttctggtcagt

SEQ ID NO: 85803 - DNA, 22 bp, Artificial Sequence
  chemically synthesized
ctggtcagtgagaactggtttc

SEQ ID NO: 85804 - DNA, 22 bp, Artificial Sequence
  chemically synthesized
tggtcagtgagaactggtttca

SEQ ID NO: 85805 - DNA, 22 bp, Artificial Sequence
  chemically synthesized
gtcagtgagaactggtttcaaa

SEQ ID NO: 85806 - DNA, 22 bp, Artificial Sequence
  chemically synthesized
gtttcaaatcttggttttgtca

SEQ ID NO: 85807 - DNA, 22 bp, Artificial Sequence
  chemically synthesized
caaatcttggttttgtcatttc

SEQ ID NO: 85808 - DNA, 22 bp, Artificial Sequence
  chemically synthesized
aaatcttggttttgtcatttct

SEQ ID NO: 85809 - DNA, 22 bp, Artificial Sequence
  chemically synthesized
ggttttgtcatttcttaggtat

SEQ ID NO: 85810 - DNA, 22 bp, Artificial Sequence
  chemically synthesized
gttttgtcatttcttaggtata

SEQ ID NO: 85811 - DNA, 22 bp, Artificial Sequence
  chemically synthesized
tgtcatttcttaggtatataat

SEQ ID NO: 85812 - DNA, 22 bp, Artificial Sequence
  chemically synthesized
gtcatttcttaggtatataatt

SEQ ID NO: 85813 - DNA, 22 bp, Artificial Sequence
  chemically synthesized
tcatttcttaggtatataattt

SEQ ID NO: 85814 - DNA, 22 bp, Artificial Sequence
  chemically synthesized
cttaggtatataatttttagct

SEQ ID NO: 85815 - DNA, 22 bp, Artificial Sequence
  chemically synthesized
ttaggtatataatttttagctc

SEQ ID NO: 85816 - DNA, 22 bp, Artificial Sequence
  chemically synthesized
aggtatataatttttagctcaa

SEQ ID NO: 85817 - DNA, 22 bp, Artificial Sequence
  chemically synthesized
ggtatataatttttagctcaac

SEQ ID NO: 85818 - DNA, 22 bp, Artificial Sequence
  chemically synthesized
ttagctcaacacttagctgcac

SEQ ID NO: 85819 - DNA, 22 bp, Artificial Sequence
  chemically synthesized
tagctcaacacttagctgcaca

SEQ ID NO: 85820 - DNA, 22 bp, Artificial Sequence
  chemically synthesized
agctcaacacttagctgcacaa

SEQ ID NO: 85821 - DNA, 22 bp, Artificial Sequence
  chemically synthesized
gctcaacacttagctgcacaat

SEQ ID NO: 85822 - DNA, 22 bp, Artificial Sequence
  chemically synthesized
aacacttagctgcacaattttt

SEQ ID NO: 85823 - DNA, 22 bp, Artificial Sequence
  chemically synthesized
agctgcacaatttttaaaaata

SEQ ID NO: 85824 - DNA, 22 bp, Artificial Sequence
  chemically synthesized
gctgcacaatttttaaaaatat

SEQ ID NO: 85825 - DNA, 22 bp, Artificial Sequence
  chemically synthesized
cacaatttttaaaaatattgtt

SEQ ID NO: 85826 - DNA, 22 bp, Artificial Sequence
  chemically synthesized
ttaaaaatattgttggtatgat

SEQ ID NO: 85827 - DNA, 22 bp, Artificial Sequence
  chemically synthesized
taaaaatattgttggtatgatg

SEQ ID NO: 85828 - DNA, 22 bp, Artificial Sequence
  chemically synthesized
aaaaatattgttggtatgatga

SEQ ID NO: 85829 - DNA, 22 bp, Artificial Sequence
  chemically synthesized
aaaatattgttggtatgatgat

SEQ ID NO: 85830 - DNA, 22 bp, Artificial Sequence
  chemically synthesized
ttggtatgatgataatatataa

SEQ ID NO: 85831 - DNA, 22 bp, Artificial Sequence
  chemically synthesized
gtatgatgataatatataaaaa

SEQ ID NO: 85832 - DNA, 22 bp, Artificial Sequence
  chemically synthesized
attatctgccactcaaaagcta

SEQ ID NO: 85833 - DNA, 22 bp, Artificial Sequence
  chemically synthesized
tctgccactcaaaagctatcag

SEQ ID NO: 85834 - DNA, 22 bp, Artificial Sequence
  chemically synthesized
ccactcaaaagctatcagtatt

SEQ ID NO: 85835 - DNA, 22 bp, Artificial Sequence
  chemically synthesized
aaaagctatcagtatttatgat

SEQ ID NO: 85836 - DNA, 22 bp, Artificial Sequence
  chemically synthesized
tcagtatttatgataataattc

SEQ ID NO: 85837 - DNA, 22 bp, Artificial Sequence
  chemically synthesized
atgataataattctagttgtga

SEQ ID NO: 85838 - DNA, 22 bp, Artificial Sequence
  chemically synthesized
tgataataattctagttgtgag

SEQ ID NO: 85839 - DNA, 22 bp, Artificial Sequence
  chemically synthesized
tagttgtgagaaattgattatt

SEQ ID NO: 85840 - DNA, 22 bp, Artificial Sequence
  chemically synthesized
gttgtgagaaattgattattaa

SEQ ID NO: 85841 - DNA, 22 bp, Artificial Sequence
  chemically synthesized
tgagaaattgattattaaatat

SEQ ID NO: 85842 - DNA, 22 bp, Artificial Sequence
  chemically synthesized
attattaaatatatataaggga

SEQ ID NO: 85843 - DNA, 22 bp, Artificial Sequence
  chemically synthesized
ttaaatatatataagggataga

SEQ ID NO: 85844 - DNA, 22 bp, Artificial Sequence
  chemically synthesized
aatatatataagggatagaaga

SEQ ID NO: 85845 - DNA, 22 bp, Artificial Sequence
  chemically synthesized
acaaaattttgtcttggaaatc

SEQ ID NO: 85846 - DNA, 22 bp, Artificial Sequence
  chemically synthesized
tgtcttggaaatctgagtgaac

SEQ ID NO: 85847 - DNA, 22 bp, Artificial Sequence
  chemically synthesized
gtcttggaaatctgagtgaacc

SEQ ID NO: 85848 - DNA, 22 bp, Artificial Sequence
  chemically synthesized
tcttggaaatctgagtgaacca

SEQ ID NO: 85849 - DNA, 22 bp, Artificial Sequence
  chemically synthesized
ggaaatctgagtgaaccattca

SEQ ID NO: 85850 - DNA, 22 bp, Artificial Sequence
  chemically synthesized
gaaatctgagtgaaccattcat

SEQ ID NO: 85851 - DNA, 22 bp, Artificial Sequence
  chemically synthesized
agtgaaccattcatcaagtttg

SEQ ID NO: 85852 - DNA, 22 bp, Artificial Sequence
  chemically synthesized
atcaagtttggaagcattagag

SEQ ID NO: 85853 - DNA, 22 bp, Artificial Sequence
  chemically synthesized
ggaagcattagaggaaactgaa

SEQ ID NO: 85854 - DNA, 22 bp, Artificial Sequence
  chemically synthesized
gaagcattagaggaaactgaaa

SEQ ID NO: 85855 - DNA, 22 bp, Artificial Sequence
  chemically synthesized
gaggaaactgaaagaagtggag

SEQ ID NO: 85856 - DNA, 22 bp, Artificial Sequence
  chemically synthesized
aaagaagtggaggataatttac

SEQ ID NO: 85857 - DNA, 22 bp, Artificial Sequence
  chemically synthesized
actatcttttcaactcgctgag

SEQ ID NO: 85858 - DNA, 22 bp, Artificial Sequence
  chemically synthesized
ctatcttttcaactcgctgagt

SEQ ID NO: 85859 - DNA, 22 bp, Artificial Sequence
  chemically synthesized
tcttttcaactcgctgagttta

SEQ ID NO: 85860 - DNA, 22 bp, Artificial Sequence
  chemically synthesized
ttcaactcgctgagtttaagag

SEQ ID NO: 85861 - DNA, 22 bp, Artificial Sequence
  chemically synthesized
tcaactcgctgagtttaagagg

SEQ ID NO: 85862 - DNA, 22 bp, Artificial Sequence
  chemically synthesized
caactcgctgagtttaagaggt

SEQ ID NO: 85863 - DNA, 22 bp, Artificial Sequence
  chemically synthesized
aactcgctgagtttaagaggtc

SEQ ID NO: 85864 - DNA, 22 bp, Artificial Sequence
  chemically synthesized
gctgagtttaagaggtccatag

SEQ ID NO: 85865 - DNA, 22 bp, Artificial Sequence
  chemically synthesized
agtttaagaggtccataggtca

SEQ ID NO: 85866 - DNA, 22 bp, Artificial Sequence
  chemically synthesized
aagaggtccataggtcatataa

SEQ ID NO: 85867 - DNA, 22 bp, Artificial Sequence
  chemically synthesized
agaggtccataggtcatataag

SEQ ID NO: 85868 - DNA, 22 bp, Artificial Sequence
  chemically synthesized
taagctattgtaacattttttt

SEQ ID NO: 85869 - DNA, 22 bp, Artificial Sequence
  chemically synthesized
ttgtaacatttttttttcatgt

SEQ ID NO: 85870 - DNA, 22 bp, Artificial Sequence
  chemically synthesized
taacatttttttttcatgtccc

SEQ ID NO: 85871 - DNA, 22 bp, Artificial Sequence
  chemically synthesized
ttttttcatgtcccaaaatgtt

SEQ ID NO: 85872 - DNA, 22 bp, Artificial Sequence
  chemically synthesized
tttttcatgtcccaaaatgtta

SEQ ID NO: 85873 - DNA, 22 bp, Artificial Sequence
  chemically synthesized
ttttcatgtcccaaaatgttaa

SEQ ID NO: 85874 - DNA, 22 bp, Artificial Sequence
  chemically synthesized
tttcatgtcccaaaatgttaat

SEQ ID NO: 85875 - DNA, 22 bp, Artificial Sequence
  chemically synthesized
ttcatgtcccaaaatgttaatg

SEQ ID NO: 85876 - DNA, 22 bp, Artificial Sequence
  chemically synthesized
tcatgtcccaaaatgttaatgt

SEQ ID NO: 85877 - DNA, 22 bp, Artificial Sequence
  chemically synthesized
catgtcccaaaatgttaatgta

SEQ ID NO: 85878 - DNA, 22 bp, Artificial Sequence
  chemically synthesized
atgtcccaaaatgttaatgtat

SEQ ID NO: 85879 - DNA, 22 bp, Artificial Sequence
  chemically synthesized
atgtatccctaacagagagcaa

SEQ ID NO: 85880 - DNA, 22 bp, Artificial Sequence
  chemically synthesized
acagagagcaatgaagttcttt

SEQ ID NO: 85881 - DNA, 22 bp, Artificial Sequence
  chemically synthesized
tttttagtggagtttctctttc

SEQ ID NO: 85882 - DNA, 22 bp, Artificial Sequence
  chemically synthesized
tttagtggagtttctctttctt

SEQ ID NO: 85883 - DNA, 22 bp, Artificial Sequence
  chemically synthesized
ttagtggagtttctctttcttg

SEQ ID NO: 85884 - DNA, 22 bp, Artificial Sequence
  chemically synthesized
tagtggagtttctctttcttga

SEQ ID NO: 85885 - DNA, 22 bp, Artificial Sequence
  chemically synthesized
agtggagtttctctttcttgac

SEQ ID NO: 85886 - DNA, 22 bp, Artificial Sequence
  chemically synthesized
gtggagtttctctttcttgaca

SEQ ID NO: 85887 - DNA, 22 bp, Artificial Sequence
  chemically synthesized
ctctttcttgacatagtaccat

SEQ ID NO: 85888 - DNA, 22 bp, Artificial Sequence
  chemically synthesized
tctttcttgacatagtaccatg

SEQ ID NO: 85889 - DNA, 22 bp, Artificial Sequence
  chemically synthesized
tttcttgacatagtaccatgta

SEQ ID NO: 85890 - DNA, 22 bp, Artificial Sequence
  chemically synthesized
tcttgacatagtaccatgtagt

SEQ ID NO: 85891 - DNA, 22 bp, Artificial Sequence
  chemically synthesized
cttgacatagtaccatgtagtg

SEQ ID NO: 85892 - DNA, 22 bp, Artificial Sequence
  chemically synthesized
ttgacatagtaccatgtagtga

SEQ ID NO: 85893 - DNA, 22 bp, Artificial Sequence
  chemically synthesized
gacatagtaccatgtagtgaag

SEQ ID NO: 85894 - DNA, 22 bp, Artificial Sequence
  chemically synthesized
acatagtaccatgtagtgaaga

SEQ ID NO: 85895 - DNA, 22 bp, Artificial Sequence
  chemically synthesized
ctgactttggaattgaaagaat

SEQ ID NO: 85896 - DNA, 22 bp, Artificial Sequence
  chemically synthesized
actttggaattgaaagaatctt

SEQ ID NO: 85897 - DNA, 22 bp, Artificial Sequence
  chemically synthesized
tggaattgaaagaatcttagct

SEQ ID NO: 85898 - DNA, 22 bp, Artificial Sequence
  chemically synthesized
ggaattgaaagaatcttagctc

SEQ ID NO: 85899 - DNA, 22 bp, Artificial Sequence
  chemically synthesized
gaattgaaagaatcttagctca

SEQ ID NO: 85900 - DNA, 22 bp, Artificial Sequence
  chemically synthesized
aaagaatcttagctcagctact

SEQ ID NO: 85901 - DNA, 22 bp, Artificial Sequence
  chemically synthesized
agctcagctacttactagctga

SEQ ID NO: 85902 - DNA, 22 bp, Artificial Sequence
  chemically synthesized
gctcagctacttactagctgag

SEQ ID NO: 85903 - DNA, 22 bp, Artificial Sequence
  chemically synthesized
agctacttactagctgagtagc

SEQ ID NO: 85904 - DNA, 22 bp, Artificial Sequence
  chemically synthesized
cttactagctgagtagctacaa

SEQ ID NO: 85905 - DNA, 22 bp, Artificial Sequence
  chemically synthesized
actagctgagtagctacaacac

SEQ ID NO: 85906 - DNA, 22 bp, Artificial Sequence
  chemically synthesized
ctagctgagtagctacaacacc

SEQ ID NO: 85907 - DNA, 22 bp, Artificial Sequence
  chemically synthesized
gctgagtagctacaacacctta

SEQ ID NO: 85908 - DNA, 22 bp, Artificial Sequence
  chemically synthesized
agtagctacaacaccttaatgc

SEQ ID NO: 85909 - DNA, 22 bp, Artificial Sequence
  chemically synthesized
caacaccttaatgcccatccca

SEQ ID NO: 85910 - DNA, 22 bp, Artificial Sequence
  chemically synthesized
aatgcccatcccaagacagtgt

SEQ ID NO: 85911 - DNA, 22 bp, Artificial Sequence
  chemically synthesized
atgcccatcccaagacagtgtg

SEQ ID NO: 85912 - DNA, 22 bp, Artificial Sequence
  chemically synthesized
aggaagcacaggatgtaccaga

SEQ ID NO: 85913 - DNA, 22 bp, Artificial Sequence
  chemically synthesized
ttcatgttgctttcctaggctt

SEQ ID NO: 85914 - DNA, 22 bp, Artificial Sequence
  chemically synthesized
tcatgttgctttcctaggcttt

SEQ ID NO: 85915 - DNA, 22 bp, Artificial Sequence
  chemically synthesized
catgttgctttcctaggctttt

SEQ ID NO: 85916 - DNA, 22 bp, Artificial Sequence
  chemically synthesized
atgttgctttcctaggcttttt

SEQ ID NO: 85917 - DNA, 22 bp, Artificial Sequence
  chemically synthesized
ctttcctaggctttttatttcc

SEQ ID NO: 85918 - DNA, 22 bp, Artificial Sequence
  chemically synthesized
tcctaggctttttatttccctc

SEQ ID NO: 85919 - DNA, 22 bp, Artificial Sequence
  chemically synthesized
cctaggctttttatttccctcc

SEQ ID NO: 85920 - DNA, 22 bp, Artificial Sequence
  chemically synthesized
ctaggctttttatttccctcct

SEQ ID NO: 85921 - DNA, 22 bp, Artificial Sequence
  chemically synthesized
ggctttttatttccctcctcta

SEQ ID NO: 85922 - DNA, 22 bp, Artificial Sequence
  chemically synthesized
tttatttccctcctctaggtat

SEQ ID NO: 85923 - DNA, 22 bp, Artificial Sequence
  chemically synthesized
ttatttccctcctctaggtatt

SEQ ID NO: 85924 - DNA, 22 bp, Artificial Sequence
  chemically synthesized
tatttccctcctctaggtattt

SEQ ID NO: 85925 - DNA, 22 bp, Artificial Sequence
  chemically synthesized
atttccctcctctaggtatttc

SEQ ID NO: 85926 - DNA, 22 bp, Artificial Sequence
  chemically synthesized
tttccctcctctaggtatttct

SEQ ID NO: 85927 - DNA, 22 bp, Artificial Sequence
  chemically synthesized
ccctcctctaggtatttctgtt

SEQ ID NO: 85928 - DNA, 22 bp, Artificial Sequence
  chemically synthesized
cctcctctaggtatttctgtta

SEQ ID NO: 85929 - DNA, 22 bp, Artificial Sequence
  chemically synthesized
ctctaggtatttctgttatttt

SEQ ID NO: 85930 - DNA, 22 bp, Artificial Sequence
  chemically synthesized
taggtatttctgttattttcct

SEQ ID NO: 85931 - DNA, 22 bp, Artificial Sequence
  chemically synthesized
ggtatttctgttattttccttt

SEQ ID NO: 85932 - DNA, 22 bp, Artificial Sequence
  chemically synthesized
ctgttattttccttttttcatt

SEQ ID NO: 85933 - DNA, 22 bp, Artificial Sequence
  chemically synthesized
tgttattttccttttttcatta

SEQ ID NO: 85934 - DNA, 22 bp, Artificial Sequence
  chemically synthesized
ttattttccttttttcattatt

SEQ ID NO: 85935 - DNA, 22 bp, Artificial Sequence
  chemically synthesized
ttttccttttttcattatttct

SEQ ID NO: 85936 - DNA, 22 bp, Artificial Sequence
  chemically synthesized
tccttttttcattatttcttcc

SEQ ID NO: 85937 - DNA, 22 bp, Artificial Sequence
  chemically synthesized
ccttttttcattatttcttccc

SEQ ID NO: 85938 - DNA, 22 bp, Artificial Sequence
  chemically synthesized
cttttttcattatttcttccct

SEQ ID NO: 85939 - DNA, 22 bp, Artificial Sequence
  chemically synthesized
ttttcattatttcttccctctt

SEQ ID NO: 85940 - DNA, 22 bp, Artificial Sequence
  chemically synthesized
tttcattatttcttccctcttc

SEQ ID NO: 85941 - DNA, 22 bp, Artificial Sequence
  chemically synthesized
ttcattatttcttccctcttct

SEQ ID NO: 85942 - DNA, 22 bp, Artificial Sequence
  chemically synthesized
tcattatttcttccctcttctt

SEQ ID NO: 85943 - DNA, 22 bp, Artificial Sequence
  chemically synthesized
cattatttcttccctcttcttc

SEQ ID NO: 85944 - DNA, 22 bp, Artificial Sequence
  chemically synthesized
attatttcttccctcttcttca

SEQ ID NO: 85945 - DNA, 22 bp, Artificial Sequence
  chemically synthesized
tttcttccctcttcttcaggaa

SEQ ID NO: 85946 - DNA, 22 bp, Artificial Sequence
  chemically synthesized
cttccctcttcttcaggaagtt

SEQ ID NO: 85947 - DNA, 22 bp, Artificial Sequence
  chemically synthesized
ttccctcttcttcaggaagtta

SEQ ID NO: 85948 - DNA, 22 bp, Artificial Sequence
  chemically synthesized
ccctcttcttcaggaagttaag

SEQ ID NO: 85949 - DNA, 22 bp, Artificial Sequence
  chemically synthesized
cctcttcttcaggaagttaaga

SEQ ID NO: 85950 - DNA, 22 bp, Artificial Sequence
  chemically synthesized
ttcttcaggaagttaagacagt

SEQ ID NO: 85951 - DNA, 22 bp, Artificial Sequence
  chemically synthesized
cttcaggaagttaagacagtct

SEQ ID NO: 85952 - DNA, 22 bp, Artificial Sequence
  chemically synthesized
ttcaggaagttaagacagtcta

SEQ ID NO: 85953 - DNA, 22 bp, Artificial Sequence
  chemically synthesized
caggaagttaagacagtctacc

SEQ ID NO: 85954 - DNA, 22 bp, Artificial Sequence
  chemically synthesized
aggaagttaagacagtctacct

SEQ ID NO: 85955 - DNA, 22 bp, Artificial Sequence
  chemically synthesized
agacagtctacctagatttaga

SEQ ID NO: 85956 - DNA, 22 bp, Artificial Sequence
  chemically synthesized
cctagatttagaagcaaatgtt

SEQ ID NO: 85957 - DNA, 22 bp, Artificial Sequence
  chemically synthesized
gatttagaagcaaatgtttata

SEQ ID NO: 85958 - DNA, 22 bp, Artificial Sequence
  chemically synthesized
agaagcaaatgtttatatagtg

SEQ ID NO: 85959 - DNA, 22 bp, Artificial Sequence
  chemically synthesized
gaagcaaatgtttatatagtgg

SEQ ID NO: 85960 - DNA, 22 bp, Artificial Sequence
  chemically synthesized
atatagtggtgaaatttaaagc

SEQ ID NO: 85961 - DNA, 22 bp, Artificial Sequence
  chemically synthesized
tatagtggtgaaatttaaagcc

SEQ ID NO: 85962 - DNA, 22 bp, Artificial Sequence
  chemically synthesized
aaagcctaattgactaaagcca

SEQ ID NO: 85963 - DNA, 22 bp, Artificial Sequence
  chemically synthesized
aagcctaattgactaaagccat

SEQ ID NO: 85964 - DNA, 22 bp, Artificial Sequence
  chemically synthesized
attgactaaagccatttaagaa

SEQ ID NO: 85965 - DNA, 22 bp, Artificial Sequence
  chemically synthesized
actaaagccatttaagaatgta

SEQ ID NO: 85966 - DNA, 22 bp, Artificial Sequence
  chemically synthesized
aagccatttaagaatgtaatat

SEQ ID NO: 85967 - DNA, 22 bp, Artificial Sequence
  chemically synthesized
aagaatgtaatatctcagttag

SEQ ID NO: 85968 - DNA, 22 bp, Artificial Sequence
  chemically synthesized
agaatgtaatatctcagttagt

SEQ ID NO: 85969 - DNA, 22 bp, Artificial Sequence
  chemically synthesized
agttagtatgcacttcttgaaa

SEQ ID NO: 85970 - DNA, 22 bp, Artificial Sequence
  chemically synthesized
gtatgcacttcttgaaatgcaa

SEQ ID NO: 85971 - DNA, 22 bp, Artificial Sequence
  chemically synthesized
cttgaaatgcaaagaaatggtc

SEQ ID NO: 85972 - DNA, 22 bp, Artificial Sequence
  chemically synthesized
ttgaaatgcaaagaaatggtct

SEQ ID NO: 85973 - DNA, 22 bp, Artificial Sequence
  chemically synthesized
gaaatgcaaagaaatggtctga

SEQ ID NO: 85974 - DNA, 22 bp, Artificial Sequence
  chemically synthesized
aaatgcaaagaaatggtctgac

SEQ ID NO: 85975 - DNA, 22 bp, Artificial Sequence
  chemically synthesized
acttttttccattgtttagttt

SEQ ID NO: 85976 - DNA, 22 bp, Artificial Sequence
  chemically synthesized
ttttccattgtttagtttctaa

SEQ ID NO: 85977 - DNA, 22 bp, Artificial Sequence
  chemically synthesized
tttccattgtttagtttctaaa

SEQ ID NO: 85978 - DNA, 22 bp, Artificial Sequence
  chemically synthesized
ttccattgtttagtttctaaat

SEQ ID NO: 85979 - DNA, 22 bp, Artificial Sequence
  chemically synthesized
tccattgtttagtttctaaatt

SEQ ID NO: 85980 - DNA, 22 bp, Artificial Sequence
  chemically synthesized
ccattgtttagtttctaaattt

SEQ ID NO: 85981 - DNA, 22 bp, Artificial Sequence
  chemically synthesized
cattgtttagtttctaaattta

SEQ ID NO: 85982 - DNA, 22 bp, Artificial Sequence
  chemically synthesized
tttagtttctaaatttagtttt

SEQ ID NO: 85983 - DNA, 22 bp, Artificial Sequence
  chemically synthesized
agtttctaaatttagtttttat

SEQ ID NO: 85984 - DNA, 22 bp, Artificial Sequence
  chemically synthesized
gtttctaaatttagtttttatt

SEQ ID NO: 85985 - DNA, 22 bp, Artificial Sequence
  chemically synthesized
ctaaatttagtttttattttaa

SEQ ID NO: 85986 - DNA, 22 bp, Artificial Sequence
  chemically synthesized
taaatttagtttttattttaat

SEQ ID NO: 85987 - DNA, 22 bp, Artificial Sequence
  chemically synthesized
aatttagtttttattttaatat

SEQ ID NO: 85988 - DNA, 22 bp, Artificial Sequence
  chemically synthesized
agtttttattttaatattttaa

SEQ ID NO: 85989 - DNA, 22 bp, Artificial Sequence
  chemically synthesized
gtttttattttaatattttaag

SEQ ID NO: 85990 - DNA, 22 bp, Artificial Sequence
  chemically synthesized
ttattttaatattttaagtaca

SEQ ID NO: 85991 - DNA, 22 bp, Artificial Sequence
  chemically synthesized
tattttaatattttaagtacag

SEQ ID NO: 85992 - DNA, 22 bp, Artificial Sequence
  chemically synthesized
attttaatattttaagtacagc

SEQ ID NO: 85993 - DNA, 22 bp, Artificial Sequence
  chemically synthesized
ttttaatattttaagtacagca

SEQ ID NO: 85994 - DNA, 22 bp, Artificial Sequence
  chemically synthesized
taatattttaagtacagcatgc

SEQ ID NO: 85995 - DNA, 22 bp, Artificial Sequence
  chemically synthesized
aatattttaagtacagcatgca

SEQ ID NO: 85996 - DNA, 22 bp, Artificial Sequence
  chemically synthesized
atattttaagtacagcatgcat

SEQ ID NO: 85997 - DNA, 22 bp, Artificial Sequence
  chemically synthesized
taagtacagcatgcatatataa

SEQ ID NO: 85998 - DNA, 22 bp, Artificial Sequence
  chemically synthesized
aagtacagcatgcatatataaa

SEQ ID NO: 85999 - DNA, 22 bp, Artificial Sequence
  chemically synthesized
agtacagcatgcatatataaaa

SEQ ID NO: 86000 - DNA, 22 bp, Artificial Sequence
  chemically synthesized
tacatgcacagctgaattaact

SEQ ID NO: 86001 - DNA, 22 bp, Artificial Sequence
  chemically synthesized
aattaacttttggaaggtgaac

SEQ ID NO: 86002 - DNA, 22 bp, Artificial Sequence
  chemically synthesized
acttttggaaggtgaacacacc

SEQ ID NO: 86003 - DNA, 22 bp, Artificial Sequence
  chemically synthesized
ttggaaggtgaacacacccatg

SEQ ID NO: 86004 - DNA, 22 bp, Artificial Sequence
  chemically synthesized
tggaaggtgaacacacccatgt

SEQ ID NO: 86005 - DNA, 22 bp, Artificial Sequence
  chemically synthesized
ggaaggtgaacacacccatgta

SEQ ID NO: 86006 - DNA, 22 bp, Artificial Sequence
  chemically synthesized
gaaggtgaacacacccatgtaa

SEQ ID NO: 86007 - DNA, 22 bp, Artificial Sequence
  chemically synthesized
ataagataggaaattaaagagt

SEQ ID NO: 86008 - DNA, 22 bp, Artificial Sequence
  chemically synthesized
aagagtaaacatatgctcactc

SEQ ID NO: 86009 - DNA, 22 bp, Artificial Sequence
  chemically synthesized
actctttatcattccactaatt

SEQ ID NO: 86010 - DNA, 22 bp, Artificial Sequence
  chemically synthesized
tttatcattccactaattgtct

SEQ ID NO: 86011 - DNA, 22 bp, Artificial Sequence
  chemically synthesized
tatcattccactaattgtctcc

SEQ ID NO: 86012 - DNA, 22 bp, Artificial Sequence
  chemically synthesized
atcattccactaattgtctcca

SEQ ID NO: 86013 - DNA, 22 bp, Artificial Sequence
  chemically synthesized
tcattccactaattgtctccaa

SEQ ID NO: 86014 - DNA, 22 bp, Artificial Sequence
  chemically synthesized
cactaattgtctccaaagttaa

SEQ ID NO: 86015 - DNA, 22 bp, Artificial Sequence
  chemically synthesized
attgtctccaaagttaataatt

SEQ ID NO: 86016 - DNA, 22 bp, Artificial Sequence
  chemically synthesized
tctccaaagttaataattatcc

SEQ ID NO: 86017 - DNA, 22 bp, Artificial Sequence
  chemically synthesized
caaagttaataattatcctgat

SEQ ID NO: 86018 - DNA, 22 bp, Artificial Sequence
  chemically synthesized
ataattatcctgatataattca

SEQ ID NO: 86019 - DNA, 22 bp, Artificial Sequence
  chemically synthesized
tcctgatataattcatttttat

SEQ ID NO: 86020 - DNA, 22 bp, Artificial Sequence
  chemically synthesized
atataattcatttttatcacga

SEQ ID NO: 86021 - DNA, 22 bp, Artificial Sequence
  chemically synthesized
atttttatcacgattgactcat

SEQ ID NO: 86022 - DNA, 22 bp, Artificial Sequence
  chemically synthesized
ttatcacgattgactcatgtcc

SEQ ID NO: 86023 - DNA, 22 bp, Artificial Sequence
  chemically synthesized
tatcacgattgactcatgtccc

SEQ ID NO: 86024 - DNA, 22 bp, Artificial Sequence
  chemically synthesized
atcacgattgactcatgtccct

SEQ ID NO: 86025 - DNA, 22 bp, Artificial Sequence
  chemically synthesized
tcacgattgactcatgtccctt

SEQ ID NO: 86026 - DNA, 22 bp, Artificial Sequence
  chemically synthesized
actcatgtccctttttttaaaa

SEQ ID NO: 86027 - DNA, 22 bp, Artificial Sequence
  chemically synthesized
atgtccctttttttaaaagtgt

SEQ ID NO: 86028 - DNA, 22 bp, Artificial Sequence
  chemically synthesized
tttttaaaagtgtgtatacatt

SEQ ID NO: 86029 - DNA, 22 bp, Artificial Sequence
  chemically synthesized
ttttaaaagtgtgtatacattg

SEQ ID NO: 86030 - DNA, 22 bp, Artificial Sequence
  chemically synthesized
tttaaaagtgtgtatacattga

SEQ ID NO: 86031 - DNA, 22 bp, Artificial Sequence
  chemically synthesized
ttaaaagtgtgtatacattgaa

SEQ ID NO: 86032 - DNA, 22 bp, Artificial Sequence
  chemically synthesized
taaaagtgtgtatacattgaat

SEQ ID NO: 86033 - DNA, 22 bp, Artificial Sequence
  chemically synthesized
aaaagtgtgtatacattgaatt

SEQ ID NO: 86034 - DNA, 22 bp, Artificial Sequence
  chemically synthesized
aaagtgtgtatacattgaatta

SEQ ID NO: 86035 - DNA, 22 bp, Artificial Sequence
  chemically synthesized
aattatactgtgttgcttatgt

SEQ ID NO: 86036 - DNA, 22 bp, Artificial Sequence
  chemically synthesized
tactgtgttgcttatgtctgac

SEQ ID NO: 86037 - DNA, 22 bp, Artificial Sequence
  chemically synthesized
tgttgcttatgtctgactttat

SEQ ID NO: 86038 - DNA, 22 bp, Artificial Sequence
  chemically synthesized
cttatgtctgactttattcaat

SEQ ID NO: 86039 - DNA, 22 bp, Artificial Sequence
  chemically synthesized
atgtctgactttattcaatatt

SEQ ID NO: 86040 - DNA, 22 bp, Artificial Sequence
  chemically synthesized
tgtctgactttattcaatatta

SEQ ID NO: 86041 - DNA, 22 bp, Artificial Sequence
  chemically synthesized
actttattcaatattatgtttg

SEQ ID NO: 86042 - DNA, 22 bp, Artificial Sequence
  chemically synthesized
tattcaatattatgtttgtgaa

SEQ ID NO: 86043 - DNA, 22 bp, Artificial Sequence
  chemically synthesized
attcaatattatgtttgtgaat

SEQ ID NO: 86044 - DNA, 22 bp, Artificial Sequence
  chemically synthesized
ttcaatattatgtttgtgaatt

SEQ ID NO: 86045 - DNA, 22 bp, Artificial Sequence
  chemically synthesized
aatattatgtttgtgaattgca

SEQ ID NO: 86046 - DNA, 22 bp, Artificial Sequence
  chemically synthesized
tgtttgtgaattgcattcatac

SEQ ID NO: 86047 - DNA, 22 bp, Artificial Sequence
  chemically synthesized
gtgaattgcattcatactagtg

SEQ ID NO: 86048 - DNA, 22 bp, Artificial Sequence
  chemically synthesized
tgaattgcattcatactagtgt

SEQ ID NO: 86049 - DNA, 22 bp, Artificial Sequence
  chemically synthesized
cattcatactagtgtatgactg

SEQ ID NO: 86050 - DNA, 22 bp, Artificial Sequence
  chemically synthesized
atactagtgtatgactgtagtt

SEQ ID NO: 86051 - DNA, 22 bp, Artificial Sequence
  chemically synthesized
gtgtatgactgtagttgatttt

SEQ ID NO: 86052 - DNA, 22 bp, Artificial Sequence
  chemically synthesized
tagttgatttttcatttctgaa

SEQ ID NO: 86053 - DNA, 22 bp, Artificial Sequence
  chemically synthesized
atttttcatttctgaatgtcat

SEQ ID NO: 86054 - DNA, 22 bp, Artificial Sequence
  chemically synthesized
ttcatttctgaatgtcattcta

SEQ ID NO: 86055 - DNA, 22 bp, Artificial Sequence
  chemically synthesized
tcatttctgaatgtcattctat

SEQ ID NO: 86056 - DNA, 22 bp, Artificial Sequence
  chemically synthesized
catttctgaatgtcattctatt

SEQ ID NO: 86057 - DNA, 22 bp, Artificial Sequence
  chemically synthesized
atttctgaatgtcattctattt

SEQ ID NO: 86058 - DNA, 22 bp, Artificial Sequence
  chemically synthesized
ctgaatgtcattctattttatg

SEQ ID NO: 86059 - DNA, 22 bp, Artificial Sequence
  chemically synthesized
tgaatgtcattctattttatgt

SEQ ID NO: 86060 - DNA, 22 bp, Artificial Sequence
  chemically synthesized
aatgtcattctattttatgtat

SEQ ID NO: 86061 - DNA, 22 bp, Artificial Sequence
  chemically synthesized
tattttatgtatataccacaat

SEQ ID NO: 86062 - DNA, 22 bp, Artificial Sequence
  chemically synthesized
ttttatgtatataccacaatat

SEQ ID NO: 86063 - DNA, 22 bp, Artificial Sequence
  chemically synthesized
tatgtatataccacaatatatt

SEQ ID NO: 86064 - DNA, 22 bp, Artificial Sequence
  chemically synthesized
atgtatataccacaatatattt

SEQ ID NO: 86065 - DNA, 22 bp, Artificial Sequence
  chemically synthesized
tgtatataccacaatatattta

SEQ ID NO: 86066 - DNA, 22 bp, Artificial Sequence
  chemically synthesized
attgactccacagttgatagat

SEQ ID NO: 86067 - DNA, 22 bp, Artificial Sequence
  chemically synthesized
ttgactccacagttgatagata

SEQ ID NO: 86068 - DNA, 22 bp, Artificial Sequence
  chemically synthesized
actccacagttgatagatattt

SEQ ID NO: 86069 - DNA, 22 bp, Artificial Sequence
  chemically synthesized
cacagttgatagatatttgagt

SEQ ID NO: 86070 - DNA, 22 bp, Artificial Sequence
  chemically synthesized
atagatatttgagtaccttcta

SEQ ID NO: 86071 - DNA, 22 bp, Artificial Sequence
  chemically synthesized
gagtaccttctagcttttggct

SEQ ID NO: 86072 - DNA, 22 bp, Artificial Sequence
  chemically synthesized
agtaccttctagcttttggcta

SEQ ID NO: 86073 - DNA, 22 bp, Artificial Sequence
  chemically synthesized
ctagcttttggctataatataa

SEQ ID NO: 86074 - DNA, 22 bp, Artificial Sequence
  chemically synthesized
tagcttttggctataatataaa

SEQ ID NO: 86075 - DNA, 22 bp, Artificial Sequence
  chemically synthesized
gcttttggctataatataaatt

SEQ ID NO: 86076 - DNA, 22 bp, Artificial Sequence
  chemically synthesized
ttggctataatataaattgctg

SEQ ID NO: 86077 - DNA, 22 bp, Artificial Sequence
  chemically synthesized
tggctataatataaattgctgc

SEQ ID NO: 86078 - DNA, 22 bp, Artificial Sequence
  chemically synthesized
ggctataatataaattgctgct

SEQ ID NO: 86079 - DNA, 22 bp, Artificial Sequence
  chemically synthesized
gctataatataaattgctgcta

SEQ ID NO: 86080 - DNA, 22 bp, Artificial Sequence
  chemically synthesized
taatataaattgctgctatgaa

SEQ ID NO: 86081 - DNA, 22 bp, Artificial Sequence
  chemically synthesized
ctgctatgaagattcttatata

SEQ ID NO: 86082 - DNA, 22 bp, Artificial Sequence
  chemically synthesized
ctatgaagattcttatatattt

SEQ ID NO: 86083 - DNA, 22 bp, Artificial Sequence
  chemically synthesized
tgaagattcttatatatttttg

SEQ ID NO: 86084 - DNA, 22 bp, Artificial Sequence
  chemically synthesized
ttatatatttttgtatatatat

SEQ ID NO: 86085 - DNA, 22 bp, Artificial Sequence
  chemically synthesized
atatatttttgtatatatattc

SEQ ID NO: 86086 - DNA, 22 bp, Artificial Sequence
  chemically synthesized
tatatttttgtatatatattct

SEQ ID NO: 86087 - DNA, 22 bp, Artificial Sequence
  chemically synthesized
ttgtatatatattctgtaaatt

SEQ ID NO: 86088 - DNA, 22 bp, Artificial Sequence
  chemically synthesized
tgtatatatattctgtaaattg

SEQ ID NO: 86089 - DNA, 22 bp, Artificial Sequence
  chemically synthesized
gtatatatattctgtaaattgc

SEQ ID NO: 86090 - DNA, 22 bp, Artificial Sequence
  chemically synthesized
tatatatattctgtaaattgct

SEQ ID NO: 86091 - DNA, 22 bp, Artificial Sequence
  chemically synthesized
tgtaaattgctaggtcataaaa

SEQ ID NO: 86092 - DNA, 22 bp, Artificial Sequence
  chemically synthesized
taaattgctaggtcataaaata

SEQ ID NO: 86093 - DNA, 22 bp, Artificial Sequence
  chemically synthesized
ctaggtcataaaatatgcatat

SEQ ID NO: 86094 - DNA, 22 bp, Artificial Sequence
  chemically synthesized
ggtcataaaatatgcatatgtt

SEQ ID NO: 86095 - DNA, 22 bp, Artificial Sequence
  chemically synthesized
aactttaaaatacactgccaac

SEQ ID NO: 86096 - DNA, 22 bp, Artificial Sequence
  chemically synthesized
taaaatacactgccaacctgtt

SEQ ID NO: 86097 - DNA, 22 bp, Artificial Sequence
  chemically synthesized
aaaatacactgccaacctgttt

SEQ ID NO: 86098 - DNA, 22 bp, Artificial Sequence
  chemically synthesized
aaatacactgccaacctgttta

SEQ ID NO: 86099 - DNA, 22 bp, Artificial Sequence
  chemically synthesized
ccaacctgtttacctccccact

SEQ ID NO: 86100 - DNA, 22 bp, Artificial Sequence
  chemically synthesized
tttacctccccactataattta

SEQ ID NO: 86101 - DNA, 22 bp, Artificial Sequence
  chemically synthesized
acctccccactataatttaatg

SEQ ID NO: 86102 - DNA, 22 bp, Artificial Sequence
  chemically synthesized
cctccccactataatttaatgt

SEQ ID NO: 86103 - DNA, 22 bp, Artificial Sequence
  chemically synthesized
cccactataatttaatgtcatt

SEQ ID NO: 86104 - DNA, 22 bp, Artificial Sequence
  chemically synthesized
taatttaatgtcatttggtcaa

SEQ ID NO: 86105 - DNA, 22 bp, Artificial Sequence
  chemically synthesized
aatgtcatttggtcaacctata

SEQ ID NO: 86106 - DNA, 22 bp, Artificial Sequence
  chemically synthesized
atgtcatttggtcaacctataa

SEQ ID NO: 86107 - DNA, 22 bp, Artificial Sequence
  chemically synthesized
ggtcaacctataatatcataga

SEQ ID NO: 86108 - DNA, 22 bp, Artificial Sequence
  chemically synthesized
gtcaacctataatatcatagat

SEQ ID NO: 86109 - DNA, 22 bp, Artificial Sequence
  chemically synthesized
taatatcatagatgttttctct

SEQ ID NO: 86110 - DNA, 22 bp, Artificial Sequence
  chemically synthesized
tctcttatagcagcctgcatgt

SEQ ID NO: 86111 - DNA, 22 bp, Artificial Sequence
  chemically synthesized
ctcttatagcagcctgcatgtg

SEQ ID NO: 86112 - DNA, 22 bp, Artificial Sequence
  chemically synthesized
tcttatagcagcctgcatgtgc

SEQ ID NO: 86113 - DNA, 22 bp, Artificial Sequence
  chemically synthesized
ttatagcagcctgcatgtgccc

SEQ ID NO: 86114 - DNA, 22 bp, Artificial Sequence
  chemically synthesized
atagcagcctgcatgtgcccag

SEQ ID NO: 86115 - DNA, 22 bp, Artificial Sequence
  chemically synthesized
tagcagcctgcatgtgcccaga

SEQ ID NO: 86116 - DNA, 22 bp, Artificial Sequence
  chemically synthesized
catgtgcccagattttgaattt

SEQ ID NO: 86117 - DNA, 22 bp, Artificial Sequence
  chemically synthesized
tgaatttatcctttgtatattt

SEQ ID NO: 86118 - DNA, 22 bp, Artificial Sequence
  chemically synthesized
gaatttatcctttgtatattta

SEQ ID NO: 86119 - DNA, 22 bp, Artificial Sequence
  chemically synthesized
aatttatcctttgtatatttac

SEQ ID NO: 86120 - DNA, 22 bp, Artificial Sequence
  chemically synthesized
atcctttgtatatttacattta

SEQ ID NO: 86121 - DNA, 22 bp, Artificial Sequence
  chemically synthesized
tcctttgtatatttacatttag

SEQ ID NO: 86122 - DNA, 22 bp, Artificial Sequence
  chemically synthesized
tgtatatttacatttagttctg

SEQ ID NO: 86123 - DNA, 22 bp, Artificial Sequence
  chemically synthesized
gtatatttacatttagttctgt

SEQ ID NO: 86124 - DNA, 22 bp, Artificial Sequence
  chemically synthesized
tatatttacatttagttctgta

SEQ ID NO: 86125 - DNA, 22 bp, Artificial Sequence
  chemically synthesized
acatttagttctgtattattac

SEQ ID NO: 86126 - DNA, 22 bp, Artificial Sequence
  chemically synthesized
catttagttctgtattattaca

SEQ ID NO: 86127 - DNA, 22 bp, Artificial Sequence
  chemically synthesized
agttctgtattattacaattag

SEQ ID NO: 86128 - DNA, 22 bp, Artificial Sequence
  chemically synthesized
gttctgtattattacaattagt

SEQ ID NO: 86129 - DNA, 22 bp, Artificial Sequence
  chemically synthesized
tgtattattacaattagttcgt

SEQ ID NO: 86130 - DNA, 22 bp, Artificial Sequence
  chemically synthesized
tattattacaattagttcgtag

SEQ ID NO: 86131 - DNA, 22 bp, Artificial Sequence
  chemically synthesized
ttacaattagttcgtagacctg

SEQ ID NO: 86132 - DNA, 22 bp, Artificial Sequence
  chemically synthesized
caattagttcgtagacctgtta

SEQ ID NO: 86133 - DNA, 22 bp, Artificial Sequence
  chemically synthesized
gttcgtagacctgttattatta

SEQ ID NO: 86134 - DNA, 22 bp, Artificial Sequence
  chemically synthesized
gtagacctgttattattattct

SEQ ID NO: 86135 - DNA, 22 bp, Artificial Sequence
  chemically synthesized
ttattattattctcatttgtag

SEQ ID NO: 86136 - DNA, 22 bp, Artificial Sequence
  chemically synthesized
ttattattctcatttgtagttg

SEQ ID NO: 86137 - DNA, 22 bp, Artificial Sequence
  chemically synthesized
ttattctcatttgtagttgaag

SEQ ID NO: 86138 - DNA, 22 bp, Artificial Sequence
  chemically synthesized
ttctcatttgtagttgaagaaa

SEQ ID NO: 86139 - DNA, 22 bp, Artificial Sequence
  chemically synthesized
tcatttgtagttgaagaaattg

SEQ ID NO: 86140 - DNA, 22 bp, Artificial Sequence
  chemically synthesized
atttgtagttgaagaaattgca

SEQ ID NO: 86141 - DNA, 22 bp, Artificial Sequence
  chemically synthesized
gtagttgaagaaattgcactcc

SEQ ID NO: 86142 - DNA, 22 bp, Artificial Sequence
  chemically synthesized
tagttgaagaaattgcactcca

SEQ ID NO: 86143 - DNA, 22 bp, Artificial Sequence
  chemically synthesized
aagaaattgcactccagcaagt

SEQ ID NO: 86144 - DNA, 22 bp, Artificial Sequence
  chemically synthesized
cactccagcaagtttaaattgc

SEQ ID NO: 86145 - DNA, 22 bp, Artificial Sequence
  chemically synthesized
cagcaagtttaaattgctcctg

SEQ ID NO: 86146 - DNA, 22 bp, Artificial Sequence
  chemically synthesized
aaattgctcctggctacatccc

SEQ ID NO: 86147 - DNA, 22 bp, Artificial Sequence
  chemically synthesized
aattgctcctggctacatccca

SEQ ID NO: 86148 - DNA, 22 bp, Artificial Sequence
  chemically synthesized
ctcctggctacatcccagaaaa

SEQ ID NO: 86149 - DNA, 22 bp, Artificial Sequence
  chemically synthesized
ctggctacatcccagaaaaaca

SEQ ID NO: 86150 - DNA, 22 bp, Artificial Sequence
  chemically synthesized
gctacatcccagaaaaacaata

SEQ ID NO: 86151 - DNA, 22 bp, Artificial Sequence
  chemically synthesized
catcccagaaaaacaataataa

SEQ ID NO: 86152 - DNA, 22 bp, Artificial Sequence
  chemically synthesized
tttgcccctacttgactaggaa

SEQ ID NO: 86153 - DNA, 22 bp, Artificial Sequence
  chemically synthesized
ttgcccctacttgactaggaat

SEQ ID NO: 86154 - DNA, 22 bp, Artificial Sequence
  chemically synthesized
tgcccctacttgactaggaatt

SEQ ID NO: 86155 - DNA, 22 bp, Artificial Sequence
  chemically synthesized
gcccctacttgactaggaattg

SEQ ID NO: 86156 - DNA, 22 bp, Artificial Sequence
  chemically synthesized
cccctacttgactaggaattgt

SEQ ID NO: 86157 - DNA, 22 bp, Artificial Sequence
  chemically synthesized
cttgactaggaattgtataaag

SEQ ID NO: 86158 - DNA, 22 bp, Artificial Sequence
  chemically synthesized
gactaggaattgtataaagaga

SEQ ID NO: 86159 - DNA, 22 bp, Artificial Sequence
  chemically synthesized
actaggaattgtataaagagaa

SEQ ID NO: 86160 - DNA, 22 bp, Artificial Sequence
  chemically synthesized
ggaattgtataaagagaacagt

SEQ ID NO: 86161 - DNA, 22 bp, Artificial Sequence
  chemically synthesized
tataaagagaacagttattctt

SEQ ID NO: 86162 - DNA, 22 bp, Artificial Sequence
  chemically synthesized
ttcttctagtgggaagcaagct

SEQ ID NO: 86163 - DNA, 22 bp, Artificial Sequence
  chemically synthesized
ttctagtgggaagcaagctggc

SEQ ID NO: 86164 - DNA, 22 bp, Artificial Sequence
  chemically synthesized
ctagtgggaagcaagctggcct

SEQ ID NO: 86165 - DNA, 22 bp, Artificial Sequence
  chemically synthesized
tagtgggaagcaagctggcctc

SEQ ID NO: 86166 - DNA, 22 bp, Artificial Sequence
  chemically synthesized
gtgggaagcaagctggcctcaa

SEQ ID NO: 86167 - DNA, 22 bp, Artificial Sequence
  chemically synthesized
gcctcaactggaacagaatgag

SEQ ID NO: 86168 - DNA, 22 bp, Artificial Sequence
  chemically synthesized
aactggaacagaatgagagaaa

SEQ ID NO: 86169 - DNA, 22 bp, Artificial Sequence
  chemically synthesized
gaacagaatgagagaaatgcaa

SEQ ID NO: 86170 - DNA, 22 bp, Artificial Sequence
  chemically synthesized
ataatccaacagtcccacaccc

SEQ ID NO: 86171 - DNA, 22 bp, Artificial Sequence
  chemically synthesized
aatgtactttttccttttcccc

SEQ ID NO: 86172 - DNA, 22 bp, Artificial Sequence
  chemically synthesized
tttccttttccccatggagtca

SEQ ID NO: 86173 - DNA, 22 bp, Artificial Sequence
  chemically synthesized
ttccttttccccatggagtcaa

SEQ ID NO: 86174 - DNA, 22 bp, Artificial Sequence
  chemically synthesized
tccttttccccatggagtcaag

SEQ ID NO: 86175 - DNA, 22 bp, Artificial Sequence
  chemically synthesized
ccttttccccatggagtcaagg

SEQ ID NO: 86176 - DNA, 22 bp, Artificial Sequence
  chemically synthesized
cttttccccatggagtcaaggc

SEQ ID NO: 86177 - DNA, 22 bp, Artificial Sequence
  chemically synthesized
ttccccatggagtcaaggctat

SEQ ID NO: 86178 - DNA, 22 bp, Artificial Sequence
  chemically synthesized
tccccatggagtcaaggctatc

SEQ ID NO: 86179 - DNA, 22 bp, Artificial Sequence
  chemically synthesized
ccccatggagtcaaggctatct

SEQ ID NO: 86180 - DNA, 22 bp, Artificial Sequence
  chemically synthesized
cccatggagtcaaggctatcta

SEQ ID NO: 86181 - DNA, 22 bp, Artificial Sequence
  chemically synthesized
tctaaacttcctttaagtgcac

SEQ ID NO: 86182 - DNA, 22 bp, Artificial Sequence
  chemically synthesized
aacttcctttaagtgcacaagc

SEQ ID NO: 86183 - DNA, 22 bp, Artificial Sequence
  chemically synthesized
cctttaagtgcacaagctaata

SEQ ID NO: 86184 - DNA, 22 bp, Artificial Sequence
  chemically synthesized
ctttaagtgcacaagctaatat

SEQ ID NO: 86185 - DNA, 22 bp, Artificial Sequence
  chemically synthesized
taagtgcacaagctaatatggt

SEQ ID NO: 86186 - DNA, 22 bp, Artificial Sequence
  chemically synthesized
aagtgcacaagctaatatggta

SEQ ID NO: 86187 - DNA, 22 bp, Artificial Sequence
  chemically synthesized
agtgcacaagctaatatggtag

SEQ ID NO: 86188 - DNA, 22 bp, Artificial Sequence
  chemically synthesized
atatggtagggaaatataaagc

SEQ ID NO: 86189 - DNA, 22 bp, Artificial Sequence
  chemically synthesized
atcctgccatccagaatgagca

SEQ ID NO: 86190 - DNA, 22 bp, Artificial Sequence
  chemically synthesized
ccatccagaatgagcaagtgga

SEQ ID NO: 86191 - DNA, 22 bp, Artificial Sequence
  chemically synthesized
ccaagtctgacctaatgccctc

SEQ ID NO: 86192 - DNA, 22 bp, Artificial Sequence
  chemically synthesized
acctaatgccctctgtttctcc

SEQ ID NO: 86193 - DNA, 22 bp, Artificial Sequence
  chemically synthesized
atgccctctgtttctcccactt

SEQ ID NO: 86194 - DNA, 22 bp, Artificial Sequence
  chemically synthesized
tgtttctcccacttgctctgca

SEQ ID NO: 86195 - DNA, 22 bp, Artificial Sequence
  chemically synthesized
tttctcccacttgctctgcagg

SEQ ID NO: 86196 - DNA, 22 bp, Artificial Sequence
  chemically synthesized
ctcccacttgctctgcaggatg

SEQ ID NO: 86197 - DNA, 22 bp, Artificial Sequence
  chemically synthesized
tcccacttgctctgcaggatgg

SEQ ID NO: 86198 - DNA, 22 bp, Artificial Sequence
  chemically synthesized
ccacttgctctgcaggatggct

SEQ ID NO: 86199 - DNA, 22 bp, Artificial Sequence
  chemically synthesized
gctctgcaggatggcttagcag

SEQ ID NO: 86200 - DNA, 22 bp, Artificial Sequence
  chemically synthesized
ctctgcaggatggcttagcagc

SEQ ID NO: 86201 - DNA, 22 bp, Artificial Sequence
  chemically synthesized
tgcaggatggcttagcagctcc

SEQ ID NO: 86202 - DNA, 22 bp, Artificial Sequence
  chemically synthesized
caggatggcttagcagctccca

SEQ ID NO: 86203 - DNA, 22 bp, Artificial Sequence
  chemically synthesized
agcagctcccagctcagggcct

SEQ ID NO: 86204 - DNA, 22 bp, Artificial Sequence
  chemically synthesized
gcagctcccagctcagggccta

SEQ ID NO: 86205 - DNA, 22 bp, Artificial Sequence
  chemically synthesized
ccagctcagggcctatcagagg

SEQ ID NO: 86206 - DNA, 22 bp, Artificial Sequence
  chemically synthesized
agggcctatcagaggctgagaa

SEQ ID NO: 86207 - DNA, 22 bp, Artificial Sequence
  chemically synthesized
tcagaggctgagaaggtcggcc

SEQ ID NO: 86208 - DNA, 22 bp, Artificial Sequence
  chemically synthesized
agaaggtcggccctctgatgca

SEQ ID NO: 86209 - DNA, 22 bp, Artificial Sequence
  chemically synthesized
tgatgcattttattccttcact

SEQ ID NO: 86210 - DNA, 22 bp, Artificial Sequence
  chemically synthesized
atgcattttattccttcactaa

SEQ ID NO: 86211 - DNA, 22 bp, Artificial Sequence
  chemically synthesized
tattccttcactaacaaagcaa

SEQ ID NO: 86212 - DNA, 22 bp, Artificial Sequence
  chemically synthesized
attccttcactaacaaagcaaa

SEQ ID NO: 86213 - DNA, 22 bp, Artificial Sequence
  chemically synthesized
ttccttcactaacaaagcaaac

SEQ ID NO: 86214 - DNA, 22 bp, Artificial Sequence
  chemically synthesized
cttcactaacaaagcaaaccca

SEQ ID NO: 86215 - DNA, 22 bp, Artificial Sequence
  chemically synthesized
cactaacaaagcaaacccagct

SEQ ID NO: 86216 - DNA, 22 bp, Artificial Sequence
  chemically synthesized
actaacaaagcaaacccagctt

SEQ ID NO: 86217 - DNA, 22 bp, Artificial Sequence
  chemically synthesized
acaaagcaaacccagctttact

SEQ ID NO: 86218 - DNA, 22 bp, Artificial Sequence
  chemically synthesized
tacttctaccctctcctctatg

SEQ ID NO: 86219 - DNA, 22 bp, Artificial Sequence
  chemically synthesized
acttctaccctctcctctatgc

SEQ ID NO: 86220 - DNA, 22 bp, Artificial Sequence
  chemically synthesized
cttctaccctctcctctatgca

SEQ ID NO: 86221 - DNA, 22 bp, Artificial Sequence
  chemically synthesized
ctaccctctcctctatgcactc

SEQ ID NO: 86222 - DNA, 22 bp, Artificial Sequence
  chemically synthesized
taccctctcctctatgcactct

SEQ ID NO: 86223 - DNA, 22 bp, Artificial Sequence
  chemically synthesized
ccctctcctctatgcactctct

SEQ ID NO: 86224 - DNA, 22 bp, Artificial Sequence
  chemically synthesized
tcctctatgcactctctcgggg

SEQ ID NO: 86225 - DNA, 22 bp, Artificial Sequence
  chemically synthesized
ctctatgcactctctcggggca

SEQ ID NO: 86226 - DNA, 22 bp, Artificial Sequence
  chemically synthesized
tatgcactctctcggggcactt

SEQ ID NO: 86227 - DNA, 22 bp, Artificial Sequence
  chemically synthesized
tgcactctctcggggcacttcc

SEQ ID NO: 86228 - DNA, 22 bp, Artificial Sequence
  chemically synthesized
tctcggggcacttcctaatctc

SEQ ID NO: 86229 - DNA, 22 bp, Artificial Sequence
  chemically synthesized
tcggggcacttcctaatctcgt

SEQ ID NO: 86230 - DNA, 22 bp, Artificial Sequence
  chemically synthesized
ggggcacttcctaatctcgtta

SEQ ID NO: 86231 - DNA, 22 bp, Artificial Sequence
  chemically synthesized
cctaatctcgttagtacctttt

SEQ ID NO: 86232 - DNA, 22 bp, Artificial Sequence
  chemically synthesized
ctaatctcgttagtaccttttg

SEQ ID NO: 86233 - DNA, 22 bp, Artificial Sequence
  chemically synthesized
atctcgttagtaccttttgaat

SEQ ID NO: 86234 - DNA, 22 bp, Artificial Sequence
  chemically synthesized
gttagtaccttttgaattagtt

SEQ ID NO: 86235 - DNA, 22 bp, Artificial Sequence
  chemically synthesized
gtaccttttgaattagttttca

SEQ ID NO: 86236 - DNA, 22 bp, Artificial Sequence
  chemically synthesized
ttgaattagttttcaagatagg

SEQ ID NO: 86237 - DNA, 22 bp, Artificial Sequence
  chemically synthesized
tgaattagttttcaagatagga

SEQ ID NO: 86238 - DNA, 22 bp, Artificial Sequence
  chemically synthesized
gaattagttttcaagataggac

SEQ ID NO: 86239 - DNA, 22 bp, Artificial Sequence
  chemically synthesized
aattagttttcaagataggact

SEQ ID NO: 86240 - DNA, 22 bp, Artificial Sequence
  chemically synthesized
gttttcaagataggacttgagt

SEQ ID NO: 86241 - DNA, 22 bp, Artificial Sequence
  chemically synthesized
tcaagataggacttgagttcct

SEQ ID NO: 86242 - DNA, 22 bp, Artificial Sequence
  chemically synthesized
caagataggacttgagttcctc

SEQ ID NO: 86243 - DNA, 22 bp, Artificial Sequence
  chemically synthesized
aagataggacttgagttcctcg

SEQ ID NO: 86244 - DNA, 22 bp, Artificial Sequence
  chemically synthesized
gagttcctcgaaggattagaaa

SEQ ID NO: 86245 - DNA, 22 bp, Artificial Sequence
  chemically synthesized
agttcctcgaaggattagaaaa

SEQ ID NO: 86246 - DNA, 22 bp, Artificial Sequence
  chemically synthesized
ctcgaaggattagaaaataaca

SEQ ID NO: 86247 - DNA, 22 bp, Artificial Sequence
  chemically synthesized
gaaggattagaaaataacagta

SEQ ID NO: 86248 - DNA, 22 bp, Artificial Sequence
  chemically synthesized
gaaaataacagtaacagttcat

SEQ ID NO: 86249 - DNA, 22 bp, Artificial Sequence
  chemically synthesized
atgttgtctgggccaagcacag

SEQ ID NO: 86250 - DNA, 22 bp, Artificial Sequence
  chemically synthesized
tctgggccaagcacagtggctc

SEQ ID NO: 86251 - DNA, 22 bp, Artificial Sequence
  chemically synthesized
ggccaagcacagtggctcacac

SEQ ID NO: 86252 - DNA, 22 bp, Artificial Sequence
  chemically synthesized
acacctgtaatcacagccgagg

SEQ ID NO: 86253 - DNA, 22 bp, Artificial Sequence
  chemically synthesized
taatcacagccgaggccggagg

SEQ ID NO: 86254 - DNA, 22 bp, Artificial Sequence
  chemically synthesized
gagctcaggagttggagaccag

SEQ ID NO: 86255 - DNA, 22 bp, Artificial Sequence
  chemically synthesized
agctcaggagttggagaccagc

SEQ ID NO: 86256 - DNA, 22 bp, Artificial Sequence
  chemically synthesized
aggagttggagaccagcttggg

SEQ ID NO: 86257 - DNA, 22 bp, Artificial Sequence
  chemically synthesized
gagaccagcttgggcaacatgg

SEQ ID NO: 86258 - DNA, 22 bp, Artificial Sequence
  chemically synthesized
gggcaacatggagaaacccctc

SEQ ID NO: 86259 - DNA, 22 bp, Artificial Sequence
  chemically synthesized
ggcaacatggagaaacccctct

SEQ ID NO: 86260 - DNA, 22 bp, Artificial Sequence
  chemically synthesized
tctacaaaaaattttaaaaagt

SEQ ID NO: 86261 - DNA, 22 bp, Artificial Sequence
  chemically synthesized
tacaaaaaattttaaaaagtag

SEQ ID NO: 86262 - DNA, 22 bp, Artificial Sequence
  chemically synthesized
caaaaaattttaaaaagtagcc

SEQ ID NO: 86263 - DNA, 22 bp, Artificial Sequence
  chemically synthesized
taaaaagtagccgaatatggtg

SEQ ID NO: 86264 - DNA, 22 bp, Artificial Sequence
  chemically synthesized
aaaaagtagccgaatatggtgt

SEQ ID NO: 86265 - DNA, 22 bp, Artificial Sequence
  chemically synthesized
aaaagtagccgaatatggtgtt

SEQ ID NO: 86266 - DNA, 22 bp, Artificial Sequence
  chemically synthesized
cgtgcctgtagtcccagctact

SEQ ID NO: 86267 - DNA, 22 bp, Artificial Sequence
  chemically synthesized
tagtcccagctacttgggaggc

SEQ ID NO: 86268 - DNA, 22 bp, Artificial Sequence
  chemically synthesized
cttgggaggctgaggtggaagg

SEQ ID NO: 86269 - DNA, 22 bp, Artificial Sequence
  chemically synthesized
gggaggctgaggtggaaggata

SEQ ID NO: 86270 - DNA, 22 bp, Artificial Sequence
  chemically synthesized
ggaggctgaggtggaaggatat

SEQ ID NO: 86271 - DNA, 22 bp, Artificial Sequence
  chemically synthesized
aggtggaaggatatcttgagcc

SEQ ID NO: 86272 - DNA, 22 bp, Artificial Sequence
  chemically synthesized
gagccaaggagggggagattgc

SEQ ID NO: 86273 - DNA, 22 bp, Artificial Sequence
  chemically synthesized
agccaaggagggggagattgca

SEQ ID NO: 86274 - DNA, 22 bp, Artificial Sequence
  chemically synthesized
cagtgagcaaagattgtaccac

SEQ ID NO: 86275 - DNA, 22 bp, Artificial Sequence
  chemically synthesized
taccactgcactccaacctggg

SEQ ID NO: 86276 - DNA, 22 bp, Artificial Sequence
  chemically synthesized
cactccaacctgggcaacacag

SEQ ID NO: 86277 - DNA, 22 bp, Artificial Sequence
  chemically synthesized
caacctgggcaacacagcgaga

SEQ ID NO: 86278 - DNA, 22 bp, Artificial Sequence
  chemically synthesized
ggcaacacagcgagaccctgtc

SEQ ID NO: 86279 - DNA, 22 bp, Artificial Sequence
  chemically synthesized
tcaaaaaaaaaaaaaagagagc

SEQ ID NO: 86280 - DNA, 22 bp, Artificial Sequence
  chemically synthesized
gaaagaaagaaattaacaattc

SEQ ID NO: 86281 - DNA, 22 bp, Artificial Sequence
  chemically synthesized
acaattcaggttgtcagaagta

SEQ ID NO: 86282 - DNA, 22 bp, Artificial Sequence
  chemically synthesized
aggttgtcagaagtaactgaat

SEQ ID NO: 86283 - DNA, 22 bp, Artificial Sequence
  chemically synthesized
tcagaagtaactgaatgtcttt

SEQ ID NO: 86284 - DNA, 22 bp, Artificial Sequence
  chemically synthesized
aatgtctttaacaaataggagc

SEQ ID NO: 86285 - DNA, 22 bp, Artificial Sequence
  chemically synthesized
taacaaataggagccataggac

SEQ ID NO: 86286 - DNA, 22 bp, Artificial Sequence
  chemically synthesized
aacaaataggagccataggact

SEQ ID NO: 86287 - DNA, 22 bp, Artificial Sequence
  chemically synthesized
acaaataggagccataggacta

SEQ ID NO: 86288 - DNA, 22 bp, Artificial Sequence
  chemically synthesized
aattgctcacattattttgagg

SEQ ID NO: 86289 - DNA, 22 bp, Artificial Sequence
  chemically synthesized
ctcacattattttgagggcaaa

SEQ ID NO: 86290 - DNA, 22 bp, Artificial Sequence
  chemically synthesized
acattattttgagggcaaaaat

SEQ ID NO: 86291 - DNA, 22 bp, Artificial Sequence
  chemically synthesized
ttttgagggcaaaaattacatt

SEQ ID NO: 86292 - DNA, 22 bp, Artificial Sequence
  chemically synthesized
tgagggcaaaaattacattgtc

SEQ ID NO: 86293 - DNA, 22 bp, Artificial Sequence
  chemically synthesized
gagggcaaaaattacattgtca

SEQ ID NO: 86294 - DNA, 22 bp, Artificial Sequence
  chemically synthesized
agggcaaaaattacattgtcat

SEQ ID NO: 86295 - DNA, 22 bp, Artificial Sequence
  chemically synthesized
cattgtcattattttttacctc

SEQ ID NO: 86296 - DNA, 22 bp, Artificial Sequence
  chemically synthesized
tcattattttttacctccaaca

SEQ ID NO: 86297 - DNA, 22 bp, Artificial Sequence
  chemically synthesized
ttttttacctccaacatatata

SEQ ID NO: 86298 - DNA, 22 bp, Artificial Sequence
  chemically synthesized
tttacctccaacatatatacag

SEQ ID NO: 86299 - DNA, 22 bp, Artificial Sequence
  chemically synthesized
ttacctccaacatatatacagt

SEQ ID NO: 86300 - DNA, 22 bp, Artificial Sequence
  chemically synthesized
tacctccaacatatatacagtt

SEQ ID NO: 86301 - DNA, 22 bp, Artificial Sequence
  chemically synthesized
acctccaacatatatacagttt

SEQ ID NO: 86302 - DNA, 22 bp, Artificial Sequence
  chemically synthesized
cctccaacatatatacagtttt

SEQ ID NO: 86303 - DNA, 22 bp, Artificial Sequence
  chemically synthesized
caacatatatacagtttttata

SEQ ID NO: 86304 - DNA, 22 bp, Artificial Sequence
  chemically synthesized
ttatatttactatataggaaca

SEQ ID NO: 86305 - DNA, 22 bp, Artificial Sequence
  chemically synthesized
tatatttactatataggaacac

SEQ ID NO: 86306 - DNA, 22 bp, Artificial Sequence
  chemically synthesized
atatttactatataggaacaca

SEQ ID NO: 86307 - DNA, 22 bp, Artificial Sequence
  chemically synthesized
tatttactatataggaacacaa

SEQ ID NO: 86308 - DNA, 22 bp, Artificial Sequence
  chemically synthesized
actatataggaacacaataaat

SEQ ID NO: 86309 - DNA, 22 bp, Artificial Sequence
  chemically synthesized
ctatataggaacacaataaatg

SEQ ID NO: 86310 - DNA, 22 bp, Artificial Sequence
  chemically synthesized
tataggaacacaataaatgctt

SEQ ID NO: 86311 - DNA, 22 bp, Artificial Sequence
  chemically synthesized
gttgcataaaatcaaattacaa

SEQ ID NO: 86312 - DNA, 22 bp, Artificial Sequence
  chemically synthesized
ttgcataaaatcaaattacaaa

SEQ ID NO: 86313 - DNA, 22 bp, Artificial Sequence
  chemically synthesized
cataaaatcaaattacaaagaa

SEQ ID NO: 86314 - DNA, 22 bp, Artificial Sequence
  chemically synthesized
caaagaaggacagagaatcatt

SEQ ID NO: 86315 - DNA, 22 bp, Artificial Sequence
  chemically synthesized
aattactttcataatgcgcata

SEQ ID NO: 86316 - DNA, 22 bp, Artificial Sequence
  chemically synthesized
ctttcataatgcgcataaaaca

SEQ ID NO: 86317 - DNA, 22 bp, Artificial Sequence
  chemically synthesized
tcataatgcgcataaaacaaca

SEQ ID NO: 86318 - DNA, 22 bp, Artificial Sequence
  chemically synthesized
cataatgcgcataaaacaacat

SEQ ID NO: 86319 - DNA, 22 bp, Artificial Sequence
  chemically synthesized
ataatgcgcataaaacaacatt

SEQ ID NO: 86320 - DNA, 22 bp, Artificial Sequence
  chemically synthesized
tgttagacttaaaaacaagctg

SEQ ID NO: 86321 - DNA, 22 bp, Artificial Sequence
  chemically synthesized
gttagacttaaaaacaagctga

SEQ ID NO: 86322 - DNA, 22 bp, Artificial Sequence
  chemically synthesized
ttagacttaaaaacaagctgat

SEQ ID NO: 86323 - DNA, 22 bp, Artificial Sequence
  chemically synthesized
gacttaaaaacaagctgattat

SEQ ID NO: 86324 - DNA, 22 bp, Artificial Sequence
  chemically synthesized
aaaaacaagctgattataacta

SEQ ID NO: 86325 - DNA, 22 bp, Artificial Sequence
  chemically synthesized
aaaacaagctgattataactat

SEQ ID NO: 86326 - DNA, 22 bp, Artificial Sequence
  chemically synthesized
attataactataaaaagatatg

SEQ ID NO: 86327 - DNA, 22 bp, Artificial Sequence
  chemically synthesized
taactataaaaagatatgtgac

SEQ ID NO: 86328 - DNA, 22 bp, Artificial Sequence
  chemically synthesized
taaaaagatatgtgactaatag

SEQ ID NO: 86329 - DNA, 22 bp, Artificial Sequence
  chemically synthesized
ataggtggaaagaggagcaagg

SEQ ID NO: 86330 - DNA, 22 bp, Artificial Sequence
  chemically synthesized
ctaaagactcacgatggtttgt

SEQ ID NO: 86331 - DNA, 22 bp, Artificial Sequence
  chemically synthesized
aagactcacgatggtttgttac

SEQ ID NO: 86332 - DNA, 22 bp, Artificial Sequence
  chemically synthesized
acgatggtttgttacatagcta

SEQ ID NO: 86333 - DNA, 22 bp, Artificial Sequence
  chemically synthesized
gttacatagctaaacacatgtc

SEQ ID NO: 86334 - DNA, 22 bp, Artificial Sequence
  chemically synthesized
ttacatagctaaacacatgtca

SEQ ID NO: 86335 - DNA, 22 bp, Artificial Sequence
  chemically synthesized
catagctaaacacatgtcatgg

SEQ ID NO: 86336 - DNA, 22 bp, Artificial Sequence
  chemically synthesized
aacacatgtcatgggtttgtcg

SEQ ID NO: 86337 - DNA, 22 bp, Artificial Sequence
  chemically synthesized
gtcgtacagattatttcatctc

SEQ ID NO: 86338 - DNA, 22 bp, Artificial Sequence
  chemically synthesized
tcgtacagattatttcatctcc

SEQ ID NO: 86339 - DNA, 22 bp, Artificial Sequence
  chemically synthesized
tttcatctcccagtactcaata

SEQ ID NO: 86340 - DNA, 22 bp, Artificial Sequence
  chemically synthesized
catctcccagtactcaatagtt

SEQ ID NO: 86341 - DNA, 22 bp, Artificial Sequence
  chemically synthesized
atctcccagtactcaatagtta

SEQ ID NO: 86342 - DNA, 22 bp, Artificial Sequence
  chemically synthesized
ccagtactcaatagttactttt

SEQ ID NO: 86343 - DNA, 22 bp, Artificial Sequence
  chemically synthesized
aatagttactttttctgctctt

SEQ ID NO: 86344 - DNA, 22 bp, Artificial Sequence
  chemically synthesized
ctttttctgctcttctccccgt

SEQ ID NO: 86345 - DNA, 22 bp, Artificial Sequence
  chemically synthesized
tttctgctcttctccccgttcc

SEQ ID NO: 86346 - DNA, 22 bp, Artificial Sequence
  chemically synthesized
ttctgctcttctccccgttccc

SEQ ID NO: 86347 - DNA, 22 bp, Artificial Sequence
  chemically synthesized
tctgctcttctccccgttccca

SEQ ID NO: 86348 - DNA, 22 bp, Artificial Sequence
  chemically synthesized
ctgctcttctccccgttcccac

SEQ ID NO: 86349 - DNA, 22 bp, Artificial Sequence
  chemically synthesized
tgctcttctccccgttcccacc

SEQ ID NO: 86350 - DNA, 22 bp, Artificial Sequence
  chemically synthesized
ctcttctccccgttcccaccct

SEQ ID NO: 86351 - DNA, 22 bp, Artificial Sequence
  chemically synthesized
ttctccccgttcccaccctcca

SEQ ID NO: 86352 - DNA, 22 bp, Artificial Sequence
  chemically synthesized
ctccccgttcccaccctccaaa

SEQ ID NO: 86353 - DNA, 22 bp, Artificial Sequence
  chemically synthesized
tccccgttcccaccctccaaac

SEQ ID NO: 86354 - DNA, 22 bp, Artificial Sequence
  chemically synthesized
cccgttcccaccctccaaactc

SEQ ID NO: 86355 - DNA, 22 bp, Artificial Sequence
  chemically synthesized
ccaccctccaaactcaattagg

SEQ ID NO: 86356 - DNA, 22 bp, Artificial Sequence
  chemically synthesized
caaactcaattaggctgcagtg

SEQ ID NO: 86357 - DNA, 22 bp, Artificial Sequence
  chemically synthesized
aattaggctgcagtgtcttttg

SEQ ID NO: 86358 - DNA, 22 bp, Artificial Sequence
  chemically synthesized
ggctgcagtgtcttttgttccc

SEQ ID NO: 86359 - DNA, 22 bp, Artificial Sequence
  chemically synthesized
cagtgtcttttgttcccgttat

SEQ ID NO: 86360 - DNA, 22 bp, Artificial Sequence
  chemically synthesized
ttgttcccgttatgtgtgcatg

SEQ ID NO: 86361 - DNA, 22 bp, Artificial Sequence
  chemically synthesized
tgttcccgttatgtgtgcatgt

SEQ ID NO: 86362 - DNA, 22 bp, Artificial Sequence
  chemically synthesized
gttcccgttatgtgtgcatgtt

SEQ ID NO: 86363 - DNA, 22 bp, Artificial Sequence
  chemically synthesized
ttcccgttatgtgtgcatgttt

SEQ ID NO: 86364 - DNA, 22 bp, Artificial Sequence
  chemically synthesized
ccgttatgtgtgcatgttttct

SEQ ID NO: 86365 - DNA, 22 bp, Artificial Sequence
  chemically synthesized
tgtgtgcatgttttctcatcat

SEQ ID NO: 86366 - DNA, 22 bp, Artificial Sequence
  chemically synthesized
tctcatcatttagttcctactt

SEQ ID NO: 86367 - DNA, 22 bp, Artificial Sequence
  chemically synthesized
ctcatcatttagttcctacttg

SEQ ID NO: 86368 - DNA, 22 bp, Artificial Sequence
  chemically synthesized
tcatcatttagttcctacttgt

SEQ ID NO: 86369 - DNA, 22 bp, Artificial Sequence
  chemically synthesized
atcatttagttcctacttgtaa

SEQ ID NO: 86370 - DNA, 22 bp, Artificial Sequence
  chemically synthesized
agttcctacttgtaagtgataa

SEQ ID NO: 86371 - DNA, 22 bp, Artificial Sequence
  chemically synthesized
gttcctacttgtaagtgataat

SEQ ID NO: 86372 - DNA, 22 bp, Artificial Sequence
  chemically synthesized
ctacttgtaagtgataatatgt

SEQ ID NO: 86373 - DNA, 22 bp, Artificial Sequence
  chemically synthesized
cttgtaagtgataatatgtagt

SEQ ID NO: 86374 - DNA, 22 bp, Artificial Sequence
  chemically synthesized
gtaagtgataatatgtagtatt

SEQ ID NO: 86375 - DNA, 22 bp, Artificial Sequence
  chemically synthesized
taagtgataatatgtagtattt

SEQ ID NO: 86376 - DNA, 22 bp, Artificial Sequence
  chemically synthesized
ggttttctgttcttacattagt

SEQ ID NO: 86377 - DNA, 22 bp, Artificial Sequence
  chemically synthesized
gttttctgttcttacattagtt

SEQ ID NO: 86378 - DNA, 22 bp, Artificial Sequence
  chemically synthesized
tctgttcttacattagtttgtt

SEQ ID NO: 86379 - DNA, 22 bp, Artificial Sequence
  chemically synthesized
ctgttcttacattagtttgtta

SEQ ID NO: 86380 - DNA, 22 bp, Artificial Sequence
  chemically synthesized
tgttcttacattagtttgttaa

SEQ ID NO: 86381 - DNA, 22 bp, Artificial Sequence
  chemically synthesized
ttcttacattagtttgttaagg

SEQ ID NO: 86382 - DNA, 22 bp, Artificial Sequence
  chemically synthesized
ttacattagtttgttaaggata

SEQ ID NO: 86383 - DNA, 22 bp, Artificial Sequence
  chemically synthesized
acattagtttgttaaggataat

SEQ ID NO: 86384 - DNA, 22 bp, Artificial Sequence
  chemically synthesized
cattagtttgttaaggataatg

SEQ ID NO: 86385 - DNA, 22 bp, Artificial Sequence
  chemically synthesized
gtttgttaaggataatggtgtc

SEQ ID NO: 86386 - DNA, 22 bp, Artificial Sequence
  chemically synthesized
gttaaggataatggtgtccggc

SEQ ID NO: 86387 - DNA, 22 bp, Artificial Sequence
  chemically synthesized
ttaaggataatggtgtccggct

SEQ ID NO: 86388 - DNA, 22 bp, Artificial Sequence
  chemically synthesized
aggataatggtgtccggctcca

SEQ ID NO: 86389 - DNA, 22 bp, Artificial Sequence
  chemically synthesized
catccatgttcctgcaaaggac

SEQ ID NO: 86390 - DNA, 22 bp, Artificial Sequence
  chemically synthesized
ctgcaaaggacatgatctcatt

SEQ ID NO: 86391 - DNA, 22 bp, Artificial Sequence
  chemically synthesized
caaaggacatgatctcattctt

SEQ ID NO: 86392 - DNA, 22 bp, Artificial Sequence
  chemically synthesized
attcttttttatggccacatag

SEQ ID NO: 86393 - DNA, 22 bp, Artificial Sequence
  chemically synthesized
ttttttatggccacatagtatt

SEQ ID NO: 86394 - DNA, 22 bp, Artificial Sequence
  chemically synthesized
ttttatggccacatagtattcc

SEQ ID NO: 86395 - DNA, 22 bp, Artificial Sequence
  chemically synthesized
tttatggccacatagtattcca

SEQ ID NO: 86396 - DNA, 22 bp, Artificial Sequence
  chemically synthesized
ttatggccacatagtattccat

SEQ ID NO: 86397 - DNA, 22 bp, Artificial Sequence
  chemically synthesized
tatggccacatagtattccatg

SEQ ID NO: 86398 - DNA, 22 bp, Artificial Sequence
  chemically synthesized
atggccacatagtattccatgg

SEQ ID NO: 86399 - DNA, 22 bp, Artificial Sequence
  chemically synthesized
tggccacatagtattccatggt

SEQ ID NO: 86400 - DNA, 22 bp, Artificial Sequence
  chemically synthesized
catggtgtatatgtacatgttc

SEQ ID NO: 86401 - DNA, 22 bp, Artificial Sequence
  chemically synthesized
tttatcggtataccactaatgg

SEQ ID NO: 86402 - DNA, 22 bp, Artificial Sequence
  chemically synthesized
tatcggtataccactaatgggc

SEQ ID NO: 86403 - DNA, 22 bp, Artificial Sequence
  chemically synthesized
atcggtataccactaatgggcc

SEQ ID NO: 86404 - DNA, 22 bp, Artificial Sequence
  chemically synthesized
tcggtataccactaatgggcct

SEQ ID NO: 86405 - DNA, 22 bp, Artificial Sequence
  chemically synthesized
atgggccttcaggttgattcta

SEQ ID NO: 86406 - DNA, 22 bp, Artificial Sequence
  chemically synthesized
caggttgattctatgtctttgc

SEQ ID NO: 86407 - DNA, 22 bp, Artificial Sequence
  chemically synthesized
aggttgattctatgtctttgct

SEQ ID NO: 86408 - DNA, 22 bp, Artificial Sequence
  chemically synthesized
attctatgtctttgctattgtg

SEQ ID NO: 86409 - DNA, 22 bp, Artificial Sequence
  chemically synthesized
tatgtctttgctattgtgatta

SEQ ID NO: 86410 - DNA, 22 bp, Artificial Sequence
  chemically synthesized
tgtctttgctattgtgattatg

SEQ ID NO: 86411 - DNA, 22 bp, Artificial Sequence
  chemically synthesized
tgctattgtgattatgctgcaa

SEQ ID NO: 86412 - DNA, 22 bp, Artificial Sequence
  chemically synthesized
gctattgtgattatgctgcaat

SEQ ID NO: 86413 - DNA, 22 bp, Artificial Sequence
  chemically synthesized
ctattgtgattatgctgcaatg

SEQ ID NO: 86414 - DNA, 22 bp, Artificial Sequence
  chemically synthesized
ttgtgattatgctgcaatggac

SEQ ID NO: 86415 - DNA, 22 bp, Artificial Sequence
  chemically synthesized
tgattatgctgcaatggacaca

SEQ ID NO: 86416 - DNA, 22 bp, Artificial Sequence
  chemically synthesized
tgctgcaatggacacaggtgtg

SEQ ID NO: 86417 - DNA, 22 bp, Artificial Sequence
  chemically synthesized
caatggacacaggtgtgcatgt

SEQ ID NO: 86418 - DNA, 22 bp, Artificial Sequence
  chemically synthesized
tgtgatagaatggtttattttc

SEQ ID NO: 86419 - DNA, 22 bp, Artificial Sequence
  chemically synthesized
gtgatagaatggtttattttcc

SEQ ID NO: 86420 - DNA, 22 bp, Artificial Sequence
  chemically synthesized
tgatagaatggtttattttcct

SEQ ID NO: 86421 - DNA, 22 bp, Artificial Sequence
  chemically synthesized
attttcctttaggtatatactc

SEQ ID NO: 86422 - DNA, 22 bp, Artificial Sequence
  chemically synthesized
ttttcctttaggtatatactca

SEQ ID NO: 86423 - DNA, 22 bp, Artificial Sequence
  chemically synthesized
tcctttaggtatatactcaata

SEQ ID NO: 86424 - DNA, 22 bp, Artificial Sequence
  chemically synthesized
cctttaggtatatactcaataa

SEQ ID NO: 86425 - DNA, 22 bp, Artificial Sequence
  chemically synthesized
ctttaggtatatactcaataat

SEQ ID NO: 86426 - DNA, 22 bp, Artificial Sequence
  chemically synthesized
taggtatatactcaataatagg

SEQ ID NO: 86427 - DNA, 22 bp, Artificial Sequence
  chemically synthesized
aggtatatactcaataatagga

SEQ ID NO: 86428 - DNA, 22 bp, Artificial Sequence
  chemically synthesized
ggtatatactcaataataggat

SEQ ID NO: 86429 - DNA, 22 bp, Artificial Sequence
  chemically synthesized
aataataggattgttgggttaa

SEQ ID NO: 86430 - DNA, 22 bp, Artificial Sequence
  chemically synthesized
ttgggttaaatggtatttctgt

SEQ ID NO: 86431 - DNA, 22 bp, Artificial Sequence
  chemically synthesized
ggttaaatggtatttctgtttt

SEQ ID NO: 86432 - DNA, 22 bp, Artificial Sequence
  chemically synthesized
aatggtatttctgtttttaggt

SEQ ID NO: 86433 - DNA, 22 bp, Artificial Sequence
  chemically synthesized
ctgtttttaggtctttagggaa

SEQ ID NO: 86434 - DNA, 22 bp, Artificial Sequence
  chemically synthesized
tgtttttaggtctttagggaat

SEQ ID NO: 86435 - DNA, 22 bp, Artificial Sequence
  chemically synthesized
tttttaggtctttagggaattg

SEQ ID NO: 86436 - DNA, 22 bp, Artificial Sequence
  chemically synthesized
ttaggtctttagggaattgcca

SEQ ID NO: 86437 - DNA, 22 bp, Artificial Sequence
  chemically synthesized
taggtctttagggaattgccac

SEQ ID NO: 86438 - DNA, 22 bp, Artificial Sequence
  chemically synthesized
aggtctttagggaattgccaca

SEQ ID NO: 86439 - DNA, 22 bp, Artificial Sequence
  chemically synthesized
ggtctttagggaattgccacac

SEQ ID NO: 86440 - DNA, 22 bp, Artificial Sequence
  chemically synthesized
tagggaattgccacactgctgt

SEQ ID NO: 86441 - DNA, 22 bp, Artificial Sequence
  chemically synthesized
agggaattgccacactgctgtc

SEQ ID NO: 86442 - DNA, 22 bp, Artificial Sequence
  chemically synthesized
gggaattgccacactgctgtct

SEQ ID NO: 86443 - DNA, 22 bp, Artificial Sequence
  chemically synthesized
ccacactgctgtctacaatggt

SEQ ID NO: 86444 - DNA, 22 bp, Artificial Sequence
  chemically synthesized
ctgtctacaatggtcgaactaa

SEQ ID NO: 86445 - DNA, 22 bp, Artificial Sequence
  chemically synthesized
tctacaatggtcgaactaattt

SEQ ID NO: 86446 - DNA, 22 bp, Artificial Sequence
  chemically synthesized
caatggtcgaactaatttatat

SEQ ID NO: 86447 - DNA, 22 bp, Artificial Sequence
  chemically synthesized
atttatattgccaccaatggtg

SEQ ID NO: 86448 - DNA, 22 bp, Artificial Sequence
  chemically synthesized
atattgccaccaatggtgtata

SEQ ID NO: 86449 - DNA, 22 bp, Artificial Sequence
  chemically synthesized
tattgccaccaatggtgtataa

SEQ ID NO: 86450 - DNA, 22 bp, Artificial Sequence
  chemically synthesized
ccaccaatggtgtataaacatt

SEQ ID NO: 86451 - DNA, 22 bp, Artificial Sequence
  chemically synthesized
ccttttctccacaaccttaccc

SEQ ID NO: 86452 - DNA, 22 bp, Artificial Sequence
  chemically synthesized
ttctccacaaccttacccacat

SEQ ID NO: 86453 - DNA, 22 bp, Artificial Sequence
  chemically synthesized
tctccacaaccttacccacatc

SEQ ID NO: 86454 - DNA, 22 bp, Artificial Sequence
  chemically synthesized
ctccacaaccttacccacatct

SEQ ID NO: 86455 - DNA, 22 bp, Artificial Sequence
  chemically synthesized
tccacaaccttacccacatctg

SEQ ID NO: 86456 - DNA, 22 bp, Artificial Sequence
  chemically synthesized
cacaaccttacccacatctgtt

SEQ ID NO: 86457 - DNA, 22 bp, Artificial Sequence
  chemically synthesized
acccacatctgttattttttga

SEQ ID NO: 86458 - DNA, 22 bp, Artificial Sequence
  chemically synthesized
cccacatctgttattttttgac

SEQ ID NO: 86459 - DNA, 22 bp, Artificial Sequence
  chemically synthesized
ttattttttgactatttaatta

SEQ ID NO: 86460 - DNA, 22 bp, Artificial Sequence
  chemically synthesized
ttttttgactatttaattatag

SEQ ID NO: 86461 - DNA, 22 bp, Artificial Sequence
  chemically synthesized
tttgactatttaattatagata

SEQ ID NO: 86462 - DNA, 22 bp, Artificial Sequence
  chemically synthesized
ttgactatttaattatagatat

SEQ ID NO: 86463 - DNA, 22 bp, Artificial Sequence
  chemically synthesized
tgactatttaattatagatatt

SEQ ID NO: 86464 - DNA, 22 bp, Artificial Sequence
  chemically synthesized
gactatttaattatagatattt

SEQ ID NO: 86465 - DNA, 22 bp, Artificial Sequence
  chemically synthesized
actatttaattatagatatttt

SEQ ID NO: 86466 - DNA, 22 bp, Artificial Sequence
  chemically synthesized
tttaattatagatattttaagt

SEQ ID NO: 86467 - DNA, 22 bp, Artificial Sequence
  chemically synthesized
aattatagatattttaagtgat

SEQ ID NO: 86468 - DNA, 22 bp, Artificial Sequence
  chemically synthesized
attatagatattttaagtgatg

SEQ ID NO: 86469 - DNA, 22 bp, Artificial Sequence
  chemically synthesized
tagatattttaagtgatgtgag

SEQ ID NO: 86470 - DNA, 22 bp, Artificial Sequence
  chemically synthesized
taagtgatgtgagatagtatct

SEQ ID NO: 86471 - DNA, 22 bp, Artificial Sequence
  chemically synthesized
aagtgatgtgagatagtatctc

SEQ ID NO: 86472 - DNA, 22 bp, Artificial Sequence
  chemically synthesized
agtgatgtgagatagtatctca

SEQ ID NO: 86473 - DNA, 22 bp, Artificial Sequence
  chemically synthesized
attttgggtttgattggcattt

SEQ ID NO: 86474 - DNA, 22 bp, Artificial Sequence
  chemically synthesized
tgggtttgattggcatttctct

SEQ ID NO: 86475 - DNA, 22 bp, Artificial Sequence
  chemically synthesized
gggtttgattggcatttctcta

SEQ ID NO: 86476 - DNA, 22 bp, Artificial Sequence
  chemically synthesized
ggtttgattggcatttctctaa

SEQ ID NO: 86477 - DNA, 22 bp, Artificial Sequence
  chemically synthesized
gattggcatttctctaatgatc

SEQ ID NO: 86478 - DNA, 22 bp, Artificial Sequence
  chemically synthesized
attggcatttctctaatgatca

SEQ ID NO: 86479 - DNA, 22 bp, Artificial Sequence
  chemically synthesized
gcatttctctaatgatcagtga

SEQ ID NO: 86480 - DNA, 22 bp, Artificial Sequence
  chemically synthesized
ctctaatgatcagtgacactga

SEQ ID NO: 86481 - DNA, 22 bp, Artificial Sequence
  chemically synthesized
tctaatgatcagtgacactgag

SEQ ID NO: 86482 - DNA, 22 bp, Artificial Sequence
  chemically synthesized
taatgatcagtgacactgagct

SEQ ID NO: 86483 - DNA, 22 bp, Artificial Sequence
  chemically synthesized
atgatcagtgacactgagcttt

SEQ ID NO: 86484 - DNA, 22 bp, Artificial Sequence
  chemically synthesized
agcttttttcatatgcttggtg

SEQ ID NO: 86485 - DNA, 22 bp, Artificial Sequence
  chemically synthesized
ttttcatatgcttggtggccac

SEQ ID NO: 86486 - DNA, 22 bp, Artificial Sequence
  chemically synthesized
tttcatatgcttggtggccaca

SEQ ID NO: 86487 - DNA, 22 bp, Artificial Sequence
  chemically synthesized
ttcatatgcttggtggccacat

SEQ ID NO: 86488 - DNA, 22 bp, Artificial Sequence
  chemically synthesized
tcatatgcttggtggccacatg

SEQ ID NO: 86489 - DNA, 22 bp, Artificial Sequence
  chemically synthesized
catatgcttggtggccacatgt

SEQ ID NO: 86490 - DNA, 22 bp, Artificial Sequence
  chemically synthesized
atatgcttggtggccacatgta

SEQ ID NO: 86491 - DNA, 22 bp, Artificial Sequence
  chemically synthesized
ggtggccacatgtatgtcttct

SEQ ID NO: 86492 - DNA, 22 bp, Artificial Sequence
  chemically synthesized
gtggccacatgtatgtcttctt

SEQ ID NO: 86493 - DNA, 22 bp, Artificial Sequence
  chemically synthesized
cttttgaatactgtctgttcat

SEQ ID NO: 86494 - DNA, 22 bp, Artificial Sequence
  chemically synthesized
ttttgaatactgtctgttcatg

SEQ ID NO: 86495 - DNA, 22 bp, Artificial Sequence
  chemically synthesized
ttgaatactgtctgttcatgtc

SEQ ID NO: 86496 - DNA, 22 bp, Artificial Sequence
  chemically synthesized
tgaatactgtctgttcatgtcc

SEQ ID NO: 86497 - DNA, 22 bp, Artificial Sequence
  chemically synthesized
gaatactgtctgttcatgtcct

SEQ ID NO: 86498 - DNA, 22 bp, Artificial Sequence
  chemically synthesized
aatactgtctgttcatgtcctt

SEQ ID NO: 86499 - DNA, 22 bp, Artificial Sequence
  chemically synthesized
tctgttcatgtcctttacccat

SEQ ID NO: 86500 - DNA, 22 bp, Artificial Sequence
  chemically synthesized
ttcatgtcctttacccattttt

SEQ ID NO: 86501 - DNA, 22 bp, Artificial Sequence
  chemically synthesized
atgtcctttacccattttttgt

SEQ ID NO: 86502 - DNA, 22 bp, Artificial Sequence
  chemically synthesized
tacccattttttgtggcattgt

SEQ ID NO: 86503 - DNA, 22 bp, Artificial Sequence
  chemically synthesized
acccattttttgtggcattgtt

SEQ ID NO: 86504 - DNA, 22 bp, Artificial Sequence
  chemically synthesized
cccattttttgtggcattgttt

SEQ ID NO: 86505 - DNA, 22 bp, Artificial Sequence
  chemically synthesized
tttgtggcattgtttgttttgt

SEQ ID NO: 86506 - DNA, 22 bp, Artificial Sequence
  chemically synthesized
ttgtggcattgtttgttttgtt

SEQ ID NO: 86507 - DNA, 22 bp, Artificial Sequence
  chemically synthesized
tgtggcattgtttgttttgttc

SEQ ID NO: 86508 - DNA, 22 bp, Artificial Sequence
  chemically synthesized
gtggcattgtttgttttgttct

SEQ ID NO: 86509 - DNA, 22 bp, Artificial Sequence
  chemically synthesized
tggcattgtttgttttgttctt

SEQ ID NO: 86510 - DNA, 22 bp, Artificial Sequence
  chemically synthesized
tttgttttgttcttgtagattc

SEQ ID NO: 86511 - DNA, 22 bp, Artificial Sequence
  chemically synthesized
gttttgttcttgtagattcatt

SEQ ID NO: 86512 - DNA, 22 bp, Artificial Sequence
  chemically synthesized
ttttgttcttgtagattcattt

SEQ ID NO: 86513 - DNA, 22 bp, Artificial Sequence
  chemically synthesized
tgttcttgtagattcatttaag

SEQ ID NO: 86514 - DNA, 22 bp, Artificial Sequence
  chemically synthesized
gttcttgtagattcatttaagt

SEQ ID NO: 86515 - DNA, 22 bp, Artificial Sequence
  chemically synthesized
ttcttgtagattcatttaagtt

SEQ ID NO: 86516 - DNA, 22 bp, Artificial Sequence
  chemically synthesized
ttgtagattcatttaagttcct

SEQ ID NO: 86517 - DNA, 22 bp, Artificial Sequence
  chemically synthesized
gtagattcatttaagttcctta

SEQ ID NO: 86518 - DNA, 22 bp, Artificial Sequence
  chemically synthesized
tagattcatttaagttccttat

SEQ ID NO: 86519 - DNA, 22 bp, Artificial Sequence
  chemically synthesized
atttaagttccttatagattct

SEQ ID NO: 86520 - DNA, 22 bp, Artificial Sequence
  chemically synthesized
aagttccttatagattctgaat

SEQ ID NO: 86521 - DNA, 22 bp, Artificial Sequence
  chemically synthesized
agttccttatagattctgaata

SEQ ID NO: 86522 - DNA, 22 bp, Artificial Sequence
  chemically synthesized
cttatagattctgaatattagg

SEQ ID NO: 86523 - DNA, 22 bp, Artificial Sequence
  chemically synthesized
atagattctgaatattaggcct

SEQ ID NO: 86524 - DNA, 22 bp, Artificial Sequence
  chemically synthesized
tagattctgaatattaggcctt

SEQ ID NO: 86525 - DNA, 22 bp, Artificial Sequence
  chemically synthesized
tgaatattaggcctttgttgga

SEQ ID NO: 86526 - DNA, 22 bp, Artificial Sequence
  chemically synthesized
aatattaggcctttgttggatg

SEQ ID NO: 86527 - DNA, 22 bp, Artificial Sequence
  chemically synthesized
ggcctttgttggatgcatagtt

SEQ ID NO: 86528 - DNA, 22 bp, Artificial Sequence
  chemically synthesized
tgttggatgcatagtttgcaaa

SEQ ID NO: 86529 - DNA, 22 bp, Artificial Sequence
  chemically synthesized
gttggatgcatagtttgcaaaa

SEQ ID NO: 86530 - DNA, 22 bp, Artificial Sequence
  chemically synthesized
ttggatgcatagtttgcaaaaa

SEQ ID NO: 86531 - DNA, 22 bp, Artificial Sequence
  chemically synthesized
gatgcatagtttgcaaaaattt

SEQ ID NO: 86532 - DNA, 22 bp, Artificial Sequence
  chemically synthesized
gcaaaaattttctcccattcta

SEQ ID NO: 86533 - DNA, 22 bp, Artificial Sequence
  chemically synthesized
caaaaattttctcccattctat

SEQ ID NO: 86534 - DNA, 22 bp, Artificial Sequence
  chemically synthesized
tctcccattctataggttgttt

SEQ ID NO: 86535 - DNA, 22 bp, Artificial Sequence
  chemically synthesized
ctcccattctataggttgttta

SEQ ID NO: 86536 - DNA, 22 bp, Artificial Sequence
  chemically synthesized
tcccattctataggttgtttac

SEQ ID NO: 86537 - DNA, 22 bp, Artificial Sequence
  chemically synthesized
ccattctataggttgtttactc

SEQ ID NO: 86538 - DNA, 22 bp, Artificial Sequence
  chemically synthesized
tataggttgtttactcagttga

SEQ ID NO: 86539 - DNA, 22 bp, Artificial Sequence
  chemically synthesized
taggttgtttactcagttgata

SEQ ID NO: 86540 - DNA, 22 bp, Artificial Sequence
  chemically synthesized
tttactcagttgatagtttctt

SEQ ID NO: 86541 - DNA, 22 bp, Artificial Sequence
  chemically synthesized
actcagttgatagtttcttttg

SEQ ID NO: 86542 - DNA, 22 bp, Artificial Sequence
  chemically synthesized
ctcagttgatagtttcttttgc

SEQ ID NO: 86543 - DNA, 22 bp, Artificial Sequence
  chemically synthesized
agttgatagtttcttttgctgt

SEQ ID NO: 86544 - DNA, 22 bp, Artificial Sequence
  chemically synthesized
atagtttcttttgctgtgcaga

SEQ ID NO: 86545 - DNA, 22 bp, Artificial Sequence
  chemically synthesized
cttttgctgtgcagaaacttta

SEQ ID NO: 86546 - DNA, 22 bp, Artificial Sequence
  chemically synthesized
ttttgctgtgcagaaactttat

SEQ ID NO: 86547 - DNA, 22 bp, Artificial Sequence
  chemically synthesized
ttgctgtgcagaaactttattt

SEQ ID NO: 86548 - DNA, 22 bp, Artificial Sequence
  chemically synthesized
tgctgtgcagaaactttatttt

SEQ ID NO: 86549 - DNA, 22 bp, Artificial Sequence
  chemically synthesized
gctgtgcagaaactttatttta

SEQ ID NO: 86550 - DNA, 22 bp, Artificial Sequence
  chemically synthesized
ctgtgcagaaactttattttaa

SEQ ID NO: 86551 - DNA, 22 bp, Artificial Sequence
  chemically synthesized
tgcagaaactttattttaatta

SEQ ID NO: 86552 - DNA, 22 bp, Artificial Sequence
  chemically synthesized
tattttaattagatcctatttg

SEQ ID NO: 86553 - DNA, 22 bp, Artificial Sequence
  chemically synthesized
attttaattagatcctatttgt

SEQ ID NO: 86554 - DNA, 22 bp, Artificial Sequence
  chemically synthesized
ttttaattagatcctatttgtc

SEQ ID NO: 86555 - DNA, 22 bp, Artificial Sequence
  chemically synthesized
taattagatcctatttgtcaat

SEQ ID NO: 86556 - DNA, 22 bp, Artificial Sequence
  chemically synthesized
aattagatcctatttgtcaatt

SEQ ID NO: 86557 - DNA, 22 bp, Artificial Sequence
  chemically synthesized
attagatcctatttgtcaattt

SEQ ID NO: 86558 - DNA, 22 bp, Artificial Sequence
  chemically synthesized
gatcctatttgtcaatttttgc

SEQ ID NO: 86559 - DNA, 22 bp, Artificial Sequence
  chemically synthesized
tttgtcaatttttgcttttgct

SEQ ID NO: 86560 - DNA, 22 bp, Artificial Sequence
  chemically synthesized
gtcaatttttgcttttgctgca

SEQ ID NO: 86561 - DNA, 22 bp, Artificial Sequence
  chemically synthesized
tcaatttttgcttttgctgcaa

SEQ ID NO: 86562 - DNA, 22 bp, Artificial Sequence
  chemically synthesized
ttgcttttgctgcaatgactgt

SEQ ID NO: 86563 - DNA, 22 bp, Artificial Sequence
  chemically synthesized
tgcttttgctgcaatgactgtt

SEQ ID NO: 86564 - DNA, 22 bp, Artificial Sequence
  chemically synthesized
gcttttgctgcaatgactgttg

SEQ ID NO: 86565 - DNA, 22 bp, Artificial Sequence
  chemically synthesized
cttttgctgcaatgactgttgg

SEQ ID NO: 86566 - DNA, 22 bp, Artificial Sequence
  chemically synthesized
ttgctgcaatgactgttggcat

SEQ ID NO: 86567 - DNA, 22 bp, Artificial Sequence
  chemically synthesized
tgctgcaatgactgttggcatc

SEQ ID NO: 86568 - DNA, 22 bp, Artificial Sequence
  chemically synthesized
gctgcaatgactgttggcatct

SEQ ID NO: 86569 - DNA, 22 bp, Artificial Sequence
  chemically synthesized
ctgcaatgactgttggcatctt

SEQ ID NO: 86570 - DNA, 22 bp, Artificial Sequence
  chemically synthesized
caatgactgttggcatctttgt

SEQ ID NO: 86571 - DNA, 22 bp, Artificial Sequence
  chemically synthesized
ttggcatctttgtcatgaaatc

SEQ ID NO: 86572 - DNA, 22 bp, Artificial Sequence
  chemically synthesized
gcatctttgtcatgaaatcttt

SEQ ID NO: 86573 - DNA, 22 bp, Artificial Sequence
  chemically synthesized
tgtcatgaaatctttgcccctg

SEQ ID NO: 86574 - DNA, 22 bp, Artificial Sequence
  chemically synthesized
gtcatgaaatctttgcccctgc

SEQ ID NO: 86575 - DNA, 22 bp, Artificial Sequence
  chemically synthesized
tcatgaaatctttgcccctgct

SEQ ID NO: 86576 - DNA, 22 bp, Artificial Sequence
  chemically synthesized
tgcccctgcttatgtccggaat

SEQ ID NO: 86577 - DNA, 22 bp, Artificial Sequence
  chemically synthesized
gcccctgcttatgtccggaatg

SEQ ID NO: 86578 - DNA, 22 bp, Artificial Sequence
  chemically synthesized
cccctgcttatgtccggaatgg

SEQ ID NO: 86579 - DNA, 22 bp, Artificial Sequence
  chemically synthesized
cttatgtccggaatggtattgc

SEQ ID NO: 86580 - DNA, 22 bp, Artificial Sequence
  chemically synthesized
atgtccggaatggtattgccta

SEQ ID NO: 86581 - DNA, 22 bp, Artificial Sequence
  chemically synthesized
tgtccggaatggtattgcctag

SEQ ID NO: 86582 - DNA, 22 bp, Artificial Sequence
  chemically synthesized
cctaggttgctttcaagcattt

SEQ ID NO: 86583 - DNA, 22 bp, Artificial Sequence
  chemically synthesized
ggttgctttcaagcatttttat

SEQ ID NO: 86584 - DNA, 22 bp, Artificial Sequence
  chemically synthesized
ctttcaagcatttttatagttt

SEQ ID NO: 86585 - DNA, 22 bp, Artificial Sequence
  chemically synthesized
tcaagcatttttatagtttggg

SEQ ID NO: 86586 - DNA, 22 bp, Artificial Sequence
  chemically synthesized
caagcatttttatagtttgggt

SEQ ID NO: 86587 - DNA, 22 bp, Artificial Sequence
  chemically synthesized
aagcatttttatagtttgggtt

SEQ ID NO: 86588 - DNA, 22 bp, Artificial Sequence
  chemically synthesized
ttatagtttgggttttgcattt

SEQ ID NO: 86589 - DNA, 22 bp, Artificial Sequence
  chemically synthesized
tatagtttgggttttgcattta

SEQ ID NO: 86590 - DNA, 22 bp, Artificial Sequence
  chemically synthesized
atagtttgggttttgcatttaa

SEQ ID NO: 86591 - DNA, 22 bp, Artificial Sequence
  chemically synthesized
tagtttgggttttgcatttaag

SEQ ID NO: 86592 - DNA, 22 bp, Artificial Sequence
  chemically synthesized
gggttttgcatttaagtctcta

SEQ ID NO: 86593 - DNA, 22 bp, Artificial Sequence
  chemically synthesized
ggttttgcatttaagtctctaa

SEQ ID NO: 86594 - DNA, 22 bp, Artificial Sequence
  chemically synthesized
tgcatttaagtctctaatccat

SEQ ID NO: 86595 - DNA, 22 bp, Artificial Sequence
  chemically synthesized
gcatttaagtctctaatccatc

SEQ ID NO: 86596 - DNA, 22 bp, Artificial Sequence
  chemically synthesized
catttaagtctctaatccatct

SEQ ID NO: 86597 - DNA, 22 bp, Artificial Sequence
  chemically synthesized
aagtctctaatccatcttgagt

SEQ ID NO: 86598 - DNA, 22 bp, Artificial Sequence
  chemically synthesized
agtctctaatccatcttgagtt

SEQ ID NO: 86599 - DNA, 22 bp, Artificial Sequence
  chemically synthesized
taatccatcttgagtttatttg

SEQ ID NO: 86600 - DNA, 22 bp, Artificial Sequence
  chemically synthesized
atccatcttgagtttatttgtg

SEQ ID NO: 86601 - DNA, 22 bp, Artificial Sequence
  chemically synthesized
gagtttatttgtgtatatgata

SEQ ID NO: 86602 - DNA, 22 bp, Artificial Sequence
  chemically synthesized
agtttatttgtgtatatgatat

SEQ ID NO: 86603 - DNA, 22 bp, Artificial Sequence
  chemically synthesized
atttgtgtatatgatatagaac

SEQ ID NO: 86604 - DNA, 22 bp, Artificial Sequence
  chemically synthesized
tttgtgtatatgatatagaacg

SEQ ID NO: 86605 - DNA, 22 bp, Artificial Sequence
  chemically synthesized
gtgtatatgatatagaacgggg

SEQ ID NO: 86606 - DNA, 22 bp, Artificial Sequence
  chemically synthesized
tgtatatgatatagaacggggt

SEQ ID NO: 86607 - DNA, 22 bp, Artificial Sequence
  chemically synthesized
gtttcaatcttctacatacggt

SEQ ID NO: 86608 - DNA, 22 bp, Artificial Sequence
  chemically synthesized
caatcttctacatacggttagt

SEQ ID NO: 86609 - DNA, 22 bp, Artificial Sequence
  chemically synthesized
aatcttctacatacggttagtc

SEQ ID NO: 86610 - DNA, 22 bp, Artificial Sequence
  chemically synthesized
ctacatacggttagtcagttat

SEQ ID NO: 86611 - DNA, 22 bp, Artificial Sequence
  chemically synthesized
tacatacggttagtcagttatc

SEQ ID NO: 86612 - DNA, 22 bp, Artificial Sequence
  chemically synthesized
catacggttagtcagttatccc

SEQ ID NO: 86613 - DNA, 22 bp, Artificial Sequence
  chemically synthesized
gtcagttatcccaacaccactt

SEQ ID NO: 86614 - DNA, 22 bp, Artificial Sequence
  chemically synthesized
tcccaacaccacttgttgaata

SEQ ID NO: 86615 - DNA, 22 bp, Artificial Sequence
  chemically synthesized
gttgaatagggtgtcttttcct

SEQ ID NO: 86616 - DNA, 22 bp, Artificial Sequence
  chemically synthesized
ttgaatagggtgtcttttcctc

SEQ ID NO: 86617 - DNA, 22 bp, Artificial Sequence
  chemically synthesized
aatagggtgtcttttcctcatt

SEQ ID NO: 86618 - DNA, 22 bp, Artificial Sequence
  chemically synthesized
ttcctcattgcttgtttttatc

SEQ ID NO: 86619 - DNA, 22 bp, Artificial Sequence
  chemically synthesized
tcctcattgcttgtttttatca

SEQ ID NO: 86620 - DNA, 22 bp, Artificial Sequence
  chemically synthesized
cctcattgcttgtttttatcag

SEQ ID NO: 86621 - DNA, 22 bp, Artificial Sequence
  chemically synthesized
ctcattgcttgtttttatcagc

SEQ ID NO: 86622 - DNA, 22 bp, Artificial Sequence
  chemically synthesized
attgcttgtttttatcagcttt

SEQ ID NO: 86623 - DNA, 22 bp, Artificial Sequence
  chemically synthesized
cttgtttttatcagctttgtca

SEQ ID NO: 86624 - DNA, 22 bp, Artificial Sequence
  chemically synthesized
gtttttatcagctttgtcaaag

SEQ ID NO: 86625 - DNA, 22 bp, Artificial Sequence
  chemically synthesized
tttttatcagctttgtcaaaga

SEQ ID NO: 86626 - DNA, 22 bp, Artificial Sequence
  chemically synthesized
ttatcagctttgtcaaagatca

SEQ ID NO: 86627 - DNA, 22 bp, Artificial Sequence
  chemically synthesized
tatcagctttgtcaaagatcag

SEQ ID NO: 86628 - DNA, 22 bp, Artificial Sequence
  chemically synthesized
atcagctttgtcaaagatcaga

SEQ ID NO: 86629 - DNA, 22 bp, Artificial Sequence
  chemically synthesized
tcagctttgtcaaagatcagat

SEQ ID NO: 86630 - DNA, 22 bp, Artificial Sequence
  chemically synthesized
tgtcaaagatcagatggttgta

SEQ ID NO: 86631 - DNA, 22 bp, Artificial Sequence
  chemically synthesized
gtcaaagatcagatggttgtag

SEQ ID NO: 86632 - DNA, 22 bp, Artificial Sequence
  chemically synthesized
tcaaagatcagatggttgtagg

SEQ ID NO: 86633 - DNA, 22 bp, Artificial Sequence
  chemically synthesized
taggcatgtggtcttatttctg

SEQ ID NO: 86634 - DNA, 22 bp, Artificial Sequence
  chemically synthesized
atttctgggctctctattctgt

SEQ ID NO: 86635 - DNA, 22 bp, Artificial Sequence
  chemically synthesized
tttctgggctctctattctgtt

SEQ ID NO: 86636 - DNA, 22 bp, Artificial Sequence
  chemically synthesized
ctgggctctctattctgttcca

SEQ ID NO: 86637 - DNA, 22 bp, Artificial Sequence
  chemically synthesized
tgggctctctattctgttccat

SEQ ID NO: 86638 - DNA, 22 bp, Artificial Sequence
  chemically synthesized
ggctctctattctgttccattt

SEQ ID NO: 86639 - DNA, 22 bp, Artificial Sequence
  chemically synthesized
tctattctgttccatttgtctg

SEQ ID NO: 86640 - DNA, 22 bp, Artificial Sequence
  chemically synthesized
tattctgttccatttgtctgtg

SEQ ID NO: 86641 - DNA, 22 bp, Artificial Sequence
  chemically synthesized
ttctgttccatttgtctgtgtg

SEQ ID NO: 86642 - DNA, 22 bp, Artificial Sequence
  chemically synthesized
tgttccatttgtctgtgtgtct

SEQ ID NO: 86643 - DNA, 22 bp, Artificial Sequence
  chemically synthesized
ttccatttgtctgtgtgtcttt

SEQ ID NO: 86644 - DNA, 22 bp, Artificial Sequence
  chemically synthesized
catttgtctgtgtgtcttttct

SEQ ID NO: 86645 - DNA, 22 bp, Artificial Sequence
  chemically synthesized
gtctgtgtgtcttttctgtaac

SEQ ID NO: 86646 - DNA, 22 bp, Artificial Sequence
  chemically synthesized
tctgtgtgtcttttctgtaaca

SEQ ID NO: 86647 - DNA, 22 bp, Artificial Sequence
  chemically synthesized
tgtgtcttttctgtaacagtac

SEQ ID NO: 86648 - DNA, 22 bp, Artificial Sequence
  chemically synthesized
ttctgtaacagtaccacactgt

SEQ ID NO: 86649 - DNA, 22 bp, Artificial Sequence
  chemically synthesized
tctgtaacagtaccacactgtt

SEQ ID NO: 86650 - DNA, 22 bp, Artificial Sequence
  chemically synthesized
ctgtaacagtaccacactgttt

SEQ ID NO: 86651 - DNA, 22 bp, Artificial Sequence
  chemically synthesized
tgtaacagtaccacactgtttt

SEQ ID NO: 86652 - DNA, 22 bp, Artificial Sequence
  chemically synthesized
taacagtaccacactgttttgg

SEQ ID NO: 86653 - DNA, 22 bp, Artificial Sequence
  chemically synthesized
ttttggttactgtagccctgtg

SEQ ID NO: 86654 - DNA, 22 bp, Artificial Sequence
  chemically synthesized
tggttactgtagccctgtggta

SEQ ID NO: 86655 - DNA, 22 bp, Artificial Sequence
  chemically synthesized
ggttactgtagccctgtggtat

SEQ ID NO: 86656 - DNA, 22 bp, Artificial Sequence
  chemically synthesized
gttactgtagccctgtggtatg

SEQ ID NO: 86657 - DNA, 22 bp, Artificial Sequence
  chemically synthesized
ctgtagccctgtggtatggttt

SEQ ID NO: 86658 - DNA, 22 bp, Artificial Sequence
  chemically synthesized
tagccctgtggtatggtttgaa

SEQ ID NO: 86659 - DNA, 22 bp, Artificial Sequence
  chemically synthesized
tggtatggtttgaagttaggca

SEQ ID NO: 86660 - DNA, 22 bp, Artificial Sequence
  chemically synthesized
gaagttaggcaatgtattatct

SEQ ID NO: 86661 - DNA, 22 bp, Artificial Sequence
  chemically synthesized
aagttaggcaatgtattatctc

SEQ ID NO: 86662 - DNA, 22 bp, Artificial Sequence
  chemically synthesized
ggcaatgtattatctccagctt

SEQ ID NO: 86663 - DNA, 22 bp, Artificial Sequence
  chemically synthesized
tctccagcttttttctttttct

SEQ ID NO: 86664 - DNA, 22 bp, Artificial Sequence
  chemically synthesized
cagcttttttctttttctcttt

SEQ ID NO: 86665 - DNA, 22 bp, Artificial Sequence
  chemically synthesized
ttttctttttctcttttttttt

SEQ ID NO: 86666 - DNA, 22 bp, Artificial Sequence
  chemically synthesized
tttctttttctctttttttttt

SEQ ID NO: 86667 - DNA, 22 bp, Artificial Sequence
  chemically synthesized
ttctttttctcttttttttttt

SEQ ID NO: 86668 - DNA, 22 bp, Artificial Sequence
  chemically synthesized
tctttttctctttttttttttt

SEQ ID NO: 86669 - DNA, 22 bp, Artificial Sequence
  chemically synthesized
ctttttctcttttttttttttt

SEQ ID NO: 86670 - DNA, 22 bp, Artificial Sequence
  chemically synthesized
tttttctctttttttttttttg

SEQ ID NO: 86671 - DNA, 22 bp, Artificial Sequence
  chemically synthesized
tttctctttttttttttttgta

SEQ ID NO: 86672 - DNA, 22 bp, Artificial Sequence
  chemically synthesized
ttctctttttttttttttgtac

SEQ ID NO: 86673 - DNA, 22 bp, Artificial Sequence
  chemically synthesized
tctctttttttttttttgtact

SEQ ID NO: 86674 - DNA, 22 bp, Artificial Sequence
  chemically synthesized
ctctttttttttttttgtactc

SEQ ID NO: 86675 - DNA, 22 bp, Artificial Sequence
  chemically synthesized
tctttttttttttttgtactct

SEQ ID NO: 86676 - DNA, 22 bp, Artificial Sequence
  chemically synthesized
tttttttttttttgtactctaa

SEQ ID NO: 86677 - DNA, 22 bp, Artificial Sequence
  chemically synthesized
tttttttttttgtactctaagt

SEQ ID NO: 86678 - DNA, 22 bp, Artificial Sequence
  chemically synthesized
ttttttttttgtactctaagtt

SEQ ID NO: 86679 - DNA, 22 bp, Artificial Sequence
  chemically synthesized
tttttttttgtactctaagttc

SEQ ID NO: 86680 - DNA, 22 bp, Artificial Sequence
  chemically synthesized
ttttttttgtactctaagttct

SEQ ID NO: 86681 - DNA, 22 bp, Artificial Sequence
  chemically synthesized
tttttttgtactctaagttcta

SEQ ID NO: 86682 - DNA, 22 bp, Artificial Sequence
  chemically synthesized
ttttttgtactctaagttctac

SEQ ID NO: 86683 - DNA, 22 bp, Artificial Sequence
  chemically synthesized
tttttgtactctaagttctacg

SEQ ID NO: 86684 - DNA, 22 bp, Artificial Sequence
  chemically synthesized
ttttgtactctaagttctacgg

SEQ ID NO: 86685 - DNA, 22 bp, Artificial Sequence
  chemically synthesized
tttgtactctaagttctacggt

SEQ ID NO: 86686 - DNA, 22 bp, Artificial Sequence
  chemically synthesized
ttgtactctaagttctacggta

SEQ ID NO: 86687 - DNA, 22 bp, Artificial Sequence
  chemically synthesized
tgtactctaagttctacggtac

SEQ ID NO: 86688 - DNA, 22 bp, Artificial Sequence
  chemically synthesized
gtactctaagttctacggtacc

SEQ ID NO: 86689 - DNA, 22 bp, Artificial Sequence
  chemically synthesized
tactctaagttctacggtacct

SEQ ID NO: 86690 - DNA, 22 bp, Artificial Sequence
  chemically synthesized
taagttctacggtacctgtgca

SEQ ID NO: 86691 - DNA, 22 bp, Artificial Sequence
  chemically synthesized
agttctacggtacctgtgcagt

SEQ ID NO: 86692 - DNA, 22 bp, Artificial Sequence
  chemically synthesized
tacggtacctgtgcagtttgtt

SEQ ID NO: 86693 - DNA, 22 bp, Artificial Sequence
  chemically synthesized
cggtacctgtgcagtttgttac

SEQ ID NO: 86694 - DNA, 22 bp, Artificial Sequence
  chemically synthesized
tgcagtttgttacatatgtata

SEQ ID NO: 86695 - DNA, 22 bp, Artificial Sequence
  chemically synthesized
gttacatatgtatacgtgtgcc

SEQ ID NO: 86696 - DNA, 22 bp, Artificial Sequence
  chemically synthesized
ttacatatgtatacgtgtgcca

SEQ ID NO: 86697 - DNA, 22 bp, Artificial Sequence
  chemically synthesized
catatgtatacgtgtgccatat

SEQ ID NO: 86698 - DNA, 22 bp, Artificial Sequence
  chemically synthesized
gtgtgctgcacccgttaactcg

SEQ ID NO: 86699 - DNA, 22 bp, Artificial Sequence
  chemically synthesized
cacccgttaactcgtcatttac

SEQ ID NO: 86700 - DNA, 22 bp, Artificial Sequence
  chemically synthesized
actcgtcatttacattagatat

SEQ ID NO: 86701 - DNA, 22 bp, Artificial Sequence
  chemically synthesized
gtcatttacattagatatatct

SEQ ID NO: 86702 - DNA, 22 bp, Artificial Sequence
  chemically synthesized
acattagatatatctcctaatg

SEQ ID NO: 86703 - DNA, 22 bp, Artificial Sequence
  chemically synthesized
cattagatatatctcctaatgt

SEQ ID NO: 86704 - DNA, 22 bp, Artificial Sequence
  chemically synthesized
gatatatctcctaatgttatcc

SEQ ID NO: 86705 - DNA, 22 bp, Artificial Sequence
  chemically synthesized
ctaatgttatccctcctctctc

SEQ ID NO: 86706 - DNA, 22 bp, Artificial Sequence
  chemically synthesized
atgttatccctcctctctccta

SEQ ID NO: 86707 - DNA, 22 bp, Artificial Sequence
  chemically synthesized
tccctcctctctcctaccaccc

SEQ ID NO: 86708 - DNA, 22 bp, Artificial Sequence
  chemically synthesized
ctctctcctaccaccccacgac

SEQ ID NO: 86709 - DNA, 22 bp, Artificial Sequence
  chemically synthesized
tctcctaccaccccacgacagg

SEQ ID NO: 86710 - DNA, 22 bp, Artificial Sequence
  chemically synthesized
tcctaccaccccacgacaggcc

SEQ ID NO: 86711 - DNA, 22 bp, Artificial Sequence
  chemically synthesized
ctaccaccccacgacaggcccc

SEQ ID NO: 86712 - DNA, 22 bp, Artificial Sequence
  chemically synthesized
ccaccccacgacaggccccggt

SEQ ID NO: 86713 - DNA, 22 bp, Artificial Sequence
  chemically synthesized
cccaccctgtgtccaagtgttc

SEQ ID NO: 86714 - DNA, 22 bp, Artificial Sequence
  chemically synthesized
tgtccaagtgttctcatttttc

SEQ ID NO: 86715 - DNA, 22 bp, Artificial Sequence
  chemically synthesized
tcatttttcaattcccacctgt

SEQ ID NO: 86716 - DNA, 22 bp, Artificial Sequence
  chemically synthesized
atttttcaattcccacctgtga

SEQ ID NO: 86717 - DNA, 22 bp, Artificial Sequence
  chemically synthesized
ttcaattcccacctgtgagtat

SEQ ID NO: 86718 - DNA, 22 bp, Artificial Sequence
  chemically synthesized
tcaattcccacctgtgagtatt

SEQ ID NO: 86719 - DNA, 22 bp, Artificial Sequence
  chemically synthesized
caattcccacctgtgagtatta

SEQ ID NO: 86720 - DNA, 22 bp, Artificial Sequence
  chemically synthesized
aattcccacctgtgagtattag

SEQ ID NO: 86721 - DNA, 22 bp, Artificial Sequence
  chemically synthesized
ccacctgtgagtattaggattt

SEQ ID NO: 86722 - DNA, 22 bp, Artificial Sequence
  chemically synthesized
tgagtattaggatttcctaggc

SEQ ID NO: 86723 - DNA, 22 bp, Artificial Sequence
  chemically synthesized
ggatttcctaggctatttggac

SEQ ID NO: 86724 - DNA, 22 bp, Artificial Sequence
  chemically synthesized
cctaggctatttggactttttt

SEQ ID NO: 86725 - DNA, 22 bp, Artificial Sequence
  chemically synthesized
ctaggctatttggacttttttt

SEQ ID NO: 86726 - DNA, 22 bp, Artificial Sequence
  chemically synthesized
ggctatttggactttttttgtt

SEQ ID NO: 86727 - DNA, 22 bp, Artificial Sequence
  chemically synthesized
tttggactttttttgttgttgt

SEQ ID NO: 86728 - DNA, 22 bp, Artificial Sequence
  chemically synthesized
ggactttttttgttgttgttcc

SEQ ID NO: 86729 - DNA, 22 bp, Artificial Sequence
  chemically synthesized
gactttttttgttgttgttcca

SEQ ID NO: 86730 - DNA, 22 bp, Artificial Sequence
  chemically synthesized
tttttgttgttgttccatatga

SEQ ID NO: 86731 - DNA, 22 bp, Artificial Sequence
  chemically synthesized
ttttgttgttgttccatatgaa

SEQ ID NO: 86732 - DNA, 22 bp, Artificial Sequence
  chemically synthesized
tttgttgttgttccatatgaac

SEQ ID NO: 86733 - DNA, 22 bp, Artificial Sequence
  chemically synthesized
ttgttgttgttccatatgaact

SEQ ID NO: 86734 - DNA, 22 bp, Artificial Sequence
  chemically synthesized
tgttgttgttccatatgaactt

SEQ ID NO: 86735 - DNA, 22 bp, Artificial Sequence
  chemically synthesized
gttgttgttccatatgaacttt

SEQ ID NO: 86736 - DNA, 22 bp, Artificial Sequence
  chemically synthesized
ttgttgttccatatgaacttta

SEQ ID NO: 86737 - DNA, 22 bp, Artificial Sequence
  chemically synthesized
ttgttccatatgaactttaaag

SEQ ID NO: 86738 - DNA, 22 bp, Artificial Sequence
  chemically synthesized
ttccatatgaactttaaagtgt

SEQ ID NO: 86739 - DNA, 22 bp, Artificial Sequence
  chemically synthesized
catatgaactttaaagtgtatt

SEQ ID NO: 86740 - DNA, 22 bp, Artificial Sequence
  chemically synthesized
taaagtgtatttttctagttct

SEQ ID NO: 86741 - DNA, 22 bp, Artificial Sequence
  chemically synthesized
aaagtgtatttttctagttctg

SEQ ID NO: 86742 - DNA, 22 bp, Artificial Sequence
  chemically synthesized
aagtgtatttttctagttctgt

SEQ ID NO: 86743 - DNA, 22 bp, Artificial Sequence
  chemically synthesized
ttctagttctgtgaagaatgtc

SEQ ID NO: 86744 - DNA, 22 bp, Artificial Sequence
  chemically synthesized
tctagttctgtgaagaatgtca

SEQ ID NO: 86745 - DNA, 22 bp, Artificial Sequence
  chemically synthesized
ctagttctgtgaagaatgtcat

SEQ ID NO: 86746 - DNA, 22 bp, Artificial Sequence
  chemically synthesized
tagttctgtgaagaatgtcatt

SEQ ID NO: 86747 - DNA, 22 bp, Artificial Sequence
  chemically synthesized
gttctgtgaagaatgtcattgg

SEQ ID NO: 86748 - DNA, 22 bp, Artificial Sequence
  chemically synthesized
tgtgaagaatgtcattggtagt

SEQ ID NO: 86749 - DNA, 22 bp, Artificial Sequence
  chemically synthesized
tgaagaatgtcattggtagttt

SEQ ID NO: 86750 - DNA, 22 bp, Artificial Sequence
  chemically synthesized
gtagtttgataggaatagcttt

SEQ ID NO: 86751 - DNA, 22 bp, Artificial Sequence
  chemically synthesized
gataggaatagctttgaaactg

SEQ ID NO: 86752 - DNA, 22 bp, Artificial Sequence
  chemically synthesized
ataggaatagctttgaaactgt

SEQ ID NO: 86753 - DNA, 22 bp, Artificial Sequence
  chemically synthesized
tgaaactgtaaattgctctagg

SEQ ID NO: 86754 - DNA, 22 bp, Artificial Sequence
  chemically synthesized
gaaactgtaaattgctctaggc

SEQ ID NO: 86755 - DNA, 22 bp, Artificial Sequence
  chemically synthesized
aaactgtaaattgctctaggca

SEQ ID NO: 86756 - DNA, 22 bp, Artificial Sequence
  chemically synthesized
taaattgctctaggcagtatgg

SEQ ID NO: 86757 - DNA, 22 bp, Artificial Sequence
  chemically synthesized
ctctaggcagtatggacatttt

SEQ ID NO: 86758 - DNA, 22 bp, Artificial Sequence
  chemically synthesized
taggcagtatggacattttaac

SEQ ID NO: 86759 - DNA, 22 bp, Artificial Sequence
  chemically synthesized
ggcagtatggacattttaacaa

SEQ ID NO: 86760 - DNA, 22 bp, Artificial Sequence
  chemically synthesized
taacaatattgattctttttat

SEQ ID NO: 86761 - DNA, 22 bp, Artificial Sequence
  chemically synthesized
aacaatattgattctttttatc

SEQ ID NO: 86762 - DNA, 22 bp, Artificial Sequence
  chemically synthesized
acaatattgattctttttatcc

SEQ ID NO: 86763 - DNA, 22 bp, Artificial Sequence
  chemically synthesized
attctttttatccatgagcatg

SEQ ID NO: 86764 - DNA, 22 bp, Artificial Sequence
  chemically synthesized
tttttatccatgagcatggaaa

SEQ ID NO: 86765 - DNA, 22 bp, Artificial Sequence
  chemically synthesized
tttatccatgagcatggaaagt

SEQ ID NO: 86766 - DNA, 22 bp, Artificial Sequence
  chemically synthesized
ttatccatgagcatggaaagtt

SEQ ID NO: 86767 - DNA, 22 bp, Artificial Sequence
  chemically synthesized
tatccatgagcatggaaagttt

SEQ ID NO: 86768 - DNA, 22 bp, Artificial Sequence
  chemically synthesized
atccatgagcatggaaagtttt

SEQ ID NO: 86769 - DNA, 22 bp, Artificial Sequence
  chemically synthesized
tccatgagcatggaaagttttt

SEQ ID NO: 86770 - DNA, 22 bp, Artificial Sequence
  chemically synthesized
ttccatttgtttctatcagctc

SEQ ID NO: 86771 - DNA, 22 bp, Artificial Sequence
  chemically synthesized
tccatttgtttctatcagctct

SEQ ID NO: 86772 - DNA, 22 bp, Artificial Sequence
  chemically synthesized
ccatttgtttctatcagctctg

SEQ ID NO: 86773 - DNA, 22 bp, Artificial Sequence
  chemically synthesized
catttgtttctatcagctctga

SEQ ID NO: 86774 - DNA, 22 bp, Artificial Sequence
  chemically synthesized
gtttctatcagctctgatttct

SEQ ID NO: 86775 - DNA, 22 bp, Artificial Sequence
  chemically synthesized
tttctatcagctctgatttctt

SEQ ID NO: 86776 - DNA, 22 bp, Artificial Sequence
  chemically synthesized
ctatcagctctgatttctttga

SEQ ID NO: 86777 - DNA, 22 bp, Artificial Sequence
  chemically synthesized
tatcagctctgatttctttgag

SEQ ID NO: 86778 - DNA, 22 bp, Artificial Sequence
  chemically synthesized
tcagctctgatttctttgagca

SEQ ID NO: 86779 - DNA, 22 bp, Artificial Sequence
  chemically synthesized
tgatttctttgagcagtgtttt

SEQ ID NO: 86780 - DNA, 22 bp, Artificial Sequence
  chemically synthesized
atttctttgagcagtgttttgt

SEQ ID NO: 86781 - DNA, 22 bp, Artificial Sequence
  chemically synthesized
ctttgagcagtgttttgtaaat

SEQ ID NO: 86782 - DNA, 22 bp, Artificial Sequence
  chemically synthesized
tttgagcagtgttttgtaaatc

SEQ ID NO: 86783 - DNA, 22 bp, Artificial Sequence
  chemically synthesized
tgagcagtgttttgtaaatctc

SEQ ID NO: 86784 - DNA, 22 bp, Artificial Sequence
  chemically synthesized
gagcagtgttttgtaaatctca

SEQ ID NO: 86785 - DNA, 22 bp, Artificial Sequence
  chemically synthesized
agcagtgttttgtaaatctcat

SEQ ID NO: 86786 - DNA, 22 bp, Artificial Sequence
  chemically synthesized
tgtaaatctcattgtagagatc

SEQ ID NO: 86787 - DNA, 22 bp, Artificial Sequence
  chemically synthesized
gtaaatctcattgtagagatct

SEQ ID NO: 86788 - DNA, 22 bp, Artificial Sequence
  chemically synthesized
taaatctcattgtagagatctt

SEQ ID NO: 86789 - DNA, 22 bp, Artificial Sequence
  chemically synthesized
attgtagagatctttcaactgc

SEQ ID NO: 86790 - DNA, 22 bp, Artificial Sequence
  chemically synthesized
tagagatctttcaactgcttgg

SEQ ID NO: 86791 - DNA, 22 bp, Artificial Sequence
  chemically synthesized
tcaactgcttggttagatatat

SEQ ID NO: 86792 - DNA, 22 bp, Artificial Sequence
  chemically synthesized
caactgcttggttagatatatc

SEQ ID NO: 86793 - DNA, 22 bp, Artificial Sequence
  chemically synthesized
aactgcttggttagatatatcc

SEQ ID NO: 86794 - DNA, 22 bp, Artificial Sequence
  chemically synthesized
cttggttagatatatccttagg

SEQ ID NO: 86795 - DNA, 22 bp, Artificial Sequence
  chemically synthesized
ggttagatatatccttaggtat

SEQ ID NO: 86796 - DNA, 22 bp, Artificial Sequence
  chemically synthesized
gttagatatatccttaggtatt

SEQ ID NO: 86797 - DNA, 22 bp, Artificial Sequence
  chemically synthesized
gatatatccttaggtattttat

SEQ ID NO: 86798 - DNA, 22 bp, Artificial Sequence
  chemically synthesized
aggtattttattctttttgtgg

SEQ ID NO: 86799 - DNA, 22 bp, Artificial Sequence
  chemically synthesized
ggtattttattctttttgtggc

SEQ ID NO: 86800 - DNA, 22 bp, Artificial Sequence
  chemically synthesized
tattctttttgtggcaacggta

SEQ ID NO: 86801 - DNA, 22 bp, Artificial Sequence
  chemically synthesized
attctttttgtggcaacggtaa

SEQ ID NO: 86802 - DNA, 22 bp, Artificial Sequence
  chemically synthesized
ttctttttgtggcaacggtaaa

SEQ ID NO: 86803 - DNA, 22 bp, Artificial Sequence
  chemically synthesized
tttttgtggcaacggtaaatgg

SEQ ID NO: 86804 - DNA, 22 bp, Artificial Sequence
  chemically synthesized
tttgtggcaacggtaaatggga

SEQ ID NO: 86805 - DNA, 22 bp, Artificial Sequence
  chemically synthesized
ttgtggcaacggtaaatgggat

SEQ ID NO: 86806 - DNA, 22 bp, Artificial Sequence
  chemically synthesized
tgtggcaacggtaaatgggatt

SEQ ID NO: 86807 - DNA, 22 bp, Artificial Sequence
  chemically synthesized
gtggcaacggtaaatgggattg

SEQ ID NO: 86808 - DNA, 22 bp, Artificial Sequence
  chemically synthesized
tggcaacggtaaatgggattga

SEQ ID NO: 86809 - DNA, 22 bp, Artificial Sequence
  chemically synthesized
acttcctgatttggctctaggc

SEQ ID NO: 86810 - DNA, 22 bp, Artificial Sequence
  chemically synthesized
cctgatttggctctaggcttgg

SEQ ID NO: 86811 - DNA, 22 bp, Artificial Sequence
  chemically synthesized
ctgatttggctctaggcttggc

SEQ ID NO: 86812 - DNA, 22 bp, Artificial Sequence
  chemically synthesized
atttggctctaggcttggctat

SEQ ID NO: 86813 - DNA, 22 bp, Artificial Sequence
  chemically synthesized
ggctctaggcttggctattgtt

SEQ ID NO: 86814 - DNA, 22 bp, Artificial Sequence
  chemically synthesized
gctctaggcttggctattgttg

SEQ ID NO: 86815 - DNA, 22 bp, Artificial Sequence
  chemically synthesized
taggcttggctattgttgatgt

SEQ ID NO: 86816 - DNA, 22 bp, Artificial Sequence
  chemically synthesized
ggcttggctattgttgatgtat

SEQ ID NO: 86817 - DNA, 22 bp, Artificial Sequence
  chemically synthesized
ggctattgttgatgtatgggaa

SEQ ID NO: 86818 - DNA, 22 bp, Artificial Sequence
  chemically synthesized
gctattgttgatgtatgggaat

SEQ ID NO: 86819 - DNA, 22 bp, Artificial Sequence
  chemically synthesized
ttgttgatgtatgggaatgcta

SEQ ID NO: 86820 - DNA, 22 bp, Artificial Sequence
  chemically synthesized
ttgatgtatgggaatgctagtg

SEQ ID NO: 86821 - DNA, 22 bp, Artificial Sequence
  chemically synthesized
atgtatgggaatgctagtgatt

SEQ ID NO: 86822 - DNA, 22 bp, Artificial Sequence
  chemically synthesized
gtgatttttgtacattgatttt

SEQ ID NO: 86823 - DNA, 22 bp, Artificial Sequence
  chemically synthesized
ttgtacattgattttatatcct

SEQ ID NO: 86824 - DNA, 22 bp, Artificial Sequence
  chemically synthesized
tgtacattgattttatatcctg

SEQ ID NO: 86825 - DNA, 22 bp, Artificial Sequence
  chemically synthesized
gtacattgattttatatcctga

SEQ ID NO: 86826 - DNA, 22 bp, Artificial Sequence
  chemically synthesized
tacattgattttatatcctgaa

SEQ ID NO: 86827 - DNA, 22 bp, Artificial Sequence
  chemically synthesized
attttatatcctgaaactttgc

SEQ ID NO: 86828 - DNA, 22 bp, Artificial Sequence
  chemically synthesized
tatatcctgaaactttgctgaa

SEQ ID NO: 86829 - DNA, 22 bp, Artificial Sequence
  chemically synthesized
atatcctgaaactttgctgaag

SEQ ID NO: 86830 - DNA, 22 bp, Artificial Sequence
  chemically synthesized
tatcctgaaactttgctgaagt

SEQ ID NO: 86831 - DNA, 22 bp, Artificial Sequence
  chemically synthesized
aaactttgctgaagttatcagc

SEQ ID NO: 86832 - DNA, 22 bp, Artificial Sequence
  chemically synthesized
tgctgaagttatcagctgaagg

SEQ ID NO: 86833 - DNA, 22 bp, Artificial Sequence
  chemically synthesized
gctgaagttatcagctgaagga

SEQ ID NO: 86834 - DNA, 22 bp, Artificial Sequence
  chemically synthesized
ctgaagttatcagctgaaggag

SEQ ID NO: 86835 - DNA, 22 bp, Artificial Sequence
  chemically synthesized
aagttatcagctgaaggagctt

SEQ ID NO: 86836 - DNA, 22 bp, Artificial Sequence
  chemically synthesized
tcagctgaaggagcttttgggc

SEQ ID NO: 86837 - DNA, 22 bp, Artificial Sequence
  chemically synthesized
aaggagcttttgggccttgact

SEQ ID NO: 86838 - DNA, 22 bp, Artificial Sequence
  chemically synthesized
ttgggccttgactatggtgttt

SEQ ID NO: 86839 - DNA, 22 bp, Artificial Sequence
  chemically synthesized
tgggccttgactatggtgtttt

SEQ ID NO: 86840 - DNA, 22 bp, Artificial Sequence
  chemically synthesized
gggccttgactatggtgttttc

SEQ ID NO: 86841 - DNA, 22 bp, Artificial Sequence
  chemically synthesized
ggccttgactatggtgttttct

SEQ ID NO: 86842 - DNA, 22 bp, Artificial Sequence
  chemically synthesized
gactatggtgttttctagatac

SEQ ID NO: 86843 - DNA, 22 bp, Artificial Sequence
  chemically synthesized
actatggtgttttctagataca

SEQ ID NO: 86844 - DNA, 22 bp, Artificial Sequence
  chemically synthesized
tggtgttttctagatacagaaa

SEQ ID NO: 86845 - DNA, 22 bp, Artificial Sequence
  chemically synthesized
tctagatacagaaaacagggat

SEQ ID NO: 86846 - DNA, 22 bp, Artificial Sequence
  chemically synthesized
ctagatacagaaaacagggata

SEQ ID NO: 86847 - DNA, 22 bp, Artificial Sequence
  chemically synthesized
tagatacagaaaacagggatac

SEQ ID NO: 86848 - DNA, 22 bp, Artificial Sequence
  chemically synthesized
gatacagaaaacagggatactt

SEQ ID NO: 86849 - DNA, 22 bp, Artificial Sequence
  chemically synthesized
tgactttctctcttcctatttg

SEQ ID NO: 86850 - DNA, 22 bp, Artificial Sequence
  chemically synthesized
gactttctctcttcctatttgg

SEQ ID NO: 86851 - DNA, 22 bp, Artificial Sequence
  chemically synthesized
actttctctcttcctatttgga

SEQ ID NO: 86852 - DNA, 22 bp, Artificial Sequence
  chemically synthesized
tctctcttcctatttggatgcc

SEQ ID NO: 86853 - DNA, 22 bp, Artificial Sequence
  chemically synthesized
ctctcttcctatttggatgccc

SEQ ID NO: 86854 - DNA, 22 bp, Artificial Sequence
  chemically synthesized
tctcttcctatttggatgccct

SEQ ID NO: 86855 - DNA, 22 bp, Artificial Sequence
  chemically synthesized
tcttcctatttggatgcccttt

SEQ ID NO: 86856 - DNA, 22 bp, Artificial Sequence
  chemically synthesized
ttcctatttggatgccctttat

SEQ ID NO: 86857 - DNA, 22 bp, Artificial Sequence
  chemically synthesized
cctatttggatgccctttattc

SEQ ID NO: 86858 - DNA, 22 bp, Artificial Sequence
  chemically synthesized
ctatttggatgccctttattcc

SEQ ID NO: 86859 - DNA, 22 bp, Artificial Sequence
  chemically synthesized
tttggatgccctttattccctt

SEQ ID NO: 86860 - DNA, 22 bp, Artificial Sequence
  chemically synthesized
ggatgccctttattcccttctc

SEQ ID NO: 86861 - DNA, 22 bp, Artificial Sequence
  chemically synthesized
gatgccctttattcccttctct

SEQ ID NO: 86862 - DNA, 22 bp, Artificial Sequence
  chemically synthesized
tattcccttctcttgcctgatt

SEQ ID NO: 86863 - DNA, 22 bp, Artificial Sequence
  chemically synthesized
attcccttctcttgcctgattg

SEQ ID NO: 86864 - DNA, 22 bp, Artificial Sequence
  chemically synthesized
ttcccttctcttgcctgattgc

SEQ ID NO: 86865 - DNA, 22 bp, Artificial Sequence
  chemically synthesized
ccttctcttgcctgattgctct

SEQ ID NO: 86866 - DNA, 22 bp, Artificial Sequence
  chemically synthesized
ctcttgcctgattgctctggcc

SEQ ID NO: 86867 - DNA, 22 bp, Artificial Sequence
  chemically synthesized
tcttgcctgattgctctggcca

SEQ ID NO: 86868 - DNA, 22 bp, Artificial Sequence
  chemically synthesized
ttgcctgattgctctggccagg

SEQ ID NO: 86869 - DNA, 22 bp, Artificial Sequence
  chemically synthesized
gcctgattgctctggccaggac

SEQ ID NO: 86870 - DNA, 22 bp, Artificial Sequence
  chemically synthesized
cctgattgctctggccaggact

SEQ ID NO: 86871 - DNA, 22 bp, Artificial Sequence
  chemically synthesized
attgctctggccaggactgcca

SEQ ID NO: 86872 - DNA, 22 bp, Artificial Sequence
  chemically synthesized
ctctggccaggactgccagtac

SEQ ID NO: 86873 - DNA, 22 bp, Artificial Sequence
  chemically synthesized
tggccaggactgccagtactat

SEQ ID NO: 86874 - DNA, 22 bp, Artificial Sequence
  chemically synthesized
gccaggactgccagtactatac

SEQ ID NO: 86875 - DNA, 22 bp, Artificial Sequence
  chemically synthesized
ccagtactatactgaatagcag

SEQ ID NO: 86876 - DNA, 22 bp, Artificial Sequence
  chemically synthesized
tactgaatagcagtggtgagag

SEQ ID NO: 86877 - DNA, 22 bp, Artificial Sequence
  chemically synthesized
aatagcagtggtgagagagggc

SEQ ID NO: 86878 - DNA, 22 bp, Artificial Sequence
  chemically synthesized
gtcttgtgccagttttcaagaa

SEQ ID NO: 86879 - DNA, 22 bp, Artificial Sequence
  chemically synthesized
tcttgtgccagttttcaagaag

SEQ ID NO: 86880 - DNA, 22 bp, Artificial Sequence
  chemically synthesized
gtgccagttttcaagaagaatg

SEQ ID NO: 86881 - DNA, 22 bp, Artificial Sequence
  chemically synthesized
tgccagttttcaagaagaatgc

SEQ ID NO: 86882 - DNA, 22 bp, Artificial Sequence
  chemically synthesized
tcaagaagaatgcttccaggtt

SEQ ID NO: 86883 - DNA, 22 bp, Artificial Sequence
  chemically synthesized
caagaagaatgcttccaggttt

SEQ ID NO: 86884 - DNA, 22 bp, Artificial Sequence
  chemically synthesized
aagaagaatgcttccaggtttt

SEQ ID NO: 86885 - DNA, 22 bp, Artificial Sequence
  chemically synthesized
ccaggttttgcccattctgtat

SEQ ID NO: 86886 - DNA, 22 bp, Artificial Sequence
  chemically synthesized
caggttttgcccattctgtatg

SEQ ID NO: 86887 - DNA, 22 bp, Artificial Sequence
  chemically synthesized
tgcccattctgtatgatgttgg

SEQ ID NO: 86888 - DNA, 22 bp, Artificial Sequence
  chemically synthesized
gcccattctgtatgatgttggc

SEQ ID NO: 86889 - DNA, 22 bp, Artificial Sequence
  chemically synthesized
cccattctgtatgatgttggct

SEQ ID NO: 86890 - DNA, 22 bp, Artificial Sequence
  chemically synthesized
tgtatgatgttggctgtgggtt

SEQ ID NO: 86891 - DNA, 22 bp, Artificial Sequence
  chemically synthesized
tatgatgttggctgtgggtttg

SEQ ID NO: 86892 - DNA, 22 bp, Artificial Sequence
  chemically synthesized
gctgtgggtttgtcatagatgg

SEQ ID NO: 86893 - DNA, 22 bp, Artificial Sequence
  chemically synthesized
tgggtttgtcatagatggctca

SEQ ID NO: 86894 - DNA, 22 bp, Artificial Sequence
  chemically synthesized
gtcatagatggctcatattatt

SEQ ID NO: 86895 - DNA, 22 bp, Artificial Sequence
  chemically synthesized
tcatagatggctcatattattt

SEQ ID NO: 86896 - DNA, 22 bp, Artificial Sequence
  chemically synthesized
atattattttgaggtcatgtcc

SEQ ID NO: 86897 - DNA, 22 bp, Artificial Sequence
  chemically synthesized
ttttgaggtcatgtccttaaat

SEQ ID NO: 86898 - DNA, 22 bp, Artificial Sequence
  chemically synthesized
tgaggtcatgtccttaaatagc

SEQ ID NO: 86899 - DNA, 22 bp, Artificial Sequence
  chemically synthesized
gaggtcatgtccttaaatagct

SEQ ID NO: 86900 - DNA, 22 bp, Artificial Sequence
  chemically synthesized
aggtcatgtccttaaatagcta

SEQ ID NO: 86901 - DNA, 22 bp, Artificial Sequence
  chemically synthesized
aaatagctagtttgttgagagg

SEQ ID NO: 86902 - DNA, 22 bp, Artificial Sequence
  chemically synthesized
aatagctagtttgttgagaggt

SEQ ID NO: 86903 - DNA, 22 bp, Artificial Sequence
  chemically synthesized
gtttgttgagaggttttaacat

SEQ ID NO: 86904 - DNA, 22 bp, Artificial Sequence
  chemically synthesized
gttgagaggttttaacatgaag

SEQ ID NO: 86905 - DNA, 22 bp, Artificial Sequence
  chemically synthesized
ttgagaggttttaacatgaagt

SEQ ID NO: 86906 - DNA, 22 bp, Artificial Sequence
  chemically synthesized
agaggttttaacatgaagtgaa

SEQ ID NO: 86907 - DNA, 22 bp, Artificial Sequence
  chemically synthesized
taacatgaagtgaagttgaatt

SEQ ID NO: 86908 - DNA, 22 bp, Artificial Sequence
  chemically synthesized
aacatgaagtgaagttgaattt

SEQ ID NO: 86909 - DNA, 22 bp, Artificial Sequence
  chemically synthesized
acatgaagtgaagttgaatttt

SEQ ID NO: 86910 - DNA, 22 bp, Artificial Sequence
  chemically synthesized
aattttatcaaaatcttttttt

SEQ ID NO: 86911 - DNA, 22 bp, Artificial Sequence
  chemically synthesized
tatcaaaatctttttttgcaca

SEQ ID NO: 86912 - DNA, 22 bp, Artificial Sequence
  chemically synthesized
atcaaaatctttttttgcacat

SEQ ID NO: 86913 - DNA, 22 bp, Artificial Sequence
  chemically synthesized
tcaaaatctttttttgcacata

SEQ ID NO: 86914 - DNA, 22 bp, Artificial Sequence
  chemically synthesized
tttttgcacatattgaaatgat

SEQ ID NO: 86915 - DNA, 22 bp, Artificial Sequence
  chemically synthesized
ttttgcacatattgaaatgatc

SEQ ID NO: 86916 - DNA, 22 bp, Artificial Sequence
  chemically synthesized
tttgcacatattgaaatgatca

SEQ ID NO: 86917 - DNA, 22 bp, Artificial Sequence
  chemically synthesized
ttgcacatattgaaatgatcat

SEQ ID NO: 86918 - DNA, 22 bp, Artificial Sequence
  chemically synthesized
tgcacatattgaaatgatcatg

SEQ ID NO: 86919 - DNA, 22 bp, Artificial Sequence
  chemically synthesized
gcacatattgaaatgatcatgt

SEQ ID NO: 86920 - DNA, 22 bp, Artificial Sequence
  chemically synthesized
cacatattgaaatgatcatgtg

SEQ ID NO: 86921 - DNA, 22 bp, Artificial Sequence
  chemically synthesized
aaatgatcatgtggtttctgtt

SEQ ID NO: 86922 - DNA, 22 bp, Artificial Sequence
  chemically synthesized
ctgtttttagtgctgtatatat

SEQ ID NO: 86923 - DNA, 22 bp, Artificial Sequence
  chemically synthesized
tgtttttagtgctgtatatatg

SEQ ID NO: 86924 - DNA, 22 bp, Artificial Sequence
  chemically synthesized
tttttagtgctgtatatatgat

SEQ ID NO: 86925 - DNA, 22 bp, Artificial Sequence
  chemically synthesized
ttagtgctgtatatatgatgaa

SEQ ID NO: 86926 - DNA, 22 bp, Artificial Sequence
  chemically synthesized
tagtgctgtatatatgatgaat

SEQ ID NO: 86927 - DNA, 22 bp, Artificial Sequence
  chemically synthesized
agtgctgtatatatgatgaatc

SEQ ID NO: 86928 - DNA, 22 bp, Artificial Sequence
  chemically synthesized
gtgctgtatatatgatgaatca

SEQ ID NO: 86929 - DNA, 22 bp, Artificial Sequence
  chemically synthesized
tatatatgatgaatcacattta

SEQ ID NO: 86930 - DNA, 22 bp, Artificial Sequence
  chemically synthesized
atcaatttgtatatgctgaacc

SEQ ID NO: 86931 - DNA, 22 bp, Artificial Sequence
  chemically synthesized
tcaatttgtatatgctgaacca

SEQ ID NO: 86932 - DNA, 22 bp, Artificial Sequence
  chemically synthesized
gtatatgctgaaccaatcttgc

SEQ ID NO: 86933 - DNA, 22 bp, Artificial Sequence
  chemically synthesized
tatatgctgaaccaatcttgct

SEQ ID NO: 86934 - DNA, 22 bp, Artificial Sequence
  chemically synthesized
aaccaatcttgcttctcaggga

SEQ ID NO: 86935 - DNA, 22 bp, Artificial Sequence
  chemically synthesized
gcttctcagggataaagcctac

SEQ ID NO: 86936 - DNA, 22 bp, Artificial Sequence
  chemically synthesized
cttctcagggataaagcctact

SEQ ID NO: 86937 - DNA, 22 bp, Artificial Sequence
  chemically synthesized
ctcagggataaagcctacttga

SEQ ID NO: 86938 - DNA, 22 bp, Artificial Sequence
  chemically synthesized
tcagggataaagcctacttgat

SEQ ID NO: 86939 - DNA, 22 bp, Artificial Sequence
  chemically synthesized
agggataaagcctacttgattg

SEQ ID NO: 86940 - DNA, 22 bp, Artificial Sequence
  chemically synthesized
cttgattgaggtggattagctt

SEQ ID NO: 86941 - DNA, 22 bp, Artificial Sequence
  chemically synthesized
gattgaggtggattagctttgt

SEQ ID NO: 86942 - DNA, 22 bp, Artificial Sequence
  chemically synthesized
attgaggtggattagctttgtg

SEQ ID NO: 86943 - DNA, 22 bp, Artificial Sequence
  chemically synthesized
aggtggattagctttgtgatgt

SEQ ID NO: 86944 - DNA, 22 bp, Artificial Sequence
  chemically synthesized
gctttgtgatgtgttgctggat

SEQ ID NO: 86945 - DNA, 22 bp, Artificial Sequence
  chemically synthesized
tgtgatgtgttgctggatttgg

SEQ ID NO: 86946 - DNA, 22 bp, Artificial Sequence
  chemically synthesized
gtgatgtgttgctggatttggc

SEQ ID NO: 86947 - DNA, 22 bp, Artificial Sequence
  chemically synthesized
tgatgtgttgctggatttggct

SEQ ID NO: 86948 - DNA, 22 bp, Artificial Sequence
  chemically synthesized
ctggatttggcttgctagtatt

SEQ ID NO: 86949 - DNA, 22 bp, Artificial Sequence
  chemically synthesized
gatttggcttgctagtattttt

SEQ ID NO: 86950 - DNA, 22 bp, Artificial Sequence
  chemically synthesized
ggcttgctagtatttttgcatc

SEQ ID NO: 86951 - DNA, 22 bp, Artificial Sequence
  chemically synthesized
gcttgctagtatttttgcatca

SEQ ID NO: 86952 - DNA, 22 bp, Artificial Sequence
  chemically synthesized
gctagtatttttgcatcaatgt

SEQ ID NO: 86953 - DNA, 22 bp, Artificial Sequence
  chemically synthesized
ctagtatttttgcatcaatgtt

SEQ ID NO: 86954 - DNA, 22 bp, Artificial Sequence
  chemically synthesized
gtatttttgcatcaatgttcaa

SEQ ID NO: 86955 - DNA, 22 bp, Artificial Sequence
  chemically synthesized
ttgcatcaatgttcaaggatat

SEQ ID NO: 86956 - DNA, 22 bp, Artificial Sequence
  chemically synthesized
tgcatcaatgttcaaggatatt

SEQ ID NO: 86957 - DNA, 22 bp, Artificial Sequence
  chemically synthesized
gcatcaatgttcaaggatattg

SEQ ID NO: 86958 - DNA, 22 bp, Artificial Sequence
  chemically synthesized
catcaatgttcaaggatattgg

SEQ ID NO: 86959 - DNA, 22 bp, Artificial Sequence
  chemically synthesized
aaggatattggcctgaagtttt

SEQ ID NO: 86960 - DNA, 22 bp, Artificial Sequence
  chemically synthesized
gcctgaagttttctttttttgt

SEQ ID NO: 86961 - DNA, 22 bp, Artificial Sequence
  chemically synthesized
aagttttctttttttgttgttg

SEQ ID NO: 86962 - DNA, 22 bp, Artificial Sequence
  chemically synthesized
tctttttttgttgttgtgtgtc

SEQ ID NO: 86963 - DNA, 22 bp, Artificial Sequence
  chemically synthesized
ctttttttgttgttgtgtgtct

SEQ ID NO: 86964 - DNA, 22 bp, Artificial Sequence
  chemically synthesized
tttttttgttgttgtgtgtcta

SEQ ID NO: 86965 - DNA, 22 bp, Artificial Sequence
  chemically synthesized
tttttgttgttgtgtgtctatc

SEQ ID NO: 86966 - DNA, 22 bp, Artificial Sequence
  chemically synthesized
ttttgttgttgtgtgtctatca

SEQ ID NO: 86967 - DNA, 22 bp, Artificial Sequence
  chemically synthesized
tttgttgttgtgtgtctatcag

SEQ ID NO: 86968 - DNA, 22 bp, Artificial Sequence
  chemically synthesized
ttgttgttgtgtgtctatcagg

SEQ ID NO: 86969 - DNA, 22 bp, Artificial Sequence
  chemically synthesized
tgttgttgtgtgtctatcaggt

SEQ ID NO: 86970 - DNA, 22 bp, Artificial Sequence
  chemically synthesized
gttgttgtgtgtctatcaggtt

SEQ ID NO: 86971 - DNA, 22 bp, Artificial Sequence
  chemically synthesized
ttgttgtgtgtctatcaggttt

SEQ ID NO: 86972 - DNA, 22 bp, Artificial Sequence
  chemically synthesized
ttgtgtgtctatcaggttttgg

SEQ ID NO: 86973 - DNA, 22 bp, Artificial Sequence
  chemically synthesized
tgtgtctatcaggttttggtat

SEQ ID NO: 86974 - DNA, 22 bp, Artificial Sequence
  chemically synthesized
tcaggttttggtatcaggatga

SEQ ID NO: 86975 - DNA, 22 bp, Artificial Sequence
  chemically synthesized
tggtatcaggatgatgctggcc

SEQ ID NO: 86976 - DNA, 22 bp, Artificial Sequence
  chemically synthesized
ggtatcaggatgatgctggcct

SEQ ID NO: 86977 - DNA, 22 bp, Artificial Sequence
  chemically synthesized
gtatcaggatgatgctggcctc

SEQ ID NO: 86978 - DNA, 22 bp, Artificial Sequence
  chemically synthesized
gcctcataaaatgagctgaggt

SEQ ID NO: 86979 - DNA, 22 bp, Artificial Sequence
  chemically synthesized
ataaaatgagctgaggttgaat

SEQ ID NO: 86980 - DNA, 22 bp, Artificial Sequence
  chemically synthesized
aggttgaatccctccccctcaa

SEQ ID NO: 86981 - DNA, 22 bp, Artificial Sequence
  chemically synthesized
aatccctccccctcaatttttt

SEQ ID NO: 86982 - DNA, 22 bp, Artificial Sequence
  chemically synthesized
cccctcaattttttggagtagc

SEQ ID NO: 86983 - DNA, 22 bp, Artificial Sequence
  chemically synthesized
aattttttggagtagcttcagt

SEQ ID NO: 86984 - DNA, 22 bp, Artificial Sequence
  chemically synthesized
tttggagtagcttcagtaggaa

SEQ ID NO: 86985 - DNA, 22 bp, Artificial Sequence
  chemically synthesized
ttggagtagcttcagtaggaat

SEQ ID NO: 86986 - DNA, 22 bp, Artificial Sequence
  chemically synthesized
tggagtagcttcagtaggaatt

SEQ ID NO: 86987 - DNA, 22 bp, Artificial Sequence
  chemically synthesized
ggagtagcttcagtaggaattt

SEQ ID NO: 86988 - DNA, 22 bp, Artificial Sequence
  chemically synthesized
gagtagcttcagtaggaatttt

SEQ ID NO: 86989 - DNA, 22 bp, Artificial Sequence
  chemically synthesized
cagtaggaatttttccaactct

SEQ ID NO: 86990 - DNA, 22 bp, Artificial Sequence
  chemically synthesized
agtaggaatttttccaactctt

SEQ ID NO: 86991 - DNA, 22 bp, Artificial Sequence
  chemically synthesized
ttccaactcttctttgtgcatc

SEQ ID NO: 86992 - DNA, 22 bp, Artificial Sequence
  chemically synthesized
tccaactcttctttgtgcatct

SEQ ID NO: 86993 - DNA, 22 bp, Artificial Sequence
  chemically synthesized
ccaactcttctttgtgcatctg

SEQ ID NO: 86994 - DNA, 22 bp, Artificial Sequence
  chemically synthesized
caactcttctttgtgcatctga

SEQ ID NO: 86995 - DNA, 22 bp, Artificial Sequence
  chemically synthesized
ttctttgtgcatctgatagaat

SEQ ID NO: 86996 - DNA, 22 bp, Artificial Sequence
  chemically synthesized
ctttgtgcatctgatagaattt

SEQ ID NO: 86997 - DNA, 22 bp, Artificial Sequence
  chemically synthesized
tttgtgcatctgatagaatttg

SEQ ID NO: 86998 - DNA, 22 bp, Artificial Sequence
  chemically synthesized
tgtgcatctgatagaatttggt

SEQ ID NO: 86999 - DNA, 22 bp, Artificial Sequence
  chemically synthesized
gtgcatctgatagaatttggtt

SEQ ID NO: 87000 - DNA, 22 bp, Artificial Sequence
  chemically synthesized
tgcatctgatagaatttggttg

SEQ ID NO: 87001 - DNA, 22 bp, Artificial Sequence
  chemically synthesized
atagaatttggttgtgaatcat

SEQ ID NO: 87002 - DNA, 22 bp, Artificial Sequence
  chemically synthesized
ggttgtgaatcatattgtccag

SEQ ID NO: 87003 - DNA, 22 bp, Artificial Sequence
  chemically synthesized
gttgtgaatcatattgtccagg

SEQ ID NO: 87004 - DNA, 22 bp, Artificial Sequence
  chemically synthesized
tgaatcatattgtccagggctt

SEQ ID NO: 87005 - DNA, 22 bp, Artificial Sequence
  chemically synthesized
tccagggctttttttgtttgat

SEQ ID NO: 87006 - DNA, 22 bp, Artificial Sequence
  chemically synthesized
tttttgtttgataggctattta

SEQ ID NO: 87007 - DNA, 22 bp, Artificial Sequence
  chemically synthesized
ttttgtttgataggctatttat

SEQ ID NO: 87008 - DNA, 22 bp, Artificial Sequence
  chemically synthesized
tttgtttgataggctatttatt

SEQ ID NO: 87009 - DNA, 22 bp, Artificial Sequence
  chemically synthesized
ttgtttgataggctatttatta

SEQ ID NO: 87010 - DNA, 22 bp, Artificial Sequence
  chemically synthesized
tgtttgataggctatttattac

SEQ ID NO: 87011 - DNA, 22 bp, Artificial Sequence
  chemically synthesized
gtttgataggctatttattact

SEQ ID NO: 87012 - DNA, 22 bp, Artificial Sequence
  chemically synthesized
tttgataggctatttattactg

SEQ ID NO: 87013 - DNA, 22 bp, Artificial Sequence
  chemically synthesized
gataggctatttattactgaat

SEQ ID NO: 87014 - DNA, 22 bp, Artificial Sequence
  chemically synthesized
ataggctatttattactgaatc

SEQ ID NO: 87015 - DNA, 22 bp, Artificial Sequence
  chemically synthesized
tttattactgaatcattttcag

SEQ ID NO: 87016 - DNA, 22 bp, Artificial Sequence
  chemically synthesized
attactgaatcattttcagagc

SEQ ID NO: 87017 - DNA, 22 bp, Artificial Sequence
  chemically synthesized
ttactgaatcattttcagagct

SEQ ID NO: 87018 - DNA, 22 bp, Artificial Sequence
  chemically synthesized
ctgaatcattttcagagctcat

SEQ ID NO: 87019 - DNA, 22 bp, Artificial Sequence
  chemically synthesized
aatcattttcagagctcatcat

SEQ ID NO: 87020 - DNA, 22 bp, Artificial Sequence
  chemically synthesized
tcagagctcatcatggatctct

SEQ ID NO: 87021 - DNA, 22 bp, Artificial Sequence
  chemically synthesized
cagagctcatcatggatctctt

SEQ ID NO: 87022 - DNA, 22 bp, Artificial Sequence
  chemically synthesized
agagctcatcatggatctcttc

SEQ ID NO: 87023 - DNA, 22 bp, Artificial Sequence
  chemically synthesized
atcatggatctcttcaggaaat

SEQ ID NO: 87024 - DNA, 22 bp, Artificial Sequence
  chemically synthesized
ttcaggaaattgatttcttcct

SEQ ID NO: 87025 - DNA, 22 bp, Artificial Sequence
  chemically synthesized
caggaaattgatttcttcctgg

SEQ ID NO: 87026 - DNA, 22 bp, Artificial Sequence
  chemically synthesized
aggaaattgatttcttcctggt

SEQ ID NO: 87027 - DNA, 22 bp, Artificial Sequence
  chemically synthesized
atttcttcctggttcagccttg

SEQ ID NO: 87028 - DNA, 22 bp, Artificial Sequence
  chemically synthesized
cttcctggttcagccttgggag

SEQ ID NO: 87029 - DNA, 22 bp, Artificial Sequence
  chemically synthesized
ttcctggttcagccttgggagg

SEQ ID NO: 87030 - DNA, 22 bp, Artificial Sequence
  chemically synthesized
cctggttcagccttgggaggac

SEQ ID NO: 87031 - DNA, 22 bp, Artificial Sequence
  chemically synthesized
ctggttcagccttgggaggacc

SEQ ID NO: 87032 - DNA, 22 bp, Artificial Sequence
  chemically synthesized
gttcagccttgggaggacctaa

SEQ ID NO: 87033 - DNA, 22 bp, Artificial Sequence
  chemically synthesized
agccttgggaggacctaaaaca

SEQ ID NO: 87034 - DNA, 22 bp, Artificial Sequence
  chemically synthesized
gggaggacctaaaacaatcctc

SEQ ID NO: 87035 - DNA, 22 bp, Artificial Sequence
  chemically synthesized
ggaggacctaaaacaatcctca

SEQ ID NO: 87036 - DNA, 22 bp, Artificial Sequence
  chemically synthesized
aaacaatcctcagcaaatgcaa

SEQ ID NO: 87037 - DNA, 22 bp, Artificial Sequence
  chemically synthesized
agcaaatgcaaaaaaaaaatca

SEQ ID NO: 87038 - DNA, 22 bp, Artificial Sequence
  chemically synthesized
tcagaccacagaggaataaaaa

SEQ ID NO: 87039 - DNA, 22 bp, Artificial Sequence
  chemically synthesized
agaccacagaggaataaaaata

SEQ ID NO: 87040 - DNA, 22 bp, Artificial Sequence
  chemically synthesized
caagactaatgaatagctgaaa

SEQ ID NO: 87041 - DNA, 22 bp, Artificial Sequence
  chemically synthesized
aagactaatgaatagctgaaaa

SEQ ID NO: 87042 - DNA, 22 bp, Artificial Sequence
  chemically synthesized
atgaatagctgaaaactatgca

SEQ ID NO: 87043 - DNA, 22 bp, Artificial Sequence
  chemically synthesized
aaaactatgcaattacatggaa

SEQ ID NO: 87044 - DNA, 22 bp, Artificial Sequence
  chemically synthesized
tgcaattacatggaaattaaac

SEQ ID NO: 87045 - DNA, 22 bp, Artificial Sequence
  chemically synthesized
catggaaattaaacaacctgct

SEQ ID NO: 87046 - DNA, 22 bp, Artificial Sequence
  chemically synthesized
aacaacctgctcctgaatgaat

SEQ ID NO: 87047 - DNA, 22 bp, Artificial Sequence
  chemically synthesized
ctcctgaatgaattttgggtaa

SEQ ID NO: 87048 - DNA, 22 bp, Artificial Sequence
  chemically synthesized
ctgaatgaattttgggtaaata

SEQ ID NO: 87049 - DNA, 22 bp, Artificial Sequence
  chemically synthesized
aatgaattttgggtaaataatg

SEQ ID NO: 87050 - DNA, 22 bp, Artificial Sequence
  chemically synthesized
tgggtaaataatgaaaactaag

SEQ ID NO: 87051 - DNA, 22 bp, Artificial Sequence
  chemically synthesized
gggtaaataatgaaaactaagg

SEQ ID NO: 87052 - DNA, 22 bp, Artificial Sequence
  chemically synthesized
ggtaaataatgaaaactaaggc

SEQ ID NO: 87053 - DNA, 22 bp, Artificial Sequence
  chemically synthesized
aggcaaaaataaaatagttctt

SEQ ID NO: 87054 - DNA, 22 bp, Artificial Sequence
  chemically synthesized
tttgaaactaatgagaacaaag

SEQ ID NO: 87055 - DNA, 22 bp, Artificial Sequence
  chemically synthesized
tgaaactaatgagaacaaagat

SEQ ID NO: 87056 - DNA, 22 bp, Artificial Sequence
  chemically synthesized
gaaactaatgagaacaaagata

SEQ ID NO: 87057 - DNA, 22 bp, Artificial Sequence
  chemically synthesized
aaactaatgagaacaaagatac

SEQ ID NO: 87058 - DNA, 22 bp, Artificial Sequence
  chemically synthesized
atgagaacaaagatacaatata

SEQ ID NO: 87059 - DNA, 22 bp, Artificial Sequence
  chemically synthesized
tgggacacagcttagacagtgt

SEQ ID NO: 87060 - DNA, 22 bp, Artificial Sequence
  chemically synthesized
ggacacagcttagacagtgtta

SEQ ID NO: 87061 - DNA, 22 bp, Artificial Sequence
  chemically synthesized
agacagtgttaagagagaaatt

SEQ ID NO: 87062 - DNA, 22 bp, Artificial Sequence
  chemically synthesized
gacagtgttaagagagaaattt

SEQ ID NO: 87063 - DNA, 22 bp, Artificial Sequence
  chemically synthesized
agagagaaatttatacactaaa

SEQ ID NO: 87064 - DNA, 22 bp, Artificial Sequence
  chemically synthesized
atacactaaatgcccacatcaa

SEQ ID NO: 87065 - DNA, 22 bp, Artificial Sequence
  chemically synthesized
tacactaaatgcccacatcaaa

SEQ ID NO: 87066 - DNA, 22 bp, Artificial Sequence
  chemically synthesized
aatgcccacatcaaaaagtctt

SEQ ID NO: 87067 - DNA, 22 bp, Artificial Sequence
  chemically synthesized
aaagccctcaaattaacaacct

SEQ ID NO: 87068 - DNA, 22 bp, Artificial Sequence
  chemically synthesized
aagccctcaaattaacaaccta

SEQ ID NO: 87069 - DNA, 22 bp, Artificial Sequence
  chemically synthesized
aaattaacaacctaatgtcaca

SEQ ID NO: 87070 - DNA, 22 bp, Artificial Sequence
  chemically synthesized
acaacctaatgtcacaactaaa

SEQ ID NO: 87071 - DNA, 22 bp, Artificial Sequence
  chemically synthesized
atgtcacaactaaaagaaccag

SEQ ID NO: 87072 - DNA, 22 bp, Artificial Sequence
  chemically synthesized
aaagaaccagagaaccaagagc

SEQ ID NO: 87073 - DNA, 22 bp, Artificial Sequence
  chemically synthesized
aatctagcagaagacaagaaat

SEQ ID NO: 87074 - DNA, 22 bp, Artificial Sequence
  chemically synthesized
gcagaagacaagaaataaacaa

SEQ ID NO: 87075 - DNA, 22 bp, Artificial Sequence
  chemically synthesized
actgaaggatattaaaacacaa

SEQ ID NO: 87076 - DNA, 22 bp, Artificial Sequence
  chemically synthesized
aaggatattaaaacacaaaata

SEQ ID NO: 87077 - DNA, 22 bp, Artificial Sequence
  chemically synthesized
aaacacaaaataccattcaaaa

SEQ ID NO: 87078 - DNA, 22 bp, Artificial Sequence
  chemically synthesized
aaaagattaatgagtccaagag

SEQ ID NO: 87079 - DNA, 22 bp, Artificial Sequence
  chemically synthesized
atgagtccaagagctggttttg

SEQ ID NO: 87080 - DNA, 22 bp, Artificial Sequence
  chemically synthesized
gttttgtgaaaaaattaataag

SEQ ID NO: 87081 - DNA, 22 bp, Artificial Sequence
  chemically synthesized
tgtgaaaaaattaataaggtag

SEQ ID NO: 87082 - DNA, 22 bp, Artificial Sequence
  chemically synthesized
gtgaaaaaattaataaggtaga

SEQ ID NO: 87083 - DNA, 22 bp, Artificial Sequence
  chemically synthesized
tgaaaaaattaataaggtagat

SEQ ID NO: 87084 - DNA, 22 bp, Artificial Sequence
  chemically synthesized
ataaggtagatcactagctaga

SEQ ID NO: 87085 - DNA, 22 bp, Artificial Sequence
  chemically synthesized
gctagactaataaagaagacaa

SEQ ID NO: 87086 - DNA, 22 bp, Artificial Sequence
  chemically synthesized
gactaataaagaagacaagaga

SEQ ID NO: 87087 - DNA, 22 bp, Artificial Sequence
  chemically synthesized
ataaagaagacaagagagaaga

SEQ ID NO: 87088 - DNA, 22 bp, Artificial Sequence
  chemically synthesized
gaaatgaaaaagggaatattat

SEQ ID NO: 87089 - DNA, 22 bp, Artificial Sequence
  chemically synthesized
tcactcaccccacagaaataca

SEQ ID NO: 87090 - DNA, 22 bp, Artificial Sequence
  chemically synthesized
accccacagaaatacaaataat

SEQ ID NO: 87091 - DNA, 22 bp, Artificial Sequence
  chemically synthesized
ctatgaacatctctatgtacat

SEQ ID NO: 87092 - DNA, 22 bp, Artificial Sequence
  chemically synthesized
tgaacatctctatgtacataaa

SEQ ID NO: 87093 - DNA, 22 bp, Artificial Sequence
  chemically synthesized
tatgtacataaactagaaaatc

SEQ ID NO: 87094 - DNA, 22 bp, Artificial Sequence
  chemically synthesized
tgtacataaactagaaaatcta

SEQ ID NO: 87095 - DNA, 22 bp, Artificial Sequence
  chemically synthesized
gaaaatctaaaagaaatggata

SEQ ID NO: 87096 - DNA, 22 bp, Artificial Sequence
  chemically synthesized
aaagaaatggataacttcctgg

SEQ ID NO: 87097 - DNA, 22 bp, Artificial Sequence
  chemically synthesized
cctggactgctcattgtcttag

SEQ ID NO: 87098 - DNA, 22 bp, Artificial Sequence
  chemically synthesized
ctggactgctcattgtcttagg

SEQ ID NO: 87099 - DNA, 22 bp, Artificial Sequence
  chemically synthesized
gactgctcattgtcttaggcaa

SEQ ID NO: 87100 - DNA, 22 bp, Artificial Sequence
  chemically synthesized
ctcattgtcttaggcaaagaag

SEQ ID NO: 87101 - DNA, 22 bp, Artificial Sequence
  chemically synthesized
attgtcttaggcaaagaagact

SEQ ID NO: 87102 - DNA, 22 bp, Artificial Sequence
  chemically synthesized
tcttaggcaaagaagactagcc

SEQ ID NO: 87103 - DNA, 22 bp, Artificial Sequence
  chemically synthesized
aggcaaagaagactagccgtac

SEQ ID NO: 87104 - DNA, 22 bp, Artificial Sequence
  chemically synthesized
ggcaaagaagactagccgtact

SEQ ID NO: 87105 - DNA, 22 bp, Artificial Sequence
  chemically synthesized
gccgtactttatttgagggctc

SEQ ID NO: 87106 - DNA, 22 bp, Artificial Sequence
  chemically synthesized
tatttgagggctctttgagtag

SEQ ID NO: 87107 - DNA, 22 bp, Artificial Sequence
  chemically synthesized
atttgagggctctttgagtaga

SEQ ID NO: 87108 - DNA, 22 bp, Artificial Sequence
  chemically synthesized
tttgagggctctttgagtagag

SEQ ID NO: 87109 - DNA, 22 bp, Artificial Sequence
  chemically synthesized
gagggctctttgagtagagtcc

SEQ ID NO: 87110 - DNA, 22 bp, Artificial Sequence
  chemically synthesized
agggctctttgagtagagtcct

SEQ ID NO: 87111 - DNA, 22 bp, Artificial Sequence
  chemically synthesized
tttgagtagagtcctataaatt

SEQ ID NO: 87112 - DNA, 22 bp, Artificial Sequence
  chemically synthesized
tgagtagagtcctataaattcc

SEQ ID NO: 87113 - DNA, 22 bp, Artificial Sequence
  chemically synthesized
gagtagagtcctataaattcct

SEQ ID NO: 87114 - DNA, 22 bp, Artificial Sequence
  chemically synthesized
agtagagtcctataaattcctg

SEQ ID NO: 87115 - DNA, 22 bp, Artificial Sequence
  chemically synthesized
taaattcctgtatttctctcaa

SEQ ID NO: 87116 - DNA, 22 bp, Artificial Sequence
  chemically synthesized
ctgtatttctctcaactctatg

SEQ ID NO: 87117 - DNA, 22 bp, Artificial Sequence
  chemically synthesized
tatttctctcaactctatgtcc

SEQ ID NO: 87118 - DNA, 22 bp, Artificial Sequence
  chemically synthesized
ctctcaactctatgtccccctc

SEQ ID NO: 87119 - DNA, 22 bp, Artificial Sequence
  chemically synthesized
tctcaactctatgtccccctcc

SEQ ID NO: 87120 - DNA, 22 bp, Artificial Sequence
  chemically synthesized
tcaactctatgtccccctcccc

SEQ ID NO: 87121 - DNA, 22 bp, Artificial Sequence
  chemically synthesized
aactctatgtccccctccccag

SEQ ID NO: 87122 - DNA, 22 bp, Artificial Sequence
  chemically synthesized
tatgtccccctccccagaatac

SEQ ID NO: 87123 - DNA, 22 bp, Artificial Sequence
  chemically synthesized
tgtccccctccccagaatacaa

SEQ ID NO: 87124 - DNA, 22 bp, Artificial Sequence
  chemically synthesized
cccagaatacaaagccccttct

SEQ ID NO: 87125 - DNA, 22 bp, Artificial Sequence
  chemically synthesized
ctgtgatgcctcctttgcttct

SEQ ID NO: 87126 - DNA, 22 bp, Artificial Sequence
  chemically synthesized
tgtgatgcctcctttgcttctt

SEQ ID NO: 87127 - DNA, 22 bp, Artificial Sequence
  chemically synthesized
tgatgcctcctttgcttctttt

SEQ ID NO: 87128 - DNA, 22 bp, Artificial Sequence
  chemically synthesized
ctttgcttcttttggttatatc

SEQ ID NO: 87129 - DNA, 22 bp, Artificial Sequence
  chemically synthesized
tgcttcttttggttatatctgt

SEQ ID NO: 87130 - DNA, 22 bp, Artificial Sequence
  chemically synthesized
gcttcttttggttatatctgtg

SEQ ID NO: 87131 - DNA, 22 bp, Artificial Sequence
  chemically synthesized
cttcttttggttatatctgtgt

SEQ ID NO: 87132 - DNA, 22 bp, Artificial Sequence
  chemically synthesized
cttttggttatatctgtgttat

SEQ ID NO: 87133 - DNA, 22 bp, Artificial Sequence
  chemically synthesized
ttttggttatatctgtgttata

SEQ ID NO: 87134 - DNA, 22 bp, Artificial Sequence
  chemically synthesized
ttggttatatctgtgttatatc

SEQ ID NO: 87135 - DNA, 22 bp, Artificial Sequence
  chemically synthesized
tggttatatctgtgttatatct

SEQ ID NO: 87136 - DNA, 22 bp, Artificial Sequence
  chemically synthesized
ggttatatctgtgttatatctg

SEQ ID NO: 87137 - DNA, 22 bp, Artificial Sequence
  chemically synthesized
gttatatctgtgttatatctga

SEQ ID NO: 87138 - DNA, 22 bp, Artificial Sequence
  chemically synthesized
tatctgtgttatatctgaatat

SEQ ID NO: 87139 - DNA, 22 bp, Artificial Sequence
  chemically synthesized
tgttatatctgaatatatggct

SEQ ID NO: 87140 - DNA, 22 bp, Artificial Sequence
  chemically synthesized
tatctgaatatatggctctaga

SEQ ID NO: 87141 - DNA, 22 bp, Artificial Sequence
  chemically synthesized
aatatatggctctagagaatcc

SEQ ID NO: 87142 - DNA, 22 bp, Artificial Sequence
  chemically synthesized
tagagaatcccaagaaatagaa

SEQ ID NO: 87143 - DNA, 22 bp, Artificial Sequence
  chemically synthesized
gagaatcccaagaaatagaaaa

SEQ ID NO: 87144 - DNA, 22 bp, Artificial Sequence
  chemically synthesized
gtccaaaatccaagctctgaat

SEQ ID NO: 87145 - DNA, 22 bp, Artificial Sequence
  chemically synthesized
tgaataagacaggtgagacctt

SEQ ID NO: 87146 - DNA, 22 bp, Artificial Sequence
  chemically synthesized
aataagacaggtgagacctttg

SEQ ID NO: 87147 - DNA, 22 bp, Artificial Sequence
  chemically synthesized
tggatgaatatcttttcacaaa

SEQ ID NO: 87148 - DNA, 22 bp, Artificial Sequence
  chemically synthesized
ggatgaatatcttttcacaaag

SEQ ID NO: 87149 - DNA, 22 bp, Artificial Sequence
  chemically synthesized
gatgaatatcttttcacaaagt

SEQ ID NO: 87150 - DNA, 22 bp, Artificial Sequence
  chemically synthesized
ttcacaaagttgagaagatgtg

SEQ ID NO: 87151 - DNA, 22 bp, Artificial Sequence
  chemically synthesized
tcacaaagttgagaagatgtga

SEQ ID NO: 87152 - DNA, 22 bp, Artificial Sequence
  chemically synthesized
cacaaagttgagaagatgtgaa

SEQ ID NO: 87153 - DNA, 22 bp, Artificial Sequence
  chemically synthesized
acaaagttgagaagatgtgaag

SEQ ID NO: 87154 - DNA, 22 bp, Artificial Sequence
  chemically synthesized
agaagatgtgaagaacccaaga

SEQ ID NO: 87155 - DNA, 22 bp, Artificial Sequence
  chemically synthesized
gagaaacagccccgaggcactg

SEQ ID NO: 87156 - DNA, 22 bp, Artificial Sequence
  chemically synthesized
caaggggttcagacctgtgttg

SEQ ID NO: 87157 - DNA, 22 bp, Artificial Sequence
  chemically synthesized
agacctgtgttggagaatatca

SEQ ID NO: 87158 - DNA, 22 bp, Artificial Sequence
  chemically synthesized
tgttggagaatatcatcaccgt

SEQ ID NO: 87159 - DNA, 22 bp, Artificial Sequence
  chemically synthesized
gagaatatcatcaccgtaacaa

SEQ ID NO: 87160 - DNA, 22 bp, Artificial Sequence
  chemically synthesized
ctatgttcttaatatctgtgtg

SEQ ID NO: 87161 - DNA, 22 bp, Artificial Sequence
  chemically synthesized
tatgttcttaatatctgtgtgt

SEQ ID NO: 87162 - DNA, 22 bp, Artificial Sequence
  chemically synthesized
tgttcttaatatctgtgtgttt

SEQ ID NO: 87163 - DNA, 22 bp, Artificial Sequence
  chemically synthesized
ttaatatctgtgtgtttgtttg

SEQ ID NO: 87164 - DNA, 22 bp, Artificial Sequence
  chemically synthesized
aatatctgtgtgtttgtttgtt

SEQ ID NO: 87165 - DNA, 22 bp, Artificial Sequence
  chemically synthesized
atatctgtgtgtttgtttgttt

SEQ ID NO: 87166 - DNA, 22 bp, Artificial Sequence
  chemically synthesized
tgtgtttgtttgtttgtttttt

SEQ ID NO: 87167 - DNA, 22 bp, Artificial Sequence
  chemically synthesized
gtttgtttgttttttgcttgtt

SEQ ID NO: 87168 - DNA, 22 bp, Artificial Sequence
  chemically synthesized
tttgtttgttttttgcttgttt

SEQ ID NO: 87169 - DNA, 22 bp, Artificial Sequence
  chemically synthesized
gtttgttttttgcttgtttgtt

SEQ ID NO: 87170 - DNA, 22 bp, Artificial Sequence
  chemically synthesized
tttgttttttgcttgtttgttt

SEQ ID NO: 87171 - DNA, 22 bp, Artificial Sequence
  chemically synthesized
gttttttgcttgtttgtttgtt

SEQ ID NO: 87172 - DNA, 22 bp, Artificial Sequence
  chemically synthesized
ttttttgcttgtttgtttgttt

SEQ ID NO: 87173 - DNA, 22 bp, Artificial Sequence
  chemically synthesized
tttgcttgtttgtttgtttttc

SEQ ID NO: 87174 - DNA, 22 bp, Artificial Sequence
  chemically synthesized
ttgcttgtttgtttgtttttcc

SEQ ID NO: 87175 - DNA, 22 bp, Artificial Sequence
  chemically synthesized
tgcttgtttgtttgtttttcct

SEQ ID NO: 87176 - DNA, 22 bp, Artificial Sequence
  chemically synthesized
gcttgtttgtttgtttttcctc

SEQ ID NO: 87177 - DNA, 22 bp, Artificial Sequence
  chemically synthesized
cttgtttgtttgtttttcctca

SEQ ID NO: 87178 - DNA, 22 bp, Artificial Sequence
  chemically synthesized
gtttgtttgtttttcctcagag

SEQ ID NO: 87179 - DNA, 22 bp, Artificial Sequence
  chemically synthesized
tttgtttgtttttcctcagaga

SEQ ID NO: 87180 - DNA, 22 bp, Artificial Sequence
  chemically synthesized
gtttgtttttcctcagagacag

SEQ ID NO: 87181 - DNA, 22 bp, Artificial Sequence
  chemically synthesized
tttgtttttcctcagagacagg

SEQ ID NO: 87182 - DNA, 22 bp, Artificial Sequence
  chemically synthesized
gtttttcctcagagacaggatc

SEQ ID NO: 87183 - DNA, 22 bp, Artificial Sequence
  chemically synthesized
tttttcctcagagacaggatct

SEQ ID NO: 87184 - DNA, 22 bp, Artificial Sequence
  chemically synthesized
ttcctcagagacaggatctcag

SEQ ID NO: 87185 - DNA, 22 bp, Artificial Sequence
  chemically synthesized
tcctcagagacaggatctcagt

SEQ ID NO: 87186 - DNA, 22 bp, Artificial Sequence
  chemically synthesized
cctcagagacaggatctcagtc

SEQ ID NO: 87187 - DNA, 22 bp, Artificial Sequence
  chemically synthesized
ctcagagacaggatctcagtca

SEQ ID NO: 87188 - DNA, 22 bp, Artificial Sequence
  chemically synthesized
agagacaggatctcagtcacca

SEQ ID NO: 87189 - DNA, 22 bp, Artificial Sequence
  chemically synthesized
agtcaccaaggctagagagcag

SEQ ID NO: 87190 - DNA, 22 bp, Artificial Sequence
  chemically synthesized
gagagcagtggtgtcattattg

SEQ ID NO: 87191 - DNA, 22 bp, Artificial Sequence
  chemically synthesized
ttgctcactgcaaccctgaaat

SEQ ID NO: 87192 - DNA, 22 bp, Artificial Sequence
  chemically synthesized
ctcactgcaaccctgaaatcct

SEQ ID NO: 87193 - DNA, 22 bp, Artificial Sequence
  chemically synthesized
actgcaaccctgaaatcctggg

SEQ ID NO: 87194 - DNA, 22 bp, Artificial Sequence
  chemically synthesized
caaccctgaaatcctgggctca

SEQ ID NO: 87195 - DNA, 22 bp, Artificial Sequence
  chemically synthesized
aaatcctgggctcaagtgatcc

SEQ ID NO: 87196 - DNA, 22 bp, Artificial Sequence
  chemically synthesized
ggctcaagtgatcctatcactt

SEQ ID NO: 87197 - DNA, 22 bp, Artificial Sequence
  chemically synthesized
aagtgatcctatcacttcagcc

SEQ ID NO: 87198 - DNA, 22 bp, Artificial Sequence
  chemically synthesized
tcacttcagcctcctgggttac

SEQ ID NO: 87199 - DNA, 22 bp, Artificial Sequence
  chemically synthesized
cagcctcctgggttactgggac

SEQ ID NO: 87200 - DNA, 22 bp, Artificial Sequence
  chemically synthesized
agcctcctgggttactgggact

SEQ ID NO: 87201 - DNA, 22 bp, Artificial Sequence
  chemically synthesized
ctgggttactgggactacagat

SEQ ID NO: 87202 - DNA, 22 bp, Artificial Sequence
  chemically synthesized
ggttactgggactacagatgca

SEQ ID NO: 87203 - DNA, 22 bp, Artificial Sequence
  chemically synthesized
ctgggactacagatgcaagcca

SEQ ID NO: 87204 - DNA, 22 bp, Artificial Sequence
  chemically synthesized
ggactacagatgcaagccactg

SEQ ID NO: 87205 - DNA, 22 bp, Artificial Sequence
  chemically synthesized
cagatgcaagccactgtgccca

SEQ ID NO: 87206 - DNA, 22 bp, Artificial Sequence
  chemically synthesized
tgcccagcttggctctttcttt

SEQ ID NO: 87207 - DNA, 22 bp, Artificial Sequence
  chemically synthesized
ggctctttctttttattttaat

SEQ ID NO: 87208 - DNA, 22 bp, Artificial Sequence
  chemically synthesized
gctctttctttttattttaatt

SEQ ID NO: 87209 - DNA, 22 bp, Artificial Sequence
  chemically synthesized
tttctttttattttaattggtc

SEQ ID NO: 87210 - DNA, 22 bp, Artificial Sequence
  chemically synthesized
tctttttattttaattggtcac

SEQ ID NO: 87211 - DNA, 22 bp, Artificial Sequence
  chemically synthesized
ctttttattttaattggtcact

SEQ ID NO: 87212 - DNA, 22 bp, Artificial Sequence
  chemically synthesized
tttttattttaattggtcactt

SEQ ID NO: 87213 - DNA, 22 bp, Artificial Sequence
  chemically synthesized
tttattttaattggtcactttg

SEQ ID NO: 87214 - DNA, 22 bp, Artificial Sequence
  chemically synthesized
ttattttaattggtcactttgt

SEQ ID NO: 87215 - DNA, 22 bp, Artificial Sequence
  chemically synthesized
tattttaattggtcactttgtt

SEQ ID NO: 87216 - DNA, 22 bp, Artificial Sequence
  chemically synthesized
attttaattggtcactttgttt

SEQ ID NO: 87217 - DNA, 22 bp, Artificial Sequence
  chemically synthesized
ttttaattggtcactttgtttt

SEQ ID NO: 87218 - DNA, 22 bp, Artificial Sequence
  chemically synthesized
taattggtcactttgttttcag

SEQ ID NO: 87219 - DNA, 22 bp, Artificial Sequence
  chemically synthesized
aattggtcactttgttttcaga

SEQ ID NO: 87220 - DNA, 22 bp, Artificial Sequence
  chemically synthesized
attggtcactttgttttcagac

SEQ ID NO: 87221 - DNA, 22 bp, Artificial Sequence
  chemically synthesized
gtcactttgttttcagacctct

SEQ ID NO: 87222 - DNA, 22 bp, Artificial Sequence
  chemically synthesized
tgttttcagacctcttgttatc

SEQ ID NO: 87223 - DNA, 22 bp, Artificial Sequence
  chemically synthesized
gttttcagacctcttgttatct

SEQ ID NO: 87224 - DNA, 22 bp, Artificial Sequence
  chemically synthesized
ttttcagacctcttgttatctt

SEQ ID NO: 87225 - DNA, 22 bp, Artificial Sequence
  chemically synthesized
tcagacctcttgttatctttaa

SEQ ID NO: 87226 - DNA, 22 bp, Artificial Sequence
  chemically synthesized
cagacctcttgttatctttaat

SEQ ID NO: 87227 - DNA, 22 bp, Artificial Sequence
  chemically synthesized
agacctcttgttatctttaatc

SEQ ID NO: 87228 - DNA, 22 bp, Artificial Sequence
  chemically synthesized
ttgttatctttaatcatttttc

SEQ ID NO: 87229 - DNA, 22 bp, Artificial Sequence
  chemically synthesized
gttatctttaatcatttttcac

SEQ ID NO: 87230 - DNA, 22 bp, Artificial Sequence
  chemically synthesized
ttatctttaatcatttttcacc

SEQ ID NO: 87231 - DNA, 22 bp, Artificial Sequence
  chemically synthesized
tctttaatcatttttcacctct

SEQ ID NO: 87232 - DNA, 22 bp, Artificial Sequence
  chemically synthesized
taatcatttttcacctctgact

SEQ ID NO: 87233 - DNA, 22 bp, Artificial Sequence
  chemically synthesized
aatcatttttcacctctgactt

SEQ ID NO: 87234 - DNA, 22 bp, Artificial Sequence
  chemically synthesized
atcatttttcacctctgacttg

SEQ ID NO: 87235 - DNA, 22 bp, Artificial Sequence
  chemically synthesized
ttcacctctgacttgacctccc

SEQ ID NO: 87236 - DNA, 22 bp, Artificial Sequence
  chemically synthesized
tcacctctgacttgacctccca

SEQ ID NO: 87237 - DNA, 22 bp, Artificial Sequence
  chemically synthesized
cacctctgacttgacctcccag

SEQ ID NO: 87238 - DNA, 22 bp, Artificial Sequence
  chemically synthesized
acctctgacttgacctcccagt

SEQ ID NO: 87239 - DNA, 22 bp, Artificial Sequence
  chemically synthesized
tgacttgacctcccagttgtca

SEQ ID NO: 87240 - DNA, 22 bp, Artificial Sequence
  chemically synthesized
acttgacctcccagttgtcaaa

SEQ ID NO: 87241 - DNA, 22 bp, Artificial Sequence
  chemically synthesized
gacctcccagttgtcaaatatt

SEQ ID NO: 87242 - DNA, 22 bp, Artificial Sequence
  chemically synthesized
acctcccagttgtcaaatattt

SEQ ID NO: 87243 - DNA, 22 bp, Artificial Sequence
  chemically synthesized
ccagttgtcaaatatttgactt

SEQ ID NO: 87244 - DNA, 22 bp, Artificial Sequence
  chemically synthesized
tcaaatatttgacttaatggga

SEQ ID NO: 87245 - DNA, 22 bp, Artificial Sequence
  chemically synthesized
gacttaatgggagactttcccc

SEQ ID NO: 87246 - DNA, 22 bp, Artificial Sequence
  chemically synthesized
acttaatgggagactttcccct

SEQ ID NO: 87247 - DNA, 22 bp, Artificial Sequence
  chemically synthesized
aatgggagactttcccctagct

SEQ ID NO: 87248 - DNA, 22 bp, Artificial Sequence
  chemically synthesized
atgggagactttcccctagctt

SEQ ID NO: 87249 - DNA, 22 bp, Artificial Sequence
  chemically synthesized
tcccctagcttgttgattccag

SEQ ID NO: 87250 - DNA, 22 bp, Artificial Sequence
  chemically synthesized
cccctagcttgttgattccaga

SEQ ID NO: 87251 - DNA, 22 bp, Artificial Sequence
  chemically synthesized
ccctagcttgttgattccagaa

SEQ ID NO: 87252 - DNA, 22 bp, Artificial Sequence
  chemically synthesized
gcttgttgattccagaaattca

SEQ ID NO: 87253 - DNA, 22 bp, Artificial Sequence
  chemically synthesized
gttgattccagaaattcaactt

SEQ ID NO: 87254 - DNA, 22 bp, Artificial Sequence
  chemically synthesized
ttgattccagaaattcaacttt

SEQ ID NO: 87255 - DNA, 22 bp, Artificial Sequence
  chemically synthesized
attccagaaattcaactttatt

SEQ ID NO: 87256 - DNA, 22 bp, Artificial Sequence
  chemically synthesized
cagaaattcaactttattctag

SEQ ID NO: 87257 - DNA, 22 bp, Artificial Sequence
  chemically synthesized
aactttattctaggcttggctc

SEQ ID NO: 87258 - DNA, 22 bp, Artificial Sequence
  chemically synthesized
tattctaggcttggctcctgtt

SEQ ID NO: 87259 - DNA, 22 bp, Artificial Sequence
  chemically synthesized
attctaggcttggctcctgttt

SEQ ID NO: 87260 - DNA, 22 bp, Artificial Sequence
  chemically synthesized
ttctaggcttggctcctgttta

SEQ ID NO: 87261 - DNA, 22 bp, Artificial Sequence
  chemically synthesized
taggcttggctcctgtttagta

SEQ ID NO: 87262 - DNA, 22 bp, Artificial Sequence
  chemically synthesized
ggcttggctcctgtttagtatt

SEQ ID NO: 87263 - DNA, 22 bp, Artificial Sequence
  chemically synthesized
ggctcctgtttagtattgctgc

SEQ ID NO: 87264 - DNA, 22 bp, Artificial Sequence
  chemically synthesized
gctcctgtttagtattgctgct

SEQ ID NO: 87265 - DNA, 22 bp, Artificial Sequence
  chemically synthesized
ctgtttagtattgctgctttga

SEQ ID NO: 87266 - DNA, 22 bp, Artificial Sequence
  chemically synthesized
tttagtattgctgctttgagat

SEQ ID NO: 87267 - DNA, 22 bp, Artificial Sequence
  chemically synthesized
agtattgctgctttgagattgt

SEQ ID NO: 87268 - DNA, 22 bp, Artificial Sequence
  chemically synthesized
gtattgctgctttgagattgtt

SEQ ID NO: 87269 - DNA, 22 bp, Artificial Sequence
  chemically synthesized
ctgctttgagattgttctggtt

SEQ ID NO: 87270 - DNA, 22 bp, Artificial Sequence
  chemically synthesized
ctttgagattgttctggttcat

SEQ ID NO: 87271 - DNA, 22 bp, Artificial Sequence
  chemically synthesized
tgagattgttctggttcatgaa

SEQ ID NO: 87272 - DNA, 22 bp, Artificial Sequence
  chemically synthesized
gagattgttctggttcatgaaa

SEQ ID NO: 87273 - DNA, 22 bp, Artificial Sequence
  chemically synthesized
agattgttctggttcatgaaaa

SEQ ID NO: 87274 - DNA, 22 bp, Artificial Sequence
  chemically synthesized
ttctggttcatgaaaaacaagt

SEQ ID NO: 87275 - DNA, 22 bp, Artificial Sequence
  chemically synthesized
tggttcatgaaaaacaagtctc

SEQ ID NO: 87276 - DNA, 22 bp, Artificial Sequence
  chemically synthesized
gttcatgaaaaacaagtctcca

SEQ ID NO: 87277 - DNA, 22 bp, Artificial Sequence
  chemically synthesized
atgaaaaacaagtctccaaaat

SEQ ID NO: 87278 - DNA, 22 bp, Artificial Sequence
  chemically synthesized
caaaattttctacttctcaata

SEQ ID NO: 87279 - DNA, 22 bp, Artificial Sequence
  chemically synthesized
tctacttctcaatattgccatt

SEQ ID NO: 87280 - DNA, 22 bp, Artificial Sequence
  chemically synthesized
ctacttctcaatattgccattt

SEQ ID NO: 87281 - DNA, 22 bp, Artificial Sequence
  chemically synthesized
tacttctcaatattgccattta

SEQ ID NO: 87282 - DNA, 22 bp, Artificial Sequence
  chemically synthesized
cttctcaatattgccatttact

SEQ ID NO: 87283 - DNA, 22 bp, Artificial Sequence
  chemically synthesized
ctcaatattgccatttactaaa

SEQ ID NO: 87284 - DNA, 22 bp, Artificial Sequence
  chemically synthesized
tcaatattgccatttactaaat

SEQ ID NO: 87285 - DNA, 22 bp, Artificial Sequence
  chemically synthesized
aatattgccatttactaaattc

SEQ ID NO: 87286 - DNA, 22 bp, Artificial Sequence
  chemically synthesized
ccatttactaaattcttataaa

SEQ ID NO: 87287 - DNA, 22 bp, Artificial Sequence
  chemically synthesized
actaaattcttataaacaaata

SEQ ID NO: 87288 - DNA, 22 bp, Artificial Sequence
  chemically synthesized
ctaaattcttataaacaaataa

SEQ ID NO: 87289 - DNA, 22 bp, Artificial Sequence
  chemically synthesized
aattcttataaacaaataagaa

SEQ ID NO: 87290 - DNA, 22 bp, Artificial Sequence
  chemically synthesized
ttataaacaaataagaaggaag

SEQ ID NO: 87291 - DNA, 22 bp, Artificial Sequence
  chemically synthesized
ataaacaaataagaaggaagac

SEQ ID NO: 87292 - DNA, 22 bp, Artificial Sequence
  chemically synthesized
taaacaaataagaaggaagact

SEQ ID NO: 87293 - DNA, 22 bp, Artificial Sequence
  chemically synthesized
tcagaaatatatggagagactg

SEQ ID NO: 87294 - DNA, 22 bp, Artificial Sequence
  chemically synthesized
agaaatatatggagagactgag

SEQ ID NO: 87295 - DNA, 22 bp, Artificial Sequence
  chemically synthesized
aggttagagttgagcaaggcct

SEQ ID NO: 87296 - DNA, 22 bp, Artificial Sequence
  chemically synthesized
gagttgagcaaggcctgaaatt

SEQ ID NO: 87297 - DNA, 22 bp, Artificial Sequence
  chemically synthesized
agcaaggcctgaaattttgtca

SEQ ID NO: 87298 - DNA, 22 bp, Artificial Sequence
  chemically synthesized
aaattttgtcacaactaatcta

SEQ ID NO: 87299 - DNA, 22 bp, Artificial Sequence
  chemically synthesized
tgtcacaactaatctagttgaa

SEQ ID NO: 87300 - DNA, 22 bp, Artificial Sequence
  chemically synthesized
gtcacaactaatctagttgaag

SEQ ID NO: 87301 - DNA, 22 bp, Artificial Sequence
  chemically synthesized
tcacaactaatctagttgaagg

SEQ ID NO: 87302 - DNA, 22 bp, Artificial Sequence
  chemically synthesized
atctagttgaaggaatgttaac

SEQ ID NO: 87303 - DNA, 22 bp, Artificial Sequence
  chemically synthesized
gttgaaggaatgttaactgact

SEQ ID NO: 87304 - DNA, 22 bp, Artificial Sequence
  chemically synthesized
aaggaatgttaactgactgaga

SEQ ID NO: 87305 - DNA, 22 bp, Artificial Sequence
  chemically synthesized
actgactgagaaaacactaaat

SEQ ID NO: 87306 - DNA, 22 bp, Artificial Sequence
  chemically synthesized
actgagaaaacactaaatttct

SEQ ID NO: 87307 - DNA, 22 bp, Artificial Sequence
  chemically synthesized
agaaaacactaaatttctgtct

SEQ ID NO: 87308 - DNA, 22 bp, Artificial Sequence
  chemically synthesized
aatttctgtctatttcaaagag

SEQ ID NO: 87309 - DNA, 22 bp, Artificial Sequence
  chemically synthesized
ctgtctatttcaaagagaaaga

SEQ ID NO: 87310 - DNA, 22 bp, Artificial Sequence
  chemically synthesized
tgtctatttcaaagagaaagac

SEQ ID NO: 87311 - DNA, 22 bp, Artificial Sequence
  chemically synthesized
tctatttcaaagagaaagactt

SEQ ID NO: 87312 - DNA, 22 bp, Artificial Sequence
  chemically synthesized
tttcaaagagaaagacttgata

SEQ ID NO: 87313 - DNA, 22 bp, Artificial Sequence
  chemically synthesized
caaagagaaagacttgataatg

SEQ ID NO: 87314 - DNA, 22 bp, Artificial Sequence
  chemically synthesized
aaagagaaagacttgataatgg

SEQ ID NO: 87315 - DNA, 22 bp, Artificial Sequence
  chemically synthesized
gataatggctctacggatgtgt

SEQ ID NO: 87316 - DNA, 22 bp, Artificial Sequence
  chemically synthesized
ataatggctctacggatgtgtg

SEQ ID NO: 87317 - DNA, 22 bp, Artificial Sequence
  chemically synthesized
tacggatgtgtgagatcagttt

SEQ ID NO: 87318 - DNA, 22 bp, Artificial Sequence
  chemically synthesized
cggatgtgtgagatcagtttta

SEQ ID NO: 87319 - DNA, 22 bp, Artificial Sequence
  chemically synthesized
taataggataacttttttttat

SEQ ID NO: 87320 - DNA, 22 bp, Artificial Sequence
  chemically synthesized
aataggataacttttttttatt

SEQ ID NO: 87321 - DNA, 22 bp, Artificial Sequence
  chemically synthesized
ataggataacttttttttatta

SEQ ID NO: 87322 - DNA, 22 bp, Artificial Sequence
  chemically synthesized
ttttttattattatacttcaag

SEQ ID NO: 87323 - DNA, 22 bp, Artificial Sequence
  chemically synthesized
tttttattattatacttcaagt

SEQ ID NO: 87324 - DNA, 22 bp, Artificial Sequence
  chemically synthesized
ttttattattatacttcaagtt

SEQ ID NO: 87325 - DNA, 22 bp, Artificial Sequence
  chemically synthesized
tttattattatacttcaagttt

SEQ ID NO: 87326 - DNA, 22 bp, Artificial Sequence
  chemically synthesized
ttattattatacttcaagtttt

SEQ ID NO: 87327 - DNA, 22 bp, Artificial Sequence
  chemically synthesized
tattattatacttcaagtttta

SEQ ID NO: 87328 - DNA, 22 bp, Artificial Sequence
  chemically synthesized
attattatacttcaagttttag

SEQ ID NO: 87329 - DNA, 22 bp, Artificial Sequence
  chemically synthesized
ttattatacttcaagttttagg

SEQ ID NO: 87330 - DNA, 22 bp, Artificial Sequence
  chemically synthesized
ttatacttcaagttttagggta

SEQ ID NO: 87331 - DNA, 22 bp, Artificial Sequence
  chemically synthesized
tacttcaagttttagggtacat

SEQ ID NO: 87332 - DNA, 22 bp, Artificial Sequence
  chemically synthesized
caagttttagggtacatgtgca

SEQ ID NO: 87333 - DNA, 22 bp, Artificial Sequence
  chemically synthesized
aagttttagggtacatgtgcac

SEQ ID NO: 87334 - DNA, 22 bp, Artificial Sequence
  chemically synthesized
tagggtacatgtgcacaacatg

SEQ ID NO: 87335 - DNA, 22 bp, Artificial Sequence
  chemically synthesized
agggtacatgtgcacaacatgc

SEQ ID NO: 87336 - DNA, 22 bp, Artificial Sequence
  chemically synthesized
gggtacatgtgcacaacatgca

SEQ ID NO: 87337 - DNA, 22 bp, Artificial Sequence
  chemically synthesized
gttatatatgtatacatgtgcc

SEQ ID NO: 87338 - DNA, 22 bp, Artificial Sequence
  chemically synthesized
ttatatatgtatacatgtgcca

SEQ ID NO: 87339 - DNA, 22 bp, Artificial Sequence
  chemically synthesized
tatatgtatacatgtgccatgt

SEQ ID NO: 87340 - DNA, 22 bp, Artificial Sequence
  chemically synthesized
gtgtgctgcacccattaactcg

SEQ ID NO: 87341 - DNA, 22 bp, Artificial Sequence
  chemically synthesized
cacccattaactcgtcatttag

SEQ ID NO: 87342 - DNA, 22 bp, Artificial Sequence
  chemically synthesized
actcgtcatttagcattaggta

SEQ ID NO: 87343 - DNA, 22 bp, Artificial Sequence
  chemically synthesized
gtcatttagcattaggtatatc

SEQ ID NO: 87344 - DNA, 22 bp, Artificial Sequence
  chemically synthesized
agcattaggtatatctcctagt

SEQ ID NO: 87345 - DNA, 22 bp, Artificial Sequence
  chemically synthesized
gcattaggtatatctcctagtg

SEQ ID NO: 87346 - DNA, 22 bp, Artificial Sequence
  chemically synthesized
ggtatatctcctagtgctatcc

SEQ ID NO: 87347 - DNA, 22 bp, Artificial Sequence
  chemically synthesized
ctagtgctatccctgcccctgc

SEQ ID NO: 87348 - DNA, 22 bp, Artificial Sequence
  chemically synthesized
gtgctatccctgcccctgcccc

SEQ ID NO: 87349 - DNA, 22 bp, Artificial Sequence
  chemically synthesized
tccctgcccctgccccccaccc

SEQ ID NO: 87350 - DNA, 22 bp, Artificial Sequence
  chemically synthesized
cccctgccccccaccccataac

SEQ ID NO: 87351 - DNA, 22 bp, Artificial Sequence
  chemically synthesized
ccccccaccccataacagtccc

SEQ ID NO: 87352 - DNA, 22 bp, Artificial Sequence
  chemically synthesized
ctcttcatgtgtccatgtgttc

SEQ ID NO: 87353 - DNA, 22 bp, Artificial Sequence
  chemically synthesized
ttcatgtgtccatgtgttctca

SEQ ID NO: 87354 - DNA, 22 bp, Artificial Sequence
  chemically synthesized
catgtgtccatgtgttctcatt

SEQ ID NO: 87355 - DNA, 22 bp, Artificial Sequence
  chemically synthesized
atgtgtccatgtgttctcattg

SEQ ID NO: 87356 - DNA, 22 bp, Artificial Sequence
  chemically synthesized
tcattgttcaattcccacctat

SEQ ID NO: 87357 - DNA, 22 bp, Artificial Sequence
  chemically synthesized
attgttcaattcccacctatga

SEQ ID NO: 87358 - DNA, 22 bp, Artificial Sequence
  chemically synthesized
ttcaattcccacctatgagtga

SEQ ID NO: 87359 - DNA, 22 bp, Artificial Sequence
  chemically synthesized
aattcccacctatgagtgagaa

SEQ ID NO: 87360 - DNA, 22 bp, Artificial Sequence
  chemically synthesized
ccacctatgagtgagaacatgc

SEQ ID NO: 87361 - DNA, 22 bp, Artificial Sequence
  chemically synthesized
tgagtgagaacatgcggtgttt

SEQ ID NO: 87362 - DNA, 22 bp, Artificial Sequence
  chemically synthesized
ggtttattctccttgtgatagt

SEQ ID NO: 87363 - DNA, 22 bp, Artificial Sequence
  chemically synthesized
gtttattctccttgtgatagtt

SEQ ID NO: 87364 - DNA, 22 bp, Artificial Sequence
  chemically synthesized
attctccttgtgatagtttgct

SEQ ID NO: 87365 - DNA, 22 bp, Artificial Sequence
  chemically synthesized
ttctccttgtgatagtttgctg

SEQ ID NO: 87366 - DNA, 22 bp, Artificial Sequence
  chemically synthesized
tccttgtgatagtttgctgaga

SEQ ID NO: 87367 - DNA, 22 bp, Artificial Sequence
  chemically synthesized
cttgtgatagtttgctgagaat

SEQ ID NO: 87368 - DNA, 22 bp, Artificial Sequence
  chemically synthesized
gtgatagtttgctgagaatgat

SEQ ID NO: 87369 - DNA, 22 bp, Artificial Sequence
  chemically synthesized
tgatagtttgctgagaatgata

SEQ ID NO: 87370 - DNA, 22 bp, Artificial Sequence
  chemically synthesized
gctgagaatgatagtttccagc

SEQ ID NO: 87371 - DNA, 22 bp, Artificial Sequence
  chemically synthesized
ctgagaatgatagtttccagct

SEQ ID NO: 87372 - DNA, 22 bp, Artificial Sequence
  chemically synthesized
agaatgatagtttccagcttca

SEQ ID NO: 87373 - DNA, 22 bp, Artificial Sequence
  chemically synthesized
ccagcttcatccatgtccctac

SEQ ID NO: 87374 - DNA, 22 bp, Artificial Sequence
  chemically synthesized
cagcttcatccatgtccctaca

SEQ ID NO: 87375 - DNA, 22 bp, Artificial Sequence
  chemically synthesized
catccatgtccctacaaaggac

SEQ ID NO: 87376 - DNA, 22 bp, Artificial Sequence
  chemically synthesized
atccatgtccctacaaaggaca

SEQ ID NO: 87377 - DNA, 22 bp, Artificial Sequence
  chemically synthesized
caaaggacatgaactcatcatt

SEQ ID NO: 87378 - DNA, 22 bp, Artificial Sequence
  chemically synthesized
atcattttttatggctgcatag

SEQ ID NO: 87379 - DNA, 22 bp, Artificial Sequence
  chemically synthesized
tttatggctgcatagtattcca

SEQ ID NO: 87380 - DNA, 22 bp, Artificial Sequence
  chemically synthesized
ttatggctgcatagtattccat

SEQ ID NO: 87381 - DNA, 22 bp, Artificial Sequence
  chemically synthesized
tatggctgcatagtattccatg

SEQ ID NO: 87382 - DNA, 22 bp, Artificial Sequence
  chemically synthesized
atggctgcatagtattccatgg

SEQ ID NO: 87383 - DNA, 22 bp, Artificial Sequence
  chemically synthesized
tggctgcatagtattccatggt

SEQ ID NO: 87384 - DNA, 22 bp, Artificial Sequence
  chemically synthesized
catagtattccatggtgtatat

SEQ ID NO: 87385 - DNA, 22 bp, Artificial Sequence
  chemically synthesized
catggtgtatatgtgccacatt

SEQ ID NO: 87386 - DNA, 22 bp, Artificial Sequence
  chemically synthesized
tcttaatccagtctatcgttgt

SEQ ID NO: 87387 - DNA, 22 bp, Artificial Sequence
  chemically synthesized
cttaatccagtctatcgttgtt

SEQ ID NO: 87388 - DNA, 22 bp, Artificial Sequence
  chemically synthesized
ttaatccagtctatcgttgttg

SEQ ID NO: 87389 - DNA, 22 bp, Artificial Sequence
  chemically synthesized
aatccagtctatcgttgttgga

SEQ ID NO: 87390 - DNA, 22 bp, Artificial Sequence
  chemically synthesized
atccagtctatcgttgttggac

SEQ ID NO: 87391 - DNA, 22 bp, Artificial Sequence
  chemically synthesized
tcgttgttggacatttgggttg

SEQ ID NO: 87392 - DNA, 22 bp, Artificial Sequence
  chemically synthesized
ttggacatttgggttggttcca

SEQ ID NO: 87393 - DNA, 22 bp, Artificial Sequence
  chemically synthesized
gacatttgggttggttccaagt

SEQ ID NO: 87394 - DNA, 22 bp, Artificial Sequence
  chemically synthesized
gggttggttccaagtctttgct

SEQ ID NO: 87395 - DNA, 22 bp, Artificial Sequence
  chemically synthesized
ggttggttccaagtctttgcta

SEQ ID NO: 87396 - DNA, 22 bp, Artificial Sequence
  chemically synthesized
gttccaagtctttgctattgtg

SEQ ID NO: 87397 - DNA, 22 bp, Artificial Sequence
  chemically synthesized
caagtctttgctattgtgaata

SEQ ID NO: 87398 - DNA, 22 bp, Artificial Sequence
  chemically synthesized
tgctattgtgaatagtgctgca

SEQ ID NO: 87399 - DNA, 22 bp, Artificial Sequence
  chemically synthesized
gctattgtgaatagtgctgcaa

SEQ ID NO: 87400 - DNA, 22 bp, Artificial Sequence
  chemically synthesized
ctattgtgaatagtgctgcaat

SEQ ID NO: 87401 - DNA, 22 bp, Artificial Sequence
  chemically synthesized
ttgtgaatagtgctgcaataaa

SEQ ID NO: 87402 - DNA, 22 bp, Artificial Sequence
  chemically synthesized
tgaatagtgctgcaataaacat

SEQ ID NO: 87403 - DNA, 22 bp, Artificial Sequence
  chemically synthesized
caataaacatacgtgtgcatgt

SEQ ID NO: 87404 - DNA, 22 bp, Artificial Sequence
  chemically synthesized
tatagcagcatgatttataatc

SEQ ID NO: 87405 - DNA, 22 bp, Artificial Sequence
  chemically synthesized
atagcagcatgatttataatcc

SEQ ID NO: 87406 - DNA, 22 bp, Artificial Sequence
  chemically synthesized
tagcagcatgatttataatcct

SEQ ID NO: 87407 - DNA, 22 bp, Artificial Sequence
  chemically synthesized
ataatcctttgggtatgtaccc

SEQ ID NO: 87408 - DNA, 22 bp, Artificial Sequence
  chemically synthesized
taatcctttgggtatgtaccca

SEQ ID NO: 87409 - DNA, 22 bp, Artificial Sequence
  chemically synthesized
tgggtatgtacccagtaatggg

SEQ ID NO: 87410 - DNA, 22 bp, Artificial Sequence
  chemically synthesized
gggtatgtacccagtaatggga

SEQ ID NO: 87411 - DNA, 22 bp, Artificial Sequence
  chemically synthesized
ggtatgtacccagtaatgggat

SEQ ID NO: 87412 - DNA, 22 bp, Artificial Sequence
  chemically synthesized
ggtcaaatggtatttctagttc

SEQ ID NO: 87413 - DNA, 22 bp, Artificial Sequence
  chemically synthesized
ctagttctagattcctgaggaa

SEQ ID NO: 87414 - DNA, 22 bp, Artificial Sequence
  chemically synthesized
tagttctagattcctgaggaat

SEQ ID NO: 87415 - DNA, 22 bp, Artificial Sequence
  chemically synthesized
gttctagattcctgaggaattg

SEQ ID NO: 87416 - DNA, 22 bp, Artificial Sequence
  chemically synthesized
tagattcctgaggaattgccac

SEQ ID NO: 87417 - DNA, 22 bp, Artificial Sequence
  chemically synthesized
gattcctgaggaattgccacac

SEQ ID NO: 87418 - DNA, 22 bp, Artificial Sequence
  chemically synthesized
ctgaggaattgccacactgact

SEQ ID NO: 87419 - DNA, 22 bp, Artificial Sequence
  chemically synthesized
aggaattgccacactgacttcc

SEQ ID NO: 87420 - DNA, 22 bp, Artificial Sequence
  chemically synthesized
ccacactgacttccgcaatggt

SEQ ID NO: 87421 - DNA, 22 bp, Artificial Sequence
  chemically synthesized
acttccgcaatggttgaactag

SEQ ID NO: 87422 - DNA, 22 bp, Artificial Sequence
  chemically synthesized
ccgcaatggttgaactagttta

SEQ ID NO: 87423 - DNA, 22 bp, Artificial Sequence
  chemically synthesized
cgcaatggttgaactagtttac

SEQ ID NO: 87424 - DNA, 22 bp, Artificial Sequence
  chemically synthesized
aactagtttacagtcccaccaa

SEQ ID NO: 87425 - DNA, 22 bp, Artificial Sequence
  chemically synthesized
gtttacagtcccaccaacagtg

SEQ ID NO: 87426 - DNA, 22 bp, Artificial Sequence
  chemically synthesized
acagtcccaccaacagtgtaaa

SEQ ID NO: 87427 - DNA, 22 bp, Artificial Sequence
  chemically synthesized
cagtcccaccaacagtgtaaaa

SEQ ID NO: 87428 - DNA, 22 bp, Artificial Sequence
  chemically synthesized
ttcctgtttctccacatcctct

SEQ ID NO: 87429 - DNA, 22 bp, Artificial Sequence
  chemically synthesized
ctgtttctccacatcctctcca

SEQ ID NO: 87430 - DNA, 22 bp, Artificial Sequence
  chemically synthesized
tttctccacatcctctccagca

SEQ ID NO: 87431 - DNA, 22 bp, Artificial Sequence
  chemically synthesized
ctccacatcctctccagcacct

SEQ ID NO: 87432 - DNA, 22 bp, Artificial Sequence
  chemically synthesized
tccacatcctctccagcacctg

SEQ ID NO: 87433 - DNA, 22 bp, Artificial Sequence
  chemically synthesized
cacatcctctccagcacctgtt

SEQ ID NO: 87434 - DNA, 22 bp, Artificial Sequence
  chemically synthesized
tccagcacctgttgtttcctga

SEQ ID NO: 87435 - DNA, 22 bp, Artificial Sequence
  chemically synthesized
cagcacctgttgtttcctgact

SEQ ID NO: 87436 - DNA, 22 bp, Artificial Sequence
  chemically synthesized
ttgtttcctgactttttaatga

SEQ ID NO: 87437 - DNA, 22 bp, Artificial Sequence
  chemically synthesized
tttcctgactttttaatgatcg

SEQ ID NO: 87438 - DNA, 22 bp, Artificial Sequence
  chemically synthesized
cctgactttttaatgatcgcca

SEQ ID NO: 87439 - DNA, 22 bp, Artificial Sequence
  chemically synthesized
ctgactttttaatgatcgccat

SEQ ID NO: 87440 - DNA, 22 bp, Artificial Sequence
  chemically synthesized
actttttaatgatcgccattct

SEQ ID NO: 87441 - DNA, 22 bp, Artificial Sequence
  chemically synthesized
tttaatgatcgccattctaact

SEQ ID NO: 87442 - DNA, 22 bp, Artificial Sequence
  chemically synthesized
ttaatgatcgccattctaactg

SEQ ID NO: 87443 - DNA, 22 bp, Artificial Sequence
  chemically synthesized
taatgatcgccattctaactgg

SEQ ID NO: 87444 - DNA, 22 bp, Artificial Sequence
  chemically synthesized
aatgatcgccattctaactggt

SEQ ID NO: 87445 - DNA, 22 bp, Artificial Sequence
  chemically synthesized
atgatcgccattctaactggtg

SEQ ID NO: 87446 - DNA, 22 bp, Artificial Sequence
  chemically synthesized
taactggtgtgagatggtatct

SEQ ID NO: 87447 - DNA, 22 bp, Artificial Sequence
  chemically synthesized
actggtgtgagatggtatctca

SEQ ID NO: 87448 - DNA, 22 bp, Artificial Sequence
  chemically synthesized
gtgtgagatggtatctcattgt

SEQ ID NO: 87449 - DNA, 22 bp, Artificial Sequence
  chemically synthesized
attgtggttttgatttgcattt

SEQ ID NO: 87450 - DNA, 22 bp, Artificial Sequence
  chemically synthesized
tggttttgatttgcatttctct

SEQ ID NO: 87451 - DNA, 22 bp, Artificial Sequence
  chemically synthesized
tgatttgcatttctctgatggc

SEQ ID NO: 87452 - DNA, 22 bp, Artificial Sequence
  chemically synthesized
gatttgcatttctctgatggct

SEQ ID NO: 87453 - DNA, 22 bp, Artificial Sequence
  chemically synthesized
atttgcatttctctgatggcta

SEQ ID NO: 87454 - DNA, 22 bp, Artificial Sequence
  chemically synthesized
gcatttctctgatggctagtga

SEQ ID NO: 87455 - DNA, 22 bp, Artificial Sequence
  chemically synthesized
catttctctgatggctagtgat

SEQ ID NO: 87456 - DNA, 22 bp, Artificial Sequence
  chemically synthesized
ctctgatggctagtgatgatga

SEQ ID NO: 87457 - DNA, 22 bp, Artificial Sequence
  chemically synthesized
tctgatggctagtgatgatgag

SEQ ID NO: 87458 - DNA, 22 bp, Artificial Sequence
  chemically synthesized
tgatggctagtgatgatgagca

SEQ ID NO: 87459 - DNA, 22 bp, Artificial Sequence
  chemically synthesized
atggctagtgatgatgagcatt

SEQ ID NO: 87460 - DNA, 22 bp, Artificial Sequence
  chemically synthesized
gtgatgatgagcattttttcat

SEQ ID NO: 87461 - DNA, 22 bp, Artificial Sequence
  chemically synthesized
tttcatgtgttttttgattaca

SEQ ID NO: 87462 - DNA, 22 bp, Artificial Sequence
  chemically synthesized
ttcatgtgttttttgattacat

SEQ ID NO: 87463 - DNA, 22 bp, Artificial Sequence
  chemically synthesized
tcatgtgttttttgattacata

SEQ ID NO: 87464 - DNA, 22 bp, Artificial Sequence
  chemically synthesized
catgtgttttttgattacataa

SEQ ID NO: 87465 - DNA, 22 bp, Artificial Sequence
  chemically synthesized
atgtgttttttgattacataaa

SEQ ID NO: 87466 - DNA, 22 bp, Artificial Sequence
  chemically synthesized
tttgattacataaatgtcttct

SEQ ID NO: 87467 - DNA, 22 bp, Artificial Sequence
  chemically synthesized
ttgattacataaatgtcttctt

SEQ ID NO: 87468 - DNA, 22 bp, Artificial Sequence
  chemically synthesized
tgattacataaatgtcttcttt

SEQ ID NO: 87469 - DNA, 22 bp, Artificial Sequence
  chemically synthesized
gattacataaatgtcttctttt

SEQ ID NO: 87470 - DNA, 22 bp, Artificial Sequence
  chemically synthesized
attacataaatgtcttcttttg

SEQ ID NO: 87471 - DNA, 22 bp, Artificial Sequence
  chemically synthesized
cataaatgtcttcttttgcgaa

SEQ ID NO: 87472 - DNA, 22 bp, Artificial Sequence
  chemically synthesized
cttttgcgaagtgtctgttcat

SEQ ID NO: 87473 - DNA, 22 bp, Artificial Sequence
  chemically synthesized
ttttgcgaagtgtctgttcata

SEQ ID NO: 87474 - DNA, 22 bp, Artificial Sequence
  chemically synthesized
ttgcgaagtgtctgttcatatc

SEQ ID NO: 87475 - DNA, 22 bp, Artificial Sequence
  chemically synthesized
tgcgaagtgtctgttcatatcc

SEQ ID NO: 87476 - DNA, 22 bp, Artificial Sequence
  chemically synthesized
gcgaagtgtctgttcatatcct

SEQ ID NO: 87477 - DNA, 22 bp, Artificial Sequence
  chemically synthesized
cgaagtgtctgttcatatcctt

SEQ ID NO: 87478 - DNA, 22 bp, Artificial Sequence
  chemically synthesized
ttcatatcctttgcccactttt

SEQ ID NO: 87479 - DNA, 22 bp, Artificial Sequence
  chemically synthesized
atatcctttgcccactttttga

SEQ ID NO: 87480 - DNA, 22 bp, Artificial Sequence
  chemically synthesized
tgcccactttttgatggggttg

SEQ ID NO: 87481 - DNA, 22 bp, Artificial Sequence
  chemically synthesized
gcccactttttgatggggttgt

SEQ ID NO: 87482 - DNA, 22 bp, Artificial Sequence
  chemically synthesized
cccactttttgatggggttgtt

SEQ ID NO: 87483 - DNA, 22 bp, Artificial Sequence
  chemically synthesized
tttgatggggttgtttgttttt

SEQ ID NO: 87484 - DNA, 22 bp, Artificial Sequence
  chemically synthesized
ttgatggggttgtttgtttttt

SEQ ID NO: 87485 - DNA, 22 bp, Artificial Sequence
  chemically synthesized
tgatggggttgtttgttttttc

SEQ ID NO: 87486 - DNA, 22 bp, Artificial Sequence
  chemically synthesized
gatggggttgtttgttttttct

SEQ ID NO: 87487 - DNA, 22 bp, Artificial Sequence
  chemically synthesized
atggggttgtttgttttttctt

SEQ ID NO: 87488 - DNA, 22 bp, Artificial Sequence
  chemically synthesized
tttgttttttcttgtaaatttg

SEQ ID NO: 87489 - DNA, 22 bp, Artificial Sequence
  chemically synthesized
gttttttcttgtaaatttgttt

SEQ ID NO: 87490 - DNA, 22 bp, Artificial Sequence
  chemically synthesized
ttttttcttgtaaatttgtttg

SEQ ID NO: 87491 - DNA, 22 bp, Artificial Sequence
  chemically synthesized
tttcttgtaaatttgtttgagt

SEQ ID NO: 87492 - DNA, 22 bp, Artificial Sequence
  chemically synthesized
ttcttgtaaatttgtttgagtt

SEQ ID NO: 87493 - DNA, 22 bp, Artificial Sequence
  chemically synthesized
tcttgtaaatttgtttgagttc

SEQ ID NO: 87494 - DNA, 22 bp, Artificial Sequence
  chemically synthesized
cttgtaaatttgtttgagttca

SEQ ID NO: 87495 - DNA, 22 bp, Artificial Sequence
  chemically synthesized
ttgtaaatttgtttgagttcat

SEQ ID NO: 87496 - DNA, 22 bp, Artificial Sequence
  chemically synthesized
gtaaatttgtttgagttcattg

SEQ ID NO: 87497 - DNA, 22 bp, Artificial Sequence
  chemically synthesized
taaatttgtttgagttcattgt

SEQ ID NO: 87498 - DNA, 22 bp, Artificial Sequence
  chemically synthesized
gtttgagttcattgtagattct

SEQ ID NO: 87499 - DNA, 22 bp, Artificial Sequence
  chemically synthesized
tttgagttcattgtagattctg

SEQ ID NO: 87500 - DNA, 22 bp, Artificial Sequence
  chemically synthesized
gagttcattgtagattctggat

SEQ ID NO: 87501 - DNA, 22 bp, Artificial Sequence
  chemically synthesized
agttcattgtagattctggata

SEQ ID NO: 87502 - DNA, 22 bp, Artificial Sequence
  chemically synthesized
attgtagattctggatattagc

SEQ ID NO: 87503 - DNA, 22 bp, Artificial Sequence
  chemically synthesized
tagattctggatattagccctt

SEQ ID NO: 87504 - DNA, 22 bp, Artificial Sequence
  chemically synthesized
tggatattagccctttgtcaga

SEQ ID NO: 87505 - DNA, 22 bp, Artificial Sequence
  chemically synthesized
gatattagccctttgtcagatg

SEQ ID NO: 87506 - DNA, 22 bp, Artificial Sequence
  chemically synthesized
gccctttgtcagatgagtagat

SEQ ID NO: 87507 - DNA, 22 bp, Artificial Sequence
  chemically synthesized
tgtcagatgagtagattgcaaa

SEQ ID NO: 87508 - DNA, 22 bp, Artificial Sequence
  chemically synthesized
gtcagatgagtagattgcaaaa

SEQ ID NO: 87509 - DNA, 22 bp, Artificial Sequence
  chemically synthesized
tcagatgagtagattgcaaaaa

SEQ ID NO: 87510 - DNA, 22 bp, Artificial Sequence
  chemically synthesized
caaaaattttctcccattttgt

SEQ ID NO: 87511 - DNA, 22 bp, Artificial Sequence
  chemically synthesized
tctcccattttgtaggttgcct

SEQ ID NO: 87512 - DNA, 22 bp, Artificial Sequence
  chemically synthesized
ctcccattttgtaggttgcctg

SEQ ID NO: 87513 - DNA, 22 bp, Artificial Sequence
  chemically synthesized
tcccattttgtaggttgcctgt

SEQ ID NO: 87514 - DNA, 22 bp, Artificial Sequence
  chemically synthesized
ccattttgtaggttgcctgttc

SEQ ID NO: 87515 - DNA, 22 bp, Artificial Sequence
  chemically synthesized
tgtaggttgcctgttcactctg

SEQ ID NO: 87516 - DNA, 22 bp, Artificial Sequence
  chemically synthesized
gtaggttgcctgttcactctga

SEQ ID NO: 87517 - DNA, 22 bp, Artificial Sequence
  chemically synthesized
taggttgcctgttcactctgat

SEQ ID NO: 87518 - DNA, 22 bp, Artificial Sequence
  chemically synthesized
cctgttcactctgatggtagtt

SEQ ID NO: 87519 - DNA, 22 bp, Artificial Sequence
  chemically synthesized
ttcactctgatggtagtttctt

SEQ ID NO: 87520 - DNA, 22 bp, Artificial Sequence
  chemically synthesized
actctgatggtagtttctttag

SEQ ID NO: 87521 - DNA, 22 bp, Artificial Sequence
  chemically synthesized
tgatggtagtttctttagctgt

SEQ ID NO: 87522 - DNA, 22 bp, Artificial Sequence
  chemically synthesized
atggtagtttctttagctgtgc

SEQ ID NO: 87523 - DNA, 22 bp, Artificial Sequence
  chemically synthesized
ctttagctgtgcagaagctctt

SEQ ID NO: 87524 - DNA, 22 bp, Artificial Sequence
  chemically synthesized
tttagctgtgcagaagctcttt

SEQ ID NO: 87525 - DNA, 22 bp, Artificial Sequence
  chemically synthesized
tagctgtgcagaagctctttag

SEQ ID NO: 87526 - DNA, 22 bp, Artificial Sequence
  chemically synthesized
agctgtgcagaagctctttagt

SEQ ID NO: 87527 - DNA, 22 bp, Artificial Sequence
  chemically synthesized
gctgtgcagaagctctttagtt

SEQ ID NO: 87528 - DNA, 22 bp, Artificial Sequence
  chemically synthesized
tgcagaagctctttagtttaat

SEQ ID NO: 87529 - DNA, 22 bp, Artificial Sequence
  chemically synthesized
tttagtttaattagatcccgtt

SEQ ID NO: 87530 - DNA, 22 bp, Artificial Sequence
  chemically synthesized
tagtttaattagatcccgtttg

SEQ ID NO: 87531 - DNA, 22 bp, Artificial Sequence
  chemically synthesized
agtttaattagatcccgtttgt

SEQ ID NO: 87532 - DNA, 22 bp, Artificial Sequence
  chemically synthesized
gtttaattagatcccgtttgtc

SEQ ID NO: 87533 - DNA, 22 bp, Artificial Sequence
  chemically synthesized
aattagatcccgtttgtccatt

SEQ ID NO: 87534 - DNA, 22 bp, Artificial Sequence
  chemically synthesized
attagatcccgtttgtccattt

SEQ ID NO: 87535 - DNA, 22 bp, Artificial Sequence
  chemically synthesized
gatcccgtttgtccattttgtc

SEQ ID NO: 87536 - DNA, 22 bp, Artificial Sequence
  chemically synthesized
gtccattttgtcttttgttgcc

SEQ ID NO: 87537 - DNA, 22 bp, Artificial Sequence
  chemically synthesized
tccattttgtcttttgttgcca

SEQ ID NO: 87538 - DNA, 22 bp, Artificial Sequence
  chemically synthesized
tgtcttttgttgccattgcttt

SEQ ID NO: 87539 - DNA, 22 bp, Artificial Sequence
  chemically synthesized
gtcttttgttgccattgctttt

SEQ ID NO: 87540 - DNA, 22 bp, Artificial Sequence
  chemically synthesized
tcttttgttgccattgcttttg

SEQ ID NO: 87541 - DNA, 22 bp, Artificial Sequence
  chemically synthesized
ttgttgccattgcttttggtgt

SEQ ID NO: 87542 - DNA, 22 bp, Artificial Sequence
  chemically synthesized
tgttgccattgcttttggtgtt

SEQ ID NO: 87543 - DNA, 22 bp, Artificial Sequence
  chemically synthesized
gttgccattgcttttggtgttt

SEQ ID NO: 87544 - DNA, 22 bp, Artificial Sequence
  chemically synthesized
ttgccattgcttttggtgtttt

SEQ ID NO: 87545 - DNA, 22 bp, Artificial Sequence
  chemically synthesized
ccattgcttttggtgttttaga

SEQ ID NO: 87546 - DNA, 22 bp, Artificial Sequence
  chemically synthesized
cttttggtgttttagacatgaa

SEQ ID NO: 87547 - DNA, 22 bp, Artificial Sequence
  chemically synthesized
ttggtgttttagacatgaagtc

SEQ ID NO: 87548 - DNA, 22 bp, Artificial Sequence
  chemically synthesized
tggtgttttagacatgaagtcc

SEQ ID NO: 87549 - DNA, 22 bp, Artificial Sequence
  chemically synthesized
ggtgttttagacatgaagtcct

SEQ ID NO: 87550 - DNA, 22 bp, Artificial Sequence
  chemically synthesized
gtgttttagacatgaagtcctt

SEQ ID NO: 87551 - DNA, 22 bp, Artificial Sequence
  chemically synthesized
tagacatgaagtccttgcccat

SEQ ID NO: 87552 - DNA, 22 bp, Artificial Sequence
  chemically synthesized
agacatgaagtccttgcccatg

SEQ ID NO: 87553 - DNA, 22 bp, Artificial Sequence
  chemically synthesized
gacatgaagtccttgcccatgc

SEQ ID NO: 87554 - DNA, 22 bp, Artificial Sequence
  chemically synthesized
gcccatgcctatgtcctgaatg

SEQ ID NO: 87555 - DNA, 22 bp, Artificial Sequence
  chemically synthesized
cccatgcctatgtcctgaatgg

SEQ ID NO: 87556 - DNA, 22 bp, Artificial Sequence
  chemically synthesized
tgtcctgaatggtattgcctag

SEQ ID NO: 87557 - DNA, 22 bp, Artificial Sequence
  chemically synthesized
aatggtattgcctaggtttttt

SEQ ID NO: 87558 - DNA, 22 bp, Artificial Sequence
  chemically synthesized
cctaggtttttttctagggttt

SEQ ID NO: 87559 - DNA, 22 bp, Artificial Sequence
  chemically synthesized
ggtttttttctagggtttttat

SEQ ID NO: 87560 - DNA, 22 bp, Artificial Sequence
  chemically synthesized
ttttctagggtttttatggttt

SEQ ID NO: 87561 - DNA, 22 bp, Artificial Sequence
  chemically synthesized
tttctagggtttttatggtttt

SEQ ID NO: 87562 - DNA, 22 bp, Artificial Sequence
  chemically synthesized
ttctagggtttttatggtttta

SEQ ID NO: 87563 - DNA, 22 bp, Artificial Sequence
  chemically synthesized
tctagggtttttatggttttag

SEQ ID NO: 87564 - DNA, 22 bp, Artificial Sequence
  chemically synthesized
ctagggtttttatggttttagg

SEQ ID NO: 87565 - DNA, 22 bp, Artificial Sequence
  chemically synthesized
tagggtttttatggttttaggt

SEQ ID NO: 87566 - DNA, 22 bp, Artificial Sequence
  chemically synthesized
gggtttttatggttttaggtct

SEQ ID NO: 87567 - DNA, 22 bp, Artificial Sequence
  chemically synthesized
ttatggttttaggtctaacatg

SEQ ID NO: 87568 - DNA, 22 bp, Artificial Sequence
  chemically synthesized
tatggttttaggtctaacatgt

SEQ ID NO: 87569 - DNA, 22 bp, Artificial Sequence
  chemically synthesized
atggttttaggtctaacatgta

SEQ ID NO: 87570 - DNA, 22 bp, Artificial Sequence
  chemically synthesized
tggttttaggtctaacatgtaa

SEQ ID NO: 87571 - DNA, 22 bp, Artificial Sequence
  chemically synthesized
taggtctaacatgtaagtcttt

SEQ ID NO: 87572 - DNA, 22 bp, Artificial Sequence
  chemically synthesized
aggtctaacatgtaagtcttta

SEQ ID NO: 87573 - DNA, 22 bp, Artificial Sequence
  chemically synthesized
ggtctaacatgtaagtctttaa

SEQ ID NO: 87574 - DNA, 22 bp, Artificial Sequence
  chemically synthesized
acatgtaagtctttaatccatc

SEQ ID NO: 87575 - DNA, 22 bp, Artificial Sequence
  chemically synthesized
taatccatcttgaattaatttt

SEQ ID NO: 87576 - DNA, 22 bp, Artificial Sequence
  chemically synthesized
aatccatcttgaattaattttt

SEQ ID NO: 87577 - DNA, 22 bp, Artificial Sequence
  chemically synthesized
atccatcttgaattaatttttg

SEQ ID NO: 87578 - DNA, 22 bp, Artificial Sequence
  chemically synthesized
gaattaatttttgtataaggtg

SEQ ID NO: 87579 - DNA, 22 bp, Artificial Sequence
  chemically synthesized
aattaatttttgtataaggtgt

SEQ ID NO: 87580 - DNA, 22 bp, Artificial Sequence
  chemically synthesized
atttttgtataaggtgtaagga

SEQ ID NO: 87581 - DNA, 22 bp, Artificial Sequence
  chemically synthesized
ttgtataaggtgtaaggaaggg

SEQ ID NO: 87582 - DNA, 22 bp, Artificial Sequence
  chemically synthesized
tgtataaggtgtaaggaaggga

SEQ ID NO: 87583 - DNA, 22 bp, Artificial Sequence
  chemically synthesized
gtataaggtgtaaggaagggat

SEQ ID NO: 87584 - DNA, 22 bp, Artificial Sequence
  chemically synthesized
tataaggtgtaaggaagggatc

SEQ ID NO: 87585 - DNA, 22 bp, Artificial Sequence
  chemically synthesized
cagctttctacatatggctagc

SEQ ID NO: 87586 - DNA, 22 bp, Artificial Sequence
  chemically synthesized
agctttctacatatggctagcc

SEQ ID NO: 87587 - DNA, 22 bp, Artificial Sequence
  chemically synthesized
tctacatatggctagccagttt

SEQ ID NO: 87588 - DNA, 22 bp, Artificial Sequence
  chemically synthesized
ctacatatggctagccagtttt

SEQ ID NO: 87589 - DNA, 22 bp, Artificial Sequence
  chemically synthesized
tacatatggctagccagttttc

SEQ ID NO: 87590 - DNA, 22 bp, Artificial Sequence
  chemically synthesized
catatggctagccagttttccc

SEQ ID NO: 87591 - DNA, 22 bp, Artificial Sequence
  chemically synthesized
gccagttttcccagcaccattt

SEQ ID NO: 87592 - DNA, 22 bp, Artificial Sequence
  chemically synthesized
tcccagcaccatttattaaata

SEQ ID NO: 87593 - DNA, 22 bp, Artificial Sequence
  chemically synthesized
cccagcaccatttattaaatag

SEQ ID NO: 87594 - DNA, 22 bp, Artificial Sequence
  chemically synthesized
ccagcaccatttattaaatagg

SEQ ID NO: 87595 - DNA, 22 bp, Artificial Sequence
  chemically synthesized
attaaatagggaatcctttccc

SEQ ID NO: 87596 - DNA, 22 bp, Artificial Sequence
  chemically synthesized
ttaaatagggaatcctttcccc

SEQ ID NO: 87597 - DNA, 22 bp, Artificial Sequence
  chemically synthesized
aatagggaatcctttccccatt

SEQ ID NO: 87598 - DNA, 22 bp, Artificial Sequence
  chemically synthesized
tccccattgcttgtttctctca

SEQ ID NO: 87599 - DNA, 22 bp, Artificial Sequence
  chemically synthesized
ccccattgcttgtttctctcag

SEQ ID NO: 87600 - DNA, 22 bp, Artificial Sequence
  chemically synthesized
cccattgcttgtttctctcagg

SEQ ID NO: 87601 - DNA, 22 bp, Artificial Sequence
  chemically synthesized
cttgtttctctcaggtttgtca

SEQ ID NO: 87602 - DNA, 22 bp, Artificial Sequence
  chemically synthesized
gtttctctcaggtttgtcaaag

SEQ ID NO: 87603 - DNA, 22 bp, Artificial Sequence
  chemically synthesized
tttctctcaggtttgtcaaaga

SEQ ID NO: 87604 - DNA, 22 bp, Artificial Sequence
  chemically synthesized
ctctcaggtttgtcaaagatca

SEQ ID NO: 87605 - DNA, 22 bp, Artificial Sequence
  chemically synthesized
tctcaggtttgtcaaagatcag

SEQ ID NO: 87606 - DNA, 22 bp, Artificial Sequence
  chemically synthesized
tcaggtttgtcaaagatcagat

SEQ ID NO: 87607 - DNA, 22 bp, Artificial Sequence
  chemically synthesized
aggtttgtcaaagatcagatag

SEQ ID NO: 87608 - DNA, 22 bp, Artificial Sequence
  chemically synthesized
gtcaaagatcagatagttgtag

SEQ ID NO: 87609 - DNA, 22 bp, Artificial Sequence
  chemically synthesized
tcaaagatcagatagttgtaga

SEQ ID NO: 87610 - DNA, 22 bp, Artificial Sequence
  chemically synthesized
tagatatgcggcattatttctg

SEQ ID NO: 87611 - DNA, 22 bp, Artificial Sequence
  chemically synthesized
tttctgagggctctgttctgtt

SEQ ID NO: 87612 - DNA, 22 bp, Artificial Sequence
  chemically synthesized
ctgagggctctgttctgttcca

SEQ ID NO: 87613 - DNA, 22 bp, Artificial Sequence
  chemically synthesized
tgagggctctgttctgttccat

SEQ ID NO: 87614 - DNA, 22 bp, Artificial Sequence
  chemically synthesized
agggctctgttctgttccattg

SEQ ID NO: 87615 - DNA, 22 bp, Artificial Sequence
  chemically synthesized
tgttctgttccattggtctaga

SEQ ID NO: 87616 - DNA, 22 bp, Artificial Sequence
  chemically synthesized
ttctgttccattggtctagatc

SEQ ID NO: 87617 - DNA, 22 bp, Artificial Sequence
  chemically synthesized
tgttccattggtctagatctct

SEQ ID NO: 87618 - DNA, 22 bp, Artificial Sequence
  chemically synthesized
ttccattggtctagatctctgt

SEQ ID NO: 87619 - DNA, 22 bp, Artificial Sequence
  chemically synthesized
cattggtctagatctctgtttt

SEQ ID NO: 87620 - DNA, 22 bp, Artificial Sequence
  chemically synthesized
gtctagatctctgttttggtac

SEQ ID NO: 87621 - DNA, 22 bp, Artificial Sequence
  chemically synthesized
gatctctgttttggtaccagta

SEQ ID NO: 87622 - DNA, 22 bp, Artificial Sequence
  chemically synthesized
tgttttggtaccagtaccatgc

SEQ ID NO: 87623 - DNA, 22 bp, Artificial Sequence
  chemically synthesized
ttttggtaccagtaccatgctg

SEQ ID NO: 87624 - DNA, 22 bp, Artificial Sequence
  chemically synthesized
tggtaccagtaccatgctgttt

SEQ ID NO: 87625 - DNA, 22 bp, Artificial Sequence
  chemically synthesized
ggtaccagtaccatgctgtttt

SEQ ID NO: 87626 - DNA, 22 bp, Artificial Sequence
  chemically synthesized
gtaccagtaccatgctgttttg

SEQ ID NO: 87627 - DNA, 22 bp, Artificial Sequence
  chemically synthesized
ttttggttaccgtagcattgta

SEQ ID NO: 87628 - DNA, 22 bp, Artificial Sequence
  chemically synthesized
tggttaccgtagcattgtagta

SEQ ID NO: 87629 - DNA, 22 bp, Artificial Sequence
  chemically synthesized
ggttaccgtagcattgtagtat

SEQ ID NO: 87630 - DNA, 22 bp, Artificial Sequence
  chemically synthesized
gttaccgtagcattgtagtata

SEQ ID NO: 87631 - DNA, 22 bp, Artificial Sequence
  chemically synthesized
ccgtagcattgtagtatagttt

SEQ ID NO: 87632 - DNA, 22 bp, Artificial Sequence
  chemically synthesized
tagtatagtttgaagtcaggta

SEQ ID NO: 87633 - DNA, 22 bp, Artificial Sequence
  chemically synthesized
gaagtcaggtagcgtgatgcct

SEQ ID NO: 87634 - DNA, 22 bp, Artificial Sequence
  chemically synthesized
aagtcaggtagcgtgatgcctc

SEQ ID NO: 87635 - DNA, 22 bp, Artificial Sequence
  chemically synthesized
cagctttgttcttttggcttag

SEQ ID NO: 87636 - DNA, 22 bp, Artificial Sequence
  chemically synthesized
tgttcttttggcttaggattgc

SEQ ID NO: 87637 - DNA, 22 bp, Artificial Sequence
  chemically synthesized
gttcttttggcttaggattgcc

SEQ ID NO: 87638 - DNA, 22 bp, Artificial Sequence
  chemically synthesized
ttcttttggcttaggattgcct

SEQ ID NO: 87639 - DNA, 22 bp, Artificial Sequence
  chemically synthesized
ttttggcttaggattgccttgg

SEQ ID NO: 87640 - DNA, 22 bp, Artificial Sequence
  chemically synthesized
ttggcttaggattgccttggtg

SEQ ID NO: 87641 - DNA, 22 bp, Artificial Sequence
  chemically synthesized
tggcttaggattgccttggtga

SEQ ID NO: 87642 - DNA, 22 bp, Artificial Sequence
  chemically synthesized
ggcttaggattgccttggtgat

SEQ ID NO: 87643 - DNA, 22 bp, Artificial Sequence
  chemically synthesized
gcttaggattgccttggtgatg

SEQ ID NO: 87644 - DNA, 22 bp, Artificial Sequence
  chemically synthesized
aggattgccttggtgatgtggg

SEQ ID NO: 87645 - DNA, 22 bp, Artificial Sequence
  chemically synthesized
ggattgccttggtgatgtgggc

SEQ ID NO: 87646 - DNA, 22 bp, Artificial Sequence
  chemically synthesized
ccttggtgatgtgggctctttt

SEQ ID NO: 87647 - DNA, 22 bp, Artificial Sequence
  chemically synthesized
ggtgatgtgggctcttttttgg

SEQ ID NO: 87648 - DNA, 22 bp, Artificial Sequence
  chemically synthesized
gtgatgtgggctcttttttggt

SEQ ID NO: 87649 - DNA, 22 bp, Artificial Sequence
  chemically synthesized
ttttttggttccatatgaactt

SEQ ID NO: 87650 - DNA, 22 bp, Artificial Sequence
  chemically synthesized
ttttggttccatatgaacttta

SEQ ID NO: 87651 - DNA, 22 bp, Artificial Sequence
  chemically synthesized
tttggttccatatgaactttaa

SEQ ID NO: 87652 - DNA, 22 bp, Artificial Sequence
  chemically synthesized
ttggttccatatgaactttaaa

SEQ ID NO: 87653 - DNA, 22 bp, Artificial Sequence
  chemically synthesized
tggttccatatgaactttaaag

SEQ ID NO: 87654 - DNA, 22 bp, Artificial Sequence
  chemically synthesized
ggttccatatgaactttaaagt

SEQ ID NO: 87655 - DNA, 22 bp, Artificial Sequence
  chemically synthesized
gttccatatgaactttaaagta

SEQ ID NO: 87656 - DNA, 22 bp, Artificial Sequence
  chemically synthesized
catatgaactttaaagtagttt

SEQ ID NO: 87657 - DNA, 22 bp, Artificial Sequence
  chemically synthesized
taaagtagttttttccagttct

SEQ ID NO: 87658 - DNA, 22 bp, Artificial Sequence
  chemically synthesized
aaagtagttttttccagttctg

SEQ ID NO: 87659 - DNA, 22 bp, Artificial Sequence
  chemically synthesized
aagtagttttttccagttctgt

SEQ ID NO: 87660 - DNA, 22 bp, Artificial Sequence
  chemically synthesized
tttccagttctgtgaagaaagt

SEQ ID NO: 87661 - DNA, 22 bp, Artificial Sequence
  chemically synthesized
ttccagttctgtgaagaaagtc

SEQ ID NO: 87662 - DNA, 22 bp, Artificial Sequence
  chemically synthesized
tccagttctgtgaagaaagtca

SEQ ID NO: 87663 - DNA, 22 bp, Artificial Sequence
  chemically synthesized
ccagttctgtgaagaaagtcat

SEQ ID NO: 87664 - DNA, 22 bp, Artificial Sequence
  chemically synthesized
cagttctgtgaagaaagtcatt

SEQ ID NO: 87665 - DNA, 22 bp, Artificial Sequence
  chemically synthesized
tgtgaagaaagtcattggtagc

SEQ ID NO: 87666 - DNA, 22 bp, Artificial Sequence
  chemically synthesized
tgaagaaagtcattggtagctt

SEQ ID NO: 87667 - DNA, 22 bp, Artificial Sequence
  chemically synthesized
gtagcttgatggggatggcatt

SEQ ID NO: 87668 - DNA, 22 bp, Artificial Sequence
  chemically synthesized
gatggggatggcattgaatcta

SEQ ID NO: 87669 - DNA, 22 bp, Artificial Sequence
  chemically synthesized
atggggatggcattgaatctat

SEQ ID NO: 87670 - DNA, 22 bp, Artificial Sequence
  chemically synthesized
aatctataaattaccttgggca

SEQ ID NO: 87671 - DNA, 22 bp, Artificial Sequence
  chemically synthesized
taaattaccttgggcagtatga

SEQ ID NO: 87672 - DNA, 22 bp, Artificial Sequence
  chemically synthesized
ccttgggcagtatgaccatttt

SEQ ID NO: 87673 - DNA, 22 bp, Artificial Sequence
  chemically synthesized
gggcagtatgaccattttcacg

SEQ ID NO: 87674 - DNA, 22 bp, Artificial Sequence
  chemically synthesized
ggcagtatgaccattttcacga

SEQ ID NO: 87675 - DNA, 22 bp, Artificial Sequence
  chemically synthesized
tcacgatattgattcttcctac

SEQ ID NO: 87676 - DNA, 22 bp, Artificial Sequence
  chemically synthesized
cacgatattgattcttcctacc

SEQ ID NO: 87677 - DNA, 22 bp, Artificial Sequence
  chemically synthesized
acgatattgattcttcctaccc

SEQ ID NO: 87678 - DNA, 22 bp, Artificial Sequence
  chemically synthesized
attcttcctacccatgagcatg

SEQ ID NO: 87679 - DNA, 22 bp, Artificial Sequence
  chemically synthesized
ttcctacccatgagcatggaat

SEQ ID NO: 87680 - DNA, 22 bp, Artificial Sequence
  chemically synthesized
cctacccatgagcatggaatgt

SEQ ID NO: 87681 - DNA, 22 bp, Artificial Sequence
  chemically synthesized
ctacccatgagcatggaatgtt

SEQ ID NO: 87682 - DNA, 22 bp, Artificial Sequence
  chemically synthesized
cccatgagcatggaatgttctt

SEQ ID NO: 87683 - DNA, 22 bp, Artificial Sequence
  chemically synthesized
ttccatttgtttgtatcctctt

SEQ ID NO: 87684 - DNA, 22 bp, Artificial Sequence
  chemically synthesized
ccatttgtttgtatcctctttt

SEQ ID NO: 87685 - DNA, 22 bp, Artificial Sequence
  chemically synthesized
catttgtttgtatcctctttta

SEQ ID NO: 87686 - DNA, 22 bp, Artificial Sequence
  chemically synthesized
gtttgtatcctcttttatttca

SEQ ID NO: 87687 - DNA, 22 bp, Artificial Sequence
  chemically synthesized
tttgtatcctcttttatttcat

SEQ ID NO: 87688 - DNA, 22 bp, Artificial Sequence
  chemically synthesized
gtatcctcttttatttcattga

SEQ ID NO: 87689 - DNA, 22 bp, Artificial Sequence
  chemically synthesized
tatcctcttttatttcattgag

SEQ ID NO: 87690 - DNA, 22 bp, Artificial Sequence
  chemically synthesized
ttttatttcattgagcagtggt

SEQ ID NO: 87691 - DNA, 22 bp, Artificial Sequence
  chemically synthesized
ttatttcattgagcagtggttt

SEQ ID NO: 87692 - DNA, 22 bp, Artificial Sequence
  chemically synthesized
tatttcattgagcagtggtttg

SEQ ID NO: 87693 - DNA, 22 bp, Artificial Sequence
  chemically synthesized
atttcattgagcagtggtttgt

SEQ ID NO: 87694 - DNA, 22 bp, Artificial Sequence
  chemically synthesized
tttcattgagcagtggtttgta

SEQ ID NO: 87695 - DNA, 22 bp, Artificial Sequence
  chemically synthesized
cattgagcagtggtttgtagtt

SEQ ID NO: 87696 - DNA, 22 bp, Artificial Sequence
  chemically synthesized
attgagcagtggtttgtagttc

SEQ ID NO: 87697 - DNA, 22 bp, Artificial Sequence
  chemically synthesized
agcagtggtttgtagttctcct

SEQ ID NO: 87698 - DNA, 22 bp, Artificial Sequence
  chemically synthesized
gtagttctccttgaagaggtcc

SEQ ID NO: 87699 - DNA, 22 bp, Artificial Sequence
  chemically synthesized
tagttctccttgaagaggtcct

SEQ ID NO: 87700 - DNA, 22 bp, Artificial Sequence
  chemically synthesized
tccttgaagaggtccttcacat

SEQ ID NO: 87701 - DNA, 22 bp, Artificial Sequence
  chemically synthesized
cttgaagaggtccttcacatcc

SEQ ID NO: 87702 - DNA, 22 bp, Artificial Sequence
  chemically synthesized
gaagaggtccttcacatccctt

SEQ ID NO: 87703 - DNA, 22 bp, Artificial Sequence
  chemically synthesized
aagaggtccttcacatcccttg

SEQ ID NO: 87704 - DNA, 22 bp, Artificial Sequence
  chemically synthesized
cacatcccttgtaagttggatt

SEQ ID NO: 87705 - DNA, 22 bp, Artificial Sequence
  chemically synthesized
acatcccttgtaagttggattc

SEQ ID NO: 87706 - DNA, 22 bp, Artificial Sequence
  chemically synthesized
gtaagttggattcctaggtatt

SEQ ID NO: 87707 - DNA, 22 bp, Artificial Sequence
  chemically synthesized
taagttggattcctaggtattt

SEQ ID NO: 87708 - DNA, 22 bp, Artificial Sequence
  chemically synthesized
gattcctaggtattttattctc

SEQ ID NO: 87709 - DNA, 22 bp, Artificial Sequence
  chemically synthesized
ctaggtattttattctctttga

SEQ ID NO: 87710 - DNA, 22 bp, Artificial Sequence
  chemically synthesized
ggtattttattctctttgaagc

SEQ ID NO: 87711 - DNA, 22 bp, Artificial Sequence
  chemically synthesized
tattctctttgaagcaattgtg

SEQ ID NO: 87712 - DNA, 22 bp, Artificial Sequence
  chemically synthesized
attctctttgaagcaattgtga

SEQ ID NO: 87713 - DNA, 22 bp, Artificial Sequence
  chemically synthesized
ttctctttgaagcaattgtgaa

SEQ ID NO: 87714 - DNA, 22 bp, Artificial Sequence
  chemically synthesized
tctttgaagcaattgtgaatgg

SEQ ID NO: 87715 - DNA, 22 bp, Artificial Sequence
  chemically synthesized
tttgaagcaattgtgaatggga

SEQ ID NO: 87716 - DNA, 22 bp, Artificial Sequence
  chemically synthesized
tgaagcaattgtgaatgggagt

SEQ ID NO: 87717 - DNA, 22 bp, Artificial Sequence
  chemically synthesized
gaagcaattgtgaatgggagtt

SEQ ID NO: 87718 - DNA, 22 bp, Artificial Sequence
  chemically synthesized
aagcaattgtgaatgggagttc

SEQ ID NO: 87719 - DNA, 22 bp, Artificial Sequence
  chemically synthesized
tgaatgggagttcactcatgat

SEQ ID NO: 87720 - DNA, 22 bp, Artificial Sequence
  chemically synthesized
actcatgatttggctctctgtt

SEQ ID NO: 87721 - DNA, 22 bp, Artificial Sequence
  chemically synthesized
atgatttggctctctgtttgtc

SEQ ID NO: 87722 - DNA, 22 bp, Artificial Sequence
  chemically synthesized
ggctctctgtttgtctgttatt

SEQ ID NO: 87723 - DNA, 22 bp, Artificial Sequence
  chemically synthesized
gctctctgtttgtctgttattg

SEQ ID NO: 87724 - DNA, 22 bp, Artificial Sequence
  chemically synthesized
tctgtttgtctgttattggtgc

SEQ ID NO: 87725 - DNA, 22 bp, Artificial Sequence
  chemically synthesized
tgtttgtctgttattggtgcat

SEQ ID NO: 87726 - DNA, 22 bp, Artificial Sequence
  chemically synthesized
tttgtctgttattggtgcatag

SEQ ID NO: 87727 - DNA, 22 bp, Artificial Sequence
  chemically synthesized
gtctgttattggtgcataggaa

SEQ ID NO: 87728 - DNA, 22 bp, Artificial Sequence
  chemically synthesized
tctgttattggtgcataggaat

SEQ ID NO: 87729 - DNA, 22 bp, Artificial Sequence
  chemically synthesized
ttattggtgcataggaatactt

SEQ ID NO: 87730 - DNA, 22 bp, Artificial Sequence
  chemically synthesized
ttggtgcataggaatacttgtg

SEQ ID NO: 87731 - DNA, 22 bp, Artificial Sequence
  chemically synthesized
gtgcataggaatacttgtgatt

SEQ ID NO: 87732 - DNA, 22 bp, Artificial Sequence
  chemically synthesized
gtgatttttgcacactgatttt

SEQ ID NO: 87733 - DNA, 22 bp, Artificial Sequence
  chemically synthesized
tgatttttgcacactgatttta

SEQ ID NO: 87734 - DNA, 22 bp, Artificial Sequence
  chemically synthesized
ttgcacactgattttatatcct

SEQ ID NO: 87735 - DNA, 22 bp, Artificial Sequence
  chemically synthesized
tgcacactgattttatatcctg

SEQ ID NO: 87736 - DNA, 22 bp, Artificial Sequence
  chemically synthesized
gcacactgattttatatcctga

SEQ ID NO: 87737 - DNA, 22 bp, Artificial Sequence
  chemically synthesized
cacactgattttatatcctgag

SEQ ID NO: 87738 - DNA, 22 bp, Artificial Sequence
  chemically synthesized
attttatatcctgagactttgc

SEQ ID NO: 87739 - DNA, 22 bp, Artificial Sequence
  chemically synthesized
tatatcctgagactttgctgaa

SEQ ID NO: 87740 - DNA, 22 bp, Artificial Sequence
  chemically synthesized
atatcctgagactttgctgaag

SEQ ID NO: 87741 - DNA, 22 bp, Artificial Sequence
  chemically synthesized
tatcctgagactttgctgaagt

SEQ ID NO: 87742 - DNA, 22 bp, Artificial Sequence
  chemically synthesized
agactttgctgaagttgcttat

SEQ ID NO: 87743 - DNA, 22 bp, Artificial Sequence
  chemically synthesized
tgctgaagttgcttatcagctt

SEQ ID NO: 87744 - DNA, 22 bp, Artificial Sequence
  chemically synthesized
gctgaagttgcttatcagctta

SEQ ID NO: 87745 - DNA, 22 bp, Artificial Sequence
  chemically synthesized
ctgaagttgcttatcagcttaa

SEQ ID NO: 87746 - DNA, 22 bp, Artificial Sequence
  chemically synthesized
aagttgcttatcagcttaagga

SEQ ID NO: 87747 - DNA, 22 bp, Artificial Sequence
  chemically synthesized
cttatcagcttaaggagatttt

SEQ ID NO: 87748 - DNA, 22 bp, Artificial Sequence
  chemically synthesized
atcagcttaaggagattttggg

SEQ ID NO: 87749 - DNA, 22 bp, Artificial Sequence
  chemically synthesized
tcagcttaaggagattttgggc

SEQ ID NO: 87750 - DNA, 22 bp, Artificial Sequence
  chemically synthesized
aaggagattttgggctgagaca

SEQ ID NO: 87751 - DNA, 22 bp, Artificial Sequence
  chemically synthesized
aggagattttgggctgagacaa

SEQ ID NO: 87752 - DNA, 22 bp, Artificial Sequence
  chemically synthesized
tgggctgagacaatggggtttt

SEQ ID NO: 87753 - DNA, 22 bp, Artificial Sequence
  chemically synthesized
gggctgagacaatggggttttc

SEQ ID NO: 87754 - DNA, 22 bp, Artificial Sequence
  chemically synthesized
ggctgagacaatggggttttct

SEQ ID NO: 87755 - DNA, 22 bp, Artificial Sequence
  chemically synthesized
agacaatggggttttctagata

SEQ ID NO: 87756 - DNA, 22 bp, Artificial Sequence
  chemically synthesized
tctagatatacaatcatgtcat

SEQ ID NO: 87757 - DNA, 22 bp, Artificial Sequence
  chemically synthesized
ctagatatacaatcatgtcatc

SEQ ID NO: 87758 - DNA, 22 bp, Artificial Sequence
  chemically synthesized
tagatatacaatcatgtcatct

SEQ ID NO: 87759 - DNA, 22 bp, Artificial Sequence
  chemically synthesized
gatatacaatcatgtcatctgc

SEQ ID NO: 87760 - DNA, 22 bp, Artificial Sequence
  chemically synthesized
caaacagggacaatttcacttc

SEQ ID NO: 87761 - DNA, 22 bp, Artificial Sequence
  chemically synthesized
cacttcctcttttcctaattga

SEQ ID NO: 87762 - DNA, 22 bp, Artificial Sequence
  chemically synthesized
acttcctcttttcctaattgaa

SEQ ID NO: 87763 - DNA, 22 bp, Artificial Sequence
  chemically synthesized
cctcttttcctaattgaatgcc

SEQ ID NO: 87764 - DNA, 22 bp, Artificial Sequence
  chemically synthesized
ctcttttcctaattgaatgccc

SEQ ID NO: 87765 - DNA, 22 bp, Artificial Sequence
  chemically synthesized
ttttcctaattgaatgcccttt

SEQ ID NO: 87766 - DNA, 22 bp, Artificial Sequence
  chemically synthesized
ttcctaattgaatgccctttat

SEQ ID NO: 87767 - DNA, 22 bp, Artificial Sequence
  chemically synthesized
tcctaattgaatgccctttatt

SEQ ID NO: 87768 - DNA, 22 bp, Artificial Sequence
  chemically synthesized
cctaattgaatgccctttattt

SEQ ID NO: 87769 - DNA, 22 bp, Artificial Sequence
  chemically synthesized
ctaattgaatgccctttatttc

SEQ ID NO: 87770 - DNA, 22 bp, Artificial Sequence
  chemically synthesized
attgaatgccctttatttcctt

SEQ ID NO: 87771 - DNA, 22 bp, Artificial Sequence
  chemically synthesized
aatgccctttatttccttctcc

SEQ ID NO: 87772 - DNA, 22 bp, Artificial Sequence
  chemically synthesized
tatttccttctcctgcctgatt

SEQ ID NO: 87773 - DNA, 22 bp, Artificial Sequence
  chemically synthesized
atttccttctcctgcctgattg

SEQ ID NO: 87774 - DNA, 22 bp, Artificial Sequence
  chemically synthesized
tttccttctcctgcctgattgc

SEQ ID NO: 87775 - DNA, 22 bp, Artificial Sequence
  chemically synthesized
ccttctcctgcctgattgccct

SEQ ID NO: 87776 - DNA, 22 bp, Artificial Sequence
  chemically synthesized
cttctcctgcctgattgccctg

SEQ ID NO: 87777 - DNA, 22 bp, Artificial Sequence
  chemically synthesized
ctcctgcctgattgccctggcc

SEQ ID NO: 87778 - DNA, 22 bp, Artificial Sequence
  chemically synthesized
tcctgcctgattgccctggcca

SEQ ID NO: 87779 - DNA, 22 bp, Artificial Sequence
  chemically synthesized
ctgcctgattgccctggccaga

SEQ ID NO: 87780 - DNA, 22 bp, Artificial Sequence
  chemically synthesized
cctgattgccctggccagaact

SEQ ID NO: 87781 - DNA, 22 bp, Artificial Sequence
  chemically synthesized
attgccctggccagaacttaca

SEQ ID NO: 87782 - DNA, 22 bp, Artificial Sequence
  chemically synthesized
ccctggccagaacttacaacac

SEQ ID NO: 87783 - DNA, 22 bp, Artificial Sequence
  chemically synthesized
gccagaacttacaacactatgt

SEQ ID NO: 87784 - DNA, 22 bp, Artificial Sequence
  chemically synthesized
acaacactatgttgaataggag

SEQ ID NO: 87785 - DNA, 22 bp, Artificial Sequence
  chemically synthesized
caacactatgttgaataggagt

SEQ ID NO: 87786 - DNA, 22 bp, Artificial Sequence
  chemically synthesized
tgttgaataggagtggtgagag

SEQ ID NO: 87787 - DNA, 22 bp, Artificial Sequence
  chemically synthesized
aataggagtggtgagagagggc

SEQ ID NO: 87788 - DNA, 22 bp, Artificial Sequence
  chemically synthesized
ccttgtgccagttttcaaaggg

SEQ ID NO: 87789 - DNA, 22 bp, Artificial Sequence
  chemically synthesized
gtgccagttttcaaagggaatg

SEQ ID NO: 87790 - DNA, 22 bp, Artificial Sequence
  chemically synthesized
tgccagttttcaaagggaatgc

SEQ ID NO: 87791 - DNA, 22 bp, Artificial Sequence
  chemically synthesized
tcaaagggaatgcttccagttt

SEQ ID NO: 87792 - DNA, 22 bp, Artificial Sequence
  chemically synthesized
caaagggaatgcttccagtttt

SEQ ID NO: 87793 - DNA, 22 bp, Artificial Sequence
  chemically synthesized
aaagggaatgcttccagttttt

SEQ ID NO: 87794 - DNA, 22 bp, Artificial Sequence
  chemically synthesized
ccagtttttgtccactcagtat

SEQ ID NO: 87795 - DNA, 22 bp, Artificial Sequence
  chemically synthesized
cagtttttgtccactcagtatg

SEQ ID NO: 87796 - DNA, 22 bp, Artificial Sequence
  chemically synthesized
ttgtccactcagtatgatattg

SEQ ID NO: 87797 - DNA, 22 bp, Artificial Sequence
  chemically synthesized
tgtccactcagtatgatattgg

SEQ ID NO: 87798 - DNA, 22 bp, Artificial Sequence
  chemically synthesized
gtccactcagtatgatattggc

SEQ ID NO: 87799 - DNA, 22 bp, Artificial Sequence
  chemically synthesized
tccactcagtatgatattggct

SEQ ID NO: 87800 - DNA, 22 bp, Artificial Sequence
  chemically synthesized
agtatgatattggctgtgggtt

SEQ ID NO: 87801 - DNA, 22 bp, Artificial Sequence
  chemically synthesized
gctgtgggtttgtcatagatag

SEQ ID NO: 87802 - DNA, 22 bp, Artificial Sequence
  chemically synthesized
tgggtttgtcatagatagctct

SEQ ID NO: 87803 - DNA, 22 bp, Artificial Sequence
  chemically synthesized
gtcatagatagctcttattatt

SEQ ID NO: 87804 - DNA, 22 bp, Artificial Sequence
  chemically synthesized
tcatagatagctcttattattt

SEQ ID NO: 87805 - DNA, 22 bp, Artificial Sequence
  chemically synthesized
ttattattttgagatatgtccc

SEQ ID NO: 87806 - DNA, 22 bp, Artificial Sequence
  chemically synthesized
attattttgagatatgtcccat

SEQ ID NO: 87807 - DNA, 22 bp, Artificial Sequence
  chemically synthesized
ttattttgagatatgtcccatc

SEQ ID NO: 87808 - DNA, 22 bp, Artificial Sequence
  chemically synthesized
ttttgagatatgtcccatcaat

SEQ ID NO: 87809 - DNA, 22 bp, Artificial Sequence
  chemically synthesized
tgagatatgtcccatcaatacc

SEQ ID NO: 87810 - DNA, 22 bp, Artificial Sequence
  chemically synthesized
gagatatgtcccatcaatacct

SEQ ID NO: 87811 - DNA, 22 bp, Artificial Sequence
  chemically synthesized
agatatgtcccatcaataccta

SEQ ID NO: 87812 - DNA, 22 bp, Artificial Sequence
  chemically synthesized
atttattgagagtttttagcat

SEQ ID NO: 87813 - DNA, 22 bp, Artificial Sequence
  chemically synthesized
attgagagtttttagcatgaag

SEQ ID NO: 87814 - DNA, 22 bp, Artificial Sequence
  chemically synthesized
ttgagagtttttagcatgaagc

SEQ ID NO: 87815 - DNA, 22 bp, Artificial Sequence
  chemically synthesized
agagtttttagcatgaagcgtt

SEQ ID NO: 87816 - DNA, 22 bp, Artificial Sequence
  chemically synthesized
ttagcatgaagcgttgttgaat

SEQ ID NO: 87817 - DNA, 22 bp, Artificial Sequence
  chemically synthesized
tagcatgaagcgttgttgaatt

SEQ ID NO: 87818 - DNA, 22 bp, Artificial Sequence
  chemically synthesized
agcatgaagcgttgttgaattt

SEQ ID NO: 87819 - DNA, 22 bp, Artificial Sequence
  chemically synthesized
gcatgaagcgttgttgaatttt

SEQ ID NO: 87820 - DNA, 22 bp, Artificial Sequence
  chemically synthesized
ttgaattttgtcaaaggccttt

SEQ ID NO: 87821 - DNA, 22 bp, Artificial Sequence
  chemically synthesized
aattttgtcaaaggccttttct

SEQ ID NO: 87822 - DNA, 22 bp, Artificial Sequence
  chemically synthesized
tgtcaaaggccttttctgcatc

SEQ ID NO: 87823 - DNA, 22 bp, Artificial Sequence
  chemically synthesized
gtcaaaggccttttctgcatct

SEQ ID NO: 87824 - DNA, 22 bp, Artificial Sequence
  chemically synthesized
tcaaaggccttttctgcatcta

SEQ ID NO: 87825 - DNA, 22 bp, Artificial Sequence
  chemically synthesized
ttctgcatctattgagataatc

SEQ ID NO: 87826 - DNA, 22 bp, Artificial Sequence
  chemically synthesized
tctgcatctattgagataatca

SEQ ID NO: 87827 - DNA, 22 bp, Artificial Sequence
  chemically synthesized
ctgcatctattgagataatcat

SEQ ID NO: 87828 - DNA, 22 bp, Artificial Sequence
  chemically synthesized
tgcatctattgagataatcata

SEQ ID NO: 87829 - DNA, 22 bp, Artificial Sequence
  chemically synthesized
catctattgagataatcatatg

SEQ ID NO: 87830 - DNA, 22 bp, Artificial Sequence
  chemically synthesized
ttgagataatcatatggtttgt

SEQ ID NO: 87831 - DNA, 22 bp, Artificial Sequence
  chemically synthesized
agataatcatatggtttgtgtc

SEQ ID NO: 87832 - DNA, 22 bp, Artificial Sequence
  chemically synthesized
gtgtctttggttctgtttatat

SEQ ID NO: 87833 - DNA, 22 bp, Artificial Sequence
  chemically synthesized
tgtctttggttctgtttatatg

SEQ ID NO: 87834 - DNA, 22 bp, Artificial Sequence
  chemically synthesized
tggttctgtttatatgctggat

SEQ ID NO: 87835 - DNA, 22 bp, Artificial Sequence
  chemically synthesized
ggttctgtttatatgctggatt

SEQ ID NO: 87836 - DNA, 22 bp, Artificial Sequence
  chemically synthesized
gttctgtttatatgctggatta

SEQ ID NO: 87837 - DNA, 22 bp, Artificial Sequence
  chemically synthesized
tgtttatatgctggattatgtt

SEQ ID NO: 87838 - DNA, 22 bp, Artificial Sequence
  chemically synthesized
tttatatgctggattatgttta

SEQ ID NO: 87839 - DNA, 22 bp, Artificial Sequence
  chemically synthesized
atatgctggattatgtttattg

SEQ ID NO: 87840 - DNA, 22 bp, Artificial Sequence
  chemically synthesized
tatgctggattatgtttattga

SEQ ID NO: 87841 - DNA, 22 bp, Artificial Sequence
  chemically synthesized
gattatgtttattgattttcgt

SEQ ID NO: 87842 - DNA, 22 bp, Artificial Sequence
  chemically synthesized
tgtttattgattttcgtatgtt

SEQ ID NO: 87843 - DNA, 22 bp, Artificial Sequence
  chemically synthesized
attgattttcgtatgttgaacc

SEQ ID NO: 87844 - DNA, 22 bp, Artificial Sequence
  chemically synthesized
ttgattttcgtatgttgaacca

SEQ ID NO: 87845 - DNA, 22 bp, Artificial Sequence
  chemically synthesized
attttcgtatgttgaaccagcc

SEQ ID NO: 87846 - DNA, 22 bp, Artificial Sequence
  chemically synthesized
tcgtatgttgaaccagccttgc

SEQ ID NO: 87847 - DNA, 22 bp, Artificial Sequence
  chemically synthesized
cgtatgttgaaccagccttgca

SEQ ID NO: 87848 - DNA, 22 bp, Artificial Sequence
  chemically synthesized
gtatgttgaaccagccttgcat

SEQ ID NO: 87849 - DNA, 22 bp, Artificial Sequence
  chemically synthesized
aaccagccttgcatggcaggga

SEQ ID NO: 87850 - DNA, 22 bp, Artificial Sequence
  chemically synthesized
gcatggcagggatgaagcccac

SEQ ID NO: 87851 - DNA, 22 bp, Artificial Sequence
  chemically synthesized
catggcagggatgaagcccact

SEQ ID NO: 87852 - DNA, 22 bp, Artificial Sequence
  chemically synthesized
gatcatggtggatcagtttgcc

SEQ ID NO: 87853 - DNA, 22 bp, Artificial Sequence
  chemically synthesized
atcatggtggatcagtttgcca

SEQ ID NO: 87854 - DNA, 22 bp, Artificial Sequence
  chemically synthesized
gccagtattttattgaggattt

SEQ ID NO: 87855 - DNA, 22 bp, Artificial Sequence
  chemically synthesized
ccagtattttattgaggatttt

SEQ ID NO: 87856 - DNA, 22 bp, Artificial Sequence
  chemically synthesized
tattgaggatttttgcatcaat

SEQ ID NO: 87857 - DNA, 22 bp, Artificial Sequence
  chemically synthesized
attgaggatttttgcatcaatg

SEQ ID NO: 87858 - DNA, 22 bp, Artificial Sequence
  chemically synthesized
ttgaggatttttgcatcaatgt

SEQ ID NO: 87859 - DNA, 22 bp, Artificial Sequence
  chemically synthesized
aggatttttgcatcaatgttca

SEQ ID NO: 87860 - DNA, 22 bp, Artificial Sequence
  chemically synthesized
ttgcatcaatgttcatcaagga

SEQ ID NO: 87861 - DNA, 22 bp, Artificial Sequence
  chemically synthesized
tgcatcaatgttcatcaaggat

SEQ ID NO: 87862 - DNA, 22 bp, Artificial Sequence
  chemically synthesized
gcatcaatgttcatcaaggata

SEQ ID NO: 87863 - DNA, 22 bp, Artificial Sequence
  chemically synthesized
catcaatgttcatcaaggatat

SEQ ID NO: 87864 - DNA, 22 bp, Artificial Sequence
  chemically synthesized
atcaaggatattggtgtaacat

SEQ ID NO: 87865 - DNA, 22 bp, Artificial Sequence
  chemically synthesized
gtgtaacattctctttttttgt

SEQ ID NO: 87866 - DNA, 22 bp, Artificial Sequence
  chemically synthesized
tctttttttgttgtgtctctgt

SEQ ID NO: 87867 - DNA, 22 bp, Artificial Sequence
  chemically synthesized
tttttttgttgtgtctctgtca

SEQ ID NO: 87868 - DNA, 22 bp, Artificial Sequence
  chemically synthesized
tttttgttgtgtctctgtcagg

SEQ ID NO: 87869 - DNA, 22 bp, Artificial Sequence
  chemically synthesized
ttttgttgtgtctctgtcaggc

SEQ ID NO: 87870 - DNA, 22 bp, Artificial Sequence
  chemically synthesized
tttgttgtgtctctgtcaggct

SEQ ID NO: 87871 - DNA, 22 bp, Artificial Sequence
  chemically synthesized
ttgttgtgtctctgtcaggctt

SEQ ID NO: 87872 - DNA, 22 bp, Artificial Sequence
  chemically synthesized
tgttgtgtctctgtcaggcttt

SEQ ID NO: 87873 - DNA, 22 bp, Artificial Sequence
  chemically synthesized
gttgtgtctctgtcaggctttg

SEQ ID NO: 87874 - DNA, 22 bp, Artificial Sequence
  chemically synthesized
ttgtgtctctgtcaggctttgg

SEQ ID NO: 87875 - DNA, 22 bp, Artificial Sequence
  chemically synthesized
tgtctctgtcaggctttggtat

SEQ ID NO: 87876 - DNA, 22 bp, Artificial Sequence
  chemically synthesized
tgtcaggctttggtatcaggat

SEQ ID NO: 87877 - DNA, 22 bp, Artificial Sequence
  chemically synthesized
tcaggctttggtatcaggatga

SEQ ID NO: 87878 - DNA, 22 bp, Artificial Sequence
  chemically synthesized
tggtatcaggatgatgctggcc

SEQ ID NO: 87879 - DNA, 22 bp, Artificial Sequence
  chemically synthesized
ggtatcaggatgatgctggcct

SEQ ID NO: 87880 - DNA, 22 bp, Artificial Sequence
  chemically synthesized
gtatcaggatgatgctggcctc

SEQ ID NO: 87881 - DNA, 22 bp, Artificial Sequence
  chemically synthesized
gcctcataaaatgagttaggga

SEQ ID NO: 87882 - DNA, 22 bp, Artificial Sequence
  chemically synthesized
ataaaatgagttagggaggatt

SEQ ID NO: 87883 - DNA, 22 bp, Artificial Sequence
  chemically synthesized
gggaggattccctctttttcta

SEQ ID NO: 87884 - DNA, 22 bp, Artificial Sequence
  chemically synthesized
cctctttttctattgattggaa

SEQ ID NO: 87885 - DNA, 22 bp, Artificial Sequence
  chemically synthesized
tttttctattgattggaatagt

SEQ ID NO: 87886 - DNA, 22 bp, Artificial Sequence
  chemically synthesized
tttctattgattggaatagttt

SEQ ID NO: 87887 - DNA, 22 bp, Artificial Sequence
  chemically synthesized
ttctattgattggaatagtttc

SEQ ID NO: 87888 - DNA, 22 bp, Artificial Sequence
  chemically synthesized
tctattgattggaatagtttca

SEQ ID NO: 87889 - DNA, 22 bp, Artificial Sequence
  chemically synthesized
ctattgattggaatagtttcag

SEQ ID NO: 87890 - DNA, 22 bp, Artificial Sequence
  chemically synthesized
tattgattggaatagtttcaga

SEQ ID NO: 87891 - DNA, 22 bp, Artificial Sequence
  chemically synthesized
ttgattggaatagtttcagaag

SEQ ID NO: 87892 - DNA, 22 bp, Artificial Sequence
  chemically synthesized
attggaatagtttcagaaggaa

SEQ ID NO: 87893 - DNA, 22 bp, Artificial Sequence
  chemically synthesized
gaatagtttcagaaggaatggt

SEQ ID NO: 87894 - DNA, 22 bp, Artificial Sequence
  chemically synthesized
cagaaggaatggtaccagctcc

SEQ ID NO: 87895 - DNA, 22 bp, Artificial Sequence
  chemically synthesized
agaaggaatggtaccagctcct

SEQ ID NO: 87896 - DNA, 22 bp, Artificial Sequence
  chemically synthesized
ctccttgtacctctggtagaat

SEQ ID NO: 87897 - DNA, 22 bp, Artificial Sequence
  chemically synthesized
cttgtacctctggtagaattcg

SEQ ID NO: 87898 - DNA, 22 bp, Artificial Sequence
  chemically synthesized
gtacctctggtagaattcggct

SEQ ID NO: 87899 - DNA, 22 bp, Artificial Sequence
  chemically synthesized
tacctctggtagaattcggcta

SEQ ID NO: 87900 - DNA, 22 bp, Artificial Sequence
  chemically synthesized
tggtagaattcggctatgaatc

SEQ ID NO: 87901 - DNA, 22 bp, Artificial Sequence
  chemically synthesized
gtagaattcggctatgaatcct

SEQ ID NO: 87902 - DNA, 22 bp, Artificial Sequence
  chemically synthesized
ggctatgaatcctactggtccc

SEQ ID NO: 87903 - DNA, 22 bp, Artificial Sequence
  chemically synthesized
tgaatcctactggtcccggact

SEQ ID NO: 87904 - DNA, 22 bp, Artificial Sequence
  chemically synthesized
ctggtcccggactttttttggt

SEQ ID NO: 87905 - DNA, 22 bp, Artificial Sequence
  chemically synthesized
gtcccggactttttttggttga

SEQ ID NO: 87906 - DNA, 22 bp, Artificial Sequence
  chemically synthesized
tttttggttgataagctattaa

SEQ ID NO: 87907 - DNA, 22 bp, Artificial Sequence
  chemically synthesized
ttttggttgataagctattaat

SEQ ID NO: 87908 - DNA, 22 bp, Artificial Sequence
  chemically synthesized
tttggttgataagctattaatt

SEQ ID NO: 87909 - DNA, 22 bp, Artificial Sequence
  chemically synthesized
ttggttgataagctattaatta

SEQ ID NO: 87910 - DNA, 22 bp, Artificial Sequence
  chemically synthesized
tggttgataagctattaattat

SEQ ID NO: 87911 - DNA, 22 bp, Artificial Sequence
  chemically synthesized
ggttgataagctattaattatt

SEQ ID NO: 87912 - DNA, 22 bp, Artificial Sequence
  chemically synthesized
gttgataagctattaattattg

SEQ ID NO: 87913 - DNA, 22 bp, Artificial Sequence
  chemically synthesized
ataagctattaattattgcctc

SEQ ID NO: 87914 - DNA, 22 bp, Artificial Sequence
  chemically synthesized
ttaattattgcctcaatttcag

SEQ ID NO: 87915 - DNA, 22 bp, Artificial Sequence
  chemically synthesized
attattgcctcaatttcagagc

SEQ ID NO: 87916 - DNA, 22 bp, Artificial Sequence
  chemically synthesized
ttgcctcaatttcagagcctgt

SEQ ID NO: 87917 - DNA, 22 bp, Artificial Sequence
  chemically synthesized
cctcaatttcagagcctgttat

SEQ ID NO: 87918 - DNA, 22 bp, Artificial Sequence
  chemically synthesized
aatttcagagcctgttattggt

SEQ ID NO: 87919 - DNA, 22 bp, Artificial Sequence
  chemically synthesized
cagagcctgttattggtctatt

SEQ ID NO: 87920 - DNA, 22 bp, Artificial Sequence
  chemically synthesized
agagcctgttattggtctattc

SEQ ID NO: 87921 - DNA, 22 bp, Artificial Sequence
  chemically synthesized
ttattggtctattcagagatac

SEQ ID NO: 87922 - DNA, 22 bp, Artificial Sequence
  chemically synthesized
ttggtctattcagagatacaac

SEQ ID NO: 87923 - DNA, 22 bp, Artificial Sequence
  chemically synthesized
gtctattcagagatacaacttc

SEQ ID NO: 87924 - DNA, 22 bp, Artificial Sequence
  chemically synthesized
ttcagagatacaacttcttcct

SEQ ID NO: 87925 - DNA, 22 bp, Artificial Sequence
  chemically synthesized
agagatacaacttcttcctggt

SEQ ID NO: 87926 - DNA, 22 bp, Artificial Sequence
  chemically synthesized
cttcctggtttagtcttggcag

SEQ ID NO: 87927 - DNA, 22 bp, Artificial Sequence
  chemically synthesized
ttcctggtttagtcttggcaga

SEQ ID NO: 87928 - DNA, 22 bp, Artificial Sequence
  chemically synthesized
cctggtttagtcttggcagagt

SEQ ID NO: 87929 - DNA, 22 bp, Artificial Sequence
  chemically synthesized
ctggtttagtcttggcagagtg

SEQ ID NO: 87930 - DNA, 22 bp, Artificial Sequence
  chemically synthesized
gtttagtcttggcagagtgtat

SEQ ID NO: 87931 - DNA, 22 bp, Artificial Sequence
  chemically synthesized
agtcttggcagagtgtatgtgt

SEQ ID NO: 87932 - DNA, 22 bp, Artificial Sequence
  chemically synthesized
gtcttggcagagtgtatgtgtc

SEQ ID NO: 87933 - DNA, 22 bp, Artificial Sequence
  chemically synthesized
ggcagagtgtatgtgtcgagga

SEQ ID NO: 87934 - DNA, 22 bp, Artificial Sequence
  chemically synthesized
gcagagtgtatgtgtcgaggaa

SEQ ID NO: 87935 - DNA, 22 bp, Artificial Sequence
  chemically synthesized
atccatttcttctagattttct

SEQ ID NO: 87936 - DNA, 22 bp, Artificial Sequence
  chemically synthesized
tccatttcttctagattttcta

SEQ ID NO: 87937 - DNA, 22 bp, Artificial Sequence
  chemically synthesized
cttctagattttctagtttatt

SEQ ID NO: 87938 - DNA, 22 bp, Artificial Sequence
  chemically synthesized
ttctagattttctagtttattt

SEQ ID NO: 87939 - DNA, 22 bp, Artificial Sequence
  chemically synthesized
ctagattttctagtttatttgc

SEQ ID NO: 87940 - DNA, 22 bp, Artificial Sequence
  chemically synthesized
tagattttctagtttatttgcg

SEQ ID NO: 87941 - DNA, 22 bp, Artificial Sequence
  chemically synthesized
gattttctagtttatttgcgta

SEQ ID NO: 87942 - DNA, 22 bp, Artificial Sequence
  chemically synthesized
tctagtttatttgcgtagaggt

SEQ ID NO: 87943 - DNA, 22 bp, Artificial Sequence
  chemically synthesized
ctagtttatttgcgtagaggtg

SEQ ID NO: 87944 - DNA, 22 bp, Artificial Sequence
  chemically synthesized
tagtttatttgcgtagaggtgt

SEQ ID NO: 87945 - DNA, 22 bp, Artificial Sequence
  chemically synthesized
gtttatttgcgtagaggtgttt

SEQ ID NO: 87946 - DNA, 22 bp, Artificial Sequence
  chemically synthesized
atttgcgtagaggtgtttatag

SEQ ID NO: 87947 - DNA, 22 bp, Artificial Sequence
  chemically synthesized
tttgcgtagaggtgtttatagt

SEQ ID NO: 87948 - DNA, 22 bp, Artificial Sequence
  chemically synthesized
gcgtagaggtgtttatagtatt

SEQ ID NO: 87949 - DNA, 22 bp, Artificial Sequence
  chemically synthesized
cgtagaggtgtttatagtattc

SEQ ID NO: 87950 - DNA, 22 bp, Artificial Sequence
  chemically synthesized
atagtattctctgacggtagtt

SEQ ID NO: 87951 - DNA, 22 bp, Artificial Sequence
  chemically synthesized
tagtattctctgacggtagttt

SEQ ID NO: 87952 - DNA, 22 bp, Artificial Sequence
  chemically synthesized
tctgacggtagtttgtatttct

SEQ ID NO: 87953 - DNA, 22 bp, Artificial Sequence
  chemically synthesized
tgacggtagtttgtatttctgt

SEQ ID NO: 87954 - DNA, 22 bp, Artificial Sequence
  chemically synthesized
acggtagtttgtatttctgtgg

SEQ ID NO: 87955 - DNA, 22 bp, Artificial Sequence
  chemically synthesized
gtatttctgtgggatcagtggt

SEQ ID NO: 87956 - DNA, 22 bp, Artificial Sequence
  chemically synthesized
tatttctgtgggatcagtggtg

SEQ ID NO: 87957 - DNA, 22 bp, Artificial Sequence
  chemically synthesized
ctgtgggatcagtggtgatacc

SEQ ID NO: 87958 - DNA, 22 bp, Artificial Sequence
  chemically synthesized
tgtgggatcagtggtgataccc

SEQ ID NO: 87959 - DNA, 22 bp, Artificial Sequence
  chemically synthesized
tgggatcagtggtgataccccg

SEQ ID NO: 87960 - DNA, 22 bp, Artificial Sequence
  chemically synthesized
tttattgcgtctatttgattct

SEQ ID NO: 87961 - DNA, 22 bp, Artificial Sequence
  chemically synthesized
ttattgcgtctatttgattctt

SEQ ID NO: 87962 - DNA, 22 bp, Artificial Sequence
  chemically synthesized
tattgcgtctatttgattcttc

SEQ ID NO: 87963 - DNA, 22 bp, Artificial Sequence
  chemically synthesized
attgcgtctatttgattcttct

SEQ ID NO: 87964 - DNA, 22 bp, Artificial Sequence
  chemically synthesized
ttgcgtctatttgattcttctc

SEQ ID NO: 87965 - DNA, 22 bp, Artificial Sequence
  chemically synthesized
cgtctatttgattcttctctct

SEQ ID NO: 87966 - DNA, 22 bp, Artificial Sequence
  chemically synthesized
tttgattcttctctcttttctt

SEQ ID NO: 87967 - DNA, 22 bp, Artificial Sequence
  chemically synthesized
gattcttctctcttttcttctt

SEQ ID NO: 87968 - DNA, 22 bp, Artificial Sequence
  chemically synthesized
attcttctctcttttcttcttt

SEQ ID NO: 87969 - DNA, 22 bp, Artificial Sequence
  chemically synthesized
ttctctcttttcttctttatta

SEQ ID NO: 87970 - DNA, 22 bp, Artificial Sequence
  chemically synthesized
ctctcttttcttctttattagt

SEQ ID NO: 87971 - DNA, 22 bp, Artificial Sequence
  chemically synthesized
tctcttttcttctttattagtc

SEQ ID NO: 87972 - DNA, 22 bp, Artificial Sequence
  chemically synthesized
tcttttcttctttattagtctt

SEQ ID NO: 87973 - DNA, 22 bp, Artificial Sequence
  chemically synthesized
ttttcttctttattagtcttgc

SEQ ID NO: 87974 - DNA, 22 bp, Artificial Sequence
  chemically synthesized
ttcttctttattagtcttgcta

SEQ ID NO: 87975 - DNA, 22 bp, Artificial Sequence
  chemically synthesized
tcttctttattagtcttgctag

SEQ ID NO: 87976 - DNA, 22 bp, Artificial Sequence
  chemically synthesized
cttctttattagtcttgctagc

SEQ ID NO: 87977 - DNA, 22 bp, Artificial Sequence
  chemically synthesized
ttctttattagtcttgctagca

SEQ ID NO: 87978 - DNA, 22 bp, Artificial Sequence
  chemically synthesized
ctttattagtcttgctagcagt

SEQ ID NO: 87979 - DNA, 22 bp, Artificial Sequence
  chemically synthesized
tttattagtcttgctagcagtc

SEQ ID NO: 87980 - DNA, 22 bp, Artificial Sequence
  chemically synthesized
tattagtcttgctagcagtcta

SEQ ID NO: 87981 - DNA, 22 bp, Artificial Sequence
  chemically synthesized
attagtcttgctagcagtctat

SEQ ID NO: 87982 - DNA, 22 bp, Artificial Sequence
  chemically synthesized
ttagtcttgctagcagtctatc

SEQ ID NO: 87983 - DNA, 22 bp, Artificial Sequence
  chemically synthesized
gtcttgctagcagtctatcaat

SEQ ID NO: 87984 - DNA, 22 bp, Artificial Sequence
  chemically synthesized
gctagcagtctatcaattttgt

SEQ ID NO: 87985 - DNA, 22 bp, Artificial Sequence
  chemically synthesized
ctagcagtctatcaattttgtt

SEQ ID NO: 87986 - DNA, 22 bp, Artificial Sequence
  chemically synthesized
gcagtctatcaattttgttgat

SEQ ID NO: 87987 - DNA, 22 bp, Artificial Sequence
  chemically synthesized
tcaattttgttgatcttttcaa

SEQ ID NO: 87988 - DNA, 22 bp, Artificial Sequence
  chemically synthesized
tgttgatcttttcaaaaaaaca

SEQ ID NO: 87989 - DNA, 22 bp, Artificial Sequence
  chemically synthesized
gttgatcttttcaaaaaaacag

SEQ ID NO: 87990 - DNA, 22 bp, Artificial Sequence
  chemically synthesized
ttgatcttttcaaaaaaacagc

SEQ ID NO: 87991 - DNA, 22 bp, Artificial Sequence
  chemically synthesized
atcttttcaaaaaaacagcttc

SEQ ID NO: 87992 - DNA, 22 bp, Artificial Sequence
  chemically synthesized
ttcaaaaaaacagcttctggat

SEQ ID NO: 87993 - DNA, 22 bp, Artificial Sequence
  chemically synthesized
tcaaaaaaacagcttctggatt

SEQ ID NO: 87994 - DNA, 22 bp, Artificial Sequence
  chemically synthesized
caaaaaaacagcttctggattc

SEQ ID NO: 87995 - DNA, 22 bp, Artificial Sequence
  chemically synthesized
aaaaaaacagcttctggattca

SEQ ID NO: 87996 - DNA, 22 bp, Artificial Sequence
  chemically synthesized
ctggattcattgatttttttga

SEQ ID NO: 87997 - DNA, 22 bp, Artificial Sequence
  chemically synthesized
tggattcattgatttttttgaa

SEQ ID NO: 87998 - DNA, 22 bp, Artificial Sequence
  chemically synthesized
gattcattgatttttttgaagg

SEQ ID NO: 87999 - DNA, 22 bp, Artificial Sequence
  chemically synthesized
attgatttttttgaagggtttt

SEQ ID NO: 88000 - DNA, 22 bp, Artificial Sequence
  chemically synthesized
atttttttgaagggtttttttg

SEQ ID NO: 88001 - DNA, 22 bp, Artificial Sequence
  chemically synthesized
ttttgaagggtttttttgtgtc

SEQ ID NO: 88002 - DNA, 22 bp, Artificial Sequence
  chemically synthesized
tttgaagggtttttttgtgtct

SEQ ID NO: 88003 - DNA, 22 bp, Artificial Sequence
  chemically synthesized
ttgaagggtttttttgtgtctc

SEQ ID NO: 88004 - DNA, 22 bp, Artificial Sequence
  chemically synthesized
tgaagggtttttttgtgtctct

SEQ ID NO: 88005 - DNA, 22 bp, Artificial Sequence
  chemically synthesized
gaagggtttttttgtgtctcta

SEQ ID NO: 88006 - DNA, 22 bp, Artificial Sequence
  chemically synthesized
aagggtttttttgtgtctctat

SEQ ID NO: 88007 - DNA, 22 bp, Artificial Sequence
  chemically synthesized
ttttgtgtctctatgtccttca

SEQ ID NO: 88008 - DNA, 22 bp, Artificial Sequence
  chemically synthesized
tttgtgtctctatgtccttcac

SEQ ID NO: 88009 - DNA, 22 bp, Artificial Sequence
  chemically synthesized
ttgtgtctctatgtccttcact

SEQ ID NO: 88010 - DNA, 22 bp, Artificial Sequence
  chemically synthesized
tgtgtctctatgtccttcactt

SEQ ID NO: 88011 - DNA, 22 bp, Artificial Sequence
  chemically synthesized
gtgtctctatgtccttcacttc

SEQ ID NO: 88012 - DNA, 22 bp, Artificial Sequence
  chemically synthesized
tgtctctatgtccttcacttct

SEQ ID NO: 88013 - DNA, 22 bp, Artificial Sequence
  chemically synthesized
tatgtccttcacttctgctctg

SEQ ID NO: 88014 - DNA, 22 bp, Artificial Sequence
  chemically synthesized
tgtccttcacttctgctctgat

SEQ ID NO: 88015 - DNA, 22 bp, Artificial Sequence
  chemically synthesized
cacttctgctctgatcttagtt

SEQ ID NO: 88016 - DNA, 22 bp, Artificial Sequence
  chemically synthesized
acttctgctctgatcttagtta

SEQ ID NO: 88017 - DNA, 22 bp, Artificial Sequence
  chemically synthesized
ctgctctgatcttagttatttc

SEQ ID NO: 88018 - DNA, 22 bp, Artificial Sequence
  chemically synthesized
tgctctgatcttagttatttct

SEQ ID NO: 88019 - DNA, 22 bp, Artificial Sequence
  chemically synthesized
ctctgatcttagttatttcttg

SEQ ID NO: 88020 - DNA, 22 bp, Artificial Sequence
  chemically synthesized
tgatcttagttatttcttgtct

SEQ ID NO: 88021 - DNA, 22 bp, Artificial Sequence
  chemically synthesized
atcttagttatttcttgtcttc

SEQ ID NO: 88022 - DNA, 22 bp, Artificial Sequence
  chemically synthesized
agttatttcttgtcttctgtta

SEQ ID NO: 88023 - DNA, 22 bp, Artificial Sequence
  chemically synthesized
gttatttcttgtcttctgttag

SEQ ID NO: 88024 - DNA, 22 bp, Artificial Sequence
  chemically synthesized
tttcttgtcttctgttagcttt

SEQ ID NO: 88025 - DNA, 22 bp, Artificial Sequence
  chemically synthesized
cttgtcttctgttagcttttga

SEQ ID NO: 88026 - DNA, 22 bp, Artificial Sequence
  chemically synthesized
ttgtcttctgttagcttttgaa

SEQ ID NO: 88027 - DNA, 22 bp, Artificial Sequence
  chemically synthesized
gtcttctgttagcttttgaatg

SEQ ID NO: 88028 - DNA, 22 bp, Artificial Sequence
  chemically synthesized
tcttctgttagcttttgaatgt

SEQ ID NO: 88029 - DNA, 22 bp, Artificial Sequence
  chemically synthesized
ctgttagcttttgaatgtgttt

SEQ ID NO: 88030 - DNA, 22 bp, Artificial Sequence
  chemically synthesized
tgttagcttttgaatgtgtttg

SEQ ID NO: 88031 - DNA, 22 bp, Artificial Sequence
  chemically synthesized
ttagcttttgaatgtgtttgct

SEQ ID NO: 88032 - DNA, 22 bp, Artificial Sequence
  chemically synthesized
gcttttgaatgtgtttgctcct

SEQ ID NO: 88033 - DNA, 22 bp, Artificial Sequence
  chemically synthesized
ttgaatgtgtttgctcctgctt

SEQ ID NO: 88034 - DNA, 22 bp, Artificial Sequence
  chemically synthesized
tgaatgtgtttgctcctgcttc

SEQ ID NO: 88035 - DNA, 22 bp, Artificial Sequence
  chemically synthesized
gaatgtgtttgctcctgcttct

SEQ ID NO: 88036 - DNA, 22 bp, Artificial Sequence
  chemically synthesized
aatgtgtttgctcctgcttctc

SEQ ID NO: 88037 - DNA, 22 bp, Artificial Sequence
  chemically synthesized
gctcctgcttctctagtttttt

SEQ ID NO: 88038 - DNA, 22 bp, Artificial Sequence
  chemically synthesized
ctcctgcttctctagtttttta

SEQ ID NO: 88039 - DNA, 22 bp, Artificial Sequence
  chemically synthesized
ctgcttctctagttttttaatt

SEQ ID NO: 88040 - DNA, 22 bp, Artificial Sequence
  chemically synthesized
cttctctagttttttaattgtg

SEQ ID NO: 88041 - DNA, 22 bp, Artificial Sequence
  chemically synthesized
ctctagttttttaattgtgatg

SEQ ID NO: 88042 - DNA, 22 bp, Artificial Sequence
  chemically synthesized
tctagttttttaattgtgatgt

SEQ ID NO: 88043 - DNA, 22 bp, Artificial Sequence
  chemically synthesized
tagttttttaattgtgatgtta

SEQ ID NO: 88044 - DNA, 22 bp, Artificial Sequence
  chemically synthesized
gttttttaattgtgatgttagg

SEQ ID NO: 88045 - DNA, 22 bp, Artificial Sequence
  chemically synthesized
tttaattgtgatgttagggtgt

SEQ ID NO: 88046 - DNA, 22 bp, Artificial Sequence
  chemically synthesized
ttaattgtgatgttagggtgtc

SEQ ID NO: 88047 - DNA, 22 bp, Artificial Sequence
  chemically synthesized
taattgtgatgttagggtgtca

SEQ ID NO: 88048 - DNA, 22 bp, Artificial Sequence
  chemically synthesized
aattgtgatgttagggtgtcaa

SEQ ID NO: 88049 - DNA, 22 bp, Artificial Sequence
  chemically synthesized
attgtgatgttagggtgtcaat

SEQ ID NO: 88050 - DNA, 22 bp, Artificial Sequence
  chemically synthesized
tgatgttagggtgtcaatttta

SEQ ID NO: 88051 - DNA, 22 bp, Artificial Sequence
  chemically synthesized
gggtgtcaattttagatctttc

SEQ ID NO: 88052 - DNA, 22 bp, Artificial Sequence
  chemically synthesized
tagatctttcctgctttccctt

SEQ ID NO: 88053 - DNA, 22 bp, Artificial Sequence
  chemically synthesized
agatctttcctgctttcccttg

SEQ ID NO: 88054 - DNA, 22 bp, Artificial Sequence
  chemically synthesized
gatctttcctgctttcccttgt

SEQ ID NO: 88055 - DNA, 22 bp, Artificial Sequence
  chemically synthesized
tcctgctttcccttgtgggcat

SEQ ID NO: 88056 - DNA, 22 bp, Artificial Sequence
  chemically synthesized
cctgctttcccttgtgggcatt

SEQ ID NO: 88057 - DNA, 22 bp, Artificial Sequence
  chemically synthesized
ctgctttcccttgtgggcattt

SEQ ID NO: 88058 - DNA, 22 bp, Artificial Sequence
  chemically synthesized
ctttcccttgtgggcatttagt

SEQ ID NO: 88059 - DNA, 22 bp, Artificial Sequence
  chemically synthesized
tcccttgtgggcatttagtgct

SEQ ID NO: 88060 - DNA, 22 bp, Artificial Sequence
  chemically synthesized
cccttgtgggcatttagtgcta

SEQ ID NO: 88061 - DNA, 22 bp, Artificial Sequence
  chemically synthesized
ccttgtgggcatttagtgctat

SEQ ID NO: 88062 - DNA, 22 bp, Artificial Sequence
  chemically synthesized
gtgggcatttagtgctataaat

SEQ ID NO: 88063 - DNA, 22 bp, Artificial Sequence
  chemically synthesized
tgggcatttagtgctataaatt

SEQ ID NO: 88064 - DNA, 22 bp, Artificial Sequence
  chemically synthesized
agtgctataaatttccctctac

SEQ ID NO: 88065 - DNA, 22 bp, Artificial Sequence
  chemically synthesized
gtgctataaatttccctctaca

SEQ ID NO: 88066 - DNA, 22 bp, Artificial Sequence
  chemically synthesized
taaatttccctctacacactgc

SEQ ID NO: 88067 - DNA, 22 bp, Artificial Sequence
  chemically synthesized
ccctctacacactgctttgaat

SEQ ID NO: 88068 - DNA, 22 bp, Artificial Sequence
  chemically synthesized
cctctacacactgctttgaatg

SEQ ID NO: 88069 - DNA, 22 bp, Artificial Sequence
  chemically synthesized
tacacactgctttgaatgtgtc

SEQ ID NO: 88070 - DNA, 22 bp, Artificial Sequence
  chemically synthesized
cacactgctttgaatgtgtctc

SEQ ID NO: 88071 - DNA, 22 bp, Artificial Sequence
  chemically synthesized
ctttgaatgtgtctcagagatt

SEQ ID NO: 88072 - DNA, 22 bp, Artificial Sequence
  chemically synthesized
tgaatgtgtctcagagattctg

SEQ ID NO: 88073 - DNA, 22 bp, Artificial Sequence
  chemically synthesized
gaatgtgtctcagagattctgg

SEQ ID NO: 88074 - DNA, 22 bp, Artificial Sequence
  chemically synthesized
aatgtgtctcagagattctggt

SEQ ID NO: 88075 - DNA, 22 bp, Artificial Sequence
  chemically synthesized
agagattctggtgtgttgtgtc

SEQ ID NO: 88076 - DNA, 22 bp, Artificial Sequence
  chemically synthesized
tggtgtgttgtgtctttgttct

SEQ ID NO: 88077 - DNA, 22 bp, Artificial Sequence
  chemically synthesized
gtgtgttgtgtctttgttctcg

SEQ ID NO: 88078 - DNA, 22 bp, Artificial Sequence
  chemically synthesized
tgtctttgttctcgttggtttc

SEQ ID NO: 88079 - DNA, 22 bp, Artificial Sequence
  chemically synthesized
tgttctcgttggtttcaaagaa

SEQ ID NO: 88080 - DNA, 22 bp, Artificial Sequence
  chemically synthesized
gttctcgttggtttcaaagaac

SEQ ID NO: 88081 - DNA, 22 bp, Artificial Sequence
  chemically synthesized
ttctcgttggtttcaaagaaca

SEQ ID NO: 88082 - DNA, 22 bp, Artificial Sequence
  chemically synthesized
tcgttggtttcaaagaacatct

SEQ ID NO: 88083 - DNA, 22 bp, Artificial Sequence
  chemically synthesized
gttggtttcaaagaacatcttt

SEQ ID NO: 88084 - DNA, 22 bp, Artificial Sequence
  chemically synthesized
gtttcaaagaacatctttattt

SEQ ID NO: 88085 - DNA, 22 bp, Artificial Sequence
  chemically synthesized
caaagaacatctttatttctgc

SEQ ID NO: 88086 - DNA, 22 bp, Artificial Sequence
  chemically synthesized
aaagaacatctttatttctgcc

SEQ ID NO: 88087 - DNA, 22 bp, Artificial Sequence
  chemically synthesized
tatttctgccttcattttgtta

SEQ ID NO: 88088 - DNA, 22 bp, Artificial Sequence
  chemically synthesized
atttctgccttcattttgttat

SEQ ID NO: 88089 - DNA, 22 bp, Artificial Sequence
  chemically synthesized
tttctgccttcattttgttatg

SEQ ID NO: 88090 - DNA, 22 bp, Artificial Sequence
  chemically synthesized
ctgccttcattttgttatgtac

SEQ ID NO: 88091 - DNA, 22 bp, Artificial Sequence
  chemically synthesized
tgccttcattttgttatgtacc

SEQ ID NO: 88092 - DNA, 22 bp, Artificial Sequence
  chemically synthesized
ccttcattttgttatgtaccca

SEQ ID NO: 88093 - DNA, 22 bp, Artificial Sequence
  chemically synthesized
cattttgttatgtacccagtag

SEQ ID NO: 88094 - DNA, 22 bp, Artificial Sequence
  chemically synthesized
attttgttatgtacccagtagt

SEQ ID NO: 88095 - DNA, 22 bp, Artificial Sequence
  chemically synthesized
tgttatgtacccagtagtcatt

SEQ ID NO: 88096 - DNA, 22 bp, Artificial Sequence
  chemically synthesized
gttatgtacccagtagtcattc

SEQ ID NO: 88097 - DNA, 22 bp, Artificial Sequence
  chemically synthesized
ttatgtacccagtagtcattca

SEQ ID NO: 88098 - DNA, 22 bp, Artificial Sequence
  chemically synthesized
tgtacccagtagtcattcagga

SEQ ID NO: 88099 - DNA, 22 bp, Artificial Sequence
  chemically synthesized
aggagcaggctgttcagtttcc

SEQ ID NO: 88100 - DNA, 22 bp, Artificial Sequence
  chemically synthesized
ttcagtttccatgtagctgagt

SEQ ID NO: 88101 - DNA, 22 bp, Artificial Sequence
  chemically synthesized
agtttccatgtagctgagtggt

SEQ ID NO: 88102 - DNA, 22 bp, Artificial Sequence
  chemically synthesized
ccatgtagctgagtggttttga

SEQ ID NO: 88103 - DNA, 22 bp, Artificial Sequence
  chemically synthesized
catgtagctgagtggttttgag

SEQ ID NO: 88104 - DNA, 22 bp, Artificial Sequence
  chemically synthesized
agtggttttgagtgagtttctt

SEQ ID NO: 88105 - DNA, 22 bp, Artificial Sequence
  chemically synthesized
tgagtgagtttcttaatcctga

SEQ ID NO: 88106 - DNA, 22 bp, Artificial Sequence
  chemically synthesized
gagtgagtttcttaatcctgag

SEQ ID NO: 88107 - DNA, 22 bp, Artificial Sequence
  chemically synthesized
agtgagtttcttaatcctgagt

SEQ ID NO: 88108 - DNA, 22 bp, Artificial Sequence
  chemically synthesized
cttaatcctgagttctagtttg

SEQ ID NO: 88109 - DNA, 22 bp, Artificial Sequence
  chemically synthesized
ttaatcctgagttctagtttga

SEQ ID NO: 88110 - DNA, 22 bp, Artificial Sequence
  chemically synthesized
aatcctgagttctagtttgatt

SEQ ID NO: 88111 - DNA, 22 bp, Artificial Sequence
  chemically synthesized
atcctgagttctagtttgattg

SEQ ID NO: 88112 - DNA, 22 bp, Artificial Sequence
  chemically synthesized
agttctagtttgattgcactgt

SEQ ID NO: 88113 - DNA, 22 bp, Artificial Sequence
  chemically synthesized
tagtttgattgcactgtggtct

SEQ ID NO: 88114 - DNA, 22 bp, Artificial Sequence
  chemically synthesized
gtttgattgcactgtggtctga

SEQ ID NO: 88115 - DNA, 22 bp, Artificial Sequence
  chemically synthesized
gattgcactgtggtctgagaga

SEQ ID NO: 88116 - DNA, 22 bp, Artificial Sequence
  chemically synthesized
attgcactgtggtctgagagac

SEQ ID NO: 88117 - DNA, 22 bp, Artificial Sequence
  chemically synthesized
cactgtggtctgagagacagtt

SEQ ID NO: 88118 - DNA, 22 bp, Artificial Sequence
  chemically synthesized
tggtctgagagacagtttgtta

SEQ ID NO: 88119 - DNA, 22 bp, Artificial Sequence
  chemically synthesized
agagacagtttgttatagtttc

SEQ ID NO: 88120 - DNA, 22 bp, Artificial Sequence
  chemically synthesized
gttatagtttctgttcttttac

SEQ ID NO: 88121 - DNA, 22 bp, Artificial Sequence
  chemically synthesized
ttatagtttctgttcttttaca

SEQ ID NO: 88122 - DNA, 22 bp, Artificial Sequence
  chemically synthesized
tagtttctgttcttttacattt

SEQ ID NO: 88123 - DNA, 22 bp, Artificial Sequence
  chemically synthesized
ctgttcttttacatttgctgag

SEQ ID NO: 88124 - DNA, 22 bp, Artificial Sequence
  chemically synthesized
tgttcttttacatttgctgagg

SEQ ID NO: 88125 - DNA, 22 bp, Artificial Sequence
  chemically synthesized
ttcttttacatttgctgaggag

SEQ ID NO: 88126 - DNA, 22 bp, Artificial Sequence
  chemically synthesized
ttttacatttgctgaggagagc

SEQ ID NO: 88127 - DNA, 22 bp, Artificial Sequence
  chemically synthesized
ttacatttgctgaggagagctt

SEQ ID NO: 88128 - DNA, 22 bp, Artificial Sequence
  chemically synthesized
tacatttgctgaggagagcttt

SEQ ID NO: 88129 - DNA, 22 bp, Artificial Sequence
  chemically synthesized
acatttgctgaggagagcttta

SEQ ID NO: 88130 - DNA, 22 bp, Artificial Sequence
  chemically synthesized
catttgctgaggagagctttac

SEQ ID NO: 88131 - DNA, 22 bp, Artificial Sequence
  chemically synthesized
gctgaggagagctttacttcca

SEQ ID NO: 88132 - DNA, 22 bp, Artificial Sequence
  chemically synthesized
ctgaggagagctttacttccaa

SEQ ID NO: 88133 - DNA, 22 bp, Artificial Sequence
  chemically synthesized
aggagagctttacttccaacta

SEQ ID NO: 88134 - DNA, 22 bp, Artificial Sequence
  chemically synthesized
tacttccaactatgtggtcagt

SEQ ID NO: 88135 - DNA, 22 bp, Artificial Sequence
  chemically synthesized
acttccaactatgtggtcagtt

SEQ ID NO: 88136 - DNA, 22 bp, Artificial Sequence
  chemically synthesized
cttccaactatgtggtcagttt

SEQ ID NO: 88137 - DNA, 22 bp, Artificial Sequence
  chemically synthesized
ccaactatgtggtcagttttgg

SEQ ID NO: 88138 - DNA, 22 bp, Artificial Sequence
  chemically synthesized
caactatgtggtcagttttgga

SEQ ID NO: 88139 - DNA, 22 bp, Artificial Sequence
  chemically synthesized
tgtggtcagttttggaataggt

SEQ ID NO: 88140 - DNA, 22 bp, Artificial Sequence
  chemically synthesized
tggaataggtgtggtgtggtgc

SEQ ID NO: 88141 - DNA, 22 bp, Artificial Sequence
  chemically synthesized
ggaataggtgtggtgtggtgct

SEQ ID NO: 88142 - DNA, 22 bp, Artificial Sequence
  chemically synthesized
gaataggtgtggtgtggtgctg

SEQ ID NO: 88143 - DNA, 22 bp, Artificial Sequence
  chemically synthesized
aaaagaatgtatattctgttga

SEQ ID NO: 88144 - DNA, 22 bp, Artificial Sequence
  chemically synthesized
tgttgatttggggtggagagtt

SEQ ID NO: 88145 - DNA, 22 bp, Artificial Sequence
  chemically synthesized
ttgatttggggtggagagttct

SEQ ID NO: 88146 - DNA, 22 bp, Artificial Sequence
  chemically synthesized
atttggggtggagagttctgta

SEQ ID NO: 88147 - DNA, 22 bp, Artificial Sequence
  chemically synthesized
ggggtggagagttctgtagatg

SEQ ID NO: 88148 - DNA, 22 bp, Artificial Sequence
  chemically synthesized
gggtggagagttctgtagatgt

SEQ ID NO: 88149 - DNA, 22 bp, Artificial Sequence
  chemically synthesized
tgtagatgtctattaggtctgc

SEQ ID NO: 88150 - DNA, 22 bp, Artificial Sequence
  chemically synthesized
tagatgtctattaggtctgctt

SEQ ID NO: 88151 - DNA, 22 bp, Artificial Sequence
  chemically synthesized
ttaggtctgcttggtgcagagc

SEQ ID NO: 88152 - DNA, 22 bp, Artificial Sequence
  chemically synthesized
ggtctgcttggtgcagagctga

SEQ ID NO: 88153 - DNA, 22 bp, Artificial Sequence
  chemically synthesized
cttggtgcagagctgagtccaa

SEQ ID NO: 88154 - DNA, 22 bp, Artificial Sequence
  chemically synthesized
ggtgcagagctgagtccaattc

SEQ ID NO: 88155 - DNA, 22 bp, Artificial Sequence
  chemically synthesized
gtgcagagctgagtccaattcc

SEQ ID NO: 88156 - DNA, 22 bp, Artificial Sequence
  chemically synthesized
agtccaattcctggatatcctt

SEQ ID NO: 88157 - DNA, 22 bp, Artificial Sequence
  chemically synthesized
ctggatatccttgttaactttc

SEQ ID NO: 88158 - DNA, 22 bp, Artificial Sequence
  chemically synthesized
gatatccttgttaactttctgt

SEQ ID NO: 88159 - DNA, 22 bp, Artificial Sequence
  chemically synthesized
gttaactttctgtctcgttgat

SEQ ID NO: 88160 - DNA, 22 bp, Artificial Sequence
  chemically synthesized
ttaactttctgtctcgttgatc

SEQ ID NO: 88161 - DNA, 22 bp, Artificial Sequence
  chemically synthesized
actttctgtctcgttgatctgt

SEQ ID NO: 88162 - DNA, 22 bp, Artificial Sequence
  chemically synthesized
tctgtctcgttgatctgtctaa

SEQ ID NO: 88163 - DNA, 22 bp, Artificial Sequence
  chemically synthesized
ctgtctcgttgatctgtctaat

SEQ ID NO: 88164 - DNA, 22 bp, Artificial Sequence
  chemically synthesized
tgtctcgttgatctgtctaatg

SEQ ID NO: 88165 - DNA, 22 bp, Artificial Sequence
  chemically synthesized
tctcgttgatctgtctaatgtt

SEQ ID NO: 88166 - DNA, 22 bp, Artificial Sequence
  chemically synthesized
gttgatctgtctaatgttgaca

SEQ ID NO: 88167 - DNA, 22 bp, Artificial Sequence
  chemically synthesized
atctgtctaatgttgacagtgg

SEQ ID NO: 88168 - DNA, 22 bp, Artificial Sequence
  chemically synthesized
tctaatgttgacagtggggtgt

SEQ ID NO: 88169 - DNA, 22 bp, Artificial Sequence
  chemically synthesized
atgttgacagtggggtgttaaa

SEQ ID NO: 88170 - DNA, 22 bp, Artificial Sequence
  chemically synthesized
acagtggggtgttaaagtctcc

SEQ ID NO: 88171 - DNA, 22 bp, Artificial Sequence
  chemically synthesized
aagtctcccattattattgtgt

SEQ ID NO: 88172 - DNA, 22 bp, Artificial Sequence
  chemically synthesized
ccattattattgtgtgggcatc

SEQ ID NO: 88173 - DNA, 22 bp, Artificial Sequence
  chemically synthesized
ttattgtgtgggcatctaagtc

SEQ ID NO: 88174 - DNA, 22 bp, Artificial Sequence
  chemically synthesized
ttgtgtgggcatctaagtctct

SEQ ID NO: 88175 - DNA, 22 bp, Artificial Sequence
  chemically synthesized
tgtgggcatctaagtctctttg

SEQ ID NO: 88176 - DNA, 22 bp, Artificial Sequence
  chemically synthesized
agtctctttgtaggtcactcag

SEQ ID NO: 88177 - DNA, 22 bp, Artificial Sequence
  chemically synthesized
tttgtaggtcactcaggacttg

SEQ ID NO: 88178 - DNA, 22 bp, Artificial Sequence
  chemically synthesized
tgtaggtcactcaggacttgtt

SEQ ID NO: 88179 - DNA, 22 bp, Artificial Sequence
  chemically synthesized
gtaggtcactcaggacttgttt

SEQ ID NO: 88180 - DNA, 22 bp, Artificial Sequence
  chemically synthesized
taggtcactcaggacttgtttt

SEQ ID NO: 88181 - DNA, 22 bp, Artificial Sequence
  chemically synthesized
aggacttgttttatgaatctgg

SEQ ID NO: 88182 - DNA, 22 bp, Artificial Sequence
  chemically synthesized
gttttatgaatctgggtgctcc

SEQ ID NO: 88183 - DNA, 22 bp, Artificial Sequence
  chemically synthesized
ttttatgaatctgggtgctcct

SEQ ID NO: 88184 - DNA, 22 bp, Artificial Sequence
  chemically synthesized
tatgaatctgggtgctcctgta

SEQ ID NO: 88185 - DNA, 22 bp, Artificial Sequence
  chemically synthesized
atgaatctgggtgctcctgtat

SEQ ID NO: 88186 - DNA, 22 bp, Artificial Sequence
  chemically synthesized
tgaatctgggtgctcctgtatt

SEQ ID NO: 88187 - DNA, 22 bp, Artificial Sequence
  chemically synthesized
ggtgctcctgtattgggtgcat

SEQ ID NO: 88188 - DNA, 22 bp, Artificial Sequence
  chemically synthesized
ctgtattgggtgcatatatatt

SEQ ID NO: 88189 - DNA, 22 bp, Artificial Sequence
  chemically synthesized
tattgggtgcatatatatttag

SEQ ID NO: 88190 - DNA, 22 bp, Artificial Sequence
  chemically synthesized
ggtgcatatatatttagtatag

SEQ ID NO: 88191 - DNA, 22 bp, Artificial Sequence
  chemically synthesized
agtatagttagttcttcttctt

SEQ ID NO: 88192 - DNA, 22 bp, Artificial Sequence
  chemically synthesized
gtatagttagttcttcttcttg

SEQ ID NO: 88193 - DNA, 22 bp, Artificial Sequence
  chemically synthesized
gttcttcttcttgaatagatcc

SEQ ID NO: 88194 - DNA, 22 bp, Artificial Sequence
  chemically synthesized
ttcttcttgaatagatcccttt

SEQ ID NO: 88195 - DNA, 22 bp, Artificial Sequence
  chemically synthesized
cttcttgaatagatccctttgc

SEQ ID NO: 88196 - DNA, 22 bp, Artificial Sequence
  chemically synthesized
ttcttgaatagatccctttgcc

SEQ ID NO: 88197 - DNA, 22 bp, Artificial Sequence
  chemically synthesized
cttgaatagatccctttgccat

SEQ ID NO: 88198 - DNA, 22 bp, Artificial Sequence
  chemically synthesized
ttgaatagatccctttgccatt

SEQ ID NO: 88199 - DNA, 22 bp, Artificial Sequence
  chemically synthesized
gaatagatccctttgccattat

SEQ ID NO: 88200 - DNA, 22 bp, Artificial Sequence
  chemically synthesized
aatagatccctttgccattatg

SEQ ID NO: 88201 - DNA, 22 bp, Artificial Sequence
  chemically synthesized
tgccattatgtaatggccttct

SEQ ID NO: 88202 - DNA, 22 bp, Artificial Sequence
  chemically synthesized
gccattatgtaatggccttctt

SEQ ID NO: 88203 - DNA, 22 bp, Artificial Sequence
  chemically synthesized
ccattatgtaatggccttcttt

SEQ ID NO: 88204 - DNA, 22 bp, Artificial Sequence
  chemically synthesized
tgtaatggccttctttgtctct

SEQ ID NO: 88205 - DNA, 22 bp, Artificial Sequence
  chemically synthesized
ctttgtctcttttgatctttgt

SEQ ID NO: 88206 - DNA, 22 bp, Artificial Sequence
  chemically synthesized
tttgtctcttttgatctttgtt

SEQ ID NO: 88207 - DNA, 22 bp, Artificial Sequence
  chemically synthesized
tgtctcttttgatctttgttgg

SEQ ID NO: 88208 - DNA, 22 bp, Artificial Sequence
  chemically synthesized
gtctcttttgatctttgttggt

SEQ ID NO: 88209 - DNA, 22 bp, Artificial Sequence
  chemically synthesized
tctcttttgatctttgttggtt

SEQ ID NO: 88210 - DNA, 22 bp, Artificial Sequence
  chemically synthesized
ttttgatctttgttggtttaaa

SEQ ID NO: 88211 - DNA, 22 bp, Artificial Sequence
  chemically synthesized
ttgatctttgttggtttaaaat

SEQ ID NO: 88212 - DNA, 22 bp, Artificial Sequence
  chemically synthesized
tgatctttgttggtttaaaatc

SEQ ID NO: 88213 - DNA, 22 bp, Artificial Sequence
  chemically synthesized
gatctttgttggtttaaaatct

SEQ ID NO: 88214 - DNA, 22 bp, Artificial Sequence
  chemically synthesized
atctttgttggtttaaaatctg

SEQ ID NO: 88215 - DNA, 22 bp, Artificial Sequence
  chemically synthesized
tgttggtttaaaatctgtttta

SEQ ID NO: 88216 - DNA, 22 bp, Artificial Sequence
  chemically synthesized
gttggtttaaaatctgttttat

SEQ ID NO: 88217 - DNA, 22 bp, Artificial Sequence
  chemically synthesized
ttggtttaaaatctgttttatc

SEQ ID NO: 88218 - DNA, 22 bp, Artificial Sequence
  chemically synthesized
gtttaaaatctgttttatcaga

SEQ ID NO: 88219 - DNA, 22 bp, Artificial Sequence
  chemically synthesized
aaaatctgttttatcagagact

SEQ ID NO: 88220 - DNA, 22 bp, Artificial Sequence
  chemically synthesized
aaatctgttttatcagagacta

SEQ ID NO: 88221 - DNA, 22 bp, Artificial Sequence
  chemically synthesized
ttttatcagagactaggattgc

SEQ ID NO: 88222 - DNA, 22 bp, Artificial Sequence
  chemically synthesized
tatcagagactaggattgcaac

SEQ ID NO: 88223 - DNA, 22 bp, Artificial Sequence
  chemically synthesized
atcagagactaggattgcaacc

SEQ ID NO: 88224 - DNA, 22 bp, Artificial Sequence
  chemically synthesized
tcagagactaggattgcaaccc

SEQ ID NO: 88225 - DNA, 22 bp, Artificial Sequence
  chemically synthesized
ggattgcaacccctgccttttt

SEQ ID NO: 88226 - DNA, 22 bp, Artificial Sequence
  chemically synthesized
caacccctgcctttttttgttt

SEQ ID NO: 88227 - DNA, 22 bp, Artificial Sequence
  chemically synthesized
cctttttttgttttccatttgc

SEQ ID NO: 88228 - DNA, 22 bp, Artificial Sequence
  chemically synthesized
tttttgttttccatttgcttgg

SEQ ID NO: 88229 - DNA, 22 bp, Artificial Sequence
  chemically synthesized
ttttgttttccatttgcttggt

SEQ ID NO: 88230 - DNA, 22 bp, Artificial Sequence
  chemically synthesized
tttgttttccatttgcttggta

SEQ ID NO: 88231 - DNA, 22 bp, Artificial Sequence
  chemically synthesized
ttgttttccatttgcttggtag

SEQ ID NO: 88232 - DNA, 22 bp, Artificial Sequence
  chemically synthesized
tgttttccatttgcttggtaga

SEQ ID NO: 88233 - DNA, 22 bp, Artificial Sequence
  chemically synthesized
gttttccatttgcttggtagat

SEQ ID NO: 88234 - DNA, 22 bp, Artificial Sequence
  chemically synthesized
ttttccatttgcttggtagata

SEQ ID NO: 88235 - DNA, 22 bp, Artificial Sequence
  chemically synthesized
tccatttgcttggtagatattc

SEQ ID NO: 88236 - DNA, 22 bp, Artificial Sequence
  chemically synthesized
ccatttgcttggtagatattcc

SEQ ID NO: 88237 - DNA, 22 bp, Artificial Sequence
  chemically synthesized
catttgcttggtagatattcct

SEQ ID NO: 88238 - DNA, 22 bp, Artificial Sequence
  chemically synthesized
gcttggtagatattcctccatc

SEQ ID NO: 88239 - DNA, 22 bp, Artificial Sequence
  chemically synthesized
cttggtagatattcctccatcc

SEQ ID NO: 88240 - DNA, 22 bp, Artificial Sequence
  chemically synthesized
ggtagatattcctccatccttt

SEQ ID NO: 88241 - DNA, 22 bp, Artificial Sequence
  chemically synthesized
gtagatattcctccatcctttt

SEQ ID NO: 88242 - DNA, 22 bp, Artificial Sequence
  chemically synthesized
ctccatccttttatttcgagcc

SEQ ID NO: 88243 - DNA, 22 bp, Artificial Sequence
  chemically synthesized
catccttttatttcgagcctat

SEQ ID NO: 88244 - DNA, 22 bp, Artificial Sequence
  chemically synthesized
ttatttcgagcctatgtgtgtc

SEQ ID NO: 88245 - DNA, 22 bp, Artificial Sequence
  chemically synthesized
tatttcgagcctatgtgtgtct

SEQ ID NO: 88246 - DNA, 22 bp, Artificial Sequence
  chemically synthesized
atttcgagcctatgtgtgtctc

SEQ ID NO: 88247 - DNA, 22 bp, Artificial Sequence
  chemically synthesized
tttcgagcctatgtgtgtctct

SEQ ID NO: 88248 - DNA, 22 bp, Artificial Sequence
  chemically synthesized
cgagcctatgtgtgtctctgca

SEQ ID NO: 88249 - DNA, 22 bp, Artificial Sequence
  chemically synthesized
gagcctatgtgtgtctctgcac

SEQ ID NO: 88250 - DNA, 22 bp, Artificial Sequence
  chemically synthesized
tgtgtgtctctgcacgtgagat

SEQ ID NO: 88251 - DNA, 22 bp, Artificial Sequence
  chemically synthesized
tgcacgtgagatgggtttcctg

SEQ ID NO: 88252 - DNA, 22 bp, Artificial Sequence
  chemically synthesized
cacgtgagatgggtttcctgaa

SEQ ID NO: 88253 - DNA, 22 bp, Artificial Sequence
  chemically synthesized
cctgaatacagaacacagatgg

SEQ ID NO: 88254 - DNA, 22 bp, Artificial Sequence
  chemically synthesized
ctgaatacagaacacagatggg

SEQ ID NO: 88255 - DNA, 22 bp, Artificial Sequence
  chemically synthesized
aatacagaacacagatgggtct

SEQ ID NO: 88256 - DNA, 22 bp, Artificial Sequence
  chemically synthesized
gactccttatccaatttgccag

SEQ ID NO: 88257 - DNA, 22 bp, Artificial Sequence
  chemically synthesized
actccttatccaatttgccagt

SEQ ID NO: 88258 - DNA, 22 bp, Artificial Sequence
  chemically synthesized
cttatccaatttgccagtctgt

SEQ ID NO: 88259 - DNA, 22 bp, Artificial Sequence
  chemically synthesized
atccaatttgccagtctgtgtc

SEQ ID NO: 88260 - DNA, 22 bp, Artificial Sequence
  chemically synthesized
tccaatttgccagtctgtgtct

SEQ ID NO: 88261 - DNA, 22 bp, Artificial Sequence
  chemically synthesized
gccagtctgtgtcttttaattg

SEQ ID NO: 88262 - DNA, 22 bp, Artificial Sequence
  chemically synthesized
ccagtctgtgtcttttaattgg

SEQ ID NO: 88263 - DNA, 22 bp, Artificial Sequence
  chemically synthesized
tgtcttttaattggagcattta

SEQ ID NO: 88264 - DNA, 22 bp, Artificial Sequence
  chemically synthesized
ttaattggagcatttagcctat

SEQ ID NO: 88265 - DNA, 22 bp, Artificial Sequence
  chemically synthesized
taattggagcatttagcctatt

SEQ ID NO: 88266 - DNA, 22 bp, Artificial Sequence
  chemically synthesized
aattggagcatttagcctattt

SEQ ID NO: 88267 - DNA, 22 bp, Artificial Sequence
  chemically synthesized
attggagcatttagcctattta

SEQ ID NO: 88268 - DNA, 22 bp, Artificial Sequence
  chemically synthesized
gagcatttagcctatttacatt

SEQ ID NO: 88269 - DNA, 22 bp, Artificial Sequence
  chemically synthesized
agcctatttacatttaaggtga

SEQ ID NO: 88270 - DNA, 22 bp, Artificial Sequence
  chemically synthesized
gcctatttacatttaaggtgag

SEQ ID NO: 88271 - DNA, 22 bp, Artificial Sequence
  chemically synthesized
tttacatttaaggtgagtattg

SEQ ID NO: 88272 - DNA, 22 bp, Artificial Sequence
  chemically synthesized
acatttaaggtgagtattgtta

SEQ ID NO: 88273 - DNA, 22 bp, Artificial Sequence
  chemically synthesized
catttaaggtgagtattgttat

SEQ ID NO: 88274 - DNA, 22 bp, Artificial Sequence
  chemically synthesized
aaggtgagtattgttatgtatg

SEQ ID NO: 88275 - DNA, 22 bp, Artificial Sequence
  chemically synthesized
aggtgagtattgttatgtatga

SEQ ID NO: 88276 - DNA, 22 bp, Artificial Sequence
  chemically synthesized
ttatgtatgaatttgatcctgt

SEQ ID NO: 88277 - DNA, 22 bp, Artificial Sequence
  chemically synthesized
tgtatgaatttgatcctgtcat

SEQ ID NO: 88278 - DNA, 22 bp, Artificial Sequence
  chemically synthesized
gatcctgtcattatgatgttag

SEQ ID NO: 88279 - DNA, 22 bp, Artificial Sequence
  chemically synthesized
atcctgtcattatgatgttagc

SEQ ID NO: 88280 - DNA, 22 bp, Artificial Sequence
  chemically synthesized
tcattatgatgttagctggtta

SEQ ID NO: 88281 - DNA, 22 bp, Artificial Sequence
  chemically synthesized
tgatgttagctggttattttgc

SEQ ID NO: 88282 - DNA, 22 bp, Artificial Sequence
  chemically synthesized
gctggttattttgctcgttgat

SEQ ID NO: 88283 - DNA, 22 bp, Artificial Sequence
  chemically synthesized
gttattttgctcgttgatgcag

SEQ ID NO: 88284 - DNA, 22 bp, Artificial Sequence
  chemically synthesized
ttttgctcgttgatgcagtttc

SEQ ID NO: 88285 - DNA, 22 bp, Artificial Sequence
  chemically synthesized
tgctcgttgatgcagtttcttc

SEQ ID NO: 88286 - DNA, 22 bp, Artificial Sequence
  chemically synthesized
gctcgttgatgcagtttcttcc

SEQ ID NO: 88287 - DNA, 22 bp, Artificial Sequence
  chemically synthesized
ctcgttgatgcagtttcttcct

SEQ ID NO: 88288 - DNA, 22 bp, Artificial Sequence
  chemically synthesized
gttgatgcagtttcttcctagc

SEQ ID NO: 88289 - DNA, 22 bp, Artificial Sequence
  chemically synthesized
atgcagtttcttcctagccttg

SEQ ID NO: 88290 - DNA, 22 bp, Artificial Sequence
  chemically synthesized
cttcctagccttgatggtcttt

SEQ ID NO: 88291 - DNA, 22 bp, Artificial Sequence
  chemically synthesized
ttcctagccttgatggtcttta

SEQ ID NO: 88292 - DNA, 22 bp, Artificial Sequence
  chemically synthesized
cctagccttgatggtctttaca

SEQ ID NO: 88293 - DNA, 22 bp, Artificial Sequence
  chemically synthesized
ctagccttgatggtctttacaa

SEQ ID NO: 88294 - DNA, 22 bp, Artificial Sequence
  chemically synthesized
gccttgatggtctttacaattt

SEQ ID NO: 88295 - DNA, 22 bp, Artificial Sequence
  chemically synthesized
gatggtctttacaatttggcat

SEQ ID NO: 88296 - DNA, 22 bp, Artificial Sequence
  chemically synthesized
atggtctttacaatttggcatg

SEQ ID NO: 88297 - DNA, 22 bp, Artificial Sequence
  chemically synthesized
tacaatttggcatgtttttgca

SEQ ID NO: 88298 - DNA, 22 bp, Artificial Sequence
  chemically synthesized
acaatttggcatgtttttgcag

SEQ ID NO: 88299 - DNA, 22 bp, Artificial Sequence
  chemically synthesized
caatttggcatgtttttgcagt

SEQ ID NO: 88300 - DNA, 22 bp, Artificial Sequence
  chemically synthesized
ggcatgtttttgcagtggctga

SEQ ID NO: 88301 - DNA, 22 bp, Artificial Sequence
  chemically synthesized
gcatgtttttgcagtggctgat

SEQ ID NO: 88302 - DNA, 22 bp, Artificial Sequence
  chemically synthesized
ttgcagtggctgatactagttg

SEQ ID NO: 88303 - DNA, 22 bp, Artificial Sequence
  chemically synthesized
tgcagtggctgatactagttgt

SEQ ID NO: 88304 - DNA, 22 bp, Artificial Sequence
  chemically synthesized
gcagtggctgatactagttgtt

SEQ ID NO: 88305 - DNA, 22 bp, Artificial Sequence
  chemically synthesized
cagtggctgatactagttgttc

SEQ ID NO: 88306 - DNA, 22 bp, Artificial Sequence
  chemically synthesized
atactagttgttcctttccatg

SEQ ID NO: 88307 - DNA, 22 bp, Artificial Sequence
  chemically synthesized
gttgttcctttccatgtttagt

SEQ ID NO: 88308 - DNA, 22 bp, Artificial Sequence
  chemically synthesized
ttcctttccatgtttagtgctt

SEQ ID NO: 88309 - DNA, 22 bp, Artificial Sequence
  chemically synthesized
ctttccatgtttagtgcttcct

SEQ ID NO: 88310 - DNA, 22 bp, Artificial Sequence
  chemically synthesized
tccatgtttagtgcttccttca

SEQ ID NO: 88311 - DNA, 22 bp, Artificial Sequence
  chemically synthesized
ccatgtttagtgcttccttcag

SEQ ID NO: 88312 - DNA, 22 bp, Artificial Sequence
  chemically synthesized
catgtttagtgcttccttcagg

SEQ ID NO: 88313 - DNA, 22 bp, Artificial Sequence
  chemically synthesized
agtgcttccttcaggagctctt

SEQ ID NO: 88314 - DNA, 22 bp, Artificial Sequence
  chemically synthesized
gtgcttccttcaggagctcttg

SEQ ID NO: 88315 - DNA, 22 bp, Artificial Sequence
  chemically synthesized
ccttcaggagctcttgtagggc

SEQ ID NO: 88316 - DNA, 22 bp, Artificial Sequence
  chemically synthesized
cttcaggagctcttgtagggca

SEQ ID NO: 88317 - DNA, 22 bp, Artificial Sequence
  chemically synthesized
caggagctcttgtagggcaggc

SEQ ID NO: 88318 - DNA, 22 bp, Artificial Sequence
  chemically synthesized
aggagctcttgtagggcaggcc

SEQ ID NO: 88319 - DNA, 22 bp, Artificial Sequence
  chemically synthesized
ttgtagggcaggcctggtggtg

SEQ ID NO: 88320 - DNA, 22 bp, Artificial Sequence
  chemically synthesized
gtagggcaggcctggtggtgac

SEQ ID NO: 88321 - DNA, 22 bp, Artificial Sequence
  chemically synthesized
tagggcaggcctggtggtgaca

SEQ ID NO: 88322 - DNA, 22 bp, Artificial Sequence
  chemically synthesized
gtggtgacaaaatctctcagca

SEQ ID NO: 88323 - DNA, 22 bp, Artificial Sequence
  chemically synthesized
tcagcatttgcttgtctgtaaa

SEQ ID NO: 88324 - DNA, 22 bp, Artificial Sequence
  chemically synthesized
agcatttgcttgtctgtaaagg

SEQ ID NO: 88325 - DNA, 22 bp, Artificial Sequence
  chemically synthesized
gcttgtctgtaaaggattttat

SEQ ID NO: 88326 - DNA, 22 bp, Artificial Sequence
  chemically synthesized
cttgtctgtaaaggattttatt

SEQ ID NO: 88327 - DNA, 22 bp, Artificial Sequence
  chemically synthesized
gtctgtaaaggattttatttct

SEQ ID NO: 88328 - DNA, 22 bp, Artificial Sequence
  chemically synthesized
tctgtaaaggattttatttctc

SEQ ID NO: 88329 - DNA, 22 bp, Artificial Sequence
  chemically synthesized
taaaggattttatttctccttc

SEQ ID NO: 88330 - DNA, 22 bp, Artificial Sequence
  chemically synthesized
tatttctccttcacttatgaag

SEQ ID NO: 88331 - DNA, 22 bp, Artificial Sequence
  chemically synthesized
atttctccttcacttatgaagc

SEQ ID NO: 88332 - DNA, 22 bp, Artificial Sequence
  chemically synthesized
tttctccttcacttatgaagct

SEQ ID NO: 88333 - DNA, 22 bp, Artificial Sequence
  chemically synthesized
ctccttcacttatgaagcttag

SEQ ID NO: 88334 - DNA, 22 bp, Artificial Sequence
  chemically synthesized
tccttcacttatgaagcttagt

SEQ ID NO: 88335 - DNA, 22 bp, Artificial Sequence
  chemically synthesized
cttcacttatgaagcttagttt

SEQ ID NO: 88336 - DNA, 22 bp, Artificial Sequence
  chemically synthesized
cacttatgaagcttagtttggc

SEQ ID NO: 88337 - DNA, 22 bp, Artificial Sequence
  chemically synthesized
acttatgaagcttagtttggct

SEQ ID NO: 88338 - DNA, 22 bp, Artificial Sequence
  chemically synthesized
atgaagcttagtttggctggat

SEQ ID NO: 88339 - DNA, 22 bp, Artificial Sequence
  chemically synthesized
tgaagcttagtttggctggata

SEQ ID NO: 88340 - DNA, 22 bp, Artificial Sequence
  chemically synthesized
agtttggctggatatgaaattc

SEQ ID NO: 88341 - DNA, 22 bp, Artificial Sequence
  chemically synthesized
gtttggctggatatgaaattct

SEQ ID NO: 88342 - DNA, 22 bp, Artificial Sequence
  chemically synthesized
ggctggatatgaaattctgggt

SEQ ID NO: 88343 - DNA, 22 bp, Artificial Sequence
  chemically synthesized
gctggatatgaaattctgggtt

SEQ ID NO: 88344 - DNA, 22 bp, Artificial Sequence
  chemically synthesized
gatatgaaattctgggttgaaa

SEQ ID NO: 88345 - DNA, 22 bp, Artificial Sequence
  chemically synthesized
tgggttgaaaattcttttcttt

SEQ ID NO: 88346 - DNA, 22 bp, Artificial Sequence
  chemically synthesized
ggttgaaaattcttttctttaa

SEQ ID NO: 88347 - DNA, 22 bp, Artificial Sequence
  chemically synthesized
aaaattcttttctttaacaatg

SEQ ID NO: 88348 - DNA, 22 bp, Artificial Sequence
  chemically synthesized
ttttctttaacaatgttgaata

SEQ ID NO: 88349 - DNA, 22 bp, Artificial Sequence
  chemically synthesized
ttctttaacaatgttgaatatt

SEQ ID NO: 88350 - DNA, 22 bp, Artificial Sequence
  chemically synthesized
tctttaacaatgttgaatattg

SEQ ID NO: 88351 - DNA, 22 bp, Artificial Sequence
  chemically synthesized
ctttaacaatgttgaatattgg

SEQ ID NO: 88352 - DNA, 22 bp, Artificial Sequence
  chemically synthesized
tttaacaatgttgaatattggc

SEQ ID NO: 88353 - DNA, 22 bp, Artificial Sequence
  chemically synthesized
taacaatgttgaatattggccc

SEQ ID NO: 88354 - DNA, 22 bp, Artificial Sequence
  chemically synthesized
aacaatgttgaatattggcccc

SEQ ID NO: 88355 - DNA, 22 bp, Artificial Sequence
  chemically synthesized
acaatgttgaatattggccccc

SEQ ID NO: 88356 - DNA, 22 bp, Artificial Sequence
  chemically synthesized
aatattggcccccactttcttc

SEQ ID NO: 88357 - DNA, 22 bp, Artificial Sequence
  chemically synthesized
gcccccactttcttctggcttg

SEQ ID NO: 88358 - DNA, 22 bp, Artificial Sequence
  chemically synthesized
tcttctggcttgtagagtttct

SEQ ID NO: 88359 - DNA, 22 bp, Artificial Sequence
  chemically synthesized
cttctggcttgtagagtttctg

SEQ ID NO: 88360 - DNA, 22 bp, Artificial Sequence
  chemically synthesized
ttctggcttgtagagtttctgc

SEQ ID NO: 88361 - DNA, 22 bp, Artificial Sequence
  chemically synthesized
ctggcttgtagagtttctgccg

SEQ ID NO: 88362 - DNA, 22 bp, Artificial Sequence
  chemically synthesized
tggcttgtagagtttctgccga

SEQ ID NO: 88363 - DNA, 22 bp, Artificial Sequence
  chemically synthesized
gcttgtagagtttctgccgata

SEQ ID NO: 88364 - DNA, 22 bp, Artificial Sequence
  chemically synthesized
gtagagtttctgccgatagatc

SEQ ID NO: 88365 - DNA, 22 bp, Artificial Sequence
  chemically synthesized
tagagtttctgccgatagatca

SEQ ID NO: 88366 - DNA, 22 bp, Artificial Sequence
  chemically synthesized
ctgccgatagatcagctgttag

SEQ ID NO: 88367 - DNA, 22 bp, Artificial Sequence
  chemically synthesized
tgccgatagatcagctgttagt

SEQ ID NO: 88368 - DNA, 22 bp, Artificial Sequence
  chemically synthesized
ccgatagatcagctgttagtct

SEQ ID NO: 88369 - DNA, 22 bp, Artificial Sequence
  chemically synthesized
ttagtctgatgggcttcccttt

SEQ ID NO: 88370 - DNA, 22 bp, Artificial Sequence
  chemically synthesized
gtctgatgggcttccctttgtg

SEQ ID NO: 88371 - DNA, 22 bp, Artificial Sequence
  chemically synthesized
atgggcttccctttgtgggtaa

SEQ ID NO: 88372 - DNA, 22 bp, Artificial Sequence
  chemically synthesized
ccctttgtgggtaacccgacct

SEQ ID NO: 88373 - DNA, 22 bp, Artificial Sequence
  chemically synthesized
cctttgtgggtaacccgacctt

SEQ ID NO: 88374 - DNA, 22 bp, Artificial Sequence
  chemically synthesized
tgtgggtaacccgacctttctc

SEQ ID NO: 88375 - DNA, 22 bp, Artificial Sequence
  chemically synthesized
gtgggtaacccgacctttctct

SEQ ID NO: 88376 - DNA, 22 bp, Artificial Sequence
  chemically synthesized
tgggtaacccgacctttctctc

SEQ ID NO: 88377 - DNA, 22 bp, Artificial Sequence
  chemically synthesized
tctctctggctgcccttaacat

SEQ ID NO: 88378 - DNA, 22 bp, Artificial Sequence
  chemically synthesized
ctctctggctgcccttaacatt

SEQ ID NO: 88379 - DNA, 22 bp, Artificial Sequence
  chemically synthesized
tctctggctgcccttaacattt

SEQ ID NO: 88380 - DNA, 22 bp, Artificial Sequence
  chemically synthesized
tctggctgcccttaacattttt

SEQ ID NO: 88381 - DNA, 22 bp, Artificial Sequence
  chemically synthesized
tggctgcccttaacattttttc

SEQ ID NO: 88382 - DNA, 22 bp, Artificial Sequence
  chemically synthesized
gctgcccttaacattttttcct

SEQ ID NO: 88383 - DNA, 22 bp, Artificial Sequence
  chemically synthesized
cccttaacattttttccttcat

SEQ ID NO: 88384 - DNA, 22 bp, Artificial Sequence
  chemically synthesized
aacattttttccttcatttcaa

SEQ ID NO: 88385 - DNA, 22 bp, Artificial Sequence
  chemically synthesized
acattttttccttcatttcaac

SEQ ID NO: 88386 - DNA, 22 bp, Artificial Sequence
  chemically synthesized
tttccttcatttcaactttggt

SEQ ID NO: 88387 - DNA, 22 bp, Artificial Sequence
  chemically synthesized
ttccttcatttcaactttggtg

SEQ ID NO: 88388 - DNA, 22 bp, Artificial Sequence
  chemically synthesized
tccttcatttcaactttggtga

SEQ ID NO: 88389 - DNA, 22 bp, Artificial Sequence
  chemically synthesized
ccttcatttcaactttggtgaa

SEQ ID NO: 88390 - DNA, 22 bp, Artificial Sequence
  chemically synthesized
cttcatttcaactttggtgaat

SEQ ID NO: 88391 - DNA, 22 bp, Artificial Sequence
  chemically synthesized
catttcaactttggtgaatctg

SEQ ID NO: 88392 - DNA, 22 bp, Artificial Sequence
  chemically synthesized
atttcaactttggtgaatctga

SEQ ID NO: 88393 - DNA, 22 bp, Artificial Sequence
  chemically synthesized
caactttggtgaatctgacagt

SEQ ID NO: 88394 - DNA, 22 bp, Artificial Sequence
  chemically synthesized
aactttggtgaatctgacagtt

SEQ ID NO: 88395 - DNA, 22 bp, Artificial Sequence
  chemically synthesized
tggtgaatctgacagttatgtg

SEQ ID NO: 88396 - DNA, 22 bp, Artificial Sequence
  chemically synthesized
ggtgaatctgacagttatgtgt

SEQ ID NO: 88397 - DNA, 22 bp, Artificial Sequence
  chemically synthesized
gtgaatctgacagttatgtgtc

SEQ ID NO: 88398 - DNA, 22 bp, Artificial Sequence
  chemically synthesized
acagttatgtgtcttggagttg

SEQ ID NO: 88399 - DNA, 22 bp, Artificial Sequence
  chemically synthesized
tgtgtcttggagttgcttttct

SEQ ID NO: 88400 - DNA, 22 bp, Artificial Sequence
  chemically synthesized
ggagttgcttttctctaggagt

SEQ ID NO: 88401 - DNA, 22 bp, Artificial Sequence
  chemically synthesized
gagttgcttttctctaggagta

SEQ ID NO: 88402 - DNA, 22 bp, Artificial Sequence
  chemically synthesized
cttttctctaggagtatctttg

SEQ ID NO: 88403 - DNA, 22 bp, Artificial Sequence
  chemically synthesized
ttctctaggagtatctttgtgg

SEQ ID NO: 88404 - DNA, 22 bp, Artificial Sequence
  chemically synthesized
tctctaggagtatctttgtggc

SEQ ID NO: 88405 - DNA, 22 bp, Artificial Sequence
  chemically synthesized
ctctaggagtatctttgtggcg

SEQ ID NO: 88406 - DNA, 22 bp, Artificial Sequence
  chemically synthesized
tctaggagtatctttgtggcgt

SEQ ID NO: 88407 - DNA, 22 bp, Artificial Sequence
  chemically synthesized
taggagtatctttgtggcgttc

SEQ ID NO: 88408 - DNA, 22 bp, Artificial Sequence
  chemically synthesized
ggagtatctttgtggcgttctc

SEQ ID NO: 88409 - DNA, 22 bp, Artificial Sequence
  chemically synthesized
tgtggcgttctctgtatttcct

SEQ ID NO: 88410 - DNA, 22 bp, Artificial Sequence
  chemically synthesized
gtggcgttctctgtatttcctg

SEQ ID NO: 88411 - DNA, 22 bp, Artificial Sequence
  chemically synthesized
tggcgttctctgtatttcctga

SEQ ID NO: 88412 - DNA, 22 bp, Artificial Sequence
  chemically synthesized
tctgtatttcctgaatgtgaat

SEQ ID NO: 88413 - DNA, 22 bp, Artificial Sequence
  chemically synthesized
tgtatttcctgaatgtgaattt

SEQ ID NO: 88414 - DNA, 22 bp, Artificial Sequence
  chemically synthesized
tatttcctgaatgtgaatttgg

SEQ ID NO: 88415 - DNA, 22 bp, Artificial Sequence
  chemically synthesized
cctgaatgtgaatttgggcttg

SEQ ID NO: 88416 - DNA, 22 bp, Artificial Sequence
  chemically synthesized
ctgaatgtgaatttgggcttgc

SEQ ID NO: 88417 - DNA, 22 bp, Artificial Sequence
  chemically synthesized
aatgtgaatttgggcttgcctt

SEQ ID NO: 88418 - DNA, 22 bp, Artificial Sequence
  chemically synthesized
gggcttgccttgctagattggg

SEQ ID NO: 88419 - DNA, 22 bp, Artificial Sequence
  chemically synthesized
ggcttgccttgctagattgggg

SEQ ID NO: 88420 - DNA, 22 bp, Artificial Sequence
  chemically synthesized
gccttgctagattggggaagtt

SEQ ID NO: 88421 - DNA, 22 bp, Artificial Sequence
  chemically synthesized
ccttgctagattggggaagttc

SEQ ID NO: 88422 - DNA, 22 bp, Artificial Sequence
  chemically synthesized
gctagattggggaagttctcct

SEQ ID NO: 88423 - DNA, 22 bp, Artificial Sequence
  chemically synthesized
ctagattggggaagttctcctg

SEQ ID NO: 88424 - DNA, 22 bp, Artificial Sequence
  chemically synthesized
gattggggaagttctcctggat

SEQ ID NO: 88425 - DNA, 22 bp, Artificial Sequence
  chemically synthesized
gggaagttctcctggataatat

SEQ ID NO: 88426 - DNA, 22 bp, Artificial Sequence
  chemically synthesized
tcctggataatatcctgcagag

SEQ ID NO: 88427 - DNA, 22 bp, Artificial Sequence
  chemically synthesized
ctggataatatcctgcagagtg

SEQ ID NO: 88428 - DNA, 22 bp, Artificial Sequence
  chemically synthesized
gataatatcctgcagagtgttt

SEQ ID NO: 88429 - DNA, 22 bp, Artificial Sequence
  chemically synthesized
cagagtgttttccaacttggtt

SEQ ID NO: 88430 - DNA, 22 bp, Artificial Sequence
  chemically synthesized
tccaacttggttccattctccc

SEQ ID NO: 88431 - DNA, 22 bp, Artificial Sequence
  chemically synthesized
ccaacttggttccattctcccc

SEQ ID NO: 88432 - DNA, 22 bp, Artificial Sequence
  chemically synthesized
caacttggttccattctcccca

SEQ ID NO: 88433 - DNA, 22 bp, Artificial Sequence
  chemically synthesized
ggttccattctccccatcactt

SEQ ID NO: 88434 - DNA, 22 bp, Artificial Sequence
  chemically synthesized
gttccattctccccatcacttt

SEQ ID NO: 88435 - DNA, 22 bp, Artificial Sequence
  chemically synthesized
cattctccccatcactttcagc

SEQ ID NO: 88436 - DNA, 22 bp, Artificial Sequence
  chemically synthesized
tccccatcactttcagctacac

SEQ ID NO: 88437 - DNA, 22 bp, Artificial Sequence
  chemically synthesized
cccatcactttcagctacacca

SEQ ID NO: 88438 - DNA, 22 bp, Artificial Sequence
  chemically synthesized
tcagctacaccaattagatgta

SEQ ID NO: 88439 - DNA, 22 bp, Artificial Sequence
  chemically synthesized
cagctacaccaattagatgtag

SEQ ID NO: 88440 - DNA, 22 bp, Artificial Sequence
  chemically synthesized
agctacaccaattagatgtaga

SEQ ID NO: 88441 - DNA, 22 bp, Artificial Sequence
  chemically synthesized
caccaattagatgtagatttgg

SEQ ID NO: 88442 - DNA, 22 bp, Artificial Sequence
  chemically synthesized
gatgtagatttggtcttttcac

SEQ ID NO: 88443 - DNA, 22 bp, Artificial Sequence
  chemically synthesized
ggtcttttcacatagtcccata

SEQ ID NO: 88444 - DNA, 22 bp, Artificial Sequence
  chemically synthesized
gtcttttcacatagtcccatat

SEQ ID NO: 88445 - DNA, 22 bp, Artificial Sequence
  chemically synthesized
ttcacatagtcccatatttctt

SEQ ID NO: 88446 - DNA, 22 bp, Artificial Sequence
  chemically synthesized
tcacatagtcccatatttcttg

SEQ ID NO: 88447 - DNA, 22 bp, Artificial Sequence
  chemically synthesized
cacatagtcccatatttcttgg

SEQ ID NO: 88448 - DNA, 22 bp, Artificial Sequence
  chemically synthesized
acatagtcccatatttcttgga

SEQ ID NO: 88449 - DNA, 22 bp, Artificial Sequence
  chemically synthesized
cttggaggctttgttcgtttct

SEQ ID NO: 88450 - DNA, 22 bp, Artificial Sequence
  chemically synthesized
ttggaggctttgttcgtttctt

SEQ ID NO: 88451 - DNA, 22 bp, Artificial Sequence
  chemically synthesized
ggaggctttgttcgtttctttt

SEQ ID NO: 88452 - DNA, 22 bp, Artificial Sequence
  chemically synthesized
gaggctttgttcgtttcttttt

SEQ ID NO: 88453 - DNA, 22 bp, Artificial Sequence
  chemically synthesized
tgttcgtttctttttattcttt

SEQ ID NO: 88454 - DNA, 22 bp, Artificial Sequence
  chemically synthesized
gttcgtttctttttattctttt

SEQ ID NO: 88455 - DNA, 22 bp, Artificial Sequence
  chemically synthesized
ttcgtttctttttattcttttt

SEQ ID NO: 88456 - DNA, 22 bp, Artificial Sequence
  chemically synthesized
gtttctttttattcttttttct

SEQ ID NO: 88457 - DNA, 22 bp, Artificial Sequence
  chemically synthesized
ctttttattcttttttctctaa

SEQ ID NO: 88458 - DNA, 22 bp, Artificial Sequence
  chemically synthesized
tttttattcttttttctctaaa

SEQ ID NO: 88459 - DNA, 22 bp, Artificial Sequence
  chemically synthesized
tttattcttttttctctaaact

SEQ ID NO: 88460 - DNA, 22 bp, Artificial Sequence
  chemically synthesized
ttattcttttttctctaaactt

SEQ ID NO: 88461 - DNA, 22 bp, Artificial Sequence
  chemically synthesized
tattcttttttctctaaacttc

SEQ ID NO: 88462 - DNA, 22 bp, Artificial Sequence
  chemically synthesized
attcttttttctctaaacttct

SEQ ID NO: 88463 - DNA, 22 bp, Artificial Sequence
  chemically synthesized
ttcttttttctctaaacttctc

SEQ ID NO: 88464 - DNA, 22 bp, Artificial Sequence
  chemically synthesized
ttttttctctaaacttctcttc

SEQ ID NO: 88465 - DNA, 22 bp, Artificial Sequence
  chemically synthesized
ttttctctaaacttctcttcat

SEQ ID NO: 88466 - DNA, 22 bp, Artificial Sequence
  chemically synthesized
tttctctaaacttctcttcatg

SEQ ID NO: 88467 - DNA, 22 bp, Artificial Sequence
  chemically synthesized
ttctctaaacttctcttcatgc

SEQ ID NO: 88468 - DNA, 22 bp, Artificial Sequence
  chemically synthesized
tctctaaacttctcttcatgct

SEQ ID NO: 88469 - DNA, 22 bp, Artificial Sequence
  chemically synthesized
ctctaaacttctcttcatgctt

SEQ ID NO: 88470 - DNA, 22 bp, Artificial Sequence
  chemically synthesized
tctaaacttctcttcatgcttc

SEQ ID NO: 88471 - DNA, 22 bp, Artificial Sequence
  chemically synthesized
taaacttctcttcatgcttcat

SEQ ID NO: 88472 - DNA, 22 bp, Artificial Sequence
  chemically synthesized
aacttctcttcatgcttcattt

SEQ ID NO: 88473 - DNA, 22 bp, Artificial Sequence
  chemically synthesized
ctcttcatgcttcatttcattc

SEQ ID NO: 88474 - DNA, 22 bp, Artificial Sequence
  chemically synthesized
tcttcatgcttcatttcattca

SEQ ID NO: 88475 - DNA, 22 bp, Artificial Sequence
  chemically synthesized
ttcatgcttcatttcattcatt

SEQ ID NO: 88476 - DNA, 22 bp, Artificial Sequence
  chemically synthesized
catgcttcatttcattcatttc

SEQ ID NO: 88477 - DNA, 22 bp, Artificial Sequence
  chemically synthesized
atgcttcatttcattcatttca

SEQ ID NO: 88478 - DNA, 22 bp, Artificial Sequence
  chemically synthesized
catttcattcatttcatctttc

SEQ ID NO: 88479 - DNA, 22 bp, Artificial Sequence
  chemically synthesized
atttcattcatttcatctttcg

SEQ ID NO: 88480 - DNA, 22 bp, Artificial Sequence
  chemically synthesized
cattcatttcatctttcgtcat

SEQ ID NO: 88481 - DNA, 22 bp, Artificial Sequence
  chemically synthesized
attcatttcatctttcgtcatt

SEQ ID NO: 88482 - DNA, 22 bp, Artificial Sequence
  chemically synthesized
atttcatctttcgtcattgata

SEQ ID NO: 88483 - DNA, 22 bp, Artificial Sequence
  chemically synthesized
catctttcgtcattgataccct

SEQ ID NO: 88484 - DNA, 22 bp, Artificial Sequence
  chemically synthesized
atctttcgtcattgataccctt

SEQ ID NO: 88485 - DNA, 22 bp, Artificial Sequence
  chemically synthesized
tcgtcattgataccctttcttc

SEQ ID NO: 88486 - DNA, 22 bp, Artificial Sequence
  chemically synthesized
cgtcattgataccctttcttcc

SEQ ID NO: 88487 - DNA, 22 bp, Artificial Sequence
  chemically synthesized
gtcattgataccctttcttcca

SEQ ID NO: 88488 - DNA, 22 bp, Artificial Sequence
  chemically synthesized
ataccctttcttccagttgatc

SEQ ID NO: 88489 - DNA, 22 bp, Artificial Sequence
  chemically synthesized
tcttccagttgatctcatcggt

SEQ ID NO: 88490 - DNA, 22 bp, Artificial Sequence
  chemically synthesized
cttccagttgatctcatcggtt

SEQ ID NO: 88491 - DNA, 22 bp, Artificial Sequence
  chemically synthesized
ttccagttgatctcatcggtta

SEQ ID NO: 88492 - DNA, 22 bp, Artificial Sequence
  chemically synthesized
ccagttgatctcatcggttact

SEQ ID NO: 88493 - DNA, 22 bp, Artificial Sequence
  chemically synthesized
cagttgatctcatcggttactg

SEQ ID NO: 88494 - DNA, 22 bp, Artificial Sequence
  chemically synthesized
atctcatcggttactgaggctt

SEQ ID NO: 88495 - DNA, 22 bp, Artificial Sequence
  chemically synthesized
atcggttactgaggcttgtgta

SEQ ID NO: 88496 - DNA, 22 bp, Artificial Sequence
  chemically synthesized
ctgaggcttgtgtatttgtcac

SEQ ID NO: 88497 - DNA, 22 bp, Artificial Sequence
  chemically synthesized
aggcttgtgtatttgtcacgta

SEQ ID NO: 88498 - DNA, 22 bp, Artificial Sequence
  chemically synthesized
gtgtatttgtcacgtagttctc

SEQ ID NO: 88499 - DNA, 22 bp, Artificial Sequence
  chemically synthesized
tgtatttgtcacgtagttctcc

SEQ ID NO: 88500 - DNA, 22 bp, Artificial Sequence
  chemically synthesized
gtcacgtagttctcctgccttg

SEQ ID NO: 88501 - DNA, 22 bp, Artificial Sequence
  chemically synthesized
tcacgtagttctcctgccttgg

SEQ ID NO: 88502 - DNA, 22 bp, Artificial Sequence
  chemically synthesized
tcctgccttggttttcagctcc

SEQ ID NO: 88503 - DNA, 22 bp, Artificial Sequence
  chemically synthesized
ctgccttggttttcagctccat

SEQ ID NO: 88504 - DNA, 22 bp, Artificial Sequence
  chemically synthesized
ccttggttttcagctccatcag

SEQ ID NO: 88505 - DNA, 22 bp, Artificial Sequence
  chemically synthesized
ggttttcagctccatcaggtcc

SEQ ID NO: 88506 - DNA, 22 bp, Artificial Sequence
  chemically synthesized
gttttcagctccatcaggtcct

SEQ ID NO: 88507 - DNA, 22 bp, Artificial Sequence
  chemically synthesized
tcagctccatcaggtcctttaa

SEQ ID NO: 88508 - DNA, 22 bp, Artificial Sequence
  chemically synthesized
cagctccatcaggtcctttaag

SEQ ID NO: 88509 - DNA, 22 bp, Artificial Sequence
  chemically synthesized
agctccatcaggtcctttaagg

SEQ ID NO: 88510 - DNA, 22 bp, Artificial Sequence
  chemically synthesized
catcaggtcctttaaggacttc

SEQ ID NO: 88511 - DNA, 22 bp, Artificial Sequence
  chemically synthesized
taaggacttctgtgcattggtt

SEQ ID NO: 88512 - DNA, 22 bp, Artificial Sequence
  chemically synthesized
aaggacttctgtgcattggtta

SEQ ID NO: 88513 - DNA, 22 bp, Artificial Sequence
  chemically synthesized
aggacttctgtgcattggttat

SEQ ID NO: 88514 - DNA, 22 bp, Artificial Sequence
  chemically synthesized
ctgtgcattggttattctagtt

SEQ ID NO: 88515 - DNA, 22 bp, Artificial Sequence
  chemically synthesized
tgtgcattggttattctagtta

SEQ ID NO: 88516 - DNA, 22 bp, Artificial Sequence
  chemically synthesized
tgcattggttattctagttatc

SEQ ID NO: 88517 - DNA, 22 bp, Artificial Sequence
  chemically synthesized
gttattctagttatccattcat

SEQ ID NO: 88518 - DNA, 22 bp, Artificial Sequence
  chemically synthesized
ttctagttatccattcatctaa

SEQ ID NO: 88519 - DNA, 22 bp, Artificial Sequence
  chemically synthesized
tagttatccattcatctaattt

SEQ ID NO: 88520 - DNA, 22 bp, Artificial Sequence
  chemically synthesized
gttatccattcatctaattttt

SEQ ID NO: 88521 - DNA, 22 bp, Artificial Sequence
  chemically synthesized
tccattcatctaattttttttc

SEQ ID NO: 88522 - DNA, 22 bp, Artificial Sequence
  chemically synthesized
atctaattttttttcaaagttt

SEQ ID NO: 88523 - DNA, 22 bp, Artificial Sequence
  chemically synthesized
attttttttcaaagttttttac

SEQ ID NO: 88524 - DNA, 22 bp, Artificial Sequence
  chemically synthesized
tttttcaaagttttttacttct

SEQ ID NO: 88525 - DNA, 22 bp, Artificial Sequence
  chemically synthesized
ttttcaaagttttttacttctt

SEQ ID NO: 88526 - DNA, 22 bp, Artificial Sequence
  chemically synthesized
tttcaaagttttttacttcttt

SEQ ID NO: 88527 - DNA, 22 bp, Artificial Sequence
  chemically synthesized
ttcaaagttttttacttctttg

SEQ ID NO: 88528 - DNA, 22 bp, Artificial Sequence
  chemically synthesized
tcaaagttttttacttctttgc

SEQ ID NO: 88529 - DNA, 22 bp, Artificial Sequence
  chemically synthesized
caaagttttttacttctttgcc

SEQ ID NO: 88530 - DNA, 22 bp, Artificial Sequence
  chemically synthesized
aaagttttttacttctttgccg

SEQ ID NO: 88531 - DNA, 22 bp, Artificial Sequence
  chemically synthesized
tttacttctttgccgtttgttc

SEQ ID NO: 88532 - DNA, 22 bp, Artificial Sequence
  chemically synthesized
ttacttctttgccgtttgttcg

SEQ ID NO: 88533 - DNA, 22 bp, Artificial Sequence
  chemically synthesized
tacttctttgccgtttgttcga

SEQ ID NO: 88534 - DNA, 22 bp, Artificial Sequence
  chemically synthesized
acttctttgccgtttgttcgaa

SEQ ID NO: 88535 - DNA, 22 bp, Artificial Sequence
  chemically synthesized
cttctttgccgtttgttcgaac

SEQ ID NO: 88536 - DNA, 22 bp, Artificial Sequence
  chemically synthesized
ctttgccgtttgttcgaacttc

SEQ ID NO: 88537 - DNA, 22 bp, Artificial Sequence
  chemically synthesized
tttgccgtttgttcgaacttcc

SEQ ID NO: 88538 - DNA, 22 bp, Artificial Sequence
  chemically synthesized
tgccgtttgttcgaacttcctc

SEQ ID NO: 88539 - DNA, 22 bp, Artificial Sequence
  chemically synthesized
gccgtttgttcgaacttcctcc

SEQ ID NO: 88540 - DNA, 22 bp, Artificial Sequence
  chemically synthesized
ccgtttgttcgaacttcctcct

SEQ ID NO: 88541 - DNA, 22 bp, Artificial Sequence
  chemically synthesized
gttcgaacttcctcctttagct

SEQ ID NO: 88542 - DNA, 22 bp, Artificial Sequence
  chemically synthesized
ttcgaacttcctcctttagctt

SEQ ID NO: 88543 - DNA, 22 bp, Artificial Sequence
  chemically synthesized
gaacttcctcctttagcttgga

SEQ ID NO: 88544 - DNA, 22 bp, Artificial Sequence
  chemically synthesized
cctcctttagcttggagtagtt

SEQ ID NO: 88545 - DNA, 22 bp, Artificial Sequence
  chemically synthesized
ctcctttagcttggagtagttt

SEQ ID NO: 88546 - DNA, 22 bp, Artificial Sequence
  chemically synthesized
ctttagcttggagtagtttgat

SEQ ID NO: 88547 - DNA, 22 bp, Artificial Sequence
  chemically synthesized
tagcttggagtagtttgatctt

SEQ ID NO: 88548 - DNA, 22 bp, Artificial Sequence
  chemically synthesized
agcttggagtagtttgatcttc

SEQ ID NO: 88549 - DNA, 22 bp, Artificial Sequence
  chemically synthesized
gcttggagtagtttgatcttct

SEQ ID NO: 88550 - DNA, 22 bp, Artificial Sequence
  chemically synthesized
ggagtagtttgatcttctgaag

SEQ ID NO: 88551 - DNA, 22 bp, Artificial Sequence
  chemically synthesized
gagtagtttgatcttctgaagc

SEQ ID NO: 88552 - DNA, 22 bp, Artificial Sequence
  chemically synthesized
gatcttctgaagccttcctctc

SEQ ID NO: 88553 - DNA, 22 bp, Artificial Sequence
  chemically synthesized
atcttctgaagccttcctctct

SEQ ID NO: 88554 - DNA, 22 bp, Artificial Sequence
  chemically synthesized
ctgaagccttcctctctcaact

SEQ ID NO: 88555 - DNA, 22 bp, Artificial Sequence
  chemically synthesized
tgaagccttcctctctcaactc

SEQ ID NO: 88556 - DNA, 22 bp, Artificial Sequence
  chemically synthesized
aagccttcctctctcaactcgt

SEQ ID NO: 88557 - DNA, 22 bp, Artificial Sequence
  chemically synthesized
cctctctcaactcgtcaaagtc

SEQ ID NO: 88558 - DNA, 22 bp, Artificial Sequence
  chemically synthesized
ctctctcaactcgtcaaagtca

SEQ ID NO: 88559 - DNA, 22 bp, Artificial Sequence
  chemically synthesized
tctcaactcgtcaaagtcattc

SEQ ID NO: 88560 - DNA, 22 bp, Artificial Sequence
  chemically synthesized
tcaactcgtcaaagtcattctc

SEQ ID NO: 88561 - DNA, 22 bp, Artificial Sequence
  chemically synthesized
aactcgtcaaagtcattctctg

SEQ ID NO: 88562 - DNA, 22 bp, Artificial Sequence
  chemically synthesized
gtcaaagtcattctctgcccag

SEQ ID NO: 88563 - DNA, 22 bp, Artificial Sequence
  chemically synthesized
tctgcccagctttgttccattg

SEQ ID NO: 88564 - DNA, 22 bp, Artificial Sequence
  chemically synthesized
tgcccagctttgttccattgct

SEQ ID NO: 88565 - DNA, 22 bp, Artificial Sequence
  chemically synthesized
cccagctttgttccattgctgg

SEQ ID NO: 88566 - DNA, 22 bp, Artificial Sequence
  chemically synthesized
tgttccattgctggtgaggagc

SEQ ID NO: 88567 - DNA, 22 bp, Artificial Sequence
  chemically synthesized
gttccattgctggtgaggagct

SEQ ID NO: 88568 - DNA, 22 bp, Artificial Sequence
  chemically synthesized
ttccattgctggtgaggagctg

SEQ ID NO: 88569 - DNA, 22 bp, Artificial Sequence
  chemically synthesized
cattgctggtgaggagctgcgt

SEQ ID NO: 88570 - DNA, 22 bp, Artificial Sequence
  chemically synthesized
ctggtgaggagctgcgttactt

SEQ ID NO: 88571 - DNA, 22 bp, Artificial Sequence
  chemically synthesized
gtgaggagctgcgttactttgg

SEQ ID NO: 88572 - DNA, 22 bp, Artificial Sequence
  chemically synthesized
cgttactttggaggaggagagg

SEQ ID NO: 88573 - DNA, 22 bp, Artificial Sequence
  chemically synthesized
ctttggaggaggagaggcactc

SEQ ID NO: 88574 - DNA, 22 bp, Artificial Sequence
  chemically synthesized
tggaggaggagaggcactctca

SEQ ID NO: 88575 - DNA, 22 bp, Artificial Sequence
  chemically synthesized
ggaggaggagaggcactctcat

SEQ ID NO: 88576 - DNA, 22 bp, Artificial Sequence
  chemically synthesized
gaggaggagaggcactctcatt

SEQ ID NO: 88577 - DNA, 22 bp, Artificial Sequence
  chemically synthesized
tcatttttagagtgtccagttt

SEQ ID NO: 88578 - DNA, 22 bp, Artificial Sequence
  chemically synthesized
atttttagagtgtccagttttt

SEQ ID NO: 88579 - DNA, 22 bp, Artificial Sequence
  chemically synthesized
ttagagtgtccagtttttctgc

SEQ ID NO: 88580 - DNA, 22 bp, Artificial Sequence
  chemically synthesized
tagagtgtccagtttttctgct

SEQ ID NO: 88581 - DNA, 22 bp, Artificial Sequence
  chemically synthesized
agagtgtccagtttttctgctc

SEQ ID NO: 88582 - DNA, 22 bp, Artificial Sequence
  chemically synthesized
gagtgtccagtttttctgctct

SEQ ID NO: 88583 - DNA, 22 bp, Artificial Sequence
  chemically synthesized
ttctgctctgctttttccccat

SEQ ID NO: 88584 - DNA, 22 bp, Artificial Sequence
  chemically synthesized
tctgctctgctttttccccatc

SEQ ID NO: 88585 - DNA, 22 bp, Artificial Sequence
  chemically synthesized
ctgctctgctttttccccatct

SEQ ID NO: 88586 - DNA, 22 bp, Artificial Sequence
  chemically synthesized
tgctctgctttttccccatctt

SEQ ID NO: 88587 - DNA, 22 bp, Artificial Sequence
  chemically synthesized
ctctgctttttccccatcttta

SEQ ID NO: 88588 - DNA, 22 bp, Artificial Sequence
  chemically synthesized
tgctttttccccatctttatgg

SEQ ID NO: 88589 - DNA, 22 bp, Artificial Sequence
  chemically synthesized
ctttttccccatctttatggtt

SEQ ID NO: 88590 - DNA, 22 bp, Artificial Sequence
  chemically synthesized
tttccccatctttatggtttta

SEQ ID NO: 88591 - DNA, 22 bp, Artificial Sequence
  chemically synthesized
ttccccatctttatggttttat

SEQ ID NO: 88592 - DNA, 22 bp, Artificial Sequence
  chemically synthesized
tccccatctttatggttttatc

SEQ ID NO: 88593 - DNA, 22 bp, Artificial Sequence
  chemically synthesized
ccccatctttatggttttatct

SEQ ID NO: 88594 - DNA, 22 bp, Artificial Sequence
  chemically synthesized
cccatctttatggttttatcta

SEQ ID NO: 88595 - DNA, 22 bp, Artificial Sequence
  chemically synthesized
tatggttttatctacctttggt

SEQ ID NO: 88596 - DNA, 22 bp, Artificial Sequence
  chemically synthesized
atggttttatctacctttggtc

SEQ ID NO: 88597 - DNA, 22 bp, Artificial Sequence
  chemically synthesized
tggttttatctacctttggtct

SEQ ID NO: 88598 - DNA, 22 bp, Artificial Sequence
  chemically synthesized
tatctacctttggtctttgatg

SEQ ID NO: 88599 - DNA, 22 bp, Artificial Sequence
  chemically synthesized
atctacctttggtctttgatga

SEQ ID NO: 88600 - DNA, 22 bp, Artificial Sequence
  chemically synthesized
tctacctttggtctttgatgat

SEQ ID NO: 88601 - DNA, 22 bp, Artificial Sequence
  chemically synthesized
cctttggtctttgatgatggcg

SEQ ID NO: 88602 - DNA, 22 bp, Artificial Sequence
  chemically synthesized
tggtctttgatgatggcgatgt

SEQ ID NO: 88603 - DNA, 22 bp, Artificial Sequence
  chemically synthesized
ggtctttgatgatggcgatgta

SEQ ID NO: 88604 - DNA, 22 bp, Artificial Sequence
  chemically synthesized
gtctttgatgatggcgatgtac

SEQ ID NO: 88605 - DNA, 22 bp, Artificial Sequence
  chemically synthesized
tgatgatggcgatgtacagatg

SEQ ID NO: 88606 - DNA, 22 bp, Artificial Sequence
  chemically synthesized
gatgatggcgatgtacagatgg

SEQ ID NO: 88607 - DNA, 22 bp, Artificial Sequence
  chemically synthesized
atgatggcgatgtacagatggg

SEQ ID NO: 88608 - DNA, 22 bp, Artificial Sequence
  chemically synthesized
ttggtgtggatgtcctttctgt

SEQ ID NO: 88609 - DNA, 22 bp, Artificial Sequence
  chemically synthesized
tggtgtggatgtcctttctgtt

SEQ ID NO: 88610 - DNA, 22 bp, Artificial Sequence
  chemically synthesized
ggtgtggatgtcctttctgttt

SEQ ID NO: 88611 - DNA, 22 bp, Artificial Sequence
  chemically synthesized
gtgtggatgtcctttctgtttg

SEQ ID NO: 88612 - DNA, 22 bp, Artificial Sequence
  chemically synthesized
tctgtttgttagttttccttct

SEQ ID NO: 88613 - DNA, 22 bp, Artificial Sequence
  chemically synthesized
ctgtttgttagttttccttcta

SEQ ID NO: 88614 - DNA, 22 bp, Artificial Sequence
  chemically synthesized
tgtttgttagttttccttctaa

SEQ ID NO: 88615 - DNA, 22 bp, Artificial Sequence
  chemically synthesized
tttgttagttttccttctaaca

SEQ ID NO: 88616 - DNA, 22 bp, Artificial Sequence
  chemically synthesized
gttagttttccttctaacagtc

SEQ ID NO: 88617 - DNA, 22 bp, Artificial Sequence
  chemically synthesized
ttagttttccttctaacagtca

SEQ ID NO: 88618 - DNA, 22 bp, Artificial Sequence
  chemically synthesized
gttttccttctaacagtcagga

SEQ ID NO: 88619 - DNA, 22 bp, Artificial Sequence
  chemically synthesized
tccttctaacagtcaggaccct

SEQ ID NO: 88620 - DNA, 22 bp, Artificial Sequence
  chemically synthesized
ccttctaacagtcaggaccctc

SEQ ID NO: 88621 - DNA, 22 bp, Artificial Sequence
  chemically synthesized
cttctaacagtcaggaccctca

SEQ ID NO: 88622 - DNA, 22 bp, Artificial Sequence
  chemically synthesized
ctaacagtcaggaccctcagct

SEQ ID NO: 88623 - DNA, 22 bp, Artificial Sequence
  chemically synthesized
taacagtcaggaccctcagctg

SEQ ID NO: 88624 - DNA, 22 bp, Artificial Sequence
  chemically synthesized
acagtcaggaccctcagctgca

SEQ ID NO: 88625 - DNA, 22 bp, Artificial Sequence
  chemically synthesized
agctgcaggtctgttggagttt

SEQ ID NO: 88626 - DNA, 22 bp, Artificial Sequence
  chemically synthesized
caggtctgttggagtttactgg

SEQ ID NO: 88627 - DNA, 22 bp, Artificial Sequence
  chemically synthesized
ttggagtttactggaggtccac

SEQ ID NO: 88628 - DNA, 22 bp, Artificial Sequence
  chemically synthesized
gagtttactggaggtccactcc

SEQ ID NO: 88629 - DNA, 22 bp, Artificial Sequence
  chemically synthesized
actggaggtccactccagaagc

SEQ ID NO: 88630 - DNA, 22 bp, Artificial Sequence
  chemically synthesized
ctggaggtccactccagaagct

SEQ ID NO: 88631 - DNA, 22 bp, Artificial Sequence
  chemically synthesized
gaggtccactccagaagctgtt

SEQ ID NO: 88632 - DNA, 22 bp, Artificial Sequence
  chemically synthesized
cagaagctgttttcctgggtat

SEQ ID NO: 88633 - DNA, 22 bp, Artificial Sequence
  chemically synthesized
ttttcctgggtatcaacagcgg

SEQ ID NO: 88634 - DNA, 22 bp, Artificial Sequence
  chemically synthesized
tcctgggtatcaacagcggtgg

SEQ ID NO: 88635 - DNA, 22 bp, Artificial Sequence
  chemically synthesized
cctgggtatcaacagcggtggc

SEQ ID NO: 88636 - DNA, 22 bp, Artificial Sequence
  chemically synthesized
ctgggtatcaacagcggtggct

SEQ ID NO: 88637 - DNA, 22 bp, Artificial Sequence
  chemically synthesized
ggtatcaacagcggtggctgca

SEQ ID NO: 88638 - DNA, 22 bp, Artificial Sequence
  chemically synthesized
cagaacagtggatattggtgaa

SEQ ID NO: 88639 - DNA, 22 bp, Artificial Sequence
  chemically synthesized
gtgaaccgcaaatgctgctgcc

SEQ ID NO: 88640 - DNA, 22 bp, Artificial Sequence
  chemically synthesized
ctgcctgatcattcctctggaa

SEQ ID NO: 88641 - DNA, 22 bp, Artificial Sequence
  chemically synthesized
cctgatcattcctctggaagtt

SEQ ID NO: 88642 - DNA, 22 bp, Artificial Sequence
  chemically synthesized
atcattcctctggaagttttgt

SEQ ID NO: 88643 - DNA, 22 bp, Artificial Sequence
  chemically synthesized
ctctggaagttttgtcttagag

SEQ ID NO: 88644 - DNA, 22 bp, Artificial Sequence
  chemically synthesized
tggaagttttgtcttagaggag

SEQ ID NO: 88645 - DNA, 22 bp, Artificial Sequence
  chemically synthesized
gaagttttgtcttagaggagta

SEQ ID NO: 88646 - DNA, 22 bp, Artificial Sequence
  chemically synthesized
tgtcttagaggagtaccagcca

SEQ ID NO: 88647 - DNA, 22 bp, Artificial Sequence
  chemically synthesized
gtcttagaggagtaccagccat

SEQ ID NO: 88648 - DNA, 22 bp, Artificial Sequence
  chemically synthesized
tcttagaggagtaccagccatg

SEQ ID NO: 88649 - DNA, 22 bp, Artificial Sequence
  chemically synthesized
agaggagtaccagccatgtgag

SEQ ID NO: 88650 - DNA, 22 bp, Artificial Sequence
  chemically synthesized
gaggagtaccagccatgtgagg

SEQ ID NO: 88651 - DNA, 22 bp, Artificial Sequence
  chemically synthesized
cccctactgggggatgcctccc

SEQ ID NO: 88652 - DNA, 22 bp, Artificial Sequence
  chemically synthesized
ctgggggatgcctcccagttag

SEQ ID NO: 88653 - DNA, 22 bp, Artificial Sequence
  chemically synthesized
ggggatgcctcccagttaggct

SEQ ID NO: 88654 - DNA, 22 bp, Artificial Sequence
  chemically synthesized
ccagttaggctactcgggggtc

SEQ ID NO: 88655 - DNA, 22 bp, Artificial Sequence
  chemically synthesized
ggctactcgggggtcagggacc

SEQ ID NO: 88656 - DNA, 22 bp, Artificial Sequence
  chemically synthesized
ctcgggggtcagggacccactt

SEQ ID NO: 88657 - DNA, 22 bp, Artificial Sequence
  chemically synthesized
gggggtcagggacccacttgag

SEQ ID NO: 88658 - DNA, 22 bp, Artificial Sequence
  chemically synthesized
gaggaggcagtctgcctgttct

SEQ ID NO: 88659 - DNA, 22 bp, Artificial Sequence
  chemically synthesized
aggaggcagtctgcctgttctc

SEQ ID NO: 88660 - DNA, 22 bp, Artificial Sequence
  chemically synthesized
cctgttctcagatctgaagcta

SEQ ID NO: 88661 - DNA, 22 bp, Artificial Sequence
  chemically synthesized
ttctcagatctgaagctatgtg

SEQ ID NO: 88662 - DNA, 22 bp, Artificial Sequence
  chemically synthesized
tcagatctgaagctatgtgctg

SEQ ID NO: 88663 - DNA, 22 bp, Artificial Sequence
  chemically synthesized
agatctgaagctatgtgctggg

SEQ ID NO: 88664 - DNA, 22 bp, Artificial Sequence
  chemically synthesized
aagctatgtgctgggagaacca

SEQ ID NO: 88665 - DNA, 22 bp, Artificial Sequence
  chemically synthesized
tgtgctgggagaaccactactc

SEQ ID NO: 88666 - DNA, 22 bp, Artificial Sequence
  chemically synthesized
ggagaaccactactctcttcaa

SEQ ID NO: 88667 - DNA, 22 bp, Artificial Sequence
  chemically synthesized
ctctcttcaaagctgtcagaca

SEQ ID NO: 88668 - DNA, 22 bp, Artificial Sequence
  chemically synthesized
tcttcaaagctgtcagacaggg

SEQ ID NO: 88669 - DNA, 22 bp, Artificial Sequence
  chemically synthesized
ttcaaagctgtcagacagggac

SEQ ID NO: 88670 - DNA, 22 bp, Artificial Sequence
  chemically synthesized
caaagctgtcagacagggacat

SEQ ID NO: 88671 - DNA, 22 bp, Artificial Sequence
  chemically synthesized
aaagctgtcagacagggacatt

SEQ ID NO: 88672 - DNA, 22 bp, Artificial Sequence
  chemically synthesized
tcagacagggacatttaagtct

SEQ ID NO: 88673 - DNA, 22 bp, Artificial Sequence
  chemically synthesized
aagtctgcagaggttcttgttg

SEQ ID NO: 88674 - DNA, 22 bp, Artificial Sequence
  chemically synthesized
agtctgcagaggttcttgttgt

SEQ ID NO: 88675 - DNA, 22 bp, Artificial Sequence
  chemically synthesized
cagaggttcttgttgtcttttg

SEQ ID NO: 88676 - DNA, 22 bp, Artificial Sequence
  chemically synthesized
ttgttgtcttttgtttgtctgt

SEQ ID NO: 88677 - DNA, 22 bp, Artificial Sequence
  chemically synthesized
gttgtcttttgtttgtctgtgc

SEQ ID NO: 88678 - DNA, 22 bp, Artificial Sequence
  chemically synthesized
ttgtcttttgtttgtctgtgcc

SEQ ID NO: 88679 - DNA, 22 bp, Artificial Sequence
  chemically synthesized
tcttttgtttgtctgtgccctg

SEQ ID NO: 88680 - DNA, 22 bp, Artificial Sequence
  chemically synthesized
ttgtttgtctgtgccctgcccc

SEQ ID NO: 88681 - DNA, 22 bp, Artificial Sequence
  chemically synthesized
tgtttgtctgtgccctgcccct

SEQ ID NO: 88682 - DNA, 22 bp, Artificial Sequence
  chemically synthesized
gtttgtctgtgccctgccccta

SEQ ID NO: 88683 - DNA, 22 bp, Artificial Sequence
  chemically synthesized
tttgtctgtgccctgcccctag

SEQ ID NO: 88684 - DNA, 22 bp, Artificial Sequence
  chemically synthesized
gtctgtgccctgcccctagagg

SEQ ID NO: 88685 - DNA, 22 bp, Artificial Sequence
  chemically synthesized
tctgtgccctgcccctagaggt

SEQ ID NO: 88686 - DNA, 22 bp, Artificial Sequence
  chemically synthesized
tgccctgcccctagaggtggag

SEQ ID NO: 88687 - DNA, 22 bp, Artificial Sequence
  chemically synthesized
cccctagaggtggagcctacag

SEQ ID NO: 88688 - DNA, 22 bp, Artificial Sequence
  chemically synthesized
gaggtggagcctacagaggcag

SEQ ID NO: 88689 - DNA, 22 bp, Artificial Sequence
  chemically synthesized
cagaggcaggcaggcctccttg

SEQ ID NO: 88690 - DNA, 22 bp, Artificial Sequence
  chemically synthesized
cttgagctgtggtgggctccac

SEQ ID NO: 88691 - DNA, 22 bp, Artificial Sequence
  chemically synthesized
gagctgtggtgggctccaccca

SEQ ID NO: 88692 - DNA, 22 bp, Artificial Sequence
  chemically synthesized
agctgtggtgggctccacccag

SEQ ID NO: 88693 - DNA, 22 bp, Artificial Sequence
  chemically synthesized
tggtgggctccacccagttcga

SEQ ID NO: 88694 - DNA, 22 bp, Artificial Sequence
  chemically synthesized
cacccagttcgagcttccaggc

SEQ ID NO: 88695 - DNA, 22 bp, Artificial Sequence
  chemically synthesized
gagcttccaggcggctttgttt

SEQ ID NO: 88696 - DNA, 22 bp, Artificial Sequence
  chemically synthesized
ccaggcggctttgtttacctgc

SEQ ID NO: 88697 - DNA, 22 bp, Artificial Sequence
  chemically synthesized
caggcggctttgtttacctgct

SEQ ID NO: 88698 - DNA, 22 bp, Artificial Sequence
  chemically synthesized
tgtttacctgctcaagcctgga

SEQ ID NO: 88699 - DNA, 22 bp, Artificial Sequence
  chemically synthesized
gtttacctgctcaagcctggac

SEQ ID NO: 88700 - DNA, 22 bp, Artificial Sequence
  chemically synthesized
tttacctgctcaagcctggaca

SEQ ID NO: 88701 - DNA, 22 bp, Artificial Sequence
  chemically synthesized
acctgctcaagcctggacaatg

SEQ ID NO: 88702 - DNA, 22 bp, Artificial Sequence
  chemically synthesized
cctgctcaagcctggacaatgg

SEQ ID NO: 88703 - DNA, 22 bp, Artificial Sequence
  chemically synthesized
ctcaagcctggacaatggtggg

SEQ ID NO: 88704 - DNA, 22 bp, Artificial Sequence
  chemically synthesized
aagcctggacaatggtgggcac

SEQ ID NO: 88705 - DNA, 22 bp, Artificial Sequence
  chemically synthesized
gacaatggtgggcacccctccc

SEQ ID NO: 88706 - DNA, 22 bp, Artificial Sequence
  chemically synthesized
ccccagcctcactgccaccttg

SEQ ID NO: 88707 - DNA, 22 bp, Artificial Sequence
  chemically synthesized
actgccaccttgcagtttgacc

SEQ ID NO: 88708 - DNA, 22 bp, Artificial Sequence
  chemically synthesized
ccaccttgcagtttgacctcag

SEQ ID NO: 88709 - DNA, 22 bp, Artificial Sequence
  chemically synthesized
gcagtttgacctcagactgctg

SEQ ID NO: 88710 - DNA, 22 bp, Artificial Sequence
  chemically synthesized
cagtttgacctcagactgctgt

SEQ ID NO: 88711 - DNA, 22 bp, Artificial Sequence
  chemically synthesized
gacctcagactgctgtgctagc

SEQ ID NO: 88712 - DNA, 22 bp, Artificial Sequence
  chemically synthesized
acctcagactgctgtgctagca

SEQ ID NO: 88713 - DNA, 22 bp, Artificial Sequence
  chemically synthesized
agactgctgtgctagcaatgag

SEQ ID NO: 88714 - DNA, 22 bp, Artificial Sequence
  chemically synthesized
ctgtgctagcaatgagcgaggc

SEQ ID NO: 88715 - DNA, 22 bp, Artificial Sequence
  chemically synthesized
tgctagcaatgagcgaggctcc

SEQ ID NO: 88716 - DNA, 22 bp, Artificial Sequence
  chemically synthesized
gcaatgagcgaggctccatggg

SEQ ID NO: 88717 - DNA, 22 bp, Artificial Sequence
  chemically synthesized
catgggcgtaggaccctctgag

SEQ ID NO: 88718 - DNA, 22 bp, Artificial Sequence
  chemically synthesized
tgagccaggcatgggatataat

SEQ ID NO: 88719 - DNA, 22 bp, Artificial Sequence
  chemically synthesized
agccaggcatgggatataatct

SEQ ID NO: 88720 - DNA, 22 bp, Artificial Sequence
  chemically synthesized
ctggtgtgccatttgttaagct

SEQ ID NO: 88721 - DNA, 22 bp, Artificial Sequence
  chemically synthesized
gtgtgccatttgttaagcttgt

SEQ ID NO: 88722 - DNA, 22 bp, Artificial Sequence
  chemically synthesized
gttaagcttgttggaagagcgc

SEQ ID NO: 88723 - DNA, 22 bp, Artificial Sequence
  chemically synthesized
ttaagcttgttggaagagcgca

SEQ ID NO: 88724 - DNA, 22 bp, Artificial Sequence
  chemically synthesized
agcttgttggaagagcgcagta

SEQ ID NO: 88725 - DNA, 22 bp, Artificial Sequence
  chemically synthesized
gttggaagagcgcagtattagg

SEQ ID NO: 88726 - DNA, 22 bp, Artificial Sequence
  chemically synthesized
ttggaagagcgcagtattaggg

SEQ ID NO: 88727 - DNA, 22 bp, Artificial Sequence
  chemically synthesized
gaagagcgcagtattagggcgg

SEQ ID NO: 88728 - DNA, 22 bp, Artificial Sequence
  chemically synthesized
gggcgggagtgacccgattttc

SEQ ID NO: 88729 - DNA, 22 bp, Artificial Sequence
  chemically synthesized
tccaggtgccatctgtcaccct

SEQ ID NO: 88730 - DNA, 22 bp, Artificial Sequence
  chemically synthesized
ccaggtgccatctgtcaccctt

SEQ ID NO: 88731 - DNA, 22 bp, Artificial Sequence
  chemically synthesized
caggtgccatctgtcacccttt

SEQ ID NO: 88732 - DNA, 22 bp, Artificial Sequence
  chemically synthesized
tcacccttttctttgactagga

SEQ ID NO: 88733 - DNA, 22 bp, Artificial Sequence
  chemically synthesized
ttctttgactaggaaagggaat

SEQ ID NO: 88734 - DNA, 22 bp, Artificial Sequence
  chemically synthesized
tctttgactaggaaagggaatt

SEQ ID NO: 88735 - DNA, 22 bp, Artificial Sequence
  chemically synthesized
ctttgactaggaaagggaattc

SEQ ID NO: 88736 - DNA, 22 bp, Artificial Sequence
  chemically synthesized
tttgactaggaaagggaattcc

SEQ ID NO: 88737 - DNA, 22 bp, Artificial Sequence
  chemically synthesized
tgactaggaaagggaattccct

SEQ ID NO: 88738 - DNA, 22 bp, Artificial Sequence
  chemically synthesized
gactaggaaagggaattccctg

SEQ ID NO: 88739 - DNA, 22 bp, Artificial Sequence
  chemically synthesized
actaggaaagggaattccctga

SEQ ID NO: 88740 - DNA, 22 bp, Artificial Sequence
  chemically synthesized
ggaaagggaattccctgacccc

SEQ ID NO: 88741 - DNA, 22 bp, Artificial Sequence
  chemically synthesized
cctgaccccttgtgcttcccgg

SEQ ID NO: 88742 - DNA, 22 bp, Artificial Sequence
  chemically synthesized
accccttgtgcttcccgggtga

SEQ ID NO: 88743 - DNA, 22 bp, Artificial Sequence
  chemically synthesized
gtgcttcccgggtgaggtgatg

SEQ ID NO: 88744 - DNA, 22 bp, Artificial Sequence
  chemically synthesized
tgcttcccgggtgaggtgatgc

SEQ ID NO: 88745 - DNA, 22 bp, Artificial Sequence
  chemically synthesized
cccgggtgaggtgatgcctcgc

SEQ ID NO: 88746 - DNA, 22 bp, Artificial Sequence
  chemically synthesized
ccgggtgaggtgatgcctcgcc

SEQ ID NO: 88747 - DNA, 22 bp, Artificial Sequence
  chemically synthesized
gccctgctttggctcatgcaca

SEQ ID NO: 88748 - DNA, 22 bp, Artificial Sequence
  chemically synthesized
ctttggctcatgcacagtgcac

SEQ ID NO: 88749 - DNA, 22 bp, Artificial Sequence
  chemically synthesized
tggctcatgcacagtgcactgc

SEQ ID NO: 88750 - DNA, 22 bp, Artificial Sequence
  chemically synthesized
ggctcatgcacagtgcactgca

SEQ ID NO: 88751 - DNA, 22 bp, Artificial Sequence
  chemically synthesized
gctcatgcacagtgcactgcac

SEQ ID NO: 88752 - DNA, 22 bp, Artificial Sequence
  chemically synthesized
atgcacagtgcactgcacctac

SEQ ID NO: 88753 - DNA, 22 bp, Artificial Sequence
  chemically synthesized
cacctactgtcctgcacccact

SEQ ID NO: 88754 - DNA, 22 bp, Artificial Sequence
  chemically synthesized
ctgtcctgcacccactgcctgg

SEQ ID NO: 88755 - DNA, 22 bp, Artificial Sequence
  chemically synthesized
tcctgcacccactgcctggcac

SEQ ID NO: 88756 - DNA, 22 bp, Artificial Sequence
  chemically synthesized
cacccactgcctggcacttccc

SEQ ID NO: 88757 - DNA, 22 bp, Artificial Sequence
  chemically synthesized
cctggcacttccctgtgagatg

SEQ ID NO: 88758 - DNA, 22 bp, Artificial Sequence
  chemically synthesized
gcacttccctgtgagatgaacc

SEQ ID NO: 88759 - DNA, 22 bp, Artificial Sequence
  chemically synthesized
ccctgtgagatgaacctggtac

SEQ ID NO: 88760 - DNA, 22 bp, Artificial Sequence
  chemically synthesized
cctgtgagatgaacctggtacc

SEQ ID NO: 88761 - DNA, 22 bp, Artificial Sequence
  chemically synthesized
tgagatgaacctggtacctcag

SEQ ID NO: 88762 - DNA, 22 bp, Artificial Sequence
  chemically synthesized
gtacctcagttggaaatgcaga

SEQ ID NO: 88763 - DNA, 22 bp, Artificial Sequence
  chemically synthesized
agttggaaatgcagaaatcacc

SEQ ID NO: 88764 - DNA, 22 bp, Artificial Sequence
  chemically synthesized
gaaatgcagaaatcacccgtct

SEQ ID NO: 88765 - DNA, 22 bp, Artificial Sequence
  chemically synthesized
ctgcgtcactcacgatgggagc

SEQ ID NO: 88766 - DNA, 22 bp, Artificial Sequence
  chemically synthesized
tgcgtcactcacgatgggagct

SEQ ID NO: 88767 - DNA, 22 bp, Artificial Sequence
  chemically synthesized
cgtcactcacgatgggagctat

SEQ ID NO: 88768 - DNA, 22 bp, Artificial Sequence
  chemically synthesized
acgatgggagctatagactgga

SEQ ID NO: 88769 - DNA, 22 bp, Artificial Sequence
  chemically synthesized
tagactggagctgttcctattc

SEQ ID NO: 88770 - DNA, 22 bp, Artificial Sequence
  chemically synthesized
gagctgttcctattcggtcatc

SEQ ID NO: 88771 - DNA, 22 bp, Artificial Sequence
  chemically synthesized
ttcctattcggtcatcttggct

SEQ ID NO: 88772 - DNA, 22 bp, Artificial Sequence
  chemically synthesized
ctattcggtcatcttggctcca

SEQ ID NO: 88773 - DNA, 22 bp, Artificial Sequence
  chemically synthesized
ttcggtcatcttggctccaccg

SEQ ID NO: 88774 - DNA, 22 bp, Artificial Sequence
  chemically synthesized
ggtcatcttggctccaccgctc

SEQ ID NO: 88775 - DNA, 22 bp, Artificial Sequence
  chemically synthesized
ggctccaccgctcccccccccc

SEQ ID NO: 88776 - DNA, 22 bp, Artificial Sequence
  chemically synthesized
gctccaccgctcccccccccct

SEQ ID NO: 88777 - DNA, 22 bp, Artificial Sequence
  chemically synthesized
caccgctccccccccccttttt

SEQ ID NO: 88778 - DNA, 22 bp, Artificial Sequence
  chemically synthesized
cccccccccttttttttttctt

SEQ ID NO: 88779 - DNA, 22 bp, Artificial Sequence
  chemically synthesized
ttttttttcttttttttttgtg

SEQ ID NO: 88780 - DNA, 22 bp, Artificial Sequence
  chemically synthesized
tttttttcttttttttttgtga

SEQ ID NO: 88781 - DNA, 22 bp, Artificial Sequence
  chemically synthesized
ttttttcttttttttttgtgac

SEQ ID NO: 88782 - DNA, 22 bp, Artificial Sequence
  chemically synthesized
tttttcttttttttttgtgacg

SEQ ID NO: 88783 - DNA, 22 bp, Artificial Sequence
  chemically synthesized
ttttcttttttttttgtgacgg

SEQ ID NO: 88784 - DNA, 22 bp, Artificial Sequence
  chemically synthesized
tttcttttttttttgtgacgga

SEQ ID NO: 88785 - DNA, 22 bp, Artificial Sequence
  chemically synthesized
ttcttttttttttgtgacggag

SEQ ID NO: 88786 - DNA, 22 bp, Artificial Sequence
  chemically synthesized
tcttttttttttgtgacggagt

SEQ ID NO: 88787 - DNA, 22 bp, Artificial Sequence
  chemically synthesized
cttttttttttgtgacggagtc

SEQ ID NO: 88788 - DNA, 22 bp, Artificial Sequence
  chemically synthesized
ttttttttttgtgacggagtct

SEQ ID NO: 88789 - DNA, 22 bp, Artificial Sequence
  chemically synthesized
ttttttttgtgacggagtctca

SEQ ID NO: 88790 - DNA, 22 bp, Artificial Sequence
  chemically synthesized
tttttttgtgacggagtctcat

SEQ ID NO: 88791 - DNA, 22 bp, Artificial Sequence
  chemically synthesized
ttttttgtgacggagtctcatg

SEQ ID NO: 88792 - DNA, 22 bp, Artificial Sequence
  chemically synthesized
tttttgtgacggagtctcatgc

SEQ ID NO: 88793 - DNA, 22 bp, Artificial Sequence
  chemically synthesized
ttttgtgacggagtctcatgct

SEQ ID NO: 88794 - DNA, 22 bp, Artificial Sequence
  chemically synthesized
tttgtgacggagtctcatgctg

SEQ ID NO: 88795 - DNA, 22 bp, Artificial Sequence
  chemically synthesized
ttgtgacggagtctcatgctgt

SEQ ID NO: 88796 - DNA, 22 bp, Artificial Sequence
  chemically synthesized
tgtgacggagtctcatgctgtc

SEQ ID NO: 88797 - DNA, 22 bp, Artificial Sequence
  chemically synthesized
gtgacggagtctcatgctgtca

SEQ ID NO: 88798 - DNA, 22 bp, Artificial Sequence
  chemically synthesized
tgacggagtctcatgctgtcac

SEQ ID NO: 88799 - DNA, 22 bp, Artificial Sequence
  chemically synthesized
atgctgtcacctgggctggaat

SEQ ID NO: 88800 - DNA, 22 bp, Artificial Sequence
  chemically synthesized
tcacctgggctggaatgcagtg

SEQ ID NO: 88801 - DNA, 22 bp, Artificial Sequence
  chemically synthesized
ggctggaatgcagtggcacaat

SEQ ID NO: 88802 - DNA, 22 bp, Artificial Sequence
  chemically synthesized
gaatgcagtggcacaatcttgg

SEQ ID NO: 88803 - DNA, 22 bp, Artificial Sequence
  chemically synthesized
ggctcactgcaacctctgcctc

SEQ ID NO: 88804 - DNA, 22 bp, Artificial Sequence
  chemically synthesized
gctcactgcaacctctgcctcc

SEQ ID NO: 88805 - DNA, 22 bp, Artificial Sequence
  chemically synthesized
actgcaacctctgcctcccagg

SEQ ID NO: 88806 - DNA, 22 bp, Artificial Sequence
  chemically synthesized
caacctctgcctcccaggatca

SEQ ID NO: 88807 - DNA, 22 bp, Artificial Sequence
  chemically synthesized
tgcctcccaggatcaagcgatt

SEQ ID NO: 88808 - DNA, 22 bp, Artificial Sequence
  chemically synthesized
cctcccaggatcaagcgattct

SEQ ID NO: 88809 - DNA, 22 bp, Artificial Sequence
  chemically synthesized
ccaggatcaagcgattctcctg

SEQ ID NO: 88810 - DNA, 22 bp, Artificial Sequence
  chemically synthesized
tcctgcctcagcctcccaaatt

SEQ ID NO: 88811 - DNA, 22 bp, Artificial Sequence
  chemically synthesized
ctgcctcagcctcccaaattgc

SEQ ID NO: 88812 - DNA, 22 bp, Artificial Sequence
  chemically synthesized
cctcagcctcccaaattgctgg

SEQ ID NO: 88813 - DNA, 22 bp, Artificial Sequence
  chemically synthesized
agcctcccaaattgctgggatt

SEQ ID NO: 88814 - DNA, 22 bp, Artificial Sequence
  chemically synthesized
ccaaattgctgggattacacat

SEQ ID NO: 88815 - DNA, 22 bp, Artificial Sequence
  chemically synthesized
ctgggattacacatgcctgcca

SEQ ID NO: 88816 - DNA, 22 bp, Artificial Sequence
  chemically synthesized
ggattacacatgcctgccacca

SEQ ID NO: 88817 - DNA, 22 bp, Artificial Sequence
  chemically synthesized
cacatgcctgccaccacgccag

SEQ ID NO: 88818 - DNA, 22 bp, Artificial Sequence
  chemically synthesized
ccaccacgccaggctaagtttt

SEQ ID NO: 88819 - DNA, 22 bp, Artificial Sequence
  chemically synthesized
agtttttatatttttagtagcg

SEQ ID NO: 88820 - DNA, 22 bp, Artificial Sequence
  chemically synthesized
ttatatttttagtagcgatgag

SEQ ID NO: 88821 - DNA, 22 bp, Artificial Sequence
  chemically synthesized
tatatttttagtagcgatgagg

SEQ ID NO: 88822 - DNA, 22 bp, Artificial Sequence
  chemically synthesized
atatttttagtagcgatgaggt

SEQ ID NO: 88823 - DNA, 22 bp, Artificial Sequence
  chemically synthesized
tatttttagtagcgatgaggtt

SEQ ID NO: 88824 - DNA, 22 bp, Artificial Sequence
  chemically synthesized
ttagtagcgatgaggtttcact

SEQ ID NO: 88825 - DNA, 22 bp, Artificial Sequence
  chemically synthesized
tagtagcgatgaggtttcacta

SEQ ID NO: 88826 - DNA, 22 bp, Artificial Sequence
  chemically synthesized
agtagcgatgaggtttcactat

SEQ ID NO: 88827 - DNA, 22 bp, Artificial Sequence
  chemically synthesized
gtagcgatgaggtttcactatg

SEQ ID NO: 88828 - DNA, 22 bp, Artificial Sequence
  chemically synthesized
cactatgttggccaggctgatc

SEQ ID NO: 88829 - DNA, 22 bp, Artificial Sequence
  chemically synthesized
actatgttggccaggctgatct

SEQ ID NO: 88830 - DNA, 22 bp, Artificial Sequence
  chemically synthesized
tgttggccaggctgatcttgaa

SEQ ID NO: 88831 - DNA, 22 bp, Artificial Sequence
  chemically synthesized
gccaggctgatcttgaactcct

SEQ ID NO: 88832 - DNA, 22 bp, Artificial Sequence
  chemically synthesized
atcttgaactcctgacgtcgtg

SEQ ID NO: 88833 - DNA, 22 bp, Artificial Sequence
  chemically synthesized
gaactcctgacgtcgtgatccg

SEQ ID NO: 88834 - DNA, 22 bp, Artificial Sequence
  chemically synthesized
aactcctgacgtcgtgatccgc

SEQ ID NO: 88835 - DNA, 22 bp, Artificial Sequence
  chemically synthesized
ctgacgtcgtgatccgcctgtc

SEQ ID NO: 88836 - DNA, 22 bp, Artificial Sequence
  chemically synthesized
acgtcgtgatccgcctgtctag

SEQ ID NO: 88837 - DNA, 22 bp, Artificial Sequence
  chemically synthesized
tctaggcctcccaaagtgctgc

SEQ ID NO: 88838 - DNA, 22 bp, Artificial Sequence
  chemically synthesized
ggcctcccaaagtgctgcaatt

SEQ ID NO: 88839 - DNA, 22 bp, Artificial Sequence
  chemically synthesized
ccaaagtgctgcaattgcaggt

SEQ ID NO: 88840 - DNA, 22 bp, Artificial Sequence
  chemically synthesized
caattgcaggtgtgagccaccg

SEQ ID NO: 88841 - DNA, 22 bp, Artificial Sequence
  chemically synthesized
caggtgtgagccaccgctccca

SEQ ID NO: 88842 - DNA, 22 bp, Artificial Sequence
  chemically synthesized
ccagcctagaataacttcttaa

SEQ ID NO: 88843 - DNA, 22 bp, Artificial Sequence
  chemically synthesized
gaataacttcttaaatgctttt

SEQ ID NO: 88844 - DNA, 22 bp, Artificial Sequence
  chemically synthesized
cttaaatgcttttattgttgac

SEQ ID NO: 88845 - DNA, 22 bp, Artificial Sequence
  chemically synthesized
ttaaatgcttttattgttgact

SEQ ID NO: 88846 - DNA, 22 bp, Artificial Sequence
  chemically synthesized
aaatgcttttattgttgactga

SEQ ID NO: 88847 - DNA, 22 bp, Artificial Sequence
  chemically synthesized
aatgcttttattgttgactgaa

SEQ ID NO: 88848 - DNA, 22 bp, Artificial Sequence
  chemically synthesized
ttattgttgactgaatttattt

SEQ ID NO: 88849 - DNA, 22 bp, Artificial Sequence
  chemically synthesized
tattgttgactgaatttatttc

SEQ ID NO: 88850 - DNA, 22 bp, Artificial Sequence
  chemically synthesized
attgttgactgaatttatttct

SEQ ID NO: 88851 - DNA, 22 bp, Artificial Sequence
  chemically synthesized
ttgttgactgaatttatttctc

SEQ ID NO: 88852 - DNA, 22 bp, Artificial Sequence
  chemically synthesized
ttgactgaatttatttctccct

SEQ ID NO: 88853 - DNA, 22 bp, Artificial Sequence
  chemically synthesized
actgaatttatttctcccttga

SEQ ID NO: 88854 - DNA, 22 bp, Artificial Sequence
  chemically synthesized
aatttatttctcccttgatagt

SEQ ID NO: 88855 - DNA, 22 bp, Artificial Sequence
  chemically synthesized
atttctcccttgatagtttcta

SEQ ID NO: 88856 - DNA, 22 bp, Artificial Sequence
  chemically synthesized
tttctcccttgatagtttctac

SEQ ID NO: 88857 - DNA, 22 bp, Artificial Sequence
  chemically synthesized
ctcccttgatagtttctacttt

SEQ ID NO: 88858 - DNA, 22 bp, Artificial Sequence
  chemically synthesized
tcccttgatagtttctactttg

SEQ ID NO: 88859 - DNA, 22 bp, Artificial Sequence
  chemically synthesized
ccttgatagtttctactttggg

SEQ ID NO: 88860 - DNA, 22 bp, Artificial Sequence
  chemically synthesized
gatagtttctactttgggttga

SEQ ID NO: 88861 - DNA, 22 bp, Artificial Sequence
  chemically synthesized
atagtttctactttgggttgat

SEQ ID NO: 88862 - DNA, 22 bp, Artificial Sequence
  chemically synthesized
ctactttgggttgataattaaa

SEQ ID NO: 88863 - DNA, 22 bp, Artificial Sequence
  chemically synthesized
tactttgggttgataattaaat

SEQ ID NO: 88864 - DNA, 22 bp, Artificial Sequence
  chemically synthesized
ctttgggttgataattaaataa

SEQ ID NO: 88865 - DNA, 22 bp, Artificial Sequence
  chemically synthesized
tgggttgataattaaataacag

SEQ ID NO: 88866 - DNA, 22 bp, Artificial Sequence
  chemically synthesized
gggttgataattaaataacagt

SEQ ID NO: 88867 - DNA, 22 bp, Artificial Sequence
  chemically synthesized
ggttgataattaaataacagtg

SEQ ID NO: 88868 - DNA, 22 bp, Artificial Sequence
  chemically synthesized
ataattaaataacagtgttatc

SEQ ID NO: 88869 - DNA, 22 bp, Artificial Sequence
  chemically synthesized
aataacagtgttatctctaaga

SEQ ID NO: 88870 - DNA, 22 bp, Artificial Sequence
  chemically synthesized
tctctaagattatatacatgtc

SEQ ID NO: 88871 - DNA, 22 bp, Artificial Sequence
  chemically synthesized
taagattatatacatgtcttcc

SEQ ID NO: 88872 - DNA, 22 bp, Artificial Sequence
  chemically synthesized
agattatatacatgtcttccca

SEQ ID NO: 88873 - DNA, 22 bp, Artificial Sequence
  chemically synthesized
tatacatgtcttcccatatttt

SEQ ID NO: 88874 - DNA, 22 bp, Artificial Sequence
  chemically synthesized
cccatatttttattctagtttt

SEQ ID NO: 88875 - DNA, 22 bp, Artificial Sequence
  chemically synthesized
ccatatttttattctagttttt

SEQ ID NO: 88876 - DNA, 22 bp, Artificial Sequence
  chemically synthesized
ttattctagttttttcgtgact

SEQ ID NO: 88877 - DNA, 22 bp, Artificial Sequence
  chemically synthesized
tattctagttttttcgtgactg

SEQ ID NO: 88878 - DNA, 22 bp, Artificial Sequence
  chemically synthesized
attctagttttttcgtgactga

SEQ ID NO: 88879 - DNA, 22 bp, Artificial Sequence
  chemically synthesized
ttctagttttttcgtgactgaa

SEQ ID NO: 88880 - DNA, 22 bp, Artificial Sequence
  chemically synthesized
tagttttttcgtgactgaattt

SEQ ID NO: 88881 - DNA, 22 bp, Artificial Sequence
  chemically synthesized
gttttttcgtgactgaatttta

SEQ ID NO: 88882 - DNA, 22 bp, Artificial Sequence
  chemically synthesized
tttcgtgactgaattttacctt

SEQ ID NO: 88883 - DNA, 22 bp, Artificial Sequence
  chemically synthesized
ttcgtgactgaattttaccttc

SEQ ID NO: 88884 - DNA, 22 bp, Artificial Sequence
  chemically synthesized
tcgtgactgaattttaccttca

SEQ ID NO: 88885 - DNA, 22 bp, Artificial Sequence
  chemically synthesized
cgtgactgaattttaccttcac

SEQ ID NO: 88886 - DNA, 22 bp, Artificial Sequence
  chemically synthesized
gtgactgaattttaccttcaca

SEQ ID NO: 88887 - DNA, 22 bp, Artificial Sequence
  chemically synthesized
aattttaccttcacacctaatt

SEQ ID NO: 88888 - DNA, 22 bp, Artificial Sequence
  chemically synthesized
taccttcacacctaattgtgta

SEQ ID NO: 88889 - DNA, 22 bp, Artificial Sequence
  chemically synthesized
accttcacacctaattgtgtaa

SEQ ID NO: 88890 - DNA, 22 bp, Artificial Sequence
  chemically synthesized
ccttcacacctaattgtgtaat

SEQ ID NO: 88891 - DNA, 22 bp, Artificial Sequence
  chemically synthesized
cacacctaattgtgtaatcgat

SEQ ID NO: 88892 - DNA, 22 bp, Artificial Sequence
  chemically synthesized
acacctaattgtgtaatcgatt

SEQ ID NO: 88893 - DNA, 22 bp, Artificial Sequence
  chemically synthesized
attgtgtaatcgattgtggtat

SEQ ID NO: 88894 - DNA, 22 bp, Artificial Sequence
  chemically synthesized
tgtaatcgattgtggtatatgc

SEQ ID NO: 88895 - DNA, 22 bp, Artificial Sequence
  chemically synthesized
tggtatatgcagttaagcattt

SEQ ID NO: 88896 - DNA, 22 bp, Artificial Sequence
  chemically synthesized
agcatttcactttactcttttc

SEQ ID NO: 88897 - DNA, 22 bp, Artificial Sequence
  chemically synthesized
cactttactcttttcaaaaagt

SEQ ID NO: 88898 - DNA, 22 bp, Artificial Sequence
  chemically synthesized
actttactcttttcaaaaagta

SEQ ID NO: 88899 - DNA, 22 bp, Artificial Sequence
  chemically synthesized
tactcttttcaaaaagtatagt

SEQ ID NO: 88900 - DNA, 22 bp, Artificial Sequence
  chemically synthesized
actcttttcaaaaagtatagtt

SEQ ID NO: 88901 - DNA, 22 bp, Artificial Sequence
  chemically synthesized
ctcttttcaaaaagtatagttg

SEQ ID NO: 88902 - DNA, 22 bp, Artificial Sequence
  chemically synthesized
ttttcaaaaagtatagttgttc

SEQ ID NO: 88903 - DNA, 22 bp, Artificial Sequence
  chemically synthesized
ttcaaaaagtatagttgttcaa

SEQ ID NO: 88904 - DNA, 22 bp, Artificial Sequence
  chemically synthesized
tcaaaaagtatagttgttcaat

SEQ ID NO: 88905 - DNA, 22 bp, Artificial Sequence
  chemically synthesized
caaaaagtatagttgttcaatt

SEQ ID NO: 88906 - DNA, 22 bp, Artificial Sequence
  chemically synthesized
aaaaagtatagttgttcaatta

SEQ ID NO: 88907 - DNA, 22 bp, Artificial Sequence
  chemically synthesized
ttcaattactgtttgtttttta

SEQ ID NO: 88908 - DNA, 22 bp, Artificial Sequence
  chemically synthesized
aattactgtttgttttttattt

SEQ ID NO: 88909 - DNA, 22 bp, Artificial Sequence
  chemically synthesized
ctgtttgttttttatttccaag

SEQ ID NO: 88910 - DNA, 22 bp, Artificial Sequence
  chemically synthesized
tttgttttttatttccaagcta

SEQ ID NO: 88911 - DNA, 22 bp, Artificial Sequence
  chemically synthesized
gttttttatttccaagctaaat

SEQ ID NO: 88912 - DNA, 22 bp, Artificial Sequence
  chemically synthesized
ttttttatttccaagctaaatt

SEQ ID NO: 88913 - DNA, 22 bp, Artificial Sequence
  chemically synthesized
tttatttccaagctaaatttaa

SEQ ID NO: 88914 - DNA, 22 bp, Artificial Sequence
  chemically synthesized
ttatttccaagctaaatttaaa

SEQ ID NO: 88915 - DNA, 22 bp, Artificial Sequence
  chemically synthesized
tatttccaagctaaatttaaaa

SEQ ID NO: 88916 - DNA, 22 bp, Artificial Sequence
  chemically synthesized
atttccaagctaaatttaaaag

SEQ ID NO: 88917 - DNA, 22 bp, Artificial Sequence
  chemically synthesized
tttccaagctaaatttaaaagc

SEQ ID NO: 88918 - DNA, 22 bp, Artificial Sequence
  chemically synthesized
ccaagctaaatttaaaagctat

SEQ ID NO: 88919 - DNA, 22 bp, Artificial Sequence
  chemically synthesized
caagctaaatttaaaagctata

SEQ ID NO: 88920 - DNA, 22 bp, Artificial Sequence
  chemically synthesized
aatttaaaagctatatttttat

SEQ ID NO: 88921 - DNA, 22 bp, Artificial Sequence
  chemically synthesized
aaaagctatatttttatatatc

SEQ ID NO: 88922 - DNA, 22 bp, Artificial Sequence
  chemically synthesized
aaagctatatttttatatatca

SEQ ID NO: 88923 - DNA, 22 bp, Artificial Sequence
  chemically synthesized
tatttttatatatcacattatt

SEQ ID NO: 88924 - DNA, 22 bp, Artificial Sequence
  chemically synthesized
ttatatatcacattattatatt

SEQ ID NO: 88925 - DNA, 22 bp, Artificial Sequence
  chemically synthesized
tatatatcacattattatattt

SEQ ID NO: 88926 - DNA, 22 bp, Artificial Sequence
  chemically synthesized
atatatcacattattatatttt

SEQ ID NO: 88927 - DNA, 22 bp, Artificial Sequence
  chemically synthesized
tatatcacattattatatttta

SEQ ID NO: 88928 - DNA, 22 bp, Artificial Sequence
  chemically synthesized
ttatattttagtgagatttagt

SEQ ID NO: 88929 - DNA, 22 bp, Artificial Sequence
  chemically synthesized
tattttagtgagatttagtttt

SEQ ID NO: 88930 - DNA, 22 bp, Artificial Sequence
  chemically synthesized
tagtgagatttagtttttggat

SEQ ID NO: 88931 - DNA, 22 bp, Artificial Sequence
  chemically synthesized
agtgagatttagtttttggatt

SEQ ID NO: 88932 - DNA, 22 bp, Artificial Sequence
  chemically synthesized
gtgagatttagtttttggattt

SEQ ID NO: 88933 - DNA, 22 bp, Artificial Sequence
  chemically synthesized
agtttttggatttctatttatt

SEQ ID NO: 88934 - DNA, 22 bp, Artificial Sequence
  chemically synthesized
gtttttggatttctatttattc

SEQ ID NO: 88935 - DNA, 22 bp, Artificial Sequence
  chemically synthesized
ttggatttctatttattccact

SEQ ID NO: 88936 - DNA, 22 bp, Artificial Sequence
  chemically synthesized
tggatttctatttattccacta

SEQ ID NO: 88937 - DNA, 22 bp, Artificial Sequence
  chemically synthesized
ggatttctatttattccactat

SEQ ID NO: 88938 - DNA, 22 bp, Artificial Sequence
  chemically synthesized
gatttctatttattccactatc

SEQ ID NO: 88939 - DNA, 22 bp, Artificial Sequence
  chemically synthesized
ctatttattccactatcttact

SEQ ID NO: 88940 - DNA, 22 bp, Artificial Sequence
  chemically synthesized
tatttattccactatcttactt

SEQ ID NO: 88941 - DNA, 22 bp, Artificial Sequence
  chemically synthesized
tttattccactatcttacttac

SEQ ID NO: 88942 - DNA, 22 bp, Artificial Sequence
  chemically synthesized
attccactatcttacttacaca

SEQ ID NO: 88943 - DNA, 22 bp, Artificial Sequence
  chemically synthesized
ttccactatcttacttacacat

SEQ ID NO: 88944 - DNA, 22 bp, Artificial Sequence
  chemically synthesized
cactatcttacttacacatgag

SEQ ID NO: 88945 - DNA, 22 bp, Artificial Sequence
  chemically synthesized
tcttacttacacatgagtggta

SEQ ID NO: 88946 - DNA, 22 bp, Artificial Sequence
  chemically synthesized
acttacacatgagtggtattaa

SEQ ID NO: 88947 - DNA, 22 bp, Artificial Sequence
  chemically synthesized
cttacacatgagtggtattaat

SEQ ID NO: 88948 - DNA, 22 bp, Artificial Sequence
  chemically synthesized
acacatgagtggtattaattta

SEQ ID NO: 88949 - DNA, 22 bp, Artificial Sequence
  chemically synthesized
cacatgagtggtattaatttaa

SEQ ID NO: 88950 - DNA, 22 bp, Artificial Sequence
  chemically synthesized
atttaacatgattttagaatga

SEQ ID NO: 88951 - DNA, 22 bp, Artificial Sequence
  chemically synthesized
aacatgattttagaatgaagaa

SEQ ID NO: 88952 - DNA, 22 bp, Artificial Sequence
  chemically synthesized
acatgattttagaatgaagaaa

SEQ ID NO: 88953 - DNA, 22 bp, Artificial Sequence
  chemically synthesized
tagaatgaagaaaatgaagcca

SEQ ID NO: 88954 - DNA, 22 bp, Artificial Sequence
  chemically synthesized
agaatgaagaaaatgaagccat

SEQ ID NO: 88955 - DNA, 22 bp, Artificial Sequence
  chemically synthesized
gaatgaagaaaatgaagccatt

SEQ ID NO: 88956 - DNA, 22 bp, Artificial Sequence
  chemically synthesized
ttagataaaccaaaagtaacaa

SEQ ID NO: 88957 - DNA, 22 bp, Artificial Sequence
  chemically synthesized
tagataaaccaaaagtaacaat

SEQ ID NO: 88958 - DNA, 22 bp, Artificial Sequence
  chemically synthesized
agataaaccaaaagtaacaatg

SEQ ID NO: 88959 - DNA, 22 bp, Artificial Sequence
  chemically synthesized
gataaaccaaaagtaacaatgt

SEQ ID NO: 88960 - DNA, 22 bp, Artificial Sequence
  chemically synthesized
ccagcagaaagagataatatta

SEQ ID NO: 88961 - DNA, 22 bp, Artificial Sequence
  chemically synthesized
cagcagaaagagataatattaa

SEQ ID NO: 88962 - DNA, 22 bp, Artificial Sequence
  chemically synthesized
aggataatcagaaaaaaataga

SEQ ID NO: 88963 - DNA, 22 bp, Artificial Sequence
  chemically synthesized
agagagaatgttagaaatgaag

SEQ ID NO: 88964 - DNA, 22 bp, Artificial Sequence
  chemically synthesized
gagagaatgttagaaatgaaga

SEQ ID NO: 88965 - DNA, 22 bp, Artificial Sequence
  chemically synthesized
gaaatgaagaaaagcatgcaaa

SEQ ID NO: 88966 - DNA, 22 bp, Artificial Sequence
  chemically synthesized
tgtacataagtgtaaacatttc

SEQ ID NO: 88967 - DNA, 22 bp, Artificial Sequence
  chemically synthesized
gtacataagtgtaaacatttct

SEQ ID NO: 88968 - DNA, 22 bp, Artificial Sequence
  chemically synthesized
tacataagtgtaaacatttctt

SEQ ID NO: 88969 - DNA, 22 bp, Artificial Sequence
  chemically synthesized
cttcactatttaataataacac

SEQ ID NO: 88970 - DNA, 22 bp, Artificial Sequence
  chemically synthesized
ttcactatttaataataacact

SEQ ID NO: 88971 - DNA, 22 bp, Artificial Sequence
  chemically synthesized
cactatttaataataacactag

SEQ ID NO: 88972 - DNA, 22 bp, Artificial Sequence
  chemically synthesized
actatttaataataacactaga

SEQ ID NO: 88973 - DNA, 22 bp, Artificial Sequence
  chemically synthesized
tttaataataacactagaaaat

SEQ ID NO: 88974 - DNA, 22 bp, Artificial Sequence
  chemically synthesized
aataataacactagaaaatcta

SEQ ID NO: 88975 - DNA, 22 bp, Artificial Sequence
  chemically synthesized
ataataacactagaaaatctag

SEQ ID NO: 88976 - DNA, 22 bp, Artificial Sequence
  chemically synthesized
gaaaatctagggagtaaaacta

SEQ ID NO: 88977 - DNA, 22 bp, Artificial Sequence
  chemically synthesized
gggagtaaaactatacaaaata

SEQ ID NO: 88978 - DNA, 22 bp, Artificial Sequence
  chemically synthesized
tacaaaatatctaaaatatata

SEQ ID NO: 88979 - DNA, 22 bp, Artificial Sequence
  chemically synthesized
aaatatatatatatataattat

SEQ ID NO: 88980 - DNA, 22 bp, Artificial Sequence
  chemically synthesized
tagattgggaaggggaaaatga

SEQ ID NO: 88981 - DNA, 22 bp, Artificial Sequence
  chemically synthesized
ggaaggggaaaatgaagataaa

SEQ ID NO: 88982 - DNA, 22 bp, Artificial Sequence
  chemically synthesized
aaatttattgtattgttttgga

SEQ ID NO: 88983 - DNA, 22 bp, Artificial Sequence
  chemically synthesized
attgtattgttttggaaaagag

SEQ ID NO: 88984 - DNA, 22 bp, Artificial Sequence
  chemically synthesized
ttgtattgttttggaaaagagt

SEQ ID NO: 88985 - DNA, 22 bp, Artificial Sequence
  chemically synthesized
tattgttttggaaaagagtaaa

SEQ ID NO: 88986 - DNA, 22 bp, Artificial Sequence
  chemically synthesized
ttttggaaaagagtaaacagtc

SEQ ID NO: 88987 - DNA, 22 bp, Artificial Sequence
  chemically synthesized
tggaaaagagtaaacagtcaaa

SEQ ID NO: 88988 - DNA, 22 bp, Artificial Sequence
  chemically synthesized
ggaaaagagtaaacagtcaaat

SEQ ID NO: 88989 - DNA, 22 bp, Artificial Sequence
  chemically synthesized
gaaaagagtaaacagtcaaatg

SEQ ID NO: 88990 - DNA, 22 bp, Artificial Sequence
  chemically synthesized
gtatctgaaaaatcaagaatgc

SEQ ID NO: 88991 - DNA, 22 bp, Artificial Sequence
  chemically synthesized
tatctgaaaaatcaagaatgca

SEQ ID NO: 88992 - DNA, 22 bp, Artificial Sequence
  chemically synthesized
aaaaatcaagaatgcaattcta

SEQ ID NO: 88993 - DNA, 22 bp, Artificial Sequence
  chemically synthesized
taatcatcaagatgcatttttt

SEQ ID NO: 88994 - DNA, 22 bp, Artificial Sequence
  chemically synthesized
atcatcaagatgcattttttta

SEQ ID NO: 88995 - DNA, 22 bp, Artificial Sequence
  chemically synthesized
ttttattttttagttttttaat

SEQ ID NO: 88996 - DNA, 22 bp, Artificial Sequence
  chemically synthesized
tttattttttagttttttaatt

SEQ ID NO: 88997 - DNA, 22 bp, Artificial Sequence
  chemically synthesized
ttattttttagttttttaattc

SEQ ID NO: 88998 - DNA, 22 bp, Artificial Sequence
  chemically synthesized
tattttttagttttttaattca

SEQ ID NO: 88999 - DNA, 22 bp, Artificial Sequence
  chemically synthesized
attttttagttttttaattcat

SEQ ID NO: 89000 - DNA, 22 bp, Artificial Sequence
  chemically synthesized
ttttttagttttttaattcatg

SEQ ID NO: 89001 - DNA, 22 bp, Artificial Sequence
  chemically synthesized
tttagttttttaattcatgtga

SEQ ID NO: 89002 - DNA, 22 bp, Artificial Sequence
  chemically synthesized
ttagttttttaattcatgtgat

SEQ ID NO: 89003 - DNA, 22 bp, Artificial Sequence
  chemically synthesized
tagttttttaattcatgtgatg

SEQ ID NO: 89004 - DNA, 22 bp, Artificial Sequence
  chemically synthesized
agttttttaattcatgtgatgt

SEQ ID NO: 89005 - DNA, 22 bp, Artificial Sequence
  chemically synthesized
gttttttaattcatgtgatgtc

SEQ ID NO: 89006 - DNA, 22 bp, Artificial Sequence
  chemically synthesized
tttaattcatgtgatgtctatt

SEQ ID NO: 89007 - DNA, 22 bp, Artificial Sequence
  chemically synthesized
ttaattcatgtgatgtctattc

SEQ ID NO: 89008 - DNA, 22 bp, Artificial Sequence
  chemically synthesized
taattcatgtgatgtctattct

SEQ ID NO: 89009 - DNA, 22 bp, Artificial Sequence
  chemically synthesized
aattcatgtgatgtctattctt

SEQ ID NO: 89010 - DNA, 22 bp, Artificial Sequence
  chemically synthesized
attcatgtgatgtctattcttt

SEQ ID NO: 89011 - DNA, 22 bp, Artificial Sequence
  chemically synthesized
atgtgatgtctattctttttta

SEQ ID NO: 89012 - DNA, 22 bp, Artificial Sequence
  chemically synthesized
ttcttttttattattcttcaac

SEQ ID NO: 89013 - DNA, 22 bp, Artificial Sequence
  chemically synthesized
ttttttattattcttcaacttt

SEQ ID NO: 89014 - DNA, 22 bp, Artificial Sequence
  chemically synthesized
ttttattattcttcaactttat

SEQ ID NO: 89015 - DNA, 22 bp, Artificial Sequence
  chemically synthesized
tttattattcttcaactttatt

SEQ ID NO: 89016 - DNA, 22 bp, Artificial Sequence
  chemically synthesized
ttattattcttcaactttattg

SEQ ID NO: 89017 - DNA, 22 bp, Artificial Sequence
  chemically synthesized
tattattcttcaactttattga

SEQ ID NO: 89018 - DNA, 22 bp, Artificial Sequence
  chemically synthesized
attattcttcaactttattgag

SEQ ID NO: 89019 - DNA, 22 bp, Artificial Sequence
  chemically synthesized
ttattcttcaactttattgagg

SEQ ID NO: 89020 - DNA, 22 bp, Artificial Sequence
  chemically synthesized
ttcttcaactttattgaggtat

SEQ ID NO: 89021 - DNA, 22 bp, Artificial Sequence
  chemically synthesized
ttcaactttattgaggtatcat

SEQ ID NO: 89022 - DNA, 22 bp, Artificial Sequence
  chemically synthesized
caactttattgaggtatcattc

SEQ ID NO: 89023 - DNA, 22 bp, Artificial Sequence
  chemically synthesized
aactttattgaggtatcattca

SEQ ID NO: 89024 - DNA, 22 bp, Artificial Sequence
  chemically synthesized
tattgaggtatcattcacaaat

SEQ ID NO: 89025 - DNA, 22 bp, Artificial Sequence
  chemically synthesized
attgaggtatcattcacaaata

SEQ ID NO: 89026 - DNA, 22 bp, Artificial Sequence
  chemically synthesized
ttgaggtatcattcacaaataa

SEQ ID NO: 89027 - DNA, 22 bp, Artificial Sequence
  chemically synthesized
aggtatcattcacaaataaaaa

SEQ ID NO: 89028 - DNA, 22 bp, Artificial Sequence
  chemically synthesized
acaaataaaaattgtatatatt

SEQ ID NO: 89029 - DNA, 22 bp, Artificial Sequence
  chemically synthesized
tatatatttaaggtgtacaaca

SEQ ID NO: 89030 - DNA, 22 bp, Artificial Sequence
  chemically synthesized
aaggtgtacaacatgatgtttt

SEQ ID NO: 89031 - DNA, 22 bp, Artificial Sequence
  chemically synthesized
aggtgtacaacatgatgtttta

SEQ ID NO: 89032 - DNA, 22 bp, Artificial Sequence
  chemically synthesized
taatatatgtataccttgtgaa

SEQ ID NO: 89033 - DNA, 22 bp, Artificial Sequence
  chemically synthesized
aatatatgtataccttgtgaaa

SEQ ID NO: 89034 - DNA, 22 bp, Artificial Sequence
  chemically synthesized
atatatgtataccttgtgaaat

SEQ ID NO: 89035 - DNA, 22 bp, Artificial Sequence
  chemically synthesized
gtgaaatgattaccacaatcaa

SEQ ID NO: 89036 - DNA, 22 bp, Artificial Sequence
  chemically synthesized
tgaaatgattaccacaatcaag

SEQ ID NO: 89037 - DNA, 22 bp, Artificial Sequence
  chemically synthesized
ccacaatcaagctaattaacat

SEQ ID NO: 89038 - DNA, 22 bp, Artificial Sequence
  chemically synthesized
attaacatacccattatctcac

SEQ ID NO: 89039 - DNA, 22 bp, Artificial Sequence
  chemically synthesized
acatacccattatctcacatag

SEQ ID NO: 89040 - DNA, 22 bp, Artificial Sequence
  chemically synthesized
tctcacatagttacctttttct

SEQ ID NO: 89041 - DNA, 22 bp, Artificial Sequence
  chemically synthesized
acatagttacctttttcttgtg

SEQ ID NO: 89042 - DNA, 22 bp, Artificial Sequence
  chemically synthesized
cctttttcttgtggtaaatgct

SEQ ID NO: 89043 - DNA, 22 bp, Artificial Sequence
  chemically synthesized
tttcttgtggtaaatgctttta

SEQ ID NO: 89044 - DNA, 22 bp, Artificial Sequence
  chemically synthesized
ttcttgtggtaaatgcttttaa

SEQ ID NO: 89045 - DNA, 22 bp, Artificial Sequence
  chemically synthesized
tcttgtggtaaatgcttttaag

SEQ ID NO: 89046 - DNA, 22 bp, Artificial Sequence
  chemically synthesized
cttgtggtaaatgcttttaaga

SEQ ID NO: 89047 - DNA, 22 bp, Artificial Sequence
  chemically synthesized
ttgtggtaaatgcttttaagat

SEQ ID NO: 89048 - DNA, 22 bp, Artificial Sequence
  chemically synthesized
gtggtaaatgcttttaagatct

SEQ ID NO: 89049 - DNA, 22 bp, Artificial Sequence
  chemically synthesized
tggtaaatgcttttaagatcta

SEQ ID NO: 89050 - DNA, 22 bp, Artificial Sequence
  chemically synthesized
ttaagatctactctcggccagg

SEQ ID NO: 89051 - DNA, 22 bp, Artificial Sequence
  chemically synthesized
taagatctactctcggccaggc

SEQ ID NO: 89052 - DNA, 22 bp, Artificial Sequence
  chemically synthesized
aagatctactctcggccaggcc

SEQ ID NO: 89053 - DNA, 22 bp, Artificial Sequence
  chemically synthesized
agatctactctcggccaggccc

SEQ ID NO: 89054 - DNA, 22 bp, Artificial Sequence
  chemically synthesized
ctctcggccaggcccggtggct

SEQ ID NO: 89055 - DNA, 22 bp, Artificial Sequence
  chemically synthesized
tcggccaggcccggtggctcac

SEQ ID NO: 89056 - DNA, 22 bp, Artificial Sequence
  chemically synthesized
ggccaggcccggtggctcacgc

SEQ ID NO: 89057 - DNA, 22 bp, Artificial Sequence
  chemically synthesized
acgcctgtaatcccagcccttt

SEQ ID NO: 89058 - DNA, 22 bp, Artificial Sequence
  chemically synthesized
taatcccagccctttgggtggc

SEQ ID NO: 89059 - DNA, 22 bp, Artificial Sequence
  chemically synthesized
tgggtggccgaggcaggcggat

SEQ ID NO: 89060 - DNA, 22 bp, Artificial Sequence
  chemically synthesized
gggtggccgaggcaggcggatc

SEQ ID NO: 89061 - DNA, 22 bp, Artificial Sequence
  chemically synthesized
ggtggccgaggcaggcggatca

SEQ ID NO: 89062 - DNA, 22 bp, Artificial Sequence
  chemically synthesized
accaacatggagaaaccccgtc

SEQ ID NO: 89063 - DNA, 22 bp, Artificial Sequence
  chemically synthesized
tactaaaaatacaaaattagct

SEQ ID NO: 89064 - DNA, 22 bp, Artificial Sequence
  chemically synthesized
ctaaaaatacaaaattagctgg

SEQ ID NO: 89065 - DNA, 22 bp, Artificial Sequence
  chemically synthesized
aaaatacaaaattagctgggca

SEQ ID NO: 89066 - DNA, 22 bp, Artificial Sequence
  chemically synthesized
gctgggcatggtgtcgcatgcc

SEQ ID NO: 89067 - DNA, 22 bp, Artificial Sequence
  chemically synthesized
ggcatggtgtcgcatgcctgta

SEQ ID NO: 89068 - DNA, 22 bp, Artificial Sequence
  chemically synthesized
taatcccagctactcgggaggc

SEQ ID NO: 89069 - DNA, 22 bp, Artificial Sequence
  chemically synthesized
ctcgggaggctgaggcaggaga

SEQ ID NO: 89070 - DNA, 22 bp, Artificial Sequence
  chemically synthesized
gggaggctgaggcaggagattt

SEQ ID NO: 89071 - DNA, 22 bp, Artificial Sequence
  chemically synthesized
aggcaggagatttgcttgaacc

SEQ ID NO: 89072 - DNA, 22 bp, Artificial Sequence
  chemically synthesized
gcttgaacccaggaggcggagg

SEQ ID NO: 89073 - DNA, 22 bp, Artificial Sequence
  chemically synthesized
cttgaacccaggaggcggaggt

SEQ ID NO: 89074 - DNA, 22 bp, Artificial Sequence
  chemically synthesized
gaacccaggaggcggaggttgc

SEQ ID NO: 89075 - DNA, 22 bp, Artificial Sequence
  chemically synthesized
aacccaggaggcggaggttgca

SEQ ID NO: 89076 - DNA, 22 bp, Artificial Sequence
  chemically synthesized
cagtgagccaagatcttgccat

SEQ ID NO: 89077 - DNA, 22 bp, Artificial Sequence
  chemically synthesized
gccattgcactccagcctggac

SEQ ID NO: 89078 - DNA, 22 bp, Artificial Sequence
  chemically synthesized
ccattgcactccagcctggaca

SEQ ID NO: 89079 - DNA, 22 bp, Artificial Sequence
  chemically synthesized
cactccagcctggacaacaaga

SEQ ID NO: 89080 - DNA, 22 bp, Artificial Sequence
  chemically synthesized
cagcctggacaacaagagcaaa

SEQ ID NO: 89081 - DNA, 22 bp, Artificial Sequence
  chemically synthesized
gacaacaagagcaaaactccat

SEQ ID NO: 89082 - DNA, 22 bp, Artificial Sequence
  chemically synthesized
catctaaaaaaaaaaaaaaatc

SEQ ID NO: 89083 - DNA, 22 bp, Artificial Sequence
  chemically synthesized
aaaaaaaaaaaaaatctactct

SEQ ID NO: 89084 - DNA, 22 bp, Artificial Sequence
  chemically synthesized
ctctctttgcaaattttaaata

SEQ ID NO: 89085 - DNA, 22 bp, Artificial Sequence
  chemically synthesized
tctttgcaaattttaaatatac

SEQ ID NO: 89086 - DNA, 22 bp, Artificial Sequence
  chemically synthesized
tttgcaaattttaaatatactt

SEQ ID NO: 89087 - DNA, 22 bp, Artificial Sequence
  chemically synthesized
tgcaaattttaaatatacttac

SEQ ID NO: 89088 - DNA, 22 bp, Artificial Sequence
  chemically synthesized
gcaaattttaaatatacttaca

SEQ ID NO: 89089 - DNA, 22 bp, Artificial Sequence
  chemically synthesized
caaattttaaatatacttacag

SEQ ID NO: 89090 - DNA, 22 bp, Artificial Sequence
  chemically synthesized
taaatatacttacagtacaatt

SEQ ID NO: 89091 - DNA, 22 bp, Artificial Sequence
  chemically synthesized
aaatatacttacagtacaatta

SEQ ID NO: 89092 - DNA, 22 bp, Artificial Sequence
  chemically synthesized
aatatacttacagtacaattaa

SEQ ID NO: 89093 - DNA, 22 bp, Artificial Sequence
  chemically synthesized
acagtacaattaactacagtca

SEQ ID NO: 89094 - DNA, 22 bp, Artificial Sequence
  chemically synthesized
cagtacaattaactacagtcac

SEQ ID NO: 89095 - DNA, 22 bp, Artificial Sequence
  chemically synthesized
actacagtcacgatgctgtaca

SEQ ID NO: 89096 - DNA, 22 bp, Artificial Sequence
  chemically synthesized
cagtcacgatgctgtacattag

SEQ ID NO: 89097 - DNA, 22 bp, Artificial Sequence
  chemically synthesized
tacattagatatctagaattta

SEQ ID NO: 89098 - DNA, 22 bp, Artificial Sequence
  chemically synthesized
gatatctagaatttattcatcc

SEQ ID NO: 89099 - DNA, 22 bp, Artificial Sequence
  chemically synthesized
gaatttattcatcccacataac

SEQ ID NO: 89100 - DNA, 22 bp, Artificial Sequence
  chemically synthesized
attcatcccacataactgaaat

SEQ ID NO: 89101 - DNA, 22 bp, Artificial Sequence
  chemically synthesized
ttcatcccacataactgaaatt

SEQ ID NO: 89102 - DNA, 22 bp, Artificial Sequence
  chemically synthesized
atcccacataactgaaatttta

SEQ ID NO: 89103 - DNA, 22 bp, Artificial Sequence
  chemically synthesized
aaattttataccctttgagtaa

SEQ ID NO: 89104 - DNA, 22 bp, Artificial Sequence
  chemically synthesized
tataccctttgagtaatagttt

SEQ ID NO: 89105 - DNA, 22 bp, Artificial Sequence
  chemically synthesized
ataccctttgagtaatagtttc

SEQ ID NO: 89106 - DNA, 22 bp, Artificial Sequence
  chemically synthesized
taccctttgagtaatagtttcc

SEQ ID NO: 89107 - DNA, 22 bp, Artificial Sequence
  chemically synthesized
tgagtaatagtttcctgattct

SEQ ID NO: 89108 - DNA, 22 bp, Artificial Sequence
  chemically synthesized
gagtaatagtttcctgattctc

SEQ ID NO: 89109 - DNA, 22 bp, Artificial Sequence
  chemically synthesized
agtaatagtttcctgattctcc

SEQ ID NO: 89110 - DNA, 22 bp, Artificial Sequence
  chemically synthesized
cctgattctcccacccccaacc

SEQ ID NO: 89111 - DNA, 22 bp, Artificial Sequence
  chemically synthesized
ctgattctcccacccccaaccc

SEQ ID NO: 89112 - DNA, 22 bp, Artificial Sequence
  chemically synthesized
attctcccacccccaacccctg

SEQ ID NO: 89113 - DNA, 22 bp, Artificial Sequence
  chemically synthesized
tcccacccccaacccctggaaa

SEQ ID NO: 89114 - DNA, 22 bp, Artificial Sequence
  chemically synthesized
ccacccccaacccctggaaacc

SEQ ID NO: 89115 - DNA, 22 bp, Artificial Sequence
  chemically synthesized
gaaaccatacctctactgtctg

SEQ ID NO: 89116 - DNA, 22 bp, Artificial Sequence
  chemically synthesized
tactgtctgtttccatgagagt

SEQ ID NO: 89117 - DNA, 22 bp, Artificial Sequence
  chemically synthesized
ctgtctgtttccatgagagtga

SEQ ID NO: 89118 - DNA, 22 bp, Artificial Sequence
  chemically synthesized
tctgtttccatgagagtgactt

SEQ ID NO: 89119 - DNA, 22 bp, Artificial Sequence
  chemically synthesized
tttccatgagagtgactttttt

SEQ ID NO: 89120 - DNA, 22 bp, Artificial Sequence
  chemically synthesized
ccatgagagtgacttttttatg

SEQ ID NO: 89121 - DNA, 22 bp, Artificial Sequence
  chemically synthesized
catgagagtgacttttttatgt

SEQ ID NO: 89122 - DNA, 22 bp, Artificial Sequence
  chemically synthesized
ttttatgtttcacatatgagca

SEQ ID NO: 89123 - DNA, 22 bp, Artificial Sequence
  chemically synthesized
tttatgtttcacatatgagcaa

SEQ ID NO: 89124 - DNA, 22 bp, Artificial Sequence
  chemically synthesized
ttatgtttcacatatgagcaag

SEQ ID NO: 89125 - DNA, 22 bp, Artificial Sequence
  chemically synthesized
tatgtttcacatatgagcaagg

SEQ ID NO: 89126 - DNA, 22 bp, Artificial Sequence
  chemically synthesized
atgtttcacatatgagcaaggt

SEQ ID NO: 89127 - DNA, 22 bp, Artificial Sequence
  chemically synthesized
tgtttcacatatgagcaaggtt

SEQ ID NO: 89128 - DNA, 22 bp, Artificial Sequence
  chemically synthesized
cacatatgagcaaggttgtgta

SEQ ID NO: 89129 - DNA, 22 bp, Artificial Sequence
  chemically synthesized
acatatgagcaaggttgtgtag

SEQ ID NO: 89130 - DNA, 22 bp, Artificial Sequence
  chemically synthesized
tgtagtatttgtctttttgtgt

SEQ ID NO: 89131 - DNA, 22 bp, Artificial Sequence
  chemically synthesized
gtctttttgtgtcaggcttatt

SEQ ID NO: 89132 - DNA, 22 bp, Artificial Sequence
  chemically synthesized
tctttttgtgtcaggcttattt

SEQ ID NO: 89133 - DNA, 22 bp, Artificial Sequence
  chemically synthesized
tttgtgtcaggcttatttttct

SEQ ID NO: 89134 - DNA, 22 bp, Artificial Sequence
  chemically synthesized
ttgtgtcaggcttatttttctt

SEQ ID NO: 89135 - DNA, 22 bp, Artificial Sequence
  chemically synthesized
tgtgtcaggcttatttttctta

SEQ ID NO: 89136 - DNA, 22 bp, Artificial Sequence
  chemically synthesized
gtgtcaggcttatttttcttag

SEQ ID NO: 89137 - DNA, 22 bp, Artificial Sequence
  chemically synthesized
tgtcaggcttatttttcttagt

SEQ ID NO: 89138 - DNA, 22 bp, Artificial Sequence
  chemically synthesized
atttttcttagttttacatcct

SEQ ID NO: 89139 - DNA, 22 bp, Artificial Sequence
  chemically synthesized
tttttcttagttttacatcctc

SEQ ID NO: 89140 - DNA, 22 bp, Artificial Sequence
  chemically synthesized
ttcttagttttacatcctccag

SEQ ID NO: 89141 - DNA, 22 bp, Artificial Sequence
  chemically synthesized
tcttagttttacatcctccagg

SEQ ID NO: 89142 - DNA, 22 bp, Artificial Sequence
  chemically synthesized
cttagttttacatcctccaggt

SEQ ID NO: 89143 - DNA, 22 bp, Artificial Sequence
  chemically synthesized
ttagttttacatcctccaggtt

SEQ ID NO: 89144 - DNA, 22 bp, Artificial Sequence
  chemically synthesized
agttttacatcctccaggttca

SEQ ID NO: 89145 - DNA, 22 bp, Artificial Sequence
  chemically synthesized
gttttacatcctccaggttcat

SEQ ID NO: 89146 - DNA, 22 bp, Artificial Sequence
  chemically synthesized
tacatcctccaggttcatcaat

SEQ ID NO: 89147 - DNA, 22 bp, Artificial Sequence
  chemically synthesized
acatcctccaggttcatcaatt

SEQ ID NO: 89148 - DNA, 22 bp, Artificial Sequence
  chemically synthesized
catcctccaggttcatcaattc

SEQ ID NO: 89149 - DNA, 22 bp, Artificial Sequence
  chemically synthesized
caggttcatcaattctgccata

SEQ ID NO: 89150 - DNA, 22 bp, Artificial Sequence
  chemically synthesized
atcaattctgccataaatggca

SEQ ID NO: 89151 - DNA, 22 bp, Artificial Sequence
  chemically synthesized
tgccataaatggcaggattttc

SEQ ID NO: 89152 - DNA, 22 bp, Artificial Sequence
  chemically synthesized
ccataaatggcaggattttctt

SEQ ID NO: 89153 - DNA, 22 bp, Artificial Sequence
  chemically synthesized
tcttctttttaatttttttatt

SEQ ID NO: 89154 - DNA, 22 bp, Artificial Sequence
  chemically synthesized
cttctttttaatttttttattt

SEQ ID NO: 89155 - DNA, 22 bp, Artificial Sequence
  chemically synthesized
ttctttttaatttttttatttt

SEQ ID NO: 89156 - DNA, 22 bp, Artificial Sequence
  chemically synthesized
ctttttaatttttttattttcc

SEQ ID NO: 89157 - DNA, 22 bp, Artificial Sequence
  chemically synthesized
tttttaatttttttattttcct

SEQ ID NO: 89158 - DNA, 22 bp, Artificial Sequence
  chemically synthesized
tttaatttttttattttcctat

SEQ ID NO: 89159 - DNA, 22 bp, Artificial Sequence
  chemically synthesized
ttaatttttttattttcctatt

SEQ ID NO: 89160 - DNA, 22 bp, Artificial Sequence
  chemically synthesized
taatttttttattttcctattt

SEQ ID NO: 89161 - DNA, 22 bp, Artificial Sequence
  chemically synthesized
aatttttttattttcctatttt

SEQ ID NO: 89162 - DNA, 22 bp, Artificial Sequence
  chemically synthesized
atttttttattttcctattttt

SEQ ID NO: 89163 - DNA, 22 bp, Artificial Sequence
  chemically synthesized
ttttattttcctatttttaatt

SEQ ID NO: 89164 - DNA, 22 bp, Artificial Sequence
  chemically synthesized
tttattttcctatttttaattt

SEQ ID NO: 89165 - DNA, 22 bp, Artificial Sequence
  chemically synthesized
ttattttcctatttttaatttt

SEQ ID NO: 89166 - DNA, 22 bp, Artificial Sequence
  chemically synthesized
tattttcctatttttaattttt

SEQ ID NO: 89167 - DNA, 22 bp, Artificial Sequence
  chemically synthesized
attttcctatttttaatttttt

SEQ ID NO: 89168 - DNA, 22 bp, Artificial Sequence
  chemically synthesized
ttttcctatttttaattttttg

SEQ ID NO: 89169 - DNA, 22 bp, Artificial Sequence
  chemically synthesized
tcctatttttaattttttgttt

SEQ ID NO: 89170 - DNA, 22 bp, Artificial Sequence
  chemically synthesized
cctatttttaattttttgtttg

SEQ ID NO: 89171 - DNA, 22 bp, Artificial Sequence
  chemically synthesized
ctatttttaattttttgtttgt

SEQ ID NO: 89172 - DNA, 22 bp, Artificial Sequence
  chemically synthesized
tttttaattttttgtttgttat

SEQ ID NO: 89173 - DNA, 22 bp, Artificial Sequence
  chemically synthesized
ttaattttttgtttgttattga

SEQ ID NO: 89174 - DNA, 22 bp, Artificial Sequence
  chemically synthesized
taattttttgtttgttattgaa

SEQ ID NO: 89175 - DNA, 22 bp, Artificial Sequence
  chemically synthesized
aattttttgtttgttattgaat

SEQ ID NO: 89176 - DNA, 22 bp, Artificial Sequence
  chemically synthesized
attttttgtttgttattgaatc

SEQ ID NO: 89177 - DNA, 22 bp, Artificial Sequence
  chemically synthesized
tttgtttgttattgaatcatct

SEQ ID NO: 89178 - DNA, 22 bp, Artificial Sequence
  chemically synthesized
ttgtttgttattgaatcatctg

SEQ ID NO: 89179 - DNA, 22 bp, Artificial Sequence
  chemically synthesized
tgtttgttattgaatcatctgt

SEQ ID NO: 89180 - DNA, 22 bp, Artificial Sequence
  chemically synthesized
gtttgttattgaatcatctgtg

SEQ ID NO: 89181 - DNA, 22 bp, Artificial Sequence
  chemically synthesized
tttgttattgaatcatctgtgt

SEQ ID NO: 89182 - DNA, 22 bp, Artificial Sequence
  chemically synthesized
gttattgaatcatctgtgtttc

SEQ ID NO: 89183 - DNA, 22 bp, Artificial Sequence
  chemically synthesized
ttattgaatcatctgtgtttct

SEQ ID NO: 89184 - DNA, 22 bp, Artificial Sequence
  chemically synthesized
ttgaatcatctgtgtttcttat

SEQ ID NO: 89185 - DNA, 22 bp, Artificial Sequence
  chemically synthesized
aatcatctgtgtttcttatata

SEQ ID NO: 89186 - DNA, 22 bp, Artificial Sequence
  chemically synthesized
tgtttcttatatattttggata

SEQ ID NO: 89187 - DNA, 22 bp, Artificial Sequence
  chemically synthesized
cttatatattttggatattaac

SEQ ID NO: 89188 - DNA, 22 bp, Artificial Sequence
  chemically synthesized
ttatatattttggatattaacc

SEQ ID NO: 89189 - DNA, 22 bp, Artificial Sequence
  chemically synthesized
atatattttggatattaaccaa

SEQ ID NO: 89190 - DNA, 22 bp, Artificial Sequence
  chemically synthesized
tatattttggatattaaccaaa

SEQ ID NO: 89191 - DNA, 22 bp, Artificial Sequence
  chemically synthesized
tggatattaaccaaaatattta

SEQ ID NO: 89192 - DNA, 22 bp, Artificial Sequence
  chemically synthesized
ggatattaaccaaaatatttaa

SEQ ID NO: 89193 - DNA, 22 bp, Artificial Sequence
  chemically synthesized
gatattaaccaaaatatttaag

SEQ ID NO: 89194 - DNA, 22 bp, Artificial Sequence
  chemically synthesized
accaaaatatttaagaaatatt

SEQ ID NO: 89195 - DNA, 22 bp, Artificial Sequence
  chemically synthesized
aagaaatatttggtttgcaaat

SEQ ID NO: 89196 - DNA, 22 bp, Artificial Sequence
  chemically synthesized
agaaatatttggtttgcaaata

SEQ ID NO: 89197 - DNA, 22 bp, Artificial Sequence
  chemically synthesized
ggtttgcaaatatgccatttca

SEQ ID NO: 89198 - DNA, 22 bp, Artificial Sequence
  chemically synthesized
gtttgcaaatatgccatttcat

SEQ ID NO: 89199 - DNA, 22 bp, Artificial Sequence
  chemically synthesized
gcaaatatgccatttcatggtt

SEQ ID NO: 89200 - DNA, 22 bp, Artificial Sequence
  chemically synthesized
caaatatgccatttcatggttc

SEQ ID NO: 89201 - DNA, 22 bp, Artificial Sequence
  chemically synthesized
catggttcacctttcatttgtt

SEQ ID NO: 89202 - DNA, 22 bp, Artificial Sequence
  chemically synthesized
atggttcacctttcatttgttc

SEQ ID NO: 89203 - DNA, 22 bp, Artificial Sequence
  chemically synthesized
acctttcatttgttcattgttt

SEQ ID NO: 89204 - DNA, 22 bp, Artificial Sequence
  chemically synthesized
tcatttgttcattgttttgttt

SEQ ID NO: 89205 - DNA, 22 bp, Artificial Sequence
  chemically synthesized
catttgttcattgttttgtttt

SEQ ID NO: 89206 - DNA, 22 bp, Artificial Sequence
  chemically synthesized
atttgttcattgttttgttttt

SEQ ID NO: 89207 - DNA, 22 bp, Artificial Sequence
  chemically synthesized
gttcattgttttgttttttgtg

SEQ ID NO: 89208 - DNA, 22 bp, Artificial Sequence
  chemically synthesized
ttcattgttttgttttttgtgt

SEQ ID NO: 89209 - DNA, 22 bp, Artificial Sequence
  chemically synthesized
attgttttgttttttgtgtgga

SEQ ID NO: 89210 - DNA, 22 bp, Artificial Sequence
  chemically synthesized
ttttgttttttgtgtggaaatt

SEQ ID NO: 89211 - DNA, 22 bp, Artificial Sequence
  chemically synthesized
tgttttttgtgtggaaattttt

SEQ ID NO: 89212 - DNA, 22 bp, Artificial Sequence
  chemically synthesized
gttttttgtgtggaaatttttt

SEQ ID NO: 89213 - DNA, 22 bp, Artificial Sequence
  chemically synthesized
ttttttgtgtggaaatttttta

SEQ ID NO: 89214 - DNA, 22 bp, Artificial Sequence
  chemically synthesized
tttgtgtggaaattttttagtt

SEQ ID NO: 89215 - DNA, 22 bp, Artificial Sequence
  chemically synthesized
ttgtgtggaaattttttagttt

SEQ ID NO: 89216 - DNA, 22 bp, Artificial Sequence
  chemically synthesized
tgtgtggaaattttttagtttg

SEQ ID NO: 89217 - DNA, 22 bp, Artificial Sequence
  chemically synthesized
gtgtggaaattttttagtttga

SEQ ID NO: 89218 - DNA, 22 bp, Artificial Sequence
  chemically synthesized
tgtggaaattttttagtttgat

SEQ ID NO: 89219 - DNA, 22 bp, Artificial Sequence
  chemically synthesized
tttagtttgatgtagcctcact

SEQ ID NO: 89220 - DNA, 22 bp, Artificial Sequence
  chemically synthesized
ttagtttgatgtagcctcactt

SEQ ID NO: 89221 - DNA, 22 bp, Artificial Sequence
  chemically synthesized
tagtttgatgtagcctcacttc

SEQ ID NO: 89222 - DNA, 22 bp, Artificial Sequence
  chemically synthesized
agtttgatgtagcctcacttct

SEQ ID NO: 89223 - DNA, 22 bp, Artificial Sequence
  chemically synthesized
gtttgatgtagcctcacttctt

SEQ ID NO: 89224 - DNA, 22 bp, Artificial Sequence
  chemically synthesized
gatgtagcctcacttctttatt

SEQ ID NO: 89225 - DNA, 22 bp, Artificial Sequence
  chemically synthesized
atgtagcctcacttctttattt

SEQ ID NO: 89226 - DNA, 22 bp, Artificial Sequence
  chemically synthesized
acttctttatttttccttttgt

SEQ ID NO: 89227 - DNA, 22 bp, Artificial Sequence
  chemically synthesized
ctttatttttccttttgttgcc

SEQ ID NO: 89228 - DNA, 22 bp, Artificial Sequence
  chemically synthesized
tttatttttccttttgttgcct

SEQ ID NO: 89229 - DNA, 22 bp, Artificial Sequence
  chemically synthesized
tatttttccttttgttgccttt

SEQ ID NO: 89230 - DNA, 22 bp, Artificial Sequence
  chemically synthesized
atttttccttttgttgcctttg

SEQ ID NO: 89231 - DNA, 22 bp, Artificial Sequence
  chemically synthesized
tttttccttttgttgcctttgc

SEQ ID NO: 89232 - DNA, 22 bp, Artificial Sequence
  chemically synthesized
ttccttttgttgcctttgcttc

SEQ ID NO: 89233 - DNA, 22 bp, Artificial Sequence
  chemically synthesized
tccttttgttgcctttgcttct

SEQ ID NO: 89234 - DNA, 22 bp, Artificial Sequence
  chemically synthesized
ccttttgttgcctttgcttctc

SEQ ID NO: 89235 - DNA, 22 bp, Artificial Sequence
  chemically synthesized
cttttgttgcctttgcttctca

SEQ ID NO: 89236 - DNA, 22 bp, Artificial Sequence
  chemically synthesized
ttgttgcctttgcttctcatat

SEQ ID NO: 89237 - DNA, 22 bp, Artificial Sequence
  chemically synthesized
tgttgcctttgcttctcatatc

SEQ ID NO: 89238 - DNA, 22 bp, Artificial Sequence
  chemically synthesized
gttgcctttgcttctcatatca

SEQ ID NO: 89239 - DNA, 22 bp, Artificial Sequence
  chemically synthesized
ttgcctttgcttctcatatcaa

SEQ ID NO: 89240 - DNA, 22 bp, Artificial Sequence
  chemically synthesized
cctttgcttctcatatcaaatt

SEQ ID NO: 89241 - DNA, 22 bp, Artificial Sequence
  chemically synthesized
tgcttctcatatcaaattcaaa

SEQ ID NO: 89242 - DNA, 22 bp, Artificial Sequence
  chemically synthesized
gcttctcatatcaaattcaaaa

SEQ ID NO: 89243 - DNA, 22 bp, Artificial Sequence
  chemically synthesized
cttctcatatcaaattcaaaaa

SEQ ID NO: 89244 - DNA, 22 bp, Artificial Sequence
  chemically synthesized
ctcatatcaaattcaaaaaacg

SEQ ID NO: 89245 - DNA, 22 bp, Artificial Sequence
  chemically synthesized
tcatatcaaattcaaaaaacgg

SEQ ID NO: 89246 - DNA, 22 bp, Artificial Sequence
  chemically synthesized
atatcaaattcaaaaaacggct

SEQ ID NO: 89247 - DNA, 22 bp, Artificial Sequence
  chemically synthesized
aaaaaacggctgcaacgtgaat

SEQ ID NO: 89248 - DNA, 22 bp, Artificial Sequence
  chemically synthesized
caacgtgaatattagaattttc

SEQ ID NO: 89249 - DNA, 22 bp, Artificial Sequence
  chemically synthesized
gaattttcttcttttgatttct

SEQ ID NO: 89250 - DNA, 22 bp, Artificial Sequence
  chemically synthesized
tcttcttttgatttctttaaaa

SEQ ID NO: 89251 - DNA, 22 bp, Artificial Sequence
  chemically synthesized
cttcttttgatttctttaaaaa

SEQ ID NO: 89252 - DNA, 22 bp, Artificial Sequence
  chemically synthesized
ttcttttgatttctttaaaaat

SEQ ID NO: 89253 - DNA, 22 bp, Artificial Sequence
  chemically synthesized
cttttgatttctttaaaaattt

SEQ ID NO: 89254 - DNA, 22 bp, Artificial Sequence
  chemically synthesized
ttttgatttctttaaaaatttt

SEQ ID NO: 89255 - DNA, 22 bp, Artificial Sequence
  chemically synthesized
ttgatttctttaaaaattttta

SEQ ID NO: 89256 - DNA, 22 bp, Artificial Sequence
  chemically synthesized
tgatttctttaaaaatttttat

SEQ ID NO: 89257 - DNA, 22 bp, Artificial Sequence
  chemically synthesized
gatttctttaaaaatttttatg

SEQ ID NO: 89258 - DNA, 22 bp, Artificial Sequence
  chemically synthesized
atttctttaaaaatttttatgg

SEQ ID NO: 89259 - DNA, 22 bp, Artificial Sequence
  chemically synthesized
ctttaaaaatttttatggtttt

SEQ ID NO: 89260 - DNA, 22 bp, Artificial Sequence
  chemically synthesized
tttaaaaatttttatggtttta

SEQ ID NO: 89261 - DNA, 22 bp, Artificial Sequence
  chemically synthesized
taaaaatttttatggttttagg

SEQ ID NO: 89262 - DNA, 22 bp, Artificial Sequence
  chemically synthesized
aaaaatttttatggttttaggt

SEQ ID NO: 89263 - DNA, 22 bp, Artificial Sequence
  chemically synthesized
aaaatttttatggttttaggtc

SEQ ID NO: 89264 - DNA, 22 bp, Artificial Sequence
  chemically synthesized
ttatggttttaggtcttagttt

SEQ ID NO: 89265 - DNA, 22 bp, Artificial Sequence
  chemically synthesized
tatggttttaggtcttagttta

SEQ ID NO: 89266 - DNA, 22 bp, Artificial Sequence
  chemically synthesized
atggttttaggtcttagtttaa

SEQ ID NO: 89267 - DNA, 22 bp, Artificial Sequence
  chemically synthesized
tggttttaggtcttagtttaat

SEQ ID NO: 89268 - DNA, 22 bp, Artificial Sequence
  chemically synthesized
taggtcttagtttaattcttta

SEQ ID NO: 89269 - DNA, 22 bp, Artificial Sequence
  chemically synthesized
aggtcttagtttaattctttaa

SEQ ID NO: 89270 - DNA, 22 bp, Artificial Sequence
  chemically synthesized
ggtcttagtttaattctttaac

SEQ ID NO: 89271 - DNA, 22 bp, Artificial Sequence
  chemically synthesized
agtttaattctttaacccattc

SEQ ID NO: 89272 - DNA, 22 bp, Artificial Sequence
  chemically synthesized
gtttaattctttaacccattca

SEQ ID NO: 89273 - DNA, 22 bp, Artificial Sequence
  chemically synthesized
aattctttaacccattcaaatt

SEQ ID NO: 89274 - DNA, 22 bp, Artificial Sequence
  chemically synthesized
attctttaacccattcaaattt

SEQ ID NO: 89275 - DNA, 22 bp, Artificial Sequence
  chemically synthesized
tttaacccattcaaatttattt

SEQ ID NO: 89276 - DNA, 22 bp, Artificial Sequence
  chemically synthesized
taacccattcaaatttattttt

SEQ ID NO: 89277 - DNA, 22 bp, Artificial Sequence
  chemically synthesized
aacccattcaaatttatttttg

SEQ ID NO: 89278 - DNA, 22 bp, Artificial Sequence
  chemically synthesized
acccattcaaatttatttttgt

SEQ ID NO: 89279 - DNA, 22 bp, Artificial Sequence
  chemically synthesized
aaatttatttttgtttatggtg

SEQ ID NO: 89280 - DNA, 22 bp, Artificial Sequence
  chemically synthesized
atttttgtttatggtgtaagac

SEQ ID NO: 89281 - DNA, 22 bp, Artificial Sequence
  chemically synthesized
tttttgtttatggtgtaagaca

SEQ ID NO: 89282 - DNA, 22 bp, Artificial Sequence
  chemically synthesized
ttgtttatggtgtaagacaagg

SEQ ID NO: 89283 - DNA, 22 bp, Artificial Sequence
  chemically synthesized
tgtttatggtgtaagacaaggg

SEQ ID NO: 89284 - DNA, 22 bp, Artificial Sequence
  chemically synthesized
gtttatggtgtaagacaagggt

SEQ ID NO: 89285 - DNA, 22 bp, Artificial Sequence
  chemically synthesized
tttatggtgtaagacaagggtc

SEQ ID NO: 89286 - DNA, 22 bp, Artificial Sequence
  chemically synthesized
atggtgtaagacaagggtctga

SEQ ID NO: 89287 - DNA, 22 bp, Artificial Sequence
  chemically synthesized
tggtgtaagacaagggtctgat

SEQ ID NO: 89288 - DNA, 22 bp, Artificial Sequence
  chemically synthesized
atttcatttcattttgagggtt

SEQ ID NO: 89289 - DNA, 22 bp, Artificial Sequence
  chemically synthesized
catttcattttgagggtttcac

SEQ ID NO: 89290 - DNA, 22 bp, Artificial Sequence
  chemically synthesized
atttcattttgagggtttcacc

SEQ ID NO: 89291 - DNA, 22 bp, Artificial Sequence
  chemically synthesized
cattttgagggtttcaccctct

SEQ ID NO: 89292 - DNA, 22 bp, Artificial Sequence
  chemically synthesized
attttgagggtttcaccctctc

SEQ ID NO: 89293 - DNA, 22 bp, Artificial Sequence
  chemically synthesized
tgagggtttcaccctctcatat

SEQ ID NO: 89294 - DNA, 22 bp, Artificial Sequence
  chemically synthesized
gagggtttcaccctctcatata

SEQ ID NO: 89295 - DNA, 22 bp, Artificial Sequence
  chemically synthesized
agggtttcaccctctcatataa

SEQ ID NO: 89296 - DNA, 22 bp, Artificial Sequence
  chemically synthesized
caccctctcatataataaaatt

SEQ ID NO: 89297 - DNA, 22 bp, Artificial Sequence
  chemically synthesized
accctctcatataataaaattc

SEQ ID NO: 89298 - DNA, 22 bp, Artificial Sequence
  chemically synthesized
tcatataataaaattcttctat

SEQ ID NO: 89299 - DNA, 22 bp, Artificial Sequence
  chemically synthesized
atataataaaattcttctatat

SEQ ID NO: 89300 - DNA, 22 bp, Artificial Sequence
  chemically synthesized
ttctatatacccttctatcatc

SEQ ID NO: 89301 - DNA, 22 bp, Artificial Sequence
  chemically synthesized
ctatatacccttctatcatcac

SEQ ID NO: 89302 - DNA, 22 bp, Artificial Sequence
  chemically synthesized
tatatacccttctatcatcact

SEQ ID NO: 89303 - DNA, 22 bp, Artificial Sequence
  chemically synthesized
tatacccttctatcatcactta

SEQ ID NO: 89304 - DNA, 22 bp, Artificial Sequence
  chemically synthesized
ctatcatcacttattactgatt

SEQ ID NO: 89305 - DNA, 22 bp, Artificial Sequence
  chemically synthesized
tatcatcacttattactgatta

SEQ ID NO: 89306 - DNA, 22 bp, Artificial Sequence
  chemically synthesized
tcatcacttattactgattata

SEQ ID NO: 89307 - DNA, 22 bp, Artificial Sequence
  chemically synthesized
attactgattatatgccttgat

SEQ ID NO: 89308 - DNA, 22 bp, Artificial Sequence
  chemically synthesized
ttactgattatatgccttgatt

SEQ ID NO: 89309 - DNA, 22 bp, Artificial Sequence
  chemically synthesized
ctgattatatgccttgatttca

SEQ ID NO: 89310 - DNA, 22 bp, Artificial Sequence
  chemically synthesized
attatatgccttgatttcagaa

SEQ ID NO: 89311 - DNA, 22 bp, Artificial Sequence
  chemically synthesized
tatgccttgatttcagaatctt

SEQ ID NO: 89312 - DNA, 22 bp, Artificial Sequence
  chemically synthesized
gatttcagaatcttgccaacta

SEQ ID NO: 89313 - DNA, 22 bp, Artificial Sequence
  chemically synthesized
atttcagaatcttgccaactag

SEQ ID NO: 89314 - DNA, 22 bp, Artificial Sequence
  chemically synthesized
cagaatcttgccaactagattc

SEQ ID NO: 89315 - DNA, 22 bp, Artificial Sequence
  chemically synthesized
agaatcttgccaactagattca

SEQ ID NO: 89316 - DNA, 22 bp, Artificial Sequence
  chemically synthesized
gccaactagattcagaatttga

SEQ ID NO: 89317 - DNA, 22 bp, Artificial Sequence
  chemically synthesized
ccaactagattcagaatttgac

SEQ ID NO: 89318 - DNA, 22 bp, Artificial Sequence
  chemically synthesized
gattcagaatttgactgggaga

SEQ ID NO: 89319 - DNA, 22 bp, Artificial Sequence
  chemically synthesized
agaatttgactgggagagagga

SEQ ID NO: 89320 - DNA, 22 bp, Artificial Sequence
  chemically synthesized
gactgggagagaggacaaggac

SEQ ID NO: 89321 - DNA, 22 bp, Artificial Sequence
  chemically synthesized
actgggagagaggacaaggacc

SEQ ID NO: 89322 - DNA, 22 bp, Artificial Sequence
  chemically synthesized
ggagagaggacaaggaccactt

SEQ ID NO: 89323 - DNA, 22 bp, Artificial Sequence
  chemically synthesized
gagactcatattttatttccag

SEQ ID NO: 89324 - DNA, 22 bp, Artificial Sequence
  chemically synthesized
agactcatattttatttccaga

SEQ ID NO: 89325 - DNA, 22 bp, Artificial Sequence
  chemically synthesized
atattttatttccagaatctag

SEQ ID NO: 89326 - DNA, 22 bp, Artificial Sequence
  chemically synthesized
tatttccagaatctagcatcta

SEQ ID NO: 89327 - DNA, 22 bp, Artificial Sequence
  chemically synthesized
atttccagaatctagcatctac

SEQ ID NO: 89328 - DNA, 22 bp, Artificial Sequence
  chemically synthesized
tttccagaatctagcatctacc

SEQ ID NO: 89329 - DNA, 22 bp, Artificial Sequence
  chemically synthesized
ccagaatctagcatctacctac

SEQ ID NO: 89330 - DNA, 22 bp, Artificial Sequence
  chemically synthesized
cagaatctagcatctacctacc

SEQ ID NO: 89331 - DNA, 22 bp, Artificial Sequence
  chemically synthesized
gcatctacctacctaggtattg

SEQ ID NO: 89332 - DNA, 22 bp, Artificial Sequence
  chemically synthesized
cctacctaggtattgaataaga

SEQ ID NO: 89333 - DNA, 22 bp, Artificial Sequence
  chemically synthesized
cctaggtattgaataagaaaaa

SEQ ID NO: 89334 - DNA, 22 bp, Artificial Sequence
  chemically synthesized
ggtattgaataagaaaaatgaa

SEQ ID NO: 89335 - DNA, 22 bp, Artificial Sequence
  chemically synthesized
aataagaaaaatgaagttaagg

SEQ ID NO: 89336 - DNA, 22 bp, Artificial Sequence
  chemically synthesized
aggtggttgatggtaacactat

SEQ ID NO: 89337 - DNA, 22 bp, Artificial Sequence
  chemically synthesized
atggtaacactatgctaataac

SEQ ID NO: 89338 - DNA, 22 bp, Artificial Sequence
  chemically synthesized
tgctaataactgcagagccaga

SEQ ID NO: 89339 - DNA, 22 bp, Artificial Sequence
  chemically synthesized
ataactgcagagccagaagcac

SEQ ID NO: 89340 - DNA, 22 bp, Artificial Sequence
  chemically synthesized
cagagccagaagcaccataagg

SEQ ID NO: 89341 - DNA, 22 bp, Artificial Sequence
  chemically synthesized
tgatctcttcctgaatgctaat

SEQ ID NO: 89342 - DNA, 22 bp, Artificial Sequence
  chemically synthesized
atctcttcctgaatgctaatct

SEQ ID NO: 89343 - DNA, 22 bp, Artificial Sequence
  chemically synthesized
ttcctgaatgctaatcttaaac

SEQ ID NO: 89344 - DNA, 22 bp, Artificial Sequence
  chemically synthesized
cctgaatgctaatcttaaacat

SEQ ID NO: 89345 - DNA, 22 bp, Artificial Sequence
  chemically synthesized
ctgaatgctaatcttaaacatc

SEQ ID NO: 89346 - DNA, 22 bp, Artificial Sequence
  chemically synthesized
aatgctaatcttaaacatcctg

SEQ ID NO: 89347 - DNA, 22 bp, Artificial Sequence
  chemically synthesized
atcttaaacatcctgaggaaga

SEQ ID NO: 89348 - DNA, 22 bp, Artificial Sequence
  chemically synthesized
aaacatcctgaggaagaatggg

SEQ ID NO: 89349 - DNA, 22 bp, Artificial Sequence
  chemically synthesized
aacatcctgaggaagaatggga

SEQ ID NO: 89350 - DNA, 22 bp, Artificial Sequence
  chemically synthesized
aggaagaatgggacttccattt

SEQ ID NO: 89351 - DNA, 22 bp, Artificial Sequence
  chemically synthesized
ccatttggggtgggcctatgac

SEQ ID NO: 89352 - DNA, 22 bp, Artificial Sequence
  chemically synthesized
catttggggtgggcctatgaca

SEQ ID NO: 89353 - DNA, 22 bp, Artificial Sequence
  chemically synthesized
ggggtgggcctatgacagggta

SEQ ID NO: 89354 - DNA, 22 bp, Artificial Sequence
  chemically synthesized
gggtgggcctatgacagggtaa

SEQ ID NO: 89355 - DNA, 22 bp, Artificial Sequence
  chemically synthesized
tgacagggtaataagacagtag

SEQ ID NO: 89356 - DNA, 22 bp, Artificial Sequence
  chemically synthesized
caaaaagccgcctttcaaattc

SEQ ID NO: 89357 - DNA, 22 bp, Artificial Sequence
  chemically synthesized
tcaaattcttctcagtcctaac

SEQ ID NO: 89358 - DNA, 22 bp, Artificial Sequence
  chemically synthesized
caaattcttctcagtcctaact

SEQ ID NO: 89359 - DNA, 22 bp, Artificial Sequence
  chemically synthesized
aaattcttctcagtcctaactt

SEQ ID NO: 89360 - DNA, 22 bp, Artificial Sequence
  chemically synthesized
ttctcagtcctaacttttcata

SEQ ID NO: 89361 - DNA, 22 bp, Artificial Sequence
  chemically synthesized
ctcagtcctaacttttcatact

SEQ ID NO: 89362 - DNA, 22 bp, Artificial Sequence
  chemically synthesized
tcagtcctaacttttcatacta

SEQ ID NO: 89363 - DNA, 22 bp, Artificial Sequence
  chemically synthesized
agtcctaacttttcatactaag

SEQ ID NO: 89364 - DNA, 22 bp, Artificial Sequence
  chemically synthesized
acttttcatactaagcccagtc

SEQ ID NO: 89365 - DNA, 22 bp, Artificial Sequence
  chemically synthesized
ttcatactaagcccagtccttc

SEQ ID NO: 89366 - DNA, 22 bp, Artificial Sequence
  chemically synthesized
tcatactaagcccagtccttcc

SEQ ID NO: 89367 - DNA, 22 bp, Artificial Sequence
  chemically synthesized
catactaagcccagtccttcca

SEQ ID NO: 89368 - DNA, 22 bp, Artificial Sequence
  chemically synthesized
atactaagcccagtccttccaa

SEQ ID NO: 89369 - DNA, 22 bp, Artificial Sequence
  chemically synthesized
agcccagtccttccaaagcaga

SEQ ID NO: 89370 - DNA, 22 bp, Artificial Sequence
  chemically synthesized
ccaaagcagactgtgaaagagt

SEQ ID NO: 89371 - DNA, 22 bp, Artificial Sequence
  chemically synthesized
caaagcagactgtgaaagagtg

SEQ ID NO: 89372 - DNA, 22 bp, Artificial Sequence
  chemically synthesized
tgaaagagtgatagttccggga

SEQ ID NO: 89373 - DNA, 22 bp, Artificial Sequence
  chemically synthesized
cgggagactagcactgcagatt

SEQ ID NO: 89374 - DNA, 22 bp, Artificial Sequence
  chemically synthesized
gcactgcagattccgggtcact

SEQ ID NO: 89375 - DNA, 22 bp, Artificial Sequence
  chemically synthesized
cagattccgggtcactgtgagt

SEQ ID NO: 89376 - DNA, 22 bp, Artificial Sequence
  chemically synthesized
cgggtcactgtgagtgggggag

SEQ ID NO: 89377 - DNA, 22 bp, Artificial Sequence
  chemically synthesized
tgagtgggggaggcagggaaga

SEQ ID NO: 89378 - DNA, 22 bp, Artificial Sequence
  chemically synthesized
acaggacagtcaaaccatgacc

SEQ ID NO: 89379 - DNA, 22 bp, Artificial Sequence
  chemically synthesized
tttttccttcttcaagtagacc

SEQ ID NO: 89380 - DNA, 22 bp, Artificial Sequence
  chemically synthesized
ttccttcttcaagtagacctct

SEQ ID NO: 89381 - DNA, 22 bp, Artificial Sequence
  chemically synthesized
tccttcttcaagtagacctcta

SEQ ID NO: 89382 - DNA, 22 bp, Artificial Sequence
  chemically synthesized
ccttcttcaagtagacctctat

SEQ ID NO: 89383 - DNA, 22 bp, Artificial Sequence
  chemically synthesized
cttcttcaagtagacctctata

SEQ ID NO: 89384 - DNA, 22 bp, Artificial Sequence
  chemically synthesized
cttcaagtagacctctataaga

SEQ ID NO: 89385 - DNA, 22 bp, Artificial Sequence
  chemically synthesized
ttcaagtagacctctataagac

SEQ ID NO: 89386 - DNA, 22 bp, Artificial Sequence
  chemically synthesized
caagtagacctctataagacaa

SEQ ID NO: 89387 - DNA, 22 bp, Artificial Sequence
  chemically synthesized
aagtagacctctataagacaac

SEQ ID NO: 89388 - DNA, 22 bp, Artificial Sequence
  chemically synthesized
tataagacaacagagacaacta

SEQ ID NO: 89389 - DNA, 22 bp, Artificial Sequence
  chemically synthesized
taagacaacagagacaactaag

SEQ ID NO: 89390 - DNA, 22 bp, Artificial Sequence
  chemically synthesized
aggctgagtggccaggcgagga

SEQ ID NO: 89391 - DNA, 22 bp, Artificial Sequence
  chemically synthesized
agtggccaggcgaggagaaacc

SEQ ID NO: 89392 - DNA, 22 bp, Artificial Sequence
  chemically synthesized
gccgtaaaacatggaaggaaca

SEQ ID NO: 89393 - DNA, 22 bp, Artificial Sequence
  chemically synthesized
caggggaaaggtggtatctcta

SEQ ID NO: 89394 - DNA, 22 bp, Artificial Sequence
  chemically synthesized
aggggaaaggtggtatctctaa

SEQ ID NO: 89395 - DNA, 22 bp, Artificial Sequence
  chemically synthesized
taagcaagagaactgagtggag

SEQ ID NO: 89396 - DNA, 22 bp, Artificial Sequence
  chemically synthesized
agcaagagaactgagtggagtc

SEQ ID NO: 89397 - DNA, 22 bp, Artificial Sequence
  chemically synthesized
agtggagtcaaggctgagagat

SEQ ID NO: 89398 - DNA, 22 bp, Artificial Sequence
  chemically synthesized
agagatgcaggataagcaaatg

SEQ ID NO: 89399 - DNA, 22 bp, Artificial Sequence
  chemically synthesized
atgaggacagctaaaacaataa

SEQ ID NO: 89400 - DNA, 22 bp, Artificial Sequence
  chemically synthesized
aaacaataagtaatgtaaaata

SEQ ID NO: 89401 - DNA, 22 bp, Artificial Sequence
  chemically synthesized
taacctccaaatcaagcctcta

SEQ ID NO: 89402 - DNA, 22 bp, Artificial Sequence
  chemically synthesized
aacctccaaatcaagcctctac

SEQ ID NO: 89403 - DNA, 22 bp, Artificial Sequence
  chemically synthesized
acctccaaatcaagcctctact

SEQ ID NO: 89404 - DNA, 22 bp, Artificial Sequence
  chemically synthesized
caaatcaagcctctacttgaat

SEQ ID NO: 89405 - DNA, 22 bp, Artificial Sequence
  chemically synthesized
tacttgaatccttttctgaggg

SEQ ID NO: 89406 - DNA, 22 bp, Artificial Sequence
  chemically synthesized
cttgaatccttttctgagggat

SEQ ID NO: 89407 - DNA, 22 bp, Artificial Sequence
  chemically synthesized
gaatccttttctgagggatgaa

SEQ ID NO: 89408 - DNA, 22 bp, Artificial Sequence
  chemically synthesized
aatccttttctgagggatgaat

SEQ ID NO: 89409 - DNA, 22 bp, Artificial Sequence
  chemically synthesized
ttctgagggatgaataaggcat

SEQ ID NO: 89410 - DNA, 22 bp, Artificial Sequence
  chemically synthesized
tctgagggatgaataaggcata

SEQ ID NO: 89411 - DNA, 22 bp, Artificial Sequence
  chemically synthesized
ctgagggatgaataaggcatat

SEQ ID NO: 89412 - DNA, 22 bp, Artificial Sequence
  chemically synthesized
tgagggatgaataaggcatatg

SEQ ID NO: 89413 - DNA, 22 bp, Artificial Sequence
  chemically synthesized
agggatgaataaggcatatgca

SEQ ID NO: 89414 - DNA, 22 bp, Artificial Sequence
  chemically synthesized
ttgccaatgtgcattagctgtt

SEQ ID NO: 89415 - DNA, 22 bp, Artificial Sequence
  chemically synthesized
ccaatgtgcattagctgtttgc

SEQ ID NO: 89416 - DNA, 22 bp, Artificial Sequence
  chemically synthesized
gctgtttgcagcctcaccttct

SEQ ID NO: 89417 - DNA, 22 bp, Artificial Sequence
  chemically synthesized
tttgcagcctcaccttctttca

SEQ ID NO: 89418 - DNA, 22 bp, Artificial Sequence
  chemically synthesized
gcagcctcaccttctttcatgg

SEQ ID NO: 89419 - DNA, 22 bp, Artificial Sequence
  chemically synthesized
cagcctcaccttctttcatgga

SEQ ID NO: 89420 - DNA, 22 bp, Artificial Sequence
  chemically synthesized
accttctttcatggagtttaag

SEQ ID NO: 89421 - DNA, 22 bp, Artificial Sequence
  chemically synthesized
ctttcatggagtttaagatata

SEQ ID NO: 89422 - DNA, 22 bp, Artificial Sequence
  chemically synthesized
tttcatggagtttaagatatag

SEQ ID NO: 89423 - DNA, 22 bp, Artificial Sequence
  chemically synthesized
tcatggagtttaagatatagtg

SEQ ID NO: 89424 - DNA, 22 bp, Artificial Sequence
  chemically synthesized
catggagtttaagatatagtgt

SEQ ID NO: 89425 - DNA, 22 bp, Artificial Sequence
  chemically synthesized
atggagtttaagatatagtgta

SEQ ID NO: 89426 - DNA, 22 bp, Artificial Sequence
  chemically synthesized
aagatatagtgtattttcccaa

SEQ ID NO: 89427 - DNA, 22 bp, Artificial Sequence
  chemically synthesized
agatatagtgtattttcccaag

SEQ ID NO: 89428 - DNA, 22 bp, Artificial Sequence
  chemically synthesized
tcccaaggtttgaactagctct

SEQ ID NO: 89429 - DNA, 22 bp, Artificial Sequence
  chemically synthesized
cccaaggtttgaactagctctt

SEQ ID NO: 89430 - DNA, 22 bp, Artificial Sequence
  chemically synthesized
ccaaggtttgaactagctcttc

SEQ ID NO: 89431 - DNA, 22 bp, Artificial Sequence
  chemically synthesized
gaactagctcttcatttcttta

SEQ ID NO: 89432 - DNA, 22 bp, Artificial Sequence
  chemically synthesized
aactagctcttcatttctttat

SEQ ID NO: 89433 - DNA, 22 bp, Artificial Sequence
  chemically synthesized
gctcttcatttctttatgtttt

SEQ ID NO: 89434 - DNA, 22 bp, Artificial Sequence
  chemically synthesized
ttcatttctttatgttttaaat

SEQ ID NO: 89435 - DNA, 22 bp, Artificial Sequence
  chemically synthesized
catttctttatgttttaaatgc

SEQ ID NO: 89436 - DNA, 22 bp, Artificial Sequence
  chemically synthesized
atttctttatgttttaaatgca

SEQ ID NO: 89437 - DNA, 22 bp, Artificial Sequence
  chemically synthesized
ctttatgttttaaatgcactga

SEQ ID NO: 89438 - DNA, 22 bp, Artificial Sequence
  chemically synthesized
tttatgttttaaatgcactgac

SEQ ID NO: 89439 - DNA, 22 bp, Artificial Sequence
  chemically synthesized
tatgttttaaatgcactgacct

SEQ ID NO: 89440 - DNA, 22 bp, Artificial Sequence
  chemically synthesized
atgttttaaatgcactgacctc

SEQ ID NO: 89441 - DNA, 22 bp, Artificial Sequence
  chemically synthesized
tgttttaaatgcactgacctcc

SEQ ID NO: 89442 - DNA, 22 bp, Artificial Sequence
  chemically synthesized
taaatgcactgacctcccacat

SEQ ID NO: 89443 - DNA, 22 bp, Artificial Sequence
  chemically synthesized
aaatgcactgacctcccacatt

SEQ ID NO: 89444 - DNA, 22 bp, Artificial Sequence
  chemically synthesized
aatgcactgacctcccacattc

SEQ ID NO: 89445 - DNA, 22 bp, Artificial Sequence
  chemically synthesized
acctcccacattccctttttag

SEQ ID NO: 89446 - DNA, 22 bp, Artificial Sequence
  chemically synthesized
ccacattccctttttagtaaaa

SEQ ID NO: 89447 - DNA, 22 bp, Artificial Sequence
  chemically synthesized
cctttttagtaaaatattcaga

SEQ ID NO: 89448 - DNA, 22 bp, Artificial Sequence
  chemically synthesized
tttagtaaaatattcagaaata

SEQ ID NO: 89449 - DNA, 22 bp, Artificial Sequence
  chemically synthesized
ttagtaaaatattcagaaataa

SEQ ID NO: 89450 - DNA, 22 bp, Artificial Sequence
  chemically synthesized
tagtaaaatattcagaaataat

SEQ ID NO: 89451 - DNA, 22 bp, Artificial Sequence
  chemically synthesized
agtaaaatattcagaaataatt

SEQ ID NO: 89452 - DNA, 22 bp, Artificial Sequence
  chemically synthesized
gtaaaatattcagaaataattt

SEQ ID NO: 89453 - DNA, 22 bp, Artificial Sequence
  chemically synthesized
agaaataatttaaatacatcat

SEQ ID NO: 89454 - DNA, 22 bp, Artificial Sequence
  chemically synthesized
aaatacatcattgcaatgaaaa

SEQ ID NO: 89455 - DNA, 22 bp, Artificial Sequence
  chemically synthesized
aatacatcattgcaatgaaaat

SEQ ID NO: 89456 - DNA, 22 bp, Artificial Sequence
  chemically synthesized
caatgaaaataaatgtttttta

SEQ ID NO: 89457 - DNA, 22 bp, Artificial Sequence
  chemically synthesized
tttattaggcagaatccagatg

SEQ ID NO: 89458 - DNA, 22 bp, Artificial Sequence
  chemically synthesized
ttattaggcagaatccagatgc

SEQ ID NO: 89459 - DNA, 22 bp, Artificial Sequence
  chemically synthesized
tattaggcagaatccagatgct

SEQ ID NO: 89460 - DNA, 22 bp, Artificial Sequence
  chemically synthesized
attaggcagaatccagatgctc

SEQ ID NO: 89461 - DNA, 22 bp, Artificial Sequence
  chemically synthesized
ttaggcagaatccagatgctca

SEQ ID NO: 89462 - DNA, 22 bp, Artificial Sequence
  chemically synthesized
ggcagaatccagatgctcaagg

SEQ ID NO: 89463 - DNA, 22 bp, Artificial Sequence
  chemically synthesized
aaggcccttcataatatccccc

SEQ ID NO: 89464 - DNA, 22 bp, Artificial Sequence
  chemically synthesized
cataatatcccccagtttagta

SEQ ID NO: 89465 - DNA, 22 bp, Artificial Sequence
  chemically synthesized
ataatatcccccagtttagtag

SEQ ID NO: 89466 - DNA, 22 bp, Artificial Sequence
  chemically synthesized
agtagttggacttagggaacaa

SEQ ID NO: 89467 - DNA, 22 bp, Artificial Sequence
  chemically synthesized
gtagttggacttagggaacaaa

SEQ ID NO: 89468 - DNA, 22 bp, Artificial Sequence
  chemically synthesized
gacttagggaacaaaggaacct

SEQ ID NO: 89469 - DNA, 22 bp, Artificial Sequence
  chemically synthesized
agggaacaaaggaacctttaat

SEQ ID NO: 89470 - DNA, 22 bp, Artificial Sequence
  chemically synthesized
gggaacaaaggaacctttaata

SEQ ID NO: 89471 - DNA, 22 bp, Artificial Sequence
  chemically synthesized
taatagaaattggacagcaaga

SEQ ID NO: 89472 - DNA, 22 bp, Artificial Sequence
  chemically synthesized
aatagaaattggacagcaagaa

SEQ ID NO: 89473 - DNA, 22 bp, Artificial Sequence
  chemically synthesized
atagaaattggacagcaagaaa

SEQ ID NO: 89474 - DNA, 22 bp, Artificial Sequence
  chemically synthesized
gacagcaagaaagcgagcttag

SEQ ID NO: 89475 - DNA, 22 bp, Artificial Sequence
  chemically synthesized
agtgatacttgtgggccagggc

SEQ ID NO: 89476 - DNA, 22 bp, Artificial Sequence
  chemically synthesized
gtgatacttgtgggccagggca

SEQ ID NO: 89477 - DNA, 22 bp, Artificial Sequence
  chemically synthesized
gtgggccagggcattagccaca

SEQ ID NO: 89478 - DNA, 22 bp, Artificial Sequence
  chemically synthesized
tgggccagggcattagccacac

SEQ ID NO: 89479 - DNA, 22 bp, Artificial Sequence
  chemically synthesized
gccacaccagccaccactttct

SEQ ID NO: 89480 - DNA, 22 bp, Artificial Sequence
  chemically synthesized
tctgataggcagcctgcactgg

SEQ ID NO: 89481 - DNA, 22 bp, Artificial Sequence
  chemically synthesized
ctgataggcagcctgcactggt

SEQ ID NO: 89482 - DNA, 22 bp, Artificial Sequence
  chemically synthesized
tgataggcagcctgcactggtg

SEQ ID NO: 89483 - DNA, 22 bp, Artificial Sequence
  chemically synthesized
ataggcagcctgcactggtggg

SEQ ID NO: 89484 - DNA, 22 bp, Artificial Sequence
  chemically synthesized
cactggtggggtgaattctttg

SEQ ID NO: 89485 - DNA, 22 bp, Artificial Sequence
  chemically synthesized
gtggggtgaattctttgccaaa

SEQ ID NO: 89486 - DNA, 22 bp, Artificial Sequence
  chemically synthesized
tttgccaaagtgatgggccagc

SEQ ID NO: 89487 - DNA, 22 bp, Artificial Sequence
  chemically synthesized
tgccaaagtgatgggccagcac

SEQ ID NO: 89488 - DNA, 22 bp, Artificial Sequence
  chemically synthesized
gccaaagtgatgggccagcaca

SEQ ID NO: 89489 - DNA, 22 bp, Artificial Sequence
  chemically synthesized
ccaaagtgatgggccagcacac

SEQ ID NO: 89490 - DNA, 22 bp, Artificial Sequence
  chemically synthesized
cccaggagctgtgggaggaaga

SEQ ID NO: 89491 - DNA, 22 bp, Artificial Sequence
  chemically synthesized
tgggaggaagataagaggtatg

SEQ ID NO: 89492 - DNA, 22 bp, Artificial Sequence
  chemically synthesized
gcaaaagggcctagcttggact

SEQ ID NO: 89493 - DNA, 22 bp, Artificial Sequence
  chemically synthesized
gcttggactcagaataatccag

SEQ ID NO: 89494 - DNA, 22 bp, Artificial Sequence
  chemically synthesized
ggactcagaataatccagcctt

SEQ ID NO: 89495 - DNA, 22 bp, Artificial Sequence
  chemically synthesized
gactcagaataatccagcctta

SEQ ID NO: 89496 - DNA, 22 bp, Artificial Sequence
  chemically synthesized
agaataatccagccttatccca

SEQ ID NO: 89497 - DNA, 22 bp, Artificial Sequence
  chemically synthesized
atcccaaccataaaataaaagc

SEQ ID NO: 89498 - DNA, 22 bp, Artificial Sequence
  chemically synthesized
tcccaaccataaaataaaagca

SEQ ID NO: 89499 - DNA, 22 bp, Artificial Sequence
  chemically synthesized
gattgtagctgctattagcaat

SEQ ID NO: 89500 - DNA, 22 bp, Artificial Sequence
  chemically synthesized
tagctgctattagcaatatgaa

SEQ ID NO: 89501 - DNA, 22 bp, Artificial Sequence
  chemically synthesized
ctattagcaatatgaaacctct

SEQ ID NO: 89502 - DNA, 22 bp, Artificial Sequence
  chemically synthesized
ttagcaatatgaaacctcttac

SEQ ID NO: 89503 - DNA, 22 bp, Artificial Sequence
  chemically synthesized
gcaatatgaaacctcttacatc

SEQ ID NO: 89504 - DNA, 22 bp, Artificial Sequence
  chemically synthesized
ttacatcagttacaatttatat

SEQ ID NO: 89505 - DNA, 22 bp, Artificial Sequence
  chemically synthesized
acatcagttacaatttatatgc

SEQ ID NO: 89506 - DNA, 22 bp, Artificial Sequence
  chemically synthesized
catcagttacaatttatatgca

SEQ ID NO: 89507 - DNA, 22 bp, Artificial Sequence
  chemically synthesized
caatttatatgcagaaatattt

SEQ ID NO: 89508 - DNA, 22 bp, Artificial Sequence
  chemically synthesized
atatgcagaaatatttatatgc

SEQ ID NO: 89509 - DNA, 22 bp, Artificial Sequence
  chemically synthesized
tatgcagaaatatttatatgca

SEQ ID NO: 89510 - DNA, 22 bp, Artificial Sequence
  chemically synthesized
atatgcagagatattgctattg

SEQ ID NO: 89511 - DNA, 22 bp, Artificial Sequence
  chemically synthesized
tatgcagagatattgctattgc

SEQ ID NO: 89512 - DNA, 22 bp, Artificial Sequence
  chemically synthesized
ctattgccttaacccagaaatt

SEQ ID NO: 89513 - DNA, 22 bp, Artificial Sequence
  chemically synthesized
ttgccttaacccagaaattatc

SEQ ID NO: 89514 - DNA, 22 bp, Artificial Sequence
  chemically synthesized
ccttaacccagaaattatcact

SEQ ID NO: 89515 - DNA, 22 bp, Artificial Sequence
  chemically synthesized
aacccagaaattatcactgtta

SEQ ID NO: 89516 - DNA, 22 bp, Artificial Sequence
  chemically synthesized
acccagaaattatcactgttat

SEQ ID NO: 89517 - DNA, 22 bp, Artificial Sequence
  chemically synthesized
tcactgttattctttagaatgg

SEQ ID NO: 89518 - DNA, 22 bp, Artificial Sequence
  chemically synthesized
ttattctttagaatggtgcaaa

SEQ ID NO: 89519 - DNA, 22 bp, Artificial Sequence
  chemically synthesized
ttctttagaatggtgcaaagag

SEQ ID NO: 89520 - DNA, 22 bp, Artificial Sequence
  chemically synthesized
tttagaatggtgcaaagaggca

SEQ ID NO: 89521 - DNA, 22 bp, Artificial Sequence
  chemically synthesized
tagaatggtgcaaagaggcatg

SEQ ID NO: 89522 - DNA, 22 bp, Artificial Sequence
  chemically synthesized
agaatggtgcaaagaggcatga

SEQ ID NO: 89523 - DNA, 22 bp, Artificial Sequence
  chemically synthesized
gaatggtgcaaagaggcatgat

SEQ ID NO: 89524 - DNA, 22 bp, Artificial Sequence
  chemically synthesized
tatcattattgccctgaaagaa

SEQ ID NO: 89525 - DNA, 22 bp, Artificial Sequence
  chemically synthesized
ttgccctgaaagaaagagatta

SEQ ID NO: 89526 - DNA, 22 bp, Artificial Sequence
  chemically synthesized
ccctgaaagaaagagattaggg

SEQ ID NO: 89527 - DNA, 22 bp, Artificial Sequence
  chemically synthesized
aaagaaagagattagggaaagt

SEQ ID NO: 89528 - DNA, 22 bp, Artificial Sequence
  chemically synthesized
gggaaagtattagaaataagat

SEQ ID NO: 89529 - DNA, 22 bp, Artificial Sequence
  chemically synthesized
gaaataagataaacaaaaaagt

SEQ ID NO: 89530 - DNA, 22 bp, Artificial Sequence
  chemically synthesized
aaagaagaaagcattttttaaa

SEQ ID NO: 89531 - DNA, 22 bp, Artificial Sequence
  chemically synthesized
tttaaaattacaaatgcaaaat

SEQ ID NO: 89532 - DNA, 22 bp, Artificial Sequence
  chemically synthesized
ttaaaattacaaatgcaaaatt

SEQ ID NO: 89533 - DNA, 22 bp, Artificial Sequence
  chemically synthesized
taaaattacaaatgcaaaatta

SEQ ID NO: 89534 - DNA, 22 bp, Artificial Sequence
  chemically synthesized
aaaattacaaatgcaaaattac

SEQ ID NO: 89535 - DNA, 22 bp, Artificial Sequence
  chemically synthesized
aaattacaaatgcaaaattacc

SEQ ID NO: 89536 - DNA, 22 bp, Artificial Sequence
  chemically synthesized
caaatgcaaaattaccctgatt

SEQ ID NO: 89537 - DNA, 22 bp, Artificial Sequence
  chemically synthesized
ccctgatttggtcaatatgtgt

SEQ ID NO: 89538 - DNA, 22 bp, Artificial Sequence
  chemically synthesized
atttggtcaatatgtgtacaca

SEQ ID NO: 89539 - DNA, 22 bp, Artificial Sequence
  chemically synthesized
ggtcaatatgtgtacacatatt

SEQ ID NO: 89540 - DNA, 22 bp, Artificial Sequence
  chemically synthesized
gtcaatatgtgtacacatatta

SEQ ID NO: 89541 - DNA, 22 bp, Artificial Sequence
  chemically synthesized
aaacattacactttaacccata

SEQ ID NO: 89542 - DNA, 22 bp, Artificial Sequence
  chemically synthesized
cactttaacccataaatatgta

SEQ ID NO: 89543 - DNA, 22 bp, Artificial Sequence
  chemically synthesized
taacccataaatatgtataatg

SEQ ID NO: 89544 - DNA, 22 bp, Artificial Sequence
  chemically synthesized
aacccataaatatgtataatga

SEQ ID NO: 89545 - DNA, 22 bp, Artificial Sequence
  chemically synthesized
acccataaatatgtataatgat

SEQ ID NO: 89546 - DNA, 22 bp, Artificial Sequence
  chemically synthesized
tgtatcaattaaaaataaaaga

SEQ ID NO: 89547 - DNA, 22 bp, Artificial Sequence
  chemically synthesized
aaaataaaagaaaataaagtag

SEQ ID NO: 89548 - DNA, 22 bp, Artificial Sequence
  chemically synthesized
tgaatatgcaaataagcacaca

SEQ ID NO: 89549 - DNA, 22 bp, Artificial Sequence
  chemically synthesized
caaatagtaatgtactaggcag

SEQ ID NO: 89550 - DNA, 22 bp, Artificial Sequence
  chemically synthesized
ggcagactgtgtaaagtttttt

SEQ ID NO: 89551 - DNA, 22 bp, Artificial Sequence
  chemically synthesized
tgtaaagtttttttttaagtta

SEQ ID NO: 89552 - DNA, 22 bp, Artificial Sequence
  chemically synthesized
ttttttaagttacttaatgtat

SEQ ID NO: 89553 - DNA, 22 bp, Artificial Sequence
  chemically synthesized
tttttaagttacttaatgtatc

SEQ ID NO: 89554 - DNA, 22 bp, Artificial Sequence
  chemically synthesized
ttttaagttacttaatgtatct

SEQ ID NO: 89555 - DNA, 22 bp, Artificial Sequence
  chemically synthesized
tttaagttacttaatgtatctc

SEQ ID NO: 89556 - DNA, 22 bp, Artificial Sequence
  chemically synthesized
ttaagttacttaatgtatctca

SEQ ID NO: 89557 - DNA, 22 bp, Artificial Sequence
  chemically synthesized
taagttacttaatgtatctcag

SEQ ID NO: 89558 - DNA, 22 bp, Artificial Sequence
  chemically synthesized
aagttacttaatgtatctcaga

SEQ ID NO: 89559 - DNA, 22 bp, Artificial Sequence
  chemically synthesized
agttacttaatgtatctcagag

SEQ ID NO: 89560 - DNA, 22 bp, Artificial Sequence
  chemically synthesized
cttaatgtatctcagagatatt

SEQ ID NO: 89561 - DNA, 22 bp, Artificial Sequence
  chemically synthesized
aatgtatctcagagatatttcc

SEQ ID NO: 89562 - DNA, 22 bp, Artificial Sequence
  chemically synthesized
atgtatctcagagatatttcct

SEQ ID NO: 89563 - DNA, 22 bp, Artificial Sequence
  chemically synthesized
agagatatttccttttgttata

SEQ ID NO: 89564 - DNA, 22 bp, Artificial Sequence
  chemically synthesized
ccttttgttatacacaatgtta

SEQ ID NO: 89565 - DNA, 22 bp, Artificial Sequence
  chemically synthesized
cttttgttatacacaatgttaa

SEQ ID NO: 89566 - DNA, 22 bp, Artificial Sequence
  chemically synthesized
ttgttatacacaatgttaaggc

SEQ ID NO: 89567 - DNA, 22 bp, Artificial Sequence
  chemically synthesized
tgttatacacaatgttaaggca

SEQ ID NO: 89568 - DNA, 22 bp, Artificial Sequence
  chemically synthesized
gttatacacaatgttaaggcat

SEQ ID NO: 89569 - DNA, 22 bp, Artificial Sequence
  chemically synthesized
ttatacacaatgttaaggcatt

SEQ ID NO: 89570 - DNA, 22 bp, Artificial Sequence
  chemically synthesized
tacacaatgttaaggcattaag

SEQ ID NO: 89571 - DNA, 22 bp, Artificial Sequence
  chemically synthesized
aggcattaagtataatagtaaa

SEQ ID NO: 89572 - DNA, 22 bp, Artificial Sequence
  chemically synthesized
agtataatagtaaaaattgcgg

SEQ ID NO: 89573 - DNA, 22 bp, Artificial Sequence
  chemically synthesized
cggagaagaaaaaaaaagaaag

SEQ ID NO: 89574 - DNA, 22 bp, Artificial Sequence
  chemically synthesized
aacaaaagaaaacaattgttat

SEQ ID NO: 89575 - DNA, 22 bp, Artificial Sequence
  chemically synthesized
ttatgaacagcaaataaaagaa

SEQ ID NO: 89576 - DNA, 22 bp, Artificial Sequence
  chemically synthesized
tgaacagcaaataaaagaaact

SEQ ID NO: 89577 - DNA, 22 bp, Artificial Sequence
  chemically synthesized
aaacgatcctgagacttccaca

SEQ ID NO: 89578 - DNA, 22 bp, Artificial Sequence
  chemically synthesized
agacttccacactgatgcaatc

SEQ ID NO: 89579 - DNA, 22 bp, Artificial Sequence
  chemically synthesized
ccacactgatgcaatcattcgt

SEQ ID NO: 89580 - DNA, 22 bp, Artificial Sequence
  chemically synthesized
cacactgatgcaatcattcgtc

SEQ ID NO: 89581 - DNA, 22 bp, Artificial Sequence
  chemically synthesized
atgcaatcattcgtctgtttcc

SEQ ID NO: 89582 - DNA, 22 bp, Artificial Sequence
  chemically synthesized
gtctgtttcccattctaaactg

SEQ ID NO: 89583 - DNA, 22 bp, Artificial Sequence
  chemically synthesized
tttcccattctaaactgtaccc

SEQ ID NO: 89584 - DNA, 22 bp, Artificial Sequence
  chemically synthesized
cccattctaaactgtaccctgt

SEQ ID NO: 89585 - DNA, 22 bp, Artificial Sequence
  chemically synthesized
ccattctaaactgtaccctgtt

SEQ ID NO: 89586 - DNA, 22 bp, Artificial Sequence
  chemically synthesized
taaactgtaccctgttacttat

SEQ ID NO: 89587 - DNA, 22 bp, Artificial Sequence
  chemically synthesized
aactgtaccctgttacttatcc

SEQ ID NO: 89588 - DNA, 22 bp, Artificial Sequence
  chemically synthesized
taccctgttacttatccccttc

SEQ ID NO: 89589 - DNA, 22 bp, Artificial Sequence
  chemically synthesized
ttacttatccccttcctatgac

SEQ ID NO: 89590 - DNA, 22 bp, Artificial Sequence
  chemically synthesized
cttatccccttcctatgacatg

SEQ ID NO: 89591 - DNA, 22 bp, Artificial Sequence
  chemically synthesized
atccccttcctatgacatgaac

SEQ ID NO: 89592 - DNA, 22 bp, Artificial Sequence
  chemically synthesized
tccccttcctatgacatgaact

SEQ ID NO: 89593 - DNA, 22 bp, Artificial Sequence
  chemically synthesized
cctatgacatgaacttaaccat

SEQ ID NO: 89594 - DNA, 22 bp, Artificial Sequence
  chemically synthesized
ctatgacatgaacttaaccata

SEQ ID NO: 89595 - DNA, 22 bp, Artificial Sequence
  chemically synthesized
tgacatgaacttaaccatagaa

SEQ ID NO: 89596 - DNA, 22 bp, Artificial Sequence
  chemically synthesized
aaccatagaaaagaaggggaaa

SEQ ID NO: 89597 - DNA, 22 bp, Artificial Sequence
  chemically synthesized
accatagaaaagaaggggaaag

SEQ ID NO: 89598 - DNA, 22 bp, Artificial Sequence
  chemically synthesized
accctgaagttctcaggatcca

SEQ ID NO: 89599 - DNA, 22 bp, Artificial Sequence
  chemically synthesized
aagttctcaggatccacgtgca

SEQ ID NO: 89600 - DNA, 22 bp, Artificial Sequence
  chemically synthesized
tcaggatccacgtgcagcttgt

SEQ ID NO: 89601 - DNA, 22 bp, Artificial Sequence
  chemically synthesized
aggatccacgtgcagcttgtca

SEQ ID NO: 89602 - DNA, 22 bp, Artificial Sequence
  chemically synthesized
gtcacagtgcagctcactcagt

SEQ ID NO: 89603 - DNA, 22 bp, Artificial Sequence
  chemically synthesized
tcacagtgcagctcactcagtg

SEQ ID NO: 89604 - DNA, 22 bp, Artificial Sequence
  chemically synthesized
actcagtgtggcaaaggtgccc

SEQ ID NO: 89605 - DNA, 22 bp, Artificial Sequence
  chemically synthesized
agtgtggcaaaggtgcccttga

SEQ ID NO: 89606 - DNA, 22 bp, Artificial Sequence
  chemically synthesized
gaggttgtccaggtgagccagg

SEQ ID NO: 89607 - DNA, 22 bp, Artificial Sequence
  chemically synthesized
aggttgtccaggtgagccaggc

SEQ ID NO: 89608 - DNA, 22 bp, Artificial Sequence
  chemically synthesized
tccaggtgagccaggccatcac

SEQ ID NO: 89609 - DNA, 22 bp, Artificial Sequence
  chemically synthesized
aaggcaccgagcactttcttgc

SEQ ID NO: 89610 - DNA, 22 bp, Artificial Sequence
  chemically synthesized
tcttgccatgagccttcacctt

SEQ ID NO: 89611 - DNA, 22 bp, Artificial Sequence
  chemically synthesized
cttgccatgagccttcacctta

SEQ ID NO: 89612 - DNA, 22 bp, Artificial Sequence
  chemically synthesized
ttgccatgagccttcaccttag

SEQ ID NO: 89613 - DNA, 22 bp, Artificial Sequence
  chemically synthesized
gccatgagccttcaccttaggg

SEQ ID NO: 89614 - DNA, 22 bp, Artificial Sequence
  chemically synthesized
ccatgagccttcaccttagggt

SEQ ID NO: 89615 - DNA, 22 bp, Artificial Sequence
  chemically synthesized
caccttagggttgcccataaca

SEQ ID NO: 89616 - DNA, 22 bp, Artificial Sequence
  chemically synthesized
accttagggttgcccataacag

SEQ ID NO: 89617 - DNA, 22 bp, Artificial Sequence
  chemically synthesized
agggttgcccataacagcatca

SEQ ID NO: 89618 - DNA, 22 bp, Artificial Sequence
  chemically synthesized
gggttgcccataacagcatcag

SEQ ID NO: 89619 - DNA, 22 bp, Artificial Sequence
  chemically synthesized
cccataacagcatcaggagtgg

SEQ ID NO: 89620 - DNA, 22 bp, Artificial Sequence
  chemically synthesized
aaagaacctctgggtccaaggg

SEQ ID NO: 89621 - DNA, 22 bp, Artificial Sequence
  chemically synthesized
tgggtccaagggtagaccacca

SEQ ID NO: 89622 - DNA, 22 bp, Artificial Sequence
  chemically synthesized
ggtccaagggtagaccaccagc

SEQ ID NO: 89623 - DNA, 22 bp, Artificial Sequence
  chemically synthesized
agggtgggaaaatagaccaata

SEQ ID NO: 89624 - DNA, 22 bp, Artificial Sequence
  chemically synthesized
tcagaaacccaagagtcttctc

SEQ ID NO: 89625 - DNA, 22 bp, Artificial Sequence
  chemically synthesized
ctctgtctccacatgcccagtt

SEQ ID NO: 89626 - DNA, 22 bp, Artificial Sequence
  chemically synthesized
tctgtctccacatgcccagttt

SEQ ID NO: 89627 - DNA, 22 bp, Artificial Sequence
  chemically synthesized
tgtctccacatgcccagtttct

SEQ ID NO: 89628 - DNA, 22 bp, Artificial Sequence
  chemically synthesized
tctccacatgcccagtttctat

SEQ ID NO: 89629 - DNA, 22 bp, Artificial Sequence
  chemically synthesized
cacatgcccagtttctattggt

SEQ ID NO: 89630 - DNA, 22 bp, Artificial Sequence
  chemically synthesized
ctattggtctccttaaacctgt

SEQ ID NO: 89631 - DNA, 22 bp, Artificial Sequence
  chemically synthesized
tattggtctccttaaacctgtc

SEQ ID NO: 89632 - DNA, 22 bp, Artificial Sequence
  chemically synthesized
ttggtctccttaaacctgtctt

SEQ ID NO: 89633 - DNA, 22 bp, Artificial Sequence
  chemically synthesized
gtctccttaaacctgtcttgta

SEQ ID NO: 89634 - DNA, 22 bp, Artificial Sequence
  chemically synthesized
cttaaacctgtcttgtaacctt

SEQ ID NO: 89635 - DNA, 22 bp, Artificial Sequence
  chemically synthesized
aaacctgtcttgtaaccttgat

SEQ ID NO: 89636 - DNA, 22 bp, Artificial Sequence
  chemically synthesized
aacctgtcttgtaaccttgata

SEQ ID NO: 89637 - DNA, 22 bp, Artificial Sequence
  chemically synthesized
tcttgtaaccttgataccaacc

SEQ ID NO: 89638 - DNA, 22 bp, Artificial Sequence
  chemically synthesized
gtaaccttgataccaacctgcc

SEQ ID NO: 89639 - DNA, 22 bp, Artificial Sequence
  chemically synthesized
taaccttgataccaacctgccc

SEQ ID NO: 89640 - DNA, 22 bp, Artificial Sequence
  chemically synthesized
gataccaacctgcccagggcct

SEQ ID NO: 89641 - DNA, 22 bp, Artificial Sequence
  chemically synthesized
ataccaacctgcccagggcctc

SEQ ID NO: 89642 - DNA, 22 bp, Artificial Sequence
  chemically synthesized
cccagggcctcaccaccaactt

SEQ ID NO: 89643 - DNA, 22 bp, Artificial Sequence
  chemically synthesized
accaccaacttcatccacgttc

SEQ ID NO: 89644 - DNA, 22 bp, Artificial Sequence
  chemically synthesized
catccacgttcaccttgcccca

SEQ ID NO: 89645 - DNA, 22 bp, Artificial Sequence
  chemically synthesized
atccacgttcaccttgccccac

SEQ ID NO: 89646 - DNA, 22 bp, Artificial Sequence
  chemically synthesized
accttgccccacagggcagtaa

SEQ ID NO: 89647 - DNA, 22 bp, Artificial Sequence
  chemically synthesized
gccccacagggcagtaacggca

SEQ ID NO: 89648 - DNA, 22 bp, Artificial Sequence
  chemically synthesized
ccccacagggcagtaacggcag

SEQ ID NO: 89649 - DNA, 22 bp, Artificial Sequence
  chemically synthesized
ctcctcaggagtcagatgcacc

SEQ ID NO: 89650 - DNA, 22 bp, Artificial Sequence
  chemically synthesized
tcctcaggagtcagatgcacca

SEQ ID NO: 89651 - DNA, 22 bp, Artificial Sequence
  chemically synthesized
ctcaggagtcagatgcaccatg

SEQ ID NO: 89652 - DNA, 22 bp, Artificial Sequence
  chemically synthesized
aggagtcagatgcaccatggtg

SEQ ID NO: 89653 - DNA, 22 bp, Artificial Sequence
  chemically synthesized
tttgaggttgctagtgaacaca

SEQ ID NO: 89654 - DNA, 22 bp, Artificial Sequence
  chemically synthesized
gaggttgctagtgaacacagtt

SEQ ID NO: 89655 - DNA, 22 bp, Artificial Sequence
  chemically synthesized
aggttgctagtgaacacagttg

SEQ ID NO: 89656 - DNA, 22 bp, Artificial Sequence
  chemically synthesized
ctagtgaacacagttgtgtcag

SEQ ID NO: 89657 - DNA, 22 bp, Artificial Sequence
  chemically synthesized
gtgaacacagttgtgtcagaag

SEQ ID NO: 89658 - DNA, 22 bp, Artificial Sequence
  chemically synthesized
tgtcagaagcaaatgtaagcaa

SEQ ID NO: 89659 - DNA, 22 bp, Artificial Sequence
  chemically synthesized
tgccctgacttttatgcccagc

SEQ ID NO: 89660 - DNA, 22 bp, Artificial Sequence
  chemically synthesized
ccctgacttttatgcccagccc

SEQ ID NO: 89661 - DNA, 22 bp, Artificial Sequence
  chemically synthesized
acttttatgcccagccctggct

SEQ ID NO: 89662 - DNA, 22 bp, Artificial Sequence
  chemically synthesized
ttatgcccagccctggctcctg

SEQ ID NO: 89663 - DNA, 22 bp, Artificial Sequence
  chemically synthesized
tatgcccagccctggctcctgc

SEQ ID NO: 89664 - DNA, 22 bp, Artificial Sequence
  chemically synthesized
atgcccagccctggctcctgcc

SEQ ID NO: 89665 - DNA, 22 bp, Artificial Sequence
  chemically synthesized
tgcccagccctggctcctgccc

SEQ ID NO: 89666 - DNA, 22 bp, Artificial Sequence
  chemically synthesized
gctcctgccctccctgctcctg

SEQ ID NO: 89667 - DNA, 22 bp, Artificial Sequence
  chemically synthesized
ctgccctccctgctcctgggag

SEQ ID NO: 89668 - DNA, 22 bp, Artificial Sequence
  chemically synthesized
ccctccctgctcctgggagtag

SEQ ID NO: 89669 - DNA, 22 bp, Artificial Sequence
  chemically synthesized
cctgctcctgggagtagattgg

SEQ ID NO: 89670 - DNA, 22 bp, Artificial Sequence
  chemically synthesized
ctcctgggagtagattggccaa

SEQ ID NO: 89671 - DNA, 22 bp, Artificial Sequence
  chemically synthesized
ctgggagtagattggccaaccc

SEQ ID NO: 89672 - DNA, 22 bp, Artificial Sequence
  chemically synthesized
ggagtagattggccaaccctag

SEQ ID NO: 89673 - DNA, 22 bp, Artificial Sequence
  chemically synthesized
gccaaccctagggtgtggctcc

SEQ ID NO: 89674 - DNA, 22 bp, Artificial Sequence
  chemically synthesized
gggtgtggctccacagggtgag

SEQ ID NO: 89675 - DNA, 22 bp, Artificial Sequence
  chemically synthesized
cacagggtgaggtctaagtgat

SEQ ID NO: 89676 - DNA, 22 bp, Artificial Sequence
  chemically synthesized
agtgatgacagccgtacctgtc

SEQ ID NO: 89677 - DNA, 22 bp, Artificial Sequence
  chemically synthesized
tccttggctcttctggcactgg

SEQ ID NO: 89678 - DNA, 22 bp, Artificial Sequence
  chemically synthesized
ggctcttctggcactggcttag

SEQ ID NO: 89679 - DNA, 22 bp, Artificial Sequence
  chemically synthesized
gctcttctggcactggcttagg

SEQ ID NO: 89680 - DNA, 22 bp, Artificial Sequence
  chemically synthesized
ttctggcactggcttaggagtt

SEQ ID NO: 89681 - DNA, 22 bp, Artificial Sequence
  chemically synthesized
ctggcactggcttaggagttgg

SEQ ID NO: 89682 - DNA, 22 bp, Artificial Sequence
  chemically synthesized
tggcactggcttaggagttgga

SEQ ID NO: 89683 - DNA, 22 bp, Artificial Sequence
  chemically synthesized
gcactggcttaggagttggact

SEQ ID NO: 89684 - DNA, 22 bp, Artificial Sequence
  chemically synthesized
gcttaggagttggacttcaaac

SEQ ID NO: 89685 - DNA, 22 bp, Artificial Sequence
  chemically synthesized
aggagttggacttcaaaccctc

SEQ ID NO: 89686 - DNA, 22 bp, Artificial Sequence
  chemically synthesized
ggagttggacttcaaaccctca

SEQ ID NO: 89687 - DNA, 22 bp, Artificial Sequence
  chemically synthesized
gacttcaaaccctcagccctcc

SEQ ID NO: 89688 - DNA, 22 bp, Artificial Sequence
  chemically synthesized
caaaccctcagccctccctcta

SEQ ID NO: 89689 - DNA, 22 bp, Artificial Sequence
  chemically synthesized
aaaccctcagccctccctctaa

SEQ ID NO: 89690 - DNA, 22 bp, Artificial Sequence
  chemically synthesized
agccctccctctaagatatatc

SEQ ID NO: 89691 - DNA, 22 bp, Artificial Sequence
  chemically synthesized
cctctaagatatatctcttggc

SEQ ID NO: 89692 - DNA, 22 bp, Artificial Sequence
  chemically synthesized
taagatatatctcttggcccca

SEQ ID NO: 89693 - DNA, 22 bp, Artificial Sequence
  chemically synthesized
agatatatctcttggccccata

SEQ ID NO: 89694 - DNA, 22 bp, Artificial Sequence
  chemically synthesized
ttggccccataccatcagtaca

SEQ ID NO: 89695 - DNA, 22 bp, Artificial Sequence
  chemically synthesized
ggccccataccatcagtacaaa

SEQ ID NO: 89696 - DNA, 22 bp, Artificial Sequence
  chemically synthesized
gccccataccatcagtacaaat

SEQ ID NO: 89697 - DNA, 22 bp, Artificial Sequence
  chemically synthesized
ctactaaaaacatcctcctttg

SEQ ID NO: 89698 - DNA, 22 bp, Artificial Sequence
  chemically synthesized
ctaaaaacatcctcctttgcaa

SEQ ID NO: 89699 - DNA, 22 bp, Artificial Sequence
  chemically synthesized
aaaacatcctcctttgcaagtg

SEQ ID NO: 89700 - DNA, 22 bp, Artificial Sequence
  chemically synthesized
ctttgcaagtgtatttacgtaa

SEQ ID NO: 89701 - DNA, 22 bp, Artificial Sequence
  chemically synthesized
tgcaagtgtatttacgtaatat

SEQ ID NO: 89702 - DNA, 22 bp, Artificial Sequence
  chemically synthesized
gcaagtgtatttacgtaatatt

SEQ ID NO: 89703 - DNA, 22 bp, Artificial Sequence
  chemically synthesized
caagtgtatttacgtaatattt

SEQ ID NO: 89704 - DNA, 22 bp, Artificial Sequence
  chemically synthesized
acgtaatatttggaatcacagc

SEQ ID NO: 89705 - DNA, 22 bp, Artificial Sequence
  chemically synthesized
cgtaatatttggaatcacagct

SEQ ID NO: 89706 - DNA, 22 bp, Artificial Sequence
  chemically synthesized
ggaatcacagcttggtaagcat

SEQ ID NO: 89707 - DNA, 22 bp, Artificial Sequence
  chemically synthesized
gaatcacagcttggtaagcata

SEQ ID NO: 89708 - DNA, 22 bp, Artificial Sequence
  chemically synthesized
ggtaagcatattgaagatcgtt

SEQ ID NO: 89709 - DNA, 22 bp, Artificial Sequence
  chemically synthesized
gtaagcatattgaagatcgttt

SEQ ID NO: 89710 - DNA, 22 bp, Artificial Sequence
  chemically synthesized
aagatcgttttcccaattttct

SEQ ID NO: 89711 - DNA, 22 bp, Artificial Sequence
  chemically synthesized
tcccaattttcttattacacaa

SEQ ID NO: 89712 - DNA, 22 bp, Artificial Sequence
  chemically synthesized
cccaattttcttattacacaaa

SEQ ID NO: 89713 - DNA, 22 bp, Artificial Sequence
  chemically synthesized
ccaattttcttattacacaaat

SEQ ID NO: 89714 - DNA, 22 bp, Artificial Sequence
  chemically synthesized
tcttattacacaaataagaagt

SEQ ID NO: 89715 - DNA, 22 bp, Artificial Sequence
  chemically synthesized
cttattacacaaataagaagtt

SEQ ID NO: 89716 - DNA, 22 bp, Artificial Sequence
  chemically synthesized
ttattacacaaataagaagttg

SEQ ID NO: 89717 - DNA, 22 bp, Artificial Sequence
  chemically synthesized
attacacaaataagaagttgat

SEQ ID NO: 89718 - DNA, 22 bp, Artificial Sequence
  chemically synthesized
ttacacaaataagaagttgatg

SEQ ID NO: 89719 - DNA, 22 bp, Artificial Sequence
  chemically synthesized
cacaaataagaagttgatgcac

SEQ ID NO: 89720 - DNA, 22 bp, Artificial Sequence
  chemically synthesized
atgcactaaaagtggaagagtt

SEQ ID NO: 89721 - DNA, 22 bp, Artificial Sequence
  chemically synthesized
aaagtggaagagttttgtctac

SEQ ID NO: 89722 - DNA, 22 bp, Artificial Sequence
  chemically synthesized
tgtctaccataattcagctttg

SEQ ID NO: 89723 - DNA, 22 bp, Artificial Sequence
  chemically synthesized
gtctaccataattcagctttgg

SEQ ID NO: 89724 - DNA, 22 bp, Artificial Sequence
  chemically synthesized
tctaccataattcagctttggg

SEQ ID NO: 89725 - DNA, 22 bp, Artificial Sequence
  chemically synthesized
ccataattcagctttgggatat

SEQ ID NO: 89726 - DNA, 22 bp, Artificial Sequence
  chemically synthesized
agctttgggatatgtagatgga

SEQ ID NO: 89727 - DNA, 22 bp, Artificial Sequence
  chemically synthesized
tgggatatgtagatggatctct

SEQ ID NO: 89728 - DNA, 22 bp, Artificial Sequence
  chemically synthesized
gggatatgtagatggatctctt

SEQ ID NO: 89729 - DNA, 22 bp, Artificial Sequence
  chemically synthesized
ggatatgtagatggatctcttc

SEQ ID NO: 89730 - DNA, 22 bp, Artificial Sequence
  chemically synthesized
ttcctgcgtctccagaatatgc

SEQ ID NO: 89731 - DNA, 22 bp, Artificial Sequence
  chemically synthesized
cctgcgtctccagaatatgcaa

SEQ ID NO: 89732 - DNA, 22 bp, Artificial Sequence
  chemically synthesized
ctgcgtctccagaatatgcaaa

SEQ ID NO: 89733 - DNA, 22 bp, Artificial Sequence
  chemically synthesized
cgtctccagaatatgcaaaata

SEQ ID NO: 89734 - DNA, 22 bp, Artificial Sequence
  chemically synthesized
cagaatatgcaaaatacttaca

SEQ ID NO: 89735 - DNA, 22 bp, Artificial Sequence
  chemically synthesized
acaggacagaatggatgaaaac

SEQ ID NO: 89736 - DNA, 22 bp, Artificial Sequence
  chemically synthesized
caggacagaatggatgaaaact

SEQ ID NO: 89737 - DNA, 22 bp, Artificial Sequence
  chemically synthesized
tacctcggttctaagcatatct

SEQ ID NO: 89738 - DNA, 22 bp, Artificial Sequence
  chemically synthesized
cctcggttctaagcatatcttc

SEQ ID NO: 89739 - DNA, 22 bp, Artificial Sequence
  chemically synthesized
ggttctaagcatatcttctcct

SEQ ID NO: 89740 - DNA, 22 bp, Artificial Sequence
  chemically synthesized
taagcatatcttctccttattt

SEQ ID NO: 89741 - DNA, 22 bp, Artificial Sequence
  chemically synthesized
agcatatcttctccttatttgg

SEQ ID NO: 89742 - DNA, 22 bp, Artificial Sequence
  chemically synthesized
ctccttatttggattaaaacct

SEQ ID NO: 89743 - DNA, 22 bp, Artificial Sequence
  chemically synthesized
tccttatttggattaaaacctt

SEQ ID NO: 89744 - DNA, 22 bp, Artificial Sequence
  chemically synthesized
cttatttggattaaaaccttct

SEQ ID NO: 89745 - DNA, 22 bp, Artificial Sequence
  chemically synthesized
atttggattaaaaccttctggt

SEQ ID NO: 89746 - DNA, 22 bp, Artificial Sequence
  chemically synthesized
tttggattaaaaccttctggta

SEQ ID NO: 89747 - DNA, 22 bp, Artificial Sequence
  chemically synthesized
ggattaaaaccttctggtaaga

SEQ ID NO: 89748 - DNA, 22 bp, Artificial Sequence
  chemically synthesized
gattaaaaccttctggtaagaa

SEQ ID NO: 89749 - DNA, 22 bp, Artificial Sequence
  chemically synthesized
aaaccttctggtaagaaaagaa

SEQ ID NO: 89750 - DNA, 22 bp, Artificial Sequence
  chemically synthesized
ctggtaagaaaagaaaaaatat

SEQ ID NO: 89751 - DNA, 22 bp, Artificial Sequence
  chemically synthesized
tggtaagaaaagaaaaaatata

SEQ ID NO: 89752 - DNA, 22 bp, Artificial Sequence
  chemically synthesized
gtaagaaaagaaaaaatatata

SEQ ID NO: 89753 - DNA, 22 bp, Artificial Sequence
  chemically synthesized
atttgttgttgtttttcttaat

SEQ ID NO: 89754 - DNA, 22 bp, Artificial Sequence
  chemically synthesized
gttgttgtttttcttaatttgc

SEQ ID NO: 89755 - DNA, 22 bp, Artificial Sequence
  chemically synthesized
ttgttgtttttcttaatttgct

SEQ ID NO: 89756 - DNA, 22 bp, Artificial Sequence
  chemically synthesized
ttgtttttcttaatttgctcat

SEQ ID NO: 89757 - DNA, 22 bp, Artificial Sequence
  chemically synthesized
tttttcttaatttgctcatgca

SEQ ID NO: 89758 - DNA, 22 bp, Artificial Sequence
  chemically synthesized
ttcttaatttgctcatgcatgc

SEQ ID NO: 89759 - DNA, 22 bp, Artificial Sequence
  chemically synthesized
tcttaatttgctcatgcatgct

SEQ ID NO: 89760 - DNA, 22 bp, Artificial Sequence
  chemically synthesized
cttaatttgctcatgcatgcta

SEQ ID NO: 89761 - DNA, 22 bp, Artificial Sequence
  chemically synthesized
ttaatttgctcatgcatgctaa

SEQ ID NO: 89762 - DNA, 22 bp, Artificial Sequence
  chemically synthesized
aatttgctcatgcatgctaata

SEQ ID NO: 89763 - DNA, 22 bp, Artificial Sequence
  chemically synthesized
atttgctcatgcatgctaataa

SEQ ID NO: 89764 - DNA, 22 bp, Artificial Sequence
  chemically synthesized
gctcatgcatgctaataaatta

SEQ ID NO: 89765 - DNA, 22 bp, Artificial Sequence
  chemically synthesized
ctcatgcatgctaataaattat

SEQ ID NO: 89766 - DNA, 22 bp, Artificial Sequence
  chemically synthesized
atgcatgctaataaattatgtc

SEQ ID NO: 89767 - DNA, 22 bp, Artificial Sequence
  chemically synthesized
ataaattatgtctaaaaataga

SEQ ID NO: 89768 - DNA, 22 bp, Artificial Sequence
  chemically synthesized
tgtctaaaaatagaataaatac

SEQ ID NO: 89769 - DNA, 22 bp, Artificial Sequence
  chemically synthesized
aaaatagaataaatacaaatca

SEQ ID NO: 89770 - DNA, 22 bp, Artificial Sequence
  chemically synthesized
tgtgcattagttacttattagg

SEQ ID NO: 89771 - DNA, 22 bp, Artificial Sequence
  chemically synthesized
tgcattagttacttattaggtt

SEQ ID NO: 89772 - DNA, 22 bp, Artificial Sequence
  chemically synthesized
gttacttattaggttttgggaa

SEQ ID NO: 89773 - DNA, 22 bp, Artificial Sequence
  chemically synthesized
cttattaggttttgggaaacaa

SEQ ID NO: 89774 - DNA, 22 bp, Artificial Sequence
  chemically synthesized
attaggttttgggaaacaagag

SEQ ID NO: 89775 - DNA, 22 bp, Artificial Sequence
  chemically synthesized
ttaggttttgggaaacaagaga

SEQ ID NO: 89776 - DNA, 22 bp, Artificial Sequence
  chemically synthesized
ggttttgggaaacaagagataa

SEQ ID NO: 89777 - DNA, 22 bp, Artificial Sequence
  chemically synthesized
tgggaaacaagagataaaaaac

SEQ ID NO: 89778 - DNA, 22 bp, Artificial Sequence
  chemically synthesized
gggaaacaagagataaaaaact

SEQ ID NO: 89779 - DNA, 22 bp, Artificial Sequence
  chemically synthesized
ggaaacaagagataaaaaacta

SEQ ID NO: 89780 - DNA, 22 bp, Artificial Sequence
  chemically synthesized
gagacctcttaatgcagtcaaa

SEQ ID NO: 89781 - DNA, 22 bp, Artificial Sequence
  chemically synthesized
ttaatgcagtcaaaaatacaaa

SEQ ID NO: 89782 - DNA, 22 bp, Artificial Sequence
  chemically synthesized
aatgcagtcaaaaatacaaata

SEQ ID NO: 89783 - DNA, 22 bp, Artificial Sequence
  chemically synthesized
atgcagtcaaaaatacaaataa

SEQ ID NO: 89784 - DNA, 22 bp, Artificial Sequence
  chemically synthesized
acaacccaaagtgtgactatca

SEQ ID NO: 89785 - DNA, 22 bp, Artificial Sequence
  chemically synthesized
caacccaaagtgtgactatcaa

SEQ ID NO: 89786 - DNA, 22 bp, Artificial Sequence
  chemically synthesized
tcaatggggtaatcagtggtgt

SEQ ID NO: 89787 - DNA, 22 bp, Artificial Sequence
  chemically synthesized
actggggacatctaactgtttc

SEQ ID NO: 89788 - DNA, 22 bp, Artificial Sequence
  chemically synthesized
gggacatctaactgtttctgcc

SEQ ID NO: 89789 - DNA, 22 bp, Artificial Sequence
  chemically synthesized
actgtttctgcctggactaatc

SEQ ID NO: 89790 - DNA, 22 bp, Artificial Sequence
  chemically synthesized
tttctgcctggactaatctgca

SEQ ID NO: 89791 - DNA, 22 bp, Artificial Sequence
  chemically synthesized
ctgcctggactaatctgcaaga

SEQ ID NO: 89792 - DNA, 22 bp, Artificial Sequence
  chemically synthesized
tgcctggactaatctgcaagag

SEQ ID NO: 89793 - DNA, 22 bp, Artificial Sequence
  chemically synthesized
cctggactaatctgcaagagtg

SEQ ID NO: 89794 - DNA, 22 bp, Artificial Sequence
  chemically synthesized
gactaatctgcaagagtgtctg

SEQ ID NO: 89795 - DNA, 22 bp, Artificial Sequence
  chemically synthesized
atctgcaagagtgtctggggga

SEQ ID NO: 89796 - DNA, 22 bp, Artificial Sequence
  chemically synthesized
caagagtgtctgggggaacaaa

SEQ ID NO: 89797 - DNA, 22 bp, Artificial Sequence
  chemically synthesized
ggggaacaaaaagcctctgtga

SEQ ID NO: 89798 - DNA, 22 bp, Artificial Sequence
  chemically synthesized
tgtgacttagaaagtaggggta

SEQ ID NO: 89799 - DNA, 22 bp, Artificial Sequence
  chemically synthesized
tgacttagaaagtaggggtagg

SEQ ID NO: 89800 - DNA, 22 bp, Artificial Sequence
  chemically synthesized
agaaagtaggggtaggagggga

SEQ ID NO: 89801 - DNA, 22 bp, Artificial Sequence
  chemically synthesized
gaaagtaggggtaggaggggaa

SEQ ID NO: 89802 - DNA, 22 bp, Artificial Sequence
  chemically synthesized
ctacttggctcagattattttt

SEQ ID NO: 89803 - DNA, 22 bp, Artificial Sequence
  chemically synthesized
tacttggctcagattatttttt

SEQ ID NO: 89804 - DNA, 22 bp, Artificial Sequence
  chemically synthesized
cttggctcagattatttttttc

SEQ ID NO: 89805 - DNA, 22 bp, Artificial Sequence
  chemically synthesized
ggctcagattatttttttcctc

SEQ ID NO: 89806 - DNA, 22 bp, Artificial Sequence
  chemically synthesized
gctcagattatttttttcctct

SEQ ID NO: 89807 - DNA, 22 bp, Artificial Sequence
  chemically synthesized
agattatttttttcctctagtc

SEQ ID NO: 89808 - DNA, 22 bp, Artificial Sequence
  chemically synthesized
tttttttcctctagtccactaa

SEQ ID NO: 89809 - DNA, 22 bp, Artificial Sequence
  chemically synthesized
ttttcctctagtccactaagaa

SEQ ID NO: 89810 - DNA, 22 bp, Artificial Sequence
  chemically synthesized
tttcctctagtccactaagaat

SEQ ID NO: 89811 - DNA, 22 bp, Artificial Sequence
  chemically synthesized
ttcctctagtccactaagaata

SEQ ID NO: 89812 - DNA, 22 bp, Artificial Sequence
  chemically synthesized
tcctctagtccactaagaatac

SEQ ID NO: 89813 - DNA, 22 bp, Artificial Sequence
  chemically synthesized
cctctagtccactaagaatact

SEQ ID NO: 89814 - DNA, 22 bp, Artificial Sequence
  chemically synthesized
ctctagtccactaagaatactg

SEQ ID NO: 89815 - DNA, 22 bp, Artificial Sequence
  chemically synthesized
tagtccactaagaatactgcgt

SEQ ID NO: 89816 - DNA, 22 bp, Artificial Sequence
  chemically synthesized
gtccactaagaatactgcgttt

SEQ ID NO: 89817 - DNA, 22 bp, Artificial Sequence
  chemically synthesized
agaatactgcgttttaaaatca

SEQ ID NO: 89818 - DNA, 22 bp, Artificial Sequence
  chemically synthesized
cgttttaaaatcatttccttga

SEQ ID NO: 89819 - DNA, 22 bp, Artificial Sequence
  chemically synthesized
taaaatcatttccttgattcaa

SEQ ID NO: 89820 - DNA, 22 bp, Artificial Sequence
  chemically synthesized
aaaatcatttccttgattcaag

SEQ ID NO: 89821 - DNA, 22 bp, Artificial Sequence
  chemically synthesized
aaatcatttccttgattcaagt

SEQ ID NO: 89822 - DNA, 22 bp, Artificial Sequence
  chemically synthesized
ccttgattcaagttcctatttc

SEQ ID NO: 89823 - DNA, 22 bp, Artificial Sequence
  chemically synthesized
cttgattcaagttcctatttct

SEQ ID NO: 89824 - DNA, 22 bp, Artificial Sequence
  chemically synthesized
gattcaagttcctatttctctt

SEQ ID NO: 89825 - DNA, 22 bp, Artificial Sequence
  chemically synthesized
attcaagttcctatttctcttt

SEQ ID NO: 89826 - DNA, 22 bp, Artificial Sequence
  chemically synthesized
aagttcctatttctctttatat

SEQ ID NO: 89827 - DNA, 22 bp, Artificial Sequence
  chemically synthesized
ctatttctctttatattttgtt

SEQ ID NO: 89828 - DNA, 22 bp, Artificial Sequence
  chemically synthesized
tttctctttatattttgtttgt

SEQ ID NO: 89829 - DNA, 22 bp, Artificial Sequence
  chemically synthesized
ctctttatattttgtttgttta

SEQ ID NO: 89830 - DNA, 22 bp, Artificial Sequence
  chemically synthesized
tctttatattttgtttgtttaa

SEQ ID NO: 89831 - DNA, 22 bp, Artificial Sequence
  chemically synthesized
tttatattttgtttgtttaaac

SEQ ID NO: 89832 - DNA, 22 bp, Artificial Sequence
  chemically synthesized
tatattttgtttgtttaaacct

SEQ ID NO: 89833 - DNA, 22 bp, Artificial Sequence
  chemically synthesized
atattttgtttgtttaaacctc

SEQ ID NO: 89834 - DNA, 22 bp, Artificial Sequence
  chemically synthesized
tattttgtttgtttaaacctcc

SEQ ID NO: 89835 - DNA, 22 bp, Artificial Sequence
  chemically synthesized
tgtttgtttaaacctcctttac

SEQ ID NO: 89836 - DNA, 22 bp, Artificial Sequence
  chemically synthesized
gtttgtttaaacctcctttact

SEQ ID NO: 89837 - DNA, 22 bp, Artificial Sequence
  chemically synthesized
tttgtttaaacctcctttacta

SEQ ID NO: 89838 - DNA, 22 bp, Artificial Sequence
  chemically synthesized
gtttaaacctcctttactaaaa

SEQ ID NO: 89839 - DNA, 22 bp, Artificial Sequence
  chemically synthesized
tttaaacctcctttactaaaat

SEQ ID NO: 89840 - DNA, 22 bp, Artificial Sequence
  chemically synthesized
aaacctcctttactaaaattta

SEQ ID NO: 89841 - DNA, 22 bp, Artificial Sequence
  chemically synthesized
aacctcctttactaaaatttac

SEQ ID NO: 89842 - DNA, 22 bp, Artificial Sequence
  chemically synthesized
ctttactaaaatttactcttct

SEQ ID NO: 89843 - DNA, 22 bp, Artificial Sequence
  chemically synthesized
tactaaaatttactcttctttc

SEQ ID NO: 89844 - DNA, 22 bp, Artificial Sequence
  chemically synthesized
actaaaatttactcttctttct

SEQ ID NO: 89845 - DNA, 22 bp, Artificial Sequence
  chemically synthesized
ctaaaatttactcttctttctc

SEQ ID NO: 89846 - DNA, 22 bp, Artificial Sequence
  chemically synthesized
aaatttactcttctttctctat

SEQ ID NO: 89847 - DNA, 22 bp, Artificial Sequence
  chemically synthesized
actcttctttctctatagcttc

SEQ ID NO: 89848 - DNA, 22 bp, Artificial Sequence
  chemically synthesized
ctcttctttctctatagcttcc

SEQ ID NO: 89849 - DNA, 22 bp, Artificial Sequence
  chemically synthesized
ttctttctctatagcttcccaa

SEQ ID NO: 89850 - DNA, 22 bp, Artificial Sequence
  chemically synthesized
ctttctctatagcttcccaacg

SEQ ID NO: 89851 - DNA, 22 bp, Artificial Sequence
  chemically synthesized
tttctctatagcttcccaacgt

SEQ ID NO: 89852 - DNA, 22 bp, Artificial Sequence
  chemically synthesized
tctctatagcttcccaacgtga

SEQ ID NO: 89853 - DNA, 22 bp, Artificial Sequence
  chemically synthesized
ctctatagcttcccaacgtgat

SEQ ID NO: 89854 - DNA, 22 bp, Artificial Sequence
  chemically synthesized
tctatagcttcccaacgtgatc

SEQ ID NO: 89855 - DNA, 22 bp, Artificial Sequence
  chemically synthesized
tatagcttcccaacgtgatcgc

SEQ ID NO: 89856 - DNA, 22 bp, Artificial Sequence
  chemically synthesized
tagcttcccaacgtgatcgcct

SEQ ID NO: 89857 - DNA, 22 bp, Artificial Sequence
  chemically synthesized
cccaacgtgatcgcctttctcc

SEQ ID NO: 89858 - DNA, 22 bp, Artificial Sequence
  chemically synthesized
ccaacgtgatcgcctttctccc

SEQ ID NO: 89859 - DNA, 22 bp, Artificial Sequence
  chemically synthesized
tctcccatccccctgtactttt

SEQ ID NO: 89860 - DNA, 22 bp, Artificial Sequence
  chemically synthesized
ctcccatccccctgtacttttt

SEQ ID NO: 89861 - DNA, 22 bp, Artificial Sequence
  chemically synthesized
tcccatccccctgtactttttc

SEQ ID NO: 89862 - DNA, 22 bp, Artificial Sequence
  chemically synthesized
ccatccccctgtactttttccc

SEQ ID NO: 89863 - DNA, 22 bp, Artificial Sequence
  chemically synthesized
tactttttccccttgtactaaa

SEQ ID NO: 89864 - DNA, 22 bp, Artificial Sequence
  chemically synthesized
tttccccttgtactaaattaac

SEQ ID NO: 89865 - DNA, 22 bp, Artificial Sequence
  chemically synthesized
ttccccttgtactaaattaact

SEQ ID NO: 89866 - DNA, 22 bp, Artificial Sequence
  chemically synthesized
tccccttgtactaaattaactc

SEQ ID NO: 89867 - DNA, 22 bp, Artificial Sequence
  chemically synthesized
ccccttgtactaaattaactcc

SEQ ID NO: 89868 - DNA, 22 bp, Artificial Sequence
  chemically synthesized
cccttgtactaaattaactcct

SEQ ID NO: 89869 - DNA, 22 bp, Artificial Sequence
  chemically synthesized
gtactaaattaactcctcaggt

SEQ ID NO: 89870 - DNA, 22 bp, Artificial Sequence
  chemically synthesized
tactaaattaactcctcaggtg

SEQ ID NO: 89871 - DNA, 22 bp, Artificial Sequence
  chemically synthesized
aattaactcctcaggtgaggaa

SEQ ID NO: 89872 - DNA, 22 bp, Artificial Sequence
  chemically synthesized
actcctcaggtgaggaaaaact

SEQ ID NO: 89873 - DNA, 22 bp, Artificial Sequence
  chemically synthesized
ctcaggtgaggaaaaacttttg

SEQ ID NO: 89874 - DNA, 22 bp, Artificial Sequence
  chemically synthesized
aggtgaggaaaaacttttgaag

SEQ ID NO: 89875 - DNA, 22 bp, Artificial Sequence
  chemically synthesized
ttgaagtgcagagttctgcttc

SEQ ID NO: 89876 - DNA, 22 bp, Artificial Sequence
  chemically synthesized
tgaagtgcagagttctgcttcc

SEQ ID NO: 89877 - DNA, 22 bp, Artificial Sequence
  chemically synthesized
gaagtgcagagttctgcttcct

SEQ ID NO: 89878 - DNA, 22 bp, Artificial Sequence
  chemically synthesized
aagtgcagagttctgcttcctg

SEQ ID NO: 89879 - DNA, 22 bp, Artificial Sequence
  chemically synthesized
tgcttcctgctattaaaagatg

SEQ ID NO: 89880 - DNA, 22 bp, Artificial Sequence
  chemically synthesized
cttcctgctattaaaagatgta

SEQ ID NO: 89881 - DNA, 22 bp, Artificial Sequence
  chemically synthesized
cctgctattaaaagatgtaatt

SEQ ID NO: 89882 - DNA, 22 bp, Artificial Sequence
  chemically synthesized
ctgctattaaaagatgtaatta

SEQ ID NO: 89883 - DNA, 22 bp, Artificial Sequence
  chemically synthesized
ctattaaaagatgtaattaaaa

SEQ ID NO: 89884 - DNA, 22 bp, Artificial Sequence
  chemically synthesized
ttaaaagatgtaattaaaacag

SEQ ID NO: 89885 - DNA, 22 bp, Artificial Sequence
  chemically synthesized
aaagatgtaattaaaacagcaa

SEQ ID NO: 89886 - DNA, 22 bp, Artificial Sequence
  chemically synthesized
aaacagcaaaggtagcaagcat

SEQ ID NO: 89887 - DNA, 22 bp, Artificial Sequence
  chemically synthesized
atgaggtcagcgtagggtctca

SEQ ID NO: 89888 - DNA, 22 bp, Artificial Sequence
  chemically synthesized
tgaggtcagcgtagggtctcag

SEQ ID NO: 89889 - DNA, 22 bp, Artificial Sequence
  chemically synthesized
agtgttccctaagggccctgtc

SEQ ID NO: 89890 - DNA, 22 bp, Artificial Sequence
  chemically synthesized
cctaagggccctgtcagtcatc

SEQ ID NO: 89891 - DNA, 22 bp, Artificial Sequence
  chemically synthesized
agggccctgtcagtcatcctga

SEQ ID NO: 89892 - DNA, 22 bp, Artificial Sequence
  chemically synthesized
tcagtcatcctgaatcctgccc

SEQ ID NO: 89893 - DNA, 22 bp, Artificial Sequence
  chemically synthesized
aatcctgcccctacctggaaac

SEQ ID NO: 89894 - DNA, 22 bp, Artificial Sequence
  chemically synthesized
cccctacctggaaacccatgtc

SEQ ID NO: 89895 - DNA, 22 bp, Artificial Sequence
  chemically synthesized
cctggaaacccatgtcggttta

SEQ ID NO: 89896 - DNA, 22 bp, Artificial Sequence
  chemically synthesized
gaaacccatgtcggtttagtaa

SEQ ID NO: 89897 - DNA, 22 bp, Artificial Sequence
  chemically synthesized
agtaaggaaagtgttatacttt

SEQ ID NO: 89898 - DNA, 22 bp, Artificial Sequence
  chemically synthesized
gtaaggaaagtgttatactttt

SEQ ID NO: 89899 - DNA, 22 bp, Artificial Sequence
  chemically synthesized
tacttttactttgcatgtttct

SEQ ID NO: 89900 - DNA, 22 bp, Artificial Sequence
  chemically synthesized
ttactttgcatgtttctcctac

SEQ ID NO: 89901 - DNA, 22 bp, Artificial Sequence
  chemically synthesized
tactttgcatgtttctcctact

SEQ ID NO: 89902 - DNA, 22 bp, Artificial Sequence
  chemically synthesized
actttgcatgtttctcctactt

SEQ ID NO: 89903 - DNA, 22 bp, Artificial Sequence
  chemically synthesized
ctttgcatgtttctcctacttc

SEQ ID NO: 89904 - DNA, 22 bp, Artificial Sequence
  chemically synthesized
tgcatgtttctcctacttcttc

SEQ ID NO: 89905 - DNA, 22 bp, Artificial Sequence
  chemically synthesized
gcatgtttctcctacttcttcc

SEQ ID NO: 89906 - DNA, 22 bp, Artificial Sequence
  chemically synthesized
catgtttctcctacttcttcct

SEQ ID NO: 89907 - DNA, 22 bp, Artificial Sequence
  chemically synthesized
ctcctacttcttcctttcagct

SEQ ID NO: 89908 - DNA, 22 bp, Artificial Sequence
  chemically synthesized
tcctacttcttcctttcagctc

SEQ ID NO: 89909 - DNA, 22 bp, Artificial Sequence
  chemically synthesized
ctacttcttcctttcagctcta

SEQ ID NO: 89910 - DNA, 22 bp, Artificial Sequence
  chemically synthesized
cttcttcctttcagctctaaca

SEQ ID NO: 89911 - DNA, 22 bp, Artificial Sequence
  chemically synthesized
cttcctttcagctctaacactc

SEQ ID NO: 89912 - DNA, 22 bp, Artificial Sequence
  chemically synthesized
ttcctttcagctctaacactct

SEQ ID NO: 89913 - DNA, 22 bp, Artificial Sequence
  chemically synthesized
cctttcagctctaacactctga

SEQ ID NO: 89914 - DNA, 22 bp, Artificial Sequence
  chemically synthesized
ctttcagctctaacactctgaa

SEQ ID NO: 89915 - DNA, 22 bp, Artificial Sequence
  chemically synthesized
tcagctctaacactctgaaact

SEQ ID NO: 89916 - DNA, 22 bp, Artificial Sequence
  chemically synthesized
cagctctaacactctgaaacta

SEQ ID NO: 89917 - DNA, 22 bp, Artificial Sequence
  chemically synthesized
agctctaacactctgaaactac

SEQ ID NO: 89918 - DNA, 22 bp, Artificial Sequence
  chemically synthesized
taacactctgaaactacgatta

SEQ ID NO: 89919 - DNA, 22 bp, Artificial Sequence
  chemically synthesized
acactctgaaactacgattaca

SEQ ID NO: 89920 - DNA, 22 bp, Artificial Sequence
  chemically synthesized
tgaaactacgattacacaaaat

SEQ ID NO: 89921 - DNA, 22 bp, Artificial Sequence
  chemically synthesized
aaactacgattacacaaaataa

SEQ ID NO: 89922 - DNA, 22 bp, Artificial Sequence
  chemically synthesized
cgattacacaaaataaaataaa

SEQ ID NO: 89923 - DNA, 22 bp, Artificial Sequence
  chemically synthesized
cacaaaataaaataaaataaaa

SEQ ID NO: 89924 - DNA, 22 bp, Artificial Sequence
  chemically synthesized
aggttaaccaaaagaaactgga

SEQ ID NO: 89925 - DNA, 22 bp, Artificial Sequence
  chemically synthesized
ggttaaccaaaagaaactggat

SEQ ID NO: 89926 - DNA, 22 bp, Artificial Sequence
  chemically synthesized
accaaaagaaactggatcctct

SEQ ID NO: 89927 - DNA, 22 bp, Artificial Sequence
  chemically synthesized
gatcctctatttctagttatca

SEQ ID NO: 89928 - DNA, 22 bp, Artificial Sequence
  chemically synthesized
tatttctagttatcagaaggaa

SEQ ID NO: 89929 - DNA, 22 bp, Artificial Sequence
  chemically synthesized
tttctagttatcagaaggaaat

SEQ ID NO: 89930 - DNA, 22 bp, Artificial Sequence
  chemically synthesized
ctagttatcagaaggaaattta

SEQ ID NO: 89931 - DNA, 22 bp, Artificial Sequence
  chemically synthesized
tagttatcagaaggaaatttac

SEQ ID NO: 89932 - DNA, 22 bp, Artificial Sequence
  chemically synthesized
gttatcagaaggaaatttacaa

SEQ ID NO: 89933 - DNA, 22 bp, Artificial Sequence
  chemically synthesized
tcagaaggaaatttacaaattt

SEQ ID NO: 89934 - DNA, 22 bp, Artificial Sequence
  chemically synthesized
acaaatttcttatttccattgc

SEQ ID NO: 89935 - DNA, 22 bp, Artificial Sequence
  chemically synthesized
caaatttcttatttccattgct

SEQ ID NO: 89936 - DNA, 22 bp, Artificial Sequence
  chemically synthesized
cttatttccattgctttattct

SEQ ID NO: 89937 - DNA, 22 bp, Artificial Sequence
  chemically synthesized
ttatttccattgctttattctc

SEQ ID NO: 89938 - DNA, 22 bp, Artificial Sequence
  chemically synthesized
atttccattgctttattctctt

SEQ ID NO: 89939 - DNA, 22 bp, Artificial Sequence
  chemically synthesized
tttccattgctttattctctta

SEQ ID NO: 89940 - DNA, 22 bp, Artificial Sequence
  chemically synthesized
ccattgctttattctcttaaat

SEQ ID NO: 89941 - DNA, 22 bp, Artificial Sequence
  chemically synthesized
cattgctttattctcttaaatg

SEQ ID NO: 89942 - DNA, 22 bp, Artificial Sequence
  chemically synthesized
ctttattctcttaaatgctttc

SEQ ID NO: 89943 - DNA, 22 bp, Artificial Sequence
  chemically synthesized
tattctcttaaatgctttctct

SEQ ID NO: 89944 - DNA, 22 bp, Artificial Sequence
  chemically synthesized
attctcttaaatgctttctcta

SEQ ID NO: 89945 - DNA, 22 bp, Artificial Sequence
  chemically synthesized
ttctcttaaatgctttctctat

SEQ ID NO: 89946 - DNA, 22 bp, Artificial Sequence
  chemically synthesized
tcttaaatgctttctctattat

SEQ ID NO: 89947 - DNA, 22 bp, Artificial Sequence
  chemically synthesized
ttaaatgctttctctattattg

SEQ ID NO: 89948 - DNA, 22 bp, Artificial Sequence
  chemically synthesized
aaatgctttctctattattgct

SEQ ID NO: 89949 - DNA, 22 bp, Artificial Sequence
  chemically synthesized
aatgctttctctattattgcta

SEQ ID NO: 89950 - DNA, 22 bp, Artificial Sequence
  chemically synthesized
tctctattattgctaaataaat

SEQ ID NO: 89951 - DNA, 22 bp, Artificial Sequence
  chemically synthesized
ctctattattgctaaataaata

SEQ ID NO: 89952 - DNA, 22 bp, Artificial Sequence
  chemically synthesized
tctattattgctaaataaatag

SEQ ID NO: 89953 - DNA, 22 bp, Artificial Sequence
  chemically synthesized
tattattgctaaataaatagag

SEQ ID NO: 89954 - DNA, 22 bp, Artificial Sequence
  chemically synthesized
ttattgctaaataaatagagat

SEQ ID NO: 89955 - DNA, 22 bp, Artificial Sequence
  chemically synthesized
ttgctaaataaatagagatctc

SEQ ID NO: 89956 - DNA, 22 bp, Artificial Sequence
  chemically synthesized
ctaaataaatagagatctctca

SEQ ID NO: 89957 - DNA, 22 bp, Artificial Sequence
  chemically synthesized
aataaatagagatctctcactt

SEQ ID NO: 89958 - DNA, 22 bp, Artificial Sequence
  chemically synthesized
tcactttttctacctgtctcaa

SEQ ID NO: 89959 - DNA, 22 bp, Artificial Sequence
  chemically synthesized
actttttctacctgtctcaacc

SEQ ID NO: 89960 - DNA, 22 bp, Artificial Sequence
  chemically synthesized
tttctacctgtctcaaccctca

SEQ ID NO: 89961 - DNA, 22 bp, Artificial Sequence
  chemically synthesized
ttctacctgtctcaaccctcat

SEQ ID NO: 89962 - DNA, 22 bp, Artificial Sequence
  chemically synthesized
tctacctgtctcaaccctcatc

SEQ ID NO: 89963 - DNA, 22 bp, Artificial Sequence
  chemically synthesized
ctacctgtctcaaccctcatca

SEQ ID NO: 89964 - DNA, 22 bp, Artificial Sequence
  chemically synthesized
tacctgtctcaaccctcatcag

SEQ ID NO: 89965 - DNA, 22 bp, Artificial Sequence
  chemically synthesized
cctgtctcaaccctcatcaggt

SEQ ID NO: 89966 - DNA, 22 bp, Artificial Sequence
  chemically synthesized
tctcaaccctcatcaggtactt

SEQ ID NO: 89967 - DNA, 22 bp, Artificial Sequence
  chemically synthesized
aaccctcatcaggtacttgtga

SEQ ID NO: 89968 - DNA, 22 bp, Artificial Sequence
  chemically synthesized
atcaggtacttgtgaaaaaatc

SEQ ID NO: 89969 - DNA, 22 bp, Artificial Sequence
  chemically synthesized
gtgaaaaaatctcactctgatt

SEQ ID NO: 89970 - DNA, 22 bp, Artificial Sequence
  chemically synthesized
tgaaaaaatctcactctgatta

SEQ ID NO: 89971 - DNA, 22 bp, Artificial Sequence
  chemically synthesized
actctgattattctcacacacg

SEQ ID NO: 89972 - DNA, 22 bp, Artificial Sequence
  chemically synthesized
tgattattctcacacacgcaga

SEQ ID NO: 89973 - DNA, 22 bp, Artificial Sequence
  chemically synthesized
attattctcacacacgcagaaa

SEQ ID NO: 89974 - DNA, 22 bp, Artificial Sequence
  chemically synthesized
ttctcacacacgcagaaagtgt

SEQ ID NO: 89975 - DNA, 22 bp, Artificial Sequence
  chemically synthesized
tcacacacgcagaaagtgtttg

SEQ ID NO: 89976 - DNA, 22 bp, Artificial Sequence
  chemically synthesized
acacacgcagaaagtgtttggt

SEQ ID NO: 89977 - DNA, 22 bp, Artificial Sequence
  chemically synthesized
ggttcttctatggctatctgga

SEQ ID NO: 89978 - DNA, 22 bp, Artificial Sequence
  chemically synthesized
gttcttctatggctatctggag

SEQ ID NO: 89979 - DNA, 22 bp, Artificial Sequence
  chemically synthesized
ttctatggctatctggagccta

SEQ ID NO: 89980 - DNA, 22 bp, Artificial Sequence
  chemically synthesized
ctatggctatctggagcctagg

SEQ ID NO: 89981 - DNA, 22 bp, Artificial Sequence
  chemically synthesized
tatggctatctggagcctaggt

SEQ ID NO: 89982 - DNA, 22 bp, Artificial Sequence
  chemically synthesized
tggctatctggagcctaggtta

SEQ ID NO: 89983 - DNA, 22 bp, Artificial Sequence
  chemically synthesized
tctggagcctaggttaaaaaat

SEQ ID NO: 89984 - DNA, 22 bp, Artificial Sequence
  chemically synthesized
gagcctaggttaaaaaattatg

SEQ ID NO: 89985 - DNA, 22 bp, Artificial Sequence
  chemically synthesized
ggttaaaaaattatgcctatgt

SEQ ID NO: 89986 - DNA, 22 bp, Artificial Sequence
  chemically synthesized
aaaaattatgcctatgtatgat

SEQ ID NO: 89987 - DNA, 22 bp, Artificial Sequence
  chemically synthesized
tgcctatgtatgattatagagg

SEQ ID NO: 89988 - DNA, 22 bp, Artificial Sequence
  chemically synthesized
tgtatgattatagaggtaagag

SEQ ID NO: 89989 - DNA, 22 bp, Artificial Sequence
  chemically synthesized
tagaggtaagagggataaaatt

SEQ ID NO: 89990 - DNA, 22 bp, Artificial Sequence
  chemically synthesized
aagtattttctttttatattca

SEQ ID NO: 89991 - DNA, 22 bp, Artificial Sequence
  chemically synthesized
agtattttctttttatattcat

SEQ ID NO: 89992 - DNA, 22 bp, Artificial Sequence
  chemically synthesized
tctttttatattcattcctctg

SEQ ID NO: 89993 - DNA, 22 bp, Artificial Sequence
  chemically synthesized
ctttttatattcattcctctgt

SEQ ID NO: 89994 - DNA, 22 bp, Artificial Sequence
  chemically synthesized
tttttatattcattcctctgta

SEQ ID NO: 89995 - DNA, 22 bp, Artificial Sequence
  chemically synthesized
tttatattcattcctctgtaaa

SEQ ID NO: 89996 - DNA, 22 bp, Artificial Sequence
  chemically synthesized
ttatattcattcctctgtaaaa

SEQ ID NO: 89997 - DNA, 22 bp, Artificial Sequence
  chemically synthesized
tatattcattcctctgtaaaaa

SEQ ID NO: 89998 - DNA, 22 bp, Artificial Sequence
  chemically synthesized
atattcattcctctgtaaaaaa

SEQ ID NO: 89999 - DNA, 22 bp, Artificial Sequence
  chemically synthesized
tattcattcctctgtaaaaaac

SEQ ID NO: 90000 - DNA, 22 bp, Artificial Sequence
  chemically synthesized
attcctctgtaaaaaactaaag

SEQ ID NO: 90001 - DNA, 22 bp, Artificial Sequence
  chemically synthesized
ctctgtaaaaaactaaagcaat

SEQ ID NO: 90002 - DNA, 22 bp, Artificial Sequence
  chemically synthesized
tgtaaaaaactaaagcaatgag

SEQ ID NO: 90003 - DNA, 22 bp, Artificial Sequence
  chemically synthesized
taaaaaactaaagcaatgagga

SEQ ID NO: 90004 - DNA, 22 bp, Artificial Sequence
  chemically synthesized
aagcaatgaggatctaggcaca

SEQ ID NO: 90005 - DNA, 22 bp, Artificial Sequence
  chemically synthesized
ggcacacgtgtatccctgagaa

SEQ ID NO: 90006 - DNA, 22 bp, Artificial Sequence
  chemically synthesized
agaaaagatttcacatgttgaa

SEQ ID NO: 90007 - DNA, 22 bp, Artificial Sequence
  chemically synthesized
cacatgttgaatcctgggaaaa

SEQ ID NO: 90008 - DNA, 22 bp, Artificial Sequence
  chemically synthesized
acatgttgaatcctgggaaaag

SEQ ID NO: 90009 - DNA, 22 bp, Artificial Sequence
  chemically synthesized
aatcctgggaaaagacgtcttt

SEQ ID NO: 90010 - DNA, 22 bp, Artificial Sequence
  chemically synthesized
ggaaaagacgtctttaaaatat

SEQ ID NO: 90011 - DNA, 22 bp, Artificial Sequence
  chemically synthesized
taaaatattttaaatgttaaaa

SEQ ID NO: 90012 - DNA, 22 bp, Artificial Sequence
  chemically synthesized
aaaatattttaaatgttaaaac

SEQ ID NO: 90013 - DNA, 22 bp, Artificial Sequence
  chemically synthesized
aaatattttaaatgttaaaaca

SEQ ID NO: 90014 - DNA, 22 bp, Artificial Sequence
  chemically synthesized
taaatgttaaaacatgcagatt

SEQ ID NO: 90015 - DNA, 22 bp, Artificial Sequence
  chemically synthesized
aaatgttaaaacatgcagattt

SEQ ID NO: 90016 - DNA, 22 bp, Artificial Sequence
  chemically synthesized
aatgttaaaacatgcagatttg

SEQ ID NO: 90017 - DNA, 22 bp, Artificial Sequence
  chemically synthesized
aaacatgcagatttgacttggc

SEQ ID NO: 90018 - DNA, 22 bp, Artificial Sequence
  chemically synthesized
gacttggctgttagattttgga

SEQ ID NO: 90019 - DNA, 22 bp, Artificial Sequence
  chemically synthesized
acttggctgttagattttggat

SEQ ID NO: 90020 - DNA, 22 bp, Artificial Sequence
  chemically synthesized
ggctgttagattttggatttta

SEQ ID NO: 90021 - DNA, 22 bp, Artificial Sequence
  chemically synthesized
gctgttagattttggattttat

SEQ ID NO: 90022 - DNA, 22 bp, Artificial Sequence
  chemically synthesized
ttagattttggattttatttta

SEQ ID NO: 90023 - DNA, 22 bp, Artificial Sequence
  chemically synthesized
gattttggattttattttatta

SEQ ID NO: 90024 - DNA, 22 bp, Artificial Sequence
  chemically synthesized
tggattttattttattaaattt

SEQ ID NO: 90025 - DNA, 22 bp, Artificial Sequence
  chemically synthesized
ggattttattttattaaattta

SEQ ID NO: 90026 - DNA, 22 bp, Artificial Sequence
  chemically synthesized
gattttattttattaaatttaa

SEQ ID NO: 90027 - DNA, 22 bp, Artificial Sequence
  chemically synthesized
tattttattaaatttaaacctg

SEQ ID NO: 90028 - DNA, 22 bp, Artificial Sequence
  chemically synthesized
attttattaaatttaaacctgc

SEQ ID NO: 90029 - DNA, 22 bp, Artificial Sequence
  chemically synthesized
ttttattaaatttaaacctgca

SEQ ID NO: 90030 - DNA, 22 bp, Artificial Sequence
  chemically synthesized
tattaaatttaaacctgcatta

SEQ ID NO: 90031 - DNA, 22 bp, Artificial Sequence
  chemically synthesized
attaaatttaaacctgcattag

SEQ ID NO: 90032 - DNA, 22 bp, Artificial Sequence
  chemically synthesized
ttaaatttaaacctgcattagc

SEQ ID NO: 90033 - DNA, 22 bp, Artificial Sequence
  chemically synthesized
aatttaaacctgcattagcatt

SEQ ID NO: 90034 - DNA, 22 bp, Artificial Sequence
  chemically synthesized
aaacctgcattagcattgtttt

SEQ ID NO: 90035 - DNA, 22 bp, Artificial Sequence
  chemically synthesized
aacctgcattagcattgtttta

SEQ ID NO: 90036 - DNA, 22 bp, Artificial Sequence
  chemically synthesized
cattagcattgttttagattta

SEQ ID NO: 90037 - DNA, 22 bp, Artificial Sequence
  chemically synthesized
gcattgttttagatttagacag

SEQ ID NO: 90038 - DNA, 22 bp, Artificial Sequence
  chemically synthesized
ttttagatttagacagttttca

SEQ ID NO: 90039 - DNA, 22 bp, Artificial Sequence
  chemically synthesized
tagatttagacagttttcaaga

SEQ ID NO: 90040 - DNA, 22 bp, Artificial Sequence
  chemically synthesized
agatttagacagttttcaagac

SEQ ID NO: 90041 - DNA, 22 bp, Artificial Sequence
  chemically synthesized
gatttagacagttttcaagacc

SEQ ID NO: 90042 - DNA, 22 bp, Artificial Sequence
  chemically synthesized
agacagttttcaagaccctgtt

SEQ ID NO: 90043 - DNA, 22 bp, Artificial Sequence
  chemically synthesized
gacagttttcaagaccctgttt

SEQ ID NO: 90044 - DNA, 22 bp, Artificial Sequence
  chemically synthesized
tcaagaccctgtttcacatccc

SEQ ID NO: 90045 - DNA, 22 bp, Artificial Sequence
  chemically synthesized
caagaccctgtttcacatccct

SEQ ID NO: 90046 - DNA, 22 bp, Artificial Sequence
  chemically synthesized
aagaccctgtttcacatccctg

SEQ ID NO: 90047 - DNA, 22 bp, Artificial Sequence
  chemically synthesized
tttcacatccctgatataagag

SEQ ID NO: 90048 - DNA, 22 bp, Artificial Sequence
  chemically synthesized
cacatccctgatataagaggca

SEQ ID NO: 90049 - DNA, 22 bp, Artificial Sequence
  chemically synthesized
acatccctgatataagaggcat

SEQ ID NO: 90050 - DNA, 22 bp, Artificial Sequence
  chemically synthesized
atataagaggcatgtatatgtg

SEQ ID NO: 90051 - DNA, 22 bp, Artificial Sequence
  chemically synthesized
tgcggaagtttgaatatgtctt

SEQ ID NO: 90052 - DNA, 22 bp, Artificial Sequence
  chemically synthesized
cggaagtttgaatatgtctttt

SEQ ID NO: 90053 - DNA, 22 bp, Artificial Sequence
  chemically synthesized
gaatatgtcttttgcaaatatc

SEQ ID NO: 90054 - DNA, 22 bp, Artificial Sequence
  chemically synthesized
aatatgtcttttgcaaatatcc

SEQ ID NO: 90055 - DNA, 22 bp, Artificial Sequence
  chemically synthesized
ttgcaaatatcctgggtcaaag

SEQ ID NO: 90056 - DNA, 22 bp, Artificial Sequence
  chemically synthesized
tgcaaatatcctgggtcaaaga

SEQ ID NO: 90057 - DNA, 22 bp, Artificial Sequence
  chemically synthesized
gcaaatatcctgggtcaaagaa

SEQ ID NO: 90058 - DNA, 22 bp, Artificial Sequence
  chemically synthesized
caaatatcctgggtcaaagaaa

SEQ ID NO: 90059 - DNA, 22 bp, Artificial Sequence
  chemically synthesized
ggtcaaagaaaatgcacagact

SEQ ID NO: 90060 - DNA, 22 bp, Artificial Sequence
  chemically synthesized
tatgaaattataatataggtta

SEQ ID NO: 90061 - DNA, 22 bp, Artificial Sequence
  chemically synthesized
atgaaattataatataggttat

SEQ ID NO: 90062 - DNA, 22 bp, Artificial Sequence
  chemically synthesized
tgaaattataatataggttata

SEQ ID NO: 90063 - DNA, 22 bp, Artificial Sequence
  chemically synthesized
taatataggttatatttatagt

SEQ ID NO: 90064 - DNA, 22 bp, Artificial Sequence
  chemically synthesized
tatttatagtattctgaaagac

SEQ ID NO: 90065 - DNA, 22 bp, Artificial Sequence
  chemically synthesized
atagtattctgaaagaccaaaa

SEQ ID NO: 90066 - DNA, 22 bp, Artificial Sequence
  chemically synthesized
tagtattctgaaagaccaaaat

SEQ ID NO: 90067 - DNA, 22 bp, Artificial Sequence
  chemically synthesized
tgaaagaccaaaattgtcaaag

SEQ ID NO: 90068 - DNA, 22 bp, Artificial Sequence
  chemically synthesized
aaagaccaaaattgtcaaagca

SEQ ID NO: 90069 - DNA, 22 bp, Artificial Sequence
  chemically synthesized
tcaaagcaagagctttgaaatc

SEQ ID NO: 90070 - DNA, 22 bp, Artificial Sequence
  chemically synthesized
tgaaatcctgattggcagaaat

SEQ ID NO: 90071 - DNA, 22 bp, Artificial Sequence
  chemically synthesized
gaaatcctgattggcagaaatt

SEQ ID NO: 90072 - DNA, 22 bp, Artificial Sequence
  chemically synthesized
aaatcctgattggcagaaattg

SEQ ID NO: 90073 - DNA, 22 bp, Artificial Sequence
  chemically synthesized
attggcagaaattgtcaccttc

SEQ ID NO: 90074 - DNA, 22 bp, Artificial Sequence
  chemically synthesized
gcagaaattgtcaccttcttaa

SEQ ID NO: 90075 - DNA, 22 bp, Artificial Sequence
  chemically synthesized
tcaccttcttaaagacttaccc

SEQ ID NO: 90076 - DNA, 22 bp, Artificial Sequence
  chemically synthesized
cttaaagacttaccctacaact

SEQ ID NO: 90077 - DNA, 22 bp, Artificial Sequence
  chemically synthesized
ttaaagacttaccctacaactt

SEQ ID NO: 90078 - DNA, 22 bp, Artificial Sequence
  chemically synthesized
aaagacttaccctacaacttct

SEQ ID NO: 90079 - DNA, 22 bp, Artificial Sequence
  chemically synthesized
aagacttaccctacaacttctt

SEQ ID NO: 90080 - DNA, 22 bp, Artificial Sequence
  chemically synthesized
accctacaacttcttatgctca

SEQ ID NO: 90081 - DNA, 22 bp, Artificial Sequence
  chemically synthesized
ccctacaacttcttatgctcag

SEQ ID NO: 90082 - DNA, 22 bp, Artificial Sequence
  chemically synthesized
caacttcttatgctcagaaata

SEQ ID NO: 90083 - DNA, 22 bp, Artificial Sequence
  chemically synthesized
cttatgctcagaaatagttttc

SEQ ID NO: 90084 - DNA, 22 bp, Artificial Sequence
  chemically synthesized
ttatgctcagaaatagttttcc

SEQ ID NO: 90085 - DNA, 22 bp, Artificial Sequence
  chemically synthesized
atgctcagaaatagttttcctt

SEQ ID NO: 90086 - DNA, 22 bp, Artificial Sequence
  chemically synthesized
tgctcagaaatagttttccttt

SEQ ID NO: 90087 - DNA, 22 bp, Artificial Sequence
  chemically synthesized
agaaatagttttcctttttcta

SEQ ID NO: 90088 - DNA, 22 bp, Artificial Sequence
  chemically synthesized
tcctttttctattttgttttct

SEQ ID NO: 90089 - DNA, 22 bp, Artificial Sequence
  chemically synthesized
cctttttctattttgttttctt

SEQ ID NO: 90090 - DNA, 22 bp, Artificial Sequence
  chemically synthesized
ctttttctattttgttttcttt

SEQ ID NO: 90091 - DNA, 22 bp, Artificial Sequence
  chemically synthesized
tttctattttgttttctttttt

SEQ ID NO: 90092 - DNA, 22 bp, Artificial Sequence
  chemically synthesized
ttctattttgttttctttttta

SEQ ID NO: 90093 - DNA, 22 bp, Artificial Sequence
  chemically synthesized
tctattttgttttcttttttaa

SEQ ID NO: 90094 - DNA, 22 bp, Artificial Sequence
  chemically synthesized
ctattttgttttcttttttaaa

SEQ ID NO: 90095 - DNA, 22 bp, Artificial Sequence
  chemically synthesized
tattttgttttcttttttaaat

SEQ ID NO: 90096 - DNA, 22 bp, Artificial Sequence
  chemically synthesized
ttttgttttcttttttaaatga

SEQ ID NO: 90097 - DNA, 22 bp, Artificial Sequence
  chemically synthesized
tgttttcttttttaaatgatga

SEQ ID NO: 90098 - DNA, 22 bp, Artificial Sequence
  chemically synthesized
gttttcttttttaaatgatgaa

SEQ ID NO: 90099 - DNA, 22 bp, Artificial Sequence
  chemically synthesized
ttttcttttttaaatgatgaac

SEQ ID NO: 90100 - DNA, 22 bp, Artificial Sequence
  chemically synthesized
tcttttttaaatgatgaactat

SEQ ID NO: 90101 - DNA, 22 bp, Artificial Sequence
  chemically synthesized
cttttttaaatgatgaactatg

SEQ ID NO: 90102 - DNA, 22 bp, Artificial Sequence
  chemically synthesized
ttttttaaatgatgaactatgg

SEQ ID NO: 90103 - DNA, 22 bp, Artificial Sequence
  chemically synthesized
ttttaaatgatgaactatggat

SEQ ID NO: 90104 - DNA, 22 bp, Artificial Sequence
  chemically synthesized
tttaaatgatgaactatggatc

SEQ ID NO: 90105 - DNA, 22 bp, Artificial Sequence
  chemically synthesized
ttaaatgatgaactatggatcc

SEQ ID NO: 90106 - DNA, 22 bp, Artificial Sequence
  chemically synthesized
taaatgatgaactatggatcct

SEQ ID NO: 90107 - DNA, 22 bp, Artificial Sequence
  chemically synthesized
aaatgatgaactatggatcctt

SEQ ID NO: 90108 - DNA, 22 bp, Artificial Sequence
  chemically synthesized
aatgatgaactatggatccttc

SEQ ID NO: 90109 - DNA, 22 bp, Artificial Sequence
  chemically synthesized
tggatccttctcttgtgttggc

SEQ ID NO: 90110 - DNA, 22 bp, Artificial Sequence
  chemically synthesized
ctcttgtgttggcaactgctgc

SEQ ID NO: 90111 - DNA, 22 bp, Artificial Sequence
  chemically synthesized
tcttgtgttggcaactgctgca

SEQ ID NO: 90112 - DNA, 22 bp, Artificial Sequence
  chemically synthesized
ttgtgttggcaactgctgcaga

SEQ ID NO: 90113 - DNA, 22 bp, Artificial Sequence
  chemically synthesized
gtgttggcaactgctgcagata

SEQ ID NO: 90114 - DNA, 22 bp, Artificial Sequence
  chemically synthesized
tgttggcaactgctgcagatac

SEQ ID NO: 90115 - DNA, 22 bp, Artificial Sequence
  chemically synthesized
gcaactgctgcagataccatca

SEQ ID NO: 90116 - DNA, 22 bp, Artificial Sequence
  chemically synthesized
ctgcagataccatcatcctggc

SEQ ID NO: 90117 - DNA, 22 bp, Artificial Sequence
  chemically synthesized
cagataccatcatcctggcttc

SEQ ID NO: 90118 - DNA, 22 bp, Artificial Sequence
  chemically synthesized
gcttcaaggcaggggttgcttt

SEQ ID NO: 90119 - DNA, 22 bp, Artificial Sequence
  chemically synthesized
caaggcaggggttgcttttcca

SEQ ID NO: 90120 - DNA, 22 bp, Artificial Sequence
  chemically synthesized
aaggcaggggttgcttttccaa

SEQ ID NO: 90121 - DNA, 22 bp, Artificial Sequence
  chemically synthesized
cttttccaatggtagttactta

SEQ ID NO: 90122 - DNA, 22 bp, Artificial Sequence
  chemically synthesized
ttccaatggtagttacttagtg

SEQ ID NO: 90123 - DNA, 22 bp, Artificial Sequence
  chemically synthesized
tccaatggtagttacttagtgt

SEQ ID NO: 90124 - DNA, 22 bp, Artificial Sequence
  chemically synthesized
ccaatggtagttacttagtgtg

SEQ ID NO: 90125 - DNA, 22 bp, Artificial Sequence
  chemically synthesized
caatggtagttacttagtgtga

SEQ ID NO: 90126 - DNA, 22 bp, Artificial Sequence
  chemically synthesized
cttagtgtgactagagtgtaac

SEQ ID NO: 90127 - DNA, 22 bp, Artificial Sequence
  chemically synthesized
agtgtgactagagtgtaacgca

SEQ ID NO: 90128 - DNA, 22 bp, Artificial Sequence
  chemically synthesized
gtgtgactagagtgtaacgcag

SEQ ID NO: 90129 - DNA, 22 bp, Artificial Sequence
  chemically synthesized
gagtgtaacgcagacttttctt

SEQ ID NO: 90130 - DNA, 22 bp, Artificial Sequence
  chemically synthesized
ttctttctattacccataatac

SEQ ID NO: 90131 - DNA, 22 bp, Artificial Sequence
  chemically synthesized
tctttctattacccataatacc

SEQ ID NO: 90132 - DNA, 22 bp, Artificial Sequence
  chemically synthesized
ctttctattacccataataccc

SEQ ID NO: 90133 - DNA, 22 bp, Artificial Sequence
  chemically synthesized
tttctattacccataataccct

SEQ ID NO: 90134 - DNA, 22 bp, Artificial Sequence
  chemically synthesized
tctattacccataataccctgc

SEQ ID NO: 90135 - DNA, 22 bp, Artificial Sequence
  chemically synthesized
ctattacccataataccctgca

SEQ ID NO: 90136 - DNA, 22 bp, Artificial Sequence
  chemically synthesized
tattacccataataccctgcag

SEQ ID NO: 90137 - DNA, 22 bp, Artificial Sequence
  chemically synthesized
ttacccataataccctgcaggg

SEQ ID NO: 90138 - DNA, 22 bp, Artificial Sequence
  chemically synthesized
cccataataccctgcagggaca

SEQ ID NO: 90139 - DNA, 22 bp, Artificial Sequence
  chemically synthesized
cagggacaaggctgcaagctat

SEQ ID NO: 90140 - DNA, 22 bp, Artificial Sequence
  chemically synthesized
caagctatactaagaccatcaa

SEQ ID NO: 90141 - DNA, 22 bp, Artificial Sequence
  chemically synthesized
tactaagaccatcaaaagccca

SEQ ID NO: 90142 - DNA, 22 bp, Artificial Sequence
  chemically synthesized
agaccatcaaaagcccaggcat

SEQ ID NO: 90143 - DNA, 22 bp, Artificial Sequence
  chemically synthesized
caagaagcaataaatagtgcaa

SEQ ID NO: 90144 - DNA, 22 bp, Artificial Sequence
  chemically synthesized
aagaagcaataaatagtgcaaa

SEQ ID NO: 90145 - DNA, 22 bp, Artificial Sequence
  chemically synthesized
ggttatggtcagagcctcagtt

SEQ ID NO: 90146 - DNA, 22 bp, Artificial Sequence
  chemically synthesized
gttatggtcagagcctcagttt

SEQ ID NO: 90147 - DNA, 22 bp, Artificial Sequence
  chemically synthesized
tggtcagagcctcagtttcaaa

SEQ ID NO: 90148 - DNA, 22 bp, Artificial Sequence
  chemically synthesized
agtttcaaatctaaatcagcat

SEQ ID NO: 90149 - DNA, 22 bp, Artificial Sequence
  chemically synthesized
caaatctaaatcagcattcaaa

SEQ ID NO: 90150 - DNA, 22 bp, Artificial Sequence
  chemically synthesized
aaatctaaatcagcattcaaag

SEQ ID NO: 90151 - DNA, 22 bp, Artificial Sequence
  chemically synthesized
aatcagcattcaaagttcctga

SEQ ID NO: 90152 - DNA, 22 bp, Artificial Sequence
  chemically synthesized
aaagttcctgaaaaactattca

SEQ ID NO: 90153 - DNA, 22 bp, Artificial Sequence
  chemically synthesized
ctgaaaaactattcaagcttac

SEQ ID NO: 90154 - DNA, 22 bp, Artificial Sequence
  chemically synthesized
aaaaactattcaagcttactga

SEQ ID NO: 90155 - DNA, 22 bp, Artificial Sequence
  chemically synthesized
ttcaagcttactgacatcttca

SEQ ID NO: 90156 - DNA, 22 bp, Artificial Sequence
  chemically synthesized
aagcttactgacatcttcacta

SEQ ID NO: 90157 - DNA, 22 bp, Artificial Sequence
  chemically synthesized
actgacatcttcactattgtga

SEQ ID NO: 90158 - DNA, 22 bp, Artificial Sequence
  chemically synthesized
ctgacatcttcactattgtgag

SEQ ID NO: 90159 - DNA, 22 bp, Artificial Sequence
  chemically synthesized
acatcttcactattgtgagctt

SEQ ID NO: 90160 - DNA, 22 bp, Artificial Sequence
  chemically synthesized
cactattgtgagcttgcttcta

SEQ ID NO: 90161 - DNA, 22 bp, Artificial Sequence
  chemically synthesized
actattgtgagcttgcttctac

SEQ ID NO: 90162 - DNA, 22 bp, Artificial Sequence
  chemically synthesized
ttgtgagcttgcttctactctg

SEQ ID NO: 90163 - DNA, 22 bp, Artificial Sequence
  chemically synthesized
tgagcttgcttctactctgtga

SEQ ID NO: 90164 - DNA, 22 bp, Artificial Sequence
  chemically synthesized
gcttctactctgtgaatggatg

SEQ ID NO: 90165 - DNA, 22 bp, Artificial Sequence
  chemically synthesized
cttctactctgtgaatggatgc

SEQ ID NO: 90166 - DNA, 22 bp, Artificial Sequence
  chemically synthesized
ctactctgtgaatggatgccac

SEQ ID NO: 90167 - DNA, 22 bp, Artificial Sequence
  chemically synthesized
tactctgtgaatggatgccaca

SEQ ID NO: 90168 - DNA, 22 bp, Artificial Sequence
  chemically synthesized
ctctgtgaatggatgccacagc

SEQ ID NO: 90169 - DNA, 22 bp, Artificial Sequence
  chemically synthesized
tgtgaatggatgccacagcagg

SEQ ID NO: 90170 - DNA, 22 bp, Artificial Sequence
  chemically synthesized
tgaatggatgccacagcaggtg

SEQ ID NO: 90171 - DNA, 22 bp, Artificial Sequence
  chemically synthesized
ttctacttttattccagcccca

SEQ ID NO: 90172 - DNA, 22 bp, Artificial Sequence
  chemically synthesized
tacttttattccagccccactg

SEQ ID NO: 90173 - DNA, 22 bp, Artificial Sequence
  chemically synthesized
cttttattccagccccactgac

SEQ ID NO: 90174 - DNA, 22 bp, Artificial Sequence
  chemically synthesized
ttattccagccccactgaccac

SEQ ID NO: 90175 - DNA, 22 bp, Artificial Sequence
  chemically synthesized
tattccagccccactgaccaca

SEQ ID NO: 90176 - DNA, 22 bp, Artificial Sequence
  chemically synthesized
attccagccccactgaccacaa

SEQ ID NO: 90177 - DNA, 22 bp, Artificial Sequence
  chemically synthesized
ttccagccccactgaccacaac

SEQ ID NO: 90178 - DNA, 22 bp, Artificial Sequence
  chemically synthesized
cagccccactgaccacaacaca

SEQ ID NO: 90179 - DNA, 22 bp, Artificial Sequence
  chemically synthesized
accacaacacacacacacacac

SEQ ID NO: 90180 - DNA, 22 bp, Artificial Sequence
  chemically synthesized
aaaaaagagacagcgagagaga

SEQ ID NO: 90181 - DNA, 22 bp, Artificial Sequence
  chemically synthesized
cctttactccagtctattaatc

SEQ ID NO: 90182 - DNA, 22 bp, Artificial Sequence
  chemically synthesized
ctttactccagtctattaatct

SEQ ID NO: 90183 - DNA, 22 bp, Artificial Sequence
  chemically synthesized
tactccagtctattaatctttc

SEQ ID NO: 90184 - DNA, 22 bp, Artificial Sequence
  chemically synthesized
actccagtctattaatctttct

SEQ ID NO: 90185 - DNA, 22 bp, Artificial Sequence
  chemically synthesized
ctccagtctattaatctttctt

SEQ ID NO: 90186 - DNA, 22 bp, Artificial Sequence
  chemically synthesized
cagtctattaatctttcttaag

SEQ ID NO: 90187 - DNA, 22 bp, Artificial Sequence
  chemically synthesized
ttaatctttcttaagtcctaat

SEQ ID NO: 90188 - DNA, 22 bp, Artificial Sequence
  chemically synthesized
atctttcttaagtcctaatgtt

SEQ ID NO: 90189 - DNA, 22 bp, Artificial Sequence
  chemically synthesized
tcttaagtcctaatgttttata

SEQ ID NO: 90190 - DNA, 22 bp, Artificial Sequence
  chemically synthesized
cttaagtcctaatgttttatat

SEQ ID NO: 90191 - DNA, 22 bp, Artificial Sequence
  chemically synthesized
ttaagtcctaatgttttatatc

SEQ ID NO: 90192 - DNA, 22 bp, Artificial Sequence
  chemically synthesized
aagtcctaatgttttatatcag

SEQ ID NO: 90193 - DNA, 22 bp, Artificial Sequence
  chemically synthesized
agtcctaatgttttatatcaga

SEQ ID NO: 90194 - DNA, 22 bp, Artificial Sequence
  chemically synthesized
atgttttatatcagaatggccc

SEQ ID NO: 90195 - DNA, 22 bp, Artificial Sequence
  chemically synthesized
tatatcagaatggccctagtct

SEQ ID NO: 90196 - DNA, 22 bp, Artificial Sequence
  chemically synthesized
atatcagaatggccctagtctg

SEQ ID NO: 90197 - DNA, 22 bp, Artificial Sequence
  chemically synthesized
tatcagaatggccctagtctgg

SEQ ID NO: 90198 - DNA, 22 bp, Artificial Sequence
  chemically synthesized
gtctgggtatacttagaggatg

SEQ ID NO: 90199 - DNA, 22 bp, Artificial Sequence
  chemically synthesized
ggtatacttagaggatgaatat

SEQ ID NO: 90200 - DNA, 22 bp, Artificial Sequence
  chemically synthesized
agaggatgaatattaacttcct

SEQ ID NO: 90201 - DNA, 22 bp, Artificial Sequence
  chemically synthesized
gaggatgaatattaacttcctc

SEQ ID NO: 90202 - DNA, 22 bp, Artificial Sequence
  chemically synthesized
acttcctccatgaaaatcatga

SEQ ID NO: 90203 - DNA, 22 bp, Artificial Sequence
  chemically synthesized
cctccatgaaaatcatgacact

SEQ ID NO: 90204 - DNA, 22 bp, Artificial Sequence
  chemically synthesized
ctccatgaaaatcatgacactc

SEQ ID NO: 90205 - DNA, 22 bp, Artificial Sequence
  chemically synthesized
catgaaaatcatgacactcatc

SEQ ID NO: 90206 - DNA, 22 bp, Artificial Sequence
  chemically synthesized
atctatgggagtgtggttttat

SEQ ID NO: 90207 - DNA, 22 bp, Artificial Sequence
  chemically synthesized
tgggagtgtggttttatcattt

SEQ ID NO: 90208 - DNA, 22 bp, Artificial Sequence
  chemically synthesized
tatcatttgtttcaaaagcagc

SEQ ID NO: 90209 - DNA, 22 bp, Artificial Sequence
  chemically synthesized
atcatttgtttcaaaagcagca

SEQ ID NO: 90210 - DNA, 22 bp, Artificial Sequence
  chemically synthesized
tcatttgtttcaaaagcagcac

SEQ ID NO: 90211 - DNA, 22 bp, Artificial Sequence
  chemically synthesized
gtttcaaaagcagcacttgact

SEQ ID NO: 90212 - DNA, 22 bp, Artificial Sequence
  chemically synthesized
tttcaaaagcagcacttgacta

SEQ ID NO: 90213 - DNA, 22 bp, Artificial Sequence
  chemically synthesized
caaaagcagcacttgactagag

SEQ ID NO: 90214 - DNA, 22 bp, Artificial Sequence
  chemically synthesized
aaaagcagcacttgactagagt

SEQ ID NO: 90215 - DNA, 22 bp, Artificial Sequence
  chemically synthesized
gactagagtatttttatacatg

SEQ ID NO: 90216 - DNA, 22 bp, Artificial Sequence
  chemically synthesized
actagagtatttttatacatgc

SEQ ID NO: 90217 - DNA, 22 bp, Artificial Sequence
  chemically synthesized
gagtatttttatacatgctcta

SEQ ID NO: 90218 - DNA, 22 bp, Artificial Sequence
  chemically synthesized
ttatacatgctctactgtttag

SEQ ID NO: 90219 - DNA, 22 bp, Artificial Sequence
  chemically synthesized
tatacatgctctactgtttagt

SEQ ID NO: 90220 - DNA, 22 bp, Artificial Sequence
  chemically synthesized
atacatgctctactgtttagtc

SEQ ID NO: 90221 - DNA, 22 bp, Artificial Sequence
  chemically synthesized
tacatgctctactgtttagtct

SEQ ID NO: 90222 - DNA, 22 bp, Artificial Sequence
  chemically synthesized
tactgtttagtctaaaattccc

SEQ ID NO: 90223 - DNA, 22 bp, Artificial Sequence
  chemically synthesized
ctgtttagtctaaaattcccca

SEQ ID NO: 90224 - DNA, 22 bp, Artificial Sequence
  chemically synthesized
tttagtctaaaattccccaagt

SEQ ID NO: 90225 - DNA, 22 bp, Artificial Sequence
  chemically synthesized
agtctaaaattccccaagtgag

SEQ ID NO: 90226 - DNA, 22 bp, Artificial Sequence
  chemically synthesized
gtctaaaattccccaagtgaga

SEQ ID NO: 90227 - DNA, 22 bp, Artificial Sequence
  chemically synthesized
aaattccccaagtgagacattt

SEQ ID NO: 90228 - DNA, 22 bp, Artificial Sequence
  chemically synthesized
cccaagtgagacattttagcaa

SEQ ID NO: 90229 - DNA, 22 bp, Artificial Sequence
  chemically synthesized
tagcaatctactgtatatgttc

SEQ ID NO: 90230 - DNA, 22 bp, Artificial Sequence
  chemically synthesized
agcaatctactgtatatgttcc

SEQ ID NO: 90231 - DNA, 22 bp, Artificial Sequence
  chemically synthesized
gcaatctactgtatatgttcct

SEQ ID NO: 90232 - DNA, 22 bp, Artificial Sequence
  chemically synthesized
ctgtatatgttcctaggtcaag

SEQ ID NO: 90233 - DNA, 22 bp, Artificial Sequence
  chemically synthesized
tatatgttcctaggtcaagcac

SEQ ID NO: 90234 - DNA, 22 bp, Artificial Sequence
  chemically synthesized
ctaggtcaagcacagtctagct

SEQ ID NO: 90235 - DNA, 22 bp, Artificial Sequence
  chemically synthesized
ggtcaagcacagtctagctact

SEQ ID NO: 90236 - DNA, 22 bp, Artificial Sequence
  chemically synthesized
gctacttgctacagacttctct

SEQ ID NO: 90237 - DNA, 22 bp, Artificial Sequence
  chemically synthesized
cttgctacagacttctctcgca

SEQ ID NO: 90238 - DNA, 22 bp, Artificial Sequence
  chemically synthesized
gctacagacttctctcgcagat

SEQ ID NO: 90239 - DNA, 22 bp, Artificial Sequence
  chemically synthesized
ctacagacttctctcgcagata

SEQ ID NO: 90240 - DNA, 22 bp, Artificial Sequence
  chemically synthesized
cagacttctctcgcagatacac

SEQ ID NO: 90241 - DNA, 22 bp, Artificial Sequence
  chemically synthesized
ctctcgcagatacacaatctct

SEQ ID NO: 90242 - DNA, 22 bp, Artificial Sequence
  chemically synthesized
tctcgcagatacacaatctctc

SEQ ID NO: 90243 - DNA, 22 bp, Artificial Sequence
  chemically synthesized
tcgcagatacacaatctctcag

SEQ ID NO: 90244 - DNA, 22 bp, Artificial Sequence
  chemically synthesized
gcagatacacaatctctcagta

SEQ ID NO: 90245 - DNA, 22 bp, Artificial Sequence
  chemically synthesized
tcagtaaacacaactcagcagc

SEQ ID NO: 90246 - DNA, 22 bp, Artificial Sequence
  chemically synthesized
agtaaacacaactcagcagctc

SEQ ID NO: 90247 - DNA, 22 bp, Artificial Sequence
  chemically synthesized
agcagctctcagaattaattaa

SEQ ID NO: 90248 - DNA, 22 bp, Artificial Sequence
  chemically synthesized
tcagaattaattaattaaaatg

SEQ ID NO: 90249 - DNA, 22 bp, Artificial Sequence
  chemically synthesized
agaattaattaattaaaatgaa

SEQ ID NO: 90250 - DNA, 22 bp, Artificial Sequence
  chemically synthesized
attaattaaaatgaaataaaaa

SEQ ID NO: 90251 - DNA, 22 bp, Artificial Sequence
  chemically synthesized
attaaaatgaaataaaaatgct

SEQ ID NO: 90252 - DNA, 22 bp, Artificial Sequence
  chemically synthesized
aaatgaaataaaaatgctccaa

SEQ ID NO: 90253 - DNA, 22 bp, Artificial Sequence
  chemically synthesized
caagaaaaccagaacccataga

SEQ ID NO: 90254 - DNA, 22 bp, Artificial Sequence
  chemically synthesized
ggaaataggatagtttagttca

SEQ ID NO: 90255 - DNA, 22 bp, Artificial Sequence
  chemically synthesized
gaaataggatagtttagttcac

SEQ ID NO: 90256 - DNA, 22 bp, Artificial Sequence
  chemically synthesized
agttcactttaaaaagttgtat

SEQ ID NO: 90257 - DNA, 22 bp, Artificial Sequence
  chemically synthesized
gttcactttaaaaagttgtatt

SEQ ID NO: 90258 - DNA, 22 bp, Artificial Sequence
  chemically synthesized
actttaaaaagttgtatttctt

SEQ ID NO: 90259 - DNA, 22 bp, Artificial Sequence
  chemically synthesized
taaaaagttgtatttcttacca

SEQ ID NO: 90260 - DNA, 22 bp, Artificial Sequence
  chemically synthesized
aaaaagttgtatttcttaccaa

SEQ ID NO: 90261 - DNA, 22 bp, Artificial Sequence
  chemically synthesized
aaaagttgtatttcttaccaaa

SEQ ID NO: 90262 - DNA, 22 bp, Artificial Sequence
  chemically synthesized
tatttcttaccaaaaagcaata

SEQ ID NO: 90263 - DNA, 22 bp, Artificial Sequence
  chemically synthesized
cttaccaaaaagcaataaagtc

SEQ ID NO: 90264 - DNA, 22 bp, Artificial Sequence
  chemically synthesized
ttaccaaaaagcaataaagtca

SEQ ID NO: 90265 - DNA, 22 bp, Artificial Sequence
  chemically synthesized
accaaaaagcaataaagtcaac

SEQ ID NO: 90266 - DNA, 22 bp, Artificial Sequence
  chemically synthesized
ccaaaaagcaataaagtcaaca

SEQ ID NO: 90267 - DNA, 22 bp, Artificial Sequence
  chemically synthesized
tgctaaagtatatgcataatta

SEQ ID NO: 90268 - DNA, 22 bp, Artificial Sequence
  chemically synthesized
gctaaagtatatgcataattat

SEQ ID NO: 90269 - DNA, 22 bp, Artificial Sequence
  chemically synthesized
ctaaagtatatgcataattatt

SEQ ID NO: 90270 - DNA, 22 bp, Artificial Sequence
  chemically synthesized
aagtatatgcataattattaca

SEQ ID NO: 90271 - DNA, 22 bp, Artificial Sequence
  chemically synthesized
ttacagaaaaatttatatttca

SEQ ID NO: 90272 - DNA, 22 bp, Artificial Sequence
  chemically synthesized
cagaaaaatttatatttcagtc

SEQ ID NO: 90273 - DNA, 22 bp, Artificial Sequence
  chemically synthesized
atatttcagtctgcaccttgtt

SEQ ID NO: 90274 - DNA, 22 bp, Artificial Sequence
  chemically synthesized
tatttcagtctgcaccttgttc

SEQ ID NO: 90275 - DNA, 22 bp, Artificial Sequence
  chemically synthesized
cagtctgcaccttgttcattaa

SEQ ID NO: 90276 - DNA, 22 bp, Artificial Sequence
  chemically synthesized
agtctgcaccttgttcattaat

SEQ ID NO: 90277 - DNA, 22 bp, Artificial Sequence
  chemically synthesized
caccttgttcattaatatttcc

SEQ ID NO: 90278 - DNA, 22 bp, Artificial Sequence
  chemically synthesized
gttcattaatatttcctccact

SEQ ID NO: 90279 - DNA, 22 bp, Artificial Sequence
  chemically synthesized
ttcattaatatttcctccactg

SEQ ID NO: 90280 - DNA, 22 bp, Artificial Sequence
  chemically synthesized
attaatatttcctccactgggc

SEQ ID NO: 90281 - DNA, 22 bp, Artificial Sequence
  chemically synthesized
atatttcctccactgggctcag

SEQ ID NO: 90282 - DNA, 22 bp, Artificial Sequence
  chemically synthesized
cctccactgggctcagattttc

SEQ ID NO: 90283 - DNA, 22 bp, Artificial Sequence
  chemically synthesized
ctccactgggctcagattttca

SEQ ID NO: 90284 - DNA, 22 bp, Artificial Sequence
  chemically synthesized
cactgggctcagattttcattc

SEQ ID NO: 90285 - DNA, 22 bp, Artificial Sequence
  chemically synthesized
ggctcagattttcattcagaat

SEQ ID NO: 90286 - DNA, 22 bp, Artificial Sequence
  chemically synthesized
agattttcattcagaattagct

SEQ ID NO: 90287 - DNA, 22 bp, Artificial Sequence
  chemically synthesized
tcattcagaattagcttttttt

SEQ ID NO: 90288 - DNA, 22 bp, Artificial Sequence
  chemically synthesized
cattcagaattagctttttttt

SEQ ID NO: 90289 - DNA, 22 bp, Artificial Sequence
  chemically synthesized
attcagaattagctttttttta

SEQ ID NO: 90290 - DNA, 22 bp, Artificial Sequence
  chemically synthesized
agaattagcttttttttaacct

SEQ ID NO: 90291 - DNA, 22 bp, Artificial Sequence
  chemically synthesized
gcttttttttaacctcattaag

SEQ ID NO: 90292 - DNA, 22 bp, Artificial Sequence
  chemically synthesized
ttttttaacctcattaagtggg

SEQ ID NO: 90293 - DNA, 22 bp, Artificial Sequence
  chemically synthesized
tttttaacctcattaagtgggc

SEQ ID NO: 90294 - DNA, 22 bp, Artificial Sequence
  chemically synthesized
ttttaacctcattaagtgggcc

SEQ ID NO: 90295 - DNA, 22 bp, Artificial Sequence
  chemically synthesized
tttaacctcattaagtgggcca

SEQ ID NO: 90296 - DNA, 22 bp, Artificial Sequence
  chemically synthesized
ttaacctcattaagtgggccat

SEQ ID NO: 90297 - DNA, 22 bp, Artificial Sequence
  chemically synthesized
taacctcattaagtgggccatg

SEQ ID NO: 90298 - DNA, 22 bp, Artificial Sequence
  chemically synthesized
aacctcattaagtgggccatgg

SEQ ID NO: 90299 - DNA, 22 bp, Artificial Sequence
  chemically synthesized
acctcattaagtgggccatggt

SEQ ID NO: 90300 - DNA, 22 bp, Artificial Sequence
  chemically synthesized
attaagtgggccatggtgtcaa

SEQ ID NO: 90301 - DNA, 22 bp, Artificial Sequence
  chemically synthesized
agtgggccatggtgtcaattta

SEQ ID NO: 90302 - DNA, 22 bp, Artificial Sequence
  chemically synthesized
atggagagcagaggtacagtct

SEQ ID NO: 90303 - DNA, 22 bp, Artificial Sequence
  chemically synthesized
tggagagcagaggtacagtctt

SEQ ID NO: 90304 - DNA, 22 bp, Artificial Sequence
  chemically synthesized
cagataaatttgagattgcatc

SEQ ID NO: 90305 - DNA, 22 bp, Artificial Sequence
  chemically synthesized
agataaatttgagattgcatct

SEQ ID NO: 90306 - DNA, 22 bp, Artificial Sequence
  chemically synthesized
gagattgcatctctttagaggt

SEQ ID NO: 90307 - DNA, 22 bp, Artificial Sequence
  chemically synthesized
agattgcatctctttagaggta

SEQ ID NO: 90308 - DNA, 22 bp, Artificial Sequence
  chemically synthesized
catctctttagaggtagaatct

SEQ ID NO: 90309 - DNA, 22 bp, Artificial Sequence
  chemically synthesized
tttagaggtagaatcttggctt

SEQ ID NO: 90310 - DNA, 22 bp, Artificial Sequence
  chemically synthesized
tagaggtagaatcttggcttca

SEQ ID NO: 90311 - DNA, 22 bp, Artificial Sequence
  chemically synthesized
agaggtagaatcttggcttcag

SEQ ID NO: 90312 - DNA, 22 bp, Artificial Sequence
  chemically synthesized
gaggtagaatcttggcttcagt

SEQ ID NO: 90313 - DNA, 22 bp, Artificial Sequence
  chemically synthesized
ggcttcagtctgaacacccttt

SEQ ID NO: 90314 - DNA, 22 bp, Artificial Sequence
  chemically synthesized
gcttcagtctgaacacccttta

SEQ ID NO: 90315 - DNA, 22 bp, Artificial Sequence
  chemically synthesized
cagtctgaacaccctttacaaa

SEQ ID NO: 90316 - DNA, 22 bp, Artificial Sequence
  chemically synthesized
agtctgaacaccctttacaaac

SEQ ID NO: 90317 - DNA, 22 bp, Artificial Sequence
  chemically synthesized
aacaccctttacaaacatgtag

SEQ ID NO: 90318 - DNA, 22 bp, Artificial Sequence
  chemically synthesized
tacaaacatgtaggcattaatt

SEQ ID NO: 90319 - DNA, 22 bp, Artificial Sequence
  chemically synthesized
acaaacatgtaggcattaattc

SEQ ID NO: 90320 - DNA, 22 bp, Artificial Sequence
  chemically synthesized
caaacatgtaggcattaattca

SEQ ID NO: 90321 - DNA, 22 bp, Artificial Sequence
  chemically synthesized
attcagaggactgctctgaagc

SEQ ID NO: 90322 - DNA, 22 bp, Artificial Sequence
  chemically synthesized
agaggactgctctgaagctcaa

SEQ ID NO: 90323 - DNA, 22 bp, Artificial Sequence
  chemically synthesized
ctctgaagctcaagagatggat

SEQ ID NO: 90324 - DNA, 22 bp, Artificial Sequence
  chemically synthesized
tgaagctcaagagatggatgat

SEQ ID NO: 90325 - DNA, 22 bp, Artificial Sequence
  chemically synthesized
aagctcaagagatggatgattt

SEQ ID NO: 90326 - DNA, 22 bp, Artificial Sequence
  chemically synthesized
aagagatggatgatttaggaga

SEQ ID NO: 90327 - DNA, 22 bp, Artificial Sequence
  chemically synthesized
aggagactattaggcttaattc

SEQ ID NO: 90328 - DNA, 22 bp, Artificial Sequence
  chemically synthesized
ggagactattaggcttaattct

SEQ ID NO: 90329 - DNA, 22 bp, Artificial Sequence
  chemically synthesized
ttaggcttaattctcctgacat

SEQ ID NO: 90330 - DNA, 22 bp, Artificial Sequence
  chemically synthesized
ggcttaattctcctgacattaa

SEQ ID NO: 90331 - DNA, 22 bp, Artificial Sequence
  chemically synthesized
aattctcctgacattaaattat

SEQ ID NO: 90332 - DNA, 22 bp, Artificial Sequence
  chemically synthesized
attctcctgacattaaattatt

SEQ ID NO: 90333 - DNA, 22 bp, Artificial Sequence
  chemically synthesized
tcctgacattaaattattttat

SEQ ID NO: 90334 - DNA, 22 bp, Artificial Sequence
  chemically synthesized
ctgacattaaattattttattg

SEQ ID NO: 90335 - DNA, 22 bp, Artificial Sequence
  chemically synthesized
acattaaattattttattgaaa

SEQ ID NO: 90336 - DNA, 22 bp, Artificial Sequence
  chemically synthesized
aattattttattgaaaaatttt

SEQ ID NO: 90337 - DNA, 22 bp, Artificial Sequence
  chemically synthesized
ttttattgaaaaattttcatga

SEQ ID NO: 90338 - DNA, 22 bp, Artificial Sequence
  chemically synthesized
tattgaaaaattttcatgaact

SEQ ID NO: 90339 - DNA, 22 bp, Artificial Sequence
  chemically synthesized
attgaaaaattttcatgaactc

SEQ ID NO: 90340 - DNA, 22 bp, Artificial Sequence
  chemically synthesized
ttgaaaaattttcatgaactca

SEQ ID NO: 90341 - DNA, 22 bp, Artificial Sequence
  chemically synthesized
aaaaattttcatgaactcaaat

SEQ ID NO: 90342 - DNA, 22 bp, Artificial Sequence
  chemically synthesized
tcatgaactcaaattcacatta

SEQ ID NO: 90343 - DNA, 22 bp, Artificial Sequence
  chemically synthesized
catgaactcaaattcacattat

SEQ ID NO: 90344 - DNA, 22 bp, Artificial Sequence
  chemically synthesized
atgaactcaaattcacattatt

SEQ ID NO: 90345 - DNA, 22 bp, Artificial Sequence
  chemically synthesized
aaattcacattattacgtcctc

SEQ ID NO: 90346 - DNA, 22 bp, Artificial Sequence
  chemically synthesized
acattattacgtcctctcttcc

SEQ ID NO: 90347 - DNA, 22 bp, Artificial Sequence
  chemically synthesized
ttacgtcctctcttcccttcct

SEQ ID NO: 90348 - DNA, 22 bp, Artificial Sequence
  chemically synthesized
cgtcctctcttcccttcctctc

SEQ ID NO: 90349 - DNA, 22 bp, Artificial Sequence
  chemically synthesized
tcttcccttcctctctccctct

SEQ ID NO: 90350 - DNA, 22 bp, Artificial Sequence
  chemically synthesized
ttcccttcctctctccctctct

SEQ ID NO: 90351 - DNA, 22 bp, Artificial Sequence
  chemically synthesized
cccttcctctctccctctcttt

SEQ ID NO: 90352 - DNA, 22 bp, Artificial Sequence
  chemically synthesized
ccttcctctctccctctctttc

SEQ ID NO: 90353 - DNA, 22 bp, Artificial Sequence
  chemically synthesized
cctctctccctctctttcacac

SEQ ID NO: 90354 - DNA, 22 bp, Artificial Sequence
  chemically synthesized
ctctctccctctctttcacaca

SEQ ID NO: 90355 - DNA, 22 bp, Artificial Sequence
  chemically synthesized
tctccctctctttcacacacac

SEQ ID NO: 90356 - DNA, 22 bp, Artificial Sequence
  chemically synthesized
tccctctctttcacacacacac

SEQ ID NO: 90357 - DNA, 22 bp, Artificial Sequence
  chemically synthesized
cctctctttcacacacacacac

SEQ ID NO: 90358 - DNA, 22 bp, Artificial Sequence
  chemically synthesized
tctttcacacacacacacaccc

SEQ ID NO: 90359 - DNA, 22 bp, Artificial Sequence
  chemically synthesized
tttcacacacacacacaccctt

SEQ ID NO: 90360 - DNA, 22 bp, Artificial Sequence
  chemically synthesized
tcacacacacacacaccctttc

SEQ ID NO: 90361 - DNA, 22 bp, Artificial Sequence
  chemically synthesized
cacacacacacacaccctttca

SEQ ID NO: 90362 - DNA, 22 bp, Artificial Sequence
  chemically synthesized
acacacacacacaccctttcat

SEQ ID NO: 90363 - DNA, 22 bp, Artificial Sequence
  chemically synthesized
tcattcagacatactgaacata

SEQ ID NO: 90364 - DNA, 22 bp, Artificial Sequence
  chemically synthesized
cattcagacatactgaacatag

SEQ ID NO: 90365 - DNA, 22 bp, Artificial Sequence
  chemically synthesized
attcagacatactgaacatagt

SEQ ID NO: 90366 - DNA, 22 bp, Artificial Sequence
  chemically synthesized
agacatactgaacatagtttat

SEQ ID NO: 90367 - DNA, 22 bp, Artificial Sequence
  chemically synthesized
aacatagtttataaagcaacgc

SEQ ID NO: 90368 - DNA, 22 bp, Artificial Sequence
  chemically synthesized
ataaagcaacgccatagtgaga

SEQ ID NO: 90369 - DNA, 22 bp, Artificial Sequence
  chemically synthesized
taaagcaacgccatagtgagaa

SEQ ID NO: 90370 - DNA, 22 bp, Artificial Sequence
  chemically synthesized
gataaattatcaaataaaatta

SEQ ID NO: 90371 - DNA, 22 bp, Artificial Sequence
  chemically synthesized
ataaattatcaaataaaattaa

SEQ ID NO: 90372 - DNA, 22 bp, Artificial Sequence
  chemically synthesized
tcaaataaaattaaagccaaat

SEQ ID NO: 90373 - DNA, 22 bp, Artificial Sequence
  chemically synthesized
aagccaaatcttgaggaattaa

SEQ ID NO: 90374 - DNA, 22 bp, Artificial Sequence
  chemically synthesized
gaggaattaattccattcctat

SEQ ID NO: 90375 - DNA, 22 bp, Artificial Sequence
  chemically synthesized
aggaattaattccattcctata

SEQ ID NO: 90376 - DNA, 22 bp, Artificial Sequence
  chemically synthesized
attccattcctatactttgttt

SEQ ID NO: 90377 - DNA, 22 bp, Artificial Sequence
  chemically synthesized
cattcctatactttgttttaac

SEQ ID NO: 90378 - DNA, 22 bp, Artificial Sequence
  chemically synthesized
ctatactttgttttaactttca

SEQ ID NO: 90379 - DNA, 22 bp, Artificial Sequence
  chemically synthesized
tactttgttttaactttcattt

SEQ ID NO: 90380 - DNA, 22 bp, Artificial Sequence
  chemically synthesized
tgttttaactttcattttaaat

SEQ ID NO: 90381 - DNA, 22 bp, Artificial Sequence
  chemically synthesized
gttttaactttcattttaaatt

SEQ ID NO: 90382 - DNA, 22 bp, Artificial Sequence
  chemically synthesized
ttttaactttcattttaaattt

SEQ ID NO: 90383 - DNA, 22 bp, Artificial Sequence
  chemically synthesized
taactttcattttaaatttggg

SEQ ID NO: 90384 - DNA, 22 bp, Artificial Sequence
  chemically synthesized
aactttcattttaaatttgggg

SEQ ID NO: 90385 - DNA, 22 bp, Artificial Sequence
  chemically synthesized
actttcattttaaatttggggg

SEQ ID NO: 90386 - DNA, 22 bp, Artificial Sequence
  chemically synthesized
tcattttaaatttgggggtaca

SEQ ID NO: 90387 - DNA, 22 bp, Artificial Sequence
  chemically synthesized
cattttaaatttgggggtacat

SEQ ID NO: 90388 - DNA, 22 bp, Artificial Sequence
  chemically synthesized
attttaaatttgggggtacatg

SEQ ID NO: 90389 - DNA, 22 bp, Artificial Sequence
  chemically synthesized
taaatttgggggtacatgtaca

SEQ ID NO: 90390 - DNA, 22 bp, Artificial Sequence
  chemically synthesized
aaatttgggggtacatgtacaa

SEQ ID NO: 90391 - DNA, 22 bp, Artificial Sequence
  chemically synthesized
aatttgggggtacatgtacaag

SEQ ID NO: 90392 - DNA, 22 bp, Artificial Sequence
  chemically synthesized
gggggtacatgtacaagttata

SEQ ID NO: 90393 - DNA, 22 bp, Artificial Sequence
  chemically synthesized
ggggtacatgtacaagttatat

SEQ ID NO: 90394 - DNA, 22 bp, Artificial Sequence
  chemically synthesized
tataggtaaattgcatatcact

SEQ ID NO: 90395 - DNA, 22 bp, Artificial Sequence
  chemically synthesized
catatcactgggtcttgatgta

SEQ ID NO: 90396 - DNA, 22 bp, Artificial Sequence
  chemically synthesized
ggtcttgatgtacagattattt

SEQ ID NO: 90397 - DNA, 22 bp, Artificial Sequence
  chemically synthesized
gatgtacagattatttcatcac

SEQ ID NO: 90398 - DNA, 22 bp, Artificial Sequence
  chemically synthesized
atgtacagattatttcatcact

SEQ ID NO: 90399 - DNA, 22 bp, Artificial Sequence
  chemically synthesized
tttcatcactcagtgatgaact

SEQ ID NO: 90400 - DNA, 22 bp, Artificial Sequence
  chemically synthesized
catcactcagtgatgaacttaa

SEQ ID NO: 90401 - DNA, 22 bp, Artificial Sequence
  chemically synthesized
atcactcagtgatgaacttaat

SEQ ID NO: 90402 - DNA, 22 bp, Artificial Sequence
  chemically synthesized
agtgatgaacttaatacccaat

SEQ ID NO: 90403 - DNA, 22 bp, Artificial Sequence
  chemically synthesized
aatacccaataggttctttttc

SEQ ID NO: 90404 - DNA, 22 bp, Artificial Sequence
  chemically synthesized
atacccaataggttctttttca

SEQ ID NO: 90405 - DNA, 22 bp, Artificial Sequence
  chemically synthesized
tttttcatcgtctccctcttcc

SEQ ID NO: 90406 - DNA, 22 bp, Artificial Sequence
  chemically synthesized
tttcatcgtctccctcttccca

SEQ ID NO: 90407 - DNA, 22 bp, Artificial Sequence
  chemically synthesized
ttcatcgtctccctcttcccac

SEQ ID NO: 90408 - DNA, 22 bp, Artificial Sequence
  chemically synthesized
tcatcgtctccctcttcccacc

SEQ ID NO: 90409 - DNA, 22 bp, Artificial Sequence
  chemically synthesized
catcgtctccctcttcccaccc

SEQ ID NO: 90410 - DNA, 22 bp, Artificial Sequence
  chemically synthesized
atcgtctccctcttcccaccct

SEQ ID NO: 90411 - DNA, 22 bp, Artificial Sequence
  chemically synthesized
cctcttcccaccctcaaccctc

SEQ ID NO: 90412 - DNA, 22 bp, Artificial Sequence
  chemically synthesized
ttcccaccctcaaccctcaagt

SEQ ID NO: 90413 - DNA, 22 bp, Artificial Sequence
  chemically synthesized
cccaccctcaaccctcaagtag

SEQ ID NO: 90414 - DNA, 22 bp, Artificial Sequence
  chemically synthesized
ccaccctcaaccctcaagtagg

SEQ ID NO: 90415 - DNA, 22 bp, Artificial Sequence
  chemically synthesized
aaccctcaagtaggcctgggtg

SEQ ID NO: 90416 - DNA, 22 bp, Artificial Sequence
  chemically synthesized
aagtaggcctgggtgtctgttg

SEQ ID NO: 90417 - DNA, 22 bp, Artificial Sequence
  chemically synthesized
ggtgtctgttgatctatttttt

SEQ ID NO: 90418 - DNA, 22 bp, Artificial Sequence
  chemically synthesized
ttgatctattttttgtgtccat

SEQ ID NO: 90419 - DNA, 22 bp, Artificial Sequence
  chemically synthesized
atctattttttgtgtccatgtg

SEQ ID NO: 90420 - DNA, 22 bp, Artificial Sequence
  chemically synthesized
ttttttgtgtccatgtgtatca

SEQ ID NO: 90421 - DNA, 22 bp, Artificial Sequence
  chemically synthesized
tttgtgtccatgtgtatcatca

SEQ ID NO: 90422 - DNA, 22 bp, Artificial Sequence
  chemically synthesized
ttgtgtccatgtgtatcatcat

SEQ ID NO: 90423 - DNA, 22 bp, Artificial Sequence
  chemically synthesized
tgtgtccatgtgtatcatcatt

SEQ ID NO: 90424 - DNA, 22 bp, Artificial Sequence
  chemically synthesized
gtgtccatgtgtatcatcattt

SEQ ID NO: 90425 - DNA, 22 bp, Artificial Sequence
  chemically synthesized
tgtccatgtgtatcatcattta

SEQ ID NO: 90426 - DNA, 22 bp, Artificial Sequence
  chemically synthesized
agctcccacactcctagactct

SEQ ID NO: 90427 - DNA, 22 bp, Artificial Sequence
  chemically synthesized
gctcccacactcctagactctt

SEQ ID NO: 90428 - DNA, 22 bp, Artificial Sequence
  chemically synthesized
ccacactcctagactcttacaa

SEQ ID NO: 90429 - DNA, 22 bp, Artificial Sequence
  chemically synthesized
ctagactcttacaaaagctcta

SEQ ID NO: 90430 - DNA, 22 bp, Artificial Sequence
  chemically synthesized
gactcttacaaaagctctactc

SEQ ID NO: 90431 - DNA, 22 bp, Artificial Sequence
  chemically synthesized
ttacaaaagctctactctaaca

SEQ ID NO: 90432 - DNA, 22 bp, Artificial Sequence
  chemically synthesized
acaaaagctctactctaacaaa

SEQ ID NO: 90433 - DNA, 22 bp, Artificial Sequence
  chemically synthesized
caaaagctctactctaacaaat

SEQ ID NO: 90434 - DNA, 22 bp, Artificial Sequence
  chemically synthesized
tactctaacaaataattttaat

SEQ ID NO: 90435 - DNA, 22 bp, Artificial Sequence
  chemically synthesized
ctctaacaaataattttaatat

SEQ ID NO: 90436 - DNA, 22 bp, Artificial Sequence
  chemically synthesized
taacaaataattttaatataac

SEQ ID NO: 90437 - DNA, 22 bp, Artificial Sequence
  chemically synthesized
acaaataattttaatataacaa

SEQ ID NO: 90438 - DNA, 22 bp, Artificial Sequence
  chemically synthesized
taatataacaacaaggtgccaa

SEQ ID NO: 90439 - DNA, 22 bp, Artificial Sequence
  chemically synthesized
aatataacaacaaggtgccaag

SEQ ID NO: 90440 - DNA, 22 bp, Artificial Sequence
  chemically synthesized
atataacaacaaggtgccaagt

SEQ ID NO: 90441 - DNA, 22 bp, Artificial Sequence
  chemically synthesized
ttttcatctcttgacctcctca

SEQ ID NO: 90442 - DNA, 22 bp, Artificial Sequence
  chemically synthesized
tttcatctcttgacctcctcat

SEQ ID NO: 90443 - DNA, 22 bp, Artificial Sequence
  chemically synthesized
ttcatctcttgacctcctcatc

SEQ ID NO: 90444 - DNA, 22 bp, Artificial Sequence
  chemically synthesized
tcatctcttgacctcctcatct

SEQ ID NO: 90445 - DNA, 22 bp, Artificial Sequence
  chemically synthesized
catctcttgacctcctcatctt

SEQ ID NO: 90446 - DNA, 22 bp, Artificial Sequence
  chemically synthesized
atctcttgacctcctcatcttc

SEQ ID NO: 90447 - DNA, 22 bp, Artificial Sequence
  chemically synthesized
ttgacctcctcatcttcaatat

SEQ ID NO: 90448 - DNA, 22 bp, Artificial Sequence
  chemically synthesized
gacctcctcatcttcaatatga

SEQ ID NO: 90449 - DNA, 22 bp, Artificial Sequence
  chemically synthesized
acctcctcatcttcaatatgaa

SEQ ID NO: 90450 - DNA, 22 bp, Artificial Sequence
  chemically synthesized
ctcatcttcaatatgaagatag

SEQ ID NO: 90451 - DNA, 22 bp, Artificial Sequence
  chemically synthesized
atcttcaatatgaagatagcaa

SEQ ID NO: 90452 - DNA, 22 bp, Artificial Sequence
  chemically synthesized
caatatgaagatagcaatgcct

SEQ ID NO: 90453 - DNA, 22 bp, Artificial Sequence
  chemically synthesized
aatatgaagatagcaatgccta

SEQ ID NO: 90454 - DNA, 22 bp, Artificial Sequence
  chemically synthesized
gcatatagtaattgtgtgtgct

SEQ ID NO: 90455 - DNA, 22 bp, Artificial Sequence
  chemically synthesized
tgtgtgctcggcacatgtccca

SEQ ID NO: 90456 - DNA, 22 bp, Artificial Sequence
  chemically synthesized
ggcacatgtcccatccaggtga

SEQ ID NO: 90457 - DNA, 22 bp, Artificial Sequence
  chemically synthesized
tcatgaattctctggtatttgg

SEQ ID NO: 90458 - DNA, 22 bp, Artificial Sequence
  chemically synthesized
atgaattctctggtatttggat

SEQ ID NO: 90459 - DNA, 22 bp, Artificial Sequence
  chemically synthesized
tctggtatttggatttttaggg

SEQ ID NO: 90460 - DNA, 22 bp, Artificial Sequence
  chemically synthesized
tggtatttggatttttagggcc

SEQ ID NO: 90461 - DNA, 22 bp, Artificial Sequence
  chemically synthesized
gtatttggatttttagggccaa

SEQ ID NO: 90462 - DNA, 22 bp, Artificial Sequence
  chemically synthesized
ggatttttagggccaacatctt

SEQ ID NO: 90463 - DNA, 22 bp, Artificial Sequence
  chemically synthesized
gatttttagggccaacatcttg

SEQ ID NO: 90464 - DNA, 22 bp, Artificial Sequence
  chemically synthesized
ttagggccaacatcttgcctag

SEQ ID NO: 90465 - DNA, 22 bp, Artificial Sequence
  chemically synthesized
tagggccaacatcttgcctaga

SEQ ID NO: 90466 - DNA, 22 bp, Artificial Sequence
  chemically synthesized
agggccaacatcttgcctagac

SEQ ID NO: 90467 - DNA, 22 bp, Artificial Sequence
  chemically synthesized
gggccaacatcttgcctagact

SEQ ID NO: 90468 - DNA, 22 bp, Artificial Sequence
  chemically synthesized
gcctagactcactgactacttc

SEQ ID NO: 90469 - DNA, 22 bp, Artificial Sequence
  chemically synthesized
cctagactcactgactacttct

SEQ ID NO: 90470 - DNA, 22 bp, Artificial Sequence
  chemically synthesized
gactcactgactacttctaatg

SEQ ID NO: 90471 - DNA, 22 bp, Artificial Sequence
  chemically synthesized
actgactacttctaatggtgta

SEQ ID NO: 90472 - DNA, 22 bp, Artificial Sequence
  chemically synthesized
actacttctaatggtgtaggaa

SEQ ID NO: 90473 - DNA, 22 bp, Artificial Sequence
  chemically synthesized
cttctaatggtgtaggaataga

SEQ ID NO: 90474 - DNA, 22 bp, Artificial Sequence
  chemically synthesized
ctaatggtgtaggaatagaagg

SEQ ID NO: 90475 - DNA, 22 bp, Artificial Sequence
  chemically synthesized
taatggtgtaggaatagaaggt

SEQ ID NO: 90476 - DNA, 22 bp, Artificial Sequence
  chemically synthesized
atggtgtaggaatagaaggtat

SEQ ID NO: 90477 - DNA, 22 bp, Artificial Sequence
  chemically synthesized
tatttgctctttttttttgact

SEQ ID NO: 90478 - DNA, 22 bp, Artificial Sequence
  chemically synthesized
gctctttttttttgacttttgg

SEQ ID NO: 90479 - DNA, 22 bp, Artificial Sequence
  chemically synthesized
ctctttttttttgacttttgga

SEQ ID NO: 90480 - DNA, 22 bp, Artificial Sequence
  chemically synthesized
tttttttttgacttttggagaa

SEQ ID NO: 90481 - DNA, 22 bp, Artificial Sequence
  chemically synthesized
tttttttgacttttggagaaag

SEQ ID NO: 90482 - DNA, 22 bp, Artificial Sequence
  chemically synthesized
ttttttgacttttggagaaagg

SEQ ID NO: 90483 - DNA, 22 bp, Artificial Sequence
  chemically synthesized
tttttgacttttggagaaagga

SEQ ID NO: 90484 - DNA, 22 bp, Artificial Sequence
  chemically synthesized
ttttgacttttggagaaaggaa

SEQ ID NO: 90485 - DNA, 22 bp, Artificial Sequence
  chemically synthesized
tttgacttttggagaaaggaat

SEQ ID NO: 90486 - DNA, 22 bp, Artificial Sequence
  chemically synthesized
ttgacttttggagaaaggaatg

SEQ ID NO: 90487 - DNA, 22 bp, Artificial Sequence
  chemically synthesized
tgacttttggagaaaggaatgt

SEQ ID NO: 90488 - DNA, 22 bp, Artificial Sequence
  chemically synthesized
gacttttggagaaaggaatgta

SEQ ID NO: 90489 - DNA, 22 bp, Artificial Sequence
  chemically synthesized
acttttggagaaaggaatgtag

SEQ ID NO: 90490 - DNA, 22 bp, Artificial Sequence
  chemically synthesized
ttggagaaaggaatgtagtttg

SEQ ID NO: 90491 - DNA, 22 bp, Artificial Sequence
  chemically synthesized
tggagaaaggaatgtagtttgt

SEQ ID NO: 90492 - DNA, 22 bp, Artificial Sequence
  chemically synthesized
ggagaaaggaatgtagtttgtt

SEQ ID NO: 90493 - DNA, 22 bp, Artificial Sequence
  chemically synthesized
gagaaaggaatgtagtttgttt

SEQ ID NO: 90494 - DNA, 22 bp, Artificial Sequence
  chemically synthesized
gttttccctatcaagatcataa

SEQ ID NO: 90495 - DNA, 22 bp, Artificial Sequence
  chemically synthesized
ttttccctatcaagatcataag

SEQ ID NO: 90496 - DNA, 22 bp, Artificial Sequence
  chemically synthesized
tccctatcaagatcataaggtc

SEQ ID NO: 90497 - DNA, 22 bp, Artificial Sequence
  chemically synthesized
ccctatcaagatcataaggtct

SEQ ID NO: 90498 - DNA, 22 bp, Artificial Sequence
  chemically synthesized
cctatcaagatcataaggtcta

SEQ ID NO: 90499 - DNA, 22 bp, Artificial Sequence
  chemically synthesized
tcaagatcataaggtctacaat

SEQ ID NO: 90500 - DNA, 22 bp, Artificial Sequence
  chemically synthesized
caatctctcttactgtctttcg

SEQ ID NO: 90501 - DNA, 22 bp, Artificial Sequence
  chemically synthesized
tcttactgtctttcgaatacca

SEQ ID NO: 90502 - DNA, 22 bp, Artificial Sequence
  chemically synthesized
ttactgtctttcgaataccaca

SEQ ID NO: 90503 - DNA, 22 bp, Artificial Sequence
  chemically synthesized
actgtctttcgaataccacaca

SEQ ID NO: 90504 - DNA, 22 bp, Artificial Sequence
  chemically synthesized
ctgtctttcgaataccacacaa

SEQ ID NO: 90505 - DNA, 22 bp, Artificial Sequence
  chemically synthesized
tctttcgaataccacacaagta

SEQ ID NO: 90506 - DNA, 22 bp, Artificial Sequence
  chemically synthesized
tcgaataccacacaagtatctc

SEQ ID NO: 90507 - DNA, 22 bp, Artificial Sequence
  chemically synthesized
cgaataccacacaagtatctcc

SEQ ID NO: 90508 - DNA, 22 bp, Artificial Sequence
  chemically synthesized
gaataccacacaagtatctcct

SEQ ID NO: 90509 - DNA, 22 bp, Artificial Sequence
  chemically synthesized
cttttaatatcttactcttatg

SEQ ID NO: 90510 - DNA, 22 bp, Artificial Sequence
  chemically synthesized
ttaatatcttactcttatgaga

SEQ ID NO: 90511 - DNA, 22 bp, Artificial Sequence
  chemically synthesized
taatatcttactcttatgagaa

SEQ ID NO: 90512 - DNA, 22 bp, Artificial Sequence
  chemically synthesized
aatatcttactcttatgagaac

SEQ ID NO: 90513 - DNA, 22 bp, Artificial Sequence
  chemically synthesized
atatcttactcttatgagaact

SEQ ID NO: 90514 - DNA, 22 bp, Artificial Sequence
  chemically synthesized
actcttatgagaacttccctat

SEQ ID NO: 90515 - DNA, 22 bp, Artificial Sequence
  chemically synthesized
ctcttatgagaacttccctatg

SEQ ID NO: 90516 - DNA, 22 bp, Artificial Sequence
  chemically synthesized
ttatgagaacttccctatgctc

SEQ ID NO: 90517 - DNA, 22 bp, Artificial Sequence
  chemically synthesized
atgagaacttccctatgctcag

SEQ ID NO: 90518 - DNA, 22 bp, Artificial Sequence
  chemically synthesized
tgagaacttccctatgctcagg

SEQ ID NO: 90519 - DNA, 22 bp, Artificial Sequence
  chemically synthesized
ccctatgctcaggaatgtgaaa

SEQ ID NO: 90520 - DNA, 22 bp, Artificial Sequence
  chemically synthesized
cctatgctcaggaatgtgaaag

SEQ ID NO: 90521 - DNA, 22 bp, Artificial Sequence
  chemically synthesized
tgctcaggaatgtgaaagtgat

SEQ ID NO: 90522 - DNA, 22 bp, Artificial Sequence
  chemically synthesized
aggaatgtgaaagtgatcttcc

SEQ ID NO: 90523 - DNA, 22 bp, Artificial Sequence
  chemically synthesized
ccccaaaatgccctgagtagct

SEQ ID NO: 90524 - DNA, 22 bp, Artificial Sequence
  chemically synthesized
cccaaaatgccctgagtagctc

SEQ ID NO: 90525 - DNA, 22 bp, Artificial Sequence
  chemically synthesized
agtagctctgcttctgatatgt

SEQ ID NO: 90526 - DNA, 22 bp, Artificial Sequence
  chemically synthesized
tgcttctgatatgtaaaccagt

SEQ ID NO: 90527 - DNA, 22 bp, Artificial Sequence
  chemically synthesized
cttctgatatgtaaaccagtgg

SEQ ID NO: 90528 - DNA, 22 bp, Artificial Sequence
  chemically synthesized
ctgatatgtaaaccagtggttc

SEQ ID NO: 90529 - DNA, 22 bp, Artificial Sequence
  chemically synthesized
tgatatgtaaaccagtggttcc

SEQ ID NO: 90530 - DNA, 22 bp, Artificial Sequence
  chemically synthesized
atatgtaaaccagtggttccta

SEQ ID NO: 90531 - DNA, 22 bp, Artificial Sequence
  chemically synthesized
ctaaatatcttattcagatata

SEQ ID NO: 90532 - DNA, 22 bp, Artificial Sequence
  chemically synthesized
aatatcttattcagatataaag

SEQ ID NO: 90533 - DNA, 22 bp, Artificial Sequence
  chemically synthesized
attcagatataaagagttctca

SEQ ID NO: 90534 - DNA, 22 bp, Artificial Sequence
  chemically synthesized
ttcagatataaagagttctcag

SEQ ID NO: 90535 - DNA, 22 bp, Artificial Sequence
  chemically synthesized
agatataaagagttctcagtgc

SEQ ID NO: 90536 - DNA, 22 bp, Artificial Sequence
  chemically synthesized
tcagtgcctactatgtataatg

SEQ ID NO: 90537 - DNA, 22 bp, Artificial Sequence
  chemically synthesized
agtgcctactatgtataatgac

SEQ ID NO: 90538 - DNA, 22 bp, Artificial Sequence
  chemically synthesized
ctatgtataatgacttaaggaa

SEQ ID NO: 90539 - DNA, 22 bp, Artificial Sequence
  chemically synthesized
tgtataatgacttaaggaaaac

SEQ ID NO: 90540 - DNA, 22 bp, Artificial Sequence
  chemically synthesized
aaggaaaacacatggatataaa

SEQ ID NO: 90541 - DNA, 22 bp, Artificial Sequence
  chemically synthesized
aggaaaacacatggatataaaa

SEQ ID NO: 90542 - DNA, 22 bp, Artificial Sequence
  chemically synthesized
ctgctgccagtcaattcaaaat

SEQ ID NO: 90543 - DNA, 22 bp, Artificial Sequence
  chemically synthesized
tgctgccagtcaattcaaaatg

SEQ ID NO: 90544 - DNA, 22 bp, Artificial Sequence
  chemically synthesized
ctgccagtcaattcaaaatgtt

SEQ ID NO: 90545 - DNA, 22 bp, Artificial Sequence
  chemically synthesized
ccagtcaattcaaaatgttgtg

SEQ ID NO: 90546 - DNA, 22 bp, Artificial Sequence
  chemically synthesized
aaaatgttgtgatcaaaacagt

SEQ ID NO: 90547 - DNA, 22 bp, Artificial Sequence
  chemically synthesized
tgatcaaaacagttaactataa

SEQ ID NO: 90548 - DNA, 22 bp, Artificial Sequence
  chemically synthesized
actataacacattgtcagtata

SEQ ID NO: 90549 - DNA, 22 bp, Artificial Sequence
  chemically synthesized
taacacattgtcagtatattct

SEQ ID NO: 90550 - DNA, 22 bp, Artificial Sequence
  chemically synthesized
tcagtatattctggcagtacag

SEQ ID NO: 90551 - DNA, 22 bp, Artificial Sequence
  chemically synthesized
tggcagtacagacagagttact

SEQ ID NO: 90552 - DNA, 22 bp, Artificial Sequence
  chemically synthesized
gcagtacagacagagttactgt

SEQ ID NO: 90553 - DNA, 22 bp, Artificial Sequence
  chemically synthesized
ctgtgaaagcactttcaaacac

SEQ ID NO: 90554 - DNA, 22 bp, Artificial Sequence
  chemically synthesized
tgaaagcactttcaaacacaag

SEQ ID NO: 90555 - DNA, 22 bp, Artificial Sequence
  chemically synthesized
tcaaacacaaggaaacaacaga

SEQ ID NO: 90556 - DNA, 22 bp, Artificial Sequence
  chemically synthesized
caaacacaaggaaacaacagat

SEQ ID NO: 90557 - DNA, 22 bp, Artificial Sequence
  chemically synthesized
aaacacaaggaaacaacagatt

SEQ ID NO: 90558 - DNA, 22 bp, Artificial Sequence
  chemically synthesized
tgtttaggtattcaagtaagtt

SEQ ID NO: 90559 - DNA, 22 bp, Artificial Sequence
  chemically synthesized
tttaggtattcaagtaagttta

SEQ ID NO: 90560 - DNA, 22 bp, Artificial Sequence
  chemically synthesized
aggtattcaagtaagtttaaaa

SEQ ID NO: 90561 - DNA, 22 bp, Artificial Sequence
  chemically synthesized
ggtattcaagtaagtttaaaat

SEQ ID NO: 90562 - DNA, 22 bp, Artificial Sequence
  chemically synthesized
aagtaagtttaaaattaatcaa

SEQ ID NO: 90563 - DNA, 22 bp, Artificial Sequence
  chemically synthesized
aaaattaatcaacatgcatata

SEQ ID NO: 90564 - DNA, 22 bp, Artificial Sequence
  chemically synthesized
aaattaatcaacatgcatataa

SEQ ID NO: 90565 - DNA, 22 bp, Artificial Sequence
  chemically synthesized
atcaacatgcatataatacaga

SEQ ID NO: 90566 - DNA, 22 bp, Artificial Sequence
  chemically synthesized
ttaaaaatgtatacaactgaga

SEQ ID NO: 90567 - DNA, 22 bp, Artificial Sequence
  chemically synthesized
taaaaatgtatacaactgagaa

SEQ ID NO: 90568 - DNA, 22 bp, Artificial Sequence
  chemically synthesized
aaaaatgtatacaactgagaaa

SEQ ID NO: 90569 - DNA, 22 bp, Artificial Sequence
  chemically synthesized
aaaatgtatacaactgagaaag

SEQ ID NO: 90570 - DNA, 22 bp, Artificial Sequence
  chemically synthesized
agaaagttctaaaaatccttct

SEQ ID NO: 90571 - DNA, 22 bp, Artificial Sequence
  chemically synthesized
taaaaatccttctaattttacc

SEQ ID NO: 90572 - DNA, 22 bp, Artificial Sequence
  chemically synthesized
aaaatccttctaattttaccta

SEQ ID NO: 90573 - DNA, 22 bp, Artificial Sequence
  chemically synthesized
ctaattttacctatggcaaaaa

SEQ ID NO: 90574 - DNA, 22 bp, Artificial Sequence
  chemically synthesized
taattttacctatggcaaaaat

SEQ ID NO: 90575 - DNA, 22 bp, Artificial Sequence
  chemically synthesized
attttacctatggcaaaaatgg

SEQ ID NO: 90576 - DNA, 22 bp, Artificial Sequence
  chemically synthesized
tacctatggcaaaaatggtgct

SEQ ID NO: 90577 - DNA, 22 bp, Artificial Sequence
  chemically synthesized
acctatggcaaaaatggtgctc

SEQ ID NO: 90578 - DNA, 22 bp, Artificial Sequence
  chemically synthesized
cctatggcaaaaatggtgctca

SEQ ID NO: 90579 - DNA, 22 bp, Artificial Sequence
  chemically synthesized
tggcaaaaatggtgctcaagga

SEQ ID NO: 90580 - DNA, 22 bp, Artificial Sequence
  chemically synthesized
aaggaaaaaaatattactccta

SEQ ID NO: 90581 - DNA, 22 bp, Artificial Sequence
  chemically synthesized
ctcctatgatcagaaaggaaat

SEQ ID NO: 90582 - DNA, 22 bp, Artificial Sequence
  chemically synthesized
ctatgatcagaaaggaaataac

SEQ ID NO: 90583 - DNA, 22 bp, Artificial Sequence
  chemically synthesized
tgatcagaaaggaaataactgt

SEQ ID NO: 90584 - DNA, 22 bp, Artificial Sequence
  chemically synthesized
ttcggttgtttactgcatgctt

SEQ ID NO: 90585 - DNA, 22 bp, Artificial Sequence
  chemically synthesized
ggttgtttactgcatgcttcct

SEQ ID NO: 90586 - DNA, 22 bp, Artificial Sequence
  chemically synthesized
tttactgcatgcttcctctttg

SEQ ID NO: 90587 - DNA, 22 bp, Artificial Sequence
  chemically synthesized
actgcatgcttcctctttgtat

SEQ ID NO: 90588 - DNA, 22 bp, Artificial Sequence
  chemically synthesized
ctgcatgcttcctctttgtatg

SEQ ID NO: 90589 - DNA, 22 bp, Artificial Sequence
  chemically synthesized
catgcttcctctttgtatgttg

SEQ ID NO: 90590 - DNA, 22 bp, Artificial Sequence
  chemically synthesized
cctctttgtatgttgtagcatt

SEQ ID NO: 90591 - DNA, 22 bp, Artificial Sequence
  chemically synthesized
ctctttgtatgttgtagcatta

SEQ ID NO: 90592 - DNA, 22 bp, Artificial Sequence
  chemically synthesized
tttgtatgttgtagcattaaca

SEQ ID NO: 90593 - DNA, 22 bp, Artificial Sequence
  chemically synthesized
tgtatgttgtagcattaacaac

SEQ ID NO: 90594 - DNA, 22 bp, Artificial Sequence
  chemically synthesized
gtatgttgtagcattaacaaca

SEQ ID NO: 90595 - DNA, 22 bp, Artificial Sequence
  chemically synthesized
tatgttgtagcattaacaacaa

SEQ ID NO: 90596 - DNA, 22 bp, Artificial Sequence
  chemically synthesized
tagcattaacaacaaagaaaca

SEQ ID NO: 90597 - DNA, 22 bp, Artificial Sequence
  chemically synthesized
acaacaaagaaacactgtgcga

SEQ ID NO: 90598 - DNA, 22 bp, Artificial Sequence
  chemically synthesized
tgcgatggtattattaatattg

SEQ ID NO: 90599 - DNA, 22 bp, Artificial Sequence
  chemically synthesized
ttaatattgtcctctaattcca

SEQ ID NO: 90600 - DNA, 22 bp, Artificial Sequence
  chemically synthesized
atattgtcctctaattccagaa

SEQ ID NO: 90601 - DNA, 22 bp, Artificial Sequence
  chemically synthesized
tcctctaattccagaagttcta

SEQ ID NO: 90602 - DNA, 22 bp, Artificial Sequence
  chemically synthesized
taattccagaagttctaaagca

SEQ ID NO: 90603 - DNA, 22 bp, Artificial Sequence
  chemically synthesized
attccagaagttctaaagcaag

SEQ ID NO: 90604 - DNA, 22 bp, Artificial Sequence
  chemically synthesized
cagaagttctaaagcaaggaat

SEQ ID NO: 90605 - DNA, 22 bp, Artificial Sequence
  chemically synthesized
taaagcaaggaataatcattcc

SEQ ID NO: 90606 - DNA, 22 bp, Artificial Sequence
  chemically synthesized
aagcaaggaataatcattcctt

SEQ ID NO: 90607 - DNA, 22 bp, Artificial Sequence
  chemically synthesized
cttcatttactcatttactcat

SEQ ID NO: 90608 - DNA, 22 bp, Artificial Sequence
  chemically synthesized
catttactcatttactcattcg

SEQ ID NO: 90609 - DNA, 22 bp, Artificial Sequence
  chemically synthesized
atttactcatttactcattcgt

SEQ ID NO: 90610 - DNA, 22 bp, Artificial Sequence
  chemically synthesized
actcatttactcattcgttcat

SEQ ID NO: 90611 - DNA, 22 bp, Artificial Sequence
  chemically synthesized
ctcatttactcattcgttcatt

SEQ ID NO: 90612 - DNA, 22 bp, Artificial Sequence
  chemically synthesized
atttactcattcgttcattcat

SEQ ID NO: 90613 - DNA, 22 bp, Artificial Sequence
  chemically synthesized
actcattcgttcattcattcac

SEQ ID NO: 90614 - DNA, 22 bp, Artificial Sequence
  chemically synthesized
ctcattcgttcattcattcact

SEQ ID NO: 90615 - DNA, 22 bp, Artificial Sequence
  chemically synthesized
attcgttcattcattcactgtt

SEQ ID NO: 90616 - DNA, 22 bp, Artificial Sequence
  chemically synthesized
gttcattcattcactgttttct

SEQ ID NO: 90617 - DNA, 22 bp, Artificial Sequence
  chemically synthesized
attcattcactgttttcttgaa

SEQ ID NO: 90618 - DNA, 22 bp, Artificial Sequence
  chemically synthesized
attcactgttttcttgaataaa

SEQ ID NO: 90619 - DNA, 22 bp, Artificial Sequence
  chemically synthesized
actgttttcttgaataaatatt

SEQ ID NO: 90620 - DNA, 22 bp, Artificial Sequence
  chemically synthesized
ttttcttgaataaatattttct

SEQ ID NO: 90621 - DNA, 22 bp, Artificial Sequence
  chemically synthesized
tcttgaataaatattttctttc

SEQ ID NO: 90622 - DNA, 22 bp, Artificial Sequence
  chemically synthesized
cttgaataaatattttctttct

SEQ ID NO: 90623 - DNA, 22 bp, Artificial Sequence
  chemically synthesized
ttgaataaatattttctttctg

SEQ ID NO: 90624 - DNA, 22 bp, Artificial Sequence
  chemically synthesized
gaataaatattttctttctgcc

SEQ ID NO: 90625 - DNA, 22 bp, Artificial Sequence
  chemically synthesized
aataaatattttctttctgccc

SEQ ID NO: 90626 - DNA, 22 bp, Artificial Sequence
  chemically synthesized
tctttctgcccattgatgaatt

SEQ ID NO: 90627 - DNA, 22 bp, Artificial Sequence
  chemically synthesized
ctttctgcccattgatgaattt

SEQ ID NO: 90628 - DNA, 22 bp, Artificial Sequence
  chemically synthesized
tttctgcccattgatgaattta

SEQ ID NO: 90629 - DNA, 22 bp, Artificial Sequence
  chemically synthesized
tctgcccattgatgaatttaat

SEQ ID NO: 90630 - DNA, 22 bp, Artificial Sequence
  chemically synthesized
ctgcccattgatgaatttaata

SEQ ID NO: 90631 - DNA, 22 bp, Artificial Sequence
  chemically synthesized
tgcccattgatgaatttaatat

SEQ ID NO: 90632 - DNA, 22 bp, Artificial Sequence
  chemically synthesized
cccattgatgaatttaatatga

SEQ ID NO: 90633 - DNA, 22 bp, Artificial Sequence
  chemically synthesized
atgaatttaatatgaggcacag

SEQ ID NO: 90634 - DNA, 22 bp, Artificial Sequence
  chemically synthesized
aatatgaggcacagtaggcatg

SEQ ID NO: 90635 - DNA, 22 bp, Artificial Sequence
  chemically synthesized
atatgaggcacagtaggcatgt

SEQ ID NO: 90636 - DNA, 22 bp, Artificial Sequence
  chemically synthesized
cttataaagcacggagtgtgtg

SEQ ID NO: 90637 - DNA, 22 bp, Artificial Sequence
  chemically synthesized
ataaagcacggagtgtgtgtgt

SEQ ID NO: 90638 - DNA, 22 bp, Artificial Sequence
  chemically synthesized
taaagcacggagtgtgtgtgtg

SEQ ID NO: 90639 - DNA, 22 bp, Artificial Sequence
  chemically synthesized
ggaaagattttttgggtagtat

SEQ ID NO: 90640 - DNA, 22 bp, Artificial Sequence
  chemically synthesized
gaaagattttttgggtagtata

SEQ ID NO: 90641 - DNA, 22 bp, Artificial Sequence
  chemically synthesized
tttgggtagtatagagaagttt

SEQ ID NO: 90642 - DNA, 22 bp, Artificial Sequence
  chemically synthesized
ttgggtagtatagagaagttta

SEQ ID NO: 90643 - DNA, 22 bp, Artificial Sequence
  chemically synthesized
tgggtagtatagagaagtttat

SEQ ID NO: 90644 - DNA, 22 bp, Artificial Sequence
  chemically synthesized
gggtagtatagagaagtttatt

SEQ ID NO: 90645 - DNA, 22 bp, Artificial Sequence
  chemically synthesized
ggtagtatagagaagtttattg

SEQ ID NO: 90646 - DNA, 22 bp, Artificial Sequence
  chemically synthesized
attgtggctggggtcaagagag

SEQ ID NO: 90647 - DNA, 22 bp, Artificial Sequence
  chemically synthesized
ttgtggctggggtcaagagagg

SEQ ID NO: 90648 - DNA, 22 bp, Artificial Sequence
  chemically synthesized
tggctggggtcaagagaggtca

SEQ ID NO: 90649 - DNA, 22 bp, Artificial Sequence
  chemically synthesized
gggtcaagagaggtcacaagta

SEQ ID NO: 90650 - DNA, 22 bp, Artificial Sequence
  chemically synthesized
gactgaaatatgggaagataag

SEQ ID NO: 90651 - DNA, 22 bp, Artificial Sequence
  chemically synthesized
actgaaatatgggaagataaga

SEQ ID NO: 90652 - DNA, 22 bp, Artificial Sequence
  chemically synthesized
aaatatgggaagataagaggaa

SEQ ID NO: 90653 - DNA, 22 bp, Artificial Sequence
  chemically synthesized
tttacagagatgttctggggca

SEQ ID NO: 90654 - DNA, 22 bp, Artificial Sequence
  chemically synthesized
tacagagatgttctggggcaag

SEQ ID NO: 90655 - DNA, 22 bp, Artificial Sequence
  chemically synthesized
acagagatgttctggggcaagt

SEQ ID NO: 90656 - DNA, 22 bp, Artificial Sequence
  chemically synthesized
cagagatgttctggggcaagta

SEQ ID NO: 90657 - DNA, 22 bp, Artificial Sequence
  chemically synthesized
tggggcaagtaagaggaggaag

SEQ ID NO: 90658 - DNA, 22 bp, Artificial Sequence
  chemically synthesized
gggcaagtaagaggaggaagct

SEQ ID NO: 90659 - DNA, 22 bp, Artificial Sequence
  chemically synthesized
tttcttggagcaggaacacttg

SEQ ID NO: 90660 - DNA, 22 bp, Artificial Sequence
  chemically synthesized
cttggagcaggaacacttgatg

SEQ ID NO: 90661 - DNA, 22 bp, Artificial Sequence
  chemically synthesized
ttggagcaggaacacttgatgg

SEQ ID NO: 90662 - DNA, 22 bp, Artificial Sequence
  chemically synthesized
ggagcaggaacacttgatgggg

SEQ ID NO: 90663 - DNA, 22 bp, Artificial Sequence
  chemically synthesized
gagcaggaacacttgatggggt

SEQ ID NO: 90664 - DNA, 22 bp, Artificial Sequence
  chemically synthesized
gatggggtatagtattatgggc

SEQ ID NO: 90665 - DNA, 22 bp, Artificial Sequence
  chemically synthesized
atggggtatagtattatgggct

SEQ ID NO: 90666 - DNA, 22 bp, Artificial Sequence
  chemically synthesized
tgggctacaatgtgcaggcaaa

SEQ ID NO: 90667 - DNA, 22 bp, Artificial Sequence
  chemically synthesized
caatgtgcaggcaaaggaagga

SEQ ID NO: 90668 - DNA, 22 bp, Artificial Sequence
  chemically synthesized
tcttgagtaatcattatgcctt

SEQ ID NO: 90669 - DNA, 22 bp, Artificial Sequence
  chemically synthesized
gagtaatcattatgcctttaat

SEQ ID NO: 90670 - DNA, 22 bp, Artificial Sequence
  chemically synthesized
agtaatcattatgcctttaatt

SEQ ID NO: 90671 - DNA, 22 bp, Artificial Sequence
  chemically synthesized
tgcctttaattgagcacattat

SEQ ID NO: 90672 - DNA, 22 bp, Artificial Sequence
  chemically synthesized
taattgagcacattattttctc

SEQ ID NO: 90673 - DNA, 22 bp, Artificial Sequence
  chemically synthesized
aattgagcacattattttctca

SEQ ID NO: 90674 - DNA, 22 bp, Artificial Sequence
  chemically synthesized
attgagcacattattttctcag

SEQ ID NO: 90675 - DNA, 22 bp, Artificial Sequence
  chemically synthesized
agcacattattttctcagtaat

SEQ ID NO: 90676 - DNA, 22 bp, Artificial Sequence
  chemically synthesized
ttttctcagtaattgttggagt

SEQ ID NO: 90677 - DNA, 22 bp, Artificial Sequence
  chemically synthesized
tctcagtaattgttggagttta

SEQ ID NO: 90678 - DNA, 22 bp, Artificial Sequence
  chemically synthesized
ctcagtaattgttggagtttaa

SEQ ID NO: 90679 - DNA, 22 bp, Artificial Sequence
  chemically synthesized
tcagtaattgttggagtttaat

SEQ ID NO: 90680 - DNA, 22 bp, Artificial Sequence
  chemically synthesized
agtaattgttggagtttaatcg

SEQ ID NO: 90681 - DNA, 22 bp, Artificial Sequence
  chemically synthesized
ttggagtttaatcgtagcatta

SEQ ID NO: 90682 - DNA, 22 bp, Artificial Sequence
  chemically synthesized
gagtttaatcgtagcattaccc

SEQ ID NO: 90683 - DNA, 22 bp, Artificial Sequence
  chemically synthesized
aatcgtagcattacccttgagg

SEQ ID NO: 90684 - DNA, 22 bp, Artificial Sequence
  chemically synthesized
atcgtagcattacccttgaggc

SEQ ID NO: 90685 - DNA, 22 bp, Artificial Sequence
  chemically synthesized
cccttgaggctatgtcttaggg

SEQ ID NO: 90686 - DNA, 22 bp, Artificial Sequence
  chemically synthesized
gaggctatgtcttagggttgag

SEQ ID NO: 90687 - DNA, 22 bp, Artificial Sequence
  chemically synthesized
aggctatgtcttagggttgagg

SEQ ID NO: 90688 - DNA, 22 bp, Artificial Sequence
  chemically synthesized
tgtcttagggttgaggtcttcc

SEQ ID NO: 90689 - DNA, 22 bp, Artificial Sequence
  chemically synthesized
agggttgaggtcttccctagaa

SEQ ID NO: 90690 - DNA, 22 bp, Artificial Sequence
  chemically synthesized
gggttgaggtcttccctagaac

SEQ ID NO: 90691 - DNA, 22 bp, Artificial Sequence
  chemically synthesized
aggtcttccctagaacctctgc

SEQ ID NO: 90692 - DNA, 22 bp, Artificial Sequence
  chemically synthesized
ccctagaacctctgcagtgcca

SEQ ID NO: 90693 - DNA, 22 bp, Artificial Sequence
  chemically synthesized
cctagaacctctgcagtgccag

SEQ ID NO: 90694 - DNA, 22 bp, Artificial Sequence
  chemically synthesized
gaacctctgcagtgccagtatt

SEQ ID NO: 90695 - DNA, 22 bp, Artificial Sequence
  chemically synthesized
tgcagtgccagtattatctttg

SEQ ID NO: 90696 - DNA, 22 bp, Artificial Sequence
  chemically synthesized
cagtgccagtattatctttgta

SEQ ID NO: 90697 - DNA, 22 bp, Artificial Sequence
  chemically synthesized
tctttgtatcaagagttcttga

SEQ ID NO: 90698 - DNA, 22 bp, Artificial Sequence
  chemically synthesized
tgtatcaagagttcttgataat

SEQ ID NO: 90699 - DNA, 22 bp, Artificial Sequence
  chemically synthesized
gtatcaagagttcttgataatt

SEQ ID NO: 90700 - DNA, 22 bp, Artificial Sequence
  chemically synthesized
tatcaagagttcttgataattt

SEQ ID NO: 90701 - DNA, 22 bp, Artificial Sequence
  chemically synthesized
ttgataatttctgctctttgga

SEQ ID NO: 90702 - DNA, 22 bp, Artificial Sequence
  chemically synthesized
gataatttctgctctttggagg

SEQ ID NO: 90703 - DNA, 22 bp, Artificial Sequence
  chemically synthesized
ataatttctgctctttggaggt

SEQ ID NO: 90704 - DNA, 22 bp, Artificial Sequence
  chemically synthesized
ctgctctttggaggtagaagtg

SEQ ID NO: 90705 - DNA, 22 bp, Artificial Sequence
  chemically synthesized
tgctctttggaggtagaagtgt

SEQ ID NO: 90706 - DNA, 22 bp, Artificial Sequence
  chemically synthesized
ctctttggaggtagaagtgtca

SEQ ID NO: 90707 - DNA, 22 bp, Artificial Sequence
  chemically synthesized
tttggaggtagaagtgtcaccc

SEQ ID NO: 90708 - DNA, 22 bp, Artificial Sequence
  chemically synthesized
tggaggtagaagtgtcacccat

SEQ ID NO: 90709 - DNA, 22 bp, Artificial Sequence
  chemically synthesized
ggaggtagaagtgtcacccatt

SEQ ID NO: 90710 - DNA, 22 bp, Artificial Sequence
  chemically synthesized
gaggtagaagtgtcacccatta

SEQ ID NO: 90711 - DNA, 22 bp, Artificial Sequence
  chemically synthesized
atgccttgtacggttcccttgc

SEQ ID NO: 90712 - DNA, 22 bp, Artificial Sequence
  chemically synthesized
gtacggttcccttgcttttctc

SEQ ID NO: 90713 - DNA, 22 bp, Artificial Sequence
  chemically synthesized
tacggttcccttgcttttctct

SEQ ID NO: 90714 - DNA, 22 bp, Artificial Sequence
  chemically synthesized
ccttgcttttctcttttcccat

SEQ ID NO: 90715 - DNA, 22 bp, Artificial Sequence
  chemically synthesized
gcttttctcttttcccatgtac

SEQ ID NO: 90716 - DNA, 22 bp, Artificial Sequence
  chemically synthesized
cttttctcttttcccatgtact

SEQ ID NO: 90717 - DNA, 22 bp, Artificial Sequence
  chemically synthesized
ttctcttttcccatgtactctt

SEQ ID NO: 90718 - DNA, 22 bp, Artificial Sequence
  chemically synthesized
tctcttttcccatgtactcttt

SEQ ID NO: 90719 - DNA, 22 bp, Artificial Sequence
  chemically synthesized
ctcttttcccatgtactctttg

SEQ ID NO: 90720 - DNA, 22 bp, Artificial Sequence
  chemically synthesized
tcttttcccatgtactctttgt

SEQ ID NO: 90721 - DNA, 22 bp, Artificial Sequence
  chemically synthesized
ttttcccatgtactctttgtaa

SEQ ID NO: 90722 - DNA, 22 bp, Artificial Sequence
  chemically synthesized
ttcccatgtactctttgtaaaa

SEQ ID NO: 90723 - DNA, 22 bp, Artificial Sequence
  chemically synthesized
tcccatgtactctttgtaaaat

SEQ ID NO: 90724 - DNA, 22 bp, Artificial Sequence
  chemically synthesized
cccatgtactctttgtaaaata

SEQ ID NO: 90725 - DNA, 22 bp, Artificial Sequence
  chemically synthesized
ccatgtactctttgtaaaataa

SEQ ID NO: 90726 - DNA, 22 bp, Artificial Sequence
  chemically synthesized
tttgtaaaataaacaagtgctc

SEQ ID NO: 90727 - DNA, 22 bp, Artificial Sequence
  chemically synthesized
tgtaaaataaacaagtgctccc

SEQ ID NO: 90728 - DNA, 22 bp, Artificial Sequence
  chemically synthesized
gtaaaataaacaagtgctccct

SEQ ID NO: 90729 - DNA, 22 bp, Artificial Sequence
  chemically synthesized
taaaataaacaagtgctcccta

SEQ ID NO: 90730 - DNA, 22 bp, Artificial Sequence
  chemically synthesized
cctatctgtagagcctcaggaa

SEQ ID NO: 90731 - DNA, 22 bp, Artificial Sequence
  chemically synthesized
tctgtagagcctcaggaacctt

SEQ ID NO: 90732 - DNA, 22 bp, Artificial Sequence
  chemically synthesized
tagagcctcaggaaccttctta

SEQ ID NO: 90733 - DNA, 22 bp, Artificial Sequence
  chemically synthesized
aggaaccttcttacacacctgg

SEQ ID NO: 90734 - DNA, 22 bp, Artificial Sequence
  chemically synthesized
cttacacacctggacaaaaaaa

SEQ ID NO: 90735 - DNA, 22 bp, Artificial Sequence
  chemically synthesized
ttacacacctggacaaaaaaat

SEQ ID NO: 90736 - DNA, 22 bp, Artificial Sequence
  chemically synthesized
acacacctggacaaaaaaatga

SEQ ID NO: 90737 - DNA, 22 bp, Artificial Sequence
  chemically synthesized
cacacctggacaaaaaaatgaa

SEQ ID NO: 90738 - DNA, 22 bp, Artificial Sequence
  chemically synthesized
gacaaaaaaatgaaataagtga

SEQ ID NO: 90739 - DNA, 22 bp, Artificial Sequence
  chemically synthesized
atcaggaagttgagctgaacat

SEQ ID NO: 90740 - DNA, 22 bp, Artificial Sequence
  chemically synthesized
agctgaacattctttattaggc

SEQ ID NO: 90741 - DNA, 22 bp, Artificial Sequence
  chemically synthesized
aacattctttattaggcagaag

SEQ ID NO: 90742 - DNA, 22 bp, Artificial Sequence
  chemically synthesized
tttattaggcagaagccatacc

SEQ ID NO: 90743 - DNA, 22 bp, Artificial Sequence
  chemically synthesized
tattaggcagaagccataccct

SEQ ID NO: 90744 - DNA, 22 bp, Artificial Sequence
  chemically synthesized
attaggcagaagccataccctt

SEQ ID NO: 90745 - DNA, 22 bp, Artificial Sequence
  chemically synthesized
ttaggcagaagccatacccttg

SEQ ID NO: 90746 - DNA, 22 bp, Artificial Sequence
  chemically synthesized
ggcagaagccatacccttgaag

SEQ ID NO: 90747 - DNA, 22 bp, Artificial Sequence
  chemically synthesized
gaagtaggcattgtgttcccaa

SEQ ID NO: 90748 - DNA, 22 bp, Artificial Sequence
  chemically synthesized
aagtaggcattgtgttcccaag

SEQ ID NO: 90749 - DNA, 22 bp, Artificial Sequence
  chemically synthesized
tgttcccaagttcagaaaatag

SEQ ID NO: 90750 - DNA, 22 bp, Artificial Sequence
  chemically synthesized
ccaagttcagaaaatagaatct

SEQ ID NO: 90751 - DNA, 22 bp, Artificial Sequence
  chemically synthesized
agaaaatagaatctagggaaat

SEQ ID NO: 90752 - DNA, 22 bp, Artificial Sequence
  chemically synthesized
gggaaatagggtcttcttatgg

SEQ ID NO: 90753 - DNA, 22 bp, Artificial Sequence
  chemically synthesized
cttatggttatcaggaaacagt

SEQ ID NO: 90754 - DNA, 22 bp, Artificial Sequence
  chemically synthesized
ttatggttatcaggaaacagtc

SEQ ID NO: 90755 - DNA, 22 bp, Artificial Sequence
  chemically synthesized
atggttatcaggaaacagtcca

SEQ ID NO: 90756 - DNA, 22 bp, Artificial Sequence
  chemically synthesized
tggttatcaggaaacagtccag

SEQ ID NO: 90757 - DNA, 22 bp, Artificial Sequence
  chemically synthesized
tcaggaaacagtccaggatctc

SEQ ID NO: 90758 - DNA, 22 bp, Artificial Sequence
  chemically synthesized
aatggtacttgtgagccagggc

SEQ ID NO: 90759 - DNA, 22 bp, Artificial Sequence
  chemically synthesized
gtgagccagggcattagccaca

SEQ ID NO: 90760 - DNA, 22 bp, Artificial Sequence
  chemically synthesized
tgagccagggcattagccacac

SEQ ID NO: 90761 - DNA, 22 bp, Artificial Sequence
  chemically synthesized
gccacaccagccaccaccttct

SEQ ID NO: 90762 - DNA, 22 bp, Artificial Sequence
  chemically synthesized
ctgataggcagcctgcatttgt

SEQ ID NO: 90763 - DNA, 22 bp, Artificial Sequence
  chemically synthesized
tgataggcagcctgcatttgtg

SEQ ID NO: 90764 - DNA, 22 bp, Artificial Sequence
  chemically synthesized
ataggcagcctgcatttgtggg

SEQ ID NO: 90765 - DNA, 22 bp, Artificial Sequence
  chemically synthesized
catttgtggggtgaattccttg

SEQ ID NO: 90766 - DNA, 22 bp, Artificial Sequence
  chemically synthesized
gtggggtgaattccttgccaaa

SEQ ID NO: 90767 - DNA, 22 bp, Artificial Sequence
  chemically synthesized
tggggtgaattccttgccaaag

SEQ ID NO: 90768 - DNA, 22 bp, Artificial Sequence
  chemically synthesized
cttgccaaagttgcgggccagc

SEQ ID NO: 90769 - DNA, 22 bp, Artificial Sequence
  chemically synthesized
gccaaagttgcgggccagcaca

SEQ ID NO: 90770 - DNA, 22 bp, Artificial Sequence
  chemically synthesized
ccaaagttgcgggccagcacac

SEQ ID NO: 90771 - DNA, 22 bp, Artificial Sequence
  chemically synthesized
cgggccagcacacacaccagca

SEQ ID NO: 90772 - DNA, 22 bp, Artificial Sequence
  chemically synthesized
cccaagagctgcggagaagagg

SEQ ID NO: 90773 - DNA, 22 bp, Artificial Sequence
  chemically synthesized
cggagaagaggtaggcagatac

SEQ ID NO: 90774 - DNA, 22 bp, Artificial Sequence
  chemically synthesized
acagagaaataaagactggctt

SEQ ID NO: 90775 - DNA, 22 bp, Artificial Sequence
  chemically synthesized
gcttctgagaaactgagccaac

SEQ ID NO: 90776 - DNA, 22 bp, Artificial Sequence
  chemically synthesized
ctgagaaactgagccaacaccc

SEQ ID NO: 90777 - DNA, 22 bp, Artificial Sequence
  chemically synthesized
tgagaaactgagccaacaccca

SEQ ID NO: 90778 - DNA, 22 bp, Artificial Sequence
  chemically synthesized
agaaactgagccaacacccatt

SEQ ID NO: 90779 - DNA, 22 bp, Artificial Sequence
  chemically synthesized
agccaacacccatttttttctg

SEQ ID NO: 90780 - DNA, 22 bp, Artificial Sequence
  chemically synthesized
ttttctgcccaaatcttagaca

SEQ ID NO: 90781 - DNA, 22 bp, Artificial Sequence
  chemically synthesized
tttctgcccaaatcttagacaa

SEQ ID NO: 90782 - DNA, 22 bp, Artificial Sequence
  chemically synthesized
ttctgcccaaatcttagacaaa

SEQ ID NO: 90783 - DNA, 22 bp, Artificial Sequence
  chemically synthesized
tctgcccaaatcttagacaaaa

SEQ ID NO: 90784 - DNA, 22 bp, Artificial Sequence
  chemically synthesized
ctgcccaaatcttagacaaaac

SEQ ID NO: 90785 - DNA, 22 bp, Artificial Sequence
  chemically synthesized
tgcccaaatcttagacaaaact

SEQ ID NO: 90786 - DNA, 22 bp, Artificial Sequence
  chemically synthesized
cccaaatcttagacaaaactga

SEQ ID NO: 90787 - DNA, 22 bp, Artificial Sequence
  chemically synthesized
agacaaaactgatccccaggtt

SEQ ID NO: 90788 - DNA, 22 bp, Artificial Sequence
  chemically synthesized
gacaaaactgatccccaggtta

SEQ ID NO: 90789 - DNA, 22 bp, Artificial Sequence
  chemically synthesized
atccccaggttattcccatcag

SEQ ID NO: 90790 - DNA, 22 bp, Artificial Sequence
  chemically synthesized
ttcccatcagcataaataagta

SEQ ID NO: 90791 - DNA, 22 bp, Artificial Sequence
  chemically synthesized
ccatcagcataaataagtacat

SEQ ID NO: 90792 - DNA, 22 bp, Artificial Sequence
  chemically synthesized
tacacacacatcctctatgtac

SEQ ID NO: 90793 - DNA, 22 bp, Artificial Sequence
  chemically synthesized
tatgtacttaactagcatgtag

SEQ ID NO: 90794 - DNA, 22 bp, Artificial Sequence
  chemically synthesized
tgtacttaactagcatgtagtc

SEQ ID NO: 90795 - DNA, 22 bp, Artificial Sequence
  chemically synthesized
aactagcatgtagtctatatat

SEQ ID NO: 90796 - DNA, 22 bp, Artificial Sequence
  chemically synthesized
actagcatgtagtctatatatg

SEQ ID NO: 90797 - DNA, 22 bp, Artificial Sequence
  chemically synthesized
gcatgtagtctatatatgtaca

SEQ ID NO: 90798 - DNA, 22 bp, Artificial Sequence
  chemically synthesized
tatatgtacatatatgctatat

SEQ ID NO: 90799 - DNA, 22 bp, Artificial Sequence
  chemically synthesized
tatatgctgtataatactatat

SEQ ID NO: 90800 - DNA, 22 bp, Artificial Sequence
  chemically synthesized
tataatactatatacaaattaa

SEQ ID NO: 90801 - DNA, 22 bp, Artificial Sequence
  chemically synthesized
tatacaaattaattccaaatta

SEQ ID NO: 90802 - DNA, 22 bp, Artificial Sequence
  chemically synthesized
attccaaattagttttaatttt

SEQ ID NO: 90803 - DNA, 22 bp, Artificial Sequence
  chemically synthesized
caaattagttttaattttgtat

SEQ ID NO: 90804 - DNA, 22 bp, Artificial Sequence
  chemically synthesized
gttttaattttgtatgtgtata

SEQ ID NO: 90805 - DNA, 22 bp, Artificial Sequence
  chemically synthesized
taattttgtatgtgtatatagc

SEQ ID NO: 90806 - DNA, 22 bp, Artificial Sequence
  chemically synthesized
aattttgtatgtgtatatagca

SEQ ID NO: 90807 - DNA, 22 bp, Artificial Sequence
  chemically synthesized
attttgtatgtgtatatagcat

SEQ ID NO: 90808 - DNA, 22 bp, Artificial Sequence
  chemically synthesized
tgtatgtgtatatagcatatac

SEQ ID NO: 90809 - DNA, 22 bp, Artificial Sequence
  chemically synthesized
gtatgtgtatatagcatataca

SEQ ID NO: 90810 - DNA, 22 bp, Artificial Sequence
  chemically synthesized
tatgtgtatatagcatatacaa

SEQ ID NO: 90811 - DNA, 22 bp, Artificial Sequence
  chemically synthesized
attactataaacagattaatag

SEQ ID NO: 90812 - DNA, 22 bp, Artificial Sequence
  chemically synthesized
ctataaacagattaatagatac

SEQ ID NO: 90813 - DNA, 22 bp, Artificial Sequence
  chemically synthesized
taaacagattaatagatacaaa

SEQ ID NO: 90814 - DNA, 22 bp, Artificial Sequence
  chemically synthesized
atagatacaaattaattgatta

SEQ ID NO: 90815 - DNA, 22 bp, Artificial Sequence
  chemically synthesized
attgattaatcagtgtgatgat

SEQ ID NO: 90816 - DNA, 22 bp, Artificial Sequence
  chemically synthesized
attaatcagtgtgatgatgggc

SEQ ID NO: 90817 - DNA, 22 bp, Artificial Sequence
  chemically synthesized
atcagtgtgatgatgggctgtc

SEQ ID NO: 90818 - DNA, 22 bp, Artificial Sequence
  chemically synthesized
tctcctagcaacgacttctgcc

SEQ ID NO: 90819 - DNA, 22 bp, Artificial Sequence
  chemically synthesized
ctagcaacgacttctgccccac

SEQ ID NO: 90820 - DNA, 22 bp, Artificial Sequence
  chemically synthesized
gcaacgacttctgccccacctc

SEQ ID NO: 90821 - DNA, 22 bp, Artificial Sequence
  chemically synthesized
ctgccccacctccagtgtaact

SEQ ID NO: 90822 - DNA, 22 bp, Artificial Sequence
  chemically synthesized
tgccccacctccagtgtaactg

SEQ ID NO: 90823 - DNA, 22 bp, Artificial Sequence
  chemically synthesized
ccccacctccagtgtaactgcc

SEQ ID NO: 90824 - DNA, 22 bp, Artificial Sequence
  chemically synthesized
cagtgtaactgcctagtctttc

SEQ ID NO: 90825 - DNA, 22 bp, Artificial Sequence
  chemically synthesized
cctagtctttcataatcaaata

SEQ ID NO: 90826 - DNA, 22 bp, Artificial Sequence
  chemically synthesized
gtctttcataatcaaatattca

SEQ ID NO: 90827 - DNA, 22 bp, Artificial Sequence
  chemically synthesized
tcataatcaaatattcactttc

SEQ ID NO: 90828 - DNA, 22 bp, Artificial Sequence
  chemically synthesized
cataatcaaatattcactttcc

SEQ ID NO: 90829 - DNA, 22 bp, Artificial Sequence
  chemically synthesized
ataatcaaatattcactttcct

SEQ ID NO: 90830 - DNA, 22 bp, Artificial Sequence
  chemically synthesized
actttcctttccattccattta

SEQ ID NO: 90831 - DNA, 22 bp, Artificial Sequence
  chemically synthesized
tcctttccattccatttactac

SEQ ID NO: 90832 - DNA, 22 bp, Artificial Sequence
  chemically synthesized
cctttccattccatttactaca

SEQ ID NO: 90833 - DNA, 22 bp, Artificial Sequence
  chemically synthesized
ctttccattccatttactacag

SEQ ID NO: 90834 - DNA, 22 bp, Artificial Sequence
  chemically synthesized
tccattccatttactacagaat

SEQ ID NO: 90835 - DNA, 22 bp, Artificial Sequence
  chemically synthesized
ccattccatttactacagaatt

SEQ ID NO: 90836 - DNA, 22 bp, Artificial Sequence
  chemically synthesized
cattccatttactacagaattt

SEQ ID NO: 90837 - DNA, 22 bp, Artificial Sequence
  chemically synthesized
catttactacagaatttataaa

SEQ ID NO: 90838 - DNA, 22 bp, Artificial Sequence
  chemically synthesized
actacagaatttataaaattcc

SEQ ID NO: 90839 - DNA, 22 bp, Artificial Sequence
  chemically synthesized
ctacagaatttataaaattcca

SEQ ID NO: 90840 - DNA, 22 bp, Artificial Sequence
  chemically synthesized
cagaatttataaaattccaatt

SEQ ID NO: 90841 - DNA, 22 bp, Artificial Sequence
  chemically synthesized
ataaaattccaattattcctta

SEQ ID NO: 90842 - DNA, 22 bp, Artificial Sequence
  chemically synthesized
taaaattccaattattccttat

SEQ ID NO: 90843 - DNA, 22 bp, Artificial Sequence
  chemically synthesized
caattattccttattgtaaaat

SEQ ID NO: 90844 - DNA, 22 bp, Artificial Sequence
  chemically synthesized
ttccttattgtaaaatgattta

SEQ ID NO: 90845 - DNA, 22 bp, Artificial Sequence
  chemically synthesized
cttattgtaaaatgatttatag

SEQ ID NO: 90846 - DNA, 22 bp, Artificial Sequence
  chemically synthesized
attgtaaaatgatttatagcct

SEQ ID NO: 90847 - DNA, 22 bp, Artificial Sequence
  chemically synthesized
ttgtaaaatgatttatagcctc

SEQ ID NO: 90848 - DNA, 22 bp, Artificial Sequence
  chemically synthesized
taaaatgatttatagcctctaa

SEQ ID NO: 90849 - DNA, 22 bp, Artificial Sequence
  chemically synthesized
atagcctctaaaacagtattct

SEQ ID NO: 90850 - DNA, 22 bp, Artificial Sequence
  chemically synthesized
tagcctctaaaacagtattcta

SEQ ID NO: 90851 - DNA, 22 bp, Artificial Sequence
  chemically synthesized
taaaacagtattctatgcctct

SEQ ID NO: 90852 - DNA, 22 bp, Artificial Sequence
  chemically synthesized
aaacagtattctatgcctctca

SEQ ID NO: 90853 - DNA, 22 bp, Artificial Sequence
  chemically synthesized
tatgcctctcatctttgagttg

SEQ ID NO: 90854 - DNA, 22 bp, Artificial Sequence
  chemically synthesized
tgcctctcatctttgagttgga

SEQ ID NO: 90855 - DNA, 22 bp, Artificial Sequence
  chemically synthesized
tcatctttgagttggagcctct

SEQ ID NO: 90856 - DNA, 22 bp, Artificial Sequence
  chemically synthesized
atctttgagttggagcctctcc

SEQ ID NO: 90857 - DNA, 22 bp, Artificial Sequence
  chemically synthesized
tgagttggagcctctcccatac

SEQ ID NO: 90858 - DNA, 22 bp, Artificial Sequence
  chemically synthesized
gagttggagcctctcccatacc

SEQ ID NO: 90859 - DNA, 22 bp, Artificial Sequence
  chemically synthesized
agttggagcctctcccataccc

SEQ ID NO: 90860 - DNA, 22 bp, Artificial Sequence
  chemically synthesized
gagcctctcccatacccatgtg

SEQ ID NO: 90861 - DNA, 22 bp, Artificial Sequence
  chemically synthesized
tcccatacccatgtggagagac

SEQ ID NO: 90862 - DNA, 22 bp, Artificial Sequence
  chemically synthesized
ccatacccatgtggagagacaa

SEQ ID NO: 90863 - DNA, 22 bp, Artificial Sequence
  chemically synthesized
ttctaagtgcagaattagcagg

SEQ ID NO: 90864 - DNA, 22 bp, Artificial Sequence
  chemically synthesized
taagtgcagaattagcaggtga

SEQ ID NO: 90865 - DNA, 22 bp, Artificial Sequence
  chemically synthesized
agtgcagaattagcaggtgaga

SEQ ID NO: 90866 - DNA, 22 bp, Artificial Sequence
  chemically synthesized
gcaggtgagagctggtatgcat

SEQ ID NO: 90867 - DNA, 22 bp, Artificial Sequence
  chemically synthesized
gtatgcataatttgagttgttg

SEQ ID NO: 90868 - DNA, 22 bp, Artificial Sequence
  chemically synthesized
gagttgttgttagagaaggaaa

SEQ ID NO: 90869 - DNA, 22 bp, Artificial Sequence
  chemically synthesized
agttgttgttagagaaggaaaa

SEQ ID NO: 90870 - DNA, 22 bp, Artificial Sequence
  chemically synthesized
ttgttagagaaggaaaaatgaa

SEQ ID NO: 90871 - DNA, 22 bp, Artificial Sequence
  chemically synthesized
ttagagaaggaaaaatgaaggg

SEQ ID NO: 90872 - DNA, 22 bp, Artificial Sequence
  chemically synthesized
gagaaggaaaaatgaagggagg

SEQ ID NO: 90873 - DNA, 22 bp, Artificial Sequence
  chemically synthesized
ggagagaaagacaggatattaa

SEQ ID NO: 90874 - DNA, 22 bp, Artificial Sequence
  chemically synthesized
aataatttaaaatagcaagatt

SEQ ID NO: 90875 - DNA, 22 bp, Artificial Sequence
  chemically synthesized
aaaatagcaagattgtgaggaa

SEQ ID NO: 90876 - DNA, 22 bp, Artificial Sequence
  chemically synthesized
aaatagcaagattgtgaggaag

SEQ ID NO: 90877 - DNA, 22 bp, Artificial Sequence
  chemically synthesized
tgaggaaggaaaaaatgcagaa

SEQ ID NO: 90878 - DNA, 22 bp, Artificial Sequence
  chemically synthesized
aaataaaaaattaacaaaattt

SEQ ID NO: 90879 - DNA, 22 bp, Artificial Sequence
  chemically synthesized
aataaaaaattaacaaaatttt

SEQ ID NO: 90880 - DNA, 22 bp, Artificial Sequence
  chemically synthesized
acaaaattttagaagcattaaa

SEQ ID NO: 90881 - DNA, 22 bp, Artificial Sequence
  chemically synthesized
tagaagcattaaatgataaaat

SEQ ID NO: 90882 - DNA, 22 bp, Artificial Sequence
  chemically synthesized
agaagcattaaatgataaaata

SEQ ID NO: 90883 - DNA, 22 bp, Artificial Sequence
  chemically synthesized
gaagcattaaatgataaaatat

SEQ ID NO: 90884 - DNA, 22 bp, Artificial Sequence
  chemically synthesized
aatgataaaatatagtaaaatg

SEQ ID NO: 90885 - DNA, 22 bp, Artificial Sequence
  chemically synthesized
gaaagtaaaaagagaaaagtga

SEQ ID NO: 90886 - DNA, 22 bp, Artificial Sequence
  chemically synthesized
ctggactcaccctgaagttctc

SEQ ID NO: 90887 - DNA, 22 bp, Artificial Sequence
  chemically synthesized
gactcaccctgaagttctcagg

SEQ ID NO: 90888 - DNA, 22 bp, Artificial Sequence
  chemically synthesized
accctgaagttctcaggatcca

SEQ ID NO: 90889 - DNA, 22 bp, Artificial Sequence
  chemically synthesized
aagttctcaggatccacgtgca

SEQ ID NO: 90890 - DNA, 22 bp, Artificial Sequence
  chemically synthesized
tcaggatccacgtgcagcttgt

SEQ ID NO: 90891 - DNA, 22 bp, Artificial Sequence
  chemically synthesized
aggatccacgtgcagcttgtca

SEQ ID NO: 90892 - DNA, 22 bp, Artificial Sequence
  chemically synthesized
gtcacagtgcagctcactcagc

SEQ ID NO: 90893 - DNA, 22 bp, Artificial Sequence
  chemically synthesized
tcacagtgcagctcactcagct

SEQ ID NO: 90894 - DNA, 22 bp, Artificial Sequence
  chemically synthesized
actcagctgagaaaaagtgccc

SEQ ID NO: 90895 - DNA, 22 bp, Artificial Sequence
  chemically synthesized
agctgagaaaaagtgcccttga

SEQ ID NO: 90896 - DNA, 22 bp, Artificial Sequence
  chemically synthesized
agaaaaagtgcccttgaggttg

SEQ ID NO: 90897 - DNA, 22 bp, Artificial Sequence
  chemically synthesized
gaggttgtccaggtgagccagg

SEQ ID NO: 90898 - DNA, 22 bp, Artificial Sequence
  chemically synthesized
aggttgtccaggtgagccaggc

SEQ ID NO: 90899 - DNA, 22 bp, Artificial Sequence
  chemically synthesized
tccaggtgagccaggccatcac

SEQ ID NO: 90900 - DNA, 22 bp, Artificial Sequence
  chemically synthesized
aaggcacctagcaccttcttgc

SEQ ID NO: 90901 - DNA, 22 bp, Artificial Sequence
  chemically synthesized
gcaccttcttgccatgagcctt

SEQ ID NO: 90902 - DNA, 22 bp, Artificial Sequence
  chemically synthesized
cttgccatgagccttcacctta

SEQ ID NO: 90903 - DNA, 22 bp, Artificial Sequence
  chemically synthesized
ttgccatgagccttcaccttag

SEQ ID NO: 90904 - DNA, 22 bp, Artificial Sequence
  chemically synthesized
gccatgagccttcaccttaggg

SEQ ID NO: 90905 - DNA, 22 bp, Artificial Sequence
  chemically synthesized
ccatgagccttcaccttagggt

SEQ ID NO: 90906 - DNA, 22 bp, Artificial Sequence
  chemically synthesized
caccttagggttgcccataaca

SEQ ID NO: 90907 - DNA, 22 bp, Artificial Sequence
  chemically synthesized
accttagggttgcccataacag

SEQ ID NO: 90908 - DNA, 22 bp, Artificial Sequence
  chemically synthesized
agggttgcccataacagcatca

SEQ ID NO: 90909 - DNA, 22 bp, Artificial Sequence
  chemically synthesized
gggttgcccataacagcatcag

SEQ ID NO: 90910 - DNA, 22 bp, Artificial Sequence
  chemically synthesized
cccataacagcatcaggagagg

SEQ ID NO: 90911 - DNA, 22 bp, Artificial Sequence
  chemically synthesized
aaagaacctctgggtccaaggg

SEQ ID NO: 90912 - DNA, 22 bp, Artificial Sequence
  chemically synthesized
tgggtccaagggtagaccacca

SEQ ID NO: 90913 - DNA, 22 bp, Artificial Sequence
  chemically synthesized
ggtccaagggtagaccaccagt

SEQ ID NO: 90914 - DNA, 22 bp, Artificial Sequence
  chemically synthesized
agggtaggaaaacagcccaagg

SEQ ID NO: 90915 - DNA, 22 bp, Artificial Sequence
  chemically synthesized
tcagaaacccaagagtcttctc

SEQ ID NO: 90916 - DNA, 22 bp, Artificial Sequence
  chemically synthesized
ctctgtctacacatgcccagtt

SEQ ID NO: 90917 - DNA, 22 bp, Artificial Sequence
  chemically synthesized
tctgtctacacatgcccagttt

SEQ ID NO: 90918 - DNA, 22 bp, Artificial Sequence
  chemically synthesized
tgtctacacatgcccagtttcc

SEQ ID NO: 90919 - DNA, 22 bp, Artificial Sequence
  chemically synthesized
tctacacatgcccagtttccat

SEQ ID NO: 90920 - DNA, 22 bp, Artificial Sequence
  chemically synthesized
cacatgcccagtttccatttgc

SEQ ID NO: 90921 - DNA, 22 bp, Artificial Sequence
  chemically synthesized
ccatttgcctccttgagcctct

SEQ ID NO: 90922 - DNA, 22 bp, Artificial Sequence
  chemically synthesized
catttgcctccttgagcctctc

SEQ ID NO: 90923 - DNA, 22 bp, Artificial Sequence
  chemically synthesized
gcctccttgagcctctcttata

SEQ ID NO: 90924 - DNA, 22 bp, Artificial Sequence
  chemically synthesized
cctccttgagcctctcttataa

SEQ ID NO: 90925 - DNA, 22 bp, Artificial Sequence
  chemically synthesized
cttgagcctctcttataacctt

SEQ ID NO: 90926 - DNA, 22 bp, Artificial Sequence
  chemically synthesized
gagcctctcttataaccttgat

SEQ ID NO: 90927 - DNA, 22 bp, Artificial Sequence
  chemically synthesized
agcctctcttataaccttgata

SEQ ID NO: 90928 - DNA, 22 bp, Artificial Sequence
  chemically synthesized
tcttataaccttgataccaacc

SEQ ID NO: 90929 - DNA, 22 bp, Artificial Sequence
  chemically synthesized
ttataaccttgataccaacctg

SEQ ID NO: 90930 - DNA, 22 bp, Artificial Sequence
  chemically synthesized
ataaccttgataccaacctgcc

SEQ ID NO: 90931 - DNA, 22 bp, Artificial Sequence
  chemically synthesized
taaccttgataccaacctgccc

SEQ ID NO: 90932 - DNA, 22 bp, Artificial Sequence
  chemically synthesized
gataccaacctgcccagggcct

SEQ ID NO: 90933 - DNA, 22 bp, Artificial Sequence
  chemically synthesized
ataccaacctgcccagggcctc

SEQ ID NO: 90934 - DNA, 22 bp, Artificial Sequence
  chemically synthesized
cccagggcctcaccaccaactg

SEQ ID NO: 90935 - DNA, 22 bp, Artificial Sequence
  chemically synthesized
accaccaactgcatccacgttc

SEQ ID NO: 90936 - DNA, 22 bp, Artificial Sequence
  chemically synthesized
catccacgttcactttgcccca

SEQ ID NO: 90937 - DNA, 22 bp, Artificial Sequence
  chemically synthesized
actttgccccacagggcattga

SEQ ID NO: 90938 - DNA, 22 bp, Artificial Sequence
  chemically synthesized
tgccccacagggcattgacagc

SEQ ID NO: 90939 - DNA, 22 bp, Artificial Sequence
  chemically synthesized
gccccacagggcattgacagca

SEQ ID NO: 90940 - DNA, 22 bp, Artificial Sequence
  chemically synthesized
ccccacagggcattgacagcag

SEQ ID NO: 90941 - DNA, 22 bp, Artificial Sequence
  chemically synthesized
acagcagtcttctcctcaggag

SEQ ID NO: 90942 - DNA, 22 bp, Artificial Sequence
  chemically synthesized
ctcctcaggagtcagatgcacc

SEQ ID NO: 90943 - DNA, 22 bp, Artificial Sequence
  chemically synthesized
tcctcaggagtcagatgcacca

SEQ ID NO: 90944 - DNA, 22 bp, Artificial Sequence
  chemically synthesized
ctcaggagtcagatgcaccatg

SEQ ID NO: 90945 - DNA, 22 bp, Artificial Sequence
  chemically synthesized
aggagtcagatgcaccatggtg

SEQ ID NO: 90946 - DNA, 22 bp, Artificial Sequence
  chemically synthesized
tttgaggttgctagtgaacact

SEQ ID NO: 90947 - DNA, 22 bp, Artificial Sequence
  chemically synthesized
gaggttgctagtgaacactgtt

SEQ ID NO: 90948 - DNA, 22 bp, Artificial Sequence
  chemically synthesized
aggttgctagtgaacactgtta

SEQ ID NO: 90949 - DNA, 22 bp, Artificial Sequence
  chemically synthesized
ctagtgaacactgttatgtcag

SEQ ID NO: 90950 - DNA, 22 bp, Artificial Sequence
  chemically synthesized
gtgaacactgttatgtcagaag

SEQ ID NO: 90951 - DNA, 22 bp, Artificial Sequence
  chemically synthesized
ttatgtcagaagaaagtgtaag

SEQ ID NO: 90952 - DNA, 22 bp, Artificial Sequence
  chemically synthesized
tgtcagaagaaagtgtaagcaa

SEQ ID NO: 90953 - DNA, 22 bp, Artificial Sequence
  chemically synthesized
tgccctgccttttatgctggtc

SEQ ID NO: 90954 - DNA, 22 bp, Artificial Sequence
  chemically synthesized
ccctgccttttatgctggtcct

SEQ ID NO: 90955 - DNA, 22 bp, Artificial Sequence
  chemically synthesized
ccttttatgctggtcctgtcct

SEQ ID NO: 90956 - DNA, 22 bp, Artificial Sequence
  chemically synthesized
ttatgctggtcctgtcctccct

SEQ ID NO: 90957 - DNA, 22 bp, Artificial Sequence
  chemically synthesized
tatgctggtcctgtcctccctg

SEQ ID NO: 90958 - DNA, 22 bp, Artificial Sequence
  chemically synthesized
atgctggtcctgtcctccctgc

SEQ ID NO: 90959 - DNA, 22 bp, Artificial Sequence
  chemically synthesized
tgctggtcctgtcctccctgct

SEQ ID NO: 90960 - DNA, 22 bp, Artificial Sequence
  chemically synthesized
gtcctgtcctccctgctccagt

SEQ ID NO: 90961 - DNA, 22 bp, Artificial Sequence
  chemically synthesized
tcctccctgctccagtgagcag

SEQ ID NO: 90962 - DNA, 22 bp, Artificial Sequence
  chemically synthesized
cctgctccagtgagcaggttgg

SEQ ID NO: 90963 - DNA, 22 bp, Artificial Sequence
  chemically synthesized
ctccagtgagcaggttggttta

SEQ ID NO: 90964 - DNA, 22 bp, Artificial Sequence
  chemically synthesized
cagtgagcaggttggtttaaga

SEQ ID NO: 90965 - DNA, 22 bp, Artificial Sequence
  chemically synthesized
gtttaagataagcagggtttca

SEQ ID NO: 90966 - DNA, 22 bp, Artificial Sequence
  chemically synthesized
aagataagcagggtttcattag

SEQ ID NO: 90967 - DNA, 22 bp, Artificial Sequence
  chemically synthesized
agataagcagggtttcattagt

SEQ ID NO: 90968 - DNA, 22 bp, Artificial Sequence
  chemically synthesized
cattagtttgtgagaatgaaaa

SEQ ID NO: 90969 - DNA, 22 bp, Artificial Sequence
  chemically synthesized
attagtttgtgagaatgaaaaa

SEQ ID NO: 90970 - DNA, 22 bp, Artificial Sequence
  chemically synthesized
gtttgtgagaatgaaaaatgaa

SEQ ID NO: 90971 - DNA, 22 bp, Artificial Sequence
  chemically synthesized
gtgagaatgaaaaatgaacctt

SEQ ID NO: 90972 - DNA, 22 bp, Artificial Sequence
  chemically synthesized
tgagaatgaaaaatgaaccttc

SEQ ID NO: 90973 - DNA, 22 bp, Artificial Sequence
  chemically synthesized
cattccactattcccttaactt

SEQ ID NO: 90974 - DNA, 22 bp, Artificial Sequence
  chemically synthesized
attccactattcccttaacttg

SEQ ID NO: 90975 - DNA, 22 bp, Artificial Sequence
  chemically synthesized
cactattcccttaacttgccct

SEQ ID NO: 90976 - DNA, 22 bp, Artificial Sequence
  chemically synthesized
ttcccttaacttgccctgagat

SEQ ID NO: 90977 - DNA, 22 bp, Artificial Sequence
  chemically synthesized
ccttaacttgccctgagattgg

SEQ ID NO: 90978 - DNA, 22 bp, Artificial Sequence
  chemically synthesized
aacttgccctgagattggctgt

SEQ ID NO: 90979 - DNA, 22 bp, Artificial Sequence
  chemically synthesized
acttgccctgagattggctgtt

SEQ ID NO: 90980 - DNA, 22 bp, Artificial Sequence
  chemically synthesized
gccctgagattggctgttctgt

SEQ ID NO: 90981 - DNA, 22 bp, Artificial Sequence
  chemically synthesized
ccctgagattggctgttctgtc

SEQ ID NO: 90982 - DNA, 22 bp, Artificial Sequence
  chemically synthesized
agattggctgttctgtcatgtg

SEQ ID NO: 90983 - DNA, 22 bp, Artificial Sequence
  chemically synthesized
gctgttctgtcatgtgtgtctt

SEQ ID NO: 90984 - DNA, 22 bp, Artificial Sequence
  chemically synthesized
ttctgtcatgtgtgtcttgact

SEQ ID NO: 90985 - DNA, 22 bp, Artificial Sequence
  chemically synthesized
tgtcatgtgtgtcttgactcag

SEQ ID NO: 90986 - DNA, 22 bp, Artificial Sequence
  chemically synthesized
tcatgtgtgtcttgactcagaa

SEQ ID NO: 90987 - DNA, 22 bp, Artificial Sequence
  chemically synthesized
gactcagaaaccctgttctcct

SEQ ID NO: 90988 - DNA, 22 bp, Artificial Sequence
  chemically synthesized
actcagaaaccctgttctcctc

SEQ ID NO: 90989 - DNA, 22 bp, Artificial Sequence
  chemically synthesized
agaaaccctgttctcctctaca

SEQ ID NO: 90990 - DNA, 22 bp, Artificial Sequence
  chemically synthesized
ttctcctctacatatctcccca

SEQ ID NO: 90991 - DNA, 22 bp, Artificial Sequence
  chemically synthesized
tcctctacatatctccccaccg

SEQ ID NO: 90992 - DNA, 22 bp, Artificial Sequence
  chemically synthesized
ctctacatatctccccaccgca

SEQ ID NO: 90993 - DNA, 22 bp, Artificial Sequence
  chemically synthesized
tacatatctccccaccgcatct

SEQ ID NO: 90994 - DNA, 22 bp, Artificial Sequence
  chemically synthesized
catatctccccaccgcatctct

SEQ ID NO: 90995 - DNA, 22 bp, Artificial Sequence
  chemically synthesized
cccaccgcatctctttcagcag

SEQ ID NO: 90996 - DNA, 22 bp, Artificial Sequence
  chemically synthesized
tttcagcagttgtttctaaaaa

SEQ ID NO: 90997 - DNA, 22 bp, Artificial Sequence
  chemically synthesized
tcagcagttgtttctaaaaata

SEQ ID NO: 90998 - DNA, 22 bp, Artificial Sequence
  chemically synthesized
cagcagttgtttctaaaaatat

SEQ ID NO: 90999 - DNA, 22 bp, Artificial Sequence
  chemically synthesized
agcagttgtttctaaaaatatc

SEQ ID NO: 91000 - DNA, 22 bp, Artificial Sequence
  chemically synthesized
tttctaaaaatatcctcctagt

SEQ ID NO: 91001 - DNA, 22 bp, Artificial Sequence
  chemically synthesized
ctaaaaatatcctcctagtttc

SEQ ID NO: 91002 - DNA, 22 bp, Artificial Sequence
  chemically synthesized
taaaaatatcctcctagtttca

SEQ ID NO: 91003 - DNA, 22 bp, Artificial Sequence
  chemically synthesized
aaaatatcctcctagtttcatt

SEQ ID NO: 91004 - DNA, 22 bp, Artificial Sequence
  chemically synthesized
ctagtttcatttttgcagaagt

SEQ ID NO: 91005 - DNA, 22 bp, Artificial Sequence
  chemically synthesized
gtttcatttttgcagaagtgtt

SEQ ID NO: 91006 - DNA, 22 bp, Artificial Sequence
  chemically synthesized
catttttgcagaagtgttttag

SEQ ID NO: 91007 - DNA, 22 bp, Artificial Sequence
  chemically synthesized
atttttgcagaagtgttttagg

SEQ ID NO: 91008 - DNA, 22 bp, Artificial Sequence
  chemically synthesized
ttgcagaagtgttttaggctaa

SEQ ID NO: 91009 - DNA, 22 bp, Artificial Sequence
  chemically synthesized
tgcagaagtgttttaggctaat

SEQ ID NO: 91010 - DNA, 22 bp, Artificial Sequence
  chemically synthesized
gcagaagtgttttaggctaata

SEQ ID NO: 91011 - DNA, 22 bp, Artificial Sequence
  chemically synthesized
cagaagtgttttaggctaatat

SEQ ID NO: 91012 - DNA, 22 bp, Artificial Sequence
  chemically synthesized
taggctaatatagtggaatgta

SEQ ID NO: 91013 - DNA, 22 bp, Artificial Sequence
  chemically synthesized
aggctaatatagtggaatgtat

SEQ ID NO: 91014 - DNA, 22 bp, Artificial Sequence
  chemically synthesized
ggctaatatagtggaatgtatc

SEQ ID NO: 91015 - DNA, 22 bp, Artificial Sequence
  chemically synthesized
atatagtggaatgtatcttaga

SEQ ID NO: 91016 - DNA, 22 bp, Artificial Sequence
  chemically synthesized
agagtttaacttatttgtttct

SEQ ID NO: 91017 - DNA, 22 bp, Artificial Sequence
  chemically synthesized
gagtttaacttatttgtttctg

SEQ ID NO: 91018 - DNA, 22 bp, Artificial Sequence
  chemically synthesized
aacttatttgtttctgtcactt

SEQ ID NO: 91019 - DNA, 22 bp, Artificial Sequence
  chemically synthesized
acttatttgtttctgtcacttt

SEQ ID NO: 91020 - DNA, 22 bp, Artificial Sequence
  chemically synthesized
atttgtttctgtcactttatac

SEQ ID NO: 91021 - DNA, 22 bp, Artificial Sequence
  chemically synthesized
tttgtttctgtcactttatact

SEQ ID NO: 91022 - DNA, 22 bp, Artificial Sequence
  chemically synthesized
gtttctgtcactttatactaag

SEQ ID NO: 91023 - DNA, 22 bp, Artificial Sequence
  chemically synthesized
tttctgtcactttatactaaga

SEQ ID NO: 91024 - DNA, 22 bp, Artificial Sequence
  chemically synthesized
ctgtcactttatactaagaaaa

SEQ ID NO: 91025 - DNA, 22 bp, Artificial Sequence
  chemically synthesized
tgtcactttatactaagaaaac

SEQ ID NO: 91026 - DNA, 22 bp, Artificial Sequence
  chemically synthesized
tcactttatactaagaaaactt

SEQ ID NO: 91027 - DNA, 22 bp, Artificial Sequence
  chemically synthesized
tatactaagaaaacttatctaa

SEQ ID NO: 91028 - DNA, 22 bp, Artificial Sequence
  chemically synthesized
atactaagaaaacttatctaaa

SEQ ID NO: 91029 - DNA, 22 bp, Artificial Sequence
  chemically synthesized
tactaagaaaacttatctaaaa

SEQ ID NO: 91030 - DNA, 22 bp, Artificial Sequence
  chemically synthesized
agaaaacttatctaaaagcaga

SEQ ID NO: 91031 - DNA, 22 bp, Artificial Sequence
  chemically synthesized
atctaaaagcagatgttttaac

SEQ ID NO: 91032 - DNA, 22 bp, Artificial Sequence
  chemically synthesized
tctaaaagcagatgttttaaca

SEQ ID NO: 91033 - DNA, 22 bp, Artificial Sequence
  chemically synthesized
aaagcagatgttttaacaagtt

SEQ ID NO: 91034 - DNA, 22 bp, Artificial Sequence
  chemically synthesized
taacaagttgactcaatataaa

SEQ ID NO: 91035 - DNA, 22 bp, Artificial Sequence
  chemically synthesized
aacaagttgactcaatataaag

SEQ ID NO: 91036 - DNA, 22 bp, Artificial Sequence
  chemically synthesized
acaagttgactcaatataaagt

SEQ ID NO: 91037 - DNA, 22 bp, Artificial Sequence
  chemically synthesized
actcaatataaagttcttcttt

SEQ ID NO: 91038 - DNA, 22 bp, Artificial Sequence
  chemically synthesized
aatataaagttcttctttgcct

SEQ ID NO: 91039 - DNA, 22 bp, Artificial Sequence
  chemically synthesized
ttctttgcctctagagattttt

SEQ ID NO: 91040 - DNA, 22 bp, Artificial Sequence
  chemically synthesized
ctttgcctctagagatttttgt

SEQ ID NO: 91041 - DNA, 22 bp, Artificial Sequence
  chemically synthesized
tttgcctctagagatttttgtc

SEQ ID NO: 91042 - DNA, 22 bp, Artificial Sequence
  chemically synthesized
tgcctctagagatttttgtctc

SEQ ID NO: 91043 - DNA, 22 bp, Artificial Sequence
  chemically synthesized
gcctctagagatttttgtctcc

SEQ ID NO: 91044 - DNA, 22 bp, Artificial Sequence
  chemically synthesized
cctctagagatttttgtctcca

SEQ ID NO: 91045 - DNA, 22 bp, Artificial Sequence
  chemically synthesized
tagagatttttgtctccaaggg

SEQ ID NO: 91046 - DNA, 22 bp, Artificial Sequence
  chemically synthesized
gagatttttgtctccaagggaa

SEQ ID NO: 91047 - DNA, 22 bp, Artificial Sequence
  chemically synthesized
ttgtctccaagggaattttgag

SEQ ID NO: 91048 - DNA, 22 bp, Artificial Sequence
  chemically synthesized
tgtctccaagggaattttgaga

SEQ ID NO: 91049 - DNA, 22 bp, Artificial Sequence
  chemically synthesized
gtctccaagggaattttgagag

SEQ ID NO: 91050 - DNA, 22 bp, Artificial Sequence
  chemically synthesized
tctccaagggaattttgagagg

SEQ ID NO: 91051 - DNA, 22 bp, Artificial Sequence
  chemically synthesized
caagggaattttgagaggttgg

SEQ ID NO: 91052 - DNA, 22 bp, Artificial Sequence
  chemically synthesized
tgagaggttggaatggacaaat

SEQ ID NO: 91053 - DNA, 22 bp, Artificial Sequence
  chemically synthesized
gagaggttggaatggacaaatc

SEQ ID NO: 91054 - DNA, 22 bp, Artificial Sequence
  chemically synthesized
agaggttggaatggacaaatct

SEQ ID NO: 91055 - DNA, 22 bp, Artificial Sequence
  chemically synthesized
gaatggacaaatctattgctgc

SEQ ID NO: 91056 - DNA, 22 bp, Artificial Sequence
  chemically synthesized
ttgctgcagtttaaacttgctt

SEQ ID NO: 91057 - DNA, 22 bp, Artificial Sequence
  chemically synthesized
ctgcagtttaaacttgcttgct

SEQ ID NO: 91058 - DNA, 22 bp, Artificial Sequence
  chemically synthesized
cagtttaaacttgcttgcttcc

SEQ ID NO: 91059 - DNA, 22 bp, Artificial Sequence
  chemically synthesized
aaacttgcttgcttcctccttc

SEQ ID NO: 91060 - DNA, 22 bp, Artificial Sequence
  chemically synthesized
aacttgcttgcttcctccttct

SEQ ID NO: 91061 - DNA, 22 bp, Artificial Sequence
  chemically synthesized
gcttgcttcctccttcttttgg

SEQ ID NO: 91062 - DNA, 22 bp, Artificial Sequence
  chemically synthesized
cttgcttcctccttcttttggt

SEQ ID NO: 91063 - DNA, 22 bp, Artificial Sequence
  chemically synthesized
gcttcctccttcttttggtaaa

SEQ ID NO: 91064 - DNA, 22 bp, Artificial Sequence
  chemically synthesized
cttcctccttcttttggtaaat

SEQ ID NO: 91065 - DNA, 22 bp, Artificial Sequence
  chemically synthesized
cctccttcttttggtaaattct

SEQ ID NO: 91066 - DNA, 22 bp, Artificial Sequence
  chemically synthesized
ctccttcttttggtaaattctt

SEQ ID NO: 91067 - DNA, 22 bp, Artificial Sequence
  chemically synthesized
cttcttttggtaaattcttcct

SEQ ID NO: 91068 - DNA, 22 bp, Artificial Sequence
  chemically synthesized
cttttggtaaattcttcctata

SEQ ID NO: 91069 - DNA, 22 bp, Artificial Sequence
  chemically synthesized
ttttggtaaattcttcctataa

SEQ ID NO: 91070 - DNA, 22 bp, Artificial Sequence
  chemically synthesized
ttggtaaattcttcctataata

SEQ ID NO: 91071 - DNA, 22 bp, Artificial Sequence
  chemically synthesized
tggtaaattcttcctataataa

SEQ ID NO: 91072 - DNA, 22 bp, Artificial Sequence
  chemically synthesized
ggtaaattcttcctataataaa

SEQ ID NO: 91073 - DNA, 22 bp, Artificial Sequence
  chemically synthesized
gtaaattcttcctataataaaa

SEQ ID NO: 91074 - DNA, 22 bp, Artificial Sequence
  chemically synthesized
ttcctataataaaactctaatt

SEQ ID NO: 91075 - DNA, 22 bp, Artificial Sequence
  chemically synthesized
cctataataaaactctaatttt

SEQ ID NO: 91076 - DNA, 22 bp, Artificial Sequence
  chemically synthesized
ctataataaaactctaattttt

SEQ ID NO: 91077 - DNA, 22 bp, Artificial Sequence
  chemically synthesized
taataaaactctaattttttat

SEQ ID NO: 91078 - DNA, 22 bp, Artificial Sequence
  chemically synthesized
taattttttattatattgaaat

SEQ ID NO: 91079 - DNA, 22 bp, Artificial Sequence
  chemically synthesized
attttttattatattgaaataa

SEQ ID NO: 91080 - DNA, 22 bp, Artificial Sequence
  chemically synthesized
tttattatattgaaataaatat

SEQ ID NO: 91081 - DNA, 22 bp, Artificial Sequence
  chemically synthesized
ttattatattgaaataaatatc

SEQ ID NO: 91082 - DNA, 22 bp, Artificial Sequence
  chemically synthesized
tattatattgaaataaatatcc

SEQ ID NO: 91083 - DNA, 22 bp, Artificial Sequence
  chemically synthesized
attatattgaaataaatatcca

SEQ ID NO: 91084 - DNA, 22 bp, Artificial Sequence
  chemically synthesized
ttatattgaaataaatatccat

SEQ ID NO: 91085 - DNA, 22 bp, Artificial Sequence
  chemically synthesized
tattgaaataaatatccattaa

SEQ ID NO: 91086 - DNA, 22 bp, Artificial Sequence
  chemically synthesized
aaataaatatccattaaaagaa

SEQ ID NO: 91087 - DNA, 22 bp, Artificial Sequence
  chemically synthesized
aaagaatatttaaaaaatgaat

SEQ ID NO: 91088 - DNA, 22 bp, Artificial Sequence
  chemically synthesized
aaaaaatgaatagtgtttattt

SEQ ID NO: 91089 - DNA, 22 bp, Artificial Sequence
  chemically synthesized
aaaaatgaatagtgtttattta

SEQ ID NO: 91090 - DNA, 22 bp, Artificial Sequence
  chemically synthesized
atttaccagttattgaaatagg

SEQ ID NO: 91091 - DNA, 22 bp, Artificial Sequence
  chemically synthesized
tttaccagttattgaaataggt

SEQ ID NO: 91092 - DNA, 22 bp, Artificial Sequence
  chemically synthesized
accagttattgaaataggttct

SEQ ID NO: 91093 - DNA, 22 bp, Artificial Sequence
  chemically synthesized
ccagttattgaaataggttctg

SEQ ID NO: 91094 - DNA, 22 bp, Artificial Sequence
  chemically synthesized
ttgaaataggttctggaaacat

SEQ ID NO: 91095 - DNA, 22 bp, Artificial Sequence
  chemically synthesized
aaataggttctggaaacatgaa

SEQ ID NO: 91096 - DNA, 22 bp, Artificial Sequence
  chemically synthesized
tggaaacatgaattttaaggtt

SEQ ID NO: 91097 - DNA, 22 bp, Artificial Sequence
  chemically synthesized
gaaacatgaattttaaggttaa

SEQ ID NO: 91098 - DNA, 22 bp, Artificial Sequence
  chemically synthesized
taaggttaacattttaatgaca

SEQ ID NO: 91099 - DNA, 22 bp, Artificial Sequence
  chemically synthesized
aaggttaacattttaatgacag

SEQ ID NO: 91100 - DNA, 22 bp, Artificial Sequence
  chemically synthesized
aggttaacattttaatgacaga

SEQ ID NO: 91101 - DNA, 22 bp, Artificial Sequence
  chemically synthesized
acattttaatgacagataaaat

SEQ ID NO: 91102 - DNA, 22 bp, Artificial Sequence
  chemically synthesized
taatgacagataaaatcaaata

SEQ ID NO: 91103 - DNA, 22 bp, Artificial Sequence
  chemically synthesized
aatgacagataaaatcaaatat

SEQ ID NO: 91104 - DNA, 22 bp, Artificial Sequence
  chemically synthesized
atgacagataaaatcaaatatt

SEQ ID NO: 91105 - DNA, 22 bp, Artificial Sequence
  chemically synthesized
tatacaaatattttgaatgttt

SEQ ID NO: 91106 - DNA, 22 bp, Artificial Sequence
  chemically synthesized
tgaatgtttaaaattatggtat

SEQ ID NO: 91107 - DNA, 22 bp, Artificial Sequence
  chemically synthesized
gaatgtttaaaattatggtatg

SEQ ID NO: 91108 - DNA, 22 bp, Artificial Sequence
  chemically synthesized
aatgtttaaaattatggtatga

SEQ ID NO: 91109 - DNA, 22 bp, Artificial Sequence
  chemically synthesized
aaaattatggtatgactaaaga

SEQ ID NO: 91110 - DNA, 22 bp, Artificial Sequence
  chemically synthesized
aaattatggtatgactaaagaa

SEQ ID NO: 91111 - DNA, 22 bp, Artificial Sequence
  chemically synthesized
tggtatgactaaagaaagaatg

SEQ ID NO: 91112 - DNA, 22 bp, Artificial Sequence
  chemically synthesized
aagaaagaatgcaaagtgaaaa

SEQ ID NO: 91113 - DNA, 22 bp, Artificial Sequence
  chemically synthesized
accatattcagccagattaaat

SEQ ID NO: 91114 - DNA, 22 bp, Artificial Sequence
  chemically synthesized
ccatattcagccagattaaatt

SEQ ID NO: 91115 - DNA, 22 bp, Artificial Sequence
  chemically synthesized
agccagattaaatttaacgaag

SEQ ID NO: 91116 - DNA, 22 bp, Artificial Sequence
  chemically synthesized
aatttaacgaagttcctgggaa

SEQ ID NO: 91117 - DNA, 22 bp, Artificial Sequence
  chemically synthesized
aacgaagttcctgggaatatgc

SEQ ID NO: 91118 - DNA, 22 bp, Artificial Sequence
  chemically synthesized
acgaagttcctgggaatatgct

SEQ ID NO: 91119 - DNA, 22 bp, Artificial Sequence
  chemically synthesized
ctgggaatatgctagtacagaa

SEQ ID NO: 91120 - DNA, 22 bp, Artificial Sequence
  chemically synthesized
ggaatatgctagtacagaacat

SEQ ID NO: 91121 - DNA, 22 bp, Artificial Sequence
  chemically synthesized
gtacagaacatttttacagatg

SEQ ID NO: 91122 - DNA, 22 bp, Artificial Sequence
  chemically synthesized
ttacagatgtgttcttaaaaaa

SEQ ID NO: 91123 - DNA, 22 bp, Artificial Sequence
  chemically synthesized
tacagatgtgttcttaaaaaaa

SEQ ID NO: 91124 - DNA, 22 bp, Artificial Sequence
  chemically synthesized
acagatgtgttcttaaaaaaaa

SEQ ID NO: 91125 - DNA, 22 bp, Artificial Sequence
  chemically synthesized
cagatgtgttcttaaaaaaaaa

SEQ ID NO: 91126 - DNA, 22 bp, Artificial Sequence
  chemically synthesized
ttaaaaaaaaatgtggaattag

SEQ ID NO: 91127 - DNA, 22 bp, Artificial Sequence
  chemically synthesized
aaaaaaaaatgtggaattagac

SEQ ID NO: 91128 - DNA, 22 bp, Artificial Sequence
  chemically synthesized
aaaaaaaatgtggaattagacc

SEQ ID NO: 91129 - DNA, 22 bp, Artificial Sequence
  chemically synthesized
gacccaggaatgaagatcccag

SEQ ID NO: 91130 - DNA, 22 bp, Artificial Sequence
  chemically synthesized
ttcactcttttctgaattcaaa

SEQ ID NO: 91131 - DNA, 22 bp, Artificial Sequence
  chemically synthesized
tcactcttttctgaattcaaat

SEQ ID NO: 91132 - DNA, 22 bp, Artificial Sequence
  chemically synthesized
cactcttttctgaattcaaata

SEQ ID NO: 91133 - DNA, 22 bp, Artificial Sequence
  chemically synthesized
actcttttctgaattcaaataa

SEQ ID NO: 91134 - DNA, 22 bp, Artificial Sequence
  chemically synthesized
ttttctgaattcaaataatgcc

SEQ ID NO: 91135 - DNA, 22 bp, Artificial Sequence
  chemically synthesized
ttctgaattcaaataatgccac

SEQ ID NO: 91136 - DNA, 22 bp, Artificial Sequence
  chemically synthesized
tctgaattcaaataatgccaca

SEQ ID NO: 91137 - DNA, 22 bp, Artificial Sequence
  chemically synthesized
ctgaattcaaataatgccacaa

SEQ ID NO: 91138 - DNA, 22 bp, Artificial Sequence
  chemically synthesized
tgaattcaaataatgccacaat

SEQ ID NO: 91139 - DNA, 22 bp, Artificial Sequence
  chemically synthesized
aattcaaataatgccacaatgg

SEQ ID NO: 91140 - DNA, 22 bp, Artificial Sequence
  chemically synthesized
aaataatgccacaatggcagac

SEQ ID NO: 91141 - DNA, 22 bp, Artificial Sequence
  chemically synthesized
aaggaaagaggaggaagaaatg

SEQ ID NO: 91142 - DNA, 22 bp, Artificial Sequence
  chemically synthesized
acagttcaaattttggtggtga

SEQ ID NO: 91143 - DNA, 22 bp, Artificial Sequence
  chemically synthesized
aaattttggtggtgatatggat

SEQ ID NO: 91144 - DNA, 22 bp, Artificial Sequence
  chemically synthesized
tggtggtgatatggatcaatag

SEQ ID NO: 91145 - DNA, 22 bp, Artificial Sequence
  chemically synthesized
ggtggtgatatggatcaataga

SEQ ID NO: 91146 - DNA, 22 bp, Artificial Sequence
  chemically synthesized
gtggtgatatggatcaatagaa

SEQ ID NO: 91147 - DNA, 22 bp, Artificial Sequence
  chemically synthesized
aaactctgttggtgacactgta

SEQ ID NO: 91148 - DNA, 22 bp, Artificial Sequence
  chemically synthesized
tgttggtgacactgtacaatag

SEQ ID NO: 91149 - DNA, 22 bp, Artificial Sequence
  chemically synthesized
ttggtgacactgtacaatagta

SEQ ID NO: 91150 - DNA, 22 bp, Artificial Sequence
  chemically synthesized
gtgacactgtacaatagtataa

SEQ ID NO: 91151 - DNA, 22 bp, Artificial Sequence
  chemically synthesized
tacaatagtataacccctttgg

SEQ ID NO: 91152 - DNA, 22 bp, Artificial Sequence
  chemically synthesized
tggaaaacctttaatagtatcc

SEQ ID NO: 91153 - DNA, 22 bp, Artificial Sequence
  chemically synthesized
ggaaaacctttaatagtatcca

SEQ ID NO: 91154 - DNA, 22 bp, Artificial Sequence
  chemically synthesized
gaaaacctttaatagtatccac

SEQ ID NO: 91155 - DNA, 22 bp, Artificial Sequence
  chemically synthesized
taatagtatccacaaatgctgg

SEQ ID NO: 91156 - DNA, 22 bp, Artificial Sequence
  chemically synthesized
aatagtatccacaaatgctgga

SEQ ID NO: 91157 - DNA, 22 bp, Artificial Sequence
  chemically synthesized
atagtatccacaaatgctggat

SEQ ID NO: 91158 - DNA, 22 bp, Artificial Sequence
  chemically synthesized
gatgcttgataagtctattacc

SEQ ID NO: 91159 - DNA, 22 bp, Artificial Sequence
  chemically synthesized
gataagtctattacctagcaat

SEQ ID NO: 91160 - DNA, 22 bp, Artificial Sequence
  chemically synthesized
ataagtctattacctagcaatt

SEQ ID NO: 91161 - DNA, 22 bp, Artificial Sequence
  chemically synthesized
ttacctagcaattacattttta

SEQ ID NO: 91162 - DNA, 22 bp, Artificial Sequence
  chemically synthesized
cctagcaattacatttttagat

SEQ ID NO: 91163 - DNA, 22 bp, Artificial Sequence
  chemically synthesized
gcaattacatttttagatattc

SEQ ID NO: 91164 - DNA, 22 bp, Artificial Sequence
  chemically synthesized
catttttagatattcagaaaca

SEQ ID NO: 91165 - DNA, 22 bp, Artificial Sequence
  chemically synthesized
ttagatattcagaaacacatgc

SEQ ID NO: 91166 - DNA, 22 bp, Artificial Sequence
  chemically synthesized
tagatattcagaaacacatgca

SEQ ID NO: 91167 - DNA, 22 bp, Artificial Sequence
  chemically synthesized
agatattcagaaacacatgcat

SEQ ID NO: 91168 - DNA, 22 bp, Artificial Sequence
  chemically synthesized
gatattcagaaacacatgcatg

SEQ ID NO: 91169 - DNA, 22 bp, Artificial Sequence
  chemically synthesized
agaaacacatgcatgtgtgtat

SEQ ID NO: 91170 - DNA, 22 bp, Artificial Sequence
  chemically synthesized
atgacagcaataatcataaaaa

SEQ ID NO: 91171 - DNA, 22 bp, Artificial Sequence
  chemically synthesized
tgacagcaataatcataaaaac

SEQ ID NO: 91172 - DNA, 22 bp, Artificial Sequence
  chemically synthesized
aaaccggtagccacttaaatgc

SEQ ID NO: 91173 - DNA, 22 bp, Artificial Sequence
  chemically synthesized
aaatgcttaccaacagtagaat

SEQ ID NO: 91174 - DNA, 22 bp, Artificial Sequence
  chemically synthesized
aatgcttaccaacagtagaatt

SEQ ID NO: 91175 - DNA, 22 bp, Artificial Sequence
  chemically synthesized
accaacagtagaattgataaat

SEQ ID NO: 91176 - DNA, 22 bp, Artificial Sequence
  chemically synthesized
ccaacagtagaattgataaatt

SEQ ID NO: 91177 - DNA, 22 bp, Artificial Sequence
  chemically synthesized
ataaattacggtatagtcaaag

SEQ ID NO: 91178 - DNA, 22 bp, Artificial Sequence
  chemically synthesized
cggtatagtcaaagaatagaat

SEQ ID NO: 91179 - DNA, 22 bp, Artificial Sequence
  chemically synthesized
cacagaaatgaaaagaatcaac

SEQ ID NO: 91180 - DNA, 22 bp, Artificial Sequence
  chemically synthesized
ctgcttaacacgtagcgataca

SEQ ID NO: 91181 - DNA, 22 bp, Artificial Sequence
  chemically synthesized
cttaacacgtagcgatacaaat

SEQ ID NO: 91182 - DNA, 22 bp, Artificial Sequence
  chemically synthesized
aacacgtagcgatacaaatgca

SEQ ID NO: 91183 - DNA, 22 bp, Artificial Sequence
  chemically synthesized
acacgtagcgatacaaatgcat

SEQ ID NO: 91184 - DNA, 22 bp, Artificial Sequence
  chemically synthesized
tacagcatttggttgattaaaa

SEQ ID NO: 91185 - DNA, 22 bp, Artificial Sequence
  chemically synthesized
acagcatttggttgattaaaag

SEQ ID NO: 91186 - DNA, 22 bp, Artificial Sequence
  chemically synthesized
cagcatttggttgattaaaagt

SEQ ID NO: 91187 - DNA, 22 bp, Artificial Sequence
  chemically synthesized
ggttgattaaaagtaaccagag

SEQ ID NO: 91188 - DNA, 22 bp, Artificial Sequence
  chemically synthesized
gttgattaaaagtaaccagagg

SEQ ID NO: 91189 - DNA, 22 bp, Artificial Sequence
  chemically synthesized
attaaaagtaaccagaggtgag

SEQ ID NO: 91190 - DNA, 22 bp, Artificial Sequence
  chemically synthesized
aaagtaaccagaggtgagttca

SEQ ID NO: 91191 - DNA, 22 bp, Artificial Sequence
  chemically synthesized
aaactatatgactttatttgta

SEQ ID NO: 91192 - DNA, 22 bp, Artificial Sequence
  chemically synthesized
tatgactttatttgtatataga

SEQ ID NO: 91193 - DNA, 22 bp, Artificial Sequence
  chemically synthesized
tatttgtatatagaaagatgga

SEQ ID NO: 91194 - DNA, 22 bp, Artificial Sequence
  chemically synthesized
atttgtatatagaaagatggat

SEQ ID NO: 91195 - DNA, 22 bp, Artificial Sequence
  chemically synthesized
tttgtatatagaaagatggatg

SEQ ID NO: 91196 - DNA, 22 bp, Artificial Sequence
  chemically synthesized
gtatatagaaagatggatgatg

SEQ ID NO: 91197 - DNA, 22 bp, Artificial Sequence
  chemically synthesized
tatatagaaagatggatgatgt

SEQ ID NO: 91198 - DNA, 22 bp, Artificial Sequence
  chemically synthesized
agattctgatcacaaggggaaa

SEQ ID NO: 91199 - DNA, 22 bp, Artificial Sequence
  chemically synthesized
tgatcacaaggggaaatgttat

SEQ ID NO: 91200 - DNA, 22 bp, Artificial Sequence
  chemically synthesized
atcacaaggggaaatgttataa

SEQ ID NO: 91201 - DNA, 22 bp, Artificial Sequence
  chemically synthesized
taaaatagggtagagaggagcc

SEQ ID NO: 91202 - DNA, 22 bp, Artificial Sequence
  chemically synthesized
taaactttgttacaagttattt

SEQ ID NO: 91203 - DNA, 22 bp, Artificial Sequence
  chemically synthesized
aaactttgttacaagttatttt

SEQ ID NO: 91204 - DNA, 22 bp, Artificial Sequence
  chemically synthesized
aactttgttacaagttattttt

SEQ ID NO: 91205 - DNA, 22 bp, Artificial Sequence
  chemically synthesized
tgttacaagttatttttctgta

SEQ ID NO: 91206 - DNA, 22 bp, Artificial Sequence
  chemically synthesized
gttacaagttatttttctgtaa

SEQ ID NO: 91207 - DNA, 22 bp, Artificial Sequence
  chemically synthesized
ttacaagttatttttctgtaac

SEQ ID NO: 91208 - DNA, 22 bp, Artificial Sequence
  chemically synthesized
caagttatttttctgtaacctg

SEQ ID NO: 91209 - DNA, 22 bp, Artificial Sequence
  chemically synthesized
tttttctgtaacctggaagcca

SEQ ID NO: 91210 - DNA, 22 bp, Artificial Sequence
  chemically synthesized
ttctgtaacctggaagccaacg

SEQ ID NO: 91211 - DNA, 22 bp, Artificial Sequence
  chemically synthesized
tctgtaacctggaagccaacga

SEQ ID NO: 91212 - DNA, 22 bp, Artificial Sequence
  chemically synthesized
ctgtaacctggaagccaacgaa

SEQ ID NO: 91213 - DNA, 22 bp, Artificial Sequence
  chemically synthesized
tgtaacctggaagccaacgaaa

SEQ ID NO: 91214 - DNA, 22 bp, Artificial Sequence
  chemically synthesized
taacctggaagccaacgaaaga

SEQ ID NO: 91215 - DNA, 22 bp, Artificial Sequence
  chemically synthesized
gaagccaacgaaagatattgaa

SEQ ID NO: 91216 - DNA, 22 bp, Artificial Sequence
  chemically synthesized
aataattcaagaaaggtggtgg

SEQ ID NO: 91217 - DNA, 22 bp, Artificial Sequence
  chemically synthesized
aagaaaggtggtggcatggttt

SEQ ID NO: 91218 - DNA, 22 bp, Artificial Sequence
  chemically synthesized
gatttgtgtctttaaaagatta

SEQ ID NO: 91219 - DNA, 22 bp, Artificial Sequence
  chemically synthesized
atttgtgtctttaaaagattat

SEQ ID NO: 91220 - DNA, 22 bp, Artificial Sequence
  chemically synthesized
gtgtctttaaaagattattctc

SEQ ID NO: 91221 - DNA, 22 bp, Artificial Sequence
  chemically synthesized
tgtctttaaaagattattctca

SEQ ID NO: 91222 - DNA, 22 bp, Artificial Sequence
  chemically synthesized
taaaagattattctcacttagt

SEQ ID NO: 91223 - DNA, 22 bp, Artificial Sequence
  chemically synthesized
aaaagattattctcacttagtg

SEQ ID NO: 91224 - DNA, 22 bp, Artificial Sequence
  chemically synthesized
aaagattattctcacttagtga

SEQ ID NO: 91225 - DNA, 22 bp, Artificial Sequence
  chemically synthesized
ttctcacttagtgaagaaatgt

SEQ ID NO: 91226 - DNA, 22 bp, Artificial Sequence
  chemically synthesized
tcacttagtgaagaaatgtatt

SEQ ID NO: 91227 - DNA, 22 bp, Artificial Sequence
  chemically synthesized
acttagtgaagaaatgtatttt

SEQ ID NO: 91228 - DNA, 22 bp, Artificial Sequence
  chemically synthesized
agtgaagaaatgtattttagaa

SEQ ID NO: 91229 - DNA, 22 bp, Artificial Sequence
  chemically synthesized
gtgaagaaatgtattttagaag

SEQ ID NO: 91230 - DNA, 22 bp, Artificial Sequence
  chemically synthesized
tagaagtagagaaaatgggaga

SEQ ID NO: 91231 - DNA, 22 bp, Artificial Sequence
  chemically synthesized
agaagtagagaaaatgggagac

SEQ ID NO: 91232 - DNA, 22 bp, Artificial Sequence
  chemically synthesized
gaagtagagaaaatgggagaca

SEQ ID NO: 91233 - DNA, 22 bp, Artificial Sequence
  chemically synthesized
ggcttctgttgcagtagggaag

SEQ ID NO: 91234 - DNA, 22 bp, Artificial Sequence
  chemically synthesized
ctgttgcagtagggaagaaagt

SEQ ID NO: 91235 - DNA, 22 bp, Artificial Sequence
  chemically synthesized
tgttgcagtagggaagaaagtg

SEQ ID NO: 91236 - DNA, 22 bp, Artificial Sequence
  chemically synthesized
ttgcagtagggaagaaagtgac

SEQ ID NO: 91237 - DNA, 22 bp, Artificial Sequence
  chemically synthesized
cagtagggaagaaagtgacaat

SEQ ID NO: 91238 - DNA, 22 bp, Artificial Sequence
  chemically synthesized
ctattatcagacttggaccatg

SEQ ID NO: 91239 - DNA, 22 bp, Artificial Sequence
  chemically synthesized
tattatcagacttggaccatga

SEQ ID NO: 91240 - DNA, 22 bp, Artificial Sequence
  chemically synthesized
ttatcagacttggaccatgacg

SEQ ID NO: 91241 - DNA, 22 bp, Artificial Sequence
  chemically synthesized
tcagacttggaccatgacggtg

SEQ ID NO: 91242 - DNA, 22 bp, Artificial Sequence
  chemically synthesized
ggaccatgacggtgatgtcagt

SEQ ID NO: 91243 - DNA, 22 bp, Artificial Sequence
  chemically synthesized
gaccatgacggtgatgtcagtc

SEQ ID NO: 91244 - DNA, 22 bp, Artificial Sequence
  chemically synthesized
gtgagtttagtggtacgataaa

SEQ ID NO: 91245 - DNA, 22 bp, Artificial Sequence
  chemically synthesized
tgagtttagtggtacgataaaa

SEQ ID NO: 91246 - DNA, 22 bp, Artificial Sequence
  chemically synthesized
agtggtacgataaaatcagaaa

SEQ ID NO: 91247 - DNA, 22 bp, Artificial Sequence
  chemically synthesized
gtggtacgataaaatcagaaat

SEQ ID NO: 91248 - DNA, 22 bp, Artificial Sequence
  chemically synthesized
ggatacattgtattgtatgcac

SEQ ID NO: 91249 - DNA, 22 bp, Artificial Sequence
  chemically synthesized
gatacattgtattgtatgcact

SEQ ID NO: 91250 - DNA, 22 bp, Artificial Sequence
  chemically synthesized
tattgtatgcactcttgtaaaa

SEQ ID NO: 91251 - DNA, 22 bp, Artificial Sequence
  chemically synthesized
tatgcactcttgtaaaatgcaa

SEQ ID NO: 91252 - DNA, 22 bp, Artificial Sequence
  chemically synthesized
ttgtaaaatgcaaaaagatgta

SEQ ID NO: 91253 - DNA, 22 bp, Artificial Sequence
  chemically synthesized
gtaaaatgcaaaaagatgtact

SEQ ID NO: 91254 - DNA, 22 bp, Artificial Sequence
  chemically synthesized
taaaatgcaaaaagatgtactt

SEQ ID NO: 91255 - DNA, 22 bp, Artificial Sequence
  chemically synthesized
agatatgtggatctggagctca

SEQ ID NO: 91256 - DNA, 22 bp, Artificial Sequence
  chemically synthesized
gatatgtggatctggagctcag

SEQ ID NO: 91257 - DNA, 22 bp, Artificial Sequence
  chemically synthesized
gagctcagaaagaatacaacca

SEQ ID NO: 91258 - DNA, 22 bp, Artificial Sequence
  chemically synthesized
agaaagaatacaaccaggtcaa

SEQ ID NO: 91259 - DNA, 22 bp, Artificial Sequence
  chemically synthesized
tgtgaatcactaccactacctg

SEQ ID NO: 91260 - DNA, 22 bp, Artificial Sequence
  chemically synthesized
ccactacctgttaaaaatgaca

SEQ ID NO: 91261 - DNA, 22 bp, Artificial Sequence
  chemically synthesized
cctgttaaaaatgacagatgat

SEQ ID NO: 91262 - DNA, 22 bp, Artificial Sequence
  chemically synthesized
ttaaaaatgacagatgatgtac

SEQ ID NO: 91263 - DNA, 22 bp, Artificial Sequence
  chemically synthesized
aaaatgacagatgatgtacttc

SEQ ID NO: 91264 - DNA, 22 bp, Artificial Sequence
  chemically synthesized
catcaatatctccttaaaatct

SEQ ID NO: 91265 - DNA, 22 bp, Artificial Sequence
  chemically synthesized
atcaatatctccttaaaatctt

SEQ ID NO: 91266 - DNA, 22 bp, Artificial Sequence
  chemically synthesized
cttaaaatcttagaatgtgttt

SEQ ID NO: 91267 - DNA, 22 bp, Artificial Sequence
  chemically synthesized
aaaatcttagaatgtgtttgtg

SEQ ID NO: 91268 - DNA, 22 bp, Artificial Sequence
  chemically synthesized
aaatcttagaatgtgtttgtga

SEQ ID NO: 91269 - DNA, 22 bp, Artificial Sequence
  chemically synthesized
agaatgtgtttgtgagggagga

SEQ ID NO: 91270 - DNA, 22 bp, Artificial Sequence
  chemically synthesized
gaatgtgtttgtgagggaggaa

SEQ ID NO: 91271 - DNA, 22 bp, Artificial Sequence
  chemically synthesized
gtgagggaggaattatgtttcc

SEQ ID NO: 91272 - DNA, 22 bp, Artificial Sequence
  chemically synthesized
tgagggaggaattatgtttcca

SEQ ID NO: 91273 - DNA, 22 bp, Artificial Sequence
  chemically synthesized
tgtttccaattcatatataaga

SEQ ID NO: 91274 - DNA, 22 bp, Artificial Sequence
  chemically synthesized
ccaattcatatataagaaaatt

SEQ ID NO: 91275 - DNA, 22 bp, Artificial Sequence
  chemically synthesized
caattcatatataagaaaattg

SEQ ID NO: 91276 - DNA, 22 bp, Artificial Sequence
  chemically synthesized
atatataagaaaattgattcta

SEQ ID NO: 91277 - DNA, 22 bp, Artificial Sequence
  chemically synthesized
attctaaaaaaaatgttaggta

SEQ ID NO: 91278 - DNA, 22 bp, Artificial Sequence
  chemically synthesized
taaaaaaaatgttaggtaaatt

SEQ ID NO: 91279 - DNA, 22 bp, Artificial Sequence
  chemically synthesized
aaaaaaatgttaggtaaattct

SEQ ID NO: 91280 - DNA, 22 bp, Artificial Sequence
  chemically synthesized
ggtaaattcttaaggccatgag

SEQ ID NO: 91281 - DNA, 22 bp, Artificial Sequence
  chemically synthesized
ttaaggccatgaggactgttat

SEQ ID NO: 91282 - DNA, 22 bp, Artificial Sequence
  chemically synthesized
aaggccatgaggactgttattt

SEQ ID NO: 91283 - DNA, 22 bp, Artificial Sequence
  chemically synthesized
aggccatgaggactgttatttg

SEQ ID NO: 91284 - DNA, 22 bp, Artificial Sequence
  chemically synthesized
ttatttgatctttgtctgttaa

SEQ ID NO: 91285 - DNA, 22 bp, Artificial Sequence
  chemically synthesized
tttgatctttgtctgttaattc

SEQ ID NO: 91286 - DNA, 22 bp, Artificial Sequence
  chemically synthesized
gatctttgtctgttaattccaa

SEQ ID NO: 91287 - DNA, 22 bp, Artificial Sequence
  chemically synthesized
atctttgtctgttaattccaaa

SEQ ID NO: 91288 - DNA, 22 bp, Artificial Sequence
  chemically synthesized
tgtctgttaattccaaagactt

SEQ ID NO: 91289 - DNA, 22 bp, Artificial Sequence
  chemically synthesized
gtctgttaattccaaagacttg

SEQ ID NO: 91290 - DNA, 22 bp, Artificial Sequence
  chemically synthesized
tctgttaattccaaagacttgg

SEQ ID NO: 91291 - DNA, 22 bp, Artificial Sequence
  chemically synthesized
ttaattccaaagacttggcttt

SEQ ID NO: 91292 - DNA, 22 bp, Artificial Sequence
  chemically synthesized
attccaaagacttggcttttca

SEQ ID NO: 91293 - DNA, 22 bp, Artificial Sequence
  chemically synthesized
caaagacttggcttttcacttt

SEQ ID NO: 91294 - DNA, 22 bp, Artificial Sequence
  chemically synthesized
ggcttttcactttaattctgtt

SEQ ID NO: 91295 - DNA, 22 bp, Artificial Sequence
  chemically synthesized
gcttttcactttaattctgttc

SEQ ID NO: 91296 - DNA, 22 bp, Artificial Sequence
  chemically synthesized
ttcactttaattctgttctacc

SEQ ID NO: 91297 - DNA, 22 bp, Artificial Sequence
  chemically synthesized
tcactttaattctgttctacct

SEQ ID NO: 91298 - DNA, 22 bp, Artificial Sequence
  chemically synthesized
cactttaattctgttctacctg

SEQ ID NO: 91299 - DNA, 22 bp, Artificial Sequence
  chemically synthesized
actttaattctgttctacctga

SEQ ID NO: 91300 - DNA, 22 bp, Artificial Sequence
  chemically synthesized
taattctgttctacctgaaatg

SEQ ID NO: 91301 - DNA, 22 bp, Artificial Sequence
  chemically synthesized
aattctgttctacctgaaatga

SEQ ID NO: 91302 - DNA, 22 bp, Artificial Sequence
  chemically synthesized
attctgttctacctgaaatgat

SEQ ID NO: 91303 - DNA, 22 bp, Artificial Sequence
  chemically synthesized
tgttctacctgaaatgatttta

SEQ ID NO: 91304 - DNA, 22 bp, Artificial Sequence
  chemically synthesized
ttctacctgaaatgattttaca

SEQ ID NO: 91305 - DNA, 22 bp, Artificial Sequence
  chemically synthesized
tacctgaaatgattttacacat

SEQ ID NO: 91306 - DNA, 22 bp, Artificial Sequence
  chemically synthesized
cctgaaatgattttacacattg

SEQ ID NO: 91307 - DNA, 22 bp, Artificial Sequence
  chemically synthesized
aaatgattttacacattgggag

SEQ ID NO: 91308 - DNA, 22 bp, Artificial Sequence
  chemically synthesized
tacacattgggagatctggtta

SEQ ID NO: 91309 - DNA, 22 bp, Artificial Sequence
  chemically synthesized
acacattgggagatctggttac

SEQ ID NO: 91310 - DNA, 22 bp, Artificial Sequence
  chemically synthesized
cacattgggagatctggttaca

SEQ ID NO: 91311 - DNA, 22 bp, Artificial Sequence
  chemically synthesized
ggagatctggttacatgtttat

SEQ ID NO: 91312 - DNA, 22 bp, Artificial Sequence
  chemically synthesized
gttacatgtttattctatatgg

SEQ ID NO: 91313 - DNA, 22 bp, Artificial Sequence
  chemically synthesized
catgtttattctatatggattg

SEQ ID NO: 91314 - DNA, 22 bp, Artificial Sequence
  chemically synthesized
attctatatggattgcattgag

SEQ ID NO: 91315 - DNA, 22 bp, Artificial Sequence
  chemically synthesized
ttctatatggattgcattgaga

SEQ ID NO: 91316 - DNA, 22 bp, Artificial Sequence
  chemically synthesized
tatatggattgcattgagagga

SEQ ID NO: 91317 - DNA, 22 bp, Artificial Sequence
  chemically synthesized
tatggattgcattgagaggatt

SEQ ID NO: 91318 - DNA, 22 bp, Artificial Sequence
  chemically synthesized
cattgagaggatttgtataaca

SEQ ID NO: 91319 - DNA, 22 bp, Artificial Sequence
  chemically synthesized
agaggatttgtataacagaata

SEQ ID NO: 91320 - DNA, 22 bp, Artificial Sequence
  chemically synthesized
gtataacagaataaggtctttt

SEQ ID NO: 91321 - DNA, 22 bp, Artificial Sequence
  chemically synthesized
tataacagaataaggtcttttt

SEQ ID NO: 91322 - DNA, 22 bp, Artificial Sequence
  chemically synthesized
tttttcttttctcttctgagat

SEQ ID NO: 91323 - DNA, 22 bp, Artificial Sequence
  chemically synthesized
ttttcttttctcttctgagatg

SEQ ID NO: 91324 - DNA, 22 bp, Artificial Sequence
  chemically synthesized
tttcttttctcttctgagatgg

SEQ ID NO: 91325 - DNA, 22 bp, Artificial Sequence
  chemically synthesized
ttcttttctcttctgagatgga

SEQ ID NO: 91326 - DNA, 22 bp, Artificial Sequence
  chemically synthesized
tcttttctcttctgagatggag

SEQ ID NO: 91327 - DNA, 22 bp, Artificial Sequence
  chemically synthesized
cttttctcttctgagatggagt

SEQ ID NO: 91328 - DNA, 22 bp, Artificial Sequence
  chemically synthesized
ttttctcttctgagatggagtt

SEQ ID NO: 91329 - DNA, 22 bp, Artificial Sequence
  chemically synthesized
ttctcttctgagatggagtttc

SEQ ID NO: 91330 - DNA, 22 bp, Artificial Sequence
  chemically synthesized
tctcttctgagatggagtttca

SEQ ID NO: 91331 - DNA, 22 bp, Artificial Sequence
  chemically synthesized
ctcttctgagatggagtttcat

SEQ ID NO: 91332 - DNA, 22 bp, Artificial Sequence
  chemically synthesized
tcttctgagatggagtttcatc

SEQ ID NO: 91333 - DNA, 22 bp, Artificial Sequence
  chemically synthesized
ttctgagatggagtttcatccc

SEQ ID NO: 91334 - DNA, 22 bp, Artificial Sequence
  chemically synthesized
ctgagatggagtttcatcccta

SEQ ID NO: 91335 - DNA, 22 bp, Artificial Sequence
  chemically synthesized
tgagatggagtttcatccctat

SEQ ID NO: 91336 - DNA, 22 bp, Artificial Sequence
  chemically synthesized
agatggagtttcatccctattg

SEQ ID NO: 91337 - DNA, 22 bp, Artificial Sequence
  chemically synthesized
catccctattgcccaagctaga

SEQ ID NO: 91338 - DNA, 22 bp, Artificial Sequence
  chemically synthesized
atccctattgcccaagctagag

SEQ ID NO: 91339 - DNA, 22 bp, Artificial Sequence
  chemically synthesized
ttgcccaagctagagtgcaatg

SEQ ID NO: 91340 - DNA, 22 bp, Artificial Sequence
  chemically synthesized
cccaagctagagtgcaatggtg

SEQ ID NO: 91341 - DNA, 22 bp, Artificial Sequence
  chemically synthesized
gagtgcaatggtgcaatctagg

SEQ ID NO: 91342 - DNA, 22 bp, Artificial Sequence
  chemically synthesized
ggctcaccgcaacctctgcctc

SEQ ID NO: 91343 - DNA, 22 bp, Artificial Sequence
  chemically synthesized
accgcaacctctgcctcctggg

SEQ ID NO: 91344 - DNA, 22 bp, Artificial Sequence
  chemically synthesized
tgcctcctgggttcaagcaatt

SEQ ID NO: 91345 - DNA, 22 bp, Artificial Sequence
  chemically synthesized
cctcctgggttcaagcaattct

SEQ ID NO: 91346 - DNA, 22 bp, Artificial Sequence
  chemically synthesized
ctgggttcaagcaattctcctg

SEQ ID NO: 91347 - DNA, 22 bp, Artificial Sequence
  chemically synthesized
ggttcaagcaattctcctgcct

SEQ ID NO: 91348 - DNA, 22 bp, Artificial Sequence
  chemically synthesized
aagcaattctcctgcctcagcc

SEQ ID NO: 91349 - DNA, 22 bp, Artificial Sequence
  chemically synthesized
tcctgcctcagccacctgaata

SEQ ID NO: 91350 - DNA, 22 bp, Artificial Sequence
  chemically synthesized
ctgcctcagccacctgaatagc

SEQ ID NO: 91351 - DNA, 22 bp, Artificial Sequence
  chemically synthesized
cctcagccacctgaatagctgg

SEQ ID NO: 91352 - DNA, 22 bp, Artificial Sequence
  chemically synthesized
agccacctgaatagctgggact

SEQ ID NO: 91353 - DNA, 22 bp, Artificial Sequence
  chemically synthesized
aatagctgggactgcaggcatg

SEQ ID NO: 91354 - DNA, 22 bp, Artificial Sequence
  chemically synthesized
ggactgcaggcatgcaccacac

SEQ ID NO: 91355 - DNA, 22 bp, Artificial Sequence
  chemically synthesized
caggcatgcaccacacgcccgg

SEQ ID NO: 91356 - DNA, 22 bp, Artificial Sequence
  chemically synthesized
attttgtatttttagtagagat

SEQ ID NO: 91357 - DNA, 22 bp, Artificial Sequence
  chemically synthesized
tgtatttttagtagagatgggg

SEQ ID NO: 91358 - DNA, 22 bp, Artificial Sequence
  chemically synthesized
gtatttttagtagagatggggt

SEQ ID NO: 91359 - DNA, 22 bp, Artificial Sequence
  chemically synthesized
tatttttagtagagatggggtt

SEQ ID NO: 91360 - DNA, 22 bp, Artificial Sequence
  chemically synthesized
ttagtagagatggggtttcacc

SEQ ID NO: 91361 - DNA, 22 bp, Artificial Sequence
  chemically synthesized
tagtagagatggggtttcacca

SEQ ID NO: 91362 - DNA, 22 bp, Artificial Sequence
  chemically synthesized
agtagagatggggtttcaccat

SEQ ID NO: 91363 - DNA, 22 bp, Artificial Sequence
  chemically synthesized
gtagagatggggtttcaccatg

SEQ ID NO: 91364 - DNA, 22 bp, Artificial Sequence
  chemically synthesized
caccatgttggtcaggctggtc

SEQ ID NO: 91365 - DNA, 22 bp, Artificial Sequence
  chemically synthesized
accatgttggtcaggctggtct

SEQ ID NO: 91366 - DNA, 22 bp, Artificial Sequence
  chemically synthesized
gtcaggctggtcttgaactcct

SEQ ID NO: 91367 - DNA, 22 bp, Artificial Sequence
  chemically synthesized
gtcttgaactcctgacctcaag

SEQ ID NO: 91368 - DNA, 22 bp, Artificial Sequence
  chemically synthesized
gaactcctgacctcaagtgatc

SEQ ID NO: 91369 - DNA, 22 bp, Artificial Sequence
  chemically synthesized
aactcctgacctcaagtgatct

SEQ ID NO: 91370 - DNA, 22 bp, Artificial Sequence
  chemically synthesized
ctgacctcaagtgatctgcctg

SEQ ID NO: 91371 - DNA, 22 bp, Artificial Sequence
  chemically synthesized
acctcaagtgatctgcctgcct

SEQ ID NO: 91372 - DNA, 22 bp, Artificial Sequence
  chemically synthesized
aagtgatctgcctgccttggcc

SEQ ID NO: 91373 - DNA, 22 bp, Artificial Sequence
  chemically synthesized
cctgccttggcctcccaaagtg

SEQ ID NO: 91374 - DNA, 22 bp, Artificial Sequence
  chemically synthesized
ccttggcctcccaaagtgctgg

SEQ ID NO: 91375 - DNA, 22 bp, Artificial Sequence
  chemically synthesized
ggcctcccaaagtgctgggttt

SEQ ID NO: 91376 - DNA, 22 bp, Artificial Sequence
  chemically synthesized
gcctcccaaagtgctgggttta

SEQ ID NO: 91377 - DNA, 22 bp, Artificial Sequence
  chemically synthesized
ccaaagtgctgggtttacaagc

SEQ ID NO: 91378 - DNA, 22 bp, Artificial Sequence
  chemically synthesized
ggtttacaagcctgagccaccg

SEQ ID NO: 91379 - DNA, 22 bp, Artificial Sequence
  chemically synthesized
acaagcctgagccaccgcatcc

SEQ ID NO: 91380 - DNA, 22 bp, Artificial Sequence
  chemically synthesized
caagcctgagccaccgcatcca

SEQ ID NO: 91381 - DNA, 22 bp, Artificial Sequence
  chemically synthesized
agccaccgcatccagccaggat

SEQ ID NO: 91382 - DNA, 22 bp, Artificial Sequence
  chemically synthesized
aaagtggaaagaatagcatcta

SEQ ID NO: 91383 - DNA, 22 bp, Artificial Sequence
  chemically synthesized
ctcttgttcaggaaacaatgag

SEQ ID NO: 91384 - DNA, 22 bp, Artificial Sequence
  chemically synthesized
ttgttcaggaaacaatgaggac

SEQ ID NO: 91385 - DNA, 22 bp, Artificial Sequence
  chemically synthesized
gttcaggaaacaatgaggacct

SEQ ID NO: 91386 - DNA, 22 bp, Artificial Sequence
  chemically synthesized
ttcaggaaacaatgaggacctg

SEQ ID NO: 91387 - DNA, 22 bp, Artificial Sequence
  chemically synthesized
aggaaacaatgaggacctgact

SEQ ID NO: 91388 - DNA, 22 bp, Artificial Sequence
  chemically synthesized
actgggcagtaagagtggtgat

SEQ ID NO: 91389 - DNA, 22 bp, Artificial Sequence
  chemically synthesized
ggcagtaagagtggtgattaat

SEQ ID NO: 91390 - DNA, 22 bp, Artificial Sequence
  chemically synthesized
atagatagggacaaattgaagc

SEQ ID NO: 91391 - DNA, 22 bp, Artificial Sequence
  chemically synthesized
aagcagaatcgaactgttgatt

SEQ ID NO: 91392 - DNA, 22 bp, Artificial Sequence
  chemically synthesized
ttgattagaggtagggaaatga

SEQ ID NO: 91393 - DNA, 22 bp, Artificial Sequence
  chemically synthesized
attagaggtagggaaatgattt

SEQ ID NO: 91394 - DNA, 22 bp, Artificial Sequence
  chemically synthesized
gaggtagggaaatgattttaat

SEQ ID NO: 91395 - DNA, 22 bp, Artificial Sequence
  chemically synthesized
taatctgtgaccttggtgaatg

SEQ ID NO: 91396 - DNA, 22 bp, Artificial Sequence
  chemically synthesized
aatctgtgaccttggtgaatgg

SEQ ID NO: 91397 - DNA, 22 bp, Artificial Sequence
  chemically synthesized
atctgtgaccttggtgaatggg

SEQ ID NO: 91398 - DNA, 22 bp, Artificial Sequence
  chemically synthesized
tgaccttggtgaatgggcaagt

SEQ ID NO: 91399 - DNA, 22 bp, Artificial Sequence
  chemically synthesized
ggtgaatgggcaagtagctatc

SEQ ID NO: 91400 - DNA, 22 bp, Artificial Sequence
  chemically synthesized
gtgaatgggcaagtagctatct

SEQ ID NO: 91401 - DNA, 22 bp, Artificial Sequence
  chemically synthesized
tctaatgactaaaatggaaaac

SEQ ID NO: 91402 - DNA, 22 bp, Artificial Sequence
  chemically synthesized
atgactaaaatggaaaacactg

SEQ ID NO: 91403 - DNA, 22 bp, Artificial Sequence
  chemically synthesized
aaatggaaaacactggaagaga

SEQ ID NO: 91404 - DNA, 22 bp, Artificial Sequence
  chemically synthesized
gaagagaaacagttttagtata

SEQ ID NO: 91405 - DNA, 22 bp, Artificial Sequence
  chemically synthesized
tagtataacaagtgaaataccc

SEQ ID NO: 91406 - DNA, 22 bp, Artificial Sequence
  chemically synthesized
agtataacaagtgaaataccca

SEQ ID NO: 91407 - DNA, 22 bp, Artificial Sequence
  chemically synthesized
gtataacaagtgaaatacccat

SEQ ID NO: 91408 - DNA, 22 bp, Artificial Sequence
  chemically synthesized
agtctgaggtgcctataggaca

SEQ ID NO: 91409 - DNA, 22 bp, Artificial Sequence
  chemically synthesized
aggtgcctataggacatctata

SEQ ID NO: 91410 - DNA, 22 bp, Artificial Sequence
  chemically synthesized
taggacatctatataaataagc

SEQ ID NO: 91411 - DNA, 22 bp, Artificial Sequence
  chemically synthesized
tataaataagcccagtacattg

SEQ ID NO: 91412 - DNA, 22 bp, Artificial Sequence
  chemically synthesized
tttgatatatgggtttggcact

SEQ ID NO: 91413 - DNA, 22 bp, Artificial Sequence
  chemically synthesized
gatatatgggtttggcactgag

SEQ ID NO: 91414 - DNA, 22 bp, Artificial Sequence
  chemically synthesized
atatatgggtttggcactgagg

SEQ ID NO: 91415 - DNA, 22 bp, Artificial Sequence
  chemically synthesized
ggcactgaggttggaggtcaga

SEQ ID NO: 91416 - DNA, 22 bp, Artificial Sequence
  chemically synthesized
gcactgaggttggaggtcagag

SEQ ID NO: 91417 - DNA, 22 bp, Artificial Sequence
  chemically synthesized
aggttggaggtcagaggttaga

SEQ ID NO: 91418 - DNA, 22 bp, Artificial Sequence
  chemically synthesized
gaggtcagaggttagaaatcag

SEQ ID NO: 91419 - DNA, 22 bp, Artificial Sequence
  chemically synthesized
gaaatcagagttgggaattggg

SEQ ID NO: 91420 - DNA, 22 bp, Artificial Sequence
  chemically synthesized
ggaattgggattatacaggctg

SEQ ID NO: 91421 - DNA, 22 bp, Artificial Sequence
  chemically synthesized
ggattatacaggctgtatttaa

SEQ ID NO: 91422 - DNA, 22 bp, Artificial Sequence
  chemically synthesized
tacaggctgtatttaagagttt

SEQ ID NO: 91423 - DNA, 22 bp, Artificial Sequence
  chemically synthesized
tatttaagagtttagatataac

SEQ ID NO: 91424 - DNA, 22 bp, Artificial Sequence
  chemically synthesized
aagagtttagatataactgtga

SEQ ID NO: 91425 - DNA, 22 bp, Artificial Sequence
  chemically synthesized
agagtttagatataactgtgaa

SEQ ID NO: 91426 - DNA, 22 bp, Artificial Sequence
  chemically synthesized
agatataactgtgaatccaaga

SEQ ID NO: 91427 - DNA, 22 bp, Artificial Sequence
  chemically synthesized
gatataactgtgaatccaagag

SEQ ID NO: 91428 - DNA, 22 bp, Artificial Sequence
  chemically synthesized
tgaatccaagagtgtgatgaat

SEQ ID NO: 91429 - DNA, 22 bp, Artificial Sequence
  chemically synthesized
aatgaaggacctttaatgaaca

SEQ ID NO: 91430 - DNA, 22 bp, Artificial Sequence
  chemically synthesized
taatgaacaccaacatttaatg

SEQ ID NO: 91431 - DNA, 22 bp, Artificial Sequence
  chemically synthesized
aatgaacaccaacatttaatgt

SEQ ID NO: 91432 - DNA, 22 bp, Artificial Sequence
  chemically synthesized
atgaacaccaacatttaatgtg

SEQ ID NO: 91433 - DNA, 22 bp, Artificial Sequence
  chemically synthesized
aatgtgaaatctcaaggaagta

SEQ ID NO: 91434 - DNA, 22 bp, Artificial Sequence
  chemically synthesized
atgtgaaatctcaaggaagtat

SEQ ID NO: 91435 - DNA, 22 bp, Artificial Sequence
  chemically synthesized
aaggaagtatgaagtaagacat

SEQ ID NO: 91436 - DNA, 22 bp, Artificial Sequence
  chemically synthesized
tagaactcagtatcgattttaa

SEQ ID NO: 91437 - DNA, 22 bp, Artificial Sequence
  chemically synthesized
agaactcagtatcgattttaat

SEQ ID NO: 91438 - DNA, 22 bp, Artificial Sequence
  chemically synthesized
gaactcagtatcgattttaatt

SEQ ID NO: 91439 - DNA, 22 bp, Artificial Sequence
  chemically synthesized
agtatcgattttaattagtgta

SEQ ID NO: 91440 - DNA, 22 bp, Artificial Sequence
  chemically synthesized
taattagtgtaatgccaatgtg

SEQ ID NO: 91441 - DNA, 22 bp, Artificial Sequence
  chemically synthesized
aattagtgtaatgccaatgtgg

SEQ ID NO: 91442 - DNA, 22 bp, Artificial Sequence
  chemically synthesized
attagtgtaatgccaatgtggg

SEQ ID NO: 91443 - DNA, 22 bp, Artificial Sequence
  chemically synthesized
gtgtaatgccaatgtgggttag

SEQ ID NO: 91444 - DNA, 22 bp, Artificial Sequence
  chemically synthesized
gaatggaagtcaacttgctgtt

SEQ ID NO: 91445 - DNA, 22 bp, Artificial Sequence
  chemically synthesized
gctgttggtttcagagcaggta

SEQ ID NO: 91446 - DNA, 22 bp, Artificial Sequence
  chemically synthesized
ctgttggtttcagagcaggtag

SEQ ID NO: 91447 - DNA, 22 bp, Artificial Sequence
  chemically synthesized
ttggtttcagagcaggtaggag

SEQ ID NO: 91448 - DNA, 22 bp, Artificial Sequence
  chemically synthesized
gtttcagagcaggtaggagata

SEQ ID NO: 91449 - DNA, 22 bp, Artificial Sequence
  chemically synthesized
cagagcaggtaggagataaggt

SEQ ID NO: 91450 - DNA, 22 bp, Artificial Sequence
  chemically synthesized
agagcaggtaggagataaggtt

SEQ ID NO: 91451 - DNA, 22 bp, Artificial Sequence
  chemically synthesized
tagattttgacacagtgaaaag

SEQ ID NO: 91452 - DNA, 22 bp, Artificial Sequence
  chemically synthesized
gattttgacacagtgaaaagct

SEQ ID NO: 91453 - DNA, 22 bp, Artificial Sequence
  chemically synthesized
tgacacagtgaaaagctgaaac

SEQ ID NO: 91454 - DNA, 22 bp, Artificial Sequence
  chemically synthesized
gacacagtgaaaagctgaaaca

SEQ ID NO: 91455 - DNA, 22 bp, Artificial Sequence
  chemically synthesized
acacagtgaaaagctgaaacaa

SEQ ID NO: 91456 - DNA, 22 bp, Artificial Sequence
  chemically synthesized
aaacaaaaaggaaaaggtaggg

SEQ ID NO: 91457 - DNA, 22 bp, Artificial Sequence
  chemically synthesized
aggactctagggtcagagaaat

SEQ ID NO: 91458 - DNA, 22 bp, Artificial Sequence
  chemically synthesized
tagggtcagagaaatatgggtt

SEQ ID NO: 91459 - DNA, 22 bp, Artificial Sequence
  chemically synthesized
gggtcagagaaatatgggttat

SEQ ID NO: 91460 - DNA, 22 bp, Artificial Sequence
  chemically synthesized
tatccttctacaaaattcacat

SEQ ID NO: 91461 - DNA, 22 bp, Artificial Sequence
  chemically synthesized
ctacaaaattcacattcttggc

SEQ ID NO: 91462 - DNA, 22 bp, Artificial Sequence
  chemically synthesized
tacaaaattcacattcttggct

SEQ ID NO: 91463 - DNA, 22 bp, Artificial Sequence
  chemically synthesized
caaaattcacattcttggctgg

SEQ ID NO: 91464 - DNA, 22 bp, Artificial Sequence
  chemically synthesized
acattcttggctgggtgtggtg

SEQ ID NO: 91465 - DNA, 22 bp, Artificial Sequence
  chemically synthesized
ttggctgggtgtggtggctcac

SEQ ID NO: 91466 - DNA, 22 bp, Artificial Sequence
  chemically synthesized
ggctgggtgtggtggctcacgc

SEQ ID NO: 91467 - DNA, 22 bp, Artificial Sequence
  chemically synthesized
gctgggtgtggtggctcacgcc

SEQ ID NO: 91468 - DNA, 22 bp, Artificial Sequence
  chemically synthesized
ggtgtggtggctcacgcctgtg

SEQ ID NO: 91469 - DNA, 22 bp, Artificial Sequence
  chemically synthesized
acgcctgtgatcccagcacttt

SEQ ID NO: 91470 - DNA, 22 bp, Artificial Sequence
  chemically synthesized
tgatcccagcactttcagaggc

SEQ ID NO: 91471 - DNA, 22 bp, Artificial Sequence
  chemically synthesized
tcagaggccgaggagggtggat

SEQ ID NO: 91472 - DNA, 22 bp, Artificial Sequence
  chemically synthesized
cagaggccgaggagggtggatc

SEQ ID NO: 91473 - DNA, 22 bp, Artificial Sequence
  chemically synthesized
agaggccgaggagggtggatca

SEQ ID NO: 91474 - DNA, 22 bp, Artificial Sequence
  chemically synthesized
atgttaggagttcgagatcagc

SEQ ID NO: 91475 - DNA, 22 bp, Artificial Sequence
  chemically synthesized
ggagttcgagatcagcctgacc

SEQ ID NO: 91476 - DNA, 22 bp, Artificial Sequence
  chemically synthesized
gagatcagcctgaccaacatgg

SEQ ID NO: 91477 - DNA, 22 bp, Artificial Sequence
  chemically synthesized
accaacatggtgaaacccccta

SEQ ID NO: 91478 - DNA, 22 bp, Artificial Sequence
  chemically synthesized
tctactaaaaatagaaaattag

SEQ ID NO: 91479 - DNA, 22 bp, Artificial Sequence
  chemically synthesized
ctaaaaatagaaaattagccag

SEQ ID NO: 91480 - DNA, 22 bp, Artificial Sequence
  chemically synthesized
aaaatagaaaattagccaggca

SEQ ID NO: 91481 - DNA, 22 bp, Artificial Sequence
  chemically synthesized
gccaggcatggtggtggcacat

SEQ ID NO: 91482 - DNA, 22 bp, Artificial Sequence
  chemically synthesized
tagtgccagctacttgggaggc

SEQ ID NO: 91483 - DNA, 22 bp, Artificial Sequence
  chemically synthesized
cttgggaggctgaggcaggaga

SEQ ID NO: 91484 - DNA, 22 bp, Artificial Sequence
  chemically synthesized
gggaggctgaggcaggagaatc

SEQ ID NO: 91485 - DNA, 22 bp, Artificial Sequence
  chemically synthesized
ggaggctgaggcaggagaatcg

SEQ ID NO: 91486 - DNA, 22 bp, Artificial Sequence
  chemically synthesized
aggcaggagaatcgcttgaacc

SEQ ID NO: 91487 - DNA, 22 bp, Artificial Sequence
  chemically synthesized
gaacctgggaggcagatgttgc

SEQ ID NO: 91488 - DNA, 22 bp, Artificial Sequence
  chemically synthesized
aacctgggaggcagatgttgca

SEQ ID NO: 91489 - DNA, 22 bp, Artificial Sequence
  chemically synthesized
ggaggcagatgttgcagtgagc

SEQ ID NO: 91490 - DNA, 22 bp, Artificial Sequence
  chemically synthesized
cagtgagcctggatcatgccat

SEQ ID NO: 91491 - DNA, 22 bp, Artificial Sequence
  chemically synthesized
gatcatgccattgcactccagc

SEQ ID NO: 91492 - DNA, 22 bp, Artificial Sequence
  chemically synthesized
cactccagcctgggcaaccata

SEQ ID NO: 91493 - DNA, 22 bp, Artificial Sequence
  chemically synthesized
cagcctgggcaaccatagcaat

SEQ ID NO: 91494 - DNA, 22 bp, Artificial Sequence
  chemically synthesized
ggcaaccatagcaatgctctat

SEQ ID NO: 91495 - DNA, 22 bp, Artificial Sequence
  chemically synthesized
tatctcagaaaaaaaaaaaaaa

SEQ ID NO: 91496 - DNA, 22 bp, Artificial Sequence
  chemically synthesized
tctcagaaaaaaaaaaaaaaag

SEQ ID NO: 91497 - DNA, 22 bp, Artificial Sequence
  chemically synthesized
agaaaaaaaaaaaaaaagttct

SEQ ID NO: 91498 - DNA, 22 bp, Artificial Sequence
  chemically synthesized
ttgctaacctgaaaaaataaat

SEQ ID NO: 91499 - DNA, 22 bp, Artificial Sequence
  chemically synthesized
gctaacctgaaaaaataaatta

SEQ ID NO: 91500 - DNA, 22 bp, Artificial Sequence
  chemically synthesized
ctaacctgaaaaaataaattat

SEQ ID NO: 91501 - DNA, 22 bp, Artificial Sequence
  chemically synthesized
acctgaaaaaataaattatttg

SEQ ID NO: 91502 - DNA, 22 bp, Artificial Sequence
  chemically synthesized
aaaaaataaattatttgagctt

SEQ ID NO: 91503 - DNA, 22 bp, Artificial Sequence
  chemically synthesized
tttgagctttgtacctaattca

SEQ ID NO: 91504 - DNA, 22 bp, Artificial Sequence
  chemically synthesized
gagctttgtacctaattcataa

SEQ ID NO: 91505 - DNA, 22 bp, Artificial Sequence
  chemically synthesized
agctttgtacctaattcataat

SEQ ID NO: 91506 - DNA, 22 bp, Artificial Sequence
  chemically synthesized
tgtacctaattcataattttca

SEQ ID NO: 91507 - DNA, 22 bp, Artificial Sequence
  chemically synthesized
gtacctaattcataattttcag

SEQ ID NO: 91508 - DNA, 22 bp, Artificial Sequence
  chemically synthesized
tacctaattcataattttcaga

SEQ ID NO: 91509 - DNA, 22 bp, Artificial Sequence
  chemically synthesized
attcataattttcagataatga

SEQ ID NO: 91510 - DNA, 22 bp, Artificial Sequence
  chemically synthesized
ataattttcagataatgaatat

SEQ ID NO: 91511 - DNA, 22 bp, Artificial Sequence
  chemically synthesized
tcagataatgaatattgagatg

SEQ ID NO: 91512 - DNA, 22 bp, Artificial Sequence
  chemically synthesized
cagataatgaatattgagatga

SEQ ID NO: 91513 - DNA, 22 bp, Artificial Sequence
  chemically synthesized
agataatgaatattgagatgat

SEQ ID NO: 91514 - DNA, 22 bp, Artificial Sequence
  chemically synthesized
agatgatatatgcacagaacaa

SEQ ID NO: 91515 - DNA, 22 bp, Artificial Sequence
  chemically synthesized
gagacacattctaagtgtgaca

SEQ ID NO: 91516 - DNA, 22 bp, Artificial Sequence
  chemically synthesized
taagtgtgacattcttaaatgc

SEQ ID NO: 91517 - DNA, 22 bp, Artificial Sequence
  chemically synthesized
agtgtgacattcttaaatgcca

SEQ ID NO: 91518 - DNA, 22 bp, Artificial Sequence
  chemically synthesized
ttaaatgccagtgctctccaca

SEQ ID NO: 91519 - DNA, 22 bp, Artificial Sequence
  chemically synthesized
aaatgccagtgctctccacaat

SEQ ID NO: 91520 - DNA, 22 bp, Artificial Sequence
  chemically synthesized
aatgccagtgctctccacaatt

SEQ ID NO: 91521 - DNA, 22 bp, Artificial Sequence
  chemically synthesized
tccacaattctaatctcagttc

SEQ ID NO: 91522 - DNA, 22 bp, Artificial Sequence
  chemically synthesized
cacaattctaatctcagttcac

SEQ ID NO: 91523 - DNA, 22 bp, Artificial Sequence
  chemically synthesized
taatctcagttcactgctgttt

SEQ ID NO: 91524 - DNA, 22 bp, Artificial Sequence
  chemically synthesized
atctcagttcactgctgtttga

SEQ ID NO: 91525 - DNA, 22 bp, Artificial Sequence
  chemically synthesized
agttcactgctgtttgaattct

SEQ ID NO: 91526 - DNA, 22 bp, Artificial Sequence
  chemically synthesized
actgctgtttgaattctgtgtt

SEQ ID NO: 91527 - DNA, 22 bp, Artificial Sequence
  chemically synthesized
ctgtttgaattctgtgttttca

SEQ ID NO: 91528 - DNA, 22 bp, Artificial Sequence
  chemically synthesized
tttgaattctgtgttttcatat

SEQ ID NO: 91529 - DNA, 22 bp, Artificial Sequence
  chemically synthesized
gaattctgtgttttcatattat

SEQ ID NO: 91530 - DNA, 22 bp, Artificial Sequence
  chemically synthesized
aattctgtgttttcatattatc

SEQ ID NO: 91531 - DNA, 22 bp, Artificial Sequence
  chemically synthesized
tgtgttttcatattatcttatc

SEQ ID NO: 91532 - DNA, 22 bp, Artificial Sequence
  chemically synthesized
tgttttcatattatcttatcaa

SEQ ID NO: 91533 - DNA, 22 bp, Artificial Sequence
  chemically synthesized
tcatattatcttatcaatacat

SEQ ID NO: 91534 - DNA, 22 bp, Artificial Sequence
  chemically synthesized
catattatcttatcaatacatt

SEQ ID NO: 91535 - DNA, 22 bp, Artificial Sequence
  chemically synthesized
atattatcttatcaatacatta

SEQ ID NO: 91536 - DNA, 22 bp, Artificial Sequence
  chemically synthesized
tcttatcaatacattaatcatt

SEQ ID NO: 91537 - DNA, 22 bp, Artificial Sequence
  chemically synthesized
atcaatacattaatcattgcaa

SEQ ID NO: 91538 - DNA, 22 bp, Artificial Sequence
  chemically synthesized
tcaatacattaatcattgcaat

SEQ ID NO: 91539 - DNA, 22 bp, Artificial Sequence
  chemically synthesized
atcattgcaataatcactgcac

SEQ ID NO: 91540 - DNA, 22 bp, Artificial Sequence
  chemically synthesized
caataatcactgcacactgtaa

SEQ ID NO: 91541 - DNA, 22 bp, Artificial Sequence
  chemically synthesized
cacactgtaattattcatttac

SEQ ID NO: 91542 - DNA, 22 bp, Artificial Sequence
  chemically synthesized
taattattcatttactggacac

SEQ ID NO: 91543 - DNA, 22 bp, Artificial Sequence
  chemically synthesized
ttcatttactggacacatccta

SEQ ID NO: 91544 - DNA, 22 bp, Artificial Sequence
  chemically synthesized
atttactggacacatcctagtt

SEQ ID NO: 91545 - DNA, 22 bp, Artificial Sequence
  chemically synthesized
actggacacatcctagtttcct

SEQ ID NO: 91546 - DNA, 22 bp, Artificial Sequence
  chemically synthesized
ctggacacatcctagtttcctt

SEQ ID NO: 91547 - DNA, 22 bp, Artificial Sequence
  chemically synthesized
gacacatcctagtttccttctg

SEQ ID NO: 91548 - DNA, 22 bp, Artificial Sequence
  chemically synthesized
gtttccttctgtcaattaccat

SEQ ID NO: 91549 - DNA, 22 bp, Artificial Sequence
  chemically synthesized
ccttctgtcaattaccattcat

SEQ ID NO: 91550 - DNA, 22 bp, Artificial Sequence
  chemically synthesized
cttctgtcaattaccattcatg

SEQ ID NO: 91551 - DNA, 22 bp, Artificial Sequence
  chemically synthesized
ctgtcaattaccattcatgtct

SEQ ID NO: 91552 - DNA, 22 bp, Artificial Sequence
  chemically synthesized
tgtcaattaccattcatgtctg

SEQ ID NO: 91553 - DNA, 22 bp, Artificial Sequence
  chemically synthesized
tcaattaccattcatgtctgct

SEQ ID NO: 91554 - DNA, 22 bp, Artificial Sequence
  chemically synthesized
ccattcatgtctgctttcacat

SEQ ID NO: 91555 - DNA, 22 bp, Artificial Sequence
  chemically synthesized
atgtctgctttcacatttattt

SEQ ID NO: 91556 - DNA, 22 bp, Artificial Sequence
  chemically synthesized
ctttcacatttatttctcatcc

SEQ ID NO: 91557 - DNA, 22 bp, Artificial Sequence
  chemically synthesized
tcacatttatttctcatccttc

SEQ ID NO: 91558 - DNA, 22 bp, Artificial Sequence
  chemically synthesized
cacatttatttctcatccttcc

SEQ ID NO: 91559 - DNA, 22 bp, Artificial Sequence
  chemically synthesized
acatttatttctcatccttccc

SEQ ID NO: 91560 - DNA, 22 bp, Artificial Sequence
  chemically synthesized
atttctcatccttccctcagtg

SEQ ID NO: 91561 - DNA, 22 bp, Artificial Sequence
  chemically synthesized
tttctcatccttccctcagtgt

SEQ ID NO: 91562 - DNA, 22 bp, Artificial Sequence
  chemically synthesized
ctcatccttccctcagtgttct

SEQ ID NO: 91563 - DNA, 22 bp, Artificial Sequence
  chemically synthesized
tcatccttccctcagtgttctc

SEQ ID NO: 91564 - DNA, 22 bp, Artificial Sequence
  chemically synthesized
atccttccctcagtgttctctg

SEQ ID NO: 91565 - DNA, 22 bp, Artificial Sequence
  chemically synthesized
ccctcagtgttctctgtatttg

SEQ ID NO: 91566 - DNA, 22 bp, Artificial Sequence
  chemically synthesized
cctcagtgttctctgtatttga

SEQ ID NO: 91567 - DNA, 22 bp, Artificial Sequence
  chemically synthesized
agtgttctctgtatttgaggaa

SEQ ID NO: 91568 - DNA, 22 bp, Artificial Sequence
  chemically synthesized
tctgtatttgaggaactgacat

SEQ ID NO: 91569 - DNA, 22 bp, Artificial Sequence
  chemically synthesized
tgtatttgaggaactgacattt

SEQ ID NO: 91570 - DNA, 22 bp, Artificial Sequence
  chemically synthesized
tatttgaggaactgacatttcc

SEQ ID NO: 91571 - DNA, 22 bp, Artificial Sequence
  chemically synthesized
gaggaactgacatttcccaggt

SEQ ID NO: 91572 - DNA, 22 bp, Artificial Sequence
  chemically synthesized
aggaactgacatttcccaggtt

SEQ ID NO: 91573 - DNA, 22 bp, Artificial Sequence
  chemically synthesized
acatttcccaggtttcctcacc

SEQ ID NO: 91574 - DNA, 22 bp, Artificial Sequence
  chemically synthesized
cccaggtttcctcaccctttca

SEQ ID NO: 91575 - DNA, 22 bp, Artificial Sequence
  chemically synthesized
ccaggtttcctcaccctttcag

SEQ ID NO: 91576 - DNA, 22 bp, Artificial Sequence
  chemically synthesized
cctcaccctttcagtcgcatgt

SEQ ID NO: 91577 - DNA, 22 bp, Artificial Sequence
  chemically synthesized
ctcaccctttcagtcgcatgta

SEQ ID NO: 91578 - DNA, 22 bp, Artificial Sequence
  chemically synthesized
accctttcagtcgcatgtacat

SEQ ID NO: 91579 - DNA, 22 bp, Artificial Sequence
  chemically synthesized
tcagtcgcatgtacattctgca

SEQ ID NO: 91580 - DNA, 22 bp, Artificial Sequence
  chemically synthesized
cagtcgcatgtacattctgcaa

SEQ ID NO: 91581 - DNA, 22 bp, Artificial Sequence
  chemically synthesized
agtcgcatgtacattctgcaat

SEQ ID NO: 91582 - DNA, 22 bp, Artificial Sequence
  chemically synthesized
tgcaatggtaaacactggctga

SEQ ID NO: 91583 - DNA, 22 bp, Artificial Sequence
  chemically synthesized
caatggtaaacactggctgagg

SEQ ID NO: 91584 - DNA, 22 bp, Artificial Sequence
  chemically synthesized
gctgagggaaagcataagcaag

SEQ ID NO: 91585 - DNA, 22 bp, Artificial Sequence
  chemically synthesized
agggaaagcataagcaagatta

SEQ ID NO: 91586 - DNA, 22 bp, Artificial Sequence
  chemically synthesized
tttctggtctctctctctctct

SEQ ID NO: 91587 - DNA, 22 bp, Artificial Sequence
  chemically synthesized
ctggtctctctctctctctgaa

SEQ ID NO: 91588 - DNA, 22 bp, Artificial Sequence
  chemically synthesized
tggtctctctctctctctgaac

SEQ ID NO: 91589 - DNA, 22 bp, Artificial Sequence
  chemically synthesized
gtctctctctctctctgaacgg

SEQ ID NO: 91590 - DNA, 22 bp, Artificial Sequence
  chemically synthesized
tctctctctctgaacggatctc

SEQ ID NO: 91591 - DNA, 22 bp, Artificial Sequence
  chemically synthesized
tctctctctgaacggatctcct

SEQ ID NO: 91592 - DNA, 22 bp, Artificial Sequence
  chemically synthesized
tctctctgaacggatctcctac

SEQ ID NO: 91593 - DNA, 22 bp, Artificial Sequence
  chemically synthesized
tctctgaacggatctcctacag

SEQ ID NO: 91594 - DNA, 22 bp, Artificial Sequence
  chemically synthesized
tctgaacggatctcctacagca

SEQ ID NO: 91595 - DNA, 22 bp, Artificial Sequence
  chemically synthesized
tgaacggatctcctacagcaga

SEQ ID NO: 91596 - DNA, 22 bp, Artificial Sequence
  chemically synthesized
aacggatctcctacagcagaca

SEQ ID NO: 91597 - DNA, 22 bp, Artificial Sequence
  chemically synthesized
ctacagcagacagtctttttta

SEQ ID NO: 91598 - DNA, 22 bp, Artificial Sequence
  chemically synthesized
cagcagacagtcttttttatgg

SEQ ID NO: 91599 - DNA, 22 bp, Artificial Sequence
  chemically synthesized
ttttatggttttttatggctga

SEQ ID NO: 91600 - DNA, 22 bp, Artificial Sequence
  chemically synthesized
tttatggttttttatggctgat

SEQ ID NO: 91601 - DNA, 22 bp, Artificial Sequence
  chemically synthesized
ttatggttttttatggctgata

SEQ ID NO: 91602 - DNA, 22 bp, Artificial Sequence
  chemically synthesized
tatggttttttatggctgatac

SEQ ID NO: 91603 - DNA, 22 bp, Artificial Sequence
  chemically synthesized
atggttttttatggctgatact

SEQ ID NO: 91604 - DNA, 22 bp, Artificial Sequence
  chemically synthesized
tggttttttatggctgatactt

SEQ ID NO: 91605 - DNA, 22 bp, Artificial Sequence
  chemically synthesized
tttatggctgatactttgatgc

SEQ ID NO: 91606 - DNA, 22 bp, Artificial Sequence
  chemically synthesized
ttatggctgatactttgatgcc

SEQ ID NO: 91607 - DNA, 22 bp, Artificial Sequence
  chemically synthesized
tatggctgatactttgatgccc

SEQ ID NO: 91608 - DNA, 22 bp, Artificial Sequence
  chemically synthesized
atggctgatactttgatgcccc

SEQ ID NO: 91609 - DNA, 22 bp, Artificial Sequence
  chemically synthesized
tggctgatactttgatgccccc

SEQ ID NO: 91610 - DNA, 22 bp, Artificial Sequence
  chemically synthesized
atactttgatgcccccattaga

SEQ ID NO: 91611 - DNA, 22 bp, Artificial Sequence
  chemically synthesized
tgatgcccccattagacagttc

SEQ ID NO: 91612 - DNA, 22 bp, Artificial Sequence
  chemically synthesized
gatgcccccattagacagttct

SEQ ID NO: 91613 - DNA, 22 bp, Artificial Sequence
  chemically synthesized
atgcccccattagacagttctg

SEQ ID NO: 91614 - DNA, 22 bp, Artificial Sequence
  chemically synthesized
gacagttctggctctctccaag

SEQ ID NO: 91615 - DNA, 22 bp, Artificial Sequence
  chemically synthesized
tggctctctccaaggagcaccc

SEQ ID NO: 91616 - DNA, 22 bp, Artificial Sequence
  chemically synthesized
gctctctccaaggagcacccac

SEQ ID NO: 91617 - DNA, 22 bp, Artificial Sequence
  chemically synthesized
tctccaaggagcacccactagc

SEQ ID NO: 91618 - DNA, 22 bp, Artificial Sequence
  chemically synthesized
tccaaggagcacccactagctc

SEQ ID NO: 91619 - DNA, 22 bp, Artificial Sequence
  chemically synthesized
caaggagcacccactagctcac

SEQ ID NO: 91620 - DNA, 22 bp, Artificial Sequence
  chemically synthesized
gctcactgaatccagtggacct

SEQ ID NO: 91621 - DNA, 22 bp, Artificial Sequence
  chemically synthesized
actgaatccagtggacctctgg

SEQ ID NO: 91622 - DNA, 22 bp, Artificial Sequence
  chemically synthesized
aatccagtggacctctggttat

SEQ ID NO: 91623 - DNA, 22 bp, Artificial Sequence
  chemically synthesized
tggttatgggctctggttctgg

SEQ ID NO: 91624 - DNA, 22 bp, Artificial Sequence
  chemically synthesized
gttatgggctctggttctggac

SEQ ID NO: 91625 - DNA, 22 bp, Artificial Sequence
  chemically synthesized
tgggctctggttctggactctg

SEQ ID NO: 91626 - DNA, 22 bp, Artificial Sequence
  chemically synthesized
tggttctggactctggtggtat

SEQ ID NO: 91627 - DNA, 22 bp, Artificial Sequence
  chemically synthesized
gttctggactctggtggtataa

SEQ ID NO: 91628 - DNA, 22 bp, Artificial Sequence
  chemically synthesized
tggactctggtggtataaacat

SEQ ID NO: 91629 - DNA, 22 bp, Artificial Sequence
  chemically synthesized
gactctggtggtataaacattt

SEQ ID NO: 91630 - DNA, 22 bp, Artificial Sequence
  chemically synthesized
tggtggtataaacattttctcc

SEQ ID NO: 91631 - DNA, 22 bp, Artificial Sequence
  chemically synthesized
gtggtataaacattttctcctt

SEQ ID NO: 91632 - DNA, 22 bp, Artificial Sequence
  chemically synthesized
tctccttctgcccttctaggcc

SEQ ID NO: 91633 - DNA, 22 bp, Artificial Sequence
  chemically synthesized
ctccttctgcccttctaggcct

SEQ ID NO: 91634 - DNA, 22 bp, Artificial Sequence
  chemically synthesized
tccttctgcccttctaggccta

SEQ ID NO: 91635 - DNA, 22 bp, Artificial Sequence
  chemically synthesized
cttctgcccttctaggcctaat

SEQ ID NO: 91636 - DNA, 22 bp, Artificial Sequence
  chemically synthesized
ctgcccttctaggcctaatggc

SEQ ID NO: 91637 - DNA, 22 bp, Artificial Sequence
  chemically synthesized
tgcccttctaggcctaatggcg

SEQ ID NO: 91638 - DNA, 22 bp, Artificial Sequence
  chemically synthesized
cccttctaggcctaatggcgga

SEQ ID NO: 91639 - DNA, 22 bp, Artificial Sequence
  chemically synthesized
ctaggcctaatggcggaagagg

SEQ ID NO: 91640 - DNA, 22 bp, Artificial Sequence
  chemically synthesized
taggcctaatggcggaagaggt

SEQ ID NO: 91641 - DNA, 22 bp, Artificial Sequence
  chemically synthesized
ggcctaatggcggaagaggttt

SEQ ID NO: 91642 - DNA, 22 bp, Artificial Sequence
  chemically synthesized
atggcggaagaggttttctgat

SEQ ID NO: 91643 - DNA, 22 bp, Artificial Sequence
  chemically synthesized
tctgatgttactaacatctaga

SEQ ID NO: 91644 - DNA, 22 bp, Artificial Sequence
  chemically synthesized
ctgatgttactaacatctagat

SEQ ID NO: 91645 - DNA, 22 bp, Artificial Sequence
  chemically synthesized
tgatgttactaacatctagatt

SEQ ID NO: 91646 - DNA, 22 bp, Artificial Sequence
  chemically synthesized
atgttactaacatctagatttc

SEQ ID NO: 91647 - DNA, 22 bp, Artificial Sequence
  chemically synthesized
ctaacatctagatttctgcact

SEQ ID NO: 91648 - DNA, 22 bp, Artificial Sequence
  chemically synthesized
acatctagatttctgcactgtc

SEQ ID NO: 91649 - DNA, 22 bp, Artificial Sequence
  chemically synthesized
gatttctgcactgtcctttatt

SEQ ID NO: 91650 - DNA, 22 bp, Artificial Sequence
  chemically synthesized
ctgcactgtcctttatttgata

SEQ ID NO: 91651 - DNA, 22 bp, Artificial Sequence
  chemically synthesized
tgcactgtcctttatttgatat

SEQ ID NO: 91652 - DNA, 22 bp, Artificial Sequence
  chemically synthesized
cactgtcctttatttgatattt

SEQ ID NO: 91653 - DNA, 22 bp, Artificial Sequence
  chemically synthesized
tcctttatttgatattttagct

SEQ ID NO: 91654 - DNA, 22 bp, Artificial Sequence
  chemically synthesized
tatttgatattttagctcttcc

SEQ ID NO: 91655 - DNA, 22 bp, Artificial Sequence
  chemically synthesized
atttgatattttagctcttcca

SEQ ID NO: 91656 - DNA, 22 bp, Artificial Sequence
  chemically synthesized
tttgatattttagctcttccaa

SEQ ID NO: 91657 - DNA, 22 bp, Artificial Sequence
  chemically synthesized
gatattttagctcttccaatac

SEQ ID NO: 91658 - DNA, 22 bp, Artificial Sequence
  chemically synthesized
atattttagctcttccaataca

SEQ ID NO: 91659 - DNA, 22 bp, Artificial Sequence
  chemically synthesized
tagctcttccaatacaaggata

SEQ ID NO: 91660 - DNA, 22 bp, Artificial Sequence
  chemically synthesized
agctcttccaatacaaggataa

SEQ ID NO: 91661 - DNA, 22 bp, Artificial Sequence
  chemically synthesized
gctcttccaatacaaggataat

SEQ ID NO: 91662 - DNA, 22 bp, Artificial Sequence
  chemically synthesized
ttccaatacaaggataattaac

SEQ ID NO: 91663 - DNA, 22 bp, Artificial Sequence
  chemically synthesized
ccaatacaaggataattaacta

SEQ ID NO: 91664 - DNA, 22 bp, Artificial Sequence
  chemically synthesized
caatacaaggataattaactat

SEQ ID NO: 91665 - DNA, 22 bp, Artificial Sequence
  chemically synthesized
actattaagagctgtatttaat

SEQ ID NO: 91666 - DNA, 22 bp, Artificial Sequence
  chemically synthesized
ttaagagctgtatttaattcta

SEQ ID NO: 91667 - DNA, 22 bp, Artificial Sequence
  chemically synthesized
agagctgtatttaattctaggt

SEQ ID NO: 91668 - DNA, 22 bp, Artificial Sequence
  chemically synthesized
tatttaattctaggttgagtaa

SEQ ID NO: 91669 - DNA, 22 bp, Artificial Sequence
  chemically synthesized
aattctaggttgagtaactgat

SEQ ID NO: 91670 - DNA, 22 bp, Artificial Sequence
  chemically synthesized
attctaggttgagtaactgata

SEQ ID NO: 91671 - DNA, 22 bp, Artificial Sequence
  chemically synthesized
taggttgagtaactgataatgg

SEQ ID NO: 91672 - DNA, 22 bp, Artificial Sequence
  chemically synthesized
ggttgagtaactgataatggtt

SEQ ID NO: 91673 - DNA, 22 bp, Artificial Sequence
  chemically synthesized
agtaactgataatggtttgtcc

SEQ ID NO: 91674 - DNA, 22 bp, Artificial Sequence
  chemically synthesized
ataatggtttgtcctttccttg

SEQ ID NO: 91675 - DNA, 22 bp, Artificial Sequence
  chemically synthesized
gtcctttccttgatggacccta

SEQ ID NO: 91676 - DNA, 22 bp, Artificial Sequence
  chemically synthesized
tcctttccttgatggaccctaa

SEQ ID NO: 91677 - DNA, 22 bp, Artificial Sequence
  chemically synthesized
tccttgatggaccctaactgat

SEQ ID NO: 91678 - DNA, 22 bp, Artificial Sequence
  chemically synthesized
ccttgatggaccctaactgata

SEQ ID NO: 91679 - DNA, 22 bp, Artificial Sequence
  chemically synthesized
cttgatggaccctaactgatat

SEQ ID NO: 91680 - DNA, 22 bp, Artificial Sequence
  chemically synthesized
gatggaccctaactgatataac

SEQ ID NO: 91681 - DNA, 22 bp, Artificial Sequence
  chemically synthesized
atggaccctaactgatataact

SEQ ID NO: 91682 - DNA, 22 bp, Artificial Sequence
  chemically synthesized
actgatataactaataaactga

SEQ ID NO: 91683 - DNA, 22 bp, Artificial Sequence
  chemically synthesized
atataactaataaactgacttc

SEQ ID NO: 91684 - DNA, 22 bp, Artificial Sequence
  chemically synthesized
ataaactgacttctgatactat

SEQ ID NO: 91685 - DNA, 22 bp, Artificial Sequence
  chemically synthesized
acttctgatactatgtcttatt

SEQ ID NO: 91686 - DNA, 22 bp, Artificial Sequence
  chemically synthesized
ctgatactatgtcttattagtg

SEQ ID NO: 91687 - DNA, 22 bp, Artificial Sequence
  chemically synthesized
tgatactatgtcttattagtgt

SEQ ID NO: 91688 - DNA, 22 bp, Artificial Sequence
  chemically synthesized
atactatgtcttattagtgtat

SEQ ID NO: 91689 - DNA, 22 bp, Artificial Sequence
  chemically synthesized
tgtcttattagtgtatgaaatt

SEQ ID NO: 91690 - DNA, 22 bp, Artificial Sequence
  chemically synthesized
attagtgtatgaaattctgatg

SEQ ID NO: 91691 - DNA, 22 bp, Artificial Sequence
  chemically synthesized
ttagtgtatgaaattctgatgt

SEQ ID NO: 91692 - DNA, 22 bp, Artificial Sequence
  chemically synthesized
gtgtatgaaattctgatgtgaa

SEQ ID NO: 91693 - DNA, 22 bp, Artificial Sequence
  chemically synthesized
tgatgtgaataaatgcatgaca

SEQ ID NO: 91694 - DNA, 22 bp, Artificial Sequence
  chemically synthesized
atgtgaataaatgcatgacaca

SEQ ID NO: 91695 - DNA, 22 bp, Artificial Sequence
  chemically synthesized
gttgactaatcaaactatagca

SEQ ID NO: 91696 - DNA, 22 bp, Artificial Sequence
  chemically synthesized
ttgactaatcaaactatagcag

SEQ ID NO: 91697 - DNA, 22 bp, Artificial Sequence
  chemically synthesized
actaatcaaactatagcagagg

SEQ ID NO: 91698 - DNA, 22 bp, Artificial Sequence
  chemically synthesized
atcaaactatagcagaggcaga

SEQ ID NO: 91699 - DNA, 22 bp, Artificial Sequence
  chemically synthesized
tagcagaggcagaggaaggaac

SEQ ID NO: 91700 - DNA, 22 bp, Artificial Sequence
  chemically synthesized
atgacctataaatactaagata

SEQ ID NO: 91701 - DNA, 22 bp, Artificial Sequence
  chemically synthesized
taaatactaagatatcacatag

SEQ ID NO: 91702 - DNA, 22 bp, Artificial Sequence
  chemically synthesized
agatatcacatagtcattttag

SEQ ID NO: 91703 - DNA, 22 bp, Artificial Sequence
  chemically synthesized
tagaaccaaaggttcctcagtt

SEQ ID NO: 91704 - DNA, 22 bp, Artificial Sequence
  chemically synthesized
agaaccaaaggttcctcagttt

SEQ ID NO: 91705 - DNA, 22 bp, Artificial Sequence
  chemically synthesized
gaaccaaaggttcctcagttta

SEQ ID NO: 91706 - DNA, 22 bp, Artificial Sequence
  chemically synthesized
ctcagtttaggtctcaaacaaa

SEQ ID NO: 91707 - DNA, 22 bp, Artificial Sequence
  chemically synthesized
agtttaggtctcaaacaaactt

SEQ ID NO: 91708 - DNA, 22 bp, Artificial Sequence
  chemically synthesized
aggtctcaaacaaacttctcta

SEQ ID NO: 91709 - DNA, 22 bp, Artificial Sequence
  chemically synthesized
ggtctcaaacaaacttctctat

SEQ ID NO: 91710 - DNA, 22 bp, Artificial Sequence
  chemically synthesized
aaacaaacttctctatggatag

SEQ ID NO: 91711 - DNA, 22 bp, Artificial Sequence
  chemically synthesized
ctctatggatagtgtaatactc

SEQ ID NO: 91712 - DNA, 22 bp, Artificial Sequence
  chemically synthesized
tctatggatagtgtaatactca

SEQ ID NO: 91713 - DNA, 22 bp, Artificial Sequence
  chemically synthesized
tatggatagtgtaatactcata

SEQ ID NO: 91714 - DNA, 22 bp, Artificial Sequence
  chemically synthesized
tggatagtgtaatactcataat

SEQ ID NO: 91715 - DNA, 22 bp, Artificial Sequence
  chemically synthesized
ataatgtagaaaagagagatct

SEQ ID NO: 91716 - DNA, 22 bp, Artificial Sequence
  chemically synthesized
attttggataatttaatctttt

SEQ ID NO: 91717 - DNA, 22 bp, Artificial Sequence
  chemically synthesized
tggataatttaatctttttttt

SEQ ID NO: 91718 - DNA, 22 bp, Artificial Sequence
  chemically synthesized
ggataatttaatcttttttttc

SEQ ID NO: 91719 - DNA, 22 bp, Artificial Sequence
  chemically synthesized
gataatttaatcttttttttca

SEQ ID NO: 91720 - DNA, 22 bp, Artificial Sequence
  chemically synthesized
aatcttttttttcatctccaaa

SEQ ID NO: 91721 - DNA, 22 bp, Artificial Sequence
  chemically synthesized
atcttttttttcatctccaaat

SEQ ID NO: 91722 - DNA, 22 bp, Artificial Sequence
  chemically synthesized
ttttttcatctccaaatactag

SEQ ID NO: 91723 - DNA, 22 bp, Artificial Sequence
  chemically synthesized
tttttcatctccaaatactagg

SEQ ID NO: 91724 - DNA, 22 bp, Artificial Sequence
  chemically synthesized
ttttcatctccaaatactaggg

SEQ ID NO: 91725 - DNA, 22 bp, Artificial Sequence
  chemically synthesized
tttcatctccaaatactaggga

SEQ ID NO: 91726 - DNA, 22 bp, Artificial Sequence
  chemically synthesized
ttcatctccaaatactagggaa

SEQ ID NO: 91727 - DNA, 22 bp, Artificial Sequence
  chemically synthesized
tcatctccaaatactagggaaa

SEQ ID NO: 91728 - DNA, 22 bp, Artificial Sequence
  chemically synthesized
catctccaaatactagggaaat

SEQ ID NO: 91729 - DNA, 22 bp, Artificial Sequence
  chemically synthesized
atctccaaatactagggaaata

SEQ ID NO: 91730 - DNA, 22 bp, Artificial Sequence
  chemically synthesized
caaatactagggaaataagagt

SEQ ID NO: 91731 - DNA, 22 bp, Artificial Sequence
  chemically synthesized
gggaaataagagtttacaagac

SEQ ID NO: 91732 - DNA, 22 bp, Artificial Sequence
  chemically synthesized
acaagacaatgtctctaccata

SEQ ID NO: 91733 - DNA, 22 bp, Artificial Sequence
  chemically synthesized
caagacaatgtctctaccataa

SEQ ID NO: 91734 - DNA, 22 bp, Artificial Sequence
  chemically synthesized
taccataaaagaggttaaaatt

SEQ ID NO: 91735 - DNA, 22 bp, Artificial Sequence
  chemically synthesized
ccataaaagaggttaaaattta

SEQ ID NO: 91736 - DNA, 22 bp, Artificial Sequence
  chemically synthesized
aaatttagtggtaggaatatac

SEQ ID NO: 91737 - DNA, 22 bp, Artificial Sequence
  chemically synthesized
agtggtaggaatatacaatgag

SEQ ID NO: 91738 - DNA, 22 bp, Artificial Sequence
  chemically synthesized
gtggtaggaatatacaatgagc

SEQ ID NO: 91739 - DNA, 22 bp, Artificial Sequence
  chemically synthesized
agtacattagtaggaaaaacac

SEQ ID NO: 91740 - DNA, 22 bp, Artificial Sequence
  chemically synthesized
gtaggaaaaacactaaatatta

SEQ ID NO: 91741 - DNA, 22 bp, Artificial Sequence
  chemically synthesized
aatattataagaaagagcccat

SEQ ID NO: 91742 - DNA, 22 bp, Artificial Sequence
  chemically synthesized
taagaaagagcccataattgta

SEQ ID NO: 91743 - DNA, 22 bp, Artificial Sequence
  chemically synthesized
tagcagagtttatagacagggc

SEQ ID NO: 91744 - DNA, 22 bp, Artificial Sequence
  chemically synthesized
atagacagggctttaagcccag

SEQ ID NO: 91745 - DNA, 22 bp, Artificial Sequence
  chemically synthesized
tagacagggctttaagcccagt

SEQ ID NO: 91746 - DNA, 22 bp, Artificial Sequence
  chemically synthesized
taagcccagttaaaattaaaaa

SEQ ID NO: 91747 - DNA, 22 bp, Artificial Sequence
  chemically synthesized
aagcccagttaaaattaaaaaa

SEQ ID NO: 91748 - DNA, 22 bp, Artificial Sequence
  chemically synthesized
agcccagttaaaattaaaaaaa

SEQ ID NO: 91749 - DNA, 22 bp, Artificial Sequence
  chemically synthesized
aaattaaaaaaaaatagcttct

SEQ ID NO: 91750 - DNA, 22 bp, Artificial Sequence
  chemically synthesized
aaaaaaaatagcttcttagttg

SEQ ID NO: 91751 - DNA, 22 bp, Artificial Sequence
  chemically synthesized
cttagttgagataacatataag

SEQ ID NO: 91752 - DNA, 22 bp, Artificial Sequence
  chemically synthesized
ttagttgagataacatataagt

SEQ ID NO: 91753 - DNA, 22 bp, Artificial Sequence
  chemically synthesized
agttgagataacatataagtta

SEQ ID NO: 91754 - DNA, 22 bp, Artificial Sequence
  chemically synthesized
gttgagataacatataagttag

SEQ ID NO: 91755 - DNA, 22 bp, Artificial Sequence
  chemically synthesized
agataacatataagttaggact

SEQ ID NO: 91756 - DNA, 22 bp, Artificial Sequence
  chemically synthesized
ggacttaaagtatgagtacaag

SEQ ID NO: 91757 - DNA, 22 bp, Artificial Sequence
  chemically synthesized
aaagtatgagtacaagatagac

SEQ ID NO: 91758 - DNA, 22 bp, Artificial Sequence
  chemically synthesized
aagtatgagtacaagatagaca

SEQ ID NO: 91759 - DNA, 22 bp, Artificial Sequence
  chemically synthesized
acagagtcaaatgcagaaatcc

SEQ ID NO: 91760 - DNA, 22 bp, Artificial Sequence
  chemically synthesized
tctagattgactggggtaattt

SEQ ID NO: 91761 - DNA, 22 bp, Artificial Sequence
  chemically synthesized
tagattgactggggtaattttg

SEQ ID NO: 91762 - DNA, 22 bp, Artificial Sequence
  chemically synthesized
gattgactggggtaattttgtc

SEQ ID NO: 91763 - DNA, 22 bp, Artificial Sequence
  chemically synthesized
actggggtaattttgtcaatgc

SEQ ID NO: 91764 - DNA, 22 bp, Artificial Sequence
  chemically synthesized
gggtaattttgtcaatgcactc

SEQ ID NO: 91765 - DNA, 22 bp, Artificial Sequence
  chemically synthesized
tgtcaatgcactcaagtatgca

SEQ ID NO: 91766 - DNA, 22 bp, Artificial Sequence
  chemically synthesized
gtcaatgcactcaagtatgcat

SEQ ID NO: 91767 - DNA, 22 bp, Artificial Sequence
  chemically synthesized
tcaatgcactcaagtatgcatc

SEQ ID NO: 91768 - DNA, 22 bp, Artificial Sequence
  chemically synthesized
aagtatgcatctgtaacagtgt

SEQ ID NO: 91769 - DNA, 22 bp, Artificial Sequence
  chemically synthesized
taacagtgtgtgttcttatgtg

SEQ ID NO: 91770 - DNA, 22 bp, Artificial Sequence
  chemically synthesized
ttatgtgtgcatggaatgtttg

SEQ ID NO: 91771 - DNA, 22 bp, Artificial Sequence
  chemically synthesized
atgtgtgcatggaatgtttgtt

SEQ ID NO: 91772 - DNA, 22 bp, Artificial Sequence
  chemically synthesized
tgtgtgcatggaatgtttgttc

SEQ ID NO: 91773 - DNA, 22 bp, Artificial Sequence
  chemically synthesized
gttcatggagcataagaaattg

SEQ ID NO: 91774 - DNA, 22 bp, Artificial Sequence
  chemically synthesized
ttcatggagcataagaaattgt

SEQ ID NO: 91775 - DNA, 22 bp, Artificial Sequence
  chemically synthesized
atggagcataagaaattgtgta

SEQ ID NO: 91776 - DNA, 22 bp, Artificial Sequence
  chemically synthesized
tgtagacatatagacacatctg

SEQ ID NO: 91777 - DNA, 22 bp, Artificial Sequence
  chemically synthesized
tatgtgtatatcagagaatgtt

SEQ ID NO: 91778 - DNA, 22 bp, Artificial Sequence
  chemically synthesized
acattgctacaagattttatat

SEQ ID NO: 91779 - DNA, 22 bp, Artificial Sequence
  chemically synthesized
cattgctacaagattttatatg

SEQ ID NO: 91780 - DNA, 22 bp, Artificial Sequence
  chemically synthesized
ctacaagattttatatgactac

SEQ ID NO: 91781 - DNA, 22 bp, Artificial Sequence
  chemically synthesized
caagattttatatgactacatg

SEQ ID NO: 91782 - DNA, 22 bp, Artificial Sequence
  chemically synthesized
tatatgactacatgcacaagca

SEQ ID NO: 91783 - DNA, 22 bp, Artificial Sequence
  chemically synthesized
atatgactacatgcacaagcat

SEQ ID NO: 91784 - DNA, 22 bp, Artificial Sequence
  chemically synthesized
tatgactacatgcacaagcatt

SEQ ID NO: 91785 - DNA, 22 bp, Artificial Sequence
  chemically synthesized
catgcacaagcattcatgctac

SEQ ID NO: 91786 - DNA, 22 bp, Artificial Sequence
  chemically synthesized
atgctacatgtcagtttggtat

SEQ ID NO: 91787 - DNA, 22 bp, Artificial Sequence
  chemically synthesized
catgtcagtttggtatattttt

SEQ ID NO: 91788 - DNA, 22 bp, Artificial Sequence
  chemically synthesized
ggtatatttttcctgtaagatg

SEQ ID NO: 91789 - DNA, 22 bp, Artificial Sequence
  chemically synthesized
gtatatttttcctgtaagatgt

SEQ ID NO: 91790 - DNA, 22 bp, Artificial Sequence
  chemically synthesized
ttcctgtaagatgtgtacttat

SEQ ID NO: 91791 - DNA, 22 bp, Artificial Sequence
  chemically synthesized
tcctgtaagatgtgtacttatg

SEQ ID NO: 91792 - DNA, 22 bp, Artificial Sequence
  chemically synthesized
cctgtaagatgtgtacttatgt

SEQ ID NO: 91793 - DNA, 22 bp, Artificial Sequence
  chemically synthesized
ctgtaagatgtgtacttatgtg

SEQ ID NO: 91794 - DNA, 22 bp, Artificial Sequence
  chemically synthesized
taagatgtgtacttatgtgttt

SEQ ID NO: 91795 - DNA, 22 bp, Artificial Sequence
  chemically synthesized
atgtgttttccactaaaggtga

SEQ ID NO: 91796 - DNA, 22 bp, Artificial Sequence
  chemically synthesized
tgtgttttccactaaaggtgaa

SEQ ID NO: 91797 - DNA, 22 bp, Artificial Sequence
  chemically synthesized
tccactaaaggtgaatgtgaaa

SEQ ID NO: 91798 - DNA, 22 bp, Artificial Sequence
  chemically synthesized
ccactaaaggtgaatgtgaaaa

SEQ ID NO: 91799 - DNA, 22 bp, Artificial Sequence
  chemically synthesized
cactaaaggtgaatgtgaaaac

SEQ ID NO: 91800 - DNA, 22 bp, Artificial Sequence
  chemically synthesized
aaggtgaatgtgaaaactcctc

SEQ ID NO: 91801 - DNA, 22 bp, Artificial Sequence
  chemically synthesized
ctcatcgagaaatgaacaataa

SEQ ID NO: 91802 - DNA, 22 bp, Artificial Sequence
  chemically synthesized
atcgagaaatgaacaataagta

SEQ ID NO: 91803 - DNA, 22 bp, Artificial Sequence
  chemically synthesized
aaccctcatctcttcatttaaa

SEQ ID NO: 91804 - DNA, 22 bp, Artificial Sequence
  chemically synthesized
atctcttcatttaaaatacaga

SEQ ID NO: 91805 - DNA, 22 bp, Artificial Sequence
  chemically synthesized
ttcatttaaaatacagagtgac

SEQ ID NO: 91806 - DNA, 22 bp, Artificial Sequence
  chemically synthesized
catttaaaatacagagtgacat

SEQ ID NO: 91807 - DNA, 22 bp, Artificial Sequence
  chemically synthesized
atttaaaatacagagtgacatt

SEQ ID NO: 91808 - DNA, 22 bp, Artificial Sequence
  chemically synthesized
aaaatacagagtgacattcaga

SEQ ID NO: 91809 - DNA, 22 bp, Artificial Sequence
  chemically synthesized
aaatacagagtgacattcagaa

SEQ ID NO: 91810 - DNA, 22 bp, Artificial Sequence
  chemically synthesized
agaagggcaagggatagcacaa

SEQ ID NO: 91811 - DNA, 22 bp, Artificial Sequence
  chemically synthesized
taaagtgtgattgtttggacac

SEQ ID NO: 91812 - DNA, 22 bp, Artificial Sequence
  chemically synthesized
aaagtgtgattgtttggacaca

SEQ ID NO: 91813 - DNA, 22 bp, Artificial Sequence
  chemically synthesized
aagtgtgattgtttggacacag

SEQ ID NO: 91814 - DNA, 22 bp, Artificial Sequence
  chemically synthesized
tttggacacagtaattattcaa

SEQ ID NO: 91815 - DNA, 22 bp, Artificial Sequence
  chemically synthesized
ggacacagtaattattcaaaga

SEQ ID NO: 91816 - DNA, 22 bp, Artificial Sequence
  chemically synthesized
gacacagtaattattcaaagaa

SEQ ID NO: 91817 - DNA, 22 bp, Artificial Sequence
  chemically synthesized
ttcaaagaatgtgcttaattaa

SEQ ID NO: 91818 - DNA, 22 bp, Artificial Sequence
  chemically synthesized
aaagaatgtgcttaattaatgt

SEQ ID NO: 91819 - DNA, 22 bp, Artificial Sequence
  chemically synthesized
aattaatgtatgctacaagaca

SEQ ID NO: 91820 - DNA, 22 bp, Artificial Sequence
  chemically synthesized
attaatgtatgctacaagacag

SEQ ID NO: 91821 - DNA, 22 bp, Artificial Sequence
  chemically synthesized
atgtatgctacaagacagcagt

SEQ ID NO: 91822 - DNA, 22 bp, Artificial Sequence
  chemically synthesized
caagacagcagttgagtgatta

SEQ ID NO: 91823 - DNA, 22 bp, Artificial Sequence
  chemically synthesized
agtgattattgtacatgagcaa

SEQ ID NO: 91824 - DNA, 22 bp, Artificial Sequence
  chemically synthesized
ttgtacatgagcaactggtatt

SEQ ID NO: 91825 - DNA, 22 bp, Artificial Sequence
  chemically synthesized
tacatgagcaactggtatttat

SEQ ID NO: 91826 - DNA, 22 bp, Artificial Sequence
  chemically synthesized
gtatttattctgctttgtgggt

SEQ ID NO: 91827 - DNA, 22 bp, Artificial Sequence
  chemically synthesized
attctgctttgtgggttattag

SEQ ID NO: 91828 - DNA, 22 bp, Artificial Sequence
  chemically synthesized
ttctgctttgtgggttattagt

SEQ ID NO: 91829 - DNA, 22 bp, Artificial Sequence
  chemically synthesized
tgctttgtgggttattagtggg

SEQ ID NO: 91830 - DNA, 22 bp, Artificial Sequence
  chemically synthesized
ctttgtgggttattagtgggga

SEQ ID NO: 91831 - DNA, 22 bp, Artificial Sequence
  chemically synthesized
tgtgggttattagtggggactc

SEQ ID NO: 91832 - DNA, 22 bp, Artificial Sequence
  chemically synthesized
gtgggttattagtggggactca

SEQ ID NO: 91833 - DNA, 22 bp, Artificial Sequence
  chemically synthesized
tgggttattagtggggactcaa

SEQ ID NO: 91834 - DNA, 22 bp, Artificial Sequence
  chemically synthesized
ttagtggggactcaaaaatatg

SEQ ID NO: 91835 - DNA, 22 bp, Artificial Sequence
  chemically synthesized
gtggggactcaaaaatatgaca

SEQ ID NO: 91836 - DNA, 22 bp, Artificial Sequence
  chemically synthesized
aaaaatatgacaaaggaatttc

SEQ ID NO: 91837 - DNA, 22 bp, Artificial Sequence
  chemically synthesized
cagaagctgttagatggtagca

SEQ ID NO: 91838 - DNA, 22 bp, Artificial Sequence
  chemically synthesized
agaagctgttagatggtagcac

SEQ ID NO: 91839 - DNA, 22 bp, Artificial Sequence
  chemically synthesized
ttagatggtagcaccgcctatc

SEQ ID NO: 91840 - DNA, 22 bp, Artificial Sequence
  chemically synthesized
gatggtagcaccgcctatctat

SEQ ID NO: 91841 - DNA, 22 bp, Artificial Sequence
  chemically synthesized
tctatgtgctcccactcaagag

SEQ ID NO: 91842 - DNA, 22 bp, Artificial Sequence
  chemically synthesized
tgtgctcccactcaagagatat

SEQ ID NO: 91843 - DNA, 22 bp, Artificial Sequence
  chemically synthesized
ccactcaagagatatggtgagg

SEQ ID NO: 91844 - DNA, 22 bp, Artificial Sequence
  chemically synthesized
aagagatatggtgaggtgagct

SEQ ID NO: 91845 - DNA, 22 bp, Artificial Sequence
  chemically synthesized
tttggggtggacacatagagga

SEQ ID NO: 91846 - DNA, 22 bp, Artificial Sequence
  chemically synthesized
tggggtggacacatagaggaaa

SEQ ID NO: 91847 - DNA, 22 bp, Artificial Sequence
  chemically synthesized
ggggtggacacatagaggaaat

SEQ ID NO: 91848 - DNA, 22 bp, Artificial Sequence
  chemically synthesized
gggtggacacatagaggaaata

SEQ ID NO: 91849 - DNA, 22 bp, Artificial Sequence
  chemically synthesized
tgagaaagaggttttgggatta

SEQ ID NO: 91850 - DNA, 22 bp, Artificial Sequence
  chemically synthesized
gagaaagaggttttgggattaa

SEQ ID NO: 91851 - DNA, 22 bp, Artificial Sequence
  chemically synthesized
agaaagaggttttgggattaat

SEQ ID NO: 91852 - DNA, 22 bp, Artificial Sequence
  chemically synthesized
tgggattaatgaaactggagaa

SEQ ID NO: 91853 - DNA, 22 bp, Artificial Sequence
  chemically synthesized
gggattaatgaaactggagaag

SEQ ID NO: 91854 - DNA, 22 bp, Artificial Sequence
  chemically synthesized
ggattaatgaaactggagaaga

SEQ ID NO: 91855 - DNA, 22 bp, Artificial Sequence
  chemically synthesized
atgaaactggagaagaaagggt

SEQ ID NO: 91856 - DNA, 22 bp, Artificial Sequence
  chemically synthesized
gagaagaaagggtattatatct

SEQ ID NO: 91857 - DNA, 22 bp, Artificial Sequence
  chemically synthesized
tatcttctaaaacctctttctt

SEQ ID NO: 91858 - DNA, 22 bp, Artificial Sequence
  chemically synthesized
ctaaaacctctttctttgaggt

SEQ ID NO: 91859 - DNA, 22 bp, Artificial Sequence
  chemically synthesized
taaaacctctttctttgaggtt

SEQ ID NO: 91860 - DNA, 22 bp, Artificial Sequence
  chemically synthesized
aaacctctttctttgaggtttt

SEQ ID NO: 91861 - DNA, 22 bp, Artificial Sequence
  chemically synthesized
tttctttgaggttttaggtttg

SEQ ID NO: 91862 - DNA, 22 bp, Artificial Sequence
  chemically synthesized
tctttgaggttttaggtttgag

SEQ ID NO: 91863 - DNA, 22 bp, Artificial Sequence
  chemically synthesized
ctttgaggttttaggtttgagg

SEQ ID NO: 91864 - DNA, 22 bp, Artificial Sequence
  chemically synthesized
tttgaggttttaggtttgaggg

SEQ ID NO: 91865 - DNA, 22 bp, Artificial Sequence
  chemically synthesized
tgaggttttaggtttgagggtg

SEQ ID NO: 91866 - DNA, 22 bp, Artificial Sequence
  chemically synthesized
gaggttttaggtttgagggtgc

SEQ ID NO: 91867 - DNA, 22 bp, Artificial Sequence
  chemically synthesized
aggttttaggtttgagggtgct

SEQ ID NO: 91868 - DNA, 22 bp, Artificial Sequence
  chemically synthesized
taggtttgagggtgctacatac

SEQ ID NO: 91869 - DNA, 22 bp, Artificial Sequence
  chemically synthesized
aggtttgagggtgctacatact

SEQ ID NO: 91870 - DNA, 22 bp, Artificial Sequence
  chemically synthesized
ggtttgagggtgctacatactt

SEQ ID NO: 91871 - DNA, 22 bp, Artificial Sequence
  chemically synthesized
gagggtgctacatacttcctaa

SEQ ID NO: 91872 - DNA, 22 bp, Artificial Sequence
  chemically synthesized
agggtgctacatacttcctaag

SEQ ID NO: 91873 - DNA, 22 bp, Artificial Sequence
  chemically synthesized
catacttcctaagggtcttggg

SEQ ID NO: 91874 - DNA, 22 bp, Artificial Sequence
  chemically synthesized
cctaagggtcttgggtacagga

SEQ ID NO: 91875 - DNA, 22 bp, Artificial Sequence
  chemically synthesized
ctaagggtcttgggtacaggag

SEQ ID NO: 91876 - DNA, 22 bp, Artificial Sequence
  chemically synthesized
agggtcttgggtacaggagttt

SEQ ID NO: 91877 - DNA, 22 bp, Artificial Sequence
  chemically synthesized
gggtacaggagtttgaagtgat

SEQ ID NO: 91878 - DNA, 22 bp, Artificial Sequence
  chemically synthesized
ggtacaggagtttgaagtgatt

SEQ ID NO: 91879 - DNA, 22 bp, Artificial Sequence
  chemically synthesized
gaagtgattgccacagaatggc

SEQ ID NO: 91880 - DNA, 22 bp, Artificial Sequence
  chemically synthesized
aagtgattgccacagaatggct

SEQ ID NO: 91881 - DNA, 22 bp, Artificial Sequence
  chemically synthesized
ccacagaatggctacgttcatt

SEQ ID NO: 91882 - DNA, 22 bp, Artificial Sequence
  chemically synthesized
cgttcattgccagatccaaaca

SEQ ID NO: 91883 - DNA, 22 bp, Artificial Sequence
  chemically synthesized
attgccagatccaaacaggggg

SEQ ID NO: 91884 - DNA, 22 bp, Artificial Sequence
  chemically synthesized
ccagatccaaacagggggcttg

SEQ ID NO: 91885 - DNA, 22 bp, Artificial Sequence
  chemically synthesized
gtaggcatttgctgttctgtca

SEQ ID NO: 91886 - DNA, 22 bp, Artificial Sequence
  chemically synthesized
taggcatttgctgttctgtcaa

SEQ ID NO: 91887 - DNA, 22 bp, Artificial Sequence
  chemically synthesized
gctgttctgtcaataaatttcc

SEQ ID NO: 91888 - DNA, 22 bp, Artificial Sequence
  chemically synthesized
ctgttctgtcaataaatttcct

SEQ ID NO: 91889 - DNA, 22 bp, Artificial Sequence
  chemically synthesized
ttctgtcaataaatttccttct

SEQ ID NO: 91890 - DNA, 22 bp, Artificial Sequence
  chemically synthesized
tgtcaataaatttccttctttt

SEQ ID NO: 91891 - DNA, 22 bp, Artificial Sequence
  chemically synthesized
tcaataaatttccttcttttca

SEQ ID NO: 91892 - DNA, 22 bp, Artificial Sequence
  chemically synthesized
ccttcttttcattcacagacag

SEQ ID NO: 91893 - DNA, 22 bp, Artificial Sequence
  chemically synthesized
cttcttttcattcacagacagg

SEQ ID NO: 91894 - DNA, 22 bp, Artificial Sequence
  chemically synthesized
cttttcattcacagacagggat

SEQ ID NO: 91895 - DNA, 22 bp, Artificial Sequence
  chemically synthesized
ttttcattcacagacagggatt

SEQ ID NO: 91896 - DNA, 22 bp, Artificial Sequence
  chemically synthesized
ttcattcacagacagggatttt

SEQ ID NO: 91897 - DNA, 22 bp, Artificial Sequence
  chemically synthesized
tcattcacagacagggatttta

SEQ ID NO: 91898 - DNA, 22 bp, Artificial Sequence
  chemically synthesized
cattcacagacagggattttag

SEQ ID NO: 91899 - DNA, 22 bp, Artificial Sequence
  chemically synthesized
attcacagacagggattttagc

SEQ ID NO: 91900 - DNA, 22 bp, Artificial Sequence
  chemically synthesized
acagacagggattttagctgtc

SEQ ID NO: 91901 - DNA, 22 bp, Artificial Sequence
  chemically synthesized
tagctgtcatctctgactctct

SEQ ID NO: 91902 - DNA, 22 bp, Artificial Sequence
  chemically synthesized
agctgtcatctctgactctctg

SEQ ID NO: 91903 - DNA, 22 bp, Artificial Sequence
  chemically synthesized
gctgtcatctctgactctctgt

SEQ ID NO: 91904 - DNA, 22 bp, Artificial Sequence
  chemically synthesized
tcatctctgactctctgtttca

SEQ ID NO: 91905 - DNA, 22 bp, Artificial Sequence
  chemically synthesized
tgactctctgtttcacaatgtt

SEQ ID NO: 91906 - DNA, 22 bp, Artificial Sequence
  chemically synthesized
actctctgtttcacaatgtttt

SEQ ID NO: 91907 - DNA, 22 bp, Artificial Sequence
  chemically synthesized
tctgtttcacaatgttttccag

SEQ ID NO: 91908 - DNA, 22 bp, Artificial Sequence
  chemically synthesized
tgtttcacaatgttttccagtt

SEQ ID NO: 91909 - DNA, 22 bp, Artificial Sequence
  chemically synthesized
tttcacaatgttttccagttct

SEQ ID NO: 91910 - DNA, 22 bp, Artificial Sequence
  chemically synthesized
cacaatgttttccagttctgtg

SEQ ID NO: 91911 - DNA, 22 bp, Artificial Sequence
  chemically synthesized
acaatgttttccagttctgtgc

SEQ ID NO: 91912 - DNA, 22 bp, Artificial Sequence
  chemically synthesized
tccagttctgtgcaatcactgc

SEQ ID NO: 91913 - DNA, 22 bp, Artificial Sequence
  chemically synthesized
ccagttctgtgcaatcactgcc

SEQ ID NO: 91914 - DNA, 22 bp, Artificial Sequence
  chemically synthesized
cagttctgtgcaatcactgcca

SEQ ID NO: 91915 - DNA, 22 bp, Artificial Sequence
  chemically synthesized
tgtgcaatcactgccacaatgg

SEQ ID NO: 91916 - DNA, 22 bp, Artificial Sequence
  chemically synthesized
tgcaatcactgccacaatggtc

SEQ ID NO: 91917 - DNA, 22 bp, Artificial Sequence
  chemically synthesized
ccacaatggtctcttactcgat

SEQ ID NO: 91918 - DNA, 22 bp, Artificial Sequence
  chemically synthesized
ttactcgattttttttcttaac

SEQ ID NO: 91919 - DNA, 22 bp, Artificial Sequence
  chemically synthesized
actcgattttttttcttaactt

SEQ ID NO: 91920 - DNA, 22 bp, Artificial Sequence
  chemically synthesized
ctcgattttttttcttaacttc

SEQ ID NO: 91921 - DNA, 22 bp, Artificial Sequence
  chemically synthesized
gattttttttcttaacttcatt

SEQ ID NO: 91922 - DNA, 22 bp, Artificial Sequence
  chemically synthesized
tttttcttaacttcattgtttc

SEQ ID NO: 91923 - DNA, 22 bp, Artificial Sequence
  chemically synthesized
ttttcttaacttcattgtttcc

SEQ ID NO: 91924 - DNA, 22 bp, Artificial Sequence
  chemically synthesized
tttcttaacttcattgtttcca

SEQ ID NO: 91925 - DNA, 22 bp, Artificial Sequence
  chemically synthesized
ttcttaacttcattgtttccat

SEQ ID NO: 91926 - DNA, 22 bp, Artificial Sequence
  chemically synthesized
tcttaacttcattgtttccatc

SEQ ID NO: 91927 - DNA, 22 bp, Artificial Sequence
  chemically synthesized
cttaacttcattgtttccatca

SEQ ID NO: 91928 - DNA, 22 bp, Artificial Sequence
  chemically synthesized
ttaacttcattgtttccatcaa

SEQ ID NO: 91929 - DNA, 22 bp, Artificial Sequence
  chemically synthesized
aacttcattgtttccatcaact

SEQ ID NO: 91930 - DNA, 22 bp, Artificial Sequence
  chemically synthesized
acttcattgtttccatcaactt

SEQ ID NO: 91931 - DNA, 22 bp, Artificial Sequence
  chemically synthesized
cattgtttccatcaacttcagt

SEQ ID NO: 91932 - DNA, 22 bp, Artificial Sequence
  chemically synthesized
attgtttccatcaacttcagtt

SEQ ID NO: 91933 - DNA, 22 bp, Artificial Sequence
  chemically synthesized
tttccatcaacttcagttcttt

SEQ ID NO: 91934 - DNA, 22 bp, Artificial Sequence
  chemically synthesized
ccatcaacttcagttctttatc

SEQ ID NO: 91935 - DNA, 22 bp, Artificial Sequence
  chemically synthesized
catcaacttcagttctttatcc

SEQ ID NO: 91936 - DNA, 22 bp, Artificial Sequence
  chemically synthesized
cagttctttatccatcacctca

SEQ ID NO: 91937 - DNA, 22 bp, Artificial Sequence
  chemically synthesized
agttctttatccatcacctcaa

SEQ ID NO: 91938 - DNA, 22 bp, Artificial Sequence
  chemically synthesized
tttatccatcacctcaatataa

SEQ ID NO: 91939 - DNA, 22 bp, Artificial Sequence
  chemically synthesized
tatccatcacctcaatataatt

SEQ ID NO: 91940 - DNA, 22 bp, Artificial Sequence
  chemically synthesized
atccatcacctcaatataatta

SEQ ID NO: 91941 - DNA, 22 bp, Artificial Sequence
  chemically synthesized
tccatcacctcaatataattac

SEQ ID NO: 91942 - DNA, 22 bp, Artificial Sequence
  chemically synthesized
aatataattacagcaagctcct

SEQ ID NO: 91943 - DNA, 22 bp, Artificial Sequence
  chemically synthesized
cagcaagctcctctgactatac

SEQ ID NO: 91944 - DNA, 22 bp, Artificial Sequence
  chemically synthesized
ctctgactatacccaagttaga

SEQ ID NO: 91945 - DNA, 22 bp, Artificial Sequence
  chemically synthesized
tgactatacccaagttagactt

SEQ ID NO: 91946 - DNA, 22 bp, Artificial Sequence
  chemically synthesized
actatacccaagttagactttg

SEQ ID NO: 91947 - DNA, 22 bp, Artificial Sequence
  chemically synthesized
tacccaagttagactttgtcta

SEQ ID NO: 91948 - DNA, 22 bp, Artificial Sequence
  chemically synthesized
gactttgtctaatcagttctat

SEQ ID NO: 91949 - DNA, 22 bp, Artificial Sequence
  chemically synthesized
tgtctaatcagttctatatata

SEQ ID NO: 91950 - DNA, 22 bp, Artificial Sequence
  chemically synthesized
gtctaatcagttctatatatat

SEQ ID NO: 91951 - DNA, 22 bp, Artificial Sequence
  chemically synthesized
tctaatcagttctatatatata

SEQ ID NO: 91952 - DNA, 22 bp, Artificial Sequence
  chemically synthesized
atcagttctatatatatatata

SEQ ID NO: 91953 - DNA, 22 bp, Artificial Sequence
  chemically synthesized
tatatatatatatacatgtgaa

SEQ ID NO: 91954 - DNA, 22 bp, Artificial Sequence
  chemically synthesized
tatatatatatacatgtgaatc

SEQ ID NO: 91955 - DNA, 22 bp, Artificial Sequence
  chemically synthesized
tctacgtttccctatttattat

SEQ ID NO: 91956 - DNA, 22 bp, Artificial Sequence
  chemically synthesized
ctacgtttccctatttattatg

SEQ ID NO: 91957 - DNA, 22 bp, Artificial Sequence
  chemically synthesized
tacgtttccctatttattatgt

SEQ ID NO: 91958 - DNA, 22 bp, Artificial Sequence
  chemically synthesized
cgtttccctatttattatgtca

SEQ ID NO: 91959 - DNA, 22 bp, Artificial Sequence
  chemically synthesized
ccctatttattatgtcactctc

SEQ ID NO: 91960 - DNA, 22 bp, Artificial Sequence
  chemically synthesized
cctatttattatgtcactctca

SEQ ID NO: 91961 - DNA, 22 bp, Artificial Sequence
  chemically synthesized
tttattatgtcactctcatatg

SEQ ID NO: 91962 - DNA, 22 bp, Artificial Sequence
  chemically synthesized
attatgtcactctcatatgcaa

SEQ ID NO: 91963 - DNA, 22 bp, Artificial Sequence
  chemically synthesized
ttatgtcactctcatatgcaag

SEQ ID NO: 91964 - DNA, 22 bp, Artificial Sequence
  chemically synthesized
tgtcactctcatatgcaagaaa

SEQ ID NO: 91965 - DNA, 22 bp, Artificial Sequence
  chemically synthesized
tcatatgcaagaaacttcagtg

SEQ ID NO: 91966 - DNA, 22 bp, Artificial Sequence
  chemically synthesized
atatgcaagaaacttcagtgat

SEQ ID NO: 91967 - DNA, 22 bp, Artificial Sequence
  chemically synthesized
cagtgatttttgctcaaaacga

SEQ ID NO: 91968 - DNA, 22 bp, Artificial Sequence
  chemically synthesized
agtgatttttgctcaaaacgat

SEQ ID NO: 91969 - DNA, 22 bp, Artificial Sequence
  chemically synthesized
ttgctcaaaacgatagctattt

SEQ ID NO: 91970 - DNA, 22 bp, Artificial Sequence
  chemically synthesized
tgctcaaaacgatagctatttt

SEQ ID NO: 91971 - DNA, 22 bp, Artificial Sequence
  chemically synthesized
gctcaaaacgatagctattttt

SEQ ID NO: 91972 - DNA, 22 bp, Artificial Sequence
  chemically synthesized
ctcaaaacgatagctatttttc

SEQ ID NO: 91973 - DNA, 22 bp, Artificial Sequence
  chemically synthesized
aaaacgatagctatttttctta

SEQ ID NO: 91974 - DNA, 22 bp, Artificial Sequence
  chemically synthesized
tttttcttacttcatctggtct

SEQ ID NO: 91975 - DNA, 22 bp, Artificial Sequence
  chemically synthesized
ttcttacttcatctggtctctg

SEQ ID NO: 91976 - DNA, 22 bp, Artificial Sequence
  chemically synthesized
tcttacttcatctggtctctgc

SEQ ID NO: 91977 - DNA, 22 bp, Artificial Sequence
  chemically synthesized
cttacttcatctggtctctgca

SEQ ID NO: 91978 - DNA, 22 bp, Artificial Sequence
  chemically synthesized
ttacttcatctggtctctgcat

SEQ ID NO: 91979 - DNA, 22 bp, Artificial Sequence
  chemically synthesized
acttcatctggtctctgcatcc

SEQ ID NO: 91980 - DNA, 22 bp, Artificial Sequence
  chemically synthesized
cttcatctggtctctgcatcca

SEQ ID NO: 91981 - DNA, 22 bp, Artificial Sequence
  chemically synthesized
catctggtctctgcatccagtt

SEQ ID NO: 91982 - DNA, 22 bp, Artificial Sequence
  chemically synthesized
atctggtctctgcatccagttt

SEQ ID NO: 91983 - DNA, 22 bp, Artificial Sequence
  chemically synthesized
gtctctgcatccagtttcccta

SEQ ID NO: 91984 - DNA, 22 bp, Artificial Sequence
  chemically synthesized
tgcatccagtttccctaatttt

SEQ ID NO: 91985 - DNA, 22 bp, Artificial Sequence
  chemically synthesized
catccagtttccctaattttat

SEQ ID NO: 91986 - DNA, 22 bp, Artificial Sequence
  chemically synthesized
ccctaattttatatcatcctgc

SEQ ID NO: 91987 - DNA, 22 bp, Artificial Sequence
  chemically synthesized
cctaattttatatcatcctgcc

SEQ ID NO: 91988 - DNA, 22 bp, Artificial Sequence
  chemically synthesized
attttatatcatcctgcctctt

SEQ ID NO: 91989 - DNA, 22 bp, Artificial Sequence
  chemically synthesized
tatatcatcctgcctcttttaa

SEQ ID NO: 91990 - DNA, 22 bp, Artificial Sequence
  chemically synthesized
atatcatcctgcctcttttaaa

SEQ ID NO: 91991 - DNA, 22 bp, Artificial Sequence
  chemically synthesized
tatcatcctgcctcttttaaat

SEQ ID NO: 91992 - DNA, 22 bp, Artificial Sequence
  chemically synthesized
cctcttttaaatgtccatattc

SEQ ID NO: 91993 - DNA, 22 bp, Artificial Sequence
  chemically synthesized
ttttaaatgtccatattctcct

SEQ ID NO: 91994 - DNA, 22 bp, Artificial Sequence
  chemically synthesized
ttaaatgtccatattctcctct

SEQ ID NO: 91995 - DNA, 22 bp, Artificial Sequence
  chemically synthesized
taaatgtccatattctcctcta

SEQ ID NO: 91996 - DNA, 22 bp, Artificial Sequence
  chemically synthesized
aaatgtccatattctcctctat

SEQ ID NO: 91997 - DNA, 22 bp, Artificial Sequence
  chemically synthesized
aatgtccatattctcctctatc

SEQ ID NO: 91998 - DNA, 22 bp, Artificial Sequence
  chemically synthesized
tcctctatcaacttgacttaac

SEQ ID NO: 91999 - DNA, 22 bp, Artificial Sequence
  chemically synthesized
ctctatcaacttgacttaacgt

SEQ ID NO: 92000 - DNA, 22 bp, Artificial Sequence
  chemically synthesized
tatcaacttgacttaacgtgct

SEQ ID NO: 92001 - DNA, 22 bp, Artificial Sequence
  chemically synthesized
tcaacttgacttaacgtgctgt

SEQ ID NO: 92002 - DNA, 22 bp, Artificial Sequence
  chemically synthesized
gacttaacgtgctgtttcctaa

SEQ ID NO: 92003 - DNA, 22 bp, Artificial Sequence
  chemically synthesized
acttaacgtgctgtttcctaaa

SEQ ID NO: 92004 - DNA, 22 bp, Artificial Sequence
  chemically synthesized
aacgtgctgtttcctaaatctc

SEQ ID NO: 92005 - DNA, 22 bp, Artificial Sequence
  chemically synthesized
acgtgctgtttcctaaatctca

SEQ ID NO: 92006 - DNA, 22 bp, Artificial Sequence
  chemically synthesized
tttcctaaatctcagcctttta

SEQ ID NO: 92007 - DNA, 22 bp, Artificial Sequence
  chemically synthesized
cctaaatctcagccttttaatc

SEQ ID NO: 92008 - DNA, 22 bp, Artificial Sequence
  chemically synthesized
ctaaatctcagccttttaatct

SEQ ID NO: 92009 - DNA, 22 bp, Artificial Sequence
  chemically synthesized
aatctcagccttttaatctgct

SEQ ID NO: 92010 - DNA, 22 bp, Artificial Sequence
  chemically synthesized
agccttttaatctgctgtttgc

SEQ ID NO: 92011 - DNA, 22 bp, Artificial Sequence
  chemically synthesized
ttaatctgctgtttgctcacat

SEQ ID NO: 92012 - DNA, 22 bp, Artificial Sequence
  chemically synthesized
taatctgctgtttgctcacata

SEQ ID NO: 92013 - DNA, 22 bp, Artificial Sequence
  chemically synthesized
aatctgctgtttgctcacataa

SEQ ID NO: 92014 - DNA, 22 bp, Artificial Sequence
  chemically synthesized
atctgctgtttgctcacataaa

SEQ ID NO: 92015 - DNA, 22 bp, Artificial Sequence
  chemically synthesized
ctgtttgctcacataaacaaaa

SEQ ID NO: 92016 - DNA, 22 bp, Artificial Sequence
  chemically synthesized
tttgctcacataaacaaaaatc

SEQ ID NO: 92017 - DNA, 22 bp, Artificial Sequence
  chemically synthesized
gctcacataaacaaaaatcagt

SEQ ID NO: 92018 - DNA, 22 bp, Artificial Sequence
  chemically synthesized
ctcacataaacaaaaatcagtg

SEQ ID NO: 92019 - DNA, 22 bp, Artificial Sequence
  chemically synthesized
acataaacaaaaatcagtggtt

SEQ ID NO: 92020 - DNA, 22 bp, Artificial Sequence
  chemically synthesized
tcaatattgattgctaataatt

SEQ ID NO: 92021 - DNA, 22 bp, Artificial Sequence
  chemically synthesized
caatattgattgctaataattt

SEQ ID NO: 92022 - DNA, 22 bp, Artificial Sequence
  chemically synthesized
aatattgattgctaataatttt

SEQ ID NO: 92023 - DNA, 22 bp, Artificial Sequence
  chemically synthesized
attgctaataattttttattca

SEQ ID NO: 92024 - DNA, 22 bp, Artificial Sequence
  chemically synthesized
ctaataattttttattcataaa

SEQ ID NO: 92025 - DNA, 22 bp, Artificial Sequence
  chemically synthesized
ataattttttattcataaaaat

SEQ ID NO: 92026 - DNA, 22 bp, Artificial Sequence
  chemically synthesized
tttattcataaaaattgtatat

SEQ ID NO: 92027 - DNA, 22 bp, Artificial Sequence
  chemically synthesized
ttattcataaaaattgtatata

SEQ ID NO: 92028 - DNA, 22 bp, Artificial Sequence
  chemically synthesized
tattcataaaaattgtatatat

SEQ ID NO: 92029 - DNA, 22 bp, Artificial Sequence
  chemically synthesized
attcataaaaattgtatatatt

SEQ ID NO: 92030 - DNA, 22 bp, Artificial Sequence
  chemically synthesized
ttcataaaaattgtatatattt

SEQ ID NO: 92031 - DNA, 22 bp, Artificial Sequence
  chemically synthesized
ataaaaattgtatatatttatg

SEQ ID NO: 92032 - DNA, 22 bp, Artificial Sequence
  chemically synthesized
tatatatttatgaatgcacaca

SEQ ID NO: 92033 - DNA, 22 bp, Artificial Sequence
  chemically synthesized
atgaatgcacacatgtgtgtgt

SEQ ID NO: 92034 - DNA, 22 bp, Artificial Sequence
  chemically synthesized
tgaatgcacacatgtgtgtgta

SEQ ID NO: 92035 - DNA, 22 bp, Artificial Sequence
  chemically synthesized
ccactaaaaacaataaaacttg

SEQ ID NO: 92036 - DNA, 22 bp, Artificial Sequence
  chemically synthesized
aaaacaataaaacttgtacata

SEQ ID NO: 92037 - DNA, 22 bp, Artificial Sequence
  chemically synthesized
gtacatatttatagaaacagag

SEQ ID NO: 92038 - DNA, 22 bp, Artificial Sequence
  chemically synthesized
tacatatttatagaaacagaga

SEQ ID NO: 92039 - DNA, 22 bp, Artificial Sequence
  chemically synthesized
atagaaacagagagctgaacaa

SEQ ID NO: 92040 - DNA, 22 bp, Artificial Sequence
  chemically synthesized
tagaaacagagagctgaacaaa

SEQ ID NO: 92041 - DNA, 22 bp, Artificial Sequence
  chemically synthesized
aacaaagagatttattatttat

SEQ ID NO: 92042 - DNA, 22 bp, Artificial Sequence
  chemically synthesized
attatttattgggtagtgtgat

SEQ ID NO: 92043 - DNA, 22 bp, Artificial Sequence
  chemically synthesized
ttatttattgggtagtgtgata

SEQ ID NO: 92044 - DNA, 22 bp, Artificial Sequence
  chemically synthesized
tttattgggtagtgtgataaag

SEQ ID NO: 92045 - DNA, 22 bp, Artificial Sequence
  chemically synthesized
attgggtagtgtgataaagact

SEQ ID NO: 92046 - DNA, 22 bp, Artificial Sequence
  chemically synthesized
ttgggtagtgtgataaagactt

SEQ ID NO: 92047 - DNA, 22 bp, Artificial Sequence
  chemically synthesized
ggtagtgtgataaagactttac

SEQ ID NO: 92048 - DNA, 22 bp, Artificial Sequence
  chemically synthesized
tacaggtatcaattcaattagt

SEQ ID NO: 92049 - DNA, 22 bp, Artificial Sequence
  chemically synthesized
acaggtatcaattcaattagtt

SEQ ID NO: 92050 - DNA, 22 bp, Artificial Sequence
  chemically synthesized
caggtatcaattcaattagttc

SEQ ID NO: 92051 - DNA, 22 bp, Artificial Sequence
  chemically synthesized
aattagttcttacaaaaatcct

SEQ ID NO: 92052 - DNA, 22 bp, Artificial Sequence
  chemically synthesized
gttcttacaaaaatcctttaag

SEQ ID NO: 92053 - DNA, 22 bp, Artificial Sequence
  chemically synthesized
ttacaaaaatcctttaaggaaa

SEQ ID NO: 92054 - DNA, 22 bp, Artificial Sequence
  chemically synthesized
acaaaaatcctttaaggaaaat

SEQ ID NO: 92055 - DNA, 22 bp, Artificial Sequence
  chemically synthesized
caaaaatcctttaaggaaaata

SEQ ID NO: 92056 - DNA, 22 bp, Artificial Sequence
  chemically synthesized
taaggaaaatacatatgataaa

SEQ ID NO: 92057 - DNA, 22 bp, Artificial Sequence
  chemically synthesized
aaggaaaatacatatgataaat

SEQ ID NO: 92058 - DNA, 22 bp, Artificial Sequence
  chemically synthesized
aggaaaatacatatgataaatc

SEQ ID NO: 92059 - DNA, 22 bp, Artificial Sequence
  chemically synthesized
tcatatgcacagcttaatggaa

SEQ ID NO: 92060 - DNA, 22 bp, Artificial Sequence
  chemically synthesized
aatggaattataaatatgtttc

SEQ ID NO: 92061 - DNA, 22 bp, Artificial Sequence
  chemically synthesized
atggaattataaatatgtttca

SEQ ID NO: 92062 - DNA, 22 bp, Artificial Sequence
  chemically synthesized
taaatatgtttcaggtcacaga

SEQ ID NO: 92063 - DNA, 22 bp, Artificial Sequence
  chemically synthesized
caggtcacagaggtagcagatg

SEQ ID NO: 92064 - DNA, 22 bp, Artificial Sequence
  chemically synthesized
aggtcacagaggtagcagatga

SEQ ID NO: 92065 - DNA, 22 bp, Artificial Sequence
  chemically synthesized
acatgccttagagataattctc

SEQ ID NO: 92066 - DNA, 22 bp, Artificial Sequence
  chemically synthesized
agagataattctctattaatac

SEQ ID NO: 92067 - DNA, 22 bp, Artificial Sequence
  chemically synthesized
gagataattctctattaatacc

SEQ ID NO: 92068 - DNA, 22 bp, Artificial Sequence
  chemically synthesized
tctattaataccattgaagacg

SEQ ID NO: 92069 - DNA, 22 bp, Artificial Sequence
  chemically synthesized
tattaataccattgaagacgtt

SEQ ID NO: 92070 - DNA, 22 bp, Artificial Sequence
  chemically synthesized
ttaataccattgaagacgttaa

SEQ ID NO: 92071 - DNA, 22 bp, Artificial Sequence
  chemically synthesized
ataccattgaagacgttaagag

SEQ ID NO: 92072 - DNA, 22 bp, Artificial Sequence
  chemically synthesized
aagacgttaagagaaagttcaa

SEQ ID NO: 92073 - DNA, 22 bp, Artificial Sequence
  chemically synthesized
agagaaagttcaaggtttggcc

SEQ ID NO: 92074 - DNA, 22 bp, Artificial Sequence
  chemically synthesized
aaggtttggcccttgattggtc

SEQ ID NO: 92075 - DNA, 22 bp, Artificial Sequence
  chemically synthesized
ggcccttgattggtctctagga

SEQ ID NO: 92076 - DNA, 22 bp, Artificial Sequence
  chemically synthesized
gcccttgattggtctctaggaa

SEQ ID NO: 92077 - DNA, 22 bp, Artificial Sequence
  chemically synthesized
gattggtctctaggaagcccca

SEQ ID NO: 92078 - DNA, 22 bp, Artificial Sequence
  chemically synthesized
attggtctctaggaagccccat

SEQ ID NO: 92079 - DNA, 22 bp, Artificial Sequence
  chemically synthesized
gtctctaggaagccccatcccc

SEQ ID NO: 92080 - DNA, 22 bp, Artificial Sequence
  chemically synthesized
taggaagccccatccccacttc

SEQ ID NO: 92081 - DNA, 22 bp, Artificial Sequence
  chemically synthesized
ggaagccccatccccacttcat

SEQ ID NO: 92082 - DNA, 22 bp, Artificial Sequence
  chemically synthesized
cattataaataataaaaaatat

SEQ ID NO: 92083 - DNA, 22 bp, Artificial Sequence
  chemically synthesized
attataaataataaaaaatatg

SEQ ID NO: 92084 - DNA, 22 bp, Artificial Sequence
  chemically synthesized
taaataataaaaaatatgttgt

SEQ ID NO: 92085 - DNA, 22 bp, Artificial Sequence
  chemically synthesized
tttaaaataagtagaagtgaac

SEQ ID NO: 92086 - DNA, 22 bp, Artificial Sequence
  chemically synthesized
aaaataagtagaagtgaactgc

SEQ ID NO: 92087 - DNA, 22 bp, Artificial Sequence
  chemically synthesized
aaataagtagaagtgaactgca

SEQ ID NO: 92088 - DNA, 22 bp, Artificial Sequence
  chemically synthesized
cagtcaccaaatgagctatatc

SEQ ID NO: 92089 - DNA, 22 bp, Artificial Sequence
  chemically synthesized
tatcctgagtttcatacaaata

SEQ ID NO: 92090 - DNA, 22 bp, Artificial Sequence
  chemically synthesized
agtttcatacaaataatagcct

SEQ ID NO: 92091 - DNA, 22 bp, Artificial Sequence
  chemically synthesized
catacaaataatagcctataca

SEQ ID NO: 92092 - DNA, 22 bp, Artificial Sequence
  chemically synthesized
atacaaataatagcctatacag

SEQ ID NO: 92093 - DNA, 22 bp, Artificial Sequence
  chemically synthesized
tacagaacttctaatttgagtc

SEQ ID NO: 92094 - DNA, 22 bp, Artificial Sequence
  chemically synthesized
ctaatttgagtcctaacatacc

SEQ ID NO: 92095 - DNA, 22 bp, Artificial Sequence
  chemically synthesized
taatttgagtcctaacatacct

SEQ ID NO: 92096 - DNA, 22 bp, Artificial Sequence
  chemically synthesized
atttgagtcctaacatacctct

SEQ ID NO: 92097 - DNA, 22 bp, Artificial Sequence
  chemically synthesized
gagtcctaacatacctctacac

SEQ ID NO: 92098 - DNA, 22 bp, Artificial Sequence
  chemically synthesized
agtcctaacatacctctacaca

SEQ ID NO: 92099 - DNA, 22 bp, Artificial Sequence
  chemically synthesized
acatacctctacacactaccaa

SEQ ID NO: 92100 - DNA, 22 bp, Artificial Sequence
  chemically synthesized
tacacactaccaacaatcctct

SEQ ID NO: 92101 - DNA, 22 bp, Artificial Sequence
  chemically synthesized
cacactaccaacaatcctctta

SEQ ID NO: 92102 - DNA, 22 bp, Artificial Sequence
  chemically synthesized
ccaacaatcctcttacacctcc

SEQ ID NO: 92103 - DNA, 22 bp, Artificial Sequence
  chemically synthesized
ttacacctccaaagagtacctc

SEQ ID NO: 92104 - DNA, 22 bp, Artificial Sequence
  chemically synthesized
acacctccaaagagtacctcca

SEQ ID NO: 92105 - DNA, 22 bp, Artificial Sequence
  chemically synthesized
cacctccaaagagtacctccat

SEQ ID NO: 92106 - DNA, 22 bp, Artificial Sequence
  chemically synthesized
caaagagtacctccattgacct

SEQ ID NO: 92107 - DNA, 22 bp, Artificial Sequence
  chemically synthesized
cattgacctccctttctgtaaa

SEQ ID NO: 92108 - DNA, 22 bp, Artificial Sequence
  chemically synthesized
acctccctttctgtaaaaacat

SEQ ID NO: 92109 - DNA, 22 bp, Artificial Sequence
  chemically synthesized
cctttctgtaaaaacattgtct

SEQ ID NO: 92110 - DNA, 22 bp, Artificial Sequence
  chemically synthesized
tctgtaaaaacattgtcttatt

SEQ ID NO: 92111 - DNA, 22 bp, Artificial Sequence
  chemically synthesized
ctgtaaaaacattgtcttattc

SEQ ID NO: 92112 - DNA, 22 bp, Artificial Sequence
  chemically synthesized
tgtaaaaacattgtcttattct

SEQ ID NO: 92113 - DNA, 22 bp, Artificial Sequence
  chemically synthesized
taaaaacattgtcttattctag

SEQ ID NO: 92114 - DNA, 22 bp, Artificial Sequence
  chemically synthesized
tcttattctagagacgatttcc

SEQ ID NO: 92115 - DNA, 22 bp, Artificial Sequence
  chemically synthesized
attctagagacgatttcccctt

SEQ ID NO: 92116 - DNA, 22 bp, Artificial Sequence
  chemically synthesized
ttctagagacgatttccccttc

SEQ ID NO: 92117 - DNA, 22 bp, Artificial Sequence
  chemically synthesized
tagagacgatttccccttccta

SEQ ID NO: 92118 - DNA, 22 bp, Artificial Sequence
  chemically synthesized
gagacgatttccccttcctagg

SEQ ID NO: 92119 - DNA, 22 bp, Artificial Sequence
  chemically synthesized
ccccttcctaggagtaactacc

SEQ ID NO: 92120 - DNA, 22 bp, Artificial Sequence
  chemically synthesized
cccttcctaggagtaactaccc

SEQ ID NO: 92121 - DNA, 22 bp, Artificial Sequence
  chemically synthesized
cctaggagtaactaccccacta

SEQ ID NO: 92122 - DNA, 22 bp, Artificial Sequence
  chemically synthesized
ctaggagtaactaccccactaa

SEQ ID NO: 92123 - DNA, 22 bp, Artificial Sequence
  chemically synthesized
ggagtaactaccccactaaatc

SEQ ID NO: 92124 - DNA, 22 bp, Artificial Sequence
  chemically synthesized
ccccactaaatccacccacgag

SEQ ID NO: 92125 - DNA, 22 bp, Artificial Sequence
  chemically synthesized
aatccacccacgagttctctct

SEQ ID NO: 92126 - DNA, 22 bp, Artificial Sequence
  chemically synthesized
tctcttttcttgcaggattgca

SEQ ID NO: 92127 - DNA, 22 bp, Artificial Sequence
  chemically synthesized
tcttttcttgcaggattgcaag

SEQ ID NO: 92128 - DNA, 22 bp, Artificial Sequence
  chemically synthesized
ttttcttgcaggattgcaagaa

SEQ ID NO: 92129 - DNA, 22 bp, Artificial Sequence
  chemically synthesized
ttcttgcaggattgcaagaaag

SEQ ID NO: 92130 - DNA, 22 bp, Artificial Sequence
  chemically synthesized
tcttgcaggattgcaagaaagt

SEQ ID NO: 92131 - DNA, 22 bp, Artificial Sequence
  chemically synthesized
cttgcaggattgcaagaaagta

SEQ ID NO: 92132 - DNA, 22 bp, Artificial Sequence
  chemically synthesized
ttgcaggattgcaagaaagtat

SEQ ID NO: 92133 - DNA, 22 bp, Artificial Sequence
  chemically synthesized
gcaggattgcaagaaagtatct

SEQ ID NO: 92134 - DNA, 22 bp, Artificial Sequence
  chemically synthesized
caggattgcaagaaagtatctt

SEQ ID NO: 92135 - DNA, 22 bp, Artificial Sequence
  chemically synthesized
caagaaagtatcttctctgtcc

SEQ ID NO: 92136 - DNA, 22 bp, Artificial Sequence
  chemically synthesized
ctctgtccttaaactcccattc

SEQ ID NO: 92137 - DNA, 22 bp, Artificial Sequence
  chemically synthesized
tctgtccttaaactcccattct

SEQ ID NO: 92138 - DNA, 22 bp, Artificial Sequence
  chemically synthesized
tgtccttaaactcccattctcc

SEQ ID NO: 92139 - DNA, 22 bp, Artificial Sequence
  chemically synthesized
tccttaaactcccattctccaa

SEQ ID NO: 92140 - DNA, 22 bp, Artificial Sequence
  chemically synthesized
aaactcccattctccaacattc

SEQ ID NO: 92141 - DNA, 22 bp, Artificial Sequence
  chemically synthesized
aactcccattctccaacattct

SEQ ID NO: 92142 - DNA, 22 bp, Artificial Sequence
  chemically synthesized
ccattctccaacattctcattt

SEQ ID NO: 92143 - DNA, 22 bp, Artificial Sequence
  chemically synthesized
tccaacattctcatttccatca

SEQ ID NO: 92144 - DNA, 22 bp, Artificial Sequence
  chemically synthesized
caacattctcatttccatcaga

SEQ ID NO: 92145 - DNA, 22 bp, Artificial Sequence
  chemically synthesized
tcatttccatcagaaatagtgc

SEQ ID NO: 92146 - DNA, 22 bp, Artificial Sequence
  chemically synthesized
atttccatcagaaatagtgcgt

SEQ ID NO: 92147 - DNA, 22 bp, Artificial Sequence
  chemically synthesized
ccatcagaaatagtgcgtcctt

SEQ ID NO: 92148 - DNA, 22 bp, Artificial Sequence
  chemically synthesized
catcagaaatagtgcgtccttt

SEQ ID NO: 92149 - DNA, 22 bp, Artificial Sequence
  chemically synthesized
ttggctgaatcagggtaaaata

SEQ ID NO: 92150 - DNA, 22 bp, Artificial Sequence
  chemically synthesized
tggctgaatcagggtaaaatat

SEQ ID NO: 92151 - DNA, 22 bp, Artificial Sequence
  chemically synthesized
ggctgaatcagggtaaaatata

SEQ ID NO: 92152 - DNA, 22 bp, Artificial Sequence
  chemically synthesized
gctgaatcagggtaaaatataa

SEQ ID NO: 92153 - DNA, 22 bp, Artificial Sequence
  chemically synthesized
aatcagggtaaaatataaagac

SEQ ID NO: 92154 - DNA, 22 bp, Artificial Sequence
  chemically synthesized
cttagagagcatatttctttat

SEQ ID NO: 92155 - DNA, 22 bp, Artificial Sequence
  chemically synthesized
ttagagagcatatttctttatt

SEQ ID NO: 92156 - DNA, 22 bp, Artificial Sequence
  chemically synthesized
agagagcatatttctttattct

SEQ ID NO: 92157 - DNA, 22 bp, Artificial Sequence
  chemically synthesized
gagagcatatttctttattcta

SEQ ID NO: 92158 - DNA, 22 bp, Artificial Sequence
  chemically synthesized
ctttattctatttttatcatgc

SEQ ID NO: 92159 - DNA, 22 bp, Artificial Sequence
  chemically synthesized
tttattctatttttatcatgca

SEQ ID NO: 92160 - DNA, 22 bp, Artificial Sequence
  chemically synthesized
tattctatttttatcatgcagg

SEQ ID NO: 92161 - DNA, 22 bp, Artificial Sequence
  chemically synthesized
attctatttttatcatgcagga

SEQ ID NO: 92162 - DNA, 22 bp, Artificial Sequence
  chemically synthesized
ttctatttttatcatgcaggaa

SEQ ID NO: 92163 - DNA, 22 bp, Artificial Sequence
  chemically synthesized
tatttttatcatgcaggaactg

SEQ ID NO: 92164 - DNA, 22 bp, Artificial Sequence
  chemically synthesized
tttttatcatgcaggaactgaa

SEQ ID NO: 92165 - DNA, 22 bp, Artificial Sequence
  chemically synthesized
ttatcatgcaggaactgaatca

SEQ ID NO: 92166 - DNA, 22 bp, Artificial Sequence
  chemically synthesized
tatcatgcaggaactgaatcag

SEQ ID NO: 92167 - DNA, 22 bp, Artificial Sequence
  chemically synthesized
atcatgcaggaactgaatcagc

SEQ ID NO: 92168 - DNA, 22 bp, Artificial Sequence
  chemically synthesized
tcatgcaggaactgaatcagca

SEQ ID NO: 92169 - DNA, 22 bp, Artificial Sequence
  chemically synthesized
aatcagcaggcaggatactgct

SEQ ID NO: 92170 - DNA, 22 bp, Artificial Sequence
  chemically synthesized
ctcttctccccaacctccccca

SEQ ID NO: 92171 - DNA, 22 bp, Artificial Sequence
  chemically synthesized
ttctccccaacctcccccatct

SEQ ID NO: 92172 - DNA, 22 bp, Artificial Sequence
  chemically synthesized
ctccccaacctcccccatctaa

SEQ ID NO: 92173 - DNA, 22 bp, Artificial Sequence
  chemically synthesized
tccccaacctcccccatctaaa

SEQ ID NO: 92174 - DNA, 22 bp, Artificial Sequence
  chemically synthesized
cccaacctcccccatctaaagg

SEQ ID NO: 92175 - DNA, 22 bp, Artificial Sequence
  chemically synthesized
ccccatctaaaggagatgagat

SEQ ID NO: 92176 - DNA, 22 bp, Artificial Sequence
  chemically synthesized
aaggagatgagattttgggaca

SEQ ID NO: 92177 - DNA, 22 bp, Artificial Sequence
  chemically synthesized
tgggacataggtacaaacatag

SEQ ID NO: 92178 - DNA, 22 bp, Artificial Sequence
  chemically synthesized
gggacataggtacaaacatagt

SEQ ID NO: 92179 - DNA, 22 bp, Artificial Sequence
  chemically synthesized
ggacataggtacaaacatagtg

SEQ ID NO: 92180 - DNA, 22 bp, Artificial Sequence
  chemically synthesized
agtggtcttgtgggctacagca

SEQ ID NO: 92181 - DNA, 22 bp, Artificial Sequence
  chemically synthesized
gtgggctacagcattaaccaca

SEQ ID NO: 92182 - DNA, 22 bp, Artificial Sequence
  chemically synthesized
tgggctacagcattaaccacag

SEQ ID NO: 92183 - DNA, 22 bp, Artificial Sequence
  chemically synthesized
cagcattaaccacagcatttgt

SEQ ID NO: 92184 - DNA, 22 bp, Artificial Sequence
  chemically synthesized
accacagcatttgttagttact

SEQ ID NO: 92185 - DNA, 22 bp, Artificial Sequence
  chemically synthesized
gttagttactgccaagaagcct

SEQ ID NO: 92186 - DNA, 22 bp, Artificial Sequence
  chemically synthesized
ttagttactgccaagaagcctg

SEQ ID NO: 92187 - DNA, 22 bp, Artificial Sequence
  chemically synthesized
gttactgccaagaagcctgtat

SEQ ID NO: 92188 - DNA, 22 bp, Artificial Sequence
  chemically synthesized
ctgccaagaagcctgtatctgt

SEQ ID NO: 92189 - DNA, 22 bp, Artificial Sequence
  chemically synthesized
ccaagaagcctgtatctgtagg

SEQ ID NO: 92190 - DNA, 22 bp, Artificial Sequence
  chemically synthesized
tatctgtagggtaaaatcctcg

SEQ ID NO: 92191 - DNA, 22 bp, Artificial Sequence
  chemically synthesized
tagggtaaaatcctcgctgaag

SEQ ID NO: 92192 - DNA, 22 bp, Artificial Sequence
  chemically synthesized
gctgaagtgggttgccaaaaca

SEQ ID NO: 92193 - DNA, 22 bp, Artificial Sequence
  chemically synthesized
aagtgggttgccaaaacaatca

SEQ ID NO: 92194 - DNA, 22 bp, Artificial Sequence
  chemically synthesized
ccaaaacaatcaatatcacgtt

SEQ ID NO: 92195 - DNA, 22 bp, Artificial Sequence
  chemically synthesized
cctaagagctggggagggagtg

SEQ ID NO: 92196 - DNA, 22 bp, Artificial Sequence
  chemically synthesized
agagctggggagggagtgaaga

SEQ ID NO: 92197 - DNA, 22 bp, Artificial Sequence
  chemically synthesized
gggagggagtgaagataaaaaa

SEQ ID NO: 92198 - DNA, 22 bp, Artificial Sequence
  chemically synthesized
aagctggacttgcagtaaatag

SEQ ID NO: 92199 - DNA, 22 bp, Artificial Sequence
  chemically synthesized
gacttgcagtaaatagatataa

SEQ ID NO: 92200 - DNA, 22 bp, Artificial Sequence
  chemically synthesized
gcagtaaatagatataacactt

SEQ ID NO: 92201 - DNA, 22 bp, Artificial Sequence
  chemically synthesized
cagtaaatagatataacactta

SEQ ID NO: 92202 - DNA, 22 bp, Artificial Sequence
  chemically synthesized
acatcctttttcaccagagttt

SEQ ID NO: 92203 - DNA, 22 bp, Artificial Sequence
  chemically synthesized
catcctttttcaccagagtttg

SEQ ID NO: 92204 - DNA, 22 bp, Artificial Sequence
  chemically synthesized
tttcaccagagtttgagcaact

SEQ ID NO: 92205 - DNA, 22 bp, Artificial Sequence
  chemically synthesized
ttcaccagagtttgagcaactc

SEQ ID NO: 92206 - DNA, 22 bp, Artificial Sequence
  chemically synthesized
tcaccagagtttgagcaactct

SEQ ID NO: 92207 - DNA, 22 bp, Artificial Sequence
  chemically synthesized
caccagagtttgagcaactctc

SEQ ID NO: 92208 - DNA, 22 bp, Artificial Sequence
  chemically synthesized
accagagtttgagcaactctca

SEQ ID NO: 92209 - DNA, 22 bp, Artificial Sequence
  chemically synthesized
gagcaactctcaccattatggg

SEQ ID NO: 92210 - DNA, 22 bp, Artificial Sequence
  chemically synthesized
agcaactctcaccattatgggc

SEQ ID NO: 92211 - DNA, 22 bp, Artificial Sequence
  chemically synthesized
tcaccattatgggctagatatc

SEQ ID NO: 92212 - DNA, 22 bp, Artificial Sequence
  chemically synthesized
accattatgggctagatatcag

SEQ ID NO: 92213 - DNA, 22 bp, Artificial Sequence
  chemically synthesized
tgggctagatatcagcttcaat

SEQ ID NO: 92214 - DNA, 22 bp, Artificial Sequence
  chemically synthesized
gatatcagcttcaatatgactg

SEQ ID NO: 92215 - DNA, 22 bp, Artificial Sequence
  chemically synthesized
caatatgactggcagccctgca

SEQ ID NO: 92216 - DNA, 22 bp, Artificial Sequence
  chemically synthesized
aatatgactggcagccctgcac

SEQ ID NO: 92217 - DNA, 22 bp, Artificial Sequence
  chemically synthesized
gcagccctgcacctcccattgt

SEQ ID NO: 92218 - DNA, 22 bp, Artificial Sequence
  chemically synthesized
cacctcccattgtgtcctatcc

SEQ ID NO: 92219 - DNA, 22 bp, Artificial Sequence
  chemically synthesized
ccattgtgtcctatccttctct

SEQ ID NO: 92220 - DNA, 22 bp, Artificial Sequence
  chemically synthesized
tgtcctatccttctcttacttg

SEQ ID NO: 92221 - DNA, 22 bp, Artificial Sequence
  chemically synthesized
tccttctcttacttgctatgcc

SEQ ID NO: 92222 - DNA, 22 bp, Artificial Sequence
  chemically synthesized
ctcttacttgctatgccaactc

SEQ ID NO: 92223 - DNA, 22 bp, Artificial Sequence
  chemically synthesized
tcttacttgctatgccaactca

SEQ ID NO: 92224 - DNA, 22 bp, Artificial Sequence
  chemically synthesized
ttacttgctatgccaactcact

SEQ ID NO: 92225 - DNA, 22 bp, Artificial Sequence
  chemically synthesized
acttgctatgccaactcactac

SEQ ID NO: 92226 - DNA, 22 bp, Artificial Sequence
  chemically synthesized
cttgctatgccaactcactacc

SEQ ID NO: 92227 - DNA, 22 bp, Artificial Sequence
  chemically synthesized
gctatgccaactcactacccca

SEQ ID NO: 92228 - DNA, 22 bp, Artificial Sequence
  chemically synthesized
ctatgccaactcactaccccaa

SEQ ID NO: 92229 - DNA, 22 bp, Artificial Sequence
  chemically synthesized
tgccaactcactaccccaacat

SEQ ID NO: 92230 - DNA, 22 bp, Artificial Sequence
  chemically synthesized
actaccccaacatattgtgatt

SEQ ID NO: 92231 - DNA, 22 bp, Artificial Sequence
  chemically synthesized
ccccaacatattgtgattgttt

SEQ ID NO: 92232 - DNA, 22 bp, Artificial Sequence
  chemically synthesized
tgattgtttcatttttttttta

SEQ ID NO: 92233 - DNA, 22 bp, Artificial Sequence
  chemically synthesized
tttcattttttttttagagact

SEQ ID NO: 92234 - DNA, 22 bp, Artificial Sequence
  chemically synthesized
cattttttttttagagacttcg

SEQ ID NO: 92235 - DNA, 22 bp, Artificial Sequence
  chemically synthesized
attttttttttagagacttcgt

SEQ ID NO: 92236 - DNA, 22 bp, Artificial Sequence
  chemically synthesized
tttttttagagacttcgtcctt

SEQ ID NO: 92237 - DNA, 22 bp, Artificial Sequence
  chemically synthesized
ttttttagagacttcgtccttt

SEQ ID NO: 92238 - DNA, 22 bp, Artificial Sequence
  chemically synthesized
tttttagagacttcgtcctttt

SEQ ID NO: 92239 - DNA, 22 bp, Artificial Sequence
  chemically synthesized
ttttagagacttcgtcctttta

SEQ ID NO: 92240 - DNA, 22 bp, Artificial Sequence
  chemically synthesized
tttagagacttcgtccttttaa

SEQ ID NO: 92241 - DNA, 22 bp, Artificial Sequence
  chemically synthesized
ttagagacttcgtccttttaaa

SEQ ID NO: 92242 - DNA, 22 bp, Artificial Sequence
  chemically synthesized
tagagacttcgtccttttaaaa

SEQ ID NO: 92243 - DNA, 22 bp, Artificial Sequence
  chemically synthesized
agagacttcgtccttttaaaaa

SEQ ID NO: 92244 - DNA, 22 bp, Artificial Sequence
  chemically synthesized
gagacttcgtccttttaaaaag

SEQ ID NO: 92245 - DNA, 22 bp, Artificial Sequence
  chemically synthesized
cgtccttttaaaaagtaggata

SEQ ID NO: 92246 - DNA, 22 bp, Artificial Sequence
  chemically synthesized
gtccttttaaaaagtaggataa

SEQ ID NO: 92247 - DNA, 22 bp, Artificial Sequence
  chemically synthesized
ttaaaaagtaggataatagtac

SEQ ID NO: 92248 - DNA, 22 bp, Artificial Sequence
  chemically synthesized
taaaaagtaggataatagtact

SEQ ID NO: 92249 - DNA, 22 bp, Artificial Sequence
  chemically synthesized
aaaaagtaggataatagtactt

SEQ ID NO: 92250 - DNA, 22 bp, Artificial Sequence
  chemically synthesized
aaaagtaggataatagtacttc

SEQ ID NO: 92251 - DNA, 22 bp, Artificial Sequence
  chemically synthesized
caaggaacagtaatggatagga

SEQ ID NO: 92252 - DNA, 22 bp, Artificial Sequence
  chemically synthesized
aaggaacagtaatggataggat

SEQ ID NO: 92253 - DNA, 22 bp, Artificial Sequence
  chemically synthesized
tcccaaacactcataacaaaga

SEQ ID NO: 92254 - DNA, 22 bp, Artificial Sequence
  chemically synthesized
cccaaacactcataacaaagaa

SEQ ID NO: 92255 - DNA, 22 bp, Artificial Sequence
  chemically synthesized
ccaaacactcataacaaagaat

SEQ ID NO: 92256 - DNA, 22 bp, Artificial Sequence
  chemically synthesized
ataacaaagaatcctgtaccat

SEQ ID NO: 92257 - DNA, 22 bp, Artificial Sequence
  chemically synthesized
taccatgcgtacaaaagtatac

SEQ ID NO: 92258 - DNA, 22 bp, Artificial Sequence
  chemically synthesized
ggagggaaacaatcctcttttt

SEQ ID NO: 92259 - DNA, 22 bp, Artificial Sequence
  chemically synthesized
tttttaacagcttcccactact

SEQ ID NO: 92260 - DNA, 22 bp, Artificial Sequence
  chemically synthesized
tttaacagcttcccactacttt

SEQ ID NO: 92261 - DNA, 22 bp, Artificial Sequence
  chemically synthesized
ttaacagcttcccactactttg

SEQ ID NO: 92262 - DNA, 22 bp, Artificial Sequence
  chemically synthesized
taacagcttcccactactttgt

SEQ ID NO: 92263 - DNA, 22 bp, Artificial Sequence
  chemically synthesized
aacagcttcccactactttgtt

SEQ ID NO: 92264 - DNA, 22 bp, Artificial Sequence
  chemically synthesized
acagcttcccactactttgttc

SEQ ID NO: 92265 - DNA, 22 bp, Artificial Sequence
  chemically synthesized
cccactactttgttcagttgat

SEQ ID NO: 92266 - DNA, 22 bp, Artificial Sequence
  chemically synthesized
ccactactttgttcagttgatc

SEQ ID NO: 92267 - DNA, 22 bp, Artificial Sequence
  chemically synthesized
ctttgttcagttgatctttttc

SEQ ID NO: 92268 - DNA, 22 bp, Artificial Sequence
  chemically synthesized
tgttcagttgatctttttctaa

SEQ ID NO: 92269 - DNA, 22 bp, Artificial Sequence
  chemically synthesized
gttcagttgatctttttctaac

SEQ ID NO: 92270 - DNA, 22 bp, Artificial Sequence
  chemically synthesized
ttcagttgatctttttctaacc

SEQ ID NO: 92271 - DNA, 22 bp, Artificial Sequence
  chemically synthesized
agttgatctttttctaacctcc

SEQ ID NO: 92272 - DNA, 22 bp, Artificial Sequence
  chemically synthesized
atctttttctaacctccaggac

SEQ ID NO: 92273 - DNA, 22 bp, Artificial Sequence
  chemically synthesized
tttctaacctccaggactatgc

SEQ ID NO: 92274 - DNA, 22 bp, Artificial Sequence
  chemically synthesized
ttctaacctccaggactatgca

SEQ ID NO: 92275 - DNA, 22 bp, Artificial Sequence
  chemically synthesized
tctaacctccaggactatgcag

SEQ ID NO: 92276 - DNA, 22 bp, Artificial Sequence
  chemically synthesized
ctaacctccaggactatgcaga

SEQ ID NO: 92277 - DNA, 22 bp, Artificial Sequence
  chemically synthesized
taacctccaggactatgcagaa

SEQ ID NO: 92278 - DNA, 22 bp, Artificial Sequence
  chemically synthesized
acctccaggactatgcagaaaa

SEQ ID NO: 92279 - DNA, 22 bp, Artificial Sequence
  chemically synthesized
caggactatgcagaaaagtgac

SEQ ID NO: 92280 - DNA, 22 bp, Artificial Sequence
  chemically synthesized
tgcagaaaagtgactattaatt

SEQ ID NO: 92281 - DNA, 22 bp, Artificial Sequence
  chemically synthesized
ttaatttttatagaaaatttcg

SEQ ID NO: 92282 - DNA, 22 bp, Artificial Sequence
  chemically synthesized
atttttatagaaaatttcgctg

SEQ ID NO: 92283 - DNA, 22 bp, Artificial Sequence
  chemically synthesized
ttatagaaaatttcgctgacca

SEQ ID NO: 92284 - DNA, 22 bp, Artificial Sequence
  chemically synthesized
tatagaaaatttcgctgaccaa

SEQ ID NO: 92285 - DNA, 22 bp, Artificial Sequence
  chemically synthesized
atagaaaatttcgctgaccaaa

SEQ ID NO: 92286 - DNA, 22 bp, Artificial Sequence
  chemically synthesized
tagaaaatttcgctgaccaaag

SEQ ID NO: 92287 - DNA, 22 bp, Artificial Sequence
  chemically synthesized
cgctgaccaaaggaaagatgtt

SEQ ID NO: 92288 - DNA, 22 bp, Artificial Sequence
  chemically synthesized
gctgaccaaaggaaagatgtta

SEQ ID NO: 92289 - DNA, 22 bp, Artificial Sequence
  chemically synthesized
accaaaggaaagatgttatttt

SEQ ID NO: 92290 - DNA, 22 bp, Artificial Sequence
  chemically synthesized
ttttctctatctcaacttctgt

SEQ ID NO: 92291 - DNA, 22 bp, Artificial Sequence
  chemically synthesized
tctctatctcaacttctgttcc

SEQ ID NO: 92292 - DNA, 22 bp, Artificial Sequence
  chemically synthesized
ctctatctcaacttctgttccc

SEQ ID NO: 92293 - DNA, 22 bp, Artificial Sequence
  chemically synthesized
tctatctcaacttctgttccct

SEQ ID NO: 92294 - DNA, 22 bp, Artificial Sequence
  chemically synthesized
tatctcaacttctgttccctca

SEQ ID NO: 92295 - DNA, 22 bp, Artificial Sequence
  chemically synthesized
tctcaacttctgttccctcatc

SEQ ID NO: 92296 - DNA, 22 bp, Artificial Sequence
  chemically synthesized
aacttctgttccctcatccaaa

SEQ ID NO: 92297 - DNA, 22 bp, Artificial Sequence
  chemically synthesized
ctgttccctcatccaaaaacac

SEQ ID NO: 92298 - DNA, 22 bp, Artificial Sequence
  chemically synthesized
tgttccctcatccaaaaacact

SEQ ID NO: 92299 - DNA, 22 bp, Artificial Sequence
  chemically synthesized
ttccctcatccaaaaacactca

SEQ ID NO: 92300 - DNA, 22 bp, Artificial Sequence
  chemically synthesized
cctcatccaaaaacactcagtt

SEQ ID NO: 92301 - DNA, 22 bp, Artificial Sequence
  chemically synthesized
atccaaaaacactcagtttgat

SEQ ID NO: 92302 - DNA, 22 bp, Artificial Sequence
  chemically synthesized
agtttgattttggccagaattt

SEQ ID NO: 92303 - DNA, 22 bp, Artificial Sequence
  chemically synthesized
gattttggccagaattttttat

SEQ ID NO: 92304 - DNA, 22 bp, Artificial Sequence
  chemically synthesized
attttggccagaattttttata

SEQ ID NO: 92305 - DNA, 22 bp, Artificial Sequence
  chemically synthesized
tggccagaattttttataagat

SEQ ID NO: 92306 - DNA, 22 bp, Artificial Sequence
  chemically synthesized
ggccagaattttttataagatg

SEQ ID NO: 92307 - DNA, 22 bp, Artificial Sequence
  chemically synthesized
gccagaattttttataagatgt

SEQ ID NO: 92308 - DNA, 22 bp, Artificial Sequence
  chemically synthesized
tttataagatgtgtttttcaga

SEQ ID NO: 92309 - DNA, 22 bp, Artificial Sequence
  chemically synthesized
ttataagatgtgtttttcagag

SEQ ID NO: 92310 - DNA, 22 bp, Artificial Sequence
  chemically synthesized
tataagatgtgtttttcagagc

SEQ ID NO: 92311 - DNA, 22 bp, Artificial Sequence
  chemically synthesized
ataagatgtgtttttcagagct

SEQ ID NO: 92312 - DNA, 22 bp, Artificial Sequence
  chemically synthesized
taagatgtgtttttcagagcta

SEQ ID NO: 92313 - DNA, 22 bp, Artificial Sequence
  chemically synthesized
ttcagagctatcaaatggtaag

SEQ ID NO: 92314 - DNA, 22 bp, Artificial Sequence
  chemically synthesized
tcagagctatcaaatggtaagt

SEQ ID NO: 92315 - DNA, 22 bp, Artificial Sequence
  chemically synthesized
cagagctatcaaatggtaagtg

SEQ ID NO: 92316 - DNA, 22 bp, Artificial Sequence
  chemically synthesized
agagctatcaaatggtaagtgg

SEQ ID NO: 92317 - DNA, 22 bp, Artificial Sequence
  chemically synthesized
tcaaatggtaagtggccttcca

SEQ ID NO: 92318 - DNA, 22 bp, Artificial Sequence
  chemically synthesized
ccattattcatagtccttgctc

SEQ ID NO: 92319 - DNA, 22 bp, Artificial Sequence
  chemically synthesized
cattattcatagtccttgctct

SEQ ID NO: 92320 - DNA, 22 bp, Artificial Sequence
  chemically synthesized
ttcatagtccttgctctaccaa

SEQ ID NO: 92321 - DNA, 22 bp, Artificial Sequence
  chemically synthesized
atagtccttgctctaccaaatt

SEQ ID NO: 92322 - DNA, 22 bp, Artificial Sequence
  chemically synthesized
gctctaccaaattttagttatg

SEQ ID NO: 92323 - DNA, 22 bp, Artificial Sequence
  chemically synthesized
ctctaccaaattttagttatgt

SEQ ID NO: 92324 - DNA, 22 bp, Artificial Sequence
  chemically synthesized
taccaaattttagttatgttat

SEQ ID NO: 92325 - DNA, 22 bp, Artificial Sequence
  chemically synthesized
ccaaattttagttatgttattt

SEQ ID NO: 92326 - DNA, 22 bp, Artificial Sequence
  chemically synthesized
tagttatgttatttacagcaac

SEQ ID NO: 92327 - DNA, 22 bp, Artificial Sequence
  chemically synthesized
agttatgttatttacagcaaca

SEQ ID NO: 92328 - DNA, 22 bp, Artificial Sequence
  chemically synthesized
gttatgttatttacagcaacat

SEQ ID NO: 92329 - DNA, 22 bp, Artificial Sequence
  chemically synthesized
tgttatttacagcaacataact

SEQ ID NO: 92330 - DNA, 22 bp, Artificial Sequence
  chemically synthesized
tttacagcaacataactctcaa

SEQ ID NO: 92331 - DNA, 22 bp, Artificial Sequence
  chemically synthesized
acagcaacataactctcaaaat

SEQ ID NO: 92332 - DNA, 22 bp, Artificial Sequence
  chemically synthesized
cagcaacataactctcaaaatc

SEQ ID NO: 92333 - DNA, 22 bp, Artificial Sequence
  chemically synthesized
tcaaaatcccactgctgaaata

SEQ ID NO: 92334 - DNA, 22 bp, Artificial Sequence
  chemically synthesized
aaaatcccactgctgaaatatc

SEQ ID NO: 92335 - DNA, 22 bp, Artificial Sequence
  chemically synthesized
ctgaaatatcatatcccatagc

SEQ ID NO: 92336 - DNA, 22 bp, Artificial Sequence
  chemically synthesized
aaatatcatatcccatagctga

SEQ ID NO: 92337 - DNA, 22 bp, Artificial Sequence
  chemically synthesized
actcataacacaagagaaagcc

SEQ ID NO: 92338 - DNA, 22 bp, Artificial Sequence
  chemically synthesized
ataacacaagagaaagccacct

SEQ ID NO: 92339 - DNA, 22 bp, Artificial Sequence
  chemically synthesized
tgctttcaaaagtacccatagt

SEQ ID NO: 92340 - DNA, 22 bp, Artificial Sequence
  chemically synthesized
ctttcaaaagtacccatagtgc

SEQ ID NO: 92341 - DNA, 22 bp, Artificial Sequence
  chemically synthesized
tcaaaagtacccatagtgcaaa

SEQ ID NO: 92342 - DNA, 22 bp, Artificial Sequence
  chemically synthesized
caaaagtacccatagtgcaaat

SEQ ID NO: 92343 - DNA, 22 bp, Artificial Sequence
  chemically synthesized
aaaagtacccatagtgcaaata

SEQ ID NO: 92344 - DNA, 22 bp, Artificial Sequence
  chemically synthesized
agggtaaagaagaaagcgtgag

SEQ ID NO: 92345 - DNA, 22 bp, Artificial Sequence
  chemically synthesized
actactcaccaggaagttctca

SEQ ID NO: 92346 - DNA, 22 bp, Artificial Sequence
  chemically synthesized
ctactcaccaggaagttctcag

SEQ ID NO: 92347 - DNA, 22 bp, Artificial Sequence
  chemically synthesized
ctcaccaggaagttctcagggt

SEQ ID NO: 92348 - DNA, 22 bp, Artificial Sequence
  chemically synthesized
accaggaagttctcagggtcca

SEQ ID NO: 92349 - DNA, 22 bp, Artificial Sequence
  chemically synthesized
tcagggtccacgtgcagcttgt

SEQ ID NO: 92350 - DNA, 22 bp, Artificial Sequence
  chemically synthesized
agggtccacgtgcagcttgtta

SEQ ID NO: 92351 - DNA, 22 bp, Artificial Sequence
  chemically synthesized
gttacagtgcaggtcactcagt

SEQ ID NO: 92352 - DNA, 22 bp, Artificial Sequence
  chemically synthesized
ttacagtgcaggtcactcagtg

SEQ ID NO: 92353 - DNA, 22 bp, Artificial Sequence
  chemically synthesized
cagtgcaggtcactcagtgtag

SEQ ID NO: 92354 - DNA, 22 bp, Artificial Sequence
  chemically synthesized
agtgtagcaaaggtgcctttga

SEQ ID NO: 92355 - DNA, 22 bp, Artificial Sequence
  chemically synthesized
tgaggtcatccgtgagcataac

SEQ ID NO: 92356 - DNA, 22 bp, Artificial Sequence
  chemically synthesized
gaggtcatccgtgagcataaca

SEQ ID NO: 92357 - DNA, 22 bp, Artificial Sequence
  chemically synthesized
aggtcatccgtgagcataacag

SEQ ID NO: 92358 - DNA, 22 bp, Artificial Sequence
  chemically synthesized
ttccgaaggagatcagcacctt

SEQ ID NO: 92359 - DNA, 22 bp, Artificial Sequence
  chemically synthesized
tccgaaggagatcagcaccttc

SEQ ID NO: 92360 - DNA, 22 bp, Artificial Sequence
  chemically synthesized
ccgaaggagatcagcaccttct

SEQ ID NO: 92361 - DNA, 22 bp, Artificial Sequence
  chemically synthesized
cgaaggagatcagcaccttctt

SEQ ID NO: 92362 - DNA, 22 bp, Artificial Sequence
  chemically synthesized
cttgccatgtgccttgactttg

SEQ ID NO: 92363 - DNA, 22 bp, Artificial Sequence
  chemically synthesized
ttgccatgtgccttgactttgg

SEQ ID NO: 92364 - DNA, 22 bp, Artificial Sequence
  chemically synthesized
gccatgtgccttgactttgggg

SEQ ID NO: 92365 - DNA, 22 bp, Artificial Sequence
  chemically synthesized
ccatgtgccttgactttggggt

SEQ ID NO: 92366 - DNA, 22 bp, Artificial Sequence
  chemically synthesized
gactttggggttgcccattatt

SEQ ID NO: 92367 - DNA, 22 bp, Artificial Sequence
  chemically synthesized
actttggggttgcccattattg

SEQ ID NO: 92368 - DNA, 22 bp, Artificial Sequence
  chemically synthesized
tggggttgcccattattgcaca

SEQ ID NO: 92369 - DNA, 22 bp, Artificial Sequence
  chemically synthesized
ggggttgcccattattgcacag

SEQ ID NO: 92370 - DNA, 22 bp, Artificial Sequence
  chemically synthesized
gggttgcccattattgcacagt

SEQ ID NO: 92371 - DNA, 22 bp, Artificial Sequence
  chemically synthesized
cccattattgcacagtcagagc

SEQ ID NO: 92372 - DNA, 22 bp, Artificial Sequence
  chemically synthesized
ttgcacagtcagagcccagata

SEQ ID NO: 92373 - DNA, 22 bp, Artificial Sequence
  chemically synthesized
cacagtcagagcccagatatcc

SEQ ID NO: 92374 - DNA, 22 bp, Artificial Sequence
  chemically synthesized
tcaaagtacctctaggtccatg

SEQ ID NO: 92375 - DNA, 22 bp, Artificial Sequence
  chemically synthesized
caaagtacctctaggtccatgg

SEQ ID NO: 92376 - DNA, 22 bp, Artificial Sequence
  chemically synthesized
aaagtacctctaggtccatggg

SEQ ID NO: 92377 - DNA, 22 bp, Artificial Sequence
  chemically synthesized
taggtccatgggtagacaacca

SEQ ID NO: 92378 - DNA, 22 bp, Artificial Sequence
  chemically synthesized
ggtccatgggtagacaaccagg

SEQ ID NO: 92379 - DNA, 22 bp, Artificial Sequence
  chemically synthesized
tgggatagtcataatcacagag

SEQ ID NO: 92380 - DNA, 22 bp, Artificial Sequence
  chemically synthesized
tgtaagacaacgggctaatccc

SEQ ID NO: 92381 - DNA, 22 bp, Artificial Sequence
  chemically synthesized
atccctctttcagaaacacttt

SEQ ID NO: 92382 - DNA, 22 bp, Artificial Sequence
  chemically synthesized
tttcagaaacactttctgcctt

SEQ ID NO: 92383 - DNA, 22 bp, Artificial Sequence
  chemically synthesized
tcagaaacactttctgcctttc

SEQ ID NO: 92384 - DNA, 22 bp, Artificial Sequence
  chemically synthesized
cagaaacactttctgcctttct

SEQ ID NO: 92385 - DNA, 22 bp, Artificial Sequence
  chemically synthesized
agaaacactttctgcctttctg

SEQ ID NO: 92386 - DNA, 22 bp, Artificial Sequence
  chemically synthesized
tctgcctttctgcaccttgtcc

SEQ ID NO: 92387 - DNA, 22 bp, Artificial Sequence
  chemically synthesized
ctgcctttctgcaccttgtccc

SEQ ID NO: 92388 - DNA, 22 bp, Artificial Sequence
  chemically synthesized
tgcctttctgcaccttgtcccg

SEQ ID NO: 92389 - DNA, 22 bp, Artificial Sequence
  chemically synthesized
cctttctgcaccttgtcccggc

SEQ ID NO: 92390 - DNA, 22 bp, Artificial Sequence
  chemically synthesized
tctgcaccttgtcccggcttcc

SEQ ID NO: 92391 - DNA, 22 bp, Artificial Sequence
  chemically synthesized
ctgcaccttgtcccggcttcca

SEQ ID NO: 92392 - DNA, 22 bp, Artificial Sequence
  chemically synthesized
tgcaccttgtcccggcttccag

SEQ ID NO: 92393 - DNA, 22 bp, Artificial Sequence
  chemically synthesized
caccttgtcccggcttccagta

SEQ ID NO: 92394 - DNA, 22 bp, Artificial Sequence
  chemically synthesized
gtcccggcttccagtacctacc

SEQ ID NO: 92395 - DNA, 22 bp, Artificial Sequence
  chemically synthesized
tcccggcttccagtacctacct

SEQ ID NO: 92396 - DNA, 22 bp, Artificial Sequence
  chemically synthesized
ccagtacctacctgcccagaat

SEQ ID NO: 92397 - DNA, 22 bp, Artificial Sequence
  chemically synthesized
cagtacctacctgcccagaatc

SEQ ID NO: 92398 - DNA, 22 bp, Artificial Sequence
  chemically synthesized
cctgcccagaatctcacctcca

SEQ ID NO: 92399 - DNA, 22 bp, Artificial Sequence
  chemically synthesized
cccagaatctcacctccagcct

SEQ ID NO: 92400 - DNA, 22 bp, Artificial Sequence
  chemically synthesized
acctccagccttctcaccttaa

SEQ ID NO: 92401 - DNA, 22 bp, Artificial Sequence
  chemically synthesized
cagccttctcaccttaaccttg

SEQ ID NO: 92402 - DNA, 22 bp, Artificial Sequence
  chemically synthesized
ctcaccttaaccttgcttcaca

SEQ ID NO: 92403 - DNA, 22 bp, Artificial Sequence
  chemically synthesized
tcaccttaaccttgcttcacag

SEQ ID NO: 92404 - DNA, 22 bp, Artificial Sequence
  chemically synthesized
accttaaccttgcttcacaggc

SEQ ID NO: 92405 - DNA, 22 bp, Artificial Sequence
  chemically synthesized
aaccttgcttcacaggctggtg

SEQ ID NO: 92406 - DNA, 22 bp, Artificial Sequence
  chemically synthesized
accttgcttcacaggctggtgg

SEQ ID NO: 92407 - DNA, 22 bp, Artificial Sequence
  chemically synthesized
gcttcacaggctggtggcagca

SEQ ID NO: 92408 - DNA, 22 bp, Artificial Sequence
  chemically synthesized
cttcacaggctggtggcagcag

SEQ ID NO: 92409 - DNA, 22 bp, Artificial Sequence
  chemically synthesized
cacaggctggtggcagcagcct

SEQ ID NO: 92410 - DNA, 22 bp, Artificial Sequence
  chemically synthesized
acaggctggtggcagcagcctt

SEQ ID NO: 92411 - DNA, 22 bp, Artificial Sequence
  chemically synthesized
gtggcagcagccttcttgtcag

SEQ ID NO: 92412 - DNA, 22 bp, Artificial Sequence
  chemically synthesized
cttgtcagcagtgaaatgcact

SEQ ID NO: 92413 - DNA, 22 bp, Artificial Sequence
  chemically synthesized
ttgtcagcagtgaaatgcacta

SEQ ID NO: 92414 - DNA, 22 bp, Artificial Sequence
  chemically synthesized
gtcagcagtgaaatgcactaca

SEQ ID NO: 92415 - DNA, 22 bp, Artificial Sequence
  chemically synthesized
tcagcagtgaaatgcactacag

SEQ ID NO: 92416 - DNA, 22 bp, Artificial Sequence
  chemically synthesized
cagtgtcagatctgggagtttc

SEQ ID NO: 92417 - DNA, 22 bp, Artificial Sequence
  chemically synthesized
ggagtttcctggtgatcacaga

SEQ ID NO: 92418 - DNA, 22 bp, Artificial Sequence
  chemically synthesized
cctggtgatcacagatgagcca

SEQ ID NO: 92419 - DNA, 22 bp, Artificial Sequence
  chemically synthesized
ctggtgatcacagatgagccag

SEQ ID NO: 92420 - DNA, 22 bp, Artificial Sequence
  chemically synthesized
gtgatcacagatgagccagaag

SEQ ID NO: 92421 - DNA, 22 bp, Artificial Sequence
  chemically synthesized
cattgctgcttcatgtgtggct

SEQ ID NO: 92422 - DNA, 22 bp, Artificial Sequence
  chemically synthesized
ctgcttcatgtgtggcttttta

SEQ ID NO: 92423 - DNA, 22 bp, Artificial Sequence
  chemically synthesized
cttcatgtgtggctttttactt

SEQ ID NO: 92424 - DNA, 22 bp, Artificial Sequence
  chemically synthesized
catgtgtggctttttacttctc

SEQ ID NO: 92425 - DNA, 22 bp, Artificial Sequence
  chemically synthesized
atgtgtggctttttacttctcc

SEQ ID NO: 92426 - DNA, 22 bp, Artificial Sequence
  chemically synthesized
tttacttctcctctctggcccc

SEQ ID NO: 92427 - DNA, 22 bp, Artificial Sequence
  chemically synthesized
ttacttctcctctctggccccc

SEQ ID NO: 92428 - DNA, 22 bp, Artificial Sequence
  chemically synthesized
tacttctcctctctggccccca

SEQ ID NO: 92429 - DNA, 22 bp, Artificial Sequence
  chemically synthesized
acttctcctctctggcccccag

SEQ ID NO: 92430 - DNA, 22 bp, Artificial Sequence
  chemically synthesized
cttctcctctctggcccccagc

SEQ ID NO: 92431 - DNA, 22 bp, Artificial Sequence
  chemically synthesized
ctcctctctggcccccagccct

SEQ ID NO: 92432 - DNA, 22 bp, Artificial Sequence
  chemically synthesized
tcctctctggcccccagccctt

SEQ ID NO: 92433 - DNA, 22 bp, Artificial Sequence
  chemically synthesized
ctctctggcccccagccctttg

SEQ ID NO: 92434 - DNA, 22 bp, Artificial Sequence
  chemically synthesized
tctggcccccagccctttgcct

SEQ ID NO: 92435 - DNA, 22 bp, Artificial Sequence
  chemically synthesized
tggcccccagccctttgcctct

SEQ ID NO: 92436 - DNA, 22 bp, Artificial Sequence
  chemically synthesized
gcccccagccctttgcctctcc

SEQ ID NO: 92437 - DNA, 22 bp, Artificial Sequence
  chemically synthesized
tgcctctcccagtgaaatgaat

SEQ ID NO: 92438 - DNA, 22 bp, Artificial Sequence
  chemically synthesized
gcctctcccagtgaaatgaatc

SEQ ID NO: 92439 - DNA, 22 bp, Artificial Sequence
  chemically synthesized
cctctcccagtgaaatgaatct

SEQ ID NO: 92440 - DNA, 22 bp, Artificial Sequence
  chemically synthesized
tcccagtgaaatgaatctattg

SEQ ID NO: 92441 - DNA, 22 bp, Artificial Sequence
  chemically synthesized
ccagtgaaatgaatctattgac

SEQ ID NO: 92442 - DNA, 22 bp, Artificial Sequence
  chemically synthesized
ttgaccagccctttgcctccct

SEQ ID NO: 92443 - DNA, 22 bp, Artificial Sequence
  chemically synthesized
accagccctttgcctccctcag

SEQ ID NO: 92444 - DNA, 22 bp, Artificial Sequence
  chemically synthesized
tgcctccctcagtaaaatgaat

SEQ ID NO: 92445 - DNA, 22 bp, Artificial Sequence
  chemically synthesized
gcctccctcagtaaaatgaatc

SEQ ID NO: 92446 - DNA, 22 bp, Artificial Sequence
  chemically synthesized
cctccctcagtaaaatgaatct

SEQ ID NO: 92447 - DNA, 22 bp, Artificial Sequence
  chemically synthesized
cctcagtaaaatgaatctattg

SEQ ID NO: 92448 - DNA, 22 bp, Artificial Sequence
  chemically synthesized
agtaaaatgaatctattggtca

SEQ ID NO: 92449 - DNA, 22 bp, Artificial Sequence
  chemically synthesized
ttggtcaagggtgggttgtgac

SEQ ID NO: 92450 - DNA, 22 bp, Artificial Sequence
  chemically synthesized
gtcaagggtgggttgtgactcc

SEQ ID NO: 92451 - DNA, 22 bp, Artificial Sequence
  chemically synthesized
tgactccaggggtggggtttgg

SEQ ID NO: 92452 - DNA, 22 bp, Artificial Sequence
  chemically synthesized
caggggtggggtttgggcaagg

SEQ ID NO: 92453 - DNA, 22 bp, Artificial Sequence
  chemically synthesized
gggcaaggaagttttgcaagat

SEQ ID NO: 92454 - DNA, 22 bp, Artificial Sequence
  chemically synthesized
ggcaaggaagttttgcaagatg

SEQ ID NO: 92455 - DNA, 22 bp, Artificial Sequence
  chemically synthesized
tgcaagatggacattcgagttt

SEQ ID NO: 92456 - DNA, 22 bp, Artificial Sequence
  chemically synthesized
gcaagatggacattcgagtttc

SEQ ID NO: 92457 - DNA, 22 bp, Artificial Sequence
  chemically synthesized
caagatggacattcgagtttct

SEQ ID NO: 92458 - DNA, 22 bp, Artificial Sequence
  chemically synthesized
gagtttctgatagaatccaggt

SEQ ID NO: 92459 - DNA, 22 bp, Artificial Sequence
  chemically synthesized
ctgatagaatccaggtggcctt

SEQ ID NO: 92460 - DNA, 22 bp, Artificial Sequence
  chemically synthesized
tgatagaatccaggtggccttc

SEQ ID NO: 92461 - DNA, 22 bp, Artificial Sequence
  chemically synthesized
atagaatccaggtggccttctc

SEQ ID NO: 92462 - DNA, 22 bp, Artificial Sequence
  chemically synthesized
ctcaggggaactttgctgttca

SEQ ID NO: 92463 - DNA, 22 bp, Artificial Sequence
  chemically synthesized
tcaggggaactttgctgttcag

SEQ ID NO: 92464 - DNA, 22 bp, Artificial Sequence
  chemically synthesized
aggggaactttgctgttcaggc

SEQ ID NO: 92465 - DNA, 22 bp, Artificial Sequence
  chemically synthesized
tgctgttcaggcttaatttgaa

SEQ ID NO: 92466 - DNA, 22 bp, Artificial Sequence
  chemically synthesized
gctgttcaggcttaatttgaaa

SEQ ID NO: 92467 - DNA, 22 bp, Artificial Sequence
  chemically synthesized
ctgttcaggcttaatttgaaac

SEQ ID NO: 92468 - DNA, 22 bp, Artificial Sequence
  chemically synthesized
ttcaggcttaatttgaaacttt

SEQ ID NO: 92469 - DNA, 22 bp, Artificial Sequence
  chemically synthesized
aggcttaatttgaaactttact

SEQ ID NO: 92470 - DNA, 22 bp, Artificial Sequence
  chemically synthesized
aatttgaaactttacttccttc

SEQ ID NO: 92471 - DNA, 22 bp, Artificial Sequence
  chemically synthesized
atttgaaactttacttccttcc

SEQ ID NO: 92472 - DNA, 22 bp, Artificial Sequence
  chemically synthesized
gaaactttacttccttcccctc

SEQ ID NO: 92473 - DNA, 22 bp, Artificial Sequence
  chemically synthesized
aaactttacttccttcccctcc

SEQ ID NO: 92474 - DNA, 22 bp, Artificial Sequence
  chemically synthesized
tacttccttcccctccattttc

SEQ ID NO: 92475 - DNA, 22 bp, Artificial Sequence
  chemically synthesized
acttccttcccctccattttcc

SEQ ID NO: 92476 - DNA, 22 bp, Artificial Sequence
  chemically synthesized
cttccttcccctccattttcct

SEQ ID NO: 92477 - DNA, 22 bp, Artificial Sequence
  chemically synthesized
ccttcccctccattttcctaca

SEQ ID NO: 92478 - DNA, 22 bp, Artificial Sequence
  chemically synthesized
cttcccctccattttcctacac

SEQ ID NO: 92479 - DNA, 22 bp, Artificial Sequence
  chemically synthesized
cccctccattttcctacactac

SEQ ID NO: 92480 - DNA, 22 bp, Artificial Sequence
  chemically synthesized
ccctccattttcctacactacc

SEQ ID NO: 92481 - DNA, 22 bp, Artificial Sequence
  chemically synthesized
cattttcctacactacccccac

SEQ ID NO: 92482 - DNA, 22 bp, Artificial Sequence
  chemically synthesized
tcctacactacccccaccatcc

SEQ ID NO: 92483 - DNA, 22 bp, Artificial Sequence
  chemically synthesized
cctacactacccccaccatcca

SEQ ID NO: 92484 - DNA, 22 bp, Artificial Sequence
  chemically synthesized
ctacactacccccaccatccag

SEQ ID NO: 92485 - DNA, 22 bp, Artificial Sequence
  chemically synthesized
cactacccccaccatccagtgt

SEQ ID NO: 92486 - DNA, 22 bp, Artificial Sequence
  chemically synthesized
cccccaccatccagtgtgcagt

SEQ ID NO: 92487 - DNA, 22 bp, Artificial Sequence
  chemically synthesized
atttctcaaggacttcgccagc

SEQ ID NO: 92488 - DNA, 22 bp, Artificial Sequence
  chemically synthesized
tttctcaaggacttcgccagca

SEQ ID NO: 92489 - DNA, 22 bp, Artificial Sequence
  chemically synthesized
ctcaaggacttcgccagcagcc

SEQ ID NO: 92490 - DNA, 22 bp, Artificial Sequence
  chemically synthesized
tcaaggacttcgccagcagccg

SEQ ID NO: 92491 - DNA, 22 bp, Artificial Sequence
  chemically synthesized
aaggacttcgccagcagccgct

SEQ ID NO: 92492 - DNA, 22 bp, Artificial Sequence
  chemically synthesized
cgccagcagccgctaataacct

SEQ ID NO: 92493 - DNA, 22 bp, Artificial Sequence
  chemically synthesized
gccagcagccgctaataacctg

SEQ ID NO: 92494 - DNA, 22 bp, Artificial Sequence
  chemically synthesized
ataacctgaatgctgacaaata

SEQ ID NO: 92495 - DNA, 22 bp, Artificial Sequence
  chemically synthesized
aatgctgacaaataggaataag

SEQ ID NO: 92496 - DNA, 22 bp, Artificial Sequence
  chemically synthesized
acaaataggaataagttacaac

SEQ ID NO: 92497 - DNA, 22 bp, Artificial Sequence
  chemically synthesized
caactgaaaaggataagaatta

SEQ ID NO: 92498 - DNA, 22 bp, Artificial Sequence
  chemically synthesized
aaaaggataagaattacgaata

SEQ ID NO: 92499 - DNA, 22 bp, Artificial Sequence
  chemically synthesized
cgaatatcttagccatcaattc

SEQ ID NO: 92500 - DNA, 22 bp, Artificial Sequence
  chemically synthesized
agccatcaattcctggatcagg

SEQ ID NO: 92501 - DNA, 22 bp, Artificial Sequence
  chemically synthesized
gccatcaattcctggatcagga

SEQ ID NO: 92502 - DNA, 22 bp, Artificial Sequence
  chemically synthesized
ctggatcaggagttgtgacaat

SEQ ID NO: 92503 - DNA, 22 bp, Artificial Sequence
  chemically synthesized
gatcaggagttgtgacaatgta

SEQ ID NO: 92504 - DNA, 22 bp, Artificial Sequence
  chemically synthesized
tgacaatgtaacaacgtgttat

SEQ ID NO: 92505 - DNA, 22 bp, Artificial Sequence
  chemically synthesized
tcctgttattcatccaggcttt

SEQ ID NO: 92506 - DNA, 22 bp, Artificial Sequence
  chemically synthesized
ttattcatccaggctttatgtg

SEQ ID NO: 92507 - DNA, 22 bp, Artificial Sequence
  chemically synthesized
ttcatccaggctttatgtggaa

SEQ ID NO: 92508 - DNA, 22 bp, Artificial Sequence
  chemically synthesized
atccaggctttatgtggaagaa

SEQ ID NO: 92509 - DNA, 22 bp, Artificial Sequence
  chemically synthesized
tatgtggaagaagccacagcct

SEQ ID NO: 92510 - DNA, 22 bp, Artificial Sequence
  chemically synthesized
atgtggaagaagccacagcctt

SEQ ID NO: 92511 - DNA, 22 bp, Artificial Sequence
  chemically synthesized
tgtggaagaagccacagccttt

SEQ ID NO: 92512 - DNA, 22 bp, Artificial Sequence
  chemically synthesized
tcttggttttcaattctcttga

SEQ ID NO: 92513 - DNA, 22 bp, Artificial Sequence
  chemically synthesized
cttggttttcaattctcttgag

SEQ ID NO: 92514 - DNA, 22 bp, Artificial Sequence
  chemically synthesized
ttggttttcaattctcttgaga

SEQ ID NO: 92515 - DNA, 22 bp, Artificial Sequence
  chemically synthesized
ggttttcaattctcttgagact

SEQ ID NO: 92516 - DNA, 22 bp, Artificial Sequence
  chemically synthesized
gttttcaattctcttgagacta

SEQ ID NO: 92517 - DNA, 22 bp, Artificial Sequence
  chemically synthesized
tcaattctcttgagactacatt

SEQ ID NO: 92518 - DNA, 22 bp, Artificial Sequence
  chemically synthesized
caattctcttgagactacattg

SEQ ID NO: 92519 - DNA, 22 bp, Artificial Sequence
  chemically synthesized
aattctcttgagactacattga

SEQ ID NO: 92520 - DNA, 22 bp, Artificial Sequence
  chemically synthesized
tcttgagactacattgaataca

SEQ ID NO: 92521 - DNA, 22 bp, Artificial Sequence
  chemically synthesized
ttgagactacattgaatacaca

SEQ ID NO: 92522 - DNA, 22 bp, Artificial Sequence
  chemically synthesized
gagactacattgaatacacaat

SEQ ID NO: 92523 - DNA, 22 bp, Artificial Sequence
  chemically synthesized
agactacattgaatacacaatt

SEQ ID NO: 92524 - DNA, 22 bp, Artificial Sequence
  chemically synthesized
cattgaatacacaatttcatca

SEQ ID NO: 92525 - DNA, 22 bp, Artificial Sequence
  chemically synthesized
aatacacaatttcatcagtttt

SEQ ID NO: 92526 - DNA, 22 bp, Artificial Sequence
  chemically synthesized
catcagtttttttttctttctt

SEQ ID NO: 92527 - DNA, 22 bp, Artificial Sequence
  chemically synthesized
atcagtttttttttctttcttt

SEQ ID NO: 92528 - DNA, 22 bp, Artificial Sequence
  chemically synthesized
ttttttctttctttctttcttt

SEQ ID NO: 92529 - DNA, 22 bp, Artificial Sequence
  chemically synthesized
tttttctttctttctttctttt

SEQ ID NO: 92530 - DNA, 22 bp, Artificial Sequence
  chemically synthesized
ttttctttctttctttcttttt

SEQ ID NO: 92531 - DNA, 22 bp, Artificial Sequence
  chemically synthesized
tttctttctttctttctttttc

SEQ ID NO: 92532 - DNA, 22 bp, Artificial Sequence
  chemically synthesized
ttctttctttctttctttttct

SEQ ID NO: 92533 - DNA, 22 bp, Artificial Sequence
  chemically synthesized
tctttctttctttctttttctt

SEQ ID NO: 92534 - DNA, 22 bp, Artificial Sequence
  chemically synthesized
ctttctttctttctttttcttt

SEQ ID NO: 92535 - DNA, 22 bp, Artificial Sequence
  chemically synthesized
tttctttctttctttttctttt

SEQ ID NO: 92536 - DNA, 22 bp, Artificial Sequence
  chemically synthesized
tctttctttctttttctttttt

SEQ ID NO: 92537 - DNA, 22 bp, Artificial Sequence
  chemically synthesized
ctttctttctttttcttttttt

SEQ ID NO: 92538 - DNA, 22 bp, Artificial Sequence
  chemically synthesized
tttctttctttttctttttttt

SEQ ID NO: 92539 - DNA, 22 bp, Artificial Sequence
  chemically synthesized
tctttctttttctttttttttt

SEQ ID NO: 92540 - DNA, 22 bp, Artificial Sequence
  chemically synthesized
ctttctttttcttttttttttt

SEQ ID NO: 92541 - DNA, 22 bp, Artificial Sequence
  chemically synthesized
tttctttttctttttttttttt

SEQ ID NO: 92542 - DNA, 22 bp, Artificial Sequence
  chemically synthesized
tctttttctttttttttttttt

SEQ ID NO: 92543 - DNA, 22 bp, Artificial Sequence
  chemically synthesized
ctttttcttttttttttttttt

SEQ ID NO: 92544 - DNA, 22 bp, Artificial Sequence
  chemically synthesized
tttttctttttttttttttttt

SEQ ID NO: 92545 - DNA, 22 bp, Artificial Sequence
  chemically synthesized
tttctttttttttttttttttt

SEQ ID NO: 92546 - DNA, 22 bp, Artificial Sequence
  chemically synthesized
ttcttttttttttttttttttt

SEQ ID NO: 92547 - DNA, 22 bp, Artificial Sequence
  chemically synthesized
tctttttttttttttttttttt

SEQ ID NO: 92548 - DNA, 22 bp, Artificial Sequence
  chemically synthesized
cttttttttttttttttttttg

SEQ ID NO: 92549 - DNA, 22 bp, Artificial Sequence
  chemically synthesized
ttttttttttttttttttttga

SEQ ID NO: 92550 - DNA, 22 bp, Artificial Sequence
  chemically synthesized
ttttttttttttttttttgaga

SEQ ID NO: 92551 - DNA, 22 bp, Artificial Sequence
  chemically synthesized
tttttttttttttttttgagat

SEQ ID NO: 92552 - DNA, 22 bp, Artificial Sequence
  chemically synthesized
ttttttttttttttttgagatg

SEQ ID NO: 92553 - DNA, 22 bp, Artificial Sequence
  chemically synthesized
tttttttttttttttgagatgg

SEQ ID NO: 92554 - DNA, 22 bp, Artificial Sequence
  chemically synthesized
ttttttttttttttgagatgga

SEQ ID NO: 92555 - DNA, 22 bp, Artificial Sequence
  chemically synthesized
tttttttttttttgagatggag

SEQ ID NO: 92556 - DNA, 22 bp, Artificial Sequence
  chemically synthesized
ttttttttttttgagatggagt

SEQ ID NO: 92557 - DNA, 22 bp, Artificial Sequence
  chemically synthesized
tttttttttttgagatggagtc

SEQ ID NO: 92558 - DNA, 22 bp, Artificial Sequence
  chemically synthesized
ttttttttttgagatggagtct

SEQ ID NO: 92559 - DNA, 22 bp, Artificial Sequence
  chemically synthesized
tttttttttgagatggagtctc

SEQ ID NO: 92560 - DNA, 22 bp, Artificial Sequence
  chemically synthesized
ttttttttgagatggagtctcg

SEQ ID NO: 92561 - DNA, 22 bp, Artificial Sequence
  chemically synthesized
tttttttgagatggagtctcgc

SEQ ID NO: 92562 - DNA, 22 bp, Artificial Sequence
  chemically synthesized
ttttttgagatggagtctcgct

SEQ ID NO: 92563 - DNA, 22 bp, Artificial Sequence
  chemically synthesized
tttttgagatggagtctcgctt

SEQ ID NO: 92564 - DNA, 22 bp, Artificial Sequence
  chemically synthesized
ttttgagatggagtctcgcttt

SEQ ID NO: 92565 - DNA, 22 bp, Artificial Sequence
  chemically synthesized
tttgagatggagtctcgctttg

SEQ ID NO: 92566 - DNA, 22 bp, Artificial Sequence
  chemically synthesized
ttgagatggagtctcgctttgt

SEQ ID NO: 92567 - DNA, 22 bp, Artificial Sequence
  chemically synthesized
tgagatggagtctcgctttgtc

SEQ ID NO: 92568 - DNA, 22 bp, Artificial Sequence
  chemically synthesized
gagatggagtctcgctttgtca

SEQ ID NO: 92569 - DNA, 22 bp, Artificial Sequence
  chemically synthesized
agatggagtctcgctttgtcac

SEQ ID NO: 92570 - DNA, 22 bp, Artificial Sequence
  chemically synthesized
gctttgtcacccaggctggagt

SEQ ID NO: 92571 - DNA, 22 bp, Artificial Sequence
  chemically synthesized
tgtcacccaggctggagtgtgc

SEQ ID NO: 92572 - DNA, 22 bp, Artificial Sequence
  chemically synthesized
gtcacccaggctggagtgtgca

SEQ ID NO: 92573 - DNA, 22 bp, Artificial Sequence
  chemically synthesized
tcacccaggctggagtgtgcag

SEQ ID NO: 92574 - DNA, 22 bp, Artificial Sequence
  chemically synthesized
gagtgtgcagtggcgcgatctc

SEQ ID NO: 92575 - DNA, 22 bp, Artificial Sequence
  chemically synthesized
tgctcaccgcaagctctgcctc

SEQ ID NO: 92576 - DNA, 22 bp, Artificial Sequence
  chemically synthesized
ctcaccgcaagctctgcctccc

SEQ ID NO: 92577 - DNA, 22 bp, Artificial Sequence
  chemically synthesized
accgcaagctctgcctcccagg

SEQ ID NO: 92578 - DNA, 22 bp, Artificial Sequence
  chemically synthesized
tgcctcccaggttcacgccatt

SEQ ID NO: 92579 - DNA, 22 bp, Artificial Sequence
  chemically synthesized
cctcccaggttcacgccattct

SEQ ID NO: 92580 - DNA, 22 bp, Artificial Sequence
  chemically synthesized
ccaggttcacgccattctcctg

SEQ ID NO: 92581 - DNA, 22 bp, Artificial Sequence
  chemically synthesized
acgccattctcctgcctcagcc

SEQ ID NO: 92582 - DNA, 22 bp, Artificial Sequence
  chemically synthesized
tcctgcctcagcctcccgagta

SEQ ID NO: 92583 - DNA, 22 bp, Artificial Sequence
  chemically synthesized
ctgcctcagcctcccgagtagc

SEQ ID NO: 92584 - DNA, 22 bp, Artificial Sequence
  chemically synthesized
cctcagcctcccgagtagctgg

SEQ ID NO: 92585 - DNA, 22 bp, Artificial Sequence
  chemically synthesized
agcctcccgagtagctgggact

SEQ ID NO: 92586 - DNA, 22 bp, Artificial Sequence
  chemically synthesized
ccgagtagctgggactacaggc

SEQ ID NO: 92587 - DNA, 22 bp, Artificial Sequence
  chemically synthesized
ggactacaggcacccgccactg

SEQ ID NO: 92588 - DNA, 22 bp, Artificial Sequence
  chemically synthesized
caggcacccgccactgtctctg

SEQ ID NO: 92589 - DNA, 22 bp, Artificial Sequence
  chemically synthesized
tctctggctaattttttgtatt

SEQ ID NO: 92590 - DNA, 22 bp, Artificial Sequence
  chemically synthesized
tggctaattttttgtattttta

SEQ ID NO: 92591 - DNA, 22 bp, Artificial Sequence
  chemically synthesized
gctaattttttgtatttttagt

SEQ ID NO: 92592 - DNA, 22 bp, Artificial Sequence
  chemically synthesized
attttttgtatttttagtagag

SEQ ID NO: 92593 - DNA, 22 bp, Artificial Sequence
  chemically synthesized
tttgtatttttagtagagatgg

SEQ ID NO: 92594 - DNA, 22 bp, Artificial Sequence
  chemically synthesized
ttgtatttttagtagagatggg

SEQ ID NO: 92595 - DNA, 22 bp, Artificial Sequence
  chemically synthesized
tgtatttttagtagagatgggg

SEQ ID NO: 92596 - DNA, 22 bp, Artificial Sequence
  chemically synthesized
gtatttttagtagagatggggt

SEQ ID NO: 92597 - DNA, 22 bp, Artificial Sequence
  chemically synthesized
tatttttagtagagatggggtt

SEQ ID NO: 92598 - DNA, 22 bp, Artificial Sequence
  chemically synthesized
ttagtagagatggggtttcacc

SEQ ID NO: 92599 - DNA, 22 bp, Artificial Sequence
  chemically synthesized
tagtagagatggggtttcacca

SEQ ID NO: 92600 - DNA, 22 bp, Artificial Sequence
  chemically synthesized
agtagagatggggtttcaccat

SEQ ID NO: 92601 - DNA, 22 bp, Artificial Sequence
  chemically synthesized
gtagagatggggtttcaccatg

SEQ ID NO: 92602 - DNA, 22 bp, Artificial Sequence
  chemically synthesized
caccatgttagccaggatggtc

SEQ ID NO: 92603 - DNA, 22 bp, Artificial Sequence
  chemically synthesized
accatgttagccaggatggtct

SEQ ID NO: 92604 - DNA, 22 bp, Artificial Sequence
  chemically synthesized
gccaggatggtcttgatctcct

SEQ ID NO: 92605 - DNA, 22 bp, Artificial Sequence
  chemically synthesized
gatctcctgacctcgtgatccg

SEQ ID NO: 92606 - DNA, 22 bp, Artificial Sequence
  chemically synthesized
atctcctgacctcgtgatccgc

SEQ ID NO: 92607 - DNA, 22 bp, Artificial Sequence
  chemically synthesized
ctgacctcgtgatccgcccacc

SEQ ID NO: 92608 - DNA, 22 bp, Artificial Sequence
  chemically synthesized
acctcgtgatccgcccacctca

SEQ ID NO: 92609 - DNA, 22 bp, Artificial Sequence
  chemically synthesized
gtgatccgcccacctcagcctc

SEQ ID NO: 92610 - DNA, 22 bp, Artificial Sequence
  chemically synthesized
agcctcccaaagtgctgggatt

SEQ ID NO: 92611 - DNA, 22 bp, Artificial Sequence
  chemically synthesized
ccaaagtgctgggattacaggt

SEQ ID NO: 92612 - DNA, 22 bp, Artificial Sequence
  chemically synthesized
ggattacaggtgtgagccaccg

SEQ ID NO: 92613 - DNA, 22 bp, Artificial Sequence
  chemically synthesized
caggtgtgagccaccgcgcccg

SEQ ID NO: 92614 - DNA, 22 bp, Artificial Sequence
  chemically synthesized
catcactttttagaatagaaat

SEQ ID NO: 92615 - DNA, 22 bp, Artificial Sequence
  chemically synthesized
atcactttttagaatagaaata

SEQ ID NO: 92616 - DNA, 22 bp, Artificial Sequence
  chemically synthesized
tttagaatagaaataaacacct

SEQ ID NO: 92617 - DNA, 22 bp, Artificial Sequence
  chemically synthesized
ttagaatagaaataaacacctc

SEQ ID NO: 92618 - DNA, 22 bp, Artificial Sequence
  chemically synthesized
tagaatagaaataaacacctct

SEQ ID NO: 92619 - DNA, 22 bp, Artificial Sequence
  chemically synthesized
agaatagaaataaacacctcta

SEQ ID NO: 92620 - DNA, 22 bp, Artificial Sequence
  chemically synthesized
gaatagaaataaacacctctat

SEQ ID NO: 92621 - DNA, 22 bp, Artificial Sequence
  chemically synthesized
tatccagcatcaacttggaaga

SEQ ID NO: 92622 - DNA, 22 bp, Artificial Sequence
  chemically synthesized
tccagcatcaacttggaagaaa

SEQ ID NO: 92623 - DNA, 22 bp, Artificial Sequence
  chemically synthesized
ggaagaaagcagaataagaaac

SEQ ID NO: 92624 - DNA, 22 bp, Artificial Sequence
  chemically synthesized
gaagaaagcagaataagaaaca

SEQ ID NO: 92625 - DNA, 22 bp, Artificial Sequence
  chemically synthesized
gggaagtaaggggaaaactggg

SEQ ID NO: 92626 - DNA, 22 bp, Artificial Sequence
  chemically synthesized
ggttttattactgtgtttttta

SEQ ID NO: 92627 - DNA, 22 bp, Artificial Sequence
  chemically synthesized
tattactgtgttttttaatcca

SEQ ID NO: 92628 - DNA, 22 bp, Artificial Sequence
  chemically synthesized
attactgtgttttttaatccat

SEQ ID NO: 92629 - DNA, 22 bp, Artificial Sequence
  chemically synthesized
ttactgtgttttttaatccatt

SEQ ID NO: 92630 - DNA, 22 bp, Artificial Sequence
  chemically synthesized
ctgtgttttttaatccatttag

SEQ ID NO: 92631 - DNA, 22 bp, Artificial Sequence
  chemically synthesized
tgttttttaatccatttagtag

SEQ ID NO: 92632 - DNA, 22 bp, Artificial Sequence
  chemically synthesized
tttaatccatttagtagtcagt

SEQ ID NO: 92633 - DNA, 22 bp, Artificial Sequence
  chemically synthesized
ttaatccatttagtagtcagtg

SEQ ID NO: 92634 - DNA, 22 bp, Artificial Sequence
  chemically synthesized
taatccatttagtagtcagtgt

SEQ ID NO: 92635 - DNA, 22 bp, Artificial Sequence
  chemically synthesized
aatccatttagtagtcagtgta

SEQ ID NO: 92636 - DNA, 22 bp, Artificial Sequence
  chemically synthesized
atccatttagtagtcagtgtac

SEQ ID NO: 92637 - DNA, 22 bp, Artificial Sequence
  chemically synthesized
agtagtcagtgtacttatctga

SEQ ID NO: 92638 - DNA, 22 bp, Artificial Sequence
  chemically synthesized
gtagtcagtgtacttatctgaa

SEQ ID NO: 92639 - DNA, 22 bp, Artificial Sequence
  chemically synthesized
atctgaacaaaggagatttcct

SEQ ID NO: 92640 - DNA, 22 bp, Artificial Sequence
  chemically synthesized
tctgaacaaaggagatttcctc

SEQ ID NO: 92641 - DNA, 22 bp, Artificial Sequence
  chemically synthesized
aacaaaggagatttcctctgaa

SEQ ID NO: 92642 - DNA, 22 bp, Artificial Sequence
  chemically synthesized
cctctgaatcattgaacaatag

SEQ ID NO: 92643 - DNA, 22 bp, Artificial Sequence
  chemically synthesized
ctctgaatcattgaacaatagt

SEQ ID NO: 92644 - DNA, 22 bp, Artificial Sequence
  chemically synthesized
tgaatcattgaacaatagtcca

SEQ ID NO: 92645 - DNA, 22 bp, Artificial Sequence
  chemically synthesized
aatcattgaacaatagtccatg

SEQ ID NO: 92646 - DNA, 22 bp, Artificial Sequence
  chemically synthesized
aacaatagtccatgtcaaatcc

SEQ ID NO: 92647 - DNA, 22 bp, Artificial Sequence
  chemically synthesized
catatctacaaaattatgccag

SEQ ID NO: 92648 - DNA, 22 bp, Artificial Sequence
  chemically synthesized
caaaattatgccagaacatcta

SEQ ID NO: 92649 - DNA, 22 bp, Artificial Sequence
  chemically synthesized
tgccagaacatctaatagtgtt

SEQ ID NO: 92650 - DNA, 22 bp, Artificial Sequence
  chemically synthesized
atagtgttgggggagaagtgtg

SEQ ID NO: 92651 - DNA, 22 bp, Artificial Sequence
  chemically synthesized
ggggagaagtgtgctgctctgt

SEQ ID NO: 92652 - DNA, 22 bp, Artificial Sequence
  chemically synthesized
ctctgttcaagcaagaggatag

SEQ ID NO: 92653 - DNA, 22 bp, Artificial Sequence
  chemically synthesized
tgttcaagcaagaggataggag

SEQ ID NO: 92654 - DNA, 22 bp, Artificial Sequence
  chemically synthesized
ttcaagcaagaggataggagat

SEQ ID NO: 92655 - DNA, 22 bp, Artificial Sequence
  chemically synthesized
aagcaagaggataggagattcc

SEQ ID NO: 92656 - DNA, 22 bp, Artificial Sequence
  chemically synthesized
cgtggcccgtgctgggcattag

SEQ ID NO: 92657 - DNA, 22 bp, Artificial Sequence
  chemically synthesized
ggcattaggtcatttgtgtctg

SEQ ID NO: 92658 - DNA, 22 bp, Artificial Sequence
  chemically synthesized
ggtcatttgtgtctggcacagg

SEQ ID NO: 92659 - DNA, 22 bp, Artificial Sequence
  chemically synthesized
gtgtctggcacaggcttgatct

SEQ ID NO: 92660 - DNA, 22 bp, Artificial Sequence
  chemically synthesized
tgtctggcacaggcttgatcta

SEQ ID NO: 92661 - DNA, 22 bp, Artificial Sequence
  chemically synthesized
gcacaggcttgatctatagtct

SEQ ID NO: 92662 - DNA, 22 bp, Artificial Sequence
  chemically synthesized
gatctatagtctaatgctgtgt

SEQ ID NO: 92663 - DNA, 22 bp, Artificial Sequence
  chemically synthesized
atctatagtctaatgctgtgtt

SEQ ID NO: 92664 - DNA, 22 bp, Artificial Sequence
  chemically synthesized
tagtctaatgctgtgtttaact

SEQ ID NO: 92665 - DNA, 22 bp, Artificial Sequence
  chemically synthesized
atgctgtgtttaacttgtcttt

SEQ ID NO: 92666 - DNA, 22 bp, Artificial Sequence
  chemically synthesized
tgtttaacttgtctttatatct

SEQ ID NO: 92667 - DNA, 22 bp, Artificial Sequence
  chemically synthesized
aacttgtctttatatctaatca

SEQ ID NO: 92668 - DNA, 22 bp, Artificial Sequence
  chemically synthesized
acttgtctttatatctaatcag

SEQ ID NO: 92669 - DNA, 22 bp, Artificial Sequence
  chemically synthesized
gtctttatatctaatcaggcaa

SEQ ID NO: 92670 - DNA, 22 bp, Artificial Sequence
  chemically synthesized
tctttatatctaatcaggcaaa

SEQ ID NO: 92671 - DNA, 22 bp, Artificial Sequence
  chemically synthesized
tatatctaatcaggcaaagaca

SEQ ID NO: 92672 - DNA, 22 bp, Artificial Sequence
  chemically synthesized
atatctaatcaggcaaagacat

SEQ ID NO: 92673 - DNA, 22 bp, Artificial Sequence
  chemically synthesized
tatctaatcaggcaaagacatt

SEQ ID NO: 92674 - DNA, 22 bp, Artificial Sequence
  chemically synthesized
atcaggcaaagacattcttcac

SEQ ID NO: 92675 - DNA, 22 bp, Artificial Sequence
  chemically synthesized
ttcactgacaatattccacagg

SEQ ID NO: 92676 - DNA, 22 bp, Artificial Sequence
  chemically synthesized
cactgacaatattccacaggct

SEQ ID NO: 92677 - DNA, 22 bp, Artificial Sequence
  chemically synthesized
actgacaatattccacaggctg

SEQ ID NO: 92678 - DNA, 22 bp, Artificial Sequence
  chemically synthesized
acaatattccacaggctgctgc

SEQ ID NO: 92679 - DNA, 22 bp, Artificial Sequence
  chemically synthesized
cacaggctgctgcacgtgtctc

SEQ ID NO: 92680 - DNA, 22 bp, Artificial Sequence
  chemically synthesized
ctgcacgtgtctcatgtgctgc

SEQ ID NO: 92681 - DNA, 22 bp, Artificial Sequence
  chemically synthesized
cacgtgtctcatgtgctgcacg

SEQ ID NO: 92682 - DNA, 22 bp, Artificial Sequence
  chemically synthesized
atgtgctgcacgtctcatgcgt

SEQ ID NO: 92683 - DNA, 22 bp, Artificial Sequence
  chemically synthesized
cacgtctcatgcgtctcaaaca

SEQ ID NO: 92684 - DNA, 22 bp, Artificial Sequence
  chemically synthesized
atgcgtctcaaacaagcaattt

SEQ ID NO: 92685 - DNA, 22 bp, Artificial Sequence
  chemically synthesized
aaacaagcaatttcaggaatag

SEQ ID NO: 92686 - DNA, 22 bp, Artificial Sequence
  chemically synthesized
caggaatagacagggcacactt

SEQ ID NO: 92687 - DNA, 22 bp, Artificial Sequence
  chemically synthesized
aggaatagacagggcacacttc

SEQ ID NO: 92688 - DNA, 22 bp, Artificial Sequence
  chemically synthesized
ccaccggcagagagaagaacag

SEQ ID NO: 92689 - DNA, 22 bp, Artificial Sequence
  chemically synthesized
caccggcagagagaagaacagt

SEQ ID NO: 92690 - DNA, 22 bp, Artificial Sequence
  chemically synthesized
attttatattcttaaggcttac

SEQ ID NO: 92691 - DNA, 22 bp, Artificial Sequence
  chemically synthesized
ttttatattcttaaggcttact

SEQ ID NO: 92692 - DNA, 22 bp, Artificial Sequence
  chemically synthesized
tatattcttaaggcttactgtc

SEQ ID NO: 92693 - DNA, 22 bp, Artificial Sequence
  chemically synthesized
atattcttaaggcttactgtcc

SEQ ID NO: 92694 - DNA, 22 bp, Artificial Sequence
  chemically synthesized
tattcttaaggcttactgtcct

SEQ ID NO: 92695 - DNA, 22 bp, Artificial Sequence
  chemically synthesized
ttaaggcttactgtcctcatac

SEQ ID NO: 92696 - DNA, 22 bp, Artificial Sequence
  chemically synthesized
aaggcttactgtcctcatactt

SEQ ID NO: 92697 - DNA, 22 bp, Artificial Sequence
  chemically synthesized
aggcttactgtcctcatactta

SEQ ID NO: 92698 - DNA, 22 bp, Artificial Sequence
  chemically synthesized
actgtcctcatacttagaggtt

SEQ ID NO: 92699 - DNA, 22 bp, Artificial Sequence
  chemically synthesized
ctgtcctcatacttagaggttc

SEQ ID NO: 92700 - DNA, 22 bp, Artificial Sequence
  chemically synthesized
tcctcatacttagaggttcagg

SEQ ID NO: 92701 - DNA, 22 bp, Artificial Sequence
  chemically synthesized
atacttagaggttcaggatgct

SEQ ID NO: 92702 - DNA, 22 bp, Artificial Sequence
  chemically synthesized
agaggttcaggatgctggtttg

SEQ ID NO: 92703 - DNA, 22 bp, Artificial Sequence
  chemically synthesized
gaggttcaggatgctggtttgt

SEQ ID NO: 92704 - DNA, 22 bp, Artificial Sequence
  chemically synthesized
aggatgctggtttgtgtgttac

SEQ ID NO: 92705 - DNA, 22 bp, Artificial Sequence
  chemically synthesized
gtttgtgtgttacccctgagat

SEQ ID NO: 92706 - DNA, 22 bp, Artificial Sequence
  chemically synthesized
gtgtgttacccctgagataaat

SEQ ID NO: 92707 - DNA, 22 bp, Artificial Sequence
  chemically synthesized
tgtgttacccctgagataaatc

SEQ ID NO: 92708 - DNA, 22 bp, Artificial Sequence
  chemically synthesized
cccctgagataaatccttacaa

SEQ ID NO: 92709 - DNA, 22 bp, Artificial Sequence
  chemically synthesized
agataaatccttacaagaaata

SEQ ID NO: 92710 - DNA, 22 bp, Artificial Sequence
  chemically synthesized
acaagaaataaagtttaggaaa

SEQ ID NO: 92711 - DNA, 22 bp, Artificial Sequence
  chemically synthesized
caagaaataaagtttaggaaat

SEQ ID NO: 92712 - DNA, 22 bp, Artificial Sequence
  chemically synthesized
aggaaatcacccccatgtgtat

SEQ ID NO: 92713 - DNA, 22 bp, Artificial Sequence
  chemically synthesized
ggaaatcacccccatgtgtatt

SEQ ID NO: 92714 - DNA, 22 bp, Artificial Sequence
  chemically synthesized
caaggagactctaaatttcaaa

SEQ ID NO: 92715 - DNA, 22 bp, Artificial Sequence
  chemically synthesized
aaggagactctaaatttcaaag

SEQ ID NO: 92716 - DNA, 22 bp, Artificial Sequence
  chemically synthesized
taaatttcaaagagttaaaccc

SEQ ID NO: 92717 - DNA, 22 bp, Artificial Sequence
  chemically synthesized
aatttcaaagagttaaacccaa

SEQ ID NO: 92718 - DNA, 22 bp, Artificial Sequence
  chemically synthesized
caaagagttaaacccaatatat

SEQ ID NO: 92719 - DNA, 22 bp, Artificial Sequence
  chemically synthesized
aaagagttaaacccaatatatt

SEQ ID NO: 92720 - DNA, 22 bp, Artificial Sequence
  chemically synthesized
aacccaatatattaaagctgaa

SEQ ID NO: 92721 - DNA, 22 bp, Artificial Sequence
  chemically synthesized
aagctgaatttctgatattaga

SEQ ID NO: 92722 - DNA, 22 bp, Artificial Sequence
  chemically synthesized
aatttctgatattagagacaca

SEQ ID NO: 92723 - DNA, 22 bp, Artificial Sequence
  chemically synthesized
ctgatattagagacacaatatt

SEQ ID NO: 92724 - DNA, 22 bp, Artificial Sequence
  chemically synthesized
tgatattagagacacaatattt

SEQ ID NO: 92725 - DNA, 22 bp, Artificial Sequence
  chemically synthesized
atattagagacacaatatttta

SEQ ID NO: 92726 - DNA, 22 bp, Artificial Sequence
  chemically synthesized
gagacacaatattttagtctac

SEQ ID NO: 92727 - DNA, 22 bp, Artificial Sequence
  chemically synthesized
tagtctacttgatatagttgag

SEQ ID NO: 92728 - DNA, 22 bp, Artificial Sequence
  chemically synthesized
agtctacttgatatagttgaga

SEQ ID NO: 92729 - DNA, 22 bp, Artificial Sequence
  chemically synthesized
gtctacttgatatagttgagag

SEQ ID NO: 92730 - DNA, 22 bp, Artificial Sequence
  chemically synthesized
cttgatatagttgagaggcagt

SEQ ID NO: 92731 - DNA, 22 bp, Artificial Sequence
  chemically synthesized
gatatagttgagaggcagttac

SEQ ID NO: 92732 - DNA, 22 bp, Artificial Sequence
  chemically synthesized
atatagttgagaggcagttacc

SEQ ID NO: 92733 - DNA, 22 bp, Artificial Sequence
  chemically synthesized
agaggcagttacctgttttact

SEQ ID NO: 92734 - DNA, 22 bp, Artificial Sequence
  chemically synthesized
cctgttttacttaggaacatgg

SEQ ID NO: 92735 - DNA, 22 bp, Artificial Sequence
  chemically synthesized
ttttacttaggaacatggggaa

SEQ ID NO: 92736 - DNA, 22 bp, Artificial Sequence
  chemically synthesized
tacttaggaacatggggaaagt

SEQ ID NO: 92737 - DNA, 22 bp, Artificial Sequence
  chemically synthesized
acttaggaacatggggaaagtt

SEQ ID NO: 92738 - DNA, 22 bp, Artificial Sequence
  chemically synthesized
cttaggaacatggggaaagttt

SEQ ID NO: 92739 - DNA, 22 bp, Artificial Sequence
  chemically synthesized
aggaacatggggaaagtttgta

SEQ ID NO: 92740 - DNA, 22 bp, Artificial Sequence
  chemically synthesized
ggaacatggggaaagtttgtag

SEQ ID NO: 92741 - DNA, 22 bp, Artificial Sequence
  chemically synthesized
gtagtgacaaacagtttgaggc

SEQ ID NO: 92742 - DNA, 22 bp, Artificial Sequence
  chemically synthesized
tagtgacaaacagtttgaggca

SEQ ID NO: 92743 - DNA, 22 bp, Artificial Sequence
  chemically synthesized
gaggcaaaaccaagattatctt

SEQ ID NO: 92744 - DNA, 22 bp, Artificial Sequence
  chemically synthesized
aggcaaaaccaagattatcttt

SEQ ID NO: 92745 - DNA, 22 bp, Artificial Sequence
  chemically synthesized
tctttaagagcagagatcgatg

SEQ ID NO: 92746 - DNA, 22 bp, Artificial Sequence
  chemically synthesized
taagagcagagatcgatgatat

SEQ ID NO: 92747 - DNA, 22 bp, Artificial Sequence
  chemically synthesized
aagagcagagatcgatgatatg

SEQ ID NO: 92748 - DNA, 22 bp, Artificial Sequence
  chemically synthesized
agagcagagatcgatgatatga

SEQ ID NO: 92749 - DNA, 22 bp, Artificial Sequence
  chemically synthesized
tgactatatgcaggaaacacat

SEQ ID NO: 92750 - DNA, 22 bp, Artificial Sequence
  chemically synthesized
gactatatgcaggaaacacatt

SEQ ID NO: 92751 - DNA, 22 bp, Artificial Sequence
  chemically synthesized
actatatgcaggaaacacattt

SEQ ID NO: 92752 - DNA, 22 bp, Artificial Sequence
  chemically synthesized
tatgcaggaaacacatttatat

SEQ ID NO: 92753 - DNA, 22 bp, Artificial Sequence
  chemically synthesized
atattgagttgtggggactggc

SEQ ID NO: 92754 - DNA, 22 bp, Artificial Sequence
  chemically synthesized
tattgagttgtggggactggcc

SEQ ID NO: 92755 - DNA, 22 bp, Artificial Sequence
  chemically synthesized
agttgtggggactggcctcaga

SEQ ID NO: 92756 - DNA, 22 bp, Artificial Sequence
  chemically synthesized
tggggactggcctcagaggaaa

SEQ ID NO: 92757 - DNA, 22 bp, Artificial Sequence
  chemically synthesized
gcctcagaggaaacttcaggtc

SEQ ID NO: 92758 - DNA, 22 bp, Artificial Sequence
  chemically synthesized
agaggaaacttcaggtcatgtc

SEQ ID NO: 92759 - DNA, 22 bp, Artificial Sequence
  chemically synthesized
caggtcatgtcctttaatggcc

SEQ ID NO: 92760 - DNA, 22 bp, Artificial Sequence
  chemically synthesized
aggtcatgtcctttaatggccc

SEQ ID NO: 92761 - DNA, 22 bp, Artificial Sequence
  chemically synthesized
taatggccctaaaactcattcc

SEQ ID NO: 92762 - DNA, 22 bp, Artificial Sequence
  chemically synthesized
aatggccctaaaactcattccc

SEQ ID NO: 92763 - DNA, 22 bp, Artificial Sequence
  chemically synthesized
atggccctaaaactcattccca

SEQ ID NO: 92764 - DNA, 22 bp, Artificial Sequence
  chemically synthesized
aaactcattcccaaaagaattt

SEQ ID NO: 92765 - DNA, 22 bp, Artificial Sequence
  chemically synthesized
attcccaaaagaatttctgttc

SEQ ID NO: 92766 - DNA, 22 bp, Artificial Sequence
  chemically synthesized
ccaaaagaatttctgttcattg

SEQ ID NO: 92767 - DNA, 22 bp, Artificial Sequence
  chemically synthesized
ctgttcattgccatacctcata

SEQ ID NO: 92768 - DNA, 22 bp, Artificial Sequence
  chemically synthesized
tgttcattgccatacctcatat

SEQ ID NO: 92769 - DNA, 22 bp, Artificial Sequence
  chemically synthesized
ttcattgccatacctcatatcc

SEQ ID NO: 92770 - DNA, 22 bp, Artificial Sequence
  chemically synthesized
attgccatacctcatatcctta

SEQ ID NO: 92771 - DNA, 22 bp, Artificial Sequence
  chemically synthesized
ccatacctcatatccttaggta

SEQ ID NO: 92772 - DNA, 22 bp, Artificial Sequence
  chemically synthesized
atatccttaggtacatacatct

SEQ ID NO: 92773 - DNA, 22 bp, Artificial Sequence
  chemically synthesized
aggtacatacatctaaaaccct

SEQ ID NO: 92774 - DNA, 22 bp, Artificial Sequence
  chemically synthesized
ggtacatacatctaaaaccctg

SEQ ID NO: 92775 - DNA, 22 bp, Artificial Sequence
  chemically synthesized
aaaccctgcgtaccagtgaaca

SEQ ID NO: 92776 - DNA, 22 bp, Artificial Sequence
  chemically synthesized
cgtaccagtgaacagctgcccc

SEQ ID NO: 92777 - DNA, 22 bp, Artificial Sequence
  chemically synthesized
ccccatctttccatcagccaac

SEQ ID NO: 92778 - DNA, 22 bp, Artificial Sequence
  chemically synthesized
tccatcagccaaccaggaattc

SEQ ID NO: 92779 - DNA, 22 bp, Artificial Sequence
  chemically synthesized
ccatcagccaaccaggaattca

SEQ ID NO: 92780 - DNA, 22 bp, Artificial Sequence
  chemically synthesized
catcagccaaccaggaattcag

SEQ ID NO: 92781 - DNA, 22 bp, Artificial Sequence
  chemically synthesized
agcagttactgctaacttccac

SEQ ID NO: 92782 - DNA, 22 bp, Artificial Sequence
  chemically synthesized
ctgctaacttccacttttctct

SEQ ID NO: 92783 - DNA, 22 bp, Artificial Sequence
  chemically synthesized
ctaacttccacttttctctcac

SEQ ID NO: 92784 - DNA, 22 bp, Artificial Sequence
  chemically synthesized
acttccacttttctctcacccg

SEQ ID NO: 92785 - DNA, 22 bp, Artificial Sequence
  chemically synthesized
ccacttttctctcacccgctcc

SEQ ID NO: 92786 - DNA, 22 bp, Artificial Sequence
  chemically synthesized
cacttttctctcacccgctcca

SEQ ID NO: 92787 - DNA, 22 bp, Artificial Sequence
  chemically synthesized
ttctctcacccgctccaggaaa

SEQ ID NO: 92788 - DNA, 22 bp, Artificial Sequence
  chemically synthesized
tctctcacccgctccaggaaaa

SEQ ID NO: 92789 - DNA, 22 bp, Artificial Sequence
  chemically synthesized
ctctcacccgctccaggaaaag

SEQ ID NO: 92790 - DNA, 22 bp, Artificial Sequence
  chemically synthesized
tctcacccgctccaggaaaagt

SEQ ID NO: 92791 - DNA, 22 bp, Artificial Sequence
  chemically synthesized
tcacccgctccaggaaaagtga

SEQ ID NO: 92792 - DNA, 22 bp, Artificial Sequence
  chemically synthesized
acccgctccaggaaaagtgacc

SEQ ID NO: 92793 - DNA, 22 bp, Artificial Sequence
  chemically synthesized
caggaaaagtgacctgcagtca

SEQ ID NO: 92794 - DNA, 22 bp, Artificial Sequence
  chemically synthesized
cagtcactttcctggaagtatt

SEQ ID NO: 92795 - DNA, 22 bp, Artificial Sequence
  chemically synthesized
tcctggaagtattgattctttc

SEQ ID NO: 92796 - DNA, 22 bp, Artificial Sequence
  chemically synthesized
cctggaagtattgattctttct

SEQ ID NO: 92797 - DNA, 22 bp, Artificial Sequence
  chemically synthesized
ctggaagtattgattctttctt

SEQ ID NO: 92798 - DNA, 22 bp, Artificial Sequence
  chemically synthesized
gaagtattgattctttcttgtt

SEQ ID NO: 92799 - DNA, 22 bp, Artificial Sequence
  chemically synthesized
attctttcttgtttgtggctgt

SEQ ID NO: 92800 - DNA, 22 bp, Artificial Sequence
  chemically synthesized
tttcttgtttgtggctgttccc

SEQ ID NO: 92801 - DNA, 22 bp, Artificial Sequence
  chemically synthesized
tcttgtttgtggctgttcccca

SEQ ID NO: 92802 - DNA, 22 bp, Artificial Sequence
  chemically synthesized
cttgtttgtggctgttccccat

SEQ ID NO: 92803 - DNA, 22 bp, Artificial Sequence
  chemically synthesized
ttgtttgtggctgttccccatt

SEQ ID NO: 92804 - DNA, 22 bp, Artificial Sequence
  chemically synthesized
gtttgtggctgttccccatttc

SEQ ID NO: 92805 - DNA, 22 bp, Artificial Sequence
  chemically synthesized
tttgtggctgttccccatttcc

SEQ ID NO: 92806 - DNA, 22 bp, Artificial Sequence
  chemically synthesized
gtggctgttccccatttccaat

SEQ ID NO: 92807 - DNA, 22 bp, Artificial Sequence
  chemically synthesized
tggctgttccccatttccaatt

SEQ ID NO: 92808 - DNA, 22 bp, Artificial Sequence
  chemically synthesized
ttccccatttccaattgttttc

SEQ ID NO: 92809 - DNA, 22 bp, Artificial Sequence
  chemically synthesized
cccatttccaattgttttccat

SEQ ID NO: 92810 - DNA, 22 bp, Artificial Sequence
  chemically synthesized
ccaattgttttccatgattatt

SEQ ID NO: 92811 - DNA, 22 bp, Artificial Sequence
  chemically synthesized
caattgttttccatgattattg

SEQ ID NO: 92812 - DNA, 22 bp, Artificial Sequence
  chemically synthesized
ttttccatgattattgcttcta

SEQ ID NO: 92813 - DNA, 22 bp, Artificial Sequence
  chemically synthesized
tccatgattattgcttctactg

SEQ ID NO: 92814 - DNA, 22 bp, Artificial Sequence
  chemically synthesized
ccatgattattgcttctactgt

SEQ ID NO: 92815 - DNA, 22 bp, Artificial Sequence
  chemically synthesized
catgattattgcttctactgtg

SEQ ID NO: 92816 - DNA, 22 bp, Artificial Sequence
  chemically synthesized
ttgcttctactgtgatctatag

SEQ ID NO: 92817 - DNA, 22 bp, Artificial Sequence
  chemically synthesized
cttctactgtgatctatagact

SEQ ID NO: 92818 - DNA, 22 bp, Artificial Sequence
  chemically synthesized
ctactgtgatctatagactctt

SEQ ID NO: 92819 - DNA, 22 bp, Artificial Sequence
  chemically synthesized
tactgtgatctatagactctta

SEQ ID NO: 92820 - DNA, 22 bp, Artificial Sequence
  chemically synthesized
ctgtgatctatagactcttata

SEQ ID NO: 92821 - DNA, 22 bp, Artificial Sequence
  chemically synthesized
tgatctatagactcttatatca

SEQ ID NO: 92822 - DNA, 22 bp, Artificial Sequence
  chemically synthesized
tagactcttatatcatcaatac

SEQ ID NO: 92823 - DNA, 22 bp, Artificial Sequence
  chemically synthesized
ttatatcatcaataccaggtta

SEQ ID NO: 92824 - DNA, 22 bp, Artificial Sequence
  chemically synthesized
atatcatcaataccaggttatc

SEQ ID NO: 92825 - DNA, 22 bp, Artificial Sequence
  chemically synthesized
tatcatcaataccaggttatca

SEQ ID NO: 92826 - DNA, 22 bp, Artificial Sequence
  chemically synthesized
tcattgcagttgtcaacttctc

SEQ ID NO: 92827 - DNA, 22 bp, Artificial Sequence
  chemically synthesized
cagttgtcaacttctctctgtt

SEQ ID NO: 92828 - DNA, 22 bp, Artificial Sequence
  chemically synthesized
tcaacttctctctgttgcatct

SEQ ID NO: 92829 - DNA, 22 bp, Artificial Sequence
  chemically synthesized
ctctctgttgcatcttatgcat

SEQ ID NO: 92830 - DNA, 22 bp, Artificial Sequence
  chemically synthesized
tctctgttgcatcttatgcatt

SEQ ID NO: 92831 - DNA, 22 bp, Artificial Sequence
  chemically synthesized
tctgttgcatcttatgcattaa

SEQ ID NO: 92832 - DNA, 22 bp, Artificial Sequence
  chemically synthesized
tgttgcatcttatgcattaatt

SEQ ID NO: 92833 - DNA, 22 bp, Artificial Sequence
  chemically synthesized
ttgcatcttatgcattaattca

SEQ ID NO: 92834 - DNA, 22 bp, Artificial Sequence
  chemically synthesized
catcttatgcattaattcaaca

SEQ ID NO: 92835 - DNA, 22 bp, Artificial Sequence
  chemically synthesized
atgcattaattcaacaaataca

SEQ ID NO: 92836 - DNA, 22 bp, Artificial Sequence
  chemically synthesized
tgcattaattcaacaaatacat

SEQ ID NO: 92837 - DNA, 22 bp, Artificial Sequence
  chemically synthesized
attcaacaaatacatattagat

SEQ ID NO: 92838 - DNA, 22 bp, Artificial Sequence
  chemically synthesized
aacaaatacatattagattcca

SEQ ID NO: 92839 - DNA, 22 bp, Artificial Sequence
  chemically synthesized
gattccatatgtcatccatgaa

SEQ ID NO: 92840 - DNA, 22 bp, Artificial Sequence
  chemically synthesized
catatgtcatccatgaagtttc

SEQ ID NO: 92841 - DNA, 22 bp, Artificial Sequence
  chemically synthesized
cattcatatgccatccattttt

SEQ ID NO: 92842 - DNA, 22 bp, Artificial Sequence
  chemically synthesized
attcatatgccatccatttttc

SEQ ID NO: 92843 - DNA, 22 bp, Artificial Sequence
  chemically synthesized
atatgccatccatttttcttaa

SEQ ID NO: 92844 - DNA, 22 bp, Artificial Sequence
  chemically synthesized
ttcttaattctgagaatcttac

SEQ ID NO: 92845 - DNA, 22 bp, Artificial Sequence
  chemically synthesized
tcttaattctgagaatcttaca

SEQ ID NO: 92846 - DNA, 22 bp, Artificial Sequence
  chemically synthesized
cttaattctgagaatcttacat

SEQ ID NO: 92847 - DNA, 22 bp, Artificial Sequence
  chemically synthesized
ttaattctgagaatcttacatg

SEQ ID NO: 92848 - DNA, 22 bp, Artificial Sequence
  chemically synthesized
aattctgagaatcttacatgaa

SEQ ID NO: 92849 - DNA, 22 bp, Artificial Sequence
  chemically synthesized
attctgagaatcttacatgaac

SEQ ID NO: 92850 - DNA, 22 bp, Artificial Sequence
  chemically synthesized
tgagaatcttacatgaactaga

SEQ ID NO: 92851 - DNA, 22 bp, Artificial Sequence
  chemically synthesized
agaatcttacatgaactagaca

SEQ ID NO: 92852 - DNA, 22 bp, Artificial Sequence
  chemically synthesized
acatgaactagacagacagatt

SEQ ID NO: 92853 - DNA, 22 bp, Artificial Sequence
  chemically synthesized
catgaactagacagacagattc

SEQ ID NO: 92854 - DNA, 22 bp, Artificial Sequence
  chemically synthesized
gacagacagattctctggctaa

SEQ ID NO: 92855 - DNA, 22 bp, Artificial Sequence
  chemically synthesized
tctggctaatggtgccctcact

SEQ ID NO: 92856 - DNA, 22 bp, Artificial Sequence
  chemically synthesized
tggctaatggtgccctcactat

SEQ ID NO: 92857 - DNA, 22 bp, Artificial Sequence
  chemically synthesized
gctaatggtgccctcactatag

SEQ ID NO: 92858 - DNA, 22 bp, Artificial Sequence
  chemically synthesized
atggtgccctcactatagtgag

SEQ ID NO: 92859 - DNA, 22 bp, Artificial Sequence
  chemically synthesized
actatagtgagcagaggagacc

SEQ ID NO: 92860 - DNA, 22 bp, Artificial Sequence
  chemically synthesized
tagtgagcagaggagaccagca

SEQ ID NO: 92861 - DNA, 22 bp, Artificial Sequence
  chemically synthesized
aaagaaatgaattaataagaga

SEQ ID NO: 92862 - DNA, 22 bp, Artificial Sequence
  chemically synthesized
ataagagatttcagatggtatt

SEQ ID NO: 92863 - DNA, 22 bp, Artificial Sequence
  chemically synthesized
cagatggtattatatgacttga

SEQ ID NO: 92864 - DNA, 22 bp, Artificial Sequence
  chemically synthesized
agatggtattatatgacttgaa

SEQ ID NO: 92865 - DNA, 22 bp, Artificial Sequence
  chemically synthesized
tatgacttgaagaaactgcata

SEQ ID NO: 92866 - DNA, 22 bp, Artificial Sequence
  chemically synthesized
gaagaaactgcatattgtacct

SEQ ID NO: 92867 - DNA, 22 bp, Artificial Sequence
  chemically synthesized
aagaaactgcatattgtaccta

SEQ ID NO: 92868 - DNA, 22 bp, Artificial Sequence
  chemically synthesized
catattgtacctacaaccatct

SEQ ID NO: 92869 - DNA, 22 bp, Artificial Sequence
  chemically synthesized
tacctacaaccatctggtcttt

SEQ ID NO: 92870 - DNA, 22 bp, Artificial Sequence
  chemically synthesized
caaccatctggtcttttagaaa

SEQ ID NO: 92871 - DNA, 22 bp, Artificial Sequence
  chemically synthesized
gtcttttagaaacctgacaaaa

SEQ ID NO: 92872 - DNA, 22 bp, Artificial Sequence
  chemically synthesized
ttagaaacctgacaaaagcaag

SEQ ID NO: 92873 - DNA, 22 bp, Artificial Sequence
  chemically synthesized
tagaaacctgacaaaagcaagc

SEQ ID NO: 92874 - DNA, 22 bp, Artificial Sequence
  chemically synthesized
agaaacctgacaaaagcaagca

SEQ ID NO: 92875 - DNA, 22 bp, Artificial Sequence
  chemically synthesized
gaaacctgacaaaagcaagcaa

SEQ ID NO: 92876 - DNA, 22 bp, Artificial Sequence
  chemically synthesized
acaaaagcaagcaatggggaaa

SEQ ID NO: 92877 - DNA, 22 bp, Artificial Sequence
  chemically synthesized
tcaatttaataaatgatggggg

SEQ ID NO: 92878 - DNA, 22 bp, Artificial Sequence
  chemically synthesized
caatttaataaatgatggggga

SEQ ID NO: 92879 - DNA, 22 bp, Artificial Sequence
  chemically synthesized
aatttaataaatgatgggggag

SEQ ID NO: 92880 - DNA, 22 bp, Artificial Sequence
  chemically synthesized
aataaatgatgggggagaactg

SEQ ID NO: 92881 - DNA, 22 bp, Artificial Sequence
  chemically synthesized
ataaatgatgggggagaactgg

SEQ ID NO: 92882 - DNA, 22 bp, Artificial Sequence
  chemically synthesized
gctagccatatgctgaaaaatg

SEQ ID NO: 92883 - DNA, 22 bp, Artificial Sequence
  chemically synthesized
gccatatgctgaaaaatgaaac

SEQ ID NO: 92884 - DNA, 22 bp, Artificial Sequence
  chemically synthesized
aaaaatgaaactggactccttc

SEQ ID NO: 92885 - DNA, 22 bp, Artificial Sequence
  chemically synthesized
gactccttccttataccttatc

SEQ ID NO: 92886 - DNA, 22 bp, Artificial Sequence
  chemically synthesized
cttccttataccttatccaaaa

SEQ ID NO: 92887 - DNA, 22 bp, Artificial Sequence
  chemically synthesized
ccttataccttatccaaaatta

SEQ ID NO: 92888 - DNA, 22 bp, Artificial Sequence
  chemically synthesized
cttataccttatccaaaattaa

SEQ ID NO: 92889 - DNA, 22 bp, Artificial Sequence
  chemically synthesized
ataccttatccaaaattaactc

SEQ ID NO: 92890 - DNA, 22 bp, Artificial Sequence
  chemically synthesized
taccttatccaaaattaactcc

SEQ ID NO: 92891 - DNA, 22 bp, Artificial Sequence
  chemically synthesized
atccaaaattaactccagatgg

SEQ ID NO: 92892 - DNA, 22 bp, Artificial Sequence
  chemically synthesized
tccaaaattaactccagatgga

SEQ ID NO: 92893 - DNA, 22 bp, Artificial Sequence
  chemically synthesized
actccagatggattagagactt

SEQ ID NO: 92894 - DNA, 22 bp, Artificial Sequence
  chemically synthesized
cagatggattagagacttaaat

SEQ ID NO: 92895 - DNA, 22 bp, Artificial Sequence
  chemically synthesized
gagacttaaatgaaaaacccca

SEQ ID NO: 92896 - DNA, 22 bp, Artificial Sequence
  chemically synthesized
aaatgaaaaaccccaaactata

SEQ ID NO: 92897 - DNA, 22 bp, Artificial Sequence
  chemically synthesized
aatgaaaaaccccaaactataa

SEQ ID NO: 92898 - DNA, 22 bp, Artificial Sequence
  chemically synthesized
taaaaagcctagaaaaaaatca

SEQ ID NO: 92899 - DNA, 22 bp, Artificial Sequence
  chemically synthesized
gaaaaaaatcaaggcaatacta

SEQ ID NO: 92900 - DNA, 22 bp, Artificial Sequence
  chemically synthesized
ttcatgatataaacacgggcac

SEQ ID NO: 92901 - DNA, 22 bp, Artificial Sequence
  chemically synthesized
atgatataaacacgggcacaga

SEQ ID NO: 92902 - DNA, 22 bp, Artificial Sequence
  chemically synthesized
catgatgaaagcgtgaaaagca

SEQ ID NO: 92903 - DNA, 22 bp, Artificial Sequence
  chemically synthesized
atgatgaaagcgtgaaaagcaa

SEQ ID NO: 92904 - DNA, 22 bp, Artificial Sequence
  chemically synthesized
cagcaaaagcaaaaattgacca

SEQ ID NO: 92905 - DNA, 22 bp, Artificial Sequence
  chemically synthesized
accaatggaatctaattaaact

SEQ ID NO: 92906 - DNA, 22 bp, Artificial Sequence
  chemically synthesized
attaaactaaagagctcctgct

SEQ ID NO: 92907 - DNA, 22 bp, Artificial Sequence
  chemically synthesized
aactaaagagctcctgctcagc

SEQ ID NO: 92908 - DNA, 22 bp, Artificial Sequence
  chemically synthesized
aagagctcctgctcagcaaaag

SEQ ID NO: 92909 - DNA, 22 bp, Artificial Sequence
  chemically synthesized
ctgctcagcaaaagaaactacc

SEQ ID NO: 92910 - DNA, 22 bp, Artificial Sequence
  chemically synthesized
ctcagcaaaagaaactaccatc

SEQ ID NO: 92911 - DNA, 22 bp, Artificial Sequence
  chemically synthesized
agcaaaagaaactaccatcaga

SEQ ID NO: 92912 - DNA, 22 bp, Artificial Sequence
  chemically synthesized
ccatcagagcgaaagacaatct

SEQ ID NO: 92913 - DNA, 22 bp, Artificial Sequence
  chemically synthesized
cagaatgggaaaaagattttcc

SEQ ID NO: 92914 - DNA, 22 bp, Artificial Sequence
  chemically synthesized
tccaatctattcttctgacaaa

SEQ ID NO: 92915 - DNA, 22 bp, Artificial Sequence
  chemically synthesized
ccaatctattcttctgacaaag

SEQ ID NO: 92916 - DNA, 22 bp, Artificial Sequence
  chemically synthesized
caatctattcttctgacaaagg

SEQ ID NO: 92917 - DNA, 22 bp, Artificial Sequence
  chemically synthesized
ttcttctgacaaaggcctaata

SEQ ID NO: 92918 - DNA, 22 bp, Artificial Sequence
  chemically synthesized
ttctgacaaaggcctaatatcc

SEQ ID NO: 92919 - DNA, 22 bp, Artificial Sequence
  chemically synthesized
ctgacaaaggcctaatatccag

SEQ ID NO: 92920 - DNA, 22 bp, Artificial Sequence
  chemically synthesized
tgacaaaggcctaatatccaga

SEQ ID NO: 92921 - DNA, 22 bp, Artificial Sequence
  chemically synthesized
acaaaggcctaatatccagagt

SEQ ID NO: 92922 - DNA, 22 bp, Artificial Sequence
  chemically synthesized
atatccagagtaaacaagaaac

SEQ ID NO: 92923 - DNA, 22 bp, Artificial Sequence
  chemically synthesized
aaacaactttacaagaaaaaaa

SEQ ID NO: 92924 - DNA, 22 bp, Artificial Sequence
  chemically synthesized
aacaactttacaagaaaaaaaa

SEQ ID NO: 92925 - DNA, 22 bp, Artificial Sequence
  chemically synthesized
tacaagaaaaaaaaaacccatt

SEQ ID NO: 92926 - DNA, 22 bp, Artificial Sequence
  chemically synthesized
acaagaaaaaaaaaacccatta

SEQ ID NO: 92927 - DNA, 22 bp, Artificial Sequence
  chemically synthesized
caagaaaaaaaaaacccattaa

SEQ ID NO: 92928 - DNA, 22 bp, Artificial Sequence
  chemically synthesized
aaaccatggcacacttttacct

SEQ ID NO: 92929 - DNA, 22 bp, Artificial Sequence
  chemically synthesized
ttacctataaaacaaacctgca

SEQ ID NO: 92930 - DNA, 22 bp, Artificial Sequence
  chemically synthesized
tacctataaaacaaacctgcat

SEQ ID NO: 92931 - DNA, 22 bp, Artificial Sequence
  chemically synthesized
acctataaaacaaacctgcata

SEQ ID NO: 92932 - DNA, 22 bp, Artificial Sequence
  chemically synthesized
cctataaaacaaacctgcatat

SEQ ID NO: 92933 - DNA, 22 bp, Artificial Sequence
  chemically synthesized
taaaacaaacctgcatatcctg

SEQ ID NO: 92934 - DNA, 22 bp, Artificial Sequence
  chemically synthesized
catatcctgtacgtgtacccct

SEQ ID NO: 92935 - DNA, 22 bp, Artificial Sequence
  chemically synthesized
tacgtgtacccctgaatttaag

SEQ ID NO: 92936 - DNA, 22 bp, Artificial Sequence
  chemically synthesized
aatttaaggtaacagtaaatta

SEQ ID NO: 92937 - DNA, 22 bp, Artificial Sequence
  chemically synthesized
aaggtaacagtaaattaaatta

SEQ ID NO: 92938 - DNA, 22 bp, Artificial Sequence
  chemically synthesized
aggtaacagtaaattaaattaa

SEQ ID NO: 92939 - DNA, 22 bp, Artificial Sequence
  chemically synthesized
aattaaaagaaaaatgccatgg

SEQ ID NO: 92940 - DNA, 22 bp, Artificial Sequence
  chemically synthesized
aaagaaaaatgccatggcaatg

SEQ ID NO: 92941 - DNA, 22 bp, Artificial Sequence
  chemically synthesized
ccctatatggcctaaaaagaga

SEQ ID NO: 92942 - DNA, 22 bp, Artificial Sequence
  chemically synthesized
tatggcctaaaaagagaaggca

SEQ ID NO: 92943 - DNA, 22 bp, Artificial Sequence
  chemically synthesized
aaaagagaaggcataaataatc

SEQ ID NO: 92944 - DNA, 22 bp, Artificial Sequence
  chemically synthesized
gtttaacatatcatcaagaaat

SEQ ID NO: 92945 - DNA, 22 bp, Artificial Sequence
  chemically synthesized
tttaacatatcatcaagaaata

SEQ ID NO: 92946 - DNA, 22 bp, Artificial Sequence
  chemically synthesized
aacatatcatcaagaaataacc

SEQ ID NO: 92947 - DNA, 22 bp, Artificial Sequence
  chemically synthesized
acatatcatcaagaaataacca

SEQ ID NO: 92948 - DNA, 22 bp, Artificial Sequence
  chemically synthesized
ggggctgctctgcctatgcagt

SEQ ID NO: 92949 - DNA, 22 bp, Artificial Sequence
  chemically synthesized
ctctgcctatgcagtagtcatt

SEQ ID NO: 92950 - DNA, 22 bp, Artificial Sequence
  chemically synthesized
tgcctatgcagtagtcattcgt

SEQ ID NO: 92951 - DNA, 22 bp, Artificial Sequence
  chemically synthesized
cctatgcagtagtcattcgttt

SEQ ID NO: 92952 - DNA, 22 bp, Artificial Sequence
  chemically synthesized
tgcagtagtcattcgtttattt

SEQ ID NO: 92953 - DNA, 22 bp, Artificial Sequence
  chemically synthesized
gtttatttctttactctctcaa

SEQ ID NO: 92954 - DNA, 22 bp, Artificial Sequence
  chemically synthesized
atttctttactctctcaagaaa

SEQ ID NO: 92955 - DNA, 22 bp, Artificial Sequence
  chemically synthesized
tttctttactctctcaagaaat

SEQ ID NO: 92956 - DNA, 22 bp, Artificial Sequence
  chemically synthesized
ctttactctctcaagaaatttg

SEQ ID NO: 92957 - DNA, 22 bp, Artificial Sequence
  chemically synthesized
tttactctctcaagaaatttgc

SEQ ID NO: 92958 - DNA, 22 bp, Artificial Sequence
  chemically synthesized
tactctctcaagaaatttgctt

SEQ ID NO: 92959 - DNA, 22 bp, Artificial Sequence
  chemically synthesized
actctctcaagaaatttgcttt

SEQ ID NO: 92960 - DNA, 22 bp, Artificial Sequence
  chemically synthesized
ctctctcaagaaatttgctttg

SEQ ID NO: 92961 - DNA, 22 bp, Artificial Sequence
  chemically synthesized
tctcaagaaatttgctttgact

SEQ ID NO: 92962 - DNA, 22 bp, Artificial Sequence
  chemically synthesized
tcaagaaatttgctttgactta

SEQ ID NO: 92963 - DNA, 22 bp, Artificial Sequence
  chemically synthesized
aagaaatttgctttgacttaaa

SEQ ID NO: 92964 - DNA, 22 bp, Artificial Sequence
  chemically synthesized
gctttgacttaaaaaaaacaaa

SEQ ID NO: 92965 - DNA, 22 bp, Artificial Sequence
  chemically synthesized
ctttgacttaaaaaaaacaaaa

SEQ ID NO: 92966 - DNA, 22 bp, Artificial Sequence
  chemically synthesized
tgacttaaaaaaaacaaaaaac

SEQ ID NO: 92967 - DNA, 22 bp, Artificial Sequence
  chemically synthesized
gacttaaaaaaaacaaaaaaca

SEQ ID NO: 92968 - DNA, 22 bp, Artificial Sequence
  chemically synthesized
acttaaaaaaaacaaaaaacaa

SEQ ID NO: 92969 - DNA, 22 bp, Artificial Sequence
  chemically synthesized
aaaaaaaacaaaaaacaaaaaa

SEQ ID NO: 92970 - DNA, 22 bp, Artificial Sequence
  chemically synthesized
aaaaaaacaaaaaacaaaaaag

SEQ ID NO: 92971 - DNA, 22 bp, Artificial Sequence
  chemically synthesized
tgaaacggtagtgactgcattt

SEQ ID NO: 92972 - DNA, 22 bp, Artificial Sequence
  chemically synthesized
aaacggtagtgactgcatttga

SEQ ID NO: 92973 - DNA, 22 bp, Artificial Sequence
  chemically synthesized
catttgaagtgggacctttatg

SEQ ID NO: 92974 - DNA, 22 bp, Artificial Sequence
  chemically synthesized
gaagtgggacctttatgatatg

SEQ ID NO: 92975 - DNA, 22 bp, Artificial Sequence
  chemically synthesized
aagtgggacctttatgatatga

SEQ ID NO: 92976 - DNA, 22 bp, Artificial Sequence
  chemically synthesized
tatgatatgatggagccaggca

SEQ ID NO: 92977 - DNA, 22 bp, Artificial Sequence
  chemically synthesized
atgatatgatggagccaggcag

SEQ ID NO: 92978 - DNA, 22 bp, Artificial Sequence
  chemically synthesized
tgatatgatggagccaggcaga

SEQ ID NO: 92979 - DNA, 22 bp, Artificial Sequence
  chemically synthesized
gagaagttcctgaaagaaggaa

SEQ ID NO: 92980 - DNA, 22 bp, Artificial Sequence
  chemically synthesized
ctgaaagaaggaagggcatgtg

SEQ ID NO: 92981 - DNA, 22 bp, Artificial Sequence
  chemically synthesized
aaagaaggaagggcatgtgcca

SEQ ID NO: 92982 - DNA, 22 bp, Artificial Sequence
  chemically synthesized
tgaggctgaggagaaaaaagaa

SEQ ID NO: 92983 - DNA, 22 bp, Artificial Sequence
  chemically synthesized
aggctgaggagaaaaaagaaag

SEQ ID NO: 92984 - DNA, 22 bp, Artificial Sequence
  chemically synthesized
aggagaaaaaagaaagaaagaa

SEQ ID NO: 92985 - DNA, 22 bp, Artificial Sequence
  chemically synthesized
tacatttcactgtatgtaaaga

SEQ ID NO: 92986 - DNA, 22 bp, Artificial Sequence
  chemically synthesized
acatttcactgtatgtaaagac

SEQ ID NO: 92987 - DNA, 22 bp, Artificial Sequence
  chemically synthesized
catttcactgtatgtaaagaca

SEQ ID NO: 92988 - DNA, 22 bp, Artificial Sequence
  chemically synthesized
cactgtatgtaaagacattaca

SEQ ID NO: 92989 - DNA, 22 bp, Artificial Sequence
  chemically synthesized
actgtatgtaaagacattacaa

SEQ ID NO: 92990 - DNA, 22 bp, Artificial Sequence
  chemically synthesized
tatgtaaagacattacaaggct

SEQ ID NO: 92991 - DNA, 22 bp, Artificial Sequence
  chemically synthesized
caaggctagagtaaagcatgtt

SEQ ID NO: 92992 - DNA, 22 bp, Artificial Sequence
  chemically synthesized
gagtaaagcatgttgaagtaaa

SEQ ID NO: 92993 - DNA, 22 bp, Artificial Sequence
  chemically synthesized
aagtaaaaataggagaaatcaa

SEQ ID NO: 92994 - DNA, 22 bp, Artificial Sequence
  chemically synthesized
gagagaagggcgcaggcttatt

SEQ ID NO: 92995 - DNA, 22 bp, Artificial Sequence
  chemically synthesized
attatttgggtcttatagatga

SEQ ID NO: 92996 - DNA, 22 bp, Artificial Sequence
  chemically synthesized
ttatttgggtcttatagatgag

SEQ ID NO: 92997 - DNA, 22 bp, Artificial Sequence
  chemically synthesized
tttgggtcttatagatgagagt

SEQ ID NO: 92998 - DNA, 22 bp, Artificial Sequence
  chemically synthesized
gggtcttatagatgagagtagt

SEQ ID NO: 92999 - DNA, 22 bp, Artificial Sequence
  chemically synthesized
ggtcttatagatgagagtagta

SEQ ID NO: 93000 - DNA, 22 bp, Artificial Sequence
  chemically synthesized
atagatgagagtagtagagtag

SEQ ID NO: 93001 - DNA, 22 bp, Artificial Sequence
  chemically synthesized
tagatgagagtagtagagtagg

SEQ ID NO: 93002 - DNA, 22 bp, Artificial Sequence
  chemically synthesized
tatactgaaacataggggacga

SEQ ID NO: 93003 - DNA, 22 bp, Artificial Sequence
  chemically synthesized
atactgaaacataggggacgag

SEQ ID NO: 93004 - DNA, 22 bp, Artificial Sequence
  chemically synthesized
tactgaaacataggggacgagg

SEQ ID NO: 93005 - DNA, 22 bp, Artificial Sequence
  chemically synthesized
aaacataggggacgaggggagc

SEQ ID NO: 93006 - DNA, 22 bp, Artificial Sequence
  chemically synthesized
tgcaaacctgagataaacatgg

SEQ ID NO: 93007 - DNA, 22 bp, Artificial Sequence
  chemically synthesized
gcaaacctgagataaacatggt

SEQ ID NO: 93008 - DNA, 22 bp, Artificial Sequence
  chemically synthesized
caaacctgagataaacatggtc

SEQ ID NO: 93009 - DNA, 22 bp, Artificial Sequence
  chemically synthesized
agataaacatggtctgtagtcc

SEQ ID NO: 93010 - DNA, 22 bp, Artificial Sequence
  chemically synthesized
tagtccactcaaaacccaagct

SEQ ID NO: 93011 - DNA, 22 bp, Artificial Sequence
  chemically synthesized
aaaacccaagcttatttttttc

SEQ ID NO: 93012 - DNA, 22 bp, Artificial Sequence
  chemically synthesized
atttttttctccttcttcatct

SEQ ID NO: 93013 - DNA, 22 bp, Artificial Sequence
  chemically synthesized
tttttttctccttcttcatctg

SEQ ID NO: 93014 - DNA, 22 bp, Artificial Sequence
  chemically synthesized
ttttctccttcttcatctgcct

SEQ ID NO: 93015 - DNA, 22 bp, Artificial Sequence
  chemically synthesized
tttctccttcttcatctgcctt

SEQ ID NO: 93016 - DNA, 22 bp, Artificial Sequence
  chemically synthesized
ttctccttcttcatctgcctta

SEQ ID NO: 93017 - DNA, 22 bp, Artificial Sequence
  chemically synthesized
tctccttcttcatctgccttac

SEQ ID NO: 93018 - DNA, 22 bp, Artificial Sequence
  chemically synthesized
ctccttcttcatctgccttact

SEQ ID NO: 93019 - DNA, 22 bp, Artificial Sequence
  chemically synthesized
tccttcttcatctgccttactc

SEQ ID NO: 93020 - DNA, 22 bp, Artificial Sequence
  chemically synthesized
cttcttcatctgccttactcag

SEQ ID NO: 93021 - DNA, 22 bp, Artificial Sequence
  chemically synthesized
cttcatctgccttactcagtgc

SEQ ID NO: 93022 - DNA, 22 bp, Artificial Sequence
  chemically synthesized
ttcatctgccttactcagtgca

SEQ ID NO: 93023 - DNA, 22 bp, Artificial Sequence
  chemically synthesized
catctgccttactcagtgcaag

SEQ ID NO: 93024 - DNA, 22 bp, Artificial Sequence
  chemically synthesized
atctgccttactcagtgcaagg

SEQ ID NO: 93025 - DNA, 22 bp, Artificial Sequence
  chemically synthesized
ccttactcagtgcaaggtgcta

SEQ ID NO: 93026 - DNA, 22 bp, Artificial Sequence
  chemically synthesized
actcagtgcaaggtgctataac

SEQ ID NO: 93027 - DNA, 22 bp, Artificial Sequence
  chemically synthesized
ctcagtgcaaggtgctataaca

SEQ ID NO: 93028 - DNA, 22 bp, Artificial Sequence
  chemically synthesized
agtgcaaggtgctataacaaaa

SEQ ID NO: 93029 - DNA, 22 bp, Artificial Sequence
  chemically synthesized
taacaaaatacaaaagactggg

SEQ ID NO: 93030 - DNA, 22 bp, Artificial Sequence
  chemically synthesized
ggtggcttcaacaacagagttt

SEQ ID NO: 93031 - DNA, 22 bp, Artificial Sequence
  chemically synthesized
caacaacagagttttttctcac

SEQ ID NO: 93032 - DNA, 22 bp, Artificial Sequence
  chemically synthesized
aacaacagagttttttctcaca

SEQ ID NO: 93033 - DNA, 22 bp, Artificial Sequence
  chemically synthesized
tttctcacatttctgaaggctg

SEQ ID NO: 93034 - DNA, 22 bp, Artificial Sequence
  chemically synthesized
ttctcacatttctgaaggctga

SEQ ID NO: 93035 - DNA, 22 bp, Artificial Sequence
  chemically synthesized
tctcacatttctgaaggctgac

SEQ ID NO: 93036 - DNA, 22 bp, Artificial Sequence
  chemically synthesized
ctcacatttctgaaggctgact

SEQ ID NO: 93037 - DNA, 22 bp, Artificial Sequence
  chemically synthesized
tcacatttctgaaggctgactc

SEQ ID NO: 93038 - DNA, 22 bp, Artificial Sequence
  chemically synthesized
acatttctgaaggctgactcgt

SEQ ID NO: 93039 - DNA, 22 bp, Artificial Sequence
  chemically synthesized
ctgaaggctgactcgtggtcag

SEQ ID NO: 93040 - DNA, 22 bp, Artificial Sequence
  chemically synthesized
tgaaggctgactcgtggtcagg

SEQ ID NO: 93041 - DNA, 22 bp, Artificial Sequence
  chemically synthesized
aaggctgactcgtggtcagggt

SEQ ID NO: 93042 - DNA, 22 bp, Artificial Sequence
  chemically synthesized
actcgtggtcagggttctcttc

SEQ ID NO: 93043 - DNA, 22 bp, Artificial Sequence
  chemically synthesized
gtggtcagggttctcttcctgg

SEQ ID NO: 93044 - DNA, 22 bp, Artificial Sequence
  chemically synthesized
tcttcctggattgcagatggcg

SEQ ID NO: 93045 - DNA, 22 bp, Artificial Sequence
  chemically synthesized
ttcctggattgcagatggcgga

SEQ ID NO: 93046 - DNA, 22 bp, Artificial Sequence
  chemically synthesized
cctggattgcagatggcggact

SEQ ID NO: 93047 - DNA, 22 bp, Artificial Sequence
  chemically synthesized
ctggattgcagatggcggactt

SEQ ID NO: 93048 - DNA, 22 bp, Artificial Sequence
  chemically synthesized
gattgcagatggcggacttctc

SEQ ID NO: 93049 - DNA, 22 bp, Artificial Sequence
  chemically synthesized
cagatggcggacttctcactgt

SEQ ID NO: 93050 - DNA, 22 bp, Artificial Sequence
  chemically synthesized
ctcactgtgtcctcaccgggag

SEQ ID NO: 93051 - DNA, 22 bp, Artificial Sequence
  chemically synthesized
tcactgtgtcctcaccgggagg

SEQ ID NO: 93052 - DNA, 22 bp, Artificial Sequence
  chemically synthesized
actgtgtcctcaccgggaggaa

SEQ ID NO: 93053 - DNA, 22 bp, Artificial Sequence
  chemically synthesized
tgtcctcaccgggaggaaagag

SEQ ID NO: 93054 - DNA, 22 bp, Artificial Sequence
  chemically synthesized
accgggaggaaagagaaatggc

SEQ ID NO: 93055 - DNA, 22 bp, Artificial Sequence
  chemically synthesized
gtctctctgcttctgataagga

SEQ ID NO: 93056 - DNA, 22 bp, Artificial Sequence
  chemically synthesized
tctctctgcttctgataaggaa

SEQ ID NO: 93057 - DNA, 22 bp, Artificial Sequence
  chemically synthesized
tctgcttctgataaggaaaata

SEQ ID NO: 93058 - DNA, 22 bp, Artificial Sequence
  chemically synthesized
tgcttctgataaggaaaataat

SEQ ID NO: 93059 - DNA, 22 bp, Artificial Sequence
  chemically synthesized
cttctgataaggaaaataattt

SEQ ID NO: 93060 - DNA, 22 bp, Artificial Sequence
  chemically synthesized
ctgataaggaaaataattttat

SEQ ID NO: 93061 - DNA, 22 bp, Artificial Sequence
  chemically synthesized
tgataaggaaaataattttatg

SEQ ID NO: 93062 - DNA, 22 bp, Artificial Sequence
  chemically synthesized
ataaggaaaataattttatgat

SEQ ID NO: 93063 - DNA, 22 bp, Artificial Sequence
  chemically synthesized
tatgatggggatctgctcttat

SEQ ID NO: 93064 - DNA, 22 bp, Artificial Sequence
  chemically synthesized
atgatggggatctgctcttatg

SEQ ID NO: 93065 - DNA, 22 bp, Artificial Sequence
  chemically synthesized
tgatggggatctgctcttatga

SEQ ID NO: 93066 - DNA, 22 bp, Artificial Sequence
  chemically synthesized
ctcttatgagctcatctaaacc

SEQ ID NO: 93067 - DNA, 22 bp, Artificial Sequence
  chemically synthesized
ttatgagctcatctaaacctaa

SEQ ID NO: 93068 - DNA, 22 bp, Artificial Sequence
  chemically synthesized
atgagctcatctaaacctaatt

SEQ ID NO: 93069 - DNA, 22 bp, Artificial Sequence
  chemically synthesized
tgagctcatctaaacctaatta

SEQ ID NO: 93070 - DNA, 22 bp, Artificial Sequence
  chemically synthesized
atctaaacctaattacttttca

SEQ ID NO: 93071 - DNA, 22 bp, Artificial Sequence
  chemically synthesized
aacctaattacttttcaaaagc

SEQ ID NO: 93072 - DNA, 22 bp, Artificial Sequence
  chemically synthesized
attacttttcaaaagcctcccc

SEQ ID NO: 93073 - DNA, 22 bp, Artificial Sequence
  chemically synthesized
cttttcaaaagcctcccccaca

SEQ ID NO: 93074 - DNA, 22 bp, Artificial Sequence
  chemically synthesized
ttcaaaagcctcccccacagat

SEQ ID NO: 93075 - DNA, 22 bp, Artificial Sequence
  chemically synthesized
tcaaaagcctcccccacagata

SEQ ID NO: 93076 - DNA, 22 bp, Artificial Sequence
  chemically synthesized
caaaagcctcccccacagataa

SEQ ID NO: 93077 - DNA, 22 bp, Artificial Sequence
  chemically synthesized
aaaagcctcccccacagataag

SEQ ID NO: 93078 - DNA, 22 bp, Artificial Sequence
  chemically synthesized
ccccacagataaggtcagttgg

SEQ ID NO: 93079 - DNA, 22 bp, Artificial Sequence
  chemically synthesized
ggagttggggattcagcatgtg

SEQ ID NO: 93080 - DNA, 22 bp, Artificial Sequence
  chemically synthesized
gggattcagcatgtgaattttg

SEQ ID NO: 93081 - DNA, 22 bp, Artificial Sequence
  chemically synthesized
agcatgtgaattttgaggagac

SEQ ID NO: 93082 - DNA, 22 bp, Artificial Sequence
  chemically synthesized
tgaggagacacaaacattaggt

SEQ ID NO: 93083 - DNA, 22 bp, Artificial Sequence
  chemically synthesized
gaggagacacaaacattaggtc

SEQ ID NO: 93084 - DNA, 22 bp, Artificial Sequence
  chemically synthesized
aggagacacaaacattaggtcc

SEQ ID NO: 93085 - DNA, 22 bp, Artificial Sequence
  chemically synthesized
ggtccgtaacaccatcatatta

SEQ ID NO: 93086 - DNA, 22 bp, Artificial Sequence
  chemically synthesized
aactcttacttatagagatgca

SEQ ID NO: 93087 - DNA, 22 bp, Artificial Sequence
  chemically synthesized
ttacttatagagatgcactaac

SEQ ID NO: 93088 - DNA, 22 bp, Artificial Sequence
  chemically synthesized
acttatagagatgcactaacat

SEQ ID NO: 93089 - DNA, 22 bp, Artificial Sequence
  chemically synthesized
cttatagagatgcactaacatc

SEQ ID NO: 93090 - DNA, 22 bp, Artificial Sequence
  chemically synthesized
atagagatgcactaacatccaa

SEQ ID NO: 93091 - DNA, 22 bp, Artificial Sequence
  chemically synthesized
tagagatgcactaacatccaac

SEQ ID NO: 93092 - DNA, 22 bp, Artificial Sequence
  chemically synthesized
acatccaactatacaaaaattc

SEQ ID NO: 93093 - DNA, 22 bp, Artificial Sequence
  chemically synthesized
tacaaaaattccattaagtaag

SEQ ID NO: 93094 - DNA, 22 bp, Artificial Sequence
  chemically synthesized
cattaagtaagccttccaatta

SEQ ID NO: 93095 - DNA, 22 bp, Artificial Sequence
  chemically synthesized
agtaagccttccaattaatgtt

SEQ ID NO: 93096 - DNA, 22 bp, Artificial Sequence
  chemically synthesized
ccaattaatgttgtacaaattc

SEQ ID NO: 93097 - DNA, 22 bp, Artificial Sequence
  chemically synthesized
caattaatgttgtacaaattct

SEQ ID NO: 93098 - DNA, 22 bp, Artificial Sequence
  chemically synthesized
atgttgtacaaattcttcccac

SEQ ID NO: 93099 - DNA, 22 bp, Artificial Sequence
  chemically synthesized
tacaaattcttcccactacatt

SEQ ID NO: 93100 - DNA, 22 bp, Artificial Sequence
  chemically synthesized
ttcccactacattttgatctca

SEQ ID NO: 93101 - DNA, 22 bp, Artificial Sequence
  chemically synthesized
cccactacattttgatctcaca

SEQ ID NO: 93102 - DNA, 22 bp, Artificial Sequence
  chemically synthesized
ccactacattttgatctcacag

SEQ ID NO: 93103 - DNA, 22 bp, Artificial Sequence
  chemically synthesized
cattttgatctcacagtgctgg

SEQ ID NO: 93104 - DNA, 22 bp, Artificial Sequence
  chemically synthesized
tgatctcacagtgctggtctgt

SEQ ID NO: 93105 - DNA, 22 bp, Artificial Sequence
  chemically synthesized
gatctcacagtgctggtctgtt

SEQ ID NO: 93106 - DNA, 22 bp, Artificial Sequence
  chemically synthesized
atctcacagtgctggtctgttt

SEQ ID NO: 93107 - DNA, 22 bp, Artificial Sequence
  chemically synthesized
acagtgctggtctgtttctcag

SEQ ID NO: 93108 - DNA, 22 bp, Artificial Sequence
  chemically synthesized
gtctgtttctcagacataacat

SEQ ID NO: 93109 - DNA, 22 bp, Artificial Sequence
  chemically synthesized
tttctcagacataacatgctca

SEQ ID NO: 93110 - DNA, 22 bp, Artificial Sequence
  chemically synthesized
ctcagacataacatgctcatgc

SEQ ID NO: 93111 - DNA, 22 bp, Artificial Sequence
  chemically synthesized
tcagacataacatgctcatgct

SEQ ID NO: 93112 - DNA, 22 bp, Artificial Sequence
  chemically synthesized
agacataacatgctcatgctga

SEQ ID NO: 93113 - DNA, 22 bp, Artificial Sequence
  chemically synthesized
atgctgacttgtgagcctctgc

SEQ ID NO: 93114 - DNA, 22 bp, Artificial Sequence
  chemically synthesized
acttgtgagcctctgctgattc

SEQ ID NO: 93115 - DNA, 22 bp, Artificial Sequence
  chemically synthesized
gtgagcctctgctgattcattt

SEQ ID NO: 93116 - DNA, 22 bp, Artificial Sequence
  chemically synthesized
tgagcctctgctgattcatttc

SEQ ID NO: 93117 - DNA, 22 bp, Artificial Sequence
  chemically synthesized
tgctgattcatttcttacacct

SEQ ID NO: 93118 - DNA, 22 bp, Artificial Sequence
  chemically synthesized
ctgattcatttcttacacctaa

SEQ ID NO: 93119 - DNA, 22 bp, Artificial Sequence
  chemically synthesized
attcatttcttacacctaagtc

SEQ ID NO: 93120 - DNA, 22 bp, Artificial Sequence
  chemically synthesized
atttcttacacctaagtcccca

SEQ ID NO: 93121 - DNA, 22 bp, Artificial Sequence
  chemically synthesized
cttacacctaagtccccacctc

SEQ ID NO: 93122 - DNA, 22 bp, Artificial Sequence
  chemically synthesized
ttacacctaagtccccacctcc

SEQ ID NO: 93123 - DNA, 22 bp, Artificial Sequence
  chemically synthesized
acacctaagtccccacctcccc

SEQ ID NO: 93124 - DNA, 22 bp, Artificial Sequence
  chemically synthesized
cacctaagtccccacctccccc

SEQ ID NO: 93125 - DNA, 22 bp, Artificial Sequence
  chemically synthesized
agtccccacctcccccagagtc

SEQ ID NO: 93126 - DNA, 22 bp, Artificial Sequence
  chemically synthesized
ccccagagtcttacaatgaggt

SEQ ID NO: 93127 - DNA, 22 bp, Artificial Sequence
  chemically synthesized
acaatgaggtctctcccttgaa

SEQ ID NO: 93128 - DNA, 22 bp, Artificial Sequence
  chemically synthesized
caatgaggtctctcccttgaaa

SEQ ID NO: 93129 - DNA, 22 bp, Artificial Sequence
  chemically synthesized
tcccttgaaatgctgtgaccaa

SEQ ID NO: 93130 - DNA, 22 bp, Artificial Sequence
  chemically synthesized
ccttgaaatgctgtgaccaatc

SEQ ID NO: 93131 - DNA, 22 bp, Artificial Sequence
  chemically synthesized
gaaatgctgtgaccaatctgca

SEQ ID NO: 93132 - DNA, 22 bp, Artificial Sequence
  chemically synthesized
aaatgctgtgaccaatctgcac

SEQ ID NO: 93133 - DNA, 22 bp, Artificial Sequence
  chemically synthesized
tgaccaatctgcacacttgagg

SEQ ID NO: 93134 - DNA, 22 bp, Artificial Sequence
  chemically synthesized
cacacttgagggcatgggatta

SEQ ID NO: 93135 - DNA, 22 bp, Artificial Sequence
  chemically synthesized
gagggcatgggattaatttcac

SEQ ID NO: 93136 - DNA, 22 bp, Artificial Sequence
  chemically synthesized
agggcatgggattaatttcact

SEQ ID NO: 93137 - DNA, 22 bp, Artificial Sequence
  chemically synthesized
atttcactttcttaggcatcca

SEQ ID NO: 93138 - DNA, 22 bp, Artificial Sequence
  chemically synthesized
cactttcttaggcatccacaag

SEQ ID NO: 93139 - DNA, 22 bp, Artificial Sequence
  chemically synthesized
actttcttaggcatccacaagg

SEQ ID NO: 93140 - DNA, 22 bp, Artificial Sequence
  chemically synthesized
tcttaggcatccacaagggctg

SEQ ID NO: 93141 - DNA, 22 bp, Artificial Sequence
  chemically synthesized
cttaggcatccacaagggctgt

SEQ ID NO: 93142 - DNA, 22 bp, Artificial Sequence
  chemically synthesized
ttaggcatccacaagggctgtg

SEQ ID NO: 93143 - DNA, 22 bp, Artificial Sequence
  chemically synthesized
aggcatccacaagggctgtgaa

SEQ ID NO: 93144 - DNA, 22 bp, Artificial Sequence
  chemically synthesized
ggcatccacaagggctgtgaaa

SEQ ID NO: 93145 - DNA, 22 bp, Artificial Sequence
  chemically synthesized
tgaaaagctaagtgccattaga

SEQ ID NO: 93146 - DNA, 22 bp, Artificial Sequence
  chemically synthesized
agtgccattagaaatagtattc

SEQ ID NO: 93147 - DNA, 22 bp, Artificial Sequence
  chemically synthesized
gaaatagtattcctcctaataa

SEQ ID NO: 93148 - DNA, 22 bp, Artificial Sequence
  chemically synthesized
ctcctaataaaatagaattgct

SEQ ID NO: 93149 - DNA, 22 bp, Artificial Sequence
  chemically synthesized
ctaataaaatagaattgctaca

SEQ ID NO: 93150 - DNA, 22 bp, Artificial Sequence
  chemically synthesized
ataaaatagaattgctacacct

SEQ ID NO: 93151 - DNA, 22 bp, Artificial Sequence
  chemically synthesized
ctacacctgactaaaccttgaa

SEQ ID NO: 93152 - DNA, 22 bp, Artificial Sequence
  chemically synthesized
cacctgactaaaccttgaattc

SEQ ID NO: 93153 - DNA, 22 bp, Artificial Sequence
  chemically synthesized
actaaaccttgaattcctaaag

SEQ ID NO: 93154 - DNA, 22 bp, Artificial Sequence
  chemically synthesized
aaccttgaattcctaaagcttg

SEQ ID NO: 93155 - DNA, 22 bp, Artificial Sequence
  chemically synthesized
gaattcctaaagcttggaacac

SEQ ID NO: 93156 - DNA, 22 bp, Artificial Sequence
  chemically synthesized
aattcctaaagcttggaacact

SEQ ID NO: 93157 - DNA, 22 bp, Artificial Sequence
  chemically synthesized
ctaaagcttggaacactttccc

SEQ ID NO: 93158 - DNA, 22 bp, Artificial Sequence
  chemically synthesized
aagcttggaacactttcccttc

SEQ ID NO: 93159 - DNA, 22 bp, Artificial Sequence
  chemically synthesized
ggaacactttcccttccttaag

SEQ ID NO: 93160 - DNA, 22 bp, Artificial Sequence
  chemically synthesized
gaacactttcccttccttaaga

SEQ ID NO: 93161 - DNA, 22 bp, Artificial Sequence
  chemically synthesized
tcccttccttaagaaccatcct

SEQ ID NO: 93162 - DNA, 22 bp, Artificial Sequence
  chemically synthesized
cccttccttaagaaccatcctt

SEQ ID NO: 93163 - DNA, 22 bp, Artificial Sequence
  chemically synthesized
ccttccttaagaaccatccttg

SEQ ID NO: 93164 - DNA, 22 bp, Artificial Sequence
  chemically synthesized
ccttaagaaccatccttgctac

SEQ ID NO: 93165 - DNA, 22 bp, Artificial Sequence
  chemically synthesized
cttaagaaccatccttgctact

SEQ ID NO: 93166 - DNA, 22 bp, Artificial Sequence
  chemically synthesized
aagaaccatccttgctactcag

SEQ ID NO: 93167 - DNA, 22 bp, Artificial Sequence
  chemically synthesized
agaaccatccttgctactcagc

SEQ ID NO: 93168 - DNA, 22 bp, Artificial Sequence
  chemically synthesized
gctactcagctgcaatcaatcc

SEQ ID NO: 93169 - DNA, 22 bp, Artificial Sequence
  chemically synthesized
ctactcagctgcaatcaatcca

SEQ ID NO: 93170 - DNA, 22 bp, Artificial Sequence
  chemically synthesized
ctcagctgcaatcaatccagcc

SEQ ID NO: 93171 - DNA, 22 bp, Artificial Sequence
  chemically synthesized
agctgcaatcaatccagccccc

SEQ ID NO: 93172 - DNA, 22 bp, Artificial Sequence
  chemically synthesized
caatcaatccagcccccaggtc

SEQ ID NO: 93173 - DNA, 22 bp, Artificial Sequence
  chemically synthesized
cactgaaccttttcccatctct

SEQ ID NO: 93174 - DNA, 22 bp, Artificial Sequence
  chemically synthesized
actgaaccttttcccatctctt

SEQ ID NO: 93175 - DNA, 22 bp, Artificial Sequence
  chemically synthesized
aaccttttcccatctcttccaa

SEQ ID NO: 93176 - DNA, 22 bp, Artificial Sequence
  chemically synthesized
ttcccatctcttccaaaacatc

SEQ ID NO: 93177 - DNA, 22 bp, Artificial Sequence
  chemically synthesized
tcccatctcttccaaaacatct

SEQ ID NO: 93178 - DNA, 22 bp, Artificial Sequence
  chemically synthesized
cccatctcttccaaaacatctg

SEQ ID NO: 93179 - DNA, 22 bp, Artificial Sequence
  chemically synthesized
ccatctcttccaaaacatctgt

SEQ ID NO: 93180 - DNA, 22 bp, Artificial Sequence
  chemically synthesized
ttccaaaacatctgtttctgag

SEQ ID NO: 93181 - DNA, 22 bp, Artificial Sequence
  chemically synthesized
ccaaaacatctgtttctgagaa

SEQ ID NO: 93182 - DNA, 22 bp, Artificial Sequence
  chemically synthesized
caaaacatctgtttctgagaag

SEQ ID NO: 93183 - DNA, 22 bp, Artificial Sequence
  chemically synthesized
tttctgagaagtcctgtcctat

SEQ ID NO: 93184 - DNA, 22 bp, Artificial Sequence
  chemically synthesized
ctgagaagtcctgtcctataga

SEQ ID NO: 93185 - DNA, 22 bp, Artificial Sequence
  chemically synthesized
tgagaagtcctgtcctatagag

SEQ ID NO: 93186 - DNA, 22 bp, Artificial Sequence
  chemically synthesized
agaagtcctgtcctatagaggt

SEQ ID NO: 93187 - DNA, 22 bp, Artificial Sequence
  chemically synthesized
tcctatagaggtctttcttccc

SEQ ID NO: 93188 - DNA, 22 bp, Artificial Sequence
  chemically synthesized
tagaggtctttcttcccaccgg

SEQ ID NO: 93189 - DNA, 22 bp, Artificial Sequence
  chemically synthesized
tcttcccaccggatttctccta

SEQ ID NO: 93190 - DNA, 22 bp, Artificial Sequence
  chemically synthesized
cttcccaccggatttctcctac

SEQ ID NO: 93191 - DNA, 22 bp, Artificial Sequence
  chemically synthesized
ttcccaccggatttctcctaca

SEQ ID NO: 93192 - DNA, 22 bp, Artificial Sequence
  chemically synthesized
cccaccggatttctcctacacc

SEQ ID NO: 93193 - DNA, 22 bp, Artificial Sequence
  chemically synthesized
ccaccggatttctcctacacca

SEQ ID NO: 93194 - DNA, 22 bp, Artificial Sequence
  chemically synthesized
ctcctacaccatttactcccac

SEQ ID NO: 93195 - DNA, 22 bp, Artificial Sequence
  chemically synthesized
tcctacaccatttactcccact

SEQ ID NO: 93196 - DNA, 22 bp, Artificial Sequence
  chemically synthesized
ctacaccatttactcccacttg

SEQ ID NO: 93197 - DNA, 22 bp, Artificial Sequence
  chemically synthesized
caccatttactcccacttgcag

SEQ ID NO: 93198 - DNA, 22 bp, Artificial Sequence
  chemically synthesized
actcccacttgcagaactcccg

SEQ ID NO: 93199 - DNA, 22 bp, Artificial Sequence
  chemically synthesized
ctcccacttgcagaactcccgt

SEQ ID NO: 93200 - DNA, 22 bp, Artificial Sequence
  chemically synthesized
ccacttgcagaactcccgtgta

SEQ ID NO: 93201 - DNA, 22 bp, Artificial Sequence
  chemically synthesized
gcagaactcccgtgtacaagtg

SEQ ID NO: 93202 - DNA, 22 bp, Artificial Sequence
  chemically synthesized
cagaactcccgtgtacaagtgt

SEQ ID NO: 93203 - DNA, 22 bp, Artificial Sequence
  chemically synthesized
ccgtgtacaagtgtctttactg

SEQ ID NO: 93204 - DNA, 22 bp, Artificial Sequence
  chemically synthesized
tactgcttttatttgctcatca

SEQ ID NO: 93205 - DNA, 22 bp, Artificial Sequence
  chemically synthesized
actgcttttatttgctcatcaa

SEQ ID NO: 93206 - DNA, 22 bp, Artificial Sequence
  chemically synthesized
ctgcttttatttgctcatcaaa

SEQ ID NO: 93207 - DNA, 22 bp, Artificial Sequence
  chemically synthesized
cttttatttgctcatcaaaatg

SEQ ID NO: 93208 - DNA, 22 bp, Artificial Sequence
  chemically synthesized
ttatttgctcatcaaaatgcac

SEQ ID NO: 93209 - DNA, 22 bp, Artificial Sequence
  chemically synthesized
tatttgctcatcaaaatgcaca

SEQ ID NO: 93210 - DNA, 22 bp, Artificial Sequence
  chemically synthesized
atttgctcatcaaaatgcacat

SEQ ID NO: 93211 - DNA, 22 bp, Artificial Sequence
  chemically synthesized
tttgctcatcaaaatgcacatc

SEQ ID NO: 93212 - DNA, 22 bp, Artificial Sequence
  chemically synthesized
gctcatcaaaatgcacatctca

SEQ ID NO: 93213 - DNA, 22 bp, Artificial Sequence
  chemically synthesized
ctcatcaaaatgcacatctcat

SEQ ID NO: 93214 - DNA, 22 bp, Artificial Sequence
  chemically synthesized
atcaaaatgcacatctcatata

SEQ ID NO: 93215 - DNA, 22 bp, Artificial Sequence
  chemically synthesized
atataaaaataaatgaggagca

SEQ ID NO: 93216 - DNA, 22 bp, Artificial Sequence
  chemically synthesized
ccctcaatataaaccctttgtg

SEQ ID NO: 93217 - DNA, 22 bp, Artificial Sequence
  chemically synthesized
cctcaatataaaccctttgtgg

SEQ ID NO: 93218 - DNA, 22 bp, Artificial Sequence
  chemically synthesized
aatataaaccctttgtggctca

SEQ ID NO: 93219 - DNA, 22 bp, Artificial Sequence
  chemically synthesized
tgtggctcatatatttaaaaag

SEQ ID NO: 93220 - DNA, 22 bp, Artificial Sequence
  chemically synthesized
gtggctcatatatttaaaaaga

SEQ ID NO: 93221 - DNA, 22 bp, Artificial Sequence
  chemically synthesized
tggctcatatatttaaaaagat

SEQ ID NO: 93222 - DNA, 22 bp, Artificial Sequence
  chemically synthesized
atatatttaaaaagatgtaaaa

SEQ ID NO: 93223 - DNA, 22 bp, Artificial Sequence
  chemically synthesized
aaaaagatgtaaaaaaaagagc

SEQ ID NO: 93224 - DNA, 22 bp, Artificial Sequence
  chemically synthesized
aaaagatgtaaaaaaaagagct

SEQ ID NO: 93225 - DNA, 22 bp, Artificial Sequence
  chemically synthesized
aagaaaatcatgtgtgatctct

SEQ ID NO: 93226 - DNA, 22 bp, Artificial Sequence
  chemically synthesized
tcagcagaatagatttattatt

SEQ ID NO: 93227 - DNA, 22 bp, Artificial Sequence
  chemically synthesized
agcagaatagatttattatttg

SEQ ID NO: 93228 - DNA, 22 bp, Artificial Sequence
  chemically synthesized
attatttgtattgcttgcagaa

SEQ ID NO: 93229 - DNA, 22 bp, Artificial Sequence
  chemically synthesized
ttatttgtattgcttgcagaat

SEQ ID NO: 93230 - DNA, 22 bp, Artificial Sequence
  chemically synthesized
tttgtattgcttgcagaataaa

SEQ ID NO: 93231 - DNA, 22 bp, Artificial Sequence
  chemically synthesized
gtattgcttgcagaataaagcc

SEQ ID NO: 93232 - DNA, 22 bp, Artificial Sequence
  chemically synthesized
tattgcttgcagaataaagcct

SEQ ID NO: 93233 - DNA, 22 bp, Artificial Sequence
  chemically synthesized
cttgcagaataaagcctatcct

SEQ ID NO: 93234 - DNA, 22 bp, Artificial Sequence
  chemically synthesized
gcagaataaagcctatccttga

SEQ ID NO: 93235 - DNA, 22 bp, Artificial Sequence
  chemically synthesized
cagaataaagcctatccttgaa

SEQ ID NO: 93236 - DNA, 22 bp, Artificial Sequence
  chemically synthesized
tccttgaaagctctgaatcatg

SEQ ID NO: 93237 - DNA, 22 bp, Artificial Sequence
  chemically synthesized
gaaagctctgaatcatgggcag

SEQ ID NO: 93238 - DNA, 22 bp, Artificial Sequence
  chemically synthesized
aaagctctgaatcatgggcagt

SEQ ID NO: 93239 - DNA, 22 bp, Artificial Sequence
  chemically synthesized
tgaatcatgggcagtgagctca

SEQ ID NO: 93240 - DNA, 22 bp, Artificial Sequence
  chemically synthesized
aatcatgggcagtgagctcagt

SEQ ID NO: 93241 - DNA, 22 bp, Artificial Sequence
  chemically synthesized
agtggtatctggaggacagggc

SEQ ID NO: 93242 - DNA, 22 bp, Artificial Sequence
  chemically synthesized
gaggacagggcactggccactg

SEQ ID NO: 93243 - DNA, 22 bp, Artificial Sequence
  chemically synthesized
gccactgcagtcaccatcttct

SEQ ID NO: 93244 - DNA, 22 bp, Artificial Sequence
  chemically synthesized
cagtcaccatcttctgccagga

SEQ ID NO: 93245 - DNA, 22 bp, Artificial Sequence
  chemically synthesized
ctgccaggaagcctgcacctca

SEQ ID NO: 93246 - DNA, 22 bp, Artificial Sequence
  chemically synthesized
tgccaggaagcctgcacctcag

SEQ ID NO: 93247 - DNA, 22 bp, Artificial Sequence
  chemically synthesized
ccaggaagcctgcacctcaggg

SEQ ID NO: 93248 - DNA, 22 bp, Artificial Sequence
  chemically synthesized
cacctcaggggtgaattctttg

SEQ ID NO: 93249 - DNA, 22 bp, Artificial Sequence
  chemically synthesized
aggggtgaattctttgccgaaa

SEQ ID NO: 93250 - DNA, 22 bp, Artificial Sequence
  chemically synthesized
tttgccgaaatggattgccaaa

SEQ ID NO: 93251 - DNA, 22 bp, Artificial Sequence
  chemically synthesized
tgccgaaatggattgccaaaac

SEQ ID NO: 93252 - DNA, 22 bp, Artificial Sequence
  chemically synthesized
gccgaaatggattgccaaaacg

SEQ ID NO: 93253 - DNA, 22 bp, Artificial Sequence
  chemically synthesized
ccgaaatggattgccaaaacgg

SEQ ID NO: 93254 - DNA, 22 bp, Artificial Sequence
  chemically synthesized
ccaaaacggtcaccagcacatt

SEQ ID NO: 93255 - DNA, 22 bp, Artificial Sequence
  chemically synthesized
cccaggagctgttgagatgaaa

SEQ ID NO: 93256 - DNA, 22 bp, Artificial Sequence
  chemically synthesized
ccaggagctgttgagatgaaag

SEQ ID NO: 93257 - DNA, 22 bp, Artificial Sequence
  chemically synthesized
ttgagatgaaaggagacaataa

SEQ ID NO: 93258 - DNA, 22 bp, Artificial Sequence
  chemically synthesized
agatgaaaggagacaataaaga

SEQ ID NO: 93259 - DNA, 22 bp, Artificial Sequence
  chemically synthesized
agagctccagcctggcctccag

SEQ ID NO: 93260 - DNA, 22 bp, Artificial Sequence
  chemically synthesized
cagcctggcctccagataacta

SEQ ID NO: 93261 - DNA, 22 bp, Artificial Sequence
  chemically synthesized
gcctccagataactacacacca

SEQ ID NO: 93262 - DNA, 22 bp, Artificial Sequence
  chemically synthesized
cagataactacacaccaagctt

SEQ ID NO: 93263 - DNA, 22 bp, Artificial Sequence
  chemically synthesized
cacaccaagcttccacccagaa

SEQ ID NO: 93264 - DNA, 22 bp, Artificial Sequence
  chemically synthesized
ccacccagaatcaagcctatgt

SEQ ID NO: 93265 - DNA, 22 bp, Artificial Sequence
  chemically synthesized
cacccagaatcaagcctatgtt

SEQ ID NO: 93266 - DNA, 22 bp, Artificial Sequence
  chemically synthesized
tgttaacttccctcaaagcctg

SEQ ID NO: 93267 - DNA, 22 bp, Artificial Sequence
  chemically synthesized
acttccctcaaagcctgagatt

SEQ ID NO: 93268 - DNA, 22 bp, Artificial Sequence
  chemically synthesized
ccctcaaagcctgagattttgc

SEQ ID NO: 93269 - DNA, 22 bp, Artificial Sequence
  chemically synthesized
cctcaaagcctgagattttgcc

SEQ ID NO: 93270 - DNA, 22 bp, Artificial Sequence
  chemically synthesized
aaagcctgagattttgccttcc

SEQ ID NO: 93271 - DNA, 22 bp, Artificial Sequence
  chemically synthesized
agattttgccttcccattaaat

SEQ ID NO: 93272 - DNA, 22 bp, Artificial Sequence
  chemically synthesized
tgccttcccattaaatgcaggt

SEQ ID NO: 93273 - DNA, 22 bp, Artificial Sequence
  chemically synthesized
gccttcccattaaatgcaggta

SEQ ID NO: 93274 - DNA, 22 bp, Artificial Sequence
  chemically synthesized
ccttcccattaaatgcaggtag

SEQ ID NO: 93275 - DNA, 22 bp, Artificial Sequence
  chemically synthesized
cccattaaatgcaggtagttgt

SEQ ID NO: 93276 - DNA, 22 bp, Artificial Sequence
  chemically synthesized
ccattaaatgcaggtagttgtt

SEQ ID NO: 93277 - DNA, 22 bp, Artificial Sequence
  chemically synthesized
aatgcaggtagttgttcccctt

SEQ ID NO: 93278 - DNA, 22 bp, Artificial Sequence
  chemically synthesized
ttccccttcaagcactagtcac

SEQ ID NO: 93279 - DNA, 22 bp, Artificial Sequence
  chemically synthesized
cccttcaagcactagtcactgg

SEQ ID NO: 93280 - DNA, 22 bp, Artificial Sequence
  chemically synthesized
caagcactagtcactggccata

SEQ ID NO: 93281 - DNA, 22 bp, Artificial Sequence
  chemically synthesized
aagcactagtcactggccataa

SEQ ID NO: 93282 - DNA, 22 bp, Artificial Sequence
  chemically synthesized
gtcactggccataatttaaatc

SEQ ID NO: 93283 - DNA, 22 bp, Artificial Sequence
  chemically synthesized
gccataatttaaatcttgctat

SEQ ID NO: 93284 - DNA, 22 bp, Artificial Sequence
  chemically synthesized
aaatcttgctatcttcttgcca

SEQ ID NO: 93285 - DNA, 22 bp, Artificial Sequence
  chemically synthesized
aatcttgctatcttcttgccac

SEQ ID NO: 93286 - DNA, 22 bp, Artificial Sequence
  chemically synthesized
gctatcttcttgccaccatgaa

SEQ ID NO: 93287 - DNA, 22 bp, Artificial Sequence
  chemically synthesized
ctatcttcttgccaccatgaac

SEQ ID NO: 93288 - DNA, 22 bp, Artificial Sequence
  chemically synthesized
tcttcttgccaccatgaaccct

SEQ ID NO: 93289 - DNA, 22 bp, Artificial Sequence
  chemically synthesized
cttgccaccatgaaccctgtat

SEQ ID NO: 93290 - DNA, 22 bp, Artificial Sequence
  chemically synthesized
ttgccaccatgaaccctgtatg

SEQ ID NO: 93291 - DNA, 22 bp, Artificial Sequence
  chemically synthesized
gccaccatgaaccctgtatgtt

SEQ ID NO: 93292 - DNA, 22 bp, Artificial Sequence
  chemically synthesized
ccaccatgaaccctgtatgttg

SEQ ID NO: 93293 - DNA, 22 bp, Artificial Sequence
  chemically synthesized
tatgttgtaggctgaagacgtt

SEQ ID NO: 93294 - DNA, 22 bp, Artificial Sequence
  chemically synthesized
taggctgaagacgttaaaagaa

SEQ ID NO: 93295 - DNA, 22 bp, Artificial Sequence
  chemically synthesized
aagacgttaaaagaaacacacg

SEQ ID NO: 93296 - DNA, 22 bp, Artificial Sequence
  chemically synthesized
aaagaaacacacgctgacacac

SEQ ID NO: 93297 - DNA, 22 bp, Artificial Sequence
  chemically synthesized
acacacacacacacacgcgcgc

SEQ ID NO: 93298 - DNA, 22 bp, Artificial Sequence
  chemically synthesized
actttcaaaatctactccagcc

SEQ ID NO: 93299 - DNA, 22 bp, Artificial Sequence
  chemically synthesized
tcaaaatctactccagcccaaa

SEQ ID NO: 93300 - DNA, 22 bp, Artificial Sequence
  chemically synthesized
caaaatctactccagcccaaat

SEQ ID NO: 93301 - DNA, 22 bp, Artificial Sequence
  chemically synthesized
aaaatctactccagcccaaatg

SEQ ID NO: 93302 - DNA, 22 bp, Artificial Sequence
  chemically synthesized
ctccagcccaaatgtttcaatt

SEQ ID NO: 93303 - DNA, 22 bp, Artificial Sequence
  chemically synthesized
cagcccaaatgtttcaattgtt

SEQ ID NO: 93304 - DNA, 22 bp, Artificial Sequence
  chemically synthesized
caattgttcctcacccctggac

SEQ ID NO: 93305 - DNA, 22 bp, Artificial Sequence
  chemically synthesized
aattgttcctcacccctggaca

SEQ ID NO: 93306 - DNA, 22 bp, Artificial Sequence
  chemically synthesized
ttcctcacccctggacatactt

SEQ ID NO: 93307 - DNA, 22 bp, Artificial Sequence
  chemically synthesized
ctcacccctggacatactttgc

SEQ ID NO: 93308 - DNA, 22 bp, Artificial Sequence
  chemically synthesized
acccctggacatactttgcccc

SEQ ID NO: 93309 - DNA, 22 bp, Artificial Sequence
  chemically synthesized
gacatactttgcccccatctgg

SEQ ID NO: 93310 - DNA, 22 bp, Artificial Sequence
  chemically synthesized
tgcccccatctggaattaaagg

SEQ ID NO: 93311 - DNA, 22 bp, Artificial Sequence
  chemically synthesized
gcccccatctggaattaaagga

SEQ ID NO: 93312 - DNA, 22 bp, Artificial Sequence
  chemically synthesized
cccccatctggaattaaaggat

SEQ ID NO: 93313 - DNA, 22 bp, Artificial Sequence
  chemically synthesized
gaattaaaggatataagtttgt

SEQ ID NO: 93314 - DNA, 22 bp, Artificial Sequence
  chemically synthesized
aaggatataagtttgtaatgaa

SEQ ID NO: 93315 - DNA, 22 bp, Artificial Sequence
  chemically synthesized
gtaatgaagcattagcagcatt

SEQ ID NO: 93316 - DNA, 22 bp, Artificial Sequence
  chemically synthesized
taatgaagcattagcagcattt

SEQ ID NO: 93317 - DNA, 22 bp, Artificial Sequence
  chemically synthesized
gcagcattttatatgtgtccag

SEQ ID NO: 93318 - DNA, 22 bp, Artificial Sequence
  chemically synthesized
tatatgtgtccagctgatatag

SEQ ID NO: 93319 - DNA, 22 bp, Artificial Sequence
  chemically synthesized
atatgtgtccagctgatatagg

SEQ ID NO: 93320 - DNA, 22 bp, Artificial Sequence
  chemically synthesized
tatgtgtccagctgatatagga

SEQ ID NO: 93321 - DNA, 22 bp, Artificial Sequence
  chemically synthesized
atataggaatagccttagcaat

SEQ ID NO: 93322 - DNA, 22 bp, Artificial Sequence
  chemically synthesized
agcaatgtatgtttggccacca

SEQ ID NO: 93323 - DNA, 22 bp, Artificial Sequence
  chemically synthesized
gcaatgtatgtttggccaccaa

SEQ ID NO: 93324 - DNA, 22 bp, Artificial Sequence
  chemically synthesized
ggccaccaaagttccccacttt

SEQ ID NO: 93325 - DNA, 22 bp, Artificial Sequence
  chemically synthesized
gccaccaaagttccccactttg

SEQ ID NO: 93326 - DNA, 22 bp, Artificial Sequence
  chemically synthesized
cccactttgactgagccaatat

SEQ ID NO: 93327 - DNA, 22 bp, Artificial Sequence
  chemically synthesized
tgactgagccaatatatgcctt

SEQ ID NO: 93328 - DNA, 22 bp, Artificial Sequence
  chemically synthesized
gactgagccaatatatgccttc

SEQ ID NO: 93329 - DNA, 22 bp, Artificial Sequence
  chemically synthesized
actgagccaatatatgccttct

SEQ ID NO: 93330 - DNA, 22 bp, Artificial Sequence
  chemically synthesized
agccaatatatgccttctgcct

SEQ ID NO: 93331 - DNA, 22 bp, Artificial Sequence
  chemically synthesized
ctgcctgcatctttttaacgac

SEQ ID NO: 93332 - DNA, 22 bp, Artificial Sequence
  chemically synthesized
tgcctgcatctttttaacgacc

SEQ ID NO: 93333 - DNA, 22 bp, Artificial Sequence
  chemically synthesized
cctgcatctttttaacgaccat

SEQ ID NO: 93334 - DNA, 22 bp, Artificial Sequence
  chemically synthesized
catctttttaacgaccatactt

SEQ ID NO: 93335 - DNA, 22 bp, Artificial Sequence
  chemically synthesized
tttaacgaccatacttgtcctg

SEQ ID NO: 93336 - DNA, 22 bp, Artificial Sequence
  chemically synthesized
ttaacgaccatacttgtcctgc

SEQ ID NO: 93337 - DNA, 22 bp, Artificial Sequence
  chemically synthesized
taacgaccatacttgtcctgcc

SEQ ID NO: 93338 - DNA, 22 bp, Artificial Sequence
  chemically synthesized
aacgaccatacttgtcctgcct

SEQ ID NO: 93339 - DNA, 22 bp, Artificial Sequence
  chemically synthesized
acgaccatacttgtcctgcctc

SEQ ID NO: 93340 - DNA, 22 bp, Artificial Sequence
  chemically synthesized
gtcctgcctccagatagatgtt

SEQ ID NO: 93341 - DNA, 22 bp, Artificial Sequence
  chemically synthesized
tcctgcctccagatagatgttt

SEQ ID NO: 93342 - DNA, 22 bp, Artificial Sequence
  chemically synthesized
cctccagatagatgttttaaaa

SEQ ID NO: 93343 - DNA, 22 bp, Artificial Sequence
  chemically synthesized
cagatagatgttttaaaacaac

SEQ ID NO: 93344 - DNA, 22 bp, Artificial Sequence
  chemically synthesized
taaaacaacaaaaatgagggaa

SEQ ID NO: 93345 - DNA, 22 bp, Artificial Sequence
  chemically synthesized
aaaacaacaaaaatgagggaaa

SEQ ID NO: 93346 - DNA, 22 bp, Artificial Sequence
  chemically synthesized
aaacaacaaaaatgagggaaag

SEQ ID NO: 93347 - DNA, 22 bp, Artificial Sequence
  chemically synthesized
tttctactggaatctaataaag

SEQ ID NO: 93348 - DNA, 22 bp, Artificial Sequence
  chemically synthesized
tctactggaatctaataaagaa

SEQ ID NO: 93349 - DNA, 22 bp, Artificial Sequence
  chemically synthesized
ctactggaatctaataaagaaa

SEQ ID NO: 93350 - DNA, 22 bp, Artificial Sequence
  chemically synthesized
tactggaatctaataaagaaaa

SEQ ID NO: 93351 - DNA, 22 bp, Artificial Sequence
  chemically synthesized
ctggaatctaataaagaaaagt

SEQ ID NO: 93352 - DNA, 22 bp, Artificial Sequence
  chemically synthesized
gaatctaataaagaaaagtcat

SEQ ID NO: 93353 - DNA, 22 bp, Artificial Sequence
  chemically synthesized
ataaagaaaagtcattttcctc

SEQ ID NO: 93354 - DNA, 22 bp, Artificial Sequence
  chemically synthesized
tcctcatttccacctctctttt

SEQ ID NO: 93355 - DNA, 22 bp, Artificial Sequence
  chemically synthesized
cctcatttccacctctcttttc

SEQ ID NO: 93356 - DNA, 22 bp, Artificial Sequence
  chemically synthesized
ctcatttccacctctcttttct

SEQ ID NO: 93357 - DNA, 22 bp, Artificial Sequence
  chemically synthesized
atttccacctctcttttctcaa

SEQ ID NO: 93358 - DNA, 22 bp, Artificial Sequence
  chemically synthesized
ccacctctcttttctcaaagtc

SEQ ID NO: 93359 - DNA, 22 bp, Artificial Sequence
  chemically synthesized
cacctctcttttctcaaagtca

SEQ ID NO: 93360 - DNA, 22 bp, Artificial Sequence
  chemically synthesized
tcttttctcaaagtcaaaattg

SEQ ID NO: 93361 - DNA, 22 bp, Artificial Sequence
  chemically synthesized
ttttctcaaagtcaaaattgtc

SEQ ID NO: 93362 - DNA, 22 bp, Artificial Sequence
  chemically synthesized
ttctcaaagtcaaaattgtcca

SEQ ID NO: 93363 - DNA, 22 bp, Artificial Sequence
  chemically synthesized
tctcaaagtcaaaattgtccat

SEQ ID NO: 93364 - DNA, 22 bp, Artificial Sequence
  chemically synthesized
ctcaaagtcaaaattgtccatc

SEQ ID NO: 93365 - DNA, 22 bp, Artificial Sequence
  chemically synthesized
tcaaagtcaaaattgtccatct

SEQ ID NO: 93366 - DNA, 22 bp, Artificial Sequence
  chemically synthesized
aaagtcaaaattgtccatctag

SEQ ID NO: 93367 - DNA, 22 bp, Artificial Sequence
  chemically synthesized
tccatctagatttttagaggca

SEQ ID NO: 93368 - DNA, 22 bp, Artificial Sequence
  chemically synthesized
gatttttagaggcactccttag

SEQ ID NO: 93369 - DNA, 22 bp, Artificial Sequence
  chemically synthesized
ttagaggcactccttaggccct

SEQ ID NO: 93370 - DNA, 22 bp, Artificial Sequence
  chemically synthesized
tagaggcactccttaggcccta

SEQ ID NO: 93371 - DNA, 22 bp, Artificial Sequence
  chemically synthesized
agaggcactccttaggccctaa

SEQ ID NO: 93372 - DNA, 22 bp, Artificial Sequence
  chemically synthesized
gaggcactccttaggccctaaa

SEQ ID NO: 93373 - DNA, 22 bp, Artificial Sequence
  chemically synthesized
cttaggccctaaaacattacca

SEQ ID NO: 93374 - DNA, 22 bp, Artificial Sequence
  chemically synthesized
aggccctaaaacattaccactg

SEQ ID NO: 93375 - DNA, 22 bp, Artificial Sequence
  chemically synthesized
ggccctaaaacattaccactgg

SEQ ID NO: 93376 - DNA, 22 bp, Artificial Sequence
  chemically synthesized
aaacattaccactgggtctcag

SEQ ID NO: 93377 - DNA, 22 bp, Artificial Sequence
  chemically synthesized
ccactgggtctcagcccagtta

SEQ ID NO: 93378 - DNA, 22 bp, Artificial Sequence
  chemically synthesized
ggtctcagcccagttagtcctc

SEQ ID NO: 93379 - DNA, 22 bp, Artificial Sequence
  chemically synthesized
agcccagttagtcctctgcagt

SEQ ID NO: 93380 - DNA, 22 bp, Artificial Sequence
  chemically synthesized
gtcctctgcagtttcttcaccc

SEQ ID NO: 93381 - DNA, 22 bp, Artificial Sequence
  chemically synthesized
tgcagtttcttcacccccaacc

SEQ ID NO: 93382 - DNA, 22 bp, Artificial Sequence
  chemically synthesized
cagtttcttcacccccaacccc

SEQ ID NO: 93383 - DNA, 22 bp, Artificial Sequence
  chemically synthesized
cttcacccccaaccccagtatc

SEQ ID NO: 93384 - DNA, 22 bp, Artificial Sequence
  chemically synthesized
ttcacccccaaccccagtatct

SEQ ID NO: 93385 - DNA, 22 bp, Artificial Sequence
  chemically synthesized
cacccccaaccccagtatcttc

SEQ ID NO: 93386 - DNA, 22 bp, Artificial Sequence
  chemically synthesized
acccccaaccccagtatcttca

SEQ ID NO: 93387 - DNA, 22 bp, Artificial Sequence
  chemically synthesized
caaacagctcacaccctgctgt

SEQ ID NO: 93388 - DNA, 22 bp, Artificial Sequence
  chemically synthesized
aaacagctcacaccctgctgtg

SEQ ID NO: 93389 - DNA, 22 bp, Artificial Sequence
  chemically synthesized
acaccctgctgtgctcagatca

SEQ ID NO: 93390 - DNA, 22 bp, Artificial Sequence
  chemically synthesized
ctgtgctcagatcaatactccg

SEQ ID NO: 93391 - DNA, 22 bp, Artificial Sequence
  chemically synthesized
tgctcagatcaatactccgttg

SEQ ID NO: 93392 - DNA, 22 bp, Artificial Sequence
  chemically synthesized
agatcaatactccgttgtctaa

SEQ ID NO: 93393 - DNA, 22 bp, Artificial Sequence
  chemically synthesized
cgttgtctaagttgcctcgaga

SEQ ID NO: 93394 - DNA, 22 bp, Artificial Sequence
  chemically synthesized
tctaagttgcctcgagactaaa

SEQ ID NO: 93395 - DNA, 22 bp, Artificial Sequence
  chemically synthesized
agttgcctcgagactaaaggca

SEQ ID NO: 93396 - DNA, 22 bp, Artificial Sequence
  chemically synthesized
cctcgagactaaaggcaacagg

SEQ ID NO: 93397 - DNA, 22 bp, Artificial Sequence
  chemically synthesized
gagactaaaggcaacagggctg

SEQ ID NO: 93398 - DNA, 22 bp, Artificial Sequence
  chemically synthesized
aaggcaacagggctgaaacatc

SEQ ID NO: 93399 - DNA, 22 bp, Artificial Sequence
  chemically synthesized
aaacatctcctggactcacctt

SEQ ID NO: 93400 - DNA, 22 bp, Artificial Sequence
  chemically synthesized
ctggactcaccttgaagttctc

SEQ ID NO: 93401 - DNA, 22 bp, Artificial Sequence
  chemically synthesized
gactcaccttgaagttctcagg

SEQ ID NO: 93402 - DNA, 22 bp, Artificial Sequence
  chemically synthesized
accttgaagttctcaggatcca

SEQ ID NO: 93403 - DNA, 22 bp, Artificial Sequence
  chemically synthesized
gaagttctcaggatccacatgc

SEQ ID NO: 93404 - DNA, 22 bp, Artificial Sequence
  chemically synthesized
aagttctcaggatccacatgca

SEQ ID NO: 93405 - DNA, 22 bp, Artificial Sequence
  chemically synthesized
tcaggatccacatgcagcttgt

SEQ ID NO: 93406 - DNA, 22 bp, Artificial Sequence
  chemically synthesized
aggatccacatgcagcttgtca

SEQ ID NO: 93407 - DNA, 22 bp, Artificial Sequence
  chemically synthesized
gtcacagtgcagttcactcagc

SEQ ID NO: 93408 - DNA, 22 bp, Artificial Sequence
  chemically synthesized
tcacagtgcagttcactcagct

SEQ ID NO: 93409 - DNA, 22 bp, Artificial Sequence
  chemically synthesized
actcagctgggcaaaggtgccc

SEQ ID NO: 93410 - DNA, 22 bp, Artificial Sequence
  chemically synthesized
agctgggcaaaggtgcccttga

SEQ ID NO: 93411 - DNA, 22 bp, Artificial Sequence
  chemically synthesized
ggcaaaggtgcccttgagatca

SEQ ID NO: 93412 - DNA, 22 bp, Artificial Sequence
  chemically synthesized
gagatcatccaggtgctttgtg

SEQ ID NO: 93413 - DNA, 22 bp, Artificial Sequence
  chemically synthesized
agatcatccaggtgctttgtgg

SEQ ID NO: 93414 - DNA, 22 bp, Artificial Sequence
  chemically synthesized
tgtggcatctcccaaggaagtc

SEQ ID NO: 93415 - DNA, 22 bp, Artificial Sequence
  chemically synthesized
gtggcatctcccaaggaagtca

SEQ ID NO: 93416 - DNA, 22 bp, Artificial Sequence
  chemically synthesized
tggcatctcccaaggaagtcag

SEQ ID NO: 93417 - DNA, 22 bp, Artificial Sequence
  chemically synthesized
ccaaggaagtcagcaccttctt

SEQ ID NO: 93418 - DNA, 22 bp, Artificial Sequence
  chemically synthesized
cttgccatgtgccttgactttg

SEQ ID NO: 93419 - DNA, 22 bp, Artificial Sequence
  chemically synthesized
ttgccatgtgccttgactttgg

SEQ ID NO: 93420 - DNA, 22 bp, Artificial Sequence
  chemically synthesized
gccatgtgccttgactttgggg

SEQ ID NO: 93421 - DNA, 22 bp, Artificial Sequence
  chemically synthesized
ccatgtgccttgactttggggt

SEQ ID NO: 93422 - DNA, 22 bp, Artificial Sequence
  chemically synthesized
gactttggggttgcccatgatg

SEQ ID NO: 93423 - DNA, 22 bp, Artificial Sequence
  chemically synthesized
actttggggttgcccatgatgg

SEQ ID NO: 93424 - DNA, 22 bp, Artificial Sequence
  chemically synthesized
tggggttgcccatgatggcaga

SEQ ID NO: 93425 - DNA, 22 bp, Artificial Sequence
  chemically synthesized
ggggttgcccatgatggcagag

SEQ ID NO: 93426 - DNA, 22 bp, Artificial Sequence
  chemically synthesized
gggttgcccatgatggcagagg

SEQ ID NO: 93427 - DNA, 22 bp, Artificial Sequence
  chemically synthesized
cccatgatggcagaggcagagg

SEQ ID NO: 93428 - DNA, 22 bp, Artificial Sequence
  chemically synthesized
ccaaagctgtcaaagaacctct

SEQ ID NO: 93429 - DNA, 22 bp, Artificial Sequence
  chemically synthesized
tcaaagaacctctgggtccatg

SEQ ID NO: 93430 - DNA, 22 bp, Artificial Sequence
  chemically synthesized
tgggtccatgggtagacaacca

SEQ ID NO: 93431 - DNA, 22 bp, Artificial Sequence
  chemically synthesized
ggtccatgggtagacaaccagg

SEQ ID NO: 93432 - DNA, 22 bp, Artificial Sequence
  chemically synthesized
tgagattgacaagaacagtttg

SEQ ID NO: 93433 - DNA, 22 bp, Artificial Sequence
  chemically synthesized
acaagaacagtttgacagtcag

SEQ ID NO: 93434 - DNA, 22 bp, Artificial Sequence
  chemically synthesized
gacagtcagaaggtgccacaaa

SEQ ID NO: 93435 - DNA, 22 bp, Artificial Sequence
  chemically synthesized
acagtcagaaggtgccacaaat

SEQ ID NO: 93436 - DNA, 22 bp, Artificial Sequence
  chemically synthesized
agaagcgacctggacttttgcc

SEQ ID NO: 93437 - DNA, 22 bp, Artificial Sequence
  chemically synthesized
gacttttgccaggcacagggtc

SEQ ID NO: 93438 - DNA, 22 bp, Artificial Sequence
  chemically synthesized
ttgccaggcacagggtccttcc

SEQ ID NO: 93439 - DNA, 22 bp, Artificial Sequence
  chemically synthesized
tgccaggcacagggtccttcct

SEQ ID NO: 93440 - DNA, 22 bp, Artificial Sequence
  chemically synthesized
gccaggcacagggtccttcctt

SEQ ID NO: 93441 - DNA, 22 bp, Artificial Sequence
  chemically synthesized
ccaggcacagggtccttccttc

SEQ ID NO: 93442 - DNA, 22 bp, Artificial Sequence
  chemically synthesized
ccttccctcccttgtcctggtc

SEQ ID NO: 93443 - DNA, 22 bp, Artificial Sequence
  chemically synthesized
cttccctcccttgtcctggtca

SEQ ID NO: 93444 - DNA, 22 bp, Artificial Sequence
  chemically synthesized
ccctcccttgtcctggtcacca

SEQ ID NO: 93445 - DNA, 22 bp, Artificial Sequence
  chemically synthesized
cctcccttgtcctggtcaccag

SEQ ID NO: 93446 - DNA, 22 bp, Artificial Sequence
  chemically synthesized
ccttgtcctggtcaccagagcc

SEQ ID NO: 93447 - DNA, 22 bp, Artificial Sequence
  chemically synthesized
gtcctggtcaccagagcctacc

SEQ ID NO: 93448 - DNA, 22 bp, Artificial Sequence
  chemically synthesized
tcctggtcaccagagcctacct

SEQ ID NO: 93449 - DNA, 22 bp, Artificial Sequence
  chemically synthesized
gtcaccagagcctaccttccca

SEQ ID NO: 93450 - DNA, 22 bp, Artificial Sequence
  chemically synthesized
ccttcccagggtttctcctcca

SEQ ID NO: 93451 - DNA, 22 bp, Artificial Sequence
  chemically synthesized
cccagggtttctcctccagcat

SEQ ID NO: 93452 - DNA, 22 bp, Artificial Sequence
  chemically synthesized
ccagggtttctcctccagcatc

SEQ ID NO: 93453 - DNA, 22 bp, Artificial Sequence
  chemically synthesized
ctcctccagcatcttccacatt

SEQ ID NO: 93454 - DNA, 22 bp, Artificial Sequence
  chemically synthesized
tcctccagcatcttccacattc

SEQ ID NO: 93455 - DNA, 22 bp, Artificial Sequence
  chemically synthesized
ctccagcatcttccacattcac

SEQ ID NO: 93456 - DNA, 22 bp, Artificial Sequence
  chemically synthesized
cagcatcttccacattcacctt

SEQ ID NO: 93457 - DNA, 22 bp, Artificial Sequence
  chemically synthesized
ccacattcaccttgccccacag

SEQ ID NO: 93458 - DNA, 22 bp, Artificial Sequence
  chemically synthesized
cacattcaccttgccccacagg

SEQ ID NO: 93459 - DNA, 22 bp, Artificial Sequence
  chemically synthesized
accttgccccacaggcttgtga

SEQ ID NO: 93460 - DNA, 22 bp, Artificial Sequence
  chemically synthesized
gccccacaggcttgtgatagta

SEQ ID NO: 93461 - DNA, 22 bp, Artificial Sequence
  chemically synthesized
ccccacaggcttgtgatagtag

SEQ ID NO: 93462 - DNA, 22 bp, Artificial Sequence
  chemically synthesized
gtgatagtagccttgtcctcct

SEQ ID NO: 93463 - DNA, 22 bp, Artificial Sequence
  chemically synthesized
tgatagtagccttgtcctcctc

SEQ ID NO: 93464 - DNA, 22 bp, Artificial Sequence
  chemically synthesized
gtcctcctctgtgaaatgaccc

SEQ ID NO: 93465 - DNA, 22 bp, Artificial Sequence
  chemically synthesized
tcctcctctgtgaaatgaccca

SEQ ID NO: 93466 - DNA, 22 bp, Artificial Sequence
  chemically synthesized
ctctgtgaaatgacccatggcg

SEQ ID NO: 93467 - DNA, 22 bp, Artificial Sequence
  chemically synthesized
tgtgaaatgacccatggcgtct

SEQ ID NO: 93468 - DNA, 22 bp, Artificial Sequence
  chemically synthesized
tgaaatgacccatggcgtctgg

SEQ ID NO: 93469 - DNA, 22 bp, Artificial Sequence
  chemically synthesized
gactaggagcttattgataacc

SEQ ID NO: 93470 - DNA, 22 bp, Artificial Sequence
  chemically synthesized
ggagcttattgataacctcaga

SEQ ID NO: 93471 - DNA, 22 bp, Artificial Sequence
  chemically synthesized
attgataacctcagacgttcca

SEQ ID NO: 93472 - DNA, 22 bp, Artificial Sequence
  chemically synthesized
ttgataacctcagacgttccag

SEQ ID NO: 93473 - DNA, 22 bp, Artificial Sequence
  chemically synthesized
ataacctcagacgttccagaag

SEQ ID NO: 93474 - DNA, 22 bp, Artificial Sequence
  chemically synthesized
agacgttccagaagcgagtgtg

SEQ ID NO: 93475 - DNA, 22 bp, Artificial Sequence
  chemically synthesized
cagaagcgagtgtgtggaactg

SEQ ID NO: 93476 - DNA, 22 bp, Artificial Sequence
  chemically synthesized
ctgaagggtgcttccttttatt

SEQ ID NO: 93477 - DNA, 22 bp, Artificial Sequence
  chemically synthesized
aagggtgcttccttttattctt

SEQ ID NO: 93478 - DNA, 22 bp, Artificial Sequence
  chemically synthesized
ccttttattcttcatccctagc

SEQ ID NO: 93479 - DNA, 22 bp, Artificial Sequence
  chemically synthesized
cttttattcttcatccctagcc

SEQ ID NO: 93480 - DNA, 22 bp, Artificial Sequence
  chemically synthesized
ttattcttcatccctagccagc

SEQ ID NO: 93481 - DNA, 22 bp, Artificial Sequence
  chemically synthesized
tattcttcatccctagccagcc

SEQ ID NO: 93482 - DNA, 22 bp, Artificial Sequence
  chemically synthesized
attcttcatccctagccagccg

SEQ ID NO: 93483 - DNA, 22 bp, Artificial Sequence
  chemically synthesized
ttcttcatccctagccagccgc

SEQ ID NO: 93484 - DNA, 22 bp, Artificial Sequence
  chemically synthesized
ttcatccctagccagccgccgg

SEQ ID NO: 93485 - DNA, 22 bp, Artificial Sequence
  chemically synthesized
catccctagccagccgccggcc

SEQ ID NO: 93486 - DNA, 22 bp, Artificial Sequence
  chemically synthesized
atccctagccagccgccggccc

SEQ ID NO: 93487 - DNA, 22 bp, Artificial Sequence
  chemically synthesized
gccagccgccggcccctggcct

SEQ ID NO: 93488 - DNA, 22 bp, Artificial Sequence
  chemically synthesized
gcctcactggatactctaagac

SEQ ID NO: 93489 - DNA, 22 bp, Artificial Sequence
  chemically synthesized
actggatactctaagactattg

SEQ ID NO: 93490 - DNA, 22 bp, Artificial Sequence
  chemically synthesized
gatactctaagactattggtca

SEQ ID NO: 93491 - DNA, 22 bp, Artificial Sequence
  chemically synthesized
taagactattggtcaagtttgc

SEQ ID NO: 93492 - DNA, 22 bp, Artificial Sequence
  chemically synthesized
agactattggtcaagtttgcct

SEQ ID NO: 93493 - DNA, 22 bp, Artificial Sequence
  chemically synthesized
ttggtcaagtttgccttgtcaa

SEQ ID NO: 93494 - DNA, 22 bp, Artificial Sequence
  chemically synthesized
gtcaagtttgccttgtcaaggc

SEQ ID NO: 93495 - DNA, 22 bp, Artificial Sequence
  chemically synthesized
gccttgtcaaggctattggtca

SEQ ID NO: 93496 - DNA, 22 bp, Artificial Sequence
  chemically synthesized
ccttgtcaaggctattggtcaa

SEQ ID NO: 93497 - DNA, 22 bp, Artificial Sequence
  chemically synthesized
gtcaaggctattggtcaaggca

SEQ ID NO: 93498 - DNA, 22 bp, Artificial Sequence
  chemically synthesized
tcaaggctattggtcaaggcaa

SEQ ID NO: 93499 - DNA, 22 bp, Artificial Sequence
  chemically synthesized
ttggtcaaggcaaggctggcca

SEQ ID NO: 93500 - DNA, 22 bp, Artificial Sequence
  chemically synthesized
gtcaaggcaaggctggccaacc

SEQ ID NO: 93501 - DNA, 22 bp, Artificial Sequence
  chemically synthesized
gccaacccatgggtggagttta

SEQ ID NO: 93502 - DNA, 22 bp, Artificial Sequence
  chemically synthesized
agccagggaccgtttcagacag

SEQ ID NO: 93503 - DNA, 22 bp, Artificial Sequence
  chemically synthesized
gccagggaccgtttcagacaga

SEQ ID NO: 93504 - DNA, 22 bp, Artificial Sequence
  chemically synthesized
cagacagatatttgcattgaga

SEQ ID NO: 93505 - DNA, 22 bp, Artificial Sequence
  chemically synthesized
agacagatatttgcattgagat

SEQ ID NO: 93506 - DNA, 22 bp, Artificial Sequence
  chemically synthesized
gcattgagatagtgtggggaag

SEQ ID NO: 93507 - DNA, 22 bp, Artificial Sequence
  chemically synthesized
cattgagatagtgtggggaagg

SEQ ID NO: 93508 - DNA, 22 bp, Artificial Sequence
  chemically synthesized
agatagtgtggggaaggggccc

SEQ ID NO: 93509 - DNA, 22 bp, Artificial Sequence
  chemically synthesized
ctaattttttttatagcctttg

SEQ ID NO: 93510 - DNA, 22 bp, Artificial Sequence
  chemically synthesized
attttttttatagcctttgcct

SEQ ID NO: 93511 - DNA, 22 bp, Artificial Sequence
  chemically synthesized
tttttatagcctttgccttgtt

SEQ ID NO: 93512 - DNA, 22 bp, Artificial Sequence
  chemically synthesized
ttttatagcctttgccttgttc

SEQ ID NO: 93513 - DNA, 22 bp, Artificial Sequence
  chemically synthesized
tttatagcctttgccttgttcc

SEQ ID NO: 93514 - DNA, 22 bp, Artificial Sequence
  chemically synthesized
ttatagcctttgccttgttccg

SEQ ID NO: 93515 - DNA, 22 bp, Artificial Sequence
  chemically synthesized
tatagcctttgccttgttccga

SEQ ID NO: 93516 - DNA, 22 bp, Artificial Sequence
  chemically synthesized
atagcctttgccttgttccgat

SEQ ID NO: 93517 - DNA, 22 bp, Artificial Sequence
  chemically synthesized
tagcctttgccttgttccgatt

SEQ ID NO: 93518 - DNA, 22 bp, Artificial Sequence
  chemically synthesized
tgccttgttccgattcagtcat

SEQ ID NO: 93519 - DNA, 22 bp, Artificial Sequence
  chemically synthesized
gccttgttccgattcagtcatt

SEQ ID NO: 93520 - DNA, 22 bp, Artificial Sequence
  chemically synthesized
ccttgttccgattcagtcattc

SEQ ID NO: 93521 - DNA, 22 bp, Artificial Sequence
  chemically synthesized
gttccgattcagtcattccagt

SEQ ID NO: 93522 - DNA, 22 bp, Artificial Sequence
  chemically synthesized
ttccgattcagtcattccagtt

SEQ ID NO: 93523 - DNA, 22 bp, Artificial Sequence
  chemically synthesized
cgattcagtcattccagttttt

SEQ ID NO: 93524 - DNA, 22 bp, Artificial Sequence
  chemically synthesized
agtcattccagtttttctctaa

SEQ ID NO: 93525 - DNA, 22 bp, Artificial Sequence
  chemically synthesized
cagtttttctctaatttattct

SEQ ID NO: 93526 - DNA, 22 bp, Artificial Sequence
  chemically synthesized
ttctctaatttattcttccctt

SEQ ID NO: 93527 - DNA, 22 bp, Artificial Sequence
  chemically synthesized
tctctaatttattcttcccttt

SEQ ID NO: 93528 - DNA, 22 bp, Artificial Sequence
  chemically synthesized
ctctaatttattcttcccttta

SEQ ID NO: 93529 - DNA, 22 bp, Artificial Sequence
  chemically synthesized
tctaatttattcttccctttag

SEQ ID NO: 93530 - DNA, 22 bp, Artificial Sequence
  chemically synthesized
taatttattcttccctttagct

SEQ ID NO: 93531 - DNA, 22 bp, Artificial Sequence
  chemically synthesized
atttattcttccctttagctag

SEQ ID NO: 93532 - DNA, 22 bp, Artificial Sequence
  chemically synthesized
attcttccctttagctagtttc

SEQ ID NO: 93533 - DNA, 22 bp, Artificial Sequence
  chemically synthesized
ttcttccctttagctagtttcc

SEQ ID NO: 93534 - DNA, 22 bp, Artificial Sequence
  chemically synthesized
ttccctttagctagtttccttc

SEQ ID NO: 93535 - DNA, 22 bp, Artificial Sequence
  chemically synthesized
ccctttagctagtttccttctc

SEQ ID NO: 93536 - DNA, 22 bp, Artificial Sequence
  chemically synthesized
cctttagctagtttccttctcc

SEQ ID NO: 93537 - DNA, 22 bp, Artificial Sequence
  chemically synthesized
tagctagtttccttctcccatc

SEQ ID NO: 93538 - DNA, 22 bp, Artificial Sequence
  chemically synthesized
agctagtttccttctcccatca

SEQ ID NO: 93539 - DNA, 22 bp, Artificial Sequence
  chemically synthesized
gctagtttccttctcccatcat

SEQ ID NO: 93540 - DNA, 22 bp, Artificial Sequence
  chemically synthesized
gtttccttctcccatcatagag

SEQ ID NO: 93541 - DNA, 22 bp, Artificial Sequence
  chemically synthesized
ccttctcccatcatagaggata

SEQ ID NO: 93542 - DNA, 22 bp, Artificial Sequence
  chemically synthesized
cttctcccatcatagaggatac

SEQ ID NO: 93543 - DNA, 22 bp, Artificial Sequence
  chemically synthesized
ctcccatcatagaggataccag

SEQ ID NO: 93544 - DNA, 22 bp, Artificial Sequence
  chemically synthesized
tcccatcatagaggataccagg

SEQ ID NO: 93545 - DNA, 22 bp, Artificial Sequence
  chemically synthesized
ccatcatagaggataccaggac

SEQ ID NO: 93546 - DNA, 22 bp, Artificial Sequence
  chemically synthesized
cttttgtcagccgttttttacc

SEQ ID NO: 93547 - DNA, 22 bp, Artificial Sequence
  chemically synthesized
ttttgtcagccgttttttacct

SEQ ID NO: 93548 - DNA, 22 bp, Artificial Sequence
  chemically synthesized
ttgtcagccgttttttaccttc

SEQ ID NO: 93549 - DNA, 22 bp, Artificial Sequence
  chemically synthesized
tgtcagccgttttttaccttct

SEQ ID NO: 93550 - DNA, 22 bp, Artificial Sequence
  chemically synthesized
gtcagccgttttttaccttctt

SEQ ID NO: 93551 - DNA, 22 bp, Artificial Sequence
  chemically synthesized
tcagccgttttttaccttcttg

SEQ ID NO: 93552 - DNA, 22 bp, Artificial Sequence
  chemically synthesized
tttaccttcttgtctctagctc

SEQ ID NO: 93553 - DNA, 22 bp, Artificial Sequence
  chemically synthesized
ttaccttcttgtctctagctcc

SEQ ID NO: 93554 - DNA, 22 bp, Artificial Sequence
  chemically synthesized
taccttcttgtctctagctcca

SEQ ID NO: 93555 - DNA, 22 bp, Artificial Sequence
  chemically synthesized
accttcttgtctctagctccag

SEQ ID NO: 93556 - DNA, 22 bp, Artificial Sequence
  chemically synthesized
ccttcttgtctctagctccagt

SEQ ID NO: 93557 - DNA, 22 bp, Artificial Sequence
  chemically synthesized
cttgtctctagctccagtgagg

SEQ ID NO: 93558 - DNA, 22 bp, Artificial Sequence
  chemically synthesized
ttgtctctagctccagtgaggc

SEQ ID NO: 93559 - DNA, 22 bp, Artificial Sequence
  chemically synthesized
gtctctagctccagtgaggcct

SEQ ID NO: 93560 - DNA, 22 bp, Artificial Sequence
  chemically synthesized
tctctagctccagtgaggcctg

SEQ ID NO: 93561 - DNA, 22 bp, Artificial Sequence
  chemically synthesized
tagctccagtgaggcctgtagt

SEQ ID NO: 93562 - DNA, 22 bp, Artificial Sequence
  chemically synthesized
gctccagtgaggcctgtagttt

SEQ ID NO: 93563 - DNA, 22 bp, Artificial Sequence
  chemically synthesized
cagtgaggcctgtagtttaaag

SEQ ID NO: 93564 - DNA, 22 bp, Artificial Sequence
  chemically synthesized
tagtttaaagctaaagcatgta

SEQ ID NO: 93565 - DNA, 22 bp, Artificial Sequence
  chemically synthesized
aaagctaaagcatgtaccaatt

SEQ ID NO: 93566 - DNA, 22 bp, Artificial Sequence
  chemically synthesized
aagctaaagcatgtaccaattt

SEQ ID NO: 93567 - DNA, 22 bp, Artificial Sequence
  chemically synthesized
aagcatgtaccaatttttgaaa

SEQ ID NO: 93568 - DNA, 22 bp, Artificial Sequence
  chemically synthesized
ttgaaaagttcagggattgtga

SEQ ID NO: 93569 - DNA, 22 bp, Artificial Sequence
  chemically synthesized
tgaaaagttcagggattgtgaa

SEQ ID NO: 93570 - DNA, 22 bp, Artificial Sequence
  chemically synthesized
gaaaagttcagggattgtgaaa

SEQ ID NO: 93571 - DNA, 22 bp, Artificial Sequence
  chemically synthesized
aaaagttcagggattgtgaaat

SEQ ID NO: 93572 - DNA, 22 bp, Artificial Sequence
  chemically synthesized
agggattgtgaaatgtgtttta

SEQ ID NO: 93573 - DNA, 22 bp, Artificial Sequence
  chemically synthesized
tgaaatgtgttttaggcatagg

SEQ ID NO: 93574 - DNA, 22 bp, Artificial Sequence
  chemically synthesized
taggcataggtccaggattttt

SEQ ID NO: 93575 - DNA, 22 bp, Artificial Sequence
  chemically synthesized
aggcataggtccaggatttttg

SEQ ID NO: 93576 - DNA, 22 bp, Artificial Sequence
  chemically synthesized
ggcataggtccaggatttttga

SEQ ID NO: 93577 - DNA, 22 bp, Artificial Sequence
  chemically synthesized
ttgacgggacaaatcttagtct

SEQ ID NO: 93578 - DNA, 22 bp, Artificial Sequence
  chemically synthesized
tgacgggacaaatcttagtctc

SEQ ID NO: 93579 - DNA, 22 bp, Artificial Sequence
  chemically synthesized
gacgggacaaatcttagtctct

SEQ ID NO: 93580 - DNA, 22 bp, Artificial Sequence
  chemically synthesized
acgggacaaatcttagtctctt

SEQ ID NO: 93581 - DNA, 22 bp, Artificial Sequence
  chemically synthesized
agtctctttcagttagcagtgg

SEQ ID NO: 93582 - DNA, 22 bp, Artificial Sequence
  chemically synthesized
gtctctttcagttagcagtggt

SEQ ID NO: 93583 - DNA, 22 bp, Artificial Sequence
  chemically synthesized
tttcagttagcagtggtttcta

SEQ ID NO: 93584 - DNA, 22 bp, Artificial Sequence
  chemically synthesized
tcagttagcagtggtttctaag

SEQ ID NO: 93585 - DNA, 22 bp, Artificial Sequence
  chemically synthesized
cagttagcagtggtttctaagg

SEQ ID NO: 93586 - DNA, 22 bp, Artificial Sequence
  chemically synthesized
agttagcagtggtttctaagga

SEQ ID NO: 93587 - DNA, 22 bp, Artificial Sequence
  chemically synthesized
gcagtggtttctaaggaaaaag

SEQ ID NO: 93588 - DNA, 22 bp, Artificial Sequence
  chemically synthesized
ctaaggaaaaagtgctatactt

SEQ ID NO: 93589 - DNA, 22 bp, Artificial Sequence
  chemically synthesized
taaggaaaaagtgctatacttc

SEQ ID NO: 93590 - DNA, 22 bp, Artificial Sequence
  chemically synthesized
aggaaaaagtgctatacttctt

SEQ ID NO: 93591 - DNA, 22 bp, Artificial Sequence
  chemically synthesized
tacttctttttgaatatactct

SEQ ID NO: 93592 - DNA, 22 bp, Artificial Sequence
  chemically synthesized
ctttttgaatatactctttgtg

SEQ ID NO: 93593 - DNA, 22 bp, Artificial Sequence
  chemically synthesized
tttttgaatatactctttgtga

SEQ ID NO: 93594 - DNA, 22 bp, Artificial Sequence
  chemically synthesized
tttgaatatactctttgtgact

SEQ ID NO: 93595 - DNA, 22 bp, Artificial Sequence
  chemically synthesized
ttgaatatactctttgtgactt

SEQ ID NO: 93596 - DNA, 22 bp, Artificial Sequence
  chemically synthesized
tgaatatactctttgtgacttt

SEQ ID NO: 93597 - DNA, 22 bp, Artificial Sequence
  chemically synthesized
gaatatactctttgtgactttt

SEQ ID NO: 93598 - DNA, 22 bp, Artificial Sequence
  chemically synthesized
aatatactctttgtgacttttg

SEQ ID NO: 93599 - DNA, 22 bp, Artificial Sequence
  chemically synthesized
tttgtgacttttgccattatct

SEQ ID NO: 93600 - DNA, 22 bp, Artificial Sequence
  chemically synthesized
tgtgacttttgccattatctct

SEQ ID NO: 93601 - DNA, 22 bp, Artificial Sequence
  chemically synthesized
gtgacttttgccattatctctt

SEQ ID NO: 93602 - DNA, 22 bp, Artificial Sequence
  chemically synthesized
tgacttttgccattatctctta

SEQ ID NO: 93603 - DNA, 22 bp, Artificial Sequence
  chemically synthesized
ttgccattatctcttaatttct

SEQ ID NO: 93604 - DNA, 22 bp, Artificial Sequence
  chemically synthesized
tgccattatctcttaatttctc

SEQ ID NO: 93605 - DNA, 22 bp, Artificial Sequence
  chemically synthesized
gccattatctcttaatttctca

SEQ ID NO: 93606 - DNA, 22 bp, Artificial Sequence
  chemically synthesized
ccattatctcttaatttctcaa

SEQ ID NO: 93607 - DNA, 22 bp, Artificial Sequence
  chemically synthesized
tctcttaatttctcaatagtgc

SEQ ID NO: 93608 - DNA, 22 bp, Artificial Sequence
  chemically synthesized
ttaatttctcaatagtgcagtg

SEQ ID NO: 93609 - DNA, 22 bp, Artificial Sequence
  chemically synthesized
aatttctcaatagtgcagtgaa

SEQ ID NO: 93610 - DNA, 22 bp, Artificial Sequence
  chemically synthesized
atttctcaatagtgcagtgaaa

SEQ ID NO: 93611 - DNA, 22 bp, Artificial Sequence
  chemically synthesized
ctcaatagtgcagtgaaaacaa

SEQ ID NO: 93612 - DNA, 22 bp, Artificial Sequence
  chemically synthesized
tcaatagtgcagtgaaaacaat

SEQ ID NO: 93613 - DNA, 22 bp, Artificial Sequence
  chemically synthesized
aatagtgcagtgaaaacaattt

SEQ ID NO: 93614 - DNA, 22 bp, Artificial Sequence
  chemically synthesized
ctataaagccacagtttcagcg

SEQ ID NO: 93615 - DNA, 22 bp, Artificial Sequence
  chemically synthesized
tataaagccacagtttcagcgc

SEQ ID NO: 93616 - DNA, 22 bp, Artificial Sequence
  chemically synthesized
taaagccacagtttcagcgcag

SEQ ID NO: 93617 - DNA, 22 bp, Artificial Sequence
  chemically synthesized
cagcgcagtaatagattagtgt

SEQ ID NO: 93618 - DNA, 22 bp, Artificial Sequence
  chemically synthesized
agcgcagtaatagattagtgtt

SEQ ID NO: 93619 - DNA, 22 bp, Artificial Sequence
  chemically synthesized
gtgttacataatataagaccta

SEQ ID NO: 93620 - DNA, 22 bp, Artificial Sequence
  chemically synthesized
cataatataagacctaatgctt

SEQ ID NO: 93621 - DNA, 22 bp, Artificial Sequence
  chemically synthesized
atgcttacctcaatatctactt

SEQ ID NO: 93622 - DNA, 22 bp, Artificial Sequence
  chemically synthesized
acctcaatatctacttatccgt

SEQ ID NO: 93623 - DNA, 22 bp, Artificial Sequence
  chemically synthesized
cctcaatatctacttatccgta

SEQ ID NO: 93624 - DNA, 22 bp, Artificial Sequence
  chemically synthesized
aatatctacttatccgtaccta

SEQ ID NO: 93625 - DNA, 22 bp, Artificial Sequence
  chemically synthesized
cttatccgtacctatttgaaat

SEQ ID NO: 93626 - DNA, 22 bp, Artificial Sequence
  chemically synthesized
atccgtacctatttgaaataaa

SEQ ID NO: 93627 - DNA, 22 bp, Artificial Sequence
  chemically synthesized
tccgtacctatttgaaataaat

SEQ ID NO: 93628 - DNA, 22 bp, Artificial Sequence
  chemically synthesized
tttgaaataaatcatgactgtt

SEQ ID NO: 93629 - DNA, 22 bp, Artificial Sequence
  chemically synthesized
gaaataaatcatgactgtttca

SEQ ID NO: 93630 - DNA, 22 bp, Artificial Sequence
  chemically synthesized
aaataaatcatgactgtttcat

SEQ ID NO: 93631 - DNA, 22 bp, Artificial Sequence
  chemically synthesized
tttcatcttagaaaaatatttg

SEQ ID NO: 93632 - DNA, 22 bp, Artificial Sequence
  chemically synthesized
catcttagaaaaatatttgatt

SEQ ID NO: 93633 - DNA, 22 bp, Artificial Sequence
  chemically synthesized
atcttagaaaaatatttgattc

SEQ ID NO: 93634 - DNA, 22 bp, Artificial Sequence
  chemically synthesized
agaaaaatatttgattccatat

SEQ ID NO: 93635 - DNA, 22 bp, Artificial Sequence
  chemically synthesized
gaaaaatatttgattccatatt

SEQ ID NO: 93636 - DNA, 22 bp, Artificial Sequence
  chemically synthesized
gattccatattcaggtatgtat

SEQ ID NO: 93637 - DNA, 22 bp, Artificial Sequence
  chemically synthesized
attccatattcaggtatgtatg

SEQ ID NO: 93638 - DNA, 22 bp, Artificial Sequence
  chemically synthesized
catattcaggtatgtatgtata

SEQ ID NO: 93639 - DNA, 22 bp, Artificial Sequence
  chemically synthesized
aggtatgtatgtatacaccaga

SEQ ID NO: 93640 - DNA, 22 bp, Artificial Sequence
  chemically synthesized
accactggataagtgtgtgtgc

SEQ ID NO: 93641 - DNA, 22 bp, Artificial Sequence
  chemically synthesized
ccactggataagtgtgtgtgct

SEQ ID NO: 93642 - DNA, 22 bp, Artificial Sequence
  chemically synthesized
gataagtgtgtgtgctggctga

SEQ ID NO: 93643 - DNA, 22 bp, Artificial Sequence
  chemically synthesized
gctgatgacccagggttttggc

SEQ ID NO: 93644 - DNA, 22 bp, Artificial Sequence
  chemically synthesized
atgacccagggttttggcgtag

SEQ ID NO: 93645 - DNA, 22 bp, Artificial Sequence
  chemically synthesized
tggcgtagctcttctatgctca

SEQ ID NO: 93646 - DNA, 22 bp, Artificial Sequence
  chemically synthesized
ggcgtagctcttctatgctcag

SEQ ID NO: 93647 - DNA, 22 bp, Artificial Sequence
  chemically synthesized
gcgtagctcttctatgctcagt

SEQ ID NO: 93648 - DNA, 22 bp, Artificial Sequence
  chemically synthesized
ttctatgctcagtaaagatgat

SEQ ID NO: 93649 - DNA, 22 bp, Artificial Sequence
  chemically synthesized
ctatgctcagtaaagatgatgg

SEQ ID NO: 93650 - DNA, 22 bp, Artificial Sequence
  chemically synthesized
tatgctcagtaaagatgatggt

SEQ ID NO: 93651 - DNA, 22 bp, Artificial Sequence
  chemically synthesized
tgctcagtaaagatgatggtag

SEQ ID NO: 93652 - DNA, 22 bp, Artificial Sequence
  chemically synthesized
agtaaagatgatggtagaatgt

SEQ ID NO: 93653 - DNA, 22 bp, Artificial Sequence
  chemically synthesized
tttggcaggtactgtggattag

SEQ ID NO: 93654 - DNA, 22 bp, Artificial Sequence
  chemically synthesized
tggcaggtactgtggattagaa

SEQ ID NO: 93655 - DNA, 22 bp, Artificial Sequence
  chemically synthesized
ggcaggtactgtggattagaat

SEQ ID NO: 93656 - DNA, 22 bp, Artificial Sequence
  chemically synthesized
gcaggtactgtggattagaatt

SEQ ID NO: 93657 - DNA, 22 bp, Artificial Sequence
  chemically synthesized
tggattagaattaattatcttg

SEQ ID NO: 93658 - DNA, 22 bp, Artificial Sequence
  chemically synthesized
gaattaattatcttgtataaat

SEQ ID NO: 93659 - DNA, 22 bp, Artificial Sequence
  chemically synthesized
attatcttgtataaatgctagg

SEQ ID NO: 93660 - DNA, 22 bp, Artificial Sequence
  chemically synthesized
tcttgtataaatgctaggttca

SEQ ID NO: 93661 - DNA, 22 bp, Artificial Sequence
  chemically synthesized
gtataaatgctaggttcacttc

SEQ ID NO: 93662 - DNA, 22 bp, Artificial Sequence
  chemically synthesized
tataaatgctaggttcacttct

SEQ ID NO: 93663 - DNA, 22 bp, Artificial Sequence
  chemically synthesized
ggttcacttctcagggaatctt

SEQ ID NO: 93664 - DNA, 22 bp, Artificial Sequence
  chemically synthesized
acttctcagggaatcttactct

SEQ ID NO: 93665 - DNA, 22 bp, Artificial Sequence
  chemically synthesized
ctcagggaatcttactctaaga

SEQ ID NO: 93666 - DNA, 22 bp, Artificial Sequence
  chemically synthesized
tcagggaatcttactctaagac

SEQ ID NO: 93667 - DNA, 22 bp, Artificial Sequence
  chemically synthesized
agggaatcttactctaagacat

SEQ ID NO: 93668 - DNA, 22 bp, Artificial Sequence
  chemically synthesized
actctaagacataagatgtgcg

SEQ ID NO: 93669 - DNA, 22 bp, Artificial Sequence
  chemically synthesized
ctctaagacataagatgtgcgt

SEQ ID NO: 93670 - DNA, 22 bp, Artificial Sequence
  chemically synthesized
taagacataagatgtgcgtgta

SEQ ID NO: 93671 - DNA, 22 bp, Artificial Sequence
  chemically synthesized
agacataagatgtgcgtgtaca

SEQ ID NO: 93672 - DNA, 22 bp, Artificial Sequence
  chemically synthesized
taaagaggcaagggttgttttt

SEQ ID NO: 93673 - DNA, 22 bp, Artificial Sequence
  chemically synthesized
aagaggcaagggttgtttttat

SEQ ID NO: 93674 - DNA, 22 bp, Artificial Sequence
  chemically synthesized
tttttattgactaatagtccac

SEQ ID NO: 93675 - DNA, 22 bp, Artificial Sequence
  chemically synthesized
ttattgactaatagtccacaca

SEQ ID NO: 93676 - DNA, 22 bp, Artificial Sequence
  chemically synthesized
tattgactaatagtccacacac

SEQ ID NO: 93677 - DNA, 22 bp, Artificial Sequence
  chemically synthesized
attgactaatagtccacacact

SEQ ID NO: 93678 - DNA, 22 bp, Artificial Sequence
  chemically synthesized
ttgactaatagtccacacacta

SEQ ID NO: 93679 - DNA, 22 bp, Artificial Sequence
  chemically synthesized
actaatagtccacacactatta

SEQ ID NO: 93680 - DNA, 22 bp, Artificial Sequence
  chemically synthesized
atagtccacacactattataac

SEQ ID NO: 93681 - DNA, 22 bp, Artificial Sequence
  chemically synthesized
ttataactcgaatattagtgta

SEQ ID NO: 93682 - DNA, 22 bp, Artificial Sequence
  chemically synthesized
taactcgaatattagtgtactt

SEQ ID NO: 93683 - DNA, 22 bp, Artificial Sequence
  chemically synthesized
gaatattagtgtactttagaca

SEQ ID NO: 93684 - DNA, 22 bp, Artificial Sequence
  chemically synthesized
gtgtactttagacagctttatt

SEQ ID NO: 93685 - DNA, 22 bp, Artificial Sequence
  chemically synthesized
tagacagctttatttctaacac

SEQ ID NO: 93686 - DNA, 22 bp, Artificial Sequence
  chemically synthesized
agacagctttatttctaacaca

SEQ ID NO: 93687 - DNA, 22 bp, Artificial Sequence
  chemically synthesized
gacagctttatttctaacacag

SEQ ID NO: 93688 - DNA, 22 bp, Artificial Sequence
  chemically synthesized
tatttctaacacagtgctgttt

SEQ ID NO: 93689 - DNA, 22 bp, Artificial Sequence
  chemically synthesized
atttctaacacagtgctgtttc

SEQ ID NO: 93690 - DNA, 22 bp, Artificial Sequence
  chemically synthesized
tttctaacacagtgctgtttct

SEQ ID NO: 93691 - DNA, 22 bp, Artificial Sequence
  chemically synthesized
ctaacacagtgctgtttctgac

SEQ ID NO: 93692 - DNA, 22 bp, Artificial Sequence
  chemically synthesized
taacacagtgctgtttctgaca

SEQ ID NO: 93693 - DNA, 22 bp, Artificial Sequence
  chemically synthesized
acacagtgctgtttctgacata

SEQ ID NO: 93694 - DNA, 22 bp, Artificial Sequence
  chemically synthesized
tttctgacatattggaccatta

SEQ ID NO: 93695 - DNA, 22 bp, Artificial Sequence
  chemically synthesized
ctgacatattggaccattaaca

SEQ ID NO: 93696 - DNA, 22 bp, Artificial Sequence
  chemically synthesized
tgacatattggaccattaacag

SEQ ID NO: 93697 - DNA, 22 bp, Artificial Sequence
  chemically synthesized
acatattggaccattaacaggg

SEQ ID NO: 93698 - DNA, 22 bp, Artificial Sequence
  chemically synthesized
gaccattaacagggtaggaagt

SEQ ID NO: 93699 - DNA, 22 bp, Artificial Sequence
  chemically synthesized
acagggtaggaagtatttatgg

SEQ ID NO: 93700 - DNA, 22 bp, Artificial Sequence
  chemically synthesized
atggtggttttttggttctgtt

SEQ ID NO: 93701 - DNA, 22 bp, Artificial Sequence
  chemically synthesized
tggtggttttttggttctgttt

SEQ ID NO: 93702 - DNA, 22 bp, Artificial Sequence
  chemically synthesized
tttggttctgttttgcttttgg

SEQ ID NO: 93703 - DNA, 22 bp, Artificial Sequence
  chemically synthesized
ttggttctgttttgcttttggt

SEQ ID NO: 93704 - DNA, 22 bp, Artificial Sequence
  chemically synthesized
tggttctgttttgcttttggtt

SEQ ID NO: 93705 - DNA, 22 bp, Artificial Sequence
  chemically synthesized
ggttctgttttgcttttggtta

SEQ ID NO: 93706 - DNA, 22 bp, Artificial Sequence
  chemically synthesized
gttctgttttgcttttggttag

SEQ ID NO: 93707 - DNA, 22 bp, Artificial Sequence
  chemically synthesized
tgttttgcttttggttagtttg

SEQ ID NO: 93708 - DNA, 22 bp, Artificial Sequence
  chemically synthesized
ttttgcttttggttagtttgtt

SEQ ID NO: 93709 - DNA, 22 bp, Artificial Sequence
  chemically synthesized
tgcttttggttagtttgttttt

SEQ ID NO: 93710 - DNA, 22 bp, Artificial Sequence
  chemically synthesized
gcttttggttagtttgtttttg

SEQ ID NO: 93711 - DNA, 22 bp, Artificial Sequence
  chemically synthesized
cttttggttagtttgtttttgt

SEQ ID NO: 93712 - DNA, 22 bp, Artificial Sequence
  chemically synthesized
ttggttagtttgtttttgtttt

SEQ ID NO: 93713 - DNA, 22 bp, Artificial Sequence
  chemically synthesized
tggttagtttgtttttgttttt

SEQ ID NO: 93714 - DNA, 22 bp, Artificial Sequence
  chemically synthesized
ggttagtttgtttttgtttttc

SEQ ID NO: 93715 - DNA, 22 bp, Artificial Sequence
  chemically synthesized
gttagtttgtttttgtttttct

SEQ ID NO: 93716 - DNA, 22 bp, Artificial Sequence
  chemically synthesized
gtttgtttttgtttttctctga

SEQ ID NO: 93717 - DNA, 22 bp, Artificial Sequence
  chemically synthesized
gtttttgtttttctctgaaagt

SEQ ID NO: 93718 - DNA, 22 bp, Artificial Sequence
  chemically synthesized
tttttgtttttctctgaaagtg

SEQ ID NO: 93719 - DNA, 22 bp, Artificial Sequence
  chemically synthesized
ttgtttttctctgaaagtgatc

SEQ ID NO: 93720 - DNA, 22 bp, Artificial Sequence
  chemically synthesized
tgtttttctctgaaagtgatcc

SEQ ID NO: 93721 - DNA, 22 bp, Artificial Sequence
  chemically synthesized
gtttttctctgaaagtgatcca

SEQ ID NO: 93722 - DNA, 22 bp, Artificial Sequence
  chemically synthesized
tttttctctgaaagtgatccat

SEQ ID NO: 93723 - DNA, 22 bp, Artificial Sequence
  chemically synthesized
ttctctgaaagtgatccatgat

SEQ ID NO: 93724 - DNA, 22 bp, Artificial Sequence
  chemically synthesized
tctctgaaagtgatccatgatc

SEQ ID NO: 93725 - DNA, 22 bp, Artificial Sequence
  chemically synthesized
ctctgaaagtgatccatgatct

SEQ ID NO: 93726 - DNA, 22 bp, Artificial Sequence
  chemically synthesized
tctgaaagtgatccatgatctc

SEQ ID NO: 93727 - DNA, 22 bp, Artificial Sequence
  chemically synthesized
tgaaagtgatccatgatctcta

SEQ ID NO: 93728 - DNA, 22 bp, Artificial Sequence
  chemically synthesized
aaagtgatccatgatctctaac

SEQ ID NO: 93729 - DNA, 22 bp, Artificial Sequence
  chemically synthesized
taaccttgctagattataatgc

SEQ ID NO: 93730 - DNA, 22 bp, Artificial Sequence
  chemically synthesized
accttgctagattataatgcca

SEQ ID NO: 93731 - DNA, 22 bp, Artificial Sequence
  chemically synthesized
gctagattataatgccagaagc

SEQ ID NO: 93732 - DNA, 22 bp, Artificial Sequence
  chemically synthesized
ctagattataatgccagaagct

SEQ ID NO: 93733 - DNA, 22 bp, Artificial Sequence
  chemically synthesized
gattataatgccagaagctctg

SEQ ID NO: 93734 - DNA, 22 bp, Artificial Sequence
  chemically synthesized
taatgccagaagctctggaatt

SEQ ID NO: 93735 - DNA, 22 bp, Artificial Sequence
  chemically synthesized
tggaattctggcttatcggagg

SEQ ID NO: 93736 - DNA, 22 bp, Artificial Sequence
  chemically synthesized
gaattctggcttatcggaggca

SEQ ID NO: 93737 - DNA, 22 bp, Artificial Sequence
  chemically synthesized
tggcttatcggaggcaagctgt

SEQ ID NO: 93738 - DNA, 22 bp, Artificial Sequence
  chemically synthesized
gcttatcggaggcaagctgtat

SEQ ID NO: 93739 - DNA, 22 bp, Artificial Sequence
  chemically synthesized
atcggaggcaagctgtatcttc

SEQ ID NO: 93740 - DNA, 22 bp, Artificial Sequence
  chemically synthesized
tcggaggcaagctgtatcttca

SEQ ID NO: 93741 - DNA, 22 bp, Artificial Sequence
  chemically synthesized
tatcttcaaattagtttatccc

SEQ ID NO: 93742 - DNA, 22 bp, Artificial Sequence
  chemically synthesized
caaattagtttatcccctaagc

SEQ ID NO: 93743 - DNA, 22 bp, Artificial Sequence
  chemically synthesized
aaattagtttatcccctaagct

SEQ ID NO: 93744 - DNA, 22 bp, Artificial Sequence
  chemically synthesized
gtttatcccctaagctatcagg

SEQ ID NO: 93745 - DNA, 22 bp, Artificial Sequence
  chemically synthesized
atcccctaagctatcaggttga

SEQ ID NO: 93746 - DNA, 22 bp, Artificial Sequence
  chemically synthesized
tcccctaagctatcaggttgat

SEQ ID NO: 93747 - DNA, 22 bp, Artificial Sequence
  chemically synthesized
agctatcaggttgattgaaatt

SEQ ID NO: 93748 - DNA, 22 bp, Artificial Sequence
  chemically synthesized
tcaggttgattgaaattattat

SEQ ID NO: 93749 - DNA, 22 bp, Artificial Sequence
  chemically synthesized
attgaaattattataatattgg

SEQ ID NO: 93750 - DNA, 22 bp, Artificial Sequence
  chemically synthesized
aaattattataatattggtgaa

SEQ ID NO: 93751 - DNA, 22 bp, Artificial Sequence
  chemically synthesized
ttataatattggtgaaattctt

SEQ ID NO: 93752 - DNA, 22 bp, Artificial Sequence
  chemically synthesized
taatattggtgaaattctttca

SEQ ID NO: 93753 - DNA, 22 bp, Artificial Sequence
  chemically synthesized
gtgaaattctttcatccttcat

SEQ ID NO: 93754 - DNA, 22 bp, Artificial Sequence
  chemically synthesized
tttcatccttcatgatcctgtg

SEQ ID NO: 93755 - DNA, 22 bp, Artificial Sequence
  chemically synthesized
tcatccttcatgatcctgtgta

SEQ ID NO: 93756 - DNA, 22 bp, Artificial Sequence
  chemically synthesized
catccttcatgatcctgtgtaa

SEQ ID NO: 93757 - DNA, 22 bp, Artificial Sequence
  chemically synthesized
atccttcatgatcctgtgtaaa

SEQ ID NO: 93758 - DNA, 22 bp, Artificial Sequence
  chemically synthesized
catgatcctgtgtaaagcttat

SEQ ID NO: 93759 - DNA, 22 bp, Artificial Sequence
  chemically synthesized
atgatcctgtgtaaagcttata

SEQ ID NO: 93760 - DNA, 22 bp, Artificial Sequence
  chemically synthesized
tgtaaagcttatatctgctcat

SEQ ID NO: 93761 - DNA, 22 bp, Artificial Sequence
  chemically synthesized
atatctgctcattgatacagat

SEQ ID NO: 93762 - DNA, 22 bp, Artificial Sequence
  chemically synthesized
tatctgctcattgatacagatg

SEQ ID NO: 93763 - DNA, 22 bp, Artificial Sequence
  chemically synthesized
ctcattgatacagatggctaaa

SEQ ID NO: 93764 - DNA, 22 bp, Artificial Sequence
  chemically synthesized
attgatacagatggctaaaagg

SEQ ID NO: 93765 - DNA, 22 bp, Artificial Sequence
  chemically synthesized
atacagatggctaaaaggccag

SEQ ID NO: 93766 - DNA, 22 bp, Artificial Sequence
  chemically synthesized
aaaggccagaaagacacacatt

SEQ ID NO: 93767 - DNA, 22 bp, Artificial Sequence
  chemically synthesized
acccatgtaacaagcctgcaca

SEQ ID NO: 93768 - DNA, 22 bp, Artificial Sequence
  chemically synthesized
cccatgtaacaagcctgcacat

SEQ ID NO: 93769 - DNA, 22 bp, Artificial Sequence
  chemically synthesized
cacatcctgcacatgtaccttc

SEQ ID NO: 93770 - DNA, 22 bp, Artificial Sequence
  chemically synthesized
cacatgtaccttcgaaattaaa

SEQ ID NO: 93771 - DNA, 22 bp, Artificial Sequence
  chemically synthesized
cgaaattaaaatgaaatgaaat

SEQ ID NO: 93772 - DNA, 22 bp, Artificial Sequence
  chemically synthesized
gaaattaaaatgaaatgaaata

SEQ ID NO: 93773 - DNA, 22 bp, Artificial Sequence
  chemically synthesized
aaatgaaatgaaataaaattaa

SEQ ID NO: 93774 - DNA, 22 bp, Artificial Sequence
  chemically synthesized
aaaggaaaaaaatgccatggca

SEQ ID NO: 93775 - DNA, 22 bp, Artificial Sequence
  chemically synthesized
tcttttatggtctaaaaatggg

SEQ ID NO: 93776 - DNA, 22 bp, Artificial Sequence
  chemically synthesized
ttatggtctaaaaatgggcagc

SEQ ID NO: 93777 - DNA, 22 bp, Artificial Sequence
  chemically synthesized
tatggtctaaaaatgggcagca

SEQ ID NO: 93778 - DNA, 22 bp, Artificial Sequence
  chemically synthesized
atggtctaaaaatgggcagcat

SEQ ID NO: 93779 - DNA, 22 bp, Artificial Sequence
  chemically synthesized
tggtctaaaaatgggcagcata

SEQ ID NO: 93780 - DNA, 22 bp, Artificial Sequence
  chemically synthesized
aaaatgggcagcataaataatc

SEQ ID NO: 93781 - DNA, 22 bp, Artificial Sequence
  chemically synthesized
ccccttgtttagcatactattg

SEQ ID NO: 93782 - DNA, 22 bp, Artificial Sequence
  chemically synthesized
gtttagcatactattgaaaaat

SEQ ID NO: 93783 - DNA, 22 bp, Artificial Sequence
  chemically synthesized
tttagcatactattgaaaaata

SEQ ID NO: 93784 - DNA, 22 bp, Artificial Sequence
  chemically synthesized
agcatactattgaaaaataaca

SEQ ID NO: 93785 - DNA, 22 bp, Artificial Sequence
  chemically synthesized
gcatactattgaaaaataacaa

SEQ ID NO: 93786 - DNA, 22 bp, Artificial Sequence
  chemically synthesized
ttgaaaaataacaataaaaatc

SEQ ID NO: 93787 - DNA, 22 bp, Artificial Sequence
  chemically synthesized
aaaaataacaataaaaatcggc

SEQ ID NO: 93788 - DNA, 22 bp, Artificial Sequence
  chemically synthesized
gcgtctactctgcctatgaagt

SEQ ID NO: 93789 - DNA, 22 bp, Artificial Sequence
  chemically synthesized
cgtctactctgcctatgaagta

SEQ ID NO: 93790 - DNA, 22 bp, Artificial Sequence
  chemically synthesized
ctctgcctatgaagtagccatt

SEQ ID NO: 93791 - DNA, 22 bp, Artificial Sequence
  chemically synthesized
tgcctatgaagtagccattcat

SEQ ID NO: 93792 - DNA, 22 bp, Artificial Sequence
  chemically synthesized
cctatgaagtagccattcattt

SEQ ID NO: 93793 - DNA, 22 bp, Artificial Sequence
  chemically synthesized
tgaagtagccattcatttattc

SEQ ID NO: 93794 - DNA, 22 bp, Artificial Sequence
  chemically synthesized
atttattccttcaattttttat

SEQ ID NO: 93795 - DNA, 22 bp, Artificial Sequence
  chemically synthesized
attccttcaattttttataaac

SEQ ID NO: 93796 - DNA, 22 bp, Artificial Sequence
  chemically synthesized
ttccttcaattttttataaact

SEQ ID NO: 93797 - DNA, 22 bp, Artificial Sequence
  chemically synthesized
cttcaattttttataaacttgt

SEQ ID NO: 93798 - DNA, 22 bp, Artificial Sequence
  chemically synthesized
caattttttataaacttgtttt

SEQ ID NO: 93799 - DNA, 22 bp, Artificial Sequence
  chemically synthesized
aattttttataaacttgtttta

SEQ ID NO: 93800 - DNA, 22 bp, Artificial Sequence
  chemically synthesized
tttataaacttgttttactaaa

SEQ ID NO: 93801 - DNA, 22 bp, Artificial Sequence
  chemically synthesized
ttataaacttgttttactaaaa

SEQ ID NO: 93802 - DNA, 22 bp, Artificial Sequence
  chemically synthesized
tataaacttgttttactaaaaa

SEQ ID NO: 93803 - DNA, 22 bp, Artificial Sequence
  chemically synthesized
ataaacttgttttactaaaaaa

SEQ ID NO: 93804 - DNA, 22 bp, Artificial Sequence
  chemically synthesized
taaacttgttttactaaaaaaa

SEQ ID NO: 93805 - DNA, 22 bp, Artificial Sequence
  chemically synthesized
gttttactaaaaaaaaaaagga

SEQ ID NO: 93806 - DNA, 22 bp, Artificial Sequence
  chemically synthesized
ttttactaaaaaaaaaaaggac

SEQ ID NO: 93807 - DNA, 22 bp, Artificial Sequence
  chemically synthesized
tactaaaaaaaaaaaggacaaa

SEQ ID NO: 93808 - DNA, 22 bp, Artificial Sequence
  chemically synthesized
actaaaaaaaaaaaggacaaag

SEQ ID NO: 93809 - DNA, 22 bp, Artificial Sequence
  chemically synthesized
ctaaaaaaaaaaaggacaaaga

SEQ ID NO: 93810 - DNA, 22 bp, Artificial Sequence
  chemically synthesized
aaaaaaaaaaggacaaagaaag

SEQ ID NO: 93811 - DNA, 22 bp, Artificial Sequence
  chemically synthesized
tgaaatggtagtgagtgatggc

SEQ ID NO: 93812 - DNA, 22 bp, Artificial Sequence
  chemically synthesized
gaagtgggtcctttatgatttg

SEQ ID NO: 93813 - DNA, 22 bp, Artificial Sequence
  chemically synthesized
aagtgggtcctttatgatttga

SEQ ID NO: 93814 - DNA, 22 bp, Artificial Sequence
  chemically synthesized
tatgatttgatggagccaggca

SEQ ID NO: 93815 - DNA, 22 bp, Artificial Sequence
  chemically synthesized
atgatttgatggagccaggcag

SEQ ID NO: 93816 - DNA, 22 bp, Artificial Sequence
  chemically synthesized
tgatttgatggagccaggcaga

SEQ ID NO: 93817 - DNA, 22 bp, Artificial Sequence
  chemically synthesized
gatggagccaggcagaagacgt

SEQ ID NO: 93818 - DNA, 22 bp, Artificial Sequence
  chemically synthesized
atggagccaggcagaagacgtt

SEQ ID NO: 93819 - DNA, 22 bp, Artificial Sequence
  chemically synthesized
ggagaaagaagttcctgaaagt

SEQ ID NO: 93820 - DNA, 22 bp, Artificial Sequence
  chemically synthesized
gagaaagaagttcctgaaagta

SEQ ID NO: 93821 - DNA, 22 bp, Artificial Sequence
  chemically synthesized
ctgaaagtaggaagggcatgtg

SEQ ID NO: 93822 - DNA, 22 bp, Artificial Sequence
  chemically synthesized
aaagtaggaagggcatgtggaa

SEQ ID NO: 93823 - DNA, 22 bp, Artificial Sequence
  chemically synthesized
tgaggctgaggaaaaaaaagaa

SEQ ID NO: 93824 - DNA, 22 bp, Artificial Sequence
  chemically synthesized
aggctgaggaaaaaaaagaaag

SEQ ID NO: 93825 - DNA, 22 bp, Artificial Sequence
  chemically synthesized
aggaaaaaaaagaaagaaagaa

SEQ ID NO: 93826 - DNA, 22 bp, Artificial Sequence
  chemically synthesized
gacatttcactgtatataaaca

SEQ ID NO: 93827 - DNA, 22 bp, Artificial Sequence
  chemically synthesized
acatttcactgtatataaacac

SEQ ID NO: 93828 - DNA, 22 bp, Artificial Sequence
  chemically synthesized
cactgtatataaacacattaca

SEQ ID NO: 93829 - DNA, 22 bp, Artificial Sequence
  chemically synthesized
actgtatataaacacattacaa

SEQ ID NO: 93830 - DNA, 22 bp, Artificial Sequence
  chemically synthesized
tatataaacacattacaagcct

SEQ ID NO: 93831 - DNA, 22 bp, Artificial Sequence
  chemically synthesized
caagcctaaagtacgttgaaga

SEQ ID NO: 93832 - DNA, 22 bp, Artificial Sequence
  chemically synthesized
aagtacgttgaagaaaaaatag

SEQ ID NO: 93833 - DNA, 22 bp, Artificial Sequence
  chemically synthesized
aagaaaaaatagaattcaaagt

SEQ ID NO: 93834 - DNA, 22 bp, Artificial Sequence
  chemically synthesized
aaagttagacagaagggctcag

SEQ ID NO: 93835 - DNA, 22 bp, Artificial Sequence
  chemically synthesized
gacagaagggctcaggcttact

SEQ ID NO: 93836 - DNA, 22 bp, Artificial Sequence
  chemically synthesized
aggcttactatttgcatcttac

SEQ ID NO: 93837 - DNA, 22 bp, Artificial Sequence
  chemically synthesized
actatttgcatcttacagatga

SEQ ID NO: 93838 - DNA, 22 bp, Artificial Sequence
  chemically synthesized
ctatttgcatcttacagatgag

SEQ ID NO: 93839 - DNA, 22 bp, Artificial Sequence
  chemically synthesized
tttgcatcttacagatgagagt

SEQ ID NO: 93840 - DNA, 22 bp, Artificial Sequence
  chemically synthesized
gcatcttacagatgagagtagt

SEQ ID NO: 93841 - DNA, 22 bp, Artificial Sequence
  chemically synthesized
catcttacagatgagagtagta

SEQ ID NO: 93842 - DNA, 22 bp, Artificial Sequence
  chemically synthesized
acagatgagagtagtagagttg

SEQ ID NO: 93843 - DNA, 22 bp, Artificial Sequence
  chemically synthesized
cagatgagagtagtagagttgg

SEQ ID NO: 93844 - DNA, 22 bp, Artificial Sequence
  chemically synthesized
gtattttattctgaaacacaga

SEQ ID NO: 93845 - DNA, 22 bp, Artificial Sequence
  chemically synthesized
tattctgaaacacagaggacaa

SEQ ID NO: 93846 - DNA, 22 bp, Artificial Sequence
  chemically synthesized
attctgaaacacagaggacaag

SEQ ID NO: 93847 - DNA, 22 bp, Artificial Sequence
  chemically synthesized
ttctgaaacacagaggacaagt

SEQ ID NO: 93848 - DNA, 22 bp, Artificial Sequence
  chemically synthesized
tgaaacacagaggacaagtgga

SEQ ID NO: 93849 - DNA, 22 bp, Artificial Sequence
  chemically synthesized
aaacacagaggacaagtggaga

SEQ ID NO: 93850 - DNA, 22 bp, Artificial Sequence
  chemically synthesized
gtaaacctgagataaacatggt

SEQ ID NO: 93851 - DNA, 22 bp, Artificial Sequence
  chemically synthesized
taaacctgagataaacatggtt

SEQ ID NO: 93852 - DNA, 22 bp, Artificial Sequence
  chemically synthesized
agataaacatggtttctaatcc

SEQ ID NO: 93853 - DNA, 22 bp, Artificial Sequence
  chemically synthesized
ctaatccactgaacaccgaagc

SEQ ID NO: 93854 - DNA, 22 bp, Artificial Sequence
  chemically synthesized
taatccactgaacaccgaagct

SEQ ID NO: 93855 - DNA, 22 bp, Artificial Sequence
  chemically synthesized
atccactgaacaccgaagctta

SEQ ID NO: 93856 - DNA, 22 bp, Artificial Sequence
  chemically synthesized
aacaccgaagcttatttttttc

SEQ ID NO: 93857 - DNA, 22 bp, Artificial Sequence
  chemically synthesized
atttttttctctttcttcatct

SEQ ID NO: 93858 - DNA, 22 bp, Artificial Sequence
  chemically synthesized
tttttttctctttcttcatctg

SEQ ID NO: 93859 - DNA, 22 bp, Artificial Sequence
  chemically synthesized
ttttctctttcttcatctgcct

SEQ ID NO: 93860 - DNA, 22 bp, Artificial Sequence
  chemically synthesized
tttctctttcttcatctgcctt

SEQ ID NO: 93861 - DNA, 22 bp, Artificial Sequence
  chemically synthesized
ttctctttcttcatctgcctta

SEQ ID NO: 93862 - DNA, 22 bp, Artificial Sequence
  chemically synthesized
tctctttcttcatctgccttac

SEQ ID NO: 93863 - DNA, 22 bp, Artificial Sequence
  chemically synthesized
ctctttcttcatctgccttact

SEQ ID NO: 93864 - DNA, 22 bp, Artificial Sequence
  chemically synthesized
tctttcttcatctgccttactt

SEQ ID NO: 93865 - DNA, 22 bp, Artificial Sequence
  chemically synthesized
tttcttcatctgccttacttag

SEQ ID NO: 93866 - DNA, 22 bp, Artificial Sequence
  chemically synthesized
tcttcatctgccttacttagtg

SEQ ID NO: 93867 - DNA, 22 bp, Artificial Sequence
  chemically synthesized
cttcatctgccttacttagtgc

SEQ ID NO: 93868 - DNA, 22 bp, Artificial Sequence
  chemically synthesized
ttcatctgccttacttagtgca

SEQ ID NO: 93869 - DNA, 22 bp, Artificial Sequence
  chemically synthesized
catctgccttacttagtgcaag

SEQ ID NO: 93870 - DNA, 22 bp, Artificial Sequence
  chemically synthesized
atctgccttacttagtgcaagg

SEQ ID NO: 93871 - DNA, 22 bp, Artificial Sequence
  chemically synthesized
ccttacttagtgcaaggtgcta

SEQ ID NO: 93872 - DNA, 22 bp, Artificial Sequence
  chemically synthesized
acttagtgcaaggtgctataac

SEQ ID NO: 93873 - DNA, 22 bp, Artificial Sequence
  chemically synthesized
cttagtgcaaggtgctataaca

SEQ ID NO: 93874 - DNA, 22 bp, Artificial Sequence
  chemically synthesized
agtgcaaggtgctataacaaaa

SEQ ID NO: 93875 - DNA, 22 bp, Artificial Sequence
  chemically synthesized
gtgcaaggtgctataacaaaat

SEQ ID NO: 93876 - DNA, 22 bp, Artificial Sequence
  chemically synthesized
taacaaaatagcatagactggg

SEQ ID NO: 93877 - DNA, 22 bp, Artificial Sequence
  chemically synthesized
ggtgacttcaacaacaggattt

SEQ ID NO: 93878 - DNA, 22 bp, Artificial Sequence
  chemically synthesized
caacaacaggattttttctcac

SEQ ID NO: 93879 - DNA, 22 bp, Artificial Sequence
  chemically synthesized
aacaacaggattttttctcact

SEQ ID NO: 93880 - DNA, 22 bp, Artificial Sequence
  chemically synthesized
tttctcacttttctgctggttc

SEQ ID NO: 93881 - DNA, 22 bp, Artificial Sequence
  chemically synthesized
ttctcacttttctgctggttcc

SEQ ID NO: 93882 - DNA, 22 bp, Artificial Sequence
  chemically synthesized
tctcacttttctgctggttcct

SEQ ID NO: 93883 - DNA, 22 bp, Artificial Sequence
  chemically synthesized
ctcacttttctgctggttcctg

SEQ ID NO: 93884 - DNA, 22 bp, Artificial Sequence
  chemically synthesized
tcacttttctgctggttcctgg

SEQ ID NO: 93885 - DNA, 22 bp, Artificial Sequence
  chemically synthesized
acttttctgctggttcctggtc

SEQ ID NO: 93886 - DNA, 22 bp, Artificial Sequence
  chemically synthesized
ttctgctggttcctggtcaggg

SEQ ID NO: 93887 - DNA, 22 bp, Artificial Sequence
  chemically synthesized
tctgctggttcctggtcagggc

SEQ ID NO: 93888 - DNA, 22 bp, Artificial Sequence
  chemically synthesized
ctgctggttcctggtcagggct

SEQ ID NO: 93889 - DNA, 22 bp, Artificial Sequence
  chemically synthesized
tgctggttcctggtcagggctc

SEQ ID NO: 93890 - DNA, 22 bp, Artificial Sequence
  chemically synthesized
ctggttcctggtcagggctctc

SEQ ID NO: 93891 - DNA, 22 bp, Artificial Sequence
  chemically synthesized
gttcctggtcagggctctcttc

SEQ ID NO: 93892 - DNA, 22 bp, Artificial Sequence
  chemically synthesized
ctggtcagggctctcttcctgg

SEQ ID NO: 93893 - DNA, 22 bp, Artificial Sequence
  chemically synthesized
gtcagggctctcttcctgggtt

SEQ ID NO: 93894 - DNA, 22 bp, Artificial Sequence
  chemically synthesized
tcttcctgggttgcaggtggct

SEQ ID NO: 93895 - DNA, 22 bp, Artificial Sequence
  chemically synthesized
ttcctgggttgcaggtggctga

SEQ ID NO: 93896 - DNA, 22 bp, Artificial Sequence
  chemically synthesized
cctgggttgcaggtggctgact

SEQ ID NO: 93897 - DNA, 22 bp, Artificial Sequence
  chemically synthesized
ctgggttgcaggtggctgactt

SEQ ID NO: 93898 - DNA, 22 bp, Artificial Sequence
  chemically synthesized
ggttgcaggtggctgacttccc

SEQ ID NO: 93899 - DNA, 22 bp, Artificial Sequence
  chemically synthesized
caggtggctgacttcccactgt

SEQ ID NO: 93900 - DNA, 22 bp, Artificial Sequence
  chemically synthesized
acttcccactgtgtcctcacca

SEQ ID NO: 93901 - DNA, 22 bp, Artificial Sequence
  chemically synthesized
cccactgtgtcctcaccagaag

SEQ ID NO: 93902 - DNA, 22 bp, Artificial Sequence
  chemically synthesized
ccactgtgtcctcaccagaagg

SEQ ID NO: 93903 - DNA, 22 bp, Artificial Sequence
  chemically synthesized
tgtcctcaccagaaggaagaga

SEQ ID NO: 93904 - DNA, 22 bp, Artificial Sequence
  chemically synthesized
accagaaggaagagaaatggct

SEQ ID NO: 93905 - DNA, 22 bp, Artificial Sequence
  chemically synthesized
atctctctgcttctgatgagga

SEQ ID NO: 93906 - DNA, 22 bp, Artificial Sequence
  chemically synthesized
tctgcttctgatgaggaaaata

SEQ ID NO: 93907 - DNA, 22 bp, Artificial Sequence
  chemically synthesized
tgcttctgatgaggaaaataat

SEQ ID NO: 93908 - DNA, 22 bp, Artificial Sequence
  chemically synthesized
cttctgatgaggaaaataattc

SEQ ID NO: 93909 - DNA, 22 bp, Artificial Sequence
  chemically synthesized
ctgatgaggaaaataattctat

SEQ ID NO: 93910 - DNA, 22 bp, Artificial Sequence
  chemically synthesized
tgatgaggaaaataattctatg

SEQ ID NO: 93911 - DNA, 22 bp, Artificial Sequence
  chemically synthesized
atgaggaaaataattctatgat

SEQ ID NO: 93912 - DNA, 22 bp, Artificial Sequence
  chemically synthesized
tatgatggggatctgctctcat

SEQ ID NO: 93913 - DNA, 22 bp, Artificial Sequence
  chemically synthesized
tgatggggatctgctctcatga

SEQ ID NO: 93914 - DNA, 22 bp, Artificial Sequence
  chemically synthesized
ctctcatgagctcctctaaacc

SEQ ID NO: 93915 - DNA, 22 bp, Artificial Sequence
  chemically synthesized
tcatgagctcctctaaacctga

SEQ ID NO: 93916 - DNA, 22 bp, Artificial Sequence
  chemically synthesized
atgagctcctctaaacctgatt

SEQ ID NO: 93917 - DNA, 22 bp, Artificial Sequence
  chemically synthesized
ctctaaacctgattacttttcc

SEQ ID NO: 93918 - DNA, 22 bp, Artificial Sequence
  chemically synthesized
taaacctgattacttttccaaa

SEQ ID NO: 93919 - DNA, 22 bp, Artificial Sequence
  chemically synthesized
aacctgattacttttccaaagc

SEQ ID NO: 93920 - DNA, 22 bp, Artificial Sequence
  chemically synthesized
attacttttccaaagcctcccc

SEQ ID NO: 93921 - DNA, 22 bp, Artificial Sequence
  chemically synthesized
cttttccaaagcctcccccaca

SEQ ID NO: 93922 - DNA, 22 bp, Artificial Sequence
  chemically synthesized
ttccaaagcctcccccacaaat

SEQ ID NO: 93923 - DNA, 22 bp, Artificial Sequence
  chemically synthesized
tccaaagcctcccccacaaatg

SEQ ID NO: 93924 - DNA, 22 bp, Artificial Sequence
  chemically synthesized
ccaaagcctcccccacaaatgg

SEQ ID NO: 93925 - DNA, 22 bp, Artificial Sequence
  chemically synthesized
caaagcctcccccacaaatgga

SEQ ID NO: 93926 - DNA, 22 bp, Artificial Sequence
  chemically synthesized
ccccacaaatggagccaattgg

SEQ ID NO: 93927 - DNA, 22 bp, Artificial Sequence
  chemically synthesized
ggagttggggattcagcatgtg

SEQ ID NO: 93928 - DNA, 22 bp, Artificial Sequence
  chemically synthesized
gggattcagcatgtgaattttc

SEQ ID NO: 93929 - DNA, 22 bp, Artificial Sequence
  chemically synthesized
agcatgtgaattttctggagac

SEQ ID NO: 93930 - DNA, 22 bp, Artificial Sequence
  chemically synthesized
tctggagacacaagcgttaagt

SEQ ID NO: 93931 - DNA, 22 bp, Artificial Sequence
  chemically synthesized
ctggagacacaagcgttaagtt

SEQ ID NO: 93932 - DNA, 22 bp, Artificial Sequence
  chemically synthesized
tggagacacaagcgttaagttc

SEQ ID NO: 93933 - DNA, 22 bp, Artificial Sequence
  chemically synthesized
gagacacaagcgttaagttcat

SEQ ID NO: 93934 - DNA, 22 bp, Artificial Sequence
  chemically synthesized
agttcataacaccatcacatta

SEQ ID NO: 93935 - DNA, 22 bp, Artificial Sequence
  chemically synthesized
ataacaccatcacattaaacta

SEQ ID NO: 93936 - DNA, 22 bp, Artificial Sequence
  chemically synthesized
aactaaactcttgcttattaac

SEQ ID NO: 93937 - DNA, 22 bp, Artificial Sequence
  chemically synthesized
aactcttgcttattaacgtgca

SEQ ID NO: 93938 - DNA, 22 bp, Artificial Sequence
  chemically synthesized
ttgcttattaacgtgcattaac

SEQ ID NO: 93939 - DNA, 22 bp, Artificial Sequence
  chemically synthesized
gcttattaacgtgcattaactt

SEQ ID NO: 93940 - DNA, 22 bp, Artificial Sequence
  chemically synthesized
cttattaacgtgcattaacttt

SEQ ID NO: 93941 - DNA, 22 bp, Artificial Sequence
  chemically synthesized
attaacgtgcattaactttcaa

SEQ ID NO: 93942 - DNA, 22 bp, Artificial Sequence
  chemically synthesized
ttaacgtgcattaactttcaat

SEQ ID NO: 93943 - DNA, 22 bp, Artificial Sequence
  chemically synthesized
acgtgcattaactttcaattat

SEQ ID NO: 93944 - DNA, 22 bp, Artificial Sequence
  chemically synthesized
actttcaattatataagaactc

SEQ ID NO: 93945 - DNA, 22 bp, Artificial Sequence
  chemically synthesized
tcaattatataagaactccagt

SEQ ID NO: 93946 - DNA, 22 bp, Artificial Sequence
  chemically synthesized
caattatataagaactccagtg

SEQ ID NO: 93947 - DNA, 22 bp, Artificial Sequence
  chemically synthesized
aattatataagaactccagtga

SEQ ID NO: 93948 - DNA, 22 bp, Artificial Sequence
  chemically synthesized
tataagaactccagtgaatctg

SEQ ID NO: 93949 - DNA, 22 bp, Artificial Sequence
  chemically synthesized
cagtgaatctgccttctcaatt

SEQ ID NO: 93950 - DNA, 22 bp, Artificial Sequence
  chemically synthesized
ccttctcaattaatgttataca

SEQ ID NO: 93951 - DNA, 22 bp, Artificial Sequence
  chemically synthesized
ctcaattaatgttatacaaatt

SEQ ID NO: 93952 - DNA, 22 bp, Artificial Sequence
  chemically synthesized
tcaattaatgttatacaaattc

SEQ ID NO: 93953 - DNA, 22 bp, Artificial Sequence
  chemically synthesized
aattaatgttatacaaattctt

SEQ ID NO: 93954 - DNA, 22 bp, Artificial Sequence
  chemically synthesized
atgttatacaaattcttcacac

SEQ ID NO: 93955 - DNA, 22 bp, Artificial Sequence
  chemically synthesized
tacaaattcttcacactatatt

SEQ ID NO: 93956 - DNA, 22 bp, Artificial Sequence
  chemically synthesized
ttcacactatattttcatctga

SEQ ID NO: 93957 - DNA, 22 bp, Artificial Sequence
  chemically synthesized
cacactatattttcatctgacc

SEQ ID NO: 93958 - DNA, 22 bp, Artificial Sequence
  chemically synthesized
acactatattttcatctgaccg

SEQ ID NO: 93959 - DNA, 22 bp, Artificial Sequence
  chemically synthesized
tattttcatctgaccgtgctgt

SEQ ID NO: 93960 - DNA, 22 bp, Artificial Sequence
  chemically synthesized
tcatctgaccgtgctgttctgc

SEQ ID NO: 93961 - DNA, 22 bp, Artificial Sequence
  chemically synthesized
catctgaccgtgctgttctgct

SEQ ID NO: 93962 - DNA, 22 bp, Artificial Sequence
  chemically synthesized
atctgaccgtgctgttctgctg

SEQ ID NO: 93963 - DNA, 22 bp, Artificial Sequence
  chemically synthesized
accgtgctgttctgctgctgag

SEQ ID NO: 93964 - DNA, 22 bp, Artificial Sequence
  chemically synthesized
ttctgctgctgagacatgacac

SEQ ID NO: 93965 - DNA, 22 bp, Artificial Sequence
  chemically synthesized
tgctgctgagacatgacacgct

SEQ ID NO: 93966 - DNA, 22 bp, Artificial Sequence
  chemically synthesized
ctgctgagacatgacacgctga

SEQ ID NO: 93967 - DNA, 22 bp, Artificial Sequence
  chemically synthesized
ctgagacatgacacgctgatgc

SEQ ID NO: 93968 - DNA, 22 bp, Artificial Sequence
  chemically synthesized
agacatgacacgctgatgctga

SEQ ID NO: 93969 - DNA, 22 bp, Artificial Sequence
  chemically synthesized
atgctgacttgtgagcttctgc

SEQ ID NO: 93970 - DNA, 22 bp, Artificial Sequence
  chemically synthesized
acttgtgagcttctgctggctc

SEQ ID NO: 93971 - DNA, 22 bp, Artificial Sequence
  chemically synthesized
gtgagcttctgctggctcattt

SEQ ID NO: 93972 - DNA, 22 bp, Artificial Sequence
  chemically synthesized
tgagcttctgctggctcatttc

SEQ ID NO: 93973 - DNA, 22 bp, Artificial Sequence
  chemically synthesized
ctgctggctcatttccttcacc

SEQ ID NO: 93974 - DNA, 22 bp, Artificial Sequence
  chemically synthesized
tgctggctcatttccttcacct

SEQ ID NO: 93975 - DNA, 22 bp, Artificial Sequence
  chemically synthesized
ctggctcatttccttcacctaa

SEQ ID NO: 93976 - DNA, 22 bp, Artificial Sequence
  chemically synthesized
gctcatttccttcacctaagtc

SEQ ID NO: 93977 - DNA, 22 bp, Artificial Sequence
  chemically synthesized
atttccttcacctaagtcccca

SEQ ID NO: 93978 - DNA, 22 bp, Artificial Sequence
  chemically synthesized
ccttcacctaagtccccacctc

SEQ ID NO: 93979 - DNA, 22 bp, Artificial Sequence
  chemically synthesized
cttcacctaagtccccacctcc

SEQ ID NO: 93980 - DNA, 22 bp, Artificial Sequence
  chemically synthesized
cacctaagtccccacctcccta

SEQ ID NO: 93981 - DNA, 22 bp, Artificial Sequence
  chemically synthesized
acctaagtccccacctccctag

SEQ ID NO: 93982 - DNA, 22 bp, Artificial Sequence
  chemically synthesized
agtccccacctccctagaagct

SEQ ID NO: 93983 - DNA, 22 bp, Artificial Sequence
  chemically synthesized
cctagaagcttacaatgaggtc

SEQ ID NO: 93984 - DNA, 22 bp, Artificial Sequence
  chemically synthesized
gaagcttacaatgaggtctcct

SEQ ID NO: 93985 - DNA, 22 bp, Artificial Sequence
  chemically synthesized
acaatgaggtctcctccttgaa

SEQ ID NO: 93986 - DNA, 22 bp, Artificial Sequence
  chemically synthesized
caatgaggtctcctccttgaaa

SEQ ID NO: 93987 - DNA, 22 bp, Artificial Sequence
  chemically synthesized
ctccttgaaatgctgtgaccag

SEQ ID NO: 93988 - DNA, 22 bp, Artificial Sequence
  chemically synthesized
cttgaaatgctgtgaccagtct

SEQ ID NO: 93989 - DNA, 22 bp, Artificial Sequence
  chemically synthesized
gaaatgctgtgaccagtctgta

SEQ ID NO: 93990 - DNA, 22 bp, Artificial Sequence
  chemically synthesized
aaatgctgtgaccagtctgtag

SEQ ID NO: 93991 - DNA, 22 bp, Artificial Sequence
  chemically synthesized
tgaccagtctgtagacttaagg

SEQ ID NO: 93992 - DNA, 22 bp, Artificial Sequence
  chemically synthesized
tagacttaagggtatgggatta

SEQ ID NO: 93993 - DNA, 22 bp, Artificial Sequence
  chemically synthesized
aagggtatgggattaatttcac

SEQ ID NO: 93994 - DNA, 22 bp, Artificial Sequence
  chemically synthesized
agggtatgggattaatttcacc

SEQ ID NO: 93995 - DNA, 22 bp, Artificial Sequence
  chemically synthesized
atttcacctctttaggcatgcg

SEQ ID NO: 93996 - DNA, 22 bp, Artificial Sequence
  chemically synthesized
cacctctttaggcatgcgtcaa

SEQ ID NO: 93997 - DNA, 22 bp, Artificial Sequence
  chemically synthesized
acctctttaggcatgcgtcaac

SEQ ID NO: 93998 - DNA, 22 bp, Artificial Sequence
  chemically synthesized
tttaggcatgcgtcaacactta

SEQ ID NO: 93999 - DNA, 22 bp, Artificial Sequence
  chemically synthesized
taggcatgcgtcaacacttaaa

SEQ ID NO: 94000 - DNA, 22 bp, Artificial Sequence
  chemically synthesized
aggcatgcgtcaacacttaaaa

SEQ ID NO: 94001 - DNA, 22 bp, Artificial Sequence
  chemically synthesized
ggcatgcgtcaacacttaaaat

SEQ ID NO: 94002 - DNA, 22 bp, Artificial Sequence
  chemically synthesized
aaaatgaaaagttccttagtaa

SEQ ID NO: 94003 - DNA, 22 bp, Artificial Sequence
  chemically synthesized
aaatgaaaagttccttagtaaa

SEQ ID NO: 94004 - DNA, 22 bp, Artificial Sequence
  chemically synthesized
cttagtaaagtaaggatcactt

SEQ ID NO: 94005 - DNA, 22 bp, Artificial Sequence
  chemically synthesized
agtaaagtaaggatcacttcat

SEQ ID NO: 94006 - DNA, 22 bp, Artificial Sequence
  chemically synthesized
gtaaagtaaggatcacttcatt

SEQ ID NO: 94007 - DNA, 22 bp, Artificial Sequence
  chemically synthesized
cattgtagttaccgtggaaaga

SEQ ID NO: 94008 - DNA, 22 bp, Artificial Sequence
  chemically synthesized
attgtagttaccgtggaaagaa

SEQ ID NO: 94009 - DNA, 22 bp, Artificial Sequence
  chemically synthesized
tagttaccgtggaaagaaaaac

SEQ ID NO: 94010 - DNA, 22 bp, Artificial Sequence
  chemically synthesized
ccgtggaaagaaaaacctgttt

SEQ ID NO: 94011 - DNA, 22 bp, Artificial Sequence
  chemically synthesized
tttcctgctctgatctctaaca

SEQ ID NO: 94012 - DNA, 22 bp, Artificial Sequence
  chemically synthesized
cctgctctgatctctaacacct

SEQ ID NO: 94013 - DNA, 22 bp, Artificial Sequence
  chemically synthesized
ctgctctgatctctaacacctc

SEQ ID NO: 94014 - DNA, 22 bp, Artificial Sequence
  chemically synthesized
ctctgatctctaacacctcaac

SEQ ID NO: 94015 - DNA, 22 bp, Artificial Sequence
  chemically synthesized
tgatctctaacacctcaacctc

SEQ ID NO: 94016 - DNA, 22 bp, Artificial Sequence
  chemically synthesized
atctctaacacctcaacctccc

SEQ ID NO: 94017 - DNA, 22 bp, Artificial Sequence
  chemically synthesized
taacacctcaacctccctgtag

SEQ ID NO: 94018 - DNA, 22 bp, Artificial Sequence
  chemically synthesized
acacctcaacctccctgtagag

SEQ ID NO: 94019 - DNA, 22 bp, Artificial Sequence
  chemically synthesized
aacctccctgtagagcctcaca

SEQ ID NO: 94020 - DNA, 22 bp, Artificial Sequence
  chemically synthesized
cctgtagagcctcacaagggct

SEQ ID NO: 94021 - DNA, 22 bp, Artificial Sequence
  chemically synthesized
tagagcctcacaagggctgaga

SEQ ID NO: 94022 - DNA, 22 bp, Artificial Sequence
  chemically synthesized
acaagggctgagaaaagccaga

SEQ ID NO: 94023 - DNA, 22 bp, Artificial Sequence
  chemically synthesized
agaaaagccagatgccgttgga

SEQ ID NO: 94024 - DNA, 22 bp, Artificial Sequence
  chemically synthesized
gaaatagtattgcccctaataa

SEQ ID NO: 94025 - DNA, 22 bp, Artificial Sequence
  chemically synthesized
cccctaataaaatagaatggct

SEQ ID NO: 94026 - DNA, 22 bp, Artificial Sequence
  chemically synthesized
ataaaatagaatggctatccct

SEQ ID NO: 94027 - DNA, 22 bp, Artificial Sequence
  chemically synthesized
tccctgcctaaaccttgacttc

SEQ ID NO: 94028 - DNA, 22 bp, Artificial Sequence
  chemically synthesized
cctaaaccttgacttcctaaag

SEQ ID NO: 94029 - DNA, 22 bp, Artificial Sequence
  chemically synthesized
aaccttgacttcctaaagcttg

SEQ ID NO: 94030 - DNA, 22 bp, Artificial Sequence
  chemically synthesized
gacttcctaaagcttggaacac

SEQ ID NO: 94031 - DNA, 22 bp, Artificial Sequence
  chemically synthesized
acttcctaaagcttggaacact

SEQ ID NO: 94032 - DNA, 22 bp, Artificial Sequence
  chemically synthesized
cctaaagcttggaacacttttt

SEQ ID NO: 94033 - DNA, 22 bp, Artificial Sequence
  chemically synthesized
ctaaagcttggaacactttttc

SEQ ID NO: 94034 - DNA, 22 bp, Artificial Sequence
  chemically synthesized
aagcttggaacactttttcttc

SEQ ID NO: 94035 - DNA, 22 bp, Artificial Sequence
  chemically synthesized
ggaacactttttcttcgttgag

SEQ ID NO: 94036 - DNA, 22 bp, Artificial Sequence
  chemically synthesized
gaacactttttcttcgttgagc

SEQ ID NO: 94037 - DNA, 22 bp, Artificial Sequence
  chemically synthesized
tttcttcgttgagccccttcct

SEQ ID NO: 94038 - DNA, 22 bp, Artificial Sequence
  chemically synthesized
ttcttcgttgagccccttcctc

SEQ ID NO: 94039 - DNA, 22 bp, Artificial Sequence
  chemically synthesized
tcttcgttgagccccttcctcg

SEQ ID NO: 94040 - DNA, 22 bp, Artificial Sequence
  chemically synthesized
cttcgttgagccccttcctcgc

SEQ ID NO: 94041 - DNA, 22 bp, Artificial Sequence
  chemically synthesized
ttcgttgagccccttcctcgct

SEQ ID NO: 94042 - DNA, 22 bp, Artificial Sequence
  chemically synthesized
cgttgagccccttcctcgctgc

SEQ ID NO: 94043 - DNA, 22 bp, Artificial Sequence
  chemically synthesized
gttgagccccttcctcgctgct

SEQ ID NO: 94044 - DNA, 22 bp, Artificial Sequence
  chemically synthesized
agccccttcctcgctgctgtgc

SEQ ID NO: 94045 - DNA, 22 bp, Artificial Sequence
  chemically synthesized
cctcgctgctgtgctgcaatcc

SEQ ID NO: 94046 - DNA, 22 bp, Artificial Sequence
  chemically synthesized
ctcgctgctgtgctgcaatcca

SEQ ID NO: 94047 - DNA, 22 bp, Artificial Sequence
  chemically synthesized
gctgctgtgctgcaatccaggg

SEQ ID NO: 94048 - DNA, 22 bp, Artificial Sequence
  chemically synthesized
ctgtgctgcaatccagggaagg

SEQ ID NO: 94049 - DNA, 22 bp, Artificial Sequence
  chemically synthesized
tgctgcaatccagggaaggggg

SEQ ID NO: 94050 - DNA, 22 bp, Artificial Sequence
  chemically synthesized
caatccagggaagggggttcag

SEQ ID NO: 94051 - DNA, 22 bp, Artificial Sequence
  chemically synthesized
agcccccttcactgaacctttc

SEQ ID NO: 94052 - DNA, 22 bp, Artificial Sequence
  chemically synthesized
cactgaacctttccccatctct

SEQ ID NO: 94053 - DNA, 22 bp, Artificial Sequence
  chemically synthesized
actgaacctttccccatctctt

SEQ ID NO: 94054 - DNA, 22 bp, Artificial Sequence
  chemically synthesized
aacctttccccatctcttccaa

SEQ ID NO: 94055 - DNA, 22 bp, Artificial Sequence
  chemically synthesized
tccccatctcttccaaaacatc

SEQ ID NO: 94056 - DNA, 22 bp, Artificial Sequence
  chemically synthesized
ccccatctcttccaaaacatct

SEQ ID NO: 94057 - DNA, 22 bp, Artificial Sequence
  chemically synthesized
cccatctcttccaaaacatctg

SEQ ID NO: 94058 - DNA, 22 bp, Artificial Sequence
  chemically synthesized
ttccaaaacatctgtttctgag

SEQ ID NO: 94059 - DNA, 22 bp, Artificial Sequence
  chemically synthesized
ccaaaacatctgtttctgagga

SEQ ID NO: 94060 - DNA, 22 bp, Artificial Sequence
  chemically synthesized
caaaacatctgtttctgaggag

SEQ ID NO: 94061 - DNA, 22 bp, Artificial Sequence
  chemically synthesized
tttctgaggagtcctgtcctat

SEQ ID NO: 94062 - DNA, 22 bp, Artificial Sequence
  chemically synthesized
ctgaggagtcctgtcctataga

SEQ ID NO: 94063 - DNA, 22 bp, Artificial Sequence
  chemically synthesized
tgaggagtcctgtcctatagag

SEQ ID NO: 94064 - DNA, 22 bp, Artificial Sequence
  chemically synthesized
aggagtcctgtcctatagaggt

SEQ ID NO: 94065 - DNA, 22 bp, Artificial Sequence
  chemically synthesized
tcctatagaggtctttcttcca

SEQ ID NO: 94066 - DNA, 22 bp, Artificial Sequence
  chemically synthesized
tagaggtctttcttccaaccag

SEQ ID NO: 94067 - DNA, 22 bp, Artificial Sequence
  chemically synthesized
tcttccaaccagatttctcctg

SEQ ID NO: 94068 - DNA, 22 bp, Artificial Sequence
  chemically synthesized
cttccaaccagatttctcctgc

SEQ ID NO: 94069 - DNA, 22 bp, Artificial Sequence
  chemically synthesized
ttccaaccagatttctcctgca

SEQ ID NO: 94070 - DNA, 22 bp, Artificial Sequence
  chemically synthesized
ccaaccagatttctcctgcacc

SEQ ID NO: 94071 - DNA, 22 bp, Artificial Sequence
  chemically synthesized
caaccagatttctcctgcacct

SEQ ID NO: 94072 - DNA, 22 bp, Artificial Sequence
  chemically synthesized
ctcctgcaccttttactcccac

SEQ ID NO: 94073 - DNA, 22 bp, Artificial Sequence
  chemically synthesized
tcctgcaccttttactcccact

SEQ ID NO: 94074 - DNA, 22 bp, Artificial Sequence
  chemically synthesized
ctgcaccttttactcccacttg

SEQ ID NO: 94075 - DNA, 22 bp, Artificial Sequence
  chemically synthesized
caccttttactcccacttgcag

SEQ ID NO: 94076 - DNA, 22 bp, Artificial Sequence
  chemically synthesized
ttactcccacttgcagaactcc

SEQ ID NO: 94077 - DNA, 22 bp, Artificial Sequence
  chemically synthesized
tactcccacttgcagaactccc

SEQ ID NO: 94078 - DNA, 22 bp, Artificial Sequence
  chemically synthesized
actcccacttgcagaactccca

SEQ ID NO: 94079 - DNA, 22 bp, Artificial Sequence
  chemically synthesized
ctcccacttgcagaactcccat

SEQ ID NO: 94080 - DNA, 22 bp, Artificial Sequence
  chemically synthesized
ccacttgcagaactcccatgta

SEQ ID NO: 94081 - DNA, 22 bp, Artificial Sequence
  chemically synthesized
gcagaactcccatgtacaagtt

SEQ ID NO: 94082 - DNA, 22 bp, Artificial Sequence
  chemically synthesized
cagaactcccatgtacaagttt

SEQ ID NO: 94083 - DNA, 22 bp, Artificial Sequence
  chemically synthesized
ccatgtacaagtttctttattg

SEQ ID NO: 94084 - DNA, 22 bp, Artificial Sequence
  chemically synthesized
ctttattgcctagttcttttat

SEQ ID NO: 94085 - DNA, 22 bp, Artificial Sequence
  chemically synthesized
tttattgcctagttcttttatt

SEQ ID NO: 94086 - DNA, 22 bp, Artificial Sequence
  chemically synthesized
tattgcctagttcttttatttg

SEQ ID NO: 94087 - DNA, 22 bp, Artificial Sequence
  chemically synthesized
attgcctagttcttttatttgc

SEQ ID NO: 94088 - DNA, 22 bp, Artificial Sequence
  chemically synthesized
ttgcctagttcttttatttgct

SEQ ID NO: 94089 - DNA, 22 bp, Artificial Sequence
  chemically synthesized
cctagttcttttatttgctcat

SEQ ID NO: 94090 - DNA, 22 bp, Artificial Sequence
  chemically synthesized
gttcttttatttgctcatcaaa

SEQ ID NO: 94091 - DNA, 22 bp, Artificial Sequence
  chemically synthesized
ttttatttgctcatcaaaaccc

SEQ ID NO: 94092 - DNA, 22 bp, Artificial Sequence
  chemically synthesized
ttatttgctcatcaaaacccac

SEQ ID NO: 94093 - DNA, 22 bp, Artificial Sequence
  chemically synthesized
tatttgctcatcaaaacccaca

SEQ ID NO: 94094 - DNA, 22 bp, Artificial Sequence
  chemically synthesized
atttgctcatcaaaacccacat

SEQ ID NO: 94095 - DNA, 22 bp, Artificial Sequence
  chemically synthesized
tttgctcatcaaaacccacatc

SEQ ID NO: 94096 - DNA, 22 bp, Artificial Sequence
  chemically synthesized
gctcatcaaaacccacatctaa

SEQ ID NO: 94097 - DNA, 22 bp, Artificial Sequence
  chemically synthesized
ctcatcaaaacccacatctaac

SEQ ID NO: 94098 - DNA, 22 bp, Artificial Sequence
  chemically synthesized
atcaaaacccacatctaacgta

SEQ ID NO: 94099 - DNA, 22 bp, Artificial Sequence
  chemically synthesized
acgtaaacaaaaaagtgtggag

SEQ ID NO: 94100 - DNA, 22 bp, Artificial Sequence
  chemically synthesized
aacataaaaccctttgtggctc

SEQ ID NO: 94101 - DNA, 22 bp, Artificial Sequence
  chemically synthesized
tgtggctcatatatttaaaaag

SEQ ID NO: 94102 - DNA, 22 bp, Artificial Sequence
  chemically synthesized
gtggctcatatatttaaaaaga

SEQ ID NO: 94103 - DNA, 22 bp, Artificial Sequence
  chemically synthesized
tggctcatatatttaaaaagac

SEQ ID NO: 94104 - DNA, 22 bp, Artificial Sequence
  chemically synthesized
atatatttaaaaagacataaaa

SEQ ID NO: 94105 - DNA, 22 bp, Artificial Sequence
  chemically synthesized
aaaaagacataaaaaaagaact

SEQ ID NO: 94106 - DNA, 22 bp, Artificial Sequence
  chemically synthesized
aaaagacataaaaaaagaactg

SEQ ID NO: 94107 - DNA, 22 bp, Artificial Sequence
  chemically synthesized
aagacaaccatgtgtgatctct

SEQ ID NO: 94108 - DNA, 22 bp, Artificial Sequence
  chemically synthesized
ttagcagaatagatttattatt

SEQ ID NO: 94109 - DNA, 22 bp, Artificial Sequence
  chemically synthesized
agcagaatagatttattatttg

SEQ ID NO: 94110 - DNA, 22 bp, Artificial Sequence
  chemically synthesized
gcagaatagatttattatttga

SEQ ID NO: 94111 - DNA, 22 bp, Artificial Sequence
  chemically synthesized
attatttgattgcttgcagaat

SEQ ID NO: 94112 - DNA, 22 bp, Artificial Sequence
  chemically synthesized
ttatttgattgcttgcagaata

SEQ ID NO: 94113 - DNA, 22 bp, Artificial Sequence
  chemically synthesized
tttgattgcttgcagaataaag

SEQ ID NO: 94114 - DNA, 22 bp, Artificial Sequence
  chemically synthesized
gattgcttgcagaataaagcct

SEQ ID NO: 94115 - DNA, 22 bp, Artificial Sequence
  chemically synthesized
attgcttgcagaataaagccta

SEQ ID NO: 94116 - DNA, 22 bp, Artificial Sequence
  chemically synthesized
cttgcagaataaagcctatcct

SEQ ID NO: 94117 - DNA, 22 bp, Artificial Sequence
  chemically synthesized
gcagaataaagcctatccttga

SEQ ID NO: 94118 - DNA, 22 bp, Artificial Sequence
  chemically synthesized
cagaataaagcctatccttgaa

SEQ ID NO: 94119 - DNA, 22 bp, Artificial Sequence
  chemically synthesized
tccttgaaagctctgcatcatg

SEQ ID NO: 94120 - DNA, 22 bp, Artificial Sequence
  chemically synthesized
gaaagctctgcatcatgggcag

SEQ ID NO: 94121 - DNA, 22 bp, Artificial Sequence
  chemically synthesized
aaagctctgcatcatgggcagt

SEQ ID NO: 94122 - DNA, 22 bp, Artificial Sequence
  chemically synthesized
tgcatcatgggcagtgagctca

SEQ ID NO: 94123 - DNA, 22 bp, Artificial Sequence
  chemically synthesized
catcatgggcagtgagctcagt

SEQ ID NO: 94124 - DNA, 22 bp, Artificial Sequence
  chemically synthesized
agtggtatctggaggacagggc

SEQ ID NO: 94125 - DNA, 22 bp, Artificial Sequence
  chemically synthesized
gaggacagggcactggccactc

SEQ ID NO: 94126 - DNA, 22 bp, Artificial Sequence
  chemically synthesized
gccactccagtcaccatcttct

SEQ ID NO: 94127 - DNA, 22 bp, Artificial Sequence
  chemically synthesized
cagtcaccatcttctgccagga

SEQ ID NO: 94128 - DNA, 22 bp, Artificial Sequence
  chemically synthesized
ctgccaggaagcctgcacctca

SEQ ID NO: 94129 - DNA, 22 bp, Artificial Sequence
  chemically synthesized
tgccaggaagcctgcacctcag

SEQ ID NO: 94130 - DNA, 22 bp, Artificial Sequence
  chemically synthesized
ccaggaagcctgcacctcaggg

SEQ ID NO: 94131 - DNA, 22 bp, Artificial Sequence
  chemically synthesized
cacctcaggggtgaattctttg

SEQ ID NO: 94132 - DNA, 22 bp, Artificial Sequence
  chemically synthesized
aggggtgaattctttgccgaaa

SEQ ID NO: 94133 - DNA, 22 bp, Artificial Sequence
  chemically synthesized
tttgccgaaatggattgccaaa

SEQ ID NO: 94134 - DNA, 22 bp, Artificial Sequence
  chemically synthesized
tgccgaaatggattgccaaaac

SEQ ID NO: 94135 - DNA, 22 bp, Artificial Sequence
  chemically synthesized
gccgaaatggattgccaaaacg

SEQ ID NO: 94136 - DNA, 22 bp, Artificial Sequence
  chemically synthesized
ccgaaatggattgccaaaacgg

SEQ ID NO: 94137 - DNA, 22 bp, Artificial Sequence
  chemically synthesized
ccaaaacggtcaccagcacatt

SEQ ID NO: 94138 - DNA, 22 bp, Artificial Sequence
  chemically synthesized
cccaggagctgttgagatgaaa

SEQ ID NO: 94139 - DNA, 22 bp, Artificial Sequence
  chemically synthesized
ccaggagctgttgagatgaaag

SEQ ID NO: 94140 - DNA, 22 bp, Artificial Sequence
  chemically synthesized
ttgagatgaaaggagacaataa

SEQ ID NO: 94141 - DNA, 22 bp, Artificial Sequence
  chemically synthesized
agatgaaaggagacaataaaga

SEQ ID NO: 94142 - DNA, 22 bp, Artificial Sequence
  chemically synthesized
agagctccagcctggcctccag

SEQ ID NO: 94143 - DNA, 22 bp, Artificial Sequence
  chemically synthesized
cagcctggcctccagataacta

SEQ ID NO: 94144 - DNA, 22 bp, Artificial Sequence
  chemically synthesized
gcctccagataactacacacca

SEQ ID NO: 94145 - DNA, 22 bp, Artificial Sequence
  chemically synthesized
cagataactacacaccaagctt

SEQ ID NO: 94146 - DNA, 22 bp, Artificial Sequence
  chemically synthesized
cacaccaagcttccacccagaa

SEQ ID NO: 94147 - DNA, 22 bp, Artificial Sequence
  chemically synthesized
ccacccagaatcaagcctatgt

SEQ ID NO: 94148 - DNA, 22 bp, Artificial Sequence
  chemically synthesized
cacccagaatcaagcctatgtt

SEQ ID NO: 94149 - DNA, 22 bp, Artificial Sequence
  chemically synthesized
tgttaacttccctcaaagcctg

SEQ ID NO: 94150 - DNA, 22 bp, Artificial Sequence
  chemically synthesized
acttccctcaaagcctgagatt

SEQ ID NO: 94151 - DNA, 22 bp, Artificial Sequence
  chemically synthesized
ccctcaaagcctgagattttgc

SEQ ID NO: 94152 - DNA, 22 bp, Artificial Sequence
  chemically synthesized
cctcaaagcctgagattttgct

SEQ ID NO: 94153 - DNA, 22 bp, Artificial Sequence
  chemically synthesized
aaagcctgagattttgctttcc

SEQ ID NO: 94154 - DNA, 22 bp, Artificial Sequence
  chemically synthesized
agattttgctttcccattaaat

SEQ ID NO: 94155 - DNA, 22 bp, Artificial Sequence
  chemically synthesized
tgctttcccattaaatgcaggt

SEQ ID NO: 94156 - DNA, 22 bp, Artificial Sequence
  chemically synthesized
gctttcccattaaatgcaggta

SEQ ID NO: 94157 - DNA, 22 bp, Artificial Sequence
  chemically synthesized
ctttcccattaaatgcaggtag

SEQ ID NO: 94158 - DNA, 22 bp, Artificial Sequence
  chemically synthesized
tcccattaaatgcaggtagttg

SEQ ID NO: 94159 - DNA, 22 bp, Artificial Sequence
  chemically synthesized
cccattaaatgcaggtagttgt

SEQ ID NO: 94160 - DNA, 22 bp, Artificial Sequence
  chemically synthesized
ccattaaatgcaggtagttgtt

SEQ ID NO: 94161 - DNA, 22 bp, Artificial Sequence
  chemically synthesized
aatgcaggtagttgttcttctt

SEQ ID NO: 94162 - DNA, 22 bp, Artificial Sequence
  chemically synthesized
ttcttcttgcagcactagtcac

SEQ ID NO: 94163 - DNA, 22 bp, Artificial Sequence
  chemically synthesized
ttcttgcagcactagtcactgg

SEQ ID NO: 94164 - DNA, 22 bp, Artificial Sequence
  chemically synthesized
cttgcagcactagtcactggcc

SEQ ID NO: 94165 - DNA, 22 bp, Artificial Sequence
  chemically synthesized
ttgcagcactagtcactggcca

SEQ ID NO: 94166 - DNA, 22 bp, Artificial Sequence
  chemically synthesized
gcagcactagtcactggccata

SEQ ID NO: 94167 - DNA, 22 bp, Artificial Sequence
  chemically synthesized
cagcactagtcactggccataa

SEQ ID NO: 94168 - DNA, 22 bp, Artificial Sequence
  chemically synthesized
gtcactggccataatttaaatc

SEQ ID NO: 94169 - DNA, 22 bp, Artificial Sequence
  chemically synthesized
gccataatttaaatcttgttat

SEQ ID NO: 94170 - DNA, 22 bp, Artificial Sequence
  chemically synthesized
aaatcttgttatcttcttgcca

SEQ ID NO: 94171 - DNA, 22 bp, Artificial Sequence
  chemically synthesized
aatcttgttatcttcttgccac

SEQ ID NO: 94172 - DNA, 22 bp, Artificial Sequence
  chemically synthesized
gttatcttcttgccaccatgaa

SEQ ID NO: 94173 - DNA, 22 bp, Artificial Sequence
  chemically synthesized
ttatcttcttgccaccatgaac

SEQ ID NO: 94174 - DNA, 22 bp, Artificial Sequence
  chemically synthesized
tcttcttgccaccatgaaccct

SEQ ID NO: 94175 - DNA, 22 bp, Artificial Sequence
  chemically synthesized
cttgccaccatgaaccctgtat

SEQ ID NO: 94176 - DNA, 22 bp, Artificial Sequence
  chemically synthesized
ttgccaccatgaaccctgtatg

SEQ ID NO: 94177 - DNA, 22 bp, Artificial Sequence
  chemically synthesized
gccaccatgaaccctgtatgct

SEQ ID NO: 94178 - DNA, 22 bp, Artificial Sequence
  chemically synthesized
ccaccatgaaccctgtatgctg

SEQ ID NO: 94179 - DNA, 22 bp, Artificial Sequence
  chemically synthesized
tatgctgtaggctgaaaacgtt

SEQ ID NO: 94180 - DNA, 22 bp, Artificial Sequence
  chemically synthesized
taggctgaaaacgttaaaagaa

SEQ ID NO: 94181 - DNA, 22 bp, Artificial Sequence
  chemically synthesized
aaaacgttaaaagaaacacacg

SEQ ID NO: 94182 - DNA, 22 bp, Artificial Sequence
  chemically synthesized
aaagaaacacacgctctcacac

SEQ ID NO: 94183 - DNA, 22 bp, Artificial Sequence
  chemically synthesized
tcacacacacacaaacacacgc

SEQ ID NO: 94184 - DNA, 22 bp, Artificial Sequence
  chemically synthesized
acacacacacaaacacacgcgc

SEQ ID NO: 94185 - DNA, 22 bp, Artificial Sequence
  chemically synthesized
actttcaaaatctactccagcc

SEQ ID NO: 94186 - DNA, 22 bp, Artificial Sequence
  chemically synthesized
tcaaaatctactccagcccaaa

SEQ ID NO: 94187 - DNA, 22 bp, Artificial Sequence
  chemically synthesized
caaaatctactccagcccaaat

SEQ ID NO: 94188 - DNA, 22 bp, Artificial Sequence
  chemically synthesized
aaaatctactccagcccaaatg

SEQ ID NO: 94189 - DNA, 22 bp, Artificial Sequence
  chemically synthesized
ctccagcccaaatgtttcaatt

SEQ ID NO: 94190 - DNA, 22 bp, Artificial Sequence
  chemically synthesized
cagcccaaatgtttcaattgtt

SEQ ID NO: 94191 - DNA, 22 bp, Artificial Sequence
  chemically synthesized
caattgttcctcacccctggac

SEQ ID NO: 94192 - DNA, 22 bp, Artificial Sequence
  chemically synthesized
aattgttcctcacccctggaca

SEQ ID NO: 94193 - DNA, 22 bp, Artificial Sequence
  chemically synthesized
ttcctcacccctggacatactt

SEQ ID NO: 94194 - DNA, 22 bp, Artificial Sequence
  chemically synthesized
ctcacccctggacatactttgc

SEQ ID NO: 94195 - DNA, 22 bp, Artificial Sequence
  chemically synthesized
acccctggacatactttgcccc

SEQ ID NO: 94196 - DNA, 22 bp, Artificial Sequence
  chemically synthesized
gacatactttgcccccatctgg

SEQ ID NO: 94197 - DNA, 22 bp, Artificial Sequence
  chemically synthesized
tgcccccatctggaattaaagg

SEQ ID NO: 94198 - DNA, 22 bp, Artificial Sequence
  chemically synthesized
gcccccatctggaattaaagga

SEQ ID NO: 94199 - DNA, 22 bp, Artificial Sequence
  chemically synthesized
cccccatctggaattaaaggat

SEQ ID NO: 94200 - DNA, 22 bp, Artificial Sequence
  chemically synthesized
gaattaaaggatataagtttgt

SEQ ID NO: 94201 - DNA, 22 bp, Artificial Sequence
  chemically synthesized
aaggatataagtttgtaatgaa

SEQ ID NO: 94202 - DNA, 22 bp, Artificial Sequence
  chemically synthesized
gtaatgaagcattagcagcatt

SEQ ID NO: 94203 - DNA, 22 bp, Artificial Sequence
  chemically synthesized
taatgaagcattagcagcattt

SEQ ID NO: 94204 - DNA, 22 bp, Artificial Sequence
  chemically synthesized
gcagcattttatatgtgtccag

SEQ ID NO: 94205 - DNA, 22 bp, Artificial Sequence
  chemically synthesized
tatatgtgtccagctgatatag

SEQ ID NO: 94206 - DNA, 22 bp, Artificial Sequence
  chemically synthesized
atatgtgtccagctgatatagg

SEQ ID NO: 94207 - DNA, 22 bp, Artificial Sequence
  chemically synthesized
tatgtgtccagctgatatagga

SEQ ID NO: 94208 - DNA, 22 bp, Artificial Sequence
  chemically synthesized
atataggaatagccttagcaat

SEQ ID NO: 94209 - DNA, 22 bp, Artificial Sequence
  chemically synthesized
agcaatgtatgtttggccacca

SEQ ID NO: 94210 - DNA, 22 bp, Artificial Sequence
  chemically synthesized
gcaatgtatgtttggccaccaa

SEQ ID NO: 94211 - DNA, 22 bp, Artificial Sequence
  chemically synthesized
ggccaccaaagttccccacttt

SEQ ID NO: 94212 - DNA, 22 bp, Artificial Sequence
  chemically synthesized
gccaccaaagttccccactttg

SEQ ID NO: 94213 - DNA, 22 bp, Artificial Sequence
  chemically synthesized
cccactttgactgagccaatat

SEQ ID NO: 94214 - DNA, 22 bp, Artificial Sequence
  chemically synthesized
tgactgagccaatatatgcctt

SEQ ID NO: 94215 - DNA, 22 bp, Artificial Sequence
  chemically synthesized
gactgagccaatatatgccttc

SEQ ID NO: 94216 - DNA, 22 bp, Artificial Sequence
  chemically synthesized
actgagccaatatatgccttct

SEQ ID NO: 94217 - DNA, 22 bp, Artificial Sequence
  chemically synthesized
agccaatatatgccttctgcct

SEQ ID NO: 94218 - DNA, 22 bp, Artificial Sequence
  chemically synthesized
ctgcctgcatctttttaatgac

SEQ ID NO: 94219 - DNA, 22 bp, Artificial Sequence
  chemically synthesized
tgcctgcatctttttaatgacc

SEQ ID NO: 94220 - DNA, 22 bp, Artificial Sequence
  chemically synthesized
cctgcatctttttaatgaccat

SEQ ID NO: 94221 - DNA, 22 bp, Artificial Sequence
  chemically synthesized
catctttttaatgaccatactt

SEQ ID NO: 94222 - DNA, 22 bp, Artificial Sequence
  chemically synthesized
tttaatgaccatacttgtcctg

SEQ ID NO: 94223 - DNA, 22 bp, Artificial Sequence
  chemically synthesized
ttaatgaccatacttgtcctgc

SEQ ID NO: 94224 - DNA, 22 bp, Artificial Sequence
  chemically synthesized
taatgaccatacttgtcctgcc

SEQ ID NO: 94225 - DNA, 22 bp, Artificial Sequence
  chemically synthesized
aatgaccatacttgtcctgcct

SEQ ID NO: 94226 - DNA, 22 bp, Artificial Sequence
  chemically synthesized
atgaccatacttgtcctgcctc

SEQ ID NO: 94227 - DNA, 22 bp, Artificial Sequence
  chemically synthesized
gtcctgcctccagatagatgtt

SEQ ID NO: 94228 - DNA, 22 bp, Artificial Sequence
  chemically synthesized
tcctgcctccagatagatgttt

SEQ ID NO: 94229 - DNA, 22 bp, Artificial Sequence
  chemically synthesized
cctccagatagatgttttaaaa

SEQ ID NO: 94230 - DNA, 22 bp, Artificial Sequence
  chemically synthesized
cagatagatgttttaaaacgaa

SEQ ID NO: 94231 - DNA, 22 bp, Artificial Sequence
  chemically synthesized
taaaacgaataacaaaaatagg

SEQ ID NO: 94232 - DNA, 22 bp, Artificial Sequence
  chemically synthesized
aaaacgaataacaaaaataggg

SEQ ID NO: 94233 - DNA, 22 bp, Artificial Sequence
  chemically synthesized
aaacgaataacaaaaatagggg

SEQ ID NO: 94234 - DNA, 22 bp, Artificial Sequence
  chemically synthesized
tttctaccgaaatctaataaag

SEQ ID NO: 94235 - DNA, 22 bp, Artificial Sequence
  chemically synthesized
tctaccgaaatctaataaagaa

SEQ ID NO: 94236 - DNA, 22 bp, Artificial Sequence
  chemically synthesized
ctaccgaaatctaataaagaaa

SEQ ID NO: 94237 - DNA, 22 bp, Artificial Sequence
  chemically synthesized
taccgaaatctaataaagaaaa

SEQ ID NO: 94238 - DNA, 22 bp, Artificial Sequence
  chemically synthesized
ccgaaatctaataaagaaaagt

SEQ ID NO: 94239 - DNA, 22 bp, Artificial Sequence
  chemically synthesized
ataaagaaaagtcattttcctc

SEQ ID NO: 94240 - DNA, 22 bp, Artificial Sequence
  chemically synthesized
tcctcatttccacctctctttt

SEQ ID NO: 94241 - DNA, 22 bp, Artificial Sequence
  chemically synthesized
cctcatttccacctctcttttc

SEQ ID NO: 94242 - DNA, 22 bp, Artificial Sequence
  chemically synthesized
ctcatttccacctctcttttct

SEQ ID NO: 94243 - DNA, 22 bp, Artificial Sequence
  chemically synthesized
atttccacctctcttttctcaa

SEQ ID NO: 94244 - DNA, 22 bp, Artificial Sequence
  chemically synthesized
ccacctctcttttctcaaagtc

SEQ ID NO: 94245 - DNA, 22 bp, Artificial Sequence
  chemically synthesized
cacctctcttttctcaaagtca

SEQ ID NO: 94246 - DNA, 22 bp, Artificial Sequence
  chemically synthesized
tcttttctcaaagtcaaagttg

SEQ ID NO: 94247 - DNA, 22 bp, Artificial Sequence
  chemically synthesized
ttttctcaaagtcaaagttgtc

SEQ ID NO: 94248 - DNA, 22 bp, Artificial Sequence
  chemically synthesized
ttctcaaagtcaaagttgtcca

SEQ ID NO: 94249 - DNA, 22 bp, Artificial Sequence
  chemically synthesized
tctcaaagtcaaagttgtccat

SEQ ID NO: 94250 - DNA, 22 bp, Artificial Sequence
  chemically synthesized
ctcaaagtcaaagttgtccatc

SEQ ID NO: 94251 - DNA, 22 bp, Artificial Sequence
  chemically synthesized
tcaaagtcaaagttgtccatct

SEQ ID NO: 94252 - DNA, 22 bp, Artificial Sequence
  chemically synthesized
aaagtcaaagttgtccatctag

SEQ ID NO: 94253 - DNA, 22 bp, Artificial Sequence
  chemically synthesized
tccatctagattttcagaggca

SEQ ID NO: 94254 - DNA, 22 bp, Artificial Sequence
  chemically synthesized
gattttcagaggcactccttag

SEQ ID NO: 94255 - DNA, 22 bp, Artificial Sequence
  chemically synthesized
tcagaggcactccttaggccct

SEQ ID NO: 94256 - DNA, 22 bp, Artificial Sequence
  chemically synthesized
cagaggcactccttaggcccta

SEQ ID NO: 94257 - DNA, 22 bp, Artificial Sequence
  chemically synthesized
agaggcactccttaggccctaa

SEQ ID NO: 94258 - DNA, 22 bp, Artificial Sequence
  chemically synthesized
cttaggccctaaaacattgcca

SEQ ID NO: 94259 - DNA, 22 bp, Artificial Sequence
  chemically synthesized
aggccctaaaacattgccactg

SEQ ID NO: 94260 - DNA, 22 bp, Artificial Sequence
  chemically synthesized
ggccctaaaacattgccactgg

SEQ ID NO: 94261 - DNA, 22 bp, Artificial Sequence
  chemically synthesized
aaacattgccactgggtctcag

SEQ ID NO: 94262 - DNA, 22 bp, Artificial Sequence
  chemically synthesized
ccactgggtctcagcccagtta

SEQ ID NO: 94263 - DNA, 22 bp, Artificial Sequence
  chemically synthesized
ggtctcagcccagttagtcctc

SEQ ID NO: 94264 - DNA, 22 bp, Artificial Sequence
  chemically synthesized
agcccagttagtcctctgcagt

SEQ ID NO: 94265 - DNA, 22 bp, Artificial Sequence
  chemically synthesized
gtcctctgcagtttcttcactc

SEQ ID NO: 94266 - DNA, 22 bp, Artificial Sequence
  chemically synthesized
tgcagtttcttcactcccaacc

SEQ ID NO: 94267 - DNA, 22 bp, Artificial Sequence
  chemically synthesized
cagtttcttcactcccaacccc

SEQ ID NO: 94268 - DNA, 22 bp, Artificial Sequence
  chemically synthesized
cttcactcccaaccccagtatc

SEQ ID NO: 94269 - DNA, 22 bp, Artificial Sequence
  chemically synthesized
ttcactcccaaccccagtatct

SEQ ID NO: 94270 - DNA, 22 bp, Artificial Sequence
  chemically synthesized
cactcccaaccccagtatcttc

SEQ ID NO: 94271 - DNA, 22 bp, Artificial Sequence
  chemically synthesized
actcccaaccccagtatcttca

SEQ ID NO: 94272 - DNA, 22 bp, Artificial Sequence
  chemically synthesized
ccaaccccagtatcttcaaaca

SEQ ID NO: 94273 - DNA, 22 bp, Artificial Sequence
  chemically synthesized
caaacagctcacaccctgctgt

SEQ ID NO: 94274 - DNA, 22 bp, Artificial Sequence
  chemically synthesized
aaacagctcacaccctgctgtg

SEQ ID NO: 94275 - DNA, 22 bp, Artificial Sequence
  chemically synthesized
acaccctgctgtgctcagatca

SEQ ID NO: 94276 - DNA, 22 bp, Artificial Sequence
  chemically synthesized
ctgtgctcagatcaatactcag

SEQ ID NO: 94277 - DNA, 22 bp, Artificial Sequence
  chemically synthesized
tgctcagatcaatactcagttg

SEQ ID NO: 94278 - DNA, 22 bp, Artificial Sequence
  chemically synthesized
agatcaatactcagttgtctaa

SEQ ID NO: 94279 - DNA, 22 bp, Artificial Sequence
  chemically synthesized
agttgtctaagttgcctcgaga

SEQ ID NO: 94280 - DNA, 22 bp, Artificial Sequence
  chemically synthesized
tctaagttgcctcgagactaaa

SEQ ID NO: 94281 - DNA, 22 bp, Artificial Sequence
  chemically synthesized
agttgcctcgagactaaaggca

SEQ ID NO: 94282 - DNA, 22 bp, Artificial Sequence
  chemically synthesized
cctcgagactaaaggcaacagt

SEQ ID NO: 94283 - DNA, 22 bp, Artificial Sequence
  chemically synthesized
gagactaaaggcaacagtgctg

SEQ ID NO: 94284 - DNA, 22 bp, Artificial Sequence
  chemically synthesized
aaggcaacagtgctgaaacatc

SEQ ID NO: 94285 - DNA, 22 bp, Artificial Sequence
  chemically synthesized
aaacatctcctggactcacctt

SEQ ID NO: 94286 - DNA, 22 bp, Artificial Sequence
  chemically synthesized
ctggactcaccttgaagttctc

SEQ ID NO: 94287 - DNA, 22 bp, Artificial Sequence
  chemically synthesized
gactcaccttgaagttctcagg

SEQ ID NO: 94288 - DNA, 22 bp, Artificial Sequence
  chemically synthesized
accttgaagttctcaggatcca

SEQ ID NO: 94289 - DNA, 22 bp, Artificial Sequence
  chemically synthesized
gaagttctcaggatccacatgc

SEQ ID NO: 94290 - DNA, 22 bp, Artificial Sequence
  chemically synthesized
aagttctcaggatccacatgca

SEQ ID NO: 94291 - DNA, 22 bp, Artificial Sequence
  chemically synthesized
tcaggatccacatgcagcttgt

SEQ ID NO: 94292 - DNA, 22 bp, Artificial Sequence
  chemically synthesized
aggatccacatgcagcttgtca

SEQ ID NO: 94293 - DNA, 22 bp, Artificial Sequence
  chemically synthesized
gtcacagtgcagttcactcagc

SEQ ID NO: 94294 - DNA, 22 bp, Artificial Sequence
  chemically synthesized
tcacagtgcagttcactcagct

SEQ ID NO: 94295 - DNA, 22 bp, Artificial Sequence
  chemically synthesized
actcagctgggcaaaggtgccc

SEQ ID NO: 94296 - DNA, 22 bp, Artificial Sequence
  chemically synthesized
agctgggcaaaggtgcccttga

SEQ ID NO: 94297 - DNA, 22 bp, Artificial Sequence
  chemically synthesized
ggcaaaggtgcccttgagatca

SEQ ID NO: 94298 - DNA, 22 bp, Artificial Sequence
  chemically synthesized
gagatcatccaggtgctttatg

SEQ ID NO: 94299 - DNA, 22 bp, Artificial Sequence
  chemically synthesized
agatcatccaggtgctttatgg

SEQ ID NO: 94300 - DNA, 22 bp, Artificial Sequence
  chemically synthesized
tatggcatctcccaaggaagtc

SEQ ID NO: 94301 - DNA, 22 bp, Artificial Sequence
  chemically synthesized
atggcatctcccaaggaagtca

SEQ ID NO: 94302 - DNA, 22 bp, Artificial Sequence
  chemically synthesized
tggcatctcccaaggaagtcag

SEQ ID NO: 94303 - DNA, 22 bp, Artificial Sequence
  chemically synthesized
ccaaggaagtcagcaccttctt

SEQ ID NO: 94304 - DNA, 22 bp, Artificial Sequence
  chemically synthesized
cttgccatgtgccttgactttg

SEQ ID NO: 94305 - DNA, 22 bp, Artificial Sequence
  chemically synthesized
ttgccatgtgccttgactttgg

SEQ ID NO: 94306 - DNA, 22 bp, Artificial Sequence
  chemically synthesized
gccatgtgccttgactttgggg

SEQ ID NO: 94307 - DNA, 22 bp, Artificial Sequence
  chemically synthesized
ccatgtgccttgactttggggt

SEQ ID NO: 94308 - DNA, 22 bp, Artificial Sequence
  chemically synthesized
gactttggggttgcccatgatg

SEQ ID NO: 94309 - DNA, 22 bp, Artificial Sequence
  chemically synthesized
actttggggttgcccatgatgg

SEQ ID NO: 94310 - DNA, 22 bp, Artificial Sequence
  chemically synthesized
tggggttgcccatgatggcaga

SEQ ID NO: 94311 - DNA, 22 bp, Artificial Sequence
  chemically synthesized
ggggttgcccatgatggcagag

SEQ ID NO: 94312 - DNA, 22 bp, Artificial Sequence
  chemically synthesized
gggttgcccatgatggcagagg

SEQ ID NO: 94313 - DNA, 22 bp, Artificial Sequence
  chemically synthesized
cccatgatggcagaggcagagg

SEQ ID NO: 94314 - DNA, 22 bp, Artificial Sequence
  chemically synthesized
ccaaagctgtcaaagaacctct

SEQ ID NO: 94315 - DNA, 22 bp, Artificial Sequence
  chemically synthesized
tcaaagaacctctgggtccatg

SEQ ID NO: 94316 - DNA, 22 bp, Artificial Sequence
  chemically synthesized
tgggtccatgggtagacaacca

SEQ ID NO: 94317 - DNA, 22 bp, Artificial Sequence
  chemically synthesized
ggtccatgggtagacaaccagg

SEQ ID NO: 94318 - DNA, 22 bp, Artificial Sequence
  chemically synthesized
tgagattgacaagaacagtttg

SEQ ID NO: 94319 - DNA, 22 bp, Artificial Sequence
  chemically synthesized
acaagaacagtttgacagtcag

SEQ ID NO: 94320 - DNA, 22 bp, Artificial Sequence
  chemically synthesized
gacagtcagaaggtgccacaaa

SEQ ID NO: 94321 - DNA, 22 bp, Artificial Sequence
  chemically synthesized
acagtcagaaggtgccacaaat

SEQ ID NO: 94322 - DNA, 22 bp, Artificial Sequence
  chemically synthesized
agaagcgacctggacttttgcc

SEQ ID NO: 94323 - DNA, 22 bp, Artificial Sequence
  chemically synthesized
gacttttgccaggcacagggtc

SEQ ID NO: 94324 - DNA, 22 bp, Artificial Sequence
  chemically synthesized
ttgccaggcacagggtccttcc

SEQ ID NO: 94325 - DNA, 22 bp, Artificial Sequence
  chemically synthesized
tgccaggcacagggtccttcct

SEQ ID NO: 94326 - DNA, 22 bp, Artificial Sequence
  chemically synthesized
gccaggcacagggtccttcctt

SEQ ID NO: 94327 - DNA, 22 bp, Artificial Sequence
  chemically synthesized
ccaggcacagggtccttccttc

SEQ ID NO: 94328 - DNA, 22 bp, Artificial Sequence
  chemically synthesized
ccttccctcccttgtcctggtc

SEQ ID NO: 94329 - DNA, 22 bp, Artificial Sequence
  chemically synthesized
cttccctcccttgtcctggtca

SEQ ID NO: 94330 - DNA, 22 bp, Artificial Sequence
  chemically synthesized
ccctcccttgtcctggtcacca

SEQ ID NO: 94331 - DNA, 22 bp, Artificial Sequence
  chemically synthesized
cctcccttgtcctggtcaccag

SEQ ID NO: 94332 - DNA, 22 bp, Artificial Sequence
  chemically synthesized
ccttgtcctggtcaccagagcc

SEQ ID NO: 94333 - DNA, 22 bp, Artificial Sequence
  chemically synthesized
gtcctggtcaccagagcctacc

SEQ ID NO: 94334 - DNA, 22 bp, Artificial Sequence
  chemically synthesized
tcctggtcaccagagcctacct

SEQ ID NO: 94335 - DNA, 22 bp, Artificial Sequence
  chemically synthesized
gtcaccagagcctaccttccca

SEQ ID NO: 94336 - DNA, 22 bp, Artificial Sequence
  chemically synthesized
ccttcccagggtttctcctcca

SEQ ID NO: 94337 - DNA, 22 bp, Artificial Sequence
  chemically synthesized
cccagggtttctcctccagcat

SEQ ID NO: 94338 - DNA, 22 bp, Artificial Sequence
  chemically synthesized
ccagggtttctcctccagcatc

SEQ ID NO: 94339 - DNA, 22 bp, Artificial Sequence
  chemically synthesized
ctcctccagcatcttccacatt

SEQ ID NO: 94340 - DNA, 22 bp, Artificial Sequence
  chemically synthesized
tcctccagcatcttccacattc

SEQ ID NO: 94341 - DNA, 22 bp, Artificial Sequence
  chemically synthesized
ctccagcatcttccacattcac

SEQ ID NO: 94342 - DNA, 22 bp, Artificial Sequence
  chemically synthesized
cagcatcttccacattcacctt

SEQ ID NO: 94343 - DNA, 22 bp, Artificial Sequence
  chemically synthesized
ccacattcaccttgccccacag

SEQ ID NO: 94344 - DNA, 22 bp, Artificial Sequence
  chemically synthesized
cacattcaccttgccccacagg

SEQ ID NO: 94345 - DNA, 22 bp, Artificial Sequence
  chemically synthesized
accttgccccacaggcttgtga

SEQ ID NO: 94346 - DNA, 22 bp, Artificial Sequence
  chemically synthesized
gccccacaggcttgtgatagta

SEQ ID NO: 94347 - DNA, 22 bp, Artificial Sequence
  chemically synthesized
ccccacaggcttgtgatagtag

SEQ ID NO: 94348 - DNA, 22 bp, Artificial Sequence
  chemically synthesized
gtgatagtagccttgtcctcct

SEQ ID NO: 94349 - DNA, 22 bp, Artificial Sequence
  chemically synthesized
tgatagtagccttgtcctcctc

SEQ ID NO: 94350 - DNA, 22 bp, Artificial Sequence
  chemically synthesized
gtcctcctctgtgaaatgaccc

SEQ ID NO: 94351 - DNA, 22 bp, Artificial Sequence
  chemically synthesized
tcctcctctgtgaaatgaccca

SEQ ID NO: 94352 - DNA, 22 bp, Artificial Sequence
  chemically synthesized
ctctgtgaaatgacccatggcg

SEQ ID NO: 94353 - DNA, 22 bp, Artificial Sequence
  chemically synthesized
tgtgaaatgacccatggcgtct

SEQ ID NO: 94354 - DNA, 22 bp, Artificial Sequence
  chemically synthesized
tgaaatgacccatggcgtctgg

SEQ ID NO: 94355 - DNA, 22 bp, Artificial Sequence
  chemically synthesized
gactaggagcttattgataacc

SEQ ID NO: 94356 - DNA, 22 bp, Artificial Sequence
  chemically synthesized
ggagcttattgataacctcaga

SEQ ID NO: 94357 - DNA, 22 bp, Artificial Sequence
  chemically synthesized
attgataacctcagacgttcca

SEQ ID NO: 94358 - DNA, 22 bp, Artificial Sequence
  chemically synthesized
ttgataacctcagacgttccag

SEQ ID NO: 94359 - DNA, 22 bp, Artificial Sequence
  chemically synthesized
ataacctcagacgttccagaag

SEQ ID NO: 94360 - DNA, 22 bp, Artificial Sequence
  chemically synthesized
agacgttccagaagcgagtgtg

SEQ ID NO: 94361 - DNA, 22 bp, Artificial Sequence
  chemically synthesized
cagaagcgagtgtgtggaactg

SEQ ID NO: 94362 - DNA, 22 bp, Artificial Sequence
  chemically synthesized
ctgaagggtgcttccttttatt

SEQ ID NO: 94363 - DNA, 22 bp, Artificial Sequence
  chemically synthesized
aagggtgcttccttttattctt

SEQ ID NO: 94364 - DNA, 22 bp, Artificial Sequence
  chemically synthesized
ccttttattcttcatccctagc

SEQ ID NO: 94365 - DNA, 22 bp, Artificial Sequence
  chemically synthesized
cttttattcttcatccctagcc

SEQ ID NO: 94366 - DNA, 22 bp, Artificial Sequence
  chemically synthesized
ttattcttcatccctagccagc

SEQ ID NO: 94367 - DNA, 22 bp, Artificial Sequence
  chemically synthesized
tattcttcatccctagccagcc

SEQ ID NO: 94368 - DNA, 22 bp, Artificial Sequence
  chemically synthesized
attcttcatccctagccagccg

SEQ ID NO: 94369 - DNA, 22 bp, Artificial Sequence
  chemically synthesized
ttcttcatccctagccagccgc

SEQ ID NO: 94370 - DNA, 22 bp, Artificial Sequence
  chemically synthesized
ttcatccctagccagccgccgg

SEQ ID NO: 94371 - DNA, 22 bp, Artificial Sequence
  chemically synthesized
catccctagccagccgccggcc

SEQ ID NO: 94372 - DNA, 22 bp, Artificial Sequence
  chemically synthesized
atccctagccagccgccggccc

SEQ ID NO: 94373 - DNA, 22 bp, Artificial Sequence
  chemically synthesized
gccagccgccggcccctggcct

SEQ ID NO: 94374 - DNA, 22 bp, Artificial Sequence
  chemically synthesized
gcctcactggatactctaagac

SEQ ID NO: 94375 - DNA, 22 bp, Artificial Sequence
  chemically synthesized
actggatactctaagactattg

SEQ ID NO: 94376 - DNA, 22 bp, Artificial Sequence
  chemically synthesized
gatactctaagactattggtca

SEQ ID NO: 94377 - DNA, 22 bp, Artificial Sequence
  chemically synthesized
taagactattggtcaagtttgc

SEQ ID NO: 94378 - DNA, 22 bp, Artificial Sequence
  chemically synthesized
agactattggtcaagtttgcct

SEQ ID NO: 94379 - DNA, 22 bp, Artificial Sequence
  chemically synthesized
ttggtcaagtttgccttgtcaa

SEQ ID NO: 94380 - DNA, 22 bp, Artificial Sequence
  chemically synthesized
gtcaagtttgccttgtcaaggc

SEQ ID NO: 94381 - DNA, 22 bp, Artificial Sequence
  chemically synthesized
gccttgtcaaggctattggtca

SEQ ID NO: 94382 - DNA, 22 bp, Artificial Sequence
  chemically synthesized
ccttgtcaaggctattggtcaa

SEQ ID NO: 94383 - DNA, 22 bp, Artificial Sequence
  chemically synthesized
gtcaaggctattggtcaaggca

SEQ ID NO: 94384 - DNA, 22 bp, Artificial Sequence
  chemically synthesized
tcaaggctattggtcaaggcaa

SEQ ID NO: 94385 - DNA, 22 bp, Artificial Sequence
  chemically synthesized
ttggtcaaggcaaggctggcca

SEQ ID NO: 94386 - DNA, 22 bp, Artificial Sequence
  chemically synthesized
gtcaaggcaaggctggccaacc

SEQ ID NO: 94387 - DNA, 22 bp, Artificial Sequence
  chemically synthesized
gccaacccatgggtggagttta

SEQ ID NO: 94388 - DNA, 22 bp, Artificial Sequence
  chemically synthesized
agccagggaccgtttcagacag

SEQ ID NO: 94389 - DNA, 22 bp, Artificial Sequence
  chemically synthesized
gccagggaccgtttcagacaga

SEQ ID NO: 94390 - DNA, 22 bp, Artificial Sequence
  chemically synthesized
cagacagatatttgcattgaga

SEQ ID NO: 94391 - DNA, 22 bp, Artificial Sequence
  chemically synthesized
agacagatatttgcattgagat

SEQ ID NO: 94392 - DNA, 22 bp, Artificial Sequence
  chemically synthesized
gcattgagatagtgtggggaag

SEQ ID NO: 94393 - DNA, 22 bp, Artificial Sequence
  chemically synthesized
cattgagatagtgtggggaagg

SEQ ID NO: 94394 - DNA, 22 bp, Artificial Sequence
  chemically synthesized
agatagtgtggggaaggggccc

SEQ ID NO: 94395 - DNA, 22 bp, Artificial Sequence
  chemically synthesized
ctgcttaattttttttatagcc

SEQ ID NO: 94396 - DNA, 22 bp, Artificial Sequence
  chemically synthesized
cttaattttttttatagccttt

SEQ ID NO: 94397 - DNA, 22 bp, Artificial Sequence
  chemically synthesized
aattttttttatagcctttgcc

SEQ ID NO: 94398 - DNA, 22 bp, Artificial Sequence
  chemically synthesized
attttttttatagcctttgcct

SEQ ID NO: 94399 - DNA, 22 bp, Artificial Sequence
  chemically synthesized
tttttatagcctttgccttgtt

SEQ ID NO: 94400 - DNA, 22 bp, Artificial Sequence
  chemically synthesized
ttttatagcctttgccttgttc

SEQ ID NO: 94401 - DNA, 22 bp, Artificial Sequence
  chemically synthesized
tttatagcctttgccttgttcc

SEQ ID NO: 94402 - DNA, 22 bp, Artificial Sequence
  chemically synthesized
ttatagcctttgccttgttccg

SEQ ID NO: 94403 - DNA, 22 bp, Artificial Sequence
  chemically synthesized
tatagcctttgccttgttccga

SEQ ID NO: 94404 - DNA, 22 bp, Artificial Sequence
  chemically synthesized
atagcctttgccttgttccgat

SEQ ID NO: 94405 - DNA, 22 bp, Artificial Sequence
  chemically synthesized
tagcctttgccttgttccgatt

SEQ ID NO: 94406 - DNA, 22 bp, Artificial Sequence
  chemically synthesized
tgccttgttccgattcagtcat

SEQ ID NO: 94407 - DNA, 22 bp, Artificial Sequence
  chemically synthesized
gccttgttccgattcagtcatt

SEQ ID NO: 94408 - DNA, 22 bp, Artificial Sequence
  chemically synthesized
ccttgttccgattcagtcattc

SEQ ID NO: 94409 - DNA, 22 bp, Artificial Sequence
  chemically synthesized
gttccgattcagtcattccaat

SEQ ID NO: 94410 - DNA, 22 bp, Artificial Sequence
  chemically synthesized
ttccgattcagtcattccaatt

SEQ ID NO: 94411 - DNA, 22 bp, Artificial Sequence
  chemically synthesized
cgattcagtcattccaattttt

SEQ ID NO: 94412 - DNA, 22 bp, Artificial Sequence
  chemically synthesized
agtcattccaatttttctctaa

SEQ ID NO: 94413 - DNA, 22 bp, Artificial Sequence
  chemically synthesized
caatttttctctaatttattct

SEQ ID NO: 94414 - DNA, 22 bp, Artificial Sequence
  chemically synthesized
ttctctaatttattcttccctt

SEQ ID NO: 94415 - DNA, 22 bp, Artificial Sequence
  chemically synthesized
tctctaatttattcttcccttt

SEQ ID NO: 94416 - DNA, 22 bp, Artificial Sequence
  chemically synthesized
ctctaatttattcttcccttta

SEQ ID NO: 94417 - DNA, 22 bp, Artificial Sequence
  chemically synthesized
tctaatttattcttccctttag

SEQ ID NO: 94418 - DNA, 22 bp, Artificial Sequence
  chemically synthesized
taatttattcttccctttagct

SEQ ID NO: 94419 - DNA, 22 bp, Artificial Sequence
  chemically synthesized
atttattcttccctttagctag

SEQ ID NO: 94420 - DNA, 22 bp, Artificial Sequence
  chemically synthesized
attcttccctttagctagtttt

SEQ ID NO: 94421 - DNA, 22 bp, Artificial Sequence
  chemically synthesized
ttcttccctttagctagttttc

SEQ ID NO: 94422 - DNA, 22 bp, Artificial Sequence
  chemically synthesized
ttccctttagctagttttcttc

SEQ ID NO: 94423 - DNA, 22 bp, Artificial Sequence
  chemically synthesized
ccctttagctagttttcttctc

SEQ ID NO: 94424 - DNA, 22 bp, Artificial Sequence
  chemically synthesized
cctttagctagttttcttctcc

SEQ ID NO: 94425 - DNA, 22 bp, Artificial Sequence
  chemically synthesized
tagctagttttcttctcccacc

SEQ ID NO: 94426 - DNA, 22 bp, Artificial Sequence
  chemically synthesized
agctagttttcttctcccacca

SEQ ID NO: 94427 - DNA, 22 bp, Artificial Sequence
  chemically synthesized
gctagttttcttctcccaccat

SEQ ID NO: 94428 - DNA, 22 bp, Artificial Sequence
  chemically synthesized
gttttcttctcccaccatagaa

SEQ ID NO: 94429 - DNA, 22 bp, Artificial Sequence
  chemically synthesized
tcttctcccaccatagaagata

SEQ ID NO: 94430 - DNA, 22 bp, Artificial Sequence
  chemically synthesized
cttctcccaccatagaagatac

SEQ ID NO: 94431 - DNA, 22 bp, Artificial Sequence
  chemically synthesized
ttctcccaccatagaagatacc

SEQ ID NO: 94432 - DNA, 22 bp, Artificial Sequence
  chemically synthesized
ctcccaccatagaagataccag

SEQ ID NO: 94433 - DNA, 22 bp, Artificial Sequence
  chemically synthesized
tcccaccatagaagataccagg

SEQ ID NO: 94434 - DNA, 22 bp, Artificial Sequence
  chemically synthesized
ccaccatagaagataccaggac

SEQ ID NO: 94435 - DNA, 22 bp, Artificial Sequence
  chemically synthesized
cttttgtcagccgtttttcacc

SEQ ID NO: 94436 - DNA, 22 bp, Artificial Sequence
  chemically synthesized
ttttgtcagccgtttttcacct

SEQ ID NO: 94437 - DNA, 22 bp, Artificial Sequence
  chemically synthesized
ttgtcagccgtttttcaccttc

SEQ ID NO: 94438 - DNA, 22 bp, Artificial Sequence
  chemically synthesized
tgtcagccgtttttcaccttct

SEQ ID NO: 94439 - DNA, 22 bp, Artificial Sequence
  chemically synthesized
gtcagccgtttttcaccttctt

SEQ ID NO: 94440 - DNA, 22 bp, Artificial Sequence
  chemically synthesized
tcagccgtttttcaccttcttg

SEQ ID NO: 94441 - DNA, 22 bp, Artificial Sequence
  chemically synthesized
ttcaccttcttgtctgtagctc

SEQ ID NO: 94442 - DNA, 22 bp, Artificial Sequence
  chemically synthesized
tcaccttcttgtctgtagctcc

SEQ ID NO: 94443 - DNA, 22 bp, Artificial Sequence
  chemically synthesized
caccttcttgtctgtagctcca

SEQ ID NO: 94444 - DNA, 22 bp, Artificial Sequence
  chemically synthesized
accttcttgtctgtagctccag

SEQ ID NO: 94445 - DNA, 22 bp, Artificial Sequence
  chemically synthesized
cttgtctgtagctccagtgagg

SEQ ID NO: 94446 - DNA, 22 bp, Artificial Sequence
  chemically synthesized
ttgtctgtagctccagtgaggc

SEQ ID NO: 94447 - DNA, 22 bp, Artificial Sequence
  chemically synthesized
gtctgtagctccagtgaggcct

SEQ ID NO: 94448 - DNA, 22 bp, Artificial Sequence
  chemically synthesized
tctgtagctccagtgaggcctg

SEQ ID NO: 94449 - DNA, 22 bp, Artificial Sequence
  chemically synthesized
tagctccagtgaggcctgtagt

SEQ ID NO: 94450 - DNA, 22 bp, Artificial Sequence
  chemically synthesized
cagtgaggcctgtagtttaaag

SEQ ID NO: 94451 - DNA, 22 bp, Artificial Sequence
  chemically synthesized
tagtttaaagttaaagcatgta

SEQ ID NO: 94452 - DNA, 22 bp, Artificial Sequence
  chemically synthesized
aaagttaaagcatgtaccaatt

SEQ ID NO: 94453 - DNA, 22 bp, Artificial Sequence
  chemically synthesized
aagttaaagcatgtaccaattt

SEQ ID NO: 94454 - DNA, 22 bp, Artificial Sequence
  chemically synthesized
aagcatgtaccaatttttgaaa

SEQ ID NO: 94455 - DNA, 22 bp, Artificial Sequence
  chemically synthesized
ttgaaaagttcagggattgtga

SEQ ID NO: 94456 - DNA, 22 bp, Artificial Sequence
  chemically synthesized
tgaaaagttcagggattgtgaa

SEQ ID NO: 94457 - DNA, 22 bp, Artificial Sequence
  chemically synthesized
gaaaagttcagggattgtgaaa

SEQ ID NO: 94458 - DNA, 22 bp, Artificial Sequence
  chemically synthesized
aaaagttcagggattgtgaaat

SEQ ID NO: 94459 - DNA, 22 bp, Artificial Sequence
  chemically synthesized
agggattgtgaaatgtgtttta

SEQ ID NO: 94460 - DNA, 22 bp, Artificial Sequence
  chemically synthesized
tgaaatgtgttttaggcatagg

SEQ ID NO: 94461 - DNA, 22 bp, Artificial Sequence
  chemically synthesized
taggcataggtccaggattttt

SEQ ID NO: 94462 - DNA, 22 bp, Artificial Sequence
  chemically synthesized
aggcataggtccaggatttttg

SEQ ID NO: 94463 - DNA, 22 bp, Artificial Sequence
  chemically synthesized
ggcataggtccaggatttttga

SEQ ID NO: 94464 - DNA, 22 bp, Artificial Sequence
  chemically synthesized
ttgatgggacacgtcttagtct

SEQ ID NO: 94465 - DNA, 22 bp, Artificial Sequence
  chemically synthesized
tgatgggacacgtcttagtctc

SEQ ID NO: 94466 - DNA, 22 bp, Artificial Sequence
  chemically synthesized
gatgggacacgtcttagtctca

SEQ ID NO: 94467 - DNA, 22 bp, Artificial Sequence
  chemically synthesized
atgggacacgtcttagtctcat

SEQ ID NO: 94468 - DNA, 22 bp, Artificial Sequence
  chemically synthesized
agtctcatttagtaagcattgg

SEQ ID NO: 94469 - DNA, 22 bp, Artificial Sequence
  chemically synthesized
gtctcatttagtaagcattggt

SEQ ID NO: 94470 - DNA, 22 bp, Artificial Sequence
  chemically synthesized
atttagtaagcattggtttcca

SEQ ID NO: 94471 - DNA, 22 bp, Artificial Sequence
  chemically synthesized
agtaagcattggtttccaaata

SEQ ID NO: 94472 - DNA, 22 bp, Artificial Sequence
  chemically synthesized
gtaagcattggtttccaaataa

SEQ ID NO: 94473 - DNA, 22 bp, Artificial Sequence
  chemically synthesized
gtttccaaataagaagtgctat

SEQ ID NO: 94474 - DNA, 22 bp, Artificial Sequence
  chemically synthesized
ccaaataagaagtgctatactt

SEQ ID NO: 94475 - DNA, 22 bp, Artificial Sequence
  chemically synthesized
caaataagaagtgctatactta

SEQ ID NO: 94476 - DNA, 22 bp, Artificial Sequence
  chemically synthesized
tacttatctttgaatatactct

SEQ ID NO: 94477 - DNA, 22 bp, Artificial Sequence
  chemically synthesized
atctttgaatatactctctgtg

SEQ ID NO: 94478 - DNA, 22 bp, Artificial Sequence
  chemically synthesized
tctttgaatatactctctgtgg

SEQ ID NO: 94479 - DNA, 22 bp, Artificial Sequence
  chemically synthesized
tgaatatactctctgtggtttt

SEQ ID NO: 94480 - DNA, 22 bp, Artificial Sequence
  chemically synthesized
gaatatactctctgtggtttta

SEQ ID NO: 94481 - DNA, 22 bp, Artificial Sequence
  chemically synthesized
aatatactctctgtggttttag

SEQ ID NO: 94482 - DNA, 22 bp, Artificial Sequence
  chemically synthesized
tctgtggttttaggccattatc

SEQ ID NO: 94483 - DNA, 22 bp, Artificial Sequence
  chemically synthesized
tgtggttttaggccattatctc

SEQ ID NO: 94484 - DNA, 22 bp, Artificial Sequence
  chemically synthesized
tggttttaggccattatctctt

SEQ ID NO: 94485 - DNA, 22 bp, Artificial Sequence
  chemically synthesized
taggccattatctcttaagttc

SEQ ID NO: 94486 - DNA, 22 bp, Artificial Sequence
  chemically synthesized
aggccattatctcttaagttct

SEQ ID NO: 94487 - DNA, 22 bp, Artificial Sequence
  chemically synthesized
ggccattatctcttaagttctc

SEQ ID NO: 94488 - DNA, 22 bp, Artificial Sequence
  chemically synthesized
tctcttaagttctcattagtgt

SEQ ID NO: 94489 - DNA, 22 bp, Artificial Sequence
  chemically synthesized
ttaagttctcattagtgtagtg

SEQ ID NO: 94490 - DNA, 22 bp, Artificial Sequence
  chemically synthesized
aagttctcattagtgtagtgaa

SEQ ID NO: 94491 - DNA, 22 bp, Artificial Sequence
  chemically synthesized
agttctcattagtgtagtgaaa

SEQ ID NO: 94492 - DNA, 22 bp, Artificial Sequence
  chemically synthesized
tcattagtgtagtgaaaaatcc

SEQ ID NO: 94493 - DNA, 22 bp, Artificial Sequence
  chemically synthesized
attagtgtagtgaaaaatccta

SEQ ID NO: 94494 - DNA, 22 bp, Artificial Sequence
  chemically synthesized
gtgtagtgaaaaatcctataaa

SEQ ID NO: 94495 - DNA, 22 bp, Artificial Sequence
  chemically synthesized
taaagcaacagtttcagtgcag

SEQ ID NO: 94496 - DNA, 22 bp, Artificial Sequence
  chemically synthesized
cagtgcaggaatagattaatgt

SEQ ID NO: 94497 - DNA, 22 bp, Artificial Sequence
  chemically synthesized
agtgcaggaatagattaatgtt

SEQ ID NO: 94498 - DNA, 22 bp, Artificial Sequence
  chemically synthesized
atgttatgtaatataatataag

SEQ ID NO: 94499 - DNA, 22 bp, Artificial Sequence
  chemically synthesized
tgtaatataatataagactgaa

SEQ ID NO: 94500 - DNA, 22 bp, Artificial Sequence
  chemically synthesized
aatccttacttcaatatctact

SEQ ID NO: 94501 - DNA, 22 bp, Artificial Sequence
  chemically synthesized
acttcaatatctacttatccgt

SEQ ID NO: 94502 - DNA, 22 bp, Artificial Sequence
  chemically synthesized
cttcaatatctacttatccgta

SEQ ID NO: 94503 - DNA, 22 bp, Artificial Sequence
  chemically synthesized
caatatctacttatccgtacct

SEQ ID NO: 94504 - DNA, 22 bp, Artificial Sequence
  chemically synthesized
aatatctacttatccgtaccta

SEQ ID NO: 94505 - DNA, 22 bp, Artificial Sequence
  chemically synthesized
cttatccgtacctatttgaaat

SEQ ID NO: 94506 - DNA, 22 bp, Artificial Sequence
  chemically synthesized
atccgtacctatttgaaataaa

SEQ ID NO: 94507 - DNA, 22 bp, Artificial Sequence
  chemically synthesized
tccgtacctatttgaaataaat

SEQ ID NO: 94508 - DNA, 22 bp, Artificial Sequence
  chemically synthesized
tttgaaataaatcacgcctgtt

SEQ ID NO: 94509 - DNA, 22 bp, Artificial Sequence
  chemically synthesized
gaaataaatcacgcctgtttca

SEQ ID NO: 94510 - DNA, 22 bp, Artificial Sequence
  chemically synthesized
aaataaatcacgcctgtttcat

SEQ ID NO: 94511 - DNA, 22 bp, Artificial Sequence
  chemically synthesized
tttcatctcagcaaaagtattt

SEQ ID NO: 94512 - DNA, 22 bp, Artificial Sequence
  chemically synthesized
catctcagcaaaagtatttttt

SEQ ID NO: 94513 - DNA, 22 bp, Artificial Sequence
  chemically synthesized
atctcagcaaaagtattttttt

SEQ ID NO: 94514 - DNA, 22 bp, Artificial Sequence
  chemically synthesized
agcaaaagtattttttttatat

SEQ ID NO: 94515 - DNA, 22 bp, Artificial Sequence
  chemically synthesized
tttttatattcaggtatgtatg

SEQ ID NO: 94516 - DNA, 22 bp, Artificial Sequence
  chemically synthesized
ttttatattcaggtatgtatgt

SEQ ID NO: 94517 - DNA, 22 bp, Artificial Sequence
  chemically synthesized
tttatattcaggtatgtatgta

SEQ ID NO: 94518 - DNA, 22 bp, Artificial Sequence
  chemically synthesized
ttatattcaggtatgtatgtag

SEQ ID NO: 94519 - DNA, 22 bp, Artificial Sequence
  chemically synthesized
tatattcaggtatgtatgtagg

SEQ ID NO: 94520 - DNA, 22 bp, Artificial Sequence
  chemically synthesized
atattcaggtatgtatgtaggc

SEQ ID NO: 94521 - DNA, 22 bp, Artificial Sequence
  chemically synthesized
tattcaggtatgtatgtaggca

SEQ ID NO: 94522 - DNA, 22 bp, Artificial Sequence
  chemically synthesized
aggtatgtatgtaggcacccga

SEQ ID NO: 94523 - DNA, 22 bp, Artificial Sequence
  chemically synthesized
atcactggataagtgtatgtgc

SEQ ID NO: 94524 - DNA, 22 bp, Artificial Sequence
  chemically synthesized
tcactggataagtgtatgtgct

SEQ ID NO: 94525 - DNA, 22 bp, Artificial Sequence
  chemically synthesized
gataagtgtatgtgctggctga

SEQ ID NO: 94526 - DNA, 22 bp, Artificial Sequence
  chemically synthesized
gctgatgacccagggttttggt

SEQ ID NO: 94527 - DNA, 22 bp, Artificial Sequence
  chemically synthesized
atgacccagggttttggtgtag

SEQ ID NO: 94528 - DNA, 22 bp, Artificial Sequence
  chemically synthesized
tggtgtagctcttctatgctcg

SEQ ID NO: 94529 - DNA, 22 bp, Artificial Sequence
  chemically synthesized
ggtgtagctcttctatgctcgg

SEQ ID NO: 94530 - DNA, 22 bp, Artificial Sequence
  chemically synthesized
gtgtagctcttctatgctcggt

SEQ ID NO: 94531 - DNA, 22 bp, Artificial Sequence
  chemically synthesized
ttctatgctcggtaaagatgat

SEQ ID NO: 94532 - DNA, 22 bp, Artificial Sequence
  chemically synthesized
ctatgctcggtaaagatgatgg

SEQ ID NO: 94533 - DNA, 22 bp, Artificial Sequence
  chemically synthesized
tatgctcggtaaagatgatggt

SEQ ID NO: 94534 - DNA, 22 bp, Artificial Sequence
  chemically synthesized
tgctcggtaaagatgatggtag

SEQ ID NO: 94535 - DNA, 22 bp, Artificial Sequence
  chemically synthesized
ggtaaagatgatggtagaatgc

SEQ ID NO: 94536 - DNA, 22 bp, Artificial Sequence
  chemically synthesized
tttaccagatactatggattag

SEQ ID NO: 94537 - DNA, 22 bp, Artificial Sequence
  chemically synthesized
taccagatactatggattagaa

SEQ ID NO: 94538 - DNA, 22 bp, Artificial Sequence
  chemically synthesized
accagatactatggattagaat

SEQ ID NO: 94539 - DNA, 22 bp, Artificial Sequence
  chemically synthesized
ccagatactatggattagaatt

SEQ ID NO: 94540 - DNA, 22 bp, Artificial Sequence
  chemically synthesized
tggattagaattaattatcttg

SEQ ID NO: 94541 - DNA, 22 bp, Artificial Sequence
  chemically synthesized
gaattaattatcttgtataaat

SEQ ID NO: 94542 - DNA, 22 bp, Artificial Sequence
  chemically synthesized
attatcttgtataaatgctagg

SEQ ID NO: 94543 - DNA, 22 bp, Artificial Sequence
  chemically synthesized
tcttgtataaatgctaggttca

SEQ ID NO: 94544 - DNA, 22 bp, Artificial Sequence
  chemically synthesized
gtataaatgctaggttcacttc

SEQ ID NO: 94545 - DNA, 22 bp, Artificial Sequence
  chemically synthesized
tataaatgctaggttcacttct

SEQ ID NO: 94546 - DNA, 22 bp, Artificial Sequence
  chemically synthesized
ggttcacttcttagggaatctt

SEQ ID NO: 94547 - DNA, 22 bp, Artificial Sequence
  chemically synthesized
acttcttagggaatcttattct

SEQ ID NO: 94548 - DNA, 22 bp, Artificial Sequence
  chemically synthesized
cttagggaatcttattctaaga

SEQ ID NO: 94549 - DNA, 22 bp, Artificial Sequence
  chemically synthesized
ttagggaatcttattctaagac

SEQ ID NO: 94550 - DNA, 22 bp, Artificial Sequence
  chemically synthesized
agggaatcttattctaagacat

SEQ ID NO: 94551 - DNA, 22 bp, Artificial Sequence
  chemically synthesized
gggaatcttattctaagacata

SEQ ID NO: 94552 - DNA, 22 bp, Artificial Sequence
  chemically synthesized
attctaagacataagacatgta

SEQ ID NO: 94553 - DNA, 22 bp, Artificial Sequence
  chemically synthesized
ttctaagacataagacatgtat

SEQ ID NO: 94554 - DNA, 22 bp, Artificial Sequence
  chemically synthesized
taagacataagacatgtatttg

SEQ ID NO: 94555 - DNA, 22 bp, Artificial Sequence
  chemically synthesized
agacataagacatgtatttgca

SEQ ID NO: 94556 - DNA, 22 bp, Artificial Sequence
  chemically synthesized
gcatggaaaacaactcttaaga

SEQ ID NO: 94557 - DNA, 22 bp, Artificial Sequence
  chemically synthesized
catggaaaacaactcttaagag

SEQ ID NO: 94558 - DNA, 22 bp, Artificial Sequence
  chemically synthesized
ttaagaggcagggactgtttta

SEQ ID NO: 94559 - DNA, 22 bp, Artificial Sequence
  chemically synthesized
aagaggcagggactgttttatt

SEQ ID NO: 94560 - DNA, 22 bp, Artificial Sequence
  chemically synthesized
agaggcagggactgttttattg

SEQ ID NO: 94561 - DNA, 22 bp, Artificial Sequence
  chemically synthesized
ttttattgactaatagtccaca

SEQ ID NO: 94562 - DNA, 22 bp, Artificial Sequence
  chemically synthesized
tattgactaatagtccacacac

SEQ ID NO: 94563 - DNA, 22 bp, Artificial Sequence
  chemically synthesized
attgactaatagtccacacact

SEQ ID NO: 94564 - DNA, 22 bp, Artificial Sequence
  chemically synthesized
ttgactaatagtccacacactg

SEQ ID NO: 94565 - DNA, 22 bp, Artificial Sequence
  chemically synthesized
actaatagtccacacactgtga

SEQ ID NO: 94566 - DNA, 22 bp, Artificial Sequence
  chemically synthesized
atagtccacacactgtgacagc

SEQ ID NO: 94567 - DNA, 22 bp, Artificial Sequence
  chemically synthesized
tgacagctgggatgtcactgta

SEQ ID NO: 94568 - DNA, 22 bp, Artificial Sequence
  chemically synthesized
ggatgtcactgtagtttagaca

SEQ ID NO: 94569 - DNA, 22 bp, Artificial Sequence
  chemically synthesized
tagtttagacatctttatctgt

SEQ ID NO: 94570 - DNA, 22 bp, Artificial Sequence
  chemically synthesized
agacatctttatctgtaactca

SEQ ID NO: 94571 - DNA, 22 bp, Artificial Sequence
  chemically synthesized
gacatctttatctgtaactcag

SEQ ID NO: 94572 - DNA, 22 bp, Artificial Sequence
  chemically synthesized
tatctgtaactcagtgctgttt

SEQ ID NO: 94573 - DNA, 22 bp, Artificial Sequence
  chemically synthesized
atctgtaactcagtgctgtttc

SEQ ID NO: 94574 - DNA, 22 bp, Artificial Sequence
  chemically synthesized
tctgtaactcagtgctgtttct

SEQ ID NO: 94575 - DNA, 22 bp, Artificial Sequence
  chemically synthesized
taactcagtgctgtttctgaca

SEQ ID NO: 94576 - DNA, 22 bp, Artificial Sequence
  chemically synthesized
agtgctgtttctgacatattgg

SEQ ID NO: 94577 - DNA, 22 bp, Artificial Sequence
  chemically synthesized
tttctgacatattggccactta

SEQ ID NO: 94578 - DNA, 22 bp, Artificial Sequence
  chemically synthesized
ctgacatattggccacttaaca

SEQ ID NO: 94579 - DNA, 22 bp, Artificial Sequence
  chemically synthesized
tgacatattggccacttaacat

SEQ ID NO: 94580 - DNA, 22 bp, Artificial Sequence
  chemically synthesized
acatattggccacttaacatgg

SEQ ID NO: 94581 - DNA, 22 bp, Artificial Sequence
  chemically synthesized
gccacttaacatggcaggaagt

SEQ ID NO: 94582 - DNA, 22 bp, Artificial Sequence
  chemically synthesized
aacatggcaggaagtattcatg

SEQ ID NO: 94583 - DNA, 22 bp, Artificial Sequence
  chemically synthesized
acatggcaggaagtattcatgc

SEQ ID NO: 94584 - DNA, 22 bp, Artificial Sequence
  chemically synthesized
atgctgtttttttctttatttt

SEQ ID NO: 94585 - DNA, 22 bp, Artificial Sequence
  chemically synthesized
tttttttctttattttttcttt

SEQ ID NO: 94586 - DNA, 22 bp, Artificial Sequence
  chemically synthesized
ttttctttattttttctttggg

SEQ ID NO: 94587 - DNA, 22 bp, Artificial Sequence
  chemically synthesized
tttctttattttttctttggga

SEQ ID NO: 94588 - DNA, 22 bp, Artificial Sequence
  chemically synthesized
ttctttattttttctttgggat

SEQ ID NO: 94589 - DNA, 22 bp, Artificial Sequence
  chemically synthesized
tctttattttttctttgggatt

SEQ ID NO: 94590 - DNA, 22 bp, Artificial Sequence
  chemically synthesized
ctttattttttctttgggattt

SEQ ID NO: 94591 - DNA, 22 bp, Artificial Sequence
  chemically synthesized
tttattttttctttgggatttt

SEQ ID NO: 94592 - DNA, 22 bp, Artificial Sequence
  chemically synthesized
tattttttctttgggattttta

SEQ ID NO: 94593 - DNA, 22 bp, Artificial Sequence
  chemically synthesized
attttttctttgggatttttat

SEQ ID NO: 94594 - DNA, 22 bp, Artificial Sequence
  chemically synthesized
ttttttctttgggatttttatt

SEQ ID NO: 94595 - DNA, 22 bp, Artificial Sequence
  chemically synthesized
tttctttgggatttttattttt

SEQ ID NO: 94596 - DNA, 22 bp, Artificial Sequence
  chemically synthesized
ttctttgggatttttatttttt

SEQ ID NO: 94597 - DNA, 22 bp, Artificial Sequence
  chemically synthesized
tctttgggatttttattttttg

SEQ ID NO: 94598 - DNA, 22 bp, Artificial Sequence
  chemically synthesized
ctttgggatttttattttttgg

SEQ ID NO: 94599 - DNA, 22 bp, Artificial Sequence
  chemically synthesized
tttgggatttttattttttggt

SEQ ID NO: 94600 - DNA, 22 bp, Artificial Sequence
  chemically synthesized
tgggatttttattttttggtag

SEQ ID NO: 94601 - DNA, 22 bp, Artificial Sequence
  chemically synthesized
gggatttttattttttggtagg

SEQ ID NO: 94602 - DNA, 22 bp, Artificial Sequence
  chemically synthesized
ggatttttattttttggtaggt

SEQ ID NO: 94603 - DNA, 22 bp, Artificial Sequence
  chemically synthesized
ttattttttggtaggtttggtt

SEQ ID NO: 94604 - DNA, 22 bp, Artificial Sequence
  chemically synthesized
tattttttggtaggtttggttt

SEQ ID NO: 94605 - DNA, 22 bp, Artificial Sequence
  chemically synthesized
attttttggtaggtttggtttt

SEQ ID NO: 94606 - DNA, 22 bp, Artificial Sequence
  chemically synthesized
ttttttggtaggtttggttttg

SEQ ID NO: 94607 - DNA, 22 bp, Artificial Sequence
  chemically synthesized
tttggtaggtttggttttgctt

SEQ ID NO: 94608 - DNA, 22 bp, Artificial Sequence
  chemically synthesized
ttggtaggtttggttttgcttt

SEQ ID NO: 94609 - DNA, 22 bp, Artificial Sequence
  chemically synthesized
tggtaggtttggttttgctttt

SEQ ID NO: 94610 - DNA, 22 bp, Artificial Sequence
  chemically synthesized
ggtaggtttggttttgcttttg

SEQ ID NO: 94611 - DNA, 22 bp, Artificial Sequence
  chemically synthesized
gtaggtttggttttgcttttgt

SEQ ID NO: 94612 - DNA, 22 bp, Artificial Sequence
  chemically synthesized
ggttttgcttttgttttttctc

SEQ ID NO: 94613 - DNA, 22 bp, Artificial Sequence
  chemically synthesized
gttttgcttttgttttttctct

SEQ ID NO: 94614 - DNA, 22 bp, Artificial Sequence
  chemically synthesized
tgcttttgttttttctctgaac

SEQ ID NO: 94615 - DNA, 22 bp, Artificial Sequence
  chemically synthesized
gcttttgttttttctctgaact

SEQ ID NO: 94616 - DNA, 22 bp, Artificial Sequence
  chemically synthesized
cttttgttttttctctgaactc

SEQ ID NO: 94617 - DNA, 22 bp, Artificial Sequence
  chemically synthesized
ttgttttttctctgaactcgat

SEQ ID NO: 94618 - DNA, 22 bp, Artificial Sequence
  chemically synthesized
tgttttttctctgaactcgatc

SEQ ID NO: 94619 - DNA, 22 bp, Artificial Sequence
  chemically synthesized
gttttttctctgaactcgatcc

SEQ ID NO: 94620 - DNA, 22 bp, Artificial Sequence
  chemically synthesized
ttttttctctgaactcgatcca

SEQ ID NO: 94621 - DNA, 22 bp, Artificial Sequence
  chemically synthesized
tttctctgaactcgatccatga

SEQ ID NO: 94622 - DNA, 22 bp, Artificial Sequence
  chemically synthesized
ttctctgaactcgatccatgac

SEQ ID NO: 94623 - DNA, 22 bp, Artificial Sequence
  chemically synthesized
tctctgaactcgatccatgacc

SEQ ID NO: 94624 - DNA, 22 bp, Artificial Sequence
  chemically synthesized
ctctgaactcgatccatgacct

SEQ ID NO: 94625 - DNA, 22 bp, Artificial Sequence
  chemically synthesized
tctgaactcgatccatgacctt

SEQ ID NO: 94626 - DNA, 22 bp, Artificial Sequence
  chemically synthesized
tgaactcgatccatgaccttgg

SEQ ID NO: 94627 - DNA, 22 bp, Artificial Sequence
  chemically synthesized
aactcgatccatgaccttggta

SEQ ID NO: 94628 - DNA, 22 bp, Artificial Sequence
  chemically synthesized
gatccatgaccttggtagatta

SEQ ID NO: 94629 - DNA, 22 bp, Artificial Sequence
  chemically synthesized
ggtagattatgacgtcagaaac

SEQ ID NO: 94630 - DNA, 22 bp, Artificial Sequence
  chemically synthesized
gtagattatgacgtcagaaact

SEQ ID NO: 94631 - DNA, 22 bp, Artificial Sequence
  chemically synthesized
tgacgtcagaaactctggaaat

SEQ ID NO: 94632 - DNA, 22 bp, Artificial Sequence
  chemically synthesized
tggaaatctggcttattggagg

SEQ ID NO: 94633 - DNA, 22 bp, Artificial Sequence
  chemically synthesized
gaaatctggcttattggaggag

SEQ ID NO: 94634 - DNA, 22 bp, Artificial Sequence
  chemically synthesized
gcttattggaggagagctctac

SEQ ID NO: 94635 - DNA, 22 bp, Artificial Sequence
  chemically synthesized
attggaggagagctctaccttc

SEQ ID NO: 94636 - DNA, 22 bp, Artificial Sequence
  chemically synthesized
ttggaggagagctctaccttcc

SEQ ID NO: 94637 - DNA, 22 bp, Artificial Sequence
  chemically synthesized
gaggagagctctaccttcccct

SEQ ID NO: 94638 - DNA, 22 bp, Artificial Sequence
  chemically synthesized
taccttcccctaacctatcagg

SEQ ID NO: 94639 - DNA, 22 bp, Artificial Sequence
  chemically synthesized
ccttcccctaacctatcaggtt

SEQ ID NO: 94640 - DNA, 22 bp, Artificial Sequence
  chemically synthesized
cccctaacctatcaggttgata

SEQ ID NO: 94641 - DNA, 22 bp, Artificial Sequence
  chemically synthesized
ccctaacctatcaggttgatag

SEQ ID NO: 94642 - DNA, 22 bp, Artificial Sequence
  chemically synthesized
acctatcaggttgataggaatt

SEQ ID NO: 94643 - DNA, 22 bp, Artificial Sequence
  chemically synthesized
tcaggttgataggaattataat

SEQ ID NO: 94644 - DNA, 22 bp, Artificial Sequence
  chemically synthesized
ataggaattataataatattgg

SEQ ID NO: 94645 - DNA, 22 bp, Artificial Sequence
  chemically synthesized
taataatattggtggaatcctt

SEQ ID NO: 94646 - DNA, 22 bp, Artificial Sequence
  chemically synthesized
gtggaatcctttcagacttcat

SEQ ID NO: 94647 - DNA, 22 bp, Artificial Sequence
  chemically synthesized
tcagacttcataatcctgtgta

SEQ ID NO: 94648 - DNA, 22 bp, Artificial Sequence
  chemically synthesized
cagacttcataatcctgtgtaa

SEQ ID NO: 94649 - DNA, 22 bp, Artificial Sequence
  chemically synthesized
agacttcataatcctgtgtaag

SEQ ID NO: 94650 - DNA, 22 bp, Artificial Sequence
  chemically synthesized
cataatcctgtgtaaggcttat

SEQ ID NO: 94651 - DNA, 22 bp, Artificial Sequence
  chemically synthesized
ataatcctgtgtaaggcttata

SEQ ID NO: 94652 - DNA, 22 bp, Artificial Sequence
  chemically synthesized
tgtaaggcttatatctgctcaa

SEQ ID NO: 94653 - DNA, 22 bp, Artificial Sequence
  chemically synthesized
atatctgctcaaagtgttaggc

SEQ ID NO: 94654 - DNA, 22 bp, Artificial Sequence
  chemically synthesized
tatctgctcaaagtgttaggcg

SEQ ID NO: 94655 - DNA, 22 bp, Artificial Sequence
  chemically synthesized
ctcaaagtgttaggcggctaaa

SEQ ID NO: 94656 - DNA, 22 bp, Artificial Sequence
  chemically synthesized
aaagtgttaggcggctaaaaga

SEQ ID NO: 94657 - DNA, 22 bp, Artificial Sequence
  chemically synthesized
ggcggctaaaagaccagaaaga

SEQ ID NO: 94658 - DNA, 22 bp, Artificial Sequence
  chemically synthesized
aaagaccagaaagatacatgtt

SEQ ID NO: 94659 - DNA, 22 bp, Artificial Sequence
  chemically synthesized
acctgcgcaacaaagctgcaca

SEQ ID NO: 94660 - DNA, 22 bp, Artificial Sequence
  chemically synthesized
cgcaacaaagctgcacatattg

SEQ ID NO: 94661 - DNA, 22 bp, Artificial Sequence
  chemically synthesized
cacatattgcacttgttctttg

SEQ ID NO: 94662 - DNA, 22 bp, Artificial Sequence
  chemically synthesized
cacttgttctttggaagttaaa

SEQ ID NO: 94663 - DNA, 22 bp, Artificial Sequence
  chemically synthesized
gttctttggaagttaaaataaa

SEQ ID NO: 94664 - DNA, 22 bp, Artificial Sequence
  chemically synthesized
ttctttggaagttaaaataaaa

SEQ ID NO: 94665 - DNA, 22 bp, Artificial Sequence
  chemically synthesized
tttggaagttaaaataaaagtt

SEQ ID NO: 94666 - DNA, 22 bp, Artificial Sequence
  chemically synthesized
tggaagttaaaataaaagttga

SEQ ID NO: 94667 - DNA, 22 bp, Artificial Sequence
  chemically synthesized
ggaagttaaaataaaagttgaa

SEQ ID NO: 94668 - DNA, 22 bp, Artificial Sequence
  chemically synthesized
gaagttaaaataaaagttgaat

SEQ ID NO: 94669 - DNA, 22 bp, Artificial Sequence
  chemically synthesized
aaataaaagttgaataagaaag

SEQ ID NO: 94670 - DNA, 22 bp, Artificial Sequence
  chemically synthesized
aataagaaaggaaagaaaaaga

SEQ ID NO: 94671 - DNA, 22 bp, Artificial Sequence
  chemically synthesized
gtcaacttatcagtatcttcca

SEQ ID NO: 94672 - DNA, 22 bp, Artificial Sequence
  chemically synthesized
tcaacttatcagtatcttccag

SEQ ID NO: 94673 - DNA, 22 bp, Artificial Sequence
  chemically synthesized
atcagtatcttccagttactca

SEQ ID NO: 94674 - DNA, 22 bp, Artificial Sequence
  chemically synthesized
tcagtatcttccagttactcac

SEQ ID NO: 94675 - DNA, 22 bp, Artificial Sequence
  chemically synthesized
ccagttactcacataataataa

SEQ ID NO: 94676 - DNA, 22 bp, Artificial Sequence
  chemically synthesized
cagttactcacataataataag

SEQ ID NO: 94677 - DNA, 22 bp, Artificial Sequence
  chemically synthesized
ctcacataataataagtgactt

SEQ ID NO: 94678 - DNA, 22 bp, Artificial Sequence
  chemically synthesized
acataataataagtgacttctc

SEQ ID NO: 94679 - DNA, 22 bp, Artificial Sequence
  chemically synthesized
ctctcaatctaaggatgggtga

SEQ ID NO: 94680 - DNA, 22 bp, Artificial Sequence
  chemically synthesized
tctcaatctaaggatgggtgag

SEQ ID NO: 94681 - DNA, 22 bp, Artificial Sequence
  chemically synthesized
tcaatctaaggatgggtgagaa

SEQ ID NO: 94682 - DNA, 22 bp, Artificial Sequence
  chemically synthesized
aatctaaggatgggtgagaaag

SEQ ID NO: 94683 - DNA, 22 bp, Artificial Sequence
  chemically synthesized
aggatgggtgagaaagattttt

SEQ ID NO: 94684 - DNA, 22 bp, Artificial Sequence
  chemically synthesized
ttattggtatgctggtacagat

SEQ ID NO: 94685 - DNA, 22 bp, Artificial Sequence
  chemically synthesized
tattggtatgctggtacagatt

SEQ ID NO: 94686 - DNA, 22 bp, Artificial Sequence
  chemically synthesized
attggtatgctggtacagatta

SEQ ID NO: 94687 - DNA, 22 bp, Artificial Sequence
  chemically synthesized
ttggtatgctggtacagattat

SEQ ID NO: 94688 - DNA, 22 bp, Artificial Sequence
  chemically synthesized
gtatgctggtacagattataga

SEQ ID NO: 94689 - DNA, 22 bp, Artificial Sequence
  chemically synthesized
gtacagattatagagactgagg

SEQ ID NO: 94690 - DNA, 22 bp, Artificial Sequence
  chemically synthesized
tagagactgaggtgaacccaaa

SEQ ID NO: 94691 - DNA, 22 bp, Artificial Sequence
  chemically synthesized
aggtgaacccaaattagggtct

SEQ ID NO: 94692 - DNA, 22 bp, Artificial Sequence
  chemically synthesized
gggtctctttaagataggggat

SEQ ID NO: 94693 - DNA, 22 bp, Artificial Sequence
  chemically synthesized
tttaagataggggatctgtgag

SEQ ID NO: 94694 - DNA, 22 bp, Artificial Sequence
  chemically synthesized
taagataggggatctgtgagat

SEQ ID NO: 94695 - DNA, 22 bp, Artificial Sequence
  chemically synthesized
aagataggggatctgtgagatg

SEQ ID NO: 94696 - DNA, 22 bp, Artificial Sequence
  chemically synthesized
agataggggatctgtgagatgg

SEQ ID NO: 94697 - DNA, 22 bp, Artificial Sequence
  chemically synthesized
tgagatgggtgtgtatagatct

SEQ ID NO: 94698 - DNA, 22 bp, Artificial Sequence
  chemically synthesized
tggccatatctgagagtctggt

SEQ ID NO: 94699 - DNA, 22 bp, Artificial Sequence
  chemically synthesized
ggccatatctgagagtctggtt

SEQ ID NO: 94700 - DNA, 22 bp, Artificial Sequence
  chemically synthesized
gccatatctgagagtctggttg

SEQ ID NO: 94701 - DNA, 22 bp, Artificial Sequence
  chemically synthesized
agagtctggttgggttccattt

SEQ ID NO: 94702 - DNA, 22 bp, Artificial Sequence
  chemically synthesized
gttgggttccatttgtagagcc

SEQ ID NO: 94703 - DNA, 22 bp, Artificial Sequence
  chemically synthesized
ggttccatttgtagagcctgac

SEQ ID NO: 94704 - DNA, 22 bp, Artificial Sequence
  chemically synthesized
catttgtagagcctgaccttta

SEQ ID NO: 94705 - DNA, 22 bp, Artificial Sequence
  chemically synthesized
gtagagcctgacctttaagaat

SEQ ID NO: 94706 - DNA, 22 bp, Artificial Sequence
  chemically synthesized
tagagcctgacctttaagaatg

SEQ ID NO: 94707 - DNA, 22 bp, Artificial Sequence
  chemically synthesized
acctttaagaatgtgtcagaga

SEQ ID NO: 94708 - DNA, 22 bp, Artificial Sequence
  chemically synthesized
taagaatgtgtcagagactggt

SEQ ID NO: 94709 - DNA, 22 bp, Artificial Sequence
  chemically synthesized
aagaatgtgtcagagactggtg

SEQ ID NO: 94710 - DNA, 22 bp, Artificial Sequence
  chemically synthesized
agaatgtgtcagagactggtgt

SEQ ID NO: 94711 - DNA, 22 bp, Artificial Sequence
  chemically synthesized
gtgtctaagcccgctaaggcct

SEQ ID NO: 94712 - DNA, 22 bp, Artificial Sequence
  chemically synthesized
agcccgctaaggcctaaacaag

SEQ ID NO: 94713 - DNA, 22 bp, Artificial Sequence
  chemically synthesized
aggcctaaacaagtgaatcttt

SEQ ID NO: 94714 - DNA, 22 bp, Artificial Sequence
  chemically synthesized
aacaagtgaatcttttgaatct

SEQ ID NO: 94715 - DNA, 22 bp, Artificial Sequence
  chemically synthesized
ttgaatctctcttttttttttt

SEQ ID NO: 94716 - DNA, 22 bp, Artificial Sequence
  chemically synthesized
tgaatctctctttttttttttt

SEQ ID NO: 94717 - DNA, 22 bp, Artificial Sequence
  chemically synthesized
gaatctctcttttttttttttg

SEQ ID NO: 94718 - DNA, 22 bp, Artificial Sequence
  chemically synthesized
aatctctcttttttttttttga

SEQ ID NO: 94719 - DNA, 22 bp, Artificial Sequence
  chemically synthesized
tcttttttttttttgagacaga

SEQ ID NO: 94720 - DNA, 22 bp, Artificial Sequence
  chemically synthesized
ttttttttttttgagacagagt

SEQ ID NO: 94721 - DNA, 22 bp, Artificial Sequence
  chemically synthesized
ttttttttttgagacagagtct

SEQ ID NO: 94722 - DNA, 22 bp, Artificial Sequence
  chemically synthesized
tttttttttgagacagagtctt

SEQ ID NO: 94723 - DNA, 22 bp, Artificial Sequence
  chemically synthesized
ttttttttgagacagagtcttg

SEQ ID NO: 94724 - DNA, 22 bp, Artificial Sequence
  chemically synthesized
tttttttgagacagagtcttgt

SEQ ID NO: 94725 - DNA, 22 bp, Artificial Sequence
  chemically synthesized
ttttttgagacagagtcttgtt

SEQ ID NO: 94726 - DNA, 22 bp, Artificial Sequence
  chemically synthesized
tttttgagacagagtcttgttc

SEQ ID NO: 94727 - DNA, 22 bp, Artificial Sequence
  chemically synthesized
ttttgagacagagtcttgttct

SEQ ID NO: 94728 - DNA, 22 bp, Artificial Sequence
  chemically synthesized
tttgagacagagtcttgttctg

SEQ ID NO: 94729 - DNA, 22 bp, Artificial Sequence
  chemically synthesized
ttgagacagagtcttgttctgt

SEQ ID NO: 94730 - DNA, 22 bp, Artificial Sequence
  chemically synthesized
tgagacagagtcttgttctgtc

SEQ ID NO: 94731 - DNA, 22 bp, Artificial Sequence
  chemically synthesized
gagacagagtcttgttctgtca

SEQ ID NO: 94732 - DNA, 22 bp, Artificial Sequence
  chemically synthesized
agacagagtcttgttctgtcac

SEQ ID NO: 94733 - DNA, 22 bp, Artificial Sequence
  chemically synthesized
gttctgtcacccaggctggagt

SEQ ID NO: 94734 - DNA, 22 bp, Artificial Sequence
  chemically synthesized
ttctgtcacccaggctggagtg

SEQ ID NO: 94735 - DNA, 22 bp, Artificial Sequence
  chemically synthesized
tgtcacccaggctggagtgcag

SEQ ID NO: 94736 - DNA, 22 bp, Artificial Sequence
  chemically synthesized
tcacccaggctggagtgcagtg

SEQ ID NO: 94737 - DNA, 22 bp, Artificial Sequence
  chemically synthesized
gagtgcagtggtatgatctcgg

SEQ ID NO: 94738 - DNA, 22 bp, Artificial Sequence
  chemically synthesized
ggctcactgcaactcctgcctt

SEQ ID NO: 94739 - DNA, 22 bp, Artificial Sequence
  chemically synthesized
actgcaactcctgccttccagg

SEQ ID NO: 94740 - DNA, 22 bp, Artificial Sequence
  chemically synthesized
caactcctgccttccaggttca

SEQ ID NO: 94741 - DNA, 22 bp, Artificial Sequence
  chemically synthesized
ctgccttccaggttcaagcaat

SEQ ID NO: 94742 - DNA, 22 bp, Artificial Sequence
  chemically synthesized
ccttccaggttcaagcaattct

SEQ ID NO: 94743 - DNA, 22 bp, Artificial Sequence
  chemically synthesized
ccaggttcaagcaattctcctt

SEQ ID NO: 94744 - DNA, 22 bp, Artificial Sequence
  chemically synthesized
caggttcaagcaattctccttc

SEQ ID NO: 94745 - DNA, 22 bp, Artificial Sequence
  chemically synthesized
aagcaattctccttcctcagcc

SEQ ID NO: 94746 - DNA, 22 bp, Artificial Sequence
  chemically synthesized
tccttcctcagcctcccaagta

SEQ ID NO: 94747 - DNA, 22 bp, Artificial Sequence
  chemically synthesized
cttcctcagcctcccaagtagc

SEQ ID NO: 94748 - DNA, 22 bp, Artificial Sequence
  chemically synthesized
cctcagcctcccaagtagctgg

SEQ ID NO: 94749 - DNA, 22 bp, Artificial Sequence
  chemically synthesized
ctcagcctcccaagtagctggg

SEQ ID NO: 94750 - DNA, 22 bp, Artificial Sequence
  chemically synthesized
agcctcccaagtagctgggatt

SEQ ID NO: 94751 - DNA, 22 bp, Artificial Sequence
  chemically synthesized
ccaagtagctgggattacaggc

SEQ ID NO: 94752 - DNA, 22 bp, Artificial Sequence
  chemically synthesized
ggattacaggcacttgccatca

SEQ ID NO: 94753 - DNA, 22 bp, Artificial Sequence
  chemically synthesized
caggcacttgccatcatgcctg

SEQ ID NO: 94754 - DNA, 22 bp, Artificial Sequence
  chemically synthesized
gccatcatgcctgtctaatttt

SEQ ID NO: 94755 - DNA, 22 bp, Artificial Sequence
  chemically synthesized
ccatcatgcctgtctaattttt

SEQ ID NO: 94756 - DNA, 22 bp, Artificial Sequence
  chemically synthesized
tctaatttttgtatttttgtag

SEQ ID NO: 94757 - DNA, 22 bp, Artificial Sequence
  chemically synthesized
atttttgtatttttgtagagat

SEQ ID NO: 94758 - DNA, 22 bp, Artificial Sequence
  chemically synthesized
ttgtatttttgtagagatggga

SEQ ID NO: 94759 - DNA, 22 bp, Artificial Sequence
  chemically synthesized
tgtatttttgtagagatgggat

SEQ ID NO: 94760 - DNA, 22 bp, Artificial Sequence
  chemically synthesized
gtatttttgtagagatgggatt

SEQ ID NO: 94761 - DNA, 22 bp, Artificial Sequence
  chemically synthesized
tatttttgtagagatgggattt

SEQ ID NO: 94762 - DNA, 22 bp, Artificial Sequence
  chemically synthesized
ttgtagagatgggatttcacca

SEQ ID NO: 94763 - DNA, 22 bp, Artificial Sequence
  chemically synthesized
tgtagagatgggatttcaccat

SEQ ID NO: 94764 - DNA, 22 bp, Artificial Sequence
  chemically synthesized
gtagagatgggatttcaccatg

SEQ ID NO: 94765 - DNA, 22 bp, Artificial Sequence
  chemically synthesized
tagagatgggatttcaccatgt

SEQ ID NO: 94766 - DNA, 22 bp, Artificial Sequence
  chemically synthesized
caccatgttggccaggttggtc

SEQ ID NO: 94767 - DNA, 22 bp, Artificial Sequence
  chemically synthesized
accatgttggccaggttggtct

SEQ ID NO: 94768 - DNA, 22 bp, Artificial Sequence
  chemically synthesized
gccaggttggtcttgaactctt

SEQ ID NO: 94769 - DNA, 22 bp, Artificial Sequence
  chemically synthesized
gtcttgaactcttgacctcagg

SEQ ID NO: 94770 - DNA, 22 bp, Artificial Sequence
  chemically synthesized
gaactcttgacctcaggtgatc

SEQ ID NO: 94771 - DNA, 22 bp, Artificial Sequence
  chemically synthesized
aactcttgacctcaggtgatct

SEQ ID NO: 94772 - DNA, 22 bp, Artificial Sequence
  chemically synthesized
ttgacctcaggtgatctgcctg

SEQ ID NO: 94773 - DNA, 22 bp, Artificial Sequence
  chemically synthesized
gacctcaggtgatctgcctgcc

SEQ ID NO: 94774 - DNA, 22 bp, Artificial Sequence
  chemically synthesized
acctcaggtgatctgcctgcct

SEQ ID NO: 94775 - DNA, 22 bp, Artificial Sequence
  chemically synthesized
aggtgatctgcctgccttggcc

SEQ ID NO: 94776 - DNA, 22 bp, Artificial Sequence
  chemically synthesized
cctgccttggcctcccaaaatt

SEQ ID NO: 94777 - DNA, 22 bp, Artificial Sequence
  chemically synthesized
ccttggcctcccaaaattctgg

SEQ ID NO: 94778 - DNA, 22 bp, Artificial Sequence
  chemically synthesized
ggcctcccaaaattctgggatt

SEQ ID NO: 94779 - DNA, 22 bp, Artificial Sequence
  chemically synthesized
gcctcccaaaattctgggatta

SEQ ID NO: 94780 - DNA, 22 bp, Artificial Sequence
  chemically synthesized
ccaaaattctgggattacaggc

SEQ ID NO: 94781 - DNA, 22 bp, Artificial Sequence
  chemically synthesized
tgggattacaggcgtgagccac

SEQ ID NO: 94782 - DNA, 22 bp, Artificial Sequence
  chemically synthesized
ggattacaggcgtgagccacca

SEQ ID NO: 94783 - DNA, 22 bp, Artificial Sequence
  chemically synthesized
caggcgtgagccaccactccca

SEQ ID NO: 94784 - DNA, 22 bp, Artificial Sequence
  chemically synthesized
ccagcctctaaacaagtgaatc

SEQ ID NO: 94785 - DNA, 22 bp, Artificial Sequence
  chemically synthesized
taaacaagtgaatcttaattgc

SEQ ID NO: 94786 - DNA, 22 bp, Artificial Sequence
  chemically synthesized
aacaagtgaatcttaattgctc

SEQ ID NO: 94787 - DNA, 22 bp, Artificial Sequence
  chemically synthesized
aattgctcctcctcagactaag

SEQ ID NO: 94788 - DNA, 22 bp, Artificial Sequence
  chemically synthesized
attgctcctcctcagactaagg

SEQ ID NO: 94789 - DNA, 22 bp, Artificial Sequence
  chemically synthesized
ctcctcctcagactaaggaata

SEQ ID NO: 94790 - DNA, 22 bp, Artificial Sequence
  chemically synthesized
ctcctcagactaaggaatatct

SEQ ID NO: 94791 - DNA, 22 bp, Artificial Sequence
  chemically synthesized
ctcagactaaggaatatctagg

SEQ ID NO: 94792 - DNA, 22 bp, Artificial Sequence
  chemically synthesized
agactaaggaatatctaggatc

SEQ ID NO: 94793 - DNA, 22 bp, Artificial Sequence
  chemically synthesized
aggaatatctaggatccctcct

SEQ ID NO: 94794 - DNA, 22 bp, Artificial Sequence
  chemically synthesized
ggatccctcctgttttcaaaca

SEQ ID NO: 94795 - DNA, 22 bp, Artificial Sequence
  chemically synthesized
ctgttttcaaacaacttcccca

SEQ ID NO: 94796 - DNA, 22 bp, Artificial Sequence
  chemically synthesized
ttttcaaacaacttccccattt

SEQ ID NO: 94797 - DNA, 22 bp, Artificial Sequence
  chemically synthesized
tcaaacaacttccccatttatc

SEQ ID NO: 94798 - DNA, 22 bp, Artificial Sequence
  chemically synthesized
caaacaacttccccatttatcc

SEQ ID NO: 94799 - DNA, 22 bp, Artificial Sequence
  chemically synthesized
aaacaacttccccatttatcca

SEQ ID NO: 94800 - DNA, 22 bp, Artificial Sequence
  chemically synthesized
ccccatttatccaaaaaccaag

SEQ ID NO: 94801 - DNA, 22 bp, Artificial Sequence
  chemically synthesized
cccatttatccaaaaaccaagg

SEQ ID NO: 94802 - DNA, 22 bp, Artificial Sequence
  chemically synthesized
atccaaaaaccaaggcagtgtt

SEQ ID NO: 94803 - DNA, 22 bp, Artificial Sequence
  chemically synthesized
tccaaaaaccaaggcagtgttc

SEQ ID NO: 94804 - DNA, 22 bp, Artificial Sequence
  chemically synthesized
taaaagtcatgtataaaccctt

SEQ ID NO: 94805 - DNA, 22 bp, Artificial Sequence
  chemically synthesized
aaagtcatgtataaacccttat

SEQ ID NO: 94806 - DNA, 22 bp, Artificial Sequence
  chemically synthesized
atttcctcttatgcttttgagg

SEQ ID NO: 94807 - DNA, 22 bp, Artificial Sequence
  chemically synthesized
tttcctcttatgcttttgaggc

SEQ ID NO: 94808 - DNA, 22 bp, Artificial Sequence
  chemically synthesized
cctcttatgcttttgaggcaat

SEQ ID NO: 94809 - DNA, 22 bp, Artificial Sequence
  chemically synthesized
ctcttatgcttttgaggcaata

SEQ ID NO: 94810 - DNA, 22 bp, Artificial Sequence
  chemically synthesized
ttatgcttttgaggcaatatct

SEQ ID NO: 94811 - DNA, 22 bp, Artificial Sequence
  chemically synthesized
atgcttttgaggcaatatcttt

SEQ ID NO: 94812 - DNA, 22 bp, Artificial Sequence
  chemically synthesized
tgcttttgaggcaatatctttt

SEQ ID NO: 94813 - DNA, 22 bp, Artificial Sequence
  chemically synthesized
ttgaggcaatatcttttaagag

SEQ ID NO: 94814 - DNA, 22 bp, Artificial Sequence
  chemically synthesized
tgaggcaatatcttttaagagt

SEQ ID NO: 94815 - DNA, 22 bp, Artificial Sequence
  chemically synthesized
gaggcaatatcttttaagagtt

SEQ ID NO: 94816 - DNA, 22 bp, Artificial Sequence
  chemically synthesized
aggcaatatcttttaagagttt

SEQ ID NO: 94817 - DNA, 22 bp, Artificial Sequence
  chemically synthesized
ttaagagtttgttgatttctcc

SEQ ID NO: 94818 - DNA, 22 bp, Artificial Sequence
  chemically synthesized
taagagtttgttgatttctcct

SEQ ID NO: 94819 - DNA, 22 bp, Artificial Sequence
  chemically synthesized
aagagtttgttgatttctcctt

SEQ ID NO: 94820 - DNA, 22 bp, Artificial Sequence
  chemically synthesized
agagtttgttgatttctcctta

SEQ ID NO: 94821 - DNA, 22 bp, Artificial Sequence
  chemically synthesized
gttgatttctccttatccataa

SEQ ID NO: 94822 - DNA, 22 bp, Artificial Sequence
  chemically synthesized
ttgatttctccttatccataac

SEQ ID NO: 94823 - DNA, 22 bp, Artificial Sequence
  chemically synthesized
atttctccttatccataactgt

SEQ ID NO: 94824 - DNA, 22 bp, Artificial Sequence
  chemically synthesized
ctccttatccataactgtctta

SEQ ID NO: 94825 - DNA, 22 bp, Artificial Sequence
  chemically synthesized
tccttatccataactgtcttat

SEQ ID NO: 94826 - DNA, 22 bp, Artificial Sequence
  chemically synthesized
cttatccataactgtcttattc

SEQ ID NO: 94827 - DNA, 22 bp, Artificial Sequence
  chemically synthesized
atccataactgtcttattcctc

SEQ ID NO: 94828 - DNA, 22 bp, Artificial Sequence
  chemically synthesized
tccataactgtcttattcctcg

SEQ ID NO: 94829 - DNA, 22 bp, Artificial Sequence
  chemically synthesized
tcttattcctcgatttttccta

SEQ ID NO: 94830 - DNA, 22 bp, Artificial Sequence
  chemically synthesized
attcctcgatttttcctatatc

SEQ ID NO: 94831 - DNA, 22 bp, Artificial Sequence
  chemically synthesized
ttcctcgatttttcctatatca

SEQ ID NO: 94832 - DNA, 22 bp, Artificial Sequence
  chemically synthesized
ctcgatttttcctatatcattg

SEQ ID NO: 94833 - DNA, 22 bp, Artificial Sequence
  chemically synthesized
gatttttcctatatcattgctt

SEQ ID NO: 94834 - DNA, 22 bp, Artificial Sequence
  chemically synthesized
ttcctatatcattgcttctgac

SEQ ID NO: 94835 - DNA, 22 bp, Artificial Sequence
  chemically synthesized
tcctatatcattgcttctgaca

SEQ ID NO: 94836 - DNA, 22 bp, Artificial Sequence
  chemically synthesized
cctatatcattgcttctgacat

SEQ ID NO: 94837 - DNA, 22 bp, Artificial Sequence
  chemically synthesized
ctatatcattgcttctgacatt

SEQ ID NO: 94838 - DNA, 22 bp, Artificial Sequence
  chemically synthesized
tatcattgcttctgacattgat

SEQ ID NO: 94839 - DNA, 22 bp, Artificial Sequence
  chemically synthesized
cttctgacattgattaaatcct

SEQ ID NO: 94840 - DNA, 22 bp, Artificial Sequence
  chemically synthesized
ctgacattgattaaatcctaac

SEQ ID NO: 94841 - DNA, 22 bp, Artificial Sequence
  chemically synthesized
tgacattgattaaatcctaact

SEQ ID NO: 94842 - DNA, 22 bp, Artificial Sequence
  chemically synthesized
acattgattaaatcctaactga

SEQ ID NO: 94843 - DNA, 22 bp, Artificial Sequence
  chemically synthesized
attaaatcctaactgataaaac

SEQ ID NO: 94844 - DNA, 22 bp, Artificial Sequence
  chemically synthesized
aatcctaactgataaaactgtt

SEQ ID NO: 94845 - DNA, 22 bp, Artificial Sequence
  chemically synthesized
actgataaaactgtttctttac

SEQ ID NO: 94846 - DNA, 22 bp, Artificial Sequence
  chemically synthesized
ataaaactgtttctttacacaa

SEQ ID NO: 94847 - DNA, 22 bp, Artificial Sequence
  chemically synthesized
tttctttacacaagcaatttca

SEQ ID NO: 94848 - DNA, 22 bp, Artificial Sequence
  chemically synthesized
ctttacacaagcaatttcaagt

SEQ ID NO: 94849 - DNA, 22 bp, Artificial Sequence
  chemically synthesized
tttacacaagcaatttcaagtg

SEQ ID NO: 94850 - DNA, 22 bp, Artificial Sequence
  chemically synthesized
tacacaagcaatttcaagtgtt

SEQ ID NO: 94851 - DNA, 22 bp, Artificial Sequence
  chemically synthesized
acacaagcaatttcaagtgttt

SEQ ID NO: 94852 - DNA, 22 bp, Artificial Sequence
  chemically synthesized
cacaagcaatttcaagtgtttt

SEQ ID NO: 94853 - DNA, 22 bp, Artificial Sequence
  chemically synthesized
caagtgttttcaagcattcttt

SEQ ID NO: 94854 - DNA, 22 bp, Artificial Sequence
  chemically synthesized
aagtgttttcaagcattctttc

SEQ ID NO: 94855 - DNA, 22 bp, Artificial Sequence
  chemically synthesized
tcaagcattctttcccatgtat

SEQ ID NO: 94856 - DNA, 22 bp, Artificial Sequence
  chemically synthesized
caagcattctttcccatgtatt

SEQ ID NO: 94857 - DNA, 22 bp, Artificial Sequence
  chemically synthesized
aagcattctttcccatgtattt

SEQ ID NO: 94858 - DNA, 22 bp, Artificial Sequence
  chemically synthesized
tttcccatgtattttcaaacat

SEQ ID NO: 94859 - DNA, 22 bp, Artificial Sequence
  chemically synthesized
tcccatgtattttcaaacattt

SEQ ID NO: 94860 - DNA, 22 bp, Artificial Sequence
  chemically synthesized
cccatgtattttcaaacatttg

SEQ ID NO: 94861 - DNA, 22 bp, Artificial Sequence
  chemically synthesized
ccatgtattttcaaacatttgt

SEQ ID NO: 94862 - DNA, 22 bp, Artificial Sequence
  chemically synthesized
tcaaacatttgttcagcaaata

SEQ ID NO: 94863 - DNA, 22 bp, Artificial Sequence
  chemically synthesized
caaacatttgttcagcaaatat

SEQ ID NO: 94864 - DNA, 22 bp, Artificial Sequence
  chemically synthesized
aaacatttgttcagcaaatatc

SEQ ID NO: 94865 - DNA, 22 bp, Artificial Sequence
  chemically synthesized
gttcagcaaatatctgttaaat

SEQ ID NO: 94866 - DNA, 22 bp, Artificial Sequence
  chemically synthesized
ttcagcaaatatctgttaaata

SEQ ID NO: 94867 - DNA, 22 bp, Artificial Sequence
  chemically synthesized
agcaaatatctgttaaataaat

SEQ ID NO: 94868 - DNA, 22 bp, Artificial Sequence
  chemically synthesized
ttaaataaatgtcataattttt

SEQ ID NO: 94869 - DNA, 22 bp, Artificial Sequence
  chemically synthesized
aataaatgtcataatttttaaa

SEQ ID NO: 94870 - DNA, 22 bp, Artificial Sequence
  chemically synthesized
ttaaagtagtgggcatttaagt

SEQ ID NO: 94871 - DNA, 22 bp, Artificial Sequence
  chemically synthesized
taaagtagtgggcatttaagtt

SEQ ID NO: 94872 - DNA, 22 bp, Artificial Sequence
  chemically synthesized
aaagtagtgggcatttaagtta

SEQ ID NO: 94873 - DNA, 22 bp, Artificial Sequence
  chemically synthesized
aagtagtgggcatttaagttaa

SEQ ID NO: 94874 - DNA, 22 bp, Artificial Sequence
  chemically synthesized
aagttaaataagtcagagaata

SEQ ID NO: 94875 - DNA, 22 bp, Artificial Sequence
  chemically synthesized
agttaaataagtcagagaataa

SEQ ID NO: 94876 - DNA, 22 bp, Artificial Sequence
  chemically synthesized
aataagtcagagaataaaactt

SEQ ID NO: 94877 - DNA, 22 bp, Artificial Sequence
  chemically synthesized
tcctctgaagattataatctag

SEQ ID NO: 94878 - DNA, 22 bp, Artificial Sequence
  chemically synthesized
cctctgaagattataatctagg

SEQ ID NO: 94879 - DNA, 22 bp, Artificial Sequence
  chemically synthesized
ctctgaagattataatctaggt

SEQ ID NO: 94880 - DNA, 22 bp, Artificial Sequence
  chemically synthesized
tgaagattataatctaggtaga

SEQ ID NO: 94881 - DNA, 22 bp, Artificial Sequence
  chemically synthesized
aagattataatctaggtagaac

SEQ ID NO: 94882 - DNA, 22 bp, Artificial Sequence
  chemically synthesized
taatctaggtagaacatacata

SEQ ID NO: 94883 - DNA, 22 bp, Artificial Sequence
  chemically synthesized
ggtagaacatacataaaattaa

SEQ ID NO: 94884 - DNA, 22 bp, Artificial Sequence
  chemically synthesized
ataattaagttaaacaacaaaa

SEQ ID NO: 94885 - DNA, 22 bp, Artificial Sequence
  chemically synthesized
agttaaacaacaaaataatttc

SEQ ID NO: 94886 - DNA, 22 bp, Artificial Sequence
  chemically synthesized
aacaacaaaataatttcagata

SEQ ID NO: 94887 - DNA, 22 bp, Artificial Sequence
  chemically synthesized
cagatattattaactaagaatg

SEQ ID NO: 94888 - DNA, 22 bp, Artificial Sequence
  chemically synthesized
agatattattaactaagaatga

SEQ ID NO: 94889 - DNA, 22 bp, Artificial Sequence
  chemically synthesized
ttaactaagaatgaaattaagg

SEQ ID NO: 94890 - DNA, 22 bp, Artificial Sequence
  chemically synthesized
actaagaatgaaattaaggaga

SEQ ID NO: 94891 - DNA, 22 bp, Artificial Sequence
  chemically synthesized
agaatgaaattaaggagaaagt

SEQ ID NO: 94892 - DNA, 22 bp, Artificial Sequence
  chemically synthesized
aggagaaagtattcgaacagag

SEQ ID NO: 94893 - DNA, 22 bp, Artificial Sequence
  chemically synthesized
gaacagaggcaaaatgacagaa

SEQ ID NO: 94894 - DNA, 22 bp, Artificial Sequence
  chemically synthesized
ccatgggaaggcattgccaaat

SEQ ID NO: 94895 - DNA, 22 bp, Artificial Sequence
  chemically synthesized
ccaaataaagtttagaagctga

SEQ ID NO: 94896 - DNA, 22 bp, Artificial Sequence
  chemically synthesized
agaagctgaaatagtaaattca

SEQ ID NO: 94897 - DNA, 22 bp, Artificial Sequence
  chemically synthesized
gaagctgaaatagtaaattcaa

SEQ ID NO: 94898 - DNA, 22 bp, Artificial Sequence
  chemically synthesized
aaatagtaaattcaaagctctg

SEQ ID NO: 94899 - DNA, 22 bp, Artificial Sequence
  chemically synthesized
aaagctctgaagcagaagaaaa

SEQ ID NO: 94900 - DNA, 22 bp, Artificial Sequence
  chemically synthesized
tgaagcagaagaaaacaaactc

SEQ ID NO: 94901 - DNA, 22 bp, Artificial Sequence
  chemically synthesized
aagcagaagaaaacaaactcct

SEQ ID NO: 94902 - DNA, 22 bp, Artificial Sequence
  chemically synthesized
ctgctgtgccagagagttagat

SEQ ID NO: 94903 - DNA, 22 bp, Artificial Sequence
  chemically synthesized
ctgtgccagagagttagataaa

SEQ ID NO: 94904 - DNA, 22 bp, Artificial Sequence
  chemically synthesized
tgccagagagttagataaagaa

SEQ ID NO: 94905 - DNA, 22 bp, Artificial Sequence
  chemically synthesized
gataaagaaccagtgccgttga

SEQ ID NO: 94906 - DNA, 22 bp, Artificial Sequence
  chemically synthesized
atatgtaaagtggagaatagca

SEQ ID NO: 94907 - DNA, 22 bp, Artificial Sequence
  chemically synthesized
tttcagggaagcataaacctaa

SEQ ID NO: 94908 - DNA, 22 bp, Artificial Sequence
  chemically synthesized
cagggaagcataaacctaagga

SEQ ID NO: 94909 - DNA, 22 bp, Artificial Sequence
  chemically synthesized
agggaagcataaacctaaggac

SEQ ID NO: 94910 - DNA, 22 bp, Artificial Sequence
  chemically synthesized
aggacataaacttgtcctcagt

SEQ ID NO: 94911 - DNA, 22 bp, Artificial Sequence
  chemically synthesized
gtcctcagtggtagggagtgag

SEQ ID NO: 94912 - DNA, 22 bp, Artificial Sequence
  chemically synthesized
tcctcagtggtagggagtgaga

SEQ ID NO: 94913 - DNA, 22 bp, Artificial Sequence
  chemically synthesized
agtggtagggagtgagaagcca

SEQ ID NO: 94914 - DNA, 22 bp, Artificial Sequence
  chemically synthesized
tagaattttaactctggtaatg

SEQ ID NO: 94915 - DNA, 22 bp, Artificial Sequence
  chemically synthesized
taactctggtaatgacataatc

SEQ ID NO: 94916 - DNA, 22 bp, Artificial Sequence
  chemically synthesized
aactctggtaatgacataatct

SEQ ID NO: 94917 - DNA, 22 bp, Artificial Sequence
  chemically synthesized
actctggtaatgacataatctc

SEQ ID NO: 94918 - DNA, 22 bp, Artificial Sequence
  chemically synthesized
tggtaatgacataatctctaag

SEQ ID NO: 94919 - DNA, 22 bp, Artificial Sequence
  chemically synthesized
gtaatgacataatctctaagca

SEQ ID NO: 94920 - DNA, 22 bp, Artificial Sequence
  chemically synthesized
taagcaacctgtactattggct

SEQ ID NO: 94921 - DNA, 22 bp, Artificial Sequence
  chemically synthesized
agcaacctgtactattggctgg

SEQ ID NO: 94922 - DNA, 22 bp, Artificial Sequence
  chemically synthesized
tactattggctggattactatt

SEQ ID NO: 94923 - DNA, 22 bp, Artificial Sequence
  chemically synthesized
ttggctggattactattctaag

SEQ ID NO: 94924 - DNA, 22 bp, Artificial Sequence
  chemically synthesized
gctggattactattctaagaat

SEQ ID NO: 94925 - DNA, 22 bp, Artificial Sequence
  chemically synthesized
gattactattctaagaatgacc

SEQ ID NO: 94926 - DNA, 22 bp, Artificial Sequence
  chemically synthesized
ctattctaagaatgacctgttt

SEQ ID NO: 94927 - DNA, 22 bp, Artificial Sequence
  chemically synthesized
ttctaagaatgacctgtttatc

SEQ ID NO: 94928 - DNA, 22 bp, Artificial Sequence
  chemically synthesized
taagaatgacctgtttatcaca

SEQ ID NO: 94929 - DNA, 22 bp, Artificial Sequence
  chemically synthesized
agaatgacctgtttatcacaac

SEQ ID NO: 94930 - DNA, 22 bp, Artificial Sequence
  chemically synthesized
tttatcacaactgttttgctta

SEQ ID NO: 94931 - DNA, 22 bp, Artificial Sequence
  chemically synthesized
atcacaactgttttgcttaaaa

SEQ ID NO: 94932 - DNA, 22 bp, Artificial Sequence
  chemically synthesized
tcacaactgttttgcttaaaaa

SEQ ID NO: 94933 - DNA, 22 bp, Artificial Sequence
  chemically synthesized
ttttgcttaaaaagcccttatt

SEQ ID NO: 94934 - DNA, 22 bp, Artificial Sequence
  chemically synthesized
tgcttaaaaagcccttattgcc

SEQ ID NO: 94935 - DNA, 22 bp, Artificial Sequence
  chemically synthesized
gcttaaaaagcccttattgcct

SEQ ID NO: 94936 - DNA, 22 bp, Artificial Sequence
  chemically synthesized
cttaaaaagcccttattgcctg

SEQ ID NO: 94937 - DNA, 22 bp, Artificial Sequence
  chemically synthesized
aaaaagcccttattgcctgtgg

SEQ ID NO: 94938 - DNA, 22 bp, Artificial Sequence
  chemically synthesized
aaaagcccttattgcctgtgga

SEQ ID NO: 94939 - DNA, 22 bp, Artificial Sequence
  chemically synthesized
attgcctgtggacaattattag

SEQ ID NO: 94940 - DNA, 22 bp, Artificial Sequence
  chemically synthesized
ttgcctgtggacaattattagt

SEQ ID NO: 94941 - DNA, 22 bp, Artificial Sequence
  chemically synthesized
cctgtggacaattattagttat

SEQ ID NO: 94942 - DNA, 22 bp, Artificial Sequence
  chemically synthesized
tggacaattattagttattctt

SEQ ID NO: 94943 - DNA, 22 bp, Artificial Sequence
  chemically synthesized
ttagttattctttcaactatta

SEQ ID NO: 94944 - DNA, 22 bp, Artificial Sequence
  chemically synthesized
gttattctttcaactattaaaa

SEQ ID NO: 94945 - DNA, 22 bp, Artificial Sequence
  chemically synthesized
ttctttcaactattaaaaatct

SEQ ID NO: 94946 - DNA, 22 bp, Artificial Sequence
  chemically synthesized
tttcaactattaaaaatcttgt

SEQ ID NO: 94947 - DNA, 22 bp, Artificial Sequence
  chemically synthesized
tcaactattaaaaatcttgtca

SEQ ID NO: 94948 - DNA, 22 bp, Artificial Sequence
  chemically synthesized
caactattaaaaatcttgtcat

SEQ ID NO: 94949 - DNA, 22 bp, Artificial Sequence
  chemically synthesized
aactattaaaaatcttgtcatg

SEQ ID NO: 94950 - DNA, 22 bp, Artificial Sequence
  chemically synthesized
ttaaaaatcttgtcatgcagat

SEQ ID NO: 94951 - DNA, 22 bp, Artificial Sequence
  chemically synthesized
aaaatcttgtcatgcagatgtg

SEQ ID NO: 94952 - DNA, 22 bp, Artificial Sequence
  chemically synthesized
gtcatgcagatgtgtgtgtgtg

SEQ ID NO: 94953 - DNA, 22 bp, Artificial Sequence
  chemically synthesized
tcatgcagatgtgtgtgtgtgt

SEQ ID NO: 94954 - DNA, 22 bp, Artificial Sequence
  chemically synthesized
attatgaatttgctttcaatta

SEQ ID NO: 94955 - DNA, 22 bp, Artificial Sequence
  chemically synthesized
tgaatttgctttcaattaagtt

SEQ ID NO: 94956 - DNA, 22 bp, Artificial Sequence
  chemically synthesized
gctttcaattaagttatcttga

SEQ ID NO: 94957 - DNA, 22 bp, Artificial Sequence
  chemically synthesized
ctttcaattaagttatcttgaa

SEQ ID NO: 94958 - DNA, 22 bp, Artificial Sequence
  chemically synthesized
tcaattaagttatcttgaattg

SEQ ID NO: 94959 - DNA, 22 bp, Artificial Sequence
  chemically synthesized
caattaagttatcttgaattgg

SEQ ID NO: 94960 - DNA, 22 bp, Artificial Sequence
  chemically synthesized
aattaagttatcttgaattggc

SEQ ID NO: 94961 - DNA, 22 bp, Artificial Sequence
  chemically synthesized
agttatcttgaattggcaatat

SEQ ID NO: 94962 - DNA, 22 bp, Artificial Sequence
  chemically synthesized
tcttgaattggcaatatctaaa

SEQ ID NO: 94963 - DNA, 22 bp, Artificial Sequence
  chemically synthesized
gaattggcaatatctaaatcta

SEQ ID NO: 94964 - DNA, 22 bp, Artificial Sequence
  chemically synthesized
aattggcaatatctaaatctag

SEQ ID NO: 94965 - DNA, 22 bp, Artificial Sequence
  chemically synthesized
gcaatatctaaatctagatata

SEQ ID NO: 94966 - DNA, 22 bp, Artificial Sequence
  chemically synthesized
aatctagatatagctccctaag

SEQ ID NO: 94967 - DNA, 22 bp, Artificial Sequence
  chemically synthesized
gatatagctccctaaggggtaa

SEQ ID NO: 94968 - DNA, 22 bp, Artificial Sequence
  chemically synthesized
cctaaggggtaaagagtgtatc

SEQ ID NO: 94969 - DNA, 22 bp, Artificial Sequence
  chemically synthesized
aggggtaaagagtgtatccact

SEQ ID NO: 94970 - DNA, 22 bp, Artificial Sequence
  chemically synthesized
cccacccctcaacatcacgtcc

SEQ ID NO: 94971 - DNA, 22 bp, Artificial Sequence
  chemically synthesized
aacatcacgtccttgattcctt

SEQ ID NO: 94972 - DNA, 22 bp, Artificial Sequence
  chemically synthesized
gattccttgatatcaaagggca

SEQ ID NO: 94973 - DNA, 22 bp, Artificial Sequence
  chemically synthesized
attccttgatatcaaagggcag

SEQ ID NO: 94974 - DNA, 22 bp, Artificial Sequence
  chemically synthesized
cttgatatcaaagggcagtata

SEQ ID NO: 94975 - DNA, 22 bp, Artificial Sequence
  chemically synthesized
gatatcaaagggcagtatagtt

SEQ ID NO: 94976 - DNA, 22 bp, Artificial Sequence
  chemically synthesized
atatcaaagggcagtatagttt

SEQ ID NO: 94977 - DNA, 22 bp, Artificial Sequence
  chemically synthesized
tgggggagaagaaaaagagaga

SEQ ID NO: 94978 - DNA, 22 bp, Artificial Sequence
  chemically synthesized
gggggagaagaaaaagagagag

SEQ ID NO: 94979 - DNA, 22 bp, Artificial Sequence
  chemically synthesized
ggggagaagaaaaagagagaga

SEQ ID NO: 94980 - DNA, 22 bp, Artificial Sequence
  chemically synthesized
attaaaaatgcatattaccgac

SEQ ID NO: 94981 - DNA, 22 bp, Artificial Sequence
  chemically synthesized
aaaatgcatattaccgacaaat

SEQ ID NO: 94982 - DNA, 22 bp, Artificial Sequence
  chemically synthesized
ccgacaaattagagggtgatgg

SEQ ID NO: 94983 - DNA, 22 bp, Artificial Sequence
  chemically synthesized
gagggtgatggcagatgggagg

SEQ ID NO: 94984 - DNA, 22 bp, Artificial Sequence
  chemically synthesized
cagctcccactcggatgcacag

SEQ ID NO: 94985 - DNA, 22 bp, Artificial Sequence
  chemically synthesized
ccactcggatgcacagagcagc

SEQ ID NO: 94986 - DNA, 22 bp, Artificial Sequence
  chemically synthesized
ggatgcacagagcagcatgtga

SEQ ID NO: 94987 - DNA, 22 bp, Artificial Sequence
  chemically synthesized
ccatcaggaattttttttgcag

SEQ ID NO: 94988 - DNA, 22 bp, Artificial Sequence
  chemically synthesized
tttttgcagaaccacctgcaga

SEQ ID NO: 94989 - DNA, 22 bp, Artificial Sequence
  chemically synthesized
ttttgcagaaccacctgcagaa

SEQ ID NO: 94990 - DNA, 22 bp, Artificial Sequence
  chemically synthesized
tttgcagaaccacctgcagaaa

SEQ ID NO: 94991 - DNA, 22 bp, Artificial Sequence
  chemically synthesized
ttgcagaaccacctgcagaaat

SEQ ID NO: 94992 - DNA, 22 bp, Artificial Sequence
  chemically synthesized
tgcagaaccacctgcagaaata

SEQ ID NO: 94993 - DNA, 22 bp, Artificial Sequence
  chemically synthesized
gcagaaccacctgcagaaataa

SEQ ID NO: 94994 - DNA, 22 bp, Artificial Sequence
  chemically synthesized
cagaaccacctgcagaaataaa

SEQ ID NO: 94995 - DNA, 22 bp, Artificial Sequence
  chemically synthesized
cagaaataaatcaagaaagctg

SEQ ID NO: 94996 - DNA, 22 bp, Artificial Sequence
  chemically synthesized
agagaacgcacacaccctctga

SEQ ID NO: 94997 - DNA, 22 bp, Artificial Sequence
  chemically synthesized
tgaaagaagcagattgctcctg

SEQ ID NO: 94998 - DNA, 22 bp, Artificial Sequence
  chemically synthesized
aaagaagcagattgctcctgca

SEQ ID NO: 94999 - DNA, 22 bp, Artificial Sequence
  chemically synthesized
ctcctgcaggacccgggaaaca

SEQ ID NO: 95000 - DNA, 22 bp, Artificial Sequence
  chemically synthesized
ctgcaggacccgggaaacaccc

SEQ ID NO: 95001 - DNA, 22 bp, Artificial Sequence
  chemically synthesized
caggacccgggaaacaccccaa

SEQ ID NO: 95002 - DNA, 22 bp, Artificial Sequence
  chemically synthesized
tgagtgcccaaactgtggaagt

SEQ ID NO: 95003 - DNA, 22 bp, Artificial Sequence
  chemically synthesized
tggaagtggaaaagggggaccg

SEQ ID NO: 95004 - DNA, 22 bp, Artificial Sequence
  chemically synthesized
cccccaaacacacatcctcact

SEQ ID NO: 95005 - DNA, 22 bp, Artificial Sequence
  chemically synthesized
actggggaacctgaagatctag

SEQ ID NO: 95006 - DNA, 22 bp, Artificial Sequence
  chemically synthesized
gggaacctgaagatctagacca

SEQ ID NO: 95007 - DNA, 22 bp, Artificial Sequence
  chemically synthesized
aagatctagaccacaggagaag

SEQ ID NO: 95008 - DNA, 22 bp, Artificial Sequence
  chemically synthesized
gaccacaggagaagattctgac

SEQ ID NO: 95009 - DNA, 22 bp, Artificial Sequence
  chemically synthesized
tgaccttacctggagctgagtc

SEQ ID NO: 95010 - DNA, 22 bp, Artificial Sequence
  chemically synthesized
accttacctggagctgagtcaa

SEQ ID NO: 95011 - DNA, 22 bp, Artificial Sequence
  chemically synthesized
acctggagctgagtcaatttag

SEQ ID NO: 95012 - DNA, 22 bp, Artificial Sequence
  chemically synthesized
cctggagctgagtcaatttaga

SEQ ID NO: 95013 - DNA, 22 bp, Artificial Sequence
  chemically synthesized
gagctgagtcaatttagagggc

SEQ ID NO: 95014 - DNA, 22 bp, Artificial Sequence
  chemically synthesized
agtcaatttagagggccaagca

SEQ ID NO: 95015 - DNA, 22 bp, Artificial Sequence
  chemically synthesized
agagggccaagcaaaatacagg

SEQ ID NO: 95016 - DNA, 22 bp, Artificial Sequence
  chemically synthesized
gagggccaagcaaaatacaggg

SEQ ID NO: 95017 - DNA, 22 bp, Artificial Sequence
  chemically synthesized
tgggctctctgggtcccctagg

SEQ ID NO: 95018 - DNA, 22 bp, Artificial Sequence
  chemically synthesized
tctgggtcccctaggaagccat

SEQ ID NO: 95019 - DNA, 22 bp, Artificial Sequence
  chemically synthesized
tgggtcccctaggaagccattt

SEQ ID NO: 95020 - DNA, 22 bp, Artificial Sequence
  chemically synthesized
ggtcccctaggaagccatttct

SEQ ID NO: 95021 - DNA, 22 bp, Artificial Sequence
  chemically synthesized
ggaagccatttctgccttgcct

SEQ ID NO: 95022 - DNA, 22 bp, Artificial Sequence
  chemically synthesized
ctgccttgcctcacaggggtca

SEQ ID NO: 95023 - DNA, 22 bp, Artificial Sequence
  chemically synthesized
tgccttgcctcacaggggtcat

SEQ ID NO: 95024 - DNA, 22 bp, Artificial Sequence
  chemically synthesized
ccttgcctcacaggggtcattt

SEQ ID NO: 95025 - DNA, 22 bp, Artificial Sequence
  chemically synthesized
gcctcacaggggtcatttggga

SEQ ID NO: 95026 - DNA, 22 bp, Artificial Sequence
  chemically synthesized
cctcacaggggtcatttgggag

SEQ ID NO: 95027 - DNA, 22 bp, Artificial Sequence
  chemically synthesized
acaggggtcatttgggagggct

SEQ ID NO: 95028 - DNA, 22 bp, Artificial Sequence
  chemically synthesized
gggagggctgccagaggaactg

SEQ ID NO: 95029 - DNA, 22 bp, Artificial Sequence
  chemically synthesized
ggagggctgccagaggaactgg

SEQ ID NO: 95030 - DNA, 22 bp, Artificial Sequence
  chemically synthesized
ccagaggaactgggaaaagatg

SEQ ID NO: 95031 - DNA, 22 bp, Artificial Sequence
  chemically synthesized
ggaaaagatgacaggaaaaaga

SEQ ID NO: 95032 - DNA, 22 bp, Artificial Sequence
  chemically synthesized
cacctggccagatctaggggct

SEQ ID NO: 95033 - DNA, 22 bp, Artificial Sequence
  chemically synthesized
gccagatctaggggctgggcag

SEQ ID NO: 95034 - DNA, 22 bp, Artificial Sequence
  chemically synthesized
ggggctgggcagtgggggggtt

SEQ ID NO: 95035 - DNA, 22 bp, Artificial Sequence
  chemically synthesized
ggcagtgggggggttggtgggg

SEQ ID NO: 95036 - DNA, 22 bp, Artificial Sequence
  chemically synthesized
gtggggggacatgaatttggtg

SEQ ID NO: 95037 - DNA, 22 bp, Artificial Sequence
  chemically synthesized
ggtgtgcagactccactggcag

SEQ ID NO: 95038 - DNA, 22 bp, Artificial Sequence
  chemically synthesized
gtgtgcagactccactggcagg

SEQ ID NO: 95039 - DNA, 22 bp, Artificial Sequence
  chemically synthesized
cactggcagggaagtaggacag

SEQ ID NO: 95040 - DNA, 22 bp, Artificial Sequence
  chemically synthesized
gcagggaagtaggacagcccta

SEQ ID NO: 95041 - DNA, 22 bp, Artificial Sequence
  chemically synthesized
cttggtttcgcagctggtagcc

SEQ ID NO: 95042 - DNA, 22 bp, Artificial Sequence
  chemically synthesized
ggtttcgcagctggtagcctgg

SEQ ID NO: 95043 - DNA, 22 bp, Artificial Sequence
  chemically synthesized
gtttcgcagctggtagcctggg

SEQ ID NO: 95044 - DNA, 22 bp, Artificial Sequence
  chemically synthesized
cgcagctggtagcctggggcaa

SEQ ID NO: 95045 - DNA, 22 bp, Artificial Sequence
  chemically synthesized
gcagctggtagcctggggcaag

SEQ ID NO: 95046 - DNA, 22 bp, Artificial Sequence
  chemically synthesized
gtagcctggggcaagttctcag

SEQ ID NO: 95047 - DNA, 22 bp, Artificial Sequence
  chemically synthesized
gggcaagttctcagccttgctc

SEQ ID NO: 95048 - DNA, 22 bp, Artificial Sequence
  chemically synthesized
tcagccttgctcactgactgca

SEQ ID NO: 95049 - DNA, 22 bp, Artificial Sequence
  chemically synthesized
agccttgctcactgactgcatg

SEQ ID NO: 95050 - DNA, 22 bp, Artificial Sequence
  chemically synthesized
gctcactgactgcatggaaaca

SEQ ID NO: 95051 - DNA, 22 bp, Artificial Sequence
  chemically synthesized
ctcactgactgcatggaaacag

SEQ ID NO: 95052 - DNA, 22 bp, Artificial Sequence
  chemically synthesized
actgactgcatggaaacagatt

SEQ ID NO: 95053 - DNA, 22 bp, Artificial Sequence
  chemically synthesized
actgcatggaaacagattcggt

SEQ ID NO: 95054 - DNA, 22 bp, Artificial Sequence
  chemically synthesized
catggaaacagattcggtgctg

SEQ ID NO: 95055 - DNA, 22 bp, Artificial Sequence
  chemically synthesized
ggtgctgttgcgggggagggtg

SEQ ID NO: 95056 - DNA, 22 bp, Artificial Sequence
  chemically synthesized
ttgcgggggagggtgcacgctg

SEQ ID NO: 95057 - DNA, 22 bp, Artificial Sequence
  chemically synthesized
cgggggagggtgcacgctggaa

SEQ ID NO: 95058 - DNA, 22 bp, Artificial Sequence
  chemically synthesized
gaagtgagaccaaccttttgag

SEQ ID NO: 95059 - DNA, 22 bp, Artificial Sequence
  chemically synthesized
ttgagttgcatgggagctgggc

SEQ ID NO: 95060 - DNA, 22 bp, Artificial Sequence
  chemically synthesized
tgagttgcatgggagctgggca

SEQ ID NO: 95061 - DNA, 22 bp, Artificial Sequence
  chemically synthesized
gagttgcatgggagctgggcaa

SEQ ID NO: 95062 - DNA, 22 bp, Artificial Sequence
  chemically synthesized
agttgcatgggagctgggcaag

SEQ ID NO: 95063 - DNA, 22 bp, Artificial Sequence
  chemically synthesized
catgggagctgggcaagtcacg

SEQ ID NO: 95064 - DNA, 22 bp, Artificial Sequence
  chemically synthesized
ggcaagtcacgtgactgcttgc

SEQ ID NO: 95065 - DNA, 22 bp, Artificial Sequence
  chemically synthesized
cttgctttcccccactttcctg

SEQ ID NO: 95066 - DNA, 22 bp, Artificial Sequence
  chemically synthesized
gctttcccccactttcctgatg

SEQ ID NO: 95067 - DNA, 22 bp, Artificial Sequence
  chemically synthesized
ctttcccccactttcctgatga

SEQ ID NO: 95068 - DNA, 22 bp, Artificial Sequence
  chemically synthesized
tcccccactttcctgatgacct

SEQ ID NO: 95069 - DNA, 22 bp, Artificial Sequence
  chemically synthesized
cccccactttcctgatgacctg

SEQ ID NO: 95070 - DNA, 22 bp, Artificial Sequence
  chemically synthesized
ccccactttcctgatgacctgc

SEQ ID NO: 95071 - DNA, 22 bp, Artificial Sequence
  chemically synthesized
tcctgatgacctgcatgacaca

SEQ ID NO: 95072 - DNA, 22 bp, Artificial Sequence
  chemically synthesized
cctgatgacctgcatgacacag

SEQ ID NO: 95073 - DNA, 22 bp, Artificial Sequence
  chemically synthesized
ctgatgacctgcatgacacagc

SEQ ID NO: 95074 - DNA, 22 bp, Artificial Sequence
  chemically synthesized
atgacctgcatgacacagcaga

SEQ ID NO: 95075 - DNA, 22 bp, Artificial Sequence
  chemically synthesized
catgacacagcagaggcagcca

SEQ ID NO: 95076 - DNA, 22 bp, Artificial Sequence
  chemically synthesized
tcctaggaacataaatccattg

SEQ ID NO: 95077 - DNA, 22 bp, Artificial Sequence
  chemically synthesized
ggaacataaatccattgacctg

SEQ ID NO: 95078 - DNA, 22 bp, Artificial Sequence
  chemically synthesized
acctggaaactacacccccatc

SEQ ID NO: 95079 - DNA, 22 bp, Artificial Sequence
  chemically synthesized
gaaactacacccccatcctccc

SEQ ID NO: 95080 - DNA, 22 bp, Artificial Sequence
  chemically synthesized
cacccccatcctcccacagtag

SEQ ID NO: 95081 - DNA, 22 bp, Artificial Sequence
  chemically synthesized
ccacagtagccacagaaagacc

SEQ ID NO: 95082 - DNA, 22 bp, Artificial Sequence
  chemically synthesized
cccaaggagactctgagctcag

SEQ ID NO: 95083 - DNA, 22 bp, Artificial Sequence
  chemically synthesized
tgagctcagacacgactagtcc

SEQ ID NO: 95084 - DNA, 22 bp, Artificial Sequence
  chemically synthesized
agctcagacacgactagtcctg

SEQ ID NO: 95085 - DNA, 22 bp, Artificial Sequence
  chemically synthesized
agacacgactagtcctgccccc

SEQ ID NO: 95086 - DNA, 22 bp, Artificial Sequence
  chemically synthesized
gtcctgcccccacctgatggtc

SEQ ID NO: 95087 - DNA, 22 bp, Artificial Sequence
  chemically synthesized
cccccacctgatggtccttcct

SEQ ID NO: 95088 - DNA, 22 bp, Artificial Sequence
  chemically synthesized
atggtccttccttactcaccct

SEQ ID NO: 95089 - DNA, 22 bp, Artificial Sequence
  chemically synthesized
ccttactcaccctggtagctga

SEQ ID NO: 95090 - DNA, 22 bp, Artificial Sequence
  chemically synthesized
cttactcaccctggtagctgaa

SEQ ID NO: 95091 - DNA, 22 bp, Artificial Sequence
  chemically synthesized
actcaccctggtagctgaagac

SEQ ID NO: 95092 - DNA, 22 bp, Artificial Sequence
  chemically synthesized
ctcaccctggtagctgaagaca

SEQ ID NO: 95093 - DNA, 22 bp, Artificial Sequence
  chemically synthesized
accctggtagctgaagacaaag

SEQ ID NO: 95094 - DNA, 22 bp, Artificial Sequence
  chemically synthesized
gtagctgaagacaaagggcata

SEQ ID NO: 95095 - DNA, 22 bp, Artificial Sequence
  chemically synthesized
aagacaaagggcatatattctt

SEQ ID NO: 95096 - DNA, 22 bp, Artificial Sequence
  chemically synthesized
ttgggagttctagggtgcccca

SEQ ID NO: 95097 - DNA, 22 bp, Artificial Sequence
  chemically synthesized
gggagttctagggtgccccagc

SEQ ID NO: 95098 - DNA, 22 bp, Artificial Sequence
  chemically synthesized
ggagttctagggtgccccagcc

SEQ ID NO: 95099 - DNA, 22 bp, Artificial Sequence
  chemically synthesized
tagggtgccccagcccccccag

SEQ ID NO: 95100 - DNA, 22 bp, Artificial Sequence
  chemically synthesized
gggtgccccagcccccccagcc

SEQ ID NO: 95101 - DNA, 22 bp, Artificial Sequence
  chemically synthesized
actgcctctgctgatgctttct

SEQ ID NO: 95102 - DNA, 22 bp, Artificial Sequence
  chemically synthesized
cctctgctgatgctttctagaa

SEQ ID NO: 95103 - DNA, 22 bp, Artificial Sequence
  chemically synthesized
tgctgatgctttctagaaagtg

SEQ ID NO: 95104 - DNA, 22 bp, Artificial Sequence
  chemically synthesized
ctgatgctttctagaaagtgcc

SEQ ID NO: 95105 - DNA, 22 bp, Artificial Sequence
  chemically synthesized
atgctttctagaaagtgccacc

SEQ ID NO: 95106 - DNA, 22 bp, Artificial Sequence
  chemically synthesized
tctagaaagtgccacctcctgg

SEQ ID NO: 95107 - DNA, 22 bp, Artificial Sequence
  chemically synthesized
ctagaaagtgccacctcctggc

SEQ ID NO: 95108 - DNA, 22 bp, Artificial Sequence
  chemically synthesized
tagaaagtgccacctcctggca

SEQ ID NO: 95109 - DNA, 22 bp, Artificial Sequence
  chemically synthesized
gaaagtgccacctcctggcagg

SEQ ID NO: 95110 - DNA, 22 bp, Artificial Sequence
  chemically synthesized
ctggcaggaggccaaccagcac

SEQ ID NO: 95111 - DNA, 22 bp, Artificial Sequence
  chemically synthesized
gcaggaggccaaccagcacaaa

SEQ ID NO: 95112 - DNA, 22 bp, Artificial Sequence
  chemically synthesized
aacaaccaaaagtaaggaccct

SEQ ID NO: 95113 - DNA, 22 bp, Artificial Sequence
  chemically synthesized
acagagtccatttcatcctctg

SEQ ID NO: 95114 - DNA, 22 bp, Artificial Sequence
  chemically synthesized
catcctctgccacctccattgg

SEQ ID NO: 95115 - DNA, 22 bp, Artificial Sequence
  chemically synthesized
atcctctgccacctccattgga

SEQ ID NO: 95116 - DNA, 22 bp, Artificial Sequence
  chemically synthesized
tgccacctccattggagcaggt

SEQ ID NO: 95117 - DNA, 22 bp, Artificial Sequence
  chemically synthesized
ccacctccattggagcaggtgg

SEQ ID NO: 95118 - DNA, 22 bp, Artificial Sequence
  chemically synthesized
cattggagcaggtggttgtatc

SEQ ID NO: 95119 - DNA, 22 bp, Artificial Sequence
  chemically synthesized
gagcaggtggttgtatctatgg

SEQ ID NO: 95120 - DNA, 22 bp, Artificial Sequence
  chemically synthesized
tatctatggctgagagacccac

SEQ ID NO: 95121 - DNA, 22 bp, Artificial Sequence
  chemically synthesized
tggctgagagacccacagatgg

SEQ ID NO: 95122 - DNA, 22 bp, Artificial Sequence
  chemically synthesized
agagacccacagatggttcacg

SEQ ID NO: 95123 - DNA, 22 bp, Artificial Sequence
  chemically synthesized
acgtcacaagactctgtgcaga

SEQ ID NO: 95124 - DNA, 22 bp, Artificial Sequence
  chemically synthesized
tgtgcagacaaaccccagtacc

SEQ ID NO: 95125 - DNA, 22 bp, Artificial Sequence
  chemically synthesized
tgcagacaaaccccagtaccag

SEQ ID NO: 95126 - DNA, 22 bp, Artificial Sequence
  chemically synthesized
gagtctggtagacctgatgggt

SEQ ID NO: 95127 - DNA, 22 bp, Artificial Sequence
  chemically synthesized
gtagacctgatgggtggctaga

SEQ ID NO: 95128 - DNA, 22 bp, Artificial Sequence
  chemically synthesized
atgggtggctagatccagaaga

SEQ ID NO: 95129 - DNA, 22 bp, Artificial Sequence
  chemically synthesized
gatccagaagagagataacaat

SEQ ID NO: 95130 - DNA, 22 bp, Artificial Sequence
  chemically synthesized
cagttcggctctcaggaagccc

SEQ ID NO: 95131 - DNA, 22 bp, Artificial Sequence
  chemically synthesized
ggctctcaggaagccccacgcc

SEQ ID NO: 95132 - DNA, 22 bp, Artificial Sequence
  chemically synthesized
tcaggaagccccacgcctagga

SEQ ID NO: 95133 - DNA, 22 bp, Artificial Sequence
  chemically synthesized
aggaagccccacgcctaggaaa

SEQ ID NO: 95134 - DNA, 22 bp, Artificial Sequence
  chemically synthesized
ggaaaagggggactgtgctaca

SEQ ID NO: 95135 - DNA, 22 bp, Artificial Sequence
  chemically synthesized
tgctacatcaagggaacacctc

SEQ ID NO: 95136 - DNA, 22 bp, Artificial Sequence
  chemically synthesized
catcaagggaacacctcatggg

SEQ ID NO: 95137 - DNA, 22 bp, Artificial Sequence
  chemically synthesized
atgggacaaaagtctcagcctt

SEQ ID NO: 95138 - DNA, 22 bp, Artificial Sequence
  chemically synthesized
agccttgaggcctagactttcc

SEQ ID NO: 95139 - DNA, 22 bp, Artificial Sequence
  chemically synthesized
gaggcctagactttccctctga

SEQ ID NO: 95140 - DNA, 22 bp, Artificial Sequence
  chemically synthesized
aggcctagactttccctctgac

SEQ ID NO: 95141 - DNA, 22 bp, Artificial Sequence
  chemically synthesized
gactttccctctgacagagcct

SEQ ID NO: 95142 - DNA, 22 bp, Artificial Sequence
  chemically synthesized
tccctctgacagagcctaccca

SEQ ID NO: 95143 - DNA, 22 bp, Artificial Sequence
  chemically synthesized
ccctctgacagagcctacccaa

SEQ ID NO: 95144 - DNA, 22 bp, Artificial Sequence
  chemically synthesized
cctctgacagagcctacccaag

SEQ ID NO: 95145 - DNA, 22 bp, Artificial Sequence
  chemically synthesized
tgacagagcctacccaagtgag

SEQ ID NO: 95146 - DNA, 22 bp, Artificial Sequence
  chemically synthesized
acagagcctacccaagtgagaa

SEQ ID NO: 95147 - DNA, 22 bp, Artificial Sequence
  chemically synthesized
cccaagtgagaaggaaccagaa

SEQ ID NO: 95148 - DNA, 22 bp, Artificial Sequence
  chemically synthesized
actctggtaatatgaaaaacaa

SEQ ID NO: 95149 - DNA, 22 bp, Artificial Sequence
  chemically synthesized
tggtaatatgaaaaacaaggtt

SEQ ID NO: 95150 - DNA, 22 bp, Artificial Sequence
  chemically synthesized
gtaatatgaaaaacaaggttct

SEQ ID NO: 95151 - DNA, 22 bp, Artificial Sequence
  chemically synthesized
tttaacaccccccaaaaaatca

SEQ ID NO: 95152 - DNA, 22 bp, Artificial Sequence
  chemically synthesized
taacaccccccaaaaaatcata

SEQ ID NO: 95153 - DNA, 22 bp, Artificial Sequence
  chemically synthesized
aacaccccccaaaaaatcatac

SEQ ID NO: 95154 - DNA, 22 bp, Artificial Sequence
  chemically synthesized
acaccccccaaaaaatcatact

SEQ ID NO: 95155 - DNA, 22 bp, Artificial Sequence
  chemically synthesized
gctcaccagcaatgcatccaaa

SEQ ID NO: 95156 - DNA, 22 bp, Artificial Sequence
  chemically synthesized
accagcaatgcatccaaaccaa

SEQ ID NO: 95157 - DNA, 22 bp, Artificial Sequence
  chemically synthesized
atttacctgaaaaataattcag

SEQ ID NO: 95158 - DNA, 22 bp, Artificial Sequence
  chemically synthesized
acctgaaaaataattcagaagg

SEQ ID NO: 95159 - DNA, 22 bp, Artificial Sequence
  chemically synthesized
cctgaaaaataattcagaaggt

SEQ ID NO: 95160 - DNA, 22 bp, Artificial Sequence
  chemically synthesized
aaaaataattcagaaggtcagt

SEQ ID NO: 95161 - DNA, 22 bp, Artificial Sequence
  chemically synthesized
agaaggtcagttattaagctaa

SEQ ID NO: 95162 - DNA, 22 bp, Artificial Sequence
  chemically synthesized
ttaagctaatcaaggaggcatc

SEQ ID NO: 95163 - DNA, 22 bp, Artificial Sequence
  chemically synthesized
agctaatcaaggaggcatccga

SEQ ID NO: 95164 - DNA, 22 bp, Artificial Sequence
  chemically synthesized
atcaaggaggcatccgaggaag

SEQ ID NO: 95165 - DNA, 22 bp, Artificial Sequence
  chemically synthesized
taaaaaaaccaaaaatatgata

SEQ ID NO: 95166 - DNA, 22 bp, Artificial Sequence
  chemically synthesized
aaaaaaaccaaaaatatgatac

SEQ ID NO: 95167 - DNA, 22 bp, Artificial Sequence
  chemically synthesized
aaaaaaccaaaaatatgataca

SEQ ID NO: 95168 - DNA, 22 bp, Artificial Sequence
  chemically synthesized
cagttaaagagatagcataaat

SEQ ID NO: 95169 - DNA, 22 bp, Artificial Sequence
  chemically synthesized
agttaaagagatagcataaata

SEQ ID NO: 95170 - DNA, 22 bp, Artificial Sequence
  chemically synthesized
aagagatagcataaataaaaaa

SEQ ID NO: 95171 - DNA, 22 bp, Artificial Sequence
  chemically synthesized
aaaacttcaggaaacaatggat

SEQ ID NO: 95172 - DNA, 22 bp, Artificial Sequence
  chemically synthesized
caggaaacaatggatgaatgga

SEQ ID NO: 95173 - DNA, 22 bp, Artificial Sequence
  chemically synthesized
aggaaacaatggatgaatggat

SEQ ID NO: 95174 - DNA, 22 bp, Artificial Sequence
  chemically synthesized
atagaaatgcaaaatgctctag

SEQ ID NO: 95175 - DNA, 22 bp, Artificial Sequence
  chemically synthesized
tagaaatgcaaaatgctctaga

SEQ ID NO: 95176 - DNA, 22 bp, Artificial Sequence
  chemically synthesized
tagaaagtctcagcaatagaat

SEQ ID NO: 95177 - DNA, 22 bp, Artificial Sequence
  chemically synthesized
gaaagtctcagcaatagaatcc

SEQ ID NO: 95178 - DNA, 22 bp, Artificial Sequence
  chemically synthesized
agcaatagaatccaagcagaag

SEQ ID NO: 95179 - DNA, 22 bp, Artificial Sequence
  chemically synthesized
agagcttgaagacaaagttttt

SEQ ID NO: 95180 - DNA, 22 bp, Artificial Sequence
  chemically synthesized
gaagacaaagtttttgaattaa

SEQ ID NO: 95181 - DNA, 22 bp, Artificial Sequence
  chemically synthesized
aagacaaagtttttgaattaac

SEQ ID NO: 95182 - DNA, 22 bp, Artificial Sequence
  chemically synthesized
ttgaattaacccaatccaacaa

SEQ ID NO: 95183 - DNA, 22 bp, Artificial Sequence
  chemically synthesized
tgaattaacccaatccaacaaa

SEQ ID NO: 95184 - DNA, 22 bp, Artificial Sequence
  chemically synthesized
gaattaacccaatccaacaaag

SEQ ID NO: 95185 - DNA, 22 bp, Artificial Sequence
  chemically synthesized
aattaacccaatccaacaaaga

SEQ ID NO: 95186 - DNA, 22 bp, Artificial Sequence
  chemically synthesized
acccaatccaacaaagacaaag

SEQ ID NO: 95187 - DNA, 22 bp, Artificial Sequence
  chemically synthesized
caagaaatctgggattatgtta

SEQ ID NO: 95188 - DNA, 22 bp, Artificial Sequence
  chemically synthesized
ggattatgttaaacaatcaaac

SEQ ID NO: 95189 - DNA, 22 bp, Artificial Sequence
  chemically synthesized
tgttaaacaatcaaacctaaga

SEQ ID NO: 95190 - DNA, 22 bp, Artificial Sequence
  chemically synthesized
aacaatcaaacctaagaataat

SEQ ID NO: 95191 - DNA, 22 bp, Artificial Sequence
  chemically synthesized
agaataatcagcattcctgaga

SEQ ID NO: 95192 - DNA, 22 bp, Artificial Sequence
  chemically synthesized
ctgagaaagaagagaaatctaa

SEQ ID NO: 95193 - DNA, 22 bp, Artificial Sequence
  chemically synthesized
agaaagaagagaaatctaaaag

SEQ ID NO: 95194 - DNA, 22 bp, Artificial Sequence
  chemically synthesized
aaagtttggaaaacttatccag

SEQ ID NO: 95195 - DNA, 22 bp, Artificial Sequence
  chemically synthesized
ggaaaacttatccagggaaata

SEQ ID NO: 95196 - DNA, 22 bp, Artificial Sequence
  chemically synthesized
gaaaacttatccagggaaataa

SEQ ID NO: 95197 - DNA, 22 bp, Artificial Sequence
  chemically synthesized
atccagggaaataatcaaggaa

SEQ ID NO: 95198 - DNA, 22 bp, Artificial Sequence
  chemically synthesized
tccagggaaataatcaaggaaa

SEQ ID NO: 95199 - DNA, 22 bp, Artificial Sequence
  chemically synthesized
cccccaccttgctagagaccta

SEQ ID NO: 95200 - DNA, 22 bp, Artificial Sequence
  chemically synthesized
ccccaccttgctagagacctag

SEQ ID NO: 95201 - DNA, 22 bp, Artificial Sequence
  chemically synthesized
gctagagacctagatatccaaa

SEQ ID NO: 95202 - DNA, 22 bp, Artificial Sequence
  chemically synthesized
ctagagacctagatatccaaat

SEQ ID NO: 95203 - DNA, 22 bp, Artificial Sequence
  chemically synthesized
gagacctagatatccaaataca

SEQ ID NO: 95204 - DNA, 22 bp, Artificial Sequence
  chemically synthesized
gatatccaaatacaagaagctc

SEQ ID NO: 95205 - DNA, 22 bp, Artificial Sequence
  chemically synthesized
aataaacacctgggaaattcat

SEQ ID NO: 95206 - DNA, 22 bp, Artificial Sequence
  chemically synthesized
ggaaattcattgcaaaaatatc

SEQ ID NO: 95207 - DNA, 22 bp, Artificial Sequence
  chemically synthesized
attgcaaaaatatcattgccta

SEQ ID NO: 95208 - DNA, 22 bp, Artificial Sequence
  chemically synthesized
caaaaatatcattgcctaggta

SEQ ID NO: 95209 - DNA, 22 bp, Artificial Sequence
  chemically synthesized
cctaggtacattgtcatcagag

SEQ ID NO: 95210 - DNA, 22 bp, Artificial Sequence
  chemically synthesized
ggtacattgtcatcagagtatc

SEQ ID NO: 95211 - DNA, 22 bp, Artificial Sequence
  chemically synthesized
tcatcagagtatccaaagttat

SEQ ID NO: 95212 - DNA, 22 bp, Artificial Sequence
  chemically synthesized
tctaaagacaaagagaatctta

SEQ ID NO: 95213 - DNA, 22 bp, Artificial Sequence
  chemically synthesized
aagacaaagagaatcttaagag

SEQ ID NO: 95214 - DNA, 22 bp, Artificial Sequence
  chemically synthesized
aagagctgtgaggtgaaactac

SEQ ID NO: 95215 - DNA, 22 bp, Artificial Sequence
  chemically synthesized
agagctgtgaggtgaaactacc

SEQ ID NO: 95216 - DNA, 22 bp, Artificial Sequence
  chemically synthesized
tgaggtgaaactaccaggtaac

SEQ ID NO: 95217 - DNA, 22 bp, Artificial Sequence
  chemically synthesized
ccaggtaacctatgaaagaaaa

SEQ ID NO: 95218 - DNA, 22 bp, Artificial Sequence
  chemically synthesized
tgaaagaaaacctatcagatta

SEQ ID NO: 95219 - DNA, 22 bp, Artificial Sequence
  chemically synthesized
tcagattaacagcagatttctc

SEQ ID NO: 95220 - DNA, 22 bp, Artificial Sequence
  chemically synthesized
acagcagatttctcagcagaaa

SEQ ID NO: 95221 - DNA, 22 bp, Artificial Sequence
  chemically synthesized
ctcagcagaaaccgtaaaagct

SEQ ID NO: 95222 - DNA, 22 bp, Artificial Sequence
  chemically synthesized
tcagcagaaaccgtaaaagcta

SEQ ID NO: 95223 - DNA, 22 bp, Artificial Sequence
  chemically synthesized
agcagaaaccgtaaaagctaga

SEQ ID NO: 95224 - DNA, 22 bp, Artificial Sequence
  chemically synthesized
gaagtgaatatggccctatctt

SEQ ID NO: 95225 - DNA, 22 bp, Artificial Sequence
  chemically synthesized
tcttcagccttcttaaacaaaa

SEQ ID NO: 95226 - DNA, 22 bp, Artificial Sequence
  chemically synthesized
cagccttcttaaacaaaacaat

SEQ ID NO: 95227 - DNA, 22 bp, Artificial Sequence
  chemically synthesized
agccttcttaaacaaaacaatt

SEQ ID NO: 95228 - DNA, 22 bp, Artificial Sequence
  chemically synthesized
cttaaacaaaacaattatcagc

SEQ ID NO: 95229 - DNA, 22 bp, Artificial Sequence
  chemically synthesized
ttaaacaaaacaattatcagcc

SEQ ID NO: 95230 - DNA, 22 bp, Artificial Sequence
  chemically synthesized
aaacaaaacaattatcagccaa

SEQ ID NO: 95231 - DNA, 22 bp, Artificial Sequence
  chemically synthesized
aacaaaacaattatcagccaag

SEQ ID NO: 95232 - DNA, 22 bp, Artificial Sequence
  chemically synthesized
tcagccaagaattttatatcca

SEQ ID NO: 95233 - DNA, 22 bp, Artificial Sequence
  chemically synthesized
tatatccagtgaaactaagctt

SEQ ID NO: 95234 - DNA, 22 bp, Artificial Sequence
  chemically synthesized
atatccagtgaaactaagcttc

SEQ ID NO: 95235 - DNA, 22 bp, Artificial Sequence
  chemically synthesized
tatccagtgaaactaagcttca

SEQ ID NO: 95236 - DNA, 22 bp, Artificial Sequence
  chemically synthesized
agcttcacaaatgaagaaaata

SEQ ID NO: 95237 - DNA, 22 bp, Artificial Sequence
  chemically synthesized
cacaaatgaagaaaatacacag

SEQ ID NO: 95238 - DNA, 22 bp, Artificial Sequence
  chemically synthesized
acaaatgaagaaaatacacagt

SEQ ID NO: 95239 - DNA, 22 bp, Artificial Sequence
  chemically synthesized
ttcagaaaaacaaatgctgaga

SEQ ID NO: 95240 - DNA, 22 bp, Artificial Sequence
  chemically synthesized
tcagaaaaacaaatgctgagag

SEQ ID NO: 95241 - DNA, 22 bp, Artificial Sequence
  chemically synthesized
cagaaaaacaaatgctgagaga

SEQ ID NO: 95242 - DNA, 22 bp, Artificial Sequence
  chemically synthesized
agaaaaacaaatgctgagagaa

SEQ ID NO: 95243 - DNA, 22 bp, Artificial Sequence
  chemically synthesized
agagaattcggcactaccaagc

SEQ ID NO: 95244 - DNA, 22 bp, Artificial Sequence
  chemically synthesized
ggcactaccaagccaacactac

SEQ ID NO: 95245 - DNA, 22 bp, Artificial Sequence
  chemically synthesized
ccaagccaacactacaagaact

SEQ ID NO: 95246 - DNA, 22 bp, Artificial Sequence
  chemically synthesized
caagaactgataaaaggagctc

SEQ ID NO: 95247 - DNA, 22 bp, Artificial Sequence
  chemically synthesized
ataaaaggagctctaaatcttg

SEQ ID NO: 95248 - DNA, 22 bp, Artificial Sequence
  chemically synthesized
taaatcttgaaataaaccctgg

SEQ ID NO: 95249 - DNA, 22 bp, Artificial Sequence
  chemically synthesized
aatcttgaaataaaccctggaa

SEQ ID NO: 95250 - DNA, 22 bp, Artificial Sequence
  chemically synthesized
gaaataaaccctggaagcacat

SEQ ID NO: 95251 - DNA, 22 bp, Artificial Sequence
  chemically synthesized
aaataaaccctggaagcacatc

SEQ ID NO: 95252 - DNA, 22 bp, Artificial Sequence
  chemically synthesized
gaagcacatcaaaacagaacct

SEQ ID NO: 95253 - DNA, 22 bp, Artificial Sequence
  chemically synthesized
tttaaagcataaatcccatagg

SEQ ID NO: 95254 - DNA, 22 bp, Artificial Sequence
  chemically synthesized
taaagcataaatcccataggac

SEQ ID NO: 95255 - DNA, 22 bp, Artificial Sequence
  chemically synthesized
aaagcataaatcccataggaca

SEQ ID NO: 95256 - DNA, 22 bp, Artificial Sequence
  chemically synthesized
aagcataaatcccataggacat

SEQ ID NO: 95257 - DNA, 22 bp, Artificial Sequence
  chemically synthesized
acacctcaatactgatgttgaa

SEQ ID NO: 95258 - DNA, 22 bp, Artificial Sequence
  chemically synthesized
aatactgatgttgaatgtaaat

SEQ ID NO: 95259 - DNA, 22 bp, Artificial Sequence
  chemically synthesized
atgttgaatgtaaatggactaa

SEQ ID NO: 95260 - DNA, 22 bp, Artificial Sequence
  chemically synthesized
aatgtaaatggactaaatgctc

SEQ ID NO: 95261 - DNA, 22 bp, Artificial Sequence
  chemically synthesized
aatgctccacttaaaagataca

SEQ ID NO: 95262 - DNA, 22 bp, Artificial Sequence
  chemically synthesized
cacttaaaagatacagaattgc

SEQ ID NO: 95263 - DNA, 22 bp, Artificial Sequence
  chemically synthesized
aaaagatacagaattgcagaat

SEQ ID NO: 95264 - DNA, 22 bp, Artificial Sequence
  chemically synthesized
aaagatacagaattgcagaatg

SEQ ID NO: 95265 - DNA, 22 bp, Artificial Sequence
  chemically synthesized
cagaatgaataagaattcacca

SEQ ID NO: 95266 - DNA, 22 bp, Artificial Sequence
  chemically synthesized
accaaccagttatctgccgcct

SEQ ID NO: 95267 - DNA, 22 bp, Artificial Sequence
  chemically synthesized
tctgccgccttcaggagactca

SEQ ID NO: 95268 - DNA, 22 bp, Artificial Sequence
  chemically synthesized
ccgccttcaggagactcaccta

SEQ ID NO: 95269 - DNA, 22 bp, Artificial Sequence
  chemically synthesized
caggagactcacctaacacata

SEQ ID NO: 95270 - DNA, 22 bp, Artificial Sequence
  chemically synthesized
aggagactcacctaacacataa

SEQ ID NO: 95271 - DNA, 22 bp, Artificial Sequence
  chemically synthesized
acctaacacataaggactcaca

SEQ ID NO: 95272 - DNA, 22 bp, Artificial Sequence
  chemically synthesized
acacataaggactcacataaac

SEQ ID NO: 95273 - DNA, 22 bp, Artificial Sequence
  chemically synthesized
acataaacttaaggtaaagggg

SEQ ID NO: 95274 - DNA, 22 bp, Artificial Sequence
  chemically synthesized
aaggtaaaggggtggaaaatga

SEQ ID NO: 95275 - DNA, 22 bp, Artificial Sequence
  chemically synthesized
aggtaaaggggtggaaaatgac

SEQ ID NO: 95276 - DNA, 22 bp, Artificial Sequence
  chemically synthesized
cacacaaatggacaccaaaagc

SEQ ID NO: 95277 - DNA, 22 bp, Artificial Sequence
  chemically synthesized
ttcttatgtcagacaaaacaaa

SEQ ID NO: 95278 - DNA, 22 bp, Artificial Sequence
  chemically synthesized
ttatgtcagacaaaacaaactt

SEQ ID NO: 95279 - DNA, 22 bp, Artificial Sequence
  chemically synthesized
atgtcagacaaaacaaacttta

SEQ ID NO: 95280 - DNA, 22 bp, Artificial Sequence
  chemically synthesized
tgtcagacaaaacaaactttaa

SEQ ID NO: 95281 - DNA, 22 bp, Artificial Sequence
  chemically synthesized
taaagaaacagcagttaaaaaa

SEQ ID NO: 95282 - DNA, 22 bp, Artificial Sequence
  chemically synthesized
aaagaaacagcagttaaaaaag

SEQ ID NO: 95283 - DNA, 22 bp, Artificial Sequence
  chemically synthesized
aagaaacagcagttaaaaaaga

SEQ ID NO: 95284 - DNA, 22 bp, Artificial Sequence
  chemically synthesized
aaaaagacaaagagggacatca

SEQ ID NO: 95285 - DNA, 22 bp, Artificial Sequence
  chemically synthesized
gtccaatgggagaatattacaa

SEQ ID NO: 95286 - DNA, 22 bp, Artificial Sequence
  chemically synthesized
tccaatgggagaatattacaat

SEQ ID NO: 95287 - DNA, 22 bp, Artificial Sequence
  chemically synthesized
caattcttaatatatatgcatc

SEQ ID NO: 95288 - DNA, 22 bp, Artificial Sequence
  chemically synthesized
ttaatatatatgcatctaatac

SEQ ID NO: 95289 - DNA, 22 bp, Artificial Sequence
  chemically synthesized
aatatatatgcatctaatactg

SEQ ID NO: 95290 - DNA, 22 bp, Artificial Sequence
  chemically synthesized
atatatatgcatctaatactgg

SEQ ID NO: 95291 - DNA, 22 bp, Artificial Sequence
  chemically synthesized
atactggagatcccaaatttat

SEQ ID NO: 95292 - DNA, 22 bp, Artificial Sequence
  chemically synthesized
gagatcccaaatttataaaaca

SEQ ID NO: 95293 - DNA, 22 bp, Artificial Sequence
  chemically synthesized
ataaaacaattactactagact

SEQ ID NO: 95294 - DNA, 22 bp, Artificial Sequence
  chemically synthesized
taaaacaattactactagacta

SEQ ID NO: 95295 - DNA, 22 bp, Artificial Sequence
  chemically synthesized
ctactagactagacagcaacat

SEQ ID NO: 95296 - DNA, 22 bp, Artificial Sequence
  chemically synthesized
ctagactagacagcaacataat

SEQ ID NO: 95297 - DNA, 22 bp, Artificial Sequence
  chemically synthesized
gactagacagcaacataataat

SEQ ID NO: 95298 - DNA, 22 bp, Artificial Sequence
  chemically synthesized
gacagcaacataataatagtgg

SEQ ID NO: 95299 - DNA, 22 bp, Artificial Sequence
  chemically synthesized
caatactccactgactgcacta

SEQ ID NO: 95300 - DNA, 22 bp, Artificial Sequence
  chemically synthesized
aatactccactgactgcactag

SEQ ID NO: 95301 - DNA, 22 bp, Artificial Sequence
  chemically synthesized
cactgactgcactaggcaggtc

SEQ ID NO: 95302 - DNA, 22 bp, Artificial Sequence
  chemically synthesized
actgcactaggcaggtcatcaa

SEQ ID NO: 95303 - DNA, 22 bp, Artificial Sequence
  chemically synthesized
cactaggcaggtcatcaagaca

SEQ ID NO: 95304 - DNA, 22 bp, Artificial Sequence
  chemically synthesized
ggcaggtcatcaagacagtcta

SEQ ID NO: 95305 - DNA, 22 bp, Artificial Sequence
  chemically synthesized
caaagaaacaatggatttaaag

SEQ ID NO: 95306 - DNA, 22 bp, Artificial Sequence
  chemically synthesized
aaagaacaaatggacttaacag

SEQ ID NO: 95307 - DNA, 22 bp, Artificial Sequence
  chemically synthesized
aagaacaaatggacttaacaga

SEQ ID NO: 95308 - DNA, 22 bp, Artificial Sequence
  chemically synthesized
aacagatatttacaggacattc

SEQ ID NO: 95309 - DNA, 22 bp, Artificial Sequence
  chemically synthesized
acagatatttacaggacattct

SEQ ID NO: 95310 - DNA, 22 bp, Artificial Sequence
  chemically synthesized
acaggacattctacccaacaac

SEQ ID NO: 95311 - DNA, 22 bp, Artificial Sequence
  chemically synthesized
caggacattctacccaacaact

SEQ ID NO: 95312 - DNA, 22 bp, Artificial Sequence
  chemically synthesized
tacccaacaactgcagaataca

SEQ ID NO: 95313 - DNA, 22 bp, Artificial Sequence
  chemically synthesized
cccaacaactgcagaatacaca

SEQ ID NO: 95314 - DNA, 22 bp, Artificial Sequence
  chemically synthesized
cagaatacacattctattcatc

SEQ ID NO: 95315 - DNA, 22 bp, Artificial Sequence
  chemically synthesized
tattcatcagcacatggaactt

SEQ ID NO: 95316 - DNA, 22 bp, Artificial Sequence
  chemically synthesized
ttcatcagcacatggaactttc

SEQ ID NO: 95317 - DNA, 22 bp, Artificial Sequence
  chemically synthesized
atcagcacatggaactttctcc

SEQ ID NO: 95318 - DNA, 22 bp, Artificial Sequence
  chemically synthesized
tctccaagataggccatatgat

SEQ ID NO: 95319 - DNA, 22 bp, Artificial Sequence
  chemically synthesized
ctccaagataggccatatgata

SEQ ID NO: 95320 - DNA, 22 bp, Artificial Sequence
  chemically synthesized
tccaagataggccatatgatat

SEQ ID NO: 95321 - DNA, 22 bp, Artificial Sequence
  chemically synthesized
caagataggccatatgatatgc

SEQ ID NO: 95322 - DNA, 22 bp, Artificial Sequence
  chemically synthesized
aataaatttttaaaaattgaaa

SEQ ID NO: 95323 - DNA, 22 bp, Artificial Sequence
  chemically synthesized
ttaaaaattgaaattatatcaa

SEQ ID NO: 95324 - DNA, 22 bp, Artificial Sequence
  chemically synthesized
taaaaattgaaattatatcaag

SEQ ID NO: 95325 - DNA, 22 bp, Artificial Sequence
  chemically synthesized
aaaaattgaaattatatcaagc

SEQ ID NO: 95326 - DNA, 22 bp, Artificial Sequence
  chemically synthesized
aaaattgaaattatatcaagca

SEQ ID NO: 95327 - DNA, 22 bp, Artificial Sequence
  chemically synthesized
aaattatatcaagcactctctc

SEQ ID NO: 95328 - DNA, 22 bp, Artificial Sequence
  chemically synthesized
tatcaagcactctctcagacca

SEQ ID NO: 95329 - DNA, 22 bp, Artificial Sequence
  chemically synthesized
tctcagaccacagtagaataaa

SEQ ID NO: 95330 - DNA, 22 bp, Artificial Sequence
  chemically synthesized
tcagaccacagtagaataaaat

SEQ ID NO: 95331 - DNA, 22 bp, Artificial Sequence
  chemically synthesized
agaccacagtagaataaaattg

SEQ ID NO: 95332 - DNA, 22 bp, Artificial Sequence
  chemically synthesized
gaaatcaactacaaaaggaacc

SEQ ID NO: 95333 - DNA, 22 bp, Artificial Sequence
  chemically synthesized
caaaaggaaccttcaaaaccat

SEQ ID NO: 95334 - DNA, 22 bp, Artificial Sequence
  chemically synthesized
caaaaccatgcaaatacaggga

SEQ ID NO: 95335 - DNA, 22 bp, Artificial Sequence
  chemically synthesized
aaaaccatgcaaatacagggaa

SEQ ID NO: 95336 - DNA, 22 bp, Artificial Sequence
  chemically synthesized
aataacctgctcctgaatgatc

SEQ ID NO: 95337 - DNA, 22 bp, Artificial Sequence
  chemically synthesized
ctcctgaatgatcattgggtca

SEQ ID NO: 95338 - DNA, 22 bp, Artificial Sequence
  chemically synthesized
ctgaatgatcattgggtcaaca

SEQ ID NO: 95339 - DNA, 22 bp, Artificial Sequence
  chemically synthesized
aatgatcattgggtcaacaatg

SEQ ID NO: 95340 - DNA, 22 bp, Artificial Sequence
  chemically synthesized
ggtcaacaatgaaatcaagatg

SEQ ID NO: 95341 - DNA, 22 bp, Artificial Sequence
  chemically synthesized
aaaaatcatttgctttgaaaac

SEQ ID NO: 95342 - DNA, 22 bp, Artificial Sequence
  chemically synthesized
aaaatcatttgctttgaaaacc

SEQ ID NO: 95343 - DNA, 22 bp, Artificial Sequence
  chemically synthesized
gctttgaaaaccggcacaagac

SEQ ID NO: 95344 - DNA, 22 bp, Artificial Sequence
  chemically synthesized
ctttgaaaaccggcacaagaca

SEQ ID NO: 95345 - DNA, 22 bp, Artificial Sequence
  chemically synthesized
tgaaaaccggcacaagacaagg

SEQ ID NO: 95346 - DNA, 22 bp, Artificial Sequence
  chemically synthesized
gaaaaccggcacaagacaagga

SEQ ID NO: 95347 - DNA, 22 bp, Artificial Sequence
  chemically synthesized
aaaaccggcacaagacaaggat

SEQ ID NO: 95348 - DNA, 22 bp, Artificial Sequence
  chemically synthesized
tcgccactcttactcaacatag

SEQ ID NO: 95349 - DNA, 22 bp, Artificial Sequence
  chemically synthesized
gccactcttactcaacatagta

SEQ ID NO: 95350 - DNA, 22 bp, Artificial Sequence
  chemically synthesized
ttactcaacatagtattggaag

SEQ ID NO: 95351 - DNA, 22 bp, Artificial Sequence
  chemically synthesized
actcaacatagtattggaagtt

SEQ ID NO: 95352 - DNA, 22 bp, Artificial Sequence
  chemically synthesized
ctcaacatagtattggaagttc

SEQ ID NO: 95353 - DNA, 22 bp, Artificial Sequence
  chemically synthesized
aacatagtattggaagttctcg

SEQ ID NO: 95354 - DNA, 22 bp, Artificial Sequence
  chemically synthesized
gaagttctcgccaggacaatca

SEQ ID NO: 95355 - DNA, 22 bp, Artificial Sequence
  chemically synthesized
tcgccaggacaatcaggcaaga

SEQ ID NO: 95356 - DNA, 22 bp, Artificial Sequence
  chemically synthesized
gccaggacaatcaggcaagaga

SEQ ID NO: 95357 - DNA, 22 bp, Artificial Sequence
  chemically synthesized
aaataggaagagaggaagtcaa

SEQ ID NO: 95358 - DNA, 22 bp, Artificial Sequence
  chemically synthesized
tctctgtttgcagatgacatga

SEQ ID NO: 95359 - DNA, 22 bp, Artificial Sequence
  chemically synthesized
tgtttgcagatgacatgattgt

SEQ ID NO: 95360 - DNA, 22 bp, Artificial Sequence
  chemically synthesized
tttgcagatgacatgattgtat

SEQ ID NO: 95361 - DNA, 22 bp, Artificial Sequence
  chemically synthesized
gcagatgacatgattgtatatt

SEQ ID NO: 95362 - DNA, 22 bp, Artificial Sequence
  chemically synthesized
cagatgacatgattgtatattt

SEQ ID NO: 95363 - DNA, 22 bp, Artificial Sequence
  chemically synthesized
tatatttagaagaccctgtcat

SEQ ID NO: 95364 - DNA, 22 bp, Artificial Sequence
  chemically synthesized
agaagaccctgtcatctcagcc

SEQ ID NO: 95365 - DNA, 22 bp, Artificial Sequence
  chemically synthesized
gaagaccctgtcatctcagccc

SEQ ID NO: 95366 - DNA, 22 bp, Artificial Sequence
  chemically synthesized
tcatctcagcccaaaatcttaa

SEQ ID NO: 95367 - DNA, 22 bp, Artificial Sequence
  chemically synthesized
agcccaaaatcttaagctgata

SEQ ID NO: 95368 - DNA, 22 bp, Artificial Sequence
  chemically synthesized
aagctgataaacagcttcagca

SEQ ID NO: 95369 - DNA, 22 bp, Artificial Sequence
  chemically synthesized
agctgataaacagcttcagcaa

SEQ ID NO: 95370 - DNA, 22 bp, Artificial Sequence
  chemically synthesized
ataaacagcttcagcaaagtct

SEQ ID NO: 95371 - DNA, 22 bp, Artificial Sequence
  chemically synthesized
cagcaaagtctcaagatacaaa

SEQ ID NO: 95372 - DNA, 22 bp, Artificial Sequence
  chemically synthesized
agcaaagtctcaagatacaaaa

SEQ ID NO: 95373 - DNA, 22 bp, Artificial Sequence
  chemically synthesized
aagatacaaaatcagtgtgcag

SEQ ID NO: 95374 - DNA, 22 bp, Artificial Sequence
  chemically synthesized
ctatacaccaataatagacaag

SEQ ID NO: 95375 - DNA, 22 bp, Artificial Sequence
  chemically synthesized
tacaccaataatagacaagcag

SEQ ID NO: 95376 - DNA, 22 bp, Artificial Sequence
  chemically synthesized
ccattcacaattgctgcaaaga

SEQ ID NO: 95377 - DNA, 22 bp, Artificial Sequence
  chemically synthesized
acaattgctgcaaagagaataa

SEQ ID NO: 95378 - DNA, 22 bp, Artificial Sequence
  chemically synthesized
ctgcaaagagaataaaataaaa

SEQ ID NO: 95379 - DNA, 22 bp, Artificial Sequence
  chemically synthesized
caaagagaataaaataaaatac

SEQ ID NO: 95380 - DNA, 22 bp, Artificial Sequence
  chemically synthesized
gaaatacaacttctaagggatg

SEQ ID NO: 95381 - DNA, 22 bp, Artificial Sequence
  chemically synthesized
ctaagggatgtgaagaacctct

SEQ ID NO: 95382 - DNA, 22 bp, Artificial Sequence
  chemically synthesized
taagggatgtgaagaacctctt

SEQ ID NO: 95383 - DNA, 22 bp, Artificial Sequence
  chemically synthesized
agggatgtgaagaacctcttca

SEQ ID NO: 95384 - DNA, 22 bp, Artificial Sequence
  chemically synthesized
ttcaaggagagctacaaaccac

SEQ ID NO: 95385 - DNA, 22 bp, Artificial Sequence
  chemically synthesized
caaggagagctacaaaccactc

SEQ ID NO: 95386 - DNA, 22 bp, Artificial Sequence
  chemically synthesized
aaggagagctacaaaccactca

SEQ ID NO: 95387 - DNA, 22 bp, Artificial Sequence
  chemically synthesized
caaaccactcactgctcaagga

SEQ ID NO: 95388 - DNA, 22 bp, Artificial Sequence
  chemically synthesized
actgctcaaggaaataagagag

SEQ ID NO: 95389 - DNA, 22 bp, Artificial Sequence
  chemically synthesized
ctcaaggaaataagagaggaca

SEQ ID NO: 95390 - DNA, 22 bp, Artificial Sequence
  chemically synthesized
aaggaaataagagaggacacaa

SEQ ID NO: 95391 - DNA, 22 bp, Artificial Sequence
  chemically synthesized
catgctcatagatagaaagaat

SEQ ID NO: 95392 - DNA, 22 bp, Artificial Sequence
  chemically synthesized
atagatagaaagaatcaatatc

SEQ ID NO: 95393 - DNA, 22 bp, Artificial Sequence
  chemically synthesized
taaaatggccatactgcccaaa

SEQ ID NO: 95394 - DNA, 22 bp, Artificial Sequence
  chemically synthesized
aaaatggccatactgcccaaag

SEQ ID NO: 95395 - DNA, 22 bp, Artificial Sequence
  chemically synthesized
aaatggccatactgcccaaagt

SEQ ID NO: 95396 - DNA, 22 bp, Artificial Sequence
  chemically synthesized
cccaaagtaatttatagattca

SEQ ID NO: 95397 - DNA, 22 bp, Artificial Sequence
  chemically synthesized
atagattcaatgctatccccat

SEQ ID NO: 95398 - DNA, 22 bp, Artificial Sequence
  chemically synthesized
tagattcaatgctatccccatc

SEQ ID NO: 95399 - DNA, 22 bp, Artificial Sequence
  chemically synthesized
aatgctatccccatcaagctac

SEQ ID NO: 95400 - DNA, 22 bp, Artificial Sequence
  chemically synthesized
tccccatcaagctaccactgac

SEQ ID NO: 95401 - DNA, 22 bp, Artificial Sequence
  chemically synthesized
ccactgacttttttcaaagaat

SEQ ID NO: 95402 - DNA, 22 bp, Artificial Sequence
  chemically synthesized
acttttttcaaagaattagaaa

SEQ ID NO: 95403 - DNA, 22 bp, Artificial Sequence
  chemically synthesized
ttttcaaagaattagaaaaaac

SEQ ID NO: 95404 - DNA, 22 bp, Artificial Sequence
  chemically synthesized
tttcaaagaattagaaaaaact

SEQ ID NO: 95405 - DNA, 22 bp, Artificial Sequence
  chemically synthesized
ttcaaagaattagaaaaaacta

SEQ ID NO: 95406 - DNA, 22 bp, Artificial Sequence
  chemically synthesized
tcaaagaattagaaaaaactac

SEQ ID NO: 95407 - DNA, 22 bp, Artificial Sequence
  chemically synthesized
caaagaattagaaaaaactact

SEQ ID NO: 95408 - DNA, 22 bp, Artificial Sequence
  chemically synthesized
aaagaattagaaaaaactactt

SEQ ID NO: 95409 - DNA, 22 bp, Artificial Sequence
  chemically synthesized
gaaaaaactactttaaatgtca

SEQ ID NO: 95410 - DNA, 22 bp, Artificial Sequence
  chemically synthesized
ctttaaatgtcatatggaatca

SEQ ID NO: 95411 - DNA, 22 bp, Artificial Sequence
  chemically synthesized
taaatgtcatatggaatcaaaa

SEQ ID NO: 95412 - DNA, 22 bp, Artificial Sequence
  chemically synthesized
aaatgtcatatggaatcaaaaa

SEQ ID NO: 95413 - DNA, 22 bp, Artificial Sequence
  chemically synthesized
aatgtcatatggaatcaaaaaa

SEQ ID NO: 95414 - DNA, 22 bp, Artificial Sequence
  chemically synthesized
aacaaaaagaacaaagctggag

SEQ ID NO: 95415 - DNA, 22 bp, Artificial Sequence
  chemically synthesized
gaggcatgatgctacctgactt

SEQ ID NO: 95416 - DNA, 22 bp, Artificial Sequence
  chemically synthesized
cctgacttcaaactatactaca

SEQ ID NO: 95417 - DNA, 22 bp, Artificial Sequence
  chemically synthesized
acttcaaactatactacaaggc

SEQ ID NO: 95418 - DNA, 22 bp, Artificial Sequence
  chemically synthesized
caaactatactacaaggctaca

SEQ ID NO: 95419 - DNA, 22 bp, Artificial Sequence
  chemically synthesized
aaactatactacaaggctacag

SEQ ID NO: 95420 - DNA, 22 bp, Artificial Sequence
  chemically synthesized
tactacaaggctacagtaacaa

SEQ ID NO: 95421 - DNA, 22 bp, Artificial Sequence
  chemically synthesized
caaggctacagtaacaaaaaca

SEQ ID NO: 95422 - DNA, 22 bp, Artificial Sequence
  chemically synthesized
cagtaacaaaaacagcatggta

SEQ ID NO: 95423 - DNA, 22 bp, Artificial Sequence
  chemically synthesized
gtaccaaaacagatatatagac

SEQ ID NO: 95424 - DNA, 22 bp, Artificial Sequence
  chemically synthesized
agaaataatgccacacatctac

SEQ ID NO: 95425 - DNA, 22 bp, Artificial Sequence
  chemically synthesized
cgaccatctgatctttgacaaa

SEQ ID NO: 95426 - DNA, 22 bp, Artificial Sequence
  chemically synthesized
atctttgacaaacatcacaaaa

SEQ ID NO: 95427 - DNA, 22 bp, Artificial Sequence
  chemically synthesized
tgacaaacatcacaaaagcaat

SEQ ID NO: 95428 - DNA, 22 bp, Artificial Sequence
  chemically synthesized
gacaaacatcacaaaagcaatg

SEQ ID NO: 95429 - DNA, 22 bp, Artificial Sequence
  chemically synthesized
acaaacatcacaaaagcaatgg

SEQ ID NO: 95430 - DNA, 22 bp, Artificial Sequence
  chemically synthesized
cctatttaataaatggtgctgg

SEQ ID NO: 95431 - DNA, 22 bp, Artificial Sequence
  chemically synthesized
tttaataaatggtgctggaaaa

SEQ ID NO: 95432 - DNA, 22 bp, Artificial Sequence
  chemically synthesized
aataaatggtgctggaaaaact

SEQ ID NO: 95433 - DNA, 22 bp, Artificial Sequence
  chemically synthesized
ataaatggtgctggaaaaactg

SEQ ID NO: 95434 - DNA, 22 bp, Artificial Sequence
  chemically synthesized
gaaaaactggctagcaatatgc

SEQ ID NO: 95435 - DNA, 22 bp, Artificial Sequence
  chemically synthesized
gctagcaatatgcataaaactg

SEQ ID NO: 95436 - DNA, 22 bp, Artificial Sequence
  chemically synthesized
gcaatatgcataaaactgaaac

SEQ ID NO: 95437 - DNA, 22 bp, Artificial Sequence
  chemically synthesized
aaactgtaccccttccttacac

SEQ ID NO: 95438 - DNA, 22 bp, Artificial Sequence
  chemically synthesized
taccccttccttacaccttata

SEQ ID NO: 95439 - DNA, 22 bp, Artificial Sequence
  chemically synthesized
ccttacaccttatacaaaaatt

SEQ ID NO: 95440 - DNA, 22 bp, Artificial Sequence
  chemically synthesized
cttacaccttatacaaaaatta

SEQ ID NO: 95441 - DNA, 22 bp, Artificial Sequence
  chemically synthesized
acaccttatacaaaaattaact

SEQ ID NO: 95442 - DNA, 22 bp, Artificial Sequence
  chemically synthesized
caccttatacaaaaattaactc

SEQ ID NO: 95443 - DNA, 22 bp, Artificial Sequence
  chemically synthesized
atacaaaaattaactcaaggtg

SEQ ID NO: 95444 - DNA, 22 bp, Artificial Sequence
  chemically synthesized
tacaaaaattaactcaaggtgg

SEQ ID NO: 95445 - DNA, 22 bp, Artificial Sequence
  chemically synthesized
actcaaggtggattaaagactt

SEQ ID NO: 95446 - DNA, 22 bp, Artificial Sequence
  chemically synthesized
aaggtggattaaagacttaaat

SEQ ID NO: 95447 - DNA, 22 bp, Artificial Sequence
  chemically synthesized
aagacttaaatgtgcaacctaa

SEQ ID NO: 95448 - DNA, 22 bp, Artificial Sequence
  chemically synthesized
aaatgtgcaacctaaaaccata

SEQ ID NO: 95449 - DNA, 22 bp, Artificial Sequence
  chemically synthesized
aatgtgcaacctaaaaccataa

SEQ ID NO: 95450 - DNA, 22 bp, Artificial Sequence
  chemically synthesized
aaaccataaaaatcctagaaga

SEQ ID NO: 95451 - DNA, 22 bp, Artificial Sequence
  chemically synthesized
gaagataacctaggcaatacca

SEQ ID NO: 95452 - DNA, 22 bp, Artificial Sequence
  chemically synthesized
ggcaataccattcaggacatag

SEQ ID NO: 95453 - DNA, 22 bp, Artificial Sequence
  chemically synthesized
aggacataggcatgggcaaaaa

SEQ ID NO: 95454 - DNA, 22 bp, Artificial Sequence
  chemically synthesized
acgactaaaacatcaaaagcaa

SEQ ID NO: 95455 - DNA, 22 bp, Artificial Sequence
  chemically synthesized
aaacatcaaaagcaatgacaac

SEQ ID NO: 95456 - DNA, 22 bp, Artificial Sequence
  chemically synthesized
acatatgggatctaattaaact

SEQ ID NO: 95457 - DNA, 22 bp, Artificial Sequence
  chemically synthesized
attaaactaaagagcttctgca

SEQ ID NO: 95458 - DNA, 22 bp, Artificial Sequence
  chemically synthesized
aactaaagagcttctgcacagc

SEQ ID NO: 95459 - DNA, 22 bp, Artificial Sequence
  chemically synthesized
aagagcttctgcacagcaaaag

SEQ ID NO: 95460 - DNA, 22 bp, Artificial Sequence
  chemically synthesized
ctgcacagcaaaagactatcat

SEQ ID NO: 95461 - DNA, 22 bp, Artificial Sequence
  chemically synthesized
tgcacagcaaaagactatcatc

SEQ ID NO: 95462 - DNA, 22 bp, Artificial Sequence
  chemically synthesized
cacagcaaaagactatcatcag

SEQ ID NO: 95463 - DNA, 22 bp, Artificial Sequence
  chemically synthesized
tcatcagagtgaacaggcaacc

SEQ ID NO: 95464 - DNA, 22 bp, Artificial Sequence
  chemically synthesized
cagaatgggagaaaatttttgc

SEQ ID NO: 95465 - DNA, 22 bp, Artificial Sequence
  chemically synthesized
ttgcaatctatccatctgacaa

SEQ ID NO: 95466 - DNA, 22 bp, Artificial Sequence
  chemically synthesized
tgcaatctatccatctgacaaa

SEQ ID NO: 95467 - DNA, 22 bp, Artificial Sequence
  chemically synthesized
gcaatctatccatctgacaaag

SEQ ID NO: 95468 - DNA, 22 bp, Artificial Sequence
  chemically synthesized
caatctatccatctgacaaagg

SEQ ID NO: 95469 - DNA, 22 bp, Artificial Sequence
  chemically synthesized
tccatctgacaaagggctaaca

SEQ ID NO: 95470 - DNA, 22 bp, Artificial Sequence
  chemically synthesized
acaaagggctaacatccaaaat

SEQ ID NO: 95471 - DNA, 22 bp, Artificial Sequence
  chemically synthesized
acatccaaaatctacaaagaac

SEQ ID NO: 95472 - DNA, 22 bp, Artificial Sequence
  chemically synthesized
caaagaacttcaacaaatttac

SEQ ID NO: 95473 - DNA, 22 bp, Artificial Sequence
  chemically synthesized
caacaaatttacaagaaaaaac

SEQ ID NO: 95474 - DNA, 22 bp, Artificial Sequence
  chemically synthesized
aacaaatttacaagaaaaaacc

SEQ ID NO: 95475 - DNA, 22 bp, Artificial Sequence
  chemically synthesized
acaagaaaaaacctaacgaccc

SEQ ID NO: 95476 - DNA, 22 bp, Artificial Sequence
  chemically synthesized
caagaaaaaacctaacgacccc

SEQ ID NO: 95477 - DNA, 22 bp, Artificial Sequence
  chemically synthesized
acgaccccatcaaaaagtggac

SEQ ID NO: 95478 - DNA, 22 bp, Artificial Sequence
  chemically synthesized
ctctaaagaagtcatttatgtg

SEQ ID NO: 95479 - DNA, 22 bp, Artificial Sequence
  chemically synthesized
tctaaagaagtcatttatgtgg

SEQ ID NO: 95480 - DNA, 22 bp, Artificial Sequence
  chemically synthesized
taaagaagtcatttatgtggcc

SEQ ID NO: 95481 - DNA, 22 bp, Artificial Sequence
  chemically synthesized
aagaagtcatttatgtggccaa

SEQ ID NO: 95482 - DNA, 22 bp, Artificial Sequence
  chemically synthesized
atgtggccaagaaacacatgaa

SEQ ID NO: 95483 - DNA, 22 bp, Artificial Sequence
  chemically synthesized
tgtggccaagaaacacatgaaa

SEQ ID NO: 95484 - DNA, 22 bp, Artificial Sequence
  chemically synthesized
atcatcactggtcattagagaa

SEQ ID NO: 95485 - DNA, 22 bp, Artificial Sequence
  chemically synthesized
gtcattagagaaatgcaaatca

SEQ ID NO: 95486 - DNA, 22 bp, Artificial Sequence
  chemically synthesized
gagaaatgcaaatcaaaaccac

SEQ ID NO: 95487 - DNA, 22 bp, Artificial Sequence
  chemically synthesized
atgccagttagaatggcaatta

SEQ ID NO: 95488 - DNA, 22 bp, Artificial Sequence
  chemically synthesized
gaatggcaattattaaaaagtc

SEQ ID NO: 95489 - DNA, 22 bp, Artificial Sequence
  chemically synthesized
ttaaaaagtcaggaaacaaaag

SEQ ID NO: 95490 - DNA, 22 bp, Artificial Sequence
  chemically synthesized
aaaagtcaggaaacaaaaggtg

SEQ ID NO: 95491 - DNA, 22 bp, Artificial Sequence
  chemically synthesized
gagaggatgtggaagaatagga

SEQ ID NO: 95492 - DNA, 22 bp, Artificial Sequence
  chemically synthesized
tacactgttgatgggtgtgtaa

SEQ ID NO: 95493 - DNA, 22 bp, Artificial Sequence
  chemically synthesized
acactgttgatgggtgtgtaaa

SEQ ID NO: 95494 - DNA, 22 bp, Artificial Sequence
  chemically synthesized
cactgttgatgggtgtgtaaat

SEQ ID NO: 95495 - DNA, 22 bp, Artificial Sequence
  chemically synthesized
ttgatgggtgtgtaaattagtt

SEQ ID NO: 95496 - DNA, 22 bp, Artificial Sequence
  chemically synthesized
atgggtgtgtaaattagttcaa

SEQ ID NO: 95497 - DNA, 22 bp, Artificial Sequence
  chemically synthesized
gttcaaccattgtggaagacag

SEQ ID NO: 95498 - DNA, 22 bp, Artificial Sequence
  chemically synthesized
aaccattgtggaagacagtgtg

SEQ ID NO: 95499 - DNA, 22 bp, Artificial Sequence
  chemically synthesized
tggaagacagtgtggcgattcc

SEQ ID NO: 95500 - DNA, 22 bp, Artificial Sequence
  chemically synthesized
ctcaaggatctagaaccagaaa

SEQ ID NO: 95501 - DNA, 22 bp, Artificial Sequence
  chemically synthesized
aaggatctagaaccagaaatac

SEQ ID NO: 95502 - DNA, 22 bp, Artificial Sequence
  chemically synthesized
gaaccagaaatactgtttgacc

SEQ ID NO: 95503 - DNA, 22 bp, Artificial Sequence
  chemically synthesized
tttgacccagcaatcccattac

SEQ ID NO: 95504 - DNA, 22 bp, Artificial Sequence
  chemically synthesized
gacccagcaatcccattactgg

SEQ ID NO: 95505 - DNA, 22 bp, Artificial Sequence
  chemically synthesized
acccagcaatcccattactggg

SEQ ID NO: 95506 - DNA, 22 bp, Artificial Sequence
  chemically synthesized
ctgggtatatacccaaagaatt

SEQ ID NO: 95507 - DNA, 22 bp, Artificial Sequence
  chemically synthesized
ggtatatacccaaagaattaga

SEQ ID NO: 95508 - DNA, 22 bp, Artificial Sequence
  chemically synthesized
gaaatcattctactataaagac

SEQ ID NO: 95509 - DNA, 22 bp, Artificial Sequence
  chemically synthesized
tactataaagacacgtgcacac

SEQ ID NO: 95510 - DNA, 22 bp, Artificial Sequence
  chemically synthesized
ctataaagacacgtgcacacgt

SEQ ID NO: 95511 - DNA, 22 bp, Artificial Sequence
  chemically synthesized
taaagacacgtgcacacgtatg

SEQ ID NO: 95512 - DNA, 22 bp, Artificial Sequence
  chemically synthesized
attgtggcactattcacaatag

SEQ ID NO: 95513 - DNA, 22 bp, Artificial Sequence
  chemically synthesized
ttgtggcactattcacaatagc

SEQ ID NO: 95514 - DNA, 22 bp, Artificial Sequence
  chemically synthesized
tggcactattcacaatagcaaa

SEQ ID NO: 95515 - DNA, 22 bp, Artificial Sequence
  chemically synthesized
ttcacaatagcaaagacttgga

SEQ ID NO: 95516 - DNA, 22 bp, Artificial Sequence
  chemically synthesized
acaatagcaaagacttggaacc

SEQ ID NO: 95517 - DNA, 22 bp, Artificial Sequence
  chemically synthesized
ggaaccaacccaaatggccatc

SEQ ID NO: 95518 - DNA, 22 bp, Artificial Sequence
  chemically synthesized
gaaccaacccaaatggccatca

SEQ ID NO: 95519 - DNA, 22 bp, Artificial Sequence
  chemically synthesized
tgcagccataaaaatgatgagt

SEQ ID NO: 95520 - DNA, 22 bp, Artificial Sequence
  chemically synthesized
atgtctttgcagggacatggat

SEQ ID NO: 95521 - DNA, 22 bp, Artificial Sequence
  chemically synthesized
tgcagggacatggatgaaggtg

SEQ ID NO: 95522 - DNA, 22 bp, Artificial Sequence
  chemically synthesized
gcagggacatggatgaaggtgg

SEQ ID NO: 95523 - DNA, 22 bp, Artificial Sequence
  chemically synthesized
cagggacatggatgaaggtgga

SEQ ID NO: 95524 - DNA, 22 bp, Artificial Sequence
  chemically synthesized
tgagcaaactaacacaggaaca

SEQ ID NO: 95525 - DNA, 22 bp, Artificial Sequence
  chemically synthesized
agcaaactaacacaggaacaga

SEQ ID NO: 95526 - DNA, 22 bp, Artificial Sequence
  chemically synthesized
acacaggaacagagaaaccaaa

SEQ ID NO: 95527 - DNA, 22 bp, Artificial Sequence
  chemically synthesized
tcactcataagtgggagttgaa

SEQ ID NO: 95528 - DNA, 22 bp, Artificial Sequence
  chemically synthesized
actcataagtgggagttgaaca

SEQ ID NO: 95529 - DNA, 22 bp, Artificial Sequence
  chemically synthesized
ataagtgggagttgaacaatga

SEQ ID NO: 95530 - DNA, 22 bp, Artificial Sequence
  chemically synthesized
aacaatgagaacacatggacac

SEQ ID NO: 95531 - DNA, 22 bp, Artificial Sequence
  chemically synthesized
tcggggggtgagggggttagga

SEQ ID NO: 95532 - DNA, 22 bp, Artificial Sequence
  chemically synthesized
ggagagggataacattaaaaga

SEQ ID NO: 95533 - DNA, 22 bp, Artificial Sequence
  chemically synthesized
aaagaaatacctaatgtagatg

SEQ ID NO: 95534 - DNA, 22 bp, Artificial Sequence
  chemically synthesized
atgtagatgacaggttgatggg

SEQ ID NO: 95535 - DNA, 22 bp, Artificial Sequence
  chemically synthesized
atgggtgcagcaaaccaccatg

SEQ ID NO: 95536 - DNA, 22 bp, Artificial Sequence
  chemically synthesized
tacctatgtaacaaacctgcac

SEQ ID NO: 95537 - DNA, 22 bp, Artificial Sequence
  chemically synthesized
tgtaacaaacctgcacattctg

SEQ ID NO: 95538 - DNA, 22 bp, Artificial Sequence
  chemically synthesized
cacattctgcacatgtatccca

SEQ ID NO: 95539 - DNA, 22 bp, Artificial Sequence
  chemically synthesized
tgcacatgtatcccagaactta

SEQ ID NO: 95540 - DNA, 22 bp, Artificial Sequence
  chemically synthesized
cacatgtatcccagaacttaaa

SEQ ID NO: 95541 - DNA, 22 bp, Artificial Sequence
  chemically synthesized
aaagtataataagaacaacaaa

SEQ ID NO: 95542 - DNA, 22 bp, Artificial Sequence
  chemically synthesized
aagtataataagaacaacaaaa

SEQ ID NO: 95543 - DNA, 22 bp, Artificial Sequence
  chemically synthesized
cttgaactgaccgacaatagtg

SEQ ID NO: 95544 - DNA, 22 bp, Artificial Sequence
  chemically synthesized
gaactgaccgacaatagtgaca

SEQ ID NO: 95545 - DNA, 22 bp, Artificial Sequence
  chemically synthesized
aactgaccgacaatagtgacac

SEQ ID NO: 95546 - DNA, 22 bp, Artificial Sequence
  chemically synthesized
accgacaatagtgacacaacct

SEQ ID NO: 95547 - DNA, 22 bp, Artificial Sequence
  chemically synthesized
tcaaaacctctaggatacagca

SEQ ID NO: 95548 - DNA, 22 bp, Artificial Sequence
  chemically synthesized
taggatacagcaaagatggtgc

SEQ ID NO: 95549 - DNA, 22 bp, Artificial Sequence
  chemically synthesized
ggatacagcaaagatggtgcta

SEQ ID NO: 95550 - DNA, 22 bp, Artificial Sequence
  chemically synthesized
aaaggaaagttcacagccctaa

SEQ ID NO: 95551 - DNA, 22 bp, Artificial Sequence
  chemically synthesized
acagccctaaatgtcgatgtca

SEQ ID NO: 95552 - DNA, 22 bp, Artificial Sequence
  chemically synthesized
aatgtcgatgtcaaagagtctg

SEQ ID NO: 95553 - DNA, 22 bp, Artificial Sequence
  chemically synthesized
aaagaggacagacagacaatat

SEQ ID NO: 95554 - DNA, 22 bp, Artificial Sequence
  chemically synthesized
gagaaacaaaaacaaacagaac

SEQ ID NO: 95555 - DNA, 22 bp, Artificial Sequence
  chemically synthesized
agataagaggagaactaaatga

SEQ ID NO: 95556 - DNA, 22 bp, Artificial Sequence
  chemically synthesized
aatgaaattaaaacaactgcaa

SEQ ID NO: 95557 - DNA, 22 bp, Artificial Sequence
  chemically synthesized
aaacaactgcaaaaaaatacaa

SEQ ID NO: 95558 - DNA, 22 bp, Artificial Sequence
  chemically synthesized
caaaaaaatacaaaagctaaat

SEQ ID NO: 95559 - DNA, 22 bp, Artificial Sequence
  chemically synthesized
aatgaaataaaaagctggttct

SEQ ID NO: 95560 - DNA, 22 bp, Artificial Sequence
  chemically synthesized
gttctttgaaaagataaataaa

SEQ ID NO: 95561 - DNA, 22 bp, Artificial Sequence
  chemically synthesized
tttgaaaagataaataaaactg

SEQ ID NO: 95562 - DNA, 22 bp, Artificial Sequence
  chemically synthesized
tgaaaagataaataaaactgat

SEQ ID NO: 95563 - DNA, 22 bp, Artificial Sequence
  chemically synthesized
gaaaagataaataaaactgata

SEQ ID NO: 95564 - DNA, 22 bp, Artificial Sequence
  chemically synthesized
aaaagataaataaaactgatag

SEQ ID NO: 95565 - DNA, 22 bp, Artificial Sequence
  chemically synthesized
atagaccattagcaagattaac

SEQ ID NO: 95566 - DNA, 22 bp, Artificial Sequence
  chemically synthesized
gcaagattaaccaagaaaagag

SEQ ID NO: 95567 - DNA, 22 bp, Artificial Sequence
  chemically synthesized
accaagaaaagaggagagaagt

SEQ ID NO: 95568 - DNA, 22 bp, Artificial Sequence
  chemically synthesized
aattagaaacaaaacaggagat

SEQ ID NO: 95569 - DNA, 22 bp, Artificial Sequence
  chemically synthesized
gaaacaaaacaggagatactat

SEQ ID NO: 95570 - DNA, 22 bp, Artificial Sequence
  chemically synthesized
ttactgataccacagaaataca

SEQ ID NO: 95571 - DNA, 22 bp, Artificial Sequence
  chemically synthesized
ctgataccacagaaatacaaaa

SEQ ID NO: 95572 - DNA, 22 bp, Artificial Sequence
  chemically synthesized
ataccacagaaatacaaaagat

SEQ ID NO: 95573 - DNA, 22 bp, Artificial Sequence
  chemically synthesized
ttcaaggctactatgaacacct

SEQ ID NO: 95574 - DNA, 22 bp, Artificial Sequence
  chemically synthesized
aaggctactatgaacaccttta

SEQ ID NO: 95575 - DNA, 22 bp, Artificial Sequence
  chemically synthesized
ctatgaacacctttacatgcat

SEQ ID NO: 95576 - DNA, 22 bp, Artificial Sequence
  chemically synthesized
tgaacacctttacatgcataaa

SEQ ID NO: 95577 - DNA, 22 bp, Artificial Sequence
  chemically synthesized
tacatgcataaactagaaaacc

SEQ ID NO: 95578 - DNA, 22 bp, Artificial Sequence
  chemically synthesized
acatgcataaactagaaaacct

SEQ ID NO: 95579 - DNA, 22 bp, Artificial Sequence
  chemically synthesized
catgcataaactagaaaaccta

SEQ ID NO: 95580 - DNA, 22 bp, Artificial Sequence
  chemically synthesized
gaaaacctaaaggagacgttcg

SEQ ID NO: 95581 - DNA, 22 bp, Artificial Sequence
  chemically synthesized
aaggagacgttcgaattcctgg

SEQ ID NO: 95582 - DNA, 22 bp, Artificial Sequence
  chemically synthesized
gaattcctggaaagatacaggg

SEQ ID NO: 95583 - DNA, 22 bp, Artificial Sequence
  chemically synthesized
ctggaaagatacagggctctag

SEQ ID NO: 95584 - DNA, 22 bp, Artificial Sequence
  chemically synthesized
gaaagatacagggctctagctt

SEQ ID NO: 95585 - DNA, 22 bp, Artificial Sequence
  chemically synthesized
tagcttaagtcaggaagaatta

SEQ ID NO: 95586 - DNA, 22 bp, Artificial Sequence
  chemically synthesized
gcttaagtcaggaagaattaga

SEQ ID NO: 95587 - DNA, 22 bp, Artificial Sequence
  chemically synthesized
aagtcaggaagaattagatacc

SEQ ID NO: 95588 - DNA, 22 bp, Artificial Sequence
  chemically synthesized
agtcaggaagaattagataccc

SEQ ID NO: 95589 - DNA, 22 bp, Artificial Sequence
  chemically synthesized
gataccctgaacagaccagtaa

SEQ ID NO: 95590 - DNA, 22 bp, Artificial Sequence
  chemically synthesized
aacagaccagtaataagcagca

SEQ ID NO: 95591 - DNA, 22 bp, Artificial Sequence
  chemically synthesized
aaatgataataaaaatttacca

SEQ ID NO: 95592 - DNA, 22 bp, Artificial Sequence
  chemically synthesized
accaacaacaaaaaagtccagg

SEQ ID NO: 95593 - DNA, 22 bp, Artificial Sequence
  chemically synthesized
ccaacaacaaaaaagtccagga

SEQ ID NO: 95594 - DNA, 22 bp, Artificial Sequence
  chemically synthesized
acagctgaattctaccagacat

SEQ ID NO: 95595 - DNA, 22 bp, Artificial Sequence
  chemically synthesized
aattctaccagacattcaaaga

SEQ ID NO: 95596 - DNA, 22 bp, Artificial Sequence
  chemically synthesized
taccagacattcaaagaagaat

SEQ ID NO: 95597 - DNA, 22 bp, Artificial Sequence
  chemically synthesized
ccagacattcaaagaagaattg

SEQ ID NO: 95598 - DNA, 22 bp, Artificial Sequence
  chemically synthesized
aaagaagaattgataccaatcc

SEQ ID NO: 95599 - DNA, 22 bp, Artificial Sequence
  chemically synthesized
ataccaatcctattgacagtat

SEQ ID NO: 95600 - DNA, 22 bp, Artificial Sequence
  chemically synthesized
ttgacagtattctacaagatag

SEQ ID NO: 95601 - DNA, 22 bp, Artificial Sequence
  chemically synthesized
acagtattctacaagatagaga

SEQ ID NO: 95602 - DNA, 22 bp, Artificial Sequence
  chemically synthesized
tacaagatagagaaagagagaa

SEQ ID NO: 95603 - DNA, 22 bp, Artificial Sequence
  chemically synthesized
caagatagagaaagagagaatc

SEQ ID NO: 95604 - DNA, 22 bp, Artificial Sequence
  chemically synthesized
cctaaatcattctatgaagcca

SEQ ID NO: 95605 - DNA, 22 bp, Artificial Sequence
  chemically synthesized
aatcattctatgaagccagtat

SEQ ID NO: 95606 - DNA, 22 bp, Artificial Sequence
  chemically synthesized
tatgaagccagtatcaccttaa

SEQ ID NO: 95607 - DNA, 22 bp, Artificial Sequence
  chemically synthesized
tgaagccagtatcaccttaata

SEQ ID NO: 95608 - DNA, 22 bp, Artificial Sequence
  chemically synthesized
aataccaaaactgggaaagaac

SEQ ID NO: 95609 - DNA, 22 bp, Artificial Sequence
  chemically synthesized
ataccaaaactgggaaagaaca

SEQ ID NO: 95610 - DNA, 22 bp, Artificial Sequence
  chemically synthesized
ggaaagaacataaccaaaaaaa

SEQ ID NO: 95611 - DNA, 22 bp, Artificial Sequence
  chemically synthesized
cagatcaatatccctgatgaac

SEQ ID NO: 95612 - DNA, 22 bp, Artificial Sequence
  chemically synthesized
atgaacatagatgccaacatcc

SEQ ID NO: 95613 - DNA, 22 bp, Artificial Sequence
  chemically synthesized
gacaaaatactagctaatagca

SEQ ID NO: 95614 - DNA, 22 bp, Artificial Sequence
  chemically synthesized
acaaaatactagctaatagcat

SEQ ID NO: 95615 - DNA, 22 bp, Artificial Sequence
  chemically synthesized
gctaatagcatccgacagcata

SEQ ID NO: 95616 - DNA, 22 bp, Artificial Sequence
  chemically synthesized
atagcatccgacagcatatcaa

SEQ ID NO: 95617 - DNA, 22 bp, Artificial Sequence
  chemically synthesized
catgcgagggatgcacggatgg

SEQ ID NO: 95618 - DNA, 22 bp, Artificial Sequence
  chemically synthesized
atgcgagggatgcacggatggt

SEQ ID NO: 95619 - DNA, 22 bp, Artificial Sequence
  chemically synthesized
aacatacgcaagtcaataagtg

SEQ ID NO: 95620 - DNA, 22 bp, Artificial Sequence
  chemically synthesized
acatacgcaagtcaataagtgt

SEQ ID NO: 95621 - DNA, 22 bp, Artificial Sequence
  chemically synthesized
gaaacaaaaatcatgtgattat

SEQ ID NO: 95622 - DNA, 22 bp, Artificial Sequence
  chemically synthesized
tctcaatagccacagaaactgc

SEQ ID NO: 95623 - DNA, 22 bp, Artificial Sequence
  chemically synthesized
aatagccacagaaactgcattc

SEQ ID NO: 95624 - DNA, 22 bp, Artificial Sequence
  chemically synthesized
cattcaacaaaattcaacatca

SEQ ID NO: 95625 - DNA, 22 bp, Artificial Sequence
  chemically synthesized
aacaaaattcaacatcacttta

SEQ ID NO: 95626 - DNA, 22 bp, Artificial Sequence
  chemically synthesized
aacatcactttatgactaaaac

SEQ ID NO: 95627 - DNA, 22 bp, Artificial Sequence
  chemically synthesized
tatgactaaaactcagcaaaat

SEQ ID NO: 95628 - DNA, 22 bp, Artificial Sequence
  chemically synthesized
atgactaaaactcagcaaaatc

SEQ ID NO: 95629 - DNA, 22 bp, Artificial Sequence
  chemically synthesized
tgactaaaactcagcaaaatcg

SEQ ID NO: 95630 - DNA, 22 bp, Artificial Sequence
  chemically synthesized
aaactcagcaaaatcggtttac

SEQ ID NO: 95631 - DNA, 22 bp, Artificial Sequence
  chemically synthesized
agcaaaatcggtttacaaagga

SEQ ID NO: 95632 - DNA, 22 bp, Artificial Sequence
  chemically synthesized
acaaaggacatacctcaatgta

SEQ ID NO: 95633 - DNA, 22 bp, Artificial Sequence
  chemically synthesized
caaaggacatacctcaatgtaa

SEQ ID NO: 95634 - DNA, 22 bp, Artificial Sequence
  chemically synthesized
aatgtaataaaagccagctatg

SEQ ID NO: 95635 - DNA, 22 bp, Artificial Sequence
  chemically synthesized
tggtaaacacacagccaacatt

SEQ ID NO: 95636 - DNA, 22 bp, Artificial Sequence
  chemically synthesized
tattgaatgggaaaaagttaaa

SEQ ID NO: 95637 - DNA, 22 bp, Artificial Sequence
  chemically synthesized
aatgggaaaaagttaaaagcat

SEQ ID NO: 95638 - DNA, 22 bp, Artificial Sequence
  chemically synthesized
aaagcattctgtctgaaaactg

SEQ ID NO: 95639 - DNA, 22 bp, Artificial Sequence
  chemically synthesized
tgtctgaaaactggaatgagac

SEQ ID NO: 95640 - DNA, 22 bp, Artificial Sequence
  chemically synthesized
tctgaaaactggaatgagacaa

SEQ ID NO: 95641 - DNA, 22 bp, Artificial Sequence
  chemically synthesized
aaaactggaatgagacaaggat

SEQ ID NO: 95642 - DNA, 22 bp, Artificial Sequence
  chemically synthesized
gaatgagacaaggatacccact

SEQ ID NO: 95643 - DNA, 22 bp, Artificial Sequence
  chemically synthesized
tcaccacttctctttaacatat

SEQ ID NO: 95644 - DNA, 22 bp, Artificial Sequence
  chemically synthesized
accacttctctttaacatatta

SEQ ID NO: 95645 - DNA, 22 bp, Artificial Sequence
  chemically synthesized
ctctttaacatattactggaag

SEQ ID NO: 95646 - DNA, 22 bp, Artificial Sequence
  chemically synthesized
tctttaacatattactggaagt

SEQ ID NO: 95647 - DNA, 22 bp, Artificial Sequence
  chemically synthesized
tttaacatattactggaagtcc

SEQ ID NO: 95648 - DNA, 22 bp, Artificial Sequence
  chemically synthesized
taacatattactggaagtccta

SEQ ID NO: 95649 - DNA, 22 bp, Artificial Sequence
  chemically synthesized
aacatattactggaagtcctag

SEQ ID NO: 95650 - DNA, 22 bp, Artificial Sequence
  chemically synthesized
acatattactggaagtcctagc

SEQ ID NO: 95651 - DNA, 22 bp, Artificial Sequence
  chemically synthesized
ctggaagtcctagcaagagcaa

SEQ ID NO: 95652 - DNA, 22 bp, Artificial Sequence
  chemically synthesized
gaagtcctagcaagagcaatca

SEQ ID NO: 95653 - DNA, 22 bp, Artificial Sequence
  chemically synthesized
gcaagagcaatcagacaagaga

SEQ ID NO: 95654 - DNA, 22 bp, Artificial Sequence
  chemically synthesized
ttaaagagaaagtcaaactgtc

SEQ ID NO: 95655 - DNA, 22 bp, Artificial Sequence
  chemically synthesized
aagagaaagtcaaactgtcact

SEQ ID NO: 95656 - DNA, 22 bp, Artificial Sequence
  chemically synthesized
tcactgtttgctgatgatatga

SEQ ID NO: 95657 - DNA, 22 bp, Artificial Sequence
  chemically synthesized
tttgctgatgatatgattgtgt

SEQ ID NO: 95658 - DNA, 22 bp, Artificial Sequence
  chemically synthesized
gctgatgatatgattgtgtatg

SEQ ID NO: 95659 - DNA, 22 bp, Artificial Sequence
  chemically synthesized
ctgatgatatgattgtgtatgt

SEQ ID NO: 95660 - DNA, 22 bp, Artificial Sequence
  chemically synthesized
atgatatgattgtgtatgtaga

SEQ ID NO: 95661 - DNA, 22 bp, Artificial Sequence
  chemically synthesized
tgtatgtagaaaactctaaaga

SEQ ID NO: 95662 - DNA, 22 bp, Artificial Sequence
  chemically synthesized
taaagactcctccaaaaccccc

SEQ ID NO: 95663 - DNA, 22 bp, Artificial Sequence
  chemically synthesized
aagactcctccaaaacccccta

SEQ ID NO: 95664 - DNA, 22 bp, Artificial Sequence
  chemically synthesized
ctccaaaaccccctagaactga

SEQ ID NO: 95665 - DNA, 22 bp, Artificial Sequence
  chemically synthesized
caaaaccccctagaactgataa

SEQ ID NO: 95666 - DNA, 22 bp, Artificial Sequence
  chemically synthesized
gaactgataaaataattcagca

SEQ ID NO: 95667 - DNA, 22 bp, Artificial Sequence
  chemically synthesized
ataaaataattcagcaaagttt

SEQ ID NO: 95668 - DNA, 22 bp, Artificial Sequence
  chemically synthesized
agcaaagtttctggatacaaaa

SEQ ID NO: 95669 - DNA, 22 bp, Artificial Sequence
  chemically synthesized
ctggatacaaaattaacgtaca

SEQ ID NO: 95670 - DNA, 22 bp, Artificial Sequence
  chemically synthesized
tggatacaaaattaacgtacac

SEQ ID NO: 95671 - DNA, 22 bp, Artificial Sequence
  chemically synthesized
gatacaaaattaacgtacacca

SEQ ID NO: 95672 - DNA, 22 bp, Artificial Sequence
  chemically synthesized
acgtacaccaatgagttgcttt

SEQ ID NO: 95673 - DNA, 22 bp, Artificial Sequence
  chemically synthesized
ctttcttacataccagcaatga

SEQ ID NO: 95674 - DNA, 22 bp, Artificial Sequence
  chemically synthesized
tcttacataccagcaatgacca

SEQ ID NO: 95675 - DNA, 22 bp, Artificial Sequence
  chemically synthesized
cttacataccagcaatgaccaa

SEQ ID NO: 95676 - DNA, 22 bp, Artificial Sequence
  chemically synthesized
ttacataccagcaatgaccaag

SEQ ID NO: 95677 - DNA, 22 bp, Artificial Sequence
  chemically synthesized
acataccagcaatgaccaagct

SEQ ID NO: 95678 - DNA, 22 bp, Artificial Sequence
  chemically synthesized
cataccagcaatgaccaagctg

SEQ ID NO: 95679 - DNA, 22 bp, Artificial Sequence
  chemically synthesized
agaataaaatcaagaactcaac

SEQ ID NO: 95680 - DNA, 22 bp, Artificial Sequence
  chemically synthesized
aaccccttttacaatagctgca

SEQ ID NO: 95681 - DNA, 22 bp, Artificial Sequence
  chemically synthesized
ttacaatagctgcaaaaaacaa

SEQ ID NO: 95682 - DNA, 22 bp, Artificial Sequence
  chemically synthesized
tacaatagctgcaaaaaacaaa

SEQ ID NO: 95683 - DNA, 22 bp, Artificial Sequence
  chemically synthesized
acaatagctgcaaaaaacaaaa

SEQ ID NO: 95684 - DNA, 22 bp, Artificial Sequence
  chemically synthesized
caatagctgcaaaaaacaaaac

SEQ ID NO: 95685 - DNA, 22 bp, Artificial Sequence
  chemically synthesized
caaaaaacaaaacaaaacaaaa

SEQ ID NO: 95686 - DNA, 22 bp, Artificial Sequence
  chemically synthesized
aggaatatatacctaaccaagg

SEQ ID NO: 95687 - DNA, 22 bp, Artificial Sequence
  chemically synthesized
ggaatatatacctaaccaagga

SEQ ID NO: 95688 - DNA, 22 bp, Artificial Sequence
  chemically synthesized
accaaggaggtgaaagacatct

SEQ ID NO: 95689 - DNA, 22 bp, Artificial Sequence
  chemically synthesized
caaggaaaactacaaaacacgg

SEQ ID NO: 95690 - DNA, 22 bp, Artificial Sequence
  chemically synthesized
caaaacacggctgaaagtaatc

SEQ ID NO: 95691 - DNA, 22 bp, Artificial Sequence
  chemically synthesized
aaagtaatcatataagacacaa

SEQ ID NO: 95692 - DNA, 22 bp, Artificial Sequence
  chemically synthesized
tcatagatgggtagaatcaata

SEQ ID NO: 95693 - DNA, 22 bp, Artificial Sequence
  chemically synthesized
atagatgggtagaatcaatatt

SEQ ID NO: 95694 - DNA, 22 bp, Artificial Sequence
  chemically synthesized
tgaaaatggccataatgccaga

SEQ ID NO: 95695 - DNA, 22 bp, Artificial Sequence
  chemically synthesized
caaattcattgcaattcccatc

SEQ ID NO: 95696 - DNA, 22 bp, Artificial Sequence
  chemically synthesized
attgcaattcccatcaaaatac

SEQ ID NO: 95697 - DNA, 22 bp, Artificial Sequence
  chemically synthesized
caattcccatcaaaataccacc

SEQ ID NO: 95698 - DNA, 22 bp, Artificial Sequence
  chemically synthesized
ccatcaaaataccaccattagt

SEQ ID NO: 95699 - DNA, 22 bp, Artificial Sequence
  chemically synthesized
gtcttcacagaactagaaaaaa

SEQ ID NO: 95700 - DNA, 22 bp, Artificial Sequence
  chemically synthesized
cacagaactagaaaaaacaatc

SEQ ID NO: 95701 - DNA, 22 bp, Artificial Sequence
  chemically synthesized
acagaactagaaaaaacaatcc

SEQ ID NO: 95702 - DNA, 22 bp, Artificial Sequence
  chemically synthesized
gaaaaaacaatcctaaaattct

SEQ ID NO: 95703 - DNA, 22 bp, Artificial Sequence
  chemically synthesized
aaattcttatggaaccaaaaaa

SEQ ID NO: 95704 - DNA, 22 bp, Artificial Sequence
  chemically synthesized
ttatggaaccaaaaaagagccc

SEQ ID NO: 95705 - DNA, 22 bp, Artificial Sequence
  chemically synthesized
atggaaccaaaaaagagcccaa

SEQ ID NO: 95706 - DNA, 22 bp, Artificial Sequence
  chemically synthesized
tggaaccaaaaaagagcccaat

SEQ ID NO: 95707 - DNA, 22 bp, Artificial Sequence
  chemically synthesized
aaaaaaagaacaaatctgaagg

SEQ ID NO: 95708 - DNA, 22 bp, Artificial Sequence
  chemically synthesized
aaggcattacattacctcattt

SEQ ID NO: 95709 - DNA, 22 bp, Artificial Sequence
  chemically synthesized
cattacctcatttcaaactata

SEQ ID NO: 95710 - DNA, 22 bp, Artificial Sequence
  chemically synthesized
cctcatttcaaactatacaata

SEQ ID NO: 95711 - DNA, 22 bp, Artificial Sequence
  chemically synthesized
atttcaaactatacaataaggc

SEQ ID NO: 95712 - DNA, 22 bp, Artificial Sequence
  chemically synthesized
caaactatacaataaggccata

SEQ ID NO: 95713 - DNA, 22 bp, Artificial Sequence
  chemically synthesized
aaactatacaataaggccatag

SEQ ID NO: 95714 - DNA, 22 bp, Artificial Sequence
  chemically synthesized
tacaataaggccatagtcacca

SEQ ID NO: 95715 - DNA, 22 bp, Artificial Sequence
  chemically synthesized
gtgtacaaataggcacatcgac

SEQ ID NO: 95716 - DNA, 22 bp, Artificial Sequence
  chemically synthesized
aaatacttacatccaactgatc

SEQ ID NO: 95717 - DNA, 22 bp, Artificial Sequence
  chemically synthesized
acatccaactgatctttgacaa

SEQ ID NO: 95718 - DNA, 22 bp, Artificial Sequence
  chemically synthesized
catccaactgatctttgacaaa

SEQ ID NO: 95719 - DNA, 22 bp, Artificial Sequence
  chemically synthesized
atctttgacaaagcaaacaaaa

SEQ ID NO: 95720 - DNA, 22 bp, Artificial Sequence
  chemically synthesized
tgacaaagcaaacaaaaacata

SEQ ID NO: 95721 - DNA, 22 bp, Artificial Sequence
  chemically synthesized
gacaaagcaaacaaaaacataa

SEQ ID NO: 95722 - DNA, 22 bp, Artificial Sequence
  chemically synthesized
acaaagcaaacaaaaacataaa

SEQ ID NO: 95723 - DNA, 22 bp, Artificial Sequence
  chemically synthesized
ttcaacaaatggtgcggggata

SEQ ID NO: 95724 - DNA, 22 bp, Artificial Sequence
  chemically synthesized
aacaaatggtgcggggatagct

SEQ ID NO: 95725 - DNA, 22 bp, Artificial Sequence
  chemically synthesized
gcaagctacatgtaggagaatg

SEQ ID NO: 95726 - DNA, 22 bp, Artificial Sequence
  chemically synthesized
catgtaggagaatgaaactgga

SEQ ID NO: 95727 - DNA, 22 bp, Artificial Sequence
  chemically synthesized
gatcttcatctctcaccttata

SEQ ID NO: 95728 - DNA, 22 bp, Artificial Sequence
  chemically synthesized
catctctcaccttatacaaaaa

SEQ ID NO: 95729 - DNA, 22 bp, Artificial Sequence
  chemically synthesized
atctctcaccttatacaaaaat

SEQ ID NO: 95730 - DNA, 22 bp, Artificial Sequence
  chemically synthesized
tcaccttatacaaaaatcaact

SEQ ID NO: 95731 - DNA, 22 bp, Artificial Sequence
  chemically synthesized
accttatacaaaaatcaactca

SEQ ID NO: 95732 - DNA, 22 bp, Artificial Sequence
  chemically synthesized
atacaaaaatcaactcaagatg

SEQ ID NO: 95733 - DNA, 22 bp, Artificial Sequence
  chemically synthesized
tacaaaaatcaactcaagatgg

SEQ ID NO: 95734 - DNA, 22 bp, Artificial Sequence
  chemically synthesized
aagatggatcaaggacttaaat

SEQ ID NO: 95735 - DNA, 22 bp, Artificial Sequence
  chemically synthesized
aaatctaagccctgaaactgta

SEQ ID NO: 95736 - DNA, 22 bp, Artificial Sequence
  chemically synthesized
aatctaagccctgaaactgtaa

SEQ ID NO: 95737 - DNA, 22 bp, Artificial Sequence
  chemically synthesized
agccctgaaactgtaacaattc

SEQ ID NO: 95738 - DNA, 22 bp, Artificial Sequence
  chemically synthesized
aaactgtaacaattctagaaaa

SEQ ID NO: 95739 - DNA, 22 bp, Artificial Sequence
  chemically synthesized
taacaattctagaaaataacat

SEQ ID NO: 95740 - DNA, 22 bp, Artificial Sequence
  chemically synthesized
tagaaaataacatcggaaaaac

SEQ ID NO: 95741 - DNA, 22 bp, Artificial Sequence
  chemically synthesized
gaaaataacatcggaaaaaccc

SEQ ID NO: 95742 - DNA, 22 bp, Artificial Sequence
  chemically synthesized
ctacacattggcttaggaaagg

SEQ ID NO: 95743 - DNA, 22 bp, Artificial Sequence
  chemically synthesized
tacacattggcttaggaaagga

SEQ ID NO: 95744 - DNA, 22 bp, Artificial Sequence
  chemically synthesized
cacattggcttaggaaaggatt

SEQ ID NO: 95745 - DNA, 22 bp, Artificial Sequence
  chemically synthesized
gcttaggaaaggatttcatgac

SEQ ID NO: 95746 - DNA, 22 bp, Artificial Sequence
  chemically synthesized
aggaaaggatttcatgaccaag

SEQ ID NO: 95747 - DNA, 22 bp, Artificial Sequence
  chemically synthesized
ggaaaggatttcatgaccaaga

SEQ ID NO: 95748 - DNA, 22 bp, Artificial Sequence
  chemically synthesized
catgaccaagaacacaaatgca

SEQ ID NO: 95749 - DNA, 22 bp, Artificial Sequence
  chemically synthesized
atgaccaagaacacaaatgcaa

SEQ ID NO: 95750 - DNA, 22 bp, Artificial Sequence
  chemically synthesized
ggactaaattaaactaaagagc

SEQ ID NO: 95751 - DNA, 22 bp, Artificial Sequence
  chemically synthesized
aattaaactaaagagcttttgc

SEQ ID NO: 95752 - DNA, 22 bp, Artificial Sequence
  chemically synthesized
aactaaagagcttttgcatggc

SEQ ID NO: 95753 - DNA, 22 bp, Artificial Sequence
  chemically synthesized
aagagcttttgcatggcaaaag

SEQ ID NO: 95754 - DNA, 22 bp, Artificial Sequence
  chemically synthesized
ttgcatggcaaaaggaagagtc

SEQ ID NO: 95755 - DNA, 22 bp, Artificial Sequence
  chemically synthesized
tgcatggcaaaaggaagagtct

SEQ ID NO: 95756 - DNA, 22 bp, Artificial Sequence
  chemically synthesized
gcatggcaaaaggaagagtctg

SEQ ID NO: 95757 - DNA, 22 bp, Artificial Sequence
  chemically synthesized
catggcaaaaggaagagtctgc

SEQ ID NO: 95758 - DNA, 22 bp, Artificial Sequence
  chemically synthesized
cagaataaacagacaacccaca

SEQ ID NO: 95759 - DNA, 22 bp, Artificial Sequence
  chemically synthesized
cacaatctatacatctgacaaa

SEQ ID NO: 95760 - DNA, 22 bp, Artificial Sequence
  chemically synthesized
acaatctatacatctgacaaaa

SEQ ID NO: 95761 - DNA, 22 bp, Artificial Sequence
  chemically synthesized
tacatctgacaaaagaataata

SEQ ID NO: 95762 - DNA, 22 bp, Artificial Sequence
  chemically synthesized
acaaaagaataatatccaggct

SEQ ID NO: 95763 - DNA, 22 bp, Artificial Sequence
  chemically synthesized
taaaatgaacacaaatagatta

SEQ ID NO: 95764 - DNA, 22 bp, Artificial Sequence
  chemically synthesized
aaatgaacacaaatagattatc

SEQ ID NO: 95765 - DNA, 22 bp, Artificial Sequence
  chemically synthesized
tcaagaaaataacaaacaatcc

SEQ ID NO: 95766 - DNA, 22 bp, Artificial Sequence
  chemically synthesized
aggacatgaacagacaattctc

SEQ ID NO: 95767 - DNA, 22 bp, Artificial Sequence
  chemically synthesized
tcagaaaaagatatacaaatga

SEQ ID NO: 95768 - DNA, 22 bp, Artificial Sequence
  chemically synthesized
agaaaaagatatacaaatgacc

SEQ ID NO: 95769 - DNA, 22 bp, Artificial Sequence
  chemically synthesized
tcaacatcactaatgatcaggg

SEQ ID NO: 95770 - DNA, 22 bp, Artificial Sequence
  chemically synthesized
aacatcactaatgatcagggaa

SEQ ID NO: 95771 - DNA, 22 bp, Artificial Sequence
  chemically synthesized
atgatcagggaaatgcaaatca

SEQ ID NO: 95772 - DNA, 22 bp, Artificial Sequence
  chemically synthesized
caatgagatatctacttactct

SEQ ID NO: 95773 - DNA, 22 bp, Artificial Sequence
  chemically synthesized
cttactctagttaaaacggcta

SEQ ID NO: 95774 - DNA, 22 bp, Artificial Sequence
  chemically synthesized
actctagttaaaacggctatta

SEQ ID NO: 95775 - DNA, 22 bp, Artificial Sequence
  chemically synthesized
ctctagttaaaacggctattaa

SEQ ID NO: 95776 - DNA, 22 bp, Artificial Sequence
  chemically synthesized
tagttaaaacggctattaacaa

SEQ ID NO: 95777 - DNA, 22 bp, Artificial Sequence
  chemically synthesized
gttaaaacggctattaacaaaa

SEQ ID NO: 95778 - DNA, 22 bp, Artificial Sequence
  chemically synthesized
aaacggctattaacaaaaaaga

SEQ ID NO: 95779 - DNA, 22 bp, Artificial Sequence
  chemically synthesized
ttaacaaaaaagacaaaaaata

SEQ ID NO: 95780 - DNA, 22 bp, Artificial Sequence
  chemically synthesized
acaaaaaagacaaaaaataaca

SEQ ID NO: 95781 - DNA, 22 bp, Artificial Sequence
  chemically synthesized
gtgaggatatggagaaaaggga

SEQ ID NO: 95782 - DNA, 22 bp, Artificial Sequence
  chemically synthesized
tgaggatatggagaaaagggaa

SEQ ID NO: 95783 - DNA, 22 bp, Artificial Sequence
  chemically synthesized
tttcttacacactgttggtggg

SEQ ID NO: 95784 - DNA, 22 bp, Artificial Sequence
  chemically synthesized
tcttacacactgttggtgggaa

SEQ ID NO: 95785 - DNA, 22 bp, Artificial Sequence
  chemically synthesized
cttacacactgttggtgggaat

SEQ ID NO: 95786 - DNA, 22 bp, Artificial Sequence
  chemically synthesized
ttacacactgttggtgggaatg

SEQ ID NO: 95787 - DNA, 22 bp, Artificial Sequence
  chemically synthesized
acacactgttggtgggaatgta

SEQ ID NO: 95788 - DNA, 22 bp, Artificial Sequence
  chemically synthesized
cacactgttggtgggaatgtaa

SEQ ID NO: 95789 - DNA, 22 bp, Artificial Sequence
  chemically synthesized
ttggtgggaatgtaaaatagta

SEQ ID NO: 95790 - DNA, 22 bp, Artificial Sequence
  chemically synthesized
gtgggaatgtaaaatagtacaa

SEQ ID NO: 95791 - DNA, 22 bp, Artificial Sequence
  chemically synthesized
tggaaaacagtatgaagatttc

SEQ ID NO: 95792 - DNA, 22 bp, Artificial Sequence
  chemically synthesized
ctcagtaaactaaaaacagaac

SEQ ID NO: 95793 - DNA, 22 bp, Artificial Sequence
  chemically synthesized
tcagtaaactaaaaacagaact

SEQ ID NO: 95794 - DNA, 22 bp, Artificial Sequence
  chemically synthesized
agtaaactaaaaacagaactat

SEQ ID NO: 95795 - DNA, 22 bp, Artificial Sequence
  chemically synthesized
aaaacagaactatcatacaatc

SEQ ID NO: 95796 - DNA, 22 bp, Artificial Sequence
  chemically synthesized
tcatacaatccagcaatctcac

SEQ ID NO: 95797 - DNA, 22 bp, Artificial Sequence
  chemically synthesized
actagtggttatttatccaaaa

SEQ ID NO: 95798 - DNA, 22 bp, Artificial Sequence
  chemically synthesized
gtggttatttatccaaaagaaa

SEQ ID NO: 95799 - DNA, 22 bp, Artificial Sequence
  chemically synthesized
tttatccaaaagaaaggaaatc

SEQ ID NO: 95800 - DNA, 22 bp, Artificial Sequence
  chemically synthesized
atccaaaagaaaggaaatcagt

SEQ ID NO: 95801 - DNA, 22 bp, Artificial Sequence
  chemically synthesized
tccaaaagaaaggaaatcagta

SEQ ID NO: 95802 - DNA, 22 bp, Artificial Sequence
  chemically synthesized
cactcatgtttattgaagcact

SEQ ID NO: 95803 - DNA, 22 bp, Artificial Sequence
  chemically synthesized
atgtttattgaagcactattca

SEQ ID NO: 95804 - DNA, 22 bp, Artificial Sequence
  chemically synthesized
attgaagcactattcacaatag

SEQ ID NO: 95805 - DNA, 22 bp, Artificial Sequence
  chemically synthesized
ttgaagcactattcacaatagt

SEQ ID NO: 95806 - DNA, 22 bp, Artificial Sequence
  chemically synthesized
aagcactattcacaatagttaa

SEQ ID NO: 95807 - DNA, 22 bp, Artificial Sequence
  chemically synthesized
ttcacaatagttaaggtttggg

SEQ ID NO: 95808 - DNA, 22 bp, Artificial Sequence
  chemically synthesized
acaatagttaaggtttgggatc

SEQ ID NO: 95809 - DNA, 22 bp, Artificial Sequence
  chemically synthesized
aggtttgggatcaacctaagtg

SEQ ID NO: 95810 - DNA, 22 bp, Artificial Sequence
  chemically synthesized
gggatcaacctaagtgtctatc

SEQ ID NO: 95811 - DNA, 22 bp, Artificial Sequence
  chemically synthesized
ggatcaacctaagtgtctatca

SEQ ID NO: 95812 - DNA, 22 bp, Artificial Sequence
  chemically synthesized
agtgtctatcaacagatgaacg

SEQ ID NO: 95813 - DNA, 22 bp, Artificial Sequence
  chemically synthesized
tcaacagatgaacggattaaaa

SEQ ID NO: 95814 - DNA, 22 bp, Artificial Sequence
  chemically synthesized
aaaaattgtatttttgcacagt

SEQ ID NO: 95815 - DNA, 22 bp, Artificial Sequence
  chemically synthesized
tatttttgcacagtactatttt

SEQ ID NO: 95816 - DNA, 22 bp, Artificial Sequence
  chemically synthesized
ttgcacagtactattttgccat

SEQ ID NO: 95817 - DNA, 22 bp, Artificial Sequence
  chemically synthesized
tgcacagtactattttgccatg

SEQ ID NO: 95818 - DNA, 22 bp, Artificial Sequence
  chemically synthesized
gcacagtactattttgccatga

SEQ ID NO: 95819 - DNA, 22 bp, Artificial Sequence
  chemically synthesized
cacagtactattttgccatgaa

SEQ ID NO: 95820 - DNA, 22 bp, Artificial Sequence
  chemically synthesized
ttttgccatgaaaaagaatgaa

SEQ ID NO: 95821 - DNA, 22 bp, Artificial Sequence
  chemically synthesized
tgccatgaaaaagaatgaaatc

SEQ ID NO: 95822 - DNA, 22 bp, Artificial Sequence
  chemically synthesized
gccatgaaaaagaatgaaatct

SEQ ID NO: 95823 - DNA, 22 bp, Artificial Sequence
  chemically synthesized
ccatgaaaaagaatgaaatctt

SEQ ID NO: 95824 - DNA, 22 bp, Artificial Sequence
  chemically synthesized
gtcatttgtagcaacatggatg

SEQ ID NO: 95825 - DNA, 22 bp, Artificial Sequence
  chemically synthesized
tcatttgtagcaacatggatgg

SEQ ID NO: 95826 - DNA, 22 bp, Artificial Sequence
  chemically synthesized
gtagcaacatggatggaaccag

SEQ ID NO: 95827 - DNA, 22 bp, Artificial Sequence
  chemically synthesized
tagcaacatggatggaaccaga

SEQ ID NO: 95828 - DNA, 22 bp, Artificial Sequence
  chemically synthesized
tgttaattgaaagccctgaagc

SEQ ID NO: 95829 - DNA, 22 bp, Artificial Sequence
  chemically synthesized
attgaaagccctgaagcagaac

SEQ ID NO: 95830 - DNA, 22 bp, Artificial Sequence
  chemically synthesized
aaagccctgaagcagaacaaaa

SEQ ID NO: 95831 - DNA, 22 bp, Artificial Sequence
  chemically synthesized
aagcagaacaaaaacaaactct

SEQ ID NO: 95832 - DNA, 22 bp, Artificial Sequence
  chemically synthesized
ttggtatgccaaagagatagat

SEQ ID NO: 95833 - DNA, 22 bp, Artificial Sequence
  chemically synthesized
ggtatgccaaagagatagataa

SEQ ID NO: 95834 - DNA, 22 bp, Artificial Sequence
  chemically synthesized
gtatgccaaagagatagataat

SEQ ID NO: 95835 - DNA, 22 bp, Artificial Sequence
  chemically synthesized
ttattcatctgtgggagctaaa

SEQ ID NO: 95836 - DNA, 22 bp, Artificial Sequence
  chemically synthesized
tattcatctgtgggagctaaaa

SEQ ID NO: 95837 - DNA, 22 bp, Artificial Sequence
  chemically synthesized
attcatctgtgggagctaaaaa

SEQ ID NO: 95838 - DNA, 22 bp, Artificial Sequence
  chemically synthesized
ttcatctgtgggagctaaaaaa

SEQ ID NO: 95839 - DNA, 22 bp, Artificial Sequence
  chemically synthesized
atctgtgggagctaaaaaagtg

SEQ ID NO: 95840 - DNA, 22 bp, Artificial Sequence
  chemically synthesized
tgggagctaaaaaagtgggtct

SEQ ID NO: 95841 - DNA, 22 bp, Artificial Sequence
  chemically synthesized
aaaaagtgggtctcatggtggt

SEQ ID NO: 95842 - DNA, 22 bp, Artificial Sequence
  chemically synthesized
atggtggtagagagtagaatga

SEQ ID NO: 95843 - DNA, 22 bp, Artificial Sequence
  chemically synthesized
tcagaggctggaaaaagtgtga

SEQ ID NO: 95844 - DNA, 22 bp, Artificial Sequence
  chemically synthesized
gaaaaagtgtgagtgtgtatgg

SEQ ID NO: 95845 - DNA, 22 bp, Artificial Sequence
  chemically synthesized
aagagatgttggttaataggta

SEQ ID NO: 95846 - DNA, 22 bp, Artificial Sequence
  chemically synthesized
agagatgttggttaataggtac

SEQ ID NO: 95847 - DNA, 22 bp, Artificial Sequence
  chemically synthesized
gttaataggtacaaacacagtt

SEQ ID NO: 95848 - DNA, 22 bp, Artificial Sequence
  chemically synthesized
ataggtacaaacacagttggat

SEQ ID NO: 95849 - DNA, 22 bp, Artificial Sequence
  chemically synthesized
gatagaaggattaagccataat

SEQ ID NO: 95850 - DNA, 22 bp, Artificial Sequence
  chemically synthesized
agccataatgtttgatatttga

SEQ ID NO: 95851 - DNA, 22 bp, Artificial Sequence
  chemically synthesized
gatatttgagtagggtgactat

SEQ ID NO: 95852 - DNA, 22 bp, Artificial Sequence
  chemically synthesized
atatttgagtagggtgactata

SEQ ID NO: 95853 - DNA, 22 bp, Artificial Sequence
  chemically synthesized
gagtagggtgactatagttaat

SEQ ID NO: 95854 - DNA, 22 bp, Artificial Sequence
  chemically synthesized
agtagggtgactatagttaatt

SEQ ID NO: 95855 - DNA, 22 bp, Artificial Sequence
  chemically synthesized
tagttaattactatttattata

SEQ ID NO: 95856 - DNA, 22 bp, Artificial Sequence
  chemically synthesized
attactatttattatatatttc

SEQ ID NO: 95857 - DNA, 22 bp, Artificial Sequence
  chemically synthesized
ctatttattatatatttcaaaa

SEQ ID NO: 95858 - DNA, 22 bp, Artificial Sequence
  chemically synthesized
tttattatatatttcaaaatgg

SEQ ID NO: 95859 - DNA, 22 bp, Artificial Sequence
  chemically synthesized
attatatatttcaaaatggcta

SEQ ID NO: 95860 - DNA, 22 bp, Artificial Sequence
  chemically synthesized
ttatatatttcaaaatggctag

SEQ ID NO: 95861 - DNA, 22 bp, Artificial Sequence
  chemically synthesized
tatatttcaaaatggctagaaa

SEQ ID NO: 95862 - DNA, 22 bp, Artificial Sequence
  chemically synthesized
caaaatggctagaaatgaggat

SEQ ID NO: 95863 - DNA, 22 bp, Artificial Sequence
  chemically synthesized
aaaatggctagaaatgaggatt

SEQ ID NO: 95864 - DNA, 22 bp, Artificial Sequence
  chemically synthesized
gaaatgaggatttgaaattttc

SEQ ID NO: 95865 - DNA, 22 bp, Artificial Sequence
  chemically synthesized
gaaattttctcaatacatagaa

SEQ ID NO: 95866 - DNA, 22 bp, Artificial Sequence
  chemically synthesized
aaattttctcaatacatagaaa

SEQ ID NO: 95867 - DNA, 22 bp, Artificial Sequence
  chemically synthesized
tctcaatacatagaaatgataa

SEQ ID NO: 95868 - DNA, 22 bp, Artificial Sequence
  chemically synthesized
ctcaatacatagaaatgataaa

SEQ ID NO: 95869 - DNA, 22 bp, Artificial Sequence
  chemically synthesized
tcaatacatagaaatgataaat

SEQ ID NO: 95870 - DNA, 22 bp, Artificial Sequence
  chemically synthesized
aatacatagaaatgataaatgc

SEQ ID NO: 95871 - DNA, 22 bp, Artificial Sequence
  chemically synthesized
aaagcaatggatatcctaaata

SEQ ID NO: 95872 - DNA, 22 bp, Artificial Sequence
  chemically synthesized
aatatctagacttaatcatcac

SEQ ID NO: 95873 - DNA, 22 bp, Artificial Sequence
  chemically synthesized
gacttaatcatcacatgttcta

SEQ ID NO: 95874 - DNA, 22 bp, Artificial Sequence
  chemically synthesized
aatcatcacatgttctaggcat

SEQ ID NO: 95875 - DNA, 22 bp, Artificial Sequence
  chemically synthesized
atcatcacatgttctaggcatg

SEQ ID NO: 95876 - DNA, 22 bp, Artificial Sequence
  chemically synthesized
taggcatgtaagtatcacatgt

SEQ ID NO: 95877 - DNA, 22 bp, Artificial Sequence
  chemically synthesized
ggcatgtaagtatcacatgtac

SEQ ID NO: 95878 - DNA, 22 bp, Artificial Sequence
  chemically synthesized
ctcccatttgttgactgactag

SEQ ID NO: 95879 - DNA, 22 bp, Artificial Sequence
  chemically synthesized
ccatttgttgactgactaggtg

SEQ ID NO: 95880 - DNA, 22 bp, Artificial Sequence
  chemically synthesized
gttgactgactaggtgaaaata

SEQ ID NO: 95881 - DNA, 22 bp, Artificial Sequence
  chemically synthesized
ttgactgactaggtgaaaatat

SEQ ID NO: 95882 - DNA, 22 bp, Artificial Sequence
  chemically synthesized
actgactaggtgaaaatattta

SEQ ID NO: 95883 - DNA, 22 bp, Artificial Sequence
  chemically synthesized
actaggtgaaaatatttagtgc

SEQ ID NO: 95884 - DNA, 22 bp, Artificial Sequence
  chemically synthesized
ggtgaaaatatttagtgccatg

SEQ ID NO: 95885 - DNA, 22 bp, Artificial Sequence
  chemically synthesized
agtgccatgaataatccctgtt

SEQ ID NO: 95886 - DNA, 22 bp, Artificial Sequence
  chemically synthesized
gtgccatgaataatccctgttt

SEQ ID NO: 95887 - DNA, 22 bp, Artificial Sequence
  chemically synthesized
tttactctgtttatgggcatat

SEQ ID NO: 95888 - DNA, 22 bp, Artificial Sequence
  chemically synthesized
actctgtttatgggcatattga

SEQ ID NO: 95889 - DNA, 22 bp, Artificial Sequence
  chemically synthesized
ctctgtttatgggcatattgaa

SEQ ID NO: 95890 - DNA, 22 bp, Artificial Sequence
  chemically synthesized
tgtttatgggcatattgaaagg

SEQ ID NO: 95891 - DNA, 22 bp, Artificial Sequence
  chemically synthesized
tttatgggcatattgaaaggtt

SEQ ID NO: 95892 - DNA, 22 bp, Artificial Sequence
  chemically synthesized
atgggcatattgaaaggttata

SEQ ID NO: 95893 - DNA, 22 bp, Artificial Sequence
  chemically synthesized
tgggcatattgaaaggttataa

SEQ ID NO: 95894 - DNA, 22 bp, Artificial Sequence
  chemically synthesized
aaaggttataaggctcagagag

SEQ ID NO: 95895 - DNA, 22 bp, Artificial Sequence
  chemically synthesized
taaggctcagagagaccagtat

SEQ ID NO: 95896 - DNA, 22 bp, Artificial Sequence
  chemically synthesized
agagagaccagtattgttgata

SEQ ID NO: 95897 - DNA, 22 bp, Artificial Sequence
  chemically synthesized
ttgatagcctgcaactacaata

SEQ ID NO: 95898 - DNA, 22 bp, Artificial Sequence
  chemically synthesized
atagcctgcaactacaataatt

SEQ ID NO: 95899 - DNA, 22 bp, Artificial Sequence
  chemically synthesized
caactacaataattatttgtct

SEQ ID NO: 95900 - DNA, 22 bp, Artificial Sequence
  chemically synthesized
caataattatttgtctctctcc

SEQ ID NO: 95901 - DNA, 22 bp, Artificial Sequence
  chemically synthesized
tttgtctctctcccatattctg

SEQ ID NO: 95902 - DNA, 22 bp, Artificial Sequence
  chemically synthesized
gtctctctcccatattctggat

SEQ ID NO: 95903 - DNA, 22 bp, Artificial Sequence
  chemically synthesized
tctctctcccatattctggata

SEQ ID NO: 95904 - DNA, 22 bp, Artificial Sequence
  chemically synthesized
tctcccatattctggatatata

SEQ ID NO: 95905 - DNA, 22 bp, Artificial Sequence
  chemically synthesized
tcccatattctggatatataca

SEQ ID NO: 95906 - DNA, 22 bp, Artificial Sequence
  chemically synthesized
ccatattctggatatatacagc

SEQ ID NO: 95907 - DNA, 22 bp, Artificial Sequence
  chemically synthesized
tggatatatacagccaaattca

SEQ ID NO: 95908 - DNA, 22 bp, Artificial Sequence
  chemically synthesized
gatatatacagccaaattcaaa

SEQ ID NO: 95909 - DNA, 22 bp, Artificial Sequence
  chemically synthesized
aaaagtaattcacaggaaaaag

SEQ ID NO: 95910 - DNA, 22 bp, Artificial Sequence
  chemically synthesized
acaggaaaaagtctgatcaatg

SEQ ID NO: 95911 - DNA, 22 bp, Artificial Sequence
  chemically synthesized
atcaatgtgagagcactataaa

SEQ ID NO: 95912 - DNA, 22 bp, Artificial Sequence
  chemically synthesized
taaaattactaataaagttata

SEQ ID NO: 95913 - DNA, 22 bp, Artificial Sequence
  chemically synthesized
ctaataaagttatatttgccaa

SEQ ID NO: 95914 - DNA, 22 bp, Artificial Sequence
  chemically synthesized
ataaagttatatttgccaaaat

SEQ ID NO: 95915 - DNA, 22 bp, Artificial Sequence
  chemically synthesized
tatttgccaaaatatggcactc

SEQ ID NO: 95916 - DNA, 22 bp, Artificial Sequence
  chemically synthesized
gccaaaatatggcactctaact

SEQ ID NO: 95917 - DNA, 22 bp, Artificial Sequence
  chemically synthesized
ccaaaatatggcactctaactt

SEQ ID NO: 95918 - DNA, 22 bp, Artificial Sequence
  chemically synthesized
taacttggaaaatgcaaaggtt

SEQ ID NO: 95919 - DNA, 22 bp, Artificial Sequence
  chemically synthesized
acttggaaaatgcaaaggttcc

SEQ ID NO: 95920 - DNA, 22 bp, Artificial Sequence
  chemically synthesized
ggaaaatgcaaaggttccttga

SEQ ID NO: 95921 - DNA, 22 bp, Artificial Sequence
  chemically synthesized
gaaaatgcaaaggttccttgat

SEQ ID NO: 95922 - DNA, 22 bp, Artificial Sequence
  chemically synthesized
cttgatatgaaagacacaagac

SEQ ID NO: 95923 - DNA, 22 bp, Artificial Sequence
  chemically synthesized
gatatgaaagacacaagacctg

SEQ ID NO: 95924 - DNA, 22 bp, Artificial Sequence
  chemically synthesized
atatgaaagacacaagacctga

SEQ ID NO: 95925 - DNA, 22 bp, Artificial Sequence
  chemically synthesized
aaggtcaaaactccctgaccaa

SEQ ID NO: 95926 - DNA, 22 bp, Artificial Sequence
  chemically synthesized
cctgaccaatctagcacttcct

SEQ ID NO: 95927 - DNA, 22 bp, Artificial Sequence
  chemically synthesized
accaatctagcacttcctaaaa

SEQ ID NO: 95928 - DNA, 22 bp, Artificial Sequence
  chemically synthesized
gcacttcctaaaaagtaaatct

SEQ ID NO: 95929 - DNA, 22 bp, Artificial Sequence
  chemically synthesized
cctaaaaagtaaatctgttaat

SEQ ID NO: 95930 - DNA, 22 bp, Artificial Sequence
  chemically synthesized
ctaaaaagtaaatctgttaata

SEQ ID NO: 95931 - DNA, 22 bp, Artificial Sequence
  chemically synthesized
aaaagtaaatctgttaatatcc

SEQ ID NO: 95932 - DNA, 22 bp, Artificial Sequence
  chemically synthesized
ttaatatccctctacccttcac

SEQ ID NO: 95933 - DNA, 22 bp, Artificial Sequence
  chemically synthesized
atatccctctacccttcacaca

SEQ ID NO: 95934 - DNA, 22 bp, Artificial Sequence
  chemically synthesized
tacccttcacacatgagagtca

SEQ ID NO: 95935 - DNA, 22 bp, Artificial Sequence
  chemically synthesized
cccttcacacatgagagtcacc

SEQ ID NO: 95936 - DNA, 22 bp, Artificial Sequence
  chemically synthesized
cacacatgagagtcaccaggtc

SEQ ID NO: 95937 - DNA, 22 bp, Artificial Sequence
  chemically synthesized
acacatgagagtcaccaggtca

SEQ ID NO: 95938 - DNA, 22 bp, Artificial Sequence
  chemically synthesized
cctcctgttatcttcaccagtc

SEQ ID NO: 95939 - DNA, 22 bp, Artificial Sequence
  chemically synthesized
ctcctgttatcttcaccagtct

SEQ ID NO: 95940 - DNA, 22 bp, Artificial Sequence
  chemically synthesized
ctgttatcttcaccagtctggg

SEQ ID NO: 95941 - DNA, 22 bp, Artificial Sequence
  chemically synthesized
ttatcttcaccagtctgggagc

SEQ ID NO: 95942 - DNA, 22 bp, Artificial Sequence
  chemically synthesized
tcttcaccagtctgggagcttt

SEQ ID NO: 95943 - DNA, 22 bp, Artificial Sequence
  chemically synthesized
caccagtctgggagctttcagt

SEQ ID NO: 95944 - DNA, 22 bp, Artificial Sequence
  chemically synthesized
accagtctgggagctttcagtc

SEQ ID NO: 95945 - DNA, 22 bp, Artificial Sequence
  chemically synthesized
ggagctttcagtcatttatcac

SEQ ID NO: 95946 - DNA, 22 bp, Artificial Sequence
  chemically synthesized
tcagtcatttatcacctccttc

SEQ ID NO: 95947 - DNA, 22 bp, Artificial Sequence
  chemically synthesized
cagtcatttatcacctccttct

SEQ ID NO: 95948 - DNA, 22 bp, Artificial Sequence
  chemically synthesized
agtcatttatcacctccttctt

SEQ ID NO: 95949 - DNA, 22 bp, Artificial Sequence
  chemically synthesized
atcacctccttcttccttctca

SEQ ID NO: 95950 - DNA, 22 bp, Artificial Sequence
  chemically synthesized
tcacctccttcttccttctcat

SEQ ID NO: 95951 - DNA, 22 bp, Artificial Sequence
  chemically synthesized
cttcttccttctcatctcccac

SEQ ID NO: 95952 - DNA, 22 bp, Artificial Sequence
  chemically synthesized
cttccttctcatctcccacagt

SEQ ID NO: 95953 - DNA, 22 bp, Artificial Sequence
  chemically synthesized
ttccttctcatctcccacagtc

SEQ ID NO: 95954 - DNA, 22 bp, Artificial Sequence
  chemically synthesized
ccttctcatctcccacagtcag

SEQ ID NO: 95955 - DNA, 22 bp, Artificial Sequence
  chemically synthesized
cttctcatctcccacagtcagt

SEQ ID NO: 95956 - DNA, 22 bp, Artificial Sequence
  chemically synthesized
ctcatctcccacagtcagtcga

SEQ ID NO: 95957 - DNA, 22 bp, Artificial Sequence
  chemically synthesized
tcatctcccacagtcagtcgaa

SEQ ID NO: 95958 - DNA, 22 bp, Artificial Sequence
  chemically synthesized
atctcccacagtcagtcgaata

SEQ ID NO: 95959 - DNA, 22 bp, Artificial Sequence
  chemically synthesized
ccacagtcagtcgaatactatg

SEQ ID NO: 95960 - DNA, 22 bp, Artificial Sequence
  chemically synthesized
tgtctttctcaccccacctttg

SEQ ID NO: 95961 - DNA, 22 bp, Artificial Sequence
  chemically synthesized
tctcaccccacctttgtccatc

SEQ ID NO: 95962 - DNA, 22 bp, Artificial Sequence
  chemically synthesized
ctcaccccacctttgtccatcc

SEQ ID NO: 95963 - DNA, 22 bp, Artificial Sequence
  chemically synthesized
tcaccccacctttgtccatcct

SEQ ID NO: 95964 - DNA, 22 bp, Artificial Sequence
  chemically synthesized
accccacctttgtccatccttc

SEQ ID NO: 95965 - DNA, 22 bp, Artificial Sequence
  chemically synthesized
tgtccatccttcaaattccaca

SEQ ID NO: 95966 - DNA, 22 bp, Artificial Sequence
  chemically synthesized
gtccatccttcaaattccacag

SEQ ID NO: 95967 - DNA, 22 bp, Artificial Sequence
  chemically synthesized
tccatccttcaaattccacaga

SEQ ID NO: 95968 - DNA, 22 bp, Artificial Sequence
  chemically synthesized
caaattccacagactcactgct

SEQ ID NO: 95969 - DNA, 22 bp, Artificial Sequence
  chemically synthesized
aaattccacagactcactgctc

SEQ ID NO: 95970 - DNA, 22 bp, Artificial Sequence
  chemically synthesized
cacagactcactgctcctcttg

SEQ ID NO: 95971 - DNA, 22 bp, Artificial Sequence
  chemically synthesized
actgctcctcttgggtttgaac

SEQ ID NO: 95972 - DNA, 22 bp, Artificial Sequence
  chemically synthesized
ctcctcttgggtttgaaccatt

SEQ ID NO: 95973 - DNA, 22 bp, Artificial Sequence
  chemically synthesized
ctcttgggtttgaaccattgta

SEQ ID NO: 95974 - DNA, 22 bp, Artificial Sequence
  chemically synthesized
ttgggtttgaaccattgtatct

SEQ ID NO: 95975 - DNA, 22 bp, Artificial Sequence
  chemically synthesized
gggtttgaaccattgtatctgt

SEQ ID NO: 95976 - DNA, 22 bp, Artificial Sequence
  chemically synthesized
ggtttgaaccattgtatctgtc

SEQ ID NO: 95977 - DNA, 22 bp, Artificial Sequence
  chemically synthesized
gaaccattgtatctgtcccctt

SEQ ID NO: 95978 - DNA, 22 bp, Artificial Sequence
  chemically synthesized
aaccattgtatctgtccccttg

SEQ ID NO: 95979 - DNA, 22 bp, Artificial Sequence
  chemically synthesized
tatctgtccccttgaatcatca

SEQ ID NO: 95980 - DNA, 22 bp, Artificial Sequence
  chemically synthesized
tccccttgaatcatcatccata

SEQ ID NO: 95981 - DNA, 22 bp, Artificial Sequence
  chemically synthesized
gaatcatcatccatattttatt

SEQ ID NO: 95982 - DNA, 22 bp, Artificial Sequence
  chemically synthesized
aatcatcatccatattttattt

SEQ ID NO: 95983 - DNA, 22 bp, Artificial Sequence
  chemically synthesized
tattttatctgcaaacttgaat

SEQ ID NO: 95984 - DNA, 22 bp, Artificial Sequence
  chemically synthesized
attttatctgcaaacttgaatc

SEQ ID NO: 95985 - DNA, 22 bp, Artificial Sequence
  chemically synthesized
ttttatctgcaaacttgaatcc

SEQ ID NO: 95986 - DNA, 22 bp, Artificial Sequence
  chemically synthesized
tatctgcaaacttgaatccatt

SEQ ID NO: 95987 - DNA, 22 bp, Artificial Sequence
  chemically synthesized
atctgcaaacttgaatccattt

SEQ ID NO: 95988 - DNA, 22 bp, Artificial Sequence
  chemically synthesized
tctgcaaacttgaatccatttt

SEQ ID NO: 95989 - DNA, 22 bp, Artificial Sequence
  chemically synthesized
caaacttgaatccattttgtgc

SEQ ID NO: 95990 - DNA, 22 bp, Artificial Sequence
  chemically synthesized
gaatccattttgtgcacataag

SEQ ID NO: 95991 - DNA, 22 bp, Artificial Sequence
  chemically synthesized
aatccattttgtgcacataagc

SEQ ID NO: 95992 - DNA, 22 bp, Artificial Sequence
  chemically synthesized
tgtgcacataagcagattactt

SEQ ID NO: 95993 - DNA, 22 bp, Artificial Sequence
  chemically synthesized
gtgcacataagcagattacttt

SEQ ID NO: 95994 - DNA, 22 bp, Artificial Sequence
  chemically synthesized
tgcacataagcagattactttt

SEQ ID NO: 95995 - DNA, 22 bp, Artificial Sequence
  chemically synthesized
ctttttcccaaaatcttatttc

SEQ ID NO: 95996 - DNA, 22 bp, Artificial Sequence
  chemically synthesized
tttcccaaaatcttatttcctg

SEQ ID NO: 95997 - DNA, 22 bp, Artificial Sequence
  chemically synthesized
ttcccaaaatcttatttcctga

SEQ ID NO: 95998 - DNA, 22 bp, Artificial Sequence
  chemically synthesized
tcccaaaatcttatttcctgag

SEQ ID NO: 95999 - DNA, 22 bp, Artificial Sequence
  chemically synthesized
cccaaaatcttatttcctgagt

SEQ ID NO: 96000 - DNA, 22 bp, Artificial Sequence
  chemically synthesized
ccaaaatcttatttcctgagtc

SEQ ID NO: 96001 - DNA, 22 bp, Artificial Sequence
  chemically synthesized
atttcctgagtcacttaacatc

SEQ ID NO: 96002 - DNA, 22 bp, Artificial Sequence
  chemically synthesized
tttcctgagtcacttaacatcc

SEQ ID NO: 96003 - DNA, 22 bp, Artificial Sequence
  chemically synthesized
cctgagtcacttaacatcctaa

SEQ ID NO: 96004 - DNA, 22 bp, Artificial Sequence
  chemically synthesized
ctgagtcacttaacatcctaat

SEQ ID NO: 96005 - DNA, 22 bp, Artificial Sequence
  chemically synthesized
agtcacttaacatcctaatgct

SEQ ID NO: 96006 - DNA, 22 bp, Artificial Sequence
  chemically synthesized
aacatcctaatgcttatcgttt

SEQ ID NO: 96007 - DNA, 22 bp, Artificial Sequence
  chemically synthesized
acatcctaatgcttatcgttta

SEQ ID NO: 96008 - DNA, 22 bp, Artificial Sequence
  chemically synthesized
atgcttatcgtttagtattgca

SEQ ID NO: 96009 - DNA, 22 bp, Artificial Sequence
  chemically synthesized
atcgtttagtattgcaatagca

SEQ ID NO: 96010 - DNA, 22 bp, Artificial Sequence
  chemically synthesized
tcgtttagtattgcaatagcat

SEQ ID NO: 96011 - DNA, 22 bp, Artificial Sequence
  chemically synthesized
agtattgcaatagcatagtaaa

SEQ ID NO: 96012 - DNA, 22 bp, Artificial Sequence
  chemically synthesized
gtattgcaatagcatagtaaaa

SEQ ID NO: 96013 - DNA, 22 bp, Artificial Sequence
  chemically synthesized
caatagcatagtaaaagcttgt

SEQ ID NO: 96014 - DNA, 22 bp, Artificial Sequence
  chemically synthesized
gtatttttgtagccaggccctg

SEQ ID NO: 96015 - DNA, 22 bp, Artificial Sequence
  chemically synthesized
tatttttgtagccaggccctgt

SEQ ID NO: 96016 - DNA, 22 bp, Artificial Sequence
  chemically synthesized
ttgtagccaggccctgtactat

SEQ ID NO: 96017 - DNA, 22 bp, Artificial Sequence
  chemically synthesized
tgtagccaggccctgtactatc

SEQ ID NO: 96018 - DNA, 22 bp, Artificial Sequence
  chemically synthesized
gtagccaggccctgtactatct

SEQ ID NO: 96019 - DNA, 22 bp, Artificial Sequence
  chemically synthesized
tagccaggccctgtactatctg

SEQ ID NO: 96020 - DNA, 22 bp, Artificial Sequence
  chemically synthesized
tactatctggtctttcctagtc

SEQ ID NO: 96021 - DNA, 22 bp, Artificial Sequence
  chemically synthesized
tctggtctttcctagtcctcta

SEQ ID NO: 96022 - DNA, 22 bp, Artificial Sequence
  chemically synthesized
gtctttcctagtcctctacgta

SEQ ID NO: 96023 - DNA, 22 bp, Artificial Sequence
  chemically synthesized
tcctagtcctctacgtatgtct

SEQ ID NO: 96024 - DNA, 22 bp, Artificial Sequence
  chemically synthesized
cctagtcctctacgtatgtctt

SEQ ID NO: 96025 - DNA, 22 bp, Artificial Sequence
  chemically synthesized
ctagtcctctacgtatgtctta

SEQ ID NO: 96026 - DNA, 22 bp, Artificial Sequence
  chemically synthesized
gtcctctacgtatgtcttactc

SEQ ID NO: 96027 - DNA, 22 bp, Artificial Sequence
  chemically synthesized
tacgtatgtcttactctccctt

SEQ ID NO: 96028 - DNA, 22 bp, Artificial Sequence
  chemically synthesized
cgtatgtcttactctcccttct

SEQ ID NO: 96029 - DNA, 22 bp, Artificial Sequence
  chemically synthesized
actctcccttctacttccagag

SEQ ID NO: 96030 - DNA, 22 bp, Artificial Sequence
  chemically synthesized
ctctcccttctacttccagaga

SEQ ID NO: 96031 - DNA, 22 bp, Artificial Sequence
  chemically synthesized
tcccttctacttccagagagcc

SEQ ID NO: 96032 - DNA, 22 bp, Artificial Sequence
  chemically synthesized
ccttctacttccagagagccag

SEQ ID NO: 96033 - DNA, 22 bp, Artificial Sequence
  chemically synthesized
ctacttccagagagccagtttc

SEQ ID NO: 96034 - DNA, 22 bp, Artificial Sequence
  chemically synthesized
tacttccagagagccagtttca

SEQ ID NO: 96035 - DNA, 22 bp, Artificial Sequence
  chemically synthesized
cttccagagagccagtttcatg

SEQ ID NO: 96036 - DNA, 22 bp, Artificial Sequence
  chemically synthesized
ccagagagccagtttcatgcaa

SEQ ID NO: 96037 - DNA, 22 bp, Artificial Sequence
  chemically synthesized
cagagagccagtttcatgcaag

SEQ ID NO: 96038 - DNA, 22 bp, Artificial Sequence
  chemically synthesized
catgcaagtcacgaagccctag

SEQ ID NO: 96039 - DNA, 22 bp, Artificial Sequence
  chemically synthesized
atgcaagtcacgaagccctagc

SEQ ID NO: 96040 - DNA, 22 bp, Artificial Sequence
  chemically synthesized
gcttgctggttttagaatttaa

SEQ ID NO: 96041 - DNA, 22 bp, Artificial Sequence
  chemically synthesized
gctggttttagaatttaagcct

SEQ ID NO: 96042 - DNA, 22 bp, Artificial Sequence
  chemically synthesized
ctggttttagaatttaagcctt

SEQ ID NO: 96043 - DNA, 22 bp, Artificial Sequence
  chemically synthesized
gttttagaatttaagcctttat

SEQ ID NO: 96044 - DNA, 22 bp, Artificial Sequence
  chemically synthesized
tagaatttaagcctttattagt

SEQ ID NO: 96045 - DNA, 22 bp, Artificial Sequence
  chemically synthesized
agaatttaagcctttattagta

SEQ ID NO: 96046 - DNA, 22 bp, Artificial Sequence
  chemically synthesized
gaatttaagcctttattagtat

SEQ ID NO: 96047 - DNA, 22 bp, Artificial Sequence
  chemically synthesized
aagcctttattagtattctatc

SEQ ID NO: 96048 - DNA, 22 bp, Artificial Sequence
  chemically synthesized
agcctttattagtattctatct

SEQ ID NO: 96049 - DNA, 22 bp, Artificial Sequence
  chemically synthesized
tattagtattctatctcccacg

SEQ ID NO: 96050 - DNA, 22 bp, Artificial Sequence
  chemically synthesized
attagtattctatctcccacgg

SEQ ID NO: 96051 - DNA, 22 bp, Artificial Sequence
  chemically synthesized
ttagtattctatctcccacgga

SEQ ID NO: 96052 - DNA, 22 bp, Artificial Sequence
  chemically synthesized
gtattctatctcccacggaaag

SEQ ID NO: 96053 - DNA, 22 bp, Artificial Sequence
  chemically synthesized
tatctcccacggaaagtcttca

SEQ ID NO: 96054 - DNA, 22 bp, Artificial Sequence
  chemically synthesized
tctcccacggaaagtcttcatc

SEQ ID NO: 96055 - DNA, 22 bp, Artificial Sequence
  chemically synthesized
ccacggaaagtcttcatcacac

SEQ ID NO: 96056 - DNA, 22 bp, Artificial Sequence
  chemically synthesized
catcacactctccaaaaacttt

SEQ ID NO: 96057 - DNA, 22 bp, Artificial Sequence
  chemically synthesized
atcacactctccaaaaactttc

SEQ ID NO: 96058 - DNA, 22 bp, Artificial Sequence
  chemically synthesized
tccaaaaactttcccactcagg

SEQ ID NO: 96059 - DNA, 22 bp, Artificial Sequence
  chemically synthesized
caaaaactttcccactcaggtc

SEQ ID NO: 96060 - DNA, 22 bp, Artificial Sequence
  chemically synthesized
tcccactcaggtcctaactcta

SEQ ID NO: 96061 - DNA, 22 bp, Artificial Sequence
  chemically synthesized
cccactcaggtcctaactctaa

SEQ ID NO: 96062 - DNA, 22 bp, Artificial Sequence
  chemically synthesized
ccactcaggtcctaactctaac

SEQ ID NO: 96063 - DNA, 22 bp, Artificial Sequence
  chemically synthesized
aggtcctaactctaactttatt

SEQ ID NO: 96064 - DNA, 22 bp, Artificial Sequence
  chemically synthesized
actctaactttattttagtgca

SEQ ID NO: 96065 - DNA, 22 bp, Artificial Sequence
  chemically synthesized
taactttattttagtgcatgtt

SEQ ID NO: 96066 - DNA, 22 bp, Artificial Sequence
  chemically synthesized
actttattttagtgcatgttac

SEQ ID NO: 96067 - DNA, 22 bp, Artificial Sequence
  chemically synthesized
tattttagtgcatgttacattc

SEQ ID NO: 96068 - DNA, 22 bp, Artificial Sequence
  chemically synthesized
attttagtgcatgttacattct

SEQ ID NO: 96069 - DNA, 22 bp, Artificial Sequence
  chemically synthesized
ttttagtgcatgttacattcta

SEQ ID NO: 96070 - DNA, 22 bp, Artificial Sequence
  chemically synthesized
tagtgcatgttacattctatca

SEQ ID NO: 96071 - DNA, 22 bp, Artificial Sequence
  chemically synthesized
agtgcatgttacattctatcag

SEQ ID NO: 96072 - DNA, 22 bp, Artificial Sequence
  chemically synthesized
gtgcatgttacattctatcaga

SEQ ID NO: 96073 - DNA, 22 bp, Artificial Sequence
  chemically synthesized
cattctatcagaagataatgca

SEQ ID NO: 96074 - DNA, 22 bp, Artificial Sequence
  chemically synthesized
tatcagaagataatgcacaatg

SEQ ID NO: 96075 - DNA, 22 bp, Artificial Sequence
  chemically synthesized
tcagaagataatgcacaatgat

SEQ ID NO: 96076 - DNA, 22 bp, Artificial Sequence
  chemically synthesized
agcttcagctaacccatgaaat

SEQ ID NO: 96077 - DNA, 22 bp, Artificial Sequence
  chemically synthesized
gcttcagctaacccatgaaata

SEQ ID NO: 96078 - DNA, 22 bp, Artificial Sequence
  chemically synthesized
cagctaacccatgaaataatgg

SEQ ID NO: 96079 - DNA, 22 bp, Artificial Sequence
  chemically synthesized
agctaacccatgaaataatgga

SEQ ID NO: 96080 - DNA, 22 bp, Artificial Sequence
  chemically synthesized
acccatgaaataatggaatcct

SEQ ID NO: 96081 - DNA, 22 bp, Artificial Sequence
  chemically synthesized
catggaaagagcaggctattgt

SEQ ID NO: 96082 - DNA, 22 bp, Artificial Sequence
  chemically synthesized
atggaaagagcaggctattgtt

SEQ ID NO: 96083 - DNA, 22 bp, Artificial Sequence
  chemically synthesized
ttgttgatacacactcatctta

SEQ ID NO: 96084 - DNA, 22 bp, Artificial Sequence
  chemically synthesized
ttgatacacactcatcttatct

SEQ ID NO: 96085 - DNA, 22 bp, Artificial Sequence
  chemically synthesized
atacacactcatcttatctcca

SEQ ID NO: 96086 - DNA, 22 bp, Artificial Sequence
  chemically synthesized
atcttatctccaaatcaatttc

SEQ ID NO: 96087 - DNA, 22 bp, Artificial Sequence
  chemically synthesized
atctccaaatcaatttcataaa

SEQ ID NO: 96088 - DNA, 22 bp, Artificial Sequence
  chemically synthesized
tctccaaatcaatttcataaaa

SEQ ID NO: 96089 - DNA, 22 bp, Artificial Sequence
  chemically synthesized
caaatcaatttcataaaacatg

SEQ ID NO: 96090 - DNA, 22 bp, Artificial Sequence
  chemically synthesized
cataaaacatgtgacaagctag

SEQ ID NO: 96091 - DNA, 22 bp, Artificial Sequence
  chemically synthesized
ataaaacatgtgacaagctagc

SEQ ID NO: 96092 - DNA, 22 bp, Artificial Sequence
  chemically synthesized
gctacttcaaaatgtaaataag

SEQ ID NO: 96093 - DNA, 22 bp, Artificial Sequence
  chemically synthesized
cttcaaaatgtaaataagagta

SEQ ID NO: 96094 - DNA, 22 bp, Artificial Sequence
  chemically synthesized
caaaatgtaaataagagtaaat

SEQ ID NO: 96095 - DNA, 22 bp, Artificial Sequence
  chemically synthesized
aaaatgtaaataagagtaaatt

SEQ ID NO: 96096 - DNA, 22 bp, Artificial Sequence
  chemically synthesized
aaatagtaattctagcctatat

SEQ ID NO: 96097 - DNA, 22 bp, Artificial Sequence
  chemically synthesized
tagcctatatcttggatatcta

SEQ ID NO: 96098 - DNA, 22 bp, Artificial Sequence
  chemically synthesized
gcctatatcttggatatctatg

SEQ ID NO: 96099 - DNA, 22 bp, Artificial Sequence
  chemically synthesized
tatcttggatatctatgaagtt

SEQ ID NO: 96100 - DNA, 22 bp, Artificial Sequence
  chemically synthesized
ggatatctatgaagttttgttt

SEQ ID NO: 96101 - DNA, 22 bp, Artificial Sequence
  chemically synthesized
gatatctatgaagttttgtttt

SEQ ID NO: 96102 - DNA, 22 bp, Artificial Sequence
  chemically synthesized
tgaagttttgttttgttttgtt

SEQ ID NO: 96103 - DNA, 22 bp, Artificial Sequence
  chemically synthesized
tgttttgttttgtttttgtttt

SEQ ID NO: 96104 - DNA, 22 bp, Artificial Sequence
  chemically synthesized
gttttgttttgtttttgttttt

SEQ ID NO: 96105 - DNA, 22 bp, Artificial Sequence
  chemically synthesized
ttttgttttgtttttgttttta

SEQ ID NO: 96106 - DNA, 22 bp, Artificial Sequence
  chemically synthesized
tgttttgtttttgtttttaatg

SEQ ID NO: 96107 - DNA, 22 bp, Artificial Sequence
  chemically synthesized
gttttgtttttgtttttaatga

SEQ ID NO: 96108 - DNA, 22 bp, Artificial Sequence
  chemically synthesized
ttttgtttttgtttttaatgaa

SEQ ID NO: 96109 - DNA, 22 bp, Artificial Sequence
  chemically synthesized
tgtttttgtttttaatgaaaag

SEQ ID NO: 96110 - DNA, 22 bp, Artificial Sequence
  chemically synthesized
gtttttgtttttaatgaaaagt

SEQ ID NO: 96111 - DNA, 22 bp, Artificial Sequence
  chemically synthesized
tttttgtttttaatgaaaagtg

SEQ ID NO: 96112 - DNA, 22 bp, Artificial Sequence
  chemically synthesized
ttgtttttaatgaaaagtgaca

SEQ ID NO: 96113 - DNA, 22 bp, Artificial Sequence
  chemically synthesized
tgtttttaatgaaaagtgacat

SEQ ID NO: 96114 - DNA, 22 bp, Artificial Sequence
  chemically synthesized
gtttttaatgaaaagtgacatg

SEQ ID NO: 96115 - DNA, 22 bp, Artificial Sequence
  chemically synthesized
tttttaatgaaaagtgacatgt

SEQ ID NO: 96116 - DNA, 22 bp, Artificial Sequence
  chemically synthesized
ttaatgaaaagtgacatgtacc

SEQ ID NO: 96117 - DNA, 22 bp, Artificial Sequence
  chemically synthesized
taatgaaaagtgacatgtacca

SEQ ID NO: 96118 - DNA, 22 bp, Artificial Sequence
  chemically synthesized
aatgaaaagtgacatgtaccac

SEQ ID NO: 96119 - DNA, 22 bp, Artificial Sequence
  chemically synthesized
atgaaaagtgacatgtaccaca

SEQ ID NO: 96120 - DNA, 22 bp, Artificial Sequence
  chemically synthesized
ctttctcaggtaccactaacag

SEQ ID NO: 96121 - DNA, 22 bp, Artificial Sequence
  chemically synthesized
tctcaggtaccactaacagctc

SEQ ID NO: 96122 - DNA, 22 bp, Artificial Sequence
  chemically synthesized
ctcaggtaccactaacagctcc

SEQ ID NO: 96123 - DNA, 22 bp, Artificial Sequence
  chemically synthesized
tcaggtaccactaacagctcct

SEQ ID NO: 96124 - DNA, 22 bp, Artificial Sequence
  chemically synthesized
aggtaccactaacagctccttc

SEQ ID NO: 96125 - DNA, 22 bp, Artificial Sequence
  chemically synthesized
acagctccttctttccccggtg

SEQ ID NO: 96126 - DNA, 22 bp, Artificial Sequence
  chemically synthesized
cttctttccccggtgcagtaaa

SEQ ID NO: 96127 - DNA, 22 bp, Artificial Sequence
  chemically synthesized
ctttccccggtgcagtaaaaac

SEQ ID NO: 96128 - DNA, 22 bp, Artificial Sequence
  chemically synthesized
tttccccggtgcagtaaaaact

SEQ ID NO: 96129 - DNA, 22 bp, Artificial Sequence
  chemically synthesized
tccccggtgcagtaaaaactgc

SEQ ID NO: 96130 - DNA, 22 bp, Artificial Sequence
  chemically synthesized
ccccggtgcagtaaaaactgcc

SEQ ID NO: 96131 - DNA, 22 bp, Artificial Sequence
  chemically synthesized
cccggtgcagtaaaaactgcct

SEQ ID NO: 96132 - DNA, 22 bp, Artificial Sequence
  chemically synthesized
cctaggagtctctgtccactta

SEQ ID NO: 96133 - DNA, 22 bp, Artificial Sequence
  chemically synthesized
ggagtctctgtccacttaatta

SEQ ID NO: 96134 - DNA, 22 bp, Artificial Sequence
  chemically synthesized
tgtccacttaattaaccatttt

SEQ ID NO: 96135 - DNA, 22 bp, Artificial Sequence
  chemically synthesized
tccacttaattaaccattttcc

SEQ ID NO: 96136 - DNA, 22 bp, Artificial Sequence
  chemically synthesized
aattaaccattttcccaccccg

SEQ ID NO: 96137 - DNA, 22 bp, Artificial Sequence
  chemically synthesized
attaaccattttcccaccccga

SEQ ID NO: 96138 - DNA, 22 bp, Artificial Sequence
  chemically synthesized
accattttcccaccccgataaa

SEQ ID NO: 96139 - DNA, 22 bp, Artificial Sequence
  chemically synthesized
tcccaccccgataaagattttt

SEQ ID NO: 96140 - DNA, 22 bp, Artificial Sequence
  chemically synthesized
cccaccccgataaagatttttc

SEQ ID NO: 96141 - DNA, 22 bp, Artificial Sequence
  chemically synthesized
ccaccccgataaagatttttct

SEQ ID NO: 96142 - DNA, 22 bp, Artificial Sequence
  chemically synthesized
ttctccatcatatcatcctcct

SEQ ID NO: 96143 - DNA, 22 bp, Artificial Sequence
  chemically synthesized
tctccatcatatcatcctcctt

SEQ ID NO: 96144 - DNA, 22 bp, Artificial Sequence
  chemically synthesized
ctccatcatatcatcctccttg

SEQ ID NO: 96145 - DNA, 22 bp, Artificial Sequence
  chemically synthesized
tccatcatatcatcctccttgg

SEQ ID NO: 96146 - DNA, 22 bp, Artificial Sequence
  chemically synthesized
catcatatcatcctccttggaa

SEQ ID NO: 96147 - DNA, 22 bp, Artificial Sequence
  chemically synthesized
cttggaatcctggaattctccc

SEQ ID NO: 96148 - DNA, 22 bp, Artificial Sequence
  chemically synthesized
ggaatcctggaattctcccata

SEQ ID NO: 96149 - DNA, 22 bp, Artificial Sequence
  chemically synthesized
gaatcctggaattctcccataa

SEQ ID NO: 96150 - DNA, 22 bp, Artificial Sequence
  chemically synthesized
gaattctcccataacatccaca

SEQ ID NO: 96151 - DNA, 22 bp, Artificial Sequence
  chemically synthesized
tcccataacatccacattaatt

SEQ ID NO: 96152 - DNA, 22 bp, Artificial Sequence
  chemically synthesized
ccataacatccacattaatttt

SEQ ID NO: 96153 - DNA, 22 bp, Artificial Sequence
  chemically synthesized
attttacaagcccccatacatt

SEQ ID NO: 96154 - DNA, 22 bp, Artificial Sequence
  chemically synthesized
tacaagcccccatacatttctt

SEQ ID NO: 96155 - DNA, 22 bp, Artificial Sequence
  chemically synthesized
acaagcccccatacatttctta

SEQ ID NO: 96156 - DNA, 22 bp, Artificial Sequence
  chemically synthesized
caagcccccatacatttcttaa

SEQ ID NO: 96157 - DNA, 22 bp, Artificial Sequence
  chemically synthesized
cttaaggaagctcttggttctt

SEQ ID NO: 96158 - DNA, 22 bp, Artificial Sequence
  chemically synthesized
ttaaggaagctcttggttcttc

SEQ ID NO: 96159 - DNA, 22 bp, Artificial Sequence
  chemically synthesized
aaggaagctcttggttcttcct

SEQ ID NO: 96160 - DNA, 22 bp, Artificial Sequence
  chemically synthesized
aggaagctcttggttcttccta

SEQ ID NO: 96161 - DNA, 22 bp, Artificial Sequence
  chemically synthesized
ttggttcttcctatgtttctct

SEQ ID NO: 96162 - DNA, 22 bp, Artificial Sequence
  chemically synthesized
ggttcttcctatgtttctctcc

SEQ ID NO: 96163 - DNA, 22 bp, Artificial Sequence
  chemically synthesized
gttcttcctatgtttctctcca

SEQ ID NO: 96164 - DNA, 22 bp, Artificial Sequence
  chemically synthesized
ttcctatgtttctctccatccc

SEQ ID NO: 96165 - DNA, 22 bp, Artificial Sequence
  chemically synthesized
cctatgtttctctccatccctc

SEQ ID NO: 96166 - DNA, 22 bp, Artificial Sequence
  chemically synthesized
ctatgtttctctccatccctca

SEQ ID NO: 96167 - DNA, 22 bp, Artificial Sequence
  chemically synthesized
tgtttctctccatccctcagcc

SEQ ID NO: 96168 - DNA, 22 bp, Artificial Sequence
  chemically synthesized
ctctccatccctcagcccatga

SEQ ID NO: 96169 - DNA, 22 bp, Artificial Sequence
  chemically synthesized
tctccatccctcagcccatgaa

SEQ ID NO: 96170 - DNA, 22 bp, Artificial Sequence
  chemically synthesized
tccatccctcagcccatgaaca

SEQ ID NO: 96171 - DNA, 22 bp, Artificial Sequence
  chemically synthesized
catccctcagcccatgaacact

SEQ ID NO: 96172 - DNA, 22 bp, Artificial Sequence
  chemically synthesized
agcccatgaacactttttcctt

SEQ ID NO: 96173 - DNA, 22 bp, Artificial Sequence
  chemically synthesized
tttccttttaacacaagagtaa

SEQ ID NO: 96174 - DNA, 22 bp, Artificial Sequence
  chemically synthesized
ttccttttaacacaagagtaaa

SEQ ID NO: 96175 - DNA, 22 bp, Artificial Sequence
  chemically synthesized
tccttttaacacaagagtaaaa

SEQ ID NO: 96176 - DNA, 22 bp, Artificial Sequence
  chemically synthesized
ccttttaacacaagagtaaaag

SEQ ID NO: 96177 - DNA, 22 bp, Artificial Sequence
  chemically synthesized
cttttaacacaagagtaaaaga

SEQ ID NO: 96178 - DNA, 22 bp, Artificial Sequence
  chemically synthesized
ttaacacaagagtaaaagatgg

SEQ ID NO: 96179 - DNA, 22 bp, Artificial Sequence
  chemically synthesized
taacacaagagtaaaagatgga

SEQ ID NO: 96180 - DNA, 22 bp, Artificial Sequence
  chemically synthesized
aacacaagagtaaaagatggag

SEQ ID NO: 96181 - DNA, 22 bp, Artificial Sequence
  chemically synthesized
acacaagagtaaaagatggaga

SEQ ID NO: 96182 - DNA, 22 bp, Artificial Sequence
  chemically synthesized
caatttttgattactgaagaaa

SEQ ID NO: 96183 - DNA, 22 bp, Artificial Sequence
  chemically synthesized
ttgattactgaagaaaatgtac

SEQ ID NO: 96184 - DNA, 22 bp, Artificial Sequence
  chemically synthesized
tgattactgaagaaaatgtact

SEQ ID NO: 96185 - DNA, 22 bp, Artificial Sequence
  chemically synthesized
gattactgaagaaaatgtactt

SEQ ID NO: 96186 - DNA, 22 bp, Artificial Sequence
  chemically synthesized
attactgaagaaaatgtacttt

SEQ ID NO: 96187 - DNA, 22 bp, Artificial Sequence
  chemically synthesized
ctgaagaaaatgtactttatta

SEQ ID NO: 96188 - DNA, 22 bp, Artificial Sequence
  chemically synthesized
aagaaaatgtactttattaaac

SEQ ID NO: 96189 - DNA, 22 bp, Artificial Sequence
  chemically synthesized
tattaaacagaaggctttctct

SEQ ID NO: 96190 - DNA, 22 bp, Artificial Sequence
  chemically synthesized
attaaacagaaggctttctctc

SEQ ID NO: 96191 - DNA, 22 bp, Artificial Sequence
  chemically synthesized
ttaaacagaaggctttctctca

SEQ ID NO: 96192 - DNA, 22 bp, Artificial Sequence
  chemically synthesized
aacagaaggctttctctcaagg

SEQ ID NO: 96193 - DNA, 22 bp, Artificial Sequence
  chemically synthesized
tctctcaaggccaagcccagtc

SEQ ID NO: 96194 - DNA, 22 bp, Artificial Sequence
  chemically synthesized
ctctcaaggccaagcccagtcc

SEQ ID NO: 96195 - DNA, 22 bp, Artificial Sequence
  chemically synthesized
tctcaaggccaagcccagtccc

SEQ ID NO: 96196 - DNA, 22 bp, Artificial Sequence
  chemically synthesized
tcaaggccaagcccagtcccca

SEQ ID NO: 96197 - DNA, 22 bp, Artificial Sequence
  chemically synthesized
aaggccaagcccagtccccatg

SEQ ID NO: 96198 - DNA, 22 bp, Artificial Sequence
  chemically synthesized
caaactggaagagaactcagtg

SEQ ID NO: 96199 - DNA, 22 bp, Artificial Sequence
  chemically synthesized
gaagagaactcagtggtactta

SEQ ID NO: 96200 - DNA, 22 bp, Artificial Sequence
  chemically synthesized
agtggtacttatgggccagggc

SEQ ID NO: 96201 - DNA, 22 bp, Artificial Sequence
  chemically synthesized
atgggccagggcaatggcgaca

SEQ ID NO: 96202 - DNA, 22 bp, Artificial Sequence
  chemically synthesized
tgggccagggcaatggcgacag

SEQ ID NO: 96203 - DNA, 22 bp, Artificial Sequence
  chemically synthesized
ctgccaggcagcctgcacttca

SEQ ID NO: 96204 - DNA, 22 bp, Artificial Sequence
  chemically synthesized
tgccaggcagcctgcacttcag

SEQ ID NO: 96205 - DNA, 22 bp, Artificial Sequence
  chemically synthesized
ccaggcagcctgcacttcaggg

SEQ ID NO: 96206 - DNA, 22 bp, Artificial Sequence
  chemically synthesized
cacttcaggggtgaactccttg

SEQ ID NO: 96207 - DNA, 22 bp, Artificial Sequence
  chemically synthesized
caggggtgaactccttgccaaa

SEQ ID NO: 96208 - DNA, 22 bp, Artificial Sequence
  chemically synthesized
aggggtgaactccttgccaaag

SEQ ID NO: 96209 - DNA, 22 bp, Artificial Sequence
  chemically synthesized
cttgccaaagtgagtagccaga

SEQ ID NO: 96210 - DNA, 22 bp, Artificial Sequence
  chemically synthesized
gccaaagtgagtagccagaata

SEQ ID NO: 96211 - DNA, 22 bp, Artificial Sequence
  chemically synthesized
ccaaagtgagtagccagaataa

SEQ ID NO: 96212 - DNA, 22 bp, Artificial Sequence
  chemically synthesized
cccaggagctgttaggcaaaag

SEQ ID NO: 96213 - DNA, 22 bp, Artificial Sequence
  chemically synthesized
ttaggcaaaagacaaaataaca

SEQ ID NO: 96214 - DNA, 22 bp, Artificial Sequence
  chemically synthesized
ggcaaaagacaaaataacacac

SEQ ID NO: 96215 - DNA, 22 bp, Artificial Sequence
  chemically synthesized
agtagaagtttccgaaaacaac

SEQ ID NO: 96216 - DNA, 22 bp, Artificial Sequence
  chemically synthesized
ccgaaaacaacttgatgaaaaa

SEQ ID NO: 96217 - DNA, 22 bp, Artificial Sequence
  chemically synthesized
cgaaaacaacttgatgaaaaaa

SEQ ID NO: 96218 - DNA, 22 bp, Artificial Sequence
  chemically synthesized
gatgaaaaaacaaacaaacaaa

SEQ ID NO: 96219 - DNA, 22 bp, Artificial Sequence
  chemically synthesized
atgaaaaaacaaacaaacaaac

SEQ ID NO: 96220 - DNA, 22 bp, Artificial Sequence
  chemically synthesized
tatacctacattcctagacaac

SEQ ID NO: 96221 - DNA, 22 bp, Artificial Sequence
  chemically synthesized
atacctacattcctagacaacc

SEQ ID NO: 96222 - DNA, 22 bp, Artificial Sequence
  chemically synthesized
tacctacattcctagacaaccc

SEQ ID NO: 96223 - DNA, 22 bp, Artificial Sequence
  chemically synthesized
cattcctagacaaccctgacct

SEQ ID NO: 96224 - DNA, 22 bp, Artificial Sequence
  chemically synthesized
ctagacaaccctgacctcaaac

SEQ ID NO: 96225 - DNA, 22 bp, Artificial Sequence
  chemically synthesized
gacaaccctgacctcaaactgt

SEQ ID NO: 96226 - DNA, 22 bp, Artificial Sequence
  chemically synthesized
acctcaaactgttccaaggttt

SEQ ID NO: 96227 - DNA, 22 bp, Artificial Sequence
  chemically synthesized
aaactgttccaaggtttgtgcc

SEQ ID NO: 96228 - DNA, 22 bp, Artificial Sequence
  chemically synthesized
ttccaaggtttgtgcccaccca

SEQ ID NO: 96229 - DNA, 22 bp, Artificial Sequence
  chemically synthesized
caaggtttgtgcccacccaaaa

SEQ ID NO: 96230 - DNA, 22 bp, Artificial Sequence
  chemically synthesized
gtgcccacccaaaaaattcaga

SEQ ID NO: 96231 - DNA, 22 bp, Artificial Sequence
  chemically synthesized
tgcccacccaaaaaattcagat

SEQ ID NO: 96232 - DNA, 22 bp, Artificial Sequence
  chemically synthesized
agatgagcttaggttcaatttt

SEQ ID NO: 96233 - DNA, 22 bp, Artificial Sequence
  chemically synthesized
aggttcaattttattctatgag

SEQ ID NO: 96234 - DNA, 22 bp, Artificial Sequence
  chemically synthesized
ggttcaattttattctatgagc

SEQ ID NO: 96235 - DNA, 22 bp, Artificial Sequence
  chemically synthesized
aattttattctatgagccctac

SEQ ID NO: 96236 - DNA, 22 bp, Artificial Sequence
  chemically synthesized
tattctatgagccctacattca

SEQ ID NO: 96237 - DNA, 22 bp, Artificial Sequence
  chemically synthesized
attctatgagccctacattcaa

SEQ ID NO: 96238 - DNA, 22 bp, Artificial Sequence
  chemically synthesized
ttctatgagccctacattcaac

SEQ ID NO: 96239 - DNA, 22 bp, Artificial Sequence
  chemically synthesized
tatgagccctacattcaacatt

SEQ ID NO: 96240 - DNA, 22 bp, Artificial Sequence
  chemically synthesized
tgagccctacattcaacattct

SEQ ID NO: 96241 - DNA, 22 bp, Artificial Sequence
  chemically synthesized
cattcaacattctacctaccta

SEQ ID NO: 96242 - DNA, 22 bp, Artificial Sequence
  chemically synthesized
aacattctacctacctacaccc

SEQ ID NO: 96243 - DNA, 22 bp, Artificial Sequence
  chemically synthesized
tacctacctacaccctcacccc

SEQ ID NO: 96244 - DNA, 22 bp, Artificial Sequence
  chemically synthesized
cctacctacaccctcaccccct

SEQ ID NO: 96245 - DNA, 22 bp, Artificial Sequence
  chemically synthesized
cctacaccctcacccccttccc

SEQ ID NO: 96246 - DNA, 22 bp, Artificial Sequence
  chemically synthesized
caccctcacccccttccccatt

SEQ ID NO: 96247 - DNA, 22 bp, Artificial Sequence
  chemically synthesized
acccccttccccattttaccag

SEQ ID NO: 96248 - DNA, 22 bp, Artificial Sequence
  chemically synthesized
ccccattttaccagtattattg

SEQ ID NO: 96249 - DNA, 22 bp, Artificial Sequence
  chemically synthesized
cccattttaccagtattattgg

SEQ ID NO: 96250 - DNA, 22 bp, Artificial Sequence
  chemically synthesized
taccagtattattgggttccct

SEQ ID NO: 96251 - DNA, 22 bp, Artificial Sequence
  chemically synthesized
accagtattattgggttccctc

SEQ ID NO: 96252 - DNA, 22 bp, Artificial Sequence
  chemically synthesized
ccagtattattgggttccctct

SEQ ID NO: 96253 - DNA, 22 bp, Artificial Sequence
  chemically synthesized
ttgggttccctctctccctgtt

SEQ ID NO: 96254 - DNA, 22 bp, Artificial Sequence
  chemically synthesized
ggttccctctctccctgttttt

SEQ ID NO: 96255 - DNA, 22 bp, Artificial Sequence
  chemically synthesized
cctctctccctgtttttcttta

SEQ ID NO: 96256 - DNA, 22 bp, Artificial Sequence
  chemically synthesized
tctccctgtttttctttaagca

SEQ ID NO: 96257 - DNA, 22 bp, Artificial Sequence
  chemically synthesized
tccctgtttttctttaagcaat

SEQ ID NO: 96258 - DNA, 22 bp, Artificial Sequence
  chemically synthesized
cctgtttttctttaagcaattg

SEQ ID NO: 96259 - DNA, 22 bp, Artificial Sequence
  chemically synthesized
tttttctttaagcaattgtcta

SEQ ID NO: 96260 - DNA, 22 bp, Artificial Sequence
  chemically synthesized
ttctttaagcaattgtctaatt

SEQ ID NO: 96261 - DNA, 22 bp, Artificial Sequence
  chemically synthesized
tctttaagcaattgtctaattt

SEQ ID NO: 96262 - DNA, 22 bp, Artificial Sequence
  chemically synthesized
ctttaagcaattgtctaatttt

SEQ ID NO: 96263 - DNA, 22 bp, Artificial Sequence
  chemically synthesized
tttaagcaattgtctaattttt

SEQ ID NO: 96264 - DNA, 22 bp, Artificial Sequence
  chemically synthesized
taagcaattgtctaatttttgt

SEQ ID NO: 96265 - DNA, 22 bp, Artificial Sequence
  chemically synthesized
aagcaattgtctaatttttgta

SEQ ID NO: 96266 - DNA, 22 bp, Artificial Sequence
  chemically synthesized
agcaattgtctaatttttgtaa

SEQ ID NO: 96267 - DNA, 22 bp, Artificial Sequence
  chemically synthesized
tctaatttttgtaaatgtagaa

SEQ ID NO: 96268 - DNA, 22 bp, Artificial Sequence
  chemically synthesized
atttttgtaaatgtagaatgtg

SEQ ID NO: 96269 - DNA, 22 bp, Artificial Sequence
  chemically synthesized
ttgtaaatgtagaatgtgagtg

SEQ ID NO: 96270 - DNA, 22 bp, Artificial Sequence
  chemically synthesized
tgtaaatgtagaatgtgagtgc

SEQ ID NO: 96271 - DNA, 22 bp, Artificial Sequence
  chemically synthesized
gtaaatgtagaatgtgagtgct

SEQ ID NO: 96272 - DNA, 22 bp, Artificial Sequence
  chemically synthesized
taaatgtagaatgtgagtgctg

SEQ ID NO: 96273 - DNA, 22 bp, Artificial Sequence
  chemically synthesized
caagagttctcagcgggagttt

SEQ ID NO: 96274 - DNA, 22 bp, Artificial Sequence
  chemically synthesized
tcagcgggagtttaaaatcccc

SEQ ID NO: 96275 - DNA, 22 bp, Artificial Sequence
  chemically synthesized
agcgggagtttaaaatccccaa

SEQ ID NO: 96276 - DNA, 22 bp, Artificial Sequence
  chemically synthesized
aaaatccccaacaaattcggaa

SEQ ID NO: 96277 - DNA, 22 bp, Artificial Sequence
  chemically synthesized
aaatccccaacaaattcggaaa

SEQ ID NO: 96278 - DNA, 22 bp, Artificial Sequence
  chemically synthesized
ggaaacaagccttcacttggtc

SEQ ID NO: 96279 - DNA, 22 bp, Artificial Sequence
  chemically synthesized
cacttggtcacaatactgatgg

SEQ ID NO: 96280 - DNA, 22 bp, Artificial Sequence
  chemically synthesized
acttggtcacaatactgatggg

SEQ ID NO: 96281 - DNA, 22 bp, Artificial Sequence
  chemically synthesized
ggtcacaatactgatgggaaat

SEQ ID NO: 96282 - DNA, 22 bp, Artificial Sequence
  chemically synthesized
gtcacaatactgatgggaaatt

SEQ ID NO: 96283 - DNA, 22 bp, Artificial Sequence
  chemically synthesized
atgggaaatttaacatatttta

SEQ ID NO: 96284 - DNA, 22 bp, Artificial Sequence
  chemically synthesized
aacatattttagaaaatgtgtc

SEQ ID NO: 96285 - DNA, 22 bp, Artificial Sequence
  chemically synthesized
acatattttagaaaatgtgtct

SEQ ID NO: 96286 - DNA, 22 bp, Artificial Sequence
  chemically synthesized
tagaaaatgtgtcttatttttc

SEQ ID NO: 96287 - DNA, 22 bp, Artificial Sequence
  chemically synthesized
agaaaatgtgtcttatttttct

SEQ ID NO: 96288 - DNA, 22 bp, Artificial Sequence
  chemically synthesized
gaaaatgtgtcttatttttctt

SEQ ID NO: 96289 - DNA, 22 bp, Artificial Sequence
  chemically synthesized
atttttctttgagcaaatcttt

SEQ ID NO: 96290 - DNA, 22 bp, Artificial Sequence
  chemically synthesized
tttttctttgagcaaatctttt

SEQ ID NO: 96291 - DNA, 22 bp, Artificial Sequence
  chemically synthesized
ttctttgagcaaatcttttatt

SEQ ID NO: 96292 - DNA, 22 bp, Artificial Sequence
  chemically synthesized
tctttgagcaaatcttttattt

SEQ ID NO: 96293 - DNA, 22 bp, Artificial Sequence
  chemically synthesized
ctttgagcaaatcttttatttt

SEQ ID NO: 96294 - DNA, 22 bp, Artificial Sequence
  chemically synthesized
tttgagcaaatcttttattttt

SEQ ID NO: 96295 - DNA, 22 bp, Artificial Sequence
  chemically synthesized
tgagcaaatcttttattttttt

SEQ ID NO: 96296 - DNA, 22 bp, Artificial Sequence
  chemically synthesized
gagcaaatcttttatttttttt

SEQ ID NO: 96297 - DNA, 22 bp, Artificial Sequence
  chemically synthesized
agcaaatcttttattttttttg

SEQ ID NO: 96298 - DNA, 22 bp, Artificial Sequence
  chemically synthesized
ttattttttttgcaaaaatctc

SEQ ID NO: 96299 - DNA, 22 bp, Artificial Sequence
  chemically synthesized
tattttttttgcaaaaatctct

SEQ ID NO: 96300 - DNA, 22 bp, Artificial Sequence
  chemically synthesized
attttttttgcaaaaatctctt

SEQ ID NO: 96301 - DNA, 22 bp, Artificial Sequence
  chemically synthesized
ttttttttgcaaaaatctcttt

SEQ ID NO: 96302 - DNA, 22 bp, Artificial Sequence
  chemically synthesized
tttttgcaaaaatctctttcta

SEQ ID NO: 96303 - DNA, 22 bp, Artificial Sequence
  chemically synthesized
ttttgcaaaaatctctttctaa

SEQ ID NO: 96304 - DNA, 22 bp, Artificial Sequence
  chemically synthesized
tttgcaaaaatctctttctaaa

SEQ ID NO: 96305 - DNA, 22 bp, Artificial Sequence
  chemically synthesized
ttgcaaaaatctctttctaaac

SEQ ID NO: 96306 - DNA, 22 bp, Artificial Sequence
  chemically synthesized
tgcaaaaatctctttctaaacc

SEQ ID NO: 96307 - DNA, 22 bp, Artificial Sequence
  chemically synthesized
gcaaaaatctctttctaaacct

SEQ ID NO: 96308 - DNA, 22 bp, Artificial Sequence
  chemically synthesized
caaaaatctctttctaaacctc

SEQ ID NO: 96309 - DNA, 22 bp, Artificial Sequence
  chemically synthesized
tttctaaacctcaattatcatg

SEQ ID NO: 96310 - DNA, 22 bp, Artificial Sequence
  chemically synthesized
tctaaacctcaattatcatgac

SEQ ID NO: 96311 - DNA, 22 bp, Artificial Sequence
  chemically synthesized
ctaaacctcaattatcatgacc

SEQ ID NO: 96312 - DNA, 22 bp, Artificial Sequence
  chemically synthesized
taaacctcaattatcatgaccc

SEQ ID NO: 96313 - DNA, 22 bp, Artificial Sequence
  chemically synthesized
aacctcaattatcatgacccac

SEQ ID NO: 96314 - DNA, 22 bp, Artificial Sequence
  chemically synthesized
aattatcatgacccacataaaa

SEQ ID NO: 96315 - DNA, 22 bp, Artificial Sequence
  chemically synthesized
tcatgacccacataaaataagg

SEQ ID NO: 96316 - DNA, 22 bp, Artificial Sequence
  chemically synthesized
ctatttccttgaaatggacttt

SEQ ID NO: 96317 - DNA, 22 bp, Artificial Sequence
  chemically synthesized
tatttccttgaaatggactttc

SEQ ID NO: 96318 - DNA, 22 bp, Artificial Sequence
  chemically synthesized
tttccttgaaatggactttcat

SEQ ID NO: 96319 - DNA, 22 bp, Artificial Sequence
  chemically synthesized
ccttgaaatggactttcatcta

SEQ ID NO: 96320 - DNA, 22 bp, Artificial Sequence
  chemically synthesized
cttgaaatggactttcatctac

SEQ ID NO: 96321 - DNA, 22 bp, Artificial Sequence
  chemically synthesized
gaaatggactttcatctaccaa

SEQ ID NO: 96322 - DNA, 22 bp, Artificial Sequence
  chemically synthesized
aaatggactttcatctaccaaa

SEQ ID NO: 96323 - DNA, 22 bp, Artificial Sequence
  chemically synthesized
tcatctaccaaaagccaaattt

SEQ ID NO: 96324 - DNA, 22 bp, Artificial Sequence
  chemically synthesized
catctaccaaaagccaaatttc

SEQ ID NO: 96325 - DNA, 22 bp, Artificial Sequence
  chemically synthesized
atctaccaaaagccaaatttca

SEQ ID NO: 96326 - DNA, 22 bp, Artificial Sequence
  chemically synthesized
ccaaaagccaaatttcattctt

SEQ ID NO: 96327 - DNA, 22 bp, Artificial Sequence
  chemically synthesized
cattcttctttcacaagtctac

SEQ ID NO: 96328 - DNA, 22 bp, Artificial Sequence
  chemically synthesized
attcttctttcacaagtctaca

SEQ ID NO: 96329 - DNA, 22 bp, Artificial Sequence
  chemically synthesized
ttctttcacaagtctacaattc

SEQ ID NO: 96330 - DNA, 22 bp, Artificial Sequence
  chemically synthesized
ctttcacaagtctacaattcta

SEQ ID NO: 96331 - DNA, 22 bp, Artificial Sequence
  chemically synthesized
tttcacaagtctacaattctat

SEQ ID NO: 96332 - DNA, 22 bp, Artificial Sequence
  chemically synthesized
tcacaagtctacaattctataa

SEQ ID NO: 96333 - DNA, 22 bp, Artificial Sequence
  chemically synthesized
cacaagtctacaattctataat

SEQ ID NO: 96334 - DNA, 22 bp, Artificial Sequence
  chemically synthesized
acaagtctacaattctataata

SEQ ID NO: 96335 - DNA, 22 bp, Artificial Sequence
  chemically synthesized
caattctataatacaattctct

SEQ ID NO: 96336 - DNA, 22 bp, Artificial Sequence
  chemically synthesized
tataatacaattctctgggata

SEQ ID NO: 96337 - DNA, 22 bp, Artificial Sequence
  chemically synthesized
taatacaattctctgggataaa

SEQ ID NO: 96338 - DNA, 22 bp, Artificial Sequence
  chemically synthesized
tctgggataaacacatcaagtt

SEQ ID NO: 96339 - DNA, 22 bp, Artificial Sequence
  chemically synthesized
tgggataaacacatcaagttct

SEQ ID NO: 96340 - DNA, 22 bp, Artificial Sequence
  chemically synthesized
ggataaacacatcaagttctgg

SEQ ID NO: 96341 - DNA, 22 bp, Artificial Sequence
  chemically synthesized
tggcaagatttcctgaaaagtt

SEQ ID NO: 96342 - DNA, 22 bp, Artificial Sequence
  chemically synthesized
gcaagatttcctgaaaagttaa

SEQ ID NO: 96343 - DNA, 22 bp, Artificial Sequence
  chemically synthesized
cctgaaaagttaagccaattca

SEQ ID NO: 96344 - DNA, 22 bp, Artificial Sequence
  chemically synthesized
ctgaaaagttaagccaattcag

SEQ ID NO: 96345 - DNA, 22 bp, Artificial Sequence
  chemically synthesized
aaaagttaagccaattcaggct

SEQ ID NO: 96346 - DNA, 22 bp, Artificial Sequence
  chemically synthesized
agccaattcaggctgttagtag

SEQ ID NO: 96347 - DNA, 22 bp, Artificial Sequence
  chemically synthesized
aggctgttagtagtcctttact

SEQ ID NO: 96348 - DNA, 22 bp, Artificial Sequence
  chemically synthesized
ttagtagtcctttactgtcact

SEQ ID NO: 96349 - DNA, 22 bp, Artificial Sequence
  chemically synthesized
gtagtcctttactgtcactagt

SEQ ID NO: 96350 - DNA, 22 bp, Artificial Sequence
  chemically synthesized
tactgtcactagttctgaatca

SEQ ID NO: 96351 - DNA, 22 bp, Artificial Sequence
  chemically synthesized
actgtcactagttctgaatcat

SEQ ID NO: 96352 - DNA, 22 bp, Artificial Sequence
  chemically synthesized
ctgtcactagttctgaatcatg

SEQ ID NO: 96353 - DNA, 22 bp, Artificial Sequence
  chemically synthesized
tcactagttctgaatcatgtaa

SEQ ID NO: 96354 - DNA, 22 bp, Artificial Sequence
  chemically synthesized
gttctgaatcatgtaagttttg

SEQ ID NO: 96355 - DNA, 22 bp, Artificial Sequence
  chemically synthesized
tgaatcatgtaagttttggtta

SEQ ID NO: 96356 - DNA, 22 bp, Artificial Sequence
  chemically synthesized
aatcatgtaagttttggttatg

SEQ ID NO: 96357 - DNA, 22 bp, Artificial Sequence
  chemically synthesized
tggttatgctcactagaagtct

SEQ ID NO: 96358 - DNA, 22 bp, Artificial Sequence
  chemically synthesized
ggttatgctcactagaagtctg

SEQ ID NO: 96359 - DNA, 22 bp, Artificial Sequence
  chemically synthesized
gttatgctcactagaagtctgc

SEQ ID NO: 96360 - DNA, 22 bp, Artificial Sequence
  chemically synthesized
tgctcactagaagtctgctgtt

SEQ ID NO: 96361 - DNA, 22 bp, Artificial Sequence
  chemically synthesized
actagaagtctgctgttctaac

SEQ ID NO: 96362 - DNA, 22 bp, Artificial Sequence
  chemically synthesized
gaagtctgctgttctaacatca

SEQ ID NO: 96363 - DNA, 22 bp, Artificial Sequence
  chemically synthesized
ctgttctaacatcaagctcgac

SEQ ID NO: 96364 - DNA, 22 bp, Artificial Sequence
  chemically synthesized
ttctaacatcaagctcgaccca

SEQ ID NO: 96365 - DNA, 22 bp, Artificial Sequence
  chemically synthesized
taacatcaagctcgacccatga

SEQ ID NO: 96366 - DNA, 22 bp, Artificial Sequence
  chemically synthesized
acatcaagctcgacccatgatt

SEQ ID NO: 96367 - DNA, 22 bp, Artificial Sequence
  chemically synthesized
gacccatgatttctgagatctt

SEQ ID NO: 96368 - DNA, 22 bp, Artificial Sequence
  chemically synthesized
ctgagatctttgttggtctttc

SEQ ID NO: 96369 - DNA, 22 bp, Artificial Sequence
  chemically synthesized
tgagatctttgttggtctttcc

SEQ ID NO: 96370 - DNA, 22 bp, Artificial Sequence
  chemically synthesized
agatctttgttggtctttccaa

SEQ ID NO: 96371 - DNA, 22 bp, Artificial Sequence
  chemically synthesized
tgttggtctttccaataagatt

SEQ ID NO: 96372 - DNA, 22 bp, Artificial Sequence
  chemically synthesized
gttggtctttccaataagatta

SEQ ID NO: 96373 - DNA, 22 bp, Artificial Sequence
  chemically synthesized
ttggtctttccaataagattat

SEQ ID NO: 96374 - DNA, 22 bp, Artificial Sequence
  chemically synthesized
gtctttccaataagattatgag

SEQ ID NO: 96375 - DNA, 22 bp, Artificial Sequence
  chemically synthesized
tccaataagattatgagcttca

SEQ ID NO: 96376 - DNA, 22 bp, Artificial Sequence
  chemically synthesized
ccaataagattatgagcttcaa

SEQ ID NO: 96377 - DNA, 22 bp, Artificial Sequence
  chemically synthesized
caataagattatgagcttcaat

SEQ ID NO: 96378 - DNA, 22 bp, Artificial Sequence
  chemically synthesized
tgagcttcaattaatgtcaaaa

SEQ ID NO: 96379 - DNA, 22 bp, Artificial Sequence
  chemically synthesized
caattaatgtcaaaatataaag

SEQ ID NO: 96380 - DNA, 22 bp, Artificial Sequence
  chemically synthesized
aattaatgtcaaaatataaagc

SEQ ID NO: 96381 - DNA, 22 bp, Artificial Sequence
  chemically synthesized
atgtcaaaatataaagccaaaa

SEQ ID NO: 96382 - DNA, 22 bp, Artificial Sequence
  chemically synthesized
aactcaccttgaagttctcagg

SEQ ID NO: 96383 - DNA, 22 bp, Artificial Sequence
  chemically synthesized
accttgaagttctcaggatcca

SEQ ID NO: 96384 - DNA, 22 bp, Artificial Sequence
  chemically synthesized
gaagttctcaggatccacatgc

SEQ ID NO: 96385 - DNA, 22 bp, Artificial Sequence
  chemically synthesized
aagttctcaggatccacatgca

SEQ ID NO: 96386 - DNA, 22 bp, Artificial Sequence
  chemically synthesized
tcaggatccacatgcagcttgt

SEQ ID NO: 96387 - DNA, 22 bp, Artificial Sequence
  chemically synthesized
aggatccacatgcagcttgtca

SEQ ID NO: 96388 - DNA, 22 bp, Artificial Sequence
  chemically synthesized
gtcacagtgcagctcactcagc

SEQ ID NO: 96389 - DNA, 22 bp, Artificial Sequence
  chemically synthesized
tcacagtgcagctcactcagct

SEQ ID NO: 96390 - DNA, 22 bp, Artificial Sequence
  chemically synthesized
actcagcttagcaaaggcgggc

SEQ ID NO: 96391 - DNA, 22 bp, Artificial Sequence
  chemically synthesized
agcttagcaaaggcgggcttga

SEQ ID NO: 96392 - DNA, 22 bp, Artificial Sequence
  chemically synthesized
agcaaaggcgggcttgaggttg

SEQ ID NO: 96393 - DNA, 22 bp, Artificial Sequence
  chemically synthesized
gcaaaggcgggcttgaggttgt

SEQ ID NO: 96394 - DNA, 22 bp, Artificial Sequence
  chemically synthesized
gaggttgtccatgtttttaata

SEQ ID NO: 96395 - DNA, 22 bp, Artificial Sequence
  chemically synthesized
aggttgtccatgtttttaatag

SEQ ID NO: 96396 - DNA, 22 bp, Artificial Sequence
  chemically synthesized
tccatgtttttaatagcatctc

SEQ ID NO: 96397 - DNA, 22 bp, Artificial Sequence
  chemically synthesized
ttaatagcatctccaaaggaag

SEQ ID NO: 96398 - DNA, 22 bp, Artificial Sequence
  chemically synthesized
taatagcatctccaaaggaagt

SEQ ID NO: 96399 - DNA, 22 bp, Artificial Sequence
  chemically synthesized
aatagcatctccaaaggaagtc

SEQ ID NO: 96400 - DNA, 22 bp, Artificial Sequence
  chemically synthesized
atagcatctccaaaggaagtca

SEQ ID NO: 96401 - DNA, 22 bp, Artificial Sequence
  chemically synthesized
caaaggaagtcagcaccttctt

SEQ ID NO: 96402 - DNA, 22 bp, Artificial Sequence
  chemically synthesized
cttgccatgggccttgaccttg

SEQ ID NO: 96403 - DNA, 22 bp, Artificial Sequence
  chemically synthesized
ttgccatgggccttgaccttgg

SEQ ID NO: 96404 - DNA, 22 bp, Artificial Sequence
  chemically synthesized
gccatgggccttgaccttgggg

SEQ ID NO: 96405 - DNA, 22 bp, Artificial Sequence
  chemically synthesized
ccatgggccttgaccttggggt

SEQ ID NO: 96406 - DNA, 22 bp, Artificial Sequence
  chemically synthesized
gaccttggggttgcccaggatg

SEQ ID NO: 96407 - DNA, 22 bp, Artificial Sequence
  chemically synthesized
accttggggttgcccaggatgg

SEQ ID NO: 96408 - DNA, 22 bp, Artificial Sequence
  chemically synthesized
ggggttgcccaggatggcagag

SEQ ID NO: 96409 - DNA, 22 bp, Artificial Sequence
  chemically synthesized
gggttgcccaggatggcagagg

SEQ ID NO: 96410 - DNA, 22 bp, Artificial Sequence
  chemically synthesized
cccaggatggcagagggagacg

SEQ ID NO: 96411 - DNA, 22 bp, Artificial Sequence
  chemically synthesized
ccaaagctgtcaaaaaatctct

SEQ ID NO: 96412 - DNA, 22 bp, Artificial Sequence
  chemically synthesized
caaagctgtcaaaaaatctctg

SEQ ID NO: 96413 - DNA, 22 bp, Artificial Sequence
  chemically synthesized
tcaaaaaatctctgggtccagg

SEQ ID NO: 96414 - DNA, 22 bp, Artificial Sequence
  chemically synthesized
tgggtccaggggtaaacaacga

SEQ ID NO: 96415 - DNA, 22 bp, Artificial Sequence
  chemically synthesized
ggtccaggggtaaacaacgagg

SEQ ID NO: 96416 - DNA, 22 bp, Artificial Sequence
  chemically synthesized
tgaaatgacaccatatcagata

SEQ ID NO: 96417 - DNA, 22 bp, Artificial Sequence
  chemically synthesized
gagatgcaaaaaatcttgagga

SEQ ID NO: 96418 - DNA, 22 bp, Artificial Sequence
  chemically synthesized
gaggactttcccaatcaacttg

SEQ ID NO: 96419 - DNA, 22 bp, Artificial Sequence
  chemically synthesized
aggactttcccaatcaacttgc

SEQ ID NO: 96420 - DNA, 22 bp, Artificial Sequence
  chemically synthesized
tcccaatcaacttgctagggta

SEQ ID NO: 96421 - DNA, 22 bp, Artificial Sequence
  chemically synthesized
cccaatcaacttgctagggtaa

SEQ ID NO: 96422 - DNA, 22 bp, Artificial Sequence
  chemically synthesized
ccaatcaacttgctagggtaat

SEQ ID NO: 96423 - DNA, 22 bp, Artificial Sequence
  chemically synthesized
gctagggtaatattcacccttc

SEQ ID NO: 96424 - DNA, 22 bp, Artificial Sequence
  chemically synthesized
ctagggtaatattcacccttca

SEQ ID NO: 96425 - DNA, 22 bp, Artificial Sequence
  chemically synthesized
gggtaatattcacccttcattc

SEQ ID NO: 96426 - DNA, 22 bp, Artificial Sequence
  chemically synthesized
acccttcattcccatgcattga

SEQ ID NO: 96427 - DNA, 22 bp, Artificial Sequence
  chemically synthesized
cattcccatgcattgagaacca

SEQ ID NO: 96428 - DNA, 22 bp, Artificial Sequence
  chemically synthesized
attcccatgcattgagaaccaa

SEQ ID NO: 96429 - DNA, 22 bp, Artificial Sequence
  chemically synthesized
ccatgcattgagaaccaatgct

SEQ ID NO: 96430 - DNA, 22 bp, Artificial Sequence
  chemically synthesized
agaaccaatgcttacctgccca

SEQ ID NO: 96431 - DNA, 22 bp, Artificial Sequence
  chemically synthesized
acctgcccaaggcttcacctcc

SEQ ID NO: 96432 - DNA, 22 bp, Artificial Sequence
  chemically synthesized
cctgcccaaggcttcacctcca

SEQ ID NO: 96433 - DNA, 22 bp, Artificial Sequence
  chemically synthesized
cccaaggcttcacctccagcct

SEQ ID NO: 96434 - DNA, 22 bp, Artificial Sequence
  chemically synthesized
cacctccagcctcttccacatt

SEQ ID NO: 96435 - DNA, 22 bp, Artificial Sequence
  chemically synthesized
acctccagcctcttccacattc

SEQ ID NO: 96436 - DNA, 22 bp, Artificial Sequence
  chemically synthesized
cagcctcttccacattcatctt

SEQ ID NO: 96437 - DNA, 22 bp, Artificial Sequence
  chemically synthesized
ttccacattcatcttgctccac

SEQ ID NO: 96438 - DNA, 22 bp, Artificial Sequence
  chemically synthesized
ccacattcatcttgctccacag

SEQ ID NO: 96439 - DNA, 22 bp, Artificial Sequence
  chemically synthesized
cacattcatcttgctccacagg

SEQ ID NO: 96440 - DNA, 22 bp, Artificial Sequence
  chemically synthesized
atcttgctccacaggctagtga

SEQ ID NO: 96441 - DNA, 22 bp, Artificial Sequence
  chemically synthesized
gctccacaggctagtgacggca

SEQ ID NO: 96442 - DNA, 22 bp, Artificial Sequence
  chemically synthesized
ctccacaggctagtgacggcag

SEQ ID NO: 96443 - DNA, 22 bp, Artificial Sequence
  chemically synthesized
cacaggctagtgacggcagcct

SEQ ID NO: 96444 - DNA, 22 bp, Artificial Sequence
  chemically synthesized
gtgacggcagccttctcctcag

SEQ ID NO: 96445 - DNA, 22 bp, Artificial Sequence
  chemically synthesized
ctcctcagcagtaaaatgcacc

SEQ ID NO: 96446 - DNA, 22 bp, Artificial Sequence
  chemically synthesized
tcctcagcagtaaaatgcacca

SEQ ID NO: 96447 - DNA, 22 bp, Artificial Sequence
  chemically synthesized
ctcagcagtaaaatgcaccatg

SEQ ID NO: 96448 - DNA, 22 bp, Artificial Sequence
  chemically synthesized
agcagtaaaatgcaccatgatg

SEQ ID NO: 96449 - DNA, 22 bp, Artificial Sequence
  chemically synthesized
agagcttgctagtgattgcagc

SEQ ID NO: 96450 - DNA, 22 bp, Artificial Sequence
  chemically synthesized
gctagtgattgcagctgtgtcg

SEQ ID NO: 96451 - DNA, 22 bp, Artificial Sequence
  chemically synthesized
ctagtgattgcagctgtgtcgg

SEQ ID NO: 96452 - DNA, 22 bp, Artificial Sequence
  chemically synthesized
gtgattgcagctgtgtcggaag

SEQ ID NO: 96453 - DNA, 22 bp, Artificial Sequence
  chemically synthesized
cagctgtgtcggaagcagatat

SEQ ID NO: 96454 - DNA, 22 bp, Artificial Sequence
  chemically synthesized
tgtcggaagcagatatgtgctg

SEQ ID NO: 96455 - DNA, 22 bp, Artificial Sequence
  chemically synthesized
ctgcctctctgtctggcctttt

SEQ ID NO: 96456 - DNA, 22 bp, Artificial Sequence
  chemically synthesized
cctctctgtctggccttttatt

SEQ ID NO: 96457 - DNA, 22 bp, Artificial Sequence
  chemically synthesized
tctgtctggccttttattcttt

SEQ ID NO: 96458 - DNA, 22 bp, Artificial Sequence
  chemically synthesized
tgtctggccttttattctttac

SEQ ID NO: 96459 - DNA, 22 bp, Artificial Sequence
  chemically synthesized
tctggccttttattctttactg

SEQ ID NO: 96460 - DNA, 22 bp, Artificial Sequence
  chemically synthesized
gccttttattctttactgccga

SEQ ID NO: 96461 - DNA, 22 bp, Artificial Sequence
  chemically synthesized
ttattctttactgccgaagttc

SEQ ID NO: 96462 - DNA, 22 bp, Artificial Sequence
  chemically synthesized
tattctttactgccgaagttct

SEQ ID NO: 96463 - DNA, 22 bp, Artificial Sequence
  chemically synthesized
attctttactgccgaagttctg

SEQ ID NO: 96464 - DNA, 22 bp, Artificial Sequence
  chemically synthesized
ttctttactgccgaagttctgg

SEQ ID NO: 96465 - DNA, 22 bp, Artificial Sequence
  chemically synthesized
tttactgccgaagttctggccc

SEQ ID NO: 96466 - DNA, 22 bp, Artificial Sequence
  chemically synthesized
tactgccgaagttctggccccc

SEQ ID NO: 96467 - DNA, 22 bp, Artificial Sequence
  chemically synthesized
actgccgaagttctggccccct

SEQ ID NO: 96468 - DNA, 22 bp, Artificial Sequence
  chemically synthesized
ctgccgaagttctggccccctg

SEQ ID NO: 96469 - DNA, 22 bp, Artificial Sequence
  chemically synthesized
ccgaagttctggccccctgttc

SEQ ID NO: 96470 - DNA, 22 bp, Artificial Sequence
  chemically synthesized
tggccccctgttctccatggta

SEQ ID NO: 96471 - DNA, 22 bp, Artificial Sequence
  chemically synthesized
gccccctgttctccatggtact

SEQ ID NO: 96472 - DNA, 22 bp, Artificial Sequence
  chemically synthesized
ttctccatggtacttaaaagtc

SEQ ID NO: 96473 - DNA, 22 bp, Artificial Sequence
  chemically synthesized
tccatggtacttaaaagtcatt

SEQ ID NO: 96474 - DNA, 22 bp, Artificial Sequence
  chemically synthesized
catggtacttaaaagtcattgg

SEQ ID NO: 96475 - DNA, 22 bp, Artificial Sequence
  chemically synthesized
aaaagtcattggtcaaggctga

SEQ ID NO: 96476 - DNA, 22 bp, Artificial Sequence
  chemically synthesized
aaagtcattggtcaaggctgac

SEQ ID NO: 96477 - DNA, 22 bp, Artificial Sequence
  chemically synthesized
gtcaaggctgacctgtgtccct

SEQ ID NO: 96478 - DNA, 22 bp, Artificial Sequence
  chemically synthesized
acctgtgtccctcaggggtgga

SEQ ID NO: 96479 - DNA, 22 bp, Artificial Sequence
  chemically synthesized
tgtccctcaggggtggagtcag

SEQ ID NO: 96480 - DNA, 22 bp, Artificial Sequence
  chemically synthesized
aggggtggagtcaggtccggag

SEQ ID NO: 96481 - DNA, 22 bp, Artificial Sequence
  chemically synthesized
agtttgtgataatgtgtgctgg

SEQ ID NO: 96482 - DNA, 22 bp, Artificial Sequence
  chemically synthesized
gtgataatgtgtgctggatcct

SEQ ID NO: 96483 - DNA, 22 bp, Artificial Sequence
  chemically synthesized
tgataatgtgtgctggatcctg

SEQ ID NO: 96484 - DNA, 22 bp, Artificial Sequence
  chemically synthesized
gatcctgaggctcttttttgtt

SEQ ID NO: 96485 - DNA, 22 bp, Artificial Sequence
  chemically synthesized
aggctcttttttgttggctcct

SEQ ID NO: 96486 - DNA, 22 bp, Artificial Sequence
  chemically synthesized
ttttttgttggctcctcatcta

SEQ ID NO: 96487 - DNA, 22 bp, Artificial Sequence
  chemically synthesized
ttttgttggctcctcatctatc

SEQ ID NO: 96488 - DNA, 22 bp, Artificial Sequence
  chemically synthesized
tttgttggctcctcatctatct

SEQ ID NO: 96489 - DNA, 22 bp, Artificial Sequence
  chemically synthesized
ttgttggctcctcatctatctg

SEQ ID NO: 96490 - DNA, 22 bp, Artificial Sequence
  chemically synthesized
tgttggctcctcatctatctgc

SEQ ID NO: 96491 - DNA, 22 bp, Artificial Sequence
  chemically synthesized
gttggctcctcatctatctgca

SEQ ID NO: 96492 - DNA, 22 bp, Artificial Sequence
  chemically synthesized
ttggctcctcatctatctgcaa

SEQ ID NO: 96493 - DNA, 22 bp, Artificial Sequence
  chemically synthesized
gctcctcatctatctgcaacac

SEQ ID NO: 96494 - DNA, 22 bp, Artificial Sequence
  chemically synthesized
ctcatctatctgcaacacaaat

SEQ ID NO: 96495 - DNA, 22 bp, Artificial Sequence
  chemically synthesized
atctatctgcaacacaaatttc

SEQ ID NO: 96496 - DNA, 22 bp, Artificial Sequence
  chemically synthesized
tctgcaacacaaatttccattt

SEQ ID NO: 96497 - DNA, 22 bp, Artificial Sequence
  chemically synthesized
caacacaaatttccatttgtcc

SEQ ID NO: 96498 - DNA, 22 bp, Artificial Sequence
  chemically synthesized
ccatttgtccccttttttaccc

SEQ ID NO: 96499 - DNA, 22 bp, Artificial Sequence
  chemically synthesized
catttgtccccttttttaccct

SEQ ID NO: 96500 - DNA, 22 bp, Artificial Sequence
  chemically synthesized
gtccccttttttaccctcttca

SEQ ID NO: 96501 - DNA, 22 bp, Artificial Sequence
  chemically synthesized
tccccttttttaccctcttcat

SEQ ID NO: 96502 - DNA, 22 bp, Artificial Sequence
  chemically synthesized
ttttaccctcttcatcatcttc

SEQ ID NO: 96503 - DNA, 22 bp, Artificial Sequence
  chemically synthesized
tttaccctcttcatcatcttcc

SEQ ID NO: 96504 - DNA, 22 bp, Artificial Sequence
  chemically synthesized
ttaccctcttcatcatcttcca

SEQ ID NO: 96505 - DNA, 22 bp, Artificial Sequence
  chemically synthesized
taccctcttcatcatcttccaa

SEQ ID NO: 96506 - DNA, 22 bp, Artificial Sequence
  chemically synthesized
accctcttcatcatcttccaaa

SEQ ID NO: 96507 - DNA, 22 bp, Artificial Sequence
  chemically synthesized
ccctcttcatcatcttccaaaa

SEQ ID NO: 96508 - DNA, 22 bp, Artificial Sequence
  chemically synthesized
ttcatcatcttccaaaatgata

SEQ ID NO: 96509 - DNA, 22 bp, Artificial Sequence
  chemically synthesized
catcatcttccaaaatgatatc

SEQ ID NO: 96510 - DNA, 22 bp, Artificial Sequence
  chemically synthesized
atcatcttccaaaatgatatcc

SEQ ID NO: 96511 - DNA, 22 bp, Artificial Sequence
  chemically synthesized
ccaaaatgatatccatctctcc

SEQ ID NO: 96512 - DNA, 22 bp, Artificial Sequence
  chemically synthesized
caaaatgatatccatctctccc

SEQ ID NO: 96513 - DNA, 22 bp, Artificial Sequence
  chemically synthesized
tcccattctccttttccaagaa

SEQ ID NO: 96514 - DNA, 22 bp, Artificial Sequence
  chemically synthesized
ccattctccttttccaagaaag

SEQ ID NO: 96515 - DNA, 22 bp, Artificial Sequence
  chemically synthesized
tccttttccaagaaagcctcat

SEQ ID NO: 96516 - DNA, 22 bp, Artificial Sequence
  chemically synthesized
cttttccaagaaagcctcatat

SEQ ID NO: 96517 - DNA, 22 bp, Artificial Sequence
  chemically synthesized
ttccaagaaagcctcatataaa

SEQ ID NO: 96518 - DNA, 22 bp, Artificial Sequence
  chemically synthesized
tccaagaaagcctcatataaag

SEQ ID NO: 96519 - DNA, 22 bp, Artificial Sequence
  chemically synthesized
ccaagaaagcctcatataaagg

SEQ ID NO: 96520 - DNA, 22 bp, Artificial Sequence
  chemically synthesized
caagaaagcctcatataaagga

SEQ ID NO: 96521 - DNA, 22 bp, Artificial Sequence
  chemically synthesized
atataaaggagcaaatctcaaa

SEQ ID NO: 96522 - DNA, 22 bp, Artificial Sequence
  chemically synthesized
aaaataggaaaaaaagtttcag

SEQ ID NO: 96523 - DNA, 22 bp, Artificial Sequence
  chemically synthesized
cagccaaagcgcatttaacatt

SEQ ID NO: 96524 - DNA, 22 bp, Artificial Sequence
  chemically synthesized
agccaaagcgcatttaacattt

SEQ ID NO: 96525 - DNA, 22 bp, Artificial Sequence
  chemically synthesized
aacatttgccttaaaggtggtg

SEQ ID NO: 96526 - DNA, 22 bp, Artificial Sequence
  chemically synthesized
acatttgccttaaaggtggtga

SEQ ID NO: 96527 - DNA, 22 bp, Artificial Sequence
  chemically synthesized
gccttaaaggtggtgacagtga

SEQ ID NO: 96528 - DNA, 22 bp, Artificial Sequence
  chemically synthesized
ccttaaaggtggtgacagtgac

SEQ ID NO: 96529 - DNA, 22 bp, Artificial Sequence
  chemically synthesized
aaaggtggtgacagtgacaaaa

SEQ ID NO: 96530 - DNA, 22 bp, Artificial Sequence
  chemically synthesized
aaggtggtgacagtgacaaaaa

SEQ ID NO: 96531 - DNA, 22 bp, Artificial Sequence
  chemically synthesized
ttaaaacagaatctcacccagt

SEQ ID NO: 96532 - DNA, 22 bp, Artificial Sequence
  chemically synthesized
aaacagaatctcacccagttct

SEQ ID NO: 96533 - DNA, 22 bp, Artificial Sequence
  chemically synthesized
acccagttctagctctcttaag

SEQ ID NO: 96534 - DNA, 22 bp, Artificial Sequence
  chemically synthesized
tagctctcttaaggagtgcatt

SEQ ID NO: 96535 - DNA, 22 bp, Artificial Sequence
  chemically synthesized
gctctcttaaggagtgcattgt

SEQ ID NO: 96536 - DNA, 22 bp, Artificial Sequence
  chemically synthesized
tcttaaggagtgcattgtaaac

SEQ ID NO: 96537 - DNA, 22 bp, Artificial Sequence
  chemically synthesized
ttaaggagtgcattgtaaacaa

SEQ ID NO: 96538 - DNA, 22 bp, Artificial Sequence
  chemically synthesized
aaggagtgcattgtaaacaaaa

SEQ ID NO: 96539 - DNA, 22 bp, Artificial Sequence
  chemically synthesized
aggagtgcattgtaaacaaaac

SEQ ID NO: 96540 - DNA, 22 bp, Artificial Sequence
  chemically synthesized
taaacaaaacttctgtacctta

SEQ ID NO: 96541 - DNA, 22 bp, Artificial Sequence
  chemically synthesized
ctgtaccttagtttctctaggg

SEQ ID NO: 96542 - DNA, 22 bp, Artificial Sequence
  chemically synthesized
tgtaccttagtttctctaggga

SEQ ID NO: 96543 - DNA, 22 bp, Artificial Sequence
  chemically synthesized
taccttagtttctctagggaga

SEQ ID NO: 96544 - DNA, 22 bp, Artificial Sequence
  chemically synthesized
agtttctctagggagacaaaaa

SEQ ID NO: 96545 - DNA, 22 bp, Artificial Sequence
  chemically synthesized
gtttctctagggagacaaaaac

SEQ ID NO: 96546 - DNA, 22 bp, Artificial Sequence
  chemically synthesized
ctctagggagacaaaaaccgta

SEQ ID NO: 96547 - DNA, 22 bp, Artificial Sequence
  chemically synthesized
tctagggagacaaaaaccgtac

SEQ ID NO: 96548 - DNA, 22 bp, Artificial Sequence
  chemically synthesized
tagggagacaaaaaccgtacat

SEQ ID NO: 96549 - DNA, 22 bp, Artificial Sequence
  chemically synthesized
gggagacaaaaaccgtacatag

SEQ ID NO: 96550 - DNA, 22 bp, Artificial Sequence
  chemically synthesized
cttctagaaactgaacagaata

SEQ ID NO: 96551 - DNA, 22 bp, Artificial Sequence
  chemically synthesized
ctagaaactgaacagaatagca

SEQ ID NO: 96552 - DNA, 22 bp, Artificial Sequence
  chemically synthesized
tagaaactgaacagaatagcaa

SEQ ID NO: 96553 - DNA, 22 bp, Artificial Sequence
  chemically synthesized
gaaactgaacagaatagcaagt

SEQ ID NO: 96554 - DNA, 22 bp, Artificial Sequence
  chemically synthesized
aacagaatagcaagtagtccac

SEQ ID NO: 96555 - DNA, 22 bp, Artificial Sequence
  chemically synthesized
aagccttaatcccaaagtacag

SEQ ID NO: 96556 - DNA, 22 bp, Artificial Sequence
  chemically synthesized
aatcccaaagtacagtaccttg

SEQ ID NO: 96557 - DNA, 22 bp, Artificial Sequence
  chemically synthesized
atcccaaagtacagtaccttgg

SEQ ID NO: 96558 - DNA, 22 bp, Artificial Sequence
  chemically synthesized
ggggtgattccctagagaggac

SEQ ID NO: 96559 - DNA, 22 bp, Artificial Sequence
  chemically synthesized
gggtgattccctagagaggaca

SEQ ID NO: 96560 - DNA, 22 bp, Artificial Sequence
  chemically synthesized
cctagagaggacagacagaaaa

SEQ ID NO: 96561 - DNA, 22 bp, Artificial Sequence
  chemically synthesized
gagaggacagacagaaaagatt

SEQ ID NO: 96562 - DNA, 22 bp, Artificial Sequence
  chemically synthesized
catccagtgcttccagagaatc

SEQ ID NO: 96563 - DNA, 22 bp, Artificial Sequence
  chemically synthesized
ccagagaatcctctctcttttc

SEQ ID NO: 96564 - DNA, 22 bp, Artificial Sequence
  chemically synthesized
cagagaatcctctctcttttca

SEQ ID NO: 96565 - DNA, 22 bp, Artificial Sequence
  chemically synthesized
tctcttttcatttctctatgac

SEQ ID NO: 96566 - DNA, 22 bp, Artificial Sequence
  chemically synthesized
tcttttcatttctctatgacca

SEQ ID NO: 96567 - DNA, 22 bp, Artificial Sequence
  chemically synthesized
ttttcatttctctatgaccaca

SEQ ID NO: 96568 - DNA, 22 bp, Artificial Sequence
  chemically synthesized
ttcatttctctatgaccacagg

SEQ ID NO: 96569 - DNA, 22 bp, Artificial Sequence
  chemically synthesized
tcatttctctatgaccacaggg

SEQ ID NO: 96570 - DNA, 22 bp, Artificial Sequence
  chemically synthesized
catttctctatgaccacagggg

SEQ ID NO: 96571 - DNA, 22 bp, Artificial Sequence
  chemically synthesized
atttctctatgaccacagggga

SEQ ID NO: 96572 - DNA, 22 bp, Artificial Sequence
  chemically synthesized
ctctatgaccacaggggacatt

SEQ ID NO: 96573 - DNA, 22 bp, Artificial Sequence
  chemically synthesized
tctatgaccacaggggacattg

SEQ ID NO: 96574 - DNA, 22 bp, Artificial Sequence
  chemically synthesized
tatgaccacaggggacattggc

SEQ ID NO: 96575 - DNA, 22 bp, Artificial Sequence
  chemically synthesized
tgaccacaggggacattggcta

SEQ ID NO: 96576 - DNA, 22 bp, Artificial Sequence
  chemically synthesized
gctactttgtgagtattgcctg

SEQ ID NO: 96577 - DNA, 22 bp, Artificial Sequence
  chemically synthesized
ctttgtgagtattgcctggggc

SEQ ID NO: 96578 - DNA, 22 bp, Artificial Sequence
  chemically synthesized
tgtgagtattgcctggggctct

SEQ ID NO: 96579 - DNA, 22 bp, Artificial Sequence
  chemically synthesized
gtgagtattgcctggggctctc

SEQ ID NO: 96580 - DNA, 22 bp, Artificial Sequence
  chemically synthesized
tgagtattgcctggggctctct

SEQ ID NO: 96581 - DNA, 22 bp, Artificial Sequence
  chemically synthesized
cctggggctctcttcttgcttg

SEQ ID NO: 96582 - DNA, 22 bp, Artificial Sequence
  chemically synthesized
gggctctcttcttgcttgcctg

SEQ ID NO: 96583 - DNA, 22 bp, Artificial Sequence
  chemically synthesized
tcttcttgcttgcctgtctgtc

SEQ ID NO: 96584 - DNA, 22 bp, Artificial Sequence
  chemically synthesized
ttcttgcttgcctgtctgtcct

SEQ ID NO: 96585 - DNA, 22 bp, Artificial Sequence
  chemically synthesized
cttgcttgcctgtctgtcctgc

SEQ ID NO: 96586 - DNA, 22 bp, Artificial Sequence
  chemically synthesized
ttgcttgcctgtctgtcctgct

SEQ ID NO: 96587 - DNA, 22 bp, Artificial Sequence
  chemically synthesized
gcttgcctgtctgtcctgctta

SEQ ID NO: 96588 - DNA, 22 bp, Artificial Sequence
  chemically synthesized
cttgcctgtctgtcctgcttat

SEQ ID NO: 96589 - DNA, 22 bp, Artificial Sequence
  chemically synthesized
gcctgtctgtcctgcttatact

SEQ ID NO: 96590 - DNA, 22 bp, Artificial Sequence
  chemically synthesized
cctgtctgtcctgcttatactt

SEQ ID NO: 96591 - DNA, 22 bp, Artificial Sequence
  chemically synthesized
tctgtcctgcttatacttctca

SEQ ID NO: 96592 - DNA, 22 bp, Artificial Sequence
  chemically synthesized
tcctgcttatacttctcactgg

SEQ ID NO: 96593 - DNA, 22 bp, Artificial Sequence
  chemically synthesized
cttatacttctcactgggaagg

SEQ ID NO: 96594 - DNA, 22 bp, Artificial Sequence
  chemically synthesized
atacttctcactgggaagggag

SEQ ID NO: 96595 - DNA, 22 bp, Artificial Sequence
  chemically synthesized
tacttctcactgggaagggagc

SEQ ID NO: 96596 - DNA, 22 bp, Artificial Sequence
  chemically synthesized
ctcactgggaagggagctgaga

SEQ ID NO: 96597 - DNA, 22 bp, Artificial Sequence
  chemically synthesized
tcactgggaagggagctgagaa

SEQ ID NO: 96598 - DNA, 22 bp, Artificial Sequence
  chemically synthesized
actgggaagggagctgagaagc

SEQ ID NO: 96599 - DNA, 22 bp, Artificial Sequence
  chemically synthesized
ggaagggagctgagaagcctaa

SEQ ID NO: 96600 - DNA, 22 bp, Artificial Sequence
  chemically synthesized
agaagcctaaaatcctaaaatt

SEQ ID NO: 96601 - DNA, 22 bp, Artificial Sequence
  chemically synthesized
aaatcctaaaattatttaaagc

SEQ ID NO: 96602 - DNA, 22 bp, Artificial Sequence
  chemically synthesized
aaattatttaaagccagaattt

SEQ ID NO: 96603 - DNA, 22 bp, Artificial Sequence
  chemically synthesized
tttaaagccagaatttgtcatc

SEQ ID NO: 96604 - DNA, 22 bp, Artificial Sequence
  chemically synthesized
aaagccagaatttgtcatcaaa

SEQ ID NO: 96605 - DNA, 22 bp, Artificial Sequence
  chemically synthesized
aagccagaatttgtcatcaaac

SEQ ID NO: 96606 - DNA, 22 bp, Artificial Sequence
  chemically synthesized
gtcatcaaacagagaaaaaagt

SEQ ID NO: 96607 - DNA, 22 bp, Artificial Sequence
  chemically synthesized
tcatcaaacagagaaaaaagtg

SEQ ID NO: 96608 - DNA, 22 bp, Artificial Sequence
  chemically synthesized
atcaggctaggagtcagggtat

SEQ ID NO: 96609 - DNA, 22 bp, Artificial Sequence
  chemically synthesized
ggagtcagggtatattattcct

SEQ ID NO: 96610 - DNA, 22 bp, Artificial Sequence
  chemically synthesized
ttcctctagtgtcctttttttt

SEQ ID NO: 96611 - DNA, 22 bp, Artificial Sequence
  chemically synthesized
ctctagtgtccttttttttttc

SEQ ID NO: 96612 - DNA, 22 bp, Artificial Sequence
  chemically synthesized
tagtgtccttttttttttctgt

SEQ ID NO: 96613 - DNA, 22 bp, Artificial Sequence
  chemically synthesized
gtgtccttttttttttctgtat

SEQ ID NO: 96614 - DNA, 22 bp, Artificial Sequence
  chemically synthesized
ttttttttctgtatgtccccat

SEQ ID NO: 96615 - DNA, 22 bp, Artificial Sequence
  chemically synthesized
tttttttctgtatgtccccatt

SEQ ID NO: 96616 - DNA, 22 bp, Artificial Sequence
  chemically synthesized
ttttttctgtatgtccccattt

SEQ ID NO: 96617 - DNA, 22 bp, Artificial Sequence
  chemically synthesized
tttttctgtatgtccccatttt

SEQ ID NO: 96618 - DNA, 22 bp, Artificial Sequence
  chemically synthesized
ttttctgtatgtccccattttg

SEQ ID NO: 96619 - DNA, 22 bp, Artificial Sequence
  chemically synthesized
tttctgtatgtccccattttga

SEQ ID NO: 96620 - DNA, 22 bp, Artificial Sequence
  chemically synthesized
ttctgtatgtccccattttgat

SEQ ID NO: 96621 - DNA, 22 bp, Artificial Sequence
  chemically synthesized
tctgtatgtccccattttgatg

SEQ ID NO: 96622 - DNA, 22 bp, Artificial Sequence
  chemically synthesized
ctgtatgtccccattttgatga

SEQ ID NO: 96623 - DNA, 22 bp, Artificial Sequence
  chemically synthesized
tgtatgtccccattttgatgac

SEQ ID NO: 96624 - DNA, 22 bp, Artificial Sequence
  chemically synthesized
tatgtccccattttgatgactt

SEQ ID NO: 96625 - DNA, 22 bp, Artificial Sequence
  chemically synthesized
tgatgacttgctagctctttac

SEQ ID NO: 96626 - DNA, 22 bp, Artificial Sequence
  chemically synthesized
gatgacttgctagctctttact

SEQ ID NO: 96627 - DNA, 22 bp, Artificial Sequence
  chemically synthesized
atgacttgctagctctttactt

SEQ ID NO: 96628 - DNA, 22 bp, Artificial Sequence
  chemically synthesized
gctagctctttacttggtagag

SEQ ID NO: 96629 - DNA, 22 bp, Artificial Sequence
  chemically synthesized
ctagctctttacttggtagagc

SEQ ID NO: 96630 - DNA, 22 bp, Artificial Sequence
  chemically synthesized
gctctttacttggtagagctga

SEQ ID NO: 96631 - DNA, 22 bp, Artificial Sequence
  chemically synthesized
tttacttggtagagctgaaact

SEQ ID NO: 96632 - DNA, 22 bp, Artificial Sequence
  chemically synthesized
tacttggtagagctgaaactgg

SEQ ID NO: 96633 - DNA, 22 bp, Artificial Sequence
  chemically synthesized
acttggtagagctgaaactgga

SEQ ID NO: 96634 - DNA, 22 bp, Artificial Sequence
  chemically synthesized
cttggtagagctgaaactggaa

SEQ ID NO: 96635 - DNA, 22 bp, Artificial Sequence
  chemically synthesized
ggtagagctgaaactggaagtt

SEQ ID NO: 96636 - DNA, 22 bp, Artificial Sequence
  chemically synthesized
gtagagctgaaactggaagttg

SEQ ID NO: 96637 - DNA, 22 bp, Artificial Sequence
  chemically synthesized
aaactggaagttgggatttaca

SEQ ID NO: 96638 - DNA, 22 bp, Artificial Sequence
  chemically synthesized
gaagttgggatttacagtgtat

SEQ ID NO: 96639 - DNA, 22 bp, Artificial Sequence
  chemically synthesized
ggatttacagtgtattcaattc

SEQ ID NO: 96640 - DNA, 22 bp, Artificial Sequence
  chemically synthesized
acagtgtattcaattcgatcca

SEQ ID NO: 96641 - DNA, 22 bp, Artificial Sequence
  chemically synthesized
cagtgtattcaattcgatccat

SEQ ID NO: 96642 - DNA, 22 bp, Artificial Sequence
  chemically synthesized
aattcgatccatgtgcctgaag

SEQ ID NO: 96643 - DNA, 22 bp, Artificial Sequence
  chemically synthesized
gatccatgtgcctgaagaatat

SEQ ID NO: 96644 - DNA, 22 bp, Artificial Sequence
  chemically synthesized
aagaatattgctcatgctatat

SEQ ID NO: 96645 - DNA, 22 bp, Artificial Sequence
  chemically synthesized
ctcatgctatatcacttaatct

SEQ ID NO: 96646 - DNA, 22 bp, Artificial Sequence
  chemically synthesized
atgctatatcacttaatctgcc

SEQ ID NO: 96647 - DNA, 22 bp, Artificial Sequence
  chemically synthesized
tatcacttaatctgcccttata

SEQ ID NO: 96648 - DNA, 22 bp, Artificial Sequence
  chemically synthesized
aatctgcccttataataccatt

SEQ ID NO: 96649 - DNA, 22 bp, Artificial Sequence
  chemically synthesized
atctgcccttataataccattg

SEQ ID NO: 96650 - DNA, 22 bp, Artificial Sequence
  chemically synthesized
cccttataataccattgtcatt

SEQ ID NO: 96651 - DNA, 22 bp, Artificial Sequence
  chemically synthesized
ataataccattgtcattatcct

SEQ ID NO: 96652 - DNA, 22 bp, Artificial Sequence
  chemically synthesized
taataccattgtcattatcctc

SEQ ID NO: 96653 - DNA, 22 bp, Artificial Sequence
  chemically synthesized
tcattatcctcatattttagaa

SEQ ID NO: 96654 - DNA, 22 bp, Artificial Sequence
  chemically synthesized
tcctcatattttagaatcaagg

SEQ ID NO: 96655 - DNA, 22 bp, Artificial Sequence
  chemically synthesized
atattttagaatcaaggaataa

SEQ ID NO: 96656 - DNA, 22 bp, Artificial Sequence
  chemically synthesized
tagaatcaaggaataaattcac

SEQ ID NO: 96657 - DNA, 22 bp, Artificial Sequence
  chemically synthesized
agaatcaaggaataaattcaca

SEQ ID NO: 96658 - DNA, 22 bp, Artificial Sequence
  chemically synthesized
gaatcaaggaataaattcacag

SEQ ID NO: 96659 - DNA, 22 bp, Artificial Sequence
  chemically synthesized
acagaaattatttaactatcaa

SEQ ID NO: 96660 - DNA, 22 bp, Artificial Sequence
  chemically synthesized
tttaactatcaatgtgacagaa

SEQ ID NO: 96661 - DNA, 22 bp, Artificial Sequence
  chemically synthesized
aactatcaatgtgacagaagta

SEQ ID NO: 96662 - DNA, 22 bp, Artificial Sequence
  chemically synthesized
actatcaatgtgacagaagtaa

SEQ ID NO: 96663 - DNA, 22 bp, Artificial Sequence
  chemically synthesized
tcaatgtgacagaagtaatgat

SEQ ID NO: 96664 - DNA, 22 bp, Artificial Sequence
  chemically synthesized
ggggaataatagaagcagagtt

SEQ ID NO: 96665 - DNA, 22 bp, Artificial Sequence
  chemically synthesized
cacaaattccagcattgttaat

SEQ ID NO: 96666 - DNA, 22 bp, Artificial Sequence
  chemically synthesized
cagcattgttaattctataaaa

SEQ ID NO: 96667 - DNA, 22 bp, Artificial Sequence
  chemically synthesized
ttaattctataaaagtccctta

SEQ ID NO: 96668 - DNA, 22 bp, Artificial Sequence
  chemically synthesized
attctataaaagtcccttacat

SEQ ID NO: 96669 - DNA, 22 bp, Artificial Sequence
  chemically synthesized
tataaaagtcccttacatcacc

SEQ ID NO: 96670 - DNA, 22 bp, Artificial Sequence
  chemically synthesized
taaaagtcccttacatcaccat

SEQ ID NO: 96671 - DNA, 22 bp, Artificial Sequence
  chemically synthesized
acatcaccataatctcattgcc

SEQ ID NO: 96672 - DNA, 22 bp, Artificial Sequence
  chemically synthesized
catcaccataatctcattgccc

SEQ ID NO: 96673 - DNA, 22 bp, Artificial Sequence
  chemically synthesized
attgccccagcccagttcctcc

SEQ ID NO: 96674 - DNA, 22 bp, Artificial Sequence
  chemically synthesized
ccccagcccagttcctccttct

SEQ ID NO: 96675 - DNA, 22 bp, Artificial Sequence
  chemically synthesized
ctccttctggcttgttctacat

SEQ ID NO: 96676 - DNA, 22 bp, Artificial Sequence
  chemically synthesized
cttctggcttgttctacatcca

SEQ ID NO: 96677 - DNA, 22 bp, Artificial Sequence
  chemically synthesized
ctggcttgttctacatccattt

SEQ ID NO: 96678 - DNA, 22 bp, Artificial Sequence
  chemically synthesized
tggcttgttctacatccattta

SEQ ID NO: 96679 - DNA, 22 bp, Artificial Sequence
  chemically synthesized
gcttgttctacatccatttatt

SEQ ID NO: 96680 - DNA, 22 bp, Artificial Sequence
  chemically synthesized
gttctacatccatttatttttt

SEQ ID NO: 96681 - DNA, 22 bp, Artificial Sequence
  chemically synthesized
ttctacatccatttattttttc

SEQ ID NO: 96682 - DNA, 22 bp, Artificial Sequence
  chemically synthesized
tacatccatttattttttcttt

SEQ ID NO: 96683 - DNA, 22 bp, Artificial Sequence
  chemically synthesized
catccatttattttttcttttt

SEQ ID NO: 96684 - DNA, 22 bp, Artificial Sequence
  chemically synthesized
attttttcttttttctttttct

SEQ ID NO: 96685 - DNA, 22 bp, Artificial Sequence
  chemically synthesized
ttttttcttttttctttttctt

SEQ ID NO: 96686 - DNA, 22 bp, Artificial Sequence
  chemically synthesized
tttcttttttctttttcttttc

SEQ ID NO: 96687 - DNA, 22 bp, Artificial Sequence
  chemically synthesized
ttcttttttctttttcttttct

SEQ ID NO: 96688 - DNA, 22 bp, Artificial Sequence
  chemically synthesized
tcttttttctttttcttttctt

SEQ ID NO: 96689 - DNA, 22 bp, Artificial Sequence
  chemically synthesized
cttttttctttttcttttcttt

SEQ ID NO: 96690 - DNA, 22 bp, Artificial Sequence
  chemically synthesized
ttttttctttttcttttctttc

SEQ ID NO: 96691 - DNA, 22 bp, Artificial Sequence
  chemically synthesized
ttttctttttcttttctttctt

SEQ ID NO: 96692 - DNA, 22 bp, Artificial Sequence
  chemically synthesized
tttctttttcttttctttcttt

SEQ ID NO: 96693 - DNA, 22 bp, Artificial Sequence
  chemically synthesized
ttctttttcttttctttctttc

SEQ ID NO: 96694 - DNA, 22 bp, Artificial Sequence
  chemically synthesized
tctttttcttttctttctttct

SEQ ID NO: 96695 - DNA, 22 bp, Artificial Sequence
  chemically synthesized
ctttttcttttctttctttctt

SEQ ID NO: 96696 - DNA, 22 bp, Artificial Sequence
  chemically synthesized
tttttcttttctttctttcttt

SEQ ID NO: 96697 - DNA, 22 bp, Artificial Sequence
  chemically synthesized
tttcttttctttctttcttttt

SEQ ID NO: 96698 - DNA, 22 bp, Artificial Sequence
  chemically synthesized
ttcttttctttctttctttttt

SEQ ID NO: 96699 - DNA, 22 bp, Artificial Sequence
  chemically synthesized
tcttttctttctttcttttttt

SEQ ID NO: 96700 - DNA, 22 bp, Artificial Sequence
  chemically synthesized
cttttctttctttctttttttt

SEQ ID NO: 96701 - DNA, 22 bp, Artificial Sequence
  chemically synthesized
ttttctttctttcttttttttt

SEQ ID NO: 96702 - DNA, 22 bp, Artificial Sequence
  chemically synthesized
ttctttctttcttttttttttt

SEQ ID NO: 96703 - DNA, 22 bp, Artificial Sequence
  chemically synthesized
tctttctttctttttttttttt

SEQ ID NO: 96704 - DNA, 22 bp, Artificial Sequence
  chemically synthesized
ctttctttcttttttttttttt

SEQ ID NO: 96705 - DNA, 22 bp, Artificial Sequence
  chemically synthesized
tttctttctttttttttttttt

SEQ ID NO: 96706 - DNA, 22 bp, Artificial Sequence
  chemically synthesized
tctttctttttttttttttttt

SEQ ID NO: 96707 - DNA, 22 bp, Artificial Sequence
  chemically synthesized
ctttcttttttttttttttttg

SEQ ID NO: 96708 - DNA, 22 bp, Artificial Sequence
  chemically synthesized
tttcttttttttttttttttga

SEQ ID NO: 96709 - DNA, 22 bp, Artificial Sequence
  chemically synthesized
tcttttttttttttttttgaga

SEQ ID NO: 96710 - DNA, 22 bp, Artificial Sequence
  chemically synthesized
cttttttttttttttttgagac

SEQ ID NO: 96711 - DNA, 22 bp, Artificial Sequence
  chemically synthesized
ttttttttttttttttgagacg

SEQ ID NO: 96712 - DNA, 22 bp, Artificial Sequence
  chemically synthesized
ttttttttttttttgagacgga

SEQ ID NO: 96713 - DNA, 22 bp, Artificial Sequence
  chemically synthesized
tttttttttttttgagacggag

SEQ ID NO: 96714 - DNA, 22 bp, Artificial Sequence
  chemically synthesized
ttttttttttttgagacggagt

SEQ ID NO: 96715 - DNA, 22 bp, Artificial Sequence
  chemically synthesized
tttttttttttgagacggagtc

SEQ ID NO: 96716 - DNA, 22 bp, Artificial Sequence
  chemically synthesized
ttttttttttgagacggagtct

SEQ ID NO: 96717 - DNA, 22 bp, Artificial Sequence
  chemically synthesized
tttttttttgagacggagtctc

SEQ ID NO: 96718 - DNA, 22 bp, Artificial Sequence
  chemically synthesized
ttttttttgagacggagtctca

SEQ ID NO: 96719 - DNA, 22 bp, Artificial Sequence
  chemically synthesized
tttttttgagacggagtctcac

SEQ ID NO: 96720 - DNA, 22 bp, Artificial Sequence
  chemically synthesized
ttttttgagacggagtctcact

SEQ ID NO: 96721 - DNA, 22 bp, Artificial Sequence
  chemically synthesized
tttttgagacggagtctcactc

SEQ ID NO: 96722 - DNA, 22 bp, Artificial Sequence
  chemically synthesized
ttttgagacggagtctcactct

SEQ ID NO: 96723 - DNA, 22 bp, Artificial Sequence
  chemically synthesized
tttgagacggagtctcactctg

SEQ ID NO: 96724 - DNA, 22 bp, Artificial Sequence
  chemically synthesized
ttgagacggagtctcactctgt

SEQ ID NO: 96725 - DNA, 22 bp, Artificial Sequence
  chemically synthesized
tgagacggagtctcactctgtt

SEQ ID NO: 96726 - DNA, 22 bp, Artificial Sequence
  chemically synthesized
gagacggagtctcactctgttg

SEQ ID NO: 96727 - DNA, 22 bp, Artificial Sequence
  chemically synthesized
agacggagtctcactctgttgc

SEQ ID NO: 96728 - DNA, 22 bp, Artificial Sequence
  chemically synthesized
actctgttgccagactggagtg

SEQ ID NO: 96729 - DNA, 22 bp, Artificial Sequence
  chemically synthesized
tgttgccagactggagtgcaat

SEQ ID NO: 96730 - DNA, 22 bp, Artificial Sequence
  chemically synthesized
ttgccagactggagtgcaatgg

SEQ ID NO: 96731 - DNA, 22 bp, Artificial Sequence
  chemically synthesized
ccagactggagtgcaatggcac

SEQ ID NO: 96732 - DNA, 22 bp, Artificial Sequence
  chemically synthesized
gagtgcaatggcactatctcag

SEQ ID NO: 96733 - DNA, 22 bp, Artificial Sequence
  chemically synthesized
tctcagctcactgcaaccttcg

SEQ ID NO: 96734 - DNA, 22 bp, Artificial Sequence
  chemically synthesized
agctcactgcaaccttcgcctc

SEQ ID NO: 96735 - DNA, 22 bp, Artificial Sequence
  chemically synthesized
actgcaaccttcgcctcctggg

SEQ ID NO: 96736 - DNA, 22 bp, Artificial Sequence
  chemically synthesized
caaccttcgcctcctgggttca

SEQ ID NO: 96737 - DNA, 22 bp, Artificial Sequence
  chemically synthesized
cgcctcctgggttcaaacgatt

SEQ ID NO: 96738 - DNA, 22 bp, Artificial Sequence
  chemically synthesized
gcctcctgggttcaaacgattc

SEQ ID NO: 96739 - DNA, 22 bp, Artificial Sequence
  chemically synthesized
ctgggttcaaacgattctcctg

SEQ ID NO: 96740 - DNA, 22 bp, Artificial Sequence
  chemically synthesized
ggttcaaacgattctcctgcct

SEQ ID NO: 96741 - DNA, 22 bp, Artificial Sequence
  chemically synthesized
aaacgattctcctgcctcagcc

SEQ ID NO: 96742 - DNA, 22 bp, Artificial Sequence
  chemically synthesized
tcctgcctcagcctcccgagca

SEQ ID NO: 96743 - DNA, 22 bp, Artificial Sequence
  chemically synthesized
ctgcctcagcctcccgagcagc

SEQ ID NO: 96744 - DNA, 22 bp, Artificial Sequence
  chemically synthesized
cctcagcctcccgagcagctgg

SEQ ID NO: 96745 - DNA, 22 bp, Artificial Sequence
  chemically synthesized
agcctcccgagcagctgggact

SEQ ID NO: 96746 - DNA, 22 bp, Artificial Sequence
  chemically synthesized
ccgagcagctgggactacaggc

SEQ ID NO: 96747 - DNA, 22 bp, Artificial Sequence
  chemically synthesized
ggactacaggcgcatgccacca

SEQ ID NO: 96748 - DNA, 22 bp, Artificial Sequence
  chemically synthesized
caggcgcatgccaccatgccca

SEQ ID NO: 96749 - DNA, 22 bp, Artificial Sequence
  chemically synthesized
atttttttatttttagtagaga

SEQ ID NO: 96750 - DNA, 22 bp, Artificial Sequence
  chemically synthesized
ttttatttttagtagagacggg

SEQ ID NO: 96751 - DNA, 22 bp, Artificial Sequence
  chemically synthesized
tttatttttagtagagacggga

SEQ ID NO: 96752 - DNA, 22 bp, Artificial Sequence
  chemically synthesized
ttatttttagtagagacgggat

SEQ ID NO: 96753 - DNA, 22 bp, Artificial Sequence
  chemically synthesized
tatttttagtagagacgggatt

SEQ ID NO: 96754 - DNA, 22 bp, Artificial Sequence
  chemically synthesized
atttttagtagagacgggattt

SEQ ID NO: 96755 - DNA, 22 bp, Artificial Sequence
  chemically synthesized
tttttagtagagacgggatttc

SEQ ID NO: 96756 - DNA, 22 bp, Artificial Sequence
  chemically synthesized
ttagtagagacgggatttcacc

SEQ ID NO: 96757 - DNA, 22 bp, Artificial Sequence
  chemically synthesized
tagtagagacgggatttcacca

SEQ ID NO: 96758 - DNA, 22 bp, Artificial Sequence
  chemically synthesized
agtagagacgggatttcaccat

SEQ ID NO: 96759 - DNA, 22 bp, Artificial Sequence
  chemically synthesized
gtagagacgggatttcaccatg

SEQ ID NO: 96760 - DNA, 22 bp, Artificial Sequence
  chemically synthesized
caccatgtttgccaggatggtc

SEQ ID NO: 96761 - DNA, 22 bp, Artificial Sequence
  chemically synthesized
accatgtttgccaggatggtct

SEQ ID NO: 96762 - DNA, 22 bp, Artificial Sequence
  chemically synthesized
gccaggatggtctcgatctctt

SEQ ID NO: 96763 - DNA, 22 bp, Artificial Sequence
  chemically synthesized
ccaggatggtctcgatctcttg

SEQ ID NO: 96764 - DNA, 22 bp, Artificial Sequence
  chemically synthesized
gatctcttgacctcatgatctg

SEQ ID NO: 96765 - DNA, 22 bp, Artificial Sequence
  chemically synthesized
ttgacctcatgatctgcccacc

SEQ ID NO: 96766 - DNA, 22 bp, Artificial Sequence
  chemically synthesized
gacctcatgatctgcccacctc

SEQ ID NO: 96767 - DNA, 22 bp, Artificial Sequence
  chemically synthesized
acctcatgatctgcccacctct

SEQ ID NO: 96768 - DNA, 22 bp, Artificial Sequence
  chemically synthesized
atgatctgcccacctctgcctc

SEQ ID NO: 96769 - DNA, 22 bp, Artificial Sequence
  chemically synthesized
cccacctctgcctccgtctcca

SEQ ID NO: 96770 - DNA, 22 bp, Artificial Sequence
  chemically synthesized
tgcctccgtctccatccatttc

SEQ ID NO: 96771 - DNA, 22 bp, Artificial Sequence
  chemically synthesized
cctccgtctccatccatttcta

SEQ ID NO: 96772 - DNA, 22 bp, Artificial Sequence
  chemically synthesized
cgtctccatccatttctaccat

SEQ ID NO: 96773 - DNA, 22 bp, Artificial Sequence
  chemically synthesized
catccatttctaccatttcttt

SEQ ID NO: 96774 - DNA, 22 bp, Artificial Sequence
  chemically synthesized
ctaccatttctttctcctatgg

SEQ ID NO: 96775 - DNA, 22 bp, Artificial Sequence
  chemically synthesized
taccatttctttctcctatggc

SEQ ID NO: 96776 - DNA, 22 bp, Artificial Sequence
  chemically synthesized
ccatttctttctcctatggctc

SEQ ID NO: 96777 - DNA, 22 bp, Artificial Sequence
  chemically synthesized
ctttctcctatggctccccttg

SEQ ID NO: 96778 - DNA, 22 bp, Artificial Sequence
  chemically synthesized
tttctcctatggctccccttgc

SEQ ID NO: 96779 - DNA, 22 bp, Artificial Sequence
  chemically synthesized
tctcctatggctccccttgccc

SEQ ID NO: 96780 - DNA, 22 bp, Artificial Sequence
  chemically synthesized
ctcctatggctccccttgcccc

SEQ ID NO: 96781 - DNA, 22 bp, Artificial Sequence
  chemically synthesized
tcctatggctccccttgcccca

SEQ ID NO: 96782 - DNA, 22 bp, Artificial Sequence
  chemically synthesized
ctatggctccccttgccccacc

SEQ ID NO: 96783 - DNA, 22 bp, Artificial Sequence
  chemically synthesized
tggctccccttgccccaccaga

SEQ ID NO: 96784 - DNA, 22 bp, Artificial Sequence
  chemically synthesized
cccttgccccaccagatctagg

SEQ ID NO: 96785 - DNA, 22 bp, Artificial Sequence
  chemically synthesized
gccccaccagatctaggaattt

SEQ ID NO: 96786 - DNA, 22 bp, Artificial Sequence
  chemically synthesized
ccccaccagatctaggaatttc

SEQ ID NO: 96787 - DNA, 22 bp, Artificial Sequence
  chemically synthesized
ggaatttctgttcctacaattt

SEQ ID NO: 96788 - DNA, 22 bp, Artificial Sequence
  chemically synthesized
ctgttcctacaatttcctgtat

SEQ ID NO: 96789 - DNA, 22 bp, Artificial Sequence
  chemically synthesized
tgttcctacaatttcctgtatg

SEQ ID NO: 96790 - DNA, 22 bp, Artificial Sequence
  chemically synthesized
ttcctacaatttcctgtatgtt

SEQ ID NO: 96791 - DNA, 22 bp, Artificial Sequence
  chemically synthesized
ctacaatttcctgtatgttcag

SEQ ID NO: 96792 - DNA, 22 bp, Artificial Sequence
  chemically synthesized
caatttcctgtatgttcaggcc

SEQ ID NO: 96793 - DNA, 22 bp, Artificial Sequence
  chemically synthesized
cctgtatgttcaggccctagag

SEQ ID NO: 96794 - DNA, 22 bp, Artificial Sequence
  chemically synthesized
ctgtatgttcaggccctagagg

SEQ ID NO: 96795 - DNA, 22 bp, Artificial Sequence
  chemically synthesized
tatgttcaggccctagaggttc

SEQ ID NO: 96796 - DNA, 22 bp, Artificial Sequence
  chemically synthesized
aggccctagaggttcttcgtct

SEQ ID NO: 96797 - DNA, 22 bp, Artificial Sequence
  chemically synthesized
gaggttcttcgtctttttcact

SEQ ID NO: 96798 - DNA, 22 bp, Artificial Sequence
  chemically synthesized
ttcgtctttttcacttagcagt

SEQ ID NO: 96799 - DNA, 22 bp, Artificial Sequence
  chemically synthesized
cgtctttttcacttagcagtat

SEQ ID NO: 96800 - DNA, 22 bp, Artificial Sequence
  chemically synthesized
gtctttttcacttagcagtatg

SEQ ID NO: 96801 - DNA, 22 bp, Artificial Sequence
  chemically synthesized
tttcacttagcagtatggctcc

SEQ ID NO: 96802 - DNA, 22 bp, Artificial Sequence
  chemically synthesized
ttcacttagcagtatggctcct

SEQ ID NO: 96803 - DNA, 22 bp, Artificial Sequence
  chemically synthesized
tcacttagcagtatggctcctg

SEQ ID NO: 96804 - DNA, 22 bp, Artificial Sequence
  chemically synthesized
cacttagcagtatggctcctgt

SEQ ID NO: 96805 - DNA, 22 bp, Artificial Sequence
  chemically synthesized
acttagcagtatggctcctgtc

SEQ ID NO: 96806 - DNA, 22 bp, Artificial Sequence
  chemically synthesized
agcagtatggctcctgtctccc

SEQ ID NO: 96807 - DNA, 22 bp, Artificial Sequence
  chemically synthesized
gcagtatggctcctgtctccca

SEQ ID NO: 96808 - DNA, 22 bp, Artificial Sequence
  chemically synthesized
ctgtctcccaagtcaagtgcct

SEQ ID NO: 96809 - DNA, 22 bp, Artificial Sequence
  chemically synthesized
tctcccaagtcaagtgcctttg

SEQ ID NO: 96810 - DNA, 22 bp, Artificial Sequence
  chemically synthesized
ccaagtcaagtgcctttgggga

SEQ ID NO: 96811 - DNA, 22 bp, Artificial Sequence
  chemically synthesized
tggggattccatattccaagtt

SEQ ID NO: 96812 - DNA, 22 bp, Artificial Sequence
  chemically synthesized
ggggattccatattccaagttt

SEQ ID NO: 96813 - DNA, 22 bp, Artificial Sequence
  chemically synthesized
gggattccatattccaagttta

SEQ ID NO: 96814 - DNA, 22 bp, Artificial Sequence
  chemically synthesized
catattccaagtttactaagag

SEQ ID NO: 96815 - DNA, 22 bp, Artificial Sequence
  chemically synthesized
caagtttactaagagcgtttct

SEQ ID NO: 96816 - DNA, 22 bp, Artificial Sequence
  chemically synthesized
actaagagcgtttctctcttct

SEQ ID NO: 96817 - DNA, 22 bp, Artificial Sequence
  chemically synthesized
ctaagagcgtttctctcttcta

SEQ ID NO: 96818 - DNA, 22 bp, Artificial Sequence
  chemically synthesized
agagcgtttctctcttctataa

SEQ ID NO: 96819 - DNA, 22 bp, Artificial Sequence
  chemically synthesized
ctctcttctataacctgacttt

SEQ ID NO: 96820 - DNA, 22 bp, Artificial Sequence
  chemically synthesized
tctcttctataacctgactttg

SEQ ID NO: 96821 - DNA, 22 bp, Artificial Sequence
  chemically synthesized
tcttctataacctgactttgtt

SEQ ID NO: 96822 - DNA, 22 bp, Artificial Sequence
  chemically synthesized
ttctataacctgactttgttat

SEQ ID NO: 96823 - DNA, 22 bp, Artificial Sequence
  chemically synthesized
ctataacctgactttgttattt

SEQ ID NO: 96824 - DNA, 22 bp, Artificial Sequence
  chemically synthesized
tataacctgactttgttattta

SEQ ID NO: 96825 - DNA, 22 bp, Artificial Sequence
  chemically synthesized
taacctgactttgttatttatt

SEQ ID NO: 96826 - DNA, 22 bp, Artificial Sequence
  chemically synthesized
actttgttatttattatatttt

SEQ ID NO: 96827 - DNA, 22 bp, Artificial Sequence
  chemically synthesized
tgttatttattatattttctta

SEQ ID NO: 96828 - DNA, 22 bp, Artificial Sequence
  chemically synthesized
gttatttattatattttcttat

SEQ ID NO: 96829 - DNA, 22 bp, Artificial Sequence
  chemically synthesized
ttatttattatattttcttatg

SEQ ID NO: 96830 - DNA, 22 bp, Artificial Sequence
  chemically synthesized
tttattatattttcttatgttt

SEQ ID NO: 96831 - DNA, 22 bp, Artificial Sequence
  chemically synthesized
attatattttcttatgtttgtg

SEQ ID NO: 96832 - DNA, 22 bp, Artificial Sequence
  chemically synthesized
ttatattttcttatgtttgtga

SEQ ID NO: 96833 - DNA, 22 bp, Artificial Sequence
  chemically synthesized
tattttcttatgtttgtgataa

SEQ ID NO: 96834 - DNA, 22 bp, Artificial Sequence
  chemically synthesized
tcttatgtttgtgataaaaaaa

SEQ ID NO: 96835 - DNA, 22 bp, Artificial Sequence
  chemically synthesized
cttatgtttgtgataaaaaaaa

SEQ ID NO: 96836 - DNA, 22 bp, Artificial Sequence
  chemically synthesized
ttatgtttgtgataaaaaaaaa

SEQ ID NO: 96837 - DNA, 22 bp, Artificial Sequence
  chemically synthesized
atgtttgtgataaaaaaaaaaa

SEQ ID NO: 96838 - DNA, 22 bp, Artificial Sequence
  chemically synthesized
tgtttgtgataaaaaaaaaaaa

SEQ ID NO: 96839 - DNA, 22 bp, Artificial Sequence
  chemically synthesized
gtgataaaaaaaaaaaaaaaaa

SEQ ID NO: 96840 - DNA, 22 bp, Artificial Sequence
  chemically synthesized
tgataaaaaaaaaaaaaaaaaa

SEQ ID NO: 96841 - DNA, 22 bp, Artificial Sequence
  chemically synthesized
gtggcaagtaagaatgtctccc

SEQ ID NO: 96842 - DNA, 22 bp, Artificial Sequence
  chemically synthesized
tggcaagtaagaatgtctccct

SEQ ID NO: 96843 - DNA, 22 bp, Artificial Sequence
  chemically synthesized
ccttgcttttctcccatgattc

SEQ ID NO: 96844 - DNA, 22 bp, Artificial Sequence
  chemically synthesized
gcttttctcccatgattccaga

SEQ ID NO: 96845 - DNA, 22 bp, Artificial Sequence
  chemically synthesized
cttttctcccatgattccagaa

SEQ ID NO: 96846 - DNA, 22 bp, Artificial Sequence
  chemically synthesized
ttctcccatgattccagaagtc

SEQ ID NO: 96847 - DNA, 22 bp, Artificial Sequence
  chemically synthesized
tctcccatgattccagaagtct

SEQ ID NO: 96848 - DNA, 22 bp, Artificial Sequence
  chemically synthesized
ctcccatgattccagaagtctt

SEQ ID NO: 96849 - DNA, 22 bp, Artificial Sequence
  chemically synthesized
tcccatgattccagaagtcttc

SEQ ID NO: 96850 - DNA, 22 bp, Artificial Sequence
  chemically synthesized
ccatgattccagaagtcttcac

SEQ ID NO: 96851 - DNA, 22 bp, Artificial Sequence
  chemically synthesized
cagaagtcttcacctgacttaa

SEQ ID NO: 96852 - DNA, 22 bp, Artificial Sequence
  chemically synthesized
cacctgacttaatgactgccca

SEQ ID NO: 96853 - DNA, 22 bp, Artificial Sequence
  chemically synthesized
acctgacttaatgactgcccaa

SEQ ID NO: 96854 - DNA, 22 bp, Artificial Sequence
  chemically synthesized
acttaatgactgcccaaattgt

SEQ ID NO: 96855 - DNA, 22 bp, Artificial Sequence
  chemically synthesized
aatgactgcccaaattgttatt

SEQ ID NO: 96856 - DNA, 22 bp, Artificial Sequence
  chemically synthesized
atgactgcccaaattgttatta

SEQ ID NO: 96857 - DNA, 22 bp, Artificial Sequence
  chemically synthesized
cccaaattgttattattccagg

SEQ ID NO: 96858 - DNA, 22 bp, Artificial Sequence
  chemically synthesized
ttattattccaggccactgaat

SEQ ID NO: 96859 - DNA, 22 bp, Artificial Sequence
  chemically synthesized
ttattccaggccactgaatttc

SEQ ID NO: 96860 - DNA, 22 bp, Artificial Sequence
  chemically synthesized
ttccaggccactgaatttctac

SEQ ID NO: 96861 - DNA, 22 bp, Artificial Sequence
  chemically synthesized
caggccactgaatttctactcc

SEQ ID NO: 96862 - DNA, 22 bp, Artificial Sequence
  chemically synthesized
aatttctactccattttctttt

SEQ ID NO: 96863 - DNA, 22 bp, Artificial Sequence
  chemically synthesized
ctactccattttcttttagcta

SEQ ID NO: 96864 - DNA, 22 bp, Artificial Sequence
  chemically synthesized
tactccattttcttttagctat

SEQ ID NO: 96865 - DNA, 22 bp, Artificial Sequence
  chemically synthesized
ctccattttcttttagctatta

SEQ ID NO: 96866 - DNA, 22 bp, Artificial Sequence
  chemically synthesized
cattttcttttagctattaacc

SEQ ID NO: 96867 - DNA, 22 bp, Artificial Sequence
  chemically synthesized
tcttttagctattaaccaatgg

SEQ ID NO: 96868 - DNA, 22 bp, Artificial Sequence
  chemically synthesized
cttttagctattaaccaatggt

SEQ ID NO: 96869 - DNA, 22 bp, Artificial Sequence
  chemically synthesized
ttttagctattaaccaatggta

SEQ ID NO: 96870 - DNA, 22 bp, Artificial Sequence
  chemically synthesized
ttagctattaaccaatggtatc

SEQ ID NO: 96871 - DNA, 22 bp, Artificial Sequence
  chemically synthesized
tagctattaaccaatggtatct

SEQ ID NO: 96872 - DNA, 22 bp, Artificial Sequence
  chemically synthesized
agctattaaccaatggtatctt

SEQ ID NO: 96873 - DNA, 22 bp, Artificial Sequence
  chemically synthesized
gctattaaccaatggtatcttt

SEQ ID NO: 96874 - DNA, 22 bp, Artificial Sequence
  chemically synthesized
ttaaccaatggtatctttctga

SEQ ID NO: 96875 - DNA, 22 bp, Artificial Sequence
  chemically synthesized
accaatggtatctttctgagca

SEQ ID NO: 96876 - DNA, 22 bp, Artificial Sequence
  chemically synthesized
tctgagcatatattctaaccat

SEQ ID NO: 96877 - DNA, 22 bp, Artificial Sequence
  chemically synthesized
ctgagcatatattctaaccatt

SEQ ID NO: 96878 - DNA, 22 bp, Artificial Sequence
  chemically synthesized
tgagcatatattctaaccattg

SEQ ID NO: 96879 - DNA, 22 bp, Artificial Sequence
  chemically synthesized
agcatatattctaaccattggc

SEQ ID NO: 96880 - DNA, 22 bp, Artificial Sequence
  chemically synthesized
taaccattggctaacacagaca

SEQ ID NO: 96881 - DNA, 22 bp, Artificial Sequence
  chemically synthesized
accattggctaacacagacaaa

SEQ ID NO: 96882 - DNA, 22 bp, Artificial Sequence
  chemically synthesized
gctaacacagacaaaaccagga

SEQ ID NO: 96883 - DNA, 22 bp, Artificial Sequence
  chemically synthesized
acacagacaaaaccaggaattc

SEQ ID NO: 96884 - DNA, 22 bp, Artificial Sequence
  chemically synthesized
ctaaactttttttgtgtcacag

SEQ ID NO: 96885 - DNA, 22 bp, Artificial Sequence
  chemically synthesized
aactttttttgtgtcacaggcc

SEQ ID NO: 96886 - DNA, 22 bp, Artificial Sequence
  chemically synthesized
tttttgtgtcacaggccagttt

SEQ ID NO: 96887 - DNA, 22 bp, Artificial Sequence
  chemically synthesized
ttttgtgtcacaggccagtttg

SEQ ID NO: 96888 - DNA, 22 bp, Artificial Sequence
  chemically synthesized
tttgtgtcacaggccagtttgg

SEQ ID NO: 96889 - DNA, 22 bp, Artificial Sequence
  chemically synthesized
ttgtgtcacaggccagtttggc

SEQ ID NO: 96890 - DNA, 22 bp, Artificial Sequence
  chemically synthesized
tgtgtcacaggccagtttggca

SEQ ID NO: 96891 - DNA, 22 bp, Artificial Sequence
  chemically synthesized
gtgtcacaggccagtttggcag

SEQ ID NO: 96892 - DNA, 22 bp, Artificial Sequence
  chemically synthesized
tgtcacaggccagtttggcaga

SEQ ID NO: 96893 - DNA, 22 bp, Artificial Sequence
  chemically synthesized
ggcagactgtaagtgctaaaaa

SEQ ID NO: 96894 - DNA, 22 bp, Artificial Sequence
  chemically synthesized
gcagactgtaagtgctaaaaaa

SEQ ID NO: 96895 - DNA, 22 bp, Artificial Sequence
  chemically synthesized
taagtgctaaaaaaatatgttt

SEQ ID NO: 96896 - DNA, 22 bp, Artificial Sequence
  chemically synthesized
aaaaaatatgtttttattgcat

SEQ ID NO: 96897 - DNA, 22 bp, Artificial Sequence
  chemically synthesized
ttattgcatcaaataatataca

SEQ ID NO: 96898 - DNA, 22 bp, Artificial Sequence
  chemically synthesized
tattgcatcaaataatatacat

SEQ ID NO: 96899 - DNA, 22 bp, Artificial Sequence
  chemically synthesized
attgcatcaaataatatacata

SEQ ID NO: 96900 - DNA, 22 bp, Artificial Sequence
  chemically synthesized
ttgcatcaaataatatacatag

SEQ ID NO: 96901 - DNA, 22 bp, Artificial Sequence
  chemically synthesized
catcaaataatatacataggag

SEQ ID NO: 96902 - DNA, 22 bp, Artificial Sequence
  chemically synthesized
agtttaattacactgaaatatc

SEQ ID NO: 96903 - DNA, 22 bp, Artificial Sequence
  chemically synthesized
aattacactgaaatatcattat

SEQ ID NO: 96904 - DNA, 22 bp, Artificial Sequence
  chemically synthesized
attacactgaaatatcattatc

SEQ ID NO: 96905 - DNA, 22 bp, Artificial Sequence
  chemically synthesized
cactgaaatatcattatcagac

SEQ ID NO: 96906 - DNA, 22 bp, Artificial Sequence
  chemically synthesized
aaatatcattatcagacatcaa

SEQ ID NO: 96907 - DNA, 22 bp, Artificial Sequence
  chemically synthesized
tcagacatcaaacattacattt

SEQ ID NO: 96908 - DNA, 22 bp, Artificial Sequence
  chemically synthesized
catttgtggtatagtatttatt

SEQ ID NO: 96909 - DNA, 22 bp, Artificial Sequence
  chemically synthesized
gtggtatagtatttattatatt

SEQ ID NO: 96910 - DNA, 22 bp, Artificial Sequence
  chemically synthesized
tggtatagtatttattatattt

SEQ ID NO: 96911 - DNA, 22 bp, Artificial Sequence
  chemically synthesized
attatatttgcttctttatgaa

SEQ ID NO: 96912 - DNA, 22 bp, Artificial Sequence
  chemically synthesized
ttatatttgcttctttatgaaa

SEQ ID NO: 96913 - DNA, 22 bp, Artificial Sequence
  chemically synthesized
tatttgcttctttatgaaagca

SEQ ID NO: 96914 - DNA, 22 bp, Artificial Sequence
  chemically synthesized
gcttctttatgaaagcattaga

SEQ ID NO: 96915 - DNA, 22 bp, Artificial Sequence
  chemically synthesized
cttctttatgaaagcattagat

SEQ ID NO: 96916 - DNA, 22 bp, Artificial Sequence
  chemically synthesized
ctttatgaaagcattagatcta

SEQ ID NO: 96917 - DNA, 22 bp, Artificial Sequence
  chemically synthesized
tttatgaaagcattagatctag

SEQ ID NO: 96918 - DNA, 22 bp, Artificial Sequence
  chemically synthesized
tatgaaagcattagatctagga

SEQ ID NO: 96919 - DNA, 22 bp, Artificial Sequence
  chemically synthesized
atgaaagcattagatctaggat

SEQ ID NO: 96920 - DNA, 22 bp, Artificial Sequence
  chemically synthesized
tgaaagcattagatctaggatt

SEQ ID NO: 96921 - DNA, 22 bp, Artificial Sequence
  chemically synthesized
gatctaggattgggtctacagc

SEQ ID NO: 96922 - DNA, 22 bp, Artificial Sequence
  chemically synthesized
ggattgggtctacagctacctt

SEQ ID NO: 96923 - DNA, 22 bp, Artificial Sequence
  chemically synthesized
ggtctacagctaccttaagatc

SEQ ID NO: 96924 - DNA, 22 bp, Artificial Sequence
  chemically synthesized
cagctaccttaagatccaagta

SEQ ID NO: 96925 - DNA, 22 bp, Artificial Sequence
  chemically synthesized
ccttaagatccaagtagtgatg

SEQ ID NO: 96926 - DNA, 22 bp, Artificial Sequence
  chemically synthesized
aagatccaagtagtgatgcaga

SEQ ID NO: 96927 - DNA, 22 bp, Artificial Sequence
  chemically synthesized
agatccaagtagtgatgcagat

SEQ ID NO: 96928 - DNA, 22 bp, Artificial Sequence
  chemically synthesized
aaaatatctgcaatgggccagg

SEQ ID NO: 96929 - DNA, 22 bp, Artificial Sequence
  chemically synthesized
caatgggccaggcgtggtggct

SEQ ID NO: 96930 - DNA, 22 bp, Artificial Sequence
  chemically synthesized
acacctataatcccagcacttc

SEQ ID NO: 96931 - DNA, 22 bp, Artificial Sequence
  chemically synthesized
taatcccagcacttcaggaggc

SEQ ID NO: 96932 - DNA, 22 bp, Artificial Sequence
  chemically synthesized
caggaggccaaggcgggcagat

SEQ ID NO: 96933 - DNA, 22 bp, Artificial Sequence
  chemically synthesized
aggaggccaaggcgggcagatc

SEQ ID NO: 96934 - DNA, 22 bp, Artificial Sequence
  chemically synthesized
aggtcaggagttcaagaccagc

SEQ ID NO: 96935 - DNA, 22 bp, Artificial Sequence
  chemically synthesized
aagaccagcctggccaacatgg

SEQ ID NO: 96936 - DNA, 22 bp, Artificial Sequence
  chemically synthesized
gccaacatggcgaaaccccatc

SEQ ID NO: 96937 - DNA, 22 bp, Artificial Sequence
  chemically synthesized
tactaaaaatacaaaaattaga

SEQ ID NO: 96938 - DNA, 22 bp, Artificial Sequence
  chemically synthesized
ctaaaaatacaaaaattagact

SEQ ID NO: 96939 - DNA, 22 bp, Artificial Sequence
  chemically synthesized
aaaatacaaaaattagactggc

SEQ ID NO: 96940 - DNA, 22 bp, Artificial Sequence
  chemically synthesized
gactggcatggtggcaggtgcc

SEQ ID NO: 96941 - DNA, 22 bp, Artificial Sequence
  chemically synthesized
gcatggtggcaggtgcctgtaa

SEQ ID NO: 96942 - DNA, 22 bp, Artificial Sequence
  chemically synthesized
taatccccagctactcaggagg

SEQ ID NO: 96943 - DNA, 22 bp, Artificial Sequence
  chemically synthesized
ctcaggaggccaaggcaggaga

SEQ ID NO: 96944 - DNA, 22 bp, Artificial Sequence
  chemically synthesized
aggaggccaaggcaggagaatt

SEQ ID NO: 96945 - DNA, 22 bp, Artificial Sequence
  chemically synthesized
cttgaatgcaggaaggggaggt

SEQ ID NO: 96946 - DNA, 22 bp, Artificial Sequence
  chemically synthesized
gaatgcaggaaggggaggttgc

SEQ ID NO: 96947 - DNA, 22 bp, Artificial Sequence
  chemically synthesized
aatgcaggaaggggaggttgca

SEQ ID NO: 96948 - DNA, 22 bp, Artificial Sequence
  chemically synthesized
cagtgagccgaaatcatgccac

SEQ ID NO: 96949 - DNA, 22 bp, Artificial Sequence
  chemically synthesized
cactccagcctgggcaataaga

SEQ ID NO: 96950 - DNA, 22 bp, Artificial Sequence
  chemically synthesized
cagcctgggcaataagagcgaa

SEQ ID NO: 96951 - DNA, 22 bp, Artificial Sequence
  chemically synthesized
ggcaataagagcgaaactccat

SEQ ID NO: 96952 - DNA, 22 bp, Artificial Sequence
  chemically synthesized
catctcaaacaaaaacaaaaac

SEQ ID NO: 96953 - DNA, 22 bp, Artificial Sequence
  chemically synthesized
aaacaaaaacaaaaacaaaaag

SEQ ID NO: 96954 - DNA, 22 bp, Artificial Sequence
  chemically synthesized
caatacctatggtgtagtatga

SEQ ID NO: 96955 - DNA, 22 bp, Artificial Sequence
  chemically synthesized
tggtgtagtatgaaaatatctg

SEQ ID NO: 96956 - DNA, 22 bp, Artificial Sequence
  chemically synthesized
tggtttctctttataactatgc

SEQ ID NO: 96957 - DNA, 22 bp, Artificial Sequence
  chemically synthesized
ctctttataactatgcaatagg

SEQ ID NO: 96958 - DNA, 22 bp, Artificial Sequence
  chemically synthesized
tctttataactatgcaataggt

SEQ ID NO: 96959 - DNA, 22 bp, Artificial Sequence
  chemically synthesized
tttataactatgcaataggtac

SEQ ID NO: 96960 - DNA, 22 bp, Artificial Sequence
  chemically synthesized
tataactatgcaataggtactg

SEQ ID NO: 96961 - DNA, 22 bp, Artificial Sequence
  chemically synthesized
ataactatgcaataggtactga

SEQ ID NO: 96962 - DNA, 22 bp, Artificial Sequence
  chemically synthesized
taactatgcaataggtactgat

SEQ ID NO: 96963 - DNA, 22 bp, Artificial Sequence
  chemically synthesized
tgcaataggtactgatgatgtc

SEQ ID NO: 96964 - DNA, 22 bp, Artificial Sequence
  chemically synthesized
atgatgtcattctagtttgtcc

SEQ ID NO: 96965 - DNA, 22 bp, Artificial Sequence
  chemically synthesized
tagtttgtcctttgcattcaaa

SEQ ID NO: 96966 - DNA, 22 bp, Artificial Sequence
  chemically synthesized
gtttgtcctttgcattcaaagt

SEQ ID NO: 96967 - DNA, 22 bp, Artificial Sequence
  chemically synthesized
gtcctttgcattcaaagtagaa

SEQ ID NO: 96968 - DNA, 22 bp, Artificial Sequence
  chemically synthesized
tcctttgcattcaaagtagaag

SEQ ID NO: 96969 - DNA, 22 bp, Artificial Sequence
  chemically synthesized
tgcattcaaagtagaagaaaat

SEQ ID NO: 96970 - DNA, 22 bp, Artificial Sequence
  chemically synthesized
gcattcaaagtagaagaaaatg

SEQ ID NO: 96971 - DNA, 22 bp, Artificial Sequence
  chemically synthesized
cattcaaagtagaagaaaatgc

SEQ ID NO: 96972 - DNA, 22 bp, Artificial Sequence
  chemically synthesized
aaagtagaagaaaatgctaaat

SEQ ID NO: 96973 - DNA, 22 bp, Artificial Sequence
  chemically synthesized
aatttcagttacatgtaagtaa

SEQ ID NO: 96974 - DNA, 22 bp, Artificial Sequence
  chemically synthesized
cagttacatgtaagtaaaaata

SEQ ID NO: 96975 - DNA, 22 bp, Artificial Sequence
  chemically synthesized
agttacatgtaagtaaaaatac

SEQ ID NO: 96976 - DNA, 22 bp, Artificial Sequence
  chemically synthesized
catgtaagtaaaaatacagatt

SEQ ID NO: 96977 - DNA, 22 bp, Artificial Sequence
  chemically synthesized
tttttctataaacttcaccagc

SEQ ID NO: 96978 - DNA, 22 bp, Artificial Sequence
  chemically synthesized
ttttctataaacttcaccagcc

SEQ ID NO: 96979 - DNA, 22 bp, Artificial Sequence
  chemically synthesized
tttctataaacttcaccagccc

SEQ ID NO: 96980 - DNA, 22 bp, Artificial Sequence
  chemically synthesized
ttctataaacttcaccagcccc

SEQ ID NO: 96981 - DNA, 22 bp, Artificial Sequence
  chemically synthesized
tctataaacttcaccagccccc

SEQ ID NO: 96982 - DNA, 22 bp, Artificial Sequence
  chemically synthesized
ctataaacttcaccagccccct

SEQ ID NO: 96983 - DNA, 22 bp, Artificial Sequence
  chemically synthesized
tataaacttcaccagcccccta

SEQ ID NO: 96984 - DNA, 22 bp, Artificial Sequence
  chemically synthesized
taaacttcaccagccccctagt

SEQ ID NO: 96985 - DNA, 22 bp, Artificial Sequence
  chemically synthesized
caccagccccctagtgttctgt

SEQ ID NO: 96986 - DNA, 22 bp, Artificial Sequence
  chemically synthesized
accagccccctagtgttctgtg

SEQ ID NO: 96987 - DNA, 22 bp, Artificial Sequence
  chemically synthesized
gtgttctgtggaccccagatta

SEQ ID NO: 96988 - DNA, 22 bp, Artificial Sequence
  chemically synthesized
tgtggaccccagattaagactt

SEQ ID NO: 96989 - DNA, 22 bp, Artificial Sequence
  chemically synthesized
tggaccccagattaagacttcc

SEQ ID NO: 96990 - DNA, 22 bp, Artificial Sequence
  chemically synthesized
agacttcctgggacaaaatata

SEQ ID NO: 96991 - DNA, 22 bp, Artificial Sequence
  chemically synthesized
cctgggacaaaatatatagcct

SEQ ID NO: 96992 - DNA, 22 bp, Artificial Sequence
  chemically synthesized
ctgggacaaaatatatagccta

SEQ ID NO: 96993 - DNA, 22 bp, Artificial Sequence
  chemically synthesized
ggacaaaatatatagcctagga

SEQ ID NO: 96994 - DNA, 22 bp, Artificial Sequence
  chemically synthesized
ggaagacaagatcctaggtttg

SEQ ID NO: 96995 - DNA, 22 bp, Artificial Sequence
  chemically synthesized
ggtttggaaagaacgtatttga

SEQ ID NO: 96996 - DNA, 22 bp, Artificial Sequence
  chemically synthesized
ggaaagaacgtatttgatccac

SEQ ID NO: 96997 - DNA, 22 bp, Artificial Sequence
  chemically synthesized
gaaagaacgtatttgatccact

SEQ ID NO: 96998 - DNA, 22 bp, Artificial Sequence
  chemically synthesized
gatccactgaaataaaagaaca

SEQ ID NO: 96999 - DNA, 22 bp, Artificial Sequence
  chemically synthesized
atccactgaaataaaagaacaa

SEQ ID NO: 97000 - DNA, 22 bp, Artificial Sequence
  chemically synthesized
aaataaaagaacaatgactaga

SEQ ID NO: 97001 - DNA, 22 bp, Artificial Sequence
  chemically synthesized
gacaaaaagcagctcagctgct

SEQ ID NO: 97002 - DNA, 22 bp, Artificial Sequence
  chemically synthesized
agctgcttgtagcttgaaccaa

SEQ ID NO: 97003 - DNA, 22 bp, Artificial Sequence
  chemically synthesized
cttgtagcttgaaccaagctga

SEQ ID NO: 97004 - DNA, 22 bp, Artificial Sequence
  chemically synthesized
gtagcttgaaccaagctgagct

SEQ ID NO: 97005 - DNA, 22 bp, Artificial Sequence
  chemically synthesized
tagcttgaaccaagctgagctt

SEQ ID NO: 97006 - DNA, 22 bp, Artificial Sequence
  chemically synthesized
gaaccaagctgagcttggctac

SEQ ID NO: 97007 - DNA, 22 bp, Artificial Sequence
  chemically synthesized
aaccaagctgagcttggctact

SEQ ID NO: 97008 - DNA, 22 bp, Artificial Sequence
  chemically synthesized
agcttggctactcagagaagaa

SEQ ID NO: 97009 - DNA, 22 bp, Artificial Sequence
  chemically synthesized
ggctactcagagaagaacagtc

SEQ ID NO: 97010 - DNA, 22 bp, Artificial Sequence
  chemically synthesized
gctactcagagaagaacagtcg

SEQ ID NO: 97011 - DNA, 22 bp, Artificial Sequence
  chemically synthesized
ctcagagaagaacagtcgttga

SEQ ID NO: 97012 - DNA, 22 bp, Artificial Sequence
  chemically synthesized
agagaagaacagtcgttgagat

SEQ ID NO: 97013 - DNA, 22 bp, Artificial Sequence
  chemically synthesized
agataatataattttttttaac

SEQ ID NO: 97014 - DNA, 22 bp, Artificial Sequence
  chemically synthesized
tttttaaccaattaagatacag

SEQ ID NO: 97015 - DNA, 22 bp, Artificial Sequence
  chemically synthesized
ttttaaccaattaagatacagc

SEQ ID NO: 97016 - DNA, 22 bp, Artificial Sequence
  chemically synthesized
tttaaccaattaagatacagct

SEQ ID NO: 97017 - DNA, 22 bp, Artificial Sequence
  chemically synthesized
ttaaccaattaagatacagctc

SEQ ID NO: 97018 - DNA, 22 bp, Artificial Sequence
  chemically synthesized
taaccaattaagatacagctct

SEQ ID NO: 97019 - DNA, 22 bp, Artificial Sequence
  chemically synthesized
aaccaattaagatacagctctg

SEQ ID NO: 97020 - DNA, 22 bp, Artificial Sequence
  chemically synthesized
accaattaagatacagctctgg

SEQ ID NO: 97021 - DNA, 22 bp, Artificial Sequence
  chemically synthesized
agatacagctctgggttttcag

SEQ ID NO: 97022 - DNA, 22 bp, Artificial Sequence
  chemically synthesized
tgggttttcagggggaatttgc

SEQ ID NO: 97023 - DNA, 22 bp, Artificial Sequence
  chemically synthesized
ggttttcagggggaatttgcta

SEQ ID NO: 97024 - DNA, 22 bp, Artificial Sequence
  chemically synthesized
tcagggggaatttgctacagat

SEQ ID NO: 97025 - DNA, 22 bp, Artificial Sequence
  chemically synthesized
cagggggaatttgctacagatc

SEQ ID NO: 97026 - DNA, 22 bp, Artificial Sequence
  chemically synthesized
agggggaatttgctacagatcc

SEQ ID NO: 97027 - DNA, 22 bp, Artificial Sequence
  chemically synthesized
gctacagatccacagtatgaag

SEQ ID NO: 97028 - DNA, 22 bp, Artificial Sequence
  chemically synthesized
ctacagatccacagtatgaagg

SEQ ID NO: 97029 - DNA, 22 bp, Artificial Sequence
  chemically synthesized
cagatccacagtatgaaggcag

SEQ ID NO: 97030 - DNA, 22 bp, Artificial Sequence
  chemically synthesized
cctcagaacttgaatgtgaggg

SEQ ID NO: 97031 - DNA, 22 bp, Artificial Sequence
  chemically synthesized
ctcagaacttgaatgtgagggt

SEQ ID NO: 97032 - DNA, 22 bp, Artificial Sequence
  chemically synthesized
agaacttgaatgtgagggtcag

SEQ ID NO: 97033 - DNA, 22 bp, Artificial Sequence
  chemically synthesized
gaatgtgagggtcagacattgc

SEQ ID NO: 97034 - DNA, 22 bp, Artificial Sequence
  chemically synthesized
aatgtgagggtcagacattgcc

SEQ ID NO: 97035 - DNA, 22 bp, Artificial Sequence
  chemically synthesized
ccaaagtccaaggaataaggac

SEQ ID NO: 97036 - DNA, 22 bp, Artificial Sequence
  chemically synthesized
aaggccaagagtttggagaaca

SEQ ID NO: 97037 - DNA, 22 bp, Artificial Sequence
  chemically synthesized
ggagaacaggtttctccctaaa

SEQ ID NO: 97038 - DNA, 22 bp, Artificial Sequence
  chemically synthesized
gagaacaggtttctccctaaaa

SEQ ID NO: 97039 - DNA, 22 bp, Artificial Sequence
  chemically synthesized
ctccctaaaacaagccctatgg

SEQ ID NO: 97040 - DNA, 22 bp, Artificial Sequence
  chemically synthesized
tccctaaaacaagccctatggg

SEQ ID NO: 97041 - DNA, 22 bp, Artificial Sequence
  chemically synthesized
cctaaaacaagccctatgggta

SEQ ID NO: 97042 - DNA, 22 bp, Artificial Sequence
  chemically synthesized
aaacaagccctatgggtaatcc

SEQ ID NO: 97043 - DNA, 22 bp, Artificial Sequence
  chemically synthesized
tgggtaatcccatcattcttcc

SEQ ID NO: 97044 - DNA, 22 bp, Artificial Sequence
  chemically synthesized
ttcccattcagagtatggacac

SEQ ID NO: 97045 - DNA, 22 bp, Artificial Sequence
  chemically synthesized
cccattcagagtatggacacca

SEQ ID NO: 97046 - DNA, 22 bp, Artificial Sequence
  chemically synthesized
ccattcagagtatggacaccag

SEQ ID NO: 97047 - DNA, 22 bp, Artificial Sequence
  chemically synthesized
agagtatggacaccagtcttct

SEQ ID NO: 97048 - DNA, 22 bp, Artificial Sequence
  chemically synthesized
ctcttagattcagagtatgggg

SEQ ID NO: 97049 - DNA, 22 bp, Artificial Sequence
  chemically synthesized
tcttagattcagagtatggggt

SEQ ID NO: 97050 - DNA, 22 bp, Artificial Sequence
  chemically synthesized
ttagattcagagtatggggttg

SEQ ID NO: 97051 - DNA, 22 bp, Artificial Sequence
  chemically synthesized
agattcagagtatggggttgat

SEQ ID NO: 97052 - DNA, 22 bp, Artificial Sequence
  chemically synthesized
gattcagagtatggggttgatc

SEQ ID NO: 97053 - DNA, 22 bp, Artificial Sequence
  chemically synthesized
agagtatggggttgatcctctc

SEQ ID NO: 97054 - DNA, 22 bp, Artificial Sequence
  chemically synthesized
atcctctcctgctccctcggag

SEQ ID NO: 97055 - DNA, 22 bp, Artificial Sequence
  chemically synthesized
tcctgctccctcggagccagtt

SEQ ID NO: 97056 - DNA, 22 bp, Artificial Sequence
  chemically synthesized
ctgctccctcggagccagttgc

SEQ ID NO: 97057 - DNA, 22 bp, Artificial Sequence
  chemically synthesized
ctccctcggagccagttgcaga

SEQ ID NO: 97058 - DNA, 22 bp, Artificial Sequence
  chemically synthesized
cctcggagccagttgcagagcc

SEQ ID NO: 97059 - DNA, 22 bp, Artificial Sequence
  chemically synthesized
ggagccagttgcagagcccaca

SEQ ID NO: 97060 - DNA, 22 bp, Artificial Sequence
  chemically synthesized
cagagcccacattttcttctct

SEQ ID NO: 97061 - DNA, 22 bp, Artificial Sequence
  chemically synthesized
tcttctctccttactgcctatg

SEQ ID NO: 97062 - DNA, 22 bp, Artificial Sequence
  chemically synthesized
cttctctccttactgcctatgg

SEQ ID NO: 97063 - DNA, 22 bp, Artificial Sequence
  chemically synthesized
ttctctccttactgcctatggt

SEQ ID NO: 97064 - DNA, 22 bp, Artificial Sequence
  chemically synthesized
ctctccttactgcctatggttc

SEQ ID NO: 97065 - DNA, 22 bp, Artificial Sequence
  chemically synthesized
tctccttactgcctatggttcc

SEQ ID NO: 97066 - DNA, 22 bp, Artificial Sequence
  chemically synthesized
tccttactgcctatggttccag

SEQ ID NO: 97067 - DNA, 22 bp, Artificial Sequence
  chemically synthesized
cttactgcctatggttccagac

SEQ ID NO: 97068 - DNA, 22 bp, Artificial Sequence
  chemically synthesized
actgcctatggttccagacctg

SEQ ID NO: 97069 - DNA, 22 bp, Artificial Sequence
  chemically synthesized
ctgcctatggttccagacctgg

SEQ ID NO: 97070 - DNA, 22 bp, Artificial Sequence
  chemically synthesized
cctatggttccagacctggctt

SEQ ID NO: 97071 - DNA, 22 bp, Artificial Sequence
  chemically synthesized
tggttccagacctggcttgcat

SEQ ID NO: 97072 - DNA, 22 bp, Artificial Sequence
  chemically synthesized
cagacctggcttgcatccaggg

SEQ ID NO: 97073 - DNA, 22 bp, Artificial Sequence
  chemically synthesized
gcttgcatccagggatctgacc

SEQ ID NO: 97074 - DNA, 22 bp, Artificial Sequence
  chemically synthesized
gcatccagggatctgacccatt

SEQ ID NO: 97075 - DNA, 22 bp, Artificial Sequence
  chemically synthesized
catccagggatctgacccattc

SEQ ID NO: 97076 - DNA, 22 bp, Artificial Sequence
  chemically synthesized
acccattccatgtttccttatg

SEQ ID NO: 97077 - DNA, 22 bp, Artificial Sequence
  chemically synthesized
catgtttccttatggctaaagg

SEQ ID NO: 97078 - DNA, 22 bp, Artificial Sequence
  chemically synthesized
ccttatggctaaaggtggtagg

SEQ ID NO: 97079 - DNA, 22 bp, Artificial Sequence
  chemically synthesized
cttatggctaaaggtggtaggg

SEQ ID NO: 97080 - DNA, 22 bp, Artificial Sequence
  chemically synthesized
atggctaaaggtggtagggagg

SEQ ID NO: 97081 - DNA, 22 bp, Artificial Sequence
  chemically synthesized
tggctaaaggtggtagggagga

SEQ ID NO: 97082 - DNA, 22 bp, Artificial Sequence
  chemically synthesized
aaggtggtagggaggagcttca

SEQ ID NO: 97083 - DNA, 22 bp, Artificial Sequence
  chemically synthesized
caagaaaggttatagcattgaa

SEQ ID NO: 97084 - DNA, 22 bp, Artificial Sequence
  chemically synthesized
aagaaaggttatagcattgaaa

SEQ ID NO: 97085 - DNA, 22 bp, Artificial Sequence
  chemically synthesized
tagcattgaaaggcccaggttt

SEQ ID NO: 97086 - DNA, 22 bp, Artificial Sequence
  chemically synthesized
aaaggcccaggtttgtgtctca

SEQ ID NO: 97087 - DNA, 22 bp, Artificial Sequence
  chemically synthesized
gtgtctcagtaacaaggcttat

SEQ ID NO: 97088 - DNA, 22 bp, Artificial Sequence
  chemically synthesized
tgtctcagtaacaaggcttata

SEQ ID NO: 97089 - DNA, 22 bp, Artificial Sequence
  chemically synthesized
agtaacaaggcttataaatcct

SEQ ID NO: 97090 - DNA, 22 bp, Artificial Sequence
  chemically synthesized
ataaatcctgactcagaagtca

SEQ ID NO: 97091 - DNA, 22 bp, Artificial Sequence
  chemically synthesized
taaatcctgactcagaagtcag

SEQ ID NO: 97092 - DNA, 22 bp, Artificial Sequence
  chemically synthesized
actcagaagtcaggtaggctgc

SEQ ID NO: 97093 - DNA, 22 bp, Artificial Sequence
  chemically synthesized
agaagtcaggtaggctgcgggc

SEQ ID NO: 97094 - DNA, 22 bp, Artificial Sequence
  chemically synthesized
cgggcagtctcattattgcttc

SEQ ID NO: 97095 - DNA, 22 bp, Artificial Sequence
  chemically synthesized
attattgcttcgatgcttgttg

SEQ ID NO: 97096 - DNA, 22 bp, Artificial Sequence
  chemically synthesized
ttgcttcgatgcttgttggttc

SEQ ID NO: 97097 - DNA, 22 bp, Artificial Sequence
  chemically synthesized
cttcgatgcttgttggttcaag

SEQ ID NO: 97098 - DNA, 22 bp, Artificial Sequence
  chemically synthesized
cgatgcttgttggttcaagata

SEQ ID NO: 97099 - DNA, 22 bp, Artificial Sequence
  chemically synthesized
gatgcttgttggttcaagataa

SEQ ID NO: 97100 - DNA, 22 bp, Artificial Sequence
  chemically synthesized
gttggttcaagataaattgctt

SEQ ID NO: 97101 - DNA, 22 bp, Artificial Sequence
  chemically synthesized
ttggttcaagataaattgcttc

SEQ ID NO: 97102 - DNA, 22 bp, Artificial Sequence
  chemically synthesized
gttcaagataaattgcttcacc

SEQ ID NO: 97103 - DNA, 22 bp, Artificial Sequence
  chemically synthesized
aagataaattgcttcacctgct

SEQ ID NO: 97104 - DNA, 22 bp, Artificial Sequence
  chemically synthesized
cttcacctgctcatttttaagc

SEQ ID NO: 97105 - DNA, 22 bp, Artificial Sequence
  chemically synthesized
cacctgctcatttttaagcatt

SEQ ID NO: 97106 - DNA, 22 bp, Artificial Sequence
  chemically synthesized
acctgctcatttttaagcattt

SEQ ID NO: 97107 - DNA, 22 bp, Artificial Sequence
  chemically synthesized
ctcatttttaagcattttattt

SEQ ID NO: 97108 - DNA, 22 bp, Artificial Sequence
  chemically synthesized
atttttaagcattttatttgtt

SEQ ID NO: 97109 - DNA, 22 bp, Artificial Sequence
  chemically synthesized
ttaagcattttatttgtttatc

SEQ ID NO: 97110 - DNA, 22 bp, Artificial Sequence
  chemically synthesized
taagcattttatttgtttatca

SEQ ID NO: 97111 - DNA, 22 bp, Artificial Sequence
  chemically synthesized
aagcattttatttgtttatcat

SEQ ID NO: 97112 - DNA, 22 bp, Artificial Sequence
  chemically synthesized
agcattttatttgtttatcata

SEQ ID NO: 97113 - DNA, 22 bp, Artificial Sequence
  chemically synthesized
tatttgtttatcatatgagata

SEQ ID NO: 97114 - DNA, 22 bp, Artificial Sequence
  chemically synthesized
atttgtttatcatatgagatac

SEQ ID NO: 97115 - DNA, 22 bp, Artificial Sequence
  chemically synthesized
tttgtttatcatatgagatacc

SEQ ID NO: 97116 - DNA, 22 bp, Artificial Sequence
  chemically synthesized
gtttatcatatgagataccatg

SEQ ID NO: 97117 - DNA, 22 bp, Artificial Sequence
  chemically synthesized
tttatcatatgagataccatga

SEQ ID NO: 97118 - DNA, 22 bp, Artificial Sequence
  chemically synthesized
atcatatgagataccatgaaaa

SEQ ID NO: 97119 - DNA, 22 bp, Artificial Sequence
  chemically synthesized
tcatatgagataccatgaaaaa

SEQ ID NO: 97120 - DNA, 22 bp, Artificial Sequence
  chemically synthesized
ttgcttttctttcctatattaa

SEQ ID NO: 97121 - DNA, 22 bp, Artificial Sequence
  chemically synthesized
cttttctttcctatattaaaag

SEQ ID NO: 97122 - DNA, 22 bp, Artificial Sequence
  chemically synthesized
ttctttcctatattaaaagccc

SEQ ID NO: 97123 - DNA, 22 bp, Artificial Sequence
  chemically synthesized
tctttcctatattaaaagccca

SEQ ID NO: 97124 - DNA, 22 bp, Artificial Sequence
  chemically synthesized
ctttcctatattaaaagcccaa

SEQ ID NO: 97125 - DNA, 22 bp, Artificial Sequence
  chemically synthesized
tttcctatattaaaagcccaaa

SEQ ID NO: 97126 - DNA, 22 bp, Artificial Sequence
  chemically synthesized
tcctatattaaaagcccaaagt

SEQ ID NO: 97127 - DNA, 22 bp, Artificial Sequence
  chemically synthesized
cctatattaaaagcccaaagtt

SEQ ID NO: 97128 - DNA, 22 bp, Artificial Sequence
  chemically synthesized
ctatattaaaagcccaaagttc

SEQ ID NO: 97129 - DNA, 22 bp, Artificial Sequence
  chemically synthesized
tattaaaagcccaaagttcaga

SEQ ID NO: 97130 - DNA, 22 bp, Artificial Sequence
  chemically synthesized
aaagcccaaagttcagagagat

SEQ ID NO: 97131 - DNA, 22 bp, Artificial Sequence
  chemically synthesized
agagagataagtgttatggcca

SEQ ID NO: 97132 - DNA, 22 bp, Artificial Sequence
  chemically synthesized
tggccatccaggatagatcaga

SEQ ID NO: 97133 - DNA, 22 bp, Artificial Sequence
  chemically synthesized
gacagtcagaaaaagtaatcag

SEQ ID NO: 97134 - DNA, 22 bp, Artificial Sequence
  chemically synthesized
atttattgtctatataattaaa

SEQ ID NO: 97135 - DNA, 22 bp, Artificial Sequence
  chemically synthesized
attgtctatataattaaaatta

SEQ ID NO: 97136 - DNA, 22 bp, Artificial Sequence
  chemically synthesized
ttgtctatataattaaaattag

SEQ ID NO: 97137 - DNA, 22 bp, Artificial Sequence
  chemically synthesized
tctatataattaaaattagtaa

SEQ ID NO: 97138 - DNA, 22 bp, Artificial Sequence
  chemically synthesized
tataattaaaattagtaaaata

SEQ ID NO: 97139 - DNA, 22 bp, Artificial Sequence
  chemically synthesized
aaattagtaaaataaaatctat

SEQ ID NO: 97140 - DNA, 22 bp, Artificial Sequence
  chemically synthesized
gtaaaataaaatctatgtatgt

SEQ ID NO: 97141 - DNA, 22 bp, Artificial Sequence
  chemically synthesized
tgtatgtcttaagacatttaag

SEQ ID NO: 97142 - DNA, 22 bp, Artificial Sequence
  chemically synthesized
aagacatttaagtataaaggac

SEQ ID NO: 97143 - DNA, 22 bp, Artificial Sequence
  chemically synthesized
agacatttaagtataaaggact

SEQ ID NO: 97144 - DNA, 22 bp, Artificial Sequence
  chemically synthesized
aagtataaaggacttttagaaa

SEQ ID NO: 97145 - DNA, 22 bp, Artificial Sequence
  chemically synthesized
agtataaaggacttttagaaag

SEQ ID NO: 97146 - DNA, 22 bp, Artificial Sequence
  chemically synthesized
ttagaaagaaacacccaaattc

SEQ ID NO: 97147 - DNA, 22 bp, Artificial Sequence
  chemically synthesized
tagaaagaaacacccaaattcg

SEQ ID NO: 97148 - DNA, 22 bp, Artificial Sequence
  chemically synthesized
agaaagaaacacccaaattcga

SEQ ID NO: 97149 - DNA, 22 bp, Artificial Sequence
  chemically synthesized
gaaagaaacacccaaattcgat

SEQ ID NO: 97150 - DNA, 22 bp, Artificial Sequence
  chemically synthesized
gatgaagattaattcctgcctg

SEQ ID NO: 97151 - DNA, 22 bp, Artificial Sequence
  chemically synthesized
attcctgcctgtttgggtttgc

SEQ ID NO: 97152 - DNA, 22 bp, Artificial Sequence
  chemically synthesized
ctgcctgtttgggtttgcttta

SEQ ID NO: 97153 - DNA, 22 bp, Artificial Sequence
  chemically synthesized
cctgtttgggtttgctttagca

SEQ ID NO: 97154 - DNA, 22 bp, Artificial Sequence
  chemically synthesized
tttgggtttgctttagcatttg

SEQ ID NO: 97155 - DNA, 22 bp, Artificial Sequence
  chemically synthesized
gggtttgctttagcatttgtaa

SEQ ID NO: 97156 - DNA, 22 bp, Artificial Sequence
  chemically synthesized
ggtttgctttagcatttgtaat

SEQ ID NO: 97157 - DNA, 22 bp, Artificial Sequence
  chemically synthesized
gctttagcatttgtaatttctt

SEQ ID NO: 97158 - DNA, 22 bp, Artificial Sequence
  chemically synthesized
ctttagcatttgtaatttctta

SEQ ID NO: 97159 - DNA, 22 bp, Artificial Sequence
  chemically synthesized
tagcatttgtaatttcttaagt

SEQ ID NO: 97160 - DNA, 22 bp, Artificial Sequence
  chemically synthesized
agcatttgtaatttcttaagtt

SEQ ID NO: 97161 - DNA, 22 bp, Artificial Sequence
  chemically synthesized
gcatttgtaatttcttaagttc

SEQ ID NO: 97162 - DNA, 22 bp, Artificial Sequence
  chemically synthesized
gtaatttcttaagttctatgca

SEQ ID NO: 97163 - DNA, 22 bp, Artificial Sequence
  chemically synthesized
taatttcttaagttctatgcag

SEQ ID NO: 97164 - DNA, 22 bp, Artificial Sequence
  chemically synthesized
cttaagttctatgcaggattct

SEQ ID NO: 97165 - DNA, 22 bp, Artificial Sequence
  chemically synthesized
ttaagttctatgcaggattcta

SEQ ID NO: 97166 - DNA, 22 bp, Artificial Sequence
  chemically synthesized
aagttctatgcaggattctaaa

SEQ ID NO: 97167 - DNA, 22 bp, Artificial Sequence
  chemically synthesized
agttctatgcaggattctaaaa

SEQ ID NO: 97168 - DNA, 22 bp, Artificial Sequence
  chemically synthesized
tatgcaggattctaaaaactgt

SEQ ID NO: 97169 - DNA, 22 bp, Artificial Sequence
  chemically synthesized
tgcaggattctaaaaactgtaa

SEQ ID NO: 97170 - DNA, 22 bp, Artificial Sequence
  chemically synthesized
taaaaactgtaagatgcctaat

SEQ ID NO: 97171 - DNA, 22 bp, Artificial Sequence
  chemically synthesized
aaaactgtaagatgcctaattt

SEQ ID NO: 97172 - DNA, 22 bp, Artificial Sequence
  chemically synthesized
taagatgcctaatttaaacaag

SEQ ID NO: 97173 - DNA, 22 bp, Artificial Sequence
  chemically synthesized
atttaaacaaggaaacatccaa

SEQ ID NO: 97174 - DNA, 22 bp, Artificial Sequence
  chemically synthesized
aaacaaggaaacatccaatatt

SEQ ID NO: 97175 - DNA, 22 bp, Artificial Sequence
  chemically synthesized
aacaaggaaacatccaatattt

SEQ ID NO: 97176 - DNA, 22 bp, Artificial Sequence
  chemically synthesized
tcttaaatctttctggctaatt

SEQ ID NO: 97177 - DNA, 22 bp, Artificial Sequence
  chemically synthesized
cttaaatctttctggctaattt

SEQ ID NO: 97178 - DNA, 22 bp, Artificial Sequence
  chemically synthesized
ttaaatctttctggctaattta

SEQ ID NO: 97179 - DNA, 22 bp, Artificial Sequence
  chemically synthesized
aaatctttctggctaatttatg

SEQ ID NO: 97180 - DNA, 22 bp, Artificial Sequence
  chemically synthesized
aatctttctggctaatttatga

SEQ ID NO: 97181 - DNA, 22 bp, Artificial Sequence
  chemically synthesized
tctggctaatttatgacatatg

SEQ ID NO: 97182 - DNA, 22 bp, Artificial Sequence
  chemically synthesized
ctggctaatttatgacatatgt

SEQ ID NO: 97183 - DNA, 22 bp, Artificial Sequence
  chemically synthesized
tggctaatttatgacatatgtt

SEQ ID NO: 97184 - DNA, 22 bp, Artificial Sequence
  chemically synthesized
gctaatttatgacatatgttta

SEQ ID NO: 97185 - DNA, 22 bp, Artificial Sequence
  chemically synthesized
atttatgacatatgtttaacct

SEQ ID NO: 97186 - DNA, 22 bp, Artificial Sequence
  chemically synthesized
atgacatatgtttaacctgaag

SEQ ID NO: 97187 - DNA, 22 bp, Artificial Sequence
  chemically synthesized
tgacatatgtttaacctgaaga

SEQ ID NO: 97188 - DNA, 22 bp, Artificial Sequence
  chemically synthesized
aacctgaagagtcaaatattgt

SEQ ID NO: 97189 - DNA, 22 bp, Artificial Sequence
  chemically synthesized
acctgaagagtcaaatattgta

SEQ ID NO: 97190 - DNA, 22 bp, Artificial Sequence
  chemically synthesized
aagagtcaaatattgtactgtt

SEQ ID NO: 97191 - DNA, 22 bp, Artificial Sequence
  chemically synthesized
tactgttcttagatgctattag

SEQ ID NO: 97192 - DNA, 22 bp, Artificial Sequence
  chemically synthesized
ttcttagatgctattagtatga

SEQ ID NO: 97193 - DNA, 22 bp, Artificial Sequence
  chemically synthesized
ttagatgctattagtatgaaaa

SEQ ID NO: 97194 - DNA, 22 bp, Artificial Sequence
  chemically synthesized
agatgctattagtatgaaaaat

SEQ ID NO: 97195 - DNA, 22 bp, Artificial Sequence
  chemically synthesized
gatgctattagtatgaaaaatt

SEQ ID NO: 97196 - DNA, 22 bp, Artificial Sequence
  chemically synthesized
ttagtatgaaaaattatataaa

SEQ ID NO: 97197 - DNA, 22 bp, Artificial Sequence
  chemically synthesized
gtatgaaaaattatataaatta

SEQ ID NO: 97198 - DNA, 22 bp, Artificial Sequence
  chemically synthesized
tataaattagattcttgttaag

SEQ ID NO: 97199 - DNA, 22 bp, Artificial Sequence
  chemically synthesized
gattcttgttaagtaaagtagg

SEQ ID NO: 97200 - DNA, 22 bp, Artificial Sequence
  chemically synthesized
ttgttaagtaaagtaggccctt

SEQ ID NO: 97201 - DNA, 22 bp, Artificial Sequence
  chemically synthesized
gttaagtaaagtaggcccttca

SEQ ID NO: 97202 - DNA, 22 bp, Artificial Sequence
  chemically synthesized
ttaagtaaagtaggcccttcac

SEQ ID NO: 97203 - DNA, 22 bp, Artificial Sequence
  chemically synthesized
agtaaagtaggcccttcacttc

SEQ ID NO: 97204 - DNA, 22 bp, Artificial Sequence
  chemically synthesized
cacttcactgaatgtttttcat

SEQ ID NO: 97205 - DNA, 22 bp, Artificial Sequence
  chemically synthesized
acttcactgaatgtttttcatg

SEQ ID NO: 97206 - DNA, 22 bp, Artificial Sequence
  chemically synthesized
cactgaatgtttttcatggtat

SEQ ID NO: 97207 - DNA, 22 bp, Artificial Sequence
  chemically synthesized
actgaatgtttttcatggtatt

SEQ ID NO: 97208 - DNA, 22 bp, Artificial Sequence
  chemically synthesized
aatgtttttcatggtattatct

SEQ ID NO: 97209 - DNA, 22 bp, Artificial Sequence
  chemically synthesized
ttcatggtattatctaagaaat

SEQ ID NO: 97210 - DNA, 22 bp, Artificial Sequence
  chemically synthesized
tcatggtattatctaagaaata

SEQ ID NO: 97211 - DNA, 22 bp, Artificial Sequence
  chemically synthesized
catggtattatctaagaaataa

SEQ ID NO: 97212 - DNA, 22 bp, Artificial Sequence
  chemically synthesized
atggtattatctaagaaataaa

SEQ ID NO: 97213 - DNA, 22 bp, Artificial Sequence
  chemically synthesized
tctaagaaataaatactttaat

SEQ ID NO: 97214 - DNA, 22 bp, Artificial Sequence
  chemically synthesized
agaaataaatactttaatgaat

SEQ ID NO: 97215 - DNA, 22 bp, Artificial Sequence
  chemically synthesized
taatgaatattctttaccacaa

SEQ ID NO: 97216 - DNA, 22 bp, Artificial Sequence
  chemically synthesized
aatgaatattctttaccacaaa

SEQ ID NO: 97217 - DNA, 22 bp, Artificial Sequence
  chemically synthesized
atgaatattctttaccacaaat

SEQ ID NO: 97218 - DNA, 22 bp, Artificial Sequence
  chemically synthesized
tttaccacaaataacttacttt

SEQ ID NO: 97219 - DNA, 22 bp, Artificial Sequence
  chemically synthesized
taccacaaataacttactttat

SEQ ID NO: 97220 - DNA, 22 bp, Artificial Sequence
  chemically synthesized
accacaaataacttactttatt

SEQ ID NO: 97221 - DNA, 22 bp, Artificial Sequence
  chemically synthesized
ccacaaataacttactttattt

SEQ ID NO: 97222 - DNA, 22 bp, Artificial Sequence
  chemically synthesized
actttatttttatttttaaaat

SEQ ID NO: 97223 - DNA, 22 bp, Artificial Sequence
  chemically synthesized
ctttatttttatttttaaaata

SEQ ID NO: 97224 - DNA, 22 bp, Artificial Sequence
  chemically synthesized
tatttttatttttaaaatagga

SEQ ID NO: 97225 - DNA, 22 bp, Artificial Sequence
  chemically synthesized
atttttatttttaaaataggaa

SEQ ID NO: 97226 - DNA, 22 bp, Artificial Sequence
  chemically synthesized
tttttatttttaaaataggaaa

SEQ ID NO: 97227 - DNA, 22 bp, Artificial Sequence
  chemically synthesized
ttatttttaaaataggaaaaat

SEQ ID NO: 97228 - DNA, 22 bp, Artificial Sequence
  chemically synthesized
tatttttaaaataggaaaaata

SEQ ID NO: 97229 - DNA, 22 bp, Artificial Sequence
  chemically synthesized
atttttaaaataggaaaaatat

SEQ ID NO: 97230 - DNA, 22 bp, Artificial Sequence
  chemically synthesized
tttttaaaataggaaaaatata

SEQ ID NO: 97231 - DNA, 22 bp, Artificial Sequence
  chemically synthesized
ttaaaataggaaaaatataaac

SEQ ID NO: 97232 - DNA, 22 bp, Artificial Sequence
  chemically synthesized
taaaataggaaaaatataaaca

SEQ ID NO: 97233 - DNA, 22 bp, Artificial Sequence
  chemically synthesized
aaaataggaaaaatataaacaa

SEQ ID NO: 97234 - DNA, 22 bp, Artificial Sequence
  chemically synthesized
aaataggaaaaatataaacaag

SEQ ID NO: 97235 - DNA, 22 bp, Artificial Sequence
  chemically synthesized
gtaaaccactgataggaaaaga

SEQ ID NO: 97236 - DNA, 22 bp, Artificial Sequence
  chemically synthesized
taaaccactgataggaaaagag

SEQ ID NO: 97237 - DNA, 22 bp, Artificial Sequence
  chemically synthesized
ataggaaaagagctgcttagga

SEQ ID NO: 97238 - DNA, 22 bp, Artificial Sequence
  chemically synthesized
cttaggattctaaattagccag

SEQ ID NO: 97239 - DNA, 22 bp, Artificial Sequence
  chemically synthesized
aggattctaaattagccagatt

SEQ ID NO: 97240 - DNA, 22 bp, Artificial Sequence
  chemically synthesized
ggattctaaattagccagattt

SEQ ID NO: 97241 - DNA, 22 bp, Artificial Sequence
  chemically synthesized
taaattagccagattttaaatt

SEQ ID NO: 97242 - DNA, 22 bp, Artificial Sequence
  chemically synthesized
aattagccagattttaaattat

SEQ ID NO: 97243 - DNA, 22 bp, Artificial Sequence
  chemically synthesized
gccagattttaaattattctgc

SEQ ID NO: 97244 - DNA, 22 bp, Artificial Sequence
  chemically synthesized
taaattattctgcttccattat

SEQ ID NO: 97245 - DNA, 22 bp, Artificial Sequence
  chemically synthesized
aaattattctgcttccattatg

SEQ ID NO: 97246 - DNA, 22 bp, Artificial Sequence
  chemically synthesized
aattattctgcttccattatgt

SEQ ID NO: 97247 - DNA, 22 bp, Artificial Sequence
  chemically synthesized
ttctgcttccattatgtatcta

SEQ ID NO: 97248 - DNA, 22 bp, Artificial Sequence
  chemically synthesized
tgcttccattatgtatctaaat

SEQ ID NO: 97249 - DNA, 22 bp, Artificial Sequence
  chemically synthesized
cttccattatgtatctaaatct

SEQ ID NO: 97250 - DNA, 22 bp, Artificial Sequence
  chemically synthesized
ccattatgtatctaaatctata

SEQ ID NO: 97251 - DNA, 22 bp, Artificial Sequence
  chemically synthesized
cattatgtatctaaatctatat

SEQ ID NO: 97252 - DNA, 22 bp, Artificial Sequence
  chemically synthesized
tgtatctaaatctatattctca

SEQ ID NO: 97253 - DNA, 22 bp, Artificial Sequence
  chemically synthesized
aatctatattctcagaacaaaa

SEQ ID NO: 97254 - DNA, 22 bp, Artificial Sequence
  chemically synthesized
tattctcagaacaaaaatagat

SEQ ID NO: 97255 - DNA, 22 bp, Artificial Sequence
  chemically synthesized
tcagaacaaaaatagatgtaag

SEQ ID NO: 97256 - DNA, 22 bp, Artificial Sequence
  chemically synthesized
agaacaaaaatagatgtaagca

SEQ ID NO: 97257 - DNA, 22 bp, Artificial Sequence
  chemically synthesized
tactagattttgtgttagattt

SEQ ID NO: 97258 - DNA, 22 bp, Artificial Sequence
  chemically synthesized
ctagattttgtgttagattttg

SEQ ID NO: 97259 - DNA, 22 bp, Artificial Sequence
  chemically synthesized
gattttgtgttagattttgcat

SEQ ID NO: 97260 - DNA, 22 bp, Artificial Sequence
  chemically synthesized
tgtgttagattttgcattatcc

SEQ ID NO: 97261 - DNA, 22 bp, Artificial Sequence
  chemically synthesized
gtgttagattttgcattatcca

SEQ ID NO: 97262 - DNA, 22 bp, Artificial Sequence
  chemically synthesized
tgttagattttgcattatccag

SEQ ID NO: 97263 - DNA, 22 bp, Artificial Sequence
  chemically synthesized
gattttgcattatccaggaatg

SEQ ID NO: 97264 - DNA, 22 bp, Artificial Sequence
  chemically synthesized
tgcattatccaggaatgacttg

SEQ ID NO: 97265 - DNA, 22 bp, Artificial Sequence
  chemically synthesized
gcattatccaggaatgacttgg

SEQ ID NO: 97266 - DNA, 22 bp, Artificial Sequence
  chemically synthesized
cattatccaggaatgacttgga

SEQ ID NO: 97267 - DNA, 22 bp, Artificial Sequence
  chemically synthesized
tccaggaatgacttggatatca

SEQ ID NO: 97268 - DNA, 22 bp, Artificial Sequence
  chemically synthesized
ggatatcacaagtcataaattc

SEQ ID NO: 97269 - DNA, 22 bp, Artificial Sequence
  chemically synthesized
gatatcacaagtcataaattct

SEQ ID NO: 97270 - DNA, 22 bp, Artificial Sequence
  chemically synthesized
tgtggctgccttgcaggaagcc

SEQ ID NO: 97271 - DNA, 22 bp, Artificial Sequence
  chemically synthesized
tggctgccttgcaggaagcctg

SEQ ID NO: 97272 - DNA, 22 bp, Artificial Sequence
  chemically synthesized
ccttgcaggaagcctgtggcta

SEQ ID NO: 97273 - DNA, 22 bp, Artificial Sequence
  chemically synthesized
gcaggaagcctgtggctatttt

SEQ ID NO: 97274 - DNA, 22 bp, Artificial Sequence
  chemically synthesized
caggaagcctgtggctattttc

SEQ ID NO: 97275 - DNA, 22 bp, Artificial Sequence
  chemically synthesized
tggctattttctagtgtaattg

SEQ ID NO: 97276 - DNA, 22 bp, Artificial Sequence
  chemically synthesized
ttttctagtgtaattgtaaaga

SEQ ID NO: 97277 - DNA, 22 bp, Artificial Sequence
  chemically synthesized
tctagtgtaattgtaaagaatg

SEQ ID NO: 97278 - DNA, 22 bp, Artificial Sequence
  chemically synthesized
ctagtgtaattgtaaagaatga

SEQ ID NO: 97279 - DNA, 22 bp, Artificial Sequence
  chemically synthesized
tagtgtaattgtaaagaatgag

SEQ ID NO: 97280 - DNA, 22 bp, Artificial Sequence
  chemically synthesized
gtgtaattgtaaagaatgagag

SEQ ID NO: 97281 - DNA, 22 bp, Artificial Sequence
  chemically synthesized
taaagaatgagagaatagacca

SEQ ID NO: 97282 - DNA, 22 bp, Artificial Sequence
  chemically synthesized
aaactgttgctttcttgttttc

SEQ ID NO: 97283 - DNA, 22 bp, Artificial Sequence
  chemically synthesized
ttgctttcttgttttcaacttt

SEQ ID NO: 97284 - DNA, 22 bp, Artificial Sequence
  chemically synthesized
ctttcttgttttcaacttttat

SEQ ID NO: 97285 - DNA, 22 bp, Artificial Sequence
  chemically synthesized
tcttgttttcaacttttatttt

SEQ ID NO: 97286 - DNA, 22 bp, Artificial Sequence
  chemically synthesized
cttgttttcaacttttatttta

SEQ ID NO: 97287 - DNA, 22 bp, Artificial Sequence
  chemically synthesized
ttgttttcaacttttattttaa

SEQ ID NO: 97288 - DNA, 22 bp, Artificial Sequence
  chemically synthesized
gttttcaacttttattttaagt

SEQ ID NO: 97289 - DNA, 22 bp, Artificial Sequence
  chemically synthesized
ttttcaacttttattttaagtt

SEQ ID NO: 97290 - DNA, 22 bp, Artificial Sequence
  chemically synthesized
tcaacttttattttaagttcag

SEQ ID NO: 97291 - DNA, 22 bp, Artificial Sequence
  chemically synthesized
caacttttattttaagttcagg

SEQ ID NO: 97292 - DNA, 22 bp, Artificial Sequence
  chemically synthesized
aacttttattttaagttcaggg

SEQ ID NO: 97293 - DNA, 22 bp, Artificial Sequence
  chemically synthesized
ttattttaagttcaggggtaca

SEQ ID NO: 97294 - DNA, 22 bp, Artificial Sequence
  chemically synthesized
tattttaagttcaggggtacat

SEQ ID NO: 97295 - DNA, 22 bp, Artificial Sequence
  chemically synthesized
attttaagttcaggggtacatg

SEQ ID NO: 97296 - DNA, 22 bp, Artificial Sequence
  chemically synthesized
ttttaagttcaggggtacatgt

SEQ ID NO: 97297 - DNA, 22 bp, Artificial Sequence
  chemically synthesized
taagttcaggggtacatgtaca

SEQ ID NO: 97298 - DNA, 22 bp, Artificial Sequence
  chemically synthesized
aagttcaggggtacatgtacag

SEQ ID NO: 97299 - DNA, 22 bp, Artificial Sequence
  chemically synthesized
agttcaggggtacatgtacagg

SEQ ID NO: 97300 - DNA, 22 bp, Artificial Sequence
  chemically synthesized
aggggtacatgtacaggatgtg

SEQ ID NO: 97301 - DNA, 22 bp, Artificial Sequence
  chemically synthesized
gttacatagataaatgaatgtc

SEQ ID NO: 97302 - DNA, 22 bp, Artificial Sequence
  chemically synthesized
ttacatagataaatgaatgtca

SEQ ID NO: 97303 - DNA, 22 bp, Artificial Sequence
  chemically synthesized
catagataaatgaatgtcaagg

SEQ ID NO: 97304 - DNA, 22 bp, Artificial Sequence
  chemically synthesized
gttgtatagatgatctcatcac

SEQ ID NO: 97305 - DNA, 22 bp, Artificial Sequence
  chemically synthesized
ttgtatagatgatctcatcact

SEQ ID NO: 97306 - DNA, 22 bp, Artificial Sequence
  chemically synthesized
tatagatgatctcatcactcag

SEQ ID NO: 97307 - DNA, 22 bp, Artificial Sequence
  chemically synthesized
atcactcaggtattacgcttag

SEQ ID NO: 97308 - DNA, 22 bp, Artificial Sequence
  chemically synthesized
aggtattacgcttagcatccat

SEQ ID NO: 97309 - DNA, 22 bp, Artificial Sequence
  chemically synthesized
cgcttagcatccattagtgatt

SEQ ID NO: 97310 - DNA, 22 bp, Artificial Sequence
  chemically synthesized
agcatccattagtgatttttcc

SEQ ID NO: 97311 - DNA, 22 bp, Artificial Sequence
  chemically synthesized
gcatccattagtgatttttcct

SEQ ID NO: 97312 - DNA, 22 bp, Artificial Sequence
  chemically synthesized
gtgatttttcctgatcctctcc

SEQ ID NO: 97313 - DNA, 22 bp, Artificial Sequence
  chemically synthesized
ttcctgatcctctccttctctc

SEQ ID NO: 97314 - DNA, 22 bp, Artificial Sequence
  chemically synthesized
tcctgatcctctccttctctca

SEQ ID NO: 97315 - DNA, 22 bp, Artificial Sequence
  chemically synthesized
cctgatcctctccttctctcac

SEQ ID NO: 97316 - DNA, 22 bp, Artificial Sequence
  chemically synthesized
ctgatcctctccttctctcacc

SEQ ID NO: 97317 - DNA, 22 bp, Artificial Sequence
  chemically synthesized
atcctctccttctctcaccctc

SEQ ID NO: 97318 - DNA, 22 bp, Artificial Sequence
  chemically synthesized
tccttctctcaccctccaccct

SEQ ID NO: 97319 - DNA, 22 bp, Artificial Sequence
  chemically synthesized
cttctctcaccctccaccctct

SEQ ID NO: 97320 - DNA, 22 bp, Artificial Sequence
  chemically synthesized
ctctcaccctccaccctctgat

SEQ ID NO: 97321 - DNA, 22 bp, Artificial Sequence
  chemically synthesized
tctcaccctccaccctctgata

SEQ ID NO: 97322 - DNA, 22 bp, Artificial Sequence
  chemically synthesized
tcaccctccaccctctgatagg

SEQ ID NO: 97323 - DNA, 22 bp, Artificial Sequence
  chemically synthesized
accctccaccctctgataggcc

SEQ ID NO: 97324 - DNA, 22 bp, Artificial Sequence
  chemically synthesized
caccctctgataggccccagta

SEQ ID NO: 97325 - DNA, 22 bp, Artificial Sequence
  chemically synthesized
tgataggccccagtatgcgttg

SEQ ID NO: 97326 - DNA, 22 bp, Artificial Sequence
  chemically synthesized
ataggccccagtatgcgttgtt

SEQ ID NO: 97327 - DNA, 22 bp, Artificial Sequence
  chemically synthesized
tttccctctatgagtccatgtg

SEQ ID NO: 97328 - DNA, 22 bp, Artificial Sequence
  chemically synthesized
ccctctatgagtccatgtgttc

SEQ ID NO: 97329 - DNA, 22 bp, Artificial Sequence
  chemically synthesized
cctctatgagtccatgtgttct

SEQ ID NO: 97330 - DNA, 22 bp, Artificial Sequence
  chemically synthesized
tatgagtccatgtgttctcatc

SEQ ID NO: 97331 - DNA, 22 bp, Artificial Sequence
  chemically synthesized
tgagtccatgtgttctcatcat

SEQ ID NO: 97332 - DNA, 22 bp, Artificial Sequence
  chemically synthesized
tcatcatttagcttctaactgt

SEQ ID NO: 97333 - DNA, 22 bp, Artificial Sequence
  chemically synthesized
atcatttagcttctaactgttg

SEQ ID NO: 97334 - DNA, 22 bp, Artificial Sequence
  chemically synthesized
agcttctaactgttgctttcgt

SEQ ID NO: 97335 - DNA, 22 bp, Artificial Sequence
  chemically synthesized
gcttctaactgttgctttcgta

SEQ ID NO: 97336 - DNA, 22 bp, Artificial Sequence
  chemically synthesized
ctaactgttgctttcgtagtgt

SEQ ID NO: 97337 - DNA, 22 bp, Artificial Sequence
  chemically synthesized
taactgttgctttcgtagtgta

SEQ ID NO: 97338 - DNA, 22 bp, Artificial Sequence
  chemically synthesized
actgttgctttcgtagtgtacc

SEQ ID NO: 97339 - DNA, 22 bp, Artificial Sequence
  chemically synthesized
ttgctttcgtagtgtacctctg

SEQ ID NO: 97340 - DNA, 22 bp, Artificial Sequence
  chemically synthesized
ctttcgtagtgtacctctgcct

SEQ ID NO: 97341 - DNA, 22 bp, Artificial Sequence
  chemically synthesized
tcgtagtgtacctctgcctcat

SEQ ID NO: 97342 - DNA, 22 bp, Artificial Sequence
  chemically synthesized
cgtagtgtacctctgcctcatc

SEQ ID NO: 97343 - DNA, 22 bp, Artificial Sequence
  chemically synthesized
gtagtgtacctctgcctcatct

SEQ ID NO: 97344 - DNA, 22 bp, Artificial Sequence
  chemically synthesized
tgcctcatctctcacgaagttt

SEQ ID NO: 97345 - DNA, 22 bp, Artificial Sequence
  chemically synthesized
cctcatctctcacgaagtttgc

SEQ ID NO: 97346 - DNA, 22 bp, Artificial Sequence
  chemically synthesized
atctctcacgaagtttgcaggt

SEQ ID NO: 97347 - DNA, 22 bp, Artificial Sequence
  chemically synthesized
tcacgaagtttgcaggtgagtt

SEQ ID NO: 97348 - DNA, 22 bp, Artificial Sequence
  chemically synthesized
acgaagtttgcaggtgagtttg

SEQ ID NO: 97349 - DNA, 22 bp, Artificial Sequence
  chemically synthesized
gcaggtgagtttgagccagggc

SEQ ID NO: 97350 - DNA, 22 bp, Artificial Sequence
  chemically synthesized
caggtgagtttgagccagggct

SEQ ID NO: 97351 - DNA, 22 bp, Artificial Sequence
  chemically synthesized
gagccagggctgaggctcattc

SEQ ID NO: 97352 - DNA, 22 bp, Artificial Sequence
  chemically synthesized
agccagggctgaggctcattct

SEQ ID NO: 97353 - DNA, 22 bp, Artificial Sequence
  chemically synthesized
aggctcattctcaagagtaatc

SEQ ID NO: 97354 - DNA, 22 bp, Artificial Sequence
  chemically synthesized
attctcaagagtaatctctctc

SEQ ID NO: 97355 - DNA, 22 bp, Artificial Sequence
  chemically synthesized
tcaagagtaatctctctctctg

SEQ ID NO: 97356 - DNA, 22 bp, Artificial Sequence
  chemically synthesized
aagagtaatctctctctctggc

SEQ ID NO: 97357 - DNA, 22 bp, Artificial Sequence
  chemically synthesized
tctctctggcaacttggagcac

SEQ ID NO: 97358 - DNA, 22 bp, Artificial Sequence
  chemically synthesized
tctctggcaacttggagcacag

SEQ ID NO: 97359 - DNA, 22 bp, Artificial Sequence
  chemically synthesized
tctggcaacttggagcacagac

SEQ ID NO: 97360 - DNA, 22 bp, Artificial Sequence
  chemically synthesized
tggcaacttggagcacagacat

SEQ ID NO: 97361 - DNA, 22 bp, Artificial Sequence
  chemically synthesized
gcaacttggagcacagacatcc

SEQ ID NO: 97362 - DNA, 22 bp, Artificial Sequence
  chemically synthesized
ggagcacagacatcctattgtg

SEQ ID NO: 97363 - DNA, 22 bp, Artificial Sequence
  chemically synthesized
gagcacagacatcctattgtgt

SEQ ID NO: 97364 - DNA, 22 bp, Artificial Sequence
  chemically synthesized
ttgtgtgactgacctcgggagc

SEQ ID NO: 97365 - DNA, 22 bp, Artificial Sequence
  chemically synthesized
tgtgactgacctcgggagccac

SEQ ID NO: 97366 - DNA, 22 bp, Artificial Sequence
  chemically synthesized
acctcgggagccactgtgccta

SEQ ID NO: 97367 - DNA, 22 bp, Artificial Sequence
  chemically synthesized
gggagccactgtgcctaaagta

SEQ ID NO: 97368 - DNA, 22 bp, Artificial Sequence
  chemically synthesized
tgcctaaagtacaaccagagtt

SEQ ID NO: 97369 - DNA, 22 bp, Artificial Sequence
  chemically synthesized
aagtacaaccagagttacttgt

SEQ ID NO: 97370 - DNA, 22 bp, Artificial Sequence
  chemically synthesized
cttgtgaatgttaattaagcag

SEQ ID NO: 97371 - DNA, 22 bp, Artificial Sequence
  chemically synthesized
gtgaatgttaattaagcaggag

SEQ ID NO: 97372 - DNA, 22 bp, Artificial Sequence
  chemically synthesized
tgaatgttaattaagcaggagg

SEQ ID NO: 97373 - DNA, 22 bp, Artificial Sequence
  chemically synthesized
attaagcaggagggatctttaa

SEQ ID NO: 97374 - DNA, 22 bp, Artificial Sequence
  chemically synthesized
agcaggagggatctttaatggg

SEQ ID NO: 97375 - DNA, 22 bp, Artificial Sequence
  chemically synthesized
taatgggaaaaaggagtagaaa

SEQ ID NO: 97376 - DNA, 22 bp, Artificial Sequence
  chemically synthesized
aatgggaaaaaggagtagaaag

SEQ ID NO: 97377 - DNA, 22 bp, Artificial Sequence
  chemically synthesized
atgggaaaaaggagtagaaagc

SEQ ID NO: 97378 - DNA, 22 bp, Artificial Sequence
  chemically synthesized
tgccacactttcctacatgatg

SEQ ID NO: 97379 - DNA, 22 bp, Artificial Sequence
  chemically synthesized
tcctacatgatgggcactgaag

SEQ ID NO: 97380 - DNA, 22 bp, Artificial Sequence
  chemically synthesized
cctacatgatgggcactgaagg

SEQ ID NO: 97381 - DNA, 22 bp, Artificial Sequence
  chemically synthesized
ctacatgatgggcactgaaggt

SEQ ID NO: 97382 - DNA, 22 bp, Artificial Sequence
  chemically synthesized
catgatgggcactgaaggttaa

SEQ ID NO: 97383 - DNA, 22 bp, Artificial Sequence
  chemically synthesized
aaggttaaaacttgagtctgtc

SEQ ID NO: 97384 - DNA, 22 bp, Artificial Sequence
  chemically synthesized
aaacttgagtctgtcaacttag

SEQ ID NO: 97385 - DNA, 22 bp, Artificial Sequence
  chemically synthesized
gagtctgtcaacttagaaaact

SEQ ID NO: 97386 - DNA, 22 bp, Artificial Sequence
  chemically synthesized
agtctgtcaacttagaaaactc

SEQ ID NO: 97387 - DNA, 22 bp, Artificial Sequence
  chemically synthesized
tcaacttagaaaactcataaat

SEQ ID NO: 97388 - DNA, 22 bp, Artificial Sequence
  chemically synthesized
agaaaactcataaatatcccat

SEQ ID NO: 97389 - DNA, 22 bp, Artificial Sequence
  chemically synthesized
gaaaactcataaatatcccatt

SEQ ID NO: 97390 - DNA, 22 bp, Artificial Sequence
  chemically synthesized
ataaatatcccattttccgctg

SEQ ID NO: 97391 - DNA, 22 bp, Artificial Sequence
  chemically synthesized
tccgctgaaatatagctttact

SEQ ID NO: 97392 - DNA, 22 bp, Artificial Sequence
  chemically synthesized
ccgctgaaatatagctttactt

SEQ ID NO: 97393 - DNA, 22 bp, Artificial Sequence
  chemically synthesized
cgctgaaatatagctttacttt

SEQ ID NO: 97394 - DNA, 22 bp, Artificial Sequence
  chemically synthesized
aaatatagctttactttcctgg

SEQ ID NO: 97395 - DNA, 22 bp, Artificial Sequence
  chemically synthesized
tactttcctggtttctttgacc

SEQ ID NO: 97396 - DNA, 22 bp, Artificial Sequence
  chemically synthesized
actttcctggtttctttgacct

SEQ ID NO: 97397 - DNA, 22 bp, Artificial Sequence
  chemically synthesized
ctttcctggtttctttgacctt

SEQ ID NO: 97398 - DNA, 22 bp, Artificial Sequence
  chemically synthesized
tcctggtttctttgaccttttg

SEQ ID NO: 97399 - DNA, 22 bp, Artificial Sequence
  chemically synthesized
cctggtttctttgaccttttgg

SEQ ID NO: 97400 - DNA, 22 bp, Artificial Sequence
  chemically synthesized
ctggtttctttgaccttttggg

SEQ ID NO: 97401 - DNA, 22 bp, Artificial Sequence
  chemically synthesized
gtttctttgaccttttgggacc

SEQ ID NO: 97402 - DNA, 22 bp, Artificial Sequence
  chemically synthesized
ctttgaccttttgggaccttga

SEQ ID NO: 97403 - DNA, 22 bp, Artificial Sequence
  chemically synthesized
tttgaccttttgggaccttgag

SEQ ID NO: 97404 - DNA, 22 bp, Artificial Sequence
  chemically synthesized
tgaccttttgggaccttgagta

SEQ ID NO: 97405 - DNA, 22 bp, Artificial Sequence
  chemically synthesized
gaccttttgggaccttgagtaa

SEQ ID NO: 97406 - DNA, 22 bp, Artificial Sequence
  chemically synthesized
accttttgggaccttgagtaag

SEQ ID NO: 97407 - DNA, 22 bp, Artificial Sequence
  chemically synthesized
ttgggaccttgagtaagtaaag

SEQ ID NO: 97408 - DNA, 22 bp, Artificial Sequence
  chemically synthesized
tgggaccttgagtaagtaaaga

SEQ ID NO: 97409 - DNA, 22 bp, Artificial Sequence
  chemically synthesized
gggaccttgagtaagtaaagat

SEQ ID NO: 97410 - DNA, 22 bp, Artificial Sequence
  chemically synthesized
ggaccttgagtaagtaaagatg

SEQ ID NO: 97411 - DNA, 22 bp, Artificial Sequence
  chemically synthesized
gagtaagtaaagatgccttcat

SEQ ID NO: 97412 - DNA, 22 bp, Artificial Sequence
  chemically synthesized
agtaagtaaagatgccttcatt

SEQ ID NO: 97413 - DNA, 22 bp, Artificial Sequence
  chemically synthesized
catttattttcatgattaaaat

SEQ ID NO: 97414 - DNA, 22 bp, Artificial Sequence
  chemically synthesized
atttattttcatgattaaaatt

SEQ ID NO: 97415 - DNA, 22 bp, Artificial Sequence
  chemically synthesized
attttcatgattaaaattctaa

SEQ ID NO: 97416 - DNA, 22 bp, Artificial Sequence
  chemically synthesized
ttttcatgattaaaattctaag

SEQ ID NO: 97417 - DNA, 22 bp, Artificial Sequence
  chemically synthesized
tcatgattaaaattctaagaaa

SEQ ID NO: 97418 - DNA, 22 bp, Artificial Sequence
  chemically synthesized
catgattaaaattctaagaaat

SEQ ID NO: 97419 - DNA, 22 bp, Artificial Sequence
  chemically synthesized
atgattaaaattctaagaaatt

SEQ ID NO: 97420 - DNA, 22 bp, Artificial Sequence
  chemically synthesized
aaattctaagaaattcttgggt

SEQ ID NO: 97421 - DNA, 22 bp, Artificial Sequence
  chemically synthesized
taagaaattcttgggttttttt

SEQ ID NO: 97422 - DNA, 22 bp, Artificial Sequence
  chemically synthesized
agaaattcttgggtttttttaa

SEQ ID NO: 97423 - DNA, 22 bp, Artificial Sequence
  chemically synthesized
ttgggtttttttaattaaattg

SEQ ID NO: 97424 - DNA, 22 bp, Artificial Sequence
  chemically synthesized
gggtttttttaattaaattgca

SEQ ID NO: 97425 - DNA, 22 bp, Artificial Sequence
  chemically synthesized
ggtttttttaattaaattgcat

SEQ ID NO: 97426 - DNA, 22 bp, Artificial Sequence
  chemically synthesized
ttttaattaaattgcattgcct

SEQ ID NO: 97427 - DNA, 22 bp, Artificial Sequence
  chemically synthesized
tttaattaaattgcattgccta

SEQ ID NO: 97428 - DNA, 22 bp, Artificial Sequence
  chemically synthesized
ttaattaaattgcattgcctaa

SEQ ID NO: 97429 - DNA, 22 bp, Artificial Sequence
  chemically synthesized
taattaaattgcattgcctaat

SEQ ID NO: 97430 - DNA, 22 bp, Artificial Sequence
  chemically synthesized
aattaaattgcattgcctaatg

SEQ ID NO: 97431 - DNA, 22 bp, Artificial Sequence
  chemically synthesized
attaaattgcattgcctaatgt

SEQ ID NO: 97432 - DNA, 22 bp, Artificial Sequence
  chemically synthesized
aattgcattgcctaatgtattt

SEQ ID NO: 97433 - DNA, 22 bp, Artificial Sequence
  chemically synthesized
cattgcctaatgtatttatgaa

SEQ ID NO: 97434 - DNA, 22 bp, Artificial Sequence
  chemically synthesized
cctaatgtatttatgaactaag

SEQ ID NO: 97435 - DNA, 22 bp, Artificial Sequence
  chemically synthesized
atgtatttatgaactaagaaca

SEQ ID NO: 97436 - DNA, 22 bp, Artificial Sequence
  chemically synthesized
atgaactaagaacatagaaata

SEQ ID NO: 97437 - DNA, 22 bp, Artificial Sequence
  chemically synthesized
tgaactaagaacatagaaataa

SEQ ID NO: 97438 - DNA, 22 bp, Artificial Sequence
  chemically synthesized
agaacatagaaataaaacaata

SEQ ID NO: 97439 - DNA, 22 bp, Artificial Sequence
  chemically synthesized
tgaagtagttcagaatgtgctt

SEQ ID NO: 97440 - DNA, 22 bp, Artificial Sequence
  chemically synthesized
aagtagttcagaatgtgctttc

SEQ ID NO: 97441 - DNA, 22 bp, Artificial Sequence
  chemically synthesized
agaatgtgctttcaatttatat

SEQ ID NO: 97442 - DNA, 22 bp, Artificial Sequence
  chemically synthesized
tcaatttatataaagagttaat

SEQ ID NO: 97443 - DNA, 22 bp, Artificial Sequence
  chemically synthesized
caatttatataaagagttaatt

SEQ ID NO: 97444 - DNA, 22 bp, Artificial Sequence
  chemically synthesized
aatttatataaagagttaattc

SEQ ID NO: 97445 - DNA, 22 bp, Artificial Sequence
  chemically synthesized
atataaagagttaattcaaatg

SEQ ID NO: 97446 - DNA, 22 bp, Artificial Sequence
  chemically synthesized
tataaagagttaattcaaatga

SEQ ID NO: 97447 - DNA, 22 bp, Artificial Sequence
  chemically synthesized
attcaaatgagactattttaag

SEQ ID NO: 97448 - DNA, 22 bp, Artificial Sequence
  chemically synthesized
aaatgagactattttaagtgca

SEQ ID NO: 97449 - DNA, 22 bp, Artificial Sequence
  chemically synthesized
ttttaagtgcagggctttgaat

SEQ ID NO: 97450 - DNA, 22 bp, Artificial Sequence
  chemically synthesized
taagtgcagggctttgaatctt

SEQ ID NO: 97451 - DNA, 22 bp, Artificial Sequence
  chemically synthesized
aagtgcagggctttgaatctta

SEQ ID NO: 97452 - DNA, 22 bp, Artificial Sequence
  chemically synthesized
agtgcagggctttgaatcttat

SEQ ID NO: 97453 - DNA, 22 bp, Artificial Sequence
  chemically synthesized
tgaatcttatgtctagaaattt

SEQ ID NO: 97454 - DNA, 22 bp, Artificial Sequence
  chemically synthesized
gaatcttatgtctagaaatttt

SEQ ID NO: 97455 - DNA, 22 bp, Artificial Sequence
  chemically synthesized
aatcttatgtctagaaattttg

SEQ ID NO: 97456 - DNA, 22 bp, Artificial Sequence
  chemically synthesized
atgtctagaaattttgaaaaac

SEQ ID NO: 97457 - DNA, 22 bp, Artificial Sequence
  chemically synthesized
tgtctagaaattttgaaaaacc

SEQ ID NO: 97458 - DNA, 22 bp, Artificial Sequence
  chemically synthesized
gaaattttgaaaaacctctgat

SEQ ID NO: 97459 - DNA, 22 bp, Artificial Sequence
  chemically synthesized
tgaaaaacctctgattatatgc

SEQ ID NO: 97460 - DNA, 22 bp, Artificial Sequence
  chemically synthesized
gaaaaacctctgattatatgct

SEQ ID NO: 97461 - DNA, 22 bp, Artificial Sequence
  chemically synthesized
aaaaacctctgattatatgcta

SEQ ID NO: 97462 - DNA, 22 bp, Artificial Sequence
  chemically synthesized
tgattatatgctaagattccac

SEQ ID NO: 97463 - DNA, 22 bp, Artificial Sequence
  chemically synthesized
attatatgctaagattccacct

SEQ ID NO: 97464 - DNA, 22 bp, Artificial Sequence
  chemically synthesized
tatgctaagattccacctctag

SEQ ID NO: 97465 - DNA, 22 bp, Artificial Sequence
  chemically synthesized
agattccacctctagtgctaga

SEQ ID NO: 97466 - DNA, 22 bp, Artificial Sequence
  chemically synthesized
cacctctagtgctagaactgag

SEQ ID NO: 97467 - DNA, 22 bp, Artificial Sequence
  chemically synthesized
tagtgctagaactgagaagtcc

SEQ ID NO: 97468 - DNA, 22 bp, Artificial Sequence
  chemically synthesized
gtgctagaactgagaagtcctt

SEQ ID NO: 97469 - DNA, 22 bp, Artificial Sequence
  chemically synthesized
gaactgagaagtccttgacttg

SEQ ID NO: 97470 - DNA, 22 bp, Artificial Sequence
  chemically synthesized
agaagtccttgacttggtgatc

SEQ ID NO: 97471 - DNA, 22 bp, Artificial Sequence
  chemically synthesized
gacttggtgatcttttttaaat

SEQ ID NO: 97472 - DNA, 22 bp, Artificial Sequence
  chemically synthesized
acttggtgatcttttttaaatt

SEQ ID NO: 97473 - DNA, 22 bp, Artificial Sequence
  chemically synthesized
ggtgatcttttttaaattctga

SEQ ID NO: 97474 - DNA, 22 bp, Artificial Sequence
  chemically synthesized
gtgatcttttttaaattctgaa

SEQ ID NO: 97475 - DNA, 22 bp, Artificial Sequence
  chemically synthesized
ttttaaattctgaaacaacagc

SEQ ID NO: 97476 - DNA, 22 bp, Artificial Sequence
  chemically synthesized
tttaaattctgaaacaacagca

SEQ ID NO: 97477 - DNA, 22 bp, Artificial Sequence
  chemically synthesized
ttaaattctgaaacaacagcaa

SEQ ID NO: 97478 - DNA, 22 bp, Artificial Sequence
  chemically synthesized
taaattctgaaacaacagcaac

SEQ ID NO: 97479 - DNA, 22 bp, Artificial Sequence
  chemically synthesized
aaattctgaaacaacagcaaca

SEQ ID NO: 97480 - DNA, 22 bp, Artificial Sequence
  chemically synthesized
aattctgaaacaacagcaacat

SEQ ID NO: 97481 - DNA, 22 bp, Artificial Sequence
  chemically synthesized
tgaaacaacagcaacataaagc

SEQ ID NO: 97482 - DNA, 22 bp, Artificial Sequence
  chemically synthesized
aaacaacagcaacataaagcta

SEQ ID NO: 97483 - DNA, 22 bp, Artificial Sequence
  chemically synthesized
aggactttttcttgcctatgca

SEQ ID NO: 97484 - DNA, 22 bp, Artificial Sequence
  chemically synthesized
tttcttgcctatgcatgctatc

SEQ ID NO: 97485 - DNA, 22 bp, Artificial Sequence
  chemically synthesized
ttcttgcctatgcatgctatct

SEQ ID NO: 97486 - DNA, 22 bp, Artificial Sequence
  chemically synthesized
tcttgcctatgcatgctatctt

SEQ ID NO: 97487 - DNA, 22 bp, Artificial Sequence
  chemically synthesized
cttgcctatgcatgctatcttc

SEQ ID NO: 97488 - DNA, 22 bp, Artificial Sequence
  chemically synthesized
ttgcctatgcatgctatcttca

SEQ ID NO: 97489 - DNA, 22 bp, Artificial Sequence
  chemically synthesized
gcctatgcatgctatcttcagt

SEQ ID NO: 97490 - DNA, 22 bp, Artificial Sequence
  chemically synthesized
cctatgcatgctatcttcagta

SEQ ID NO: 97491 - DNA, 22 bp, Artificial Sequence
  chemically synthesized
tgcatgctatcttcagtacttt

SEQ ID NO: 97492 - DNA, 22 bp, Artificial Sequence
  chemically synthesized
tcttcagtactttgattattta

SEQ ID NO: 97493 - DNA, 22 bp, Artificial Sequence
  chemically synthesized
cagtactttgattatttagtat

SEQ ID NO: 97494 - DNA, 22 bp, Artificial Sequence
  chemically synthesized
agtactttgattatttagtatt

SEQ ID NO: 97495 - DNA, 22 bp, Artificial Sequence
  chemically synthesized
tgattatttagtattgaaacta

SEQ ID NO: 97496 - DNA, 22 bp, Artificial Sequence
  chemically synthesized
gattatttagtattgaaactat

SEQ ID NO: 97497 - DNA, 22 bp, Artificial Sequence
  chemically synthesized
attatttagtattgaaactata

SEQ ID NO: 97498 - DNA, 22 bp, Artificial Sequence
  chemically synthesized
tttagtattgaaactataacat

SEQ ID NO: 97499 - DNA, 22 bp, Artificial Sequence
  chemically synthesized
agtattgaaactataacatagt

SEQ ID NO: 97500 - DNA, 22 bp, Artificial Sequence
  chemically synthesized
gtattgaaactataacatagta

SEQ ID NO: 97501 - DNA, 22 bp, Artificial Sequence
  chemically synthesized
aaactataacatagtatgtttc

SEQ ID NO: 97502 - DNA, 22 bp, Artificial Sequence
  chemically synthesized
taacatagtatgtttcctgaat

SEQ ID NO: 97503 - DNA, 22 bp, Artificial Sequence
  chemically synthesized
cctgaataaaaaatgtgtattt

SEQ ID NO: 97504 - DNA, 22 bp, Artificial Sequence
  chemically synthesized
ctgaataaaaaatgtgtatttc

SEQ ID NO: 97505 - DNA, 22 bp, Artificial Sequence
  chemically synthesized
aataaaaaatgtgtatttctct

SEQ ID NO: 97506 - DNA, 22 bp, Artificial Sequence
  chemically synthesized
ctctggagaaggttaaaactga

SEQ ID NO: 97507 - DNA, 22 bp, Artificial Sequence
  chemically synthesized
tctggagaaggttaaaactgag

SEQ ID NO: 97508 - DNA, 22 bp, Artificial Sequence
  chemically synthesized
tggagaaggttaaaactgagga

SEQ ID NO: 97509 - DNA, 22 bp, Artificial Sequence
  chemically synthesized
gagaaggttaaaactgaggatt

SEQ ID NO: 97510 - DNA, 22 bp, Artificial Sequence
  chemically synthesized
aaactgaggattggcaagtgag

SEQ ID NO: 97511 - DNA, 22 bp, Artificial Sequence
  chemically synthesized
aggattggcaagtgagcaaggc

SEQ ID NO: 97512 - DNA, 22 bp, Artificial Sequence
  chemically synthesized
gcaagtgagcaaggcttaaatg

SEQ ID NO: 97513 - DNA, 22 bp, Artificial Sequence
  chemically synthesized
aaatggaagaagcaatgatctc

SEQ ID NO: 97514 - DNA, 22 bp, Artificial Sequence
  chemically synthesized
aatggaagaagcaatgatctcg

SEQ ID NO: 97515 - DNA, 22 bp, Artificial Sequence
  chemically synthesized
gtcagaccaccttcattaacga

SEQ ID NO: 97516 - DNA, 22 bp, Artificial Sequence
  chemically synthesized
cattaacgagatcatccatcat

SEQ ID NO: 97517 - DNA, 22 bp, Artificial Sequence
  chemically synthesized
attaacgagatcatccatcatg

SEQ ID NO: 97518 - DNA, 22 bp, Artificial Sequence
  chemically synthesized
acgagatcatccatcatgagga

SEQ ID NO: 97519 - DNA, 22 bp, Artificial Sequence
  chemically synthesized
tgttttgtgtcactaagggtga

SEQ ID NO: 97520 - DNA, 22 bp, Artificial Sequence
  chemically synthesized
ttttgtgtcactaagggtgagg

SEQ ID NO: 97521 - DNA, 22 bp, Artificial Sequence
  chemically synthesized
tgtgtcactaagggtgaggatg

SEQ ID NO: 97522 - DNA, 22 bp, Artificial Sequence
  chemically synthesized
gtgtcactaagggtgaggatgc

SEQ ID NO: 97523 - DNA, 22 bp, Artificial Sequence
  chemically synthesized
tgtcactaagggtgaggatgct

SEQ ID NO: 97524 - DNA, 22 bp, Artificial Sequence
  chemically synthesized
agggtgaggatgctgaatgatt

SEQ ID NO: 97525 - DNA, 22 bp, Artificial Sequence
  chemically synthesized
aatgatttttccctcccccggg

SEQ ID NO: 97526 - DNA, 22 bp, Artificial Sequence
  chemically synthesized
ttccctcccccgggcttctttt

SEQ ID NO: 97527 - DNA, 22 bp, Artificial Sequence
  chemically synthesized
tccctcccccgggcttctttta

SEQ ID NO: 97528 - DNA, 22 bp, Artificial Sequence
  chemically synthesized
ccctcccccgggcttcttttag

SEQ ID NO: 97529 - DNA, 22 bp, Artificial Sequence
  chemically synthesized
cctcccccgggcttcttttagc

SEQ ID NO: 97530 - DNA, 22 bp, Artificial Sequence
  chemically synthesized
ccccgggcttcttttagccatc

SEQ ID NO: 97531 - DNA, 22 bp, Artificial Sequence
  chemically synthesized
cttttagccatcaataattcta

SEQ ID NO: 97532 - DNA, 22 bp, Artificial Sequence
  chemically synthesized
ttttagccatcaataattctag

SEQ ID NO: 97533 - DNA, 22 bp, Artificial Sequence
  chemically synthesized
ttagccatcaataattctagcc

SEQ ID NO: 97534 - DNA, 22 bp, Artificial Sequence
  chemically synthesized
tagccatcaataattctagccc

SEQ ID NO: 97535 - DNA, 22 bp, Artificial Sequence
  chemically synthesized
agccatcaataattctagcccc

SEQ ID NO: 97536 - DNA, 22 bp, Artificial Sequence
  chemically synthesized
gccatcaataattctagcccca

SEQ ID NO: 97537 - DNA, 22 bp, Artificial Sequence
  chemically synthesized
tagccccacaggagtttgttct

SEQ ID NO: 97538 - DNA, 22 bp, Artificial Sequence
  chemically synthesized
gccccacaggagtttgttctga

SEQ ID NO: 97539 - DNA, 22 bp, Artificial Sequence
  chemically synthesized
gttctgaaagtaaacttccaca

SEQ ID NO: 97540 - DNA, 22 bp, Artificial Sequence
  chemically synthesized
ttctgaaagtaaacttccacaa

SEQ ID NO: 97541 - DNA, 22 bp, Artificial Sequence
  chemically synthesized
tgaaagtaaacttccacaaccg

SEQ ID NO: 97542 - DNA, 22 bp, Artificial Sequence
  chemically synthesized
aaagtaaacttccacaaccgca

SEQ ID NO: 97543 - DNA, 22 bp, Artificial Sequence
  chemically synthesized
ccacaaccgcaagcttattgag

SEQ ID NO: 97544 - DNA, 22 bp, Artificial Sequence
  chemically synthesized
cacaaccgcaagcttattgagg

SEQ ID NO: 97545 - DNA, 22 bp, Artificial Sequence
  chemically synthesized
attgaggctaaggcatctgtga

SEQ ID NO: 97546 - DNA, 22 bp, Artificial Sequence
  chemically synthesized
ttgaggctaaggcatctgtgaa

SEQ ID NO: 97547 - DNA, 22 bp, Artificial Sequence
  chemically synthesized
aggctaaggcatctgtgaagga

SEQ ID NO: 97548 - DNA, 22 bp, Artificial Sequence
  chemically synthesized
aggcatctgtgaaggaaagaaa

SEQ ID NO: 97549 - DNA, 22 bp, Artificial Sequence
  chemically synthesized
tgaaggaaagaaacatctcctc

SEQ ID NO: 97550 - DNA, 22 bp, Artificial Sequence
  chemically synthesized
ctctaaaccactatgctgctag

SEQ ID NO: 97551 - DNA, 22 bp, Artificial Sequence
  chemically synthesized
taaaccactatgctgctagagc

SEQ ID NO: 97552 - DNA, 22 bp, Artificial Sequence
  chemically synthesized
aaccactatgctgctagagcct

SEQ ID NO: 97553 - DNA, 22 bp, Artificial Sequence
  chemically synthesized
tgctgctagagcctcttttctg

SEQ ID NO: 97554 - DNA, 22 bp, Artificial Sequence
  chemically synthesized
ctagagcctcttttctgtactc

SEQ ID NO: 97555 - DNA, 22 bp, Artificial Sequence
  chemically synthesized
gagcctcttttctgtactcaag

SEQ ID NO: 97556 - DNA, 22 bp, Artificial Sequence
  chemically synthesized
ttttctgtactcaagcctcatt

SEQ ID NO: 97557 - DNA, 22 bp, Artificial Sequence
  chemically synthesized
ttctgtactcaagcctcattca

SEQ ID NO: 97558 - DNA, 22 bp, Artificial Sequence
  chemically synthesized
tctgtactcaagcctcattcag

SEQ ID NO: 97559 - DNA, 22 bp, Artificial Sequence
  chemically synthesized
ctgtactcaagcctcattcaga

SEQ ID NO: 97560 - DNA, 22 bp, Artificial Sequence
  chemically synthesized
tgtactcaagcctcattcagac

SEQ ID NO: 97561 - DNA, 22 bp, Artificial Sequence
  chemically synthesized
tactcaagcctcattcagacac

SEQ ID NO: 97562 - DNA, 22 bp, Artificial Sequence
  chemically synthesized
aagcctcattcagacactagtg

SEQ ID NO: 97563 - DNA, 22 bp, Artificial Sequence
  chemically synthesized
attcagacactagtgtcaccag

SEQ ID NO: 97564 - DNA, 22 bp, Artificial Sequence
  chemically synthesized
agacactagtgtcaccagtctc

SEQ ID NO: 97565 - DNA, 22 bp, Artificial Sequence
  chemically synthesized
gtgtcaccagtctcctcatata

SEQ ID NO: 97566 - DNA, 22 bp, Artificial Sequence
  chemically synthesized
ctcatatacctattgtattttc

SEQ ID NO: 97567 - DNA, 22 bp, Artificial Sequence
  chemically synthesized
atatacctattgtattttcttc

SEQ ID NO: 97568 - DNA, 22 bp, Artificial Sequence
  chemically synthesized
ttgtattttcttcttcttgctg

SEQ ID NO: 97569 - DNA, 22 bp, Artificial Sequence
  chemically synthesized
tattttcttcttcttgctggtt

SEQ ID NO: 97570 - DNA, 22 bp, Artificial Sequence
  chemically synthesized
tcttcttcttgctggtttagtc

SEQ ID NO: 97571 - DNA, 22 bp, Artificial Sequence
  chemically synthesized
cttcttcttgctggtttagtca

SEQ ID NO: 97572 - DNA, 22 bp, Artificial Sequence
  chemically synthesized
ttcttcttgctggtttagtcat

SEQ ID NO: 97573 - DNA, 22 bp, Artificial Sequence
  chemically synthesized
cttcttgctggtttagtcatgt

SEQ ID NO: 97574 - DNA, 22 bp, Artificial Sequence
  chemically synthesized
ttcttgctggtttagtcatgtt

SEQ ID NO: 97575 - DNA, 22 bp, Artificial Sequence
  chemically synthesized
cttgctggtttagtcatgtttt

SEQ ID NO: 97576 - DNA, 22 bp, Artificial Sequence
  chemically synthesized
ttgctggtttagtcatgttttc

SEQ ID NO: 97577 - DNA, 22 bp, Artificial Sequence
  chemically synthesized
gctggtttagtcatgttttctg

SEQ ID NO: 97578 - DNA, 22 bp, Artificial Sequence
  chemically synthesized
ctggtttagtcatgttttctgg

SEQ ID NO: 97579 - DNA, 22 bp, Artificial Sequence
  chemically synthesized
gtttagtcatgttttctgggag

SEQ ID NO: 97580 - DNA, 22 bp, Artificial Sequence
  chemically synthesized
agtcatgttttctgggagctta

SEQ ID NO: 97581 - DNA, 22 bp, Artificial Sequence
  chemically synthesized
gtcatgttttctgggagcttag

SEQ ID NO: 97582 - DNA, 22 bp, Artificial Sequence
  chemically synthesized
tctgggagcttaggggcttatt

SEQ ID NO: 97583 - DNA, 22 bp, Artificial Sequence
  chemically synthesized
ctgggagcttaggggcttattt

SEQ ID NO: 97584 - DNA, 22 bp, Artificial Sequence
  chemically synthesized
tgggagcttaggggcttatttt

SEQ ID NO: 97585 - DNA, 22 bp, Artificial Sequence
  chemically synthesized
ggagcttaggggcttattttat

SEQ ID NO: 97586 - DNA, 22 bp, Artificial Sequence
  chemically synthesized
aggggcttattttattttgttt

SEQ ID NO: 97587 - DNA, 22 bp, Artificial Sequence
  chemically synthesized
ggggcttattttattttgtttt

SEQ ID NO: 97588 - DNA, 22 bp, Artificial Sequence
  chemically synthesized
attttattttgttttgttttct

SEQ ID NO: 97589 - DNA, 22 bp, Artificial Sequence
  chemically synthesized
ttttattttgttttgttttcta

SEQ ID NO: 97590 - DNA, 22 bp, Artificial Sequence
  chemically synthesized
tattttgttttgttttctaatc

SEQ ID NO: 97591 - DNA, 22 bp, Artificial Sequence
  chemically synthesized
attttgttttgttttctaatca

SEQ ID NO: 97592 - DNA, 22 bp, Artificial Sequence
  chemically synthesized
ttttgttttgttttctaatcaa

SEQ ID NO: 97593 - DNA, 22 bp, Artificial Sequence
  chemically synthesized
tgttttgttttctaatcaacag

SEQ ID NO: 97594 - DNA, 22 bp, Artificial Sequence
  chemically synthesized
gttttgttttctaatcaacaga

SEQ ID NO: 97595 - DNA, 22 bp, Artificial Sequence
  chemically synthesized
ttttgttttctaatcaacagag

SEQ ID NO: 97596 - DNA, 22 bp, Artificial Sequence
  chemically synthesized
tgttttctaatcaacagagatg

SEQ ID NO: 97597 - DNA, 22 bp, Artificial Sequence
  chemically synthesized
gttttctaatcaacagagatgg

SEQ ID NO: 97598 - DNA, 22 bp, Artificial Sequence
  chemically synthesized
ttttctaatcaacagagatggg

SEQ ID NO: 97599 - DNA, 22 bp, Artificial Sequence
  chemically synthesized
tctaatcaacagagatgggcaa

SEQ ID NO: 97600 - DNA, 22 bp, Artificial Sequence
  chemically synthesized
ctaatcaacagagatgggcaaa

SEQ ID NO: 97601 - DNA, 22 bp, Artificial Sequence
  chemically synthesized
taatcaacagagatgggcaaac

SEQ ID NO: 97602 - DNA, 22 bp, Artificial Sequence
  chemically synthesized
atcaacagagatgggcaaaccc

SEQ ID NO: 97603 - DNA, 22 bp, Artificial Sequence
  chemically synthesized
tttttttctttagacttgggat

SEQ ID NO: 97604 - DNA, 22 bp, Artificial Sequence
  chemically synthesized
ttttctttagacttgggatggt

SEQ ID NO: 97605 - DNA, 22 bp, Artificial Sequence
  chemically synthesized
tttctttagacttgggatggtg

SEQ ID NO: 97606 - DNA, 22 bp, Artificial Sequence
  chemically synthesized
ttctttagacttgggatggtga

SEQ ID NO: 97607 - DNA, 22 bp, Artificial Sequence
  chemically synthesized
tctttagacttgggatggtgat

SEQ ID NO: 97608 - DNA, 22 bp, Artificial Sequence
  chemically synthesized
ctttagacttgggatggtgata

SEQ ID NO: 97609 - DNA, 22 bp, Artificial Sequence
  chemically synthesized
tttagacttgggatggtgatag

SEQ ID NO: 97610 - DNA, 22 bp, Artificial Sequence
  chemically synthesized
tagacttgggatggtgatagct

SEQ ID NO: 97611 - DNA, 22 bp, Artificial Sequence
  chemically synthesized
agacttgggatggtgatagctg

SEQ ID NO: 97612 - DNA, 22 bp, Artificial Sequence
  chemically synthesized
gacttgggatggtgatagctgg

SEQ ID NO: 97613 - DNA, 22 bp, Artificial Sequence
  chemically synthesized
gggatggtgatagctgggcagc

SEQ ID NO: 97614 - DNA, 22 bp, Artificial Sequence
  chemically synthesized
ggatggtgatagctgggcagcg

SEQ ID NO: 97615 - DNA, 22 bp, Artificial Sequence
  chemically synthesized
ggcagcgtcagaaactgtgtgt

SEQ ID NO: 97616 - DNA, 22 bp, Artificial Sequence
  chemically synthesized
tgtgtggatatagataagagct

SEQ ID NO: 97617 - DNA, 22 bp, Artificial Sequence
  chemically synthesized
aggactatgctgagctgtgatg

SEQ ID NO: 97618 - DNA, 22 bp, Artificial Sequence
  chemically synthesized
tgctgagctgtgatgagggagg

SEQ ID NO: 97619 - DNA, 22 bp, Artificial Sequence
  chemically synthesized
agctgtgatgagggaggggcct

SEQ ID NO: 97620 - DNA, 22 bp, Artificial Sequence
  chemically synthesized
tgatgagggaggggcctagcta

SEQ ID NO: 97621 - DNA, 22 bp, Artificial Sequence
  chemically synthesized
gctaaaggcagtgagagtcaga

SEQ ID NO: 97622 - DNA, 22 bp, Artificial Sequence
  chemically synthesized
aaggcagtgagagtcagaatgc

SEQ ID NO: 97623 - DNA, 22 bp, Artificial Sequence
  chemically synthesized
ctgctattgccttctcagtccc

SEQ ID NO: 97624 - DNA, 22 bp, Artificial Sequence
  chemically synthesized
ctattgccttctcagtccccac

SEQ ID NO: 97625 - DNA, 22 bp, Artificial Sequence
  chemically synthesized
ttgccttctcagtccccacgct

SEQ ID NO: 97626 - DNA, 22 bp, Artificial Sequence
  chemically synthesized
ccttctcagtccccacgcttgg

SEQ ID NO: 97627 - DNA, 22 bp, Artificial Sequence
  chemically synthesized
ctcagtccccacgcttggtttc

SEQ ID NO: 97628 - DNA, 22 bp, Artificial Sequence
  chemically synthesized
tcagtccccacgcttggtttct

SEQ ID NO: 97629 - DNA, 22 bp, Artificial Sequence
  chemically synthesized
agtccccacgcttggtttctac

SEQ ID NO: 97630 - DNA, 22 bp, Artificial Sequence
  chemically synthesized
ggtttctacacaagtagataca

SEQ ID NO: 97631 - DNA, 22 bp, Artificial Sequence
  chemically synthesized
gtttctacacaagtagatacat

SEQ ID NO: 97632 - DNA, 22 bp, Artificial Sequence
  chemically synthesized
ctacacaagtagatacatagaa

SEQ ID NO: 97633 - DNA, 22 bp, Artificial Sequence
  chemically synthesized
tacacaagtagatacatagaaa

SEQ ID NO: 97634 - DNA, 22 bp, Artificial Sequence
  chemically synthesized
cacaagtagatacatagaaaag

SEQ ID NO: 97635 - DNA, 22 bp, Artificial Sequence
  chemically synthesized
taggttagtgtttgagagtcct

SEQ ID NO: 97636 - DNA, 22 bp, Artificial Sequence
  chemically synthesized
gtgtttgagagtcctgcatgat

SEQ ID NO: 97637 - DNA, 22 bp, Artificial Sequence
  chemically synthesized
gagagtcctgcatgattagttg

SEQ ID NO: 97638 - DNA, 22 bp, Artificial Sequence
  chemically synthesized
agagtcctgcatgattagttgc

SEQ ID NO: 97639 - DNA, 22 bp, Artificial Sequence
  chemically synthesized
catgattagttgctcagaaatg

SEQ ID NO: 97640 - DNA, 22 bp, Artificial Sequence
  chemically synthesized
gttgctcagaaatgcccgataa

SEQ ID NO: 97641 - DNA, 22 bp, Artificial Sequence
  chemically synthesized
ctcagaaatgcccgataaatat

SEQ ID NO: 97642 - DNA, 22 bp, Artificial Sequence
  chemically synthesized
agaaatgcccgataaatatgtt

SEQ ID NO: 97643 - DNA, 22 bp, Artificial Sequence
  chemically synthesized
tgtgtgtttatgtatatatatg

SEQ ID NO: 97644 - DNA, 22 bp, Artificial Sequence
  chemically synthesized
atgtatatatatgttttatata

SEQ ID NO: 97645 - DNA, 22 bp, Artificial Sequence
  chemically synthesized
tgtatatatatgttttatatat

SEQ ID NO: 97646 - DNA, 22 bp, Artificial Sequence
  chemically synthesized
tatatatatatatatgtgtgtg

SEQ ID NO: 97647 - DNA, 22 bp, Artificial Sequence
  chemically synthesized
atatatatatatatgtgtgtgt

SEQ ID NO: 97648 - DNA, 22 bp, Artificial Sequence
  chemically synthesized
tatatatatatatgtgtgtgtg

SEQ ID NO: 97649 - DNA, 22 bp, Artificial Sequence
  chemically synthesized
tgtttacaaatatgtgattatc

SEQ ID NO: 97650 - DNA, 22 bp, Artificial Sequence
  chemically synthesized
acaaatatgtgattatcatcaa

SEQ ID NO: 97651 - DNA, 22 bp, Artificial Sequence
  chemically synthesized
caaatatgtgattatcatcaaa

SEQ ID NO: 97652 - DNA, 22 bp, Artificial Sequence
  chemically synthesized
tcatcaaaacgtgagggctaaa

SEQ ID NO: 97653 - DNA, 22 bp, Artificial Sequence
  chemically synthesized
aagtgaccagataacttgcaag

SEQ ID NO: 97654 - DNA, 22 bp, Artificial Sequence
  chemically synthesized
gcaagtcctaggataccaggaa

SEQ ID NO: 97655 - DNA, 22 bp, Artificial Sequence
  chemically synthesized
caagtcctaggataccaggaaa

SEQ ID NO: 97656 - DNA, 22 bp, Artificial Sequence
  chemically synthesized
ggataccaggaaaataaattac

SEQ ID NO: 97657 - DNA, 22 bp, Artificial Sequence
  chemically synthesized
cattccaaaaatttaactgaga

SEQ ID NO: 97658 - DNA, 22 bp, Artificial Sequence
  chemically synthesized
caaaaatttaactgagacttta

SEQ ID NO: 97659 - DNA, 22 bp, Artificial Sequence
  chemically synthesized
aactgagactttaaaaaaaaaa

SEQ ID NO: 97660 - DNA, 22 bp, Artificial Sequence
  chemically synthesized
actgagactttaaaaaaaaaaa

SEQ ID NO: 97661 - DNA, 22 bp, Artificial Sequence
  chemically synthesized
agactttaaaaaaaaaaaaaaa

SEQ ID NO: 97662 - DNA, 22 bp, Artificial Sequence
  chemically synthesized
taaaaaaaaaaaaaaaacaaaa

SEQ ID NO: 97663 - DNA, 22 bp, Artificial Sequence
  chemically synthesized
aaaaaaaaaaaaaaaacaaaaa

SEQ ID NO: 97664 - DNA, 22 bp, Artificial Sequence
  chemically synthesized
aaaaaaaaaaaaaaacaaaaaa

SEQ ID NO: 97665 - DNA, 22 bp, Artificial Sequence
  chemically synthesized
gggcctgttgggggtggggggc

SEQ ID NO: 97666 - DNA, 22 bp, Artificial Sequence
  chemically synthesized
ttgggggtggggggctagggga

SEQ ID NO: 97667 - DNA, 22 bp, Artificial Sequence
  chemically synthesized
ggggtggggggctaggggaagg

SEQ ID NO: 97668 - DNA, 22 bp, Artificial Sequence
  chemically synthesized
ggggaaggatagcattaggaga

SEQ ID NO: 97669 - DNA, 22 bp, Artificial Sequence
  chemically synthesized
ggagaaatacctaatgtagatg

SEQ ID NO: 97670 - DNA, 22 bp, Artificial Sequence
  chemically synthesized
atgtagatgacgggttgatggg

SEQ ID NO: 97671 - DNA, 22 bp, Artificial Sequence
  chemically synthesized
atgggtgcagcaaaccaccatg

SEQ ID NO: 97672 - DNA, 22 bp, Artificial Sequence
  chemically synthesized
aaagcatattaaaaaaacagtg

SEQ ID NO: 97673 - DNA, 22 bp, Artificial Sequence
  chemically synthesized
aagcatattaaaaaaacagtga

SEQ ID NO: 97674 - DNA, 22 bp, Artificial Sequence
  chemically synthesized
aaaaaacagtgatcataaaaga

SEQ ID NO: 97675 - DNA, 22 bp, Artificial Sequence
  chemically synthesized
aaatttaactataagagacgga

SEQ ID NO: 97676 - DNA, 22 bp, Artificial Sequence
  chemically synthesized
aactataagagacggaatggct

SEQ ID NO: 97677 - DNA, 22 bp, Artificial Sequence
  chemically synthesized
actataagagacggaatggctc

SEQ ID NO: 97678 - DNA, 22 bp, Artificial Sequence
  chemically synthesized
taagagacggaatggctcccac

SEQ ID NO: 97679 - DNA, 22 bp, Artificial Sequence
  chemically synthesized
ccacaattcttaactataatct

SEQ ID NO: 97680 - DNA, 22 bp, Artificial Sequence
  chemically synthesized
ttaactataatcttacagaata

SEQ ID NO: 97681 - DNA, 22 bp, Artificial Sequence
  chemically synthesized
aactataatcttacagaatatt

SEQ ID NO: 97682 - DNA, 22 bp, Artificial Sequence
  chemically synthesized
actataatcttacagaatattc

SEQ ID NO: 97683 - DNA, 22 bp, Artificial Sequence
  chemically synthesized
taatcttacagaatattctcat

SEQ ID NO: 97684 - DNA, 22 bp, Artificial Sequence
  chemically synthesized
acagaatattctcattgaatag

SEQ ID NO: 97685 - DNA, 22 bp, Artificial Sequence
  chemically synthesized
cagaatattctcattgaataga

SEQ ID NO: 97686 - DNA, 22 bp, Artificial Sequence
  chemically synthesized
tcattgaatagaagtatgctta

SEQ ID NO: 97687 - DNA, 22 bp, Artificial Sequence
  chemically synthesized
attgaatagaagtatgcttatc

SEQ ID NO: 97688 - DNA, 22 bp, Artificial Sequence
  chemically synthesized
aatagaagtatgcttatcatta

SEQ ID NO: 97689 - DNA, 22 bp, Artificial Sequence
  chemically synthesized
atcattagagatttggacagcc

SEQ ID NO: 97690 - DNA, 22 bp, Artificial Sequence
  chemically synthesized
tcattagagatttggacagcca

SEQ ID NO: 97691 - DNA, 22 bp, Artificial Sequence
  chemically synthesized
gagatttggacagccaggaaag

SEQ ID NO: 97692 - DNA, 22 bp, Artificial Sequence
  chemically synthesized
ggacagccaggaaagcacagaa

SEQ ID NO: 97693 - DNA, 22 bp, Artificial Sequence
  chemically synthesized
gacagccaggaaagcacagaaa

SEQ ID NO: 97694 - DNA, 22 bp, Artificial Sequence
  chemically synthesized
tgttgccttatagcctagaggt

SEQ ID NO: 97695 - DNA, 22 bp, Artificial Sequence
  chemically synthesized
ttgccttatagcctagaggtgt

SEQ ID NO: 97696 - DNA, 22 bp, Artificial Sequence
  chemically synthesized
ccttatagcctagaggtgtttt

SEQ ID NO: 97697 - DNA, 22 bp, Artificial Sequence
  chemically synthesized
atagcctagaggtgttttgaac

SEQ ID NO: 97698 - DNA, 22 bp, Artificial Sequence
  chemically synthesized
tagcctagaggtgttttgaacc

SEQ ID NO: 97699 - DNA, 22 bp, Artificial Sequence
  chemically synthesized
gaggtgttttgaacctcacata

SEQ ID NO: 97700 - DNA, 22 bp, Artificial Sequence
  chemically synthesized
tgaacctcacataacactgatg

SEQ ID NO: 97701 - DNA, 22 bp, Artificial Sequence
  chemically synthesized
gaacctcacataacactgatgt

SEQ ID NO: 97702 - DNA, 22 bp, Artificial Sequence
  chemically synthesized
aacctcacataacactgatgtc

SEQ ID NO: 97703 - DNA, 22 bp, Artificial Sequence
  chemically synthesized
acataacactgatgtccaggcc

SEQ ID NO: 97704 - DNA, 22 bp, Artificial Sequence
  chemically synthesized
atgtccaggccaaggccatcct

SEQ ID NO: 97705 - DNA, 22 bp, Artificial Sequence
  chemically synthesized
cccatgaagatggatgaataag

SEQ ID NO: 97706 - DNA, 22 bp, Artificial Sequence
  chemically synthesized
ccatgaagatggatgaataagc

SEQ ID NO: 97707 - DNA, 22 bp, Artificial Sequence
  chemically synthesized
acacctatgaaataatgtttac

SEQ ID NO: 97708 - DNA, 22 bp, Artificial Sequence
  chemically synthesized
tgaaataatgtttactttagtg

SEQ ID NO: 97709 - DNA, 22 bp, Artificial Sequence
  chemically synthesized
actttagtggcatattgcatta

SEQ ID NO: 97710 - DNA, 22 bp, Artificial Sequence
  chemically synthesized
ctttagtggcatattgcattag

SEQ ID NO: 97711 - DNA, 22 bp, Artificial Sequence
  chemically synthesized
tagtggcatattgcattaggct

SEQ ID NO: 97712 - DNA, 22 bp, Artificial Sequence
  chemically synthesized
agtggcatattgcattaggcta

SEQ ID NO: 97713 - DNA, 22 bp, Artificial Sequence
  chemically synthesized
gtggcatattgcattaggctac

SEQ ID NO: 97714 - DNA, 22 bp, Artificial Sequence
  chemically synthesized
cattaggctacctgccttggca

SEQ ID NO: 97715 - DNA, 22 bp, Artificial Sequence
  chemically synthesized
ggctacctgccttggcacagtt

SEQ ID NO: 97716 - DNA, 22 bp, Artificial Sequence
  chemically synthesized
cctgccttggcacagtttttct

SEQ ID NO: 97717 - DNA, 22 bp, Artificial Sequence
  chemically synthesized
ccttggcacagtttttctttac

SEQ ID NO: 97718 - DNA, 22 bp, Artificial Sequence
  chemically synthesized
ggcacagtttttctttactttt

SEQ ID NO: 97719 - DNA, 22 bp, Artificial Sequence
  chemically synthesized
gcacagtttttctttactttta

SEQ ID NO: 97720 - DNA, 22 bp, Artificial Sequence
  chemically synthesized
ttctttacttttacctgactga

SEQ ID NO: 97721 - DNA, 22 bp, Artificial Sequence
  chemically synthesized
tctttacttttacctgactgat

SEQ ID NO: 97722 - DNA, 22 bp, Artificial Sequence
  chemically synthesized
ctttacttttacctgactgatg

SEQ ID NO: 97723 - DNA, 22 bp, Artificial Sequence
  chemically synthesized
tttacttttacctgactgatga

SEQ ID NO: 97724 - DNA, 22 bp, Artificial Sequence
  chemically synthesized
tacttttacctgactgatgaaa

SEQ ID NO: 97725 - DNA, 22 bp, Artificial Sequence
  chemically synthesized
acttttacctgactgatgaaac

SEQ ID NO: 97726 - DNA, 22 bp, Artificial Sequence
  chemically synthesized
cttttacctgactgatgaaaca

SEQ ID NO: 97727 - DNA, 22 bp, Artificial Sequence
  chemically synthesized
ttacctgactgatgaaacaatt

SEQ ID NO: 97728 - DNA, 22 bp, Artificial Sequence
  chemically synthesized
tacctgactgatgaaacaatta

SEQ ID NO: 97729 - DNA, 22 bp, Artificial Sequence
  chemically synthesized
acctgactgatgaaacaattaa

SEQ ID NO: 97730 - DNA, 22 bp, Artificial Sequence
  chemically synthesized
cctgactgatgaaacaattaat

SEQ ID NO: 97731 - DNA, 22 bp, Artificial Sequence
  chemically synthesized
actgatgaaacaattaattgct

SEQ ID NO: 97732 - DNA, 22 bp, Artificial Sequence
  chemically synthesized
atgaaacaattaattgcttaca

SEQ ID NO: 97733 - DNA, 22 bp, Artificial Sequence
  chemically synthesized
attgcttacataaacatgagtg

SEQ ID NO: 97734 - DNA, 22 bp, Artificial Sequence
  chemically synthesized
cttacataaacatgagtgctct

SEQ ID NO: 97735 - DNA, 22 bp, Artificial Sequence
  chemically synthesized
acataaacatgagtgctctagt

SEQ ID NO: 97736 - DNA, 22 bp, Artificial Sequence
  chemically synthesized
cataaacatgagtgctctagtt

SEQ ID NO: 97737 - DNA, 22 bp, Artificial Sequence
  chemically synthesized
tagttataaattccagtgtaaa

SEQ ID NO: 97738 - DNA, 22 bp, Artificial Sequence
  chemically synthesized
gttataaattccagtgtaaaaa

SEQ ID NO: 97739 - DNA, 22 bp, Artificial Sequence
  chemically synthesized
taaattccagtgtaaaaaacac

SEQ ID NO: 97740 - DNA, 22 bp, Artificial Sequence
  chemically synthesized
cagtgtaaaaaacaccctggtt

SEQ ID NO: 97741 - DNA, 22 bp, Artificial Sequence
  chemically synthesized
gtttcgatattcatcttttgag

SEQ ID NO: 97742 - DNA, 22 bp, Artificial Sequence
  chemically synthesized
cgatattcatcttttgagcctt

SEQ ID NO: 97743 - DNA, 22 bp, Artificial Sequence
  chemically synthesized
gatattcatcttttgagccttt

SEQ ID NO: 97744 - DNA, 22 bp, Artificial Sequence
  chemically synthesized
atcttttgagccttttattttg

SEQ ID NO: 97745 - DNA, 22 bp, Artificial Sequence
  chemically synthesized
ttgagccttttattttggtcag

SEQ ID NO: 97746 - DNA, 22 bp, Artificial Sequence
  chemically synthesized
tgagccttttattttggtcaga

SEQ ID NO: 97747 - DNA, 22 bp, Artificial Sequence
  chemically synthesized
gagccttttattttggtcagaa

SEQ ID NO: 97748 - DNA, 22 bp, Artificial Sequence
  chemically synthesized
agccttttattttggtcagaac

SEQ ID NO: 97749 - DNA, 22 bp, Artificial Sequence
  chemically synthesized
ttattttggtcagaacaagttt

SEQ ID NO: 97750 - DNA, 22 bp, Artificial Sequence
  chemically synthesized
tattttggtcagaacaagtttt

SEQ ID NO: 97751 - DNA, 22 bp, Artificial Sequence
  chemically synthesized
attttggtcagaacaagttttc

SEQ ID NO: 97752 - DNA, 22 bp, Artificial Sequence
  chemically synthesized
ttttggtcagaacaagttttca

SEQ ID NO: 97753 - DNA, 22 bp, Artificial Sequence
  chemically synthesized
tggtcagaacaagttttcaaga

SEQ ID NO: 97754 - DNA, 22 bp, Artificial Sequence
  chemically synthesized
ggtcagaacaagttttcaagag

SEQ ID NO: 97755 - DNA, 22 bp, Artificial Sequence
  chemically synthesized
gtcagaacaagttttcaagagc

SEQ ID NO: 97756 - DNA, 22 bp, Artificial Sequence
  chemically synthesized
tcaagagcaaatctcagcctac

SEQ ID NO: 97757 - DNA, 22 bp, Artificial Sequence
  chemically synthesized
caagagcaaatctcagcctaca

SEQ ID NO: 97758 - DNA, 22 bp, Artificial Sequence
  chemically synthesized
aagagcaaatctcagcctacaa

SEQ ID NO: 97759 - DNA, 22 bp, Artificial Sequence
  chemically synthesized
agcctacaaaacaaatgagtcc

SEQ ID NO: 97760 - DNA, 22 bp, Artificial Sequence
  chemically synthesized
caaaacaaatgagtccaattct

SEQ ID NO: 97761 - DNA, 22 bp, Artificial Sequence
  chemically synthesized
tagaactcagtaatcccatcaa

SEQ ID NO: 97762 - DNA, 22 bp, Artificial Sequence
  chemically synthesized
gaactcagtaatcccatcaagg

SEQ ID NO: 97763 - DNA, 22 bp, Artificial Sequence
  chemically synthesized
agtaatcccatcaaggctctgc

SEQ ID NO: 97764 - DNA, 22 bp, Artificial Sequence
  chemically synthesized
tgcctgcggagggctaactagc

SEQ ID NO: 97765 - DNA, 22 bp, Artificial Sequence
  chemically synthesized
cctgcggagggctaactagctc

SEQ ID NO: 97766 - DNA, 22 bp, Artificial Sequence
  chemically synthesized
cggagggctaactagctctatg

SEQ ID NO: 97767 - DNA, 22 bp, Artificial Sequence
  chemically synthesized
actagctctatgcaggcttagc

SEQ ID NO: 97768 - DNA, 22 bp, Artificial Sequence
  chemically synthesized
gctctatgcaggcttagcactt

SEQ ID NO: 97769 - DNA, 22 bp, Artificial Sequence
  chemically synthesized
tatgcaggcttagcacttccag

SEQ ID NO: 97770 - DNA, 22 bp, Artificial Sequence
  chemically synthesized
tgcaggcttagcacttccagct

SEQ ID NO: 97771 - DNA, 22 bp, Artificial Sequence
  chemically synthesized
agcacttccagctctactccac

SEQ ID NO: 97772 - DNA, 22 bp, Artificial Sequence
  chemically synthesized
gcacttccagctctactccact

SEQ ID NO: 97773 - DNA, 22 bp, Artificial Sequence
  chemically synthesized
ccagctctactccactgatttc

SEQ ID NO: 97774 - DNA, 22 bp, Artificial Sequence
  chemically synthesized
cagctctactccactgatttct

SEQ ID NO: 97775 - DNA, 22 bp, Artificial Sequence
  chemically synthesized
tactccactgatttctttgtgt

SEQ ID NO: 97776 - DNA, 22 bp, Artificial Sequence
  chemically synthesized
ctccactgatttctttgtgtgt

SEQ ID NO: 97777 - DNA, 22 bp, Artificial Sequence
  chemically synthesized
cactgatttctttgtgtgtgca

SEQ ID NO: 97778 - DNA, 22 bp, Artificial Sequence
  chemically synthesized
atttctttgtgtgtgcatagca

SEQ ID NO: 97779 - DNA, 22 bp, Artificial Sequence
  chemically synthesized
ctttgtgtgtgcatagcagtgg

SEQ ID NO: 97780 - DNA, 22 bp, Artificial Sequence
  chemically synthesized
tttgtgtgtgcatagcagtgga

SEQ ID NO: 97781 - DNA, 22 bp, Artificial Sequence
  chemically synthesized
tgtgtgtgcatagcagtggatg

SEQ ID NO: 97782 - DNA, 22 bp, Artificial Sequence
  chemically synthesized
gtgtgtgcatagcagtggatgt

SEQ ID NO: 97783 - DNA, 22 bp, Artificial Sequence
  chemically synthesized
tgtgtgcatagcagtggatgtg

SEQ ID NO: 97784 - DNA, 22 bp, Artificial Sequence
  chemically synthesized
ttaattatagttgtatatgtgt

SEQ ID NO: 97785 - DNA, 22 bp, Artificial Sequence
  chemically synthesized
taattatagttgtatatgtgtt

SEQ ID NO: 97786 - DNA, 22 bp, Artificial Sequence
  chemically synthesized
aattatagttgtatatgtgttt

SEQ ID NO: 97787 - DNA, 22 bp, Artificial Sequence
  chemically synthesized
attatagttgtatatgtgtttg

SEQ ID NO: 97788 - DNA, 22 bp, Artificial Sequence
  chemically synthesized
tagttgtatatgtgtttgactg

SEQ ID NO: 97789 - DNA, 22 bp, Artificial Sequence
  chemically synthesized
tatatgtgtttgactgctcatt

SEQ ID NO: 97790 - DNA, 22 bp, Artificial Sequence
  chemically synthesized
gactgctcattcattcattcaa

SEQ ID NO: 97791 - DNA, 22 bp, Artificial Sequence
  chemically synthesized
actgctcattcattcattcaaa

SEQ ID NO: 97792 - DNA, 22 bp, Artificial Sequence
  chemically synthesized
ctcattcattcattcaaaattg

SEQ ID NO: 97793 - DNA, 22 bp, Artificial Sequence
  chemically synthesized
attcattcattcaaaattgtaa

SEQ ID NO: 97794 - DNA, 22 bp, Artificial Sequence
  chemically synthesized
attcattcaaaattgtaaaatt

SEQ ID NO: 97795 - DNA, 22 bp, Artificial Sequence
  chemically synthesized
attcaaaattgtaaaattgcta

SEQ ID NO: 97796 - DNA, 22 bp, Artificial Sequence
  chemically synthesized
aaaattgtaaaattgctaagaa

SEQ ID NO: 97797 - DNA, 22 bp, Artificial Sequence
  chemically synthesized
taaaattgctaagaatacagca

SEQ ID NO: 97798 - DNA, 22 bp, Artificial Sequence
  chemically synthesized
ctaagaatacagcacaaaaaca

SEQ ID NO: 97799 - DNA, 22 bp, Artificial Sequence
  chemically synthesized
agaatacagcacaaaaacagaa

SEQ ID NO: 97800 - DNA, 22 bp, Artificial Sequence
  chemically synthesized
ctgttttcatggacttgatagt

SEQ ID NO: 97801 - DNA, 22 bp, Artificial Sequence
  chemically synthesized
ttttcatggacttgatagtgga

SEQ ID NO: 97802 - DNA, 22 bp, Artificial Sequence
  chemically synthesized
tcatggacttgatagtggaaag

SEQ ID NO: 97803 - DNA, 22 bp, Artificial Sequence
  chemically synthesized
catggacttgatagtggaaaga

SEQ ID NO: 97804 - DNA, 22 bp, Artificial Sequence
  chemically synthesized
atggacttgatagtggaaagag

SEQ ID NO: 97805 - DNA, 22 bp, Artificial Sequence
  chemically synthesized
gatagtggaaagagcttgacat

SEQ ID NO: 97806 - DNA, 22 bp, Artificial Sequence
  chemically synthesized
atagtggaaagagcttgacatt

SEQ ID NO: 97807 - DNA, 22 bp, Artificial Sequence
  chemically synthesized
gacattaaataagcaaatgaaa

SEQ ID NO: 97808 - DNA, 22 bp, Artificial Sequence
  chemically synthesized
acattaaataagcaaatgaaac

SEQ ID NO: 97809 - DNA, 22 bp, Artificial Sequence
  chemically synthesized
aataagcaaatgaaacatgtta

SEQ ID NO: 97810 - DNA, 22 bp, Artificial Sequence
  chemically synthesized
tataccaatgagattaggtgct

SEQ ID NO: 97811 - DNA, 22 bp, Artificial Sequence
  chemically synthesized
ggtgctatggagaaaaaaaaaa

SEQ ID NO: 97812 - DNA, 22 bp, Artificial Sequence
  chemically synthesized
tggagaaaaaaaaaaaactgaa

SEQ ID NO: 97813 - DNA, 22 bp, Artificial Sequence
  chemically synthesized
aaatgaaggccagagtgtgatt

SEQ ID NO: 97814 - DNA, 22 bp, Artificial Sequence
  chemically synthesized
ggacagggtgaaagggtatcgc

SEQ ID NO: 97815 - DNA, 22 bp, Artificial Sequence
  chemically synthesized
ctttaagtagtatggcaggaaa

SEQ ID NO: 97816 - DNA, 22 bp, Artificial Sequence
  chemically synthesized
taagtagtatggcaggaaagtc

SEQ ID NO: 97817 - DNA, 22 bp, Artificial Sequence
  chemically synthesized
aagtagtatggcaggaaagtcc

SEQ ID NO: 97818 - DNA, 22 bp, Artificial Sequence
  chemically synthesized
agtagtatggcaggaaagtcct

SEQ ID NO: 97819 - DNA, 22 bp, Artificial Sequence
  chemically synthesized
actataaagttaacacctgaga

SEQ ID NO: 97820 - DNA, 22 bp, Artificial Sequence
  chemically synthesized
taaagttaacacctgagagagt

SEQ ID NO: 97821 - DNA, 22 bp, Artificial Sequence
  chemically synthesized
acacctgagagagtacccatag

SEQ ID NO: 97822 - DNA, 22 bp, Artificial Sequence
  chemically synthesized
agagagtacccatagatgatga

SEQ ID NO: 97823 - DNA, 22 bp, Artificial Sequence
  chemically synthesized
atatgaaactatgattaaatat

SEQ ID NO: 97824 - DNA, 22 bp, Artificial Sequence
  chemically synthesized
tatgaaactatgattaaatatt

SEQ ID NO: 97825 - DNA, 22 bp, Artificial Sequence
  chemically synthesized
tgattaaatatttagggcatag

SEQ ID NO: 97826 - DNA, 22 bp, Artificial Sequence
  chemically synthesized
aatatttagggcatagggaatg

SEQ ID NO: 97827 - DNA, 22 bp, Artificial Sequence
  chemically synthesized
agggcatagggaatggcaaatg

SEQ ID NO: 97828 - DNA, 22 bp, Artificial Sequence
  chemically synthesized
gggcatagggaatggcaaatgt

SEQ ID NO: 97829 - DNA, 22 bp, Artificial Sequence
  chemically synthesized
aagatgtaagatgcttagaatt

SEQ ID NO: 97830 - DNA, 22 bp, Artificial Sequence
  chemically synthesized
agaattttcaaggaatatcaat

SEQ ID NO: 97831 - DNA, 22 bp, Artificial Sequence
  chemically synthesized
gaattttcaaggaatatcaata

SEQ ID NO: 97832 - DNA, 22 bp, Artificial Sequence
  chemically synthesized
tcaaggaatatcaataaggcca

SEQ ID NO: 97833 - DNA, 22 bp, Artificial Sequence
  chemically synthesized
caaggaatatcaataaggccaa

SEQ ID NO: 97834 - DNA, 22 bp, Artificial Sequence
  chemically synthesized
aaggaatatcaataaggccaat

SEQ ID NO: 97835 - DNA, 22 bp, Artificial Sequence
  chemically synthesized
ggtgaaggggagaataaaagat

SEQ ID NO: 97836 - DNA, 22 bp, Artificial Sequence
  chemically synthesized
aattataaaatttgggacacta

SEQ ID NO: 97837 - DNA, 22 bp, Artificial Sequence
  chemically synthesized
taaaatttgggacactaataat

SEQ ID NO: 97838 - DNA, 22 bp, Artificial Sequence
  chemically synthesized
gggacactaataatacctacat

SEQ ID NO: 97839 - DNA, 22 bp, Artificial Sequence
  chemically synthesized
ggacactaataatacctacatc

SEQ ID NO: 97840 - DNA, 22 bp, Artificial Sequence
  chemically synthesized
ataatacctacatcatagagtt

SEQ ID NO: 97841 - DNA, 22 bp, Artificial Sequence
  chemically synthesized
catcatagagttgtaagaaaaa

SEQ ID NO: 97842 - DNA, 22 bp, Artificial Sequence
  chemically synthesized
taagaaaaaacactctacacac

SEQ ID NO: 97843 - DNA, 22 bp, Artificial Sequence
  chemically synthesized
tacacacatacacataaatata

SEQ ID NO: 97844 - DNA, 22 bp, Artificial Sequence
  chemically synthesized
cacacatacacataaatatata

SEQ ID NO: 97845 - DNA, 22 bp, Artificial Sequence
  chemically synthesized
atttatatgagagctatatata

SEQ ID NO: 97846 - DNA, 22 bp, Artificial Sequence
  chemically synthesized
tttatatgagagctatatatat

SEQ ID NO: 97847 - DNA, 22 bp, Artificial Sequence
  chemically synthesized
atatgagagctatatatatgta

SEQ ID NO: 97848 - DNA, 22 bp, Artificial Sequence
  chemically synthesized
tatgagagctatatatatgtat

SEQ ID NO: 97849 - DNA, 22 bp, Artificial Sequence
  chemically synthesized
tatatatgtatctgtaataaac

SEQ ID NO: 97850 - DNA, 22 bp, Artificial Sequence
  chemically synthesized
taataaacataatatatgcatg

SEQ ID NO: 97851 - DNA, 22 bp, Artificial Sequence
  chemically synthesized
ttgtagagaattgtaaggattt

SEQ ID NO: 97852 - DNA, 22 bp, Artificial Sequence
  chemically synthesized
tagagaattgtaaggatttggt

SEQ ID NO: 97853 - DNA, 22 bp, Artificial Sequence
  chemically synthesized
taaggatttggttttattataa

SEQ ID NO: 97854 - DNA, 22 bp, Artificial Sequence
  chemically synthesized
ggttttattataaatgatatag

SEQ ID NO: 97855 - DNA, 22 bp, Artificial Sequence
  chemically synthesized
gttttattataaatgatatagg

SEQ ID NO: 97856 - DNA, 22 bp, Artificial Sequence
  chemically synthesized
tattataaatgatataggaaac

SEQ ID NO: 97857 - DNA, 22 bp, Artificial Sequence
  chemically synthesized
attataaatgatataggaaact

SEQ ID NO: 97858 - DNA, 22 bp, Artificial Sequence
  chemically synthesized
ttataaatgatataggaaacta

SEQ ID NO: 97859 - DNA, 22 bp, Artificial Sequence
  chemically synthesized
taaatgatataggaaactatca

SEQ ID NO: 97860 - DNA, 22 bp, Artificial Sequence
  chemically synthesized
tcagaagactttgaacaaagag

SEQ ID NO: 97861 - DNA, 22 bp, Artificial Sequence
  chemically synthesized
tgaacaaagaggtgaccatata

SEQ ID NO: 97862 - DNA, 22 bp, Artificial Sequence
  chemically synthesized
gaacaaagaggtgaccatatat

SEQ ID NO: 97863 - DNA, 22 bp, Artificial Sequence
  chemically synthesized
aacaaagaggtgaccatatatg

SEQ ID NO: 97864 - DNA, 22 bp, Artificial Sequence
  chemically synthesized
acattttgaaaagactaatttg

SEQ ID NO: 97865 - DNA, 22 bp, Artificial Sequence
  chemically synthesized
cattttgaaaagactaatttgg

SEQ ID NO: 97866 - DNA, 22 bp, Artificial Sequence
  chemically synthesized
tgaaaagactaatttggatagt

SEQ ID NO: 97867 - DNA, 22 bp, Artificial Sequence
  chemically synthesized
gaaaagactaatttggatagta

SEQ ID NO: 97868 - DNA, 22 bp, Artificial Sequence
  chemically synthesized
aaaagactaatttggatagtat

SEQ ID NO: 97869 - DNA, 22 bp, Artificial Sequence
  chemically synthesized
atttggatagtatattgggaag

SEQ ID NO: 97870 - DNA, 22 bp, Artificial Sequence
  chemically synthesized
ggatagtatattgggaagaaat

SEQ ID NO: 97871 - DNA, 22 bp, Artificial Sequence
  chemically synthesized
gatagtatattgggaagaaatt

SEQ ID NO: 97872 - DNA, 22 bp, Artificial Sequence
  chemically synthesized
ggaagaaattgtagtggggcag

SEQ ID NO: 97873 - DNA, 22 bp, Artificial Sequence
  chemically synthesized
tagtggggcagtggtagaagca

SEQ ID NO: 97874 - DNA, 22 bp, Artificial Sequence
  chemically synthesized
ttatgagtcaacagctataatt

SEQ ID NO: 97875 - DNA, 22 bp, Artificial Sequence
  chemically synthesized
tgagtcaacagctataatttag

SEQ ID NO: 97876 - DNA, 22 bp, Artificial Sequence
  chemically synthesized
taatttaggtggtggtgacagt

SEQ ID NO: 97877 - DNA, 22 bp, Artificial Sequence
  chemically synthesized
aggtggtggtgacagtgactta

SEQ ID NO: 97878 - DNA, 22 bp, Artificial Sequence
  chemically synthesized
ggtggtggtgacagtgacttag

SEQ ID NO: 97879 - DNA, 22 bp, Artificial Sequence
  chemically synthesized
agaccagagtggtagcattgga

SEQ ID NO: 97880 - DNA, 22 bp, Artificial Sequence
  chemically synthesized
gaccagagtggtagcattggag

SEQ ID NO: 97881 - DNA, 22 bp, Artificial Sequence
  chemically synthesized
gaggtgaaggcaaggggtcagc

SEQ ID NO: 97882 - DNA, 22 bp, Artificial Sequence
  chemically synthesized
tgaaaacatcctttcacgaaaa

SEQ ID NO: 97883 - DNA, 22 bp, Artificial Sequence
  chemically synthesized
aaaacatcctttcacgaaaaac

SEQ ID NO: 97884 - DNA, 22 bp, Artificial Sequence
  chemically synthesized
tcacgaaaaaccaacaggattt

SEQ ID NO: 97885 - DNA, 22 bp, Artificial Sequence
  chemically synthesized
cacgaaaaaccaacaggatttt

SEQ ID NO: 97886 - DNA, 22 bp, Artificial Sequence
  chemically synthesized
acgaaaaaccaacaggattttc

SEQ ID NO: 97887 - DNA, 22 bp, Artificial Sequence
  chemically synthesized
tctgacagagaatatggaattg

SEQ ID NO: 97888 - DNA, 22 bp, Artificial Sequence
  chemically synthesized
ctgacagagaatatggaattgg

SEQ ID NO: 97889 - DNA, 22 bp, Artificial Sequence
  chemically synthesized
tgacagagaatatggaattggt

SEQ ID NO: 97890 - DNA, 22 bp, Artificial Sequence
  chemically synthesized
acagagaatatggaattggtgt

SEQ ID NO: 97891 - DNA, 22 bp, Artificial Sequence
  chemically synthesized
gtgtgtgtgtgtgttgcactca

SEQ ID NO: 97892 - DNA, 22 bp, Artificial Sequence
  chemically synthesized
cactcatgcacactctagtgca

SEQ ID NO: 97893 - DNA, 22 bp, Artificial Sequence
  chemically synthesized
atgcacactctagtgcatgcta

SEQ ID NO: 97894 - DNA, 22 bp, Artificial Sequence
  chemically synthesized
tagtgcatgctaatttctggct

SEQ ID NO: 97895 - DNA, 22 bp, Artificial Sequence
  chemically synthesized
gtgcatgctaatttctggctgt

SEQ ID NO: 97896 - DNA, 22 bp, Artificial Sequence
  chemically synthesized
atttctggctgtgagtatatgt

SEQ ID NO: 97897 - DNA, 22 bp, Artificial Sequence
  chemically synthesized
ctggctgtgagtatatgtcaga

SEQ ID NO: 97898 - DNA, 22 bp, Artificial Sequence
  chemically synthesized
tggctgtgagtatatgtcagag

SEQ ID NO: 97899 - DNA, 22 bp, Artificial Sequence
  chemically synthesized
gctgtgagtatatgtcagagta

SEQ ID NO: 97900 - DNA, 22 bp, Artificial Sequence
  chemically synthesized
tgagtatatgtcagagtaagga

SEQ ID NO: 97901 - DNA, 22 bp, Artificial Sequence
  chemically synthesized
tgaagctaggcaaagtgagtct

SEQ ID NO: 97902 - DNA, 22 bp, Artificial Sequence
  chemically synthesized
gaagctaggcaaagtgagtctt

SEQ ID NO: 97903 - DNA, 22 bp, Artificial Sequence
  chemically synthesized
aagctaggcaaagtgagtcttt

SEQ ID NO: 97904 - DNA, 22 bp, Artificial Sequence
  chemically synthesized
ggcaaagtgagtctttgggttg

SEQ ID NO: 97905 - DNA, 22 bp, Artificial Sequence
  chemically synthesized
tgggttgaattttgtcaaggtg

SEQ ID NO: 97906 - DNA, 22 bp, Artificial Sequence
  chemically synthesized
gggttgaattttgtcaaggtgt

SEQ ID NO: 97907 - DNA, 22 bp, Artificial Sequence
  chemically synthesized
ggttgaattttgtcaaggtgtt

SEQ ID NO: 97908 - DNA, 22 bp, Artificial Sequence
  chemically synthesized
aattttgtcaaggtgtttgttc

SEQ ID NO: 97909 - DNA, 22 bp, Artificial Sequence
  chemically synthesized
tgtcaaggtgtttgttcatcac

SEQ ID NO: 97910 - DNA, 22 bp, Artificial Sequence
  chemically synthesized
gtcaaggtgtttgttcatcaca

SEQ ID NO: 97911 - DNA, 22 bp, Artificial Sequence
  chemically synthesized
tcaaggtgtttgttcatcacag

SEQ ID NO: 97912 - DNA, 22 bp, Artificial Sequence
  chemically synthesized
gttcatcacagtctctacctca

SEQ ID NO: 97913 - DNA, 22 bp, Artificial Sequence
  chemically synthesized
ttcatcacagtctctacctcag

SEQ ID NO: 97914 - DNA, 22 bp, Artificial Sequence
  chemically synthesized
atcacagtctctacctcagaat

SEQ ID NO: 97915 - DNA, 22 bp, Artificial Sequence
  chemically synthesized
tacctcagaattggctttaaaa

SEQ ID NO: 97916 - DNA, 22 bp, Artificial Sequence
  chemically synthesized
cctcagaattggctttaaaatt

SEQ ID NO: 97917 - DNA, 22 bp, Artificial Sequence
  chemically synthesized
agaattggctttaaaattggaa

SEQ ID NO: 97918 - DNA, 22 bp, Artificial Sequence
  chemically synthesized
gctttaaaattggaaagctggg

SEQ ID NO: 97919 - DNA, 22 bp, Artificial Sequence
  chemically synthesized
taaaattggaaagctgggtggg

SEQ ID NO: 97920 - DNA, 22 bp, Artificial Sequence
  chemically synthesized
aaaattggaaagctgggtgggt

SEQ ID NO: 97921 - DNA, 22 bp, Artificial Sequence
  chemically synthesized
aaattggaaagctgggtgggtg

SEQ ID NO: 97922 - DNA, 22 bp, Artificial Sequence
  chemically synthesized
gaaagctgggtgggtggatatg

SEQ ID NO: 97923 - DNA, 22 bp, Artificial Sequence
  chemically synthesized
ggtgggtggatatggaaatgag

SEQ ID NO: 97924 - DNA, 22 bp, Artificial Sequence
  chemically synthesized
tggagcttgtctacacatcata

SEQ ID NO: 97925 - DNA, 22 bp, Artificial Sequence
  chemically synthesized
gagcttgtctacacatcatacc

SEQ ID NO: 97926 - DNA, 22 bp, Artificial Sequence
  chemically synthesized
gtctacacatcatacctttagc

SEQ ID NO: 97927 - DNA, 22 bp, Artificial Sequence
  chemically synthesized
tctacacatcatacctttagcc

SEQ ID NO: 97928 - DNA, 22 bp, Artificial Sequence
  chemically synthesized
cacatcatacctttagccaaag

SEQ ID NO: 97929 - DNA, 22 bp, Artificial Sequence
  chemically synthesized
tagccaaagtgacatcaagtat

SEQ ID NO: 97930 - DNA, 22 bp, Artificial Sequence
  chemically synthesized
agccaaagtgacatcaagtatt

SEQ ID NO: 97931 - DNA, 22 bp, Artificial Sequence
  chemically synthesized
gccaaagtgacatcaagtattt

SEQ ID NO: 97932 - DNA, 22 bp, Artificial Sequence
  chemically synthesized
cttggatgctgaccagaggctt

SEQ ID NO: 97933 - DNA, 22 bp, Artificial Sequence
  chemically synthesized
ttggatgctgaccagaggcttc

SEQ ID NO: 97934 - DNA, 22 bp, Artificial Sequence
  chemically synthesized
ggatgctgaccagaggcttctg

SEQ ID NO: 97935 - DNA, 22 bp, Artificial Sequence
  chemically synthesized
gatgctgaccagaggcttctga

SEQ ID NO: 97936 - DNA, 22 bp, Artificial Sequence
  chemically synthesized
accagaggcttctgagccaggc

SEQ ID NO: 97937 - DNA, 22 bp, Artificial Sequence
  chemically synthesized
ctgagccaggcccctctagctg

SEQ ID NO: 97938 - DNA, 22 bp, Artificial Sequence
  chemically synthesized
tgagccaggcccctctagctga

SEQ ID NO: 97939 - DNA, 22 bp, Artificial Sequence
  chemically synthesized
agccaggcccctctagctgaag

SEQ ID NO: 97940 - DNA, 22 bp, Artificial Sequence
  chemically synthesized
tagctgaaggaagttcacagtt

SEQ ID NO: 97941 - DNA, 22 bp, Artificial Sequence
  chemically synthesized
gctgaaggaagttcacagtttc

SEQ ID NO: 97942 - DNA, 22 bp, Artificial Sequence
  chemically synthesized
aaggaagttcacagtttcttta

SEQ ID NO: 97943 - DNA, 22 bp, Artificial Sequence
  chemically synthesized
acagtttctttaaggagggaaa

SEQ ID NO: 97944 - DNA, 22 bp, Artificial Sequence
  chemically synthesized
ctttaaggagggaaaatggtag

SEQ ID NO: 97945 - DNA, 22 bp, Artificial Sequence
  chemically synthesized
tttaaggagggaaaatggtaga

SEQ ID NO: 97946 - DNA, 22 bp, Artificial Sequence
  chemically synthesized
taaggagggaaaatggtagata

SEQ ID NO: 97947 - DNA, 22 bp, Artificial Sequence
  chemically synthesized
aaggagggaaaatggtagataa

SEQ ID NO: 97948 - DNA, 22 bp, Artificial Sequence
  chemically synthesized
aggagggaaaatggtagataag

SEQ ID NO: 97949 - DNA, 22 bp, Artificial Sequence
  chemically synthesized
tgttcggtcagggaatttgatg

SEQ ID NO: 97950 - DNA, 22 bp, Artificial Sequence
  chemically synthesized
ttcggtcagggaatttgatggg

SEQ ID NO: 97951 - DNA, 22 bp, Artificial Sequence
  chemically synthesized
ggtcagggaatttgatgggttt

SEQ ID NO: 97952 - DNA, 22 bp, Artificial Sequence
  chemically synthesized
gatgggttttgtttgtttgttt

SEQ ID NO: 97953 - DNA, 22 bp, Artificial Sequence
  chemically synthesized
atgggttttgtttgtttgtttg

SEQ ID NO: 97954 - DNA, 22 bp, Artificial Sequence
  chemically synthesized
tgtttgtttgtttgtttgtttg

SEQ ID NO: 97955 - DNA, 22 bp, Artificial Sequence
  chemically synthesized
gtttgtttgtttgtttgtttgt

SEQ ID NO: 97956 - DNA, 22 bp, Artificial Sequence
  chemically synthesized
tttgtttgtttgtttgtttgtt

SEQ ID NO: 97957 - DNA, 22 bp, Artificial Sequence
  chemically synthesized
gtttgtttgtttgtttgttttc

SEQ ID NO: 97958 - DNA, 22 bp, Artificial Sequence
  chemically synthesized
tttgtttgtttgtttgttttcg

SEQ ID NO: 97959 - DNA, 22 bp, Artificial Sequence
  chemically synthesized
gtttgtttgtttgttttcgttt

SEQ ID NO: 97960 - DNA, 22 bp, Artificial Sequence
  chemically synthesized
tttgtttgtttgttttcgtttt

SEQ ID NO: 97961 - DNA, 22 bp, Artificial Sequence
  chemically synthesized
gtttgtttgttttcgtttttct

SEQ ID NO: 97962 - DNA, 22 bp, Artificial Sequence
  chemically synthesized
tttgtttgttttcgtttttctt

SEQ ID NO: 97963 - DNA, 22 bp, Artificial Sequence
  chemically synthesized
gtttgttttcgtttttctttag

SEQ ID NO: 97964 - DNA, 22 bp, Artificial Sequence
  chemically synthesized
tttgttttcgtttttctttaga

SEQ ID NO: 97965 - DNA, 22 bp, Artificial Sequence
  chemically synthesized
gttttcgtttttctttagacag

SEQ ID NO: 97966 - DNA, 22 bp, Artificial Sequence
  chemically synthesized
ttttcgtttttctttagacaga

SEQ ID NO: 97967 - DNA, 22 bp, Artificial Sequence
  chemically synthesized
tcgtttttctttagacagagtc

SEQ ID NO: 97968 - DNA, 22 bp, Artificial Sequence
  chemically synthesized
cgtttttctttagacagagtct

SEQ ID NO: 97969 - DNA, 22 bp, Artificial Sequence
  chemically synthesized
gtttttctttagacagagtctc

SEQ ID NO: 97970 - DNA, 22 bp, Artificial Sequence
  chemically synthesized
ttctttagacagagtctcgctc

SEQ ID NO: 97971 - DNA, 22 bp, Artificial Sequence
  chemically synthesized
tctttagacagagtctcgctct

SEQ ID NO: 97972 - DNA, 22 bp, Artificial Sequence
  chemically synthesized
ctttagacagagtctcgctctg

SEQ ID NO: 97973 - DNA, 22 bp, Artificial Sequence
  chemically synthesized
tttagacagagtctcgctctgg

SEQ ID NO: 97974 - DNA, 22 bp, Artificial Sequence
  chemically synthesized
tagacagagtctcgctctggag

SEQ ID NO: 97975 - DNA, 22 bp, Artificial Sequence
  chemically synthesized
agacagagtctcgctctggagg

SEQ ID NO: 97976 - DNA, 22 bp, Artificial Sequence
  chemically synthesized
gacagagtctcgctctggaggc

SEQ ID NO: 97977 - DNA, 22 bp, Artificial Sequence
  chemically synthesized
gctctggaggctggagtgcaat

SEQ ID NO: 97978 - DNA, 22 bp, Artificial Sequence
  chemically synthesized
tggaggctggagtgcaatggca

SEQ ID NO: 97979 - DNA, 22 bp, Artificial Sequence
  chemically synthesized
gaggctggagtgcaatggcatg

SEQ ID NO: 97980 - DNA, 22 bp, Artificial Sequence
  chemically synthesized
gagtgcaatggcatgatctctg

SEQ ID NO: 97981 - DNA, 22 bp, Artificial Sequence
  chemically synthesized
tgctcagtgcaaactccacctc

SEQ ID NO: 97982 - DNA, 22 bp, Artificial Sequence
  chemically synthesized
ctcagtgcaaactccacctccc

SEQ ID NO: 97983 - DNA, 22 bp, Artificial Sequence
  chemically synthesized
agtgcaaactccacctccccgg

SEQ ID NO: 97984 - DNA, 22 bp, Artificial Sequence
  chemically synthesized
cacctccccggttcaagcgatt

SEQ ID NO: 97985 - DNA, 22 bp, Artificial Sequence
  chemically synthesized
cccggttcaagcgattctcctg

SEQ ID NO: 97986 - DNA, 22 bp, Artificial Sequence
  chemically synthesized
aagcgattctcctgcctcagcc

SEQ ID NO: 97987 - DNA, 22 bp, Artificial Sequence
  chemically synthesized
tcctgcctcagcctcccaagta

SEQ ID NO: 97988 - DNA, 22 bp, Artificial Sequence
  chemically synthesized
ctgcctcagcctcccaagtagt

SEQ ID NO: 97989 - DNA, 22 bp, Artificial Sequence
  chemically synthesized
cctcagcctcccaagtagttgg

SEQ ID NO: 97990 - DNA, 22 bp, Artificial Sequence
  chemically synthesized
agcctcccaagtagttggatta

SEQ ID NO: 97991 - DNA, 22 bp, Artificial Sequence
  chemically synthesized
ccaagtagttggattacaggct

SEQ ID NO: 97992 - DNA, 22 bp, Artificial Sequence
  chemically synthesized
gattacaggctcccgtcaccac

SEQ ID NO: 97993 - DNA, 22 bp, Artificial Sequence
  chemically synthesized
caggctcccgtcaccacgtcca

SEQ ID NO: 97994 - DNA, 22 bp, Artificial Sequence
  chemically synthesized
ccgtcaccacgtccagctaatt

SEQ ID NO: 97995 - DNA, 22 bp, Artificial Sequence
  chemically synthesized
atttttatatttttaagcagag

SEQ ID NO: 97996 - DNA, 22 bp, Artificial Sequence
  chemically synthesized
ttatatttttaagcagagacca

SEQ ID NO: 97997 - DNA, 22 bp, Artificial Sequence
  chemically synthesized
tatatttttaagcagagaccag

SEQ ID NO: 97998 - DNA, 22 bp, Artificial Sequence
  chemically synthesized
atatttttaagcagagaccagg

SEQ ID NO: 97999 - DNA, 22 bp, Artificial Sequence
  chemically synthesized
tatttttaagcagagaccaggt

SEQ ID NO: 98000 - DNA, 22 bp, Artificial Sequence
  chemically synthesized
ttaagcagagaccaggtttcac

SEQ ID NO: 98001 - DNA, 22 bp, Artificial Sequence
  chemically synthesized
taagcagagaccaggtttcact

SEQ ID NO: 98002 - DNA, 22 bp, Artificial Sequence
  chemically synthesized
aagcagagaccaggtttcacta

SEQ ID NO: 98003 - DNA, 22 bp, Artificial Sequence
  chemically synthesized
agcagagaccaggtttcactat

SEQ ID NO: 98004 - DNA, 22 bp, Artificial Sequence
  chemically synthesized
cactatgttggctgggctggtg

SEQ ID NO: 98005 - DNA, 22 bp, Artificial Sequence
  chemically synthesized
actatgttggctgggctggtgt

SEQ ID NO: 98006 - DNA, 22 bp, Artificial Sequence
  chemically synthesized
tgttggctgggctggtgtccaa

SEQ ID NO: 98007 - DNA, 22 bp, Artificial Sequence
  chemically synthesized
gctgggctggtgtccaactcct

SEQ ID NO: 98008 - DNA, 22 bp, Artificial Sequence
  chemically synthesized
ggctggtgtccaactcctgacc

SEQ ID NO: 98009 - DNA, 22 bp, Artificial Sequence
  chemically synthesized
gtgtccaactcctgacctcaag

SEQ ID NO: 98010 - DNA, 22 bp, Artificial Sequence
  chemically synthesized
ctgacctcaagtgatctgccca

SEQ ID NO: 98011 - DNA, 22 bp, Artificial Sequence
  chemically synthesized
acctcaagtgatctgcccacct

SEQ ID NO: 98012 - DNA, 22 bp, Artificial Sequence
  chemically synthesized
aagtgatctgcccaccttggcg

SEQ ID NO: 98013 - DNA, 22 bp, Artificial Sequence
  chemically synthesized
cccaccttggcgtcccaaactg

SEQ ID NO: 98014 - DNA, 22 bp, Artificial Sequence
  chemically synthesized
ggcgtcccaaactgctgtgatt

SEQ ID NO: 98015 - DNA, 22 bp, Artificial Sequence
  chemically synthesized
gcgtcccaaactgctgtgatta

SEQ ID NO: 98016 - DNA, 22 bp, Artificial Sequence
  chemically synthesized
ctgtgattacaggagtgagcca

SEQ ID NO: 98017 - DNA, 22 bp, Artificial Sequence
  chemically synthesized
tgattacaggagtgagccaccg

SEQ ID NO: 98018 - DNA, 22 bp, Artificial Sequence
  chemically synthesized
caggagtgagccaccgcacctc

SEQ ID NO: 98019 - DNA, 22 bp, Artificial Sequence
  chemically synthesized
aaggaatttgatgtttaggctg

SEQ ID NO: 98020 - DNA, 22 bp, Artificial Sequence
  chemically synthesized
gatgtttaggctgtgacctctg

SEQ ID NO: 98021 - DNA, 22 bp, Artificial Sequence
  chemically synthesized
atgtttaggctgtgacctctgc

SEQ ID NO: 98022 - DNA, 22 bp, Artificial Sequence
  chemically synthesized
aggctgtgacctctgcactagg

SEQ ID NO: 98023 - DNA, 22 bp, Artificial Sequence
  chemically synthesized
ggctgtgacctctgcactagga

SEQ ID NO: 98024 - DNA, 22 bp, Artificial Sequence
  chemically synthesized
tgacctctgcactaggaatgga

SEQ ID NO: 98025 - DNA, 22 bp, Artificial Sequence
  chemically synthesized
tgcactaggaatggaaggttag

SEQ ID NO: 98026 - DNA, 22 bp, Artificial Sequence
  chemically synthesized
cactaggaatggaaggttagcc

SEQ ID NO: 98027 - DNA, 22 bp, Artificial Sequence
  chemically synthesized
ggaatggaaggttagccactcc

SEQ ID NO: 98028 - DNA, 22 bp, Artificial Sequence
  chemically synthesized
gccactcccaccccacccttcg

SEQ ID NO: 98029 - DNA, 22 bp, Artificial Sequence
  chemically synthesized
ccaccccacccttcgtcctgca

SEQ ID NO: 98030 - DNA, 22 bp, Artificial Sequence
  chemically synthesized
cgtcctgcaagtacccaatcac

SEQ ID NO: 98031 - DNA, 22 bp, Artificial Sequence
  chemically synthesized
gtcctgcaagtacccaatcaca

SEQ ID NO: 98032 - DNA, 22 bp, Artificial Sequence
  chemically synthesized
caagtacccaatcacactgcag

SEQ ID NO: 98033 - DNA, 22 bp, Artificial Sequence
  chemically synthesized
cagagccacacctgccttcctt

SEQ ID NO: 98034 - DNA, 22 bp, Artificial Sequence
  chemically synthesized
ccttccttagaggcgtgcctcc

SEQ ID NO: 98035 - DNA, 22 bp, Artificial Sequence
  chemically synthesized
ccttagaggcgtgcctccatcc

SEQ ID NO: 98036 - DNA, 22 bp, Artificial Sequence
  chemically synthesized
cttagaggcgtgcctccatccc

SEQ ID NO: 98037 - DNA, 22 bp, Artificial Sequence
  chemically synthesized
agaggcgtgcctccatccctga

SEQ ID NO: 98038 - DNA, 22 bp, Artificial Sequence
  chemically synthesized
gaggcgtgcctccatccctgat

SEQ ID NO: 98039 - DNA, 22 bp, Artificial Sequence
  chemically synthesized
catccctgatgagtttttcctc

SEQ ID NO: 98040 - DNA, 22 bp, Artificial Sequence
  chemically synthesized
atgagtttttcctccatgtgta

SEQ ID NO: 98041 - DNA, 22 bp, Artificial Sequence
  chemically synthesized
ttcctccatgtgtagaattgaa

SEQ ID NO: 98042 - DNA, 22 bp, Artificial Sequence
  chemically synthesized
tcctccatgtgtagaattgaat

SEQ ID NO: 98043 - DNA, 22 bp, Artificial Sequence
  chemically synthesized
cctccatgtgtagaattgaata

SEQ ID NO: 98044 - DNA, 22 bp, Artificial Sequence
  chemically synthesized
ctccatgtgtagaattgaataa

SEQ ID NO: 98045 - DNA, 22 bp, Artificial Sequence
  chemically synthesized
catgtgtagaattgaataagaa

SEQ ID NO: 98046 - DNA, 22 bp, Artificial Sequence
  chemically synthesized
aataagaaggatagaattcaat

SEQ ID NO: 98047 - DNA, 22 bp, Artificial Sequence
  chemically synthesized
aatttaacaagctttgagtact

SEQ ID NO: 98048 - DNA, 22 bp, Artificial Sequence
  chemically synthesized
aacaagctttgagtacttccta

SEQ ID NO: 98049 - DNA, 22 bp, Artificial Sequence
  chemically synthesized
acaagctttgagtacttcctat

SEQ ID NO: 98050 - DNA, 22 bp, Artificial Sequence
  chemically synthesized
tgagtacttcctatagcctagg

SEQ ID NO: 98051 - DNA, 22 bp, Artificial Sequence
  chemically synthesized
gagtacttcctatagcctaggc

SEQ ID NO: 98052 - DNA, 22 bp, Artificial Sequence
  chemically synthesized
agtacttcctatagcctaggca

SEQ ID NO: 98053 - DNA, 22 bp, Artificial Sequence
  chemically synthesized
cctatagcctaggcattgtgct

SEQ ID NO: 98054 - DNA, 22 bp, Artificial Sequence
  chemically synthesized
ctatagcctaggcattgtgctg

SEQ ID NO: 98055 - DNA, 22 bp, Artificial Sequence
  chemically synthesized
tagcctaggcattgtgctgaca

SEQ ID NO: 98056 - DNA, 22 bp, Artificial Sequence
  chemically synthesized
ggcattgtgctgacaactatgt

SEQ ID NO: 98057 - DNA, 22 bp, Artificial Sequence
  chemically synthesized
tgctgacaactatgttagagag

SEQ ID NO: 98058 - DNA, 22 bp, Artificial Sequence
  chemically synthesized
acaactatgttagagagagaaa

SEQ ID NO: 98059 - DNA, 22 bp, Artificial Sequence
  chemically synthesized
tgttagagagagaaatagacaa

SEQ ID NO: 98060 - DNA, 22 bp, Artificial Sequence
  chemically synthesized
gagagagaaatagacaagctat

SEQ ID NO: 98061 - DNA, 22 bp, Artificial Sequence
  chemically synthesized
taaacttttcctcaggaccatc

SEQ ID NO: 98062 - DNA, 22 bp, Artificial Sequence
  chemically synthesized
ttcctcaggaccatctacataa

SEQ ID NO: 98063 - DNA, 22 bp, Artificial Sequence
  chemically synthesized
tcctcaggaccatctacataat

SEQ ID NO: 98064 - DNA, 22 bp, Artificial Sequence
  chemically synthesized
cctcaggaccatctacataatt

SEQ ID NO: 98065 - DNA, 22 bp, Artificial Sequence
  chemically synthesized
ctcaggaccatctacataattt

SEQ ID NO: 98066 - DNA, 22 bp, Artificial Sequence
  chemically synthesized
aggaccatctacataatttcta

SEQ ID NO: 98067 - DNA, 22 bp, Artificial Sequence
  chemically synthesized
cataatttctaggcccaatata

SEQ ID NO: 98068 - DNA, 22 bp, Artificial Sequence
  chemically synthesized
ctaggcccaatataaaatgaaa

SEQ ID NO: 98069 - DNA, 22 bp, Artificial Sequence
  chemically synthesized
taggcccaatataaaatgaaaa

SEQ ID NO: 98070 - DNA, 22 bp, Artificial Sequence
  chemically synthesized
ggcccaatataaaatgaaaatg

SEQ ID NO: 98071 - DNA, 22 bp, Artificial Sequence
  chemically synthesized
tgtcaaaaattaaggatttcat

SEQ ID NO: 98072 - DNA, 22 bp, Artificial Sequence
  chemically synthesized
gtcaaaaattaaggatttcatg

SEQ ID NO: 98073 - DNA, 22 bp, Artificial Sequence
  chemically synthesized
tcaaaaattaaggatttcatgt

SEQ ID NO: 98074 - DNA, 22 bp, Artificial Sequence
  chemically synthesized
aggatttcatgtcaggaacagc

SEQ ID NO: 98075 - DNA, 22 bp, Artificial Sequence
  chemically synthesized
catgtcaggaacagcaaggatg

SEQ ID NO: 98076 - DNA, 22 bp, Artificial Sequence
  chemically synthesized
atgtcaggaacagcaaggatgt

SEQ ID NO: 98077 - DNA, 22 bp, Artificial Sequence
  chemically synthesized
aaccaagcatggggccatcaag

SEQ ID NO: 98078 - DNA, 22 bp, Artificial Sequence
  chemically synthesized
tatctgctattcatgatacgaa

SEQ ID NO: 98079 - DNA, 22 bp, Artificial Sequence
  chemically synthesized
ctattcatgatacgaaaaaata

SEQ ID NO: 98080 - DNA, 22 bp, Artificial Sequence
  chemically synthesized
ttcatgatacgaaaaaataaag

SEQ ID NO: 98081 - DNA, 22 bp, Artificial Sequence
  chemically synthesized
atgatacgaaaaaataaagagt

SEQ ID NO: 98082 - DNA, 22 bp, Artificial Sequence
  chemically synthesized
tagttatttagccacatatttc

SEQ ID NO: 98083 - DNA, 22 bp, Artificial Sequence
  chemically synthesized
gttatttagccacatatttcaa

SEQ ID NO: 98084 - DNA, 22 bp, Artificial Sequence
  chemically synthesized
tttagccacatatttcaagttt

SEQ ID NO: 98085 - DNA, 22 bp, Artificial Sequence
  chemically synthesized
agccacatatttcaagtttagt

SEQ ID NO: 98086 - DNA, 22 bp, Artificial Sequence
  chemically synthesized
gccacatatttcaagtttagtc

SEQ ID NO: 98087 - DNA, 22 bp, Artificial Sequence
  chemically synthesized
caagtttagtctgatatcaccc

SEQ ID NO: 98088 - DNA, 22 bp, Artificial Sequence
  chemically synthesized
aagtttagtctgatatcaccct

SEQ ID NO: 98089 - DNA, 22 bp, Artificial Sequence
  chemically synthesized
agtctgatatcaccctttaaac

SEQ ID NO: 98090 - DNA, 22 bp, Artificial Sequence
  chemically synthesized
gtctgatatcaccctttaaaca

SEQ ID NO: 98091 - DNA, 22 bp, Artificial Sequence
  chemically synthesized
atatcaccctttaaacactgcc

SEQ ID NO: 98092 - DNA, 22 bp, Artificial Sequence
  chemically synthesized
taaacactgccactcaacctaa

SEQ ID NO: 98093 - DNA, 22 bp, Artificial Sequence
  chemically synthesized
aaacactgccactcaacctaaa

SEQ ID NO: 98094 - DNA, 22 bp, Artificial Sequence
  chemically synthesized
aacactgccactcaacctaaaa

SEQ ID NO: 98095 - DNA, 22 bp, Artificial Sequence
  chemically synthesized
ccactcaacctaaaacaatgct

SEQ ID NO: 98096 - DNA, 22 bp, Artificial Sequence
  chemically synthesized
aacctaaaacaatgctagtctt

SEQ ID NO: 98097 - DNA, 22 bp, Artificial Sequence
  chemically synthesized
aaacaatgctagtctttctaga

SEQ ID NO: 98098 - DNA, 22 bp, Artificial Sequence
  chemically synthesized
gtctttctagacccatccatgg

SEQ ID NO: 98099 - DNA, 22 bp, Artificial Sequence
  chemically synthesized
tctagacccatccatggaattt

SEQ ID NO: 98100 - DNA, 22 bp, Artificial Sequence
  chemically synthesized
ctagacccatccatggaatttt

SEQ ID NO: 98101 - DNA, 22 bp, Artificial Sequence
  chemically synthesized
tagacccatccatggaattttt

SEQ ID NO: 98102 - DNA, 22 bp, Artificial Sequence
  chemically synthesized
gacccatccatggaattttttc

SEQ ID NO: 98103 - DNA, 22 bp, Artificial Sequence
  chemically synthesized
tttccccactgttttttttcta

SEQ ID NO: 98104 - DNA, 22 bp, Artificial Sequence
  chemically synthesized
ttccccactgttttttttctaa

SEQ ID NO: 98105 - DNA, 22 bp, Artificial Sequence
  chemically synthesized
tccccactgttttttttctaat

SEQ ID NO: 98106 - DNA, 22 bp, Artificial Sequence
  chemically synthesized
ccccactgttttttttctaatt

SEQ ID NO: 98107 - DNA, 22 bp, Artificial Sequence
  chemically synthesized
cccactgttttttttctaatta

SEQ ID NO: 98108 - DNA, 22 bp, Artificial Sequence
  chemically synthesized
ttttttttctaattaatttgtg

SEQ ID NO: 98109 - DNA, 22 bp, Artificial Sequence
  chemically synthesized
tttttctaattaatttgtgatt

SEQ ID NO: 98110 - DNA, 22 bp, Artificial Sequence
  chemically synthesized
ttttctaattaatttgtgattt

SEQ ID NO: 98111 - DNA, 22 bp, Artificial Sequence
  chemically synthesized
tttctaattaatttgtgattta

SEQ ID NO: 98112 - DNA, 22 bp, Artificial Sequence
  chemically synthesized
ttctaattaatttgtgatttaa

SEQ ID NO: 98113 - DNA, 22 bp, Artificial Sequence
  chemically synthesized
tctaattaatttgtgatttaaa

SEQ ID NO: 98114 - DNA, 22 bp, Artificial Sequence
  chemically synthesized
ctaattaatttgtgatttaaat

SEQ ID NO: 98115 - DNA, 22 bp, Artificial Sequence
  chemically synthesized
taattaatttgtgatttaaatg

SEQ ID NO: 98116 - DNA, 22 bp, Artificial Sequence
  chemically synthesized
attaatttgtgatttaaatggc

SEQ ID NO: 98117 - DNA, 22 bp, Artificial Sequence
  chemically synthesized
atttgtgatttaaatggctcat

SEQ ID NO: 98118 - DNA, 22 bp, Artificial Sequence
  chemically synthesized
gtgatttaaatggctcatattc

SEQ ID NO: 98119 - DNA, 22 bp, Artificial Sequence
  chemically synthesized
tgatttaaatggctcatattcc

SEQ ID NO: 98120 - DNA, 22 bp, Artificial Sequence
  chemically synthesized
aaatggctcatattccagcctg

SEQ ID NO: 98121 - DNA, 22 bp, Artificial Sequence
  chemically synthesized
aatggctcatattccagcctgt

SEQ ID NO: 98122 - DNA, 22 bp, Artificial Sequence
  chemically synthesized
atattccagcctgtgccacagt

SEQ ID NO: 98123 - DNA, 22 bp, Artificial Sequence
  chemically synthesized
cagcctgtgccacagttattac

SEQ ID NO: 98124 - DNA, 22 bp, Artificial Sequence
  chemically synthesized
tgccacagttattacacattta

SEQ ID NO: 98125 - DNA, 22 bp, Artificial Sequence
  chemically synthesized
ttacacatttaactcactctct

SEQ ID NO: 98126 - DNA, 22 bp, Artificial Sequence
  chemically synthesized
cacatttaactcactctctgta

SEQ ID NO: 98127 - DNA, 22 bp, Artificial Sequence
  chemically synthesized
aactcactctctgtattttgtt

SEQ ID NO: 98128 - DNA, 22 bp, Artificial Sequence
  chemically synthesized
actcactctctgtattttgtta

SEQ ID NO: 98129 - DNA, 22 bp, Artificial Sequence
  chemically synthesized
actctctgtattttgttatctg

SEQ ID NO: 98130 - DNA, 22 bp, Artificial Sequence
  chemically synthesized
tctgtattttgttatctgtata

SEQ ID NO: 98131 - DNA, 22 bp, Artificial Sequence
  chemically synthesized
tgtattttgttatctgtataaa

SEQ ID NO: 98132 - DNA, 22 bp, Artificial Sequence
  chemically synthesized
tattttgttatctgtataaata

SEQ ID NO: 98133 - DNA, 22 bp, Artificial Sequence
  chemically synthesized
tgttatctgtataaatactctt

SEQ ID NO: 98134 - DNA, 22 bp, Artificial Sequence
  chemically synthesized
gttatctgtataaatactcttc

SEQ ID NO: 98135 - DNA, 22 bp, Artificial Sequence
  chemically synthesized
ttatctgtataaatactcttca

SEQ ID NO: 98136 - DNA, 22 bp, Artificial Sequence
  chemically synthesized
tctgtataaatactcttcaggt

SEQ ID NO: 98137 - DNA, 22 bp, Artificial Sequence
  chemically synthesized
tataaatactcttcaggttgat

SEQ ID NO: 98138 - DNA, 22 bp, Artificial Sequence
  chemically synthesized
ttcaggttgatttcctttctta

SEQ ID NO: 98139 - DNA, 22 bp, Artificial Sequence
  chemically synthesized
caggttgatttcctttcttaat

SEQ ID NO: 98140 - DNA, 22 bp, Artificial Sequence
  chemically synthesized
aggttgatttcctttcttaatg

SEQ ID NO: 98141 - DNA, 22 bp, Artificial Sequence
  chemically synthesized
atttcctttcttaatgtttgtg

SEQ ID NO: 98142 - DNA, 22 bp, Artificial Sequence
  chemically synthesized
cctttcttaatgtttgtgttta

SEQ ID NO: 98143 - DNA, 22 bp, Artificial Sequence
  chemically synthesized
ctttcttaatgtttgtgtttat

SEQ ID NO: 98144 - DNA, 22 bp, Artificial Sequence
  chemically synthesized
tcttaatgtttgtgtttatgtt

SEQ ID NO: 98145 - DNA, 22 bp, Artificial Sequence
  chemically synthesized
cttaatgtttgtgtttatgtta

SEQ ID NO: 98146 - DNA, 22 bp, Artificial Sequence
  chemically synthesized
ttaatgtttgtgtttatgttag

SEQ ID NO: 98147 - DNA, 22 bp, Artificial Sequence
  chemically synthesized
aatgtttgtgtttatgttagat

SEQ ID NO: 98148 - DNA, 22 bp, Artificial Sequence
  chemically synthesized
atgtttgtgtttatgttagata

SEQ ID NO: 98149 - DNA, 22 bp, Artificial Sequence
  chemically synthesized
gtgtttatgttagatatgcatc

SEQ ID NO: 98150 - DNA, 22 bp, Artificial Sequence
  chemically synthesized
tgtttatgttagatatgcatca

SEQ ID NO: 98151 - DNA, 22 bp, Artificial Sequence
  chemically synthesized
atgttagatatgcatcatgtag

SEQ ID NO: 98152 - DNA, 22 bp, Artificial Sequence
  chemically synthesized
tgttagatatgcatcatgtagc

SEQ ID NO: 98153 - DNA, 22 bp, Artificial Sequence
  chemically synthesized
gatatgcatcatgtagcctgtc

SEQ ID NO: 98154 - DNA, 22 bp, Artificial Sequence
  chemically synthesized
tcttcatttctatcacaaacat

SEQ ID NO: 98155 - DNA, 22 bp, Artificial Sequence
  chemically synthesized
catttctatcacaaacatacac

SEQ ID NO: 98156 - DNA, 22 bp, Artificial Sequence
  chemically synthesized
atttctatcacaaacatacact

SEQ ID NO: 98157 - DNA, 22 bp, Artificial Sequence
  chemically synthesized
ctatcacaaacatacacttgaa

SEQ ID NO: 98158 - DNA, 22 bp, Artificial Sequence
  chemically synthesized
tatcacaaacatacacttgaac

SEQ ID NO: 98159 - DNA, 22 bp, Artificial Sequence
  chemically synthesized
tcacaaacatacacttgaacca

SEQ ID NO: 98160 - DNA, 22 bp, Artificial Sequence
  chemically synthesized
gaaccaaaaaggaagtttttac

SEQ ID NO: 98161 - DNA, 22 bp, Artificial Sequence
  chemically synthesized
aaccaaaaaggaagtttttaca

SEQ ID NO: 98162 - DNA, 22 bp, Artificial Sequence
  chemically synthesized
ttacatagcatcactaaatctt

SEQ ID NO: 98163 - DNA, 22 bp, Artificial Sequence
  chemically synthesized
tacatagcatcactaaatcttc

SEQ ID NO: 98164 - DNA, 22 bp, Artificial Sequence
  chemically synthesized
acatagcatcactaaatcttct

SEQ ID NO: 98165 - DNA, 22 bp, Artificial Sequence
  chemically synthesized
catagcatcactaaatcttctc

SEQ ID NO: 98166 - DNA, 22 bp, Artificial Sequence
  chemically synthesized
aatcttctctctgtgctcttag

SEQ ID NO: 98167 - DNA, 22 bp, Artificial Sequence
  chemically synthesized
ctctctgtgctcttagcgaaac

SEQ ID NO: 98168 - DNA, 22 bp, Artificial Sequence
  chemically synthesized
tctctgtgctcttagcgaaacc

SEQ ID NO: 98169 - DNA, 22 bp, Artificial Sequence
  chemically synthesized
tctgtgctcttagcgaaaccaa

SEQ ID NO: 98170 - DNA, 22 bp, Artificial Sequence
  chemically synthesized
tgtgctcttagcgaaaccaagt

SEQ ID NO: 98171 - DNA, 22 bp, Artificial Sequence
  chemically synthesized
tgctcttagcgaaaccaagtag

SEQ ID NO: 98172 - DNA, 22 bp, Artificial Sequence
  chemically synthesized
ttagcgaaaccaagtaggctga

SEQ ID NO: 98173 - DNA, 22 bp, Artificial Sequence
  chemically synthesized
agcgaaaccaagtaggctgaca

SEQ ID NO: 98174 - DNA, 22 bp, Artificial Sequence
  chemically synthesized
gcgaaaccaagtaggctgacaa

SEQ ID NO: 98175 - DNA, 22 bp, Artificial Sequence
  chemically synthesized
acaagacatcattcattcacag

SEQ ID NO: 98176 - DNA, 22 bp, Artificial Sequence
  chemically synthesized
attcacagcgaaaccgagtaga

SEQ ID NO: 98177 - DNA, 22 bp, Artificial Sequence
  chemically synthesized
acagcgaaaccgagtagactga

SEQ ID NO: 98178 - DNA, 22 bp, Artificial Sequence
  chemically synthesized
acaagaggtcattcattcacaa

SEQ ID NO: 98179 - DNA, 22 bp, Artificial Sequence
  chemically synthesized
attcacaaatgaatacaaaaaa

SEQ ID NO: 98180 - DNA, 22 bp, Artificial Sequence
  chemically synthesized
acaaatgaatacaaaaaacagt

SEQ ID NO: 98181 - DNA, 22 bp, Artificial Sequence
  chemically synthesized
taatgggtcctgggcctgcaaa

SEQ ID NO: 98182 - DNA, 22 bp, Artificial Sequence
  chemically synthesized
ggcctgcaaaaccctcacagct

SEQ ID NO: 98183 - DNA, 22 bp, Artificial Sequence
  chemically synthesized
caaaaccctcacagctgctaac

SEQ ID NO: 98184 - DNA, 22 bp, Artificial Sequence
  chemically synthesized
acagctgctaacctcaagaagc

SEQ ID NO: 98185 - DNA, 22 bp, Artificial Sequence
  chemically synthesized
ctaacctcaagaagctcagtgg

SEQ ID NO: 98186 - DNA, 22 bp, Artificial Sequence
  chemically synthesized
acctcaagaagctcagtggaga

SEQ ID NO: 98187 - DNA, 22 bp, Artificial Sequence
  chemically synthesized
aagaagctcagtggagacataa

SEQ ID NO: 98188 - DNA, 22 bp, Artificial Sequence
  chemically synthesized
agtggagacataacattcatct

SEQ ID NO: 98189 - DNA, 22 bp, Artificial Sequence
  chemically synthesized
atctgaaaattccttgcatgtc

SEQ ID NO: 98190 - DNA, 22 bp, Artificial Sequence
  chemically synthesized
aaaattccttgcatgtctgttg

SEQ ID NO: 98191 - DNA, 22 bp, Artificial Sequence
  chemically synthesized
cttgcatgtctgttgaactaat

SEQ ID NO: 98192 - DNA, 22 bp, Artificial Sequence
  chemically synthesized
gcatgtctgttgaactaattta

SEQ ID NO: 98193 - DNA, 22 bp, Artificial Sequence
  chemically synthesized
catgtctgttgaactaatttat

SEQ ID NO: 98194 - DNA, 22 bp, Artificial Sequence
  chemically synthesized
ttgaactaatttatctgcctct

SEQ ID NO: 98195 - DNA, 22 bp, Artificial Sequence
  chemically synthesized
aactaatttatctgcctctcct

SEQ ID NO: 98196 - DNA, 22 bp, Artificial Sequence
  chemically synthesized
atttatctgcctctccttaaat

SEQ ID NO: 98197 - DNA, 22 bp, Artificial Sequence
  chemically synthesized
atctgcctctccttaaatttgt

SEQ ID NO: 98198 - DNA, 22 bp, Artificial Sequence
  chemically synthesized
tctgcctctccttaaatttgtt

SEQ ID NO: 98199 - DNA, 22 bp, Artificial Sequence
  chemically synthesized
cctctccttaaatttgttcctt

SEQ ID NO: 98200 - DNA, 22 bp, Artificial Sequence
  chemically synthesized
tccttaaatttgttcctttttg

SEQ ID NO: 98201 - DNA, 22 bp, Artificial Sequence
  chemically synthesized
cttaaatttgttcctttttgta

SEQ ID NO: 98202 - DNA, 22 bp, Artificial Sequence
  chemically synthesized
aaatttgttcctttttgtatag

SEQ ID NO: 98203 - DNA, 22 bp, Artificial Sequence
  chemically synthesized
aatttgttcctttttgtatagt

SEQ ID NO: 98204 - DNA, 22 bp, Artificial Sequence
  chemically synthesized
gttcctttttgtatagttcctt

SEQ ID NO: 98205 - DNA, 22 bp, Artificial Sequence
  chemically synthesized
ttcctttttgtatagttcctta

SEQ ID NO: 98206 - DNA, 22 bp, Artificial Sequence
  chemically synthesized
ctttttgtatagttccttaagt

SEQ ID NO: 98207 - DNA, 22 bp, Artificial Sequence
  chemically synthesized
tttgtatagttccttaagtcat

SEQ ID NO: 98208 - DNA, 22 bp, Artificial Sequence
  chemically synthesized
ttgtatagttccttaagtcatg

SEQ ID NO: 98209 - DNA, 22 bp, Artificial Sequence
  chemically synthesized
tgtatagttccttaagtcatgt

SEQ ID NO: 98210 - DNA, 22 bp, Artificial Sequence
  chemically synthesized
gtatagttccttaagtcatgtc

SEQ ID NO: 98211 - DNA, 22 bp, Artificial Sequence
  chemically synthesized
tatagttccttaagtcatgtca

SEQ ID NO: 98212 - DNA, 22 bp, Artificial Sequence
  chemically synthesized
cttaagtcatgtcacatttctg

SEQ ID NO: 98213 - DNA, 22 bp, Artificial Sequence
  chemically synthesized
aagtcatgtcacatttctgaaa

SEQ ID NO: 98214 - DNA, 22 bp, Artificial Sequence
  chemically synthesized
agtcatgtcacatttctgaaac

SEQ ID NO: 98215 - DNA, 22 bp, Artificial Sequence
  chemically synthesized
ctgaaacatctttgccactgtg

SEQ ID NO: 98216 - DNA, 22 bp, Artificial Sequence
  chemically synthesized
tgaaacatctttgccactgtga

SEQ ID NO: 98217 - DNA, 22 bp, Artificial Sequence
  chemically synthesized
aaacatctttgccactgtgaac

SEQ ID NO: 98218 - DNA, 22 bp, Artificial Sequence
  chemically synthesized
tgccactgtgaactcctacaga

SEQ ID NO: 98219 - DNA, 22 bp, Artificial Sequence
  chemically synthesized
gccactgtgaactcctacagaa

SEQ ID NO: 98220 - DNA, 22 bp, Artificial Sequence
  chemically synthesized
ccactgtgaactcctacagaag

SEQ ID NO: 98221 - DNA, 22 bp, Artificial Sequence
  chemically synthesized
tgaactcctacagaagccagct

SEQ ID NO: 98222 - DNA, 22 bp, Artificial Sequence
  chemically synthesized
ctacagaagccagcttcaaagc

SEQ ID NO: 98223 - DNA, 22 bp, Artificial Sequence
  chemically synthesized
cagaagccagcttcaaagccat

SEQ ID NO: 98224 - DNA, 22 bp, Artificial Sequence
  chemically synthesized
caaagccattcttctggaagcc

SEQ ID NO: 98225 - DNA, 22 bp, Artificial Sequence
  chemically synthesized
aaagccattcttctggaagcct

SEQ ID NO: 98226 - DNA, 22 bp, Artificial Sequence
  chemically synthesized
ttctggaagccttctctatccc

SEQ ID NO: 98227 - DNA, 22 bp, Artificial Sequence
  chemically synthesized
ctggaagccttctctatcccct

SEQ ID NO: 98228 - DNA, 22 bp, Artificial Sequence
  chemically synthesized
tggaagccttctctatcccctt

SEQ ID NO: 98229 - DNA, 22 bp, Artificial Sequence
  chemically synthesized
gaagccttctctatccccttga

SEQ ID NO: 98230 - DNA, 22 bp, Artificial Sequence
  chemically synthesized
ctctatccccttgacctcctgt

SEQ ID NO: 98231 - DNA, 22 bp, Artificial Sequence
  chemically synthesized
tctatccccttgacctcctgtt

SEQ ID NO: 98232 - DNA, 22 bp, Artificial Sequence
  chemically synthesized
tatccccttgacctcctgtttt

SEQ ID NO: 98233 - DNA, 22 bp, Artificial Sequence
  chemically synthesized
tccccttgacctcctgtttttt

SEQ ID NO: 98234 - DNA, 22 bp, Artificial Sequence
  chemically synthesized
gacctcctgttttttctcccac

SEQ ID NO: 98235 - DNA, 22 bp, Artificial Sequence
  chemically synthesized
acctcctgttttttctcccaca

SEQ ID NO: 98236 - DNA, 22 bp, Artificial Sequence
  chemically synthesized
ctgttttttctcccacaagcat

SEQ ID NO: 98237 - DNA, 22 bp, Artificial Sequence
  chemically synthesized
ttttttctcccacaagcattat

SEQ ID NO: 98238 - DNA, 22 bp, Artificial Sequence
  chemically synthesized
tttctcccacaagcattatgtc

SEQ ID NO: 98239 - DNA, 22 bp, Artificial Sequence
  chemically synthesized
ttctcccacaagcattatgtct

SEQ ID NO: 98240 - DNA, 22 bp, Artificial Sequence
  chemically synthesized
tctcccacaagcattatgtctg

SEQ ID NO: 98241 - DNA, 22 bp, Artificial Sequence
  chemically synthesized
ctcccacaagcattatgtctgt

SEQ ID NO: 98242 - DNA, 22 bp, Artificial Sequence
  chemically synthesized
tcccacaagcattatgtctgtc

SEQ ID NO: 98243 - DNA, 22 bp, Artificial Sequence
  chemically synthesized
ccacaagcattatgtctgtctg

SEQ ID NO: 98244 - DNA, 22 bp, Artificial Sequence
  chemically synthesized
tgtctgtctgtcattgtttttc

SEQ ID NO: 98245 - DNA, 22 bp, Artificial Sequence
  chemically synthesized
tctgtcattgtttttcatcctc

SEQ ID NO: 98246 - DNA, 22 bp, Artificial Sequence
  chemically synthesized
tcattgtttttcatcctcttgt

SEQ ID NO: 98247 - DNA, 22 bp, Artificial Sequence
  chemically synthesized
tttttcatcctcttgtagtcct

SEQ ID NO: 98248 - DNA, 22 bp, Artificial Sequence
  chemically synthesized
ttcatcctcttgtagtccttca

SEQ ID NO: 98249 - DNA, 22 bp, Artificial Sequence
  chemically synthesized
tcatcctcttgtagtccttcac

SEQ ID NO: 98250 - DNA, 22 bp, Artificial Sequence
  chemically synthesized
catcctcttgtagtccttcaca

SEQ ID NO: 98251 - DNA, 22 bp, Artificial Sequence
  chemically synthesized
atcctcttgtagtccttcacag

SEQ ID NO: 98252 - DNA, 22 bp, Artificial Sequence
  chemically synthesized
ttgtagtccttcacagttaccc

SEQ ID NO: 98253 - DNA, 22 bp, Artificial Sequence
  chemically synthesized
gtagtccttcacagttacccac

SEQ ID NO: 98254 - DNA, 22 bp, Artificial Sequence
  chemically synthesized
tagtccttcacagttacccaca

SEQ ID NO: 98255 - DNA, 22 bp, Artificial Sequence
  chemically synthesized
cacagttacccacacaggtgaa

SEQ ID NO: 98256 - DNA, 22 bp, Artificial Sequence
  chemically synthesized
acagttacccacacaggtgaac

SEQ ID NO: 98257 - DNA, 22 bp, Artificial Sequence
  chemically synthesized
cccacacaggtgaaccctttta

SEQ ID NO: 98258 - DNA, 22 bp, Artificial Sequence
  chemically synthesized
ttagctctcctggaggaatgtt

SEQ ID NO: 98259 - DNA, 22 bp, Artificial Sequence
  chemically synthesized
tagctctcctggaggaatgttt

SEQ ID NO: 98260 - DNA, 22 bp, Artificial Sequence
  chemically synthesized
agctctcctggaggaatgtttc

SEQ ID NO: 98261 - DNA, 22 bp, Artificial Sequence
  chemically synthesized
gctctcctggaggaatgtttct

SEQ ID NO: 98262 - DNA, 22 bp, Artificial Sequence
  chemically synthesized
tcctggaggaatgtttctttcc

SEQ ID NO: 98263 - DNA, 22 bp, Artificial Sequence
  chemically synthesized
ctggaggaatgtttctttcctc

SEQ ID NO: 98264 - DNA, 22 bp, Artificial Sequence
  chemically synthesized
gaggaatgtttctttcctctca

SEQ ID NO: 98265 - DNA, 22 bp, Artificial Sequence
  chemically synthesized
ctttcctctcaggatcagagtt

SEQ ID NO: 98266 - DNA, 22 bp, Artificial Sequence
  chemically synthesized
tttcctctcaggatcagagttg

SEQ ID NO: 98267 - DNA, 22 bp, Artificial Sequence
  chemically synthesized
tcctctcaggatcagagttgcc

SEQ ID NO: 98268 - DNA, 22 bp, Artificial Sequence
  chemically synthesized
cctctcaggatcagagttgcct

SEQ ID NO: 98269 - DNA, 22 bp, Artificial Sequence
  chemically synthesized
ctctcaggatcagagttgccta

SEQ ID NO: 98270 - DNA, 22 bp, Artificial Sequence
  chemically synthesized
tcaggatcagagttgcctacat

SEQ ID NO: 98271 - DNA, 22 bp, Artificial Sequence
  chemically synthesized
aggatcagagttgcctacatct

SEQ ID NO: 98272 - DNA, 22 bp, Artificial Sequence
  chemically synthesized
cctacatcttcctaatgcacca

SEQ ID NO: 98273 - DNA, 22 bp, Artificial Sequence
  chemically synthesized
catcttcctaatgcaccaagac

SEQ ID NO: 98274 - DNA, 22 bp, Artificial Sequence
  chemically synthesized
cctaatgcaccaagactggcct

SEQ ID NO: 98275 - DNA, 22 bp, Artificial Sequence
  chemically synthesized
ctaatgcaccaagactggcctg

SEQ ID NO: 98276 - DNA, 22 bp, Artificial Sequence
  chemically synthesized
atgcaccaagactggcctgaga

SEQ ID NO: 98277 - DNA, 22 bp, Artificial Sequence
  chemically synthesized
gcctgagatgtatccttaagat

SEQ ID NO: 98278 - DNA, 22 bp, Artificial Sequence
  chemically synthesized
agatgtatccttaagatgagag

SEQ ID NO: 98279 - DNA, 22 bp, Artificial Sequence
  chemically synthesized
aagatgagagcttcccagtagc

SEQ ID NO: 98280 - DNA, 22 bp, Artificial Sequence
  chemically synthesized
agatgagagcttcccagtagca

SEQ ID NO: 98281 - DNA, 22 bp, Artificial Sequence
  chemically synthesized
cccagtagcaccccaagtcaga

SEQ ID NO: 98282 - DNA, 22 bp, Artificial Sequence
  chemically synthesized
ccagtagcaccccaagtcagat

SEQ ID NO: 98283 - DNA, 22 bp, Artificial Sequence
  chemically synthesized
accccgtatgtgagcatgtgtc

SEQ ID NO: 98284 - DNA, 22 bp, Artificial Sequence
  chemically synthesized
taacagcacaggccttttgcca

SEQ ID NO: 98285 - DNA, 22 bp, Artificial Sequence
  chemically synthesized
acagcacaggccttttgccacc

SEQ ID NO: 98286 - DNA, 22 bp, Artificial Sequence
  chemically synthesized
ttgccacctagctgtccagggg

SEQ ID NO: 98287 - DNA, 22 bp, Artificial Sequence
  chemically synthesized
tgccacctagctgtccaggggt

SEQ ID NO: 98288 - DNA, 22 bp, Artificial Sequence
  chemically synthesized
gccacctagctgtccaggggtg

SEQ ID NO: 98289 - DNA, 22 bp, Artificial Sequence
  chemically synthesized
ccacctagctgtccaggggtgc

SEQ ID NO: 98290 - DNA, 22 bp, Artificial Sequence
  chemically synthesized
gctgtccaggggtgccttaaaa

SEQ ID NO: 98291 - DNA, 22 bp, Artificial Sequence
  chemically synthesized
tccaggggtgccttaaaatggc

SEQ ID NO: 98292 - DNA, 22 bp, Artificial Sequence
  chemically synthesized
aaaatggcaaacaaggtttgtt

SEQ ID NO: 98293 - DNA, 22 bp, Artificial Sequence
  chemically synthesized
aaatggcaaacaaggtttgttt

SEQ ID NO: 98294 - DNA, 22 bp, Artificial Sequence
  chemically synthesized
gttttcttttcctgttttcatg

SEQ ID NO: 98295 - DNA, 22 bp, Artificial Sequence
  chemically synthesized
ttttcttttcctgttttcatgc

SEQ ID NO: 98296 - DNA, 22 bp, Artificial Sequence
  chemically synthesized
tcttttcctgttttcatgcctt

SEQ ID NO: 98297 - DNA, 22 bp, Artificial Sequence
  chemically synthesized
cttttcctgttttcatgccttc

SEQ ID NO: 98298 - DNA, 22 bp, Artificial Sequence
  chemically synthesized
ttttcctgttttcatgccttcc

SEQ ID NO: 98299 - DNA, 22 bp, Artificial Sequence
  chemically synthesized
ttcctgttttcatgccttcctc

SEQ ID NO: 98300 - DNA, 22 bp, Artificial Sequence
  chemically synthesized
tcctgttttcatgccttcctct

SEQ ID NO: 98301 - DNA, 22 bp, Artificial Sequence
  chemically synthesized
cctgttttcatgccttcctctt

SEQ ID NO: 98302 - DNA, 22 bp, Artificial Sequence
  chemically synthesized
ctgttttcatgccttcctcttc

SEQ ID NO: 98303 - DNA, 22 bp, Artificial Sequence
  chemically synthesized
ttttcatgccttcctcttccat

SEQ ID NO: 98304 - DNA, 22 bp, Artificial Sequence
  chemically synthesized
tcatgccttcctcttccatatc

SEQ ID NO: 98305 - DNA, 22 bp, Artificial Sequence
  chemically synthesized
catgccttcctcttccatatcc

SEQ ID NO: 98306 - DNA, 22 bp, Artificial Sequence
  chemically synthesized
atgccttcctcttccatatcct

SEQ ID NO: 98307 - DNA, 22 bp, Artificial Sequence
  chemically synthesized
cctcttccatatccttgtttca

SEQ ID NO: 98308 - DNA, 22 bp, Artificial Sequence
  chemically synthesized
ctcttccatatccttgtttcat

SEQ ID NO: 98309 - DNA, 22 bp, Artificial Sequence
  chemically synthesized
ttccatatccttgtttcatatt

SEQ ID NO: 98310 - DNA, 22 bp, Artificial Sequence
  chemically synthesized
ccatatccttgtttcatattaa

SEQ ID NO: 98311 - DNA, 22 bp, Artificial Sequence
  chemically synthesized
catatccttgtttcatattaat

SEQ ID NO: 98312 - DNA, 22 bp, Artificial Sequence
  chemically synthesized
gtttcatattaatacatgtgta

SEQ ID NO: 98313 - DNA, 22 bp, Artificial Sequence
  chemically synthesized
tttcatattaatacatgtgtat

SEQ ID NO: 98314 - DNA, 22 bp, Artificial Sequence
  chemically synthesized
catattaatacatgtgtataga

SEQ ID NO: 98315 - DNA, 22 bp, Artificial Sequence
  chemically synthesized
atattaatacatgtgtatagat

SEQ ID NO: 98316 - DNA, 22 bp, Artificial Sequence
  chemically synthesized
atacatgtgtatagatcctaaa

SEQ ID NO: 98317 - DNA, 22 bp, Artificial Sequence
  chemically synthesized
aaaatctatacacatgtattaa

SEQ ID NO: 98318 - DNA, 22 bp, Artificial Sequence
  chemically synthesized
tacacatgtattaataaagcct

SEQ ID NO: 98319 - DNA, 22 bp, Artificial Sequence
  chemically synthesized
ataaagcctgattctgccgctt

SEQ ID NO: 98320 - DNA, 22 bp, Artificial Sequence
  chemically synthesized
attctgccgcttctaggtatag

SEQ ID NO: 98321 - DNA, 22 bp, Artificial Sequence
  chemically synthesized
tgccgcttctaggtatagaggc

SEQ ID NO: 98322 - DNA, 22 bp, Artificial Sequence
  chemically synthesized
ccgcttctaggtatagaggcca

SEQ ID NO: 98323 - DNA, 22 bp, Artificial Sequence
  chemically synthesized
ctaggtatagaggccacctgca

SEQ ID NO: 98324 - DNA, 22 bp, Artificial Sequence
  chemically synthesized
taggtatagaggccacctgcaa

SEQ ID NO: 98325 - DNA, 22 bp, Artificial Sequence
  chemically synthesized
ggtatagaggccacctgcaaga

SEQ ID NO: 98326 - DNA, 22 bp, Artificial Sequence
  chemically synthesized
caagataaatatttgattcaca

SEQ ID NO: 98327 - DNA, 22 bp, Artificial Sequence
  chemically synthesized
gattcacaataactaatcattc

SEQ ID NO: 98328 - DNA, 22 bp, Artificial Sequence
  chemically synthesized
attcacaataactaatcattct

SEQ ID NO: 98329 - DNA, 22 bp, Artificial Sequence
  chemically synthesized
acaataactaatcattctatgg

SEQ ID NO: 98330 - DNA, 22 bp, Artificial Sequence
  chemically synthesized
atcattctatggcaattgataa

SEQ ID NO: 98331 - DNA, 22 bp, Artificial Sequence
  chemically synthesized
tatggcaattgataacaacaaa

SEQ ID NO: 98332 - DNA, 22 bp, Artificial Sequence
  chemically synthesized
tggcaattgataacaacaaata

SEQ ID NO: 98333 - DNA, 22 bp, Artificial Sequence
  chemically synthesized
ataacaacaaatatatatatat

SEQ ID NO: 98334 - DNA, 22 bp, Artificial Sequence
  chemically synthesized
aggaaataatatattctagaat

SEQ ID NO: 98335 - DNA, 22 bp, Artificial Sequence
  chemically synthesized
tagaatatgtcacattctgtct

SEQ ID NO: 98336 - DNA, 22 bp, Artificial Sequence
  chemically synthesized
gaatatgtcacattctgtctca

SEQ ID NO: 98337 - DNA, 22 bp, Artificial Sequence
  chemically synthesized
tgtctcaggcatccattttctt

SEQ ID NO: 98338 - DNA, 22 bp, Artificial Sequence
  chemically synthesized
tctcaggcatccattttcttta

SEQ ID NO: 98339 - DNA, 22 bp, Artificial Sequence
  chemically synthesized
aggcatccattttctttatgat

SEQ ID NO: 98340 - DNA, 22 bp, Artificial Sequence
  chemically synthesized
tctttatgatgccgtttgaggt

SEQ ID NO: 98341 - DNA, 22 bp, Artificial Sequence
  chemically synthesized
ctttatgatgccgtttgaggtg

SEQ ID NO: 98342 - DNA, 22 bp, Artificial Sequence
  chemically synthesized
tttatgatgccgtttgaggtgg

SEQ ID NO: 98343 - DNA, 22 bp, Artificial Sequence
  chemically synthesized
tatgatgccgtttgaggtggag

SEQ ID NO: 98344 - DNA, 22 bp, Artificial Sequence
  chemically synthesized
atgatgccgtttgaggtggagt

SEQ ID NO: 98345 - DNA, 22 bp, Artificial Sequence
  chemically synthesized
tgatgccgtttgaggtggagtt

SEQ ID NO: 98346 - DNA, 22 bp, Artificial Sequence
  chemically synthesized
gaggtggagttttagtcaggtg

SEQ ID NO: 98347 - DNA, 22 bp, Artificial Sequence
  chemically synthesized
aggtggagttttagtcaggtgg

SEQ ID NO: 98348 - DNA, 22 bp, Artificial Sequence
  chemically synthesized
tagtcaggtggtcagcttctcc

SEQ ID NO: 98349 - DNA, 22 bp, Artificial Sequence
  chemically synthesized
agtcaggtggtcagcttctcct

SEQ ID NO: 98350 - DNA, 22 bp, Artificial Sequence
  chemically synthesized
gtcaggtggtcagcttctcctt

SEQ ID NO: 98351 - DNA, 22 bp, Artificial Sequence
  chemically synthesized
ctccttttttttgccatctgcc

SEQ ID NO: 98352 - DNA, 22 bp, Artificial Sequence
  chemically synthesized
tccttttttttgccatctgccc

SEQ ID NO: 98353 - DNA, 22 bp, Artificial Sequence
  chemically synthesized
cttttttttgccatctgccctg

SEQ ID NO: 98354 - DNA, 22 bp, Artificial Sequence
  chemically synthesized
ttttttgccatctgccctgtaa

SEQ ID NO: 98355 - DNA, 22 bp, Artificial Sequence
  chemically synthesized
tttttgccatctgccctgtaag

SEQ ID NO: 98356 - DNA, 22 bp, Artificial Sequence
  chemically synthesized
ttttgccatctgccctgtaagc

SEQ ID NO: 98357 - DNA, 22 bp, Artificial Sequence
  chemically synthesized
tttgccatctgccctgtaagca

SEQ ID NO: 98358 - DNA, 22 bp, Artificial Sequence
  chemically synthesized
ttgccatctgccctgtaagcat

SEQ ID NO: 98359 - DNA, 22 bp, Artificial Sequence
  chemically synthesized
tgccatctgccctgtaagcatc

SEQ ID NO: 98360 - DNA, 22 bp, Artificial Sequence
  chemically synthesized
gccatctgccctgtaagcatcc

SEQ ID NO: 98361 - DNA, 22 bp, Artificial Sequence
  chemically synthesized
ccatctgccctgtaagcatcct

SEQ ID NO: 98362 - DNA, 22 bp, Artificial Sequence
  chemically synthesized
ccctgtaagcatcctgctgggg

SEQ ID NO: 98363 - DNA, 22 bp, Artificial Sequence
  chemically synthesized
taagcatcctgctggggaccca

SEQ ID NO: 98364 - DNA, 22 bp, Artificial Sequence
  chemically synthesized
ctggggacccagataggagtca

SEQ ID NO: 98365 - DNA, 22 bp, Artificial Sequence
  chemically synthesized
gggacccagataggagtcatca

SEQ ID NO: 98366 - DNA, 22 bp, Artificial Sequence
  chemically synthesized
taggctgagaacatctgggcac

SEQ ID NO: 98367 - DNA, 22 bp, Artificial Sequence
  chemically synthesized
ggctgagaacatctgggcacac

SEQ ID NO: 98368 - DNA, 22 bp, Artificial Sequence
  chemically synthesized
agaacatctgggcacacaccct

SEQ ID NO: 98369 - DNA, 22 bp, Artificial Sequence
  chemically synthesized
ggcacacaccctaagcctcagc

SEQ ID NO: 98370 - DNA, 22 bp, Artificial Sequence
  chemically synthesized
agcctcagcatgactcatcatg

SEQ ID NO: 98371 - DNA, 22 bp, Artificial Sequence
  chemically synthesized
agcatgactcatcatgactcag

SEQ ID NO: 98372 - DNA, 22 bp, Artificial Sequence
  chemically synthesized
atcatgactcagcattgctgtg

SEQ ID NO: 98373 - DNA, 22 bp, Artificial Sequence
  chemically synthesized
agcattgctgtgcttgagccag

SEQ ID NO: 98374 - DNA, 22 bp, Artificial Sequence
  chemically synthesized
ctgtgcttgagccagaaggttt

SEQ ID NO: 98375 - DNA, 22 bp, Artificial Sequence
  chemically synthesized
tgcttgagccagaaggtttgct

SEQ ID NO: 98376 - DNA, 22 bp, Artificial Sequence
  chemically synthesized
gagccagaaggtttgcttagaa

SEQ ID NO: 98377 - DNA, 22 bp, Artificial Sequence
  chemically synthesized
agccagaaggtttgcttagaag

SEQ ID NO: 98378 - DNA, 22 bp, Artificial Sequence
  chemically synthesized
gcttagaaggttacacagaacc

SEQ ID NO: 98379 - DNA, 22 bp, Artificial Sequence
  chemically synthesized
cttagaaggttacacagaacca

SEQ ID NO: 98380 - DNA, 22 bp, Artificial Sequence
  chemically synthesized
agaaggttacacagaaccagaa

SEQ ID NO: 98381 - DNA, 22 bp, Artificial Sequence
  chemically synthesized
gaaggttacacagaaccagaag

SEQ ID NO: 98382 - DNA, 22 bp, Artificial Sequence
  chemically synthesized
cacagaaccagaaggcgggggt

SEQ ID NO: 98383 - DNA, 22 bp, Artificial Sequence
  chemically synthesized
accccgacaggggcctggccag

SEQ ID NO: 98384 - DNA, 22 bp, Artificial Sequence
  chemically synthesized
gccagaactgctcatgcttgga

SEQ ID NO: 98385 - DNA, 22 bp, Artificial Sequence
  chemically synthesized
ctcatgcttggactatgggagg

SEQ ID NO: 98386 - DNA, 22 bp, Artificial Sequence
  chemically synthesized
atgcttggactatgggaggtca

SEQ ID NO: 98387 - DNA, 22 bp, Artificial Sequence
  chemically synthesized
ggactatgggaggtcactaatg

SEQ ID NO: 98388 - DNA, 22 bp, Artificial Sequence
  chemically synthesized
gactatgggaggtcactaatgg

SEQ ID NO: 98389 - DNA, 22 bp, Artificial Sequence
  chemically synthesized
tgggaggtcactaatggagaca

SEQ ID NO: 98390 - DNA, 22 bp, Artificial Sequence
  chemically synthesized
atggagacacacagaaatgtaa

SEQ ID NO: 98391 - DNA, 22 bp, Artificial Sequence
  chemically synthesized
aggaaaaactgaagcttattta

SEQ ID NO: 98392 - DNA, 22 bp, Artificial Sequence
  chemically synthesized
aagcttatttaatcagagatga

SEQ ID NO: 98393 - DNA, 22 bp, Artificial Sequence
  chemically synthesized
atttaatcagagatgaggatgc

SEQ ID NO: 98394 - DNA, 22 bp, Artificial Sequence
  chemically synthesized
tttaatcagagatgaggatgct

SEQ ID NO: 98395 - DNA, 22 bp, Artificial Sequence
  chemically synthesized
aatcagagatgaggatgctgga

SEQ ID NO: 98396 - DNA, 22 bp, Artificial Sequence
  chemically synthesized
atcagagatgaggatgctggaa

SEQ ID NO: 98397 - DNA, 22 bp, Artificial Sequence
  chemically synthesized
gaagggatagagggagctgagc

SEQ ID NO: 98398 - DNA, 22 bp, Artificial Sequence
  chemically synthesized
agcttgtaaaaagtatagtaat

SEQ ID NO: 98399 - DNA, 22 bp, Artificial Sequence
  chemically synthesized
gtaaaaagtatagtaatcattc

SEQ ID NO: 98400 - DNA, 22 bp, Artificial Sequence
  chemically synthesized
taaaaagtatagtaatcattca

SEQ ID NO: 98401 - DNA, 22 bp, Artificial Sequence
  chemically synthesized
agcaaatggttttgaagcacct

SEQ ID NO: 98402 - DNA, 22 bp, Artificial Sequence
  chemically synthesized
tgaagcacctgctggatgctaa

SEQ ID NO: 98403 - DNA, 22 bp, Artificial Sequence
  chemically synthesized
gaagcacctgctggatgctaaa

SEQ ID NO: 98404 - DNA, 22 bp, Artificial Sequence
  chemically synthesized
aagcacctgctggatgctaaac

SEQ ID NO: 98405 - DNA, 22 bp, Artificial Sequence
  chemically synthesized
ctggatgctaaacactattttc

SEQ ID NO: 98406 - DNA, 22 bp, Artificial Sequence
  chemically synthesized
gatgctaaacactattttcagt

SEQ ID NO: 98407 - DNA, 22 bp, Artificial Sequence
  chemically synthesized
aacactattttcagtgcttgaa

SEQ ID NO: 98408 - DNA, 22 bp, Artificial Sequence
  chemically synthesized
ttttcagtgcttgaatcataaa

SEQ ID NO: 98409 - DNA, 22 bp, Artificial Sequence
  chemically synthesized
tcagtgcttgaatcataaataa

SEQ ID NO: 98410 - DNA, 22 bp, Artificial Sequence
  chemically synthesized
cagtgcttgaatcataaataag

SEQ ID NO: 98411 - DNA, 22 bp, Artificial Sequence
  chemically synthesized
agtgcttgaatcataaataaga

SEQ ID NO: 98412 - DNA, 22 bp, Artificial Sequence
  chemically synthesized
gaatcataaataagaataaaac

SEQ ID NO: 98413 - DNA, 22 bp, Artificial Sequence
  chemically synthesized
aatcataaataagaataaaaca

SEQ ID NO: 98414 - DNA, 22 bp, Artificial Sequence
  chemically synthesized
attccccacaagagtccaagta

SEQ ID NO: 98415 - DNA, 22 bp, Artificial Sequence
  chemically synthesized
ttccccacaagagtccaagtaa

SEQ ID NO: 98416 - DNA, 22 bp, Artificial Sequence
  chemically synthesized
cccacaagagtccaagtaaaaa

SEQ ID NO: 98417 - DNA, 22 bp, Artificial Sequence
  chemically synthesized
attataatgtgctctgtccccc

SEQ ID NO: 98418 - DNA, 22 bp, Artificial Sequence
  chemically synthesized
taatgtgctctgtcccccaggc

SEQ ID NO: 98419 - DNA, 22 bp, Artificial Sequence
  chemically synthesized
tgtcccccaggctggagtgcag

SEQ ID NO: 98420 - DNA, 22 bp, Artificial Sequence
  chemically synthesized
tcccccaggctggagtgcagtg

SEQ ID NO: 98421 - DNA, 22 bp, Artificial Sequence
  chemically synthesized
gagtgcagtggcacgatctcag

SEQ ID NO: 98422 - DNA, 22 bp, Artificial Sequence
  chemically synthesized
agctcactgcaacctccgcctc

SEQ ID NO: 98423 - DNA, 22 bp, Artificial Sequence
  chemically synthesized
actgcaacctccgcctcccggg

SEQ ID NO: 98424 - DNA, 22 bp, Artificial Sequence
  chemically synthesized
caacctccgcctcccgggttca

SEQ ID NO: 98425 - DNA, 22 bp, Artificial Sequence
  chemically synthesized
cgcctcccgggttcaagcaatt

SEQ ID NO: 98426 - DNA, 22 bp, Artificial Sequence
  chemically synthesized
ccgggttcaagcaattctcctg

SEQ ID NO: 98427 - DNA, 22 bp, Artificial Sequence
  chemically synthesized
aagcaattctcctgcctcagcc

SEQ ID NO: 98428 - DNA, 22 bp, Artificial Sequence
  chemically synthesized
tcctgcctcagccaccctaata

SEQ ID NO: 98429 - DNA, 22 bp, Artificial Sequence
  chemically synthesized
ctgcctcagccaccctaatagc

SEQ ID NO: 98430 - DNA, 22 bp, Artificial Sequence
  chemically synthesized
cctcagccaccctaatagctgg

SEQ ID NO: 98431 - DNA, 22 bp, Artificial Sequence
  chemically synthesized
agccaccctaatagctgggatt

SEQ ID NO: 98432 - DNA, 22 bp, Artificial Sequence
  chemically synthesized
atagctgggattacaggtgcac

SEQ ID NO: 98433 - DNA, 22 bp, Artificial Sequence
  chemically synthesized
ggattacaggtgcacaccacca

SEQ ID NO: 98434 - DNA, 22 bp, Artificial Sequence
  chemically synthesized
caggtgcacaccaccatgccag

SEQ ID NO: 98435 - DNA, 22 bp, Artificial Sequence
  chemically synthesized
atttttgtactttttgtagagg

SEQ ID NO: 98436 - DNA, 22 bp, Artificial Sequence
  chemically synthesized
ttgtactttttgtagaggcagg

SEQ ID NO: 98437 - DNA, 22 bp, Artificial Sequence
  chemically synthesized
tgtactttttgtagaggcaggg

SEQ ID NO: 98438 - DNA, 22 bp, Artificial Sequence
  chemically synthesized
gtactttttgtagaggcagggt

SEQ ID NO: 98439 - DNA, 22 bp, Artificial Sequence
  chemically synthesized
tactttttgtagaggcagggta

SEQ ID NO: 98440 - DNA, 22 bp, Artificial Sequence
  chemically synthesized
tttgtagaggcagggtatcacc

SEQ ID NO: 98441 - DNA, 22 bp, Artificial Sequence
  chemically synthesized
ttgtagaggcagggtatcacca

SEQ ID NO: 98442 - DNA, 22 bp, Artificial Sequence
  chemically synthesized
tgtagaggcagggtatcaccat

SEQ ID NO: 98443 - DNA, 22 bp, Artificial Sequence
  chemically synthesized
gtagaggcagggtatcaccatg

SEQ ID NO: 98444 - DNA, 22 bp, Artificial Sequence
  chemically synthesized
tagaggcagggtatcaccatgt

SEQ ID NO: 98445 - DNA, 22 bp, Artificial Sequence
  chemically synthesized
tccaagatggtcttgaactcct

SEQ ID NO: 98446 - DNA, 22 bp, Artificial Sequence
  chemically synthesized
gaactcctgagctccaagcagt

SEQ ID NO: 98447 - DNA, 22 bp, Artificial Sequence
  chemically synthesized
aactcctgagctccaagcagtc

SEQ ID NO: 98448 - DNA, 22 bp, Artificial Sequence
  chemically synthesized
ctgagctccaagcagtccaccc

SEQ ID NO: 98449 - DNA, 22 bp, Artificial Sequence
  chemically synthesized
agctccaagcagtccacccacc

SEQ ID NO: 98450 - DNA, 22 bp, Artificial Sequence
  chemically synthesized
caagcagtccacccacctcagc

SEQ ID NO: 98451 - DNA, 22 bp, Artificial Sequence
  chemically synthesized
agcctcccaaagtgctgggatt

SEQ ID NO: 98452 - DNA, 22 bp, Artificial Sequence
  chemically synthesized
ccaaagtgctgggattacaggt

SEQ ID NO: 98453 - DNA, 22 bp, Artificial Sequence
  chemically synthesized
ggattacaggtgtgagacacca

SEQ ID NO: 98454 - DNA, 22 bp, Artificial Sequence
  chemically synthesized
caggtgtgagacaccatgccca

SEQ ID NO: 98455 - DNA, 22 bp, Artificial Sequence
  chemically synthesized
tccatatttaatagaggtattt

SEQ ID NO: 98456 - DNA, 22 bp, Artificial Sequence
  chemically synthesized
ccatatttaatagaggtattta

SEQ ID NO: 98457 - DNA, 22 bp, Artificial Sequence
  chemically synthesized
catatttaatagaggtatttat

SEQ ID NO: 98458 - DNA, 22 bp, Artificial Sequence
  chemically synthesized
aatagaggtatttatgggatgg

SEQ ID NO: 98459 - DNA, 22 bp, Artificial Sequence
  chemically synthesized
atagaggtatttatgggatggg

SEQ ID NO: 98460 - DNA, 22 bp, Artificial Sequence
  chemically synthesized
atgggatgggggaaaagaatgt

SEQ ID NO: 98461 - DNA, 22 bp, Artificial Sequence
  chemically synthesized
tgggatgggggaaaagaatgtt

SEQ ID NO: 98462 - DNA, 22 bp, Artificial Sequence
  chemically synthesized
ctctcactgtggattattttag

SEQ ID NO: 98463 - DNA, 22 bp, Artificial Sequence
  chemically synthesized
tctcactgtggattattttaga

SEQ ID NO: 98464 - DNA, 22 bp, Artificial Sequence
  chemically synthesized
tcactgtggattattttagaga

SEQ ID NO: 98465 - DNA, 22 bp, Artificial Sequence
  chemically synthesized
actgtggattattttagagagt

SEQ ID NO: 98466 - DNA, 22 bp, Artificial Sequence
  chemically synthesized
tggattattttagagagtggag

SEQ ID NO: 98467 - DNA, 22 bp, Artificial Sequence
  chemically synthesized
ttttagagagtggagaatggtc

SEQ ID NO: 98468 - DNA, 22 bp, Artificial Sequence
  chemically synthesized
tagagagtggagaatggtcaag

SEQ ID NO: 98469 - DNA, 22 bp, Artificial Sequence
  chemically synthesized
agagagtggagaatggtcaaga

SEQ ID NO: 98470 - DNA, 22 bp, Artificial Sequence
  chemically synthesized
gagagtggagaatggtcaagat

SEQ ID NO: 98471 - DNA, 22 bp, Artificial Sequence
  chemically synthesized
ttttaaaaattaagaaaacata

SEQ ID NO: 98472 - DNA, 22 bp, Artificial Sequence
  chemically synthesized
tttaaaaattaagaaaacataa

SEQ ID NO: 98473 - DNA, 22 bp, Artificial Sequence
  chemically synthesized
ttaaaaattaagaaaacataag

SEQ ID NO: 98474 - DNA, 22 bp, Artificial Sequence
  chemically synthesized
taaaaattaagaaaacataagt

SEQ ID NO: 98475 - DNA, 22 bp, Artificial Sequence
  chemically synthesized
aaaaattaagaaaacataagtt

SEQ ID NO: 98476 - DNA, 22 bp, Artificial Sequence
  chemically synthesized
aaaattaagaaaacataagttg

SEQ ID NO: 98477 - DNA, 22 bp, Artificial Sequence
  chemically synthesized
agaaaacataagttggaccttg

SEQ ID NO: 98478 - DNA, 22 bp, Artificial Sequence
  chemically synthesized
gaccttgagaaatgaaaattta

SEQ ID NO: 98479 - DNA, 22 bp, Artificial Sequence
  chemically synthesized
gagaaatgaaaatttatttttt

SEQ ID NO: 98480 - DNA, 22 bp, Artificial Sequence
  chemically synthesized
agaaatgaaaatttattttttt

SEQ ID NO: 98481 - DNA, 22 bp, Artificial Sequence
  chemically synthesized
atttttttgttggaggataccc

SEQ ID NO: 98482 - DNA, 22 bp, Artificial Sequence
  chemically synthesized
tttttttgttggaggataccca

SEQ ID NO: 98483 - DNA, 22 bp, Artificial Sequence
  chemically synthesized
ttttgttggaggatacccattc

SEQ ID NO: 98484 - DNA, 22 bp, Artificial Sequence
  chemically synthesized
tttgttggaggatacccattct

SEQ ID NO: 98485 - DNA, 22 bp, Artificial Sequence
  chemically synthesized
ttgttggaggatacccattctc

SEQ ID NO: 98486 - DNA, 22 bp, Artificial Sequence
  chemically synthesized
tgttggaggatacccattctct

SEQ ID NO: 98487 - DNA, 22 bp, Artificial Sequence
  chemically synthesized
gttggaggatacccattctcta

SEQ ID NO: 98488 - DNA, 22 bp, Artificial Sequence
  chemically synthesized
ttggaggatacccattctctat

SEQ ID NO: 98489 - DNA, 22 bp, Artificial Sequence
  chemically synthesized
gaggatacccattctctatctc

SEQ ID NO: 98490 - DNA, 22 bp, Artificial Sequence
  chemically synthesized
tctatctcccatcagggcaagc

SEQ ID NO: 98491 - DNA, 22 bp, Artificial Sequence
  chemically synthesized
tatctcccatcagggcaagctg

SEQ ID NO: 98492 - DNA, 22 bp, Artificial Sequence
  chemically synthesized
tctcccatcagggcaagctgta

SEQ ID NO: 98493 - DNA, 22 bp, Artificial Sequence
  chemically synthesized
ccatcagggcaagctgtaagga

SEQ ID NO: 98494 - DNA, 22 bp, Artificial Sequence
  chemically synthesized
taaggaactggctaagacacag

SEQ ID NO: 98495 - DNA, 22 bp, Artificial Sequence
  chemically synthesized
gctaagacacagtgagacagag

SEQ ID NO: 98496 - DNA, 22 bp, Artificial Sequence
  chemically synthesized
agacacagtgagacagagtgac

SEQ ID NO: 98497 - DNA, 22 bp, Artificial Sequence
  chemically synthesized
agtcttagaggccccactggta

SEQ ID NO: 98498 - DNA, 22 bp, Artificial Sequence
  chemically synthesized
gtcttagaggccccactggtac

SEQ ID NO: 98499 - DNA, 22 bp, Artificial Sequence
  chemically synthesized
agaggccccactggtacccaga

SEQ ID NO: 98500 - DNA, 22 bp, Artificial Sequence
  chemically synthesized
gaggccccactggtacccagat

SEQ ID NO: 98501 - DNA, 22 bp, Artificial Sequence
  chemically synthesized
gtacccagatgagaaggcacct

SEQ ID NO: 98502 - DNA, 22 bp, Artificial Sequence
  chemically synthesized
catcactcatcacagtcagctc

SEQ ID NO: 98503 - DNA, 22 bp, Artificial Sequence
  chemically synthesized
atcactcatcacagtcagctct

SEQ ID NO: 98504 - DNA, 22 bp, Artificial Sequence
  chemically synthesized
atcacagtcagctctgcctttc

SEQ ID NO: 98505 - DNA, 22 bp, Artificial Sequence
  chemically synthesized
tgcctttctcctctctcctttc

SEQ ID NO: 98506 - DNA, 22 bp, Artificial Sequence
  chemically synthesized
cctttctcctctctcctttctc

SEQ ID NO: 98507 - DNA, 22 bp, Artificial Sequence
  chemically synthesized
tctcctctctcctttctcatca

SEQ ID NO: 98508 - DNA, 22 bp, Artificial Sequence
  chemically synthesized
ctcctctctcctttctcatcag

SEQ ID NO: 98509 - DNA, 22 bp, Artificial Sequence
  chemically synthesized
tcctctctcctttctcatcaga

SEQ ID NO: 98510 - DNA, 22 bp, Artificial Sequence
  chemically synthesized
ctctctcctttctcatcagaaa

SEQ ID NO: 98511 - DNA, 22 bp, Artificial Sequence
  chemically synthesized
tctcctttctcatcagaaattt

SEQ ID NO: 98512 - DNA, 22 bp, Artificial Sequence
  chemically synthesized
tcctttctcatcagaaatttca

SEQ ID NO: 98513 - DNA, 22 bp, Artificial Sequence
  chemically synthesized
ctttctcatcagaaatttcata

SEQ ID NO: 98514 - DNA, 22 bp, Artificial Sequence
  chemically synthesized
tctcatcagaaatttcataagt

SEQ ID NO: 98515 - DNA, 22 bp, Artificial Sequence
  chemically synthesized
ctcatcagaaatttcataagtc

SEQ ID NO: 98516 - DNA, 22 bp, Artificial Sequence
  chemically synthesized
tcatcagaaatttcataagtct

SEQ ID NO: 98517 - DNA, 22 bp, Artificial Sequence
  chemically synthesized
atcagaaatttcataagtctac

SEQ ID NO: 98518 - DNA, 22 bp, Artificial Sequence
  chemically synthesized
cataagtctactagggtcaggc

SEQ ID NO: 98519 - DNA, 22 bp, Artificial Sequence
  chemically synthesized
ataagtctactagggtcaggca

SEQ ID NO: 98520 - DNA, 22 bp, Artificial Sequence
  chemically synthesized
ctagggtcaggcagatcacata

SEQ ID NO: 98521 - DNA, 22 bp, Artificial Sequence
  chemically synthesized
gggtcaggcagatcacataaga

SEQ ID NO: 98522 - DNA, 22 bp, Artificial Sequence
  chemically synthesized
aggtctgcagtgagtatgagcc

SEQ ID NO: 98523 - DNA, 22 bp, Artificial Sequence
  chemically synthesized
cagtgagtatgagcccatccct

SEQ ID NO: 98524 - DNA, 22 bp, Artificial Sequence
  chemically synthesized
atgaattaaggcaatcaacact

SEQ ID NO: 98525 - DNA, 22 bp, Artificial Sequence
  chemically synthesized
aggcaatcaacactttaggcag

SEQ ID NO: 98526 - DNA, 22 bp, Artificial Sequence
  chemically synthesized
taggcagccatgttgccatgag

SEQ ID NO: 98527 - DNA, 22 bp, Artificial Sequence
  chemically synthesized
aggcagccatgttgccatgaga

SEQ ID NO: 98528 - DNA, 22 bp, Artificial Sequence
  chemically synthesized
ggcagccatgttgccatgagag

SEQ ID NO: 98529 - DNA, 22 bp, Artificial Sequence
  chemically synthesized
ccatgagagattaggaggggcc

SEQ ID NO: 98530 - DNA, 22 bp, Artificial Sequence
  chemically synthesized
ggaggggccaaatgagcccaga

SEQ ID NO: 98531 - DNA, 22 bp, Artificial Sequence
  chemically synthesized
cttcttagatgatcttgagcaa

SEQ ID NO: 98532 - DNA, 22 bp, Artificial Sequence
  chemically synthesized
cttagatgatcttgagcaagtt

SEQ ID NO: 98533 - DNA, 22 bp, Artificial Sequence
  chemically synthesized
ttagatgatcttgagcaagttg

SEQ ID NO: 98534 - DNA, 22 bp, Artificial Sequence
  chemically synthesized
agatgatcttgagcaagttgct

SEQ ID NO: 98535 - DNA, 22 bp, Artificial Sequence
  chemically synthesized
gatgatcttgagcaagttgctt

SEQ ID NO: 98536 - DNA, 22 bp, Artificial Sequence
  chemically synthesized
gagcaagttgcttaacttcttg

SEQ ID NO: 98537 - DNA, 22 bp, Artificial Sequence
  chemically synthesized
agcaagttgcttaacttcttga

SEQ ID NO: 98538 - DNA, 22 bp, Artificial Sequence
  chemically synthesized
cttaacttcttgaagtctctga

SEQ ID NO: 98539 - DNA, 22 bp, Artificial Sequence
  chemically synthesized
aacttcttgaagtctctgaaat

SEQ ID NO: 98540 - DNA, 22 bp, Artificial Sequence
  chemically synthesized
acttcttgaagtctctgaaata

SEQ ID NO: 98541 - DNA, 22 bp, Artificial Sequence
  chemically synthesized
cttgaagtctctgaaatatagg

SEQ ID NO: 98542 - DNA, 22 bp, Artificial Sequence
  chemically synthesized
ttgaagtctctgaaatatagga

SEQ ID NO: 98543 - DNA, 22 bp, Artificial Sequence
  chemically synthesized
gaagtctctgaaatataggatg

SEQ ID NO: 98544 - DNA, 22 bp, Artificial Sequence
  chemically synthesized
aagtctctgaaatataggatga

SEQ ID NO: 98545 - DNA, 22 bp, Artificial Sequence
  chemically synthesized
tgaaatataggatgataatatg

SEQ ID NO: 98546 - DNA, 22 bp, Artificial Sequence
  chemically synthesized
aaatataggatgataatatgta

SEQ ID NO: 98547 - DNA, 22 bp, Artificial Sequence
  chemically synthesized
gctaatagaattatgaggatga

SEQ ID NO: 98548 - DNA, 22 bp, Artificial Sequence
  chemically synthesized
atagaattatgaggatgagatt

SEQ ID NO: 98549 - DNA, 22 bp, Artificial Sequence
  chemically synthesized
tgaggatgagattagtttattg

SEQ ID NO: 98550 - DNA, 22 bp, Artificial Sequence
  chemically synthesized
gtttattgtgtaaagaactagg

SEQ ID NO: 98551 - DNA, 22 bp, Artificial Sequence
  chemically synthesized
attgtgtaaagaactagggaca

SEQ ID NO: 98552 - DNA, 22 bp, Artificial Sequence
  chemically synthesized
ttgtgtaaagaactagggacac

SEQ ID NO: 98553 - DNA, 22 bp, Artificial Sequence
  chemically synthesized
tgtaaagaactagggacacagt

SEQ ID NO: 98554 - DNA, 22 bp, Artificial Sequence
  chemically synthesized
gggacacagtatatattcagta

SEQ ID NO: 98555 - DNA, 22 bp, Artificial Sequence
  chemically synthesized
agtaagtgttttctgttacagt

SEQ ID NO: 98556 - DNA, 22 bp, Artificial Sequence
  chemically synthesized
tctgttacagtattatgataaa

SEQ ID NO: 98557 - DNA, 22 bp, Artificial Sequence
  chemically synthesized
ctgttacagtattatgataaat

SEQ ID NO: 98558 - DNA, 22 bp, Artificial Sequence
  chemically synthesized
tgttacagtattatgataaata

SEQ ID NO: 98559 - DNA, 22 bp, Artificial Sequence
  chemically synthesized
ttacagtattatgataaatata

SEQ ID NO: 98560 - DNA, 22 bp, Artificial Sequence
  chemically synthesized
cagtattatgataaatatatac

SEQ ID NO: 98561 - DNA, 22 bp, Artificial Sequence
  chemically synthesized
tgataaatatatacatgcaact

SEQ ID NO: 98562 - DNA, 22 bp, Artificial Sequence
  chemically synthesized
ttacagttgcatgctaccttaa

SEQ ID NO: 98563 - DNA, 22 bp, Artificial Sequence
  chemically synthesized
cagttgcatgctaccttaaaga

SEQ ID NO: 98564 - DNA, 22 bp, Artificial Sequence
  chemically synthesized
catgctaccttaaagaataatt

SEQ ID NO: 98565 - DNA, 22 bp, Artificial Sequence
  chemically synthesized
ccttaaagaataattggaggta

SEQ ID NO: 98566 - DNA, 22 bp, Artificial Sequence
  chemically synthesized
aaagaataattggaggtacagt

SEQ ID NO: 98567 - DNA, 22 bp, Artificial Sequence
  chemically synthesized
aagaataattggaggtacagtt

SEQ ID NO: 98568 - DNA, 22 bp, Artificial Sequence
  chemically synthesized
gaggtacagttattcggaggta

SEQ ID NO: 98569 - DNA, 22 bp, Artificial Sequence
  chemically synthesized
ttcggaggtatttcttgactgt

SEQ ID NO: 98570 - DNA, 22 bp, Artificial Sequence
  chemically synthesized
ggaggtatttcttgactgttaa

SEQ ID NO: 98571 - DNA, 22 bp, Artificial Sequence
  chemically synthesized
cttgactgttaatgttggcagc

SEQ ID NO: 98572 - DNA, 22 bp, Artificial Sequence
  chemically synthesized
ttgactgttaatgttggcagca

SEQ ID NO: 98573 - DNA, 22 bp, Artificial Sequence
  chemically synthesized
gactgttaatgttggcagcaga

SEQ ID NO: 98574 - DNA, 22 bp, Artificial Sequence
  chemically synthesized
actgttaatgttggcagcagat

SEQ ID NO: 98575 - DNA, 22 bp, Artificial Sequence
  chemically synthesized
ttaatgttggcagcagattcag

SEQ ID NO: 98576 - DNA, 22 bp, Artificial Sequence
  chemically synthesized
atgttggcagcagattcagctt

SEQ ID NO: 98577 - DNA, 22 bp, Artificial Sequence
  chemically synthesized
gcagcagattcagcttatttta

SEQ ID NO: 98578 - DNA, 22 bp, Artificial Sequence
  chemically synthesized
agcttattttacaacactattc

SEQ ID NO: 98579 - DNA, 22 bp, Artificial Sequence
  chemically synthesized
attttacaacactattcagacc

SEQ ID NO: 98580 - DNA, 22 bp, Artificial Sequence
  chemically synthesized
ttttacaacactattcagacct

SEQ ID NO: 98581 - DNA, 22 bp, Artificial Sequence
  chemically synthesized
tacaacactattcagacctctc

SEQ ID NO: 98582 - DNA, 22 bp, Artificial Sequence
  chemically synthesized
acaacactattcagacctctca

SEQ ID NO: 98583 - DNA, 22 bp, Artificial Sequence
  chemically synthesized
caacactattcagacctctcac

SEQ ID NO: 98584 - DNA, 22 bp, Artificial Sequence
  chemically synthesized
ttcagacctctcacaataattc

SEQ ID NO: 98585 - DNA, 22 bp, Artificial Sequence
  chemically synthesized
agacctctcacaataattccct

SEQ ID NO: 98586 - DNA, 22 bp, Artificial Sequence
  chemically synthesized
tcacaataattccctaggagat

SEQ ID NO: 98587 - DNA, 22 bp, Artificial Sequence
  chemically synthesized
acaataattccctaggagatat

SEQ ID NO: 98588 - DNA, 22 bp, Artificial Sequence
  chemically synthesized
cctaggagatatttagacaaca

SEQ ID NO: 98589 - DNA, 22 bp, Artificial Sequence
  chemically synthesized
ggagatatttagacaacaagcc

SEQ ID NO: 98590 - DNA, 22 bp, Artificial Sequence
  chemically synthesized
agacaacaagccatcatgttgt

SEQ ID NO: 98591 - DNA, 22 bp, Artificial Sequence
  chemically synthesized
gacaacaagccatcatgttgta

SEQ ID NO: 98592 - DNA, 22 bp, Artificial Sequence
  chemically synthesized
taacttctcatttgtcttttct

SEQ ID NO: 98593 - DNA, 22 bp, Artificial Sequence
  chemically synthesized
ctcatttgtcttttctcactta

SEQ ID NO: 98594 - DNA, 22 bp, Artificial Sequence
  chemically synthesized
tcatttgtcttttctcacttac

SEQ ID NO: 98595 - DNA, 22 bp, Artificial Sequence
  chemically synthesized
atttgtcttttctcacttaccc

SEQ ID NO: 98596 - DNA, 22 bp, Artificial Sequence
  chemically synthesized
gtcttttctcacttaccctctc

SEQ ID NO: 98597 - DNA, 22 bp, Artificial Sequence
  chemically synthesized
tcttttctcacttaccctctca

SEQ ID NO: 98598 - DNA, 22 bp, Artificial Sequence
  chemically synthesized
ttctcacttaccctctcattca

SEQ ID NO: 98599 - DNA, 22 bp, Artificial Sequence
  chemically synthesized
tctcacttaccctctcattcac

SEQ ID NO: 98600 - DNA, 22 bp, Artificial Sequence
  chemically synthesized
ctcacttaccctctcattcacc

SEQ ID NO: 98601 - DNA, 22 bp, Artificial Sequence
  chemically synthesized
tcacttaccctctcattcaccc

SEQ ID NO: 98602 - DNA, 22 bp, Artificial Sequence
  chemically synthesized
acttaccctctcattcacccac

SEQ ID NO: 98603 - DNA, 22 bp, Artificial Sequence
  chemically synthesized
accctctcattcacccacctct

SEQ ID NO: 98604 - DNA, 22 bp, Artificial Sequence
  chemically synthesized
ccctctcattcacccacctctt

SEQ ID NO: 98605 - DNA, 22 bp, Artificial Sequence
  chemically synthesized
tcattcacccacctcttttgct

SEQ ID NO: 98606 - DNA, 22 bp, Artificial Sequence
  chemically synthesized
attcacccacctcttttgctct

SEQ ID NO: 98607 - DNA, 22 bp, Artificial Sequence
  chemically synthesized
acccacctcttttgctctctgt

SEQ ID NO: 98608 - DNA, 22 bp, Artificial Sequence
  chemically synthesized
ttttgctctctgttcctgtgaa

SEQ ID NO: 98609 - DNA, 22 bp, Artificial Sequence
  chemically synthesized
ttgctctctgttcctgtgaaag

SEQ ID NO: 98610 - DNA, 22 bp, Artificial Sequence
  chemically synthesized
tgctctctgttcctgtgaaagt

SEQ ID NO: 98611 - DNA, 22 bp, Artificial Sequence
  chemically synthesized
gctctctgttcctgtgaaagta

SEQ ID NO: 98612 - DNA, 22 bp, Artificial Sequence
  chemically synthesized
ctctctgttcctgtgaaagtac

SEQ ID NO: 98613 - DNA, 22 bp, Artificial Sequence
  chemically synthesized
tctgttcctgtgaaagtaccct

SEQ ID NO: 98614 - DNA, 22 bp, Artificial Sequence
  chemically synthesized
tgttcctgtgaaagtacccttc

SEQ ID NO: 98615 - DNA, 22 bp, Artificial Sequence
  chemically synthesized
ttcctgtgaaagtacccttcta

SEQ ID NO: 98616 - DNA, 22 bp, Artificial Sequence
  chemically synthesized
ctgtgaaagtacccttctactt

SEQ ID NO: 98617 - DNA, 22 bp, Artificial Sequence
  chemically synthesized
tgaaagtacccttctacttagc

SEQ ID NO: 98618 - DNA, 22 bp, Artificial Sequence
  chemically synthesized
ctacttagcctacttttgacca

SEQ ID NO: 98619 - DNA, 22 bp, Artificial Sequence
  chemically synthesized
tacttagcctacttttgaccag

SEQ ID NO: 98620 - DNA, 22 bp, Artificial Sequence
  chemically synthesized
cttagcctacttttgaccagtg

SEQ ID NO: 98621 - DNA, 22 bp, Artificial Sequence
  chemically synthesized
agcctacttttgaccagtgtgc

SEQ ID NO: 98622 - DNA, 22 bp, Artificial Sequence
  chemically synthesized
gcctacttttgaccagtgtgca

SEQ ID NO: 98623 - DNA, 22 bp, Artificial Sequence
  chemically synthesized
cttttgaccagtgtgcatgtca

SEQ ID NO: 98624 - DNA, 22 bp, Artificial Sequence
  chemically synthesized
ttgaccagtgtgcatgtcactg

SEQ ID NO: 98625 - DNA, 22 bp, Artificial Sequence
  chemically synthesized
tgaccagtgtgcatgtcactgg

SEQ ID NO: 98626 - DNA, 22 bp, Artificial Sequence
  chemically synthesized
gaccagtgtgcatgtcactggg

SEQ ID NO: 98627 - DNA, 22 bp, Artificial Sequence
  chemically synthesized
accagtgtgcatgtcactgggc

SEQ ID NO: 98628 - DNA, 22 bp, Artificial Sequence
  chemically synthesized
ggcaatacaagacctctgagct

SEQ ID NO: 98629 - DNA, 22 bp, Artificial Sequence
  chemically synthesized
tgagctttggcttagaaggaaa

SEQ ID NO: 98630 - DNA, 22 bp, Artificial Sequence
  chemically synthesized
agctttggcttagaaggaaata

SEQ ID NO: 98631 - DNA, 22 bp, Artificial Sequence
  chemically synthesized
tggcttagaaggaaatacaata

SEQ ID NO: 98632 - DNA, 22 bp, Artificial Sequence
  chemically synthesized
ggcttagaaggaaatacaataa

SEQ ID NO: 98633 - DNA, 22 bp, Artificial Sequence
  chemically synthesized
gcttagaaggaaatacaataat

SEQ ID NO: 98634 - DNA, 22 bp, Artificial Sequence
  chemically synthesized
agaaggaaatacaataatggct

SEQ ID NO: 98635 - DNA, 22 bp, Artificial Sequence
  chemically synthesized
gaaggaaatacaataatggcta

SEQ ID NO: 98636 - DNA, 22 bp, Artificial Sequence
  chemically synthesized
atttttgagaaagaggaactct

SEQ ID NO: 98637 - DNA, 22 bp, Artificial Sequence
  chemically synthesized
ttgagaaagaggaactctagcc

SEQ ID NO: 98638 - DNA, 22 bp, Artificial Sequence
  chemically synthesized
tgagaaagaggaactctagccc

SEQ ID NO: 98639 - DNA, 22 bp, Artificial Sequence
  chemically synthesized
gagaaagaggaactctagccca

SEQ ID NO: 98640 - DNA, 22 bp, Artificial Sequence
  chemically synthesized
agaaagaggaactctagcccat

SEQ ID NO: 98641 - DNA, 22 bp, Artificial Sequence
  chemically synthesized
tagcccatcagggaagacatag

SEQ ID NO: 98642 - DNA, 22 bp, Artificial Sequence
  chemically synthesized
gcccatcagggaagacataggg

SEQ ID NO: 98643 - DNA, 22 bp, Artificial Sequence
  chemically synthesized
tgtaggaatgagttcttccatt

SEQ ID NO: 98644 - DNA, 22 bp, Artificial Sequence
  chemically synthesized
taggaatgagttcttccattct

SEQ ID NO: 98645 - DNA, 22 bp, Artificial Sequence
  chemically synthesized
ttccattctttttacagatgag

SEQ ID NO: 98646 - DNA, 22 bp, Artificial Sequence
  chemically synthesized
ccattctttttacagatgagaa

SEQ ID NO: 98647 - DNA, 22 bp, Artificial Sequence
  chemically synthesized
cattctttttacagatgagaaa

SEQ ID NO: 98648 - DNA, 22 bp, Artificial Sequence
  chemically synthesized
tttttacagatgagaaagacaa

SEQ ID NO: 98649 - DNA, 22 bp, Artificial Sequence
  chemically synthesized
tttacagatgagaaagacaatg

SEQ ID NO: 98650 - DNA, 22 bp, Artificial Sequence
  chemically synthesized
ttacagatgagaaagacaatgt

SEQ ID NO: 98651 - DNA, 22 bp, Artificial Sequence
  chemically synthesized
tacagatgagaaagacaatgtg

SEQ ID NO: 98652 - DNA, 22 bp, Artificial Sequence
  chemically synthesized
acagatgagaaagacaatgtga

SEQ ID NO: 98653 - DNA, 22 bp, Artificial Sequence
  chemically synthesized
cagatgagaaagacaatgtgaa

SEQ ID NO: 98654 - DNA, 22 bp, Artificial Sequence
  chemically synthesized
taaagtagttagcatatggaga

SEQ ID NO: 98655 - DNA, 22 bp, Artificial Sequence
  chemically synthesized
aaagtagttagcatatggagaa

SEQ ID NO: 98656 - DNA, 22 bp, Artificial Sequence
  chemically synthesized
aagtagttagcatatggagaaa

SEQ ID NO: 98657 - DNA, 22 bp, Artificial Sequence
  chemically synthesized
gcatatggagaaatggcttgca

SEQ ID NO: 98658 - DNA, 22 bp, Artificial Sequence
  chemically synthesized
gcattggtaaaatttggggaaa

SEQ ID NO: 98659 - DNA, 22 bp, Artificial Sequence
  chemically synthesized
cattggtaaaatttggggaaac

SEQ ID NO: 98660 - DNA, 22 bp, Artificial Sequence
  chemically synthesized
gtaaaatttggggaaactttgt

SEQ ID NO: 98661 - DNA, 22 bp, Artificial Sequence
  chemically synthesized
ggggaaactttgttgtcagacc

SEQ ID NO: 98662 - DNA, 22 bp, Artificial Sequence
  chemically synthesized
gggaaactttgttgtcagaccc

SEQ ID NO: 98663 - DNA, 22 bp, Artificial Sequence
  chemically synthesized
tgttgtcagacccggcaaaggg

SEQ ID NO: 98664 - DNA, 22 bp, Artificial Sequence
  chemically synthesized
gttgtcagacccggcaaaggga

SEQ ID NO: 98665 - DNA, 22 bp, Artificial Sequence
  chemically synthesized
ttgtcagacccggcaaagggag

SEQ ID NO: 98666 - DNA, 22 bp, Artificial Sequence
  chemically synthesized
tcagacccggcaaagggagatg

SEQ ID NO: 98667 - DNA, 22 bp, Artificial Sequence
  chemically synthesized
cagtttcttctcatttcttgtg

SEQ ID NO: 98668 - DNA, 22 bp, Artificial Sequence
  chemically synthesized
cttctcatttcttgtgtaccta

SEQ ID NO: 98669 - DNA, 22 bp, Artificial Sequence
  chemically synthesized
ttctcatttcttgtgtacctat

SEQ ID NO: 98670 - DNA, 22 bp, Artificial Sequence
  chemically synthesized
ctcatttcttgtgtacctatca

SEQ ID NO: 98671 - DNA, 22 bp, Artificial Sequence
  chemically synthesized
tcatttcttgtgtacctatcac

SEQ ID NO: 98672 - DNA, 22 bp, Artificial Sequence
  chemically synthesized
atttcttgtgtacctatcacag

SEQ ID NO: 98673 - DNA, 22 bp, Artificial Sequence
  chemically synthesized
cttgtgtacctatcacagcacc

SEQ ID NO: 98674 - DNA, 22 bp, Artificial Sequence
  chemically synthesized
ttgtgtacctatcacagcacca

SEQ ID NO: 98675 - DNA, 22 bp, Artificial Sequence
  chemically synthesized
gtgtacctatcacagcaccaca

SEQ ID NO: 98676 - DNA, 22 bp, Artificial Sequence
  chemically synthesized
tgtacctatcacagcaccacag

SEQ ID NO: 98677 - DNA, 22 bp, Artificial Sequence
  chemically synthesized
tcacagcaccacagcactattc

SEQ ID NO: 98678 - DNA, 22 bp, Artificial Sequence
  chemically synthesized
ttcctagcatagtttagggccc

SEQ ID NO: 98679 - DNA, 22 bp, Artificial Sequence
  chemically synthesized
ctagcatagtttagggccctca

SEQ ID NO: 98680 - DNA, 22 bp, Artificial Sequence
  chemically synthesized
gcatagtttagggccctcagtt

SEQ ID NO: 98681 - DNA, 22 bp, Artificial Sequence
  chemically synthesized
agggccctcagttcttgacgct

SEQ ID NO: 98682 - DNA, 22 bp, Artificial Sequence
  chemically synthesized
gggccctcagttcttgacgcta

SEQ ID NO: 98683 - DNA, 22 bp, Artificial Sequence
  chemically synthesized
agttcttgacgctagttagaat

SEQ ID NO: 98684 - DNA, 22 bp, Artificial Sequence
  chemically synthesized
ttgacgctagttagaatttcac

SEQ ID NO: 98685 - DNA, 22 bp, Artificial Sequence
  chemically synthesized
gacgctagttagaatttcacac

SEQ ID NO: 98686 - DNA, 22 bp, Artificial Sequence
  chemically synthesized
acgctagttagaatttcacaca

SEQ ID NO: 98687 - DNA, 22 bp, Artificial Sequence
  chemically synthesized
gttagaatttcacacaaactta

SEQ ID NO: 98688 - DNA, 22 bp, Artificial Sequence
  chemically synthesized
gaatttcacacaaacttaaact

SEQ ID NO: 98689 - DNA, 22 bp, Artificial Sequence
  chemically synthesized
cacacaaacttaaactagacaa

SEQ ID NO: 98690 - DNA, 22 bp, Artificial Sequence
  chemically synthesized
acacaaacttaaactagacaaa

SEQ ID NO: 98691 - DNA, 22 bp, Artificial Sequence
  chemically synthesized
aaactagacaaacatatgtatg

SEQ ID NO: 98692 - DNA, 22 bp, Artificial Sequence
  chemically synthesized
aactagacaaacatatgtatgt

SEQ ID NO: 98693 - DNA, 22 bp, Artificial Sequence
  chemically synthesized
gacaaacatatgtatgtttctg

SEQ ID NO: 98694 - DNA, 22 bp, Artificial Sequence
  chemically synthesized
ctgaggcactgaggtcactgca

SEQ ID NO: 98695 - DNA, 22 bp, Artificial Sequence
  chemically synthesized
tgaggcactgaggtcactgcag

SEQ ID NO: 98696 - DNA, 22 bp, Artificial Sequence
  chemically synthesized
aggcactgaggtcactgcagga

SEQ ID NO: 98697 - DNA, 22 bp, Artificial Sequence
  chemically synthesized
aggtcactgcaggatgaagacg

SEQ ID NO: 98698 - DNA, 22 bp, Artificial Sequence
  chemically synthesized
caggatgaagacggagccaatg

SEQ ID NO: 98699 - DNA, 22 bp, Artificial Sequence
  chemically synthesized
gaccagaagagtaaatgaacac

SEQ ID NO: 98700 - DNA, 22 bp, Artificial Sequence
  chemically synthesized
taacacataaacactcccttta

SEQ ID NO: 98701 - DNA, 22 bp, Artificial Sequence
  chemically synthesized
cctttaaccaaagttgcagctt

SEQ ID NO: 98702 - DNA, 22 bp, Artificial Sequence
  chemically synthesized
taaccaaagttgcagcttgacc

SEQ ID NO: 98703 - DNA, 22 bp, Artificial Sequence
  chemically synthesized
aaccaaagttgcagcttgacca

SEQ ID NO: 98704 - DNA, 22 bp, Artificial Sequence
  chemically synthesized
accaaagttgcagcttgaccaa

SEQ ID NO: 98705 - DNA, 22 bp, Artificial Sequence
  chemically synthesized
cagcttgaccaaggggtcaaag

SEQ ID NO: 98706 - DNA, 22 bp, Artificial Sequence
  chemically synthesized
gaccaaggggtcaaagggtaat

SEQ ID NO: 98707 - DNA, 22 bp, Artificial Sequence
  chemically synthesized
accaaggggtcaaagggtaatt

SEQ ID NO: 98708 - DNA, 22 bp, Artificial Sequence
  chemically synthesized
gggcaggcatgggccttcagtt

SEQ ID NO: 98709 - DNA, 22 bp, Artificial Sequence
  chemically synthesized
ggcaggcatgggccttcagttt

SEQ ID NO: 98710 - DNA, 22 bp, Artificial Sequence
  chemically synthesized
cagttttctcaagtgtctgctt

SEQ ID NO: 98711 - DNA, 22 bp, Artificial Sequence
  chemically synthesized
agttttctcaagtgtctgctta

SEQ ID NO: 98712 - DNA, 22 bp, Artificial Sequence
  chemically synthesized
tctcaagtgtctgcttataatt

SEQ ID NO: 98713 - DNA, 22 bp, Artificial Sequence
  chemically synthesized
ctcaagtgtctgcttataattt

SEQ ID NO: 98714 - DNA, 22 bp, Artificial Sequence
  chemically synthesized
tcaagtgtctgcttataatttg

SEQ ID NO: 98715 - DNA, 22 bp, Artificial Sequence
  chemically synthesized
aagtgtctgcttataatttgtc

SEQ ID NO: 98716 - DNA, 22 bp, Artificial Sequence
  chemically synthesized
cttataatttgtcatatgacaa

SEQ ID NO: 98717 - DNA, 22 bp, Artificial Sequence
  chemically synthesized
ataatttgtcatatgacaatct

SEQ ID NO: 98718 - DNA, 22 bp, Artificial Sequence
  chemically synthesized
taatttgtcatatgacaatctc

SEQ ID NO: 98719 - DNA, 22 bp, Artificial Sequence
  chemically synthesized
gtcatatgacaatctctgtaac

SEQ ID NO: 98720 - DNA, 22 bp, Artificial Sequence
  chemically synthesized
tcatatgacaatctctgtaacc

SEQ ID NO: 98721 - DNA, 22 bp, Artificial Sequence
  chemically synthesized
tgtaacccaagagaaaatctct

SEQ ID NO: 98722 - DNA, 22 bp, Artificial Sequence
  chemically synthesized
taacccaagagaaaatctcttt

SEQ ID NO: 98723 - DNA, 22 bp, Artificial Sequence
  chemically synthesized
tttattctgaagttgtttctaa

SEQ ID NO: 98724 - DNA, 22 bp, Artificial Sequence
  chemically synthesized
tattctgaagttgtttctaaat

SEQ ID NO: 98725 - DNA, 22 bp, Artificial Sequence
  chemically synthesized
attctgaagttgtttctaaatt

SEQ ID NO: 98726 - DNA, 22 bp, Artificial Sequence
  chemically synthesized
ttctgaagttgtttctaaattt

SEQ ID NO: 98727 - DNA, 22 bp, Artificial Sequence
  chemically synthesized
tgaagttgtttctaaatttttc

SEQ ID NO: 98728 - DNA, 22 bp, Artificial Sequence
  chemically synthesized
aagttgtttctaaatttttctt

SEQ ID NO: 98729 - DNA, 22 bp, Artificial Sequence
  chemically synthesized
tttctaaatttttctttacctt

SEQ ID NO: 98730 - DNA, 22 bp, Artificial Sequence
  chemically synthesized
ctaaatttttctttaccttttt

SEQ ID NO: 98731 - DNA, 22 bp, Artificial Sequence
  chemically synthesized
taaatttttctttacctttttc

SEQ ID NO: 98732 - DNA, 22 bp, Artificial Sequence
  chemically synthesized
aatttttctttacctttttctc

SEQ ID NO: 98733 - DNA, 22 bp, Artificial Sequence
  chemically synthesized
ttctttacctttttctccctca

SEQ ID NO: 98734 - DNA, 22 bp, Artificial Sequence
  chemically synthesized
tctttacctttttctccctcaa

SEQ ID NO: 98735 - DNA, 22 bp, Artificial Sequence
  chemically synthesized
ctttacctttttctccctcaaa

SEQ ID NO: 98736 - DNA, 22 bp, Artificial Sequence
  chemically synthesized
tttacctttttctccctcaaac

SEQ ID NO: 98737 - DNA, 22 bp, Artificial Sequence
  chemically synthesized
tacctttttctccctcaaactt

SEQ ID NO: 98738 - DNA, 22 bp, Artificial Sequence
  chemically synthesized
acctttttctccctcaaacttt

SEQ ID NO: 98739 - DNA, 22 bp, Artificial Sequence
  chemically synthesized
cctttttctccctcaaactttc

SEQ ID NO: 98740 - DNA, 22 bp, Artificial Sequence
  chemically synthesized
tttctccctcaaactttcctga

SEQ ID NO: 98741 - DNA, 22 bp, Artificial Sequence
  chemically synthesized
ttctccctcaaactttcctgaa

SEQ ID NO: 98742 - DNA, 22 bp, Artificial Sequence
  chemically synthesized
tctccctcaaactttcctgaag

SEQ ID NO: 98743 - DNA, 22 bp, Artificial Sequence
  chemically synthesized
ctccctcaaactttcctgaaga

SEQ ID NO: 98744 - DNA, 22 bp, Artificial Sequence
  chemically synthesized
tccctcaaactttcctgaagaa

SEQ ID NO: 98745 - DNA, 22 bp, Artificial Sequence
  chemically synthesized
cctcaaactttcctgaagaaat

SEQ ID NO: 98746 - DNA, 22 bp, Artificial Sequence
  chemically synthesized
aaactttcctgaagaaatgcaa

SEQ ID NO: 98747 - DNA, 22 bp, Artificial Sequence
  chemically synthesized
tcctgaagaaatgcaattatgg

SEQ ID NO: 98748 - DNA, 22 bp, Artificial Sequence
  chemically synthesized
cctgaagaaatgcaattatggt

SEQ ID NO: 98749 - DNA, 22 bp, Artificial Sequence
  chemically synthesized
ctgaagaaatgcaattatggtt

SEQ ID NO: 98750 - DNA, 22 bp, Artificial Sequence
  chemically synthesized
aagaaatgcaattatggttgag

SEQ ID NO: 98751 - DNA, 22 bp, Artificial Sequence
  chemically synthesized
tggttgaggaagtatggtctgc

SEQ ID NO: 98752 - DNA, 22 bp, Artificial Sequence
  chemically synthesized
aggaagtatggtctgcaactgt

SEQ ID NO: 98753 - DNA, 22 bp, Artificial Sequence
  chemically synthesized
caactgtggcttggaccacaac

SEQ ID NO: 98754 - DNA, 22 bp, Artificial Sequence
  chemically synthesized
tggcttggaccacaacttccaa

SEQ ID NO: 98755 - DNA, 22 bp, Artificial Sequence
  chemically synthesized
ggaccacaacttccaatcgaca

SEQ ID NO: 98756 - DNA, 22 bp, Artificial Sequence
  chemically synthesized
gaccacaacttccaatcgacaa

SEQ ID NO: 98757 - DNA, 22 bp, Artificial Sequence
  chemically synthesized
ccaatcgacaagaagtaaaagt

SEQ ID NO: 98758 - DNA, 22 bp, Artificial Sequence
  chemically synthesized
caatcgacaagaagtaaaagta

SEQ ID NO: 98759 - DNA, 22 bp, Artificial Sequence
  chemically synthesized
cttctaatttctcgcatccaca

SEQ ID NO: 98760 - DNA, 22 bp, Artificial Sequence
  chemically synthesized
ctaatttctcgcatccacaata

SEQ ID NO: 98761 - DNA, 22 bp, Artificial Sequence
  chemically synthesized
taatttctcgcatccacaatat

SEQ ID NO: 98762 - DNA, 22 bp, Artificial Sequence
  chemically synthesized
atttctcgcatccacaatatct

SEQ ID NO: 98763 - DNA, 22 bp, Artificial Sequence
  chemically synthesized
ctcgcatccacaatatctgagt

SEQ ID NO: 98764 - DNA, 22 bp, Artificial Sequence
  chemically synthesized
tcgcatccacaatatctgagtt

SEQ ID NO: 98765 - DNA, 22 bp, Artificial Sequence
  chemically synthesized
gcatccacaatatctgagtttg

SEQ ID NO: 98766 - DNA, 22 bp, Artificial Sequence
  chemically synthesized
agtttgtgttttgctgtggaaa

SEQ ID NO: 98767 - DNA, 22 bp, Artificial Sequence
  chemically synthesized
gtgttttgctgtggaaaaaaca

SEQ ID NO: 98768 - DNA, 22 bp, Artificial Sequence
  chemically synthesized
tgttttgctgtggaaaaaacac

SEQ ID NO: 98769 - DNA, 22 bp, Artificial Sequence
  chemically synthesized
tgctgtggaaaaaacactgtct

SEQ ID NO: 98770 - DNA, 22 bp, Artificial Sequence
  chemically synthesized
gctgtggaaaaaacactgtctt

SEQ ID NO: 98771 - DNA, 22 bp, Artificial Sequence
  chemically synthesized
ctgtggaaaaaacactgtcttc

SEQ ID NO: 98772 - DNA, 22 bp, Artificial Sequence
  chemically synthesized
tggaaaaaacactgtcttcaga

SEQ ID NO: 98773 - DNA, 22 bp, Artificial Sequence
  chemically synthesized
tcttcagaggtagcagaactgg

SEQ ID NO: 98774 - DNA, 22 bp, Artificial Sequence
  chemically synthesized
cagaggtagcagaactgggtct

SEQ ID NO: 98775 - DNA, 22 bp, Artificial Sequence
  chemically synthesized
agaggtagcagaactgggtcta

SEQ ID NO: 98776 - DNA, 22 bp, Artificial Sequence
  chemically synthesized
ggtctacatcctagccttacta

SEQ ID NO: 98777 - DNA, 22 bp, Artificial Sequence
  chemically synthesized
catcctagccttactacttggt

SEQ ID NO: 98778 - DNA, 22 bp, Artificial Sequence
  chemically synthesized
gccttactacttggtggttctg

SEQ ID NO: 98779 - DNA, 22 bp, Artificial Sequence
  chemically synthesized
actacttggtggttctgtaagc

SEQ ID NO: 98780 - DNA, 22 bp, Artificial Sequence
  chemically synthesized
ctacttggtggttctgtaagct

SEQ ID NO: 98781 - DNA, 22 bp, Artificial Sequence
  chemically synthesized
cttggtggttctgtaagcttgg

SEQ ID NO: 98782 - DNA, 22 bp, Artificial Sequence
  chemically synthesized
ggtggttctgtaagcttggaca

SEQ ID NO: 98783 - DNA, 22 bp, Artificial Sequence
  chemically synthesized
gtggttctgtaagcttggacaa

SEQ ID NO: 98784 - DNA, 22 bp, Artificial Sequence
  chemically synthesized
tgtaagcttggacaaattattt

SEQ ID NO: 98785 - DNA, 22 bp, Artificial Sequence
  chemically synthesized
taagcttggacaaattatttca

SEQ ID NO: 98786 - DNA, 22 bp, Artificial Sequence
  chemically synthesized
ggacaaattatttcatgtcttt

SEQ ID NO: 98787 - DNA, 22 bp, Artificial Sequence
  chemically synthesized
gacaaattatttcatgtctttg

SEQ ID NO: 98788 - DNA, 22 bp, Artificial Sequence
  chemically synthesized
tttcatgtctttgattttcgag

SEQ ID NO: 98789 - DNA, 22 bp, Artificial Sequence
  chemically synthesized
catgtctttgattttcgagtcc

SEQ ID NO: 98790 - DNA, 22 bp, Artificial Sequence
  chemically synthesized
atgtctttgattttcgagtccc

SEQ ID NO: 98791 - DNA, 22 bp, Artificial Sequence
  chemically synthesized
tgattttcgagtccccagttaa

SEQ ID NO: 98792 - DNA, 22 bp, Artificial Sequence
  chemically synthesized
gattttcgagtccccagttaat

SEQ ID NO: 98793 - DNA, 22 bp, Artificial Sequence
  chemically synthesized
attttcgagtccccagttaata

SEQ ID NO: 98794 - DNA, 22 bp, Artificial Sequence
  chemically synthesized
tcgagtccccagttaataagag

SEQ ID NO: 98795 - DNA, 22 bp, Artificial Sequence
  chemically synthesized
cgagtccccagttaataagagc

SEQ ID NO: 98796 - DNA, 22 bp, Artificial Sequence
  chemically synthesized
gagtccccagttaataagagct

SEQ ID NO: 98797 - DNA, 22 bp, Artificial Sequence
  chemically synthesized
ataagagctcatgtaatgtaga

SEQ ID NO: 98798 - DNA, 22 bp, Artificial Sequence
  chemically synthesized
atgtaatgtagacagtaggaga

SEQ ID NO: 98799 - DNA, 22 bp, Artificial Sequence
  chemically synthesized
agaccatctgacttctaattac

SEQ ID NO: 98800 - DNA, 22 bp, Artificial Sequence
  chemically synthesized
acttctaattactaattgtcta

SEQ ID NO: 98801 - DNA, 22 bp, Artificial Sequence
  chemically synthesized
ctaattactaattgtctactta

SEQ ID NO: 98802 - DNA, 22 bp, Artificial Sequence
  chemically synthesized
taattactaattgtctacttat

SEQ ID NO: 98803 - DNA, 22 bp, Artificial Sequence
  chemically synthesized
attactaattgtctacttatta

SEQ ID NO: 98804 - DNA, 22 bp, Artificial Sequence
  chemically synthesized
ctaattgtctacttattagctt

SEQ ID NO: 98805 - DNA, 22 bp, Artificial Sequence
  chemically synthesized
attgtctacttattagcttgtg

SEQ ID NO: 98806 - DNA, 22 bp, Artificial Sequence
  chemically synthesized
tctacttattagcttgtgcttt

SEQ ID NO: 98807 - DNA, 22 bp, Artificial Sequence
  chemically synthesized
cttattagcttgtgctttcaat

SEQ ID NO: 98808 - DNA, 22 bp, Artificial Sequence
  chemically synthesized
attagcttgtgctttcaataag

SEQ ID NO: 98809 - DNA, 22 bp, Artificial Sequence
  chemically synthesized
ttagcttgtgctttcaataagt

SEQ ID NO: 98810 - DNA, 22 bp, Artificial Sequence
  chemically synthesized
gcttgtgctttcaataagttga

SEQ ID NO: 98811 - DNA, 22 bp, Artificial Sequence
  chemically synthesized
gtgctttcaataagttgatcta

SEQ ID NO: 98812 - DNA, 22 bp, Artificial Sequence
  chemically synthesized
tgctttcaataagttgatctac

SEQ ID NO: 98813 - DNA, 22 bp, Artificial Sequence
  chemically synthesized
tcaataagttgatctacactac

SEQ ID NO: 98814 - DNA, 22 bp, Artificial Sequence
  chemically synthesized
caataagttgatctacactaca

SEQ ID NO: 98815 - DNA, 22 bp, Artificial Sequence
  chemically synthesized
aataagttgatctacactacaa

SEQ ID NO: 98816 - DNA, 22 bp, Artificial Sequence
  chemically synthesized
atctacactacaagtacattgg

SEQ ID NO: 98817 - DNA, 22 bp, Artificial Sequence
  chemically synthesized
cactacaagtacattgggctcc

SEQ ID NO: 98818 - DNA, 22 bp, Artificial Sequence
  chemically synthesized
caagtacattgggctcctcatc

SEQ ID NO: 98819 - DNA, 22 bp, Artificial Sequence
  chemically synthesized
ggctcctcatcaataaatgagg

SEQ ID NO: 98820 - DNA, 22 bp, Artificial Sequence
  chemically synthesized
ctcatcaataaatgaggtaata

SEQ ID NO: 98821 - DNA, 22 bp, Artificial Sequence
  chemically synthesized
atcaataaatgaggtaataatc

SEQ ID NO: 98822 - DNA, 22 bp, Artificial Sequence
  chemically synthesized
cttctgagtattggtgtgagta

SEQ ID NO: 98823 - DNA, 22 bp, Artificial Sequence
  chemically synthesized
ctgagtattggtgtgagtaaaa

SEQ ID NO: 98824 - DNA, 22 bp, Artificial Sequence
  chemically synthesized
tgagtattggtgtgagtaaaac

SEQ ID NO: 98825 - DNA, 22 bp, Artificial Sequence
  chemically synthesized
agtattggtgtgagtaaaacta

SEQ ID NO: 98826 - DNA, 22 bp, Artificial Sequence
  chemically synthesized
gtgtgagtaaaactaagttaat

SEQ ID NO: 98827 - DNA, 22 bp, Artificial Sequence
  chemically synthesized
agttaattcatataataaactt

SEQ ID NO: 98828 - DNA, 22 bp, Artificial Sequence
  chemically synthesized
attcatataataaacttctttt

SEQ ID NO: 98829 - DNA, 22 bp, Artificial Sequence
  chemically synthesized
atataataaacttctttttttt

SEQ ID NO: 98830 - DNA, 22 bp, Artificial Sequence
  chemically synthesized
ctttttttttttttgagatgga

SEQ ID NO: 98831 - DNA, 22 bp, Artificial Sequence
  chemically synthesized
tttttttttttttgagatggag

SEQ ID NO: 98832 - DNA, 22 bp, Artificial Sequence
  chemically synthesized
tttttttttttgagatggagtc

SEQ ID NO: 98833 - DNA, 22 bp, Artificial Sequence
  chemically synthesized
ttttttttttgagatggagtct

SEQ ID NO: 98834 - DNA, 22 bp, Artificial Sequence
  chemically synthesized
tttttttttgagatggagtctc

SEQ ID NO: 98835 - DNA, 22 bp, Artificial Sequence
  chemically synthesized
ttttttttgagatggagtctca

SEQ ID NO: 98836 - DNA, 22 bp, Artificial Sequence
  chemically synthesized
tttttttgagatggagtctcac

SEQ ID NO: 98837 - DNA, 22 bp, Artificial Sequence
  chemically synthesized
ttttttgagatggagtctcact

SEQ ID NO: 98838 - DNA, 22 bp, Artificial Sequence
  chemically synthesized
tttttgagatggagtctcactc

SEQ ID NO: 98839 - DNA, 22 bp, Artificial Sequence
  chemically synthesized
ttttgagatggagtctcactct

SEQ ID NO: 98840 - DNA, 22 bp, Artificial Sequence
  chemically synthesized
tttgagatggagtctcactctg

SEQ ID NO: 98841 - DNA, 22 bp, Artificial Sequence
  chemically synthesized
ttgagatggagtctcactctgt

SEQ ID NO: 98842 - DNA, 22 bp, Artificial Sequence
  chemically synthesized
tgagatggagtctcactctgtc

SEQ ID NO: 98843 - DNA, 22 bp, Artificial Sequence
  chemically synthesized
gagatggagtctcactctgtcg

SEQ ID NO: 98844 - DNA, 22 bp, Artificial Sequence
  chemically synthesized
agatggagtctcactctgtcgc

SEQ ID NO: 98845 - DNA, 22 bp, Artificial Sequence
  chemically synthesized
actctgtcgcctaggctggagt

SEQ ID NO: 98846 - DNA, 22 bp, Artificial Sequence
  chemically synthesized
tgtcgcctaggctggagtgcag

SEQ ID NO: 98847 - DNA, 22 bp, Artificial Sequence
  chemically synthesized
tcgcctaggctggagtgcagtg

SEQ ID NO: 98848 - DNA, 22 bp, Artificial Sequence
  chemically synthesized
ggctggagtgcagtggtgcaat

SEQ ID NO: 98849 - DNA, 22 bp, Artificial Sequence
  chemically synthesized
gagtgcagtggtgcaatcttag

SEQ ID NO: 98850 - DNA, 22 bp, Artificial Sequence
  chemically synthesized
agctcactgcaacctccacctc

SEQ ID NO: 98851 - DNA, 22 bp, Artificial Sequence
  chemically synthesized
gctcactgcaacctccacctcc

SEQ ID NO: 98852 - DNA, 22 bp, Artificial Sequence
  chemically synthesized
actgcaacctccacctcctggg

SEQ ID NO: 98853 - DNA, 22 bp, Artificial Sequence
  chemically synthesized
caacctccacctcctgggttca

SEQ ID NO: 98854 - DNA, 22 bp, Artificial Sequence
  chemically synthesized
cacctcctgggttcaagtgatt

SEQ ID NO: 98855 - DNA, 22 bp, Artificial Sequence
  chemically synthesized
ctgggttcaagtgattctcctg

SEQ ID NO: 98856 - DNA, 22 bp, Artificial Sequence
  chemically synthesized
ggttcaagtgattctcctgcct

SEQ ID NO: 98857 - DNA, 22 bp, Artificial Sequence
  chemically synthesized
aagtgattctcctgcctcagcc

SEQ ID NO: 98858 - DNA, 22 bp, Artificial Sequence
  chemically synthesized
tcctgcctcagcctcctgagta

SEQ ID NO: 98859 - DNA, 22 bp, Artificial Sequence
  chemically synthesized
ctgcctcagcctcctgagtagc

SEQ ID NO: 98860 - DNA, 22 bp, Artificial Sequence
  chemically synthesized
cctcagcctcctgagtagctgg

SEQ ID NO: 98861 - DNA, 22 bp, Artificial Sequence
  chemically synthesized
agcctcctgagtagctgggatt

SEQ ID NO: 98862 - DNA, 22 bp, Artificial Sequence
  chemically synthesized
ctgagtagctgggattatagac

SEQ ID NO: 98863 - DNA, 22 bp, Artificial Sequence
  chemically synthesized
agtagctgggattatagacgcg

SEQ ID NO: 98864 - DNA, 22 bp, Artificial Sequence
  chemically synthesized
ggattatagacgcgtgccacca

SEQ ID NO: 98865 - DNA, 22 bp, Artificial Sequence
  chemically synthesized
tagacgcgtgccaccacacctg

SEQ ID NO: 98866 - DNA, 22 bp, Artificial Sequence
  chemically synthesized
gctgattttttgtattttttag

SEQ ID NO: 98867 - DNA, 22 bp, Artificial Sequence
  chemically synthesized
attttttgtattttttagtaga

SEQ ID NO: 98868 - DNA, 22 bp, Artificial Sequence
  chemically synthesized
tttgtattttttagtagagaag

SEQ ID NO: 98869 - DNA, 22 bp, Artificial Sequence
  chemically synthesized
ttgtattttttagtagagaagg

SEQ ID NO: 98870 - DNA, 22 bp, Artificial Sequence
  chemically synthesized
tgtattttttagtagagaaggg

SEQ ID NO: 98871 - DNA, 22 bp, Artificial Sequence
  chemically synthesized
gtattttttagtagagaagggg

SEQ ID NO: 98872 - DNA, 22 bp, Artificial Sequence
  chemically synthesized
tattttttagtagagaaggggt

SEQ ID NO: 98873 - DNA, 22 bp, Artificial Sequence
  chemically synthesized
tttagtagagaaggggtttcac

SEQ ID NO: 98874 - DNA, 22 bp, Artificial Sequence
  chemically synthesized
ttagtagagaaggggtttcacc

SEQ ID NO: 98875 - DNA, 22 bp, Artificial Sequence
  chemically synthesized
tagtagagaaggggtttcacca

SEQ ID NO: 98876 - DNA, 22 bp, Artificial Sequence
  chemically synthesized
agtagagaaggggtttcaccat

SEQ ID NO: 98877 - DNA, 22 bp, Artificial Sequence
  chemically synthesized
gtagagaaggggtttcaccatg

SEQ ID NO: 98878 - DNA, 22 bp, Artificial Sequence
  chemically synthesized
caccatgttggccaggctggtc

SEQ ID NO: 98879 - DNA, 22 bp, Artificial Sequence
  chemically synthesized
accatgttggccaggctggtct

SEQ ID NO: 98880 - DNA, 22 bp, Artificial Sequence
  chemically synthesized
gccaggctggtctggaactcct

SEQ ID NO: 98881 - DNA, 22 bp, Artificial Sequence
  chemically synthesized
gtctggaactcctgacctcagg

SEQ ID NO: 98882 - DNA, 22 bp, Artificial Sequence
  chemically synthesized
gaactcctgacctcaggtgatc

SEQ ID NO: 98883 - DNA, 22 bp, Artificial Sequence
  chemically synthesized
ctgacctcaggtgatccaattg

SEQ ID NO: 98884 - DNA, 22 bp, Artificial Sequence
  chemically synthesized
acctcaggtgatccaattgcct

SEQ ID NO: 98885 - DNA, 22 bp, Artificial Sequence
  chemically synthesized
aggtgatccaattgccttggcc

SEQ ID NO: 98886 - DNA, 22 bp, Artificial Sequence
  chemically synthesized
ccttggcctcccaaagtgctgg

SEQ ID NO: 98887 - DNA, 22 bp, Artificial Sequence
  chemically synthesized
ggcctcccaaagtgctgggatt

SEQ ID NO: 98888 - DNA, 22 bp, Artificial Sequence
  chemically synthesized
gcctcccaaagtgctgggatta

SEQ ID NO: 98889 - DNA, 22 bp, Artificial Sequence
  chemically synthesized
ccaaagtgctgggattacaggc

SEQ ID NO: 98890 - DNA, 22 bp, Artificial Sequence
  chemically synthesized
ggattacaggcatgtaatccca

SEQ ID NO: 98891 - DNA, 22 bp, Artificial Sequence
  chemically synthesized
caggcatgtaatcccatatatg

SEQ ID NO: 98892 - DNA, 22 bp, Artificial Sequence
  chemically synthesized
atatgataaacttaaatttgat

SEQ ID NO: 98893 - DNA, 22 bp, Artificial Sequence
  chemically synthesized
aaatttgattctagcatatact

SEQ ID NO: 98894 - DNA, 22 bp, Artificial Sequence
  chemically synthesized
aatttgattctagcatatacta

SEQ ID NO: 98895 - DNA, 22 bp, Artificial Sequence
  chemically synthesized
gattctagcatatactaagtac

SEQ ID NO: 98896 - DNA, 22 bp, Artificial Sequence
  chemically synthesized
attctagcatatactaagtact

SEQ ID NO: 98897 - DNA, 22 bp, Artificial Sequence
  chemically synthesized
tagcatatactaagtactcaag

SEQ ID NO: 98898 - DNA, 22 bp, Artificial Sequence
  chemically synthesized
gcatatactaagtactcaagag

SEQ ID NO: 98899 - DNA, 22 bp, Artificial Sequence
  chemically synthesized
agtactcaagaggtgttactta

SEQ ID NO: 98900 - DNA, 22 bp, Artificial Sequence
  chemically synthesized
aagaggtgttacttatcattag

SEQ ID NO: 98901 - DNA, 22 bp, Artificial Sequence
  chemically synthesized
cttatcattagtattaattata

SEQ ID NO: 98902 - DNA, 22 bp, Artificial Sequence
  chemically synthesized
atcattagtattaattatagta

SEQ ID NO: 98903 - DNA, 22 bp, Artificial Sequence
  chemically synthesized
tcattagtattaattatagtat

SEQ ID NO: 98904 - DNA, 22 bp, Artificial Sequence
  chemically synthesized
gtattaattatagtatgttcaa

SEQ ID NO: 98905 - DNA, 22 bp, Artificial Sequence
  chemically synthesized
attatagtatgttcaataatac

SEQ ID NO: 98906 - DNA, 22 bp, Artificial Sequence
  chemically synthesized
tagtatgttcaataatacatat

SEQ ID NO: 98907 - DNA, 22 bp, Artificial Sequence
  chemically synthesized
aataatacatatctcacagaat

SEQ ID NO: 98908 - DNA, 22 bp, Artificial Sequence
  chemically synthesized
acagaattaccatatgtaatga

SEQ ID NO: 98909 - DNA, 22 bp, Artificial Sequence
  chemically synthesized
ccatatgtaatgagattattaa

SEQ ID NO: 98910 - DNA, 22 bp, Artificial Sequence
  chemically synthesized
ttaaatatcataaaatggcacc

SEQ ID NO: 98911 - DNA, 22 bp, Artificial Sequence
  chemically synthesized
aatatcataaaatggcacctga

SEQ ID NO: 98912 - DNA, 22 bp, Artificial Sequence
  chemically synthesized
acatatagaaagatttcagtaa

SEQ ID NO: 98913 - DNA, 22 bp, Artificial Sequence
  chemically synthesized
cagtaagtattaattcccactt

SEQ ID NO: 98914 - DNA, 22 bp, Artificial Sequence
  chemically synthesized
agtaagtattaattcccacttc

SEQ ID NO: 98915 - DNA, 22 bp, Artificial Sequence
  chemically synthesized
attcccacttctctttcattta

SEQ ID NO: 98916 - DNA, 22 bp, Artificial Sequence
  chemically synthesized
ccacttctctttcatttacctc

SEQ ID NO: 98917 - DNA, 22 bp, Artificial Sequence
  chemically synthesized
ctctttcatttacctccagcct

SEQ ID NO: 98918 - DNA, 22 bp, Artificial Sequence
  chemically synthesized
tctttcatttacctccagccta

SEQ ID NO: 98919 - DNA, 22 bp, Artificial Sequence
  chemically synthesized
tttcatttacctccagcctaaa

SEQ ID NO: 98920 - DNA, 22 bp, Artificial Sequence
  chemically synthesized
tcatttacctccagcctaaatc

SEQ ID NO: 98921 - DNA, 22 bp, Artificial Sequence
  chemically synthesized
catttacctccagcctaaatct

SEQ ID NO: 98922 - DNA, 22 bp, Artificial Sequence
  chemically synthesized
atttacctccagcctaaatcta

SEQ ID NO: 98923 - DNA, 22 bp, Artificial Sequence
  chemically synthesized
acctccagcctaaatctacact

SEQ ID NO: 98924 - DNA, 22 bp, Artificial Sequence
  chemically synthesized
cctccagcctaaatctacacta

SEQ ID NO: 98925 - DNA, 22 bp, Artificial Sequence
  chemically synthesized
cagcctaaatctacactatttc

SEQ ID NO: 98926 - DNA, 22 bp, Artificial Sequence
  chemically synthesized
aatctacactatttcctcgtgt

SEQ ID NO: 98927 - DNA, 22 bp, Artificial Sequence
  chemically synthesized
cactatttcctcgtgtctctca

SEQ ID NO: 98928 - DNA, 22 bp, Artificial Sequence
  chemically synthesized
tttcctcgtgtctctcatgtgg

SEQ ID NO: 98929 - DNA, 22 bp, Artificial Sequence
  chemically synthesized
cctcgtgtctctcatgtggttt

SEQ ID NO: 98930 - DNA, 22 bp, Artificial Sequence
  chemically synthesized
ctcgtgtctctcatgtggtttc

SEQ ID NO: 98931 - DNA, 22 bp, Artificial Sequence
  chemically synthesized
gtgtctctcatgtggtttctag

SEQ ID NO: 98932 - DNA, 22 bp, Artificial Sequence
  chemically synthesized
tcatgtggtttctagtcccttc

SEQ ID NO: 98933 - DNA, 22 bp, Artificial Sequence
  chemically synthesized
atgtggtttctagtcccttcac

SEQ ID NO: 98934 - DNA, 22 bp, Artificial Sequence
  chemically synthesized
ctagtcccttcaccatcttgtt

SEQ ID NO: 98935 - DNA, 22 bp, Artificial Sequence
  chemically synthesized
tagtcccttcaccatcttgttt

SEQ ID NO: 98936 - DNA, 22 bp, Artificial Sequence
  chemically synthesized
gtcccttcaccatcttgtttcc

SEQ ID NO: 98937 - DNA, 22 bp, Artificial Sequence
  chemically synthesized
caccatcttgtttccctctcaa

SEQ ID NO: 98938 - DNA, 22 bp, Artificial Sequence
  chemically synthesized
accatcttgtttccctctcaac

SEQ ID NO: 98939 - DNA, 22 bp, Artificial Sequence
  chemically synthesized
gtttccctctcaactcctgtgc

SEQ ID NO: 98940 - DNA, 22 bp, Artificial Sequence
  chemically synthesized
tttccctctcaactcctgtgca

SEQ ID NO: 98941 - DNA, 22 bp, Artificial Sequence
  chemically synthesized
ccctctcaactcctgtgcagat

SEQ ID NO: 98942 - DNA, 22 bp, Artificial Sequence
  chemically synthesized
cctctcaactcctgtgcagatt

SEQ ID NO: 98943 - DNA, 22 bp, Artificial Sequence
  chemically synthesized
tcaactcctgtgcagattccta

SEQ ID NO: 98944 - DNA, 22 bp, Artificial Sequence
  chemically synthesized
aactcctgtgcagattcctaaa

SEQ ID NO: 98945 - DNA, 22 bp, Artificial Sequence
  chemically synthesized
ctgtgcagattcctaaaaattt

SEQ ID NO: 98946 - DNA, 22 bp, Artificial Sequence
  chemically synthesized
tgcagattcctaaaaatttctc

SEQ ID NO: 98947 - DNA, 22 bp, Artificial Sequence
  chemically synthesized
ctaaaaatttctcatgttcaga

SEQ ID NO: 98948 - DNA, 22 bp, Artificial Sequence
  chemically synthesized
aaaatttctcatgttcagaacc

SEQ ID NO: 98949 - DNA, 22 bp, Artificial Sequence
  chemically synthesized
ctcatgttcagaaccttgggct

SEQ ID NO: 98950 - DNA, 22 bp, Artificial Sequence
  chemically synthesized
tcatgttcagaaccttgggctt

SEQ ID NO: 98951 - DNA, 22 bp, Artificial Sequence
  chemically synthesized
atgttcagaaccttgggcttcc

SEQ ID NO: 98952 - DNA, 22 bp, Artificial Sequence
  chemically synthesized
agaaccttgggcttccatgttt

SEQ ID NO: 98953 - DNA, 22 bp, Artificial Sequence
  chemically synthesized
gggcttccatgtttccagtgaa

SEQ ID NO: 98954 - DNA, 22 bp, Artificial Sequence
  chemically synthesized
ggcttccatgtttccagtgaag

SEQ ID NO: 98955 - DNA, 22 bp, Artificial Sequence
  chemically synthesized
ccatgtttccagtgaagtcaga

SEQ ID NO: 98956 - DNA, 22 bp, Artificial Sequence
  chemically synthesized
catgtttccagtgaagtcagat

SEQ ID NO: 98957 - DNA, 22 bp, Artificial Sequence
  chemically synthesized
ccagtgaagtcagattttttta

SEQ ID NO: 98958 - DNA, 22 bp, Artificial Sequence
  chemically synthesized
cagtgaagtcagatttttttag

SEQ ID NO: 98959 - DNA, 22 bp, Artificial Sequence
  chemically synthesized
ttttagatggcaaagttgctgt

SEQ ID NO: 98960 - DNA, 22 bp, Artificial Sequence
  chemically synthesized
tttagatggcaaagttgctgtt

SEQ ID NO: 98961 - DNA, 22 bp, Artificial Sequence
  chemically synthesized
ttagatggcaaagttgctgtta

SEQ ID NO: 98962 - DNA, 22 bp, Artificial Sequence
  chemically synthesized
tagatggcaaagttgctgttag

SEQ ID NO: 98963 - DNA, 22 bp, Artificial Sequence
  chemically synthesized
agatggcaaagttgctgttaga

SEQ ID NO: 98964 - DNA, 22 bp, Artificial Sequence
  chemically synthesized
gatggcaaagttgctgttagac

SEQ ID NO: 98965 - DNA, 22 bp, Artificial Sequence
  chemically synthesized
ctgttagacaatttcatctgtg

SEQ ID NO: 98966 - DNA, 22 bp, Artificial Sequence
  chemically synthesized
ttagacaatttcatctgtgccc

SEQ ID NO: 98967 - DNA, 22 bp, Artificial Sequence
  chemically synthesized
gacaatttcatctgtgccctgc

SEQ ID NO: 98968 - DNA, 22 bp, Artificial Sequence
  chemically synthesized
catctgtgccctgcttaggagc

SEQ ID NO: 98969 - DNA, 22 bp, Artificial Sequence
  chemically synthesized
atctgtgccctgcttaggagct

SEQ ID NO: 98970 - DNA, 22 bp, Artificial Sequence
  chemically synthesized
tgccctgcttaggagcttaatc

SEQ ID NO: 98971 - DNA, 22 bp, Artificial Sequence
  chemically synthesized
cttaggagcttaatctttaatg

SEQ ID NO: 98972 - DNA, 22 bp, Artificial Sequence
  chemically synthesized
aggagcttaatctttaatgaaa

SEQ ID NO: 98973 - DNA, 22 bp, Artificial Sequence
  chemically synthesized
ggagcttaatctttaatgaaag

SEQ ID NO: 98974 - DNA, 22 bp, Artificial Sequence
  chemically synthesized
aatctttaatgaaagctaagct

SEQ ID NO: 98975 - DNA, 22 bp, Artificial Sequence
  chemically synthesized
atctttaatgaaagctaagctt

SEQ ID NO: 98976 - DNA, 22 bp, Artificial Sequence
  chemically synthesized
taatgaaagctaagctttcatt

SEQ ID NO: 98977 - DNA, 22 bp, Artificial Sequence
  chemically synthesized
aatgaaagctaagctttcatta

SEQ ID NO: 98978 - DNA, 22 bp, Artificial Sequence
  chemically synthesized
atgaaagctaagctttcattaa

SEQ ID NO: 98979 - DNA, 22 bp, Artificial Sequence
  chemically synthesized
agctttcattaaaaaaagtcta

SEQ ID NO: 98980 - DNA, 22 bp, Artificial Sequence
  chemically synthesized
tcattaaaaaaagtctaaccag

SEQ ID NO: 98981 - DNA, 22 bp, Artificial Sequence
  chemically synthesized
cattaaaaaaagtctaaccagc

SEQ ID NO: 98982 - DNA, 22 bp, Artificial Sequence
  chemically synthesized
attaaaaaaagtctaaccagct

SEQ ID NO: 98983 - DNA, 22 bp, Artificial Sequence
  chemically synthesized
aaaaaagtctaaccagctgcat

SEQ ID NO: 98984 - DNA, 22 bp, Artificial Sequence
  chemically synthesized
accagctgcattcgactttgac

SEQ ID NO: 98985 - DNA, 22 bp, Artificial Sequence
  chemically synthesized
cattcgactttgactgcagcag

SEQ ID NO: 98986 - DNA, 22 bp, Artificial Sequence
  chemically synthesized
gactttgactgcagcagctggt

SEQ ID NO: 98987 - DNA, 22 bp, Artificial Sequence
  chemically synthesized
tgactgcagcagctggttagaa

SEQ ID NO: 98988 - DNA, 22 bp, Artificial Sequence
  chemically synthesized
gactgcagcagctggttagaag

SEQ ID NO: 98989 - DNA, 22 bp, Artificial Sequence
  chemically synthesized
actgcagcagctggttagaagg

SEQ ID NO: 98990 - DNA, 22 bp, Artificial Sequence
  chemically synthesized
cagcagctggttagaaggttct

SEQ ID NO: 98991 - DNA, 22 bp, Artificial Sequence
  chemically synthesized
gttagaaggttctactggagga

SEQ ID NO: 98992 - DNA, 22 bp, Artificial Sequence
  chemically synthesized
gaaggttctactggaggagggt

SEQ ID NO: 98993 - DNA, 22 bp, Artificial Sequence
  chemically synthesized
tactggaggagggtcccagccc

SEQ ID NO: 98994 - DNA, 22 bp, Artificial Sequence
  chemically synthesized
ctggaggagggtcccagcccat

SEQ ID NO: 98995 - DNA, 22 bp, Artificial Sequence
  chemically synthesized
gaggagggtcccagcccattgc

SEQ ID NO: 98996 - DNA, 22 bp, Artificial Sequence
  chemically synthesized
ctaaattaacatcaggctctga

SEQ ID NO: 98997 - DNA, 22 bp, Artificial Sequence
  chemically synthesized
aattaacatcaggctctgagac

SEQ ID NO: 98998 - DNA, 22 bp, Artificial Sequence
  chemically synthesized
acatcaggctctgagactggca

SEQ ID NO: 98999 - DNA, 22 bp, Artificial Sequence
  chemically synthesized
tgagactggcagtatatctcta

SEQ ID NO: 99000 - DNA, 22 bp, Artificial Sequence
  chemically synthesized
agactggcagtatatctctaac

SEQ ID NO: 99001 - DNA, 22 bp, Artificial Sequence
  chemically synthesized
gcagtatatctctaacagtggt

SEQ ID NO: 99002 - DNA, 22 bp, Artificial Sequence
  chemically synthesized
taacagtggttgatgctatctt

SEQ ID NO: 99003 - DNA, 22 bp, Artificial Sequence
  chemically synthesized
acagtggttgatgctatcttct

SEQ ID NO: 99004 - DNA, 22 bp, Artificial Sequence
  chemically synthesized
atgctatcttctggaacttgcc

SEQ ID NO: 99005 - DNA, 22 bp, Artificial Sequence
  chemically synthesized
tcttctggaacttgcctgctac

SEQ ID NO: 99006 - DNA, 22 bp, Artificial Sequence
  chemically synthesized
ctggaacttgcctgctacattg

SEQ ID NO: 99007 - DNA, 22 bp, Artificial Sequence
  chemically synthesized
tggaacttgcctgctacattga

SEQ ID NO: 99008 - DNA, 22 bp, Artificial Sequence
  chemically synthesized
gaacttgcctgctacattgaga

SEQ ID NO: 99009 - DNA, 22 bp, Artificial Sequence
  chemically synthesized
gcctgctacattgagaccactg

SEQ ID NO: 99010 - DNA, 22 bp, Artificial Sequence
  chemically synthesized
cctgctacattgagaccactga

SEQ ID NO: 99011 - DNA, 22 bp, Artificial Sequence
  chemically synthesized
ctacattgagaccactgaccca

SEQ ID NO: 99012 - DNA, 22 bp, Artificial Sequence
  chemically synthesized
cattgagaccactgacccatac

SEQ ID NO: 99013 - DNA, 22 bp, Artificial Sequence
  chemically synthesized
agaccactgacccatacatagg

SEQ ID NO: 99014 - DNA, 22 bp, Artificial Sequence
  chemically synthesized
acccatacataggaagcccata

SEQ ID NO: 99015 - DNA, 22 bp, Artificial Sequence
  chemically synthesized
tgtcctgaactgttaggccact

SEQ ID NO: 99016 - DNA, 22 bp, Artificial Sequence
  chemically synthesized
tcctgaactgttaggccactgg

SEQ ID NO: 99017 - DNA, 22 bp, Artificial Sequence
  chemically synthesized
aactgttaggccactggtccag

SEQ ID NO: 99018 - DNA, 22 bp, Artificial Sequence
  chemically synthesized
ttaggccactggtccagagagt

SEQ ID NO: 99019 - DNA, 22 bp, Artificial Sequence
  chemically synthesized
ggccactggtccagagagtgtg

SEQ ID NO: 99020 - DNA, 22 bp, Artificial Sequence
  chemically synthesized
gtccagagagtgtgcatctcct

SEQ ID NO: 99021 - DNA, 22 bp, Artificial Sequence
  chemically synthesized
ctttgatcctcataataaccct

SEQ ID NO: 99022 - DNA, 22 bp, Artificial Sequence
  chemically synthesized
tgatcctcataataaccctatg

SEQ ID NO: 99023 - DNA, 22 bp, Artificial Sequence
  chemically synthesized
gatcctcataataaccctatga

SEQ ID NO: 99024 - DNA, 22 bp, Artificial Sequence
  chemically synthesized
atcctcataataaccctatgag

SEQ ID NO: 99025 - DNA, 22 bp, Artificial Sequence
  chemically synthesized
ataataaccctatgagatagac

SEQ ID NO: 99026 - DNA, 22 bp, Artificial Sequence
  chemically synthesized
tgagatagacacaattattact

SEQ ID NO: 99027 - DNA, 22 bp, Artificial Sequence
  chemically synthesized
ttactcttactttatagatgat

SEQ ID NO: 99028 - DNA, 22 bp, Artificial Sequence
  chemically synthesized
ctcttactttatagatgatgat

SEQ ID NO: 99029 - DNA, 22 bp, Artificial Sequence
  chemically synthesized
ttactttatagatgatgatcct

SEQ ID NO: 99030 - DNA, 22 bp, Artificial Sequence
  chemically synthesized
actttatagatgatgatcctga

SEQ ID NO: 99031 - DNA, 22 bp, Artificial Sequence
  chemically synthesized
ctttatagatgatgatcctgaa

SEQ ID NO: 99032 - DNA, 22 bp, Artificial Sequence
  chemically synthesized
tatagatgatgatcctgaaaac

SEQ ID NO: 99033 - DNA, 22 bp, Artificial Sequence
  chemically synthesized
atagatgatgatcctgaaaaca

SEQ ID NO: 99034 - DNA, 22 bp, Artificial Sequence
  chemically synthesized
tagatgatgatcctgaaaacat

SEQ ID NO: 99035 - DNA, 22 bp, Artificial Sequence
  chemically synthesized
aaaacataggagtcaaggcact

SEQ ID NO: 99036 - DNA, 22 bp, Artificial Sequence
  chemically synthesized
gcccctagctgggggtataggg

SEQ ID NO: 99037 - DNA, 22 bp, Artificial Sequence
  chemically synthesized
cccctagctgggggtatagggg

SEQ ID NO: 99038 - DNA, 22 bp, Artificial Sequence
  chemically synthesized
gctgggggtataggggagcagt

SEQ ID NO: 99039 - DNA, 22 bp, Artificial Sequence
  chemically synthesized
ggggtataggggagcagtccca

SEQ ID NO: 99040 - DNA, 22 bp, Artificial Sequence
  chemically synthesized
ctatgctgtgcctcccccacct

SEQ ID NO: 99041 - DNA, 22 bp, Artificial Sequence
  chemically synthesized
tgctgtgcctcccccacctttc

SEQ ID NO: 99042 - DNA, 22 bp, Artificial Sequence
  chemically synthesized
tgcctcccccacctttcccatg

SEQ ID NO: 99043 - DNA, 22 bp, Artificial Sequence
  chemically synthesized
ccccacctttcccatgtctgcc

SEQ ID NO: 99044 - DNA, 22 bp, Artificial Sequence
  chemically synthesized
tcccatgtctgccctctactca

SEQ ID NO: 99045 - DNA, 22 bp, Artificial Sequence
  chemically synthesized
cccatgtctgccctctactcat

SEQ ID NO: 99046 - DNA, 22 bp, Artificial Sequence
  chemically synthesized
ccatgtctgccctctactcatg

SEQ ID NO: 99047 - DNA, 22 bp, Artificial Sequence
  chemically synthesized
ccctctactcatggtctatctc

SEQ ID NO: 99048 - DNA, 22 bp, Artificial Sequence
  chemically synthesized
tactcatggtctatctctcctg

SEQ ID NO: 99049 - DNA, 22 bp, Artificial Sequence
  chemically synthesized
ctcatggtctatctctcctggc

SEQ ID NO: 99050 - DNA, 22 bp, Artificial Sequence
  chemically synthesized
atggtctatctctcctggctcc

SEQ ID NO: 99051 - DNA, 22 bp, Artificial Sequence
  chemically synthesized
tctctcctggctcctgggagtc

SEQ ID NO: 99052 - DNA, 22 bp, Artificial Sequence
  chemically synthesized
tcctggctcctgggagtcatgg

SEQ ID NO: 99053 - DNA, 22 bp, Artificial Sequence
  chemically synthesized
ctggctcctgggagtcatggac

SEQ ID NO: 99054 - DNA, 22 bp, Artificial Sequence
  chemically synthesized
gctcctgggagtcatggactcc

SEQ ID NO: 99055 - DNA, 22 bp, Artificial Sequence
  chemically synthesized
ctgggagtcatggactccaccc

SEQ ID NO: 99056 - DNA, 22 bp, Artificial Sequence
  chemically synthesized
ggagtcatggactccacccagc

SEQ ID NO: 99057 - DNA, 22 bp, Artificial Sequence
  chemically synthesized
cacccagcaccaccaacctgac

SEQ ID NO: 99058 - DNA, 22 bp, Artificial Sequence
  chemically synthesized
acctaaccacctatctgagcct

SEQ ID NO: 99059 - DNA, 22 bp, Artificial Sequence
  chemically synthesized
accacctatctgagcctgccag

SEQ ID NO: 99060 - DNA, 22 bp, Artificial Sequence
  chemically synthesized
tctgagcctgccagcctataac

SEQ ID NO: 99061 - DNA, 22 bp, Artificial Sequence
  chemically synthesized
agcctgccagcctataacccat

SEQ ID NO: 99062 - DNA, 22 bp, Artificial Sequence
  chemically synthesized
ccagcctataacccatctgggc

SEQ ID NO: 99063 - DNA, 22 bp, Artificial Sequence
  chemically synthesized
taacccatctgggccctgatag

SEQ ID NO: 99064 - DNA, 22 bp, Artificial Sequence
  chemically synthesized
ggccctgatagctggtggccag

SEQ ID NO: 99065 - DNA, 22 bp, Artificial Sequence
  chemically synthesized
atagctggtggccagccctgac

SEQ ID NO: 99066 - DNA, 22 bp, Artificial Sequence
  chemically synthesized
gtggccagccctgaccccaccc

SEQ ID NO: 99067 - DNA, 22 bp, Artificial Sequence
  chemically synthesized
accccaccccaccctccctgga

SEQ ID NO: 99068 - DNA, 22 bp, Artificial Sequence
  chemically synthesized
cctggaacctctgatagacaca

SEQ ID NO: 99069 - DNA, 22 bp, Artificial Sequence
  chemically synthesized
gaacctctgatagacacatctg

SEQ ID NO: 99070 - DNA, 22 bp, Artificial Sequence
  chemically synthesized
tgatagacacatctggcacacc

SEQ ID NO: 99071 - DNA, 22 bp, Artificial Sequence
  chemically synthesized
atagacacatctggcacaccag

SEQ ID NO: 99072 - DNA, 22 bp, Artificial Sequence
  chemically synthesized
gcacaccagctcgcaaagtcac

SEQ ID NO: 99073 - DNA, 22 bp, Artificial Sequence
  chemically synthesized
gcaaagtcaccgtgagggtctt

SEQ ID NO: 99074 - DNA, 22 bp, Artificial Sequence
  chemically synthesized
gtgtttgctgagtcaaaattcc

SEQ ID NO: 99075 - DNA, 22 bp, Artificial Sequence
  chemically synthesized
tgtttgctgagtcaaaattcct

SEQ ID NO: 99076 - DNA, 22 bp, Artificial Sequence
  chemically synthesized
gctgagtcaaaattccttgaaa

SEQ ID NO: 99077 - DNA, 22 bp, Artificial Sequence
  chemically synthesized
ctgagtcaaaattccttgaaat

SEQ ID NO: 99078 - DNA, 22 bp, Artificial Sequence
  chemically synthesized
agtcaaaattccttgaaatcca

SEQ ID NO: 99079 - DNA, 22 bp, Artificial Sequence
  chemically synthesized
cttgaaatccaagtccttagag

SEQ ID NO: 99080 - DNA, 22 bp, Artificial Sequence
  chemically synthesized
gaaatccaagtccttagagact

SEQ ID NO: 99081 - DNA, 22 bp, Artificial Sequence
  chemically synthesized
aaatccaagtccttagagactc

SEQ ID NO: 99082 - DNA, 22 bp, Artificial Sequence
  chemically synthesized
agagactcctgctcccaaattt

SEQ ID NO: 99083 - DNA, 22 bp, Artificial Sequence
  chemically synthesized
gagactcctgctcccaaattta

SEQ ID NO: 99084 - DNA, 22 bp, Artificial Sequence
  chemically synthesized
ctgctcccaaatttacagtcat

SEQ ID NO: 99085 - DNA, 22 bp, Artificial Sequence
  chemically synthesized
ctcccaaatttacagtcataga

SEQ ID NO: 99086 - DNA, 22 bp, Artificial Sequence
  chemically synthesized
ccaaatttacagtcatagactt

SEQ ID NO: 99087 - DNA, 22 bp, Artificial Sequence
  chemically synthesized
acagtcatagacttcttcatgg

SEQ ID NO: 99088 - DNA, 22 bp, Artificial Sequence
  chemically synthesized
cagtcatagacttcttcatggc

SEQ ID NO: 99089 - DNA, 22 bp, Artificial Sequence
  chemically synthesized
cttcatggctgtctcctttatc

SEQ ID NO: 99090 - DNA, 22 bp, Artificial Sequence
  chemically synthesized
ttcatggctgtctcctttatcc

SEQ ID NO: 99091 - DNA, 22 bp, Artificial Sequence
  chemically synthesized
catggctgtctcctttatccac

SEQ ID NO: 99092 - DNA, 22 bp, Artificial Sequence
  chemically synthesized
atggctgtctcctttatccaca

SEQ ID NO: 99093 - DNA, 22 bp, Artificial Sequence
  chemically synthesized
tctcctttatccacagaatgat

SEQ ID NO: 99094 - DNA, 22 bp, Artificial Sequence
  chemically synthesized
ctttatccacagaatgattcct

SEQ ID NO: 99095 - DNA, 22 bp, Artificial Sequence
  chemically synthesized
tatccacagaatgattcctttg

SEQ ID NO: 99096 - DNA, 22 bp, Artificial Sequence
  chemically synthesized
atccacagaatgattcctttgc

SEQ ID NO: 99097 - DNA, 22 bp, Artificial Sequence
  chemically synthesized
tccacagaatgattcctttgct

SEQ ID NO: 99098 - DNA, 22 bp, Artificial Sequence
  chemically synthesized
ctttgcttcattgccccatcca

SEQ ID NO: 99099 - DNA, 22 bp, Artificial Sequence
  chemically synthesized
tgcttcattgccccatccatct

SEQ ID NO: 99100 - DNA, 22 bp, Artificial Sequence
  chemically synthesized
gcttcattgccccatccatctg

SEQ ID NO: 99101 - DNA, 22 bp, Artificial Sequence
  chemically synthesized
cttcattgccccatccatctga

SEQ ID NO: 99102 - DNA, 22 bp, Artificial Sequence
  chemically synthesized
cattgccccatccatctgatcc

SEQ ID NO: 99103 - DNA, 22 bp, Artificial Sequence
  chemically synthesized
attgccccatccatctgatcct

SEQ ID NO: 99104 - DNA, 22 bp, Artificial Sequence
  chemically synthesized
ccccatccatctgatcctcctc

SEQ ID NO: 99105 - DNA, 22 bp, Artificial Sequence
  chemically synthesized
atcctcctcatcagtgcagcac

SEQ ID NO: 99106 - DNA, 22 bp, Artificial Sequence
  chemically synthesized
ctcatcagtgcagcacagggcc

SEQ ID NO: 99107 - DNA, 22 bp, Artificial Sequence
  chemically synthesized
atcagtgcagcacagggcccat

SEQ ID NO: 99108 - DNA, 22 bp, Artificial Sequence
  chemically synthesized
cagagtctcacataggtctggc

SEQ ID NO: 99109 - DNA, 22 bp, Artificial Sequence
  chemically synthesized
acataggtctggcactgcctct

SEQ ID NO: 99110 - DNA, 22 bp, Artificial Sequence
  chemically synthesized
gcactgcctctgacatgtccga

SEQ ID NO: 99111 - DNA, 22 bp, Artificial Sequence
  chemically synthesized
cctctgacatgtccgaccttag

SEQ ID NO: 99112 - DNA, 22 bp, Artificial Sequence
  chemically synthesized
tgacatgtccgaccttaggcaa

SEQ ID NO: 99113 - DNA, 22 bp, Artificial Sequence
  chemically synthesized
acatgtccgaccttaggcaaat

SEQ ID NO: 99114 - DNA, 22 bp, Artificial Sequence
  chemically synthesized
aggcaaatgcttgactcttctg

SEQ ID NO: 99115 - DNA, 22 bp, Artificial Sequence
  chemically synthesized
ggcaaatgcttgactcttctga

SEQ ID NO: 99116 - DNA, 22 bp, Artificial Sequence
  chemically synthesized
gactcttctgagctcagtcttg

SEQ ID NO: 99117 - DNA, 22 bp, Artificial Sequence
  chemically synthesized
actcttctgagctcagtcttgt

SEQ ID NO: 99118 - DNA, 22 bp, Artificial Sequence
  chemically synthesized
ttctgagctcagtcttgtcatg

SEQ ID NO: 99119 - DNA, 22 bp, Artificial Sequence
  chemically synthesized
ctgagctcagtcttgtcatggc

SEQ ID NO: 99120 - DNA, 22 bp, Artificial Sequence
  chemically synthesized
tgagctcagtcttgtcatggca

SEQ ID NO: 99121 - DNA, 22 bp, Artificial Sequence
  chemically synthesized
agctcagtcttgtcatggcaaa

SEQ ID NO: 99122 - DNA, 22 bp, Artificial Sequence
  chemically synthesized
agtcttgtcatggcaaaataaa

SEQ ID NO: 99123 - DNA, 22 bp, Artificial Sequence
  chemically synthesized
gtcatggcaaaataaagataat

SEQ ID NO: 99124 - DNA, 22 bp, Artificial Sequence
  chemically synthesized
tcatggcaaaataaagataata

SEQ ID NO: 99125 - DNA, 22 bp, Artificial Sequence
  chemically synthesized
ttttatggagttagcgtgagga

SEQ ID NO: 99126 - DNA, 22 bp, Artificial Sequence
  chemically synthesized
tttatggagttagcgtgaggat

SEQ ID NO: 99127 - DNA, 22 bp, Artificial Sequence
  chemically synthesized
ttatggagttagcgtgaggatg

SEQ ID NO: 99128 - DNA, 22 bp, Artificial Sequence
  chemically synthesized
tatggagttagcgtgaggatgg

SEQ ID NO: 99129 - DNA, 22 bp, Artificial Sequence
  chemically synthesized
atggagttagcgtgaggatgga

SEQ ID NO: 99130 - DNA, 22 bp, Artificial Sequence
  chemically synthesized
tggagttagcgtgaggatggaa

SEQ ID NO: 99131 - DNA, 22 bp, Artificial Sequence
  chemically synthesized
gcgtgaggatggaaaacaatag

SEQ ID NO: 99132 - DNA, 22 bp, Artificial Sequence
  chemically synthesized
attagactataaaaggtctcaa

SEQ ID NO: 99133 - DNA, 22 bp, Artificial Sequence
  chemically synthesized
gactataaaaggtctcaacaaa

SEQ ID NO: 99134 - DNA, 22 bp, Artificial Sequence
  chemically synthesized
taaaaggtctcaacaaatagta

SEQ ID NO: 99135 - DNA, 22 bp, Artificial Sequence
  chemically synthesized
aacaaatagtagtagattttat

SEQ ID NO: 99136 - DNA, 22 bp, Artificial Sequence
  chemically synthesized
tatcgtccattaatccttccct

SEQ ID NO: 99137 - DNA, 22 bp, Artificial Sequence
  chemically synthesized
atcgtccattaatccttccctc

SEQ ID NO: 99138 - DNA, 22 bp, Artificial Sequence
  chemically synthesized
tcgtccattaatccttccctct

SEQ ID NO: 99139 - DNA, 22 bp, Artificial Sequence
  chemically synthesized
atccttccctctcctctcttac

SEQ ID NO: 99140 - DNA, 22 bp, Artificial Sequence
  chemically synthesized
ccctctcctctcttactcatcc

SEQ ID NO: 99141 - DNA, 22 bp, Artificial Sequence
  chemically synthesized
cctctcctctcttactcatccc

SEQ ID NO: 99142 - DNA, 22 bp, Artificial Sequence
  chemically synthesized
tcctctcttactcatcccatca

SEQ ID NO: 99143 - DNA, 22 bp, Artificial Sequence
  chemically synthesized
ctctcttactcatcccatcacg

SEQ ID NO: 99144 - DNA, 22 bp, Artificial Sequence
  chemically synthesized
tcttactcatcccatcacgtat

SEQ ID NO: 99145 - DNA, 22 bp, Artificial Sequence
  chemically synthesized
ttactcatcccatcacgtatgc

SEQ ID NO: 99146 - DNA, 22 bp, Artificial Sequence
  chemically synthesized
actcatcccatcacgtatgcct

SEQ ID NO: 99147 - DNA, 22 bp, Artificial Sequence
  chemically synthesized
ctcatcccatcacgtatgcctc

SEQ ID NO: 99148 - DNA, 22 bp, Artificial Sequence
  chemically synthesized
atcccatcacgtatgcctctta

SEQ ID NO: 99149 - DNA, 22 bp, Artificial Sequence
  chemically synthesized
ttaattttcccttacctataat

SEQ ID NO: 99150 - DNA, 22 bp, Artificial Sequence
  chemically synthesized
aattttcccttacctataataa

SEQ ID NO: 99151 - DNA, 22 bp, Artificial Sequence
  chemically synthesized
attttcccttacctataataag

SEQ ID NO: 99152 - DNA, 22 bp, Artificial Sequence
  chemically synthesized
tcccttacctataataagagtt

SEQ ID NO: 99153 - DNA, 22 bp, Artificial Sequence
  chemically synthesized
cccttacctataataagagtta

SEQ ID NO: 99154 - DNA, 22 bp, Artificial Sequence
  chemically synthesized
ccttacctataataagagttat

SEQ ID NO: 99155 - DNA, 22 bp, Artificial Sequence
  chemically synthesized
acctataataagagttattcct

SEQ ID NO: 99156 - DNA, 22 bp, Artificial Sequence
  chemically synthesized
cctataataagagttattcctc

SEQ ID NO: 99157 - DNA, 22 bp, Artificial Sequence
  chemically synthesized
taataagagttattcctcttat

SEQ ID NO: 99158 - DNA, 22 bp, Artificial Sequence
  chemically synthesized
ttcctcttattatattcttctt

SEQ ID NO: 99159 - DNA, 22 bp, Artificial Sequence
  chemically synthesized
ctcttattatattcttcttata

SEQ ID NO: 99160 - DNA, 22 bp, Artificial Sequence
  chemically synthesized
ttattatattcttcttatagtg

SEQ ID NO: 99161 - DNA, 22 bp, Artificial Sequence
  chemically synthesized
attatattcttcttatagtgat

SEQ ID NO: 99162 - DNA, 22 bp, Artificial Sequence
  chemically synthesized
ttatattcttcttatagtgatt

SEQ ID NO: 99163 - DNA, 22 bp, Artificial Sequence
  chemically synthesized
tattcttcttatagtgattctg

SEQ ID NO: 99164 - DNA, 22 bp, Artificial Sequence
  chemically synthesized
ttcttatagtgattctggatat

SEQ ID NO: 99165 - DNA, 22 bp, Artificial Sequence
  chemically synthesized
cttatagtgattctggatatta

SEQ ID NO: 99166 - DNA, 22 bp, Artificial Sequence
  chemically synthesized
ttatagtgattctggatattaa

SEQ ID NO: 99167 - DNA, 22 bp, Artificial Sequence
  chemically synthesized
atagtgattctggatattaaag

SEQ ID NO: 99168 - DNA, 22 bp, Artificial Sequence
  chemically synthesized
tagtgattctggatattaaagt

SEQ ID NO: 99169 - DNA, 22 bp, Artificial Sequence
  chemically synthesized
tggatattaaagtgggaatgag

SEQ ID NO: 99170 - DNA, 22 bp, Artificial Sequence
  chemically synthesized
gatattaaagtgggaatgaggg

SEQ ID NO: 99171 - DNA, 22 bp, Artificial Sequence
  chemically synthesized
aagtgggaatgaggggcaggcc

SEQ ID NO: 99172 - DNA, 22 bp, Artificial Sequence
  chemically synthesized
acgaagaagatgtttctcaaag

SEQ ID NO: 99173 - DNA, 22 bp, Artificial Sequence
  chemically synthesized
ctcaaagaagccattctcccca

SEQ ID NO: 99174 - DNA, 22 bp, Artificial Sequence
  chemically synthesized
tcaaagaagccattctccccac

SEQ ID NO: 99175 - DNA, 22 bp, Artificial Sequence
  chemically synthesized
aaagaagccattctccccacat

SEQ ID NO: 99176 - DNA, 22 bp, Artificial Sequence
  chemically synthesized
tccccacatagatcatctcagc

SEQ ID NO: 99177 - DNA, 22 bp, Artificial Sequence
  chemically synthesized
cccacatagatcatctcagcag

SEQ ID NO: 99178 - DNA, 22 bp, Artificial Sequence
  chemically synthesized
agcagggttcaggaagataaag

SEQ ID NO: 99179 - DNA, 22 bp, Artificial Sequence
  chemically synthesized
aggaagataaaggaggatcaag

SEQ ID NO: 99180 - DNA, 22 bp, Artificial Sequence
  chemically synthesized
aggaagaacactgggcaagtgg

SEQ ID NO: 99181 - DNA, 22 bp, Artificial Sequence
  chemically synthesized
ggcaagtggatccaggttgtcc

SEQ ID NO: 99182 - DNA, 22 bp, Artificial Sequence
  chemically synthesized
tccaacgctgaaagtaggaatc

SEQ ID NO: 99183 - DNA, 22 bp, Artificial Sequence
  chemically synthesized
aaagtaggaatctaagcactag

SEQ ID NO: 99184 - DNA, 22 bp, Artificial Sequence
  chemically synthesized
agcactagtctctggatgctag

SEQ ID NO: 99185 - DNA, 22 bp, Artificial Sequence
  chemically synthesized
gtctctggatgctaggagggcc

SEQ ID NO: 99186 - DNA, 22 bp, Artificial Sequence
  chemically synthesized
tggatgctaggagggcctctgc

SEQ ID NO: 99187 - DNA, 22 bp, Artificial Sequence
  chemically synthesized
gatgctaggagggcctctgcat

SEQ ID NO: 99188 - DNA, 22 bp, Artificial Sequence
  chemically synthesized
ggagggcctctgcatgggtaac

SEQ ID NO: 99189 - DNA, 22 bp, Artificial Sequence
  chemically synthesized
tgcatgggtaactctttcaact

SEQ ID NO: 99190 - DNA, 22 bp, Artificial Sequence
  chemically synthesized
catgggtaactctttcaactag

SEQ ID NO: 99191 - DNA, 22 bp, Artificial Sequence
  chemically synthesized
tttcaactagccaggggctgga

SEQ ID NO: 99192 - DNA, 22 bp, Artificial Sequence
  chemically synthesized
tcaactagccaggggctggact

SEQ ID NO: 99193 - DNA, 22 bp, Artificial Sequence
  chemically synthesized
caactagccaggggctggactg

SEQ ID NO: 99194 - DNA, 22 bp, Artificial Sequence
  chemically synthesized
aactagccaggggctggactgt

SEQ ID NO: 99195 - DNA, 22 bp, Artificial Sequence
  chemically synthesized
gccaggggctggactgtggaga

SEQ ID NO: 99196 - DNA, 22 bp, Artificial Sequence
  chemically synthesized
gactgtggagaaaccatttcca

SEQ ID NO: 99197 - DNA, 22 bp, Artificial Sequence
  chemically synthesized
tggagaaaccatttccagatag

SEQ ID NO: 99198 - DNA, 22 bp, Artificial Sequence
  chemically synthesized
ccagatagaagtgaggagattc

SEQ ID NO: 99199 - DNA, 22 bp, Artificial Sequence
  chemically synthesized
cagatagaagtgaggagattcc

SEQ ID NO: 99200 - DNA, 22 bp, Artificial Sequence
  chemically synthesized
cagcaggaaacacttaagagag

SEQ ID NO: 99201 - DNA, 22 bp, Artificial Sequence
  chemically synthesized
aagagaggatccctggaagttc

SEQ ID NO: 99202 - DNA, 22 bp, Artificial Sequence
  chemically synthesized
agagaggatccctggaagttcg

SEQ ID NO: 99203 - DNA, 22 bp, Artificial Sequence
  chemically synthesized
gaagttcggggcaggaggctcc

SEQ ID NO: 99204 - DNA, 22 bp, Artificial Sequence
  chemically synthesized
ggggcaggaggctccctgtcac

SEQ ID NO: 99205 - DNA, 22 bp, Artificial Sequence
  chemically synthesized
cctgtcacatgaaggaaacctg

SEQ ID NO: 99206 - DNA, 22 bp, Artificial Sequence
  chemically synthesized
tcacatgaaggaaacctgctca

SEQ ID NO: 99207 - DNA, 22 bp, Artificial Sequence
  chemically synthesized
ctcagcgtaggctctaggttct

SEQ ID NO: 99208 - DNA, 22 bp, Artificial Sequence
  chemically synthesized
agcgtaggctctaggttcttcc

SEQ ID NO: 99209 - DNA, 22 bp, Artificial Sequence
  chemically synthesized
taggttcttccctactcttatc

SEQ ID NO: 99210 - DNA, 22 bp, Artificial Sequence
  chemically synthesized
ggttcttccctactcttatcca

SEQ ID NO: 99211 - DNA, 22 bp, Artificial Sequence
  chemically synthesized
ttccctactcttatccaatggg

SEQ ID NO: 99212 - DNA, 22 bp, Artificial Sequence
  chemically synthesized
ccctactcttatccaatggggc

SEQ ID NO: 99213 - DNA, 22 bp, Artificial Sequence
  chemically synthesized
cctactcttatccaatggggct

SEQ ID NO: 99214 - DNA, 22 bp, Artificial Sequence
  chemically synthesized
ctcttatccaatggggcttctg

SEQ ID NO: 99215 - DNA, 22 bp, Artificial Sequence
  chemically synthesized
ttatccaatggggcttctgatt

SEQ ID NO: 99216 - DNA, 22 bp, Artificial Sequence
  chemically synthesized
atccaatggggcttctgatttt

SEQ ID NO: 99217 - DNA, 22 bp, Artificial Sequence
  chemically synthesized
tccaatggggcttctgatttta

SEQ ID NO: 99218 - DNA, 22 bp, Artificial Sequence
  chemically synthesized
ctgattttaagccagtcttcac

SEQ ID NO: 99219 - DNA, 22 bp, Artificial Sequence
  chemically synthesized
tgattttaagccagtcttcaca

SEQ ID NO: 99220 - DNA, 22 bp, Artificial Sequence
  chemically synthesized
attttaagccagtcttcacaaa

SEQ ID NO: 99221 - DNA, 22 bp, Artificial Sequence
  chemically synthesized
taagccagtcttcacaaagccc

SEQ ID NO: 99222 - DNA, 22 bp, Artificial Sequence
  chemically synthesized
aagccagtcttcacaaagcccc

SEQ ID NO: 99223 - DNA, 22 bp, Artificial Sequence
  chemically synthesized
agccagtcttcacaaagcccca

SEQ ID NO: 99224 - DNA, 22 bp, Artificial Sequence
  chemically synthesized
cacaaagccccagatttctaca

SEQ ID NO: 99225 - DNA, 22 bp, Artificial Sequence
  chemically synthesized
acaaagccccagatttctacat

SEQ ID NO: 99226 - DNA, 22 bp, Artificial Sequence
  chemically synthesized
ctacatgctggagccctgaatg

SEQ ID NO: 99227 - DNA, 22 bp, Artificial Sequence
  chemically synthesized
tacatgctggagccctgaatgg

SEQ ID NO: 99228 - DNA, 22 bp, Artificial Sequence
  chemically synthesized
catgctggagccctgaatgggc

SEQ ID NO: 99229 - DNA, 22 bp, Artificial Sequence
  chemically synthesized
gagccctgaatgggcaggaagc

SEQ ID NO: 99230 - DNA, 22 bp, Artificial Sequence
  chemically synthesized
aatgggcaggaagcattgcggt

SEQ ID NO: 99231 - DNA, 22 bp, Artificial Sequence
  chemically synthesized
cggtttccatttcattcagagc

SEQ ID NO: 99232 - DNA, 22 bp, Artificial Sequence
  chemically synthesized
ccatttcattcagagctctttc

SEQ ID NO: 99233 - DNA, 22 bp, Artificial Sequence
  chemically synthesized
catttcattcagagctctttca

SEQ ID NO: 99234 - DNA, 22 bp, Artificial Sequence
  chemically synthesized
cattcagagctctttcataccc

SEQ ID NO: 99235 - DNA, 22 bp, Artificial Sequence
  chemically synthesized
attcagagctctttcataccct

SEQ ID NO: 99236 - DNA, 22 bp, Artificial Sequence
  chemically synthesized
agagctctttcataccctgctt

SEQ ID NO: 99237 - DNA, 22 bp, Artificial Sequence
  chemically synthesized
tttcataccctgcttccccata

SEQ ID NO: 99238 - DNA, 22 bp, Artificial Sequence
  chemically synthesized
tcataccctgcttccccatagt

SEQ ID NO: 99239 - DNA, 22 bp, Artificial Sequence
  chemically synthesized
cataccctgcttccccatagtt

SEQ ID NO: 99240 - DNA, 22 bp, Artificial Sequence
  chemically synthesized
ataccctgcttccccatagttt

SEQ ID NO: 99241 - DNA, 22 bp, Artificial Sequence
  chemically synthesized
cttccccatagtttgtctcaac

SEQ ID NO: 99242 - DNA, 22 bp, Artificial Sequence
  chemically synthesized
ccccatagtttgtctcaacatt

SEQ ID NO: 99243 - DNA, 22 bp, Artificial Sequence
  chemically synthesized
cccatagtttgtctcaacattt

SEQ ID NO: 99244 - DNA, 22 bp, Artificial Sequence
  chemically synthesized
gtctcaacatttctgttgataa

SEQ ID NO: 99245 - DNA, 22 bp, Artificial Sequence
  chemically synthesized
tctcaacatttctgttgataat

SEQ ID NO: 99246 - DNA, 22 bp, Artificial Sequence
  chemically synthesized
aacatttctgttgataatctga

SEQ ID NO: 99247 - DNA, 22 bp, Artificial Sequence
  chemically synthesized
ctgttgataatctgattcatgc

SEQ ID NO: 99248 - DNA, 22 bp, Artificial Sequence
  chemically synthesized
tgttgataatctgattcatgca

SEQ ID NO: 99249 - DNA, 22 bp, Artificial Sequence
  chemically synthesized
ttgataatctgattcatgcaac

SEQ ID NO: 99250 - DNA, 22 bp, Artificial Sequence
  chemically synthesized
ataatctgattcatgcaaccaa

SEQ ID NO: 99251 - DNA, 22 bp, Artificial Sequence
  chemically synthesized
attcatgcaaccaagaattatg

SEQ ID NO: 99252 - DNA, 22 bp, Artificial Sequence
  chemically synthesized
atgcaaccaagaattatgagag

SEQ ID NO: 99253 - DNA, 22 bp, Artificial Sequence
  chemically synthesized
tgagagagccttcagtcatgcc

SEQ ID NO: 99254 - DNA, 22 bp, Artificial Sequence
  chemically synthesized
cagtcatgcctaggcctgcatt

SEQ ID NO: 99255 - DNA, 22 bp, Artificial Sequence
  chemically synthesized
agtcatgcctaggcctgcattt

SEQ ID NO: 99256 - DNA, 22 bp, Artificial Sequence
  chemically synthesized
ggcctgcatttattgttgtgca

SEQ ID NO: 99257 - DNA, 22 bp, Artificial Sequence
  chemically synthesized
catttattgttgtgcatatgat

SEQ ID NO: 99258 - DNA, 22 bp, Artificial Sequence
  chemically synthesized
attgttgtgcatatgatggggt

SEQ ID NO: 99259 - DNA, 22 bp, Artificial Sequence
  chemically synthesized
ttgttgtgcatatgatggggta

SEQ ID NO: 99260 - DNA, 22 bp, Artificial Sequence
  chemically synthesized
ttgtgcatatgatggggtagca

SEQ ID NO: 99261 - DNA, 22 bp, Artificial Sequence
  chemically synthesized
tgcatatgatggggtagcagac

SEQ ID NO: 99262 - DNA, 22 bp, Artificial Sequence
  chemically synthesized
acagcatagactttctcagagc

SEQ ID NO: 99263 - DNA, 22 bp, Artificial Sequence
  chemically synthesized
tctcagagctatatgagtttgg

SEQ ID NO: 99264 - DNA, 22 bp, Artificial Sequence
  chemically synthesized
ctcagagctatatgagtttggg

SEQ ID NO: 99265 - DNA, 22 bp, Artificial Sequence
  chemically synthesized
tcagagctatatgagtttggga

SEQ ID NO: 99266 - DNA, 22 bp, Artificial Sequence
  chemically synthesized
agagctatatgagtttgggaat

SEQ ID NO: 99267 - DNA, 22 bp, Artificial Sequence
  chemically synthesized
tatgagtttgggaattaatcaa

SEQ ID NO: 99268 - DNA, 22 bp, Artificial Sequence
  chemically synthesized
gggaattaatcaagaccagcct

SEQ ID NO: 99269 - DNA, 22 bp, Artificial Sequence
  chemically synthesized
ggaattaatcaagaccagcctt

SEQ ID NO: 99270 - DNA, 22 bp, Artificial Sequence
  chemically synthesized
atcaagaccagccttttgctca

SEQ ID NO: 99271 - DNA, 22 bp, Artificial Sequence
  chemically synthesized
ttgctcagggtagaaatcccct

SEQ ID NO: 99272 - DNA, 22 bp, Artificial Sequence
  chemically synthesized
tgctcagggtagaaatccccta

SEQ ID NO: 99273 - DNA, 22 bp, Artificial Sequence
  chemically synthesized
gctcagggtagaaatcccctat

SEQ ID NO: 99274 - DNA, 22 bp, Artificial Sequence
  chemically synthesized
ctcagggtagaaatcccctata

SEQ ID NO: 99275 - DNA, 22 bp, Artificial Sequence
  chemically synthesized
agggtagaaatcccctataggg

SEQ ID NO: 99276 - DNA, 22 bp, Artificial Sequence
  chemically synthesized
tagggatttattcaatgatggg

SEQ ID NO: 99277 - DNA, 22 bp, Artificial Sequence
  chemically synthesized
attcaatgatgggttaaaagct

SEQ ID NO: 99278 - DNA, 22 bp, Artificial Sequence
  chemically synthesized
ttcaatgatgggttaaaagctt

SEQ ID NO: 99279 - DNA, 22 bp, Artificial Sequence
  chemically synthesized
aatgatgggttaaaagctttct

SEQ ID NO: 99280 - DNA, 22 bp, Artificial Sequence
  chemically synthesized
aaagctttctatatggtgagga

SEQ ID NO: 99281 - DNA, 22 bp, Artificial Sequence
  chemically synthesized
tctatatggtgaggagctcaca

SEQ ID NO: 99282 - DNA, 22 bp, Artificial Sequence
  chemically synthesized
ctatatggtgaggagctcacag

SEQ ID NO: 99283 - DNA, 22 bp, Artificial Sequence
  chemically synthesized
tatatggtgaggagctcacaga

SEQ ID NO: 99284 - DNA, 22 bp, Artificial Sequence
  chemically synthesized
tatggtgaggagctcacagatt

SEQ ID NO: 99285 - DNA, 22 bp, Artificial Sequence
  chemically synthesized
acagattttccaagcccttgct

SEQ ID NO: 99286 - DNA, 22 bp, Artificial Sequence
  chemically synthesized
tccaagcccttgcttttgctag

SEQ ID NO: 99287 - DNA, 22 bp, Artificial Sequence
  chemically synthesized
ccaagcccttgcttttgctaga

SEQ ID NO: 99288 - DNA, 22 bp, Artificial Sequence
  chemically synthesized
caagcccttgcttttgctagac

SEQ ID NO: 99289 - DNA, 22 bp, Artificial Sequence
  chemically synthesized
gcttttgctagacagcttaatg

SEQ ID NO: 99290 - DNA, 22 bp, Artificial Sequence
  chemically synthesized
cttttgctagacagcttaatgt

SEQ ID NO: 99291 - DNA, 22 bp, Artificial Sequence
  chemically synthesized
ttgctagacagcttaatgttta

SEQ ID NO: 99292 - DNA, 22 bp, Artificial Sequence
  chemically synthesized
tgctagacagcttaatgtttat

SEQ ID NO: 99293 - DNA, 22 bp, Artificial Sequence
  chemically synthesized
gctagacagcttaatgtttatg

SEQ ID NO: 99294 - DNA, 22 bp, Artificial Sequence
  chemically synthesized
ctagacagcttaatgtttatga

SEQ ID NO: 99295 - DNA, 22 bp, Artificial Sequence
  chemically synthesized
gacagcttaatgtttatgaaat

SEQ ID NO: 99296 - DNA, 22 bp, Artificial Sequence
  chemically synthesized
aatgtttatgaaattcttacac

SEQ ID NO: 99297 - DNA, 22 bp, Artificial Sequence
  chemically synthesized
atgtttatgaaattcttacaca

SEQ ID NO: 99298 - DNA, 22 bp, Artificial Sequence
  chemically synthesized
atgaaattcttacacacagaag

SEQ ID NO: 99299 - DNA, 22 bp, Artificial Sequence
  chemically synthesized
tgaaattcttacacacagaaga

SEQ ID NO: 99300 - DNA, 22 bp, Artificial Sequence
  chemically synthesized
ttacacacagaagaatcttcta

SEQ ID NO: 99301 - DNA, 22 bp, Artificial Sequence
  chemically synthesized
acacacagaagaatcttctaat

SEQ ID NO: 99302 - DNA, 22 bp, Artificial Sequence
  chemically synthesized
cacacagaagaatcttctaatc

SEQ ID NO: 99303 - DNA, 22 bp, Artificial Sequence
  chemically synthesized
ctaatcctgggttacataatat

SEQ ID NO: 99304 - DNA, 22 bp, Artificial Sequence
  chemically synthesized
taatcctgggttacataatata

SEQ ID NO: 99305 - DNA, 22 bp, Artificial Sequence
  chemically synthesized
atcctgggttacataatataac

SEQ ID NO: 99306 - DNA, 22 bp, Artificial Sequence
  chemically synthesized
ggttacataatataacttgatt

SEQ ID NO: 99307 - DNA, 22 bp, Artificial Sequence
  chemically synthesized
cataatataacttgattcccta

SEQ ID NO: 99308 - DNA, 22 bp, Artificial Sequence
  chemically synthesized
gattccctattccagaagataa

SEQ ID NO: 99309 - DNA, 22 bp, Artificial Sequence
  chemically synthesized
attccctattccagaagataat

SEQ ID NO: 99310 - DNA, 22 bp, Artificial Sequence
  chemically synthesized
cctattccagaagataatattc

SEQ ID NO: 99311 - DNA, 22 bp, Artificial Sequence
  chemically synthesized
ttccagaagataatattcccat

SEQ ID NO: 99312 - DNA, 22 bp, Artificial Sequence
  chemically synthesized
cagaagataatattcccatatt

SEQ ID NO: 99313 - DNA, 22 bp, Artificial Sequence
  chemically synthesized
ccatattctgaagcattcatgc

SEQ ID NO: 99314 - DNA, 22 bp, Artificial Sequence
  chemically synthesized
tgaagcattcatgcatttgtta

SEQ ID NO: 99315 - DNA, 22 bp, Artificial Sequence
  chemically synthesized
aagcattcatgcatttgttaaa

SEQ ID NO: 99316 - DNA, 22 bp, Artificial Sequence
  chemically synthesized
atgcatttgttaaataataggc

SEQ ID NO: 99317 - DNA, 22 bp, Artificial Sequence
  chemically synthesized
gttaaataataggcatagtgac

SEQ ID NO: 99318 - DNA, 22 bp, Artificial Sequence
  chemically synthesized
ttaaataataggcatagtgaca

SEQ ID NO: 99319 - DNA, 22 bp, Artificial Sequence
  chemically synthesized
aataataggcatagtgacaagt

SEQ ID NO: 99320 - DNA, 22 bp, Artificial Sequence
  chemically synthesized
taacagtcaaccagagagccac

SEQ ID NO: 99321 - DNA, 22 bp, Artificial Sequence
  chemically synthesized
acagtcaaccagagagccacag

SEQ ID NO: 99322 - DNA, 22 bp, Artificial Sequence
  chemically synthesized
tcaacttcacaaagttaaccat

SEQ ID NO: 99323 - DNA, 22 bp, Artificial Sequence
  chemically synthesized
caacttcacaaagttaaccatc

SEQ ID NO: 99324 - DNA, 22 bp, Artificial Sequence
  chemically synthesized
aacttcacaaagttaaccatct

SEQ ID NO: 99325 - DNA, 22 bp, Artificial Sequence
  chemically synthesized
cacaaagttaaccatctaactg

SEQ ID NO: 99326 - DNA, 22 bp, Artificial Sequence
  chemically synthesized
acaaagttaaccatctaactga

SEQ ID NO: 99327 - DNA, 22 bp, Artificial Sequence
  chemically synthesized
accatctaactgaagacagcag

SEQ ID NO: 99328 - DNA, 22 bp, Artificial Sequence
  chemically synthesized
actgaagacagcagcaatcaaa

SEQ ID NO: 99329 - DNA, 22 bp, Artificial Sequence
  chemically synthesized
aagacagcagcaatcaaaacca

SEQ ID NO: 99330 - DNA, 22 bp, Artificial Sequence
  chemically synthesized
ctccacatggtgtagtctttcc

SEQ ID NO: 99331 - DNA, 22 bp, Artificial Sequence
  chemically synthesized
tccacatggtgtagtctttcct

SEQ ID NO: 99332 - DNA, 22 bp, Artificial Sequence
  chemically synthesized
cacatggtgtagtctttcctga

SEQ ID NO: 99333 - DNA, 22 bp, Artificial Sequence
  chemically synthesized
tcctgatgtcagggatgttagg

SEQ ID NO: 99334 - DNA, 22 bp, Artificial Sequence
  chemically synthesized
cctgatgtcagggatgttaggc

SEQ ID NO: 99335 - DNA, 22 bp, Artificial Sequence
  chemically synthesized
ctgatgtcagggatgttaggct

SEQ ID NO: 99336 - DNA, 22 bp, Artificial Sequence
  chemically synthesized
atgtcagggatgttaggctcag

SEQ ID NO: 99337 - DNA, 22 bp, Artificial Sequence
  chemically synthesized
ggctcaggttaggaaagtcaga

SEQ ID NO: 99338 - DNA, 22 bp, Artificial Sequence
  chemically synthesized
aggttaggaaagtcagactatc

SEQ ID NO: 99339 - DNA, 22 bp, Artificial Sequence
  chemically synthesized
ggaaagtcagactatcatccca

SEQ ID NO: 99340 - DNA, 22 bp, Artificial Sequence
  chemically synthesized
tcatcccagagcaggacacaga

SEQ ID NO: 99341 - DNA, 22 bp, Artificial Sequence
  chemically synthesized
tttagtcacttaggaaaaacag

SEQ ID NO: 99342 - DNA, 22 bp, Artificial Sequence
  chemically synthesized
ttagtcacttaggaaaaacagt

SEQ ID NO: 99343 - DNA, 22 bp, Artificial Sequence
  chemically synthesized
tagtcacttaggaaaaacagtg

SEQ ID NO: 99344 - DNA, 22 bp, Artificial Sequence
  chemically synthesized
agtcacttaggaaaaacagtgg

SEQ ID NO: 99345 - DNA, 22 bp, Artificial Sequence
  chemically synthesized
gtcacttaggaaaaacagtgga

SEQ ID NO: 99346 - DNA, 22 bp, Artificial Sequence
  chemically synthesized
aggaaaaacagtggaatgcaaa

SEQ ID NO: 99347 - DNA, 22 bp, Artificial Sequence
  chemically synthesized
ggaaaaacagtggaatgcaaag

SEQ ID NO: 99348 - DNA, 22 bp, Artificial Sequence
  chemically synthesized
tctgaatggataacttggcctg

SEQ ID NO: 99349 - DNA, 22 bp, Artificial Sequence
  chemically synthesized
ctgaatggataacttggcctgg

SEQ ID NO: 99350 - DNA, 22 bp, Artificial Sequence
  chemically synthesized
tgaatggataacttggcctggg

SEQ ID NO: 99351 - DNA, 22 bp, Artificial Sequence
  chemically synthesized
aatggataacttggcctgggag

SEQ ID NO: 99352 - DNA, 22 bp, Artificial Sequence
  chemically synthesized
ggcctgggaggcctttggaagc

SEQ ID NO: 99353 - DNA, 22 bp, Artificial Sequence
  chemically synthesized
gcctgggaggcctttggaagca

SEQ ID NO: 99354 - DNA, 22 bp, Artificial Sequence
  chemically synthesized
ggaggcctttggaagcagagac

SEQ ID NO: 99355 - DNA, 22 bp, Artificial Sequence
  chemically synthesized
tggaagcagagactggagctta

SEQ ID NO: 99356 - DNA, 22 bp, Artificial Sequence
  chemically synthesized
ggaagcagagactggagcttaa

SEQ ID NO: 99357 - DNA, 22 bp, Artificial Sequence
  chemically synthesized
gaagcagagactggagcttaaa

SEQ ID NO: 99358 - DNA, 22 bp, Artificial Sequence
  chemically synthesized
gagcttaaatttaaacatcttt

SEQ ID NO: 99359 - DNA, 22 bp, Artificial Sequence
  chemically synthesized
aaatttaaacatctttgtatcc

SEQ ID NO: 99360 - DNA, 22 bp, Artificial Sequence
  chemically synthesized
aatttaaacatctttgtatccc

SEQ ID NO: 99361 - DNA, 22 bp, Artificial Sequence
  chemically synthesized
aaacatctttgtatccccagca

SEQ ID NO: 99362 - DNA, 22 bp, Artificial Sequence
  chemically synthesized
aacatctttgtatccccagcat

SEQ ID NO: 99363 - DNA, 22 bp, Artificial Sequence
  chemically synthesized
tgtatccccagcatccagcata

SEQ ID NO: 99364 - DNA, 22 bp, Artificial Sequence
  chemically synthesized
gtatccccagcatccagcatac

SEQ ID NO: 99365 - DNA, 22 bp, Artificial Sequence
  chemically synthesized
tatccccagcatccagcataca

SEQ ID NO: 99366 - DNA, 22 bp, Artificial Sequence
  chemically synthesized
ccaagaagtacatgtcaataaa

SEQ ID NO: 99367 - DNA, 22 bp, Artificial Sequence
  chemically synthesized
attggatagtgagcaaagacat

SEQ ID NO: 99368 - DNA, 22 bp, Artificial Sequence
  chemically synthesized
ttggatagtgagcaaagacata

SEQ ID NO: 99369 - DNA, 22 bp, Artificial Sequence
  chemically synthesized
gatagtgagcaaagacataatt

SEQ ID NO: 99370 - DNA, 22 bp, Artificial Sequence
  chemically synthesized
ggaccaaatctcaattctacta

SEQ ID NO: 99371 - DNA, 22 bp, Artificial Sequence
  chemically synthesized
aattctactatttgctagtagt

SEQ ID NO: 99372 - DNA, 22 bp, Artificial Sequence
  chemically synthesized
tactatttgctagtagtttatg

SEQ ID NO: 99373 - DNA, 22 bp, Artificial Sequence
  chemically synthesized
ctatttgctagtagtttatgtt

SEQ ID NO: 99374 - DNA, 22 bp, Artificial Sequence
  chemically synthesized
tttgctagtagtttatgtttgt

SEQ ID NO: 99375 - DNA, 22 bp, Artificial Sequence
  chemically synthesized
gctagtagtttatgtttgtgtg

SEQ ID NO: 99376 - DNA, 22 bp, Artificial Sequence
  chemically synthesized
ctagtagtttatgtttgtgtgt

SEQ ID NO: 99377 - DNA, 22 bp, Artificial Sequence
  chemically synthesized
gtagtttatgtttgtgtgtgtg

SEQ ID NO: 99378 - DNA, 22 bp, Artificial Sequence
  chemically synthesized
atgtttgtgtgtgtgagagtgt

SEQ ID NO: 99379 - DNA, 22 bp, Artificial Sequence
  chemically synthesized
tgtttgtgtgtgtgagagtgta

SEQ ID NO: 99380 - DNA, 22 bp, Artificial Sequence
  chemically synthesized
gtgtgtgtgagagtgtatgctt

SEQ ID NO: 99381 - DNA, 22 bp, Artificial Sequence
  chemically synthesized
tgtgtgtgagagtgtatgcttg

SEQ ID NO: 99382 - DNA, 22 bp, Artificial Sequence
  chemically synthesized
gagcaagttgagaggtagtttt

SEQ ID NO: 99383 - DNA, 22 bp, Artificial Sequence
  chemically synthesized
agcaagttgagaggtagttttt

SEQ ID NO: 99384 - DNA, 22 bp, Artificial Sequence
  chemically synthesized
agaggtagtttttttaactgta

SEQ ID NO: 99385 - DNA, 22 bp, Artificial Sequence
  chemically synthesized
ttttaactgtagtaaaatgggg

SEQ ID NO: 99386 - DNA, 22 bp, Artificial Sequence
  chemically synthesized
tttaactgtagtaaaatgggga

SEQ ID NO: 99387 - DNA, 22 bp, Artificial Sequence
  chemically synthesized
ttaactgtagtaaaatggggat

SEQ ID NO: 99388 - DNA, 22 bp, Artificial Sequence
  chemically synthesized
taactgtagtaaaatggggata

SEQ ID NO: 99389 - DNA, 22 bp, Artificial Sequence
  chemically synthesized
aactgtagtaaaatggggataa

SEQ ID NO: 99390 - DNA, 22 bp, Artificial Sequence
  chemically synthesized
actgtagtaaaatggggataat

SEQ ID NO: 99391 - DNA, 22 bp, Artificial Sequence
  chemically synthesized
tagtaaaatggggataataata

SEQ ID NO: 99392 - DNA, 22 bp, Artificial Sequence
  chemically synthesized
cctgaaagaatccaagagtatt

SEQ ID NO: 99393 - DNA, 22 bp, Artificial Sequence
  chemically synthesized
aaagaatccaagagtattaaat

SEQ ID NO: 99394 - DNA, 22 bp, Artificial Sequence
  chemically synthesized
aatatgattaattatgcaaagc

SEQ ID NO: 99395 - DNA, 22 bp, Artificial Sequence
  chemically synthesized
attatgcaaagcactaattaca

SEQ ID NO: 99396 - DNA, 22 bp, Artificial Sequence
  chemically synthesized
tgcaaagcactaattacagtct

SEQ ID NO: 99397 - DNA, 22 bp, Artificial Sequence
  chemically synthesized
attacagtctctgatagccttc

SEQ ID NO: 99398 - DNA, 22 bp, Artificial Sequence
  chemically synthesized
cagtctctgatagccttcaata

SEQ ID NO: 99399 - DNA, 22 bp, Artificial Sequence
  chemically synthesized
tgatagccttcaataaatgtca

SEQ ID NO: 99400 - DNA, 22 bp, Artificial Sequence
  chemically synthesized
atagccttcaataaatgtcagt

SEQ ID NO: 99401 - DNA, 22 bp, Artificial Sequence
  chemically synthesized
caataaatgtcagttattttta

SEQ ID NO: 99402 - DNA, 22 bp, Artificial Sequence
  chemically synthesized
aataaatgtcagttatttttat

SEQ ID NO: 99403 - DNA, 22 bp, Artificial Sequence
  chemically synthesized
tttttattattacagttaaaga

SEQ ID NO: 99404 - DNA, 22 bp, Artificial Sequence
  chemically synthesized
ttattattacagttaaagatga

SEQ ID NO: 99405 - DNA, 22 bp, Artificial Sequence
  chemically synthesized
tattattacagttaaagatgaa

SEQ ID NO: 99406 - DNA, 22 bp, Artificial Sequence
  chemically synthesized
attattacagttaaagatgaat

SEQ ID NO: 99407 - DNA, 22 bp, Artificial Sequence
  chemically synthesized
ttattacagttaaagatgaatg

SEQ ID NO: 99408 - DNA, 22 bp, Artificial Sequence
  chemically synthesized
ttacagttaaagatgaatgggc

SEQ ID NO: 99409 - DNA, 22 bp, Artificial Sequence
  chemically synthesized
cagttaaagatgaatgggcata

SEQ ID NO: 99410 - DNA, 22 bp, Artificial Sequence
  chemically synthesized
aagatgaatgggcataaagtac

SEQ ID NO: 99411 - DNA, 22 bp, Artificial Sequence
  chemically synthesized
gttttcacctgcagcaagaatg

SEQ ID NO: 99412 - DNA, 22 bp, Artificial Sequence
  chemically synthesized
tcacctgcagcaagaatgattg

SEQ ID NO: 99413 - DNA, 22 bp, Artificial Sequence
  chemically synthesized
cacctgcagcaagaatgattgc

SEQ ID NO: 99414 - DNA, 22 bp, Artificial Sequence
  chemically synthesized
acctgcagcaagaatgattgca

SEQ ID NO: 99415 - DNA, 22 bp, Artificial Sequence
  chemically synthesized
cagcaagaatgattgcagttaa

SEQ ID NO: 99416 - DNA, 22 bp, Artificial Sequence
  chemically synthesized
cagttaaacaaaaaatactagc

SEQ ID NO: 99417 - DNA, 22 bp, Artificial Sequence
  chemically synthesized
aacaaaaaatactagcaaacat

SEQ ID NO: 99418 - DNA, 22 bp, Artificial Sequence
  chemically synthesized
gcaaacatttctagagtagtta

SEQ ID NO: 99419 - DNA, 22 bp, Artificial Sequence
  chemically synthesized
ctagagtagttagcatttataa

SEQ ID NO: 99420 - DNA, 22 bp, Artificial Sequence
  chemically synthesized
tagagtagttagcatttataag

SEQ ID NO: 99421 - DNA, 22 bp, Artificial Sequence
  chemically synthesized
gagtagttagcatttataagtc

SEQ ID NO: 99422 - DNA, 22 bp, Artificial Sequence
  chemically synthesized
gcatttataagtcactgcttta

SEQ ID NO: 99423 - DNA, 22 bp, Artificial Sequence
  chemically synthesized
ataagtcactgctttaaactct

SEQ ID NO: 99424 - DNA, 22 bp, Artificial Sequence
  chemically synthesized
taagtcactgctttaaactctt

SEQ ID NO: 99425 - DNA, 22 bp, Artificial Sequence
  chemically synthesized
ctttaaactctttgcatgtatt

SEQ ID NO: 99426 - DNA, 22 bp, Artificial Sequence
  chemically synthesized
taaactctttgcatgtattaac

SEQ ID NO: 99427 - DNA, 22 bp, Artificial Sequence
  chemically synthesized
aaactctttgcatgtattaact

SEQ ID NO: 99428 - DNA, 22 bp, Artificial Sequence
  chemically synthesized
aactctttgcatgtattaactc

SEQ ID NO: 99429 - DNA, 22 bp, Artificial Sequence
  chemically synthesized
tttgcatgtattaactcactcg

SEQ ID NO: 99430 - DNA, 22 bp, Artificial Sequence
  chemically synthesized
tgcatgtattaactcactcggg

SEQ ID NO: 99431 - DNA, 22 bp, Artificial Sequence
  chemically synthesized
gcatgtattaactcactcgggc

SEQ ID NO: 99432 - DNA, 22 bp, Artificial Sequence
  chemically synthesized
catgtattaactcactcgggct

SEQ ID NO: 99433 - DNA, 22 bp, Artificial Sequence
  chemically synthesized
actcactcgggctgcagaacaa

SEQ ID NO: 99434 - DNA, 22 bp, Artificial Sequence
  chemically synthesized
actcgggctgcagaacaatctt

SEQ ID NO: 99435 - DNA, 22 bp, Artificial Sequence
  chemically synthesized
gggctgcagaacaatcttatga

SEQ ID NO: 99436 - DNA, 22 bp, Artificial Sequence
  chemically synthesized
cagaacaatcttatgagcctgt

SEQ ID NO: 99437 - DNA, 22 bp, Artificial Sequence
  chemically synthesized
atgagcctgttaaaactcctgt

SEQ ID NO: 99438 - DNA, 22 bp, Artificial Sequence
  chemically synthesized
tgagcctgttaaaactcctgta

SEQ ID NO: 99439 - DNA, 22 bp, Artificial Sequence
  chemically synthesized
ttaaaactcctgtaatcatgct

SEQ ID NO: 99440 - DNA, 22 bp, Artificial Sequence
  chemically synthesized
aaactcctgtaatcatgcttat

SEQ ID NO: 99441 - DNA, 22 bp, Artificial Sequence
  chemically synthesized
ctgtaatcatgcttataatccc

SEQ ID NO: 99442 - DNA, 22 bp, Artificial Sequence
  chemically synthesized
taatcatgcttataatcccagc

SEQ ID NO: 99443 - DNA, 22 bp, Artificial Sequence
  chemically synthesized
ataatcccagcactttggaagg

SEQ ID NO: 99444 - DNA, 22 bp, Artificial Sequence
  chemically synthesized
taatcccagcactttggaaggc

SEQ ID NO: 99445 - DNA, 22 bp, Artificial Sequence
  chemically synthesized
tggaaggctgaggtgggcagat

SEQ ID NO: 99446 - DNA, 22 bp, Artificial Sequence
  chemically synthesized
ggaaggctgaggtgggcagatt

SEQ ID NO: 99447 - DNA, 22 bp, Artificial Sequence
  chemically synthesized
gaaggctgaggtgggcagattg

SEQ ID NO: 99448 - DNA, 22 bp, Artificial Sequence
  chemically synthesized
aggtgggcagattgcttgagct

SEQ ID NO: 99449 - DNA, 22 bp, Artificial Sequence
  chemically synthesized
cttgagctccggagtctgagac

SEQ ID NO: 99450 - DNA, 22 bp, Artificial Sequence
  chemically synthesized
gagctccggagtctgagaccat

SEQ ID NO: 99451 - DNA, 22 bp, Artificial Sequence
  chemically synthesized
agctccggagtctgagaccatc

SEQ ID NO: 99452 - DNA, 22 bp, Artificial Sequence
  chemically synthesized
cggagtctgagaccatcctgtg

SEQ ID NO: 99453 - DNA, 22 bp, Artificial Sequence
  chemically synthesized
agaccatcctgtgtaacatgtg

SEQ ID NO: 99454 - DNA, 22 bp, Artificial Sequence
  chemically synthesized
tgtaacatgtgaaaccccatct

SEQ ID NO: 99455 - DNA, 22 bp, Artificial Sequence
  chemically synthesized
taccaaaaatacaaaaaattag

SEQ ID NO: 99456 - DNA, 22 bp, Artificial Sequence
  chemically synthesized
ccaaaaatacaaaaaattagcg

SEQ ID NO: 99457 - DNA, 22 bp, Artificial Sequence
  chemically synthesized
gcgaggtatggtggtgtgtacc

SEQ ID NO: 99458 - DNA, 22 bp, Artificial Sequence
  chemically synthesized
tggttccagctactcaggatgt

SEQ ID NO: 99459 - DNA, 22 bp, Artificial Sequence
  chemically synthesized
cagctactcaggatgttgaggt

SEQ ID NO: 99460 - DNA, 22 bp, Artificial Sequence
  chemically synthesized
ctcaggatgttgaggtgggagg

SEQ ID NO: 99461 - DNA, 22 bp, Artificial Sequence
  chemically synthesized
aggatgttgaggtgggaggacc

SEQ ID NO: 99462 - DNA, 22 bp, Artificial Sequence
  chemically synthesized
aggtgggaggaccgcttgagcc

SEQ ID NO: 99463 - DNA, 22 bp, Artificial Sequence
  chemically synthesized
gagcctgggaagtgcaagttgc

SEQ ID NO: 99464 - DNA, 22 bp, Artificial Sequence
  chemically synthesized
agcctgggaagtgcaagttgca

SEQ ID NO: 99465 - DNA, 22 bp, Artificial Sequence
  chemically synthesized
ggaagtgcaagttgcagtgagc

SEQ ID NO: 99466 - DNA, 22 bp, Artificial Sequence
  chemically synthesized
cagtgagccgagattttgccac

SEQ ID NO: 99467 - DNA, 22 bp, Artificial Sequence
  chemically synthesized
tgccactacactcccatttggg

SEQ ID NO: 99468 - DNA, 22 bp, Artificial Sequence
  chemically synthesized
gccactacactcccatttgggt

SEQ ID NO: 99469 - DNA, 22 bp, Artificial Sequence
  chemically synthesized
ccactacactcccatttgggtg

SEQ ID NO: 99470 - DNA, 22 bp, Artificial Sequence
  chemically synthesized
cactcccatttgggtgacagag

SEQ ID NO: 99471 - DNA, 22 bp, Artificial Sequence
  chemically synthesized
ccatttgggtgacagagtgaga

SEQ ID NO: 99472 - DNA, 22 bp, Artificial Sequence
  chemically synthesized
gggtgacagagtgagacccttt

SEQ ID NO: 99473 - DNA, 22 bp, Artificial Sequence
  chemically synthesized
ggtgacagagtgagaccctttc

SEQ ID NO: 99474 - DNA, 22 bp, Artificial Sequence
  chemically synthesized
tctcaaaaacaaactaattaaa

SEQ ID NO: 99475 - DNA, 22 bp, Artificial Sequence
  chemically synthesized
ctcaaaaacaaactaattaaaa

SEQ ID NO: 99476 - DNA, 22 bp, Artificial Sequence
  chemically synthesized
tcaaaaacaaactaattaaaaa

SEQ ID NO: 99477 - DNA, 22 bp, Artificial Sequence
  chemically synthesized
aaaaacaaactaattaaaaaac

SEQ ID NO: 99478 - DNA, 22 bp, Artificial Sequence
  chemically synthesized
attaaaaaaccctccattttac

SEQ ID NO: 99479 - DNA, 22 bp, Artificial Sequence
  chemically synthesized
aaaaaccctccattttacagat

SEQ ID NO: 99480 - DNA, 22 bp, Artificial Sequence
  chemically synthesized
cattttacagatgaagaaactg

SEQ ID NO: 99481 - DNA, 22 bp, Artificial Sequence
  chemically synthesized
tacagatgaagaaactgagtca

SEQ ID NO: 99482 - DNA, 22 bp, Artificial Sequence
  chemically synthesized
acagatgaagaaactgagtcat

SEQ ID NO: 99483 - DNA, 22 bp, Artificial Sequence
  chemically synthesized
cagatgaagaaactgagtcata

SEQ ID NO: 99484 - DNA, 22 bp, Artificial Sequence
  chemically synthesized
agtcatacaactactaagagaa

SEQ ID NO: 99485 - DNA, 22 bp, Artificial Sequence
  chemically synthesized
ctaagagaaactgagtcactaa

SEQ ID NO: 99486 - DNA, 22 bp, Artificial Sequence
  chemically synthesized
agagaaactgagtcactaatca

SEQ ID NO: 99487 - DNA, 22 bp, Artificial Sequence
  chemically synthesized
agtcactaatcactcaggtggt

SEQ ID NO: 99488 - DNA, 22 bp, Artificial Sequence
  chemically synthesized
atcactcaggtggtctggctcc

SEQ ID NO: 99489 - DNA, 22 bp, Artificial Sequence
  chemically synthesized
aggtggtctggctccagcatct

SEQ ID NO: 99490 - DNA, 22 bp, Artificial Sequence
  chemically synthesized
gctccagcatctgtactcttaa

SEQ ID NO: 99491 - DNA, 22 bp, Artificial Sequence
  chemically synthesized
cagcatctgtactcttaatctc

SEQ ID NO: 99492 - DNA, 22 bp, Artificial Sequence
  chemically synthesized
tactcttaatctctgctctata

SEQ ID NO: 99493 - DNA, 22 bp, Artificial Sequence
  chemically synthesized
ttaatctctgctctatactgcc

SEQ ID NO: 99494 - DNA, 22 bp, Artificial Sequence
  chemically synthesized
aatctctgctctatactgccca

SEQ ID NO: 99495 - DNA, 22 bp, Artificial Sequence
  chemically synthesized
atctctgctctatactgcccaa

SEQ ID NO: 99496 - DNA, 22 bp, Artificial Sequence
  chemically synthesized
tgctctatactgcccaagactt

SEQ ID NO: 99497 - DNA, 22 bp, Artificial Sequence
  chemically synthesized
ctctatactgcccaagactttt

SEQ ID NO: 99498 - DNA, 22 bp, Artificial Sequence
  chemically synthesized
tatactgcccaagacttttata

SEQ ID NO: 99499 - DNA, 22 bp, Artificial Sequence
  chemically synthesized
tactgcccaagacttttataaa

SEQ ID NO: 99500 - DNA, 22 bp, Artificial Sequence
  chemically synthesized
cccaagacttttataaagtcaa

SEQ ID NO: 99501 - DNA, 22 bp, Artificial Sequence
  chemically synthesized
ttataaagtcaagggttgagtc

SEQ ID NO: 99502 - DNA, 22 bp, Artificial Sequence
  chemically synthesized
tataaagtcaagggttgagtca

SEQ ID NO: 99503 - DNA, 22 bp, Artificial Sequence
  chemically synthesized
ataaagtcaagggttgagtcac

SEQ ID NO: 99504 - DNA, 22 bp, Artificial Sequence
  chemically synthesized
taaagtcaagggttgagtcact

SEQ ID NO: 99505 - DNA, 22 bp, Artificial Sequence
  chemically synthesized
agtcactgaaatgagttattgg

SEQ ID NO: 99506 - DNA, 22 bp, Artificial Sequence
  chemically synthesized
aaatgagttattgggatggctg

SEQ ID NO: 99507 - DNA, 22 bp, Artificial Sequence
  chemically synthesized
ttgggatggctgtgtgggaagg

SEQ ID NO: 99508 - DNA, 22 bp, Artificial Sequence
  chemically synthesized
ggatggctgtgtgggaagggtg

SEQ ID NO: 99509 - DNA, 22 bp, Artificial Sequence
  chemically synthesized
tgtgggaagggtgctaagttct

SEQ ID NO: 99510 - DNA, 22 bp, Artificial Sequence
  chemically synthesized
agttctttcctaaaggtatgtg

SEQ ID NO: 99511 - DNA, 22 bp, Artificial Sequence
  chemically synthesized
tttcctaaaggtatgtgagaat

SEQ ID NO: 99512 - DNA, 22 bp, Artificial Sequence
  chemically synthesized
tcctaaaggtatgtgagaatac

SEQ ID NO: 99513 - DNA, 22 bp, Artificial Sequence
  chemically synthesized
cctaaaggtatgtgagaataca

SEQ ID NO: 99514 - DNA, 22 bp, Artificial Sequence
  chemically synthesized
ctaaaggtatgtgagaatacaa

SEQ ID NO: 99515 - DNA, 22 bp, Artificial Sequence
  chemically synthesized
aaggtatgtgagaatacaaagg

SEQ ID NO: 99516 - DNA, 22 bp, Artificial Sequence
  chemically synthesized
ctttttacacacgtgaactagt

SEQ ID NO: 99517 - DNA, 22 bp, Artificial Sequence
  chemically synthesized
tttacacacgtgaactagtgca

SEQ ID NO: 99518 - DNA, 22 bp, Artificial Sequence
  chemically synthesized
ttacacacgtgaactagtgcat

SEQ ID NO: 99519 - DNA, 22 bp, Artificial Sequence
  chemically synthesized
tacacacgtgaactagtgcatg

SEQ ID NO: 99520 - DNA, 22 bp, Artificial Sequence
  chemically synthesized
acacacgtgaactagtgcatgc

SEQ ID NO: 99521 - DNA, 22 bp, Artificial Sequence
  chemically synthesized
cacacgtgaactagtgcatgca

SEQ ID NO: 99522 - DNA, 22 bp, Artificial Sequence
  chemically synthesized
gtgcatgcaaatctgacactca

SEQ ID NO: 99523 - DNA, 22 bp, Artificial Sequence
  chemically synthesized
acactcagtgggcctgggtgaa

SEQ ID NO: 99524 - DNA, 22 bp, Artificial Sequence
  chemically synthesized
agtgggcctgggtgaaggtgag

SEQ ID NO: 99525 - DNA, 22 bp, Artificial Sequence
  chemically synthesized
ggtgaaggtgagaattttattg

SEQ ID NO: 99526 - DNA, 22 bp, Artificial Sequence
  chemically synthesized
tattgctgaatgagagcctctg

SEQ ID NO: 99527 - DNA, 22 bp, Artificial Sequence
  chemically synthesized
attgctgaatgagagcctctgg

SEQ ID NO: 99528 - DNA, 22 bp, Artificial Sequence
  chemically synthesized
ttgctgaatgagagcctctggg

SEQ ID NO: 99529 - DNA, 22 bp, Artificial Sequence
  chemically synthesized
ctgaatgagagcctctggggac

SEQ ID NO: 99530 - DNA, 22 bp, Artificial Sequence
  chemically synthesized
aatgagagcctctggggacatc

SEQ ID NO: 99531 - DNA, 22 bp, Artificial Sequence
  chemically synthesized
tggggacatcttgccagtcaat

SEQ ID NO: 99532 - DNA, 22 bp, Artificial Sequence
  chemically synthesized
gggacatcttgccagtcaatga

SEQ ID NO: 99533 - DNA, 22 bp, Artificial Sequence
  chemically synthesized
gccagtcaatgagtctcaggtt

SEQ ID NO: 99534 - DNA, 22 bp, Artificial Sequence
  chemically synthesized
ccagtcaatgagtctcaggttc

SEQ ID NO: 99535 - DNA, 22 bp, Artificial Sequence
  chemically synthesized
aggttcaatttccttctcagtc

SEQ ID NO: 99536 - DNA, 22 bp, Artificial Sequence
  chemically synthesized
aatttccttctcagtcttggag

SEQ ID NO: 99537 - DNA, 22 bp, Artificial Sequence
  chemically synthesized
ccttctcagtcttggagtaaca

SEQ ID NO: 99538 - DNA, 22 bp, Artificial Sequence
  chemically synthesized
cttctcagtcttggagtaacag

SEQ ID NO: 99539 - DNA, 22 bp, Artificial Sequence
  chemically synthesized
ctcagtcttggagtaacagaag

SEQ ID NO: 99540 - DNA, 22 bp, Artificial Sequence
  chemically synthesized
tcagtcttggagtaacagaagc

SEQ ID NO: 99541 - DNA, 22 bp, Artificial Sequence
  chemically synthesized
agtcttggagtaacagaagctc

SEQ ID NO: 99542 - DNA, 22 bp, Artificial Sequence
  chemically synthesized
ggagtaacagaagctcatgcat

SEQ ID NO: 99543 - DNA, 22 bp, Artificial Sequence
  chemically synthesized
gagtaacagaagctcatgcatt

SEQ ID NO: 99544 - DNA, 22 bp, Artificial Sequence
  chemically synthesized
atgcatttaataaacggaaatt

SEQ ID NO: 99545 - DNA, 22 bp, Artificial Sequence
  chemically synthesized
aataaacggaaattttgtattg

SEQ ID NO: 99546 - DNA, 22 bp, Artificial Sequence
  chemically synthesized
ataaacggaaattttgtattga

SEQ ID NO: 99547 - DNA, 22 bp, Artificial Sequence
  chemically synthesized
tgtattgaaatgagagccattg

SEQ ID NO: 99548 - DNA, 22 bp, Artificial Sequence
  chemically synthesized
gtattgaaatgagagccattgg

SEQ ID NO: 99549 - DNA, 22 bp, Artificial Sequence
  chemically synthesized
tattgaaatgagagccattgga

SEQ ID NO: 99550 - DNA, 22 bp, Artificial Sequence
  chemically synthesized
aaatgagagccattggaaatca

SEQ ID NO: 99551 - DNA, 22 bp, Artificial Sequence
  chemically synthesized
gaaatcatttactccagactcc

SEQ ID NO: 99552 - DNA, 22 bp, Artificial Sequence
  chemically synthesized
actccagactcctacttataaa

SEQ ID NO: 99553 - DNA, 22 bp, Artificial Sequence
  chemically synthesized
ctccagactcctacttataaaa

SEQ ID NO: 99554 - DNA, 22 bp, Artificial Sequence
  chemically synthesized
cagactcctacttataaaaaga

SEQ ID NO: 99555 - DNA, 22 bp, Artificial Sequence
  chemically synthesized
ctacttataaaaagagaaactg

SEQ ID NO: 99556 - DNA, 22 bp, Artificial Sequence
  chemically synthesized
cttataaaaagagaaactgagg

SEQ ID NO: 99557 - DNA, 22 bp, Artificial Sequence
  chemically synthesized
ataaaaagagaaactgaggctc

SEQ ID NO: 99558 - DNA, 22 bp, Artificial Sequence
  chemically synthesized
taaaaagagaaactgaggctca

SEQ ID NO: 99559 - DNA, 22 bp, Artificial Sequence
  chemically synthesized
aggctcagagaagggtggggac

SEQ ID NO: 99560 - DNA, 22 bp, Artificial Sequence
  chemically synthesized
agagaagggtggggactttctc

SEQ ID NO: 99561 - DNA, 22 bp, Artificial Sequence
  chemically synthesized
tctcagtatgacatggaaatga

SEQ ID NO: 99562 - DNA, 22 bp, Artificial Sequence
  chemically synthesized
ctcagtatgacatggaaatgat

SEQ ID NO: 99563 - DNA, 22 bp, Artificial Sequence
  chemically synthesized
tcagtatgacatggaaatgatc

SEQ ID NO: 99564 - DNA, 22 bp, Artificial Sequence
  chemically synthesized
agtatgacatggaaatgatcag

SEQ ID NO: 99565 - DNA, 22 bp, Artificial Sequence
  chemically synthesized
ggattcaaagctcctgactttc

SEQ ID NO: 99566 - DNA, 22 bp, Artificial Sequence
  chemically synthesized
gattcaaagctcctgactttct

SEQ ID NO: 99567 - DNA, 22 bp, Artificial Sequence
  chemically synthesized
aaagctcctgactttctgtcta

SEQ ID NO: 99568 - DNA, 22 bp, Artificial Sequence
  chemically synthesized
ctgactttctgtctagtgtatg

SEQ ID NO: 99569 - DNA, 22 bp, Artificial Sequence
  chemically synthesized
actttctgtctagtgtatgtgc

SEQ ID NO: 99570 - DNA, 22 bp, Artificial Sequence
  chemically synthesized
tctgtctagtgtatgtgcagtg

SEQ ID NO: 99571 - DNA, 22 bp, Artificial Sequence
  chemically synthesized
ctgtctagtgtatgtgcagtga

SEQ ID NO: 99572 - DNA, 22 bp, Artificial Sequence
  chemically synthesized
tgtctagtgtatgtgcagtgag

SEQ ID NO: 99573 - DNA, 22 bp, Artificial Sequence
  chemically synthesized
tctagtgtatgtgcagtgagcc

SEQ ID NO: 99574 - DNA, 22 bp, Artificial Sequence
  chemically synthesized
gtgtatgtgcagtgagcccctt

SEQ ID NO: 99575 - DNA, 22 bp, Artificial Sequence
  chemically synthesized
ttcctctaactgaaagaaggaa

SEQ ID NO: 99576 - DNA, 22 bp, Artificial Sequence
  chemically synthesized
tcctctaactgaaagaaggaaa

SEQ ID NO: 99577 - DNA, 22 bp, Artificial Sequence
  chemically synthesized
cctctaactgaaagaaggaaaa

SEQ ID NO: 99578 - DNA, 22 bp, Artificial Sequence
  chemically synthesized
ctctaactgaaagaaggaaaaa

SEQ ID NO: 99579 - DNA, 22 bp, Artificial Sequence
  chemically synthesized
taactgaaagaaggaaaaaaaa

SEQ ID NO: 99580 - DNA, 22 bp, Artificial Sequence
  chemically synthesized
actgaaagaaggaaaaaaaaat

SEQ ID NO: 99581 - DNA, 22 bp, Artificial Sequence
  chemically synthesized
aaagaaggaaaaaaaaatggaa

SEQ ID NO: 99582 - DNA, 22 bp, Artificial Sequence
  chemically synthesized
tacatagtttccatgtcacagc

SEQ ID NO: 99583 - DNA, 22 bp, Artificial Sequence
  chemically synthesized
catagtttccatgtcacagcca

SEQ ID NO: 99584 - DNA, 22 bp, Artificial Sequence
  chemically synthesized
ccatgtcacagccagggctggg

SEQ ID NO: 99585 - DNA, 22 bp, Artificial Sequence
  chemically synthesized
catgtcacagccagggctgggc

SEQ ID NO: 99586 - DNA, 22 bp, Artificial Sequence
  chemically synthesized
ggcagtctcctgttatttcttt

SEQ ID NO: 99587 - DNA, 22 bp, Artificial Sequence
  chemically synthesized
ctgttatttcttttaaaataaa

SEQ ID NO: 99588 - DNA, 22 bp, Artificial Sequence
  chemically synthesized
ttatttcttttaaaataaatat

SEQ ID NO: 99589 - DNA, 22 bp, Artificial Sequence
  chemically synthesized
tttcttttaaaataaatatatc

SEQ ID NO: 99590 - DNA, 22 bp, Artificial Sequence
  chemically synthesized
cttttaaaataaatatatcatt

SEQ ID NO: 99591 - DNA, 22 bp, Artificial Sequence
  chemically synthesized
ttttaaaataaatatatcattt

SEQ ID NO: 99592 - DNA, 22 bp, Artificial Sequence
  chemically synthesized
ttaaaataaatatatcatttaa

SEQ ID NO: 99593 - DNA, 22 bp, Artificial Sequence
  chemically synthesized
taaaataaatatatcatttaaa

SEQ ID NO: 99594 - DNA, 22 bp, Artificial Sequence
  chemically synthesized
aaaataaatatatcatttaaat

SEQ ID NO: 99595 - DNA, 22 bp, Artificial Sequence
  chemically synthesized
aaataaatatatcatttaaatg

SEQ ID NO: 99596 - DNA, 22 bp, Artificial Sequence
  chemically synthesized
aaatgcataaataagcaaaccc

SEQ ID NO: 99597 - DNA, 22 bp, Artificial Sequence
  chemically synthesized
aatgcataaataagcaaaccct

SEQ ID NO: 99598 - DNA, 22 bp, Artificial Sequence
  chemically synthesized
ctcgggaatgggagggagagtc

SEQ ID NO: 99599 - DNA, 22 bp, Artificial Sequence
  chemically synthesized
gggaatgggagggagagtctct

SEQ ID NO: 99600 - DNA, 22 bp, Artificial Sequence
  chemically synthesized
tggagtccaccccttctcggcc

SEQ ID NO: 99601 - DNA, 22 bp, Artificial Sequence
  chemically synthesized
gagtccaccccttctcggccct

SEQ ID NO: 99602 - DNA, 22 bp, Artificial Sequence
  chemically synthesized
ctcggccctggctctgcagata

SEQ ID NO: 99603 - DNA, 22 bp, Artificial Sequence
  chemically synthesized
tcggccctggctctgcagatag

SEQ ID NO: 99604 - DNA, 22 bp, Artificial Sequence
  chemically synthesized
ggccctggctctgcagatagtg

SEQ ID NO: 99605 - DNA, 22 bp, Artificial Sequence
  chemically synthesized
gctctgcagatagtgctatcaa

SEQ ID NO: 99606 - DNA, 22 bp, Artificial Sequence
  chemically synthesized
tgcagatagtgctatcaaagcc

SEQ ID NO: 99607 - DNA, 22 bp, Artificial Sequence
  chemically synthesized
cagatagtgctatcaaagccct

SEQ ID NO: 99608 - DNA, 22 bp, Artificial Sequence
  chemically synthesized
tcaaagccctgacagagccctg

SEQ ID NO: 99609 - DNA, 22 bp, Artificial Sequence
  chemically synthesized
acagagccctgcccattgctgg

SEQ ID NO: 99610 - DNA, 22 bp, Artificial Sequence
  chemically synthesized
cccattgctgggccttggagtg

SEQ ID NO: 99611 - DNA, 22 bp, Artificial Sequence
  chemically synthesized
ctgggccttggagtgagtcagc

SEQ ID NO: 99612 - DNA, 22 bp, Artificial Sequence
  chemically synthesized
ggccttggagtgagtcagccta

SEQ ID NO: 99613 - DNA, 22 bp, Artificial Sequence
  chemically synthesized
ggagtgagtcagcctagtagag

SEQ ID NO: 99614 - DNA, 22 bp, Artificial Sequence
  chemically synthesized
gagtgagtcagcctagtagaga

SEQ ID NO: 99615 - DNA, 22 bp, Artificial Sequence
  chemically synthesized
gtagagaggcagggcaagccat

SEQ ID NO: 99616 - DNA, 22 bp, Artificial Sequence
  chemically synthesized
atagctgctgagtgggagagag

SEQ ID NO: 99617 - DNA, 22 bp, Artificial Sequence
  chemically synthesized
ctgagtgggagagagaaaaggg

SEQ ID NO: 99618 - DNA, 22 bp, Artificial Sequence
  chemically synthesized
agtgggagagagaaaagggctc

SEQ ID NO: 99619 - DNA, 22 bp, Artificial Sequence
  chemically synthesized
attgtctataaactcaggtcat

SEQ ID NO: 99620 - DNA, 22 bp, Artificial Sequence
  chemically synthesized
tctataaactcaggtcatggct

SEQ ID NO: 99621 - DNA, 22 bp, Artificial Sequence
  chemically synthesized
taaactcaggtcatggctattc

SEQ ID NO: 99622 - DNA, 22 bp, Artificial Sequence
  chemically synthesized
aggtcatggctattcttattct

SEQ ID NO: 99623 - DNA, 22 bp, Artificial Sequence
  chemically synthesized
ttcttattctcacactaagaaa

SEQ ID NO: 99624 - DNA, 22 bp, Artificial Sequence
  chemically synthesized
ttattctcacactaagaaaaag

SEQ ID NO: 99625 - DNA, 22 bp, Artificial Sequence
  chemically synthesized
attctcacactaagaaaaagaa

SEQ ID NO: 99626 - DNA, 22 bp, Artificial Sequence
  chemically synthesized
ttctcacactaagaaaaagaat

SEQ ID NO: 99627 - DNA, 22 bp, Artificial Sequence
  chemically synthesized
tcacactaagaaaaagaatgag

SEQ ID NO: 99628 - DNA, 22 bp, Artificial Sequence
  chemically synthesized
acactaagaaaaagaatgagat

SEQ ID NO: 99629 - DNA, 22 bp, Artificial Sequence
  chemically synthesized
agaaaaagaatgagatgtctac

SEQ ID NO: 99630 - DNA, 22 bp, Artificial Sequence
  chemically synthesized
catataccctgcgtcccctctt

SEQ ID NO: 99631 - DNA, 22 bp, Artificial Sequence
  chemically synthesized
cgtcccctcttgtgtactgggg

SEQ ID NO: 99632 - DNA, 22 bp, Artificial Sequence
  chemically synthesized
ttgtgtactggggtccccaaga

SEQ ID NO: 99633 - DNA, 22 bp, Artificial Sequence
  chemically synthesized
gtgtactggggtccccaagagc

SEQ ID NO: 99634 - DNA, 22 bp, Artificial Sequence
  chemically synthesized
tgtactggggtccccaagagct

SEQ ID NO: 99635 - DNA, 22 bp, Artificial Sequence
  chemically synthesized
gggtccccaagagctctctaaa

SEQ ID NO: 99636 - DNA, 22 bp, Artificial Sequence
  chemically synthesized
tctaaaagtgatggcaaagtca

SEQ ID NO: 99637 - DNA, 22 bp, Artificial Sequence
  chemically synthesized
taaaagtgatggcaaagtcatt

SEQ ID NO: 99638 - DNA, 22 bp, Artificial Sequence
  chemically synthesized
aaagtgatggcaaagtcattgc

SEQ ID NO: 99639 - DNA, 22 bp, Artificial Sequence
  chemically synthesized
cgctagatgccatcccatctat

SEQ ID NO: 99640 - DNA, 22 bp, Artificial Sequence
  chemically synthesized
gatgccatcccatctattataa

SEQ ID NO: 99641 - DNA, 22 bp, Artificial Sequence
  chemically synthesized
ttataaacctgcatttgtctcc

SEQ ID NO: 99642 - DNA, 22 bp, Artificial Sequence
  chemically synthesized
taaacctgcatttgtctccaca

SEQ ID NO: 99643 - DNA, 22 bp, Artificial Sequence
  chemically synthesized
catttgtctccacacaccagtc

SEQ ID NO: 99644 - DNA, 22 bp, Artificial Sequence
  chemically synthesized
gtctccacacaccagtcatgga

SEQ ID NO: 99645 - DNA, 22 bp, Artificial Sequence
  chemically synthesized
tctccacacaccagtcatggac

SEQ ID NO: 99646 - DNA, 22 bp, Artificial Sequence
  chemically synthesized
cacacaccagtcatggacaata

SEQ ID NO: 99647 - DNA, 22 bp, Artificial Sequence
  chemically synthesized
ctcccaggtccacgtgcttgtc

SEQ ID NO: 99648 - DNA, 22 bp, Artificial Sequence
  chemically synthesized
ccaggtccacgtgcttgtcttt

SEQ ID NO: 99649 - DNA, 22 bp, Artificial Sequence
  chemically synthesized
gtctttgtataatactcaagta

SEQ ID NO: 99650 - DNA, 22 bp, Artificial Sequence
  chemically synthesized
tctttgtataatactcaagtaa

SEQ ID NO: 99651 - DNA, 22 bp, Artificial Sequence
  chemically synthesized
tgtataatactcaagtaatttc

SEQ ID NO: 99652 - DNA, 22 bp, Artificial Sequence
  chemically synthesized
gtataatactcaagtaatttcg

SEQ ID NO: 99653 - DNA, 22 bp, Artificial Sequence
  chemically synthesized
tataatactcaagtaatttcgg

SEQ ID NO: 99654 - DNA, 22 bp, Artificial Sequence
  chemically synthesized
aagtaatttcggaaaatgtatt

SEQ ID NO: 99655 - DNA, 22 bp, Artificial Sequence
  chemically synthesized
cggaaaatgtattctttcaatc

SEQ ID NO: 99656 - DNA, 22 bp, Artificial Sequence
  chemically synthesized
ggaaaatgtattctttcaatct

SEQ ID NO: 99657 - DNA, 22 bp, Artificial Sequence
  chemically synthesized
tttcaatcttgttctgttattc

SEQ ID NO: 99658 - DNA, 22 bp, Artificial Sequence
  chemically synthesized
tcaatcttgttctgttattcct

SEQ ID NO: 99659 - DNA, 22 bp, Artificial Sequence
  chemically synthesized
caatcttgttctgttattcctg

SEQ ID NO: 99660 - DNA, 22 bp, Artificial Sequence
  chemically synthesized
aatcttgttctgttattcctgt

SEQ ID NO: 99661 - DNA, 22 bp, Artificial Sequence
  chemically synthesized
gttctgttattcctgtttcaat

SEQ ID NO: 99662 - DNA, 22 bp, Artificial Sequence
  chemically synthesized
ttctgttattcctgtttcaatg

SEQ ID NO: 99663 - DNA, 22 bp, Artificial Sequence
  chemically synthesized
tgttattcctgtttcaatggct

SEQ ID NO: 99664 - DNA, 22 bp, Artificial Sequence
  chemically synthesized
ttattcctgtttcaatggctta

SEQ ID NO: 99665 - DNA, 22 bp, Artificial Sequence
  chemically synthesized
ttcctgtttcaatggcttagta

SEQ ID NO: 99666 - DNA, 22 bp, Artificial Sequence
  chemically synthesized
ctgtttcaatggcttagtagaa

SEQ ID NO: 99667 - DNA, 22 bp, Artificial Sequence
  chemically synthesized
tttcaatggcttagtagaaaaa

SEQ ID NO: 99668 - DNA, 22 bp, Artificial Sequence
  chemically synthesized
caatggcttagtagaaaaagta

SEQ ID NO: 99669 - DNA, 22 bp, Artificial Sequence
  chemically synthesized
aatggcttagtagaaaaagtac

SEQ ID NO: 99670 - DNA, 22 bp, Artificial Sequence
  chemically synthesized
agtagaaaaagtacatacttgt

SEQ ID NO: 99671 - DNA, 22 bp, Artificial Sequence
  chemically synthesized
gtagaaaaagtacatacttgtt

SEQ ID NO: 99672 - DNA, 22 bp, Artificial Sequence
  chemically synthesized
gttttcccataaattgacaata

SEQ ID NO: 99673 - DNA, 22 bp, Artificial Sequence
  chemically synthesized
ttttcccataaattgacaatag

SEQ ID NO: 99674 - DNA, 22 bp, Artificial Sequence
  chemically synthesized
tcccataaattgacaatagaca

SEQ ID NO: 99675 - DNA, 22 bp, Artificial Sequence
  chemically synthesized
cccataaattgacaatagacaa

SEQ ID NO: 99676 - DNA, 22 bp, Artificial Sequence
  chemically synthesized
ccataaattgacaatagacaat

SEQ ID NO: 99677 - DNA, 22 bp, Artificial Sequence
  chemically synthesized
acaatagacaatttcacatcaa

SEQ ID NO: 99678 - DNA, 22 bp, Artificial Sequence
  chemically synthesized
cacatcaatgtctatatgggtc

SEQ ID NO: 99679 - DNA, 22 bp, Artificial Sequence
  chemically synthesized
acatcaatgtctatatgggtcg

SEQ ID NO: 99680 - DNA, 22 bp, Artificial Sequence
  chemically synthesized
tatgggtcgttgtgtttgctgt

SEQ ID NO: 99681 - DNA, 22 bp, Artificial Sequence
  chemically synthesized
tgtttgctgtgtttgcaaaaac

SEQ ID NO: 99682 - DNA, 22 bp, Artificial Sequence
  chemically synthesized
gctgtgtttgcaaaaactcaca

SEQ ID NO: 99683 - DNA, 22 bp, Artificial Sequence
  chemically synthesized
ctgtgtttgcaaaaactcacaa

SEQ ID NO: 99684 - DNA, 22 bp, Artificial Sequence
  chemically synthesized
tgtttgcaaaaactcacaataa

SEQ ID NO: 99685 - DNA, 22 bp, Artificial Sequence
  chemically synthesized
gcaaaaactcacaataacttta

SEQ ID NO: 99686 - DNA, 22 bp, Artificial Sequence
  chemically synthesized
caaaaactcacaataactttat

SEQ ID NO: 99687 - DNA, 22 bp, Artificial Sequence
  chemically synthesized
acaataactttatattgttact

SEQ ID NO: 99688 - DNA, 22 bp, Artificial Sequence
  chemically synthesized
tatattgttactactctaagaa

SEQ ID NO: 99689 - DNA, 22 bp, Artificial Sequence
  chemically synthesized
atattgttactactctaagaaa

SEQ ID NO: 99690 - DNA, 22 bp, Artificial Sequence
  chemically synthesized
tattgttactactctaagaaag

SEQ ID NO: 99691 - DNA, 22 bp, Artificial Sequence
  chemically synthesized
ttactactctaagaaagttaca

SEQ ID NO: 99692 - DNA, 22 bp, Artificial Sequence
  chemically synthesized
ctactctaagaaagttacaaca

SEQ ID NO: 99693 - DNA, 22 bp, Artificial Sequence
  chemically synthesized
ctctaagaaagttacaacatgg

SEQ ID NO: 99694 - DNA, 22 bp, Artificial Sequence
  chemically synthesized
taagaaagttacaacatggtga

SEQ ID NO: 99695 - DNA, 22 bp, Artificial Sequence
  chemically synthesized
agaaagttacaacatggtgaat

SEQ ID NO: 99696 - DNA, 22 bp, Artificial Sequence
  chemically synthesized
caacatggtgaatacaagagaa

SEQ ID NO: 99697 - DNA, 22 bp, Artificial Sequence
  chemically synthesized
ttacaagtccagaaaataaaag

SEQ ID NO: 99698 - DNA, 22 bp, Artificial Sequence
  chemically synthesized
caagtccagaaaataaaagtta

SEQ ID NO: 99699 - DNA, 22 bp, Artificial Sequence
  chemically synthesized
tcatcttgaggcctcagctttc

SEQ ID NO: 99700 - DNA, 22 bp, Artificial Sequence
  chemically synthesized
gaggcctcagctttctaggaat

SEQ ID NO: 99701 - DNA, 22 bp, Artificial Sequence
  chemically synthesized
aggcctcagctttctaggaata

SEQ ID NO: 99702 - DNA, 22 bp, Artificial Sequence
  chemically synthesized
agctttctaggaataatatcaa

SEQ ID NO: 99703 - DNA, 22 bp, Artificial Sequence
  chemically synthesized
tctaggaataatatcaatatta

SEQ ID NO: 99704 - DNA, 22 bp, Artificial Sequence
  chemically synthesized
ctaggaataatatcaatattac

SEQ ID NO: 99705 - DNA, 22 bp, Artificial Sequence
  chemically synthesized
taggaataatatcaatattaca

SEQ ID NO: 99706 - DNA, 22 bp, Artificial Sequence
  chemically synthesized
ggaataatatcaatattacaaa

SEQ ID NO: 99707 - DNA, 22 bp, Artificial Sequence
  chemically synthesized
caaaattaatctaacaattatg

SEQ ID NO: 99708 - DNA, 22 bp, Artificial Sequence
  chemically synthesized
atctaacaattatgaacagcaa

SEQ ID NO: 99709 - DNA, 22 bp, Artificial Sequence
  chemically synthesized
acaattatgaacagcaatgaga

SEQ ID NO: 99710 - DNA, 22 bp, Artificial Sequence
  chemically synthesized
tgaacagcaatgagataatgtg

SEQ ID NO: 99711 - DNA, 22 bp, Artificial Sequence
  chemically synthesized
tgtggtagagcatcaaggaagc

SEQ ID NO: 99712 - DNA, 22 bp, Artificial Sequence
  chemically synthesized
cggagcagttttttgtttgttt

SEQ ID NO: 99713 - DNA, 22 bp, Artificial Sequence
  chemically synthesized
tttgtttgtttgtttttgtatt

SEQ ID NO: 99714 - DNA, 22 bp, Artificial Sequence
  chemically synthesized
ttgtttgtttgtttttgtattc

SEQ ID NO: 99715 - DNA, 22 bp, Artificial Sequence
  chemically synthesized
tgtttgtttgtttttgtattct

SEQ ID NO: 99716 - DNA, 22 bp, Artificial Sequence
  chemically synthesized
gtttgtttgtttttgtattctg

SEQ ID NO: 99717 - DNA, 22 bp, Artificial Sequence
  chemically synthesized
tttgtttgtttttgtattctgt

SEQ ID NO: 99718 - DNA, 22 bp, Artificial Sequence
  chemically synthesized
gtttgtttttgtattctgtttc

SEQ ID NO: 99719 - DNA, 22 bp, Artificial Sequence
  chemically synthesized
tttgtttttgtattctgtttcg

SEQ ID NO: 99720 - DNA, 22 bp, Artificial Sequence
  chemically synthesized
gtttttgtattctgtttcgtga

SEQ ID NO: 99721 - DNA, 22 bp, Artificial Sequence
  chemically synthesized
tttttgtattctgtttcgtgag

SEQ ID NO: 99722 - DNA, 22 bp, Artificial Sequence
  chemically synthesized
ttgtattctgtttcgtgaggca

SEQ ID NO: 99723 - DNA, 22 bp, Artificial Sequence
  chemically synthesized
tgtattctgtttcgtgaggcaa

SEQ ID NO: 99724 - DNA, 22 bp, Artificial Sequence
  chemically synthesized
gtattctgtttcgtgaggcaag

SEQ ID NO: 99725 - DNA, 22 bp, Artificial Sequence
  chemically synthesized
tattctgtttcgtgaggcaagg

SEQ ID NO: 99726 - DNA, 22 bp, Artificial Sequence
  chemically synthesized
tgtttcgtgaggcaaggtttca

SEQ ID NO: 99727 - DNA, 22 bp, Artificial Sequence
  chemically synthesized
tttcgtgaggcaaggtttcact

SEQ ID NO: 99728 - DNA, 22 bp, Artificial Sequence
  chemically synthesized
cgtgaggcaaggtttcactctg

SEQ ID NO: 99729 - DNA, 22 bp, Artificial Sequence
  chemically synthesized
gtgaggcaaggtttcactctgc

SEQ ID NO: 99730 - DNA, 22 bp, Artificial Sequence
  chemically synthesized
cactctgctgtccaggctggag

SEQ ID NO: 99731 - DNA, 22 bp, Artificial Sequence
  chemically synthesized
actctgctgtccaggctggagt

SEQ ID NO: 99732 - DNA, 22 bp, Artificial Sequence
  chemically synthesized
tgctgtccaggctggagtgcag

SEQ ID NO: 99733 - DNA, 22 bp, Artificial Sequence
  chemically synthesized
ctgtccaggctggagtgcagtg

SEQ ID NO: 99734 - DNA, 22 bp, Artificial Sequence
  chemically synthesized
tccaggctggagtgcagtggca

SEQ ID NO: 99735 - DNA, 22 bp, Artificial Sequence
  chemically synthesized
gagtgcagtggcaagatcatgt

SEQ ID NO: 99736 - DNA, 22 bp, Artificial Sequence
  chemically synthesized
actgcagccttgacctcctgag

SEQ ID NO: 99737 - DNA, 22 bp, Artificial Sequence
  chemically synthesized
cagccttgacctcctgagctca

SEQ ID NO: 99738 - DNA, 22 bp, Artificial Sequence
  chemically synthesized
gacctcctgagctcaagggatc

SEQ ID NO: 99739 - DNA, 22 bp, Artificial Sequence
  chemically synthesized
acctcctgagctcaagggatcc

SEQ ID NO: 99740 - DNA, 22 bp, Artificial Sequence
  chemically synthesized
ctgagctcaagggatcctccca

SEQ ID NO: 99741 - DNA, 22 bp, Artificial Sequence
  chemically synthesized
agctcaagggatcctcccattt

SEQ ID NO: 99742 - DNA, 22 bp, Artificial Sequence
  chemically synthesized
aagggatcctcccatttcggcc

SEQ ID NO: 99743 - DNA, 22 bp, Artificial Sequence
  chemically synthesized
ccatttcggcctcctgagtagc

SEQ ID NO: 99744 - DNA, 22 bp, Artificial Sequence
  chemically synthesized
cggcctcctgagtagctgggac

SEQ ID NO: 99745 - DNA, 22 bp, Artificial Sequence
  chemically synthesized
ggcctcctgagtagctgggact

SEQ ID NO: 99746 - DNA, 22 bp, Artificial Sequence
  chemically synthesized
ctgagtagctgggactacaggt

SEQ ID NO: 99747 - DNA, 22 bp, Artificial Sequence
  chemically synthesized
agtagctgggactacaggtgta

SEQ ID NO: 99748 - DNA, 22 bp, Artificial Sequence
  chemically synthesized
ggactacaggtgtacatcacat

SEQ ID NO: 99749 - DNA, 22 bp, Artificial Sequence
  chemically synthesized
caggtgtacatcacatgcctgg

SEQ ID NO: 99750 - DNA, 22 bp, Artificial Sequence
  chemically synthesized
gctaatttttttttttttttta

SEQ ID NO: 99751 - DNA, 22 bp, Artificial Sequence
  chemically synthesized
attttttttttttttttaagta

SEQ ID NO: 99752 - DNA, 22 bp, Artificial Sequence
  chemically synthesized
tttttttttttttaagtagaga

SEQ ID NO: 99753 - DNA, 22 bp, Artificial Sequence
  chemically synthesized
ttttttttttttaagtagagac

SEQ ID NO: 99754 - DNA, 22 bp, Artificial Sequence
  chemically synthesized
tttttttttttaagtagagacg

SEQ ID NO: 99755 - DNA, 22 bp, Artificial Sequence
  chemically synthesized
ttttttttttaagtagagacga

SEQ ID NO: 99756 - DNA, 22 bp, Artificial Sequence
  chemically synthesized
tttttttttaagtagagacgag

SEQ ID NO: 99757 - DNA, 22 bp, Artificial Sequence
  chemically synthesized
ttttttttaagtagagacgagg

SEQ ID NO: 99758 - DNA, 22 bp, Artificial Sequence
  chemically synthesized
tttttttaagtagagacgaggt

SEQ ID NO: 99759 - DNA, 22 bp, Artificial Sequence
  chemically synthesized
ttttttaagtagagacgaggtc

SEQ ID NO: 99760 - DNA, 22 bp, Artificial Sequence
  chemically synthesized
tttttaagtagagacgaggtct

SEQ ID NO: 99761 - DNA, 22 bp, Artificial Sequence
  chemically synthesized
ttttaagtagagacgaggtctt

SEQ ID NO: 99762 - DNA, 22 bp, Artificial Sequence
  chemically synthesized
tttaagtagagacgaggtcttg

SEQ ID NO: 99763 - DNA, 22 bp, Artificial Sequence
  chemically synthesized
ttaagtagagacgaggtcttgc

SEQ ID NO: 99764 - DNA, 22 bp, Artificial Sequence
  chemically synthesized
taagtagagacgaggtcttgct

SEQ ID NO: 99765 - DNA, 22 bp, Artificial Sequence
  chemically synthesized
aagtagagacgaggtcttgcta

SEQ ID NO: 99766 - DNA, 22 bp, Artificial Sequence
  chemically synthesized
agtagagacgaggtcttgctat

SEQ ID NO: 99767 - DNA, 22 bp, Artificial Sequence
  chemically synthesized
gctatgttgtccaggataatat

SEQ ID NO: 99768 - DNA, 22 bp, Artificial Sequence
  chemically synthesized
ctatgttgtccaggataatatc

SEQ ID NO: 99769 - DNA, 22 bp, Artificial Sequence
  chemically synthesized
tgttgtccaggataatatcaaa

SEQ ID NO: 99770 - DNA, 22 bp, Artificial Sequence
  chemically synthesized
tccaggataatatcaaactctt

SEQ ID NO: 99771 - DNA, 22 bp, Artificial Sequence
  chemically synthesized
ttgagctcaagcagtcctccca

SEQ ID NO: 99772 - DNA, 22 bp, Artificial Sequence
  chemically synthesized
gagctcaagcagtcctcccact

SEQ ID NO: 99773 - DNA, 22 bp, Artificial Sequence
  chemically synthesized
agctcaagcagtcctcccactt

SEQ ID NO: 99774 - DNA, 22 bp, Artificial Sequence
  chemically synthesized
aagcagtcctcccacttctacc

SEQ ID NO: 99775 - DNA, 22 bp, Artificial Sequence
  chemically synthesized
ccacttctacctctcaagtgct

SEQ ID NO: 99776 - DNA, 22 bp, Artificial Sequence
  chemically synthesized
ctacctctcaagtgctggaatt

SEQ ID NO: 99777 - DNA, 22 bp, Artificial Sequence
  chemically synthesized
tacctctcaagtgctggaatta

SEQ ID NO: 99778 - DNA, 22 bp, Artificial Sequence
  chemically synthesized
cctctcaagtgctggaattaca

SEQ ID NO: 99779 - DNA, 22 bp, Artificial Sequence
  chemically synthesized
tcaagtgctggaattacagaca

SEQ ID NO: 99780 - DNA, 22 bp, Artificial Sequence
  chemically synthesized
aagtgctggaattacagacatg

SEQ ID NO: 99781 - DNA, 22 bp, Artificial Sequence
  chemically synthesized
gaattacagacatgagccacca

SEQ ID NO: 99782 - DNA, 22 bp, Artificial Sequence
  chemically synthesized
cagacatgagccaccactcctg

SEQ ID NO: 99783 - DNA, 22 bp, Artificial Sequence
  chemically synthesized
ctggcttgcagactatttaaat

SEQ ID NO: 99784 - DNA, 22 bp, Artificial Sequence
  chemically synthesized
gcttgcagactatttaaatgac

SEQ ID NO: 99785 - DNA, 22 bp, Artificial Sequence
  chemically synthesized
gcagactatttaaatgactaat

SEQ ID NO: 99786 - DNA, 22 bp, Artificial Sequence
  chemically synthesized
cagactatttaaatgactaatt

SEQ ID NO: 99787 - DNA, 22 bp, Artificial Sequence
  chemically synthesized
tttaaatgactaattcctgaca

SEQ ID NO: 99788 - DNA, 22 bp, Artificial Sequence
  chemically synthesized
aaatgactaattcctgacacta

SEQ ID NO: 99789 - DNA, 22 bp, Artificial Sequence
  chemically synthesized
aatgactaattcctgacactac

SEQ ID NO: 99790 - DNA, 22 bp, Artificial Sequence
  chemically synthesized
attcctgacactacttgaggga

SEQ ID NO: 99791 - DNA, 22 bp, Artificial Sequence
  chemically synthesized
ctgacactacttgagggatact

SEQ ID NO: 99792 - DNA, 22 bp, Artificial Sequence
  chemically synthesized
acactacttgagggatactaga

SEQ ID NO: 99793 - DNA, 22 bp, Artificial Sequence
  chemically synthesized
cttgagggatactagacagtag

SEQ ID NO: 99794 - DNA, 22 bp, Artificial Sequence
  chemically synthesized
gagggatactagacagtagaca

SEQ ID NO: 99795 - DNA, 22 bp, Artificial Sequence
  chemically synthesized
agggatactagacagtagacaa

SEQ ID NO: 99796 - DNA, 22 bp, Artificial Sequence
  chemically synthesized
gacagtagacaacacatcttta

SEQ ID NO: 99797 - DNA, 22 bp, Artificial Sequence
  chemically synthesized
taatataccaaatgggtgactg

SEQ ID NO: 99798 - DNA, 22 bp, Artificial Sequence
  chemically synthesized
aatataccaaatgggtgactgt

SEQ ID NO: 99799 - DNA, 22 bp, Artificial Sequence
  chemically synthesized
atataccaaatgggtgactgta

SEQ ID NO: 99800 - DNA, 22 bp, Artificial Sequence
  chemically synthesized
tagggttgagagggagattaga

SEQ ID NO: 99801 - DNA, 22 bp, Artificial Sequence
  chemically synthesized
agagggagattagaattcaatg

SEQ ID NO: 99802 - DNA, 22 bp, Artificial Sequence
  chemically synthesized
gaattcaatgttttatgaccaa

SEQ ID NO: 99803 - DNA, 22 bp, Artificial Sequence
  chemically synthesized
aatgttttatgaccaaaaaggc

SEQ ID NO: 99804 - DNA, 22 bp, Artificial Sequence
  chemically synthesized
tatgaccaaaaaggcttaaatc

SEQ ID NO: 99805 - DNA, 22 bp, Artificial Sequence
  chemically synthesized
atgaccaaaaaggcttaaatca

SEQ ID NO: 99806 - DNA, 22 bp, Artificial Sequence
  chemically synthesized
tgaccaaaaaggcttaaatcag

SEQ ID NO: 99807 - DNA, 22 bp, Artificial Sequence
  chemically synthesized
aaatcaggcacaagcttaggtc

SEQ ID NO: 99808 - DNA, 22 bp, Artificial Sequence
  chemically synthesized
aatcaggcacaagcttaggtct

SEQ ID NO: 99809 - DNA, 22 bp, Artificial Sequence
  chemically synthesized
aggtcttttcaactgtgaggac

SEQ ID NO: 99810 - DNA, 22 bp, Artificial Sequence
  chemically synthesized
ggtcttttcaactgtgaggacc

SEQ ID NO: 99811 - DNA, 22 bp, Artificial Sequence
  chemically synthesized
ttcaactgtgaggaccggactg

SEQ ID NO: 99812 - DNA, 22 bp, Artificial Sequence
  chemically synthesized
tcaactgtgaggaccggactga

SEQ ID NO: 99813 - DNA, 22 bp, Artificial Sequence
  chemically synthesized
caactgtgaggaccggactgaa

SEQ ID NO: 99814 - DNA, 22 bp, Artificial Sequence
  chemically synthesized
aactgtgaggaccggactgaaa

SEQ ID NO: 99815 - DNA, 22 bp, Artificial Sequence
  chemically synthesized
tgaggaccggactgaaagtgtg

SEQ ID NO: 99816 - DNA, 22 bp, Artificial Sequence
  chemically synthesized
aaagtgtgcagttcaaggccct

SEQ ID NO: 99817 - DNA, 22 bp, Artificial Sequence
  chemically synthesized
aaggccctgtagttgctgttta

SEQ ID NO: 99818 - DNA, 22 bp, Artificial Sequence
  chemically synthesized
tagttgctgtttaactgttccc

SEQ ID NO: 99819 - DNA, 22 bp, Artificial Sequence
  chemically synthesized
ctgtttaactgttcccaggtgg

SEQ ID NO: 99820 - DNA, 22 bp, Artificial Sequence
  chemically synthesized
tttaactgttcccaggtggaag

SEQ ID NO: 99821 - DNA, 22 bp, Artificial Sequence
  chemically synthesized
aactgttcccaggtggaagtct

SEQ ID NO: 99822 - DNA, 22 bp, Artificial Sequence
  chemically synthesized
actgttcccaggtggaagtctc

SEQ ID NO: 99823 - DNA, 22 bp, Artificial Sequence
  chemically synthesized
ttcccaggtggaagtctcttca

SEQ ID NO: 99824 - DNA, 22 bp, Artificial Sequence
  chemically synthesized
ccaggtggaagtctcttcaaag

SEQ ID NO: 99825 - DNA, 22 bp, Artificial Sequence
  chemically synthesized
ttcaaagaaccactggtgcaaa

SEQ ID NO: 99826 - DNA, 22 bp, Artificial Sequence
  chemically synthesized
caaagaaccactggtgcaaaaa

SEQ ID NO: 99827 - DNA, 22 bp, Artificial Sequence
  chemically synthesized
aaagaaccactggtgcaaaaag

SEQ ID NO: 99828 - DNA, 22 bp, Artificial Sequence
  chemically synthesized
gtgcaaaaagggaactacctgg

SEQ ID NO: 99829 - DNA, 22 bp, Artificial Sequence
  chemically synthesized
cctggggataaatatttcctcc

SEQ ID NO: 99830 - DNA, 22 bp, Artificial Sequence
  chemically synthesized
gggataaatatttcctccagaa

SEQ ID NO: 99831 - DNA, 22 bp, Artificial Sequence
  chemically synthesized
cctccagaaagggggaaagtgc

SEQ ID NO: 99832 - DNA, 22 bp, Artificial Sequence
  chemically synthesized
ctccagaaagggggaaagtgca

SEQ ID NO: 99833 - DNA, 22 bp, Artificial Sequence
  chemically synthesized
cagaaagggggaaagtgcaagc

SEQ ID NO: 99834 - DNA, 22 bp, Artificial Sequence
  chemically synthesized
ccctaccaaaagcaccaggcaa

SEQ ID NO: 99835 - DNA, 22 bp, Artificial Sequence
  chemically synthesized
ccaaaagcaccaggcaagtcct

SEQ ID NO: 99836 - DNA, 22 bp, Artificial Sequence
  chemically synthesized
gtctattttccctgaagttctc

SEQ ID NO: 99837 - DNA, 22 bp, Artificial Sequence
  chemically synthesized
tctattttccctgaagttctca

SEQ ID NO: 99838 - DNA, 22 bp, Artificial Sequence
  chemically synthesized
ttttccctgaagttctcaaaga

SEQ ID NO: 99839 - DNA, 22 bp, Artificial Sequence
  chemically synthesized
tccctgaagttctcaaagaaat

SEQ ID NO: 99840 - DNA, 22 bp, Artificial Sequence
  chemically synthesized
ccctgaagttctcaaagaaatg

SEQ ID NO: 99841 - DNA, 22 bp, Artificial Sequence
  chemically synthesized
cctgaagttctcaaagaaatga

SEQ ID NO: 99842 - DNA, 22 bp, Artificial Sequence
  chemically synthesized
aagttctcaaagaaatgagacc

SEQ ID NO: 99843 - DNA, 22 bp, Artificial Sequence
  chemically synthesized
tcaaagaaatgagacccttgtt

SEQ ID NO: 99844 - DNA, 22 bp, Artificial Sequence
  chemically synthesized
aaagaaatgagacccttgttta

SEQ ID NO: 99845 - DNA, 22 bp, Artificial Sequence
  chemically synthesized
gtttacctttaagattagagaa

SEQ ID NO: 99846 - DNA, 22 bp, Artificial Sequence
  chemically synthesized
tttacctttaagattagagaag

SEQ ID NO: 99847 - DNA, 22 bp, Artificial Sequence
  chemically synthesized
acctttaagattagagaaggct

SEQ ID NO: 99848 - DNA, 22 bp, Artificial Sequence
  chemically synthesized
cctttaagattagagaaggctt

SEQ ID NO: 99849 - DNA, 22 bp, Artificial Sequence
  chemically synthesized
taagattagagaaggcttgaaa

SEQ ID NO: 99850 - DNA, 22 bp, Artificial Sequence
  chemically synthesized
aagattagagaaggcttgaaaa

SEQ ID NO: 99851 - DNA, 22 bp, Artificial Sequence
  chemically synthesized
agattagagaaggcttgaaaag

SEQ ID NO: 99852 - DNA, 22 bp, Artificial Sequence
  chemically synthesized
gagaaggcttgaaaagtttgag

SEQ ID NO: 99853 - DNA, 22 bp, Artificial Sequence
  chemically synthesized
gaaaagtttgagctgtgccttt

SEQ ID NO: 99854 - DNA, 22 bp, Artificial Sequence
  chemically synthesized
aaaagtttgagctgtgcctttg

SEQ ID NO: 99855 - DNA, 22 bp, Artificial Sequence
  chemically synthesized
gagctgtgcctttggaggccaa

SEQ ID NO: 99856 - DNA, 22 bp, Artificial Sequence
  chemically synthesized
agctgtgcctttggaggccaac

SEQ ID NO: 99857 - DNA, 22 bp, Artificial Sequence
  chemically synthesized
tgcctttggaggccaacaaact

SEQ ID NO: 99858 - DNA, 22 bp, Artificial Sequence
  chemically synthesized
tggaggccaacaaacttttctc

SEQ ID NO: 99859 - DNA, 22 bp, Artificial Sequence
  chemically synthesized
ggaggccaacaaacttttctcc

SEQ ID NO: 99860 - DNA, 22 bp, Artificial Sequence
  chemically synthesized
gaggccaacaaacttttctcct

SEQ ID NO: 99861 - DNA, 22 bp, Artificial Sequence
  chemically synthesized
ttctcctttgttgaccaagttc

SEQ ID NO: 99862 - DNA, 22 bp, Artificial Sequence
  chemically synthesized
tctcctttgttgaccaagttca

SEQ ID NO: 99863 - DNA, 22 bp, Artificial Sequence
  chemically synthesized
ctcctttgttgaccaagttcag

SEQ ID NO: 99864 - DNA, 22 bp, Artificial Sequence
  chemically synthesized
tcctttgttgaccaagttcagc

SEQ ID NO: 99865 - DNA, 22 bp, Artificial Sequence
  chemically synthesized
ctttgttgaccaagttcagctc

SEQ ID NO: 99866 - DNA, 22 bp, Artificial Sequence
  chemically synthesized
tgttgaccaagttcagctctcc

SEQ ID NO: 99867 - DNA, 22 bp, Artificial Sequence
  chemically synthesized
gttgaccaagttcagctctcct

SEQ ID NO: 99868 - DNA, 22 bp, Artificial Sequence
  chemically synthesized
ttgaccaagttcagctctcctg

SEQ ID NO: 99869 - DNA, 22 bp, Artificial Sequence
  chemically synthesized
accaagttcagctctcctgtat

SEQ ID NO: 99870 - DNA, 22 bp, Artificial Sequence
  chemically synthesized
agctctcctgtatgcttccaag

SEQ ID NO: 99871 - DNA, 22 bp, Artificial Sequence
  chemically synthesized
tcctgtatgcttccaaggtctg

SEQ ID NO: 99872 - DNA, 22 bp, Artificial Sequence
  chemically synthesized
ctgtatgcttccaaggtctgtt

SEQ ID NO: 99873 - DNA, 22 bp, Artificial Sequence
  chemically synthesized
tatgcttccaaggtctgttgca

SEQ ID NO: 99874 - DNA, 22 bp, Artificial Sequence
  chemically synthesized
ccaaggtctgttgcatcaagag

SEQ ID NO: 99875 - DNA, 22 bp, Artificial Sequence
  chemically synthesized
caaggtctgttgcatcaagagt

SEQ ID NO: 99876 - DNA, 22 bp, Artificial Sequence
  chemically synthesized
ttgcatcaagagtgagaattga

SEQ ID NO: 99877 - DNA, 22 bp, Artificial Sequence
  chemically synthesized
catcaagagtgagaattgaagg

SEQ ID NO: 99878 - DNA, 22 bp, Artificial Sequence
  chemically synthesized
aaggtcttagaagctgggatct

SEQ ID NO: 99879 - DNA, 22 bp, Artificial Sequence
  chemically synthesized
agaagctgggatctcagatgta

SEQ ID NO: 99880 - DNA, 22 bp, Artificial Sequence
  chemically synthesized
gaagctgggatctcagatgtag

SEQ ID NO: 99881 - DNA, 22 bp, Artificial Sequence
  chemically synthesized
ggatctcagatgtagggaaaag

SEQ ID NO: 99882 - DNA, 22 bp, Artificial Sequence
  chemically synthesized
agatgtagggaaaagaggagat

SEQ ID NO: 99883 - DNA, 22 bp, Artificial Sequence
  chemically synthesized
cctgttcactcactgttaagat

SEQ ID NO: 99884 - DNA, 22 bp, Artificial Sequence
  chemically synthesized
ctgttcactcactgttaagata

SEQ ID NO: 99885 - DNA, 22 bp, Artificial Sequence
  chemically synthesized
ttcactcactgttaagatatgg

SEQ ID NO: 99886 - DNA, 22 bp, Artificial Sequence
  chemically synthesized
actcactgttaagatatggctg

SEQ ID NO: 99887 - DNA, 22 bp, Artificial Sequence
  chemically synthesized
actgttaagatatggctgaaat

SEQ ID NO: 99888 - DNA, 22 bp, Artificial Sequence
  chemically synthesized
ttaagatatggctgaaattttt

SEQ ID NO: 99889 - DNA, 22 bp, Artificial Sequence
  chemically synthesized
agatatggctgaaattttttga

SEQ ID NO: 99890 - DNA, 22 bp, Artificial Sequence
  chemically synthesized
aaattttttgatctagtcatct

SEQ ID NO: 99891 - DNA, 22 bp, Artificial Sequence
  chemically synthesized
tttgatctagtcatctacaaag

SEQ ID NO: 99892 - DNA, 22 bp, Artificial Sequence
  chemically synthesized
ttgatctagtcatctacaaagc

SEQ ID NO: 99893 - DNA, 22 bp, Artificial Sequence
  chemically synthesized
tgatctagtcatctacaaagca

SEQ ID NO: 99894 - DNA, 22 bp, Artificial Sequence
  chemically synthesized
gatctagtcatctacaaagcat

SEQ ID NO: 99895 - DNA, 22 bp, Artificial Sequence
  chemically synthesized
atctagtcatctacaaagcatg

SEQ ID NO: 99896 - DNA, 22 bp, Artificial Sequence
  chemically synthesized
gtcatctacaaagcatgagttg

SEQ ID NO: 99897 - DNA, 22 bp, Artificial Sequence
  chemically synthesized
caaagcatgagttgtgggtcag

SEQ ID NO: 99898 - DNA, 22 bp, Artificial Sequence
  chemically synthesized
tgggtcagaaattgtttttcac

SEQ ID NO: 99899 - DNA, 22 bp, Artificial Sequence
  chemically synthesized
tttttcacatcttttgacttcc

SEQ ID NO: 99900 - DNA, 22 bp, Artificial Sequence
  chemically synthesized
ttcacatcttttgacttccttt

SEQ ID NO: 99901 - DNA, 22 bp, Artificial Sequence
  chemically synthesized
tcacatcttttgacttcctttg

SEQ ID NO: 99902 - DNA, 22 bp, Artificial Sequence
  chemically synthesized
cacatcttttgacttcctttga

SEQ ID NO: 99903 - DNA, 22 bp, Artificial Sequence
  chemically synthesized
acatcttttgacttcctttgac

SEQ ID NO: 99904 - DNA, 22 bp, Artificial Sequence
  chemically synthesized
ttgacttcctttgacatcagaa

SEQ ID NO: 99905 - DNA, 22 bp, Artificial Sequence
  chemically synthesized
tgacttcctttgacatcagaat

SEQ ID NO: 99906 - DNA, 22 bp, Artificial Sequence
  chemically synthesized
gacttcctttgacatcagaata

SEQ ID NO: 99907 - DNA, 22 bp, Artificial Sequence
  chemically synthesized
acttcctttgacatcagaatat

SEQ ID NO: 99908 - DNA, 22 bp, Artificial Sequence
  chemically synthesized
cctttgacatcagaatataacc

SEQ ID NO: 99909 - DNA, 22 bp, Artificial Sequence
  chemically synthesized
ctttgacatcagaatataacct

SEQ ID NO: 99910 - DNA, 22 bp, Artificial Sequence
  chemically synthesized
tgacatcagaatataacctagg

SEQ ID NO: 99911 - DNA, 22 bp, Artificial Sequence
  chemically synthesized
gacatcagaatataacctagga

SEQ ID NO: 99912 - DNA, 22 bp, Artificial Sequence
  chemically synthesized
acatcagaatataacctaggaa

SEQ ID NO: 99913 - DNA, 22 bp, Artificial Sequence
  chemically synthesized
ggaattgattacttaagtgaag

SEQ ID NO: 99914 - DNA, 22 bp, Artificial Sequence
  chemically synthesized
attacttaagtgaaggcaaggt

SEQ ID NO: 99915 - DNA, 22 bp, Artificial Sequence
  chemically synthesized
cttaagtgaaggcaaggtactt

SEQ ID NO: 99916 - DNA, 22 bp, Artificial Sequence
  chemically synthesized
aagtgaaggcaaggtactttgg

SEQ ID NO: 99917 - DNA, 22 bp, Artificial Sequence
  chemically synthesized
agtgaaggcaaggtactttggt

SEQ ID NO: 99918 - DNA, 22 bp, Artificial Sequence
  chemically synthesized
tggtctggacaggaacattttg

SEQ ID NO: 99919 - DNA, 22 bp, Artificial Sequence
  chemically synthesized
ggtctggacaggaacattttga

SEQ ID NO: 99920 - DNA, 22 bp, Artificial Sequence
  chemically synthesized
gtctggacaggaacattttgaa

SEQ ID NO: 99921 - DNA, 22 bp, Artificial Sequence
  chemically synthesized
gacaggaacattttgaacaagg

SEQ ID NO: 99922 - DNA, 22 bp, Artificial Sequence
  chemically synthesized
tgaacaaggtagggagacagct

SEQ ID NO: 99923 - DNA, 22 bp, Artificial Sequence
  chemically synthesized
gaacaaggtagggagacagcta

SEQ ID NO: 99924 - DNA, 22 bp, Artificial Sequence
  chemically synthesized
aacaaggtagggagacagctat

SEQ ID NO: 99925 - DNA, 22 bp, Artificial Sequence
  chemically synthesized
tgaaggcaagcatttattctat

SEQ ID NO: 99926 - DNA, 22 bp, Artificial Sequence
  chemically synthesized
attctatctatcatctatctgt

SEQ ID NO: 99927 - DNA, 22 bp, Artificial Sequence
  chemically synthesized
ttctatctatcatctatctgtc

SEQ ID NO: 99928 - DNA, 22 bp, Artificial Sequence
  chemically synthesized
tatctatcatctatctgtctat

SEQ ID NO: 99929 - DNA, 22 bp, Artificial Sequence
  chemically synthesized
tctatcatctatctgtctatct

SEQ ID NO: 99930 - DNA, 22 bp, Artificial Sequence
  chemically synthesized
tcatctatctgtctatctatct

SEQ ID NO: 99931 - DNA, 22 bp, Artificial Sequence
  chemically synthesized
tctgtctatctatctatctatt

SEQ ID NO: 99932 - DNA, 22 bp, Artificial Sequence
  chemically synthesized
tctatctatctatctattcttt

SEQ ID NO: 99933 - DNA, 22 bp, Artificial Sequence
  chemically synthesized
tctatctatctattctttcatc

SEQ ID NO: 99934 - DNA, 22 bp, Artificial Sequence
  chemically synthesized
tctatctattctttcatccact

SEQ ID NO: 99935 - DNA, 22 bp, Artificial Sequence
  chemically synthesized
tctattctttcatccacttatt

SEQ ID NO: 99936 - DNA, 22 bp, Artificial Sequence
  chemically synthesized
ttctttcatccacttatttata

SEQ ID NO: 99937 - DNA, 22 bp, Artificial Sequence
  chemically synthesized
tttcatccacttatttatacat

SEQ ID NO: 99938 - DNA, 22 bp, Artificial Sequence
  chemically synthesized
tcatccacttatttatacattt

SEQ ID NO: 99939 - DNA, 22 bp, Artificial Sequence
  chemically synthesized
catccacttatttatacattta

SEQ ID NO: 99940 - DNA, 22 bp, Artificial Sequence
  chemically synthesized
atccacttatttatacatttaa

SEQ ID NO: 99941 - DNA, 22 bp, Artificial Sequence
  chemically synthesized
atttatacatttaaacaaaaag

SEQ ID NO: 99942 - DNA, 22 bp, Artificial Sequence
  chemically synthesized
tttatacatttaaacaaaaagt

SEQ ID NO: 99943 - DNA, 22 bp, Artificial Sequence
  chemically synthesized
atacatttaaacaaaaagtata

SEQ ID NO: 99944 - DNA, 22 bp, Artificial Sequence
  chemically synthesized
tacatttaaacaaaaagtatag

SEQ ID NO: 99945 - DNA, 22 bp, Artificial Sequence
  chemically synthesized
aaacaaaaagtatagagcgtag

SEQ ID NO: 99946 - DNA, 22 bp, Artificial Sequence
  chemically synthesized
aacaaaaagtatagagcgtagt

SEQ ID NO: 99947 - DNA, 22 bp, Artificial Sequence
  chemically synthesized
gtaagtgctcagggctgtgtgt

SEQ ID NO: 99948 - DNA, 22 bp, Artificial Sequence
  chemically synthesized
taagtgctcagggctgtgtgtg

SEQ ID NO: 99949 - DNA, 22 bp, Artificial Sequence
  chemically synthesized
agggctgtgtgtgtatggattg

SEQ ID NO: 99950 - DNA, 22 bp, Artificial Sequence
  chemically synthesized
tgtgtgtatggattgtttgaaa

SEQ ID NO: 99951 - DNA, 22 bp, Artificial Sequence
  chemically synthesized
tttgaaatgaaactaaagtggg

SEQ ID NO: 99952 - DNA, 22 bp, Artificial Sequence
  chemically synthesized
gaaatgaaactaaagtgggagt

SEQ ID NO: 99953 - DNA, 22 bp, Artificial Sequence
  chemically synthesized
aaatgaaactaaagtgggagta

SEQ ID NO: 99954 - DNA, 22 bp, Artificial Sequence
  chemically synthesized
aagtgggagtataattctactg

SEQ ID NO: 99955 - DNA, 22 bp, Artificial Sequence
  chemically synthesized
tactgcccccttaaccctgtgg

SEQ ID NO: 99956 - DNA, 22 bp, Artificial Sequence
  chemically synthesized
ctgcccccttaaccctgtggtc

SEQ ID NO: 99957 - DNA, 22 bp, Artificial Sequence
  chemically synthesized
cccccttaaccctgtggtccct

SEQ ID NO: 99958 - DNA, 22 bp, Artificial Sequence
  chemically synthesized
aaccctgtggtccctacactac

SEQ ID NO: 99959 - DNA, 22 bp, Artificial Sequence
  chemically synthesized
accctgtggtccctacactacc

SEQ ID NO: 99960 - DNA, 22 bp, Artificial Sequence
  chemically synthesized
tggtccctacactaccctgcaa

SEQ ID NO: 99961 - DNA, 22 bp, Artificial Sequence
  chemically synthesized
cactaccctgcaagactcttag

SEQ ID NO: 99962 - DNA, 22 bp, Artificial Sequence
  chemically synthesized
ccctgcaagactcttagctgct

SEQ ID NO: 99963 - DNA, 22 bp, Artificial Sequence
  chemically synthesized
caagactcttagctgcttagct

SEQ ID NO: 99964 - DNA, 22 bp, Artificial Sequence
  chemically synthesized
ttagctgcttagcttaattgtg

SEQ ID NO: 99965 - DNA, 22 bp, Artificial Sequence
  chemically synthesized
agctgcttagcttaattgtgag

SEQ ID NO: 99966 - DNA, 22 bp, Artificial Sequence
  chemically synthesized
gctgcttagcttaattgtgagg

SEQ ID NO: 99967 - DNA, 22 bp, Artificial Sequence
  chemically synthesized
cttagcttaattgtgaggctga

SEQ ID NO: 99968 - DNA, 22 bp, Artificial Sequence
  chemically synthesized
agcttaattgtgaggctgattt

SEQ ID NO: 99969 - DNA, 22 bp, Artificial Sequence
  chemically synthesized
gcttaattgtgaggctgatttg

SEQ ID NO: 99970 - DNA, 22 bp, Artificial Sequence
  chemically synthesized
aattgtgaggctgatttggggc

SEQ ID NO: 99971 - DNA, 22 bp, Artificial Sequence
  chemically synthesized
attgtgaggctgatttggggca

SEQ ID NO: 99972 - DNA, 22 bp, Artificial Sequence
  chemically synthesized
tgaggctgatttggggcatagc

SEQ ID NO: 99973 - DNA, 22 bp, Artificial Sequence
  chemically synthesized
atttggggcatagcaccccatc

SEQ ID NO: 99974 - DNA, 22 bp, Artificial Sequence
  chemically synthesized
ggggcatagcaccccatcctct

SEQ ID NO: 99975 - DNA, 22 bp, Artificial Sequence
  chemically synthesized
gggcatagcaccccatcctctc

SEQ ID NO: 99976 - DNA, 22 bp, Artificial Sequence
  chemically synthesized
tctgtctttcaacatcctcata

SEQ ID NO: 99977 - DNA, 22 bp, Artificial Sequence
  chemically synthesized
tgtctttcaacatcctcataat

SEQ ID NO: 99978 - DNA, 22 bp, Artificial Sequence
  chemically synthesized
tctttcaacatcctcataataa

SEQ ID NO: 99979 - DNA, 22 bp, Artificial Sequence
  chemically synthesized
tcaacatcctcataataacttg

SEQ ID NO: 99980 - DNA, 22 bp, Artificial Sequence
  chemically synthesized
caacatcctcataataacttga

SEQ ID NO: 99981 - DNA, 22 bp, Artificial Sequence
  chemically synthesized
aacatcctcataataacttgag

SEQ ID NO: 99982 - DNA, 22 bp, Artificial Sequence
  chemically synthesized
ataataacttgagaataatttt

SEQ ID NO: 99983 - DNA, 22 bp, Artificial Sequence
  chemically synthesized
gagaataattttataaaatatc

SEQ ID NO: 99984 - DNA, 22 bp, Artificial Sequence
  chemically synthesized
agaataattttataaaatatca

SEQ ID NO: 99985 - DNA, 22 bp, Artificial Sequence
  chemically synthesized
tataaaatatcacaatagggtc

SEQ ID NO: 99986 - DNA, 22 bp, Artificial Sequence
  chemically synthesized
ataaaatatcacaatagggtca

SEQ ID NO: 99987 - DNA, 22 bp, Artificial Sequence
  chemically synthesized
taaaatatcacaatagggtcat

SEQ ID NO: 99988 - DNA, 22 bp, Artificial Sequence
  chemically synthesized
agtagggtgatatataaaatta

SEQ ID NO: 99989 - DNA, 22 bp, Artificial Sequence
  chemically synthesized
gacaagccatagtttgagttta

SEQ ID NO: 99990 - DNA, 22 bp, Artificial Sequence
  chemically synthesized
gagtttacccttttgaataaat

SEQ ID NO: 99991 - DNA, 22 bp, Artificial Sequence
  chemically synthesized
agtttacccttttgaataaata

SEQ ID NO: 99992 - DNA, 22 bp, Artificial Sequence
  chemically synthesized
acccttttgaataaatatatga

SEQ ID NO: 99993 - DNA, 22 bp, Artificial Sequence
  chemically synthesized
cccttttgaataaatatatgac

SEQ ID NO: 99994 - DNA, 22 bp, Artificial Sequence
  chemically synthesized
ttgaataaatatatgacaaaag

SEQ ID NO: 99995 - DNA, 22 bp, Artificial Sequence
  chemically synthesized
tgaataaatatatgacaaaagg

SEQ ID NO: 99996 - DNA, 22 bp, Artificial Sequence
  chemically synthesized
gaataaatatatgacaaaaggc

SEQ ID NO: 99997 - DNA, 22 bp, Artificial Sequence
  chemically synthesized
aataaatatatgacaaaaggca

SEQ ID NO: 99998 - DNA, 22 bp, Artificial Sequence
  chemically synthesized
aattatctttatgagtttggag

SEQ ID NO: 99999 - DNA, 22 bp, Artificial Sequence
  chemically synthesized
attatctttatgagtttggagg

SEQ ID NO: 100000 - DNA, 22 bp, Artificial Sequence
  chemically synthesized
tctttatgagtttggaggtatc

SEQ ID NO: 100001 - DNA, 22 bp, Artificial Sequence
  chemically synthesized
tatgagtttggaggtatccagt

SEQ ID NO: 100002 - DNA, 22 bp, Artificial Sequence
  chemically synthesized
atgagtttggaggtatccagta

SEQ ID NO: 100003 - DNA, 22 bp, Artificial Sequence
  chemically synthesized
tgagtttggaggtatccagtat

SEQ ID NO: 100004 - DNA, 22 bp, Artificial Sequence
  chemically synthesized
ggaggtatccagtatgaaattt

SEQ ID NO: 100005 - DNA, 22 bp, Artificial Sequence
  chemically synthesized
gaggtatccagtatgaaattta

SEQ ID NO: 100006 - DNA, 22 bp, Artificial Sequence
  chemically synthesized
agataatacctgccttctagtg

SEQ ID NO: 100007 - DNA, 22 bp, Artificial Sequence
  chemically synthesized
gataatacctgccttctagtgt

SEQ ID NO: 100008 - DNA, 22 bp, Artificial Sequence
  chemically synthesized
ccttctagtgttgaaattagaa

SEQ ID NO: 100009 - DNA, 22 bp, Artificial Sequence
  chemically synthesized
ctagtgttgaaattagaactta

SEQ ID NO: 100010 - DNA, 22 bp, Artificial Sequence
  chemically synthesized
tagtgttgaaattagaacttaa

SEQ ID NO: 100011 - DNA, 22 bp, Artificial Sequence
  chemically synthesized
gtgttgaaattagaacttaatg

SEQ ID NO: 100012 - DNA, 22 bp, Artificial Sequence
  chemically synthesized
aaattagaacttaatgatataa

SEQ ID NO: 100013 - DNA, 22 bp, Artificial Sequence
  chemically synthesized
gaacttaatgatataatgcatc

SEQ ID NO: 100014 - DNA, 22 bp, Artificial Sequence
  chemically synthesized
aatgatataatgcatcaatgaa

SEQ ID NO: 100015 - DNA, 22 bp, Artificial Sequence
  chemically synthesized
atgatataatgcatcaatgaac

SEQ ID NO: 100016 - DNA, 22 bp, Artificial Sequence
  chemically synthesized
attatagttcctagcacaaagt

SEQ ID NO: 100017 - DNA, 22 bp, Artificial Sequence
  chemically synthesized
ttatagttcctagcacaaagta

SEQ ID NO: 100018 - DNA, 22 bp, Artificial Sequence
  chemically synthesized
tagttcctagcacaaagtaaga

SEQ ID NO: 100019 - DNA, 22 bp, Artificial Sequence
  chemically synthesized
ctagcacaaagtaagaatcctt

SEQ ID NO: 100020 - DNA, 22 bp, Artificial Sequence
  chemically synthesized
gcacaaagtaagaatcctttca

SEQ ID NO: 100021 - DNA, 22 bp, Artificial Sequence
  chemically synthesized
tcaatgtgtgtgtgtgtgtatg

SEQ ID NO: 100022 - DNA, 22 bp, Artificial Sequence
  chemically synthesized
caatgtgtgtgtgtgtgtatgt

SEQ ID NO: 100023 - DNA, 22 bp, Artificial Sequence
  chemically synthesized
aatgtgtgtgtgtgtgtatgta

SEQ ID NO: 100024 - DNA, 22 bp, Artificial Sequence
  chemically synthesized
atctgttattaataggaatctt

SEQ ID NO: 100025 - DNA, 22 bp, Artificial Sequence
  chemically synthesized
tctgttattaataggaatctta

SEQ ID NO: 100026 - DNA, 22 bp, Artificial Sequence
  chemically synthesized
ttattaataggaatcttatggg

SEQ ID NO: 100027 - DNA, 22 bp, Artificial Sequence
  chemically synthesized
ttaataggaatcttatgggcat

SEQ ID NO: 100028 - DNA, 22 bp, Artificial Sequence
  chemically synthesized
ataggaatcttatgggcattat

SEQ ID NO: 100029 - DNA, 22 bp, Artificial Sequence
  chemically synthesized
atgggcattatctcacttaatc

SEQ ID NO: 100030 - DNA, 22 bp, Artificial Sequence
  chemically synthesized
tgggcattatctcacttaatcc

SEQ ID NO: 100031 - DNA, 22 bp, Artificial Sequence
  chemically synthesized
tctcacttaatccttattaata

SEQ ID NO: 100032 - DNA, 22 bp, Artificial Sequence
  chemically synthesized
acttaatccttattaataacta

SEQ ID NO: 100033 - DNA, 22 bp, Artificial Sequence
  chemically synthesized
aatccttattaataactatgaa

SEQ ID NO: 100034 - DNA, 22 bp, Artificial Sequence
  chemically synthesized
atccttattaataactatgaag

SEQ ID NO: 100035 - DNA, 22 bp, Artificial Sequence
  chemically synthesized
attaataactatgaagcaggta

SEQ ID NO: 100036 - DNA, 22 bp, Artificial Sequence
  chemically synthesized
ttaataactatgaagcaggtat

SEQ ID NO: 100037 - DNA, 22 bp, Artificial Sequence
  chemically synthesized
ataactatgaagcaggtattta

SEQ ID NO: 100038 - DNA, 22 bp, Artificial Sequence
  chemically synthesized
tgaagcaggtatttatttgagt

SEQ ID NO: 100039 - DNA, 22 bp, Artificial Sequence
  chemically synthesized
atttgagttttccaagtgagtt

SEQ ID NO: 100040 - DNA, 22 bp, Artificial Sequence
  chemically synthesized
tttgagttttccaagtgagtta

SEQ ID NO: 100041 - DNA, 22 bp, Artificial Sequence
  chemically synthesized
gagttttccaagtgagttaagt

SEQ ID NO: 100042 - DNA, 22 bp, Artificial Sequence
  chemically synthesized
agttttccaagtgagttaagta

SEQ ID NO: 100043 - DNA, 22 bp, Artificial Sequence
  chemically synthesized
tccaagtgagttaagtatagct

SEQ ID NO: 100044 - DNA, 22 bp, Artificial Sequence
  chemically synthesized
ccaagtgagttaagtatagctt

SEQ ID NO: 100045 - DNA, 22 bp, Artificial Sequence
  chemically synthesized
caagtgagttaagtatagcttg

SEQ ID NO: 100046 - DNA, 22 bp, Artificial Sequence
  chemically synthesized
agtatagcttgtaatacttaag

SEQ ID NO: 100047 - DNA, 22 bp, Artificial Sequence
  chemically synthesized
gtaatacttaaggaaatatcca

SEQ ID NO: 100048 - DNA, 22 bp, Artificial Sequence
  chemically synthesized
taatacttaaggaaatatccac

SEQ ID NO: 100049 - DNA, 22 bp, Artificial Sequence
  chemically synthesized
aaggaaatatccacaggttaca

SEQ ID NO: 100050 - DNA, 22 bp, Artificial Sequence
  chemically synthesized
aggaaatatccacaggttacat

SEQ ID NO: 100051 - DNA, 22 bp, Artificial Sequence
  chemically synthesized
catagctagtatataactgaga

SEQ ID NO: 100052 - DNA, 22 bp, Artificial Sequence
  chemically synthesized
gtatataactgagaaataattt

SEQ ID NO: 100053 - DNA, 22 bp, Artificial Sequence
  chemically synthesized
agaaataattttatttatatta

SEQ ID NO: 100054 - DNA, 22 bp, Artificial Sequence
  chemically synthesized
tatttatattataaaacattct

SEQ ID NO: 100055 - DNA, 22 bp, Artificial Sequence
  chemically synthesized
atttatattataaaacattcta

SEQ ID NO: 100056 - DNA, 22 bp, Artificial Sequence
  chemically synthesized
tttatattataaaacattctaa

SEQ ID NO: 100057 - DNA, 22 bp, Artificial Sequence
  chemically synthesized
atattataaaacattctaacaa

SEQ ID NO: 100058 - DNA, 22 bp, Artificial Sequence
  chemically synthesized
tattataaaacattctaacaat

SEQ ID NO: 100059 - DNA, 22 bp, Artificial Sequence
  chemically synthesized
taaaacattctaacaatacaga

SEQ ID NO: 100060 - DNA, 22 bp, Artificial Sequence
  chemically synthesized
taacaatacagatgtatataaa

SEQ ID NO: 100061 - DNA, 22 bp, Artificial Sequence
  chemically synthesized
acaatacagatgtatataaact

SEQ ID NO: 100062 - DNA, 22 bp, Artificial Sequence
  chemically synthesized
aaaaactgaaagggctcatgca

SEQ ID NO: 100063 - DNA, 22 bp, Artificial Sequence
  chemically synthesized
aaagggctcatgcaaccctacc

SEQ ID NO: 100064 - DNA, 22 bp, Artificial Sequence
  chemically synthesized
atgcaaccctaccttctcaata

SEQ ID NO: 100065 - DNA, 22 bp, Artificial Sequence
  chemically synthesized
ccttctcaatatcacttcttca

SEQ ID NO: 100066 - DNA, 22 bp, Artificial Sequence
  chemically synthesized
ctcaatatcacttcttcactta

SEQ ID NO: 100067 - DNA, 22 bp, Artificial Sequence
  chemically synthesized
tcaatatcacttcttcacttag

SEQ ID NO: 100068 - DNA, 22 bp, Artificial Sequence
  chemically synthesized
aatatcacttcttcacttagaa

SEQ ID NO: 100069 - DNA, 22 bp, Artificial Sequence
  chemically synthesized
cttcacttagaaaaaaccagcc

SEQ ID NO: 100070 - DNA, 22 bp, Artificial Sequence
  chemically synthesized
ttcacttagaaaaaaccagcct

SEQ ID NO: 100071 - DNA, 22 bp, Artificial Sequence
  chemically synthesized
cacttagaaaaaaccagcctta

SEQ ID NO: 100072 - DNA, 22 bp, Artificial Sequence
  chemically synthesized
acttagaaaaaaccagccttag

SEQ ID NO: 100073 - DNA, 22 bp, Artificial Sequence
  chemically synthesized
agaaaaaaccagccttagctgt

SEQ ID NO: 100074 - DNA, 22 bp, Artificial Sequence
  chemically synthesized
gaaaaaaccagccttagctgtc

SEQ ID NO: 100075 - DNA, 22 bp, Artificial Sequence
  chemically synthesized
agctgtctgctatgaatccttt

SEQ ID NO: 100076 - DNA, 22 bp, Artificial Sequence
  chemically synthesized
gctgtctgctatgaatcctttc

SEQ ID NO: 100077 - DNA, 22 bp, Artificial Sequence
  chemically synthesized
tctgctatgaatcctttcaaaa

SEQ ID NO: 100078 - DNA, 22 bp, Artificial Sequence
  chemically synthesized
ctatgaatcctttcaaaatata

SEQ ID NO: 100079 - DNA, 22 bp, Artificial Sequence
  chemically synthesized
tgaatcctttcaaaatatactt

SEQ ID NO: 100080 - DNA, 22 bp, Artificial Sequence
  chemically synthesized
tcaaaatatacttctgagaaat

SEQ ID NO: 100081 - DNA, 22 bp, Artificial Sequence
  chemically synthesized
caaaatatacttctgagaaatg

SEQ ID NO: 100082 - DNA, 22 bp, Artificial Sequence
  chemically synthesized
aaaatatacttctgagaaatga

SEQ ID NO: 100083 - DNA, 22 bp, Artificial Sequence
  chemically synthesized
ctgagaaatgagagagagaaat

SEQ ID NO: 100084 - DNA, 22 bp, Artificial Sequence
  chemically synthesized
tgagaaatgagagagagaaatg

SEQ ID NO: 100085 - DNA, 22 bp, Artificial Sequence
  chemically synthesized
agaaatgagagagagaaatggg

SEQ ID NO: 100086 - DNA, 22 bp, Artificial Sequence
  chemically synthesized
aattattcttttctctgtctct

SEQ ID NO: 100087 - DNA, 22 bp, Artificial Sequence
  chemically synthesized
ttcttttctctgtctcttgaaa

SEQ ID NO: 100088 - DNA, 22 bp, Artificial Sequence
  chemically synthesized
ttttctctgtctcttgaaagag

SEQ ID NO: 100089 - DNA, 22 bp, Artificial Sequence
  chemically synthesized
ttctctgtctcttgaaagagct

SEQ ID NO: 100090 - DNA, 22 bp, Artificial Sequence
  chemically synthesized
tctctgtctcttgaaagagctc

SEQ ID NO: 100091 - DNA, 22 bp, Artificial Sequence
  chemically synthesized
ctctgtctcttgaaagagctct

SEQ ID NO: 100092 - DNA, 22 bp, Artificial Sequence
  chemically synthesized
tctgtctcttgaaagagctctt

SEQ ID NO: 100093 - DNA, 22 bp, Artificial Sequence
  chemically synthesized
tgtctcttgaaagagctctttc

SEQ ID NO: 100094 - DNA, 22 bp, Artificial Sequence
  chemically synthesized
tctcttgaaagagctctttcca

SEQ ID NO: 100095 - DNA, 22 bp, Artificial Sequence
  chemically synthesized
ttgaaagagctctttccattac

SEQ ID NO: 100096 - DNA, 22 bp, Artificial Sequence
  chemically synthesized
gaaagagctctttccattacat

SEQ ID NO: 100097 - DNA, 22 bp, Artificial Sequence
  chemically synthesized
aaagagctctttccattacatt

SEQ ID NO: 100098 - DNA, 22 bp, Artificial Sequence
  chemically synthesized
tttccattacattgaatcaaag

SEQ ID NO: 100099 - DNA, 22 bp, Artificial Sequence
  chemically synthesized
tccattacattgaatcaaaggt

SEQ ID NO: 100100 - DNA, 22 bp, Artificial Sequence
  chemically synthesized
ccattacattgaatcaaaggta

SEQ ID NO: 100101 - DNA, 22 bp, Artificial Sequence
  chemically synthesized
cattacattgaatcaaaggtaa

SEQ ID NO: 100102 - DNA, 22 bp, Artificial Sequence
  chemically synthesized
cattgaatcaaaggtaatgttg

SEQ ID NO: 100103 - DNA, 22 bp, Artificial Sequence
  chemically synthesized
aatcaaaggtaatgttgccatt

SEQ ID NO: 100104 - DNA, 22 bp, Artificial Sequence
  chemically synthesized
ccatttctggactcttgaaata

SEQ ID NO: 100105 - DNA, 22 bp, Artificial Sequence
  chemically synthesized
ctggactcttgaaataaagaaa

SEQ ID NO: 100106 - DNA, 22 bp, Artificial Sequence
  chemically synthesized
tggactcttgaaataaagaaag

SEQ ID NO: 100107 - DNA, 22 bp, Artificial Sequence
  chemically synthesized
gactcttgaaataaagaaagac

SEQ ID NO: 100108 - DNA, 22 bp, Artificial Sequence
  chemically synthesized
ttgaaataaagaaagaccgatg

SEQ ID NO: 100109 - DNA, 22 bp, Artificial Sequence
  chemically synthesized
gaaataaagaaagaccgatgta

SEQ ID NO: 100110 - DNA, 22 bp, Artificial Sequence
  chemically synthesized
aaataaagaaagaccgatgtat

SEQ ID NO: 100111 - DNA, 22 bp, Artificial Sequence
  chemically synthesized
tgaaagtctatggcattttcaa

SEQ ID NO: 100112 - DNA, 22 bp, Artificial Sequence
  chemically synthesized
gaaagtctatggcattttcaaa

SEQ ID NO: 100113 - DNA, 22 bp, Artificial Sequence
  chemically synthesized
aaagtctatggcattttcaaaa

SEQ ID NO: 100114 - DNA, 22 bp, Artificial Sequence
  chemically synthesized
tggcattttcaaaatgcaaggt

SEQ ID NO: 100115 - DNA, 22 bp, Artificial Sequence
  chemically synthesized
tcaaaatgcaaggtgatgtctt

SEQ ID NO: 100116 - DNA, 22 bp, Artificial Sequence
  chemically synthesized
caaaatgcaaggtgatgtctta

SEQ ID NO: 100117 - DNA, 22 bp, Artificial Sequence
  chemically synthesized
aaaatgcaaggtgatgtcttac

SEQ ID NO: 100118 - DNA, 22 bp, Artificial Sequence
  chemically synthesized
actaactagcctttgctttatt

SEQ ID NO: 100119 - DNA, 22 bp, Artificial Sequence
  chemically synthesized
ctaactagcctttgctttatta

SEQ ID NO: 100120 - DNA, 22 bp, Artificial Sequence
  chemically synthesized
actagcctttgctttattatta

SEQ ID NO: 100121 - DNA, 22 bp, Artificial Sequence
  chemically synthesized
gcctttgctttattattagaaa

SEQ ID NO: 100122 - DNA, 22 bp, Artificial Sequence
  chemically synthesized
tgctttattattagaaatgggg

SEQ ID NO: 100123 - DNA, 22 bp, Artificial Sequence
  chemically synthesized
gctttattattagaaatgggga

SEQ ID NO: 100124 - DNA, 22 bp, Artificial Sequence
  chemically synthesized
ctttattattagaaatggggaa

SEQ ID NO: 100125 - DNA, 22 bp, Artificial Sequence
  chemically synthesized
tattattagaaatggggaagtg

SEQ ID NO: 100126 - DNA, 22 bp, Artificial Sequence
  chemically synthesized
attattagaaatggggaagtga

SEQ ID NO: 100127 - DNA, 22 bp, Artificial Sequence
  chemically synthesized
ttattagaaatggggaagtgag

SEQ ID NO: 100128 - DNA, 22 bp, Artificial Sequence
  chemically synthesized
ttagaaatggggaagtgagtat

SEQ ID NO: 100129 - DNA, 22 bp, Artificial Sequence
  chemically synthesized
gaaatggggaagtgagtataga

SEQ ID NO: 100130 - DNA, 22 bp, Artificial Sequence
  chemically synthesized
tatcaggagatatattaggaaa

SEQ ID NO: 100131 - DNA, 22 bp, Artificial Sequence
  chemically synthesized
atcaggagatatattaggaaaa

SEQ ID NO: 100132 - DNA, 22 bp, Artificial Sequence
  chemically synthesized
tcaggagatatattaggaaaaa

SEQ ID NO: 100133 - DNA, 22 bp, Artificial Sequence
  chemically synthesized
ggaaaaagggaaactggagaaa

SEQ ID NO: 100134 - DNA, 22 bp, Artificial Sequence
  chemically synthesized
gagaaactgggaggagtatcca

SEQ ID NO: 100135 - DNA, 22 bp, Artificial Sequence
  chemically synthesized
ggaggagtatccagatgtcctg

SEQ ID NO: 100136 - DNA, 22 bp, Artificial Sequence
  chemically synthesized
tccctgtaaggtgggggcaccc

SEQ ID NO: 100137 - DNA, 22 bp, Artificial Sequence
  chemically synthesized
taaggtgggggcacccaccttc

SEQ ID NO: 100138 - DNA, 22 bp, Artificial Sequence
  chemically synthesized
caatcaaaagggctccttaaca

SEQ ID NO: 100139 - DNA, 22 bp, Artificial Sequence
  chemically synthesized
aatcaaaagggctccttaacaa

SEQ ID NO: 100140 - DNA, 22 bp, Artificial Sequence
  chemically synthesized
cttaacaacttccttgcttggg

SEQ ID NO: 100141 - DNA, 22 bp, Artificial Sequence
  chemically synthesized
aacaacttccttgcttggggct

SEQ ID NO: 100142 - DNA, 22 bp, Artificial Sequence
  chemically synthesized
acaacttccttgcttggggctc

SEQ ID NO: 100143 - DNA, 22 bp, Artificial Sequence
  chemically synthesized
ccttgcttggggctccaccatc

SEQ ID NO: 100144 - DNA, 22 bp, Artificial Sequence
  chemically synthesized
cttgcttggggctccaccatct

SEQ ID NO: 100145 - DNA, 22 bp, Artificial Sequence
  chemically synthesized
gcttggggctccaccatcttgg

SEQ ID NO: 100146 - DNA, 22 bp, Artificial Sequence
  chemically synthesized
cttggggctccaccatcttgga

SEQ ID NO: 100147 - DNA, 22 bp, Artificial Sequence
  chemically synthesized
ggggctccaccatcttggacca

SEQ ID NO: 100148 - DNA, 22 bp, Artificial Sequence
  chemically synthesized
gggctccaccatcttggaccat

SEQ ID NO: 100149 - DNA, 22 bp, Artificial Sequence
  chemically synthesized
caccatcttggaccattagctc

SEQ ID NO: 100150 - DNA, 22 bp, Artificial Sequence
  chemically synthesized
ggaccattagctccacaggtat

SEQ ID NO: 100151 - DNA, 22 bp, Artificial Sequence
  chemically synthesized
gaccattagctccacaggtatc

SEQ ID NO: 100152 - DNA, 22 bp, Artificial Sequence
  chemically synthesized
gctccacaggtatcttcttccc

SEQ ID NO: 100153 - DNA, 22 bp, Artificial Sequence
  chemically synthesized
cacaggtatcttcttccctcta

SEQ ID NO: 100154 - DNA, 22 bp, Artificial Sequence
  chemically synthesized
cttccctctagtggtcataaca

SEQ ID NO: 100155 - DNA, 22 bp, Artificial Sequence
  chemically synthesized
ttccctctagtggtcataacag

SEQ ID NO: 100156 - DNA, 22 bp, Artificial Sequence
  chemically synthesized
ccctctagtggtcataacagca

SEQ ID NO: 100157 - DNA, 22 bp, Artificial Sequence
  chemically synthesized
cctctagtggtcataacagcag

SEQ ID NO: 100158 - DNA, 22 bp, Artificial Sequence
  chemically synthesized
tagtggtcataacagcagcttc

SEQ ID NO: 100159 - DNA, 22 bp, Artificial Sequence
  chemically synthesized
gtggtcataacagcagcttcag

SEQ ID NO: 100160 - DNA, 22 bp, Artificial Sequence
  chemically synthesized
cagctacctctctaaagagtcc

SEQ ID NO: 100161 - DNA, 22 bp, Artificial Sequence
  chemically synthesized
agctacctctctaaagagtcct

SEQ ID NO: 100162 - DNA, 22 bp, Artificial Sequence
  chemically synthesized
cctctctaaagagtcctgccag

SEQ ID NO: 100163 - DNA, 22 bp, Artificial Sequence
  chemically synthesized
tctaaagagtcctgccagatat

SEQ ID NO: 100164 - DNA, 22 bp, Artificial Sequence
  chemically synthesized
taaagagtcctgccagatatag

SEQ ID NO: 100165 - DNA, 22 bp, Artificial Sequence
  chemically synthesized
aagagtcctgccagatataggt

SEQ ID NO: 100166 - DNA, 22 bp, Artificial Sequence
  chemically synthesized
ccagatataggtcaggaaatat

SEQ ID NO: 100167 - DNA, 22 bp, Artificial Sequence
  chemically synthesized
ataaaaagagaaacattttgac

SEQ ID NO: 100168 - DNA, 22 bp, Artificial Sequence
  chemically synthesized
tgactgtagttgtttgtttttt

SEQ ID NO: 100169 - DNA, 22 bp, Artificial Sequence
  chemically synthesized
gactgtagttgtttgttttttg

SEQ ID NO: 100170 - DNA, 22 bp, Artificial Sequence
  chemically synthesized
actgtagttgtttgttttttgt

SEQ ID NO: 100171 - DNA, 22 bp, Artificial Sequence
  chemically synthesized
tagttgtttgttttttgtcatt

SEQ ID NO: 100172 - DNA, 22 bp, Artificial Sequence
  chemically synthesized
tttgttttttgtcattgtgact

SEQ ID NO: 100173 - DNA, 22 bp, Artificial Sequence
  chemically synthesized
gttttttgtcattgtgactatc

SEQ ID NO: 100174 - DNA, 22 bp, Artificial Sequence
  chemically synthesized
ttttttgtcattgtgactatca

SEQ ID NO: 100175 - DNA, 22 bp, Artificial Sequence
  chemically synthesized
tttgtcattgtgactatcaata

SEQ ID NO: 100176 - DNA, 22 bp, Artificial Sequence
  chemically synthesized
ttgtcattgtgactatcaataa

SEQ ID NO: 100177 - DNA, 22 bp, Artificial Sequence
  chemically synthesized
tgtcattgtgactatcaataac

SEQ ID NO: 100178 - DNA, 22 bp, Artificial Sequence
  chemically synthesized
gtcattgtgactatcaataaca

SEQ ID NO: 100179 - DNA, 22 bp, Artificial Sequence
  chemically synthesized
tcattgtgactatcaataacat

SEQ ID NO: 100180 - DNA, 22 bp, Artificial Sequence
  chemically synthesized
tgactatcaataacattctcac

SEQ ID NO: 100181 - DNA, 22 bp, Artificial Sequence
  chemically synthesized
tcaataacattctcactctttc

SEQ ID NO: 100182 - DNA, 22 bp, Artificial Sequence
  chemically synthesized
tcactctttcatcagtaatcac

SEQ ID NO: 100183 - DNA, 22 bp, Artificial Sequence
  chemically synthesized
actctttcatcagtaatcactc

SEQ ID NO: 100184 - DNA, 22 bp, Artificial Sequence
  chemically synthesized
tttcatcagtaatcactcaggt

SEQ ID NO: 100185 - DNA, 22 bp, Artificial Sequence
  chemically synthesized
tcatcagtaatcactcaggtta

SEQ ID NO: 100186 - DNA, 22 bp, Artificial Sequence
  chemically synthesized
catcagtaatcactcaggttat

SEQ ID NO: 100187 - DNA, 22 bp, Artificial Sequence
  chemically synthesized
atcagtaatcactcaggttatt

SEQ ID NO: 100188 - DNA, 22 bp, Artificial Sequence
  chemically synthesized
aggttattctgtgaccaacaga

SEQ ID NO: 100189 - DNA, 22 bp, Artificial Sequence
  chemically synthesized
ttctgtgaccaacagactgtgg

SEQ ID NO: 100190 - DNA, 22 bp, Artificial Sequence
  chemically synthesized
tgtgaccaacagactgtgggaa

SEQ ID NO: 100191 - DNA, 22 bp, Artificial Sequence
  chemically synthesized
tgaccaacagactgtgggaaaa

SEQ ID NO: 100192 - DNA, 22 bp, Artificial Sequence
  chemically synthesized
tgggaaaaatcagagaaggagg

SEQ ID NO: 100193 - DNA, 22 bp, Artificial Sequence
  chemically synthesized
atgcttactagcctaaactgaa

SEQ ID NO: 100194 - DNA, 22 bp, Artificial Sequence
  chemically synthesized
actagcctaaactgaaattgct

SEQ ID NO: 100195 - DNA, 22 bp, Artificial Sequence
  chemically synthesized
ctagcctaaactgaaattgcta

SEQ ID NO: 100196 - DNA, 22 bp, Artificial Sequence
  chemically synthesized
gcctaaactgaaattgctatag

SEQ ID NO: 100197 - DNA, 22 bp, Artificial Sequence
  chemically synthesized
aactgaaattgctatagcagag

SEQ ID NO: 100198 - DNA, 22 bp, Artificial Sequence
  chemically synthesized
aaattgctatagcagagtgaac

SEQ ID NO: 100199 - DNA, 22 bp, Artificial Sequence
  chemically synthesized
ctatagcagagtgaaccagaag

SEQ ID NO: 100200 - DNA, 22 bp, Artificial Sequence
  chemically synthesized
tagcagagtgaaccagaaggtt

SEQ ID NO: 100201 - DNA, 22 bp, Artificial Sequence
  chemically synthesized
acagatattttccacaaagagt

SEQ ID NO: 100202 - DNA, 22 bp, Artificial Sequence
  chemically synthesized
cagatattttccacaaagagta

SEQ ID NO: 100203 - DNA, 22 bp, Artificial Sequence
  chemically synthesized
tccacaaagagtaaaaggattg

SEQ ID NO: 100204 - DNA, 22 bp, Artificial Sequence
  chemically synthesized
ccacaaagagtaaaaggattga

SEQ ID NO: 100205 - DNA, 22 bp, Artificial Sequence
  chemically synthesized
cacaaagagtaaaaggattgaa

SEQ ID NO: 100206 - DNA, 22 bp, Artificial Sequence
  chemically synthesized
aagccttctccagatcaatgca

SEQ ID NO: 100207 - DNA, 22 bp, Artificial Sequence
  chemically synthesized
ctccagatcaatgcataggaaa

SEQ ID NO: 100208 - DNA, 22 bp, Artificial Sequence
  chemically synthesized
tccagatcaatgcataggaaat

SEQ ID NO: 100209 - DNA, 22 bp, Artificial Sequence
  chemically synthesized
cagatcaatgcataggaaataa

SEQ ID NO: 100210 - DNA, 22 bp, Artificial Sequence
  chemically synthesized
tgacgaacaacattaggataag

SEQ ID NO: 100211 - DNA, 22 bp, Artificial Sequence
  chemically synthesized
ggataagtccatatcaattttt

SEQ ID NO: 100212 - DNA, 22 bp, Artificial Sequence
  chemically synthesized
ttaatccagtcataagcacaga

SEQ ID NO: 100213 - DNA, 22 bp, Artificial Sequence
  chemically synthesized
taatccagtcataagcacagac

SEQ ID NO: 100214 - DNA, 22 bp, Artificial Sequence
  chemically synthesized
aatccagtcataagcacagact

SEQ ID NO: 100215 - DNA, 22 bp, Artificial Sequence
  chemically synthesized
atccagtcataagcacagacta

SEQ ID NO: 100216 - DNA, 22 bp, Artificial Sequence
  chemically synthesized
cgtgaagcacgtccaagtgaag

SEQ ID NO: 100217 - DNA, 22 bp, Artificial Sequence
  chemically synthesized
gatcaagaatagcagaaaaagg

SEQ ID NO: 100218 - DNA, 22 bp, Artificial Sequence
  chemically synthesized
atcaagaatagcagaaaaagga

SEQ ID NO: 100219 - DNA, 22 bp, Artificial Sequence
  chemically synthesized
acaaatgattgtcatgccaaca

SEQ ID NO: 100220 - DNA, 22 bp, Artificial Sequence
  chemically synthesized
tcatgccaacagtacagataac

SEQ ID NO: 100221 - DNA, 22 bp, Artificial Sequence
  chemically synthesized
tgctaataaaggtagaggcata

SEQ ID NO: 100222 - DNA, 22 bp, Artificial Sequence
  chemically synthesized
ctaataaaggtagaggcataat

SEQ ID NO: 100223 - DNA, 22 bp, Artificial Sequence
  chemically synthesized
ataaaggtagaggcataataca

SEQ ID NO: 100224 - DNA, 22 bp, Artificial Sequence
  chemically synthesized
catagtagttaaaggacatggc

SEQ ID NO: 100225 - DNA, 22 bp, Artificial Sequence
  chemically synthesized
aaggacatggccatcagtacag

SEQ ID NO: 100226 - DNA, 22 bp, Artificial Sequence
  chemically synthesized
cataaaggagaacctaaagagg

SEQ ID NO: 100227 - DNA, 22 bp, Artificial Sequence
  chemically synthesized
aagaggaagaataatttgtcag

SEQ ID NO: 100228 - DNA, 22 bp, Artificial Sequence
  chemically synthesized
gtcagaagcttaaaagctgaac

SEQ ID NO: 100229 - DNA, 22 bp, Artificial Sequence
  chemically synthesized
tcagaagcttaaaagctgaact

SEQ ID NO: 100230 - DNA, 22 bp, Artificial Sequence
  chemically synthesized
aaaagctgaactctgaggcatt

SEQ ID NO: 100231 - DNA, 22 bp, Artificial Sequence
  chemically synthesized
aaagctgaactctgaggcatta

SEQ ID NO: 100232 - DNA, 22 bp, Artificial Sequence
  chemically synthesized
aactctgaggcattaaactaca

SEQ ID NO: 100233 - DNA, 22 bp, Artificial Sequence
  chemically synthesized
tgaggcattaaactacaatatc

SEQ ID NO: 100234 - DNA, 22 bp, Artificial Sequence
  chemically synthesized
aggcattaaactacaatatcct

SEQ ID NO: 100235 - DNA, 22 bp, Artificial Sequence
  chemically synthesized
aactacaatatccttttgactg

SEQ ID NO: 100236 - DNA, 22 bp, Artificial Sequence
  chemically synthesized
caatatccttttgactgtggaa

SEQ ID NO: 100237 - DNA, 22 bp, Artificial Sequence
  chemically synthesized
ttgactgtggaaagggtggtga

SEQ ID NO: 100238 - DNA, 22 bp, Artificial Sequence
  chemically synthesized
tgactgtggaaagggtggtgaa

SEQ ID NO: 100239 - DNA, 22 bp, Artificial Sequence
  chemically synthesized
gactgtggaaagggtggtgaaa

SEQ ID NO: 100240 - DNA, 22 bp, Artificial Sequence
  chemically synthesized
actgtggaaagggtggtgaaag

SEQ ID NO: 100241 - DNA, 22 bp, Artificial Sequence
  chemically synthesized
tggaaagggtggtgaaaggaaa

SEQ ID NO: 100242 - DNA, 22 bp, Artificial Sequence
  chemically synthesized
aaggacatttgagccaacatag

SEQ ID NO: 100243 - DNA, 22 bp, Artificial Sequence
  chemically synthesized
gagccaacatagagaggaacat

SEQ ID NO: 100244 - DNA, 22 bp, Artificial Sequence
  chemically synthesized
agccaacatagagaggaacatt

SEQ ID NO: 100245 - DNA, 22 bp, Artificial Sequence
  chemically synthesized
gcttggtgagggatatctgtcc

SEQ ID NO: 100246 - DNA, 22 bp, Artificial Sequence
  chemically synthesized
ggtgagggatatctgtcctgat

SEQ ID NO: 100247 - DNA, 22 bp, Artificial Sequence
  chemically synthesized
gtgagggatatctgtcctgatg

SEQ ID NO: 100248 - DNA, 22 bp, Artificial Sequence
  chemically synthesized
tcctgatgttgtccaggatggt

SEQ ID NO: 100249 - DNA, 22 bp, Artificial Sequence
  chemically synthesized
atgttgtccaggatggtgatga

SEQ ID NO: 100250 - DNA, 22 bp, Artificial Sequence
  chemically synthesized
tccaggatggtgatgataccca

SEQ ID NO: 100251 - DNA, 22 bp, Artificial Sequence
  chemically synthesized
gacaaagaggcatcaaagatag

SEQ ID NO: 100252 - DNA, 22 bp, Artificial Sequence
  chemically synthesized
gtaaggatgaaatagaacgttt

SEQ ID NO: 100253 - DNA, 22 bp, Artificial Sequence
  chemically synthesized
taaggatgaaatagaacgtttt

SEQ ID NO: 100254 - DNA, 22 bp, Artificial Sequence
  chemically synthesized
tttgcgttagtcaccgtgagga

SEQ ID NO: 100255 - DNA, 22 bp, Artificial Sequence
  chemically synthesized
ttgcgttagtcaccgtgaggat

SEQ ID NO: 100256 - DNA, 22 bp, Artificial Sequence
  chemically synthesized
tgcgttagtcaccgtgaggatg

SEQ ID NO: 100257 - DNA, 22 bp, Artificial Sequence
  chemically synthesized
gcgttagtcaccgtgaggatga

SEQ ID NO: 100258 - DNA, 22 bp, Artificial Sequence
  chemically synthesized
cgttagtcaccgtgaggatgac

SEQ ID NO: 100259 - DNA, 22 bp, Artificial Sequence
  chemically synthesized
gtcaccgtgaggatgaccggta

SEQ ID NO: 100260 - DNA, 22 bp, Artificial Sequence
  chemically synthesized
atgcctttgttattttttatta

SEQ ID NO: 100261 - DNA, 22 bp, Artificial Sequence
  chemically synthesized
tgttattttttattatttcatt

SEQ ID NO: 100262 - DNA, 22 bp, Artificial Sequence
  chemically synthesized
gttattttttattatttcattt

SEQ ID NO: 100263 - DNA, 22 bp, Artificial Sequence
  chemically synthesized
ttattttttattatttcatttt

SEQ ID NO: 100264 - DNA, 22 bp, Artificial Sequence
  chemically synthesized
ttttttattatttcattttaaa

SEQ ID NO: 100265 - DNA, 22 bp, Artificial Sequence
  chemically synthesized
tttattatttcattttaaattg

SEQ ID NO: 100266 - DNA, 22 bp, Artificial Sequence
  chemically synthesized
ttattatttcattttaaattga

SEQ ID NO: 100267 - DNA, 22 bp, Artificial Sequence
  chemically synthesized
tattatttcattttaaattgac

SEQ ID NO: 100268 - DNA, 22 bp, Artificial Sequence
  chemically synthesized
attatttcattttaaattgaca

SEQ ID NO: 100269 - DNA, 22 bp, Artificial Sequence
  chemically synthesized
ttatttcattttaaattgacaa

SEQ ID NO: 100270 - DNA, 22 bp, Artificial Sequence
  chemically synthesized
tttcattttaaattgacaaata

SEQ ID NO: 100271 - DNA, 22 bp, Artificial Sequence
  chemically synthesized
cattttaaattgacaaataata

SEQ ID NO: 100272 - DNA, 22 bp, Artificial Sequence
  chemically synthesized
attttaaattgacaaataataa

SEQ ID NO: 100273 - DNA, 22 bp, Artificial Sequence
  chemically synthesized
taaattgacaaataataattgt

SEQ ID NO: 100274 - DNA, 22 bp, Artificial Sequence
  chemically synthesized
aaattgacaaataataattgtg

SEQ ID NO: 100275 - DNA, 22 bp, Artificial Sequence
  chemically synthesized
aattgacaaataataattgtgt

SEQ ID NO: 100276 - DNA, 22 bp, Artificial Sequence
  chemically synthesized
acaaataataattgtgtgtatt

SEQ ID NO: 100277 - DNA, 22 bp, Artificial Sequence
  chemically synthesized
tgtgtattcatggggtacaaca

SEQ ID NO: 100278 - DNA, 22 bp, Artificial Sequence
  chemically synthesized
atggggtacaacatgatgcttt

SEQ ID NO: 100279 - DNA, 22 bp, Artificial Sequence
  chemically synthesized
tggtgtacgtgtacaatattaa

SEQ ID NO: 100280 - DNA, 22 bp, Artificial Sequence
  chemically synthesized
ggtgtacgtgtacaatattaaa

SEQ ID NO: 100281 - DNA, 22 bp, Artificial Sequence
  chemically synthesized
gtgtacgtgtacaatattaaat

SEQ ID NO: 100282 - DNA, 22 bp, Artificial Sequence
  chemically synthesized
aatggttaaataaggctaatta

SEQ ID NO: 100283 - DNA, 22 bp, Artificial Sequence
  chemically synthesized
aataaggctaattaacaaatcc

SEQ ID NO: 100284 - DNA, 22 bp, Artificial Sequence
  chemically synthesized
attaacaaatccaccacttcac

SEQ ID NO: 100285 - DNA, 22 bp, Artificial Sequence
  chemically synthesized
acaaatccaccacttcacatac

SEQ ID NO: 100286 - DNA, 22 bp, Artificial Sequence
  chemically synthesized
cacatacttattttttgtggtg

SEQ ID NO: 100287 - DNA, 22 bp, Artificial Sequence
  chemically synthesized
acatacttattttttgtggtga

SEQ ID NO: 100288 - DNA, 22 bp, Artificial Sequence
  chemically synthesized
attttttgtggtgaaaacattt

SEQ ID NO: 100289 - DNA, 22 bp, Artificial Sequence
  chemically synthesized
ttttttgtggtgaaaacattta

SEQ ID NO: 100290 - DNA, 22 bp, Artificial Sequence
  chemically synthesized
tttgtggtgaaaacatttaaaa

SEQ ID NO: 100291 - DNA, 22 bp, Artificial Sequence
  chemically synthesized
ttgtggtgaaaacatttaaaat

SEQ ID NO: 100292 - DNA, 22 bp, Artificial Sequence
  chemically synthesized
tgtggtgaaaacatttaaaatt

SEQ ID NO: 100293 - DNA, 22 bp, Artificial Sequence
  chemically synthesized
gtggtgaaaacatttaaaattt

SEQ ID NO: 100294 - DNA, 22 bp, Artificial Sequence
  chemically synthesized
tggtgaaaacatttaaaattta

SEQ ID NO: 100295 - DNA, 22 bp, Artificial Sequence
  chemically synthesized
aaaatttacactcttcattcaa

SEQ ID NO: 100296 - DNA, 22 bp, Artificial Sequence
  chemically synthesized
aaatttacactcttcattcaaa

SEQ ID NO: 100297 - DNA, 22 bp, Artificial Sequence
  chemically synthesized
acactcttcattcaaaaatctg

SEQ ID NO: 100298 - DNA, 22 bp, Artificial Sequence
  chemically synthesized
cactcttcattcaaaaatctgg

SEQ ID NO: 100299 - DNA, 22 bp, Artificial Sequence
  chemically synthesized
ttcattcaaaaatctggaacat

SEQ ID NO: 100300 - DNA, 22 bp, Artificial Sequence
  chemically synthesized
cattcaaaaatctggaacatag

SEQ ID NO: 100301 - DNA, 22 bp, Artificial Sequence
  chemically synthesized
attcaaaaatctggaacatagt

SEQ ID NO: 100302 - DNA, 22 bp, Artificial Sequence
  chemically synthesized
aaaaatctggaacatagttaaa

SEQ ID NO: 100303 - DNA, 22 bp, Artificial Sequence
  chemically synthesized
gaacatagttaaaatgtcatat

SEQ ID NO: 100304 - DNA, 22 bp, Artificial Sequence
  chemically synthesized
aaatgtcatatgtgtcaggatg

SEQ ID NO: 100305 - DNA, 22 bp, Artificial Sequence
  chemically synthesized
agaaaacattgaatgattcctt

SEQ ID NO: 100306 - DNA, 22 bp, Artificial Sequence
  chemically synthesized
gaaaacattgaatgattccttg

SEQ ID NO: 100307 - DNA, 22 bp, Artificial Sequence
  chemically synthesized
aatgattccttgcaaatcatga

SEQ ID NO: 100308 - DNA, 22 bp, Artificial Sequence
  chemically synthesized
cttgcaaatcatgaataatgat

SEQ ID NO: 100309 - DNA, 22 bp, Artificial Sequence
  chemically synthesized
gcaaatcatgaataatgatcaa

SEQ ID NO: 100310 - DNA, 22 bp, Artificial Sequence
  chemically synthesized
caaatcatgaataatgatcaat

SEQ ID NO: 100311 - DNA, 22 bp, Artificial Sequence
  chemically synthesized
tgaaaatgagaaaattttggag

SEQ ID NO: 100312 - DNA, 22 bp, Artificial Sequence
  chemically synthesized
tggagcctgaactaaaaatatc

SEQ ID NO: 100313 - DNA, 22 bp, Artificial Sequence
  chemically synthesized
ggagcctgaactaaaaatatct

SEQ ID NO: 100314 - DNA, 22 bp, Artificial Sequence
  chemically synthesized
gagcctgaactaaaaatatctt

SEQ ID NO: 100315 - DNA, 22 bp, Artificial Sequence
  chemically synthesized
aactaaaaatatcttgatcact

SEQ ID NO: 100316 - DNA, 22 bp, Artificial Sequence
  chemically synthesized
aaaatatcttgatcacttttgg

SEQ ID NO: 100317 - DNA, 22 bp, Artificial Sequence
  chemically synthesized
gatcacttttggaggtcaggaa

SEQ ID NO: 100318 - DNA, 22 bp, Artificial Sequence
  chemically synthesized
atcacttttggaggtcaggaat

SEQ ID NO: 100319 - DNA, 22 bp, Artificial Sequence
  chemically synthesized
ttggaggtcaggaattcagatt

SEQ ID NO: 100320 - DNA, 22 bp, Artificial Sequence
  chemically synthesized
tggaggtcaggaattcagattc

SEQ ID NO: 100321 - DNA, 22 bp, Artificial Sequence
  chemically synthesized
ggaggtcaggaattcagattca

SEQ ID NO: 100322 - DNA, 22 bp, Artificial Sequence
  chemically synthesized
gaggtcaggaattcagattcat

SEQ ID NO: 100323 - DNA, 22 bp, Artificial Sequence
  chemically synthesized
agattcatttttctcggcctgt

SEQ ID NO: 100324 - DNA, 22 bp, Artificial Sequence
  chemically synthesized
atttttctcggcctgtaaagaa

SEQ ID NO: 100325 - DNA, 22 bp, Artificial Sequence
  chemically synthesized
ttctcggcctgtaaagaacttg

SEQ ID NO: 100326 - DNA, 22 bp, Artificial Sequence
  chemically synthesized
tctcggcctgtaaagaacttga

SEQ ID NO: 100327 - DNA, 22 bp, Artificial Sequence
  chemically synthesized
ctcggcctgtaaagaacttgaa

SEQ ID NO: 100328 - DNA, 22 bp, Artificial Sequence
  chemically synthesized
tcggcctgtaaagaacttgaaa

SEQ ID NO: 100329 - DNA, 22 bp, Artificial Sequence
  chemically synthesized
ggcctgtaaagaacttgaaatt

SEQ ID NO: 100330 - DNA, 22 bp, Artificial Sequence
  chemically synthesized
taaagaacttgaaattgcatta

SEQ ID NO: 100331 - DNA, 22 bp, Artificial Sequence
  chemically synthesized
gaaattgcattatagcagaatg

SEQ ID NO: 100332 - DNA, 22 bp, Artificial Sequence
  chemically synthesized
aaattgcattatagcagaatgt

SEQ ID NO: 100333 - DNA, 22 bp, Artificial Sequence
  chemically synthesized
cattatagcagaatgtaggcct

SEQ ID NO: 100334 - DNA, 22 bp, Artificial Sequence
  chemically synthesized
tagcagaatgtaggccttgagt

SEQ ID NO: 100335 - DNA, 22 bp, Artificial Sequence
  chemically synthesized
gagtggattgatgtggaagcaa

SEQ ID NO: 100336 - DNA, 22 bp, Artificial Sequence
  chemically synthesized
agtggattgatgtggaagcaaa

SEQ ID NO: 100337 - DNA, 22 bp, Artificial Sequence
  chemically synthesized
atgtggaagcaaaacaagccac

SEQ ID NO: 100338 - DNA, 22 bp, Artificial Sequence
  chemically synthesized
gtgccattaattttaagcagtt

SEQ ID NO: 100339 - DNA, 22 bp, Artificial Sequence
  chemically synthesized
tgccattaattttaagcagttt

SEQ ID NO: 100340 - DNA, 22 bp, Artificial Sequence
  chemically synthesized
attttaagcagtttcatatgaa

SEQ ID NO: 100341 - DNA, 22 bp, Artificial Sequence
  chemically synthesized
taagcagtttcatatgaaacgt

SEQ ID NO: 100342 - DNA, 22 bp, Artificial Sequence
  chemically synthesized
aagcagtttcatatgaaacgtg

SEQ ID NO: 100343 - DNA, 22 bp, Artificial Sequence
  chemically synthesized
agcagtttcatatgaaacgtgg

SEQ ID NO: 100344 - DNA, 22 bp, Artificial Sequence
  chemically synthesized
catatgaaacgtgggtttcttt

SEQ ID NO: 100345 - DNA, 22 bp, Artificial Sequence
  chemically synthesized
atatgaaacgtgggtttcttta

SEQ ID NO: 100346 - DNA, 22 bp, Artificial Sequence
  chemically synthesized
ctttattgctacgtcacagtca

SEQ ID NO: 100347 - DNA, 22 bp, Artificial Sequence
  chemically synthesized
tttattgctacgtcacagtcag

SEQ ID NO: 100348 - DNA, 22 bp, Artificial Sequence
  chemically synthesized
tattgctacgtcacagtcagat

SEQ ID NO: 100349 - DNA, 22 bp, Artificial Sequence
  chemically synthesized
attgctacgtcacagtcagatg

SEQ ID NO: 100350 - DNA, 22 bp, Artificial Sequence
  chemically synthesized
ttgctacgtcacagtcagatgt

SEQ ID NO: 100351 - DNA, 22 bp, Artificial Sequence
  chemically synthesized
ctacgtcacagtcagatgttca

SEQ ID NO: 100352 - DNA, 22 bp, Artificial Sequence
  chemically synthesized
cgtcacagtcagatgttcatgg

SEQ ID NO: 100353 - DNA, 22 bp, Artificial Sequence
  chemically synthesized
atggtcctgagtgctctcctcc

SEQ ID NO: 100354 - DNA, 22 bp, Artificial Sequence
  chemically synthesized
agtgctctcctccaagcagtgg

SEQ ID NO: 100355 - DNA, 22 bp, Artificial Sequence
  chemically synthesized
tcctccaagcagtgggccagga

SEQ ID NO: 100356 - DNA, 22 bp, Artificial Sequence
  chemically synthesized
ctccaagcagtgggccaggagt

SEQ ID NO: 100357 - DNA, 22 bp, Artificial Sequence
  chemically synthesized
caagcagtgggccaggagtcca

SEQ ID NO: 100358 - DNA, 22 bp, Artificial Sequence
  chemically synthesized
cctgtgattgactttatcattt

SEQ ID NO: 100359 - DNA, 22 bp, Artificial Sequence
  chemically synthesized
ctgtgattgactttatcatttc

SEQ ID NO: 100360 - DNA, 22 bp, Artificial Sequence
  chemically synthesized
tgattgactttatcatttcaga

SEQ ID NO: 100361 - DNA, 22 bp, Artificial Sequence
  chemically synthesized
actttatcatttcagaatcttt

SEQ ID NO: 100362 - DNA, 22 bp, Artificial Sequence
  chemically synthesized
tatcatttcagaatcttttact

SEQ ID NO: 100363 - DNA, 22 bp, Artificial Sequence
  chemically synthesized
atcatttcagaatcttttactt

SEQ ID NO: 100364 - DNA, 22 bp, Artificial Sequence
  chemically synthesized
tcatttcagaatcttttacttt

SEQ ID NO: 100365 - DNA, 22 bp, Artificial Sequence
  chemically synthesized
cagaatcttttactttctgcca

SEQ ID NO: 100366 - DNA, 22 bp, Artificial Sequence
  chemically synthesized
agaatcttttactttctgccac

SEQ ID NO: 100367 - DNA, 22 bp, Artificial Sequence
  chemically synthesized
ttactttctgccacatagagga

SEQ ID NO: 100368 - DNA, 22 bp, Artificial Sequence
  chemically synthesized
tactttctgccacatagaggaa

SEQ ID NO: 100369 - DNA, 22 bp, Artificial Sequence
  chemically synthesized
actttctgccacatagaggaag

SEQ ID NO: 100370 - DNA, 22 bp, Artificial Sequence
  chemically synthesized
ctttctgccacatagaggaagg

SEQ ID NO: 100371 - DNA, 22 bp, Artificial Sequence
  chemically synthesized
tctgccacatagaggaagggaa

SEQ ID NO: 100372 - DNA, 22 bp, Artificial Sequence
  chemically synthesized
ctgccacatagaggaagggaaa

SEQ ID NO: 100373 - DNA, 22 bp, Artificial Sequence
  chemically synthesized
tgccacatagaggaagggaaag

SEQ ID NO: 100374 - DNA, 22 bp, Artificial Sequence
  chemically synthesized
ccacatagaggaagggaaagag

SEQ ID NO: 100375 - DNA, 22 bp, Artificial Sequence
  chemically synthesized
tgccttagggagtaacacatta

SEQ ID NO: 100376 - DNA, 22 bp, Artificial Sequence
  chemically synthesized
ccttagggagtaacacattatt

SEQ ID NO: 100377 - DNA, 22 bp, Artificial Sequence
  chemically synthesized
agggagtaacacattattatct

SEQ ID NO: 100378 - DNA, 22 bp, Artificial Sequence
  chemically synthesized
gggagtaacacattattatctc

SEQ ID NO: 100379 - DNA, 22 bp, Artificial Sequence
  chemically synthesized
ttatctccacattattttagtc

SEQ ID NO: 100380 - DNA, 22 bp, Artificial Sequence
  chemically synthesized
tctccacattattttagtcaca

SEQ ID NO: 100381 - DNA, 22 bp, Artificial Sequence
  chemically synthesized
cacattattttagtcacaacca

SEQ ID NO: 100382 - DNA, 22 bp, Artificial Sequence
  chemically synthesized
ttttagtcacaaccagtcacat

SEQ ID NO: 100383 - DNA, 22 bp, Artificial Sequence
  chemically synthesized
tagtcacaaccagtcacatggc

SEQ ID NO: 100384 - DNA, 22 bp, Artificial Sequence
  chemically synthesized
agtcacaaccagtcacatggcc

SEQ ID NO: 100385 - DNA, 22 bp, Artificial Sequence
  chemically synthesized
gtcacaaccagtcacatggcca

SEQ ID NO: 100386 - DNA, 22 bp, Artificial Sequence
  chemically synthesized
attgcaagggctgttggaaatt

SEQ ID NO: 100387 - DNA, 22 bp, Artificial Sequence
  chemically synthesized
caagggctgttggaaattgttg

SEQ ID NO: 100388 - DNA, 22 bp, Artificial Sequence
  chemically synthesized
ttggaaattgttgagaagtata

SEQ ID NO: 100389 - DNA, 22 bp, Artificial Sequence
  chemically synthesized
gaaattgttgagaagtatattg

SEQ ID NO: 100390 - DNA, 22 bp, Artificial Sequence
  chemically synthesized
ttgagaagtatattgatttagt

SEQ ID NO: 100391 - DNA, 22 bp, Artificial Sequence
  chemically synthesized
agaagtatattgatttagtgac

SEQ ID NO: 100392 - DNA, 22 bp, Artificial Sequence
  chemically synthesized
atttagtgactcatattgtttc

SEQ ID NO: 100393 - DNA, 22 bp, Artificial Sequence
  chemically synthesized
agtgactcatattgtttctgac

SEQ ID NO: 100394 - DNA, 22 bp, Artificial Sequence
  chemically synthesized
gtgactcatattgtttctgaca

SEQ ID NO: 100395 - DNA, 22 bp, Artificial Sequence
  chemically synthesized
atattgtttctgacatactgtg

SEQ ID NO: 100396 - DNA, 22 bp, Artificial Sequence
  chemically synthesized
tttctgacatactgtgtccgga

SEQ ID NO: 100397 - DNA, 22 bp, Artificial Sequence
  chemically synthesized
ctgacatactgtgtccggaatt

SEQ ID NO: 100398 - DNA, 22 bp, Artificial Sequence
  chemically synthesized
tgacatactgtgtccggaattg

SEQ ID NO: 100399 - DNA, 22 bp, Artificial Sequence
  chemically synthesized
acatactgtgtccggaattggt

SEQ ID NO: 100400 - DNA, 22 bp, Artificial Sequence
  chemically synthesized
tgtccggaattggtgggttctt

SEQ ID NO: 100401 - DNA, 22 bp, Artificial Sequence
  chemically synthesized
gtgggttcttggtttcactgac

SEQ ID NO: 100402 - DNA, 22 bp, Artificial Sequence
  chemically synthesized
ttggtttcactgacttcaagaa

SEQ ID NO: 100403 - DNA, 22 bp, Artificial Sequence
  chemically synthesized
ggtttcactgacttcaagaatg

SEQ ID NO: 100404 - DNA, 22 bp, Artificial Sequence
  chemically synthesized
gtttcactgacttcaagaatga

SEQ ID NO: 100405 - DNA, 22 bp, Artificial Sequence
  chemically synthesized
cactgacttcaagaatgaagcc

SEQ ID NO: 100406 - DNA, 22 bp, Artificial Sequence
  chemically synthesized
actgacttcaagaatgaagccg

SEQ ID NO: 100407 - DNA, 22 bp, Artificial Sequence
  chemically synthesized
acttcaagaatgaagccgggga

SEQ ID NO: 100408 - DNA, 22 bp, Artificial Sequence
  chemically synthesized
caagaatgaagccggggaccct

SEQ ID NO: 100409 - DNA, 22 bp, Artificial Sequence
  chemically synthesized
aagaatgaagccggggaccctc

SEQ ID NO: 100410 - DNA, 22 bp, Artificial Sequence
  chemically synthesized
gtggtgagtgttacagttctta

SEQ ID NO: 100411 - DNA, 22 bp, Artificial Sequence
  chemically synthesized
cagttcttaaaggctgcgtgtg

SEQ ID NO: 100412 - DNA, 22 bp, Artificial Sequence
  chemically synthesized
ttaaaggctgcgtgtgtggagt

SEQ ID NO: 100413 - DNA, 22 bp, Artificial Sequence
  chemically synthesized
aaaggctgcgtgtgtggagttt

SEQ ID NO: 100414 - DNA, 22 bp, Artificial Sequence
  chemically synthesized
aaggctgcgtgtgtggagtttg

SEQ ID NO: 100415 - DNA, 22 bp, Artificial Sequence
  chemically synthesized
cgtgtgtggagtttgttcgttc

SEQ ID NO: 100416 - DNA, 22 bp, Artificial Sequence
  chemically synthesized
gttcgttctgatgtttggatgt

SEQ ID NO: 100417 - DNA, 22 bp, Artificial Sequence
  chemically synthesized
ttcgttctgatgtttggatgtg

SEQ ID NO: 100418 - DNA, 22 bp, Artificial Sequence
  chemically synthesized
gttctgatgtttggatgtgttc

SEQ ID NO: 100419 - DNA, 22 bp, Artificial Sequence
  chemically synthesized
tgatgtttggatgtgttcggag

SEQ ID NO: 100420 - DNA, 22 bp, Artificial Sequence
  chemically synthesized
atgtttggatgtgttcggagtt

SEQ ID NO: 100421 - DNA, 22 bp, Artificial Sequence
  chemically synthesized
ggatgtgttcggagtttcttcc

SEQ ID NO: 100422 - DNA, 22 bp, Artificial Sequence
  chemically synthesized
gatgtgttcggagtttcttcct

SEQ ID NO: 100423 - DNA, 22 bp, Artificial Sequence
  chemically synthesized
ggagtttcttccttctgatggg

SEQ ID NO: 100424 - DNA, 22 bp, Artificial Sequence
  chemically synthesized
cttccttctgatgggttcgtgg

SEQ ID NO: 100425 - DNA, 22 bp, Artificial Sequence
  chemically synthesized
ttccttctgatgggttcgtggt

SEQ ID NO: 100426 - DNA, 22 bp, Artificial Sequence
  chemically synthesized
ccttctgatgggttcgtggtct

SEQ ID NO: 100427 - DNA, 22 bp, Artificial Sequence
  chemically synthesized
cttctgatgggttcgtggtctc

SEQ ID NO: 100428 - DNA, 22 bp, Artificial Sequence
  chemically synthesized
ctgatgggttcgtggtctcgct

SEQ ID NO: 100429 - DNA, 22 bp, Artificial Sequence
  chemically synthesized
tgatgggttcgtggtctcgctg

SEQ ID NO: 100430 - DNA, 22 bp, Artificial Sequence
  chemically synthesized
atgggttcgtggtctcgctggc

SEQ ID NO: 100431 - DNA, 22 bp, Artificial Sequence
  chemically synthesized
gtggtctcgctggctcaggagt

SEQ ID NO: 100432 - DNA, 22 bp, Artificial Sequence
  chemically synthesized
gctggctcaggagtgaagctgc

SEQ ID NO: 100433 - DNA, 22 bp, Artificial Sequence
  chemically synthesized
gctcaggagtgaagctgcagac

SEQ ID NO: 100434 - DNA, 22 bp, Artificial Sequence
  chemically synthesized
aggagtgaagctgcagaccttc

SEQ ID NO: 100435 - DNA, 22 bp, Artificial Sequence
  chemically synthesized
cagaccttcacagtgaacgttc

SEQ ID NO: 100436 - DNA, 22 bp, Artificial Sequence
  chemically synthesized
cacagtgaacgttccagctctt

SEQ ID NO: 100437 - DNA, 22 bp, Artificial Sequence
  chemically synthesized
acagtgaacgttccagctctta

SEQ ID NO: 100438 - DNA, 22 bp, Artificial Sequence
  chemically synthesized
cagctcttaaggcggcgcctct

SEQ ID NO: 100439 - DNA, 22 bp, Artificial Sequence
  chemically synthesized
ttaaggcggcgcctctggagtt

SEQ ID NO: 100440 - DNA, 22 bp, Artificial Sequence
  chemically synthesized
aaggcggcgcctctggagttgt

SEQ ID NO: 100441 - DNA, 22 bp, Artificial Sequence
  chemically synthesized
aggcggcgcctctggagttgtt

SEQ ID NO: 100442 - DNA, 22 bp, Artificial Sequence
  chemically synthesized
tggagttgttcgttcctcccgg

SEQ ID NO: 100443 - DNA, 22 bp, Artificial Sequence
  chemically synthesized
gagttgttcgttcctcccggtg

SEQ ID NO: 100444 - DNA, 22 bp, Artificial Sequence
  chemically synthesized
ttcgttcctcccggtgggttcg

SEQ ID NO: 100445 - DNA, 22 bp, Artificial Sequence
  chemically synthesized
gttcctcccggtgggttcgtgg

SEQ ID NO: 100446 - DNA, 22 bp, Artificial Sequence
  chemically synthesized
ctcccggtgggttcgtggtctc

SEQ ID NO: 100447 - DNA, 22 bp, Artificial Sequence
  chemically synthesized
ccggtgggttcgtggtctcgct

SEQ ID NO: 100448 - DNA, 22 bp, Artificial Sequence
  chemically synthesized
gtggtctcgctggcttcaagag

SEQ ID NO: 100449 - DNA, 22 bp, Artificial Sequence
  chemically synthesized
gctggcttcaagagtgaagctg

SEQ ID NO: 100450 - DNA, 22 bp, Artificial Sequence
  chemically synthesized
gcttcaagagtgaagctgcaga

SEQ ID NO: 100451 - DNA, 22 bp, Artificial Sequence
  chemically synthesized
caagagtgaagctgcagacctt

SEQ ID NO: 100452 - DNA, 22 bp, Artificial Sequence
  chemically synthesized
aagagtgaagctgcagaccttc

SEQ ID NO: 100453 - DNA, 22 bp, Artificial Sequence
  chemically synthesized
cagaccttcgcggtgagcgtta

SEQ ID NO: 100454 - DNA, 22 bp, Artificial Sequence
  chemically synthesized
cgcggtgagcgttacagctcat

SEQ ID NO: 100455 - DNA, 22 bp, Artificial Sequence
  chemically synthesized
gcggtgagcgttacagctcata

SEQ ID NO: 100456 - DNA, 22 bp, Artificial Sequence
  chemically synthesized
cagctcataaaggcagtgtaga

SEQ ID NO: 100457 - DNA, 22 bp, Artificial Sequence
  chemically synthesized
ataaaggcagtgtagacccaaa

SEQ ID NO: 100458 - DNA, 22 bp, Artificial Sequence
  chemically synthesized
attgcaaagagcgaaagaacaa

SEQ ID NO: 100459 - DNA, 22 bp, Artificial Sequence
  chemically synthesized
ttgcaaagagcgaaagaacaaa

SEQ ID NO: 100460 - DNA, 22 bp, Artificial Sequence
  chemically synthesized
caaagagcgaaagaacaaagct

SEQ ID NO: 100461 - DNA, 22 bp, Artificial Sequence
  chemically synthesized
ccacagtgtggaaggggacccg

SEQ ID NO: 100462 - DNA, 22 bp, Artificial Sequence
  chemically synthesized
cacagtgtggaaggggacccga

SEQ ID NO: 100463 - DNA, 22 bp, Artificial Sequence
  chemically synthesized
ccactgctggctcgggcagcct

SEQ ID NO: 100464 - DNA, 22 bp, Artificial Sequence
  chemically synthesized
ctggctcgggcagcctgctttt

SEQ ID NO: 100465 - DNA, 22 bp, Artificial Sequence
  chemically synthesized
gctcgggcagcctgcttttatt

SEQ ID NO: 100466 - DNA, 22 bp, Artificial Sequence
  chemically synthesized
gggcagcctgcttttattctct

SEQ ID NO: 100467 - DNA, 22 bp, Artificial Sequence
  chemically synthesized
cttttattctcttatctggccc

SEQ ID NO: 100468 - DNA, 22 bp, Artificial Sequence
  chemically synthesized
ttattctcttatctggccccac

SEQ ID NO: 100469 - DNA, 22 bp, Artificial Sequence
  chemically synthesized
tattctcttatctggccccacc

SEQ ID NO: 100470 - DNA, 22 bp, Artificial Sequence
  chemically synthesized
attctcttatctggccccaccc

SEQ ID NO: 100471 - DNA, 22 bp, Artificial Sequence
  chemically synthesized
ttctcttatctggccccaccca

SEQ ID NO: 100472 - DNA, 22 bp, Artificial Sequence
  chemically synthesized
tcttatctggccccacccacat

SEQ ID NO: 100473 - DNA, 22 bp, Artificial Sequence
  chemically synthesized
ttatctggccccacccacatcc

SEQ ID NO: 100474 - DNA, 22 bp, Artificial Sequence
  chemically synthesized
atctggccccacccacatcctg

SEQ ID NO: 100475 - DNA, 22 bp, Artificial Sequence
  chemically synthesized
tctggccccacccacatcctgc

SEQ ID NO: 100476 - DNA, 22 bp, Artificial Sequence
  chemically synthesized
gccccacccacatcctgctgat

SEQ ID NO: 100477 - DNA, 22 bp, Artificial Sequence
  chemically synthesized
ctgattggtagagcccagtggt

SEQ ID NO: 100478 - DNA, 22 bp, Artificial Sequence
  chemically synthesized
attggtagagcccagtggtctg

SEQ ID NO: 100479 - DNA, 22 bp, Artificial Sequence
  chemically synthesized
gtagagcccagtggtctgtttt

SEQ ID NO: 100480 - DNA, 22 bp, Artificial Sequence
  chemically synthesized
ttttgacagggcactgattggt

SEQ ID NO: 100481 - DNA, 22 bp, Artificial Sequence
  chemically synthesized
tgacagggcactgattggtgca

SEQ ID NO: 100482 - DNA, 22 bp, Artificial Sequence
  chemically synthesized
gacagggcactgattggtgcat

SEQ ID NO: 100483 - DNA, 22 bp, Artificial Sequence
  chemically synthesized
acagggcactgattggtgcatt

SEQ ID NO: 100484 - DNA, 22 bp, Artificial Sequence
  chemically synthesized
attggtgcatttacaatccatg

SEQ ID NO: 100485 - DNA, 22 bp, Artificial Sequence
  chemically synthesized
gtgcatttacaatccatgagct

SEQ ID NO: 100486 - DNA, 22 bp, Artificial Sequence
  chemically synthesized
acaatccatgagctagacacaa

SEQ ID NO: 100487 - DNA, 22 bp, Artificial Sequence
  chemically synthesized
caatccatgagctagacacaaa

SEQ ID NO: 100488 - DNA, 22 bp, Artificial Sequence
  chemically synthesized
gacacaaaggttctccacgtcc

SEQ ID NO: 100489 - DNA, 22 bp, Artificial Sequence
  chemically synthesized
tccacgtccccaccagattagc

SEQ ID NO: 100490 - DNA, 22 bp, Artificial Sequence
  chemically synthesized
cacgtccccaccagattagcta

SEQ ID NO: 100491 - DNA, 22 bp, Artificial Sequence
  chemically synthesized
gctagatacagagtgtccacac

SEQ ID NO: 100492 - DNA, 22 bp, Artificial Sequence
  chemically synthesized
gatacagagtgtccacacaaag

SEQ ID NO: 100493 - DNA, 22 bp, Artificial Sequence
  chemically synthesized
tccaagtccccaccagagtagc

SEQ ID NO: 100494 - DNA, 22 bp, Artificial Sequence
  chemically synthesized
caagtccccaccagagtagcta

SEQ ID NO: 100495 - DNA, 22 bp, Artificial Sequence
  chemically synthesized
gatacagagtgttgattggtgc

SEQ ID NO: 100496 - DNA, 22 bp, Artificial Sequence
  chemically synthesized
attggtgcattcacaaaccctg

SEQ ID NO: 100497 - DNA, 22 bp, Artificial Sequence
  chemically synthesized
gtgcattcacaaaccctgagct

SEQ ID NO: 100498 - DNA, 22 bp, Artificial Sequence
  chemically synthesized
acaaaccctgagctagacacag

SEQ ID NO: 100499 - DNA, 22 bp, Artificial Sequence
  chemically synthesized
agctagacacagggtgctgatt

SEQ ID NO: 100500 - DNA, 22 bp, Artificial Sequence
  chemically synthesized
gacacagggtgctgattggtgt

SEQ ID NO: 100501 - DNA, 22 bp, Artificial Sequence
  chemically synthesized
attggtgtgtttacaaaccttg

SEQ ID NO: 100502 - DNA, 22 bp, Artificial Sequence
  chemically synthesized
gtgtgtttacaaaccttgagct

SEQ ID NO: 100503 - DNA, 22 bp, Artificial Sequence
  chemically synthesized
acaaaccttgagctagatacag

SEQ ID NO: 100504 - DNA, 22 bp, Artificial Sequence
  chemically synthesized
caaaccttgagctagatacaga

SEQ ID NO: 100505 - DNA, 22 bp, Artificial Sequence
  chemically synthesized
gagctagatacagactgccgag

SEQ ID NO: 100506 - DNA, 22 bp, Artificial Sequence
  chemically synthesized
agctagatacagactgccgagt

SEQ ID NO: 100507 - DNA, 22 bp, Artificial Sequence
  chemically synthesized
gatacagactgccgagtggtgt

SEQ ID NO: 100508 - DNA, 22 bp, Artificial Sequence
  chemically synthesized
ccgagtggtgtatttacaatcc

SEQ ID NO: 100509 - DNA, 22 bp, Artificial Sequence
  chemically synthesized
acaatccctgagctagacataa

SEQ ID NO: 100510 - DNA, 22 bp, Artificial Sequence
  chemically synthesized
caatccctgagctagacataaa

SEQ ID NO: 100511 - DNA, 22 bp, Artificial Sequence
  chemically synthesized
agctagacataaaggttctcca

SEQ ID NO: 100512 - DNA, 22 bp, Artificial Sequence
  chemically synthesized
gacataaaggttctccacgtcc

SEQ ID NO: 100513 - DNA, 22 bp, Artificial Sequence
  chemically synthesized
tccacgtccccaccagagtagc

SEQ ID NO: 100514 - DNA, 22 bp, Artificial Sequence
  chemically synthesized
cacgtccccaccagagtagcta

SEQ ID NO: 100515 - DNA, 22 bp, Artificial Sequence
  chemically synthesized
gatacagagtgttgattggtgc

SEQ ID NO: 100516 - DNA, 22 bp, Artificial Sequence
  chemically synthesized
attggtgcattcacaaaccctg

SEQ ID NO: 100517 - DNA, 22 bp, Artificial Sequence
  chemically synthesized
gtgcattcacaaaccctgagct

SEQ ID NO: 100518 - DNA, 22 bp, Artificial Sequence
  chemically synthesized
acaaaccctgagctagacacag

SEQ ID NO: 100519 - DNA, 22 bp, Artificial Sequence
  chemically synthesized
agctagacacagggtgctgatt

SEQ ID NO: 100520 - DNA, 22 bp, Artificial Sequence
  chemically synthesized
gacacagggtgctgattggtgt

SEQ ID NO: 100521 - DNA, 22 bp, Artificial Sequence
  chemically synthesized
attggtgtgtttacaaaccttg

SEQ ID NO: 100522 - DNA, 22 bp, Artificial Sequence
  chemically synthesized
gtgtgtttacaaaccttgagct

SEQ ID NO: 100523 - DNA, 22 bp, Artificial Sequence
  chemically synthesized
acaaaccttgagctagatacag

SEQ ID NO: 100524 - DNA, 22 bp, Artificial Sequence
  chemically synthesized
caaaccttgagctagatacaga

SEQ ID NO: 100525 - DNA, 22 bp, Artificial Sequence
  chemically synthesized
gagctagatacagactgccgat

SEQ ID NO: 100526 - DNA, 22 bp, Artificial Sequence
  chemically synthesized
agctagatacagactgccgatt

SEQ ID NO: 100527 - DNA, 22 bp, Artificial Sequence
  chemically synthesized
gatacagactgccgattggtgt

SEQ ID NO: 100528 - DNA, 22 bp, Artificial Sequence
  chemically synthesized
ccgattggtgtatttacaatcc

SEQ ID NO: 100529 - DNA, 22 bp, Artificial Sequence
  chemically synthesized
gtgtatttacaatccctgagct

SEQ ID NO: 100530 - DNA, 22 bp, Artificial Sequence
  chemically synthesized
acaatccctgagctagacataa

SEQ ID NO: 100531 - DNA, 22 bp, Artificial Sequence
  chemically synthesized
caatccctgagctagacataaa

SEQ ID NO: 100532 - DNA, 22 bp, Artificial Sequence
  chemically synthesized
agctagacataaaggttctcca

SEQ ID NO: 100533 - DNA, 22 bp, Artificial Sequence
  chemically synthesized
gacataaaggttctccaaggcc

SEQ ID NO: 100534 - DNA, 22 bp, Artificial Sequence
  chemically synthesized
tccaaggccccaccagagtagc

SEQ ID NO: 100535 - DNA, 22 bp, Artificial Sequence
  chemically synthesized
caaggccccaccagagtagcta

SEQ ID NO: 100536 - DNA, 22 bp, Artificial Sequence
  chemically synthesized
gatagagtgttgattggtgcat

SEQ ID NO: 100537 - DNA, 22 bp, Artificial Sequence
  chemically synthesized
attggtgcattcacaaaccctg

SEQ ID NO: 100538 - DNA, 22 bp, Artificial Sequence
  chemically synthesized
gtgcattcacaaaccctgagct

SEQ ID NO: 100539 - DNA, 22 bp, Artificial Sequence
  chemically synthesized
acaaaccctgagctagacacag

SEQ ID NO: 100540 - DNA, 22 bp, Artificial Sequence
  chemically synthesized
agctagacacagggtgctgatt

SEQ ID NO: 100541 - DNA, 22 bp, Artificial Sequence
  chemically synthesized
gacacagggtgctgattggtgt

SEQ ID NO: 100542 - DNA, 22 bp, Artificial Sequence
  chemically synthesized
attggtgtgtttacaaaccttg

SEQ ID NO: 100543 - DNA, 22 bp, Artificial Sequence
  chemically synthesized
gtgtgtttacaaaccttgagct

SEQ ID NO: 100544 - DNA, 22 bp, Artificial Sequence
  chemically synthesized
acaaaccttgagctagatacag

SEQ ID NO: 100545 - DNA, 22 bp, Artificial Sequence
  chemically synthesized
caaaccttgagctagatacaga

SEQ ID NO: 100546 - DNA, 22 bp, Artificial Sequence
  chemically synthesized
gagctagatacagagtgccaat

SEQ ID NO: 100547 - DNA, 22 bp, Artificial Sequence
  chemically synthesized
agctagatacagagtgccaatt

SEQ ID NO: 100548 - DNA, 22 bp, Artificial Sequence
  chemically synthesized
gatacagagtgccaattggtgt

SEQ ID NO: 100549 - DNA, 22 bp, Artificial Sequence
  chemically synthesized
gtgtatttacaatcccttatct

SEQ ID NO: 100550 - DNA, 22 bp, Artificial Sequence
  chemically synthesized
acaatcccttatctagacataa

SEQ ID NO: 100551 - DNA, 22 bp, Artificial Sequence
  chemically synthesized
caatcccttatctagacataag

SEQ ID NO: 100552 - DNA, 22 bp, Artificial Sequence
  chemically synthesized
atctagacataagggttcttcg

SEQ ID NO: 100553 - DNA, 22 bp, Artificial Sequence
  chemically synthesized
tctagacataagggttcttcgc

SEQ ID NO: 100554 - DNA, 22 bp, Artificial Sequence
  chemically synthesized
gacataagggttcttcgcatcc

SEQ ID NO: 100555 - DNA, 22 bp, Artificial Sequence
  chemically synthesized
ttcgcatccccagcaaactcag

SEQ ID NO: 100556 - DNA, 22 bp, Artificial Sequence
  chemically synthesized
cgcatccccagcaaactcagga

SEQ ID NO: 100557 - DNA, 22 bp, Artificial Sequence
  chemically synthesized
gcatccccagcaaactcaggag

SEQ ID NO: 100558 - DNA, 22 bp, Artificial Sequence
  chemically synthesized
aggagcctagccggcttcaccc

SEQ ID NO: 100559 - DNA, 22 bp, Artificial Sequence
  chemically synthesized
gccggcttcacccagtggatcc

SEQ ID NO: 100560 - DNA, 22 bp, Artificial Sequence
  chemically synthesized
cacccagtggatcccgcacctg

SEQ ID NO: 100561 - DNA, 22 bp, Artificial Sequence
  chemically synthesized
acccagtggatcccgcacctgg

SEQ ID NO: 100562 - DNA, 22 bp, Artificial Sequence
  chemically synthesized
ggctgcagggggagctgcctgc

SEQ ID NO: 100563 - DNA, 22 bp, Artificial Sequence
  chemically synthesized
cagggggagctgcctgccagtc

SEQ ID NO: 100564 - DNA, 22 bp, Artificial Sequence
  chemically synthesized
cctgccagtcccctgccgtgcg

SEQ ID NO: 100565 - DNA, 22 bp, Artificial Sequence
  chemically synthesized
ccagtcccctgccgtgcgcccg

SEQ ID NO: 100566 - DNA, 22 bp, Artificial Sequence
  chemically synthesized
ccgtgcgcccgcactcttcagc

SEQ ID NO: 100567 - DNA, 22 bp, Artificial Sequence
  chemically synthesized
ttcagcccttgggtggtcgatg

SEQ ID NO: 100568 - DNA, 22 bp, Artificial Sequence
  chemically synthesized
cagcccttgggtggtcgatggg

SEQ ID NO: 100569 - DNA, 22 bp, Artificial Sequence
  chemically synthesized
agcccttgggtggtcgatggga

SEQ ID NO: 100570 - DNA, 22 bp, Artificial Sequence
  chemically synthesized
gggtggtcgatgggactgggtg

SEQ ID NO: 100571 - DNA, 22 bp, Artificial Sequence
  chemically synthesized
ggtggtcgatgggactgggtgc

SEQ ID NO: 100572 - DNA, 22 bp, Artificial Sequence
  chemically synthesized
ggtgccctggagcagggggcgg

SEQ ID NO: 100573 - DNA, 22 bp, Artificial Sequence
  chemically synthesized
gagcagggggcggcgctcgtcg

SEQ ID NO: 100574 - DNA, 22 bp, Artificial Sequence
  chemically synthesized
gtcggcgaggctcgggccgcac

SEQ ID NO: 100575 - DNA, 22 bp, Artificial Sequence
  chemically synthesized
gggccgcacaggagcccatgaa

SEQ ID NO: 100576 - DNA, 22 bp, Artificial Sequence
  chemically synthesized
aggcatggcgcgctgcaggtcc

SEQ ID NO: 100577 - DNA, 22 bp, Artificial Sequence
  chemically synthesized
caggtcccgagccctgccccgc

SEQ ID NO: 100578 - DNA, 22 bp, Artificial Sequence
  chemically synthesized
ccccgcaggaaggcagctaagg

SEQ ID NO: 100579 - DNA, 22 bp, Artificial Sequence
  chemically synthesized
aggcccggcgaggaattgagca

SEQ ID NO: 100580 - DNA, 22 bp, Artificial Sequence
  chemically synthesized
agcacagcagctgctggcccag

SEQ ID NO: 100581 - DNA, 22 bp, Artificial Sequence
  chemically synthesized
ctggcccaggtgctaagcccct

SEQ ID NO: 100582 - DNA, 22 bp, Artificial Sequence
  chemically synthesized
gcccaggtgctaagcccctcac

SEQ ID NO: 100583 - DNA, 22 bp, Artificial Sequence
  chemically synthesized
agcccctcactgcccgcggccg

SEQ ID NO: 100584 - DNA, 22 bp, Artificial Sequence
  chemically synthesized
actgcccgcggccggtggggcc

SEQ ID NO: 100585 - DNA, 22 bp, Artificial Sequence
  chemically synthesized
cccgcggccggtggggccggct

SEQ ID NO: 100586 - DNA, 22 bp, Artificial Sequence
  chemically synthesized
gcggctccgagtgcggggtcct

SEQ ID NO: 100587 - DNA, 22 bp, Artificial Sequence
  chemically synthesized
cgagtgcggggtcctcggagcc

SEQ ID NO: 100588 - DNA, 22 bp, Artificial Sequence
  chemically synthesized
ggagcccatgcccacccggaac

SEQ ID NO: 100589 - DNA, 22 bp, Artificial Sequence
  chemically synthesized
cctcaagcacggcgcacagccc

SEQ ID NO: 100590 - DNA, 22 bp, Artificial Sequence
  chemically synthesized
aagcacggcgcacagcccggtt

SEQ ID NO: 100591 - DNA, 22 bp, Artificial Sequence
  chemically synthesized
ctgcccgcgtctgtccctccac

SEQ ID NO: 100592 - DNA, 22 bp, Artificial Sequence
  chemically synthesized
cccgcgtctgtccctccacacc

SEQ ID NO: 100593 - DNA, 22 bp, Artificial Sequence
  chemically synthesized
tccctccacacctcctggcaag

SEQ ID NO: 100594 - DNA, 22 bp, Artificial Sequence
  chemically synthesized
cacacctcctggcaagctgagg

SEQ ID NO: 100595 - DNA, 22 bp, Artificial Sequence
  chemically synthesized
ctggcaagctgagggagccggc

SEQ ID NO: 100596 - DNA, 22 bp, Artificial Sequence
  chemically synthesized
gcaagctgagggagccggctct

SEQ ID NO: 100597 - DNA, 22 bp, Artificial Sequence
  chemically synthesized
agggagccggctctggccttgg

SEQ ID NO: 100598 - DNA, 22 bp, Artificial Sequence
  chemically synthesized
tggccttggccagcccagaaaa

SEQ ID NO: 100599 - DNA, 22 bp, Artificial Sequence
  chemically synthesized
gccttggccagcccagaaaagg

SEQ ID NO: 100600 - DNA, 22 bp, Artificial Sequence
  chemically synthesized
ggccagcccagaaaagggctcc

SEQ ID NO: 100601 - DNA, 22 bp, Artificial Sequence
  chemically synthesized
gccagcccagaaaagggctccc

SEQ ID NO: 100602 - DNA, 22 bp, Artificial Sequence
  chemically synthesized
ccacagtgcagcggccggctga

SEQ ID NO: 100603 - DNA, 22 bp, Artificial Sequence
  chemically synthesized
aagggctcctcaagtgccacca

SEQ ID NO: 100604 - DNA, 22 bp, Artificial Sequence
  chemically synthesized
ctcaagtgccaccaatgtggga

SEQ ID NO: 100605 - DNA, 22 bp, Artificial Sequence
  chemically synthesized
aagtgccaccaatgtgggagcc

SEQ ID NO: 100606 - DNA, 22 bp, Artificial Sequence
  chemically synthesized
tgaggactgccagcacgctgtc

SEQ ID NO: 100607 - DNA, 22 bp, Artificial Sequence
  chemically synthesized
ccagcacgctgtcacctctcaa

SEQ ID NO: 100608 - DNA, 22 bp, Artificial Sequence
  chemically synthesized
tcacctctcaatactaatcact

SEQ ID NO: 100609 - DNA, 22 bp, Artificial Sequence
  chemically synthesized
tcaatactaatcactagtaatt

SEQ ID NO: 100610 - DNA, 22 bp, Artificial Sequence
  chemically synthesized
aatactaatcactagtaattag

SEQ ID NO: 100611 - DNA, 22 bp, Artificial Sequence
  chemically synthesized
atcactagtaattagcattatc

SEQ ID NO: 100612 - DNA, 22 bp, Artificial Sequence
  chemically synthesized
gtaattagcattatcccacacc

SEQ ID NO: 100613 - DNA, 22 bp, Artificial Sequence
  chemically synthesized
gcattatcccacaccctgtgct

SEQ ID NO: 100614 - DNA, 22 bp, Artificial Sequence
  chemically synthesized
tcccacaccctgtgcttccaaa

SEQ ID NO: 100615 - DNA, 22 bp, Artificial Sequence
  chemically synthesized
tgcttccaaaaataacaggaat

SEQ ID NO: 100616 - DNA, 22 bp, Artificial Sequence
  chemically synthesized
ccaaaaataacaggaatattat

SEQ ID NO: 100617 - DNA, 22 bp, Artificial Sequence
  chemically synthesized
caaaaataacaggaatattatt

SEQ ID NO: 100618 - DNA, 22 bp, Artificial Sequence
  chemically synthesized
ttgtaaaatcaaaggcatactg

SEQ ID NO: 100619 - DNA, 22 bp, Artificial Sequence
  chemically synthesized
taaaatcaaaggcatactgaac

SEQ ID NO: 100620 - DNA, 22 bp, Artificial Sequence
  chemically synthesized
aaccatatgttttattatgttt

SEQ ID NO: 100621 - DNA, 22 bp, Artificial Sequence
  chemically synthesized
tattatgtttaagcagtaaaaa

SEQ ID NO: 100622 - DNA, 22 bp, Artificial Sequence
  chemically synthesized
attatgtttaagcagtaaaaat

SEQ ID NO: 100623 - DNA, 22 bp, Artificial Sequence
  chemically synthesized
ttatgtttaagcagtaaaaata

SEQ ID NO: 100624 - DNA, 22 bp, Artificial Sequence
  chemically synthesized
tgtttaagcagtaaaaataaga

SEQ ID NO: 100625 - DNA, 22 bp, Artificial Sequence
  chemically synthesized
aagcagtaaaaataagacctgg

SEQ ID NO: 100626 - DNA, 22 bp, Artificial Sequence
  chemically synthesized
agcagtaaaaataagacctgga

SEQ ID NO: 100627 - DNA, 22 bp, Artificial Sequence
  chemically synthesized
gagtgcaaaaagactaccaaat

SEQ ID NO: 100628 - DNA, 22 bp, Artificial Sequence
  chemically synthesized
ccaaatgctgtaatacttcatg

SEQ ID NO: 100629 - DNA, 22 bp, Artificial Sequence
  chemically synthesized
taatacttcatggaatctaagc

SEQ ID NO: 100630 - DNA, 22 bp, Artificial Sequence
  chemically synthesized
catggaatctaagctttctcac

SEQ ID NO: 100631 - DNA, 22 bp, Artificial Sequence
  chemically synthesized
atggaatctaagctttctcacc

SEQ ID NO: 100632 - DNA, 22 bp, Artificial Sequence
  chemically synthesized
agctttctcaccccaaattatg

SEQ ID NO: 100633 - DNA, 22 bp, Artificial Sequence
  chemically synthesized
tctcaccccaaattatgtctta

SEQ ID NO: 100634 - DNA, 22 bp, Artificial Sequence
  chemically synthesized
ctcaccccaaattatgtcttat

SEQ ID NO: 100635 - DNA, 22 bp, Artificial Sequence
  chemically synthesized
tcaccccaaattatgtcttatt

SEQ ID NO: 100636 - DNA, 22 bp, Artificial Sequence
  chemically synthesized
accccaaattatgtcttatttc

SEQ ID NO: 100637 - DNA, 22 bp, Artificial Sequence
  chemically synthesized
tgtcttatttcagagcaaataa

SEQ ID NO: 100638 - DNA, 22 bp, Artificial Sequence
  chemically synthesized
atttcagagcaaataacttagg

SEQ ID NO: 100639 - DNA, 22 bp, Artificial Sequence
  chemically synthesized
tttcagagcaaataacttaggc

SEQ ID NO: 100640 - DNA, 22 bp, Artificial Sequence
  chemically synthesized
cagagcaaataacttaggcttt

SEQ ID NO: 100641 - DNA, 22 bp, Artificial Sequence
  chemically synthesized
agagcaaataacttaggcttta

SEQ ID NO: 100642 - DNA, 22 bp, Artificial Sequence
  chemically synthesized
aggctttaaaaaatgtttcctc

SEQ ID NO: 100643 - DNA, 22 bp, Artificial Sequence
  chemically synthesized
ggctttaaaaaatgtttcctca

SEQ ID NO: 100644 - DNA, 22 bp, Artificial Sequence
  chemically synthesized
taaaaaatgtttcctcatgaat

SEQ ID NO: 100645 - DNA, 22 bp, Artificial Sequence
  chemically synthesized
aaaaaatgtttcctcatgaatt

SEQ ID NO: 100646 - DNA, 22 bp, Artificial Sequence
  chemically synthesized
aaaaatgtttcctcatgaatta

SEQ ID NO: 100647 - DNA, 22 bp, Artificial Sequence
  chemically synthesized
cctcatgaattattattgtata

SEQ ID NO: 100648 - DNA, 22 bp, Artificial Sequence
  chemically synthesized
ctcatgaattattattgtataa

SEQ ID NO: 100649 - DNA, 22 bp, Artificial Sequence
  chemically synthesized
atgaattattattgtataatga

SEQ ID NO: 100650 - DNA, 22 bp, Artificial Sequence
  chemically synthesized
ttattgtataatgattcagagc

SEQ ID NO: 100651 - DNA, 22 bp, Artificial Sequence
  chemically synthesized
ttgtataatgattcagagcatg

SEQ ID NO: 100652 - DNA, 22 bp, Artificial Sequence
  chemically synthesized
tataatgattcagagcatgtat

SEQ ID NO: 100653 - DNA, 22 bp, Artificial Sequence
  chemically synthesized
agagcatgtattctagagccaa

SEQ ID NO: 100654 - DNA, 22 bp, Artificial Sequence
  chemically synthesized
tagagccaaatatcatgagttg

SEQ ID NO: 100655 - DNA, 22 bp, Artificial Sequence
  chemically synthesized
gagccaaatatcatgagttgaa

SEQ ID NO: 100656 - DNA, 22 bp, Artificial Sequence
  chemically synthesized
aattatgccctctgtcagttag

SEQ ID NO: 100657 - DNA, 22 bp, Artificial Sequence
  chemically synthesized
tgccctctgtcagttagtagcc

SEQ ID NO: 100658 - DNA, 22 bp, Artificial Sequence
  chemically synthesized
tgtcagttagtagccacttcat

SEQ ID NO: 100659 - DNA, 22 bp, Artificial Sequence
  chemically synthesized
tcagttagtagccacttcatct

SEQ ID NO: 100660 - DNA, 22 bp, Artificial Sequence
  chemically synthesized
gtagccacttcatcttggaata

SEQ ID NO: 100661 - DNA, 22 bp, Artificial Sequence
  chemically synthesized
catcttggaatattactttagg

SEQ ID NO: 100662 - DNA, 22 bp, Artificial Sequence
  chemically synthesized
atcttggaatattactttaggg

SEQ ID NO: 100663 - DNA, 22 bp, Artificial Sequence
  chemically synthesized
ggaatattactttagggccctg

SEQ ID NO: 100664 - DNA, 22 bp, Artificial Sequence
  chemically synthesized
gaatattactttagggccctgt

SEQ ID NO: 100665 - DNA, 22 bp, Artificial Sequence
  chemically synthesized
ctttagggccctgtgcctcagt

SEQ ID NO: 100666 - DNA, 22 bp, Artificial Sequence
  chemically synthesized
tagggccctgtgcctcagtttc

SEQ ID NO: 100667 - DNA, 22 bp, Artificial Sequence
  chemically synthesized
agggccctgtgcctcagtttcc

SEQ ID NO: 100668 - DNA, 22 bp, Artificial Sequence
  chemically synthesized
gggccctgtgcctcagtttcct

SEQ ID NO: 100669 - DNA, 22 bp, Artificial Sequence
  chemically synthesized
tgcctcagtttcctcctcttaa

SEQ ID NO: 100670 - DNA, 22 bp, Artificial Sequence
  chemically synthesized
agtttcctcctcttaaagggta

SEQ ID NO: 100671 - DNA, 22 bp, Artificial Sequence
  chemically synthesized
cctcctcttaaagggtattaca

SEQ ID NO: 100672 - DNA, 22 bp, Artificial Sequence
  chemically synthesized
ctcctcttaaagggtattacaa

SEQ ID NO: 100673 - DNA, 22 bp, Artificial Sequence
  chemically synthesized
ctcttaaagggtattacaatag

SEQ ID NO: 100674 - DNA, 22 bp, Artificial Sequence
  chemically synthesized
ttaaagggtattacaatagtac

SEQ ID NO: 100675 - DNA, 22 bp, Artificial Sequence
  chemically synthesized
aaagggtattacaatagtactt

SEQ ID NO: 100676 - DNA, 22 bp, Artificial Sequence
  chemically synthesized
aagggtattacaatagtacttg

SEQ ID NO: 100677 - DNA, 22 bp, Artificial Sequence
  chemically synthesized
caatagtacttgaggcacagag

SEQ ID NO: 100678 - DNA, 22 bp, Artificial Sequence
  chemically synthesized
gaggcacagagttactgtgaat

SEQ ID NO: 100679 - DNA, 22 bp, Artificial Sequence
  chemically synthesized
aggcacagagttactgtgaata

SEQ ID NO: 100680 - DNA, 22 bp, Artificial Sequence
  chemically synthesized
ctgtgaatactaaatgaaataa

SEQ ID NO: 100681 - DNA, 22 bp, Artificial Sequence
  chemically synthesized
tgaatactaaatgaaataatat

SEQ ID NO: 100682 - DNA, 22 bp, Artificial Sequence
  chemically synthesized
aatgaaataatatatcaacagt

SEQ ID NO: 100683 - DNA, 22 bp, Artificial Sequence
  chemically synthesized
gtgtatagtataagccataatc

SEQ ID NO: 100684 - DNA, 22 bp, Artificial Sequence
  chemically synthesized
tgtatagtataagccataatca

SEQ ID NO: 100685 - DNA, 22 bp, Artificial Sequence
  chemically synthesized
tattgttattactattactact

SEQ ID NO: 100686 - DNA, 22 bp, Artificial Sequence
  chemically synthesized
ttattactattactactattat

SEQ ID NO: 100687 - DNA, 22 bp, Artificial Sequence
  chemically synthesized
ttactattactactattattac

SEQ ID NO: 100688 - DNA, 22 bp, Artificial Sequence
  chemically synthesized
ctattactactattattactat

SEQ ID NO: 100689 - DNA, 22 bp, Artificial Sequence
  chemically synthesized
ttactactattattactattac

SEQ ID NO: 100690 - DNA, 22 bp, Artificial Sequence
  chemically synthesized
ctactattattactattacttt

SEQ ID NO: 100691 - DNA, 22 bp, Artificial Sequence
  chemically synthesized
ctattattactattacttttat

SEQ ID NO: 100692 - DNA, 22 bp, Artificial Sequence
  chemically synthesized
ttattactattacttttatact

SEQ ID NO: 100693 - DNA, 22 bp, Artificial Sequence
  chemically synthesized
ttactattacttttatactatc

SEQ ID NO: 100694 - DNA, 22 bp, Artificial Sequence
  chemically synthesized
ctattacttttatactatccta

SEQ ID NO: 100695 - DNA, 22 bp, Artificial Sequence
  chemically synthesized
ttacttttatactatcctagtg

SEQ ID NO: 100696 - DNA, 22 bp, Artificial Sequence
  chemically synthesized
cttttatactatcctagtgtgt

SEQ ID NO: 100697 - DNA, 22 bp, Artificial Sequence
  chemically synthesized
ttatactatcctagtgtgtaga

SEQ ID NO: 100698 - DNA, 22 bp, Artificial Sequence
  chemically synthesized
tatactatcctagtgtgtagat

SEQ ID NO: 100699 - DNA, 22 bp, Artificial Sequence
  chemically synthesized
atactatcctagtgtgtagatt

SEQ ID NO: 100700 - DNA, 22 bp, Artificial Sequence
  chemically synthesized
tactatcctagtgtgtagattg

SEQ ID NO: 100701 - DNA, 22 bp, Artificial Sequence
  chemically synthesized
tcctagtgtgtagattgaggat

SEQ ID NO: 100702 - DNA, 22 bp, Artificial Sequence
  chemically synthesized
gtgtgtagattgaggatgtagg

SEQ ID NO: 100703 - DNA, 22 bp, Artificial Sequence
  chemically synthesized
aggatgtaggggcttagagcaa

SEQ ID NO: 100704 - DNA, 22 bp, Artificial Sequence
  chemically synthesized
agagcaaagacatgaaggtcac

SEQ ID NO: 100705 - DNA, 22 bp, Artificial Sequence
  chemically synthesized
gagcaaagacatgaaggtcaca

SEQ ID NO: 100706 - DNA, 22 bp, Artificial Sequence
  chemically synthesized
tcaaggattacacgagtctttc

SEQ ID NO: 100707 - DNA, 22 bp, Artificial Sequence
  chemically synthesized
cacgagtctttctctgcaaagc

SEQ ID NO: 100708 - DNA, 22 bp, Artificial Sequence
  chemically synthesized
tctctgcaaagcgagggaaggt

SEQ ID NO: 100709 - DNA, 22 bp, Artificial Sequence
  chemically synthesized
ctctgcaaagcgagggaaggtt

SEQ ID NO: 100710 - DNA, 22 bp, Artificial Sequence
  chemically synthesized
tctgcaaagcgagggaaggtta

SEQ ID NO: 100711 - DNA, 22 bp, Artificial Sequence
  chemically synthesized
tgcaaagcgagggaaggttagt

SEQ ID NO: 100712 - DNA, 22 bp, Artificial Sequence
  chemically synthesized
caaagcgagggaaggttagtct

SEQ ID NO: 100713 - DNA, 22 bp, Artificial Sequence
  chemically synthesized
gtctctttcagagaacatcatg

SEQ ID NO: 100714 - DNA, 22 bp, Artificial Sequence
  chemically synthesized
tttcagagaacatcatggcaga

SEQ ID NO: 100715 - DNA, 22 bp, Artificial Sequence
  chemically synthesized
tcagagaacatcatggcagaaa

SEQ ID NO: 100716 - DNA, 22 bp, Artificial Sequence
  chemically synthesized
cagagaacatcatggcagaaac

SEQ ID NO: 100717 - DNA, 22 bp, Artificial Sequence
  chemically synthesized
agagaacatcatggcagaaaca

SEQ ID NO: 100718 - DNA, 22 bp, Artificial Sequence
  chemically synthesized
tttcaagagaatccatgcattt

SEQ ID NO: 100719 - DNA, 22 bp, Artificial Sequence
  chemically synthesized
ttcaagagaatccatgcatttt

SEQ ID NO: 100720 - DNA, 22 bp, Artificial Sequence
  chemically synthesized
tcaagagaatccatgcatttta

SEQ ID NO: 100721 - DNA, 22 bp, Artificial Sequence
  chemically synthesized
caagagaatccatgcattttac

SEQ ID NO: 100722 - DNA, 22 bp, Artificial Sequence
  chemically synthesized
aagagaatccatgcattttacg

SEQ ID NO: 100723 - DNA, 22 bp, Artificial Sequence
  chemically synthesized
tacgtccatgtagttgcaaaca

SEQ ID NO: 100724 - DNA, 22 bp, Artificial Sequence
  chemically synthesized
acgtccatgtagttgcaaacaa

SEQ ID NO: 100725 - DNA, 22 bp, Artificial Sequence
  chemically synthesized
cgtccatgtagttgcaaacaat

SEQ ID NO: 100726 - DNA, 22 bp, Artificial Sequence
  chemically synthesized
caaacaatgccaagtagaactc

SEQ ID NO: 100727 - DNA, 22 bp, Artificial Sequence
  chemically synthesized
caatccagagctaagtggggct

SEQ ID NO: 100728 - DNA, 22 bp, Artificial Sequence
  chemically synthesized
agtggggctgtgggaactatgt

SEQ ID NO: 100729 - DNA, 22 bp, Artificial Sequence
  chemically synthesized
tgggaactatgtaccaattgat

SEQ ID NO: 100730 - DNA, 22 bp, Artificial Sequence
  chemically synthesized
tgtaccaattgatggacatgct

SEQ ID NO: 100731 - DNA, 22 bp, Artificial Sequence
  chemically synthesized
atggacatgctgctttttgact

SEQ ID NO: 100732 - DNA, 22 bp, Artificial Sequence
  chemically synthesized
ctttttgactcagaggtggata

SEQ ID NO: 100733 - DNA, 22 bp, Artificial Sequence
  chemically synthesized
tttgactcagaggtggataaga

SEQ ID NO: 100734 - DNA, 22 bp, Artificial Sequence
  chemically synthesized
ttgactcagaggtggataagag

SEQ ID NO: 100735 - DNA, 22 bp, Artificial Sequence
  chemically synthesized
tgactcagaggtggataagaga

SEQ ID NO: 100736 - DNA, 22 bp, Artificial Sequence
  chemically synthesized
gactcagaggtggataagagac

SEQ ID NO: 100737 - DNA, 22 bp, Artificial Sequence
  chemically synthesized
actcagaggtggataagagaca

SEQ ID NO: 100738 - DNA, 22 bp, Artificial Sequence
  chemically synthesized
agaggtggataagagacaaaac

SEQ ID NO: 100739 - DNA, 22 bp, Artificial Sequence
  chemically synthesized
ttttcttcttagatgtactaaa

SEQ ID NO: 100740 - DNA, 22 bp, Artificial Sequence
  chemically synthesized
ttcttcttagatgtactaaaaa

SEQ ID NO: 100741 - DNA, 22 bp, Artificial Sequence
  chemically synthesized
tcttcttagatgtactaaaaag

SEQ ID NO: 100742 - DNA, 22 bp, Artificial Sequence
  chemically synthesized
cttcttagatgtactaaaaagt

SEQ ID NO: 100743 - DNA, 22 bp, Artificial Sequence
  chemically synthesized
ttcttagatgtactaaaaagta

SEQ ID NO: 100744 - DNA, 22 bp, Artificial Sequence
  chemically synthesized
cttagatgtactaaaaagtagt

SEQ ID NO: 100745 - DNA, 22 bp, Artificial Sequence
  chemically synthesized
ttagatgtactaaaaagtagtt

SEQ ID NO: 100746 - DNA, 22 bp, Artificial Sequence
  chemically synthesized
agatgtactaaaaagtagttag

SEQ ID NO: 100747 - DNA, 22 bp, Artificial Sequence
  chemically synthesized
gatgtactaaaaagtagttagt

SEQ ID NO: 100748 - DNA, 22 bp, Artificial Sequence
  chemically synthesized
aaaagtagttagtctggaagta

SEQ ID NO: 100749 - DNA, 22 bp, Artificial Sequence
  chemically synthesized
gtctggaagtatttagaaggct

SEQ ID NO: 100750 - DNA, 22 bp, Artificial Sequence
  chemically synthesized
gaagtatttagaaggctttgga

SEQ ID NO: 100751 - DNA, 22 bp, Artificial Sequence
  chemically synthesized
agaaggctttggagaggaatgt

SEQ ID NO: 100752 - DNA, 22 bp, Artificial Sequence
  chemically synthesized
gaaggctttggagaggaatgtg

SEQ ID NO: 100753 - DNA, 22 bp, Artificial Sequence
  chemically synthesized
tggagaggaatgtgattttatc

SEQ ID NO: 100754 - DNA, 22 bp, Artificial Sequence
  chemically synthesized
ggagaggaatgtgattttatca

SEQ ID NO: 100755 - DNA, 22 bp, Artificial Sequence
  chemically synthesized
gagaggaatgtgattttatcag

SEQ ID NO: 100756 - DNA, 22 bp, Artificial Sequence
  chemically synthesized
tatcaggtaaatcaaaaataga

SEQ ID NO: 100757 - DNA, 22 bp, Artificial Sequence
  chemically synthesized
atcaggtaaatcaaaaatagag

SEQ ID NO: 100758 - DNA, 22 bp, Artificial Sequence
  chemically synthesized
tcaggtaaatcaaaaatagagg

SEQ ID NO: 100759 - DNA, 22 bp, Artificial Sequence
  chemically synthesized
tttctgaaagaagcaactagaa

SEQ ID NO: 100760 - DNA, 22 bp, Artificial Sequence
  chemically synthesized
ctgaaagaagcaactagaacca

SEQ ID NO: 100761 - DNA, 22 bp, Artificial Sequence
  chemically synthesized
tgaaagaagcaactagaaccaa

SEQ ID NO: 100762 - DNA, 22 bp, Artificial Sequence
  chemically synthesized
aaagaagcaactagaaccaagt

SEQ ID NO: 100763 - DNA, 22 bp, Artificial Sequence
  chemically synthesized
gaaccaagttacacacagaaaa

SEQ ID NO: 100764 - DNA, 22 bp, Artificial Sequence
  chemically synthesized
cacacagaaaatacccataatg

SEQ ID NO: 100765 - DNA, 22 bp, Artificial Sequence
  chemically synthesized
ttgactagagtagcatgtgcaa

SEQ ID NO: 100766 - DNA, 22 bp, Artificial Sequence
  chemically synthesized
tgactagagtagcatgtgcaaa

SEQ ID NO: 100767 - DNA, 22 bp, Artificial Sequence
  chemically synthesized
gactagagtagcatgtgcaaat

SEQ ID NO: 100768 - DNA, 22 bp, Artificial Sequence
  chemically synthesized
actagagtagcatgtgcaaatt

SEQ ID NO: 100769 - DNA, 22 bp, Artificial Sequence
  chemically synthesized
gagtagcatgtgcaaatttgta

SEQ ID NO: 100770 - DNA, 22 bp, Artificial Sequence
  chemically synthesized
gtataaaatatttgcaggtaag

SEQ ID NO: 100771 - DNA, 22 bp, Artificial Sequence
  chemically synthesized
tataaaatatttgcaggtaagt

SEQ ID NO: 100772 - DNA, 22 bp, Artificial Sequence
  chemically synthesized
gcaggtaagttaggtaatgcaa

SEQ ID NO: 100773 - DNA, 22 bp, Artificial Sequence
  chemically synthesized
caggtaagttaggtaatgcaac

SEQ ID NO: 100774 - DNA, 22 bp, Artificial Sequence
  chemically synthesized
ggtaatgcaacatttgagactc

SEQ ID NO: 100775 - DNA, 22 bp, Artificial Sequence
  chemically synthesized
gagactctaagtttgtgggaaa

SEQ ID NO: 100776 - DNA, 22 bp, Artificial Sequence
  chemically synthesized
agactctaagtttgtgggaaac

SEQ ID NO: 100777 - DNA, 22 bp, Artificial Sequence
  chemically synthesized
taagtttgtgggaaacttagaa

SEQ ID NO: 100778 - DNA, 22 bp, Artificial Sequence
  chemically synthesized
agtttgtgggaaacttagaact

SEQ ID NO: 100779 - DNA, 22 bp, Artificial Sequence
  chemically synthesized
gtgggaaacttagaactgtttc

SEQ ID NO: 100780 - DNA, 22 bp, Artificial Sequence
  chemically synthesized
tgggaaacttagaactgtttca

SEQ ID NO: 100781 - DNA, 22 bp, Artificial Sequence
  chemically synthesized
agaactgtttcagttttctaca

SEQ ID NO: 100782 - DNA, 22 bp, Artificial Sequence
  chemically synthesized
gaactgtttcagttttctacat

SEQ ID NO: 100783 - DNA, 22 bp, Artificial Sequence
  chemically synthesized
tttcagttttctacattattcc

SEQ ID NO: 100784 - DNA, 22 bp, Artificial Sequence
  chemically synthesized
cagttttctacattattcctaa

SEQ ID NO: 100785 - DNA, 22 bp, Artificial Sequence
  chemically synthesized
agttttctacattattcctaac

SEQ ID NO: 100786 - DNA, 22 bp, Artificial Sequence
  chemically synthesized
tctacattattcctaactattt

SEQ ID NO: 100787 - DNA, 22 bp, Artificial Sequence
  chemically synthesized
ctacattattcctaactattta

SEQ ID NO: 100788 - DNA, 22 bp, Artificial Sequence
  chemically synthesized
tacattattcctaactatttaa

SEQ ID NO: 100789 - DNA, 22 bp, Artificial Sequence
  chemically synthesized
cattattcctaactatttaaaa

SEQ ID NO: 100790 - DNA, 22 bp, Artificial Sequence
  chemically synthesized
ttcctaactatttaaaatgcta

SEQ ID NO: 100791 - DNA, 22 bp, Artificial Sequence
  chemically synthesized
ctaactatttaaaatgctatga

SEQ ID NO: 100792 - DNA, 22 bp, Artificial Sequence
  chemically synthesized
actatttaaaatgctatgaaat

SEQ ID NO: 100793 - DNA, 22 bp, Artificial Sequence
  chemically synthesized
tttaaaatgctatgaaatgatt

SEQ ID NO: 100794 - DNA, 22 bp, Artificial Sequence
  chemically synthesized
aaaatgctatgaaatgattttg

SEQ ID NO: 100795 - DNA, 22 bp, Artificial Sequence
  chemically synthesized
aaatgctatgaaatgattttgc

SEQ ID NO: 100796 - DNA, 22 bp, Artificial Sequence
  chemically synthesized
tgaaatgattttgcagattttt

SEQ ID NO: 100797 - DNA, 22 bp, Artificial Sequence
  chemically synthesized
tgcagatttttctgagatgttt

SEQ ID NO: 100798 - DNA, 22 bp, Artificial Sequence
  chemically synthesized
gcagatttttctgagatgttta

SEQ ID NO: 100799 - DNA, 22 bp, Artificial Sequence
  chemically synthesized
cagatttttctgagatgtttat

SEQ ID NO: 100800 - DNA, 22 bp, Artificial Sequence
  chemically synthesized
ttctgagatgtttatagtgata

SEQ ID NO: 100801 - DNA, 22 bp, Artificial Sequence
  chemically synthesized
tctgagatgtttatagtgataa

SEQ ID NO: 100802 - DNA, 22 bp, Artificial Sequence
  chemically synthesized
ctgagatgtttatagtgataag

SEQ ID NO: 100803 - DNA, 22 bp, Artificial Sequence
  chemically synthesized
tgagatgtttatagtgataagt

SEQ ID NO: 100804 - DNA, 22 bp, Artificial Sequence
  chemically synthesized
agatgtttatagtgataagtga

SEQ ID NO: 100805 - DNA, 22 bp, Artificial Sequence
  chemically synthesized
atagtgataagtgagaatatat

SEQ ID NO: 100806 - DNA, 22 bp, Artificial Sequence
  chemically synthesized
tagtgataagtgagaatatatg

SEQ ID NO: 100807 - DNA, 22 bp, Artificial Sequence
  chemically synthesized
ttcctttgttgtataactctgt

SEQ ID NO: 100808 - DNA, 22 bp, Artificial Sequence
  chemically synthesized
ctttgttgtataactctgttta

SEQ ID NO: 100809 - DNA, 22 bp, Artificial Sequence
  chemically synthesized
tgttgtataactctgtttaaaa

SEQ ID NO: 100810 - DNA, 22 bp, Artificial Sequence
  chemically synthesized
gttgtataactctgtttaaaat

SEQ ID NO: 100811 - DNA, 22 bp, Artificial Sequence
  chemically synthesized
ttgtataactctgtttaaaata

SEQ ID NO: 100812 - DNA, 22 bp, Artificial Sequence
  chemically synthesized
tataactctgtttaaaatatct

SEQ ID NO: 100813 - DNA, 22 bp, Artificial Sequence
  chemically synthesized
tgtttaaaatatcttttatata

SEQ ID NO: 100814 - DNA, 22 bp, Artificial Sequence
  chemically synthesized
tttaaaatatcttttatataat

SEQ ID NO: 100815 - DNA, 22 bp, Artificial Sequence
  chemically synthesized
aaaatatcttttatataatgat

SEQ ID NO: 100816 - DNA, 22 bp, Artificial Sequence
  chemically synthesized
aaatatcttttatataatgata

SEQ ID NO: 100817 - DNA, 22 bp, Artificial Sequence
  chemically synthesized
ttatataatgataaaaaatcta

SEQ ID NO: 100818 - DNA, 22 bp, Artificial Sequence
  chemically synthesized
tatataatgataaaaaatctat

SEQ ID NO: 100819 - DNA, 22 bp, Artificial Sequence
  chemically synthesized
atataatgataaaaaatctatc

SEQ ID NO: 100820 - DNA, 22 bp, Artificial Sequence
  chemically synthesized
tataatgataaaaaatctatct

SEQ ID NO: 100821 - DNA, 22 bp, Artificial Sequence
  chemically synthesized
tctctttgtaacttaccacagc

SEQ ID NO: 100822 - DNA, 22 bp, Artificial Sequence
  chemically synthesized
tttgtaacttaccacagcagat

SEQ ID NO: 100823 - DNA, 22 bp, Artificial Sequence
  chemically synthesized
tgtaacttaccacagcagattt

SEQ ID NO: 100824 - DNA, 22 bp, Artificial Sequence
  chemically synthesized
gtaacttaccacagcagatttg

SEQ ID NO: 100825 - DNA, 22 bp, Artificial Sequence
  chemically synthesized
taacttaccacagcagatttgt

SEQ ID NO: 100826 - DNA, 22 bp, Artificial Sequence
  chemically synthesized
accacagcagatttgtattatt

SEQ ID NO: 100827 - DNA, 22 bp, Artificial Sequence
  chemically synthesized
ccacagcagatttgtattattt

SEQ ID NO: 100828 - DNA, 22 bp, Artificial Sequence
  chemically synthesized
gtattattttatgtgaagaaac

SEQ ID NO: 100829 - DNA, 22 bp, Artificial Sequence
  chemically synthesized
tattattttatgtgaagaaact

SEQ ID NO: 100830 - DNA, 22 bp, Artificial Sequence
  chemically synthesized
ttttatgtgaagaaactcagaa

SEQ ID NO: 100831 - DNA, 22 bp, Artificial Sequence
  chemically synthesized
tatgtgaagaaactcagaatat

SEQ ID NO: 100832 - DNA, 22 bp, Artificial Sequence
  chemically synthesized
atgtgaagaaactcagaatatg

SEQ ID NO: 100833 - DNA, 22 bp, Artificial Sequence
  chemically synthesized
tgtgaagaaactcagaatatgg

SEQ ID NO: 100834 - DNA, 22 bp, Artificial Sequence
  chemically synthesized
agaatatggagtattttttttc

SEQ ID NO: 100835 - DNA, 22 bp, Artificial Sequence
  chemically synthesized
tttttctcaaattatcactttt

SEQ ID NO: 100836 - DNA, 22 bp, Artificial Sequence
  chemically synthesized
ttttctcaaattatcactttta

SEQ ID NO: 100837 - DNA, 22 bp, Artificial Sequence
  chemically synthesized
tttctcaaattatcacttttat

SEQ ID NO: 100838 - DNA, 22 bp, Artificial Sequence
  chemically synthesized
ttctcaaattatcacttttata

SEQ ID NO: 100839 - DNA, 22 bp, Artificial Sequence
  chemically synthesized
tctcaaattatcacttttataa

SEQ ID NO: 100840 - DNA, 22 bp, Artificial Sequence
  chemically synthesized
ctcaaattatcacttttataag

SEQ ID NO: 100841 - DNA, 22 bp, Artificial Sequence
  chemically synthesized
tcaaattatcacttttataagg

SEQ ID NO: 100842 - DNA, 22 bp, Artificial Sequence
  chemically synthesized
aaattatcacttttataaggat

SEQ ID NO: 100843 - DNA, 22 bp, Artificial Sequence
  chemically synthesized
tcacttttataaggatctgcta

SEQ ID NO: 100844 - DNA, 22 bp, Artificial Sequence
  chemically synthesized
ttataaggatctgctatctatc

SEQ ID NO: 100845 - DNA, 22 bp, Artificial Sequence
  chemically synthesized
tataaggatctgctatctatcc

SEQ ID NO: 100846 - DNA, 22 bp, Artificial Sequence
  chemically synthesized
ataaggatctgctatctatcca

SEQ ID NO: 100847 - DNA, 22 bp, Artificial Sequence
  chemically synthesized
taaggatctgctatctatccat

SEQ ID NO: 100848 - DNA, 22 bp, Artificial Sequence
  chemically synthesized
ctatctatccatcttattttct

SEQ ID NO: 100849 - DNA, 22 bp, Artificial Sequence
  chemically synthesized
tctatccatcttattttcttta

SEQ ID NO: 100850 - DNA, 22 bp, Artificial Sequence
  chemically synthesized
tccatcttattttctttatgta

SEQ ID NO: 100851 - DNA, 22 bp, Artificial Sequence
  chemically synthesized
attttctttatgtaaaccagtg

SEQ ID NO: 100852 - DNA, 22 bp, Artificial Sequence
  chemically synthesized
ttttctttatgtaaaccagtgt

SEQ ID NO: 100853 - DNA, 22 bp, Artificial Sequence
  chemically synthesized
tctttatgtaaaccagtgtttt

SEQ ID NO: 100854 - DNA, 22 bp, Artificial Sequence
  chemically synthesized
ctttatgtaaaccagtgtttta

SEQ ID NO: 100855 - DNA, 22 bp, Artificial Sequence
  chemically synthesized
tttatgtaaaccagtgttttat

SEQ ID NO: 100856 - DNA, 22 bp, Artificial Sequence
  chemically synthesized
tatgtaaaccagtgttttatct

SEQ ID NO: 100857 - DNA, 22 bp, Artificial Sequence
  chemically synthesized
atgtaaaccagtgttttatctc

SEQ ID NO: 100858 - DNA, 22 bp, Artificial Sequence
  chemically synthesized
tgtaaaccagtgttttatctct

SEQ ID NO: 100859 - DNA, 22 bp, Artificial Sequence
  chemically synthesized
tatctcttctcattttctatca

SEQ ID NO: 100860 - DNA, 22 bp, Artificial Sequence
  chemically synthesized
atctcttctcattttctatcaa

SEQ ID NO: 100861 - DNA, 22 bp, Artificial Sequence
  chemically synthesized
tctcttctcattttctatcaag

SEQ ID NO: 100862 - DNA, 22 bp, Artificial Sequence
  chemically synthesized
ttctcattttctatcaaggatt

SEQ ID NO: 100863 - DNA, 22 bp, Artificial Sequence
  chemically synthesized
ctcattttctatcaaggattaa

SEQ ID NO: 100864 - DNA, 22 bp, Artificial Sequence
  chemically synthesized
tcattttctatcaaggattaat

SEQ ID NO: 100865 - DNA, 22 bp, Artificial Sequence
  chemically synthesized
attttctatcaaggattaatag

SEQ ID NO: 100866 - DNA, 22 bp, Artificial Sequence
  chemically synthesized
tctatcaaggattaatagattt

SEQ ID NO: 100867 - DNA, 22 bp, Artificial Sequence
  chemically synthesized
ctatcaaggattaatagatttt

SEQ ID NO: 100868 - DNA, 22 bp, Artificial Sequence
  chemically synthesized
tatcaaggattaatagattttt

SEQ ID NO: 100869 - DNA, 22 bp, Artificial Sequence
  chemically synthesized
tcaaggattaatagatttttgt

SEQ ID NO: 100870 - DNA, 22 bp, Artificial Sequence
  chemically synthesized
atagatttttgtcatctttatt

SEQ ID NO: 100871 - DNA, 22 bp, Artificial Sequence
  chemically synthesized
ttgtcatctttattgtcttttt

SEQ ID NO: 100872 - DNA, 22 bp, Artificial Sequence
  chemically synthesized
tgtcatctttattgtctttttt

SEQ ID NO: 100873 - DNA, 22 bp, Artificial Sequence
  chemically synthesized
gtcatctttattgtcttttttt

SEQ ID NO: 100874 - DNA, 22 bp, Artificial Sequence
  chemically synthesized
tcatctttattgtctttttttc

SEQ ID NO: 100875 - DNA, 22 bp, Artificial Sequence
  chemically synthesized
tattgtctttttttctccaact

SEQ ID NO: 100876 - DNA, 22 bp, Artificial Sequence
  chemically synthesized
attgtctttttttctccaactt

SEQ ID NO: 100877 - DNA, 22 bp, Artificial Sequence
  chemically synthesized
ttgtctttttttctccaacttt

SEQ ID NO: 100878 - DNA, 22 bp, Artificial Sequence
  chemically synthesized
tctttttttctccaactttttg

SEQ ID NO: 100879 - DNA, 22 bp, Artificial Sequence
  chemically synthesized
tttttctccaactttttgtatc

SEQ ID NO: 100880 - DNA, 22 bp, Artificial Sequence
  chemically synthesized
ttttctccaactttttgtatct

SEQ ID NO: 100881 - DNA, 22 bp, Artificial Sequence
  chemically synthesized
tttctccaactttttgtatcta

SEQ ID NO: 100882 - DNA, 22 bp, Artificial Sequence
  chemically synthesized
ttctccaactttttgtatctac

SEQ ID NO: 100883 - DNA, 22 bp, Artificial Sequence
  chemically synthesized
tctccaactttttgtatctaca

SEQ ID NO: 100884 - DNA, 22 bp, Artificial Sequence
  chemically synthesized
ctccaactttttgtatctacag

SEQ ID NO: 100885 - DNA, 22 bp, Artificial Sequence
  chemically synthesized
tccaactttttgtatctacagg

SEQ ID NO: 100886 - DNA, 22 bp, Artificial Sequence
  chemically synthesized
caactttttgtatctacaggtt

SEQ ID NO: 100887 - DNA, 22 bp, Artificial Sequence
  chemically synthesized
tttgtatctacaggttcctacc
